United States Patent 12,606,847 (ENGINEERED VIRAL CAPSID POLYPEPTIDES AND USES THEREOF) - sequence listing, part 9

SEQ ID NO: 177299 - protein, 33 aa, Artificial Sequence
  Description of Artificial Sequence: Synthetic polypeptide
DEDEIATTNPVATEQWGGCVAAKAQLMMNPGDH

SEQ ID NO: 177300 - protein, 32 aa, Artificial Sequence
  Description of Artificial Sequence: Synthetic polypeptide
TEEEIASVNPVCYEHYGVTVSINTSQEGGNNQ

SEQ ID NO: 177301 - protein, 32 aa, Artificial Sequence
  Description of Artificial Sequence: Synthetic polypeptide
TEEEIASVNPVCYEAYGVVSINEFSQQSGGNQ

SEQ ID NO: 177302 - protein, 32 aa, Artificial Sequence
  Description of Artificial Sequence: Synthetic polypeptide
TEEEIASVNPVCYEAYGVVSIGELSQSGGNQW

SEQ ID NO: 177303 - protein, 31 aa, Artificial Sequence
  Description of Artificial Sequence: Synthetic polypeptide
TEEEIASVNPVCYEAYGVVADNALSTSGGNQ

SEQ ID NO: 177304 - protein, 33 aa, Artificial Sequence
  Description of Artificial Sequence: Synthetic polypeptide
TEEEIASVNPVCYEAYGKVSIPNELSQSGGNQW

SEQ ID NO: 177305 - protein, 36 aa, Artificial Sequence
  Description of Artificial Sequence: Synthetic polypeptide
DEEEISTTNPVATEQYGCVCSSGEDNQENFGSEFQA

SEQ ID NO: 177306 - protein, 34 aa, Artificial Sequence
  Description of Artificial Sequence: Synthetic polypeptide
DEDEIATTNPVATEQWGGCVAAKANLAMNPNNQH

SEQ ID NO: 177307 - protein, 36 aa, Artificial Sequence
  Description of Artificial Sequence: Synthetic polypeptide
DEEEISTTNPVATEQYGCVCSSGEDNQENFGSETQS

SEQ ID NO: 177308 - protein, 36 aa, Artificial Sequence
  Description of Artificial Sequence: Synthetic polypeptide
DEEEISTTNPVATEQYGCVCSSGEHNAENFPSDNQS

SEQ ID NO: 177309 - protein, 36 aa, Artificial Sequence
  Description of Artificial Sequence: Synthetic polypeptide
DEEEISTTNPVATEQYGCVCSSGEHNEENFGSDPQS

SEQ ID NO: 177310 - protein, 36 aa, Artificial Sequence
  Description of Artificial Sequence: Synthetic polypeptide
DEEEISTTNPVATEQYGCVCSSGEHNQEFFNSDNQS

SEQ ID NO: 177311 - protein, 36 aa, Artificial Sequence
  Description of Artificial Sequence: Synthetic polypeptide
DEEEISTTNPVATEQYGCVCSSGEHNQEFSGSETQT

SEQ ID NO: 177312 - protein, 33 aa, Artificial Sequence
  Description of Artificial Sequence: Synthetic polypeptide
DEDEIATTNPVATEQWGGCVAAKANLAMNPEEH

SEQ ID NO: 177313 - protein, 31 aa, Artificial Sequence
  Description of Artificial Sequence: Synthetic polypeptide
DDSEVASTNPCSTEGYGNVAANTIQSRVGTR

SEQ ID NO: 177314 - protein, 33 aa, Artificial Sequence
  Description of Artificial Sequence: Synthetic polypeptide
DEDEIATTNPVATEQWGGCCAGTGHQAEGPIMT

SEQ ID NO: 177315 - protein, 36 aa, Artificial Sequence
  Description of Artificial Sequence: Synthetic polypeptide
DEDEIRTTNPVATEAWGSVSTVVNNNEQGSTDEQGT

SEQ ID NO: 177316 - protein, 36 aa, Artificial Sequence
  Description of Artificial Sequence: Synthetic polypeptide
TEECIRTTNPTATEQYGQCVSCTQIEPSQFLVGNDP

SEQ ID NO: 177317 - protein, 37 aa, Artificial Sequence
  Description of Artificial Sequence: Synthetic polypeptide
DEEEIRTTNPVATEQYGCVCSMWGEHNQEYFNSDNQS

SEQ ID NO: 177318 - protein, 36 aa, Artificial Sequence
  Description of Artificial Sequence: Synthetic polypeptide
DEEEIRTTNPVAYEQYGCVCSMWGEHNQENFGSEQG

SEQ ID NO: 177319 - protein, 33 aa, Artificial Sequence
  Description of Artificial Sequence: Synthetic polypeptide
DEDEIATTNPVATEQWGCVAAKGHDEENMTGNH

SEQ ID NO: 177320 - protein, 34 aa, Artificial Sequence
  Description of Artificial Sequence: Synthetic polypeptide
DEPEIRTTNPVATEQWGACVSVIEQMIAVEAAAE

SEQ ID NO: 177321 - protein, 36 aa, Artificial Sequence
  Description of Artificial Sequence: Synthetic polypeptide
DEEEIRTTNPVAYEQYGCVCSMWEDHNQENFNSDQS

SEQ ID NO: 177322 - protein, 37 aa, Artificial Sequence
  Description of Artificial Sequence: Synthetic polypeptide
DEEEIRTTNPVAYEQYGCVCSMTGEHNQEYFNSETQA

SEQ ID NO: 177323 - protein, 37 aa, Artificial Sequence
  Description of Artificial Sequence: Synthetic polypeptide
DEEEIRTTNPVAYEQYGCVCSMTEDHNQENFGSETQA

SEQ ID NO: 177324 - protein, 39 aa, Artificial Sequence
  Description of Artificial Sequence: Synthetic polypeptide
DEEEIRTTNPVATEAYGVVSTVQNGNLQQGTEQGTEESE

SEQ ID NO: 177325 - protein, 34 aa, Artificial Sequence
  Description of Artificial Sequence: Synthetic polypeptide
DESEMRTTNPVATECWGSFGCINEPEAREGENMG

SEQ ID NO: 177326 - protein, 33 aa, Artificial Sequence
  Description of Artificial Sequence: Synthetic polypeptide
DESELATTNPVATAHWGSVCTWEDQQRQEHGMH

SEQ ID NO: 177327 - protein, 35 aa, Artificial Sequence
  Description of Artificial Sequence: Synthetic polypeptide
DEAEIRTTNPVAYEQWGCTVTGDNGNHQGNHGNPD

SEQ ID NO: 177328 - protein, 34 aa, Artificial Sequence
  Description of Artificial Sequence: Synthetic polypeptide
DESEIYCTNPVCTECWGSVSYCIKEPQDREGENG

SEQ ID NO: 177329 - protein, 36 aa, Artificial Sequence
  Description of Artificial Sequence: Synthetic polypeptide
TEECIRATNPVATEQYGICVSCELNEVSQFVPGNDC

SEQ ID NO: 177330 - protein, 36 aa, Artificial Sequence
  Description of Artificial Sequence: Synthetic polypeptide
TEECIRATNPVATEHYGCTVSCTLNEVSQFLGGNDC

SEQ ID NO: 177331 - protein, 37 aa, Artificial Sequence
  Description of Artificial Sequence: Synthetic polypeptide
DEEEISTTNPVATEQYGCVCSTGEDHEQEHFGSDTQD

SEQ ID NO: 177332 - protein, 37 aa, Artificial Sequence
  Description of Artificial Sequence: Synthetic polypeptide
DEEEISTTNPVATEQYGCVCSTGEDHNTEHFGSETQS

SEQ ID NO: 177333 - protein, 35 aa, Artificial Sequence
  Description of Artificial Sequence: Synthetic polypeptide
DEEEIRTTNPVAYEQYGCVCQWGEDNQYFISDNQS

SEQ ID NO: 177334 - protein, 35 aa, Artificial Sequence
  Description of Artificial Sequence: Synthetic polypeptide
TEECIATTNPVAYEQWGSVSKTNNPEDGMGKNEQE

SEQ ID NO: 177335 - protein, 35 aa, Artificial Sequence
  Description of Artificial Sequence: Synthetic polypeptide
TEECIATTNPVAYEQWGSVSKTNNPEDGMGKGNDQ

SEQ ID NO: 177336 - protein, 33 aa, Artificial Sequence
  Description of Artificial Sequence: Synthetic polypeptide
TEECIATTNPVAYEQWGSVSKGNNPEDGMGKTQ

SEQ ID NO: 177337 - protein, 39 aa, Artificial Sequence
  Description of Artificial Sequence: Synthetic polypeptide
DEEEIRTTNPVATEAYGSVSTYGNSDEIGTTSISTTGNT

SEQ ID NO: 177338 - protein, 36 aa, Artificial Sequence
  Description of Artificial Sequence: Synthetic polypeptide
DEEEISTTNPVATEQYGCVCSTGEHNAENFISDTQS

SEQ ID NO: 177339 - protein, 34 aa, Artificial Sequence
  Description of Artificial Sequence: Synthetic polypeptide
TEECIATTNPEATDQYGQVCCCDQDQKREGNGER

SEQ ID NO: 177340 - protein, 33 aa, Artificial Sequence
  Description of Artificial Sequence: Synthetic polypeptide
TEECIASVNPVCTEPYGVTVSVINLSQSGGNNQ

SEQ ID NO: 177341 - protein, 35 aa, Artificial Sequence
  Description of Artificial Sequence: Synthetic polypeptide
DEPEIRTTNPVATEQWGACVSMVIEQMIAVEADNE

SEQ ID NO: 177342 - protein, 37 aa, Artificial Sequence
  Description of Artificial Sequence: Synthetic polypeptide
AEEEIRTTNPVATEGYGCVTSTWGAHNAENFGSDNVA

SEQ ID NO: 177343 - protein, 36 aa, Artificial Sequence
  Description of Artificial Sequence: Synthetic polypeptide
TEECIRTTNPVATEHWGVVCFTNEDQHHRGMTKGND

SEQ ID NO: 177344 - protein, 34 aa, Artificial Sequence
  Description of Artificial Sequence: Synthetic polypeptide
DEAEIRTTNPVAYEKWGSVCGDQGEGDRQGDNGA

SEQ ID NO: 177345 - protein, 32 aa, Artificial Sequence
  Description of Artificial Sequence: Synthetic polypeptide
DEDEIATTNPVATEQWGGCCAGTGHQAEAPQF

SEQ ID NO: 177346 - protein, 36 aa, Artificial Sequence
  Description of Artificial Sequence: Synthetic polypeptide
DESEIRTTNPVATEQYGSVPYATDEEDITPSIEENP

SEQ ID NO: 177347 - protein, 36 aa, Artificial Sequence
  Description of Artificial Sequence: Synthetic polypeptide
DEEEIRTTNPVAYEQYGCVCSNWEEHNQENFGSDQA

SEQ ID NO: 177348 - protein, 36 aa, Artificial Sequence
  Description of Artificial Sequence: Synthetic polypeptide
DEEEIRTTNPVAYEQYGCVCSNWEEHNQEHFNSDQA

SEQ ID NO: 177349 - protein, 36 aa, Artificial Sequence
  Description of Artificial Sequence: Synthetic polypeptide
TEECIRTTNPVATEQYGCVSCTQEEPSQFLGGHYDP

SEQ ID NO: 177350 - protein, 36 aa, Artificial Sequence
  Description of Artificial Sequence: Synthetic polypeptide
DEEEIRTTNPVAYEQYGCVCSNWEEHNAENFNSDQA

SEQ ID NO: 177351 - protein, 37 aa, Artificial Sequence
  Description of Artificial Sequence: Synthetic polypeptide
DEEEIRTTNPVSTEQYGSVMLPWNNELQIQQAVQPQI

SEQ ID NO: 177352 - protein, 37 aa, Artificial Sequence
  Description of Artificial Sequence: Synthetic polypeptide
DEEEIRTTNPVAYEQYGCVCSNWEEHNAENFGSQNQS

SEQ ID NO: 177353 - protein, 34 aa, Artificial Sequence
  Description of Artificial Sequence: Synthetic polypeptide
TEECIRTTNPVATEQYGCVCSWGEHNAYFFSDQS

SEQ ID NO: 177354 - protein, 31 aa, Artificial Sequence
  Description of Artificial Sequence: Synthetic polypeptide
DDSEVASTNPVSTEGYGNVAAEEIQSRVGQR

SEQ ID NO: 177355 - protein, 34 aa, Artificial Sequence
  Description of Artificial Sequence: Synthetic polypeptide
TEECIRTTNPVATEQYGCVCSWGEHNANFLSEQA

SEQ ID NO: 177356 - protein, 34 aa, Artificial Sequence
  Description of Artificial Sequence: Synthetic polypeptide
DEDEIATTNPVATEQWGGCCAGNGHAAEGNPMRN

SEQ ID NO: 177357 - protein, 35 aa, Artificial Sequence
  Description of Artificial Sequence: Synthetic polypeptide
DEDEIATTNPVATEQWGCVAMGNGENPPDQTEGNN

SEQ ID NO: 177358 - protein, 34 aa, Artificial Sequence
  Description of Artificial Sequence: Synthetic polypeptide
TEECIRTTNPVATEQYGCVCSWEEHNAHFLSDQS

SEQ ID NO: 177359 - protein, 33 aa, Artificial Sequence
  Description of Artificial Sequence: Synthetic polypeptide
DEPEIRTTNPVATEQWGACGSVIEQMIAVEDAG

SEQ ID NO: 177360 - protein, 34 aa, Artificial Sequence
  Description of Artificial Sequence: Synthetic polypeptide
DEAEIRTTNPVAYEKWGEVAMADNQGNHGNGNGR

SEQ ID NO: 177361 - protein, 36 aa, Artificial Sequence
  Description of Artificial Sequence: Synthetic polypeptide
DEEEIRTTNPVAYEQYGCVCSNTGEHQENFPSETQP

SEQ ID NO: 177362 - protein, 37 aa, Artificial Sequence
  Description of Artificial Sequence: Synthetic polypeptide
DEEEIRTTNPVAYEQYGCVCSNTGEHNAENFNSDTQA

SEQ ID NO: 177363 - protein, 37 aa, Artificial Sequence
  Description of Artificial Sequence: Synthetic polypeptide
DEEEIRTTNPVAYEQYGCVCSNTGEHNAEFFNSDNQP

SEQ ID NO: 177364 - protein, 35 aa, Artificial Sequence
  Description of Artificial Sequence: Synthetic polypeptide
TEECIRTTNPVATEQYGCVCSTGEHNAENFLSQQA

SEQ ID NO: 177365 - protein, 37 aa, Artificial Sequence
  Description of Artificial Sequence: Synthetic polypeptide
DEEEIRTTNPVATEQYGAVVTQGFGQGGQDTDQTTGF

SEQ ID NO: 177366 - protein, 33 aa, Artificial Sequence
  Description of Artificial Sequence: Synthetic polypeptide
DEPEIRTTNPVATEQWGACQSVIEQMIAVEEKE

SEQ ID NO: 177367 - protein, 33 aa, Artificial Sequence
  Description of Artificial Sequence: Synthetic polypeptide
DEDEIATTNPVATEQWGCVAGEGEAQAAEDNAE

SEQ ID NO: 177368 - protein, 35 aa, Artificial Sequence
  Description of Artificial Sequence: Synthetic polypeptide
TEECIRTTNPVATEQYGCVCSNTGEHNAYFLSDQA

SEQ ID NO: 177369 - protein, 36 aa, Artificial Sequence
  Description of Artificial Sequence: Synthetic polypeptide
DEEEIRTTNPVAYEQYGCVCSNSGEHQEFFGSDTQS

SEQ ID NO: 177370 - protein, 35 aa, Artificial Sequence
  Description of Artificial Sequence: Synthetic polypeptide
DEAEIRTTNPVAYENWGKTVSCQNESDQVRGMTSK

SEQ ID NO: 177371 - protein, 32 aa, Artificial Sequence
  Description of Artificial Sequence: Synthetic polypeptide
TEEEIASVNPVCYEQWGCVVSINEHSQSGGNQ

SEQ ID NO: 177372 - protein, 36 aa, Artificial Sequence
  Description of Artificial Sequence: Synthetic polypeptide
DEEEISTTNPVATEQYGCVCSSGEDHNQNFGSDTQG

SEQ ID NO: 177373 - protein, 32 aa, Artificial Sequence
  Description of Artificial Sequence: Synthetic polypeptide
TEEEIASVNPVCYEQWGVVVSIGELSQSGGNQ

SEQ ID NO: 177374 - protein, 36 aa, Artificial Sequence
  Description of Artificial Sequence: Synthetic polypeptide
VEEEIRTTNPVATESYGSVVLGFQNGGQETGGQFEG

SEQ ID NO: 177375 - protein, 34 aa, Artificial Sequence
  Description of Artificial Sequence: Synthetic polypeptide
DEAEIRTTNPVAYEEWGCVCPNNNDQADLGDNEP

SEQ ID NO: 177376 - protein, 31 aa, Artificial Sequence
  Description of Artificial Sequence: Synthetic polypeptide
DDSEVASTNPCSTEGYGNVAANTIQSRVGQR

SEQ ID NO: 177377 - protein, 36 aa, Artificial Sequence
  Description of Artificial Sequence: Synthetic polypeptide
DEEEISTTNPVATEQYGCVCSNWGEPNQEHFNSEQA

SEQ ID NO: 177378 - protein, 34 aa, Artificial Sequence
  Description of Artificial Sequence: Synthetic polypeptide
DEDEIATTNPVATEQYGCVAANNDATMPPGEQFH

SEQ ID NO: 177379 - protein, 36 aa, Artificial Sequence
  Description of Artificial Sequence: Synthetic polypeptide
DEEEISTTNPVATEQYGCVCSNWGEPNQNFNSQNQA

SEQ ID NO: 177380 - protein, 37 aa, Artificial Sequence
  Description of Artificial Sequence: Synthetic polypeptide
DEEEISTTNPVATEQYGCVCSNWGETNQENFGSDTQS

SEQ ID NO: 177381 - protein, 37 aa, Artificial Sequence
  Description of Artificial Sequence: Synthetic polypeptide
DEEEISTTNPVATEQYGCVCSNWGETNQENFISDNQL

SEQ ID NO: 177382 - protein, 37 aa, Artificial Sequence
  Description of Artificial Sequence: Synthetic polypeptide
DEEEISTTNPVATEQYGCVCSNWGETNQENFNSDNQA

SEQ ID NO: 177383 - protein, 37 aa, Artificial Sequence
  Description of Artificial Sequence: Synthetic polypeptide
DEEEISTTNPVATEQYGCVCSNWGETNTENFGSETQS

SEQ ID NO: 177384 - protein, 37 aa, Artificial Sequence
  Description of Artificial Sequence: Synthetic polypeptide
DEEEIRTTNPVATEQYGCAVCSMWMEHNQENFNSEQS

SEQ ID NO: 177385 - protein, 37 aa, Artificial Sequence
  Description of Artificial Sequence: Synthetic polypeptide
DEEEISTTNPVATEQYGCVCSNWGNHNQENFISENQS

SEQ ID NO: 177386 - protein, 37 aa, Artificial Sequence
  Description of Artificial Sequence: Synthetic polypeptide
DEEEISTTNPVATEQYGCVCSNWGPDHQENFGSDNQL

SEQ ID NO: 177387 - protein, 39 aa, Artificial Sequence
  Description of Artificial Sequence: Synthetic polypeptide
DEEEIRTTNPVATEAYGVVSTVNNNNNNQQSGNQNNDED

SEQ ID NO: 177388 - protein, 31 aa, Artificial Sequence
  Description of Artificial Sequence: Synthetic polypeptide
DDSEVASTNPVSTEGYGNTAANTIQSRVGQR

SEQ ID NO: 177389 - protein, 34 aa, Artificial Sequence
  Description of Artificial Sequence: Synthetic polypeptide
DEDEIATTNPVATEQWGTVCAANDGPVEDGGNND

SEQ ID NO: 177390 - protein, 36 aa, Artificial Sequence
  Description of Artificial Sequence: Synthetic polypeptide
TEEEIATTNPVATEQYGVVPCWENHGQDRQGGGHAE

SEQ ID NO: 177391 - protein, 36 aa, Artificial Sequence
  Description of Artificial Sequence: Synthetic polypeptide
DEEEISTTNPVATEQYGCVCSNWGYHNQENFNSDQS

SEQ ID NO: 177392 - protein, 34 aa, Artificial Sequence
  Description of Artificial Sequence: Synthetic polypeptide
DEDEIATTNPVATEQWGTVCAANDGPVEDDGNDI

SEQ ID NO: 177393 - protein, 36 aa, Artificial Sequence
  Description of Artificial Sequence: Synthetic polypeptide
DEEEISTTNPVATEQYGCVCSNWGYHQENFGSDTQT

SEQ ID NO: 177394 - protein, 38 aa, Artificial Sequence
  Description of Artificial Sequence: Synthetic polypeptide
DEEEIRTTNPVATEAYGTVATVVNSDVGTNSISTTGNT

SEQ ID NO: 177395 - protein, 34 aa, Artificial Sequence
  Description of Artificial Sequence: Synthetic polypeptide
DEDEIATTNPVATEQWGTVCAANDGGVEDGGNDM

SEQ ID NO: 177396 - protein, 32 aa, Artificial Sequence
  Description of Artificial Sequence: Synthetic polypeptide
DDSEVASTNPVSTEGYGNVAAANTEQSRVGQR

SEQ ID NO: 177397 - protein, 32 aa, Artificial Sequence
  Description of Artificial Sequence: Synthetic polypeptide
DDSEVASTNPVSTEGYGNVAAANTIQSRVGQR

SEQ ID NO: 177398 - protein, 38 aa, Artificial Sequence
  Description of Artificial Sequence: Synthetic polypeptide
DEEEIRTTNPVATEAYGTVATVSNSQVGTTSISTTGNT

SEQ ID NO: 177399 - protein, 37 aa, Artificial Sequence
  Description of Artificial Sequence: Synthetic polypeptide
DEEEIRTTNPVATEQYGCAVCSNTGEHNTNFNSETQF

SEQ ID NO: 177400 - protein, 38 aa, Artificial Sequence
  Description of Artificial Sequence: Synthetic polypeptide
DEEEIRTTNPVATEAYGTVATVNPNNLQQGEQDEEDEG

SEQ ID NO: 177401 - protein, 33 aa, Artificial Sequence
  Description of Artificial Sequence: Synthetic polypeptide
DEAEIRTTNPVAYEEWGCVCINNDEMDTGDNEP

SEQ ID NO: 177402 - protein, 37 aa, Artificial Sequence
  Description of Artificial Sequence: Synthetic polypeptide
VEEEIRTTNPVATEQYGYVYQGSSEFEEEQVGEMNQS

SEQ ID NO: 177403 - protein, 36 aa, Artificial Sequence
  Description of Artificial Sequence: Synthetic polypeptide
DEEEISTTNPVATEQYGCVCSNWGEHNQEYFNSEQA

SEQ ID NO: 177404 - protein, 36 aa, Artificial Sequence
  Description of Artificial Sequence: Synthetic polypeptide
DEEEISTTNPVATEQYGCVCSNWGEHNQGFGSDTQS

SEQ ID NO: 177405 - protein, 36 aa, Artificial Sequence
  Description of Artificial Sequence: Synthetic polypeptide
DEEEISTTNPVATEQYGCVCSNWGEHNQHFGSETQA

SEQ ID NO: 177406 - protein, 36 aa, Artificial Sequence
  Description of Artificial Sequence: Synthetic polypeptide
DEEEISTTNPVATEQYGCVCSNWGEHNQHFNSQNQL

SEQ ID NO: 177407 - protein, 36 aa, Artificial Sequence
  Description of Artificial Sequence: Synthetic polypeptide
DEEEISTTNPVATEQYGCVCSNWGEHNQNFGSDTQA

SEQ ID NO: 177408 - protein, 36 aa, Artificial Sequence
  Description of Artificial Sequence: Synthetic polypeptide
DEEEISTTNPVATEQYGCVCSNWGEHNQNFGSDTQP

SEQ ID NO: 177409 - protein, 34 aa, Artificial Sequence
  Description of Artificial Sequence: Synthetic polypeptide
DEAEIRTTNPVAYECWGTVYFINENQDRQMMNNG

SEQ ID NO: 177410 - protein, 36 aa, Artificial Sequence
  Description of Artificial Sequence: Synthetic polypeptide
DEEEISTTNPVATEQYGCVCSNWGEHNQNFGSETQF

SEQ ID NO: 177411 - protein, 36 aa, Artificial Sequence
  Description of Artificial Sequence: Synthetic polypeptide
DEEEISTTNPVATEQYGCVCSNWGEHNQNFGSQFQP

SEQ ID NO: 177412 - protein, 36 aa, Artificial Sequence
  Description of Artificial Sequence: Synthetic polypeptide
DEEEISTTNPVATEQYGCVCSNWGEHNQNFGSQTQS

SEQ ID NO: 177413 - protein, 36 aa, Artificial Sequence
  Description of Artificial Sequence: Synthetic polypeptide
DEEEISTTNPVATEQYGCVCSNWGEHNQNFISDNQS

SEQ ID NO: 177414 - protein, 35 aa, Artificial Sequence
  Description of Artificial Sequence: Synthetic polypeptide
VEEEIRTTNPVATEQYGVVVNQDGQEQGIGQGEGQ

SEQ ID NO: 177415 - protein, 35 aa, Artificial Sequence
  Description of Artificial Sequence: Synthetic polypeptide
DEEEISTTNPVATEQYGCVCSNWGEHNQNFISEQA

SEQ ID NO: 177416 - protein, 36 aa, Artificial Sequence
  Description of Artificial Sequence: Synthetic polypeptide
DEEEISTTNPVATEQYGCVCSNWGEHNQNFNSDTQS

SEQ ID NO: 177417 - protein, 35 aa, Artificial Sequence
  Description of Artificial Sequence: Synthetic polypeptide
DEAEIRTTNPVAYECWGVCSTTNLPGMNEGGDDQR

SEQ ID NO: 177418 - protein, 35 aa, Artificial Sequence
  Description of Artificial Sequence: Synthetic polypeptide
DEAEIRTTNPVAYECWGVCSTTNLPGMNEGGDGQR

SEQ ID NO: 177419 - protein, 32 aa, Artificial Sequence
  Description of Artificial Sequence: Synthetic polypeptide
DESEVASTNPVSTEGYGNVAAAETIQSRVGPR

SEQ ID NO: 177420 - protein, 37 aa, Artificial Sequence
  Description of Artificial Sequence: Synthetic polypeptide
DEEEISTTNPVATEQYGCVCSNWGEHNTENFGSNFQA

SEQ ID NO: 177421 - protein, 38 aa, Artificial Sequence
  Description of Artificial Sequence: Synthetic polypeptide
DEEEIRTTNPVATEAYGTVTQTGNSEQGSTSIGTTGNT

SEQ ID NO: 177422 - protein, 36 aa, Artificial Sequence
  Description of Artificial Sequence: Synthetic polypeptide
DEEEISTTNPVATEQYGCVCSNWGEHNTENFNSDQT

SEQ ID NO: 177423 - protein, 37 aa, Artificial Sequence
  Description of Artificial Sequence: Synthetic polypeptide
DEEEISTTNPVATEQYGCVCSNWGEHNTENFNSENAS

SEQ ID NO: 177424 - protein, 31 aa, Artificial Sequence
  Description of Artificial Sequence: Synthetic polypeptide
TEEEIATTNPVAYEQYGEAPCEVMHSQHEEK

SEQ ID NO: 177425 - protein, 36 aa, Artificial Sequence
  Description of Artificial Sequence: Synthetic polypeptide
DEEEISTTNPVATEQYGCVCSNWGEHQEHFISQNQS

SEQ ID NO: 177426 - protein, 31 aa, Artificial Sequence
  Description of Artificial Sequence: Synthetic polypeptide
DDSEVASTNPVSTEGYGNSAANTIQSRVGQR

SEQ ID NO: 177427 - protein, 29 aa, Artificial Sequence
  Description of Artificial Sequence: Synthetic peptide
DESEVASTNPVSTEGYGNAAAEVIQREEK

SEQ ID NO: 177428 - protein, 34 aa, Artificial Sequence
  Description of Artificial Sequence: Synthetic polypeptide
DEAEIRTTNPVAYECWGVVSGGNADDSRNGQGMS

SEQ ID NO: 177429 - protein, 31 aa, Artificial Sequence
  Description of Artificial Sequence: Synthetic polypeptide
DESEVASTNPVSTEGWGNVAANIIMSRVGQR

SEQ ID NO: 177430 - protein, 33 aa, Artificial Sequence
  Description of Artificial Sequence: Synthetic polypeptide
DEDEIATTNPVATEQWGTNCAANNGEEPDEGND

SEQ ID NO: 177431 - protein, 31 aa, Artificial Sequence
  Description of Artificial Sequence: Synthetic polypeptide
DDSEVASTNPVSTEGYGNVAAATIAERVGQR

SEQ ID NO: 177432 - protein, 35 aa, Artificial Sequence
  Description of Artificial Sequence: Synthetic polypeptide
DEDEIATTNPVATEQWGSVSGEGPPPDNAGPEGPH

SEQ ID NO: 177433 - protein, 36 aa, Artificial Sequence
  Description of Artificial Sequence: Synthetic polypeptide
DEEEIRTTNPVATEAYGSVYSETDDMAADVTLHEED

SEQ ID NO: 177434 - protein, 36 aa, Artificial Sequence
  Description of Artificial Sequence: Synthetic polypeptide
DEEEIRTTNPVAYEQYGCVCSWEEHEQENFGSETQS

SEQ ID NO: 177435 - protein, 37 aa, Artificial Sequence
  Description of Artificial Sequence: Synthetic polypeptide
DEEEISTTNPVATEQYGCVCSSEEDHNEENFGSDNQA

SEQ ID NO: 177436 - protein, 33 aa, Artificial Sequence
  Description of Artificial Sequence: Synthetic polypeptide
TEEEIATTNPVATAQWGCVAGTGGLEATANGEN

SEQ ID NO: 177437 - protein, 36 aa, Artificial Sequence
  Description of Artificial Sequence: Synthetic polypeptide
DEDEIATTNPVATEQWGSVSGEGGPGENTASGNMGS

SEQ ID NO: 177438 - protein, 39 aa, Artificial Sequence
  Description of Artificial Sequence: Synthetic polypeptide
DEEEIRTTNPVATEAYGVVSTVNQNQQANTNEQGTNVTD

SEQ ID NO: 177439 - protein, 37 aa, Artificial Sequence
  Description of Artificial Sequence: Synthetic polypeptide
DEEEIRTTNPVAYEQYGCVCSVSGEPNQENFNSDNQS

SEQ ID NO: 177440 - protein, 31 aa, Artificial Sequence
  Description of Artificial Sequence: Synthetic polypeptide
DDSEVASTNPVSTEGYGNVAADTIQNRVGQR

SEQ ID NO: 177441 - protein, 37 aa, Artificial Sequence
  Description of Artificial Sequence: Synthetic polypeptide
DEEEIRTTNPVAYEQYGCVCSTWEEHDQENFNSDTQS

SEQ ID NO: 177442 - protein, 37 aa, Artificial Sequence
  Description of Artificial Sequence: Synthetic polypeptide
DEEEIRTTNPVAYEQYGCVCSTWEEDHNQNFNSDNQS

SEQ ID NO: 177443 - protein, 37 aa, Artificial Sequence
  Description of Artificial Sequence: Synthetic polypeptide
DEEEIRTTNPVAYEQYGCVCSTTPAHNAEYSGSDPVA

SEQ ID NO: 177444 - protein, 37 aa, Artificial Sequence
  Description of Artificial Sequence: Synthetic polypeptide
DEEEIRTTNPVAYEQYGCVCSTSGAHNAENSGSDPVS

SEQ ID NO: 177445 - protein, 34 aa, Artificial Sequence
  Description of Artificial Sequence: Synthetic polypeptide
DEAAIRTTNPVAYEAYGKVVHCTMNHAGEPGNGH

SEQ ID NO: 177446 - protein, 33 aa, Artificial Sequence
  Description of Artificial Sequence: Synthetic polypeptide
CEDEIATTNPVAYEQYGSCATAALTQNDLDQAD

SEQ ID NO: 177447 - protein, 34 aa, Artificial Sequence
  Description of Artificial Sequence: Synthetic polypeptide
TEEEIASVNPVCYERYGVTVSTINLSQEAGGNNV

SEQ ID NO: 177448 - protein, 33 aa, Artificial Sequence
  Description of Artificial Sequence: Synthetic polypeptide
TEEEIASVNPVCYERYGVTVPSCDNLAQSGGNQ

SEQ ID NO: 177449 - protein, 36 aa, Artificial Sequence
  Description of Artificial Sequence: Synthetic polypeptide
DEEEISTTNPVATEQYGCVCSSGEDDNQENFNSNQS

SEQ ID NO: 177450 - protein, 35 aa, Artificial Sequence
  Description of Artificial Sequence: Synthetic polypeptide
AEECIRTTNPVATEQYGCVCSNWGEHQENFGSDQS

SEQ ID NO: 177451 - protein, 34 aa, Artificial Sequence
  Description of Artificial Sequence: Synthetic polypeptide
TEEEIASVNPVCYEQYGVVSCINALSQISGGNDQ

SEQ ID NO: 177452 - protein, 37 aa, Artificial Sequence
  Description of Artificial Sequence: Synthetic polypeptide
DEEEISTTNPVATEQYGCVCSSGEDHNIENFGSDNQD

SEQ ID NO: 177453 - protein, 35 aa, Artificial Sequence
  Description of Artificial Sequence: Synthetic polypeptide
DEDEIATTNPVATEQWGSVAMGPGENPADQTEGRN

SEQ ID NO: 177454 - protein, 33 aa, Artificial Sequence
  Description of Artificial Sequence: Synthetic polypeptide
TEEEIASVNPVCYEQYGVTVASCDGLSQSGGNQ

SEQ ID NO: 177455 - protein, 35 aa, Artificial Sequence
  Description of Artificial Sequence: Synthetic polypeptide
TEEEIASVNPVCYEQYGQVTVPSCDNLAQSGGNQR

SEQ ID NO: 177456 - protein, 36 aa, Artificial Sequence
  Description of Artificial Sequence: Synthetic polypeptide
DEDEIATTNPVATEQWGSVAITNNPEDTGEGGEGNN

SEQ ID NO: 177457 - protein, 35 aa, Artificial Sequence
  Description of Artificial Sequence: Synthetic polypeptide
DEDEIATTNPVATEQWGSVSGQGPPQEAPDGSDHN

SEQ ID NO: 177458 - protein, 35 aa, Artificial Sequence
  Description of Artificial Sequence: Synthetic polypeptide
AEEEIRTTNPVATEEYGCSCSNWEHNQESFGSDQA

SEQ ID NO: 177459 - protein, 32 aa, Artificial Sequence
  Description of Artificial Sequence: Synthetic polypeptide
TEEEIATTNPVATEQYGCFCPWVDQHFISEQM

SEQ ID NO: 177460 - protein, 33 aa, Artificial Sequence
  Description of Artificial Sequence: Synthetic polypeptide
TEEEIATTNPVATEQYGCSCQWADNQHFISEQS

SEQ ID NO: 177461 - protein, 32 aa, Artificial Sequence
  Description of Artificial Sequence: Synthetic polypeptide
DDSEVASTNPVSTEGYGNVAAATIDQSRVGQR

SEQ ID NO: 177462 - protein, 37 aa, Artificial Sequence
  Description of Artificial Sequence: Synthetic polypeptide
DEEEISTTNPVATEQYGCVCSNWMEHDQENFGSENQP

SEQ ID NO: 177463 - protein, 37 aa, Artificial Sequence
  Description of Artificial Sequence: Synthetic polypeptide
DEEEIRTTNPVSTEQYGSVPFPWNNLPQVQQVTQPQI

SEQ ID NO: 177464 - protein, 32 aa, Artificial Sequence
  Description of Artificial Sequence: Synthetic polypeptide
DDSEVASTNPVSTEGYGNVAAATIIQSRVGQR

SEQ ID NO: 177465 - protein, 31 aa, Artificial Sequence
  Description of Artificial Sequence: Synthetic polypeptide
DDSEVASTNPVSTEGYGNVAAATINSRVGQR

SEQ ID NO: 177466 - protein, 35 aa, Artificial Sequence
  Description of Artificial Sequence: Synthetic polypeptide
AEEEIRTTNPVATEAYGVVVTVTNNQQQAEEEEDE

SEQ ID NO: 177467 - protein, 38 aa, Artificial Sequence
  Description of Artificial Sequence: Synthetic polypeptide
DEEEIRTTNPVATEAYGTVATVGNQDQGTTSISTTGNT

SEQ ID NO: 177468 - protein, 38 aa, Artificial Sequence
  Description of Artificial Sequence: Synthetic polypeptide
DEEEIRTTNPVATEAYGTVATSGNSQGGTTSISTTGNT

SEQ ID NO: 177469 - protein, 33 aa, Artificial Sequence
  Description of Artificial Sequence: Synthetic polypeptide
DEDEIATTNPVATEQWGTNCAANDGEVEDDGND

SEQ ID NO: 177470 - protein, 36 aa, Artificial Sequence
  Description of Artificial Sequence: Synthetic polypeptide
DEEEIRTTNPVSTEQYGSVPCPWNNEQIQQVQTPQI

SEQ ID NO: 177471 - protein, 38 aa, Artificial Sequence
  Description of Artificial Sequence: Synthetic polypeptide
DEEEIRTTNPVATEAYGTVATNGNLDEIGTSISTTGNT

SEQ ID NO: 177472 - protein, 35 aa, Artificial Sequence
  Description of Artificial Sequence: Synthetic polypeptide
CEDEIATTNPVAYEQYGCVAAIANNDTQDNGENRD

SEQ ID NO: 177473 - protein, 36 aa, Artificial Sequence
  Description of Artificial Sequence: Synthetic polypeptide
TEECEIATTNPVAYEQWGSVCSTTRDEDDQQRGDDS

SEQ ID NO: 177474 - protein, 31 aa, Artificial Sequence
  Description of Artificial Sequence: Synthetic polypeptide
DDSEVASTNPVSTEGYGNVAAATIQSRVGQR

SEQ ID NO: 177475 - protein, 33 aa, Artificial Sequence
  Description of Artificial Sequence: Synthetic polypeptide
DEDEIATTNPVATEQWGTNCAANDGDVPDEGND

SEQ ID NO: 177476 - protein, 38 aa, Artificial Sequence
  Description of Artificial Sequence: Synthetic polypeptide
DEEEIRTTNPVATEAYGVVSTVNQNGNNNNQQGTDETS

SEQ ID NO: 177477 - protein, 34 aa, Artificial Sequence
  Description of Artificial Sequence: Synthetic polypeptide
DEDEIATTNPVATEQWGTFVCAANDGPVEDEGND

SEQ ID NO: 177478 - protein, 31 aa, Artificial Sequence
  Description of Artificial Sequence: Synthetic polypeptide
DDSEVASTNPVSTEGYGNVAACTEQSRVGQR

SEQ ID NO: 177479 - protein, 31 aa, Artificial Sequence
  Description of Artificial Sequence: Synthetic polypeptide
DDSEVASTNPVSTEGYGNVAACTIQSRVGQR

SEQ ID NO: 177480 - protein, 36 aa, Artificial Sequence
  Description of Artificial Sequence: Synthetic polypeptide
DEDEIATTNPVATEQWGSVTSAAANNLDATTNPDEE

SEQ ID NO: 177481 - protein, 36 aa, Artificial Sequence
  Description of Artificial Sequence: Synthetic polypeptide
DEEEISTTNPVATEQYGCVCSNWMEHQENFGSDTQS

SEQ ID NO: 177482 - protein, 34 aa, Artificial Sequence
  Description of Artificial Sequence: Synthetic polypeptide
DEAEIRTTNPVAYEEWGVVCYTNIDNDHGQDGHN

SEQ ID NO: 177483 - protein, 35 aa, Artificial Sequence
  Description of Artificial Sequence: Synthetic polypeptide
DEDEIATTNPVATEQWGSVSQGPPPQMGQGDSLEE

SEQ ID NO: 177484 - protein, 36 aa, Artificial Sequence
  Description of Artificial Sequence: Synthetic polypeptide
DEPEIATTNPVATEQYGSVIDDDANNGQGEQGGQQQ

SEQ ID NO: 177485 - protein, 34 aa, Artificial Sequence
  Description of Artificial Sequence: Synthetic polypeptide
TEEEIATTNPVATEQYGCYCPNWEDNQHFNSEQS

SEQ ID NO: 177486 - protein, 38 aa, Artificial Sequence
  Description of Artificial Sequence: Synthetic polypeptide
DEEEIRTTNPVATEAYGVVSTVNQNQQAGTEQGTVVTD

SEQ ID NO: 177487 - protein, 32 aa, Artificial Sequence
  Description of Artificial Sequence: Synthetic polypeptide
DDSEVASTNPVSTEGYGNVAACTEPQSRVGQR

SEQ ID NO: 177488 - protein, 30 aa, Artificial Sequence
  Description of Artificial Sequence: Synthetic polypeptide
DDSEVASTNPVSTEGYGNIANTIQSRNGQR

SEQ ID NO: 177489 - protein, 36 aa, Artificial Sequence
  Description of Artificial Sequence: Synthetic polypeptide
DEEEISTTNPVATEQYGCVCSTGEHNQENFFSDTQT

SEQ ID NO: 177490 - protein, 37 aa, Artificial Sequence
  Description of Artificial Sequence: Synthetic polypeptide
AEEEIRTTNPVATEQYGAYSCPSTAEPNSPVGHPPVC

SEQ ID NO: 177491 - protein, 33 aa, Artificial Sequence
  Description of Artificial Sequence: Synthetic polypeptide
DEDEIATTNPVAYEQYGSVCAAGPEDTMNMNEN

SEQ ID NO: 177492 - protein, 33 aa, Artificial Sequence
  Description of Artificial Sequence: Synthetic polypeptide
DDSEIVSTNPVATEGYGTVCAATDGIVEREGQR

SEQ ID NO: 177493 - protein, 33 aa, Artificial Sequence
  Description of Artificial Sequence: Synthetic polypeptide
DDSEIVSTNPVATEGYGTVAATDTPVQSREGQD

SEQ ID NO: 177494 - protein, 31 aa, Artificial Sequence
  Description of Artificial Sequence: Synthetic polypeptide
DDSEVASTNPVSTEGYGNVAAMTIQDREGQR

SEQ ID NO: 177495 - protein, 34 aa, Artificial Sequence
  Description of Artificial Sequence: Synthetic polypeptide
STEEIRTTNPAATYHYGSVSPFNPLEEFEHNQYE

SEQ ID NO: 177496 - protein, 34 aa, Artificial Sequence
  Description of Artificial Sequence: Synthetic polypeptide
STEEIRTTNPAATYHYGSVSPFNPDQELEHGQQE

SEQ ID NO: 177497 - protein, 37 aa, Artificial Sequence
  Description of Artificial Sequence: Synthetic polypeptide
DEEEIRTTNPVATEAYGSVLGVFEDDGGGNDQENGID

SEQ ID NO: 177498 - protein, 33 aa, Artificial Sequence
  Description of Artificial Sequence: Synthetic polypeptide
DDSEIVSTNPVATEGYGTVAATDTIVQSREGQD

SEQ ID NO: 177499 - protein, 36 aa, Artificial Sequence
  Description of Artificial Sequence: Synthetic polypeptide
DEEEIRTTNPVATEAYGSVFGVFEDDEQGNIQENGD

SEQ ID NO: 177500 - protein, 37 aa, Artificial Sequence
  Description of Artificial Sequence: Synthetic polypeptide
DESEIVTTNPVATEQYGSVDQDTNEGQNLDSNGGEQT

SEQ ID NO: 177501 - protein, 35 aa, Artificial Sequence
  Description of Artificial Sequence: Synthetic polypeptide
STEEICTTNPAATDAYGSVVSTEGMGEQRGQGNGE

SEQ ID NO: 177502 - protein, 36 aa, Artificial Sequence
  Description of Artificial Sequence: Synthetic polypeptide
DEEEIRTTNPVSTEQYGQCVCGWGEDNQEGFNSQQS

SEQ ID NO: 177503 - protein, 37 aa, Artificial Sequence
  Description of Artificial Sequence: Synthetic polypeptide
DESEIVTTNPVATEQYGSVDQDTNEGQNLDSNGGDLN

SEQ ID NO: 177504 - protein, 35 aa, Artificial Sequence
  Description of Artificial Sequence: Synthetic polypeptide
SSSEIRTTNPVATEQYGSVIKMSLDTGEGGIENFG

SEQ ID NO: 177505 - protein, 36 aa, Artificial Sequence
  Description of Artificial Sequence: Synthetic polypeptide
SSSEIRTTNPVATEQYGSVICMSLADTQEGGIENFG

SEQ ID NO: 177506 - protein, 36 aa, Artificial Sequence
  Description of Artificial Sequence: Synthetic polypeptide
DEEEIRTTNPVAYEQYGQCVCSWGEHNQENFNSDQM

SEQ ID NO: 177507 - protein, 33 aa, Artificial Sequence
  Description of Artificial Sequence: Synthetic polypeptide
DETEIRTTNPIATECWGATVWSEEDWQEPKGPL

SEQ ID NO: 177508 - protein, 36 aa, Artificial Sequence
  Description of Artificial Sequence: Synthetic polypeptide
DEPEIRTTNPVATEQYGSVCSWTYDTEIDFTEELQI

SEQ ID NO: 177509 - protein, 33 aa, Artificial Sequence
  Description of Artificial Sequence: Synthetic polypeptide
DETEIRTTNPIATECWGATVWSNAEGPAFKGND

SEQ ID NO: 177510 - protein, 36 aa, Artificial Sequence
  Description of Artificial Sequence: Synthetic polypeptide
DEEEIRTTNPVAYEQYGQCVCSWGEHNQNFGSETQS

SEQ ID NO: 177511 - protein, 31 aa, Artificial Sequence
  Description of Artificial Sequence: Synthetic polypeptide
DETEIRTTNPIATECWGATWAADCQPKGPYI

SEQ ID NO: 177512 - protein, 33 aa, Artificial Sequence
  Description of Artificial Sequence: Synthetic polypeptide
DDSEIVSTNPVATEGYGNVAATDTIVQSREGQD

SEQ ID NO: 177513 - protein, 37 aa, Artificial Sequence
  Description of Artificial Sequence: Synthetic polypeptide
DEEEIRTTNPVAYEQYGQCVCSWGNDTNQENFGSEQA

SEQ ID NO: 177514 - protein, 37 aa, Artificial Sequence
  Description of Artificial Sequence: Synthetic polypeptide
DEEEISTTNPVATEQYGCVCSTSGEDNQENFNSDFQS

SEQ ID NO: 177515 - protein, 37 aa, Artificial Sequence
  Description of Artificial Sequence: Synthetic polypeptide
DEEEISTTNPVATEQYGCVCSTSGEHNQEAFNSDNQS

SEQ ID NO: 177516 - protein, 31 aa, Artificial Sequence
  Description of Artificial Sequence: Synthetic polypeptide
DDSELASTNPVSTAGYGNVAANTIQSRVGQR

SEQ ID NO: 177517 - protein, 37 aa, Artificial Sequence
  Description of Artificial Sequence: Synthetic polypeptide
DEEEISTTNPVATEQYGCVCSTSGEHNQEHFNSDTQS

SEQ ID NO: 177518 - protein, 36 aa, Artificial Sequence
  Description of Artificial Sequence: Synthetic polypeptide
STNEIRTTNPVATEQYGTVTTVWLQDEGENLQIDEI

SEQ ID NO: 177519 - protein, 31 aa, Artificial Sequence
  Description of Artificial Sequence: Synthetic polypeptide
DDSELASTNPVSTEGYGNVAANTIQSRVSQR

SEQ ID NO: 177520 - protein, 36 aa, Artificial Sequence
  Description of Artificial Sequence: Synthetic polypeptide
CEEEIRTTNPVATEQYGCVCSNWEEHNQNFGSDTQE

SEQ ID NO: 177521 - protein, 35 aa, Artificial Sequence
  Description of Artificial Sequence: Synthetic polypeptide
TCEECIATTNPVAYEQWGSVSKTNPEDGMGQKNDQ

SEQ ID NO: 177522 - protein, 36 aa, Artificial Sequence
  Description of Artificial Sequence: Synthetic polypeptide
WEEEIACTNPVATEQYGSVAITNHDENGMPMENDPN

SEQ ID NO: 177523 - protein, 34 aa, Artificial Sequence
  Description of Artificial Sequence: Synthetic polypeptide
TAEEIRTTNPVAYEQWGCYVWIDQDHLQRGEKTE

SEQ ID NO: 177524 - protein, 36 aa, Artificial Sequence
  Description of Artificial Sequence: Synthetic polypeptide
AEEEIRTTNPVATEQYGCVCSNWMEHNAEYFGSQQS

SEQ ID NO: 177525 - protein, 33 aa, Artificial Sequence
  Description of Artificial Sequence: Synthetic polypeptide
TAEEINTTNPVAYEQWGCYVWIDQDHLQMGHRT

SEQ ID NO: 177526 - protein, 32 aa, Artificial Sequence
  Description of Artificial Sequence: Synthetic polypeptide
DDSEVASTNPVSTEGYGNVAALTIVQSRVGQR

SEQ ID NO: 177527 - protein, 36 aa, Artificial Sequence
  Description of Artificial Sequence: Synthetic polypeptide
WEEEIATTNPVATEQWGCNVALNGLENGMPMENDRN

SEQ ID NO: 177528 - protein, 31 aa, Artificial Sequence
  Description of Artificial Sequence: Synthetic polypeptide
DDSEVAATNPVSTEGYGNVAANTIQSVVGQR

SEQ ID NO: 177529 - protein, 36 aa, Artificial Sequence
  Description of Artificial Sequence: Synthetic polypeptide
WEEEIATTNPVATEQWGCVAGTNGLPQTAPMEDFNW

SEQ ID NO: 177530 - protein, 35 aa, Artificial Sequence
  Description of Artificial Sequence: Synthetic polypeptide
TESEIVTTNPVATEQYGTVCSCTDGPSEFEGGNYD

SEQ ID NO: 177531 - protein, 36 aa, Artificial Sequence
  Description of Artificial Sequence: Synthetic polypeptide
DEEEIRTTNPVSTEQYGSAPTPWINEQIQQVTQPQI

SEQ ID NO: 177532 - protein, 39 aa, Artificial Sequence
  Description of Artificial Sequence: Synthetic polypeptide
DEEEIRTTNPVATEAYGSVSTTIGNTEQGSTNDEQDEED

SEQ ID NO: 177533 - protein, 39 aa, Artificial Sequence
  Description of Artificial Sequence: Synthetic polypeptide
DEEEIRTTNPVATEAYGSVSTTGNSNVIGTTSISTTGNT

SEQ ID NO: 177534 - protein, 31 aa, Artificial Sequence
  Description of Artificial Sequence: Synthetic polypeptide
DDSETASTNPVSTEGYGNVAAPTIQSRVGQR

SEQ ID NO: 177535 - protein, 32 aa, Artificial Sequence
  Description of Artificial Sequence: Synthetic polypeptide
DDSETASTNPVSTEGYGNVAANTIQSRVGQER

SEQ ID NO: 177536 - protein, 36 aa, Artificial Sequence
  Description of Artificial Sequence: Synthetic polypeptide
DEEEIRTTNPVSTEQYGSAPTPWGNEQIQQVPQEQI

SEQ ID NO: 177537 - protein, 31 aa, Artificial Sequence
  Description of Artificial Sequence: Synthetic polypeptide
DDSEMASTNPVSTEGYGNVAANTIQSEVGQR

SEQ ID NO: 177538 - protein, 31 aa, Artificial Sequence
  Description of Artificial Sequence: Synthetic polypeptide
DDSELASTNPVSTTGYGNVAANTIQSRVGQR

SEQ ID NO: 177539 - protein, 34 aa, Artificial Sequence
  Description of Artificial Sequence: Synthetic polypeptide
TESEIVTTNPVAYEQYGTVCSYTDGPSEFEGNND

SEQ ID NO: 177540 - protein, 34 aa, Artificial Sequence
  Description of Artificial Sequence: Synthetic polypeptide
DEDEIATTNPVATASWGCVAAANNEPQDRAGENG

SEQ ID NO: 177541 - protein, 37 aa, Artificial Sequence
  Description of Artificial Sequence: Synthetic polypeptide
CEEEIRTTNPVATEQYGCVCSNWEEHNQEGFGSDNQA

SEQ ID NO: 177542 - protein, 34 aa, Artificial Sequence
  Description of Artificial Sequence: Synthetic polypeptide
DETEIRTTNPIATECWGATVAAINEAEREGENYG

SEQ ID NO: 177543 - protein, 31 aa, Artificial Sequence
  Description of Artificial Sequence: Synthetic polypeptide
DETEIRTTNPIATECWGATVANADWAHGPYI

SEQ ID NO: 177544 - protein, 31 aa, Artificial Sequence
  Description of Artificial Sequence: Synthetic polypeptide
DETEIRTTNPIATECWGATVANADWAHGPYL

SEQ ID NO: 177545 - protein, 35 aa, Artificial Sequence
  Description of Artificial Sequence: Synthetic polypeptide
STQEIATTNPVATEQYGSVSATGLNEDHQGLEDEN

SEQ ID NO: 177546 - protein, 31 aa, Artificial Sequence
  Description of Artificial Sequence: Synthetic polypeptide
DDSEVASTNPVSTEGYGNVAALTIQSRTGQR

SEQ ID NO: 177547 - protein, 32 aa, Artificial Sequence
  Description of Artificial Sequence: Synthetic polypeptide
DETEIRTTNPIATECWGATWANAEDLAPKGPI

SEQ ID NO: 177548 - protein, 37 aa, Artificial Sequence
  Description of Artificial Sequence: Synthetic polypeptide
DEEEISTTNPVATEQYGCVCSTSGEHNQENFISDNQS

SEQ ID NO: 177549 - protein, 32 aa, Artificial Sequence
  Description of Artificial Sequence: Synthetic polypeptide
DDSEVASTNPVSTEGYGNVAANAIQSRVGQRI

SEQ ID NO: 177550 - protein, 37 aa, Artificial Sequence
  Description of Artificial Sequence: Synthetic polypeptide
DEEEISTTNPVATEQYGCVCSTWGEDHFQEHFGSEQA

SEQ ID NO: 177551 - protein, 32 aa, Artificial Sequence
  Description of Artificial Sequence: Synthetic polypeptide
DETEIRTTNPIATECWGAVANAENWAPKGPYI

SEQ ID NO: 177552 - protein, 36 aa, Artificial Sequence
  Description of Artificial Sequence: Synthetic polypeptide
AEEEIRTTNPVATEQYGCVCSWMEHNQENFSSDNQS

SEQ ID NO: 177553 - protein, 31 aa, Artificial Sequence
  Description of Artificial Sequence: Synthetic polypeptide
DDSEVASTNPVSTEGYGNVAANAIQSRVGQT

SEQ ID NO: 177554 - protein, 34 aa, Artificial Sequence
  Description of Artificial Sequence: Synthetic polypeptide
DETEIRTTNPIATECWGAVWACENEPQDPKGNYG

SEQ ID NO: 177555 - protein, 34 aa, Artificial Sequence
  Description of Artificial Sequence: Synthetic polypeptide
SSEEIRTTNPVATHQYGCVCSWEDHNQNFGSDQA

SEQ ID NO: 177556 - protein, 38 aa, Artificial Sequence
  Description of Artificial Sequence: Synthetic polypeptide
DEEEISTTNPVATEQYGCVCSTWGEDHNAENFGSDNQS

SEQ ID NO: 177557 - protein, 38 aa, Artificial Sequence
  Description of Artificial Sequence: Synthetic polypeptide
DEAEIRTTNPVAYEQWGMVSIPGAGNAGPDQRNGDNPR

SEQ ID NO: 177558 - protein, 34 aa, Artificial Sequence
  Description of Artificial Sequence: Synthetic polypeptide
TETEIATTNPVAYEQYGTVCSCTDGPSEFEGTND

SEQ ID NO: 177559 - protein, 37 aa, Artificial Sequence
  Description of Artificial Sequence: Synthetic polypeptide
DEEEIRTTNPVATEQYGCVCSMWGEHEQEHFGSETQS

SEQ ID NO: 177560 - protein, 32 aa, Artificial Sequence
  Description of Artificial Sequence: Synthetic polypeptide
DETEIRTTNPIATECWGAVWANAEDWAPGPYI

SEQ ID NO: 177561 - protein, 34 aa, Artificial Sequence
  Description of Artificial Sequence: Synthetic polypeptide
DETEIRTTNPIATECWGAVWANAEDWQERKGPYI

SEQ ID NO: 177562 - protein, 32 aa, Artificial Sequence
  Description of Artificial Sequence: Synthetic polypeptide
DDSEVASTNPVSTEGYGNVAANATIQSRVGQR

SEQ ID NO: 177563 - protein, 32 aa, Artificial Sequence
  Description of Artificial Sequence: Synthetic polypeptide
DEDEIATTNPVATASWGCIATTNAEQDDNKNN

SEQ ID NO: 177564 - protein, 33 aa, Artificial Sequence
  Description of Artificial Sequence: Synthetic polypeptide
DDSEVASTNPVSTEGYGNVAANATLIQSRVGQR

SEQ ID NO: 177565 - protein, 37 aa, Artificial Sequence
  Description of Artificial Sequence: Synthetic polypeptide
DEEEISTTNPVATEQYGCVCSTWGEDHNQENFNSEQS

SEQ ID NO: 177566 - protein, 36 aa, Artificial Sequence
  Description of Artificial Sequence: Synthetic polypeptide
DEDEIATTNPVATAQYGSVSAIWPAGTNQGNPMEGV

SEQ ID NO: 177567 - protein, 31 aa, Artificial Sequence
  Description of Artificial Sequence: Synthetic polypeptide
DETEIRTTNPIATECWGAVWSADWMEPKEDA

SEQ ID NO: 177568 - protein, 33 aa, Artificial Sequence
  Description of Artificial Sequence: Synthetic polypeptide
DEDEIATTNPVATAQWGTVCAANDGEVEDGGND

SEQ ID NO: 177569 - protein, 31 aa, Artificial Sequence
  Description of Artificial Sequence: Synthetic polypeptide
DETEIRTTNPIATECWGAVWSEIWMEPKEDA

SEQ ID NO: 177570 - protein, 35 aa, Artificial Sequence
  Description of Artificial Sequence: Synthetic polypeptide
DEAEIRTTNPVAYEQWGSVACGPNPEDDENGGDNH

SEQ ID NO: 177571 - protein, 37 aa, Artificial Sequence
  Description of Artificial Sequence: Synthetic polypeptide
DEEEISTTNPVATEQYGCVCSTWGEHDAENFGSENQP

SEQ ID NO: 177572 - protein, 34 aa, Artificial Sequence
  Description of Artificial Sequence: Synthetic polypeptide
DEDEIATTNPVATAQWGGCVATNALTAAPQNQDM

SEQ ID NO: 177573 - protein, 37 aa, Artificial Sequence
  Description of Artificial Sequence: Synthetic polypeptide
DEEEISTTNPVATEQYGCVCSTWGEHNAENFNSDTQA

SEQ ID NO: 177574 - protein, 31 aa, Artificial Sequence
  Description of Artificial Sequence: Synthetic polypeptide
DDSEVASTNPVSTEGYGNVAAMTIQSRVGQR

SEQ ID NO: 177575 - protein, 32 aa, Artificial Sequence
  Description of Artificial Sequence: Synthetic polypeptide
DETEIRTTNPIATECWGATWANAEDLAPKGTI

SEQ ID NO: 177576 - protein, 37 aa, Artificial Sequence
  Description of Artificial Sequence: Synthetic polypeptide
DEEEISTTNPVATEQYGCVCSTWGEDHAENFGSQNQD

SEQ ID NO: 177577 - protein, 36 aa, Artificial Sequence
  Description of Artificial Sequence: Synthetic polypeptide
AEEEIRTTNPVATEQYGCVCSWGEHNQENFNSDTQS

SEQ ID NO: 177578 - protein, 37 aa, Artificial Sequence
  Description of Artificial Sequence: Synthetic polypeptide
DEEEISTTNPVATEQYGCVCSTSGPHNQENFNSDTQS

SEQ ID NO: 177579 - protein, 31 aa, Artificial Sequence
  Description of Artificial Sequence: Synthetic polypeptide
DDSEVASTNPVSTEGYGNVAAMTIQSQVGQR

SEQ ID NO: 177580 - protein, 32 aa, Artificial Sequence
  Description of Artificial Sequence: Synthetic polypeptide
DETEIRTTNPIATECWGATWANAEDWAPKGTR

SEQ ID NO: 177581 - protein, 32 aa, Artificial Sequence
  Description of Artificial Sequence: Synthetic polypeptide
DETEIRTTNPIATECWGATWANAENWAPKGTR

SEQ ID NO: 177582 - protein, 37 aa, Artificial Sequence
  Description of Artificial Sequence: Synthetic polypeptide
DEEEISTTNPVATEQYGCVCSTTGEHDQEGFISDTQS

SEQ ID NO: 177583 - protein, 32 aa, Artificial Sequence
  Description of Artificial Sequence: Synthetic polypeptide
DETEIRTTNPIATECWGATWANCEDLAPKGTI

SEQ ID NO: 177584 - protein, 37 aa, Artificial Sequence
  Description of Artificial Sequence: Synthetic polypeptide
DEEEISTTNPVATEQYGCVCSTTGEHNQENFGSDPQL

SEQ ID NO: 177585 - protein, 34 aa, Artificial Sequence
  Description of Artificial Sequence: Synthetic polypeptide
AEDEIRTTNPVTTEHWGSVYCMDNMQDQQRQGDP

SEQ ID NO: 177586 - protein, 38 aa, Artificial Sequence
  Description of Artificial Sequence: Synthetic polypeptide
DEEEIRTTNPVAYEQWGSVSGGLPANGGNMRNGMGDDA

SEQ ID NO: 177587 - protein, 37 aa, Artificial Sequence
  Description of Artificial Sequence: Synthetic polypeptide
DEEEISTTNPVATEQYGCVCSTWEEHNAEGFNSDNQA

SEQ ID NO: 177588 - protein, 37 aa, Artificial Sequence
  Description of Artificial Sequence: Synthetic polypeptide
DEEEISTTNPVATEQYGCVCSTWEEHNQEGFGSDTQS

SEQ ID NO: 177589 - protein, 37 aa, Artificial Sequence
  Description of Artificial Sequence: Synthetic polypeptide
AEEEIRTTNPVATEQYGCVCSTWEEHNQENFNSDNQG

SEQ ID NO: 177590 - protein, 37 aa, Artificial Sequence
  Description of Artificial Sequence: Synthetic polypeptide
AEEEIRTTNPVATEQYGCVCSTWEEHNQENFNSDTQS

SEQ ID NO: 177591 - protein, 34 aa, Artificial Sequence
  Description of Artificial Sequence: Synthetic polypeptide
DETEIRTTNPIATECWGATWSNAIDWPQERKGNG

SEQ ID NO: 177592 - protein, 36 aa, Artificial Sequence
  Description of Artificial Sequence: Synthetic polypeptide
DEEEIRTTNPVAYEQYGQCVCSWMEDHNQENNSQQA

SEQ ID NO: 177593 - protein, 34 aa, Artificial Sequence
  Description of Artificial Sequence: Synthetic polypeptide
DETEIRTTNPIATECWGATWSNAIDWQERKGNYG

SEQ ID NO: 177594 - protein, 37 aa, Artificial Sequence
  Description of Artificial Sequence: Synthetic polypeptide
DEEEISTTNPVATEQYGCVCSTWEEHNQENFNSDTQL

SEQ ID NO: 177595 - protein, 37 aa, Artificial Sequence
  Description of Artificial Sequence: Synthetic polypeptide
DEEEISTTNPVATEQYGCVCSTWEEHNQENFNSQNQA

SEQ ID NO: 177596 - protein, 36 aa, Artificial Sequence
  Description of Artificial Sequence: Synthetic polypeptide
AEEEIRTTNPVATEQYGCVCSWGEHNAEYFNSDFQA

SEQ ID NO: 177597 - protein, 36 aa, Artificial Sequence
  Description of Artificial Sequence: Synthetic polypeptide
AEEEIRTTNPVATEQYGCVCSWGEHNDEFFNSDNQS

SEQ ID NO: 177598 - protein, 36 aa, Artificial Sequence
  Description of Artificial Sequence: Synthetic polypeptide
AEEEIRTTNPVATEQYGCVCSWGEHNIENFNSENQL

SEQ ID NO: 177599 - protein, 38 aa, Artificial Sequence
  Description of Artificial Sequence: Synthetic polypeptide
DEEEIRTTNPVAYEQWGSVSGGLPANGGNMRNGDGDVD

SEQ ID NO: 177600 - protein, 36 aa, Artificial Sequence
  Description of Artificial Sequence: Synthetic polypeptide
CEEEIRTTNPVATEQYGCVCSNWEDNEENFNSDNQS

SEQ ID NO: 177601 - protein, 37 aa, Artificial Sequence
  Description of Artificial Sequence: Synthetic polypeptide
CEEEIRTTNPVATEQYGCVCSNTGEHNQENFGSDTQF

SEQ ID NO: 177602 - protein, 38 aa, Artificial Sequence
  Description of Artificial Sequence: Synthetic polypeptide
DEEEISTTNPVATEQYGCVCSTWGEDDNQENFGSDNQS

SEQ ID NO: 177603 - protein, 36 aa, Artificial Sequence
  Description of Artificial Sequence: Synthetic polypeptide
AEEEIRTTNPVATEQYGCVCSWGEHNQENFNSETQS

SEQ ID NO: 177604 - protein, 32 aa, Artificial Sequence
  Description of Artificial Sequence: Synthetic polypeptide
DDSEVASTNPVSTEGYGNVAALTIEQSRVGQR

SEQ ID NO: 177605 - protein, 31 aa, Artificial Sequence
  Description of Artificial Sequence: Synthetic polypeptide
TCSEVASTNPVSTEGYGNVAANTIQSRVGQR

SEQ ID NO: 177606 - protein, 37 aa, Artificial Sequence
  Description of Artificial Sequence: Synthetic polypeptide
DEEEIRTTNPVAYEQYGQCVCSWGEHNQENFGSENQS

SEQ ID NO: 177607 - protein, 35 aa, Artificial Sequence
  Description of Artificial Sequence: Synthetic polypeptide
VENEIRTTNPVATEQYGSVYTWNMINTESSEEHTA

SEQ ID NO: 177608 - protein, 36 aa, Artificial Sequence
  Description of Artificial Sequence: Synthetic polypeptide
DEEEIRTTNPVATEQYGAVVNGFGQGQDTDQTTGMN

SEQ ID NO: 177609 - protein, 34 aa, Artificial Sequence
  Description of Artificial Sequence: Synthetic polypeptide
VENEIRTTNPVSTEPYGTAISTMEDCQQQQNGNH

SEQ ID NO: 177610 - protein, 33 aa, Artificial Sequence
  Description of Artificial Sequence: Synthetic polypeptide
TECEIATTNPCAYEHWGSVCYTNDDQDHGQNDH

SEQ ID NO: 177611 - protein, 37 aa, Artificial Sequence
  Description of Artificial Sequence: Synthetic polypeptide
DEEEIRTTNPVATEQYGCVCSMWGEHNQEFFNSDTQA

SEQ ID NO: 177612 - protein, 36 aa, Artificial Sequence
  Description of Artificial Sequence: Synthetic polypeptide
DEEEIRTTNPVATEQYGCVCSMWGEHNINFNSDTQS

SEQ ID NO: 177613 - protein, 31 aa, Artificial Sequence
  Description of Artificial Sequence: Synthetic polypeptide
DDSEVASTNPVSTEGYGNVAAGTIQMRVGQR

SEQ ID NO: 177614 - protein, 34 aa, Artificial Sequence
  Description of Artificial Sequence: Synthetic polypeptide
TEANEIATTNPVAYEQWGSVCSGENDQHDTNDHK

SEQ ID NO: 177615 - protein, 35 aa, Artificial Sequence
  Description of Artificial Sequence: Synthetic polypeptide
DEEEIRTTNPVAYEQYGCVCGNWEHNQYFISDTQS

SEQ ID NO: 177616 - protein, 36 aa, Artificial Sequence
  Description of Artificial Sequence: Synthetic polypeptide
DEEEIRTTNPVAYEQYGCVCGNSGEHNAENFNSDQA

SEQ ID NO: 177617 - protein, 36 aa, Artificial Sequence
  Description of Artificial Sequence: Synthetic polypeptide
AEEEIRTTNPVATEQYGCVCSNSEEHNQNFGSETQG

SEQ ID NO: 177618 - protein, 31 aa, Artificial Sequence
  Description of Artificial Sequence: Synthetic polypeptide
DDSEVASTNPVSTEGYGNVAAGTIQSRTGQR

SEQ ID NO: 177619 - protein, 37 aa, Artificial Sequence
  Description of Artificial Sequence: Synthetic polypeptide
AEEEIRTTNPVATEQYGCVCSNSGEHNQENFGSDNQS

SEQ ID NO: 177620 - protein, 31 aa, Artificial Sequence
  Description of Artificial Sequence: Synthetic polypeptide
DDSEVASTNPVSTEGYGNVAAGTIQSRVGQR

SEQ ID NO: 177621 - protein, 36 aa, Artificial Sequence
  Description of Artificial Sequence: Synthetic polypeptide
DEEEIRTTNPVAYEQYGCSCSSGEPHNAENFNSDQA

SEQ ID NO: 177622 - protein, 37 aa, Artificial Sequence
  Description of Artificial Sequence: Synthetic polypeptide
AEEEIRTTNPVATEQYGCVCSNTEEHNAEYFNSDFQA

SEQ ID NO: 177623 - protein, 36 aa, Artificial Sequence
  Description of Artificial Sequence: Synthetic polypeptide
DEEEISTTNPVATEQYGCVCSTGPDDAENFNSETQA

SEQ ID NO: 177624 - protein, 36 aa, Artificial Sequence
  Description of Artificial Sequence: Synthetic polypeptide
DEEEISTTNPVATEQYGCVCSTGPDHNQENFMSDQS

SEQ ID NO: 177625 - protein, 37 aa, Artificial Sequence
  Description of Artificial Sequence: Synthetic polypeptide
AEEEIRTTNPVATEQYGCVCSNTGEHNQENFNSDTQA

SEQ ID NO: 177626 - protein, 31 aa, Artificial Sequence
  Description of Artificial Sequence: Synthetic polypeptide
DDSEVASTNPVSTEGYGNVAAGTTQSRVGQR

SEQ ID NO: 177627 - protein, 31 aa, Artificial Sequence
  Description of Artificial Sequence: Synthetic polypeptide
DDSEVASTNPVSTEGYGNVAAHTIQSRDGQR

SEQ ID NO: 177628 - protein, 36 aa, Artificial Sequence
  Description of Artificial Sequence: Synthetic polypeptide
AEEEIRTTNPVATEQYGCVCSNTMEHNANFNSQFQA

SEQ ID NO: 177629 - protein, 35 aa, Artificial Sequence
  Description of Artificial Sequence: Synthetic polypeptide
TEAEIRTTNPVATEQYGSIDHTTLEDHNDEGSDEQ

SEQ ID NO: 177630 - protein, 35 aa, Artificial Sequence
  Description of Artificial Sequence: Synthetic polypeptide
TEAEIRTTNPVATEQYGSICNTTLEDYNGESDEQC

SEQ ID NO: 177631 - protein, 37 aa, Artificial Sequence
  Description of Artificial Sequence: Synthetic polypeptide
DEEEIRTTNPVAYEQYGCQVCSTGEDHQENFNSETQQ

SEQ ID NO: 177632 - protein, 32 aa, Artificial Sequence
  Description of Artificial Sequence: Synthetic polypeptide
TECEIATTNPVAYEQWGCTPTNHMMEDGGNTQ

SEQ ID NO: 177633 - protein, 36 aa, Artificial Sequence
  Description of Artificial Sequence: Synthetic polypeptide
DEEEIRTTNPVAYEQYGCQVCSNWGEHQENFGSEQS

SEQ ID NO: 177634 - protein, 37 aa, Artificial Sequence
  Description of Artificial Sequence: Synthetic polypeptide
AEEEIRTTNPVATEQYGCVCSDWGEHNTENFSSDNQS

SEQ ID NO: 177635 - protein, 35 aa, Artificial Sequence
  Description of Artificial Sequence: Synthetic polypeptide
TECGICTTNPVAYEQYGSVSCLNASNDRPEGNNAY

SEQ ID NO: 177636 - protein, 36 aa, Artificial Sequence
  Description of Artificial Sequence: Synthetic polypeptide
DEEEISTTNPVATEQYGCVCSTGEHNQENFTSDTQA

SEQ ID NO: 177637 - protein, 35 aa, Artificial Sequence
  Description of Artificial Sequence: Synthetic polypeptide
TEEAEIRTTNPVAYEPWGVVCSTWEQGDQGGGNTE

SEQ ID NO: 177638 - protein, 31 aa, Artificial Sequence
  Description of Artificial Sequence: Synthetic polypeptide
DDSEVASTNPVSTEGYGNVAAETIQSRVGQR

SEQ ID NO: 177639 - protein, 32 aa, Artificial Sequence
  Description of Artificial Sequence: Synthetic polypeptide
TEDEIRTTNPVSYEPYGTISMEDISQQQNGNH

SEQ ID NO: 177640 - protein, 34 aa, Artificial Sequence
  Description of Artificial Sequence: Synthetic polypeptide
TEDEIRTTNPVAYEPYGKVSICNEHAGTITPPRY

SEQ ID NO: 177641 - protein, 36 aa, Artificial Sequence
  Description of Artificial Sequence: Synthetic polypeptide
DEEEIRTTNPVATEQYGAVVNGMGQGGGDTDQTTGF

SEQ ID NO: 177642 - protein, 34 aa, Artificial Sequence
  Description of Artificial Sequence: Synthetic polypeptide
DEEEIRTTNPVAYEQYGCVCGWGEHNAYFNSDQS

SEQ ID NO: 177643 - protein, 35 aa, Artificial Sequence
  Description of Artificial Sequence: Synthetic polypeptide
DESEIVTTNPVAYEPYGTVCSATGGEQSEFEGGND

SEQ ID NO: 177644 - protein, 35 aa, Artificial Sequence
  Description of Artificial Sequence: Synthetic polypeptide
AEEEIRTTNPVATEQYGCVCNWGEDNQHFGSDTQS

SEQ ID NO: 177645 - protein, 35 aa, Artificial Sequence
  Description of Artificial Sequence: Synthetic polypeptide
AEEEIRTTNPVATEQYGCVCNWGEHNAYFGSDTQS

SEQ ID NO: 177646 - protein, 35 aa, Artificial Sequence
  Description of Artificial Sequence: Synthetic polypeptide
DEEEIRTTNPVATEQYGAVVNGFGQGQDTIDTTGF

SEQ ID NO: 177647 - protein, 36 aa, Artificial Sequence
  Description of Artificial Sequence: Synthetic polypeptide
AEEEIRTTNPVATEQYGCVCSAGEDLNDEFFGSDQS

SEQ ID NO: 177648 - protein, 37 aa, Artificial Sequence
  Description of Artificial Sequence: Synthetic polypeptide
DEEEIRTTNPVATEQYGCVCSMWGEHNQENFGSDTQS

SEQ ID NO: 177649 - protein, 31 aa, Artificial Sequence
  Description of Artificial Sequence: Synthetic polypeptide
DDSEVASTNPVSTEGYGNVAAEVCQSRVGQR

SEQ ID NO: 177650 - protein, 35 aa, Artificial Sequence
  Description of Artificial Sequence: Synthetic polypeptide
AEEEIRTTNPVATEQYGCVCSAGEHNDEFFISDQS

SEQ ID NO: 177651 - protein, 36 aa, Artificial Sequence
  Description of Artificial Sequence: Synthetic polypeptide
DESEIVTTNPVATEQYGTVVSATDGDDEEGGEGNED

SEQ ID NO: 177652 - protein, 32 aa, Artificial Sequence
  Description of Artificial Sequence: Synthetic polypeptide
TEDEICTTNPVAYEPYGQSVFWNASMRVTSEE

SEQ ID NO: 177653 - protein, 36 aa, Artificial Sequence
  Description of Artificial Sequence: Synthetic polypeptide
DESEIVTTNPVATEQYGTVVCSATGGEPSEFEGGND

SEQ ID NO: 177654 - protein, 31 aa, Artificial Sequence
  Description of Artificial Sequence: Synthetic polypeptide
DDSEVASTNPVSTEGYGNVAAFTINSHVGQR

SEQ ID NO: 177655 - protein, 35 aa, Artificial Sequence
  Description of Artificial Sequence: Synthetic polypeptide
TEDEIATTNPVAYEQWGSVCGNPPLMDDRGSNGTQ

SEQ ID NO: 177656 - protein, 35 aa, Artificial Sequence
  Description of Artificial Sequence: Synthetic polypeptide
TEDEIATTNPVATEVWGSVCYTLNDLQDQGGQGDE

SEQ ID NO: 177657 - protein, 37 aa, Artificial Sequence
  Description of Artificial Sequence: Synthetic polypeptide
DEEEISTTNPCATEQYGQCVCSTGEDHNQNFGSDNQS

SEQ ID NO: 177658 - protein, 36 aa, Artificial Sequence
  Description of Artificial Sequence: Synthetic polypeptide
CEEEIRTTNPVATEQYGCVCSNWMEDHQENFGSDQA

SEQ ID NO: 177659 - protein, 36 aa, Artificial Sequence
  Description of Artificial Sequence: Synthetic polypeptide
DEEEIRTTNPVATEQYGAVVNGFGQGQDTDQVTGFE

SEQ ID NO: 177660 - protein, 37 aa, Artificial Sequence
  Description of Artificial Sequence: Synthetic polypeptide
DEEEIRTTNPVATEQYGCVCSMWGEHNQEHFNSDTQS

SEQ ID NO: 177661 - protein, 37 aa, Artificial Sequence
  Description of Artificial Sequence: Synthetic polypeptide
VENEIRTTNPVATEQYGSVITVGDLGLGGGEEDNDEF

SEQ ID NO: 177662 - protein, 31 aa, Artificial Sequence
  Description of Artificial Sequence: Synthetic polypeptide
DDSEVASTNPVSTEGYGNVAAHTIQSRIGQR

SEQ ID NO: 177663 - protein, 31 aa, Artificial Sequence
  Description of Artificial Sequence: Synthetic polypeptide
DDSEVASTNPVSTEGYGNVAAHTIQSRVGQR

SEQ ID NO: 177664 - protein, 33 aa, Artificial Sequence
  Description of Artificial Sequence: Synthetic polypeptide
DEAEIRTTNPVAYEQWGCVCMNNDEMGTGDTEQ

SEQ ID NO: 177665 - protein, 34 aa, Artificial Sequence
  Description of Artificial Sequence: Synthetic polypeptide
DEDEIATTNPVATASWGCVSAANNNPQDAGGENG

SEQ ID NO: 177666 - protein, 37 aa, Artificial Sequence
  Description of Artificial Sequence: Synthetic polypeptide
DEEEIRTTNPVATEQYGCVCSMWGEHNAENFNSETQS

SEQ ID NO: 177667 - protein, 31 aa, Artificial Sequence
  Description of Artificial Sequence: Synthetic polypeptide
DDSEVACTNPVSTEGYGCVATWTIQNRVGQQ

SEQ ID NO: 177668 - protein, 34 aa, Artificial Sequence
  Description of Artificial Sequence: Synthetic polypeptide
DEDEIATTNPVATASWGCVSAANNEPMDRGDGNG

SEQ ID NO: 177669 - protein, 34 aa, Artificial Sequence
  Description of Artificial Sequence: Synthetic polypeptide
TEAEIATTNPEATDQYGQVCCCDQDQKREGDDNR

SEQ ID NO: 177670 - protein, 35 aa, Artificial Sequence
  Description of Artificial Sequence: Synthetic polypeptide
DEDEIATTNPVATASWGCVSAANNEPLGRGGENGM

SEQ ID NO: 177671 - protein, 33 aa, Artificial Sequence
  Description of Artificial Sequence: Synthetic polypeptide
TEAEIASVNPVCYEQYGVVVSCDNLSQSEGGNQ

SEQ ID NO: 177672 - protein, 31 aa, Artificial Sequence
  Description of Artificial Sequence: Synthetic polypeptide
TEAEIAATNPCSYEQWGIVSKCNDDQSGDTR

SEQ ID NO: 177673 - protein, 36 aa, Artificial Sequence
  Description of Artificial Sequence: Synthetic polypeptide
CEEEIRTTNPVATEQYGCVCSNWEEHQENFGSQTQA

SEQ ID NO: 177674 - protein, 32 aa, Artificial Sequence
  Description of Artificial Sequence: Synthetic polypeptide
TEADEIATTNPVAYERWGTCSTDDQHQQGNED

SEQ ID NO: 177675 - protein, 35 aa, Artificial Sequence
  Description of Artificial Sequence: Synthetic polypeptide
DEDEIATTNPVATASWGCVSAANNEPLDRGGENHQ

SEQ ID NO: 177676 - protein, 36 aa, Artificial Sequence
  Description of Artificial Sequence: Synthetic polypeptide
CEEEIRTTNPVATEQYGCVCSNWEEHNQNFNSQPQS

SEQ ID NO: 177677 - protein, 35 aa, Artificial Sequence
  Description of Artificial Sequence: Synthetic polypeptide
DEDEIATTNPVATASWGCVSAANNEPLDRGGENDN

SEQ ID NO: 177678 - protein, 33 aa, Artificial Sequence
  Description of Artificial Sequence: Synthetic polypeptide
DEDEIATTNPVATASWGCVAGNNNLQDAGAGWN

SEQ ID NO: 177679 - protein, 33 aa, Artificial Sequence
  Description of Artificial Sequence: Synthetic polypeptide
VESEISTTNPVAYEQWGMTCVTDNDDQRQAQRL

SEQ ID NO: 177680 - protein, 33 aa, Artificial Sequence
  Description of Artificial Sequence: Synthetic polypeptide
TDETEIATTNPVAYEAWGVCATNLNGDTGNGSS

SEQ ID NO: 177681 - protein, 36 aa, Artificial Sequence
  Description of Artificial Sequence: Synthetic polypeptide
DEEEIRTTNPVATEQYGAVVNGFGQGGQDDSATTGQ

SEQ ID NO: 177682 - protein, 36 aa, Artificial Sequence
  Description of Artificial Sequence: Synthetic polypeptide
DEEEIRTTNPVATEQYGAVVNGFGQGGQDDPETTGG

SEQ ID NO: 177683 - protein, 37 aa, Artificial Sequence
  Description of Artificial Sequence: Synthetic polypeptide
TDEEIRTTNPVATEQYGSVVPSANQQETVMTLNPVDF

SEQ ID NO: 177684 - protein, 37 aa, Artificial Sequence
  Description of Artificial Sequence: Synthetic polypeptide
AEEEIRTTNPVATEQYGCVCSNWGEHNDEYFGSDNQS

SEQ ID NO: 177685 - protein, 37 aa, Artificial Sequence
  Description of Artificial Sequence: Synthetic polypeptide
AEEEIRTTNPVATEQYGCVCSNWGEHNQENFGSDNQS

SEQ ID NO: 177686 - protein, 36 aa, Artificial Sequence
  Description of Artificial Sequence: Synthetic polypeptide
AEEEIRTTNPVATEQYGCVCSNWGEHNQENFGSEQA

SEQ ID NO: 177687 - protein, 37 aa, Artificial Sequence
  Description of Artificial Sequence: Synthetic polypeptide
AEEEIRTTNPVATEQYGCVCSNWGEHNTENFNSENQG

SEQ ID NO: 177688 - protein, 36 aa, Artificial Sequence
  Description of Artificial Sequence: Synthetic polypeptide
AEEEIRTTNPVATEQYGCVCSNWGEHQENFISDNQS

SEQ ID NO: 177689 - protein, 36 aa, Artificial Sequence
  Description of Artificial Sequence: Synthetic polypeptide
DEEEIRTTNPVATEQYGAVVNGFGQDGQDTDQTTGA

SEQ ID NO: 177690 - protein, 35 aa, Artificial Sequence
  Description of Artificial Sequence: Synthetic polypeptide
DEDEIATTNPVATASWGCVSAANTEPQDRGGENDG

SEQ ID NO: 177691 - protein, 36 aa, Artificial Sequence
  Description of Artificial Sequence: Synthetic polypeptide
DEEEIRTTNPVATEQYGAVVNGFGQGGQDDSQTTAI

SEQ ID NO: 177692 - protein, 36 aa, Artificial Sequence
  Description of Artificial Sequence: Synthetic polypeptide
DESEIRTTNPVATEQYGSVPYQTDEEDITPSQEHWP

SEQ ID NO: 177693 - protein, 36 aa, Artificial Sequence
  Description of Artificial Sequence: Synthetic polypeptide
VESEIRTTNPVATEAWGSVVSCGHEFSQDREGENLW

SEQ ID NO: 177694 - protein, 38 aa, Artificial Sequence
  Description of Artificial Sequence: Synthetic polypeptide
DEEEIRTTNPVATEAYGSVSTTVQQQQNATEQGTTEEE

SEQ ID NO: 177695 - protein, 37 aa, Artificial Sequence
  Description of Artificial Sequence: Synthetic polypeptide
DEEEIRTTNPVATEQYGCVCSMWGEHNIENFNSDNQS

SEQ ID NO: 177696 - protein, 37 aa, Artificial Sequence
  Description of Artificial Sequence: Synthetic polypeptide
DEEEISTTNPVATEQYGCVCSTMEDHNQENFGSETQS

SEQ ID NO: 177697 - protein, 36 aa, Artificial Sequence
  Description of Artificial Sequence: Synthetic polypeptide
TEAEIRTTNPVATEAYGNTVCCCQGNSDQVRGGNTS

SEQ ID NO: 177698 - protein, 34 aa, Artificial Sequence
  Description of Artificial Sequence: Synthetic polypeptide
TEAEICTTNPVAYEQWGCVSTTLDLGEDERNGDS

SEQ ID NO: 177699 - protein, 36 aa, Artificial Sequence
  Description of Artificial Sequence: Synthetic polypeptide
TEAEICTTNPVAYECWGSVATGNGPLNDDRGQNGQR

SEQ ID NO: 177700 - protein, 35 aa, Artificial Sequence
  Description of Artificial Sequence: Synthetic polypeptide
DEDEIATTNPVATEMWGCVATNAQPTNGNQTEGNN

SEQ ID NO: 177701 - protein, 33 aa, Artificial Sequence
  Description of Artificial Sequence: Synthetic polypeptide
DEAEIRTTNPVAYEQWGCVCPNNDENDTGDSEQ

SEQ ID NO: 177702 - protein, 34 aa, Artificial Sequence
  Description of Artificial Sequence: Synthetic polypeptide
DEDEIATTNPVATECYGSVCAAVANLADTPPEEG

SEQ ID NO: 177703 - protein, 34 aa, Artificial Sequence
  Description of Artificial Sequence: Synthetic polypeptide
TEAEIATTNPVAYEQWGCVSTTLDLGEDERNGGH

SEQ ID NO: 177704 - protein, 35 aa, Artificial Sequence
  Description of Artificial Sequence: Synthetic polypeptide
DEDEIATTNPVATECYGSVCAAVANLADMPPEEAR

SEQ ID NO: 177705 - protein, 34 aa, Artificial Sequence
  Description of Artificial Sequence: Synthetic polypeptide
DEDEIATTNPVATECYGSVCAAIEGLEADNLGPM

SEQ ID NO: 177706 - protein, 33 aa, Artificial Sequence
  Description of Artificial Sequence: Synthetic polypeptide
DETEIRTTNPIATECWGATTWANDEDLQPGPYI

SEQ ID NO: 177707 - protein, 34 aa, Artificial Sequence
  Description of Artificial Sequence: Synthetic polypeptide
DEAAISTTNPVATEQYGCVCSWGEHNAYFGSDQS

SEQ ID NO: 177708 - protein, 32 aa, Artificial Sequence
  Description of Artificial Sequence: Synthetic polypeptide
DDSEVASTNPVSTEGYGNVAAHTYIQSRVGQR

SEQ ID NO: 177709 - protein, 31 aa, Artificial Sequence
  Description of Artificial Sequence: Synthetic polypeptide
DDSEVASTNPVSTEGYGNVAAITIESRVGQR

SEQ ID NO: 177710 - protein, 35 aa, Artificial Sequence
  Description of Artificial Sequence: Synthetic polypeptide
DEDEIATTNPVATECWGSVCYNNDQGDHGGQNDQA

SEQ ID NO: 177711 - protein, 34 aa, Artificial Sequence
  Description of Artificial Sequence: Synthetic polypeptide
DEDEIATTNPVATECWGSVCYNNDQGDHGGQGDP

SEQ ID NO: 177712 - protein, 36 aa, Artificial Sequence
  Description of Artificial Sequence: Synthetic polypeptide
DEDEIATTNPVATECWGSVCFTNEDNQDGQRGGTDQ

SEQ ID NO: 177713 - protein, 36 aa, Artificial Sequence
  Description of Artificial Sequence: Synthetic polypeptide
DEDEIATTNPVATEAWGVVSKTNNPLDDRQNGGGDH

SEQ ID NO: 177714 - protein, 31 aa, Artificial Sequence
  Description of Artificial Sequence: Synthetic polypeptide
DDSEVASTNPVSTEGYGNVAAITIQSRVGQR

SEQ ID NO: 177715 - protein, 31 aa, Artificial Sequence
  Description of Artificial Sequence: Synthetic polypeptide
DDSEVASTNPVSTEGYGNVAAITITSRVGQR

SEQ ID NO: 177716 - protein, 35 aa, Artificial Sequence
  Description of Artificial Sequence: Synthetic polypeptide
DEDEIATTNPVATASWGSVSVANNTPADQGGENAG

SEQ ID NO: 177717 - protein, 34 aa, Artificial Sequence
  Description of Artificial Sequence: Synthetic polypeptide
DEDEIATTNPVATASWGSVSAANNEPTDNGGENG

SEQ ID NO: 177718 - protein, 36 aa, Artificial Sequence
  Description of Artificial Sequence: Synthetic polypeptide
DEPEIRTTNPVATEQYGQCQSITVHEQSTLAVEQSG

SEQ ID NO: 177719 - protein, 37 aa, Artificial Sequence
  Description of Artificial Sequence: Synthetic polypeptide
DEEEIRTTNPVATEQYGCVCSMWGEHNAENFNSQNQS

SEQ ID NO: 177720 - protein, 35 aa, Artificial Sequence
  Description of Artificial Sequence: Synthetic polypeptide
TEAEIATTNPVAYDAYGQIVPSTNLAQNKGTPNPD

SEQ ID NO: 177721 - protein, 35 aa, Artificial Sequence
  Description of Artificial Sequence: Synthetic polypeptide
DETEICTTNPVAYEQWGSVSGGNGNESGLEGDGTS

SEQ ID NO: 177722 - protein, 35 aa, Artificial Sequence
  Description of Artificial Sequence: Synthetic polypeptide
DEAEIRTTNPVAYECWGSVYYGNGMEQQNGGGNAV

SEQ ID NO: 177723 - protein, 37 aa, Artificial Sequence
  Description of Artificial Sequence: Synthetic polypeptide
DEEEISTTNPVATEQYGCVCSNWGEHNQEYFGSENQS

SEQ ID NO: 177724 - protein, 34 aa, Artificial Sequence
  Description of Artificial Sequence: Synthetic polypeptide
DETEIRTTNPCAYEQWGSVCGDNNNDQQGQHGDL

SEQ ID NO: 177725 - protein, 36 aa, Artificial Sequence
  Description of Artificial Sequence: Synthetic polypeptide
DEEEIRTTNPVATEQYGCVCSNWGEHNQEFFISDQS

SEQ ID NO: 177726 - protein, 37 aa, Artificial Sequence
  Description of Artificial Sequence: Synthetic polypeptide
DEEEIRTTNPVATEQYGCVCSNWGEHNQEFFNSQNQA

SEQ ID NO: 177727 - protein, 34 aa, Artificial Sequence
  Description of Artificial Sequence: Synthetic polypeptide
DETEIRTTNPCAYEQWGSVCGDNNNDSQGQGGDA

SEQ ID NO: 177728 - protein, 33 aa, Artificial Sequence
  Description of Artificial Sequence: Synthetic polypeptide
DETEIRTTNPCAYEQWGSVCYNIEQEDQDSIDS

SEQ ID NO: 177729 - protein, 31 aa, Artificial Sequence
  Description of Artificial Sequence: Synthetic polypeptide
DDSEVASTNPVSTEGYGIVAACTIQSRVGQR

SEQ ID NO: 177730 - protein, 37 aa, Artificial Sequence
  Description of Artificial Sequence: Synthetic polypeptide
TEEEIRTTNPVATEQYGCVCNNWGNHNQENFGSNNQS

SEQ ID NO: 177731 - protein, 37 aa, Artificial Sequence
  Description of Artificial Sequence: Synthetic polypeptide
TEEEIRTTNPVATEQYGCVCNNTGEHNQEYFGSNTQS

SEQ ID NO: 177732 - protein, 35 aa, Artificial Sequence
  Description of Artificial Sequence: Synthetic polypeptide
DEEEIRTTNPVATEQYGCMAYWGDPGAPPDEMGND

SEQ ID NO: 177733 - protein, 33 aa, Artificial Sequence
  Description of Artificial Sequence: Synthetic polypeptide
DETEIRTTNPCAYEQWGVVCYNIEKSDQDSGDS

SEQ ID NO: 177734 - protein, 33 aa, Artificial Sequence
  Description of Artificial Sequence: Synthetic polypeptide
DETEIRTTNPCAYEQWGVVCYNIEQLDQDNIDS

SEQ ID NO: 177735 - protein, 37 aa, Artificial Sequence
  Description of Artificial Sequence: Synthetic polypeptide
DEEEIRTTNPVATEQYGCVCSNWGEHNQEHFNSDNQA

SEQ ID NO: 177736 - protein, 37 aa, Artificial Sequence
  Description of Artificial Sequence: Synthetic polypeptide
DEEEIRTTNPVATEQYGCVCSNWGEHNQENFGSDFQL

SEQ ID NO: 177737 - protein, 35 aa, Artificial Sequence
  Description of Artificial Sequence: Synthetic polypeptide
TEEEIRTTNPVATEQYGCIHHTTLEDHNDESDEQD

SEQ ID NO: 177738 - protein, 37 aa, Artificial Sequence
  Description of Artificial Sequence: Synthetic polypeptide
DEEEIRTTNPVATEQYGCVCSNWGEHNQENFGSDTQS

SEQ ID NO: 177739 - protein, 38 aa, Artificial Sequence
  Description of Artificial Sequence: Synthetic polypeptide
DEEEIRTTNPVATEAYGVVSTTNQQQNNQNQNGTEQGS

SEQ ID NO: 177740 - protein, 37 aa, Artificial Sequence
  Description of Artificial Sequence: Synthetic polypeptide
DEEEIRTTNPVATEQYGCVCSNWGEHNQENFGSDTQT

SEQ ID NO: 177741 - protein, 36 aa, Artificial Sequence
  Description of Artificial Sequence: Synthetic polypeptide
TESEIRTTNPVATECWGSVVSCGSEFSQDREGENGA

SEQ ID NO: 177742 - protein, 37 aa, Artificial Sequence
  Description of Artificial Sequence: Synthetic polypeptide
DEEEIRTTNPVATEQYGCVCSNWGEHNQENFGSETQD

SEQ ID NO: 177743 - protein, 37 aa, Artificial Sequence
  Description of Artificial Sequence: Synthetic polypeptide
DEEEIRTTNPVATEQYGCVCSNWGEHNQENFGSETQS

SEQ ID NO: 177744 - protein, 37 aa, Artificial Sequence
  Description of Artificial Sequence: Synthetic polypeptide
DEEEIRTTNPVATEQYGCVCSNWGEHNQENFISDNQS

SEQ ID NO: 177745 - protein, 36 aa, Artificial Sequence
  Description of Artificial Sequence: Synthetic polypeptide
DEEEIRTTNPVATEQYGCVCSNWGEHNQENFISDQS

SEQ ID NO: 177746 - protein, 36 aa, Artificial Sequence
  Description of Artificial Sequence: Synthetic polypeptide
DEDEIRTTNPVATEAWGVVSTVVNVEQGTNNEQGQE

SEQ ID NO: 177747 - protein, 36 aa, Artificial Sequence
  Description of Artificial Sequence: Synthetic polypeptide
DEDEIRTTNPVATEAWGVVSTVVNTEQGTNVEQYGS

SEQ ID NO: 177748 - protein, 36 aa, Artificial Sequence
  Description of Artificial Sequence: Synthetic polypeptide
DEDEIRTTNPVATEAWGVVSTVVNNVEQGTNNEQGE

SEQ ID NO: 177749 - protein, 35 aa, Artificial Sequence
  Description of Artificial Sequence: Synthetic polypeptide
DETEIRTTNPCAYEQWGSVCGDNNNDQQGQGGGVR

SEQ ID NO: 177750 - protein, 37 aa, Artificial Sequence
  Description of Artificial Sequence: Synthetic polypeptide
DEEEIRTTNPVATEAYGVVSTTQQQQNATEQGTEEEE

SEQ ID NO: 177751 - protein, 36 aa, Artificial Sequence
  Description of Artificial Sequence: Synthetic polypeptide
TEEEIRTTNPVATEQYGCVCNTMEHNQENFNSDNQA

SEQ ID NO: 177752 - protein, 37 aa, Artificial Sequence
  Description of Artificial Sequence: Synthetic polypeptide
VEEEIRTTNPVATEQYGSVSQTTAMGEIEEEIMSNGC

SEQ ID NO: 177753 - protein, 37 aa, Artificial Sequence
  Description of Artificial Sequence: Synthetic polypeptide
DEEEIRTTNPVATEQYGCQVCGNTGEHNIENFGSDQA

SEQ ID NO: 177754 - protein, 32 aa, Artificial Sequence
  Description of Artificial Sequence: Synthetic polypeptide
DDSEVASTNPVSTEGYGFVAANETMQVRVGQR

SEQ ID NO: 177755 - protein, 35 aa, Artificial Sequence
  Description of Artificial Sequence: Synthetic polypeptide
DEDEIATTNPVAYEGWGSVCSGTDNQDRDGGTQEQ

SEQ ID NO: 177756 - protein, 37 aa, Artificial Sequence
  Description of Artificial Sequence: Synthetic polypeptide
TEEEIRTTNPVATEQYGETYPSVNMSGDPIRQVEENI

SEQ ID NO: 177757 - protein, 38 aa, Artificial Sequence
  Description of Artificial Sequence: Synthetic polypeptide
DEEEIRTTNPVAYEQYGQCVCSTWEEHNIENFGSENQS

SEQ ID NO: 177758 - protein, 35 aa, Artificial Sequence
  Description of Artificial Sequence: Synthetic polypeptide
AESEEIATTNPVAYEQWGWVSTGGNAGNQQHGDDP

SEQ ID NO: 177759 - protein, 37 aa, Artificial Sequence
  Description of Artificial Sequence: Synthetic polypeptide
TEEEIRTTNPVATEQYGETYPSVNMSEDPQGQVNEND

SEQ ID NO: 177760 - protein, 34 aa, Artificial Sequence
  Description of Artificial Sequence: Synthetic polypeptide
DEDEIATTNPVAYECWGVVSGGNGLLQDHPNGGS

SEQ ID NO: 177761 - protein, 31 aa, Artificial Sequence
  Description of Artificial Sequence: Synthetic polypeptide
DDSEVASTNPVSTEGYGHVAAETIQSRVGQR

SEQ ID NO: 177762 - protein, 37 aa, Artificial Sequence
  Description of Artificial Sequence: Synthetic polypeptide
TEEEIRTTNPVATEQYGETYPSVAMSEDPIGQVNENN

SEQ ID NO: 177763 - protein, 37 aa, Artificial Sequence
  Description of Artificial Sequence: Synthetic polypeptide
TEEEIRTTNPVATEQYGETYNSVNMSEDPIEQVNENI

SEQ ID NO: 177764 - protein, 36 aa, Artificial Sequence
  Description of Artificial Sequence: Synthetic polypeptide
DEQEIATTNPVATEQYGSVDNATGDGEDQEGEGDIG

SEQ ID NO: 177765 - protein, 36 aa, Artificial Sequence
  Description of Artificial Sequence: Synthetic polypeptide
DEQEIATTNPVATEQYGSVFVWINGEQDRKKVSEDS

SEQ ID NO: 177766 - protein, 37 aa, Artificial Sequence
  Description of Artificial Sequence: Synthetic polypeptide
DEEEIRTTNPVATEQYGCVCSNWGEHNEENSNSDFQS

SEQ ID NO: 177767 - protein, 36 aa, Artificial Sequence
  Description of Artificial Sequence: Synthetic polypeptide
DETEIRTTNPCATEQYGSVSPNITMEVVPRVHQLIE

SEQ ID NO: 177768 - protein, 38 aa, Artificial Sequence
  Description of Artificial Sequence: Synthetic polypeptide
DEEEIRTTNPVATEQYGCNVCSNTGEDHQENFNSDNQQ

SEQ ID NO: 177769 - protein, 35 aa, Artificial Sequence
  Description of Artificial Sequence: Synthetic polypeptide
DEAAIRTTNPVATEQYGCVCSNWEEHQNFGSDFQS

SEQ ID NO: 177770 - protein, 38 aa, Artificial Sequence
  Description of Artificial Sequence: Synthetic polypeptide
AEEEIRTTNPCATEQYGVVSTVVSTTNNATEAGTNDTN

SEQ ID NO: 177771 - protein, 35 aa, Artificial Sequence
  Description of Artificial Sequence: Synthetic polypeptide
DEDEIATTNPVAYECWGSVASNDNLGEERNGDKDS

SEQ ID NO: 177772 - protein, 35 aa, Artificial Sequence
  Description of Artificial Sequence: Synthetic polypeptide
DETEIRTTNPCAYEEWGSVAVTWNDHQGDRQSNAQ

SEQ ID NO: 177773 - protein, 36 aa, Artificial Sequence
  Description of Artificial Sequence: Synthetic polypeptide
DEEEIRTTNPVATEQYGCVCSNWGEHNENFNSDTQS

SEQ ID NO: 177774 - protein, 34 aa, Artificial Sequence
  Description of Artificial Sequence: Synthetic polypeptide
DETEIRTTNPCAYEQWGSVCGDNGNDQQGQGGDD

SEQ ID NO: 177775 - protein, 37 aa, Artificial Sequence
  Description of Artificial Sequence: Synthetic polypeptide
DEEEIRTTNPVATEQYGCVCSNWGEHNIENFNSDNQS

SEQ ID NO: 177776 - protein, 37 aa, Artificial Sequence
  Description of Artificial Sequence: Synthetic polypeptide
DEEEIRTTNPVATEQYGCVCSNWGEHNIENFNSDTQA

SEQ ID NO: 177777 - protein, 39 aa, Artificial Sequence
  Description of Artificial Sequence: Synthetic polypeptide
DEEEIRTTNPVATEAYGVVSTTNQQQGSNQNQNGTEQGA

SEQ ID NO: 177778 - protein, 34 aa, Artificial Sequence
  Description of Artificial Sequence: Synthetic polypeptide
DETEIRTTNPCAYEQWGSVCGDNNNDQGGQGGED

SEQ ID NO: 177779 - protein, 38 aa, Artificial Sequence
  Description of Artificial Sequence: Synthetic polypeptide
AEEEIRTTNPCATEQYGVVSTVVNTTQNATEAGTTNTD

SEQ ID NO: 177780 - protein, 37 aa, Artificial Sequence
  Description of Artificial Sequence: Synthetic polypeptide
DEEEIRTTNPVATEQYGCVCSNWGEHNQENFNSDNQS

SEQ ID NO: 177781 - protein, 37 aa, Artificial Sequence
  Description of Artificial Sequence: Synthetic polypeptide
DEEEIRTTNPVATEQYGCVCSNWGEHNQENFNSDTQS

SEQ ID NO: 177782 - protein, 35 aa, Artificial Sequence
  Description of Artificial Sequence: Synthetic polypeptide
CEDEIATTNPVATEQYGSVCAGTNPANPDAEDNQM

SEQ ID NO: 177783 - protein, 36 aa, Artificial Sequence
  Description of Artificial Sequence: Synthetic polypeptide
DEEEISTTNPVATEQYGCVCSNWEEDNQNFNSENQA

SEQ ID NO: 177784 - protein, 31 aa, Artificial Sequence
  Description of Artificial Sequence: Synthetic polypeptide
DDSEVASTNPVSTEGYGLVAANTISSRVGQR

SEQ ID NO: 177785 - protein, 36 aa, Artificial Sequence
  Description of Artificial Sequence: Synthetic polypeptide
DEEEISTTNPVATEQYGCVCSNWEEHDQEGFISDQS

SEQ ID NO: 177786 - protein, 37 aa, Artificial Sequence
  Description of Artificial Sequence: Synthetic polypeptide
DEEEISTTNPVATEQYGCVCSNWEEHNAEFFGSDNQS

SEQ ID NO: 177787 - protein, 37 aa, Artificial Sequence
  Description of Artificial Sequence: Synthetic polypeptide
DEAEIRTTNPVATEQYGSVYSVTAANQDTEYSEEVES

SEQ ID NO: 177788 - protein, 33 aa, Artificial Sequence
  Description of Artificial Sequence: Synthetic polypeptide
VEEEIACTNPVATEQYGCAPIHHGQDSEGENDD

SEQ ID NO: 177789 - protein, 32 aa, Artificial Sequence
  Description of Artificial Sequence: Synthetic polypeptide
DDSEVASTNPVSTEGYGMVAANTIQEVRQGQR

SEQ ID NO: 177790 - protein, 37 aa, Artificial Sequence
  Description of Artificial Sequence: Synthetic polypeptide
DEEEISTTNPVATEQYGCVCSNWEEHNAENFGSDNQP

SEQ ID NO: 177791 - protein, 38 aa, Artificial Sequence
  Description of Artificial Sequence: Synthetic polypeptide
TEEEIRTTNPVATEPYGSTVYSVESNEDSGPTNGGNNR

SEQ ID NO: 177792 - protein, 38 aa, Artificial Sequence
  Description of Artificial Sequence: Synthetic polypeptide
DEAEIRTTNPVATEQYGSYMSYSCIMLEELRNGNEEVF

SEQ ID NO: 177793 - protein, 36 aa, Artificial Sequence
  Description of Artificial Sequence: Synthetic polypeptide
DEEEIRTTNPVAYEQYGQCVCSWEDHNQEYFGSEQN

SEQ ID NO: 177794 - protein, 37 aa, Artificial Sequence
  Description of Artificial Sequence: Synthetic polypeptide
DESEIRTTNPVATEQYGSVIVDFGNGGFDTGDDGNTW

SEQ ID NO: 177795 - protein, 38 aa, Artificial Sequence
  Description of Artificial Sequence: Synthetic polypeptide
DEAEIRTTNPVATEQYGSYVCPSGIMLEELMNGNEEVF

SEQ ID NO: 177796 - protein, 36 aa, Artificial Sequence
  Description of Artificial Sequence: Synthetic polypeptide
DEEEISTTNPVATEQYGCVCSNWEEHNAGFNSDPQS

SEQ ID NO: 177797 - protein, 30 aa, Artificial Sequence
  Description of Artificial Sequence: Synthetic polypeptide
DESEVATTNPVATEGWGNVSNIIMNAAEDA

SEQ ID NO: 177798 - protein, 36 aa, Artificial Sequence
  Description of Artificial Sequence: Synthetic polypeptide
DEEEISTTNPVATEQYGCVCSNWEEHNQENFGSDQS

SEQ ID NO: 177799 - protein, 38 aa, Artificial Sequence
  Description of Artificial Sequence: Synthetic polypeptide
DEAEIRTTNPVATEQYGSYVKCSGILCEELMNGNEEVF

SEQ ID NO: 177800 - protein, 38 aa, Artificial Sequence
  Description of Artificial Sequence: Synthetic polypeptide
DEEEIRTTNPVATEAYGVVSTTVTNNNEQGTEQGSETG

SEQ ID NO: 177801 - protein, 36 aa, Artificial Sequence
  Description of Artificial Sequence: Synthetic polypeptide
TESEIRTTNPVATEHWGSVVSCGHEFSQDREGENGL

SEQ ID NO: 177802 - protein, 31 aa, Artificial Sequence
  Description of Artificial Sequence: Synthetic polypeptide
DDSEVASTNPVSTEGYGMVAANTIQSRVLQR

SEQ ID NO: 177803 - protein, 34 aa, Artificial Sequence
  Description of Artificial Sequence: Synthetic polypeptide
AEECISTTNPVATEQYGCVCSWGEDHQYFGSDQS

SEQ ID NO: 177804 - protein, 38 aa, Artificial Sequence
  Description of Artificial Sequence: Synthetic polypeptide
DEAEIRTTNPVATEQYGSYVSASIIMWEELRNGNEEVF

SEQ ID NO: 177805 - protein, 36 aa, Artificial Sequence
  Description of Artificial Sequence: Synthetic polypeptide
DEEEISTTNPVATEQYGCVCSNWEEHNQEYFGSEQA

SEQ ID NO: 177806 - protein, 37 aa, Artificial Sequence
  Description of Artificial Sequence: Synthetic polypeptide
DEDEIATTNPVATEQYGSVSSMTPAGGTNQGNNMEPV

SEQ ID NO: 177807 - protein, 36 aa, Artificial Sequence
  Description of Artificial Sequence: Synthetic polypeptide
DEAEIRTTNPVATEQYGSVYQFWTLNEVEDFSVQEF

SEQ ID NO: 177808 - protein, 37 aa, Artificial Sequence
  Description of Artificial Sequence: Synthetic polypeptide
DEEEIRTTNPVATEQYGCVCSNWGEHNQENFNSDTQN

SEQ ID NO: 177809 - protein, 36 aa, Artificial Sequence
  Description of Artificial Sequence: Synthetic polypeptide
DEAEIRTTNPVATEQYGSVYQCWTLNEYEDFSHQEF

SEQ ID NO: 177810 - protein, 36 aa, Artificial Sequence
  Description of Artificial Sequence: Synthetic polypeptide
DEEEISTTNPVATEQYGCVCSNWEEDHNQNFGSEQA

SEQ ID NO: 177811 - protein, 37 aa, Artificial Sequence
  Description of Artificial Sequence: Synthetic polypeptide
DEEEIRTTNPVATEQYGCVCSNWGEHNQENFNSQTQP

SEQ ID NO: 177812 - protein, 31 aa, Artificial Sequence
  Description of Artificial Sequence: Synthetic polypeptide
DDSEVASTNPVSTEGYGIVAANTIQSRVGQG

SEQ ID NO: 177813 - protein, 37 aa, Artificial Sequence
  Description of Artificial Sequence: Synthetic polypeptide
DEEEIRTTNPVATEQYGCVCSNWGEHNQENFSSDNQM

SEQ ID NO: 177814 - protein, 31 aa, Artificial Sequence
  Description of Artificial Sequence: Synthetic polypeptide
DDSEVACTNPVSTEGYGNVAAETIQSRVGQR

SEQ ID NO: 177815 - protein, 36 aa, Artificial Sequence
  Description of Artificial Sequence: Synthetic polypeptide
DEEEIRTTNPVAYEQYGQCVCSNWEHNQHFNSEFQS

SEQ ID NO: 177816 - protein, 33 aa, Artificial Sequence
  Description of Artificial Sequence: Synthetic polypeptide
DENQIRTTNPVSTEPYGTISMEDIQQQQNGNNP

SEQ ID NO: 177817 - protein, 32 aa, Artificial Sequence
  Description of Artificial Sequence: Synthetic polypeptide
DENQIRTTNPVSTEPYGTISMEDIQQQQNLNH

SEQ ID NO: 177818 - protein, 37 aa, Artificial Sequence
  Description of Artificial Sequence: Synthetic polypeptide
DEEEIRTTNPVATEQYGCVCSNWGEHNTEHFNSETQA

SEQ ID NO: 177819 - protein, 37 aa, Artificial Sequence
  Description of Artificial Sequence: Synthetic polypeptide
DEEEIRTTNPVATEQYGCVCSNWGEHNTENFGSEPQA

SEQ ID NO: 177820 - protein, 37 aa, Artificial Sequence
  Description of Artificial Sequence: Synthetic polypeptide
DEEEISTTNPVATEQYGCVCSNWEAHEQENFGSDNQS

SEQ ID NO: 177821 - protein, 39 aa, Artificial Sequence
  Description of Artificial Sequence: Synthetic polypeptide
DEEEIRTTNPVATEAYGVVSTTVNDQAGSVNEQGNQQEE

SEQ ID NO: 177822 - protein, 36 aa, Artificial Sequence
  Description of Artificial Sequence: Synthetic polypeptide
DEEEISTTNPVATEQYGCVCSNWEDDNQENFNSEQS

SEQ ID NO: 177823 - protein, 35 aa, Artificial Sequence
  Description of Artificial Sequence: Synthetic polypeptide
DEAEIRTTNPVATEQYGSVYQCWFLNEEDFSTQEF

SEQ ID NO: 177824 - protein, 36 aa, Artificial Sequence
  Description of Artificial Sequence: Synthetic polypeptide
DEAEIRTTNPVATEQYGSVYQCWTLNEEEDESVQEF

SEQ ID NO: 177825 - protein, 36 aa, Artificial Sequence
  Description of Artificial Sequence: Synthetic polypeptide
DEAEIRTTNPVATEQYGSVYQCWTLNEEEDFSVQKF

SEQ ID NO: 177826 - protein, 37 aa, Artificial Sequence
  Description of Artificial Sequence: Synthetic polypeptide
DEEEISTTNPVATEQYGCVCSNWEDHNQEGFGSDNQA

SEQ ID NO: 177827 - protein, 36 aa, Artificial Sequence
  Description of Artificial Sequence: Synthetic polypeptide
DEAEIRTTNPVATEQYGSVYQCWTLNEENDFSQQEF

SEQ ID NO: 177828 - protein, 32 aa, Artificial Sequence
  Description of Artificial Sequence: Synthetic polypeptide
DENQITTTNPVSTEPYGTISMEDIQQQQNGNH

SEQ ID NO: 177829 - protein, 37 aa, Artificial Sequence
  Description of Artificial Sequence: Synthetic polypeptide
DEEEIRTTNPVATEQYGCVCSNWGEHNTENFNSDTQS

SEQ ID NO: 177830 - protein, 31 aa, Artificial Sequence
  Description of Artificial Sequence: Synthetic polypeptide
DETEIRTTNPIATECWGATAAEDWQHKGPYI

SEQ ID NO: 177831 - protein, 31 aa, Artificial Sequence
  Description of Artificial Sequence: Synthetic polypeptide
DETEIRTTNPIATECWGATAANWAEPKGGYI

SEQ ID NO: 177832 - protein, 32 aa, Artificial Sequence
  Description of Artificial Sequence: Synthetic polypeptide
DETEIRTTNPIATECWGATAMEDIQEQKGNYH

SEQ ID NO: 177833 - protein, 36 aa, Artificial Sequence
  Description of Artificial Sequence: Synthetic polypeptide
DEEEISTTNPVATEQYGCVCSNWEDNQEYFGSDTQS

SEQ ID NO: 177834 - protein, 37 aa, Artificial Sequence
  Description of Artificial Sequence: Synthetic polypeptide
DEEEISTTNPVATEQYGCVCSNWEDPNQENFGSENQS

SEQ ID NO: 177835 - protein, 36 aa, Artificial Sequence
  Description of Artificial Sequence: Synthetic polypeptide
DEAEIRTTNPVATEQYGSVYQCWTLNEEPDFSIIEF

SEQ ID NO: 177836 - protein, 36 aa, Artificial Sequence
  Description of Artificial Sequence: Synthetic polypeptide
DEAEIRTTNPVATEQYGSVYQCWTLNEEPTFSVQEF

SEQ ID NO: 177837 - protein, 37 aa, Artificial Sequence
  Description of Artificial Sequence: Synthetic polypeptide
DEEEIRTTNPVATEQYGCVCSNWGEHNEENFNSDTQA

SEQ ID NO: 177838 - protein, 36 aa, Artificial Sequence
  Description of Artificial Sequence: Synthetic polypeptide
DEAEIRTTNPVATEQYGSVWVTAANQDTSISEEVES

SEQ ID NO: 177839 - protein, 36 aa, Artificial Sequence
  Description of Artificial Sequence: Synthetic polypeptide
DEEEIRTTNPVATEQYGCVCSNWGEHNEENFISDQA

SEQ ID NO: 177840 - protein, 37 aa, Artificial Sequence
  Description of Artificial Sequence: Synthetic polypeptide
AEEEIRATNPCATEQYGVVSTVTNQQQNQQQGTNNDD

SEQ ID NO: 177841 - protein, 37 aa, Artificial Sequence
  Description of Artificial Sequence: Synthetic polypeptide
DEEEIRTTNPVATEQYGCVCSNWGEDHNQYFNSENQA

SEQ ID NO: 177842 - protein, 37 aa, Artificial Sequence
  Description of Artificial Sequence: Synthetic polypeptide
DEEEISTTNPVATEQYGCVCSNTGEHNTESFGSDTQA

SEQ ID NO: 177843 - protein, 38 aa, Artificial Sequence
  Description of Artificial Sequence: Synthetic polypeptide
DEEEIRTTNPVATEQYGCVCSNWGEDHNTENFGSDNQS

SEQ ID NO: 177844 - protein, 38 aa, Artificial Sequence
  Description of Artificial Sequence: Synthetic polypeptide
DEEEIRTTNPVATEQYGCVCSNWGEDHNTENFNSDNQS

SEQ ID NO: 177845 - protein, 36 aa, Artificial Sequence
  Description of Artificial Sequence: Synthetic polypeptide
DEEEIRTTNPVATEQYGCVCSNWGEDHQENFFSDQS

SEQ ID NO: 177846 - protein, 33 aa, Artificial Sequence
  Description of Artificial Sequence: Synthetic polypeptide
DESEVATTNPVSTEGWGNVAACTEPQSREGEQR

SEQ ID NO: 177847 - protein, 35 aa, Artificial Sequence
  Description of Artificial Sequence: Synthetic polypeptide
DEDEIATTNPVAYEPWGSVYCTNTLDEDHGNDGSS

SEQ ID NO: 177848 - protein, 36 aa, Artificial Sequence
  Description of Artificial Sequence: Synthetic polypeptide
DEQEIATTNPVATEQYGSVCAATMHGEVTADGDDRM

SEQ ID NO: 177849 - protein, 37 aa, Artificial Sequence
  Description of Artificial Sequence: Synthetic polypeptide
DEEEIRTTNPVATEQYGCVCSNWGEDHQENFGSQFQG

SEQ ID NO: 177850 - protein, 37 aa, Artificial Sequence
  Description of Artificial Sequence: Synthetic polypeptide
DEEEIRTTNPVATEQYGCVCSNWGEDHQESFGSDTQS

SEQ ID NO: 177851 - protein, 38 aa, Artificial Sequence
  Description of Artificial Sequence: Synthetic polypeptide
DEEEIRTTNPVAYEQYGCVTSTWGADDNAEHFGSDNQS

SEQ ID NO: 177852 - protein, 37 aa, Artificial Sequence
  Description of Artificial Sequence: Synthetic polypeptide
DEEEIRTTNPVATEQYGCVCSNWGEDNQEHFNSDNQS

SEQ ID NO: 177853 - protein, 35 aa, Artificial Sequence
  Description of Artificial Sequence: Synthetic polypeptide
DEDEIATTNPVAYEPWGSVYCTNILGEDHGNNGQS

SEQ ID NO: 177854 - protein, 37 aa, Artificial Sequence
  Description of Artificial Sequence: Synthetic polypeptide
DEEEIRTTNPVATEQYGCVCSNWGEDPNEENFNSDQA

SEQ ID NO: 177855 - protein, 37 aa, Artificial Sequence
  Description of Artificial Sequence: Synthetic polypeptide
DEEEIRTTNPVATEQYGCVCSNWGEDPNQENFNSEQA

SEQ ID NO: 177856 - protein, 33 aa, Artificial Sequence
  Description of Artificial Sequence: Synthetic polypeptide
DENEIRTTNPVSTEPYGTISVEDEQQPQSMEHN

SEQ ID NO: 177857 - protein, 35 aa, Artificial Sequence
  Description of Artificial Sequence: Synthetic polypeptide
DENEIRTTNPVSTEPYGTISTTPAGQQMQNGMNPV

SEQ ID NO: 177858 - protein, 35 aa, Artificial Sequence
  Description of Artificial Sequence: Synthetic polypeptide
DEDEIATTNPVAYEPWGSVYCTNGLGEDHGNNGGN

SEQ ID NO: 177859 - protein, 36 aa, Artificial Sequence
  Description of Artificial Sequence: Synthetic polypeptide
VEEEIRTTNPVATEQYGSVSLSPWLEMVSMPEEEGM

SEQ ID NO: 177860 - protein, 34 aa, Artificial Sequence
  Description of Artificial Sequence: Synthetic polypeptide
DETEIRCTNPIATEQWGATWANEEDWQERKGPYR

SEQ ID NO: 177861 - protein, 35 aa, Artificial Sequence
  Description of Artificial Sequence: Synthetic polypeptide
AEEEIRCTNPVATEQYGCVCSWGEHNAHFGSDTQS

SEQ ID NO: 177862 - protein, 35 aa, Artificial Sequence
  Description of Artificial Sequence: Synthetic polypeptide
DEAAIRTTNPVATEQYGCFCSWEDHNIENFGSNQS

SEQ ID NO: 177863 - protein, 34 aa, Artificial Sequence
  Description of Artificial Sequence: Synthetic polypeptide
DEAAIRTTNPVATEQYGCFCSWEHNINFNSNTQS

SEQ ID NO: 177864 - protein, 35 aa, Artificial Sequence
  Description of Artificial Sequence: Synthetic polypeptide
DENEIRTTNPVSTEPYGTISSMPDIQNQQNGMNPV

SEQ ID NO: 177865 - protein, 35 aa, Artificial Sequence
  Description of Artificial Sequence: Synthetic polypeptide
DETEINTTNPVAYEQYGQTVVSINELSTESEGGLQ

SEQ ID NO: 177866 - protein, 35 aa, Artificial Sequence
  Description of Artificial Sequence: Synthetic polypeptide
DENEIRTTNPVSTEPYGTISSMPDIQNMQNGMNPV

SEQ ID NO: 177867 - protein, 37 aa, Artificial Sequence
  Description of Artificial Sequence: Synthetic polypeptide
AEEEIRATNPCATEQYGVVSTVTNQQGNEQIGTNNDD

SEQ ID NO: 177868 - protein, 35 aa, Artificial Sequence
  Description of Artificial Sequence: Synthetic polypeptide
DETEINTTNPVAYEQYGETVVPINELSQESNGGMQ

SEQ ID NO: 177869 - protein, 33 aa, Artificial Sequence
  Description of Artificial Sequence: Synthetic polypeptide
DENEIRTTNPVSTEPYGTITVEDIQQQQIGFEH

SEQ ID NO: 177870 - protein, 33 aa, Artificial Sequence
  Description of Artificial Sequence: Synthetic polypeptide
DENEIRTTNPVSTEPYGTITHMEDIQQQQNGNH

SEQ ID NO: 177871 - protein, 34 aa, Artificial Sequence
  Description of Artificial Sequence: Synthetic polypeptide
DETEICTTNPVAYEQWGVVVHTDQHNQQQGQGPM

SEQ ID NO: 177872 - protein, 34 aa, Artificial Sequence
  Description of Artificial Sequence: Synthetic polypeptide
DENEIRTTNPVSTEPYGTISWMEDIQQQQNGNHF

SEQ ID NO: 177873 - protein, 34 aa, Artificial Sequence
  Description of Artificial Sequence: Synthetic polypeptide
DENEIRTTNPVSTEPYGTISWEEPNQEQFGSDQA

SEQ ID NO: 177874 - protein, 34 aa, Artificial Sequence
  Description of Artificial Sequence: Synthetic polypeptide
DENEIRTTNPVSTEPYGTISWEEIQQEQMGSNQS

SEQ ID NO: 177875 - protein, 35 aa, Artificial Sequence
  Description of Artificial Sequence: Synthetic polypeptide
DENEIRTTNPVSTEPYGTISWEEDINQEQFGSNQS

SEQ ID NO: 177876 - protein, 33 aa, Artificial Sequence
  Description of Artificial Sequence: Synthetic polypeptide
DENEIRTTNPVSTEPYGTISWEDHNQEQFNSDQ

SEQ ID NO: 177877 - protein, 37 aa, Artificial Sequence
  Description of Artificial Sequence: Synthetic polypeptide
AEEEIRATNPCATEQYGVVSTVNNQNGNQQIGTNPVD

SEQ ID NO: 177878 - protein, 37 aa, Artificial Sequence
  Description of Artificial Sequence: Synthetic polypeptide
AEEEIRATNPCATEQYGVVSTVNNQNGNQQQGTNLTD

SEQ ID NO: 177879 - protein, 37 aa, Artificial Sequence
  Description of Artificial Sequence: Synthetic polypeptide
AEEEIRATNPCATEQYGVVSTVNNQQGNQQIGNNNTD

SEQ ID NO: 177880 - protein, 37 aa, Artificial Sequence
  Description of Artificial Sequence: Synthetic polypeptide
AEEEIRATNPCATEQYGVVSTVNNQQGNQQIGTDTED

SEQ ID NO: 177881 - protein, 37 aa, Artificial Sequence
  Description of Artificial Sequence: Synthetic polypeptide
AEEEIRATNPCATEQYGVVSTVNNQQGNQQIGTNNEQ

SEQ ID NO: 177882 - protein, 37 aa, Artificial Sequence
  Description of Artificial Sequence: Synthetic polypeptide
AEEEIRATNPCATEQYGVVSTVNNQQGNQQLGTNNDD

SEQ ID NO: 177883 - protein, 34 aa, Artificial Sequence
  Description of Artificial Sequence: Synthetic polypeptide
DENEIRTTNPVSTEPYGTISWEDDNQEQFGSDQS

SEQ ID NO: 177884 - protein, 37 aa, Artificial Sequence
  Description of Artificial Sequence: Synthetic polypeptide
AEEEIRATNPCATEQYGVVSTVTNQAGNQQIGTNDQG

SEQ ID NO: 177885 - protein, 37 aa, Artificial Sequence
  Description of Artificial Sequence: Synthetic polypeptide
DEEEIRTTNPVATEQYGCVCSNWGEDHNQNFNSDTQA

SEQ ID NO: 177886 - protein, 34 aa, Artificial Sequence
  Description of Artificial Sequence: Synthetic polypeptide
DETEIKTTNPVATEAYGSVSIDGGEGEEEDGEGI

SEQ ID NO: 177887 - protein, 37 aa, Artificial Sequence
  Description of Artificial Sequence: Synthetic polypeptide
AEEEIRATNPCATEQYGVVSTVTNQAGNQQQGTNTQD

SEQ ID NO: 177888 - protein, 35 aa, Artificial Sequence
  Description of Artificial Sequence: Synthetic polypeptide
DETEIKTTNPVATEQYGVVITNDDNIGGEDGGQEG

SEQ ID NO: 177889 - protein, 37 aa, Artificial Sequence
  Description of Artificial Sequence: Synthetic polypeptide
AEEEIRATNPCATEQYGVVSTVTNQLGNQQIGTTTQD

SEQ ID NO: 177890 - protein, 37 aa, Artificial Sequence
  Description of Artificial Sequence: Synthetic polypeptide
DEEEIRTTNPVATEQYGCVCSNWGEDHNQNFNSDTQM

SEQ ID NO: 177891 - protein, 37 aa, Artificial Sequence
  Description of Artificial Sequence: Synthetic polypeptide
DEEEIRTTNPVATEQYGCVCSNWGEDHNQYFNSDTQA

SEQ ID NO: 177892 - protein, 34 aa, Artificial Sequence
  Description of Artificial Sequence: Synthetic polypeptide
DENEIRTTNPVSTEPYGTISVEDEQQPQSTLQHN

SEQ ID NO: 177893 - protein, 37 aa, Artificial Sequence
  Description of Artificial Sequence: Synthetic polypeptide
DEEEISTTNPVATEQYGCVCSNTGEHNTEHFGSDTQS

SEQ ID NO: 177894 - protein, 37 aa, Artificial Sequence
  Description of Artificial Sequence: Synthetic polypeptide
AEEEIRATNPCATEQYGVVSTVTNQNQNQQQGTNNVA

SEQ ID NO: 177895 - protein, 34 aa, Artificial Sequence
  Description of Artificial Sequence: Synthetic polypeptide
DEDEIRTTNPVATEAWGVVTVVVNNNNDEEGENG

SEQ ID NO: 177896 - protein, 36 aa, Artificial Sequence
  Description of Artificial Sequence: Synthetic polypeptide
DEQEIATTNPVATEQYGSVCADHNHHEAPDNQENNH

SEQ ID NO: 177897 - protein, 33 aa, Artificial Sequence
  Description of Artificial Sequence: Synthetic polypeptide
DENEIRTTNPVSTEPYGTISSMEDIQQQQNGWH

SEQ ID NO: 177898 - protein, 37 aa, Artificial Sequence
  Description of Artificial Sequence: Synthetic polypeptide
VEEEIRTTNPVATEQYGSVSMTSAMGEIEDEHVSNTC

SEQ ID NO: 177899 - protein, 37 aa, Artificial Sequence
  Description of Artificial Sequence: Synthetic polypeptide
TEEEIRTTNPVATEQYGQCVCNWGELNQENFGSQNQS

SEQ ID NO: 177900 - protein, 37 aa, Artificial Sequence
  Description of Artificial Sequence: Synthetic polypeptide
VEEEIRTTNPVATEQYGSVSMTSAMGEIEEEIMMNFC

SEQ ID NO: 177901 - protein, 36 aa, Artificial Sequence
  Description of Artificial Sequence: Synthetic polypeptide
DEEEIRTTNPVATEQYGCVCSNWGEHNANFNSDTQS

SEQ ID NO: 177902 - protein, 37 aa, Artificial Sequence
  Description of Artificial Sequence: Synthetic polypeptide
VEEEIRTTNPVATEQYGSVSMVSAMGEIEFEIESNTC

SEQ ID NO: 177903 - protein, 37 aa, Artificial Sequence
  Description of Artificial Sequence: Synthetic polypeptide
DEEEISTTNPVATEQYGCVCSNTGPHNQENFGSETQA

SEQ ID NO: 177904 - protein, 37 aa, Artificial Sequence
  Description of Artificial Sequence: Synthetic polypeptide
AEEEIRTTNPCATEQYGVVSTTDQAGNNNQQGTEEED

SEQ ID NO: 177905 - protein, 36 aa, Artificial Sequence
  Description of Artificial Sequence: Synthetic polypeptide
DEQEIATTNPVATEQYGSVCAMNNGVENQTAGPMES

SEQ ID NO: 177906 - protein, 37 aa, Artificial Sequence
  Description of Artificial Sequence: Synthetic polypeptide
DEQEIATTNPVATEQYGSVCAMNNGVLIQDSPDENGN

SEQ ID NO: 177907 - protein, 38 aa, Artificial Sequence
  Description of Artificial Sequence: Synthetic polypeptide
AEEEIRTTNPCATEQYGVVSTVTNQQQSATEAGTNDTD

SEQ ID NO: 177908 - protein, 34 aa, Artificial Sequence
  Description of Artificial Sequence: Synthetic polypeptide
DEDEIRTTNPVATEAWGVVTVVNNNNADEGENGD

SEQ ID NO: 177909 - protein, 38 aa, Artificial Sequence
  Description of Artificial Sequence: Synthetic polypeptide
AEEEIRTTNPCATEQYGVVSTVVNGQQNATEAGTNDTQ

SEQ ID NO: 177910 - protein, 38 aa, Artificial Sequence
  Description of Artificial Sequence: Synthetic polypeptide
AEEEIRTTNPCATEQYGVVSTVVNGQQNATEEGTNQTD

SEQ ID NO: 177911 - protein, 30 aa, Artificial Sequence
  Description of Artificial Sequence: Synthetic polypeptide
DDSEVASTNPVSTEGYGEVPAETCQHVGQR

SEQ ID NO: 177912 - protein, 38 aa, Artificial Sequence
  Description of Artificial Sequence: Synthetic polypeptide
AEEEIRTTNPCATEQYGVVSTVVNLQQNATEAGTTQQP

SEQ ID NO: 177913 - protein, 37 aa, Artificial Sequence
  Description of Artificial Sequence: Synthetic polypeptide
DEEEIRTTNPVATEQYGCVCSNWGEHNEENFISDNQA

SEQ ID NO: 177914 - protein, 38 aa, Artificial Sequence
  Description of Artificial Sequence: Synthetic polypeptide
DEEEIRTTNPVATEQYGCQVCSNWGEDHQENFGSENQA

SEQ ID NO: 177915 - protein, 37 aa, Artificial Sequence
  Description of Artificial Sequence: Synthetic polypeptide
TEEEIRTTNPVATEQYGIVVESANQQEEVMTLNPVDF

SEQ ID NO: 177916 - protein, 38 aa, Artificial Sequence
  Description of Artificial Sequence: Synthetic polypeptide
AEEEIRTTNPCATEQYGVVSTVVNQQQNATEAGTNETS

SEQ ID NO: 177917 - protein, 38 aa, Artificial Sequence
  Description of Artificial Sequence: Synthetic polypeptide
AEEEIRTTNPCATEQYGVVSTVVNQQQNATEAGTNQDD

SEQ ID NO: 177918 - protein, 38 aa, Artificial Sequence
  Description of Artificial Sequence: Synthetic polypeptide
AEEEIRTTNPCATEQYGVVSTVVNQQQNATEAGVNGTD

SEQ ID NO: 177919 - protein, 36 aa, Artificial Sequence
  Description of Artificial Sequence: Synthetic polypeptide
TESEIRTTNPVATECWGSVVSCGHEISQDREGENGW

SEQ ID NO: 177920 - protein, 38 aa, Artificial Sequence
  Description of Artificial Sequence: Synthetic polypeptide
AEEEIRTTNPCATEQYGVVSTVVNQQQNATEQGTNDTD

SEQ ID NO: 177921 - protein, 38 aa, Artificial Sequence
  Description of Artificial Sequence: Synthetic polypeptide
DEEEIRTTNPVATEQYGCQVCSNTGEHNQENFNSDTQS

SEQ ID NO: 177922 - protein, 36 aa, Artificial Sequence
  Description of Artificial Sequence: Synthetic polypeptide
DEDEIRTTNPVATEAWGVVTVTVVNNQQGTNNEQGE

SEQ ID NO: 177923 - protein, 37 aa, Artificial Sequence
  Description of Artificial Sequence: Synthetic polypeptide
TEEEIRTTNPVATEQYGQCVCSWMNHNQENFNSDNQS

SEQ ID NO: 177924 - protein, 39 aa, Artificial Sequence
  Description of Artificial Sequence: Synthetic polypeptide
DEEEIRTTNPVATEAYGVVSTTNQQQGNNQLQQGTEQGE

SEQ ID NO: 177925 - protein, 34 aa, Artificial Sequence
  Description of Artificial Sequence: Synthetic polypeptide
DEAAIRTTNPVATEQYGCFCSWGEHNINFGSEQS

SEQ ID NO: 177926 - protein, 37 aa, Artificial Sequence
  Description of Artificial Sequence: Synthetic polypeptide
DEEEIRTTNPVATEQYGCVCSNWGEHNAENFNSDTQS

SEQ ID NO: 177927 - protein, 34 aa, Artificial Sequence
  Description of Artificial Sequence: Synthetic polypeptide
DENEIRTTNPVSTEPYGTISSMEDIQQQQNGNPH

SEQ ID NO: 177928 - protein, 36 aa, Artificial Sequence
  Description of Artificial Sequence: Synthetic polypeptide
DEEEIRTTNPVATEQYGCVCSNWGEHEEHFGSETQT

SEQ ID NO: 177929 - protein, 37 aa, Artificial Sequence
  Description of Artificial Sequence: Synthetic polypeptide
DEQEIATTNPVATEQYGSVCAGMTHGGAEAPIGDNRF

SEQ ID NO: 177930 - protein, 36 aa, Artificial Sequence
  Description of Artificial Sequence: Synthetic polypeptide
VEEEIRTTNPVATEQYGSVSLSPWLHMVSMMPEEEL

SEQ ID NO: 177931 - protein, 37 aa, Artificial Sequence
  Description of Artificial Sequence: Synthetic polypeptide
DEEEIRTTNPVATEQYGCVCSNWGEHFTENFGSETQA

SEQ ID NO: 177932 - protein, 36 aa, Artificial Sequence
  Description of Artificial Sequence: Synthetic polypeptide
TEEEIRTTNPVATEQYGSITHTTLEDHNDEESDEQM

SEQ ID NO: 177933 - protein, 37 aa, Artificial Sequence
  Description of Artificial Sequence: Synthetic polypeptide
TEEEIRTTNPVATEQYGSIPEPTMIELQEATIEANDI

SEQ ID NO: 177934 - protein, 36 aa, Artificial Sequence
  Description of Artificial Sequence: Synthetic polypeptide
VEEEIRTTNPVATEQYGSVSLSPWLIMVSPPEEQGS

SEQ ID NO: 177935 - protein, 36 aa, Artificial Sequence
  Description of Artificial Sequence: Synthetic polypeptide
DEEEIRTTNPVATEQYGCVCSNWGEHIEFFGSDTQS

SEQ ID NO: 177936 - protein, 36 aa, Artificial Sequence
  Description of Artificial Sequence: Synthetic polypeptide
TEEEIRTTNPVATEQYGSIIHWTTLEDHNDESDEQG

SEQ ID NO: 177937 - protein, 35 aa, Artificial Sequence
  Description of Artificial Sequence: Synthetic polypeptide
TEEEIRTTNPVATEQYGSIHNFTLEDHNGESDEQQ

SEQ ID NO: 177938 - protein, 36 aa, Artificial Sequence
  Description of Artificial Sequence: Synthetic polypeptide
TEEEIRTTNPVATEQYGSIHHTTLEDHNDEASDEQV

SEQ ID NO: 177939 - protein, 37 aa, Artificial Sequence
  Description of Artificial Sequence: Synthetic polypeptide
DEEEIRTTNPVATEQYGCVCSNSEEPNEENFNSDTQS

SEQ ID NO: 177940 - protein, 37 aa, Artificial Sequence
  Description of Artificial Sequence: Synthetic polypeptide
DEEEISTTNPVATEQYGCVCSNTGETNQENFNSQNQS

SEQ ID NO: 177941 - protein, 36 aa, Artificial Sequence
  Description of Artificial Sequence: Synthetic polypeptide
TEEEIRTTNPVATEQYGSGVPMPSQWIDAEEQLVEI

SEQ ID NO: 177942 - protein, 38 aa, Artificial Sequence
  Description of Artificial Sequence: Synthetic polypeptide
TEEEIRTTNPVATEQYGSFVTNSQNQGMELEQAVVPTA

SEQ ID NO: 177943 - protein, 37 aa, Artificial Sequence
  Description of Artificial Sequence: Synthetic polypeptide
DEQEIATTNPVATEQYGSVCAGMTHGGAEAQIGDNSK

SEQ ID NO: 177944 - protein, 32 aa, Artificial Sequence
  Description of Artificial Sequence: Synthetic polypeptide
DDSEVASTNPVSTEGYGEVAAANTIQSRVGQR

SEQ ID NO: 177945 - protein, 31 aa, Artificial Sequence
  Description of Artificial Sequence: Synthetic polypeptide
DDSEVASTNPVSTEGYGEVAANDIQSDEGQR

SEQ ID NO: 177946 - protein, 37 aa, Artificial Sequence
  Description of Artificial Sequence: Synthetic polypeptide
DEEEIRTTNPVATEQYGCVCSNWGEHNAENFNSDNQA

SEQ ID NO: 177947 - protein, 35 aa, Artificial Sequence
  Description of Artificial Sequence: Synthetic polypeptide
DEQEIATTNPVATEQYGSVCAMNGNLEPDSDQPDA

SEQ ID NO: 177948 - protein, 37 aa, Artificial Sequence
  Description of Artificial Sequence: Synthetic polypeptide
DEEEIRTTNPVATEQYGCVCSNWGEHNAENFNSDNQS

SEQ ID NO: 177949 - protein, 32 aa, Artificial Sequence
  Description of Artificial Sequence: Synthetic polypeptide
DDSEVASTNPVSTEGYGEVAANTIQSRVGMQR

SEQ ID NO: 177950 - protein, 37 aa, Artificial Sequence
  Description of Artificial Sequence: Synthetic polypeptide
DEEEIRTTNPVATEQYGCVCSNWGEHNAENFNSDTQP

SEQ ID NO: 177951 - protein, 36 aa, Artificial Sequence
  Description of Artificial Sequence: Synthetic polypeptide
AEEEIRTTNPCATECYGVVCYKTNDEGQRQQMGGMS

SEQ ID NO: 177952 - protein, 35 aa, Artificial Sequence
  Description of Artificial Sequence: Synthetic polypeptide
AEEEIRTTNPCATEQYGCVCSWGEHNAENFGSDQS

SEQ ID NO: 177953 - protein, 37 aa, Artificial Sequence
  Description of Artificial Sequence: Synthetic polypeptide
DEEEIRTTNPVATEQYGCVCSNWGEHNAEFFNSDNQS

SEQ ID NO: 177954 - protein, 36 aa, Artificial Sequence
  Description of Artificial Sequence: Synthetic polypeptide
VEEEIRTTNPVATEQYGVVVDDFENVDEQGGGEETP

SEQ ID NO: 177955 - protein, 36 aa, Artificial Sequence
  Description of Artificial Sequence: Synthetic polypeptide
DEEEISTTNPVATEQYGCVCSNWEEHNQEYFNSDQS

SEQ ID NO: 177956 - protein, 37 aa, Artificial Sequence
  Description of Artificial Sequence: Synthetic polypeptide
DEEEIRTTNPVATEQYGCVCSNWGEPNEENFNSETQP

SEQ ID NO: 177957 - protein, 36 aa, Artificial Sequence
  Description of Artificial Sequence: Synthetic polypeptide
DEEEISTTNPVATEQYGCVCSNWGEHNAEYFNSEQS

SEQ ID NO: 177958 - protein, 32 aa, Artificial Sequence
  Description of Artificial Sequence: Synthetic polypeptide
DDSEVASTNPVSTEGYGNCVAANTIQSRVGQR

SEQ ID NO: 177959 - protein, 32 aa, Artificial Sequence
  Description of Artificial Sequence: Synthetic polypeptide
DDSEVASTNPVSTEGYGNIAANEDIQSRVGNR

SEQ ID NO: 177960 - protein, 33 aa, Artificial Sequence
  Description of Artificial Sequence: Synthetic polypeptide
DENVIRTTNPVSTEPYGTIFSMEDIQQQQNGNH

SEQ ID NO: 177961 - protein, 31 aa, Artificial Sequence
  Description of Artificial Sequence: Synthetic polypeptide
DDSEVASTNPVSTEGYGNIAANTIQDRVGQR

SEQ ID NO: 177962 - protein, 38 aa, Artificial Sequence
  Description of Artificial Sequence: Synthetic polypeptide
VEEEIRTTNPVATEQYGSVVLPNTLEGPEMGQGENEEG

SEQ ID NO: 177963 - protein, 33 aa, Artificial Sequence
  Description of Artificial Sequence: Synthetic polypeptide
DENVIRTTNPVSTEPYGTISMEDIQQQQNGMNH

SEQ ID NO: 177964 - protein, 38 aa, Artificial Sequence
  Description of Artificial Sequence: Synthetic polypeptide
AEEEIRTTNPVATEAYGSVVVVVTTNLQQNGEGTEEEA

SEQ ID NO: 177965 - protein, 36 aa, Artificial Sequence
  Description of Artificial Sequence: Synthetic polypeptide
DEEEISTTNPVATEQYGCVCSNWGEHNAFFNSDNQS

SEQ ID NO: 177966 - protein, 38 aa, Artificial Sequence
  Description of Artificial Sequence: Synthetic polypeptide
AEEEIRTTNPVATEAYGSVVVVVTTNNLQQGEGEEQEE

SEQ ID NO: 177967 - protein, 36 aa, Artificial Sequence
  Description of Artificial Sequence: Synthetic polypeptide
DEEEISTTNPVATEQYGCVCSNWGEHNAGFNSDNQS

SEQ ID NO: 177968 - protein, 37 aa, Artificial Sequence
  Description of Artificial Sequence: Synthetic polypeptide
AEEEIRTTNPVATEAYGSVVVVVTTNNQQQGEGDEEE

SEQ ID NO: 177969 - protein, 36 aa, Artificial Sequence
  Description of Artificial Sequence: Synthetic polypeptide
DEEEISTTNPVATEQYGCVCSNWGEHNAGFNSDTQS

SEQ ID NO: 177970 - protein, 36 aa, Artificial Sequence
  Description of Artificial Sequence: Synthetic polypeptide
DEEEISTTNPVATEQYGCVCSNWGEHNANFGSETQA

SEQ ID NO: 177971 - protein, 36 aa, Artificial Sequence
  Description of Artificial Sequence: Synthetic polypeptide
DEEEISTTNPVATEQYGCVCSNWGEHNANFISDNQP

SEQ ID NO: 177972 - protein, 31 aa, Artificial Sequence
  Description of Artificial Sequence: Synthetic polypeptide
DDSEVASTNPVSTEGYGNIAANTIQSRNGQR

SEQ ID NO: 177973 - protein, 33 aa, Artificial Sequence
  Description of Artificial Sequence: Synthetic polypeptide
DENVIRTTNPVSTEPYGTISMEDIQQQQNGNFH

SEQ ID NO: 177974 - protein, 36 aa, Artificial Sequence
  Description of Artificial Sequence: Synthetic polypeptide
DEEEIRTTNPVATEQYGCVCSSGEHDAENFNSDTQS

SEQ ID NO: 177975 - protein, 36 aa, Artificial Sequence
  Description of Artificial Sequence: Synthetic polypeptide
DEEEISTTNPVATEQYGCVCSNWGEHNASFNSDNQA

SEQ ID NO: 177976 - protein, 32 aa, Artificial Sequence
  Description of Artificial Sequence: Synthetic polypeptide
DESEVASTNPVSTEGYGNVAANTIQSRVGEQG

SEQ ID NO: 177977 - protein, 37 aa, Artificial Sequence
  Description of Artificial Sequence: Synthetic polypeptide
DEDEIRTTNPVATEAWGSVSTVVNVNEQGTNNEQYGV

SEQ ID NO: 177978 - protein, 31 aa, Artificial Sequence
  Description of Artificial Sequence: Synthetic polypeptide
DDSEVASTNPVSTEGYGNIAANTIQSRVGQR

SEQ ID NO: 177979 - protein, 36 aa, Artificial Sequence
  Description of Artificial Sequence: Synthetic polypeptide
DEEEISTTNPVATEQYGCVCSNWGEHNIEHFNSDQS

SEQ ID NO: 177980 - protein, 39 aa, Artificial Sequence
  Description of Artificial Sequence: Synthetic polypeptide
DEEEIRTTNPVATEAYGVVSTVNLQNLQQGTEQGTDEEE

SEQ ID NO: 177981 - protein, 37 aa, Artificial Sequence
  Description of Artificial Sequence: Synthetic polypeptide
DEDEIATTNPVATEQYGSVCAANNGVLPEDDGGNDDQ

SEQ ID NO: 177982 - protein, 37 aa, Artificial Sequence
  Description of Artificial Sequence: Synthetic polypeptide
DEAEIRTTNPVATETYGYSSGSNRENDLSQTIEENNE

SEQ ID NO: 177983 - protein, 37 aa, Artificial Sequence
  Description of Artificial Sequence: Synthetic polypeptide
DEEEISTTNPVATEQYGCVCSNWGEHNIENFGSDNQA

SEQ ID NO: 177984 - protein, 36 aa, Artificial Sequence
  Description of Artificial Sequence: Synthetic polypeptide
DEAEIRTTNPVATETYGSYSVTAANQDTGYSEEVES

SEQ ID NO: 177985 - protein, 36 aa, Artificial Sequence
  Description of Artificial Sequence: Synthetic polypeptide
DEAEIRTTNPVATETYGSVTSYVEDVCHTSQESINF

SEQ ID NO: 177986 - protein, 37 aa, Artificial Sequence
  Description of Artificial Sequence: Synthetic polypeptide
DEAEIRTTNPVATEQYGSVNWCYANLETPNDSQNSSF

SEQ ID NO: 177987 - protein, 30 aa, Artificial Sequence
  Description of Artificial Sequence: Synthetic polypeptide
DESEVASTNPVSTEGYGNVAETIQSHVGQK

SEQ ID NO: 177988 - protein, 36 aa, Artificial Sequence
  Description of Artificial Sequence: Synthetic polypeptide
DEEEISTTNPVATEQYGCVCSNWGEHNAENFNSDQP

SEQ ID NO: 177989 - protein, 36 aa, Artificial Sequence
  Description of Artificial Sequence: Synthetic polypeptide
DEEEISTTNPVATEQYGCVCSNWGEHNAENFNSDQS

SEQ ID NO: 177990 - protein, 35 aa, Artificial Sequence
  Description of Artificial Sequence: Synthetic polypeptide
DEDEIATTNPVATEQYGSVCAATMHGETTADGDDA

SEQ ID NO: 177991 - protein, 37 aa, Artificial Sequence
  Description of Artificial Sequence: Synthetic polypeptide
DEDEIATTNPVATEQYGSVCAATMHGENTADGVDDRW

SEQ ID NO: 177992 - protein, 38 aa, Artificial Sequence
  Description of Artificial Sequence: Synthetic polypeptide
VEEEIRTTNPVATEQYGSVVGDGTDNEQENENIEGGGN

SEQ ID NO: 177993 - protein, 37 aa, Artificial Sequence
  Description of Artificial Sequence: Synthetic polypeptide
DEEEIRTTNPVATEQYGCVCSSGEDHNAEFFNSEFQS

SEQ ID NO: 177994 - protein, 35 aa, Artificial Sequence
  Description of Artificial Sequence: Synthetic polypeptide
DEDEIATTNPVATEQYGSVCAATMHGEATADLDDR

SEQ ID NO: 177995 - protein, 36 aa, Artificial Sequence
  Description of Artificial Sequence: Synthetic polypeptide
DEDEIATTNPVATEQYGSVCAATMGLADAPAENDNH

SEQ ID NO: 177996 - protein, 38 aa, Artificial Sequence
  Description of Artificial Sequence: Synthetic polypeptide
DEEEIRTTNPVATEAYGVVSTVNANLNDEQGTTDEEED

SEQ ID NO: 177997 - protein, 37 aa, Artificial Sequence
  Description of Artificial Sequence: Synthetic polypeptide
DEEEIRTTNPVATEQYGCVCSSGEDHNAENFNSDNQA

SEQ ID NO: 177998 - protein, 39 aa, Artificial Sequence
  Description of Artificial Sequence: Synthetic polypeptide
DEEEIRTTNPVATEAYGVVSTVNDENLQQGTEQGTEEEE

SEQ ID NO: 177999 - protein, 38 aa, Artificial Sequence
  Description of Artificial Sequence: Synthetic polypeptide
AEEEIRTTNPVATEAYGSVVVVVTNNNLQQGEAEEEED

SEQ ID NO: 178000 - protein, 36 aa, Artificial Sequence
  Description of Artificial Sequence: Synthetic polypeptide
DEEEIRTTNPVATEQYGCVCSSGEDHNANFNSETQS

SEQ ID NO: 178001 - protein, 32 aa, Artificial Sequence
  Description of Artificial Sequence: Synthetic polypeptide
DENVIRTTNPVSGEPYGTISMEDIQQQQNGNH

SEQ ID NO: 178002 - protein, 38 aa, Artificial Sequence
  Description of Artificial Sequence: Synthetic polypeptide
AEEEIRTTNPVATEAYGSVVVVVTNNNLQQGEGTEDED

SEQ ID NO: 178003 - protein, 36 aa, Artificial Sequence
  Description of Artificial Sequence: Synthetic polypeptide
DEAEIRTTNPVATETWGSVSRCIMCEPQVRDDENLG

SEQ ID NO: 178004 - protein, 37 aa, Artificial Sequence
  Description of Artificial Sequence: Synthetic polypeptide
DEEEIRTTNPVATEQYGCVCSSGEDHNQEHFNSDNQL

SEQ ID NO: 178005 - protein, 37 aa, Artificial Sequence
  Description of Artificial Sequence: Synthetic polypeptide
DEEEIRTTNPVATEQYGCVCSSGEDHNQENFISDNQL

SEQ ID NO: 178006 - protein, 36 aa, Artificial Sequence
  Description of Artificial Sequence: Synthetic polypeptide
DEAEIRTTNPVATETWGSVSRCINAEPQVIDDENLG

SEQ ID NO: 178007 - protein, 37 aa, Artificial Sequence
  Description of Artificial Sequence: Synthetic polypeptide
DEEEIRTTNPVATEQYGCVCSSGEDHNQENFNSETQS

SEQ ID NO: 178008 - protein, 36 aa, Artificial Sequence
  Description of Artificial Sequence: Synthetic polypeptide
AEEEIRTTNPVATEAYGSVVVVVTTNGTNVEQGEEF

SEQ ID NO: 178009 - protein, 35 aa, Artificial Sequence
  Description of Artificial Sequence: Synthetic polypeptide
DEDEIATTNPVATEQYGSVCAAPPMQPDNQTEGMM

SEQ ID NO: 178010 - protein, 36 aa, Artificial Sequence
  Description of Artificial Sequence: Synthetic polypeptide
DEEEISTTNPVATEQYGCVCSNWGEHNAENSNSDQG

SEQ ID NO: 178011 - protein, 36 aa, Artificial Sequence
  Description of Artificial Sequence: Synthetic polypeptide
DEEEISTTNPVATEQYGCVCSNWGEHNAESFGSEQG

SEQ ID NO: 178012 - protein, 31 aa, Artificial Sequence
  Description of Artificial Sequence: Synthetic polypeptide
DDSEVAPTNPVSTEGYGNVAANTIVSRVGQR

SEQ ID NO: 178013 - protein, 37 aa, Artificial Sequence
  Description of Artificial Sequence: Synthetic polypeptide
DEEEISTTNPVATEQYGCVCSNWGEHNIENFGSDNQL

SEQ ID NO: 178014 - protein, 33 aa, Artificial Sequence
  Description of Artificial Sequence: Synthetic polypeptide
DESEVASTNPVSTEGYGNVAANTIPQSRVGEQR

SEQ ID NO: 178015 - protein, 36 aa, Artificial Sequence
  Description of Artificial Sequence: Synthetic polypeptide
DEDEIATTNPVATEQYGSACPPVDGVTTAQDITNQN

SEQ ID NO: 178016 - protein, 37 aa, Artificial Sequence
  Description of Artificial Sequence: Synthetic polypeptide
DEDEIATTNPVATEQYGSACAATNPQEAPDSGMGNWM

SEQ ID NO: 178017 - protein, 37 aa, Artificial Sequence
  Description of Artificial Sequence: Synthetic polypeptide
DEDEIATTNPVATEQYGSACAATNPQEAGDSPMDNGM

SEQ ID NO: 178018 - protein, 37 aa, Artificial Sequence
  Description of Artificial Sequence: Synthetic polypeptide
DEDEIATTNPVATEQYGSACAATNPQEAGDSLMGNNM

SEQ ID NO: 178019 - protein, 37 aa, Artificial Sequence
  Description of Artificial Sequence: Synthetic polypeptide
DEDEIATTNPVATEQYGSACAATNPQEAGDSGSGNEM

SEQ ID NO: 178020 - protein, 37 aa, Artificial Sequence
  Description of Artificial Sequence: Synthetic polypeptide
DEDEIATTNPVATEQYGSACAATNPQEAGDSGMGNSH

SEQ ID NO: 178021 - protein, 36 aa, Artificial Sequence
  Description of Artificial Sequence: Synthetic polypeptide
DEEEIRTTNPVAYEQYGQCVCSNWEHNQENFGSEQQ

SEQ ID NO: 178022 - protein, 37 aa, Artificial Sequence
  Description of Artificial Sequence: Synthetic polypeptide
DEEEISTTNPVATEQYGCVCSNWGEHNQENFQSDNQS

SEQ ID NO: 178023 - protein, 36 aa, Artificial Sequence
  Description of Artificial Sequence: Synthetic polypeptide
DEDEIATTNPVATEQYGSACAATNPQEADSGMGMEM

SEQ ID NO: 178024 - protein, 38 aa, Artificial Sequence
  Description of Artificial Sequence: Synthetic polypeptide
DEEEIRTTNPVATEQYGCAVCSTGEDHDQENFNSNNQL

SEQ ID NO: 178025 - protein, 36 aa, Artificial Sequence
  Description of Artificial Sequence: Synthetic polypeptide
VEEEIRTTNPVATEQYGVVDDFENVDGQQGGQEEDP

SEQ ID NO: 178026 - protein, 37 aa, Artificial Sequence
  Description of Artificial Sequence: Synthetic polypeptide
DEEEISTTNPVATEQYGCVCSNWGEHNQENGNSENQL

SEQ ID NO: 178027 - protein, 37 aa, Artificial Sequence
  Description of Artificial Sequence: Synthetic polypeptide
DEDEIATTNPVATEQYGSACAATNPEEAGDSGMDNRM

SEQ ID NO: 178028 - protein, 37 aa, Artificial Sequence
  Description of Artificial Sequence: Synthetic polypeptide
VEEEIRTTNPVATEQYGVVDDNDDDDEEQGGEGNQQG

SEQ ID NO: 178029 - protein, 33 aa, Artificial Sequence
  Description of Artificial Sequence: Synthetic polypeptide
DESEVASTNPVSTEGYGNVAAMETIQQSRVGQR

SEQ ID NO: 178030 - protein, 36 aa, Artificial Sequence
  Description of Artificial Sequence: Synthetic polypeptide
DEEEIRTTNPVATEQYGCAVCSNWGEHQENFMSDQS

SEQ ID NO: 178031 - protein, 36 aa, Artificial Sequence
  Description of Artificial Sequence: Synthetic polypeptide
DEDEIATTNPVATEQYGCVSAIWPAGTNQGNPMEPV

SEQ ID NO: 178032 - protein, 35 aa, Artificial Sequence
  Description of Artificial Sequence: Synthetic polypeptide
DEAEIRTTNPVAYECWGSVCYTNIDNNHTGQDGDN

SEQ ID NO: 178033 - protein, 35 aa, Artificial Sequence
  Description of Artificial Sequence: Synthetic polypeptide
DEAEIRTTNPVAYECWGSVCYTNIDQQDKGQDGDN

SEQ ID NO: 178034 - protein, 36 aa, Artificial Sequence
  Description of Artificial Sequence: Synthetic polypeptide
AEEEIRTTNPVATEAYGVVSTVTNNQQQAEEEEEDT

SEQ ID NO: 178035 - protein, 34 aa, Artificial Sequence
  Description of Artificial Sequence: Synthetic polypeptide
DEAEIRTTNPVAYECWGSVCYTTIDQDTGQDGDN

SEQ ID NO: 178036 - protein, 35 aa, Artificial Sequence
  Description of Artificial Sequence: Synthetic polypeptide
DEAEIRTTNPVAYECWGSVYYGNGMEQNDGGGNAP

SEQ ID NO: 178037 - protein, 32 aa, Artificial Sequence
  Description of Artificial Sequence: Synthetic polypeptide
DESEVASTNPVSTEGYGNVAAAETIQSRVGQR

SEQ ID NO: 178038 - protein, 37 aa, Artificial Sequence
  Description of Artificial Sequence: Synthetic polypeptide
AEEEIRTTNPVATEAYGVVSTVVSNNNVTEEGNNNQD

SEQ ID NO: 178039 - protein, 33 aa, Artificial Sequence
  Description of Artificial Sequence: Synthetic polypeptide
VEEEIACTNPVATEQWGGCSAMHLDPDAQGGEM

SEQ ID NO: 178040 - protein, 31 aa, Artificial Sequence
  Description of Artificial Sequence: Synthetic polypeptide
DESEVASTNPVSTEGYGNVAAMTIQSRNGQH

SEQ ID NO: 178041 - protein, 37 aa, Artificial Sequence
  Description of Artificial Sequence: Synthetic polypeptide
DEEEISTTNPVATEQYGCVCSNWGEHNIENFGSDNQY

SEQ ID NO: 178042 - protein, 37 aa, Artificial Sequence
  Description of Artificial Sequence: Synthetic polypeptide
DEEEIRTTNPVATEQYGCVCSMWGEPHNQNFNSETQS

SEQ ID NO: 178043 - protein, 35 aa, Artificial Sequence
  Description of Artificial Sequence: Synthetic polypeptide
DEDEIATTNPVATEQYGSCSAGNNPDENGMDIGEM

SEQ ID NO: 178044 - protein, 36 aa, Artificial Sequence
  Description of Artificial Sequence: Synthetic polypeptide
DEEEIRTTNPVAYEQYGQCVCSWEHNQENFNSDTQS

SEQ ID NO: 178045 - protein, 37 aa, Artificial Sequence
  Description of Artificial Sequence: Synthetic polypeptide
DEEEIRTTNPVAYEQYGQCVCSWENDDNQENFNSEQA

SEQ ID NO: 178046 - protein, 36 aa, Artificial Sequence
  Description of Artificial Sequence: Synthetic polypeptide
VEEEIRTTNPVATEQYGSVVVAIEEQIENTEEDNDM

SEQ ID NO: 178047 - protein, 37 aa, Artificial Sequence
  Description of Artificial Sequence: Synthetic polypeptide
DEAEIRTTNPVATNQYGSVSVTAANQSDTGYSEEVES

SEQ ID NO: 178048 - protein, 31 aa, Artificial Sequence
  Description of Artificial Sequence: Synthetic polypeptide
DESEVASTNPVSTEGYGNVAANTEMSAVGQR

SEQ ID NO: 178049 - protein, 36 aa, Artificial Sequence
  Description of Artificial Sequence: Synthetic polypeptide
DEEEISTTNPVATEQYGCVCSNWGEHNINFGSDTQS

SEQ ID NO: 178050 - protein, 36 aa, Artificial Sequence
  Description of Artificial Sequence: Synthetic polypeptide
DEDEIATTNPVATEQYGSVCAAINAGTEHQDGAEMK

SEQ ID NO: 178051 - protein, 36 aa, Artificial Sequence
  Description of Artificial Sequence: Synthetic polypeptide
DEAEIRTTNPVAVECWGSVSRCINEPQVRDDENLGD

SEQ ID NO: 178052 - protein, 31 aa, Artificial Sequence
  Description of Artificial Sequence: Synthetic polypeptide
DESEVASTNPVSTEGYGNVAANTEMSAVGDR

SEQ ID NO: 178053 - protein, 36 aa, Artificial Sequence
  Description of Artificial Sequence: Synthetic polypeptide
DEEEISTTNPVATEQYGCVCSNWGEHNQEGFISDQN

SEQ ID NO: 178054 - protein, 35 aa, Artificial Sequence
  Description of Artificial Sequence: Synthetic polypeptide
DEAEIRTTNPVAYEAWGTVCSNDNHDQPGQGGNEH

SEQ ID NO: 178055 - protein, 37 aa, Artificial Sequence
  Description of Artificial Sequence: Synthetic polypeptide
DEEEISTTNPVATEQYGCVCSNWGEHNQEGFNSDTQA

SEQ ID NO: 178056 - protein, 37 aa, Artificial Sequence
  Description of Artificial Sequence: Synthetic polypeptide
DEEEISTTNPVATEQYGCVCSNWGEHNQEGFNSDTQS

SEQ ID NO: 178057 - protein, 37 aa, Artificial Sequence
  Description of Artificial Sequence: Synthetic polypeptide
DEDEIATTNPVATEQYGSVAIVTNGLEATGDGMGPLA

SEQ ID NO: 178058 - protein, 33 aa, Artificial Sequence
  Description of Artificial Sequence: Synthetic polypeptide
DEAEIRTTNPVAYEAWGVVTGGNGNQGETNDDL

SEQ ID NO: 178059 - protein, 36 aa, Artificial Sequence
  Description of Artificial Sequence: Synthetic polypeptide
DEEEISTTNPVATEQYGCVCSNWGEHNQENFGSDQA

SEQ ID NO: 178060 - protein, 36 aa, Artificial Sequence
  Description of Artificial Sequence: Synthetic polypeptide
DEEEISTTNPVATEQYGCVCSNWGEHNQENFGSDQD

SEQ ID NO: 178061 - protein, 36 aa, Artificial Sequence
  Description of Artificial Sequence: Synthetic polypeptide
DEEEISTTNPVATEQYGCVCSNWGEHNQENFGSDQN

SEQ ID NO: 178062 - protein, 33 aa, Artificial Sequence
  Description of Artificial Sequence: Synthetic polypeptide
DESEVASTNPVSTEGYGNVAANETIQQSRVGQR

SEQ ID NO: 178063 - protein, 37 aa, Artificial Sequence
  Description of Artificial Sequence: Synthetic polypeptide
DEEEISTTNPVATEQYGCVCSNWGEHNQENFGSENQA

SEQ ID NO: 178064 - protein, 36 aa, Artificial Sequence
  Description of Artificial Sequence: Synthetic polypeptide
DEDEIATTNPVATEQYGSVAATTPAGTNQGAGMEPV

SEQ ID NO: 178065 - protein, 36 aa, Artificial Sequence
  Description of Artificial Sequence: Synthetic polypeptide
DEEEIRTTNPVATEQYGCVCSSGEHNQENFISETQA

SEQ ID NO: 178066 - protein, 37 aa, Artificial Sequence
  Description of Artificial Sequence: Synthetic polypeptide
DEEEIRTTNPVAYEQYGQCVCSWGEDDNQRFGSDPQF

SEQ ID NO: 178067 - protein, 35 aa, Artificial Sequence
  Description of Artificial Sequence: Synthetic polypeptide
DEAEIRTTNPVAYECWGSVCYTNDDQNDHGQEGDN

SEQ ID NO: 178068 - protein, 35 aa, Artificial Sequence
  Description of Artificial Sequence: Synthetic polypeptide
DEDEIATTNPVATEQYGSCSAGPAPGANGAGMGQD

SEQ ID NO: 178069 - protein, 31 aa, Artificial Sequence
  Description of Artificial Sequence: Synthetic polypeptide
DDSEVASTNPCSTEGYGNVAANNIQSRVGTR

SEQ ID NO: 178070 - protein, 36 aa, Artificial Sequence
  Description of Artificial Sequence: Synthetic polypeptide
AEEEIRTTNPVATEAYGSVVTVTTNGTNVETGTEQF

SEQ ID NO: 178071 - protein, 31 aa, Artificial Sequence
  Description of Artificial Sequence: Synthetic polypeptide
DDSEVASTNPVSTEGYGNCAANTIQSRVGQR

SEQ ID NO: 178072 - protein, 36 aa, Artificial Sequence
  Description of Artificial Sequence: Synthetic polypeptide
DEDEIATTNPVATEQYGSVCAAVMHGENTADGIDDR

SEQ ID NO: 178073 - protein, 36 aa, Artificial Sequence
  Description of Artificial Sequence: Synthetic polypeptide
DEEEISTTNPVATEQYGCVCSNWGEDDNQNFNSDQG

SEQ ID NO: 178074 - protein, 35 aa, Artificial Sequence
  Description of Artificial Sequence: Synthetic polypeptide
AEECISTTNPVATEQYGCVCSTWEHNQESFGSDQS

SEQ ID NO: 178075 - protein, 37 aa, Artificial Sequence
  Description of Artificial Sequence: Synthetic polypeptide
DEEEISTTNPVATEQYGCVCSNWGEDDQENFGSDNQA

SEQ ID NO: 178076 - protein, 38 aa, Artificial Sequence
  Description of Artificial Sequence: Synthetic polypeptide
DEAEIRTTNPVATEQYGSYVSVEGILCEELMNGNEEVF

SEQ ID NO: 178077 - protein, 36 aa, Artificial Sequence
  Description of Artificial Sequence: Synthetic polypeptide
DEEEISTTNPVATEQYGCVCSNWGEDDQENFNSDQD

SEQ ID NO: 178078 - protein, 37 aa, Artificial Sequence
  Description of Artificial Sequence: Synthetic polypeptide
AEEEIRTTNPVATEAYGSVSTVTDNGNNTEQGTEDED

SEQ ID NO: 178079 - protein, 38 aa, Artificial Sequence
  Description of Artificial Sequence: Synthetic polypeptide
DEAEIRTTNPVATEQYGSYVSYSCIMLEELNNGNEEIF

SEQ ID NO: 178080 - protein, 38 aa, Artificial Sequence
  Description of Artificial Sequence: Synthetic polypeptide
DEAEIRTTNPVATEQYGSYVSYSGIMLEELADGNEEVF

SEQ ID NO: 178081 - protein, 36 aa, Artificial Sequence
  Description of Artificial Sequence: Synthetic polypeptide
DEDEIRTTNPVATEAWGVVSTVVNGTEQGTNVEEGS

SEQ ID NO: 178082 - protein, 39 aa, Artificial Sequence
  Description of Artificial Sequence: Synthetic polypeptide
DEEEIRTTNPVATEAYGTVSTNGNGNQIGTTSISTTGNT

SEQ ID NO: 178083 - protein, 36 aa, Artificial Sequence
  Description of Artificial Sequence: Synthetic polypeptide
DEEEIRTTNPVATEQYGCVCSNSEEHQENFMSDTQA

SEQ ID NO: 178084 - protein, 36 aa, Artificial Sequence
  Description of Artificial Sequence: Synthetic polypeptide
DEAEIRTTNPVATEQYGSYWTTVDHNQDEISFNEYI

SEQ ID NO: 178085 - protein, 34 aa, Artificial Sequence
  Description of Artificial Sequence: Synthetic polypeptide
AEECISTTNPVATEQYGCVCSSGEHQEFFGSDQP

SEQ ID NO: 178086 - protein, 32 aa, Artificial Sequence
  Description of Artificial Sequence: Synthetic polypeptide
DENSIATTNPVAYEQWGYCQEDLKRGHDNQGK

SEQ ID NO: 178087 - protein, 36 aa, Artificial Sequence
  Description of Artificial Sequence: Synthetic polypeptide
DEDEIRTTNPVATEAWGVVSTVVNAVEQGTNTEQGS

SEQ ID NO: 178088 - protein, 29 aa, Artificial Sequence
  Description of Artificial Sequence: Synthetic peptide
DDSEVASTNPVSTEGYGNAAAETIQRGEK

SEQ ID NO: 178089 - protein, 36 aa, Artificial Sequence
  Description of Artificial Sequence: Synthetic polypeptide
DEDEIRTTNPVATEAWGVVSTVNNVNEQGTNVEQGS

SEQ ID NO: 178090 - protein, 37 aa, Artificial Sequence
  Description of Artificial Sequence: Synthetic polypeptide
DEEEIRTTNPVATEQYGCFVSTVGVIEQWHFDAEQGE

SEQ ID NO: 178091 - protein, 37 aa, Artificial Sequence
  Description of Artificial Sequence: Synthetic polypeptide
DEEEIRTTNPVATEQYGCVCSNSEEHNAEFFNSDNQS

SEQ ID NO: 178092 - protein, 37 aa, Artificial Sequence
  Description of Artificial Sequence: Synthetic polypeptide
DEEEISTTNPVATEQYGCVCSNWGEDHNAHFGSENQS

SEQ ID NO: 178093 - protein, 37 aa, Artificial Sequence
  Description of Artificial Sequence: Synthetic polypeptide
DEEEISTTNPVATEQYGCVCSNWGEDHNANFGSENQD

SEQ ID NO: 178094 - protein, 36 aa, Artificial Sequence
  Description of Artificial Sequence: Synthetic polypeptide
DEDEIRTTNPVATEAWGTVSTVVNVEQGTNNEQLGS

SEQ ID NO: 178095 - protein, 37 aa, Artificial Sequence
  Description of Artificial Sequence: Synthetic polypeptide
DEDEIATTNPVATEQYGSVCANMNNEEAPDNQTEGNH

SEQ ID NO: 178096 - protein, 39 aa, Artificial Sequence
  Description of Artificial Sequence: Synthetic polypeptide
DEEEIRTTNPVATEQYGCFVNGATNLEYDDSRSGEIHQI

SEQ ID NO: 178097 - protein, 37 aa, Artificial Sequence
  Description of Artificial Sequence: Synthetic polypeptide
DESEIRTTNPVATEQYGSVIVDFGNGGFDTGTDNGNT

SEQ ID NO: 178098 - protein, 35 aa, Artificial Sequence
  Description of Artificial Sequence: Synthetic polypeptide
AEECISTTNPVATEQYGCVCSWEDHNQERFGSDQS

SEQ ID NO: 178099 - protein, 33 aa, Artificial Sequence
  Description of Artificial Sequence: Synthetic polypeptide
DENSIRTTNPVSTEPYGTISMEDIQQQQNGNHQ

SEQ ID NO: 178100 - protein, 34 aa, Artificial Sequence
  Description of Artificial Sequence: Synthetic polypeptide
AEECISTTNPVATEQYGCVCSWEHNIEHFGSDQS

SEQ ID NO: 178101 - protein, 36 aa, Artificial Sequence
  Description of Artificial Sequence: Synthetic polypeptide
AEECISTTNPVATEQYGCVCSWENHNQENFGSQNQS

SEQ ID NO: 178102 - protein, 36 aa, Artificial Sequence
  Description of Artificial Sequence: Synthetic polypeptide
DEEEISTTNPVATEQYGCVCSNWEEHNQYFNSETQA

SEQ ID NO: 178103 - protein, 36 aa, Artificial Sequence
  Description of Artificial Sequence: Synthetic polypeptide
DEEEISTTNPVATEQYGCVCSNWEEHNQYFNSETQD

SEQ ID NO: 178104 - protein, 36 aa, Artificial Sequence
  Description of Artificial Sequence: Synthetic polypeptide
DEEEISTTNPVATEQYGCVCSNWEEHNTNFGSETQA

SEQ ID NO: 178105 - protein, 37 aa, Artificial Sequence
  Description of Artificial Sequence: Synthetic polypeptide
DEEEISTTNPVATEQYGCVCSNWEETNQENFNSQTQA

SEQ ID NO: 178106 - protein, 37 aa, Artificial Sequence
  Description of Artificial Sequence: Synthetic polypeptide
DEDEIATTNPVATEQYGSVSATTPAGTNQGNGMEGVM

SEQ ID NO: 178107 - protein, 36 aa, Artificial Sequence
  Description of Artificial Sequence: Synthetic polypeptide
DEEEISTTNPVATEQYGCVCSNWEHNAENFGSETQA

SEQ ID NO: 178108 - protein, 36 aa, Artificial Sequence
  Description of Artificial Sequence: Synthetic polypeptide
DEEEISTTNPVATEQYGCVCSNWEHNAENFNSDTQA

SEQ ID NO: 178109 - protein, 36 aa, Artificial Sequence
  Description of Artificial Sequence: Synthetic polypeptide
DEEEISTTNPVATEQYGCVCSNWEHNQENFGSDTQA

SEQ ID NO: 178110 - protein, 36 aa, Artificial Sequence
  Description of Artificial Sequence: Synthetic polypeptide
DEEEISTTNPVATEQYGCVCSNWEHNQENFGSDTQE

SEQ ID NO: 178111 - protein, 38 aa, Artificial Sequence
  Description of Artificial Sequence: Synthetic polypeptide
DEAEIRTTNPVATEQYGSYVSCSGILFEELMNGNEGVF

SEQ ID NO: 178112 - protein, 35 aa, Artificial Sequence
  Description of Artificial Sequence: Synthetic polypeptide
DEEEISTTNPVATEQYGCVCSNWEHNQENFISEQF

SEQ ID NO: 178113 - protein, 35 aa, Artificial Sequence
  Description of Artificial Sequence: Synthetic polypeptide
DEEEISTTNPVATEQYGCVCSNWEHNQESFFSEQA

SEQ ID NO: 178114 - protein, 37 aa, Artificial Sequence
  Description of Artificial Sequence: Synthetic polypeptide
AEEEIRTTNPVATEAYGSVSTTTDNGNNDEQGTEEED

SEQ ID NO: 178115 - protein, 37 aa, Artificial Sequence
  Description of Artificial Sequence: Synthetic polypeptide
TEEEIRTTNPVATEGYGSVNGQTDNNDEQEEMEGGGN

SEQ ID NO: 178116 - protein, 38 aa, Artificial Sequence
  Description of Artificial Sequence: Synthetic polypeptide
DEAEIRTTNPVATEQYGSYVSCSGIMLEELMNGNIEVF

SEQ ID NO: 178117 - protein, 35 aa, Artificial Sequence
  Description of Artificial Sequence: Synthetic polypeptide
DEEEISTTNPVATEQYGCVCSNWEHNQNFISETQS

SEQ ID NO: 178118 - protein, 36 aa, Artificial Sequence
  Description of Artificial Sequence: Synthetic polypeptide
DEEEISTTNPVATEQYGCVCSNWEHNTEFFGSETQA

SEQ ID NO: 178119 - protein, 37 aa, Artificial Sequence
  Description of Artificial Sequence: Synthetic polypeptide
AEEEIRTTNPVATEAYGSVSTTTNNGNNVEQGTEDEN

SEQ ID NO: 178120 - protein, 36 aa, Artificial Sequence
  Description of Artificial Sequence: Synthetic polypeptide
DEEEIRTTNPVAYEQYGCVCSWEEHNQENFNSDTQS

SEQ ID NO: 178121 - protein, 36 aa, Artificial Sequence
  Description of Artificial Sequence: Synthetic polypeptide
DEEEIRTTNPVAYEQYGCVCSWEEHNQENFNSDNQA

SEQ ID NO: 178122 - protein, 37 aa, Artificial Sequence
  Description of Artificial Sequence: Synthetic polypeptide
DEEEIRTTNPVATEQYGCVCSNWGYDHQENFNSDTQA

SEQ ID NO: 178123 - protein, 38 aa, Artificial Sequence
  Description of Artificial Sequence: Synthetic polypeptide
DEAEIRTTNPVATEQYGSYVSCSGIMLEELMNYNEEVR

SEQ ID NO: 178124 - protein, 36 aa, Artificial Sequence
  Description of Artificial Sequence: Synthetic polypeptide
DEEEISTTNPVATEQYGCVCSNWESHFQEHFGSEQA

SEQ ID NO: 178125 - protein, 37 aa, Artificial Sequence
  Description of Artificial Sequence: Synthetic polypeptide
DEDEIATTNPVATEQYGSVSAGWPAGTNQGNGMEPVN

SEQ ID NO: 178126 - protein, 36 aa, Artificial Sequence
  Description of Artificial Sequence: Synthetic polypeptide
DEEEISTTNPVATEQYGCVCSNWGAHNQNFNSETQA

SEQ ID NO: 178127 - protein, 38 aa, Artificial Sequence
  Description of Artificial Sequence: Synthetic polypeptide
DEAEIRTTNPVATEQYGSYVSCSSIMLEELMNGNENVF

SEQ ID NO: 178128 - protein, 39 aa, Artificial Sequence
  Description of Artificial Sequence: Synthetic polypeptide
DEEEIRTTNPVATEAYGVVSTTVTNNQQNQDEGTNVATE

SEQ ID NO: 178129 - protein, 36 aa, Artificial Sequence
  Description of Artificial Sequence: Synthetic polypeptide
DEAEIRTTNPVATEQYGVVCSNTGEHNQENFPSDQA

SEQ ID NO: 178130 - protein, 37 aa, Artificial Sequence
  Description of Artificial Sequence: Synthetic polypeptide
DEEEISTTNPVATEQYGCVCSNWGEDHNIGFGSDNQS

SEQ ID NO: 178131 - protein, 36 aa, Artificial Sequence
  Description of Artificial Sequence: Synthetic polypeptide
DEDEIATTNPVATEQYGSVCAMNNGNLEEGRDVPDA

SEQ ID NO: 178132 - protein, 36 aa, Artificial Sequence
  Description of Artificial Sequence: Synthetic polypeptide
DEDEIATTNPVATEQYGSVCAMNNGNEEPGMDVNNA

SEQ ID NO: 178133 - protein, 31 aa, Artificial Sequence
  Description of Artificial Sequence: Synthetic polypeptide
DESEVASTNPVSTEGYGVMAANTLQSHVGDI

SEQ ID NO: 178134 - protein, 36 aa, Artificial Sequence
  Description of Artificial Sequence: Synthetic polypeptide
DEDEIATTNPVATEQYGSVCAMNNGELTNDSDENGM

SEQ ID NO: 178135 - protein, 36 aa, Artificial Sequence
  Description of Artificial Sequence: Synthetic polypeptide
DEEEISTTNPVATEQYGCVCSNWGEHEEYFGSNTQA

SEQ ID NO: 178136 - protein, 37 aa, Artificial Sequence
  Description of Artificial Sequence: Synthetic polypeptide
DEEEIRTTNPVATEAYGTVSTLQQAATEQGTVATQDQ

SEQ ID NO: 178137 - protein, 37 aa, Artificial Sequence
  Description of Artificial Sequence: Synthetic polypeptide
DEEEISTTNPVATEQYGCVCSNWGEHEQENFGSDNQV

SEQ ID NO: 178138 - protein, 38 aa, Artificial Sequence
  Description of Artificial Sequence: Synthetic polypeptide
DEEEIRTTNPVATEAYGTVSTIGNTEIGTTSISTTGNT

SEQ ID NO: 178139 - protein, 36 aa, Artificial Sequence
  Description of Artificial Sequence: Synthetic polypeptide
DEEEISTTNPVATEQYGCVCSNWGEHEQYFGSDTQS

SEQ ID NO: 178140 - protein, 36 aa, Artificial Sequence
  Description of Artificial Sequence: Synthetic polypeptide
DEDEIATTNPVATEQYGSVCAMNNGDLPADGSGGDP

SEQ ID NO: 178141 - protein, 38 aa, Artificial Sequence
  Description of Artificial Sequence: Synthetic polypeptide
DEAEIRTTNPVATEQYGVYCSYSGIMLEELRNGNEEVF

SEQ ID NO: 178142 - protein, 35 aa, Artificial Sequence
  Description of Artificial Sequence: Synthetic polypeptide
DEDEIATTNPVATEQYGSVCAMANPAEDNMALANH

SEQ ID NO: 178143 - protein, 35 aa, Artificial Sequence
  Description of Artificial Sequence: Synthetic polypeptide
DENTIATTNPVATEFYGQYSVDINGLEQGEGDTED

SEQ ID NO: 178144 - protein, 38 aa, Artificial Sequence
  Description of Artificial Sequence: Synthetic polypeptide
DEEEIRTTNPVATEAYGTVSTEGNGDIGTTSISTTGNT

SEQ ID NO: 178145 - protein, 35 aa, Artificial Sequence
  Description of Artificial Sequence: Synthetic polypeptide
DEEEISTTNPVATEQYGCVCSNWGEHIENFGSDQA

SEQ ID NO: 178146 - protein, 36 aa, Artificial Sequence
  Description of Artificial Sequence: Synthetic polypeptide
DEEEISTTNPVATEQYGCVCSNWGEHNAEFFGSDQE

SEQ ID NO: 178147 - protein, 31 aa, Artificial Sequence
  Description of Artificial Sequence: Synthetic polypeptide
DDSEVASTNPVSTEGYGNAAANTIQSRVGQR

SEQ ID NO: 178148 - protein, 37 aa, Artificial Sequence
  Description of Artificial Sequence: Synthetic polypeptide
DEEEISTTNPVATEQYGCVCSNWGEHNAEHFGSENQA

SEQ ID NO: 178149 - protein, 38 aa, Artificial Sequence
  Description of Artificial Sequence: Synthetic polypeptide
DEEEIRTTNPVATEAYGTVSTAGNSDIGTTSISTTENT

SEQ ID NO: 178150 - protein, 37 aa, Artificial Sequence
  Description of Artificial Sequence: Synthetic polypeptide
DEEEIRTTNPVATEQYGCVCSNSEEDNQENFNSDNQS

SEQ ID NO: 178151 - protein, 32 aa, Artificial Sequence
  Description of Artificial Sequence: Synthetic polypeptide
DENTIQTTNPVSTEPYGTISMEDIQQQQNGNH

SEQ ID NO: 178152 - protein, 37 aa, Artificial Sequence
  Description of Artificial Sequence: Synthetic polypeptide
CEEEIRTTNPVATEQYGCVCSTTGEHNQENFISDNQA

SEQ ID NO: 178153 - protein, 37 aa, Artificial Sequence
  Description of Artificial Sequence: Synthetic polypeptide
DEEEISTTNPVATEQYGCVCSNWGEHNAENFGSDNQA

SEQ ID NO: 178154 - protein, 36 aa, Artificial Sequence
  Description of Artificial Sequence: Synthetic polypeptide
AEEEIRTTNPVATEAYGSVVTVTNNQQQAEEEEEDQ

SEQ ID NO: 178155 - protein, 31 aa, Artificial Sequence
  Description of Artificial Sequence: Synthetic polypeptide
DESEVASTNPVSTEGYGTVAAMTIQSRNGQH

SEQ ID NO: 178156 - protein, 36 aa, Artificial Sequence
  Description of Artificial Sequence: Synthetic polypeptide
DEDEIATTNPVATEQYGSVCAMNNGNLEPADIPNED

SEQ ID NO: 178157 - protein, 39 aa, Artificial Sequence
  Description of Artificial Sequence: Synthetic polypeptide
DEEEIRTTNPVATEAYGVVSTTVTQQGNNQDEGTNVATE

SEQ ID NO: 178158 - protein, 38 aa, Artificial Sequence
  Description of Artificial Sequence: Synthetic polypeptide
DEEEIRTTNPVATEAYGVVSTTVTNQQNGTEQGTEEED

SEQ ID NO: 178159 - protein, 37 aa, Artificial Sequence
  Description of Artificial Sequence: Synthetic polypeptide
DEEEISTTNPVATEQYGCVCSNWGEDTNQNFGSETQA

SEQ ID NO: 178160 - protein, 31 aa, Artificial Sequence
  Description of Artificial Sequence: Synthetic polypeptide
DESEVASTNPVSTEPYGTVAAMTIQSRNGQH

SEQ ID NO: 178161 - protein, 38 aa, Artificial Sequence
  Description of Artificial Sequence: Synthetic polypeptide
DEDEIATTNPVATEQYGSVCAMTNGQLPQDDTTGGGLE

SEQ ID NO: 178162 - protein, 36 aa, Artificial Sequence
  Description of Artificial Sequence: Synthetic polypeptide
DEDEIATTNPVATEQYGSVCAMSNDLPAGDPMGDMN

SEQ ID NO: 178163 - protein, 36 aa, Artificial Sequence
  Description of Artificial Sequence: Synthetic polypeptide
DEEEIRTTNPVATEQYGCVCSSEEHNQENFISDTQS

SEQ ID NO: 178164 - protein, 37 aa, Artificial Sequence
  Description of Artificial Sequence: Synthetic polypeptide
TEEEIRTTNPVATDQYGSVTMGNQGGQTGGGNGLEEQ

SEQ ID NO: 178165 - protein, 37 aa, Artificial Sequence
  Description of Artificial Sequence: Synthetic polypeptide
DEDEIATTNPVATEQYGSVCAMNNGVLPEGDDGGNDQ

SEQ ID NO: 178166 - protein, 37 aa, Artificial Sequence
  Description of Artificial Sequence: Synthetic polypeptide
TEEEIRTTNPVATDPYGSTVPSVAGNNLSDEFEMNNR

SEQ ID NO: 178167 - protein, 36 aa, Artificial Sequence
  Description of Artificial Sequence: Synthetic polypeptide
DEEEIRTTNPVATEQYGCFCSWPNDHNQNFISDTQS

SEQ ID NO: 178168 - protein, 36 aa, Artificial Sequence
  Description of Artificial Sequence: Synthetic polypeptide
DEDEIATTNPVATEQYGSVCAMNNGNLEPTRDVPDN

SEQ ID NO: 178169 - protein, 36 aa, Artificial Sequence
  Description of Artificial Sequence: Synthetic polypeptide
DEDEIATTNPVATEQYGSVCAMNNGNLEPPADIPNH

SEQ ID NO: 178170 - protein, 37 aa, Artificial Sequence
  Description of Artificial Sequence: Synthetic polypeptide
DEEEISTTNPVATEQYGCVCSNWGEDHNQFFGSNTQS

SEQ ID NO: 178171 - protein, 36 aa, Artificial Sequence
  Description of Artificial Sequence: Synthetic polypeptide
DEEEISTTNPVATEQYGCVCSNWGEDHNQNFGSDQA

SEQ ID NO: 178172 - protein, 36 aa, Artificial Sequence
  Description of Artificial Sequence: Synthetic polypeptide
DEEEISTTNPVATEQYGCVCSNWEEHNQSFGSETQA

SEQ ID NO: 178173 - protein, 30 aa, Artificial Sequence
  Description of Artificial Sequence: Synthetic polypeptide
DDSEVASTNPVSTEGYGNAAAETIQSRGER

SEQ ID NO: 178174 - protein, 36 aa, Artificial Sequence
  Description of Artificial Sequence: Synthetic polypeptide
DEEEISTTNPVATEQYGCVCSNWGEDHNQSFGSDQS

SEQ ID NO: 178175 - protein, 34 aa, Artificial Sequence
  Description of Artificial Sequence: Synthetic polypeptide
TEEEIRTTNPCAYAEYGSVAYTANEHSGAGGNGY

SEQ ID NO: 178176 - protein, 36 aa, Artificial Sequence
  Description of Artificial Sequence: Synthetic polypeptide
DEDEIRTTNPVATEAWGTVSTVVNNTEQGTNNEQGS

SEQ ID NO: 178177 - protein, 36 aa, Artificial Sequence
  Description of Artificial Sequence: Synthetic polypeptide
DEEEISTTNPVATEQYGCVCSNWGEDNQENFNSDQS

SEQ ID NO: 178178 - protein, 37 aa, Artificial Sequence
  Description of Artificial Sequence: Synthetic polypeptide
DEDEIATTNPVATEQYGSVCAMNNGNLEPGADIPNAL

SEQ ID NO: 178179 - protein, 36 aa, Artificial Sequence
  Description of Artificial Sequence: Synthetic polypeptide
DEEEISTTNPVATEQYGCVCSNWGEDNQFFNSDNQE

SEQ ID NO: 178180 - protein, 36 aa, Artificial Sequence
  Description of Artificial Sequence: Synthetic polypeptide
DEEEISTTNPVATEQYGCVCSNWGEDNQNFNSDTQE

SEQ ID NO: 178181 - protein, 37 aa, Artificial Sequence
  Description of Artificial Sequence: Synthetic polypeptide
DEEEISTTNPVATEQYGCVCSNWGEDNTENFNSENQS

SEQ ID NO: 178182 - protein, 32 aa, Artificial Sequence
  Description of Artificial Sequence: Synthetic polypeptide
DENSTRTTNPVSTEPYGTISMEDIQQQQNGNH

SEQ ID NO: 178183 - protein, 38 aa, Artificial Sequence
  Description of Artificial Sequence: Synthetic polypeptide
DEEEISTTNPVATEQYGCVCSNWGEDTNQENFGSDNQS

SEQ ID NO: 178184 - protein, 31 aa, Artificial Sequence
  Description of Artificial Sequence: Synthetic polypeptide
DETEIRTTNPIATECWGATTWAAEDWARGPI

SEQ ID NO: 178185 - protein, 36 aa, Artificial Sequence
  Description of Artificial Sequence: Synthetic polypeptide
DEDEIATTNPVATEQYGSVCAMNNGNLEPDRDPPDA

SEQ ID NO: 178186 - protein, 36 aa, Artificial Sequence
  Description of Artificial Sequence: Synthetic polypeptide
DEEEISTTNPVATEQYGCVCSNWGEDHNQNFGSQQA

SEQ ID NO: 178187 - protein, 34 aa, Artificial Sequence
  Description of Artificial Sequence: Synthetic polypeptide
DEEEISTTNPVAYENWGSTVPSTPEGSQTEDQED

SEQ ID NO: 178188 - protein, 37 aa, Artificial Sequence
  Description of Artificial Sequence: Synthetic polypeptide
SEEEIRTTNPVATEQYGSVGYPTFDDMNNNGLEVNME

SEQ ID NO: 178189 - protein, 37 aa, Artificial Sequence
  Description of Artificial Sequence: Synthetic polypeptide
CEEEIRTTNPVATEQYGSYSSPITAEPNSNVGHPPVC

SEQ ID NO: 178190 - protein, 34 aa, Artificial Sequence
  Description of Artificial Sequence: Synthetic polypeptide
DESEIRTTNPVAYECWGTVYRINENQDRRNENGM

SEQ ID NO: 178191 - protein, 35 aa, Artificial Sequence
  Description of Artificial Sequence: Synthetic polypeptide
EETEIATTNPCATESYGCVATGNGLNDTERGGDGR

SEQ ID NO: 178192 - protein, 34 aa, Artificial Sequence
  Description of Artificial Sequence: Synthetic polypeptide
DEAEIRTTNPVATEGWGCVCSWGEENQDYFGSEQ

SEQ ID NO: 178193 - protein, 32 aa, Artificial Sequence
  Description of Artificial Sequence: Synthetic polypeptide
SECGIRGTNPTATEAYGAVAVIMNGARIGNDM

SEQ ID NO: 178194 - protein, 35 aa, Artificial Sequence
  Description of Artificial Sequence: Synthetic polypeptide
DEEEIRTTNPVATEGYGCVCQWGEDNTEYFGSDQS

SEQ ID NO: 178195 - protein, 35 aa, Artificial Sequence
  Description of Artificial Sequence: Synthetic polypeptide
DEEEIRTTNPVATEGYGCVCSDSGEHNQNFSSDQS

SEQ ID NO: 178196 - protein, 35 aa, Artificial Sequence
  Description of Artificial Sequence: Synthetic polypeptide
DESEIRTTNPVAYECWGTVYRINENQDRRGENNGK

SEQ ID NO: 178197 - protein, 36 aa, Artificial Sequence
  Description of Artificial Sequence: Synthetic polypeptide
DEEEIRCTNPVATEQYGCVCSTWGEHNDHFISDTQS

SEQ ID NO: 178198 - protein, 35 aa, Artificial Sequence
  Description of Artificial Sequence: Synthetic polypeptide
EEVEIACTNPTAYEQWGSTVYGENDLDQRTGDNKR

SEQ ID NO: 178199 - protein, 36 aa, Artificial Sequence
  Description of Artificial Sequence: Synthetic polypeptide
DESEIATTNPVATEQWGSVSATAHAGGNAPMNNGMT

SEQ ID NO: 178200 - protein, 34 aa, Artificial Sequence
  Description of Artificial Sequence: Synthetic polypeptide
DEQEIATTNPIATEQWGSTWSNTEDLADHEGPDL

SEQ ID NO: 178201 - protein, 30 aa, Artificial Sequence
  Description of Artificial Sequence: Synthetic polypeptide
EEVEIATTNPVAYECWGCSYYEHILQHEEA

SEQ ID NO: 178202 - protein, 30 aa, Artificial Sequence
  Description of Artificial Sequence: Synthetic polypeptide
EEVEIATTNPVAYECWGCVAYNEHIQHNEA

SEQ ID NO: 178203 - protein, 40 aa, Artificial Sequence
  Description of Artificial Sequence: Synthetic polypeptide
DEETIRTTNPVATEQYGVVSTVVSTNNNGNNLQQGDEEDE

SEQ ID NO: 178204 - protein, 30 aa, Artificial Sequence
  Description of Artificial Sequence: Synthetic polypeptide
EEVEIATTNPVAYECWGCVYECLQHNEQEA

SEQ ID NO: 178205 - protein, 31 aa, Artificial Sequence
  Description of Artificial Sequence: Synthetic polypeptide
DDSEVASTNPVSTEGYGNVSAETIMSRVGQA

SEQ ID NO: 178206 - protein, 31 aa, Artificial Sequence
  Description of Artificial Sequence: Synthetic polypeptide
EEVEIATTNPVAYECWGCVYYEHLQEHEREA

SEQ ID NO: 178207 - protein, 34 aa, Artificial Sequence
  Description of Artificial Sequence: Synthetic polypeptide
DESEIRTTNPVAYECWGTVYRINENGDRRGESNG

SEQ ID NO: 178208 - protein, 30 aa, Artificial Sequence
  Description of Artificial Sequence: Synthetic polypeptide
EEVEIATTNPVAYECWGCVYYGEQLQHEDA

SEQ ID NO: 178209 - protein, 31 aa, Artificial Sequence
  Description of Artificial Sequence: Synthetic polypeptide
DDSEVASTNPVSTEGYGNVSANCIQSRVEQL

SEQ ID NO: 178210 - protein, 30 aa, Artificial Sequence
  Description of Artificial Sequence: Synthetic polypeptide
EEVEIATTNPVAYECWGEVYYGEHLQHMEA

SEQ ID NO: 178211 - protein, 33 aa, Artificial Sequence
  Description of Artificial Sequence: Synthetic polypeptide
SECEIATTNPVAYEGWGSVVCNDQGDTGGFNEV

SEQ ID NO: 178212 - protein, 37 aa, Artificial Sequence
  Description of Artificial Sequence: Synthetic polypeptide
DESEIATTNPVATEQWGCVTAATANGLGPRDAPGGNN

SEQ ID NO: 178213 - protein, 38 aa, Artificial Sequence
  Description of Artificial Sequence: Synthetic polypeptide
DEETIRTTNPVATEQYGVVSTVVTTNNNNTQQGDEEDE

SEQ ID NO: 178214 - protein, 37 aa, Artificial Sequence
  Description of Artificial Sequence: Synthetic polypeptide
DESEIATTNPVATEQWGCVTAAPANGLQPRDAPGGNA

SEQ ID NO: 178215 - protein, 36 aa, Artificial Sequence
  Description of Artificial Sequence: Synthetic polypeptide
DEEEIRCTNPVATEQYGCVCSWEEDHNQNFNSENQL

SEQ ID NO: 178216 - protein, 29 aa, Artificial Sequence
  Description of Artificial Sequence: Synthetic peptide
EEVEIATTNPVAYECWGVAYECLQHEEDA

SEQ ID NO: 178217 - protein, 36 aa, Artificial Sequence
  Description of Artificial Sequence: Synthetic polypeptide
DEEEIRCTNPVATEQYGCVCSWEEDNAEHFGSDTQS

SEQ ID NO: 178218 - protein, 36 aa, Artificial Sequence
  Description of Artificial Sequence: Synthetic polypeptide
DEEEIRTTNPVATEGYGCVCFWMEDHNTNFGSDNQS

SEQ ID NO: 178219 - protein, 34 aa, Artificial Sequence
  Description of Artificial Sequence: Synthetic polypeptide
EESEIATTNPVAYECWGSVATGQINGDIQGGNQS

SEQ ID NO: 178220 - protein, 36 aa, Artificial Sequence
  Description of Artificial Sequence: Synthetic polypeptide
DEAEIATTNPVATECYGCVYIMDNGQQQGDHRNDRA

SEQ ID NO: 178221 - protein, 34 aa, Artificial Sequence
  Description of Artificial Sequence: Synthetic polypeptide
EESEIATTNPVAYEQWGSVRWWNQDDQKGGNQKT

SEQ ID NO: 178222 - protein, 36 aa, Artificial Sequence
  Description of Artificial Sequence: Synthetic polypeptide
DEAEIATTNPVATECYGTVAATPNDGDERNGQGGRR

SEQ ID NO: 178223 - protein, 40 aa, Artificial Sequence
  Description of Artificial Sequence: Synthetic polypeptide
DEETIRTTNPVATEQYGVVSTVTANLQQGNNQQGTEQGND

SEQ ID NO: 178224 - protein, 36 aa, Artificial Sequence
  Description of Artificial Sequence: Synthetic polypeptide
DECEIATTNPVAYEQYGTVCSYTDGLNDDKMEGNDS

SEQ ID NO: 178225 - protein, 36 aa, Artificial Sequence
  Description of Artificial Sequence: Synthetic polypeptide
DEEEIRCTNPVATEQYGCVCSWGEDNTEYFGSDTQA

SEQ ID NO: 178226 - protein, 35 aa, Artificial Sequence
  Description of Artificial Sequence: Synthetic polypeptide
SEDEIATTNPVAYEQYGTVATMNGGQQNGGQRGEA

SEQ ID NO: 178227 - protein, 31 aa, Artificial Sequence
  Description of Artificial Sequence: Synthetic polypeptide
DDSEVASTNPVSTEGYGNVPANTCQSHVGQR

SEQ ID NO: 178228 - protein, 40 aa, Artificial Sequence
  Description of Artificial Sequence: Synthetic polypeptide
DEETIRTTNPVATEQYGVVSTVTSNLQAGNNEQGTEQGED

SEQ ID NO: 178229 - protein, 34 aa, Artificial Sequence
  Description of Artificial Sequence: Synthetic polypeptide
DEECISCTNPVATEQYGCVCSWEEDNQNFGSDLS

SEQ ID NO: 178230 - protein, 40 aa, Artificial Sequence
  Description of Artificial Sequence: Synthetic polypeptide
DEETIRTTNPVATEQYGVVSTVTTNLQAGNNQQGTEQGNQ

SEQ ID NO: 178231 - protein, 36 aa, Artificial Sequence
  Description of Artificial Sequence: Synthetic polypeptide
SEDEIATTNPVATEQYGSVVITPNEQDQHQQGKGGQ

SEQ ID NO: 178232 - protein, 31 aa, Artificial Sequence
  Description of Artificial Sequence: Synthetic polypeptide
DDSEVASTNPVSTEGYGNVPANTIQSEVGQR

SEQ ID NO: 178233 - protein, 33 aa, Artificial Sequence
  Description of Artificial Sequence: Synthetic polypeptide
SEDEIATTNPVATEQWGGCCTAAAGNLDAMGTH

SEQ ID NO: 178234 - protein, 36 aa, Artificial Sequence
  Description of Artificial Sequence: Synthetic polypeptide
SEDEIATTNPVATEQWGCVAGTGQNPEAQTEGNNRN

SEQ ID NO: 178235 - protein, 36 aa, Artificial Sequence
  Description of Artificial Sequence: Synthetic polypeptide
DEEEIRCTNPVATEQYGCVCSWENHNDEHFGSDTQF

SEQ ID NO: 178236 - protein, 33 aa, Artificial Sequence
  Description of Artificial Sequence: Synthetic polypeptide
DEQEIATTNPIATEQWGATVSAADLAEHKGPYI

SEQ ID NO: 178237 - protein, 31 aa, Artificial Sequence
  Description of Artificial Sequence: Synthetic polypeptide
DDSEVASTNPVSTEGYGNVPANTIQSHVGQR

SEQ ID NO: 178238 - protein, 36 aa, Artificial Sequence
  Description of Artificial Sequence: Synthetic polypeptide
DEQEIATTNPVATEQWGSVSANGDMGPDHEGGEDNH

SEQ ID NO: 178239 - protein, 34 aa, Artificial Sequence
  Description of Artificial Sequence: Synthetic polypeptide
CEEEIACTNPVATEQYGCVAGTNSHQEADIIEHN

SEQ ID NO: 178240 - protein, 35 aa, Artificial Sequence
  Description of Artificial Sequence: Synthetic polypeptide
DEQEIATTNPVATEQWGSVSANGDMGEDHQGIEDN

SEQ ID NO: 178241 - protein, 40 aa, Artificial Sequence
  Description of Artificial Sequence: Synthetic polypeptide
DEETIRTTNPVATEQYGVVSTVTVNLQAGNNQQGTETGND

SEQ ID NO: 178242 - protein, 34 aa, Artificial Sequence
  Description of Artificial Sequence: Synthetic polypeptide
TTAEIATTNPVAYECWGSVSGNGLNDDRQEGGNH

SEQ ID NO: 178243 - protein, 35 aa, Artificial Sequence
  Description of Artificial Sequence: Synthetic polypeptide
SEDEIACTNPVATEQYGSVYCNWNDQHHQGHNGQS

SEQ ID NO: 178244 - protein, 35 aa, Artificial Sequence
  Description of Artificial Sequence: Synthetic polypeptide
DEAEIRTTNPVATEGWGCVCSWGEENQEYEGSNTQ

SEQ ID NO: 178245 - protein, 35 aa, Artificial Sequence
  Description of Artificial Sequence: Synthetic polypeptide
DEAEIATTNPVATECYGCVFCTDNQGQHQQQNNEE

SEQ ID NO: 178246 - protein, 39 aa, Artificial Sequence
  Description of Artificial Sequence: Synthetic polypeptide
DEETIRTTNPVATEQYGVVSTVVVGTNLQAGTTEEAEED

SEQ ID NO: 178247 - protein, 31 aa, Artificial Sequence
  Description of Artificial Sequence: Synthetic polypeptide
EEVEIATTNPVAYEKWGCVYYSEDNHQHEDF

SEQ ID NO: 178248 - protein, 34 aa, Artificial Sequence
  Description of Artificial Sequence: Synthetic polypeptide
EGEEIATTNPVAYEQWGSVYWNVEGDGKRHGDTR

SEQ ID NO: 178249 - protein, 36 aa, Artificial Sequence
  Description of Artificial Sequence: Synthetic polypeptide
DEDEIATTNPVAYEQYGSVSTTADIGTEHMNNNEAD

SEQ ID NO: 178250 - protein, 35 aa, Artificial Sequence
  Description of Artificial Sequence: Synthetic polypeptide
AEAEIATTNPVAYEQWGSVYGGWNDDQPQGNRGGN

SEQ ID NO: 178251 - protein, 36 aa, Artificial Sequence
  Description of Artificial Sequence: Synthetic polypeptide
SEAEIRTTNPVATEAYGCTVWCQGNSDQVRAGGNTS

SEQ ID NO: 178252 - protein, 38 aa, Artificial Sequence
  Description of Artificial Sequence: Synthetic polypeptide
DEEEIRTTNPVATEQYGSAVQFITMGDEQPEPGSVPEI

SEQ ID NO: 178253 - protein, 33 aa, Artificial Sequence
  Description of Artificial Sequence: Synthetic polypeptide
TTAEIATTNPVAYERWGSVSGGLNDDRQHQGNP

SEQ ID NO: 178254 - protein, 32 aa, Artificial Sequence
  Description of Artificial Sequence: Synthetic polypeptide
EGTEIATTNPVAYEQWGSVTWTEGDQRNTTDP

SEQ ID NO: 178255 - protein, 38 aa, Artificial Sequence
  Description of Artificial Sequence: Synthetic polypeptide
DDEEIRTTNPVATEQYGSVVIMTTPDGPNMGNGENDGD

SEQ ID NO: 178256 - protein, 37 aa, Artificial Sequence
  Description of Artificial Sequence: Synthetic polypeptide
DDEEIRTTNPVATEQYGSVVGVDQEDLQNNGFGQSEE

SEQ ID NO: 178257 - protein, 34 aa, Artificial Sequence
  Description of Artificial Sequence: Synthetic polypeptide
AEAEIATTNPVAYEQWGSVYGGWNDDQPQGNMDQ

SEQ ID NO: 178258 - protein, 35 aa, Artificial Sequence
  Description of Artificial Sequence: Synthetic polypeptide
SEAEIRCTNPVATEQYGCVCEWELNQEHFGSDNQA

SEQ ID NO: 178259 - protein, 37 aa, Artificial Sequence
  Description of Artificial Sequence: Synthetic polypeptide
DDEEIRTTNPVATEQYGSVVDVDQEDQQQGTGFGQNT

SEQ ID NO: 178260 - protein, 36 aa, Artificial Sequence
  Description of Artificial Sequence: Synthetic polypeptide
DDEEIRTTNPVATEQYGSVVDLMVNTGQGEEQTEGD

SEQ ID NO: 178261 - protein, 34 aa, Artificial Sequence
  Description of Artificial Sequence: Synthetic polypeptide
AEAEIATTNPVAYEQWGSVYGGWNDDQPQGMRGP

SEQ ID NO: 178262 - protein, 34 aa, Artificial Sequence
  Description of Artificial Sequence: Synthetic polypeptide
EIEEIATTNPVAYEQWGTCYIITNDQHGHGNDRE

SEQ ID NO: 178263 - protein, 33 aa, Artificial Sequence
  Description of Artificial Sequence: Synthetic polypeptide
SEAEIRCTNPCATEQYGCVCSWELNANFGSDQS

SEQ ID NO: 178264 - protein, 37 aa, Artificial Sequence
  Description of Artificial Sequence: Synthetic polypeptide
DDEEIRTTNPVATEQYGSVVDIMQNVEGQATNNTGDG

SEQ ID NO: 178265 - protein, 35 aa, Artificial Sequence
  Description of Artificial Sequence: Synthetic polypeptide
EITEIATTNPVATECYGCVATGNGLNDTERGGDER

SEQ ID NO: 178266 - protein, 33 aa, Artificial Sequence
  Description of Artificial Sequence: Synthetic polypeptide
EITEIATTNPVAYEQWGNVSGGEMQQTGDGGNR

SEQ ID NO: 178267 - protein, 34 aa, Artificial Sequence
  Description of Artificial Sequence: Synthetic polypeptide
ENAEIAATNPVATEPYGSVSWNEQQQKNGKQDRN

SEQ ID NO: 178268 - protein, 33 aa, Artificial Sequence
  Description of Artificial Sequence: Synthetic polypeptide
ENAEIATTNPVATTQWGNVSKTWNPNEQGQNDG

SEQ ID NO: 178269 - protein, 32 aa, Artificial Sequence
  Description of Artificial Sequence: Synthetic polypeptide
ENAEIATTNPVAYERWGVVYSNLQGDHGPTDR

SEQ ID NO: 178270 - protein, 34 aa, Artificial Sequence
  Description of Artificial Sequence: Synthetic polypeptide
DEDEIRGTNCVATEGWGSVSAGMGEGQDGEGENG

SEQ ID NO: 178271 - protein, 33 aa, Artificial Sequence
  Description of Artificial Sequence: Synthetic polypeptide
SEAEICTTNPVAYEQWGSVCSGMNDEHHDGGDH

SEQ ID NO: 178272 - protein, 36 aa, Artificial Sequence
  Description of Artificial Sequence: Synthetic polypeptide
SEAEICTTNPVATEWWGTVSTGNGLLDDDRGQNMED

SEQ ID NO: 178273 - protein, 33 aa, Artificial Sequence
  Description of Artificial Sequence: Synthetic polypeptide
EGEEIATTNPVAYEQWGSVYWNEGDGRIGKTGG

SEQ ID NO: 178274 - protein, 35 aa, Artificial Sequence
  Description of Artificial Sequence: Synthetic polypeptide
CEEEIACTNPVATEQYGCVAIANNLPQEAPGGQAH

SEQ ID NO: 178275 - protein, 33 aa, Artificial Sequence
  Description of Artificial Sequence: Synthetic polypeptide
AEAEICTTNPVATQAYGCICCCNLSTRPGGNNV

SEQ ID NO: 178276 - protein, 36 aa, Artificial Sequence
  Description of Artificial Sequence: Synthetic polypeptide
DESEIATTNPVATEGYGTVCSATGGEPSENFEGGNG

SEQ ID NO: 178277 - protein, 31 aa, Artificial Sequence
  Description of Artificial Sequence: Synthetic polypeptide
EEVEIATTNPVAYEKWGCVYYSEDTNQHEDA

SEQ ID NO: 178278 - protein, 37 aa, Artificial Sequence
  Description of Artificial Sequence: Synthetic polypeptide
DEEEIRTTNPVATEGYGCVCSNTEEHNAENFNSDNQS

SEQ ID NO: 178279 - protein, 36 aa, Artificial Sequence
  Description of Artificial Sequence: Synthetic polypeptide
DENEIRTTNPVATEIYGQCVCSWGELNQENFGSDQS

SEQ ID NO: 178280 - protein, 32 aa, Artificial Sequence
  Description of Artificial Sequence: Synthetic polypeptide
DDSEVASTNPVSTEGYGNVSANITIQDRVGQG

SEQ ID NO: 178281 - protein, 30 aa, Artificial Sequence
  Description of Artificial Sequence: Synthetic polypeptide
EEVEIATTNPVAYERWGCVYECLQHNEEAE

SEQ ID NO: 178282 - protein, 37 aa, Artificial Sequence
  Description of Artificial Sequence: Synthetic polypeptide
DDEEIRTTNPVATEQYGSVVSAGGDQNDGEGEEGFEM

SEQ ID NO: 178283 - protein, 34 aa, Artificial Sequence
  Description of Artificial Sequence: Synthetic polypeptide
AEAEIRTTNPVATEQYGSTYTWLMESMESIEDQM

SEQ ID NO: 178284 - protein, 35 aa, Artificial Sequence
  Description of Artificial Sequence: Synthetic polypeptide
SECEIACTNPVATEQYGSVYCTWNDQHHQGHVGQE

SEQ ID NO: 178285 - protein, 35 aa, Artificial Sequence
  Description of Artificial Sequence: Synthetic polypeptide
EEVEIRCTNPTAYEQWGSTVYGENDLDQRDGDNKI

SEQ ID NO: 178286 - protein, 35 aa, Artificial Sequence
  Description of Artificial Sequence: Synthetic polypeptide
AEAEIRTTNPVATEQYGCVCSWGEDNAENFNSDQA

SEQ ID NO: 178287 - protein, 37 aa, Artificial Sequence
  Description of Artificial Sequence: Synthetic polypeptide
DDEEIRTTNPVATEQYGSVVQTDDPEMVEQGGGGGED

SEQ ID NO: 178288 - protein, 39 aa, Artificial Sequence
  Description of Artificial Sequence: Synthetic polypeptide
DEEEIRTTNPVATEQYGSAVGSHPWLNLENTTQQEELFQ

SEQ ID NO: 178289 - protein, 38 aa, Artificial Sequence
  Description of Artificial Sequence: Synthetic polypeptide
DEEEIRTTNPVATEQYGSAVILPLWSPQNQENINPVND

SEQ ID NO: 178290 - protein, 34 aa, Artificial Sequence
  Description of Artificial Sequence: Synthetic polypeptide
DESEIATTNPVATEHWGSVCYNNDDQDHDDQDRG

SEQ ID NO: 178291 - protein, 36 aa, Artificial Sequence
  Description of Artificial Sequence: Synthetic polypeptide
SEAEIRTTNPVATEQYGSVYEFHVDNQMESTQFEER

SEQ ID NO: 178292 - protein, 37 aa, Artificial Sequence
  Description of Artificial Sequence: Synthetic polypeptide
SEAEIRTTNPVATEQYGSVSTMEDCLNEPGYMQEPID

SEQ ID NO: 178293 - protein, 37 aa, Artificial Sequence
  Description of Artificial Sequence: Synthetic polypeptide
DEEEIRTTNPVATEQYGCVCGNTGEHNQENFNSDTQS

SEQ ID NO: 178294 - protein, 36 aa, Artificial Sequence
  Description of Artificial Sequence: Synthetic polypeptide
SEAEIRTTNPVATEQYGSVCPTTLYLQDFPDDVQIE

SEQ ID NO: 178295 - protein, 39 aa, Artificial Sequence
  Description of Artificial Sequence: Synthetic polypeptide
DDEEIRTTNPVATEQYGSVVNSTTSGNMDQTDQGGGGQG

SEQ ID NO: 178296 - protein, 35 aa, Artificial Sequence
  Description of Artificial Sequence: Synthetic polypeptide
SEAEIRTTNPVATEQYGSSYTAVWQDAIIGEYPQE

SEQ ID NO: 178297 - protein, 34 aa, Artificial Sequence
  Description of Artificial Sequence: Synthetic polypeptide
TTAEIATTNPVAYECWGSVTNGGLNDDRQRQGNH

SEQ ID NO: 178298 - protein, 35 aa, Artificial Sequence
  Description of Artificial Sequence: Synthetic polypeptide
SEAEIRTTNPVATEQYGSITPTMQDDNTTEGDTDN

SEQ ID NO: 178299 - protein, 35 aa, Artificial Sequence
  Description of Artificial Sequence: Synthetic polypeptide
AEAEIRTTNPVATEAYGCTVWCQGNSDQVIGGNTS

SEQ ID NO: 178300 - protein, 33 aa, Artificial Sequence
  Description of Artificial Sequence: Synthetic polypeptide
EGEEIATTNPVAYEQWGSVMWTEGDQKGDTTEP

SEQ ID NO: 178301 - protein, 35 aa, Artificial Sequence
  Description of Artificial Sequence: Synthetic polypeptide
DESEIATTNPVATEGYGTVCSATGHEVSEFEGGND

SEQ ID NO: 178302 - protein, 36 aa, Artificial Sequence
  Description of Artificial Sequence: Synthetic polypeptide
DEQEIATTNPVATEQWGSVSANGDMGEDHQGGEDHH

SEQ ID NO: 178303 - protein, 33 aa, Artificial Sequence
  Description of Artificial Sequence: Synthetic polypeptide
EESEIATTNPVATAHWGSVCTWEDQQRDTHNMQ

SEQ ID NO: 178304 - protein, 36 aa, Artificial Sequence
  Description of Artificial Sequence: Synthetic polypeptide
CEEEISTTNPVATEQYGQCVCSNTEHNQNFGSQTQS

SEQ ID NO: 178305 - protein, 36 aa, Artificial Sequence
  Description of Artificial Sequence: Synthetic polypeptide
DECEIATTNPVAYEQYGTVCSYTDGLNEEHRPGQDD

SEQ ID NO: 178306 - protein, 37 aa, Artificial Sequence
  Description of Artificial Sequence: Synthetic polypeptide
EEETICTTNPVATEQYGVVSTVVNNQNQQLQGTNQGD

SEQ ID NO: 178307 - protein, 36 aa, Artificial Sequence
  Description of Artificial Sequence: Synthetic polypeptide
SEECIRTTNPVATEQYGCVCSWGEENAENFGSENQS

SEQ ID NO: 178308 - protein, 33 aa, Artificial Sequence
  Description of Artificial Sequence: Synthetic polypeptide
DDSEVASTNPVSTEGYGNVCSANTIVQSRVGQR

SEQ ID NO: 178309 - protein, 37 aa, Artificial Sequence
  Description of Artificial Sequence: Synthetic polypeptide
DDEEIRTTNPVATEQYGSVYGQGQGDLEVGNGGEEQL

SEQ ID NO: 178310 - protein, 35 aa, Artificial Sequence
  Description of Artificial Sequence: Synthetic polypeptide
VEDEIATTNPVATEPYGSVCAGNNLTTAGGDNEQN

SEQ ID NO: 178311 - protein, 35 aa, Artificial Sequence
  Description of Artificial Sequence: Synthetic polypeptide
DEAEIATTNPVATCQYGCVCSTTGAHNANFGSDQS

SEQ ID NO: 178312 - protein, 30 aa, Artificial Sequence
  Description of Artificial Sequence: Synthetic polypeptide
EEGEIATTNPVAYECWGCVYYGEHLQHEHA

SEQ ID NO: 178313 - protein, 32 aa, Artificial Sequence
  Description of Artificial Sequence: Synthetic polypeptide
SEECIRCTNPIATEQYGCVCSWEHANFGSDQS

SEQ ID NO: 178314 - protein, 37 aa, Artificial Sequence
  Description of Artificial Sequence: Synthetic polypeptide
DESEIRTTNPVATEQYGSVYVTYDVSHLERPQHVQYG

SEQ ID NO: 178315 - protein, 32 aa, Artificial Sequence
  Description of Artificial Sequence: Synthetic polypeptide
DDSEVASTNPVSTEGYGNVCYNTDIQDRSGQR

SEQ ID NO: 178316 - protein, 36 aa, Artificial Sequence
  Description of Artificial Sequence: Synthetic polypeptide
EEGEIRTTNPVATEQYGSSSHPNEMEYLENQNEETL

SEQ ID NO: 178317 - protein, 35 aa, Artificial Sequence
  Description of Artificial Sequence: Synthetic polypeptide
DEQEIATTNPVATEQWGSVSATGDMADHGGGEDLK

SEQ ID NO: 178318 - protein, 34 aa, Artificial Sequence
  Description of Artificial Sequence: Synthetic polypeptide
DESEIRTTNPVAYEHWGITVSCANSSSDRHVGMV

SEQ ID NO: 178319 - protein, 36 aa, Artificial Sequence
  Description of Artificial Sequence: Synthetic polypeptide
DEEEIRCTNPVATEQYGQCVCSWNHNDEHFGSDTQS

SEQ ID NO: 178320 - protein, 36 aa, Artificial Sequence
  Description of Artificial Sequence: Synthetic polypeptide
DEEEIRTTNPVATEGYGCSCSWGPDNQEYFNSDTQA

SEQ ID NO: 178321 - protein, 35 aa, Artificial Sequence
  Description of Artificial Sequence: Synthetic polypeptide
DESEIRTTNPVAYEHWGISVTCANESSSDREGGNV

SEQ ID NO: 178322 - protein, 33 aa, Artificial Sequence
  Description of Artificial Sequence: Synthetic polypeptide
DEAEISTTNPVAYEQYGCICSTNHNENFPSDQA

SEQ ID NO: 178323 - protein, 34 aa, Artificial Sequence
  Description of Artificial Sequence: Synthetic polypeptide
EEMEIRTTNPVATEQYGCVSCPQLMEDSESSQEE

SEQ ID NO: 178324 - protein, 36 aa, Artificial Sequence
  Description of Artificial Sequence: Synthetic polypeptide
DEQEIATTNPVATEQWGSVSATGDLEADTEGDEDAW

SEQ ID NO: 178325 - protein, 35 aa, Artificial Sequence
  Description of Artificial Sequence: Synthetic polypeptide
DESEIRTTNPVAYEHWGISVSCQNSSSDREGGMMV

SEQ ID NO: 178326 - protein, 37 aa, Artificial Sequence
  Description of Artificial Sequence: Synthetic polypeptide
DEEEIRCTNPVATEQYGQCVCSMTGEDNQGFGSQTQS

SEQ ID NO: 178327 - protein, 37 aa, Artificial Sequence
  Description of Artificial Sequence: Synthetic polypeptide
DESEIATTNPVATEQYGCVTAATANGLQPADPPNVNF

SEQ ID NO: 178328 - protein, 30 aa, Artificial Sequence
  Description of Artificial Sequence: Synthetic polypeptide
DDSEVASTNPVCTEGYGVVADTIQSRVGQQ

SEQ ID NO: 178329 - protein, 35 aa, Artificial Sequence
  Description of Artificial Sequence: Synthetic polypeptide
DESEIRTTNPVAYEGWGCVCSWMNENQEHFGSNQS

SEQ ID NO: 178330 - protein, 37 aa, Artificial Sequence
  Description of Artificial Sequence: Synthetic polypeptide
DESEIATTNPVATEQYGCVTAANANGLQPADQPGNNN

SEQ ID NO: 178331 - protein, 37 aa, Artificial Sequence
  Description of Artificial Sequence: Synthetic polypeptide
EEETICTTNPVATEQYGTVSTVNNLQNQLQQGTTQDD

SEQ ID NO: 178332 - protein, 34 aa, Artificial Sequence
  Description of Artificial Sequence: Synthetic polypeptide
DEAEIATTNPVATCQYGCVCSWAHNQEYFGSEQA

SEQ ID NO: 178333 - protein, 32 aa, Artificial Sequence
  Description of Artificial Sequence: Synthetic polypeptide
CEEEIACTNPVATEQYGCAPIGHGQDSEGETM

SEQ ID NO: 178334 - protein, 36 aa, Artificial Sequence
  Description of Artificial Sequence: Synthetic polypeptide
CEEEISTTNPVATEQYGCVCSTGNHNAENFNSETQT

SEQ ID NO: 178335 - protein, 35 aa, Artificial Sequence
  Description of Artificial Sequence: Synthetic polypeptide
CEEEISTTNPVATEQYGCVCSNWGELANFGSETQT

SEQ ID NO: 178336 - protein, 35 aa, Artificial Sequence
  Description of Artificial Sequence: Synthetic polypeptide
DEEEIRTTNPVATEQYGSANSGIWVDDDDSEIDMG

SEQ ID NO: 178337 - protein, 36 aa, Artificial Sequence
  Description of Artificial Sequence: Synthetic polypeptide
DEAEIATTNPIATEQWGSIVPTNNWDQHEHGQNGAD

SEQ ID NO: 178338 - protein, 38 aa, Artificial Sequence
  Description of Artificial Sequence: Synthetic polypeptide
DEEEIRTTNPVATEQYGSANSPTTNIENTTSVMEENAF

SEQ ID NO: 178339 - protein, 37 aa, Artificial Sequence
  Description of Artificial Sequence: Synthetic polypeptide
DEEEIRTTNPVATEQYGSANSPTTTEGMEMEGSQFLQ

SEQ ID NO: 178340 - protein, 38 aa, Artificial Sequence
  Description of Artificial Sequence: Synthetic polypeptide
DEEEIRTTNPVATEQYGSANTPTTPLENTTSVGEENAS

SEQ ID NO: 178341 - protein, 37 aa, Artificial Sequence
  Description of Artificial Sequence: Synthetic polypeptide
DEEEIRTTNPVATEQYGSANWEANPDDLGGSMQEEIG

SEQ ID NO: 178342 - protein, 37 aa, Artificial Sequence
  Description of Artificial Sequence: Synthetic polypeptide
DEEEIRTTNPVATEQYGSANWEANPDDLNGSGQEEEG

SEQ ID NO: 178343 - protein, 36 aa, Artificial Sequence
  Description of Artificial Sequence: Synthetic polypeptide
DEEEIRTTNPVATEQYGSANYEANPDDEDSGQEEIG

SEQ ID NO: 178344 - protein, 37 aa, Artificial Sequence
  Description of Artificial Sequence: Synthetic polypeptide
DEEEIRTTNPVATEQYGSAPESQVSLWPHTVGEPDYD

SEQ ID NO: 178345 - protein, 34 aa, Artificial Sequence
  Description of Artificial Sequence: Synthetic polypeptide
DEAEIATTNPIATEQWGSIVPTWWDQHEHMTNDS

SEQ ID NO: 178346 - protein, 34 aa, Artificial Sequence
  Description of Artificial Sequence: Synthetic polypeptide
DEAEIATTNPIAYEQWGSIVPTNWDQHEHGQDGH

SEQ ID NO: 178347 - protein, 34 aa, Artificial Sequence
  Description of Artificial Sequence: Synthetic polypeptide
TTAEIATTNPVATECYGSVSGGLNDDRQHQNNDD

SEQ ID NO: 178348 - protein, 36 aa, Artificial Sequence
  Description of Artificial Sequence: Synthetic polypeptide
YEEEIRTTNPVATEQYGSCGTVTDGDTGQGGEQEGE

SEQ ID NO: 178349 - protein, 37 aa, Artificial Sequence
  Description of Artificial Sequence: Synthetic polypeptide
DEEEIRTTNPVATEQYGSAQLTFGEIQEINTIEMNTN

SEQ ID NO: 178350 - protein, 37 aa, Artificial Sequence
  Description of Artificial Sequence: Synthetic polypeptide
DEEEIRTTNPVATEGYGCSCSNWGETNQEYFNSDTQA

SEQ ID NO: 178351 - protein, 36 aa, Artificial Sequence
  Description of Artificial Sequence: Synthetic polypeptide
DESEIATTNPVATEQYGSACAATNPQEVDDDGMGDD

SEQ ID NO: 178352 - protein, 36 aa, Artificial Sequence
  Description of Artificial Sequence: Synthetic polypeptide
EEETICTTNPVATEAYGVVSTVVNQQQLQQGTQQED

SEQ ID NO: 178353 - protein, 32 aa, Artificial Sequence
  Description of Artificial Sequence: Synthetic polypeptide
CEEEIACTNPVATEQYGCAPGMHGQDSEGEDA

SEQ ID NO: 178354 - protein, 33 aa, Artificial Sequence
  Description of Artificial Sequence: Synthetic polypeptide
DEAEIATTNPVATCQYGCVCSSAHNQNFISDQS

SEQ ID NO: 178355 - protein, 35 aa, Artificial Sequence
  Description of Artificial Sequence: Synthetic polypeptide
DEAEIATTNPVATCQYGCVCSTAHNAENFGSDTQS

SEQ ID NO: 178356 - protein, 34 aa, Artificial Sequence
  Description of Artificial Sequence: Synthetic polypeptide
TTAEIATTNPVATTQWGSVAWTENGDQDNGKNTT

SEQ ID NO: 178357 - protein, 38 aa, Artificial Sequence
  Description of Artificial Sequence: Synthetic polypeptide
YEEEIRTTNPVATEQYGSVDPNTQNEGDQQEGGDQEGG

SEQ ID NO: 178358 - protein, 35 aa, Artificial Sequence
  Description of Artificial Sequence: Synthetic polypeptide
CEEEISTTNPVATEQYGCVCSTGEDAENFGSETQA

SEQ ID NO: 178359 - protein, 35 aa, Artificial Sequence
  Description of Artificial Sequence: Synthetic polypeptide
CEEEISTTNPVATEQYGCVCSTGEDHAENFGSDQS

SEQ ID NO: 178360 - protein, 36 aa, Artificial Sequence
  Description of Artificial Sequence: Synthetic polypeptide
YEEEIRTTNPVATEQYGSVDTGGDTGDDDEGDGEEG

SEQ ID NO: 178361 - protein, 35 aa, Artificial Sequence
  Description of Artificial Sequence: Synthetic polypeptide
VEDEIACTNPVAYEQYGSVCSTNPQQEHQDGTAQK

SEQ ID NO: 178362 - protein, 36 aa, Artificial Sequence
  Description of Artificial Sequence: Synthetic polypeptide
VEDEIACTNPVAYEQYGSVCATNPMLQEHQDGNQHE

SEQ ID NO: 178363 - protein, 32 aa, Artificial Sequence
  Description of Artificial Sequence: Synthetic polypeptide
DDSEVASTNPVSTEGYGNVFENTIQSRSGERN

SEQ ID NO: 178364 - protein, 35 aa, Artificial Sequence
  Description of Artificial Sequence: Synthetic polypeptide
SEDEIRTTNPVAYEQWGSVAGTGAPGEEQRQGGDA

SEQ ID NO: 178365 - protein, 37 aa, Artificial Sequence
  Description of Artificial Sequence: Synthetic polypeptide
DDEEIRTTNPVATEQYGSVVSAGVDQNDGEGEEGDTG

SEQ ID NO: 178366 - protein, 36 aa, Artificial Sequence
  Description of Artificial Sequence: Synthetic polypeptide
DEEEIRTTNPVATEVYGSVMGQNMEDETGGEEVEFE

SEQ ID NO: 178367 - protein, 33 aa, Artificial Sequence
  Description of Artificial Sequence: Synthetic polypeptide
EENEIRTTNPVSTEPYGTISMEDIQQQQNGNQH

SEQ ID NO: 178368 - protein, 34 aa, Artificial Sequence
  Description of Artificial Sequence: Synthetic polypeptide
CEEEIACTNPVATEQYGCTAATENLTADIGGEDM

SEQ ID NO: 178369 - protein, 32 aa, Artificial Sequence
  Description of Artificial Sequence: Synthetic polypeptide
EENEIRTTNPVSVEPYGTISMEDIQQQQNGNH

SEQ ID NO: 178370 - protein, 33 aa, Artificial Sequence
  Description of Artificial Sequence: Synthetic polypeptide
TTAEIATTNPVAYECWGSVSGGLNDDRQSDGNH

SEQ ID NO: 178371 - protein, 32 aa, Artificial Sequence
  Description of Artificial Sequence: Synthetic polypeptide
EENEITTTNPVSTEPYGTISMEDIQQQQNGNH

SEQ ID NO: 178372 - protein, 36 aa, Artificial Sequence
  Description of Artificial Sequence: Synthetic polypeptide
DEEEIRTTNPVATEVYGSVMGQGMEDETGGEENEGE

SEQ ID NO: 178373 - protein, 36 aa, Artificial Sequence
  Description of Artificial Sequence: Synthetic polypeptide
DEEEIRTTNPVATEVYGSVMGMNMEDETGGEEDEGE

SEQ ID NO: 178374 - protein, 34 aa, Artificial Sequence
  Description of Artificial Sequence: Synthetic polypeptide
EEPEIRTTNPVATDQYGSVNIMQQEVHMQANSDN

SEQ ID NO: 178375 - protein, 33 aa, Artificial Sequence
  Description of Artificial Sequence: Synthetic polypeptide
EEPEIRTTNPVATEQWGDCVSVIEQMIAVTDAK

SEQ ID NO: 178376 - protein, 38 aa, Artificial Sequence
  Description of Artificial Sequence: Synthetic polypeptide
DDEEIRTTNPVATEQYGSVVSAGVDQNDDEGEEGNTEG

SEQ ID NO: 178377 - protein, 35 aa, Artificial Sequence
  Description of Artificial Sequence: Synthetic polypeptide
DEEEIRTTNPVATETYGSVSVYDSHDSSIDEEMFL

SEQ ID NO: 178378 - protein, 33 aa, Artificial Sequence
  Description of Artificial Sequence: Synthetic polypeptide
VEDEIACTNPVAYEQYGCVATNLAEAPGSIDDN

SEQ ID NO: 178379 - protein, 36 aa, Artificial Sequence
  Description of Artificial Sequence: Synthetic polypeptide
SEDEIRTTNPVATECYGCVCTIDSNNMNGQQGGDNP

SEQ ID NO: 178380 - protein, 38 aa, Artificial Sequence
  Description of Artificial Sequence: Synthetic polypeptide
DEEEIRTTNPVATEPYGSSTVCFVTNAISTDTGGNQFH

SEQ ID NO: 178381 - protein, 37 aa, Artificial Sequence
  Description of Artificial Sequence: Synthetic polypeptide
DEEEIRCTNPVATEQYGCVTSTWPAHNAEHFGSDPQS

SEQ ID NO: 178382 - protein, 36 aa, Artificial Sequence
  Description of Artificial Sequence: Synthetic polypeptide
DEEEIRTTNPVATETYGSVSVYDNIHDSSIDSEMFL

SEQ ID NO: 178383 - protein, 34 aa, Artificial Sequence
  Description of Artificial Sequence: Synthetic polypeptide
EESAEIATTNPVAYECWGSVYCTEIQQGNDGQDR

SEQ ID NO: 178384 - protein, 35 aa, Artificial Sequence
  Description of Artificial Sequence: Synthetic polypeptide
DEAEIATTNPVATECWGMHCWTMNEQQRGEDNHMP

SEQ ID NO: 178385 - protein, 35 aa, Artificial Sequence
  Description of Artificial Sequence: Synthetic polypeptide
DEAEIATTNPVATECWGMHCWTMNEQQRGQDQDKR

SEQ ID NO: 178386 - protein, 33 aa, Artificial Sequence
  Description of Artificial Sequence: Synthetic polypeptide
EESEIAATNPVATAHWGSVCTWEDQQRQEHGMR

SEQ ID NO: 178387 - protein, 34 aa, Artificial Sequence
  Description of Artificial Sequence: Synthetic polypeptide
SEDEIRCTNPTAYEPYGSTVPSTPALSVDGGNPS

SEQ ID NO: 178388 - protein, 30 aa, Artificial Sequence
  Description of Artificial Sequence: Synthetic polypeptide
EESEIASTNPVGTEGWGVCAPTDLQHGDDA

SEQ ID NO: 178389 - protein, 33 aa, Artificial Sequence
  Description of Artificial Sequence: Synthetic polypeptide
EENEIRTTNPVATEQWGYDVSVIEQMNAAEVDT

SEQ ID NO: 178390 - protein, 37 aa, Artificial Sequence
  Description of Artificial Sequence: Synthetic polypeptide
DDEEIRTTNPVATEQYGSVVSGGFNGEFTGETGEGQG

SEQ ID NO: 178391 - protein, 35 aa, Artificial Sequence
  Description of Artificial Sequence: Synthetic polypeptide
SEDEIRTTNPVAYEQWGSVCSTEQDQAEDTQNGDA

SEQ ID NO: 178392 - protein, 35 aa, Artificial Sequence
  Description of Artificial Sequence: Synthetic polypeptide
DEAEIATTNPVATCQYGQCVCSSGALNQNFGSDQS

SEQ ID NO: 178393 - protein, 32 aa, Artificial Sequence
  Description of Artificial Sequence: Synthetic polypeptide
DDSEVASTNPVSTEGYGNVGAANTIQSRVGQR

SEQ ID NO: 178394 - protein, 31 aa, Artificial Sequence
  Description of Artificial Sequence: Synthetic polypeptide
DDSEVASTNPVCTEGYGVVAANTIQSRVGQQ

SEQ ID NO: 178395 - protein, 31 aa, Artificial Sequence
  Description of Artificial Sequence: Synthetic polypeptide
DDSEVASTNPVSTEGYGNVMAGTIQSRVGER

SEQ ID NO: 178396 - protein, 36 aa, Artificial Sequence
  Description of Artificial Sequence: Synthetic polypeptide
DESEIATTNPVATEQYGCVAADHNDNNQTAGGEGRH

SEQ ID NO: 178397 - protein, 36 aa, Artificial Sequence
  Description of Artificial Sequence: Synthetic polypeptide
DDEEIRTTNPVATEQYGSVVYDGMFGELGDQEEDDG

SEQ ID NO: 178398 - protein, 35 aa, Artificial Sequence
  Description of Artificial Sequence: Synthetic polypeptide
EENEIATTNPVATEQYGCVAANNNLNTMNPGTPRA

SEQ ID NO: 178399 - protein, 38 aa, Artificial Sequence
  Description of Artificial Sequence: Synthetic polypeptide
DDEEIRTTNPVATEQYGSVVVSAGVDQNDGEGETGNEG

SEQ ID NO: 178400 - protein, 30 aa, Artificial Sequence
  Description of Artificial Sequence: Synthetic polypeptide
EENEIATTNPVAYECWGCVAECLQHEQEAG

SEQ ID NO: 178401 - protein, 34 aa, Artificial Sequence
  Description of Artificial Sequence: Synthetic polypeptide
CEEEISTTNPVATEQYGCVCSWGEHAENFNSDQS

SEQ ID NO: 178402 - protein, 30 aa, Artificial Sequence
  Description of Artificial Sequence: Synthetic polypeptide
EENEIATTNPVAYECWGCVYECLQHQEEAT

SEQ ID NO: 178403 - protein, 29 aa, Artificial Sequence
  Description of Artificial Sequence: Synthetic peptide
EENEIATTNPVAYECWGCVYYEHIQHKEA

SEQ ID NO: 178404 - protein, 35 aa, Artificial Sequence
  Description of Artificial Sequence: Synthetic polypeptide
CEEEISTTNPVATEQYGCVCSWGEHNAENFNSDQD

SEQ ID NO: 178405 - protein, 35 aa, Artificial Sequence
  Description of Artificial Sequence: Synthetic polypeptide
AEAEIATTNPVAYEQWGSVYGGWNDDQPMGNRGQQ

SEQ ID NO: 178406 - protein, 37 aa, Artificial Sequence
  Description of Artificial Sequence: Synthetic polypeptide
DDEEIRTTNPVATEQYGSVVVAGVDQNDGEGEEGNEI

SEQ ID NO: 178407 - protein, 34 aa, Artificial Sequence
  Description of Artificial Sequence: Synthetic polypeptide
SEEAIRTTNPVATEQYGCMNTSVLETTYPENKEA

SEQ ID NO: 178408 - protein, 32 aa, Artificial Sequence
  Description of Artificial Sequence: Synthetic polypeptide
DDSEVASTNPVSTEGYGNVPAANTIQSRQGQR

SEQ ID NO: 178409 - protein, 32 aa, Artificial Sequence
  Description of Artificial Sequence: Synthetic polypeptide
EENEIGTTNPVSTEPYGTISMIDIQVQQNGNH

SEQ ID NO: 178410 - protein, 32 aa, Artificial Sequence
  Description of Artificial Sequence: Synthetic polypeptide
EENEIHTTNPVSTEPYGTISMEDIQQQQNGNH

SEQ ID NO: 178411 - protein, 37 aa, Artificial Sequence
  Description of Artificial Sequence: Synthetic polypeptide
DEEEIRTTNPVATEVYGSVSDGQGENFGNDDTGEAGQ

SEQ ID NO: 178412 - protein, 34 aa, Artificial Sequence
  Description of Artificial Sequence: Synthetic polypeptide
SEDEVATTNPVAYEQWGSTCSTWEHLDYRVGGND

SEQ ID NO: 178413 - protein, 33 aa, Artificial Sequence
  Description of Artificial Sequence: Synthetic polypeptide
EENEIRTTNPVATDQYGSVNIMQAEVHQQAQSD

SEQ ID NO: 178414 - protein, 34 aa, Artificial Sequence
  Description of Artificial Sequence: Synthetic polypeptide
EENEIRTTNPVATDQYGSVNIMQQEVHQQANSDQ

SEQ ID NO: 178415 - protein, 35 aa, Artificial Sequence
  Description of Artificial Sequence: Synthetic polypeptide
DEAEIRTTNPVATEGWGCVCSWMNENQESFGSDQS

SEQ ID NO: 178416 - protein, 37 aa, Artificial Sequence
  Description of Artificial Sequence: Synthetic polypeptide
DEEEIRTTNPVATEVYGSVSDGMGENSGNFDTGEAGQ

SEQ ID NO: 178417 - protein, 35 aa, Artificial Sequence
  Description of Artificial Sequence: Synthetic polypeptide
EENEIRTTNPVATDQYGSVNTTMQQAQVQQANSDH

SEQ ID NO: 178418 - protein, 32 aa, Artificial Sequence
  Description of Artificial Sequence: Synthetic polypeptide
DDSEVASTNPVSTEGYGNVPAANTIQSRVGQR

SEQ ID NO: 178419 - protein, 32 aa, Artificial Sequence
  Description of Artificial Sequence: Synthetic polypeptide
DDSEVASTNPVSTEGYGNVNAANTGQSRVGQR

SEQ ID NO: 178420 - protein, 36 aa, Artificial Sequence
  Description of Artificial Sequence: Synthetic polypeptide
DEAEIATTNPVATEPWGSVCPTDNDNQDQGGQNGSS

SEQ ID NO: 178421 - protein, 35 aa, Artificial Sequence
  Description of Artificial Sequence: Synthetic polypeptide
AEAEIATTNPVAYEQWGSVYGGINDDQPQGNRGQV

SEQ ID NO: 178422 - protein, 37 aa, Artificial Sequence
  Description of Artificial Sequence: Synthetic polypeptide
DEAEIRTTNPVATECYGSVNYTATNLEEPNNVQEDPN

SEQ ID NO: 178423 - protein, 35 aa, Artificial Sequence
  Description of Artificial Sequence: Synthetic polypeptide
DEEEIRTTNPVATEQYGSAYYPIPDKESDGEEEED

SEQ ID NO: 178424 - protein, 32 aa, Artificial Sequence
  Description of Artificial Sequence: Synthetic polypeptide
FEEEIGSVNPVSTEQYGVVSVNTQGQQQPQQG

SEQ ID NO: 178425 - protein, 34 aa, Artificial Sequence
  Description of Artificial Sequence: Synthetic polypeptide
FEEEIGSVNPVSTEQYGVVSVNTQGQWQGPNPQG

SEQ ID NO: 178426 - protein, 38 aa, Artificial Sequence
  Description of Artificial Sequence: Synthetic polypeptide
DEEEIRTTNPVATEQYGSAYYSPTTNENTTSVEEENQA

SEQ ID NO: 178427 - protein, 33 aa, Artificial Sequence
  Description of Artificial Sequence: Synthetic polypeptide
DEQEIATTNPVATECWGAVWAATDLAEHEGPDI

SEQ ID NO: 178428 - protein, 34 aa, Artificial Sequence
  Description of Artificial Sequence: Synthetic polypeptide
DECEIATTNPVAYECWGSVCPTDNHDTQQNDHNQ

SEQ ID NO: 178429 - protein, 40 aa, Artificial Sequence
  Description of Artificial Sequence: Synthetic polypeptide
DEEEIRTTNPVATESYGTVTTGQSNTISTNNTQQQEVGNR

SEQ ID NO: 178430 - protein, 36 aa, Artificial Sequence
  Description of Artificial Sequence: Synthetic polypeptide
FEEEIRATNPVATEQYGSVMGNFNNNNEQQGQEEFE

SEQ ID NO: 178431 - protein, 38 aa, Artificial Sequence
  Description of Artificial Sequence: Synthetic polypeptide
DEEEIRTTNPVATEQYGSAYYSPTTNEVTTSVNEENQF

SEQ ID NO: 178432 - protein, 33 aa, Artificial Sequence
  Description of Artificial Sequence: Synthetic polypeptide
DENEIRTTNPVATEGWGCVCSSAEANAFNSDAS

SEQ ID NO: 178433 - protein, 35 aa, Artificial Sequence
  Description of Artificial Sequence: Synthetic polypeptide
DECEIATTNPVAYECWGSVATTGGNTGNAGNDNQR

SEQ ID NO: 178434 - protein, 32 aa, Artificial Sequence
  Description of Artificial Sequence: Synthetic polypeptide
SDECIATTNPVAYEQWGGVCSTWEDHQQDVNS

SEQ ID NO: 178435 - protein, 33 aa, Artificial Sequence
  Description of Artificial Sequence: Synthetic polypeptide
SDECIATTNPVATEQWGWVCSTWEDHQQQQNLQ

SEQ ID NO: 178436 - protein, 35 aa, Artificial Sequence
  Description of Artificial Sequence: Synthetic polypeptide
FEEEIRATNPVATEQYGSVVMNGFNGGGFDGETID

SEQ ID NO: 178437 - protein, 33 aa, Artificial Sequence
  Description of Artificial Sequence: Synthetic polypeptide
SDECIATTNPVATEQWGQVCSTWEDHQQQQNNL

SEQ ID NO: 178438 - protein, 36 aa, Artificial Sequence
  Description of Artificial Sequence: Synthetic polypeptide
FEEEIRATNPVATEQYGSVYGDGNNLIFEGQGELEV

SEQ ID NO: 178439 - protein, 35 aa, Artificial Sequence
  Description of Artificial Sequence: Synthetic polypeptide
DENEIRTTNPVATEFYGTVMNDQNVGGQGELEGEI

SEQ ID NO: 178440 - protein, 33 aa, Artificial Sequence
  Description of Artificial Sequence: Synthetic polypeptide
DEQEIATTNPVATECWGAVWAATDLAEPEGPDI

SEQ ID NO: 178441 - protein, 37 aa, Artificial Sequence
  Description of Artificial Sequence: Synthetic polypeptide
DENEIRTTNPVATEFYGSVVGDGNNEQNVGENGEQMT

SEQ ID NO: 178442 - protein, 37 aa, Artificial Sequence
  Description of Artificial Sequence: Synthetic polypeptide
DENEIRTTNPVATEFYGSVVGDGINEQNVGENGEGMQ

SEQ ID NO: 178443 - protein, 40 aa, Artificial Sequence
  Description of Artificial Sequence: Synthetic polypeptide
DEEEIRTTNPVATESYGTVTTGQSGVTISTNTQMTEVGNP

SEQ ID NO: 178444 - protein, 32 aa, Artificial Sequence
  Description of Artificial Sequence: Synthetic polypeptide
DDSEVASTNPVSTEGYGNVSATDLESHEGEDR

SEQ ID NO: 178445 - protein, 34 aa, Artificial Sequence
  Description of Artificial Sequence: Synthetic polypeptide
DECEIATTNPVAYECWGCVSGWNGEERNNMNGNA

SEQ ID NO: 178446 - protein, 33 aa, Artificial Sequence
  Description of Artificial Sequence: Synthetic polypeptide
DEQEIATTNPVATECWGAVWAATDLAEPKGPDI

SEQ ID NO: 178447 - protein, 33 aa, Artificial Sequence
  Description of Artificial Sequence: Synthetic polypeptide
SDECIATTNPVATEQWGKVCSTWEDHQGQQNQE

SEQ ID NO: 178448 - protein, 35 aa, Artificial Sequence
  Description of Artificial Sequence: Synthetic polypeptide
DEECISTTNPVATEGYGCVCNTEALNQEYFGSQQS

SEQ ID NO: 178449 - protein, 33 aa, Artificial Sequence
  Description of Artificial Sequence: Synthetic polypeptide
SDECIATTNPVATEQWGKVCSTWEDGQQQQNEE

SEQ ID NO: 178450 - protein, 35 aa, Artificial Sequence
  Description of Artificial Sequence: Synthetic polypeptide
AEACIACTNPVATEQYGSVSWNEGEQERQRHNGEN

SEQ ID NO: 178451 - protein, 38 aa, Artificial Sequence
  Description of Artificial Sequence: Synthetic polypeptide
DEEEIRTTNPVATEQYGSAYVNGIVMESGDSLQDSIVM

SEQ ID NO: 178452 - protein, 39 aa, Artificial Sequence
  Description of Artificial Sequence: Synthetic polypeptide
DEEEIRTTNPVATESYGTVTTGQSVTISTTTQMQEEGNT

SEQ ID NO: 178453 - protein, 39 aa, Artificial Sequence
  Description of Artificial Sequence: Synthetic polypeptide
DEEEIRTTNPVATESYGTVTTGQSVTISTNTQMQEVGVT

SEQ ID NO: 178454 - protein, 37 aa, Artificial Sequence
  Description of Artificial Sequence: Synthetic polypeptide
FEDEIRTTNPVATEQYGSVNMDTDGQDQEDEGQNEGT

SEQ ID NO: 178455 - protein, 39 aa, Artificial Sequence
  Description of Artificial Sequence: Synthetic polypeptide
DEEEIRTTNPVATESYGTVTTGQSTTISTNTQMGEVGNT

SEQ ID NO: 178456 - protein, 33 aa, Artificial Sequence
  Description of Artificial Sequence: Synthetic polypeptide
DECEIATTNPVAYEEWGSVCPNDGQDQNHDNPM

SEQ ID NO: 178457 - protein, 36 aa, Artificial Sequence
  Description of Artificial Sequence: Synthetic polypeptide
DECEIATTNPVAYEEWGSVATNGGNTGNRGTNDNQR

SEQ ID NO: 178458 - protein, 38 aa, Artificial Sequence
  Description of Artificial Sequence: Synthetic polypeptide
DENEIRTTNPVATEGYGMVNNSGMGNNLQNNNGGNNQV

SEQ ID NO: 178459 - protein, 32 aa, Artificial Sequence
  Description of Artificial Sequence: Synthetic polypeptide
DDSEVASTNPVSTEGYGNVSATDLEDHEGEDR

SEQ ID NO: 178460 - protein, 39 aa, Artificial Sequence
  Description of Artificial Sequence: Synthetic polypeptide
DEEEIRTTNPVATESYGTVTTGQSNTISTNTQTGEVGND

SEQ ID NO: 178461 - protein, 39 aa, Artificial Sequence
  Description of Artificial Sequence: Synthetic polypeptide
DEEEIRTTNPVATESYGTVTTGQSNTISTNTQMTEVGNG

SEQ ID NO: 178462 - protein, 34 aa, Artificial Sequence
  Description of Artificial Sequence: Synthetic polypeptide
DEECISTTNPVATEGYGCVCNTEADNQYFGSEQS

SEQ ID NO: 178463 - protein, 33 aa, Artificial Sequence
  Description of Artificial Sequence: Synthetic polypeptide
DEECISTTNPVATEGYGCVCNTEADQYFISDQA

SEQ ID NO: 178464 - protein, 34 aa, Artificial Sequence
  Description of Artificial Sequence: Synthetic polypeptide
DEECISTTNPVATEGYGCVCNTEAHNAYFGSDQS

SEQ ID NO: 178465 - protein, 35 aa, Artificial Sequence
  Description of Artificial Sequence: Synthetic polypeptide
FEDEIRTTNPVATEQYGSVVDDNNMTMEFIGDGDI

SEQ ID NO: 178466 - protein, 36 aa, Artificial Sequence
  Description of Artificial Sequence: Synthetic polypeptide
FEDEIRTTNPVATEQYGSVVDDNNMTMEGQGDANED

SEQ ID NO: 178467 - protein, 35 aa, Artificial Sequence
  Description of Artificial Sequence: Synthetic polypeptide
DENEIRTTNPVATEGYGCVCSWGEHNQNFNSDTQS

SEQ ID NO: 178468 - protein, 36 aa, Artificial Sequence
  Description of Artificial Sequence: Synthetic polypeptide
FEDEIRTTNPVATEQYGSVVDTTDNNGEMDDNEEGL

SEQ ID NO: 178469 - protein, 36 aa, Artificial Sequence
  Description of Artificial Sequence: Synthetic polypeptide
DENEIRTTNPVATEGYGCVCSNWGELNQENFGSDQA

SEQ ID NO: 178470 - protein, 35 aa, Artificial Sequence
  Description of Artificial Sequence: Synthetic polypeptide
DECEIATTNPVAYEEWGSVATMGGNTGNAGNDHQR

SEQ ID NO: 178471 - protein, 35 aa, Artificial Sequence
  Description of Artificial Sequence: Synthetic polypeptide
DECEIATTNPVAYEEWGSVATEGNTGNANGNDNQR

SEQ ID NO: 178472 - protein, 35 aa, Artificial Sequence
  Description of Artificial Sequence: Synthetic polypeptide
DECEIATTNPVAYEEWGSVASGGNTGNAGPNDNQR

SEQ ID NO: 178473 - protein, 34 aa, Artificial Sequence
  Description of Artificial Sequence: Synthetic polypeptide
SDEEIRTTNPVATCQYGCVCSWEHNQNFGSDTQA

SEQ ID NO: 178474 - protein, 34 aa, Artificial Sequence
  Description of Artificial Sequence: Synthetic polypeptide
SDEEIRTTNPVATCQYGCVCSWEDNAYFGSDTQA

SEQ ID NO: 178475 - protein, 35 aa, Artificial Sequence
  Description of Artificial Sequence: Synthetic polypeptide
DEQEIATTNPVATDQYGSVNATGDGEDQEGEGDGG

SEQ ID NO: 178476 - protein, 39 aa, Artificial Sequence
  Description of Artificial Sequence: Synthetic polypeptide
DEEEIRTTNPVATESYGTVTTGQSNTISTNTQMQEVTNR

SEQ ID NO: 178477 - protein, 39 aa, Artificial Sequence
  Description of Artificial Sequence: Synthetic polypeptide
DEEEIRTTNPVATESYGTVTTGQSNTISTNTQMQEGGNP

SEQ ID NO: 178478 - protein, 34 aa, Artificial Sequence
  Description of Artificial Sequence: Synthetic polypeptide
SDECIATTNPVATEQWGEVCSTWEDHQQQQQNLR

SEQ ID NO: 178479 - protein, 38 aa, Artificial Sequence
  Description of Artificial Sequence: Synthetic polypeptide
FEEEIRGTNPVATEQYGSVNIFTNNDDQEEEGGNDIEQ

SEQ ID NO: 178480 - protein, 38 aa, Artificial Sequence
  Description of Artificial Sequence: Synthetic polypeptide
FEEEIRGTNPVATEQYGSVVIMTNPDGPNMQEGENDGD

SEQ ID NO: 178481 - protein, 36 aa, Artificial Sequence
  Description of Artificial Sequence: Synthetic polypeptide
DEEEIRTTNPVATEQYGSCAPEFWDDQIMQIGMVAD

SEQ ID NO: 178482 - protein, 36 aa, Artificial Sequence
  Description of Artificial Sequence: Synthetic polypeptide
DEEEIRTTNPVATEQYGSCAPEQTDVDQIMQTMVAD

SEQ ID NO: 178483 - protein, 36 aa, Artificial Sequence
  Description of Artificial Sequence: Synthetic polypeptide
FEEEIRTTNPVATEAYGSVNMGDQGGEETGGNNNDD

SEQ ID NO: 178484 - protein, 39 aa, Artificial Sequence
  Description of Artificial Sequence: Synthetic polypeptide
DEEEIRTTNPVATESYGTVTTGQSGTISTNTNMQEVGNP

SEQ ID NO: 178485 - protein, 35 aa, Artificial Sequence
  Description of Artificial Sequence: Synthetic polypeptide
FEEEIRTTNPVATEAYGSVVVDGFGQENDQDEDGT

SEQ ID NO: 178486 - protein, 37 aa, Artificial Sequence
  Description of Artificial Sequence: Synthetic polypeptide
DEEEIRTTNPVATEQYGSCAPEQTGLDQIAQSVMVAD

SEQ ID NO: 178487 - protein, 37 aa, Artificial Sequence
  Description of Artificial Sequence: Synthetic polypeptide
DEEEIRTTNPVATEQYGSCAPEQTGLDQIMQTLMVAD

SEQ ID NO: 178488 - protein, 36 aa, Artificial Sequence
  Description of Artificial Sequence: Synthetic polypeptide
FEEEIRTTNPVATEFYGSVNMDGGNTQGQQEGEGDG

SEQ ID NO: 178489 - protein, 37 aa, Artificial Sequence
  Description of Artificial Sequence: Synthetic polypeptide
DEEEIRTTNPVATEQYGSCAPEQTMLDQQAQTIMVAD

SEQ ID NO: 178490 - protein, 33 aa, Artificial Sequence
  Description of Artificial Sequence: Synthetic polypeptide
DEQEIATTNPVATECWGSTWANTDLADHEGPDL

SEQ ID NO: 178491 - protein, 37 aa, Artificial Sequence
  Description of Artificial Sequence: Synthetic polypeptide
SAEEIATTNPVATEQYGSVCAMNHTGPLDQGEGNNHN

SEQ ID NO: 178492 - protein, 39 aa, Artificial Sequence
  Description of Artificial Sequence: Synthetic polypeptide
DEEEIRTTNPVATESYGTVTTGQSGTISTNQQGQEVGNT

SEQ ID NO: 178493 - protein, 36 aa, Artificial Sequence
  Description of Artificial Sequence: Synthetic polypeptide
CEEEIACTNPVATEQYGSVCAGTNGLADRPIDEAAM

SEQ ID NO: 178494 - protein, 36 aa, Artificial Sequence
  Description of Artificial Sequence: Synthetic polypeptide
DEEEIRTTNPVATEGYGCVCSNWGEHNQENFNSDQS

SEQ ID NO: 178495 - protein, 37 aa, Artificial Sequence
  Description of Artificial Sequence: Synthetic polypeptide
FEEEIRTTNPVATEFYGSVVTAGVNDNNGQGEFNEID

SEQ ID NO: 178496 - protein, 35 aa, Artificial Sequence
  Description of Artificial Sequence: Synthetic polypeptide
FEEEIRTTNPVATEFYGSVVVDGFGQENDQEEDGG

SEQ ID NO: 178497 - protein, 37 aa, Artificial Sequence
  Description of Artificial Sequence: Synthetic polypeptide
FEEEIRTTNPVATEFYGVVVMENDLGMGQGGNTGNGE

SEQ ID NO: 178498 - protein, 35 aa, Artificial Sequence
  Description of Artificial Sequence: Synthetic polypeptide
FEEEIRTTNPVATEFYGVVVNQTDGEFGQGQNEQE

SEQ ID NO: 178499 - protein, 35 aa, Artificial Sequence
  Description of Artificial Sequence: Synthetic polypeptide
SAEEIATTNPVATEQYGSVCAAGGPDEAGNSNNRN

SEQ ID NO: 178500 - protein, 38 aa, Artificial Sequence
  Description of Artificial Sequence: Synthetic polypeptide
DEEEIRTTNPVATEQYGSCAQPEMMESTVLENGSTLID

SEQ ID NO: 178501 - protein, 34 aa, Artificial Sequence
  Description of Artificial Sequence: Synthetic polypeptide
DECEIATTNPVATETWGAVCTIEGQQGQDGQHRD

SEQ ID NO: 178502 - protein, 35 aa, Artificial Sequence
  Description of Artificial Sequence: Synthetic polypeptide
CEEEISTTNPVATEQYGQCVCSWGEHNAHFGSEQS

SEQ ID NO: 178503 - protein, 34 aa, Artificial Sequence
  Description of Artificial Sequence: Synthetic polypeptide
FEEEIRTTNPVATEGYGDVVNQDGQEQGGQGEGQ

SEQ ID NO: 178504 - protein, 37 aa, Artificial Sequence
  Description of Artificial Sequence: Synthetic polypeptide
DEEEIRTTNPVATEQYGCVCGNWGEHNQENFNSDTQS

SEQ ID NO: 178505 - protein, 36 aa, Artificial Sequence
  Description of Artificial Sequence: Synthetic polypeptide
FEEEIRTTNPVATEGYGSVDPVGIMGELDQTGEAGQ

SEQ ID NO: 178506 - protein, 35 aa, Artificial Sequence
  Description of Artificial Sequence: Synthetic polypeptide
FEEEIRTTNPVATDAYGVVMQDNNMLIREGMGGGT

SEQ ID NO: 178507 - protein, 39 aa, Artificial Sequence
  Description of Artificial Sequence: Synthetic polypeptide
DEEEIRTTNPVATESYGTVTTGQSGTISTNTQEGENGNP

SEQ ID NO: 178508 - protein, 33 aa, Artificial Sequence
  Description of Artificial Sequence: Synthetic polypeptide
DEQEIATTNPVATECWGAVWSATDWEDHEGPDL

SEQ ID NO: 178509 - protein, 39 aa, Artificial Sequence
  Description of Artificial Sequence: Synthetic polypeptide
DEEEIRTTNPVATESYGTVTTGQSGTISTNTQENEVGNT

SEQ ID NO: 178510 - protein, 37 aa, Artificial Sequence
  Description of Artificial Sequence: Synthetic polypeptide
FEEEIRGTNPVATEQYGTVNNMNFGELDQQRGEMGDT

SEQ ID NO: 178511 - protein, 36 aa, Artificial Sequence
  Description of Artificial Sequence: Synthetic polypeptide
SDAEIRTTNPVATEQYGSVISPDKTSVTDEIQGNED

SEQ ID NO: 178512 - protein, 37 aa, Artificial Sequence
  Description of Artificial Sequence: Synthetic polypeptide
DEEEIRTTNPVATEGYGCVCSNWGEHDQENFGSENQD

SEQ ID NO: 178513 - protein, 39 aa, Artificial Sequence
  Description of Artificial Sequence: Synthetic polypeptide
DEEEIRTTNPVATESYGTVTTGQSGTISTTTQLQENGNT

SEQ ID NO: 178514 - protein, 39 aa, Artificial Sequence
  Description of Artificial Sequence: Synthetic polypeptide
DEEEIRTTNPVATESYGTVTTGQSGTISTNTQTTEVGNP

SEQ ID NO: 178515 - protein, 35 aa, Artificial Sequence
  Description of Artificial Sequence: Synthetic polypeptide
DEEEIRTTNPVATEQYGSCAAGPALGIEHPDAQAN

SEQ ID NO: 178516 - protein, 39 aa, Artificial Sequence
  Description of Artificial Sequence: Synthetic polypeptide
DEEEIRTTNPVATESYGTVTTGQSGTISTNTQMQESGNN

SEQ ID NO: 178517 - protein, 36 aa, Artificial Sequence
  Description of Artificial Sequence: Synthetic polypeptide
FEEEIRSTNPVATEQYGSVNDTAGQENGEGQEQTEI

SEQ ID NO: 178518 - protein, 37 aa, Artificial Sequence
  Description of Artificial Sequence: Synthetic polypeptide
DEEEIRTTNPVATEQYGSCAAPEQTGLDQIAQVMVAD

SEQ ID NO: 178519 - protein, 35 aa, Artificial Sequence
  Description of Artificial Sequence: Synthetic polypeptide
DENEIRTTNPVATEFYGSVDAPGGDEGGGQTGEQE

SEQ ID NO: 178520 - protein, 35 aa, Artificial Sequence
  Description of Artificial Sequence: Synthetic polypeptide
DENEIRTTNPVATEFYGMVTATGGDEGGGQTGEQD

SEQ ID NO: 178521 - protein, 35 aa, Artificial Sequence
  Description of Artificial Sequence: Synthetic polypeptide
FEEEIRSTNPVATEQYGSVVVDGFGDENDQEEDGG

SEQ ID NO: 178522 - protein, 36 aa, Artificial Sequence
  Description of Artificial Sequence: Synthetic polypeptide
FEDEIRTTNPVATEQYGSVMGGVNQEQGGGGQEEQA

SEQ ID NO: 178523 - protein, 36 aa, Artificial Sequence
  Description of Artificial Sequence: Synthetic polypeptide
FEEEIRSTNPVATEQYGVVVSDGEGQIGQGGGNNIQ

SEQ ID NO: 178524 - protein, 34 aa, Artificial Sequence
  Description of Artificial Sequence: Synthetic polypeptide
DECEIATTNPVAYEAWGVVSGENQGGQDRQNNQQ

SEQ ID NO: 178525 - protein, 33 aa, Artificial Sequence
  Description of Artificial Sequence: Synthetic polypeptide
DEQEIATTNPVATECWGAVWAATDLEEHEGPDI

SEQ ID NO: 178526 - protein, 35 aa, Artificial Sequence
  Description of Artificial Sequence: Synthetic polypeptide
FEEEIRSTNPVATEQYGVVVSGMGQIGQGGEQQTQ

SEQ ID NO: 178527 - protein, 36 aa, Artificial Sequence
  Description of Artificial Sequence: Synthetic polypeptide
CEEEIACTNPVATEQYGSVCAMTEPGGAVAIGDNRD

SEQ ID NO: 178528 - protein, 35 aa, Artificial Sequence
  Description of Artificial Sequence: Synthetic polypeptide
FEEEIRSTNPVATEQYGVVVSGVGQIGEGGEQQTG

SEQ ID NO: 178529 - protein, 36 aa, Artificial Sequence
  Description of Artificial Sequence: Synthetic polypeptide
FEEEIRSTNPVATEQYGVVVSSGGQIGQGGGNQTQQ

SEQ ID NO: 178530 - protein, 39 aa, Artificial Sequence
  Description of Artificial Sequence: Synthetic polypeptide
DEEEIRTTNPVATESYGTVTTGQSGTISTNTQMEEEGNP

SEQ ID NO: 178531 - protein, 34 aa, Artificial Sequence
  Description of Artificial Sequence: Synthetic polypeptide
SAQEIATTNPVATEQWGSVSGTGNPPDNNSDDAD

SEQ ID NO: 178532 - protein, 36 aa, Artificial Sequence
  Description of Artificial Sequence: Synthetic polypeptide
DEEEIRTTNPVATEGYGCVCSNWGEHNAENFNSEQS

SEQ ID NO: 178533 - protein, 39 aa, Artificial Sequence
  Description of Artificial Sequence: Synthetic polypeptide
DEEEIRTTNPVATESYGTVTTGQSGTISTNTQGSESGNP

SEQ ID NO: 178534 - protein, 37 aa, Artificial Sequence
  Description of Artificial Sequence: Synthetic polypeptide
FEEEIRTTNPAATEQYGSVDDDDLQLGNDGQEGGTGQ

SEQ ID NO: 178535 - protein, 36 aa, Artificial Sequence
  Description of Artificial Sequence: Synthetic polypeptide
FEEEIRTTNPAATEQYGSVDDDDQLENEGQEGGTGT

SEQ ID NO: 178536 - protein, 34 aa, Artificial Sequence
  Description of Artificial Sequence: Synthetic polypeptide
CEEEIACTNPVATEQYGSVCAPNPEAQANQTEGT

SEQ ID NO: 178537 - protein, 37 aa, Artificial Sequence
  Description of Artificial Sequence: Synthetic polypeptide
DDEEIRTTNPVATEQYGVVNDTENMDEGNEGGAENIE

SEQ ID NO: 178538 - protein, 36 aa, Artificial Sequence
  Description of Artificial Sequence: Synthetic polypeptide
FEDEIRTTNPVATEQYGSVMGEVNQEQGQGGQIEQA

SEQ ID NO: 178539 - protein, 36 aa, Artificial Sequence
  Description of Artificial Sequence: Synthetic polypeptide
FEDEIRTTNPVATEQYGSVMGDVNQEQGGGGQDEQQ

SEQ ID NO: 178540 - protein, 34 aa, Artificial Sequence
  Description of Artificial Sequence: Synthetic polypeptide
DECEIATTNPVAYEHWGSVCPTDNQDQNNNDNIS

SEQ ID NO: 178541 - protein, 33 aa, Artificial Sequence
  Description of Artificial Sequence: Synthetic polypeptide
AEAEIACTNPVAYEQWGEAYCIENLQDRGGERT

SEQ ID NO: 178542 - protein, 36 aa, Artificial Sequence
  Description of Artificial Sequence: Synthetic polypeptide
DEEEIRCTNPVATEQYGCVCSMWMEDFQGFNSDNQS

SEQ ID NO: 178543 - protein, 34 aa, Artificial Sequence
  Description of Artificial Sequence: Synthetic polypeptide
SEAEIATTNPVATECYGSVCAATGEEADSGGNHM

SEQ ID NO: 178544 - protein, 35 aa, Artificial Sequence
  Description of Artificial Sequence: Synthetic polypeptide
SEAEIATTNPCATECYGVVCYKTNDEGQRQGDNDS

SEQ ID NO: 178545 - protein, 29 aa, Artificial Sequence
  Description of Artificial Sequence: Synthetic peptide
ENNEIATTNPVAYECWGCVAECLQHEEAT

SEQ ID NO: 178546 - protein, 29 aa, Artificial Sequence
  Description of Artificial Sequence: Synthetic peptide
ENNEIATTNPVAYECWGCVAECLQHQEMA

SEQ ID NO: 178547 - protein, 34 aa, Artificial Sequence
  Description of Artificial Sequence: Synthetic polypeptide
DEEVIATTNPDATEGYGSCSTPMLGARYMQEYDG

SEQ ID NO: 178548 - protein, 32 aa, Artificial Sequence
  Description of Artificial Sequence: Synthetic polypeptide
ENNEIATTNPVAYERWGVVYTNLQGDHGPTDP

SEQ ID NO: 178549 - protein, 33 aa, Artificial Sequence
  Description of Artificial Sequence: Synthetic polypeptide
DEEVIATTNPDAYEGYGSCSTPPLAGYGMEYDG

SEQ ID NO: 178550 - protein, 33 aa, Artificial Sequence
  Description of Artificial Sequence: Synthetic polypeptide
AEAEIACTNPVAYEPYGEASCEQNLSQIVGGRK

SEQ ID NO: 178551 - protein, 39 aa, Artificial Sequence
  Description of Artificial Sequence: Synthetic polypeptide
DEEEIRTTNPVATESYGVVTNLQSGTISTNTTNQELGNV

SEQ ID NO: 178552 - protein, 35 aa, Artificial Sequence
  Description of Artificial Sequence: Synthetic polypeptide
ENTEIATTNPVATENYGCVSTGNGLNDTEGGGDSR

SEQ ID NO: 178553 - protein, 39 aa, Artificial Sequence
  Description of Artificial Sequence: Synthetic polypeptide
DEEEIRTTNPVATESYGVVTNLQSGTISTNTQNTEQGNA

SEQ ID NO: 178554 - protein, 37 aa, Artificial Sequence
  Description of Artificial Sequence: Synthetic polypeptide
DEQEIATTNPVATAQWGSVSANGDPMGEDHQGGEDNR

SEQ ID NO: 178555 - protein, 35 aa, Artificial Sequence
  Description of Artificial Sequence: Synthetic polypeptide
EQEEIATTNPVAYEQWGSVACMNNDLSDQGDNEDR

SEQ ID NO: 178556 - protein, 35 aa, Artificial Sequence
  Description of Artificial Sequence: Synthetic polypeptide
EQEEIRTTNPVATEQWGATISTNLEQQELDVPEGP

SEQ ID NO: 178557 - protein, 35 aa, Artificial Sequence
  Description of Artificial Sequence: Synthetic polypeptide
EQEEIRTTNPVATEQWGATVSTNSEQQELDVPEGV

SEQ ID NO: 178558 - protein, 34 aa, Artificial Sequence
  Description of Artificial Sequence: Synthetic polypeptide
SEAEIACTNPVATEQYGSVCAMTNPEEATDGTGN

SEQ ID NO: 178559 - protein, 35 aa, Artificial Sequence
  Description of Artificial Sequence: Synthetic polypeptide
SEAEIACTNPVATEQYGSVCAGTGPGGAVAIGDNR

SEQ ID NO: 178560 - protein, 39 aa, Artificial Sequence
  Description of Artificial Sequence: Synthetic polypeptide
DEEEIRTTNPVATESYGVVTNLQSGTISTNTQNQESGNM

SEQ ID NO: 178561 - protein, 39 aa, Artificial Sequence
  Description of Artificial Sequence: Synthetic polypeptide
DEEEIRTTNPVATESYGVVTNLQSGTISTNTQNQEQGER

SEQ ID NO: 178562 - protein, 38 aa, Artificial Sequence
  Description of Artificial Sequence: Synthetic polypeptide
DEEEIRTTNPVATEQYGSAWQNGIVMISGDSLQDSIVG

SEQ ID NO: 178563 - protein, 36 aa, Artificial Sequence
  Description of Artificial Sequence: Synthetic polypeptide
CEEEIACTNPVATEQYGSVSPTGEGGINPDDGMEKV

SEQ ID NO: 178564 - protein, 34 aa, Artificial Sequence
  Description of Artificial Sequence: Synthetic polypeptide
TTAEISTTNPVAYEQWGTVCSTNDLHDDGGGNQQ

SEQ ID NO: 178565 - protein, 36 aa, Artificial Sequence
  Description of Artificial Sequence: Synthetic polypeptide
DEEEIRCTNPVATEQYGCVCSNTEDHNQENFMSDQS

SEQ ID NO: 178566 - protein, 36 aa, Artificial Sequence
  Description of Artificial Sequence: Synthetic polypeptide
CEEEIACTNPVATEQYGSVSATGEAGINPRDGMEKV

SEQ ID NO: 178567 - protein, 34 aa, Artificial Sequence
  Description of Artificial Sequence: Synthetic polypeptide
DEAEIRTTNPVATECWGSVSRCIEEPEWSEGEIE

SEQ ID NO: 178568 - protein, 34 aa, Artificial Sequence
  Description of Artificial Sequence: Synthetic polypeptide
DEAEIRTTNPVATECWGSVSRCIEEPQWSEAEFE

SEQ ID NO: 178569 - protein, 38 aa, Artificial Sequence
  Description of Artificial Sequence: Synthetic polypeptide
DDEEIRTTNPVATEQYGSVVASAGVDQNDGEGEEGNEG

SEQ ID NO: 178570 - protein, 37 aa, Artificial Sequence
  Description of Artificial Sequence: Synthetic polypeptide
DEEEIRTTNPVATEQYGCVCGNTGNDHNIENFGSDQS

SEQ ID NO: 178571 - protein, 31 aa, Artificial Sequence
  Description of Artificial Sequence: Synthetic polypeptide
DDSEVASTNPVCTEGYGNVAANTIQSRVGQQ

SEQ ID NO: 178572 - protein, 35 aa, Artificial Sequence
  Description of Artificial Sequence: Synthetic polypeptide
SEAEIATTNPVAYEQWGSVYGGWNDDQPQGNPRGQ

SEQ ID NO: 178573 - protein, 37 aa, Artificial Sequence
  Description of Artificial Sequence: Synthetic polypeptide
DEEEIRTTNPVATETYGSVCSVESLMDHVRVEDDQQP

SEQ ID NO: 178574 - protein, 36 aa, Artificial Sequence
  Description of Artificial Sequence: Synthetic polypeptide
DEEEIRTTNPVATETYGSVCSVEDMAHVNVGDDQQE

SEQ ID NO: 178575 - protein, 36 aa, Artificial Sequence
  Description of Artificial Sequence: Synthetic polypeptide
DEEEIRTTNPVATETYGSVCSVEDMAHVDVGEDQQL

SEQ ID NO: 178576 - protein, 33 aa, Artificial Sequence
  Description of Artificial Sequence: Synthetic polypeptide
ENEEIATTNPVAYEQWGVTYYTWLQGDHQNSDR

SEQ ID NO: 178577 - protein, 36 aa, Artificial Sequence
  Description of Artificial Sequence: Synthetic polypeptide
DEEEIRTTNPVATETYGSVCSVAQDMAHVDTGDDQQ

SEQ ID NO: 178578 - protein, 36 aa, Artificial Sequence
  Description of Artificial Sequence: Synthetic polypeptide
DEEEIRTTNPVATETYGSCVTWVVPHHEGTTDNMQE

SEQ ID NO: 178579 - protein, 34 aa, Artificial Sequence
  Description of Artificial Sequence: Synthetic polypeptide
TTAEIRTTNPVATEQYGMTTAGVGLQHMGGNIGE

SEQ ID NO: 178580 - protein, 35 aa, Artificial Sequence
  Description of Artificial Sequence: Synthetic polypeptide
DENEIRTTNPVATEIYGCVCSWGEHNQNFNSDNQA

SEQ ID NO: 178581 - protein, 35 aa, Artificial Sequence
  Description of Artificial Sequence: Synthetic polypeptide
DEEEIRTTNPVATETYGSCVTWVVIHEGTTDTMQE

SEQ ID NO: 178582 - protein, 35 aa, Artificial Sequence
  Description of Artificial Sequence: Synthetic polypeptide
SEAEIATTNPVATEQYGVVPCWDNHGQDRQEGGAE

SEQ ID NO: 178583 - protein, 36 aa, Artificial Sequence
  Description of Artificial Sequence: Synthetic polypeptide
DEEEIRCTNPVATEQYGCVCSNWGEHNQEYFGSDQA

SEQ ID NO: 178584 - protein, 32 aa, Artificial Sequence
  Description of Artificial Sequence: Synthetic polypeptide
DECEIATTNPVAYEQWGCTWNNHMPDEDGNTQ

SEQ ID NO: 178585 - protein, 37 aa, Artificial Sequence
  Description of Artificial Sequence: Synthetic polypeptide
DEEEIRTTNPVATEGYGCVCSNTGEHNQENFNSDTQT

SEQ ID NO: 178586 - protein, 34 aa, Artificial Sequence
  Description of Artificial Sequence: Synthetic polypeptide
AEAEIACTNPVAYEQYGEIQSCEQNLSQIVGGRK

SEQ ID NO: 178587 - protein, 35 aa, Artificial Sequence
  Description of Artificial Sequence: Synthetic polypeptide
SEAEIATTNPVATEQYGSVCAAGPLGFATMGDSNG

SEQ ID NO: 178588 - protein, 33 aa, Artificial Sequence
  Description of Artificial Sequence: Synthetic polypeptide
AEAEIACTNPVAYEQYGEASCEGNLSDRVGGSQ

SEQ ID NO: 178589 - protein, 35 aa, Artificial Sequence
  Description of Artificial Sequence: Synthetic polypeptide
DECEIATTNPVAYEKWGSVATGGNTGNAGNDNQRH

SEQ ID NO: 178590 - protein, 33 aa, Artificial Sequence
  Description of Artificial Sequence: Synthetic polypeptide
TTAEIRTTNPVATEQYGMTTAGVGLQHMGPGGE

SEQ ID NO: 178591 - protein, 37 aa, Artificial Sequence
  Description of Artificial Sequence: Synthetic polypeptide
DEEEIRCTNPVATEQYGCVCSNWGEDFQEGFNSDTQA

SEQ ID NO: 178592 - protein, 35 aa, Artificial Sequence
  Description of Artificial Sequence: Synthetic polypeptide
DENEIRTTNPVATEIYGCVCSWEDHNQNFGSDTQS

SEQ ID NO: 178593 - protein, 34 aa, Artificial Sequence
  Description of Artificial Sequence: Synthetic polypeptide
DECEIATTNPVAYEHWGSVCPTDNQNQQNNDNPS

SEQ ID NO: 178594 - protein, 37 aa, Artificial Sequence
  Description of Artificial Sequence: Synthetic polypeptide
DEEEIRCTNPVATEQYGCVCSNTGEDHEQNFGSETQN

SEQ ID NO: 178595 - protein, 35 aa, Artificial Sequence
  Description of Artificial Sequence: Synthetic polypeptide
CEEEIACTNPVATEQYGSVCWVPGEATEDGTGARD

SEQ ID NO: 178596 - protein, 38 aa, Artificial Sequence
  Description of Artificial Sequence: Synthetic polypeptide
DEEEIRTTNPVATEQYGSAWVNGIVMDSGDSLQDSIVI

SEQ ID NO: 178597 - protein, 38 aa, Artificial Sequence
  Description of Artificial Sequence: Synthetic polypeptide
DEEEIRTTNPVATEQYGSAWVNGIVMESGDSLQDEIVV

SEQ ID NO: 178598 - protein, 39 aa, Artificial Sequence
  Description of Artificial Sequence: Synthetic polypeptide
DEEEIRTTNPVATESYGTVTTTQSTTISTNTQGQEVGNT

SEQ ID NO: 178599 - protein, 36 aa, Artificial Sequence
  Description of Artificial Sequence: Synthetic polypeptide
SEAEAEIRTTNPVAYEQWGSVAWTDQLNQDQGGDTA

SEQ ID NO: 178600 - protein, 33 aa, Artificial Sequence
  Description of Artificial Sequence: Synthetic polypeptide
DECEIATTNPVAYEEWGSVTGGNPGNAGNDGDG

SEQ ID NO: 178601 - protein, 36 aa, Artificial Sequence
  Description of Artificial Sequence: Synthetic polypeptide
DEEEIRTTNPVATEQYGCVCGNWGEHNIENFNSQQA

SEQ ID NO: 178602 - protein, 35 aa, Artificial Sequence
  Description of Artificial Sequence: Synthetic polypeptide
ETQEIATTNPVATTQWGSVAWTENGDQDQRGGKSR

SEQ ID NO: 178603 - protein, 39 aa, Artificial Sequence
  Description of Artificial Sequence: Synthetic polypeptide
DEEEIRTTNPVATESYGTVTTTQSNTISTNTQMQEVGNS

SEQ ID NO: 178604 - protein, 34 aa, Artificial Sequence
  Description of Artificial Sequence: Synthetic polypeptide
CEEEIACTNPVATEQYGSVCATHPEAPANQTEGT

SEQ ID NO: 178605 - protein, 35 aa, Artificial Sequence
  Description of Artificial Sequence: Synthetic polypeptide
AEAEEIATTNPVAYEQWGWVSTGGNPGNEQHGDDH

SEQ ID NO: 178606 - protein, 33 aa, Artificial Sequence
  Description of Artificial Sequence: Synthetic polypeptide
ETTEIATTNPVAYEQWGSVAWTEIDQNMGGNNN

SEQ ID NO: 178607 - protein, 39 aa, Artificial Sequence
  Description of Artificial Sequence: Synthetic polypeptide
DEEEIRTTNPVATESYGTVTTTQQVTISTNTQMQEVGNQ

SEQ ID NO: 178608 - protein, 39 aa, Artificial Sequence
  Description of Artificial Sequence: Synthetic polypeptide
DEEEIRTTNPVATESYGTVTTTQAGTISTNTQMEEVGNP

SEQ ID NO: 178609 - protein, 37 aa, Artificial Sequence
  Description of Artificial Sequence: Synthetic polypeptide
DEEEIRTTNPVATEQYGSAYSAYAPQKNNESAQDVQD

SEQ ID NO: 178610 - protein, 39 aa, Artificial Sequence
  Description of Artificial Sequence: Synthetic polypeptide
DEEEIRTTNPVATESYGTVTTQQQVTISTNTQEQEVGNG

SEQ ID NO: 178611 - protein, 37 aa, Artificial Sequence
  Description of Artificial Sequence: Synthetic polypeptide
FEDEIRATNPVATEQYGSVNSTTGVNEGQNVEGQSGD

SEQ ID NO: 178612 - protein, 35 aa, Artificial Sequence
  Description of Artificial Sequence: Synthetic polypeptide
FEDEIRTTNCVATEGYGSVSTLGMEGEGEMGNGGT

SEQ ID NO: 178613 - protein, 37 aa, Artificial Sequence
  Description of Artificial Sequence: Synthetic polypeptide
DEEEIRTTNPVATEQYGCVCGNWGEHNQENFNSDNQS

SEQ ID NO: 178614 - protein, 39 aa, Artificial Sequence
  Description of Artificial Sequence: Synthetic polypeptide
DEEEIRTTNPVATESYGTVTTLQSGTISTNTQMSEVGNP

SEQ ID NO: 178615 - protein, 35 aa, Artificial Sequence
  Description of Artificial Sequence: Synthetic polypeptide
SDEEIRTTNPVATHQYGCVCSTEHNQENFGSDTQA

SEQ ID NO: 178616 - protein, 39 aa, Artificial Sequence
  Description of Artificial Sequence: Synthetic polypeptide
DEEEIRTTNPVATESYGTVTTLQSGTISTNTQEQEVGNN

SEQ ID NO: 178617 - protein, 34 aa, Artificial Sequence
  Description of Artificial Sequence: Synthetic polypeptide
DECEIATTNPVAYEEWGSVCPTDNQDRNLNDNPS

SEQ ID NO: 178618 - protein, 36 aa, Artificial Sequence
  Description of Artificial Sequence: Synthetic polypeptide
FEDEIRTTNPVATEGYGSVSTLGMEGEGEMGNNGGE

SEQ ID NO: 178619 - protein, 35 aa, Artificial Sequence
  Description of Artificial Sequence: Synthetic polypeptide
FEDEIRTTNPVATEGYGSVVTLGMEGQGEMGEGQE

SEQ ID NO: 178620 - protein, 34 aa, Artificial Sequence
  Description of Artificial Sequence: Synthetic polypeptide
SDEEIRTTNPVATHQYGCVCSSEHNQEYFGSDQA

SEQ ID NO: 178621 - protein, 35 aa, Artificial Sequence
  Description of Artificial Sequence: Synthetic polypeptide
DEECISTTNPVATEGYGCVCGWGEALNQYFGSNQS

SEQ ID NO: 178622 - protein, 37 aa, Artificial Sequence
  Description of Artificial Sequence: Synthetic polypeptide
DEEEIRTTNPVATEQYGSAYSSYAPQKNNESQTDQQD

SEQ ID NO: 178623 - protein, 38 aa, Artificial Sequence
  Description of Artificial Sequence: Synthetic polypeptide
DEEEIRTTNPVATEQYGSAYMENTNVQGINLVHENLGE

SEQ ID NO: 178624 - protein, 37 aa, Artificial Sequence
  Description of Artificial Sequence: Synthetic polypeptide
DENEIRTTNPVATEGYGSVQSGVGMTDDEGGGGINGD

SEQ ID NO: 178625 - protein, 36 aa, Artificial Sequence
  Description of Artificial Sequence: Synthetic polypeptide
DEEEISCTNPVATEQYGCVCSNTGEHNQENFGSDQA

SEQ ID NO: 178626 - protein, 37 aa, Artificial Sequence
  Description of Artificial Sequence: Synthetic polypeptide
DENEIRTTNPVATEGYGSVQSIVGMTDDEGGGNQNGD

SEQ ID NO: 178627 - protein, 37 aa, Artificial Sequence
  Description of Artificial Sequence: Synthetic polypeptide
DEEEIRTTNPVATEQYGSAWVNGIVMISGDSIQDSIE

SEQ ID NO: 178628 - protein, 38 aa, Artificial Sequence
  Description of Artificial Sequence: Synthetic polypeptide
DEEEIRTTNPVATEQYGSAWVNGNVEISGDSLNTDSIV

SEQ ID NO: 178629 - protein, 38 aa, Artificial Sequence
  Description of Artificial Sequence: Synthetic polypeptide
DEEEIRTTNPVATEQYGSAWVNGNVEISPDSLSQDSIV

SEQ ID NO: 178630 - protein, 32 aa, Artificial Sequence
  Description of Artificial Sequence: Synthetic polypeptide
ETAEIATTNPCAYEEWGSVYFVDLQDQKGNTR

SEQ ID NO: 178631 - protein, 32 aa, Artificial Sequence
  Description of Artificial Sequence: Synthetic polypeptide
ETAEIATTNPCAYEEWGSVYYVDEQRQQGNRE

SEQ ID NO: 178632 - protein, 34 aa, Artificial Sequence
  Description of Artificial Sequence: Synthetic polypeptide
ETAEIATTNPVATEAYGSVSWNEGDQQDGQGGHD

SEQ ID NO: 178633 - protein, 34 aa, Artificial Sequence
  Description of Artificial Sequence: Synthetic polypeptide
DENEIRTTNPVATEGYGVVDIMGNNGGEDNDEEN

SEQ ID NO: 178634 - protein, 33 aa, Artificial Sequence
  Description of Artificial Sequence: Synthetic polypeptide
ETAEIATTNPVAYECWGSVSGGLNDDMQEQGNH

SEQ ID NO: 178635 - protein, 38 aa, Artificial Sequence
  Description of Artificial Sequence: Synthetic polypeptide
DEEEIRTTNPVATEQYGSAWVNGNVEPSGDSLQDSIVQ

SEQ ID NO: 178636 - protein, 35 aa, Artificial Sequence
  Description of Artificial Sequence: Synthetic polypeptide
TTDEIATTNPVATTQWGSVAWTENGDQDQRGEVSR

SEQ ID NO: 178637 - protein, 35 aa, Artificial Sequence
  Description of Artificial Sequence: Synthetic polypeptide
ETAEIATTNPVAYEQWGSVCDTDNQNGQRGQGGDR

SEQ ID NO: 178638 - protein, 35 aa, Artificial Sequence
  Description of Artificial Sequence: Synthetic polypeptide
SEAEIACTNPVATEQYGSACAANPQQEHQDGNQHR

SEQ ID NO: 178639 - protein, 39 aa, Artificial Sequence
  Description of Artificial Sequence: Synthetic polypeptide
DEEEIRTTNPVATESYGTVTTLQSGTIGTNTTNQEVGNP

SEQ ID NO: 178640 - protein, 37 aa, Artificial Sequence
  Description of Artificial Sequence: Synthetic polypeptide
DEEEIRTTNPVATEQYGSAWVNGNVESSGDSLADSIV

SEQ ID NO: 178641 - protein, 31 aa, Artificial Sequence
  Description of Artificial Sequence: Synthetic polypeptide
ETCEIATTNPCAYEEWGSVYFVDEQRGQGNH

SEQ ID NO: 178642 - protein, 38 aa, Artificial Sequence
  Description of Artificial Sequence: Synthetic polypeptide
DEEEIRTTNPVATEQYGSAWVNGPSMISGDSLEQDSIV

SEQ ID NO: 178643 - protein, 37 aa, Artificial Sequence
  Description of Artificial Sequence: Synthetic polypeptide
CEEEIACTNPVATEQYGSVCSPTPNPQNEAGIGEADD

SEQ ID NO: 178644 - protein, 36 aa, Artificial Sequence
  Description of Artificial Sequence: Synthetic polypeptide
ETDEIATTNPVATTQWGSVAWTENGDKQDQRGENSR

SEQ ID NO: 178645 - protein, 38 aa, Artificial Sequence
  Description of Artificial Sequence: Synthetic polypeptide
DEEEIRTTNPVATEQYGSAWVNTIVMESGDSLQDSIVE

SEQ ID NO: 178646 - protein, 34 aa, Artificial Sequence
  Description of Artificial Sequence: Synthetic polypeptide
CEEEIACTNPVATEQYGSVCATPEEAGDLMGDLH

SEQ ID NO: 178647 - protein, 38 aa, Artificial Sequence
  Description of Artificial Sequence: Synthetic polypeptide
DEEEIRTTNPVATEQYGSAWVNVITMISGDSLEQDSIV

SEQ ID NO: 178648 - protein, 33 aa, Artificial Sequence
  Description of Artificial Sequence: Synthetic polypeptide
ETEEIATTNPCAYEEWGSVYYIVDEQLQGQGNR

SEQ ID NO: 178649 - protein, 31 aa, Artificial Sequence
  Description of Artificial Sequence: Synthetic polypeptide
ETEEIATTNPCAYEEWGSVYYVDEQRGQGDQ

SEQ ID NO: 178650 - protein, 31 aa, Artificial Sequence
  Description of Artificial Sequence: Synthetic polypeptide
DDSEVATTNPVSTEGYGNVAAETIQSRVEQR

SEQ ID NO: 178651 - protein, 35 aa, Artificial Sequence
  Description of Artificial Sequence: Synthetic polypeptide
CEEEISTTNPVATEQYGQCVCSTEEPTEGFGSEQT

SEQ ID NO: 178652 - protein, 34 aa, Artificial Sequence
  Description of Artificial Sequence: Synthetic polypeptide
ETEEIATTNPVATTQWGSVAWTENGDQDNGGGTE

SEQ ID NO: 178653 - protein, 37 aa, Artificial Sequence
  Description of Artificial Sequence: Synthetic polypeptide
DEEEIRTTNPVATEQYGCVCGNWGEHDQEFFNSDNQS

SEQ ID NO: 178654 - protein, 39 aa, Artificial Sequence
  Description of Artificial Sequence: Synthetic polypeptide
DEEEIRTTNPVATESYGTVTTGQSGTISTNNQMQENGNP

SEQ ID NO: 178655 - protein, 36 aa, Artificial Sequence
  Description of Artificial Sequence: Synthetic polypeptide
CEEEISTTNPVATEQYGCVCSNWGEHNQENFGSNQA

SEQ ID NO: 178656 - protein, 33 aa, Artificial Sequence
  Description of Artificial Sequence: Synthetic polypeptide
DDSEVASTNPVSTEGYGNVCANSTCIQSRVGQR

SEQ ID NO: 178657 - protein, 39 aa, Artificial Sequence
  Description of Artificial Sequence: Synthetic polypeptide
EEEEIRTTNPVATEAYGVVSTVVVTNLQLQNGNQNGQED

SEQ ID NO: 178658 - protein, 39 aa, Artificial Sequence
  Description of Artificial Sequence: Synthetic polypeptide
EEEEIRTTNPVATEAYGVVSVTVATNLQQGTEQGNEEGD

SEQ ID NO: 178659 - protein, 37 aa, Artificial Sequence
  Description of Artificial Sequence: Synthetic polypeptide
DEQEIRTTNPVATEQYGSVNPPVTSHLNEQEDVTESN

SEQ ID NO: 178660 - protein, 37 aa, Artificial Sequence
  Description of Artificial Sequence: Synthetic polypeptide
DEETICTTNPVATEFYGSVVNTFDNTGEQDEFGGNVN

SEQ ID NO: 178661 - protein, 34 aa, Artificial Sequence
  Description of Artificial Sequence: Synthetic polypeptide
DEDEIRGTNPVATEAWGVVSAGMEGQDGEGENGG

SEQ ID NO: 178662 - protein, 38 aa, Artificial Sequence
  Description of Artificial Sequence: Synthetic polypeptide
DEEEIRTTNPVATEQYGQCVTSTTPADNIEYFGSDPVA

SEQ ID NO: 178663 - protein, 38 aa, Artificial Sequence
  Description of Artificial Sequence: Synthetic polypeptide
DEEEIRTTNPVATEQYGQCVTSTTPAPNAEYFGSDPQS

SEQ ID NO: 178664 - protein, 37 aa, Artificial Sequence
  Description of Artificial Sequence: Synthetic polypeptide
DESEIRTTNPVATEQYGSVVGQGQDGGELDDGENDDD

SEQ ID NO: 178665 - protein, 38 aa, Artificial Sequence
  Description of Artificial Sequence: Synthetic polypeptide
EEEEIRTTNPVATEQYGDVGVNTDPDPGLQRGEGGQEG

SEQ ID NO: 178666 - protein, 34 aa, Artificial Sequence
  Description of Artificial Sequence: Synthetic polypeptide
CEEEIACTNPVATEQWGCVAGTGLQENPNEDMHW

SEQ ID NO: 178667 - protein, 34 aa, Artificial Sequence
  Description of Artificial Sequence: Synthetic polypeptide
CEEEIACTNPVATEQWGCVAGTGLVQSAENAGMF

SEQ ID NO: 178668 - protein, 37 aa, Artificial Sequence
  Description of Artificial Sequence: Synthetic polypeptide
EEEEIRTTNPVATEQYGMVYSEAPNLEIFVNMQGQPN

SEQ ID NO: 178669 - protein, 35 aa, Artificial Sequence
  Description of Artificial Sequence: Synthetic polypeptide
CEEEIACTNPVATEQWGCVAGTGLVQTAENAGTNY

SEQ ID NO: 178670 - protein, 32 aa, Artificial Sequence
  Description of Artificial Sequence: Synthetic polypeptide
DDSEVASTNPVSTEGYGNVAGNTIQSRVGPQR

SEQ ID NO: 178671 - protein, 36 aa, Artificial Sequence
  Description of Artificial Sequence: Synthetic polypeptide
DENEIRTTNPVATEQWGCVCSTSPENINAFNSDTAA

SEQ ID NO: 178672 - protein, 35 aa, Artificial Sequence
  Description of Artificial Sequence: Synthetic polypeptide
SEEEIATTNPVATEQWGGCSAATATLTQPDNQGQE

SEQ ID NO: 178673 - protein, 38 aa, Artificial Sequence
  Description of Artificial Sequence: Synthetic polypeptide
EEEEIRTTNPVATEQYGSAVQVSGSVTQAQNVLSFVGE

SEQ ID NO: 178674 - protein, 34 aa, Artificial Sequence
  Description of Artificial Sequence: Synthetic polypeptide
SEEEIATTNPVATEQWGGCCTAAAGNVDDGMGNH

SEQ ID NO: 178675 - protein, 35 aa, Artificial Sequence
  Description of Artificial Sequence: Synthetic polypeptide
SEEEIATTNPVATEQWGCVAATATLTQPDDGMGDN

SEQ ID NO: 178676 - protein, 32 aa, Artificial Sequence
  Description of Artificial Sequence: Synthetic polypeptide
DDSEVASTNPVSTEGYGNVAGNTIQSRVGQVR

SEQ ID NO: 178677 - protein, 32 aa, Artificial Sequence
  Description of Artificial Sequence: Synthetic polypeptide
DDSEVASTNPVSTEGYGNVAINDTIQDRQGQR

SEQ ID NO: 178678 - protein, 38 aa, Artificial Sequence
  Description of Artificial Sequence: Synthetic polypeptide
DEEEIRTTNPVATEQYGQCVTSTWGEHNAEHFGSDPQS

SEQ ID NO: 178679 - protein, 38 aa, Artificial Sequence
  Description of Artificial Sequence: Synthetic polypeptide
AEGEICTTNPVATEAYGSVYTVSNEEIGTNLQIGNEEM

SEQ ID NO: 178680 - protein, 38 aa, Artificial Sequence
  Description of Artificial Sequence: Synthetic polypeptide
DEEEIRTTNPVATEQYGQCVTSTWPAGNAENFNSDPQS

SEQ ID NO: 178681 - protein, 38 aa, Artificial Sequence
  Description of Artificial Sequence: Synthetic polypeptide
DEEEIRTTNPVATEQYGQCVTSTWPAHNAEHFGSDTQS

SEQ ID NO: 178682 - protein, 36 aa, Artificial Sequence
  Description of Artificial Sequence: Synthetic polypeptide
DEQEIRTTNPVATEQYGSVNIWVTSLIEPEDMTEEN

SEQ ID NO: 178683 - protein, 38 aa, Artificial Sequence
  Description of Artificial Sequence: Synthetic polypeptide
DEEEIRTTNPVATEQYGQCVTSTWPEDNAEYFGSDPQS

SEQ ID NO: 178684 - protein, 38 aa, Artificial Sequence
  Description of Artificial Sequence: Synthetic polypeptide
EEEEIRTTNPVATEAYGVVSTTVNQAGNQQGNNNSTDD

SEQ ID NO: 178685 - protein, 30 aa, Artificial Sequence
  Description of Artificial Sequence: Synthetic polypeptide
DDSEVASTNPVSTEGYGNVAETIQSRVGQK

SEQ ID NO: 178686 - protein, 34 aa, Artificial Sequence
  Description of Artificial Sequence: Synthetic polypeptide
CEEEIACTNPVATEQWGCVAGNGELAQANNSQNH

SEQ ID NO: 178687 - protein, 33 aa, Artificial Sequence
  Description of Artificial Sequence: Synthetic polypeptide
SEEEIATTNPVATEQYGICSCPSEDQEHFISEQ

SEQ ID NO: 178688 - protein, 34 aa, Artificial Sequence
  Description of Artificial Sequence: Synthetic polypeptide
EEEEIATTNPVAYEQWGSVYHPINDMQATKGKES

SEQ ID NO: 178689 - protein, 33 aa, Artificial Sequence
  Description of Artificial Sequence: Synthetic polypeptide
EEEEIATTNPVAYEQYGEAPCEVETSQHAEGEM

SEQ ID NO: 178690 - protein, 36 aa, Artificial Sequence
  Description of Artificial Sequence: Synthetic polypeptide
DEECIRTTNPVATEQYGQCVCSWEHNEENFNSDNQP

SEQ ID NO: 178691 - protein, 32 aa, Artificial Sequence
  Description of Artificial Sequence: Synthetic polypeptide
SEEEIATTNPVATEQYGEACPSEDQEHFESEQ

SEQ ID NO: 178692 - protein, 36 aa, Artificial Sequence
  Description of Artificial Sequence: Synthetic polypeptide
DEECIRTTNPVATEQYGQCVCSWGEDNQEFFGSEQS

SEQ ID NO: 178693 - protein, 31 aa, Artificial Sequence
  Description of Artificial Sequence: Synthetic polypeptide
DDSEVASTNPVSTEGYGNVAENTIQSGVGTR

SEQ ID NO: 178694 - protein, 37 aa, Artificial Sequence
  Description of Artificial Sequence: Synthetic polypeptide
DEEEIRGTNPVATEQYGSVQNMNFPNAGEENGQTGGQ

SEQ ID NO: 178695 - protein, 32 aa, Artificial Sequence
  Description of Artificial Sequence: Synthetic polypeptide
SEEEIATTNPVATEQYGCTCPWADNQHFSSEQ

SEQ ID NO: 178696 - protein, 32 aa, Artificial Sequence
  Description of Artificial Sequence: Synthetic polypeptide
DDSEVASTNPVSTEGYGNVAENVISQSRVGER

SEQ ID NO: 178697 - protein, 35 aa, Artificial Sequence
  Description of Artificial Sequence: Synthetic polypeptide
AEIEEIATTNPVAYEQWGSVSTGGNAGEHQGTDEH

SEQ ID NO: 178698 - protein, 33 aa, Artificial Sequence
  Description of Artificial Sequence: Synthetic polypeptide
SEEEIATTNPVATEQYGCSCPWPDNQHFESEQN

SEQ ID NO: 178699 - protein, 34 aa, Artificial Sequence
  Description of Artificial Sequence: Synthetic polypeptide
SEEEIATTNPVATEQYGCSCPSEDQEHFNSENQS

SEQ ID NO: 178700 - protein, 34 aa, Artificial Sequence
  Description of Artificial Sequence: Synthetic polypeptide
SEEEIATTNPVATEQYGCSCPSEDDQEHFSSEQS

SEQ ID NO: 178701 - protein, 33 aa, Artificial Sequence
  Description of Artificial Sequence: Synthetic polypeptide
DESEIATTNPVATQHWGSVCTIEGHNRHTQNDS

SEQ ID NO: 178702 - protein, 35 aa, Artificial Sequence
  Description of Artificial Sequence: Synthetic polypeptide
EEEEIRCTNPTAYEQWGSTVYGEMNHDQRGGDEKR

SEQ ID NO: 178703 - protein, 37 aa, Artificial Sequence
  Description of Artificial Sequence: Synthetic polypeptide
DEEEIRGTNPVATEQYGSVPTSQNGGIVPSVIVENEG

SEQ ID NO: 178704 - protein, 36 aa, Artificial Sequence
  Description of Artificial Sequence: Synthetic polypeptide
DEEEIRGTNPVATEQYGSVPSQYGGIMPSSIVEGVG

SEQ ID NO: 178705 - protein, 36 aa, Artificial Sequence
  Description of Artificial Sequence: Synthetic polypeptide
EEEEIRCTNPTAYEQWGSTVYGENNHQDQRGGDNKR

SEQ ID NO: 178706 - protein, 35 aa, Artificial Sequence
  Description of Artificial Sequence: Synthetic polypeptide
EEEEIRCTNPTAYEQWGSTVYGEQHDQRGGDNKRK

SEQ ID NO: 178707 - protein, 31 aa, Artificial Sequence
  Description of Artificial Sequence: Synthetic polypeptide
DDSEVATTNPVSTEGYGNVAANTIESHVGQR

SEQ ID NO: 178708 - protein, 35 aa, Artificial Sequence
  Description of Artificial Sequence: Synthetic polypeptide
EEEEIRTTNPAATEQYGSVAIDGMGGENGMGFGEE

SEQ ID NO: 178709 - protein, 37 aa, Artificial Sequence
  Description of Artificial Sequence: Synthetic polypeptide
DEETICTTNPVATEFYGSVVENTTDNTGEQDEFGGNE

SEQ ID NO: 178710 - protein, 37 aa, Artificial Sequence
  Description of Artificial Sequence: Synthetic polypeptide
EEEEIRTTNPVATDQYGSVPEPPLTADQPNLEVELNI

SEQ ID NO: 178711 - protein, 38 aa, Artificial Sequence
  Description of Artificial Sequence: Synthetic polypeptide
EEEEIRTTNPVATEAYGVVSTTNEQAGNQQGNNNQTDT

SEQ ID NO: 178712 - protein, 35 aa, Artificial Sequence
  Description of Artificial Sequence: Synthetic polypeptide
DEETICTTNPVATEAYGVVVTVVNDQQGTEEQEED

SEQ ID NO: 178713 - protein, 36 aa, Artificial Sequence
  Description of Artificial Sequence: Synthetic polypeptide
DESEIATTNPVATEQYGTVVSATGGEPSENFEGGQD

SEQ ID NO: 178714 - protein, 36 aa, Artificial Sequence
  Description of Artificial Sequence: Synthetic polypeptide
DEEEIRTTNPVATEFYGTVMNDQQNVAGENEGEGEI

SEQ ID NO: 178715 - protein, 37 aa, Artificial Sequence
  Description of Artificial Sequence: Synthetic polypeptide
DESEIATTNPVATEQYGTVCSATGFEPSENFNGGNDI

SEQ ID NO: 178716 - protein, 36 aa, Artificial Sequence
  Description of Artificial Sequence: Synthetic polypeptide
DESEIATTNPVATEQYGTVCSATGFEPSEEFEGGND

SEQ ID NO: 178717 - protein, 39 aa, Artificial Sequence
  Description of Artificial Sequence: Synthetic polypeptide
DEEEIRTTNPVATEQYGQSSNLSNMNDLEMEDEGQEENG

SEQ ID NO: 178718 - protein, 34 aa, Artificial Sequence
  Description of Artificial Sequence: Synthetic polypeptide
CEEEIATTNPVATAQWGHSVAAGNGDEAEGHNNQ

SEQ ID NO: 178719 - protein, 37 aa, Artificial Sequence
  Description of Artificial Sequence: Synthetic polypeptide
DEEEIRGTNPVATEQYGSVLQVTTGQPQTPENEESLL

SEQ ID NO: 178720 - protein, 37 aa, Artificial Sequence
  Description of Artificial Sequence: Synthetic polypeptide
EEEEIRTTNPVATEQYGSVCSNTEDMQTEEVLEVHVH

SEQ ID NO: 178721 - protein, 35 aa, Artificial Sequence
  Description of Artificial Sequence: Synthetic polypeptide
DEQEIATTNPVATEQWGSVSATGDMGEDHEGGSDN

SEQ ID NO: 178722 - protein, 36 aa, Artificial Sequence
  Description of Artificial Sequence: Synthetic polypeptide
DEAEIACTNPVATEQYGSVCAGTENLAGTPQDEAAD

SEQ ID NO: 178723 - protein, 37 aa, Artificial Sequence
  Description of Artificial Sequence: Synthetic polypeptide
DEEEIRGTNPVATEQYGSVIGPTNNQDHMPVLEIEDT

SEQ ID NO: 178724 - protein, 34 aa, Artificial Sequence
  Description of Artificial Sequence: Synthetic polypeptide
DEAEIACTNPVATEQYGSVCAMANPAEDNMALNH

SEQ ID NO: 178725 - protein, 34 aa, Artificial Sequence
  Description of Artificial Sequence: Synthetic polypeptide
DENEIRTTNPVATEQWGCVCSSGPEANAFISDAN

SEQ ID NO: 178726 - protein, 37 aa, Artificial Sequence
  Description of Artificial Sequence: Synthetic polypeptide
DEEEIRGTNPVATEQYGSVDNMNMPTAGGEGGQTGGQ

SEQ ID NO: 178727 - protein, 39 aa, Artificial Sequence
  Description of Artificial Sequence: Synthetic polypeptide
DESEIRTTNPVATEQYGSVVSNMNLVGDDQDQEDDDNNQ

SEQ ID NO: 178728 - protein, 35 aa, Artificial Sequence
  Description of Artificial Sequence: Synthetic polypeptide
DESEIATTNPVATEQYGTVCSAEGPEVSEFEGGND

SEQ ID NO: 178729 - protein, 38 aa, Artificial Sequence
  Description of Artificial Sequence: Synthetic polypeptide
AECEICTTNPVATEAYGSVSTVTTEEIGTNLQIGNEEM

SEQ ID NO: 178730 - protein, 33 aa, Artificial Sequence
  Description of Artificial Sequence: Synthetic polypeptide
DESEIATTNPVATEQYGTVCAAADGPVEFEIND

SEQ ID NO: 178731 - protein, 37 aa, Artificial Sequence
  Description of Artificial Sequence: Synthetic polypeptide
DEEEIRTTNPVATEFYGTVSVEGMGDRGQGQEAQENT

SEQ ID NO: 178732 - protein, 35 aa, Artificial Sequence
  Description of Artificial Sequence: Synthetic polypeptide
DESEIATTNPVATEQYGTNCSYTGGEVSEFEGGND

SEQ ID NO: 178733 - protein, 34 aa, Artificial Sequence
  Description of Artificial Sequence: Synthetic polypeptide
DENEIRTTNPVATEQWGCVCSSGEEANNINSDAS

SEQ ID NO: 178734 - protein, 35 aa, Artificial Sequence
  Description of Artificial Sequence: Synthetic polypeptide
EEEEIRTTNPVATEQYGSVGWGYADAQSMASAQSY

SEQ ID NO: 178735 - protein, 36 aa, Artificial Sequence
  Description of Artificial Sequence: Synthetic polypeptide
EEEEIRTTNPVATEQYGSVGYLMPGEEQMIMNAEEL

SEQ ID NO: 178736 - protein, 33 aa, Artificial Sequence
  Description of Artificial Sequence: Synthetic polypeptide
AECEIATTNPVAYEQWGSVRWWNQDEQTGDMHP

SEQ ID NO: 178737 - protein, 36 aa, Artificial Sequence
  Description of Artificial Sequence: Synthetic polypeptide
EEEEIRTTNPVATEQYGSVISNSIAEIEHNFMNSGI

SEQ ID NO: 178738 - protein, 31 aa, Artificial Sequence
  Description of Artificial Sequence: Synthetic polypeptide
DDSEVASTNPVSTEGYGNVAKNTIQSIVGQR

SEQ ID NO: 178739 - protein, 34 aa, Artificial Sequence
  Description of Artificial Sequence: Synthetic polypeptide
CEEEIACTNPVATEQWGCVAGTGQLDNQMGGSLE

SEQ ID NO: 178740 - protein, 35 aa, Artificial Sequence
  Description of Artificial Sequence: Synthetic polypeptide
DESEIATTNPVATEQYGTVCSATGGEFSEFEGGLD

SEQ ID NO: 178741 - protein, 37 aa, Artificial Sequence
  Description of Artificial Sequence: Synthetic polypeptide
AEGEICTTNPVATEAYGSVYTNSTELIGNNQEGNEGM

SEQ ID NO: 178742 - protein, 36 aa, Artificial Sequence
  Description of Artificial Sequence: Synthetic polypeptide
DESEIATTNPVATEQYGTVCSATGGEPSEFEGGNVV

SEQ ID NO: 178743 - protein, 35 aa, Artificial Sequence
  Description of Artificial Sequence: Synthetic polypeptide
DEECIRTTNPVATEQYYAQCVCSWGEDQNFGSDQA

SEQ ID NO: 178744 - protein, 37 aa, Artificial Sequence
  Description of Artificial Sequence: Synthetic polypeptide
AEGEICTTNPVATEAYGSVYTNSTEEIGNNQIGNENM

SEQ ID NO: 178745 - protein, 35 aa, Artificial Sequence
  Description of Artificial Sequence: Synthetic polypeptide
SEEEIATTNPVATEMYGIVTHCTNEHDTSSTNNRM

SEQ ID NO: 178746 - protein, 38 aa, Artificial Sequence
  Description of Artificial Sequence: Synthetic polypeptide
AEGEICTTNPVATEAYGSVTTVSTEEIGTNLQIGNETM

SEQ ID NO: 178747 - protein, 35 aa, Artificial Sequence
  Description of Artificial Sequence: Synthetic polypeptide
DENEIRTTNPVATEQWGCVCSTSPEANAFISDTAS

SEQ ID NO: 178748 - protein, 34 aa, Artificial Sequence
  Description of Artificial Sequence: Synthetic polypeptide
CEEEIACTNPVATEQWGCVAGTGLVQTAENGGMY

SEQ ID NO: 178749 - protein, 36 aa, Artificial Sequence
  Description of Artificial Sequence: Synthetic polypeptide
AEGEIATTNPVATEQYGSSFSATDTLEPHEGHEDTR

SEQ ID NO: 178750 - protein, 35 aa, Artificial Sequence
  Description of Artificial Sequence: Synthetic polypeptide
DENEIRTTNPVATEQWGCVCSTSEENAEASESDAS

SEQ ID NO: 178751 - protein, 34 aa, Artificial Sequence
  Description of Artificial Sequence: Synthetic polypeptide
DENEIRTTNPVATEQWGCVCSSPENTEAFSSDAS

SEQ ID NO: 178752 - protein, 33 aa, Artificial Sequence
  Description of Artificial Sequence: Synthetic polypeptide
AECEIRTTNPVAYEQWGSVCVNWEHGEQDMHQF

SEQ ID NO: 178753 - protein, 37 aa, Artificial Sequence
  Description of Artificial Sequence: Synthetic polypeptide
DEEEIRTTNPVATEQYGQCVYPSMPVELGFLNGVEGW

SEQ ID NO: 178754 - protein, 39 aa, Artificial Sequence
  Description of Artificial Sequence: Synthetic polypeptide
DEEEIRTTNPVATEQYGQFVTNSTFQNHCELEQAVVPTQ

SEQ ID NO: 178755 - protein, 34 aa, Artificial Sequence
  Description of Artificial Sequence: Synthetic polypeptide
DENEIRTTNPVATEQWGCVCSSPEANYFISDTAA

SEQ ID NO: 178756 - protein, 36 aa, Artificial Sequence
  Description of Artificial Sequence: Synthetic polypeptide
DEETICTTNPVATESYGSVVNETDNTGEQDEFGGEI

SEQ ID NO: 178757 - protein, 35 aa, Artificial Sequence
  Description of Artificial Sequence: Synthetic polypeptide
DEECIRTTNPVATEQYSACVCSWEEHNQNFGSDQS

SEQ ID NO: 178758 - protein, 36 aa, Artificial Sequence
  Description of Artificial Sequence: Synthetic polypeptide
DEEEIRGTNPVATEQYGSVMVDQNVMEENGIGGGGT

SEQ ID NO: 178759 - protein, 37 aa, Artificial Sequence
  Description of Artificial Sequence: Synthetic polypeptide
DESEIATTNPVATEQYGTVCSGTGGEPSENFNGGNPD

SEQ ID NO: 178760 - protein, 33 aa, Artificial Sequence
  Description of Artificial Sequence: Synthetic polypeptide
DENEIRTTNPVATEQWGCVCSSPEAEAFISDAI

SEQ ID NO: 178761 - protein, 36 aa, Artificial Sequence
  Description of Artificial Sequence: Synthetic polypeptide
DEEEIRTTNPVATEFYGTVMNDQQNVVGQNEGEGEE

SEQ ID NO: 178762 - protein, 36 aa, Artificial Sequence
  Description of Artificial Sequence: Synthetic polypeptide
DEECIRTTNPVATEQYYACVCSNWGELNQNFGSDQS

SEQ ID NO: 178763 - protein, 37 aa, Artificial Sequence
  Description of Artificial Sequence: Synthetic polypeptide
DESEIATTNPVATEQYGTVCSATGGEPSENFNQGNDN

SEQ ID NO: 178764 - protein, 34 aa, Artificial Sequence
  Description of Artificial Sequence: Synthetic polypeptide
DENEIRTTNPVATEQWGCVCSSPDEANAFMSDAA

SEQ ID NO: 178765 - protein, 33 aa, Artificial Sequence
  Description of Artificial Sequence: Synthetic polypeptide
SEEEIATTNPVATAQWGCVAGTVGLEATANPEF

SEQ ID NO: 178766 - protein, 36 aa, Artificial Sequence
  Description of Artificial Sequence: Synthetic polypeptide
DEECIRTTNPVATEQYYACVCSWGETNQENFGSDQA

SEQ ID NO: 178767 - protein, 37 aa, Artificial Sequence
  Description of Artificial Sequence: Synthetic polypeptide
DESEIATTNPVATEQYGTVCSATGGEPSENFNGGNSV

SEQ ID NO: 178768 - protein, 33 aa, Artificial Sequence
  Description of Artificial Sequence: Synthetic polypeptide
SEEEIATTNPVATAQWGCVAGTQGNEATANGEF

SEQ ID NO: 178769 - protein, 37 aa, Artificial Sequence
  Description of Artificial Sequence: Synthetic polypeptide
DESEIATTNPVATEQYGTVCSATGGEPSENFHGGNDG

SEQ ID NO: 178770 - protein, 34 aa, Artificial Sequence
  Description of Artificial Sequence: Synthetic polypeptide
TSHSIQTTNPVATEEWGSVSCEGNSSDRPDGNPR

SEQ ID NO: 178771 - protein, 32 aa, Artificial Sequence
  Description of Artificial Sequence: Synthetic polypeptide
DDSEVASTNPVSTEGYGNVAENGTIQQRVGER

SEQ ID NO: 178772 - protein, 36 aa, Artificial Sequence
  Description of Artificial Sequence: Synthetic polypeptide
SEEEIATTNPVATEQYGSTACATNNEEAPDDQGDNP

SEQ ID NO: 178773 - protein, 36 aa, Artificial Sequence
  Description of Artificial Sequence: Synthetic polypeptide
DEEEIRTTNPVATEQYGQCVCSWGEHEENFGSDTQS

SEQ ID NO: 178774 - protein, 37 aa, Artificial Sequence
  Description of Artificial Sequence: Synthetic polypeptide
DEEEIRTTNPVATEQYGQCVCSWGEHNAENFNSDTQA

SEQ ID NO: 178775 - protein, 37 aa, Artificial Sequence
  Description of Artificial Sequence: Synthetic polypeptide
DEEEIRTTNPVATEQYGQCVCSWGEHNEENFNSDTQM

SEQ ID NO: 178776 - protein, 37 aa, Artificial Sequence
  Description of Artificial Sequence: Synthetic polypeptide
DEEEIRTTNPVATEQYGQCVCSWGEHNIENFNSDTQS

SEQ ID NO: 178777 - protein, 37 aa, Artificial Sequence
  Description of Artificial Sequence: Synthetic polypeptide
DEEEIRTTNPVATEQYGQCVCSWGEHNQEFFNSDNQS

SEQ ID NO: 178778 - protein, 37 aa, Artificial Sequence
  Description of Artificial Sequence: Synthetic polypeptide
DEEEIRTTNPVATEQYGQCVCSWGEHNQEFFNSDTQS

SEQ ID NO: 178779 - protein, 37 aa, Artificial Sequence
  Description of Artificial Sequence: Synthetic polypeptide
DEEEIRTTNPVATEQYGQCVCSWGEHNQENFGSDTQA

SEQ ID NO: 178780 - protein, 34 aa, Artificial Sequence
  Description of Artificial Sequence: Synthetic polypeptide
EEAAEIATTNPVAYEQWGCVAGGDLGQTNGNTER

SEQ ID NO: 178781 - protein, 37 aa, Artificial Sequence
  Description of Artificial Sequence: Synthetic polypeptide
DEEEIRTTNPVATEQYGQCVCSWGEHNQENFGSDTQS

SEQ ID NO: 178782 - protein, 34 aa, Artificial Sequence
  Description of Artificial Sequence: Synthetic polypeptide
EEAAEICTTNPVAYEQWGSVYSGMNDEHHDGGNH

SEQ ID NO: 178783 - protein, 37 aa, Artificial Sequence
  Description of Artificial Sequence: Synthetic polypeptide
DEEEIRTTNPVATEQYGQCVCSWGEHNQENFGSETQG

SEQ ID NO: 178784 - protein, 34 aa, Artificial Sequence
  Description of Artificial Sequence: Synthetic polypeptide
DESEIATTNPVAYEKWGSVCSGENDQHDTNDHKK

SEQ ID NO: 178785 - protein, 37 aa, Artificial Sequence
  Description of Artificial Sequence: Synthetic polypeptide
DEEEIRTTNPVATEQYGQCVCSWGEHNQENFNSDTQS

SEQ ID NO: 178786 - protein, 37 aa, Artificial Sequence
  Description of Artificial Sequence: Synthetic polypeptide
DEEEIRTTNPVATEQYGQCVCSWGEHNQENFNSQPQL

SEQ ID NO: 178787 - protein, 37 aa, Artificial Sequence
  Description of Artificial Sequence: Synthetic polypeptide
DEEEIRTTNPVATEQYGQCVCSWGEHNQENFNSQTQS

SEQ ID NO: 178788 - protein, 33 aa, Artificial Sequence
  Description of Artificial Sequence: Synthetic polypeptide
EEAEIATTNPVATECYGCVYVWENGIQKTGDTG

SEQ ID NO: 178789 - protein, 34 aa, Artificial Sequence
  Description of Artificial Sequence: Synthetic polypeptide
EEAEIATTNPVATECYGCVYVWENGIQKTGGDNS

SEQ ID NO: 178790 - protein, 37 aa, Artificial Sequence
  Description of Artificial Sequence: Synthetic polypeptide
EEAEIATTNPVATENYGCVSCTLNGLNDHEGGRGENS

SEQ ID NO: 178791 - protein, 35 aa, Artificial Sequence
  Description of Artificial Sequence: Synthetic polypeptide
EEAEIATTNPVATEVWGSVCYTNDGQQDDHNGNQH

SEQ ID NO: 178792 - protein, 36 aa, Artificial Sequence
  Description of Artificial Sequence: Synthetic polypeptide
DEQEIRTTNPVATEQYGSVNIPVTSLNHPEDVTEEN

SEQ ID NO: 178793 - protein, 35 aa, Artificial Sequence
  Description of Artificial Sequence: Synthetic polypeptide
DEESIRTTNPVAYDPWGCVVSCANEDAQDGNVGNR

SEQ ID NO: 178794 - protein, 36 aa, Artificial Sequence
  Description of Artificial Sequence: Synthetic polypeptide
EEAEIRTTNPVATEAYGCTVCCCCGNSDQVRGGNTY

SEQ ID NO: 178795 - protein, 36 aa, Artificial Sequence
  Description of Artificial Sequence: Synthetic polypeptide
EEAEIRTTNPVATEAYGCTVCCCIGNSDQARGGNTS

SEQ ID NO: 178796 - protein, 36 aa, Artificial Sequence
  Description of Artificial Sequence: Synthetic polypeptide
EEAEIRTTNPVATEAYGCTVCNCQGNSDQVRGGNTS

SEQ ID NO: 178797 - protein, 36 aa, Artificial Sequence
  Description of Artificial Sequence: Synthetic polypeptide
EEAEIRTTNPVATEAYGCTVCWCQGNPDQERGGNTS

SEQ ID NO: 178798 - protein, 36 aa, Artificial Sequence
  Description of Artificial Sequence: Synthetic polypeptide
DEEEIRTTNPVATEQYGQCVCSWGEHDQENFFSDQS

SEQ ID NO: 178799 - protein, 36 aa, Artificial Sequence
  Description of Artificial Sequence: Synthetic polypeptide
EEAEIRTTNPVATEAYGCTVCWCQGNSSQPRGGNTS

SEQ ID NO: 178800 - protein, 31 aa, Artificial Sequence
  Description of Artificial Sequence: Synthetic polypeptide
DDSEVASTNPVSHEGYGQVAANTIQSRVGQR

SEQ ID NO: 178801 - protein, 37 aa, Artificial Sequence
  Description of Artificial Sequence: Synthetic polypeptide
DEQEIRTTNPVATEQYGSVNIPVTSGQNEQEDVDEEN

SEQ ID NO: 178802 - protein, 31 aa, Artificial Sequence
  Description of Artificial Sequence: Synthetic polypeptide
DDSEVASTNPVSTEGYGNVACNTIQSHVGQR

SEQ ID NO: 178803 - protein, 35 aa, Artificial Sequence
  Description of Artificial Sequence: Synthetic polypeptide
EDETICTTNPVATEQWGTVSTTNLQQLEQGTEDES

SEQ ID NO: 178804 - protein, 31 aa, Artificial Sequence
  Description of Artificial Sequence: Synthetic polypeptide
DDSEVASTNPVSTEGYGNVACNTIQSRDEQR

SEQ ID NO: 178805 - protein, 37 aa, Artificial Sequence
  Description of Artificial Sequence: Synthetic polypeptide
DEEEIRTTNPVATEQYGQCVCSWGEDHNENFGSETQP

SEQ ID NO: 178806 - protein, 36 aa, Artificial Sequence
  Description of Artificial Sequence: Synthetic polypeptide
EDETICTTNPVATEQWGTVSTTNNLNQLEQGTNVET

SEQ ID NO: 178807 - protein, 36 aa, Artificial Sequence
  Description of Artificial Sequence: Synthetic polypeptide
EDETICTTNPVATEQWGTVSTTNNLQGSEQGTNVEQ

SEQ ID NO: 178808 - protein, 35 aa, Artificial Sequence
  Description of Artificial Sequence: Synthetic polypeptide
EDETICTTNPVATEQWGTVSTTNNLQQNEQGTTED

SEQ ID NO: 178809 - protein, 35 aa, Artificial Sequence
  Description of Artificial Sequence: Synthetic polypeptide
DESEIATTNPVAYEQWGSVCSGENDQHLTNDHAKL

SEQ ID NO: 178810 - protein, 32 aa, Artificial Sequence
  Description of Artificial Sequence: Synthetic polypeptide
DDSEVASTNPVSTEGYGNVACNTIQSRPGGQR

SEQ ID NO: 178811 - protein, 37 aa, Artificial Sequence
  Description of Artificial Sequence: Synthetic polypeptide
DESEIRTTNPVATEQYGSVSVTYDESHTERPQHVPYQ

SEQ ID NO: 178812 - protein, 33 aa, Artificial Sequence
  Description of Artificial Sequence: Synthetic polypeptide
DDSEVATTNPVSTEGYGNVAANTIPQSRVGMQR

SEQ ID NO: 178813 - protein, 35 aa, Artificial Sequence
  Description of Artificial Sequence: Synthetic polypeptide
EDETICTTNPVATEQWGTVSTVNNLQQLEQGTEDD

SEQ ID NO: 178814 - protein, 32 aa, Artificial Sequence
  Description of Artificial Sequence: Synthetic polypeptide
AEDEIACTNPVAYEQWGEAAYIENDQDRGGER

SEQ ID NO: 178815 - protein, 37 aa, Artificial Sequence
  Description of Artificial Sequence: Synthetic polypeptide
DESEIRTTNPVATEQYGSVSVTYDVSTTERTQHVQYQ

SEQ ID NO: 178816 - protein, 31 aa, Artificial Sequence
  Description of Artificial Sequence: Synthetic polypeptide
DDSEVASTNPVSHEVYGNVAANTIQSRVGDR

SEQ ID NO: 178817 - protein, 31 aa, Artificial Sequence
  Description of Artificial Sequence: Synthetic polypeptide
DDSEVASTNPVSTEGYGNVACNTIQSRVGQV

SEQ ID NO: 178818 - protein, 34 aa, Artificial Sequence
  Description of Artificial Sequence: Synthetic polypeptide
EDETICTTNPVATEQWGTVSTVNTNQLEQGTEDE

SEQ ID NO: 178819 - protein, 36 aa, Artificial Sequence
  Description of Artificial Sequence: Synthetic polypeptide
DEESIMTTNPVAYEQYGQSITSNTDDLLQPRSIEKH

SEQ ID NO: 178820 - protein, 38 aa, Artificial Sequence
  Description of Artificial Sequence: Synthetic polypeptide
DEEEIRTTNPVATEQYGQCVCSWGEDHNQENFGSQNQS

SEQ ID NO: 178821 - protein, 33 aa, Artificial Sequence
  Description of Artificial Sequence: Synthetic polypeptide
DESEIATTNPVAYEQWGCVCGDEGTGQRGGGDN

SEQ ID NO: 178822 - protein, 35 aa, Artificial Sequence
  Description of Artificial Sequence: Synthetic polypeptide
DEEEISTTNPVAYEQWGCSTVPSSPELSQTEDQED

SEQ ID NO: 178823 - protein, 37 aa, Artificial Sequence
  Description of Artificial Sequence: Synthetic polypeptide
DEQEIRTTNPVATEQYGSVNIPVTSGLNEQEDVTEEL

SEQ ID NO: 178824 - protein, 37 aa, Artificial Sequence
  Description of Artificial Sequence: Synthetic polypeptide
EDETICTTNPVATEQYGVVSTTNNQQLQQLEGNNNDD

SEQ ID NO: 178825 - protein, 37 aa, Artificial Sequence
  Description of Artificial Sequence: Synthetic polypeptide
DEEEIRTTNPVATEQYGQCVCSWGEDHNQNFGSDTQS

SEQ ID NO: 178826 - protein, 37 aa, Artificial Sequence
  Description of Artificial Sequence: Synthetic polypeptide
DEEEIRTTNPVATEQYGQCVCSWGEDHQENSNSDNQS

SEQ ID NO: 178827 - protein, 37 aa, Artificial Sequence
  Description of Artificial Sequence: Synthetic polypeptide
DEEEIRTTNPVATEQYGQCVCSWGEDNQENFNSENQA

SEQ ID NO: 178828 - protein, 36 aa, Artificial Sequence
  Description of Artificial Sequence: Synthetic polypeptide
EEAEIRTTNPVATEAYGCTVPCQGNSDQVRGGNTPL

SEQ ID NO: 178829 - protein, 35 aa, Artificial Sequence
  Description of Artificial Sequence: Synthetic polypeptide
EEAEIRTTNPVATEAYGCTVWCQGNFDQVHGGNTS

SEQ ID NO: 178830 - protein, 36 aa, Artificial Sequence
  Description of Artificial Sequence: Synthetic polypeptide
EEAEIRTTNPVATEAYGCTVWCQGNHDQVRPGGNTS

SEQ ID NO: 178831 - protein, 35 aa, Artificial Sequence
  Description of Artificial Sequence: Synthetic polypeptide
SEEEIATTNPVATEQYGSVCAAGPLGFATQGDEEG

SEQ ID NO: 178832 - protein, 36 aa, Artificial Sequence
  Description of Artificial Sequence: Synthetic polypeptide
DEQEIRTTNPVATEQYGSVNIPVTSLNVAEDVTESN

SEQ ID NO: 178833 - protein, 35 aa, Artificial Sequence
  Description of Artificial Sequence: Synthetic polypeptide
EEAEISTTNPVATEAYGKTVACQGNSDQVRGGNTS

SEQ ID NO: 178834 - protein, 34 aa, Artificial Sequence
  Description of Artificial Sequence: Synthetic polypeptide
DESEIATTNPVAYECWGSVYYTINDGGNQDDNGK

SEQ ID NO: 178835 - protein, 34 aa, Artificial Sequence
  Description of Artificial Sequence: Synthetic polypeptide
EECEIATTNPVATEHWGSVCYNNDDQDHGDQDRQ

SEQ ID NO: 178836 - protein, 37 aa, Artificial Sequence
  Description of Artificial Sequence: Synthetic polypeptide
DEEEIRTTNPVATEQYGQCVCSWGEHNTENFGSETQP

SEQ ID NO: 178837 - protein, 36 aa, Artificial Sequence
  Description of Artificial Sequence: Synthetic polypeptide
DEEEIRTTNPVATEQYGQCVCSWGEHQENFISDTQP

SEQ ID NO: 178838 - protein, 36 aa, Artificial Sequence
  Description of Artificial Sequence: Synthetic polypeptide
DEEEIRTTNPVATEQYGQCVCSWGEHQENFISETQS

SEQ ID NO: 178839 - protein, 33 aa, Artificial Sequence
  Description of Artificial Sequence: Synthetic polypeptide
DENEIRTTNPVATEQWGCVTSSMEEAEAFESDA

SEQ ID NO: 178840 - protein, 37 aa, Artificial Sequence
  Description of Artificial Sequence: Synthetic polypeptide
DEECIRTTNPVATEQYGQCVCSNWEPNQEFFGSDNQS

SEQ ID NO: 178841 - protein, 36 aa, Artificial Sequence
  Description of Artificial Sequence: Synthetic polypeptide
DEEEIRTTNPVATEQYGQCVCSWGEHQENFISQFQG

SEQ ID NO: 178842 - protein, 37 aa, Artificial Sequence
  Description of Artificial Sequence: Synthetic polypeptide
DEESIRTTNPVAYEQYYQEVNSNTINDLLQPRSIEKH

SEQ ID NO: 178843 - protein, 36 aa, Artificial Sequence
  Description of Artificial Sequence: Synthetic polypeptide
DEESIRTTNPVAYEQYYQSVNANTDDLLQPRSIEKH

SEQ ID NO: 178844 - protein, 36 aa, Artificial Sequence
  Description of Artificial Sequence: Synthetic polypeptide
DEDEIATTNPVAYEQYGSVCSVPDGAQATPGDNTQM

SEQ ID NO: 178845 - protein, 37 aa, Artificial Sequence
  Description of Artificial Sequence: Synthetic polypeptide
DEEEIRTTNPVATEQYGQCVCSWGEPNQENFNSDNQL

SEQ ID NO: 178846 - protein, 31 aa, Artificial Sequence
  Description of Artificial Sequence: Synthetic polypeptide
DDSEVASTNPVSTEGYGNVADNTINSRVGQR

SEQ ID NO: 178847 - protein, 35 aa, Artificial Sequence
  Description of Artificial Sequence: Synthetic polypeptide
DEAEIACTNPVATEQYGSVATPAPIAQLSDVNPLF

SEQ ID NO: 178848 - protein, 32 aa, Artificial Sequence
  Description of Artificial Sequence: Synthetic polypeptide
DDSEVASTNPVSTEGYGNVADNTIQSRVGQRR

SEQ ID NO: 178849 - protein, 37 aa, Artificial Sequence
  Description of Artificial Sequence: Synthetic polypeptide
DEQEIRTTNPVATEQYGSVNIPVTSVPNEQEDVTEEN

SEQ ID NO: 178850 - protein, 37 aa, Artificial Sequence
  Description of Artificial Sequence: Synthetic polypeptide
DEEEIRTTNPVATEQYGQCVCSWMEHNEENFNSDTQS

SEQ ID NO: 178851 - protein, 37 aa, Artificial Sequence
  Description of Artificial Sequence: Synthetic polypeptide
DEEEIRGTNPVATEQYGSVTNGGLGEEEMTGGEGAGG

SEQ ID NO: 178852 - protein, 34 aa, Artificial Sequence
  Description of Artificial Sequence: Synthetic polypeptide
EEEEIATTNPVATEPWGIWVCSYSPVSQMGGNNG

SEQ ID NO: 178853 - protein, 31 aa, Artificial Sequence
  Description of Artificial Sequence: Synthetic polypeptide
DDSEVASTNPVSTEGYGNVADNTIQSRVGQW

SEQ ID NO: 178854 - protein, 34 aa, Artificial Sequence
  Description of Artificial Sequence: Synthetic polypeptide
DENEIRTTNPVATEQWGCVTSEVGEMNIAEDETN

SEQ ID NO: 178855 - protein, 35 aa, Artificial Sequence
  Description of Artificial Sequence: Synthetic polypeptide
VEDEIATTNPVATEQYGCVAANNGLAEAPIGDHNA

SEQ ID NO: 178856 - protein, 37 aa, Artificial Sequence
  Description of Artificial Sequence: Synthetic polypeptide
EEAEIRTTNPVAYEQWGSYTISPNEGDHQQRAGNNER

SEQ ID NO: 178857 - protein, 35 aa, Artificial Sequence
  Description of Artificial Sequence: Synthetic polypeptide
SEEEIATTNPVATEQYGSVCAAMMHGDNEMGNSDI

SEQ ID NO: 178858 - protein, 35 aa, Artificial Sequence
  Description of Artificial Sequence: Synthetic polypeptide
DESEIATTNPVAYEEWGCSVSCTTGFSQSGEGNSA

SEQ ID NO: 178859 - protein, 36 aa, Artificial Sequence
  Description of Artificial Sequence: Synthetic polypeptide
SEEEIATTNPVATEQYGSVCAANNGEEAGDEMENNH

SEQ ID NO: 178860 - protein, 36 aa, Artificial Sequence
  Description of Artificial Sequence: Synthetic polypeptide
EEAEIRTTNPVATEAYGCTVWCQGNNSDQVRGGNQS

SEQ ID NO: 178861 - protein, 36 aa, Artificial Sequence
  Description of Artificial Sequence: Synthetic polypeptide
EEAEIRTTNPVATEAYGCTVWCQGNSAQVRGGNTSW

SEQ ID NO: 178862 - protein, 35 aa, Artificial Sequence
  Description of Artificial Sequence: Synthetic polypeptide
EEAEIRTTNPVATEAYGCTVWCQGNSDHVRGGNYS

SEQ ID NO: 178863 - protein, 36 aa, Artificial Sequence
  Description of Artificial Sequence: Synthetic polypeptide
EEAEIRTTNPVATEAYGCTVWCQGNSDQDRGGNTSS

SEQ ID NO: 178864 - protein, 35 aa, Artificial Sequence
  Description of Artificial Sequence: Synthetic polypeptide
EEAEIRTTNPVATEAYGCTVWCQGNSDQVGGGNTA

SEQ ID NO: 178865 - protein, 36 aa, Artificial Sequence
  Description of Artificial Sequence: Synthetic polypeptide
EEAEIRTTNPVATEAYGCTVWCQGNSDQVRGGNNSG

SEQ ID NO: 178866 - protein, 36 aa, Artificial Sequence
  Description of Artificial Sequence: Synthetic polypeptide
EEAEIRTTNPVATEAYGKTVPSCQGNSDQVRGGDTS

SEQ ID NO: 178867 - protein, 36 aa, Artificial Sequence
  Description of Artificial Sequence: Synthetic polypeptide
EEAEIRTTNPVATEAYGKTVPWCQGNSDQVRGGNTH

SEQ ID NO: 178868 - protein, 36 aa, Artificial Sequence
  Description of Artificial Sequence: Synthetic polypeptide
EEAEIRTTNPVATEAYGKTVSCQGNSDQVRGGETSN

SEQ ID NO: 178869 - protein, 36 aa, Artificial Sequence
  Description of Artificial Sequence: Synthetic polypeptide
EEAEIRTTNPVATEAYGKTVSCQGNSSDQVRGGQTS

SEQ ID NO: 178870 - protein, 35 aa, Artificial Sequence
  Description of Artificial Sequence: Synthetic polypeptide
EEAEIRTTNPVATEAYGKTVWCQGNSDVVRGGNTP

SEQ ID NO: 178871 - protein, 36 aa, Artificial Sequence
  Description of Artificial Sequence: Synthetic polypeptide
EEAEIRTTNPVATEPYGCTVCCCQGNSDQVRGGNTN

SEQ ID NO: 178872 - protein, 34 aa, Artificial Sequence
  Description of Artificial Sequence: Synthetic polypeptide
VEDEIATTNPVATEQWGGCVAAKANLMMQPGDTD

SEQ ID NO: 178873 - protein, 36 aa, Artificial Sequence
  Description of Artificial Sequence: Synthetic polypeptide
EEAEIRTTNPVATEQYGSTSNVYPEAFTQEGVNEEN

SEQ ID NO: 178874 - protein, 38 aa, Artificial Sequence
  Description of Artificial Sequence: Synthetic polypeptide
EEAEIRTTNPVATEQYGSVCSNLTNMHINTGDETKNEE

SEQ ID NO: 178875 - protein, 38 aa, Artificial Sequence
  Description of Artificial Sequence: Synthetic polypeptide
EEAEIRTTNPVATEQYGSVCSNLTWMHINTGPEAQNRM

SEQ ID NO: 178876 - protein, 32 aa, Artificial Sequence
  Description of Artificial Sequence: Synthetic polypeptide
DDSEVASTNPVSTEGYGNVACNTISQSRVGSR

SEQ ID NO: 178877 - protein, 35 aa, Artificial Sequence
  Description of Artificial Sequence: Synthetic polypeptide
DEESIRTTNPVAYDPWGCVVSCANEDSQNGNDGNR

SEQ ID NO: 178878 - protein, 34 aa, Artificial Sequence
  Description of Artificial Sequence: Synthetic polypeptide
EEAEIRTTNPVAYEAWGTVCSTNDHHEHDGGERG

SEQ ID NO: 178879 - protein, 35 aa, Artificial Sequence
  Description of Artificial Sequence: Synthetic polypeptide
EEAEIRTTNPVAYEAYGKTVSCQGASDQVRGGNTS

SEQ ID NO: 178880 - protein, 34 aa, Artificial Sequence
  Description of Artificial Sequence: Synthetic polypeptide
EEAEIRTTNPVAYECWGVCSTTNLPGMNEGGDNQ

SEQ ID NO: 178881 - protein, 35 aa, Artificial Sequence
  Description of Artificial Sequence: Synthetic polypeptide
EEAEIRTTNPVAYEQWGCYTISPNEGDQQRQGQRT

SEQ ID NO: 178882 - protein, 37 aa, Artificial Sequence
  Description of Artificial Sequence: Synthetic polypeptide
DEEEIRTTNPVATEQYGQCVCSWGEHNQEYFNSDNQE

SEQ ID NO: 178883 - protein, 34 aa, Artificial Sequence
  Description of Artificial Sequence: Synthetic polypeptide
EEAEIRTTNPVAYEQWGMYTIQPNEGDQQRQGGR

SEQ ID NO: 178884 - protein, 35 aa, Artificial Sequence
  Description of Artificial Sequence: Synthetic polypeptide
EEAEIRTTNPVAYEQWGSVCSTMDRDNGPGDTDRE

SEQ ID NO: 178885 - protein, 35 aa, Artificial Sequence
  Description of Artificial Sequence: Synthetic polypeptide
EEAEIRTTNPVAYEQWGSVCSTMDRDNQMGEGEKE

SEQ ID NO: 178886 - protein, 35 aa, Artificial Sequence
  Description of Artificial Sequence: Synthetic polypeptide
DEESIRTTNPVAYDPWGCVVSCANEDQDNNVGNRS

SEQ ID NO: 178887 - protein, 36 aa, Artificial Sequence
  Description of Artificial Sequence: Synthetic polypeptide
YEEEIRTTNPVATEGYGCTGSIMNDIGDQGGDRGEG

SEQ ID NO: 178888 - protein, 34 aa, Artificial Sequence
  Description of Artificial Sequence: Synthetic polypeptide
CEEEIACTNPVATEQWGCVAGTNGDENGMGEEDR

SEQ ID NO: 178889 - protein, 38 aa, Artificial Sequence
  Description of Artificial Sequence: Synthetic polypeptide
EEEEIRTTNPVATEQYGSVISWIMSNDDMLSQLPELWE

SEQ ID NO: 178890 - protein, 37 aa, Artificial Sequence
  Description of Artificial Sequence: Synthetic polypeptide
EEEEIRTTNPVATEQYGSVVLGTADMTMDEPEQEGTP

SEQ ID NO: 178891 - protein, 37 aa, Artificial Sequence
  Description of Artificial Sequence: Synthetic polypeptide
EEEEIRTTNPVATEQYGSVVLLIADMTMEEPEQEGTS

SEQ ID NO: 178892 - protein, 37 aa, Artificial Sequence
  Description of Artificial Sequence: Synthetic polypeptide
EEEEIRTTNPVATEQYGSVVNGIADMTMEEPAQEGTP

SEQ ID NO: 178893 - protein, 36 aa, Artificial Sequence
  Description of Artificial Sequence: Synthetic polypeptide
DEAEIRTTNPVATEPWGSVCPTDNDNNDQGGDGQDT

SEQ ID NO: 178894 - protein, 37 aa, Artificial Sequence
  Description of Artificial Sequence: Synthetic polypeptide
DEAEIRTTNPVATEMYGSVCSVTAANQDTGYSEEVES

SEQ ID NO: 178895 - protein, 33 aa, Artificial Sequence
  Description of Artificial Sequence: Synthetic polypeptide
DENEIRTTNPVATEPYGATTAMEDWQQQQKGPI

SEQ ID NO: 178896 - protein, 33 aa, Artificial Sequence
  Description of Artificial Sequence: Synthetic polypeptide
DENEIRTTNPVATEPYGATTAMEDWQAQQKGPI

SEQ ID NO: 178897 - protein, 33 aa, Artificial Sequence
  Description of Artificial Sequence: Synthetic polypeptide
DENEIRTTNPVATEPYGATIAMEDWQQQQKGPI

SEQ ID NO: 178898 - protein, 37 aa, Artificial Sequence
  Description of Artificial Sequence: Synthetic polypeptide
EEEEIRTTNPVATEQYGSVYMEAPALEIQVNQQGQTD

SEQ ID NO: 178899 - protein, 38 aa, Artificial Sequence
  Description of Artificial Sequence: Synthetic polypeptide
EEEEIRTTNPVATEQYGSVYMEAPNLEIQMVNSQGQVD

SEQ ID NO: 178900 - protein, 37 aa, Artificial Sequence
  Description of Artificial Sequence: Synthetic polypeptide
EEEEIRTTNPVATEQYGSVYMEAPSLEIQVNSVGQPD

SEQ ID NO: 178901 - protein, 37 aa, Artificial Sequence
  Description of Artificial Sequence: Synthetic polypeptide
EEEEIRTTNPVATEQYGSVYMEAPTLEIQHNSQGQPD

SEQ ID NO: 178902 - protein, 37 aa, Artificial Sequence
  Description of Artificial Sequence: Synthetic polypeptide
EEEEIRTTNPVATEQYGSVYMEAPVLEIHVNQQGQLD

SEQ ID NO: 178903 - protein, 37 aa, Artificial Sequence
  Description of Artificial Sequence: Synthetic polypeptide
DEEEIRTTNPVATEQYGSACPCNTSMMLGQQMQVDIE

SEQ ID NO: 178904 - protein, 35 aa, Artificial Sequence
  Description of Artificial Sequence: Synthetic polypeptide
DEECIRTTNPVAYEQYGCVCSWGEHNQYFISDNQS

SEQ ID NO: 178905 - protein, 32 aa, Artificial Sequence
  Description of Artificial Sequence: Synthetic polypeptide
CEEEIACTNPVATEQYGCAAGEGHGQDSEGED

SEQ ID NO: 178906 - protein, 38 aa, Artificial Sequence
  Description of Artificial Sequence: Synthetic polypeptide
EEEEIRTTNPVATEQYGSVYSEAPQLEIQEVNSQGQPD

SEQ ID NO: 178907 - protein, 32 aa, Artificial Sequence
  Description of Artificial Sequence: Synthetic polypeptide
DDSEVASTNPVSTEGYGNVAWNTIGQSRVGQR

SEQ ID NO: 178908 - protein, 36 aa, Artificial Sequence
  Description of Artificial Sequence: Synthetic polypeptide
EEEEIRTTNPVATEQYGSVYVYIEEQIENTEEDNDM

SEQ ID NO: 178909 - protein, 37 aa, Artificial Sequence
  Description of Artificial Sequence: Synthetic polypeptide
EEEEIRTTNPVATEQYGSYSSPSTAEPNIPVGHPPVC

SEQ ID NO: 178910 - protein, 32 aa, Artificial Sequence
  Description of Artificial Sequence: Synthetic polypeptide
VEDEIATTNPVATEQWGCVAGTGELINMEMFD

SEQ ID NO: 178911 - protein, 38 aa, Artificial Sequence
  Description of Artificial Sequence: Synthetic polypeptide
DEEEIRTTNPVATEQYGSAFVNGIVMESGDSLMQDSIV

SEQ ID NO: 178912 - protein, 37 aa, Artificial Sequence
  Description of Artificial Sequence: Synthetic polypeptide
EEEEIRTTNPVATEQYGTVGISTDALTEMVSTADNLE

SEQ ID NO: 178913 - protein, 37 aa, Artificial Sequence
  Description of Artificial Sequence: Synthetic polypeptide
EEEEIRTTNPVATEQYGTVGISTDALTVVSTATDNLG

SEQ ID NO: 178914 - protein, 33 aa, Artificial Sequence
  Description of Artificial Sequence: Synthetic polypeptide
DENEIRTTNPVATEPWGTTISNAEDIQQPNGPI

SEQ ID NO: 178915 - protein, 37 aa, Artificial Sequence
  Description of Artificial Sequence: Synthetic polypeptide
EEEEIRTTNPVATEQYGSVVLGIADQTSEEPEQEGTP

SEQ ID NO: 178916 - protein, 33 aa, Artificial Sequence
  Description of Artificial Sequence: Synthetic polypeptide
DENEIRTTNPVATEPWGTTISNAEDIQEPNGPI

SEQ ID NO: 178917 - protein, 34 aa, Artificial Sequence
  Description of Artificial Sequence: Synthetic polypeptide
CEEEIACTNPVATEQWGTSQSLATALGQHDDMVN

SEQ ID NO: 178918 - protein, 37 aa, Artificial Sequence
  Description of Artificial Sequence: Synthetic polypeptide
EEEEIRTTNPVATEQYGSVVLGIADDTMEEPEQEGHP

SEQ ID NO: 178919 - protein, 37 aa, Artificial Sequence
  Description of Artificial Sequence: Synthetic polypeptide
DESEIATTNPVATEQYGSVCAADNGLEATRNAMIDRH

SEQ ID NO: 178920 - protein, 38 aa, Artificial Sequence
  Description of Artificial Sequence: Synthetic polypeptide
DEEEIRTTNPVATEQYGQVVCSNSGEHNQEGFNSDTQS

SEQ ID NO: 178921 - protein, 38 aa, Artificial Sequence
  Description of Artificial Sequence: Synthetic polypeptide
DEEEIRCTNPVATEQYGSVVNDTDDQNLEGENGEGGDQ

SEQ ID NO: 178922 - protein, 35 aa, Artificial Sequence
  Description of Artificial Sequence: Synthetic polypeptide
DESEIATTNPVATEQYGSVCAADNGLEATAAMIMH

SEQ ID NO: 178923 - protein, 37 aa, Artificial Sequence
  Description of Artificial Sequence: Synthetic polypeptide
DESEIATTNPVATEQYGSVCAADNGLEAPDDAMGARH

SEQ ID NO: 178924 - protein, 35 aa, Artificial Sequence
  Description of Artificial Sequence: Synthetic polypeptide
CEEEISTTNPVATEQYGCVCSNWEHAENFGSNTQS

SEQ ID NO: 178925 - protein, 35 aa, Artificial Sequence
  Description of Artificial Sequence: Synthetic polypeptide
DESEIATTNPVATEQYGSVCAADNGLEAAAMIDHH

SEQ ID NO: 178926 - protein, 36 aa, Artificial Sequence
  Description of Artificial Sequence: Synthetic polypeptide
SEEEIACTNPVATEQYGSACSAANPLAEAEMGNGLY

SEQ ID NO: 178927 - protein, 36 aa, Artificial Sequence
  Description of Artificial Sequence: Synthetic polypeptide
TSYEIRTTNPVATEQYGSVSNTPNNETPMFSQEEDF

SEQ ID NO: 178928 - protein, 34 aa, Artificial Sequence
  Description of Artificial Sequence: Synthetic polypeptide
DEECIRTTNPVAYEQWGVYWSLDNDLRKAKVDDR

SEQ ID NO: 178929 - protein, 36 aa, Artificial Sequence
  Description of Artificial Sequence: Synthetic polypeptide
DESEIATTNPVATEQYGSVCAADNGDETGMDINNVN

SEQ ID NO: 178930 - protein, 31 aa, Artificial Sequence
  Description of Artificial Sequence: Synthetic polypeptide
DDSEVASTNPVGTEGYGNVAASTIQSHVGQR

SEQ ID NO: 178931 - protein, 37 aa, Artificial Sequence
  Description of Artificial Sequence: Synthetic polypeptide
EEEEIRTTNPVATEQYGSVSWIMSPDDMLRQLPELYE

SEQ ID NO: 178932 - protein, 37 aa, Artificial Sequence
  Description of Artificial Sequence: Synthetic polypeptide
EEEEIRTTNPVATEQYGSVTCLSPEIYSIQFEQENLQ

SEQ ID NO: 178933 - protein, 37 aa, Artificial Sequence
  Description of Artificial Sequence: Synthetic polypeptide
EEEEIRTTNPVATEQYGSVTMLSPEEYSIQQEQEGRQ

SEQ ID NO: 178934 - protein, 37 aa, Artificial Sequence
  Description of Artificial Sequence: Synthetic polypeptide
DEETIRTTNPVATEQWGVVVVTVNNNNQQLLGNNQDT

SEQ ID NO: 178935 - protein, 38 aa, Artificial Sequence
  Description of Artificial Sequence: Synthetic polypeptide
DEEEIRTTNPVATEQYGQYGVNSNMDLEMEDEGQDGEE

SEQ ID NO: 178936 - protein, 31 aa, Artificial Sequence
  Description of Artificial Sequence: Synthetic polypeptide
DDSEVASTNPVSTEGYGNVAVNTIQSRVGQY

SEQ ID NO: 178937 - protein, 32 aa, Artificial Sequence
  Description of Artificial Sequence: Synthetic polypeptide
DDSEVASTNPVSTEGYGNVAVNTIQSRVGVQR

SEQ ID NO: 178938 - protein, 31 aa, Artificial Sequence
  Description of Artificial Sequence: Synthetic polypeptide
DDSEVASTNPVSTEGYGNVAVWEIQSRVGQR

SEQ ID NO: 178939 - protein, 38 aa, Artificial Sequence
  Description of Artificial Sequence: Synthetic polypeptide
DEEEIRTTNPVATEQYGSVVSDGMFGQEGEQEEDQDGG

SEQ ID NO: 178940 - protein, 36 aa, Artificial Sequence
  Description of Artificial Sequence: Synthetic polypeptide
YEEEIRTTNPVATEQYGEVVDNNNENMVGGGNENEG

SEQ ID NO: 178941 - protein, 35 aa, Artificial Sequence
  Description of Artificial Sequence: Synthetic polypeptide
DEECIRTTNPVAYEQYGCVCSNWGEDNQYFGSEQS

SEQ ID NO: 178942 - protein, 32 aa, Artificial Sequence
  Description of Artificial Sequence: Synthetic polypeptide
DDSEVASTNPVSTEGYGNVAWNDTIQQREGQR

SEQ ID NO: 178943 - protein, 35 aa, Artificial Sequence
  Description of Artificial Sequence: Synthetic polypeptide
DEECIRTTNPVAYEQYGCVCSNWGEHNQHFGSQQA

SEQ ID NO: 178944 - protein, 37 aa, Artificial Sequence
  Description of Artificial Sequence: Synthetic polypeptide
EEEEIRTTNPVATEQYGSVVLGIADMGMENPEQEGTP

SEQ ID NO: 178945 - protein, 37 aa, Artificial Sequence
  Description of Artificial Sequence: Synthetic polypeptide
EEEEIRTTNPVATEQYGVVATSLQFAGTEAGSTDTDD

SEQ ID NO: 178946 - protein, 34 aa, Artificial Sequence
  Description of Artificial Sequence: Synthetic polypeptide
DENEIRTTNPVATEPWGTIWANMEDIQQQPNGNH

SEQ ID NO: 178947 - protein, 37 aa, Artificial Sequence
  Description of Artificial Sequence: Synthetic polypeptide
DEEEIRTTNPVATEQYGSAGETTNQAVIVAEQVADFG

SEQ ID NO: 178948 - protein, 31 aa, Artificial Sequence
  Description of Artificial Sequence: Synthetic polypeptide
SEEEIACTNPVATASWGCVAGTGLARNPDQD

SEQ ID NO: 178949 - protein, 37 aa, Artificial Sequence
  Description of Artificial Sequence: Synthetic polypeptide
DEEEIRTTNPVATEQYGSAMQLEVIEVQTPLMMEMEE

SEQ ID NO: 178950 - protein, 34 aa, Artificial Sequence
  Description of Artificial Sequence: Synthetic polypeptide
TTAEIATTNPVATECYGSVCSGGLNDDRQEQNND

SEQ ID NO: 178951 - protein, 37 aa, Artificial Sequence
  Description of Artificial Sequence: Synthetic polypeptide
DEEEIRTTNPVATEQYGSAMQLWVDEVSTPQMMELEE

SEQ ID NO: 178952 - protein, 36 aa, Artificial Sequence
  Description of Artificial Sequence: Synthetic polypeptide
DDEEIRTTNPVATEQYGVVVGGTDQNTGEGEEGDEG

SEQ ID NO: 178953 - protein, 37 aa, Artificial Sequence
  Description of Artificial Sequence: Synthetic polypeptide
DEEEIRTTNPVATEQYGSAMYTTGPLALEPEGEIVTA

SEQ ID NO: 178954 - protein, 37 aa, Artificial Sequence
  Description of Artificial Sequence: Synthetic polypeptide
EEEEIRTTNPVATESYGSVSLTVLEEIHAPVGQFQMQ

SEQ ID NO: 178955 - protein, 37 aa, Artificial Sequence
  Description of Artificial Sequence: Synthetic polypeptide
EEEEIRTTNPVATESYGSVSLTVTEEIEARVGQFQMP

SEQ ID NO: 178956 - protein, 35 aa, Artificial Sequence
  Description of Artificial Sequence: Synthetic polypeptide
DEAEIRTTNPVATEGYGCVCSTGEHNQNFPSDTQA

SEQ ID NO: 178957 - protein, 36 aa, Artificial Sequence
  Description of Artificial Sequence: Synthetic polypeptide
DDEEIRTTNPVATEQYGVVVAGDDQNDGNGEEGNEG

SEQ ID NO: 178958 - protein, 38 aa, Artificial Sequence
  Description of Artificial Sequence: Synthetic polypeptide
DEEEIRTTNPVATEQYGSANCPTNLALIAAISQFQEPE

SEQ ID NO: 178959 - protein, 34 aa, Artificial Sequence
  Description of Artificial Sequence: Synthetic polypeptide
DEAEIRTTNPVATEGYGCVCFWEHNTENFGSDQS

SEQ ID NO: 178960 - protein, 37 aa, Artificial Sequence
  Description of Artificial Sequence: Synthetic polypeptide
DEEEIRTTNPVATEQYGSANSEADNPDDEDSGQEETG

SEQ ID NO: 178961 - protein, 34 aa, Artificial Sequence
  Description of Artificial Sequence: Synthetic polypeptide
AEANEIATTNPVAYEQWGSVAWTENQNGGPNGEG

SEQ ID NO: 178962 - protein, 36 aa, Artificial Sequence
  Description of Artificial Sequence: Synthetic polypeptide
DDEEIRTTNPVATEQYGVVSAGDDQNDEEGEEGEEG

SEQ ID NO: 178963 - protein, 38 aa, Artificial Sequence
  Description of Artificial Sequence: Synthetic polypeptide
DEEEIRTTNPVATEQYGSANSEAFNPDDLGMSGQEEIG

SEQ ID NO: 178964 - protein, 35 aa, Artificial Sequence
  Description of Artificial Sequence: Synthetic polypeptide
CEEEISTTNPVATEQYGCVCSNWGEHNAGFGSEQT

SEQ ID NO: 178965 - protein, 37 aa, Artificial Sequence
  Description of Artificial Sequence: Synthetic polypeptide
DEEEIRTTNPVATEQYGSANSEANPDDEMGSGQEEFG

SEQ ID NO: 178966 - protein, 35 aa, Artificial Sequence
  Description of Artificial Sequence: Synthetic polypeptide
EEEEIRTTNPVAYEAYGKVVHCTNHAGTPKGENGF

SEQ ID NO: 178967 - protein, 37 aa, Artificial Sequence
  Description of Artificial Sequence: Synthetic polypeptide
DEEEIRTTNPVATEQYGSANSEANPDDTGGSTQEEIG

SEQ ID NO: 178968 - protein, 33 aa, Artificial Sequence
  Description of Artificial Sequence: Synthetic polypeptide
DECEIATTNPVAYEQYGVCSTIDQHQQPKEMDE

SEQ ID NO: 178969 - protein, 37 aa, Artificial Sequence
  Description of Artificial Sequence: Synthetic polypeptide
DEEEIRTTNPVATEQYGCVCSDWEEDHNQNSNSENQA

SEQ ID NO: 178970 - protein, 32 aa, Artificial Sequence
  Description of Artificial Sequence: Synthetic polypeptide
DDSEVASTNPVSTEGYGNVCAANTIQSRVGQR

SEQ ID NO: 178971 - protein, 36 aa, Artificial Sequence
  Description of Artificial Sequence: Synthetic polypeptide
DEEEISCTNPVATEQYGCVCSTEEHNQENFGSETQA

SEQ ID NO: 178972 - protein, 34 aa, Artificial Sequence
  Description of Artificial Sequence: Synthetic polypeptide
TTAEIATTNPVATECYGSVSGGLNDDRQDQGGDM

SEQ ID NO: 178973 - protein, 39 aa, Artificial Sequence
  Description of Artificial Sequence: Synthetic polypeptide
EEEEIRTTNPVATEQYGVVTVTVTNLQLNQNGNQNGTDE

SEQ ID NO: 178974 - protein, 34 aa, Artificial Sequence
  Description of Artificial Sequence: Synthetic polypeptide
DEAEIATTNPIATEQWGHIVPTWWDQHEHDGNMK

SEQ ID NO: 178975 - protein, 37 aa, Artificial Sequence
  Description of Artificial Sequence: Synthetic polypeptide
DDEEIRTTNPVATEQYGYVATEVMVLNGHFRPNEEVK

SEQ ID NO: 178976 - protein, 32 aa, Artificial Sequence
  Description of Artificial Sequence: Synthetic polypeptide
DDSEVASTNPVSTEGYGNVAYNTIQSRVGQRE

SEQ ID NO: 178977 - protein, 34 aa, Artificial Sequence
  Description of Artificial Sequence: Synthetic polypeptide
DENEIRTTNPVATEPWGTIWANAEDIQQQPNGNH

SEQ ID NO: 178978 - protein, 37 aa, Artificial Sequence
  Description of Artificial Sequence: Synthetic polypeptide
EEEEIRTTNPVATEQYGVVSSVELQAGTEAGSTTTDD

SEQ ID NO: 178979 - protein, 35 aa, Artificial Sequence
  Description of Artificial Sequence: Synthetic polypeptide
DEECIRTTNPVAYEQYGCVCSWGEHNQYFNSDFQA

SEQ ID NO: 178980 - protein, 37 aa, Artificial Sequence
  Description of Artificial Sequence: Synthetic polypeptide
DEETIRTTNPVATEQYGSVQPNENYLVMVTEHVEQNE

SEQ ID NO: 178981 - protein, 32 aa, Artificial Sequence
  Description of Artificial Sequence: Synthetic polypeptide
DENEIRTTNPVATEPWGDISMEIIQMNQAEDA

SEQ ID NO: 178982 - protein, 34 aa, Artificial Sequence
  Description of Artificial Sequence: Synthetic polypeptide
DEAEIATTNPEATDQYGQVCCCDQDQKREGDDDR

SEQ ID NO: 178983 - protein, 34 aa, Artificial Sequence
  Description of Artificial Sequence: Synthetic polypeptide
DEAEIATTNPEATDQYGQVCCCDQDQKREGNNQI

SEQ ID NO: 178984 - protein, 38 aa, Artificial Sequence
  Description of Artificial Sequence: Synthetic polypeptide
EEEEIRTTNPVATEQYGVVSTTTQQQLQAGTEEGSEGG

SEQ ID NO: 178985 - protein, 36 aa, Artificial Sequence
  Description of Artificial Sequence: Synthetic polypeptide
DEEEIRTTNPVATEQYGSAIFISGGEEVPEGEVPEI

SEQ ID NO: 178986 - protein, 39 aa, Artificial Sequence
  Description of Artificial Sequence: Synthetic polypeptide
EEEEIRTTNPVATEQYGVVSTVVNNNNQQGNQEETDETD

SEQ ID NO: 178987 - protein, 39 aa, Artificial Sequence
  Description of Artificial Sequence: Synthetic polypeptide
EEEEIRTTNPVATEQYGVVSTVVNNNNQQGNQEETEEDT

SEQ ID NO: 178988 - protein, 39 aa, Artificial Sequence
  Description of Artificial Sequence: Synthetic polypeptide
EEEEIRTTNPVATEQYGVVSTVVNNQNGNNGQEGTEAGE

SEQ ID NO: 178989 - protein, 36 aa, Artificial Sequence
  Description of Artificial Sequence: Synthetic polypeptide
CEEEISTTNPVATEQYGCVCSNTMEHNQNFNSDTQS

SEQ ID NO: 178990 - protein, 39 aa, Artificial Sequence
  Description of Artificial Sequence: Synthetic polypeptide
EEEEIRTTNPVATEQYGVVSTVVNNQNGNQGQISTEAGE

SEQ ID NO: 178991 - protein, 39 aa, Artificial Sequence
  Description of Artificial Sequence: Synthetic polypeptide
EEEEIRTTNPVATEQYGVVSTVVNNQQGNQTQGTNVATE

SEQ ID NO: 178992 - protein, 39 aa, Artificial Sequence
  Description of Artificial Sequence: Synthetic polypeptide
EEEEIRTTNPVATEQYGVVSTVVNSNQQQGENQNTEEEE

SEQ ID NO: 178993 - protein, 39 aa, Artificial Sequence
  Description of Artificial Sequence: Synthetic polypeptide
EEEEIRTTNPVATEQYGVVSTVVNTNQQQGNQEEGDEDT

SEQ ID NO: 178994 - protein, 33 aa, Artificial Sequence
  Description of Artificial Sequence: Synthetic polypeptide
TTAEIATTNPVATECWGSVAGGLNDDRQEQGNH

SEQ ID NO: 178995 - protein, 39 aa, Artificial Sequence
  Description of Artificial Sequence: Synthetic polypeptide
EEEEIRTTNPVATEQYGVVSTVVNTQQGNQQATTNVATE

SEQ ID NO: 178996 - protein, 39 aa, Artificial Sequence
  Description of Artificial Sequence: Synthetic polypeptide
EEEEIRTTNPVATEQYGVVSTVVSNNQQQGNNEEIDEED

SEQ ID NO: 178997 - protein, 36 aa, Artificial Sequence
  Description of Artificial Sequence: Synthetic polypeptide
DEETIRTTNPVATEQYGSVSPVMTMDVITAIEQSMP

SEQ ID NO: 178998 - protein, 39 aa, Artificial Sequence
  Description of Artificial Sequence: Synthetic polypeptide
EEEEIRTTNPVATEQYGVVSTVVVTNQQQGNQEEEEEDT

SEQ ID NO: 178999 - protein, 39 aa, Artificial Sequence
  Description of Artificial Sequence: Synthetic polypeptide
EEEEIRTTNPVATEQYGVVSTVVVTNQQQGNQEENDEED

SEQ ID NO: 179000 - protein, 39 aa, Artificial Sequence
  Description of Artificial Sequence: Synthetic polypeptide
EEEEIRTTNPVATEQYGVVSTVVVTNQQQGNTEEGEEDE

SEQ ID NO: 179001 - protein, 34 aa, Artificial Sequence
  Description of Artificial Sequence: Synthetic polypeptide
TTAEIATTNPVATECWGSVSGGLNDDRQEQGNEQ

SEQ ID NO: 179002 - protein, 38 aa, Artificial Sequence
  Description of Artificial Sequence: Synthetic polypeptide
EEEEIRTTNPVATEQYGVVSVVVSTQQQQAATTNVATE

SEQ ID NO: 179003 - protein, 39 aa, Artificial Sequence
  Description of Artificial Sequence: Synthetic polypeptide
EEEEIRTTNPVATEQYGVVSTVVNNQNGNQLQSTTEAGE

SEQ ID NO: 179004 - protein, 36 aa, Artificial Sequence
  Description of Artificial Sequence: Synthetic polypeptide
EEEEIRTTNPVAYEQWGCSYNVPPEDTDQRPGDRPV

SEQ ID NO: 179005 - protein, 37 aa, Artificial Sequence
  Description of Artificial Sequence: Synthetic polypeptide
CEEEISTTNPVATEQYGCVCSNTMEHNQENFGSNTQS

SEQ ID NO: 179006 - protein, 36 aa, Artificial Sequence
  Description of Artificial Sequence: Synthetic polypeptide
DEECIRTTNPVAYEQWGVVCFTIEQDGQRQQPNGNN

SEQ ID NO: 179007 - protein, 37 aa, Artificial Sequence
  Description of Artificial Sequence: Synthetic polypeptide
AEEQIRTTNPVATEQYGVVSTVTNQGQNQNNQQGTTE

SEQ ID NO: 179008 - protein, 33 aa, Artificial Sequence
  Description of Artificial Sequence: Synthetic polypeptide
DENEIRTTNPVATEQWGCCVTREVEMNILEDES

SEQ ID NO: 179009 - protein, 33 aa, Artificial Sequence
  Description of Artificial Sequence: Synthetic polypeptide
SEEEIASVNPVCTEQYGCVCSWNHNQSFGSEQA

SEQ ID NO: 179010 - protein, 33 aa, Artificial Sequence
  Description of Artificial Sequence: Synthetic polypeptide
DENEIRTTNPVATEQWGAVVDQIMQMNIAEMDA

SEQ ID NO: 179011 - protein, 31 aa, Artificial Sequence
  Description of Artificial Sequence: Synthetic polypeptide
DDSEVASTNPVSTEGYGNVAMNTIPSRVGQR

SEQ ID NO: 179012 - protein, 31 aa, Artificial Sequence
  Description of Artificial Sequence: Synthetic polypeptide
DDSEVASTNPVSTEGYGNVAMNTIVSRVGQR

SEQ ID NO: 179013 - protein, 31 aa, Artificial Sequence
  Description of Artificial Sequence: Synthetic polypeptide
DDSEVASTNPVSTEGYGNVANATIQSRVGQR

SEQ ID NO: 179014 - protein, 33 aa, Artificial Sequence
  Description of Artificial Sequence: Synthetic polypeptide
VEDEIATTNPVATEQWGGCVAAKANLMMPMGET

SEQ ID NO: 179015 - protein, 34 aa, Artificial Sequence
  Description of Artificial Sequence: Synthetic polypeptide
DDEEISTTNPVATCQYGCVCSTGEPMENFGSDQA

SEQ ID NO: 179016 - protein, 34 aa, Artificial Sequence
  Description of Artificial Sequence: Synthetic polypeptide
DEECIRTTNPVAYEQWGCYWSLDNDLQPKSQHTG

SEQ ID NO: 179017 - protein, 34 aa, Artificial Sequence
  Description of Artificial Sequence: Synthetic polypeptide
DENEIRTTNPVATEQWGAVDNEEGEEMNAGEGGA

SEQ ID NO: 179018 - protein, 34 aa, Artificial Sequence
  Description of Artificial Sequence: Synthetic polypeptide
DENEIRTTNPVATEQWGAVDNEEGDEMNAGEGDG

SEQ ID NO: 179019 - protein, 33 aa, Artificial Sequence
  Description of Artificial Sequence: Synthetic polypeptide
DENEIRTTNPVATEQWGATTWANAIWANPKGPI

SEQ ID NO: 179020 - protein, 33 aa, Artificial Sequence
  Description of Artificial Sequence: Synthetic polypeptide
DENEIRTTNPVATEQWGATTWANAIWANAKGPI

SEQ ID NO: 179021 - protein, 36 aa, Artificial Sequence
  Description of Artificial Sequence: Synthetic polypeptide
DEEEIRTTNPVATEFYGTVVLDLINMDQTTDEGGQG

SEQ ID NO: 179022 - protein, 36 aa, Artificial Sequence
  Description of Artificial Sequence: Synthetic polypeptide
DEEEIRTTNPVATEFYGTVVLDLINMDQVEGEGGQG

SEQ ID NO: 179023 - protein, 33 aa, Artificial Sequence
  Description of Artificial Sequence: Synthetic polypeptide
DENEIRTTNPVATEQWGATTANAIEANAKEDYI

SEQ ID NO: 179024 - protein, 33 aa, Artificial Sequence
  Description of Artificial Sequence: Synthetic polypeptide
DENEIRTTNPVATEQWGATTAEENWAEPKGPYI

SEQ ID NO: 179025 - protein, 36 aa, Artificial Sequence
  Description of Artificial Sequence: Synthetic polypeptide
DEEEIRTTNPVATEFYGTVVLDLINMTQDTGEGGQG

SEQ ID NO: 179026 - protein, 36 aa, Artificial Sequence
  Description of Artificial Sequence: Synthetic polypeptide
DEECIRTTNPVAYEQWGEVCFTIEFDGPRQQTGGNR

SEQ ID NO: 179027 - protein, 36 aa, Artificial Sequence
  Description of Artificial Sequence: Synthetic polypeptide
DEAAEIATTNPVAYEQWGSVSHTMNDRGNGGDNDTG

SEQ ID NO: 179028 - protein, 36 aa, Artificial Sequence
  Description of Artificial Sequence: Synthetic polypeptide
DEETIRTTNPCATEQYGSVIEPVNHQGITQGFQPAP

SEQ ID NO: 179029 - protein, 35 aa, Artificial Sequence
  Description of Artificial Sequence: Synthetic polypeptide
DDEEISTTNPVATCQYGCVCSTEHNIENFGSDTQA

SEQ ID NO: 179030 - protein, 34 aa, Artificial Sequence
  Description of Artificial Sequence: Synthetic polypeptide
DDEEISTTNPVATCQYGCVCSSEPNIENFGSDQA

SEQ ID NO: 179031 - protein, 35 aa, Artificial Sequence
  Description of Artificial Sequence: Synthetic polypeptide
DEAEIRTTNPVATEQWGCVCSSGEENANASNSDAS

SEQ ID NO: 179032 - protein, 37 aa, Artificial Sequence
  Description of Artificial Sequence: Synthetic polypeptide
EEEEIRTTNPVATEQYGSVSLHMLEHQAQDQYQSMVD

SEQ ID NO: 179033 - protein, 33 aa, Artificial Sequence
  Description of Artificial Sequence: Synthetic polypeptide
DEAEIRTTNPVATEQWGCVAGEGVEMNAALDDA

SEQ ID NO: 179034 - protein, 34 aa, Artificial Sequence
  Description of Artificial Sequence: Synthetic polypeptide
DENEIRTTNPVATEQWGCVCSNSAEINAFISDAA

SEQ ID NO: 179035 - protein, 34 aa, Artificial Sequence
  Description of Artificial Sequence: Synthetic polypeptide
AEESIATTNPVATEEYGCICCCNHSTRPGGNNVR

SEQ ID NO: 179036 - protein, 37 aa, Artificial Sequence
  Description of Artificial Sequence: Synthetic polypeptide
DEEEIRGTNPVATEQYGMISVSDGFGDGQEEGEGEEV

SEQ ID NO: 179037 - protein, 36 aa, Artificial Sequence
  Description of Artificial Sequence: Synthetic polypeptide
AEGEEIATTNPVAYEQWGWVSTGGNAGETQKGGDER

SEQ ID NO: 179038 - protein, 35 aa, Artificial Sequence
  Description of Artificial Sequence: Synthetic polypeptide
CDEEIRTTNPVATEQYGCVCSNWGEHNQNFGSEQA

SEQ ID NO: 179039 - protein, 34 aa, Artificial Sequence
  Description of Artificial Sequence: Synthetic polypeptide
DEAEIACTNPVAYEQYGSCAAATNLADAPGGEGW

SEQ ID NO: 179040 - protein, 34 aa, Artificial Sequence
  Description of Artificial Sequence: Synthetic polypeptide
DENEIRTTNPVATEQWGCVCSSEHNANASESDAA

SEQ ID NO: 179041 - protein, 36 aa, Artificial Sequence
  Description of Artificial Sequence: Synthetic polypeptide
AEGEEIATTNPVAYEQWGSVSTTGGNAGEHQRTTDE

SEQ ID NO: 179042 - protein, 36 aa, Artificial Sequence
  Description of Artificial Sequence: Synthetic polypeptide
DEECIRTTNPVAYEEWGSVACTNNGLQDDQQDNDIS

SEQ ID NO: 179043 - protein, 34 aa, Artificial Sequence
  Description of Artificial Sequence: Synthetic polypeptide
DENEIRTTNPVATEQWGCVCSSEENANNSMSDAA

SEQ ID NO: 179044 - protein, 34 aa, Artificial Sequence
  Description of Artificial Sequence: Synthetic polypeptide
DENEIRTTNPVATEQWGCVCSSEENANASISDQS

SEQ ID NO: 179045 - protein, 34 aa, Artificial Sequence
  Description of Artificial Sequence: Synthetic polypeptide
DENEIRTTNPVATEQWGCVCSSEENANAFESDAS

SEQ ID NO: 179046 - protein, 36 aa, Artificial Sequence
  Description of Artificial Sequence: Synthetic polypeptide
EEEEIRTTNPVATEQYGSVPADGMGGQGNVGVEDGI

SEQ ID NO: 179047 - protein, 36 aa, Artificial Sequence
  Description of Artificial Sequence: Synthetic polypeptide
EEEEIRTTNPVATEQYGSVQCPLTTPELEFMETVQS

SEQ ID NO: 179048 - protein, 37 aa, Artificial Sequence
  Description of Artificial Sequence: Synthetic polypeptide
EEEEIRTTNPVATEQYGSVQCTTLTPELERAMETVQD

SEQ ID NO: 179049 - protein, 34 aa, Artificial Sequence
  Description of Artificial Sequence: Synthetic polypeptide
SEEEIASVNPVCTEQYGVVCSWNHNQESFGSNQF

SEQ ID NO: 179050 - protein, 34 aa, Artificial Sequence
  Description of Artificial Sequence: Synthetic polypeptide
DENEIRTTNPVATEQWGCVCSSEENAEASISDAI

SEQ ID NO: 179051 - protein, 38 aa, Artificial Sequence
  Description of Artificial Sequence: Synthetic polypeptide
EEEEIRTTNPVATEQYGSVQVSGISVTEAQNVLSFVGE

SEQ ID NO: 179052 - protein, 34 aa, Artificial Sequence
  Description of Artificial Sequence: Synthetic polypeptide
DENEIRTTNPVATEQWGCVCSNSPEANAFESDAS

SEQ ID NO: 179053 - protein, 34 aa, Artificial Sequence
  Description of Artificial Sequence: Synthetic polypeptide
CEEEIACTNPVATEQWGCVAITENLEAGPGEEDA

SEQ ID NO: 179054 - protein, 33 aa, Artificial Sequence
  Description of Artificial Sequence: Synthetic polypeptide
SEEEIASVNPVCTEQYGVVCSWEDDQSFGSNQA

SEQ ID NO: 179055 - protein, 32 aa, Artificial Sequence
  Description of Artificial Sequence: Synthetic polypeptide
DDSEVASTNPVSTEGYGNVAMNTEIQSRVGQR

SEQ ID NO: 179056 - protein, 34 aa, Artificial Sequence
  Description of Artificial Sequence: Synthetic polypeptide
SEEEIASVNPVCTEQYGVVCSNWGNHQSFGSNQS

SEQ ID NO: 179057 - protein, 34 aa, Artificial Sequence
  Description of Artificial Sequence: Synthetic polypeptide
DEECIRTTNPVAYEQWGAYWSLDNDLAKKKVNDP

SEQ ID NO: 179058 - protein, 34 aa, Artificial Sequence
  Description of Artificial Sequence: Synthetic polypeptide
DEECIRTTNPVAYEQWGAYWSLDNDLAKRKKDPE

SEQ ID NO: 179059 - protein, 33 aa, Artificial Sequence
  Description of Artificial Sequence: Synthetic polypeptide
DEECIRTTNPVAYEQWGAYWSLDNDLPKKKVEK

SEQ ID NO: 179060 - protein, 34 aa, Artificial Sequence
  Description of Artificial Sequence: Synthetic polypeptide
DEECIRTTNPVAYEQWGAYWSLDNDLRLEKVDRG

SEQ ID NO: 179061 - protein, 37 aa, Artificial Sequence
  Description of Artificial Sequence: Synthetic polypeptide
DEEEIRGTNPVATEQYGDVMQVNQNQNVEMGMNGQGG

SEQ ID NO: 179062 - protein, 36 aa, Artificial Sequence
  Description of Artificial Sequence: Synthetic polypeptide
DEECIRTTNPVAYEQWGSVACTNNGLQDLQADHEQN

SEQ ID NO: 179063 - protein, 35 aa, Artificial Sequence
  Description of Artificial Sequence: Synthetic polypeptide
DEEEIRTTNPVATEFYGVVDGGNQDEGDEDGGAEI

SEQ ID NO: 179064 - protein, 37 aa, Artificial Sequence
  Description of Artificial Sequence: Synthetic polypeptide
AEENIRTTNPVATEQYGVVSTVVNQQQQIGTTEAGSQ

SEQ ID NO: 179065 - protein, 35 aa, Artificial Sequence
  Description of Artificial Sequence: Synthetic polypeptide
DEEEIRGTNPVATEFYGSVVEDFGEGNEGEDEQFD

SEQ ID NO: 179066 - protein, 34 aa, Artificial Sequence
  Description of Artificial Sequence: Synthetic polypeptide
DEEEIRGTNPVATEFYGQVNNMDNIFNEGGGDEE

SEQ ID NO: 179067 - protein, 34 aa, Artificial Sequence
  Description of Artificial Sequence: Synthetic polypeptide
CEEEIACTNPVATEQWGSASLANMGQAEDPNESK

SEQ ID NO: 179068 - protein, 32 aa, Artificial Sequence
  Description of Artificial Sequence: Synthetic polypeptide
DDSEVASTNPVSTEGYGNVAQNTDIQSRVGQR

SEQ ID NO: 179069 - protein, 36 aa, Artificial Sequence
  Description of Artificial Sequence: Synthetic polypeptide
DEEEIRGTNPVATECYGSVSDGMGENFGNDTGEAGQ

SEQ ID NO: 179070 - protein, 33 aa, Artificial Sequence
  Description of Artificial Sequence: Synthetic polypeptide
DEECIRTTNPVAYEQWGTYVYNQDGDEDRGEDD

SEQ ID NO: 179071 - protein, 36 aa, Artificial Sequence
  Description of Artificial Sequence: Synthetic polypeptide
DEEEIRGTNPVATEAYGSVVLNGMGEGQEDEIGGDV

SEQ ID NO: 179072 - protein, 38 aa, Artificial Sequence
  Description of Artificial Sequence: Synthetic polypeptide
DEEEIRGTNPVATEAYGSVVGSTNVDDGNNEFDQSEGQ

SEQ ID NO: 179073 - protein, 34 aa, Artificial Sequence
  Description of Artificial Sequence: Synthetic polypeptide
DEECIRTTNPVAYEQWGTYVYNQDSDDDRGNDNS

SEQ ID NO: 179074 - protein, 31 aa, Artificial Sequence
  Description of Artificial Sequence: Synthetic polypeptide
DDSEVASTNPVSTEGYGNVAQNTIQSRVGQE

SEQ ID NO: 179075 - protein, 36 aa, Artificial Sequence
  Description of Artificial Sequence: Synthetic polypeptide
DEEEIRTTNPVATEQYGQTAEPTENFHIANILNNVN

SEQ ID NO: 179076 - protein, 35 aa, Artificial Sequence
  Description of Artificial Sequence: Synthetic polypeptide
DECEIATTNPVAYERWGSVSGGNEDDSRNNGNGNE

SEQ ID NO: 179077 - protein, 36 aa, Artificial Sequence
  Description of Artificial Sequence: Synthetic polypeptide
DEEEIRGTNPVATDQYGVVNDNSIGQNGGQEDNVPD

SEQ ID NO: 179078 - protein, 37 aa, Artificial Sequence
  Description of Artificial Sequence: Synthetic polypeptide
DEEEIRTTNPVATEPYGSVCVFTLYELATSRAAQEVV

SEQ ID NO: 179079 - protein, 36 aa, Artificial Sequence
  Description of Artificial Sequence: Synthetic polypeptide
DEEEIRGTNPVATDQYGVVNDNSIGQNGGQEDNGTD

SEQ ID NO: 179080 - protein, 35 aa, Artificial Sequence
  Description of Artificial Sequence: Synthetic polypeptide
DECEIATTNPVAYERWGSVSGGNADDRRNNGNGNP

SEQ ID NO: 179081 - protein, 31 aa, Artificial Sequence
  Description of Artificial Sequence: Synthetic polypeptide
DDSEVASTNPVSTEGYGNVAQNTIQSRVPQR

SEQ ID NO: 179082 - protein, 36 aa, Artificial Sequence
  Description of Artificial Sequence: Synthetic polypeptide
DESEIATTNPVATEQYGSVCAMNNGDNQTAPGPMES

SEQ ID NO: 179083 - protein, 36 aa, Artificial Sequence
  Description of Artificial Sequence: Synthetic polypeptide
DESEIATTNPVATEQYGSVCAANNGDENGMDINEDN

SEQ ID NO: 179084 - protein, 34 aa, Artificial Sequence
  Description of Artificial Sequence: Synthetic polypeptide
DEECIRTTNPVAYEQWGTYVYNQDSDNDRGEDSI

SEQ ID NO: 179085 - protein, 36 aa, Artificial Sequence
  Description of Artificial Sequence: Synthetic polypeptide
DEEEIRGTNPAATEQYGSVNNGQNQNFTNNEEGGGT

SEQ ID NO: 179086 - protein, 36 aa, Artificial Sequence
  Description of Artificial Sequence: Synthetic polypeptide
DEEEIRCTNPVAYERWGHYTVVCTNALSGRPGGNDV

SEQ ID NO: 179087 - protein, 38 aa, Artificial Sequence
  Description of Artificial Sequence: Synthetic polypeptide
DEEEIRTTNPVATEPYGSVCGFCNYLLAAQRVHQEEEV

SEQ ID NO: 179088 - protein, 35 aa, Artificial Sequence
  Description of Artificial Sequence: Synthetic polypeptide
DEAEIRTTNPVATEQFGQCVCSWMYHNANFGSDQS

SEQ ID NO: 179089 - protein, 37 aa, Artificial Sequence
  Description of Artificial Sequence: Synthetic polypeptide
DEEEIRTTNPVATEQYGSVVQVTSEQVEHLHMEAQDE

SEQ ID NO: 179090 - protein, 36 aa, Artificial Sequence
  Description of Artificial Sequence: Synthetic polypeptide
DEEEIRTTNPVATEFYGVVVDGGGNATNDDETGIQG

SEQ ID NO: 179091 - protein, 36 aa, Artificial Sequence
  Description of Artificial Sequence: Synthetic polypeptide
AEANEIATTNPVAYEQWGSVCSTDNGERMEGGNNEI

SEQ ID NO: 179092 - protein, 36 aa, Artificial Sequence
  Description of Artificial Sequence: Synthetic polypeptide
DEEEIRTTNPVATEFYGVVVDDNNMTMETFDGENGI

SEQ ID NO: 179093 - protein, 34 aa, Artificial Sequence
  Description of Artificial Sequence: Synthetic polypeptide
DEEEIRGTNPVATEGYGMVVGIGGQGEGEDEDTG

SEQ ID NO: 179094 - protein, 37 aa, Artificial Sequence
  Description of Artificial Sequence: Synthetic polypeptide
AEENIRTTNPVATEQYGVVSTVVNDQQQIGTTEQGSE

SEQ ID NO: 179095 - protein, 35 aa, Artificial Sequence
  Description of Artificial Sequence: Synthetic polypeptide
DDEEISTTNPVATCQYGCVCSMTGEPNANFGSDQA

SEQ ID NO: 179096 - protein, 38 aa, Artificial Sequence
  Description of Artificial Sequence: Synthetic polypeptide
DEEEIRTTNPVATEQYGCVCSDWGEDHNTENFNSDNQS

SEQ ID NO: 179097 - protein, 34 aa, Artificial Sequence
  Description of Artificial Sequence: Synthetic polypeptide
CEEEIACTNPVATEQWGHSASLANAGQAEDPGEN

SEQ ID NO: 179098 - protein, 37 aa, Artificial Sequence
  Description of Artificial Sequence: Synthetic polypeptide
AEENIRTTNPVATEQYGVVSTTNQQQQQIGTTEQGQE

SEQ ID NO: 179099 - protein, 34 aa, Artificial Sequence
  Description of Artificial Sequence: Synthetic polypeptide
AEASEIATTNPVAYEQWGSVCIEGNDRQMNGNEQ

SEQ ID NO: 179100 - protein, 34 aa, Artificial Sequence
  Description of Artificial Sequence: Synthetic polypeptide
DDEEISTTNPCATEHYGCVCSWGELNQYFNSDQS

SEQ ID NO: 179101 - protein, 37 aa, Artificial Sequence
  Description of Artificial Sequence: Synthetic polypeptide
DEEEIRGTNPVATEQWGHFNVTVNENFLQHGPGGGNE

SEQ ID NO: 179102 - protein, 34 aa, Artificial Sequence
  Description of Artificial Sequence: Synthetic polypeptide
AEEEVSTTNPVATEQYGCVCSWGEHNQYIGSDQS

SEQ ID NO: 179103 - protein, 35 aa, Artificial Sequence
  Description of Artificial Sequence: Synthetic polypeptide
DDEEISSTNPVATEQYGCVCSWEHNQENSGSQNQS

SEQ ID NO: 179104 - protein, 34 aa, Artificial Sequence
  Description of Artificial Sequence: Synthetic polypeptide
DDEEISSTNPVATEQYGCSCSSGEHNQNFGSDQS

SEQ ID NO: 179105 - protein, 35 aa, Artificial Sequence
  Description of Artificial Sequence: Synthetic polypeptide
DECEICTTNPMATECWGSCAPTDNQQQDHRGQNGT

SEQ ID NO: 179106 - protein, 36 aa, Artificial Sequence
  Description of Artificial Sequence: Synthetic polypeptide
DESEIATTNPVATEQYGSVCAADNHLEATRNAMIKH

SEQ ID NO: 179107 - protein, 34 aa, Artificial Sequence
  Description of Artificial Sequence: Synthetic polypeptide
DEEEIRGTNPVATEMWGCIVVGGQLIGGGGNDEQ

SEQ ID NO: 179108 - protein, 35 aa, Artificial Sequence
  Description of Artificial Sequence: Synthetic polypeptide
AEEEVRTTNPVATEQYGCVCSSGEHDQYINSDNQS

SEQ ID NO: 179109 - protein, 36 aa, Artificial Sequence
  Description of Artificial Sequence: Synthetic polypeptide
SEEEIACTNPVATEQYGSVCSVPHGPLDSMGGNDEH

SEQ ID NO: 179110 - protein, 35 aa, Artificial Sequence
  Description of Artificial Sequence: Synthetic polypeptide
SEEEIACTNPVATEQYGSVCAPDNLENNDDLGAQM

SEQ ID NO: 179111 - protein, 30 aa, Artificial Sequence
  Description of Artificial Sequence: Synthetic polypeptide
DDSEVASTNPVSTEGYGNVANTIQSHVGQR

SEQ ID NO: 179112 - protein, 35 aa, Artificial Sequence
  Description of Artificial Sequence: Synthetic polypeptide
SEEEIACTNPVATEQYGSVCAMTEPGGAVAIGDNG

SEQ ID NO: 179113 - protein, 33 aa, Artificial Sequence
  Description of Artificial Sequence: Synthetic polypeptide
DEECIRTTNPVAYEQWGTCCYRGDDEQQGGMNW

SEQ ID NO: 179114 - protein, 35 aa, Artificial Sequence
  Description of Artificial Sequence: Synthetic polypeptide
DECEICTTNPMATECWGSCAPTDNQQQDHRGGNGP

SEQ ID NO: 179115 - protein, 30 aa, Artificial Sequence
  Description of Artificial Sequence: Synthetic polypeptide
DDSEVASTNPVSTEGYGNVANTIQSRVEER

SEQ ID NO: 179116 - protein, 36 aa, Artificial Sequence
  Description of Artificial Sequence: Synthetic polypeptide
DEEEIRTTNPVATEQYGCVCSDWGEDHAENFNSDQS

SEQ ID NO: 179117 - protein, 33 aa, Artificial Sequence
  Description of Artificial Sequence: Synthetic polypeptide
DEECIRTTNPVAYEQWGTCCYRINDEQQGTTMK

SEQ ID NO: 179118 - protein, 37 aa, Artificial Sequence
  Description of Artificial Sequence: Synthetic polypeptide
DEEEIRGTNPVATEGYGSVNMDSGMEGGNALDGGVTD

SEQ ID NO: 179119 - protein, 31 aa, Artificial Sequence
  Description of Artificial Sequence: Synthetic polypeptide
DECEIATTNPVAYERWGTVSKEIEMNGKKDH

SEQ ID NO: 179120 - protein, 35 aa, Artificial Sequence
  Description of Artificial Sequence: Synthetic polypeptide
AEEEVRTTNPVATEQYGCVCSTEEHDAEYIGSDQS

SEQ ID NO: 179121 - protein, 36 aa, Artificial Sequence
  Description of Artificial Sequence: Synthetic polypeptide
SAEEIATTNPVATEQYGSACATNPLPADQGNGDEYA

SEQ ID NO: 179122 - protein, 39 aa, Artificial Sequence
  Description of Artificial Sequence: Synthetic polypeptide
DEEEIRTTNPVATESYGTVTTGQSGTISTNNQEQGVGNP

SEQ ID NO: 179123 - protein, 33 aa, Artificial Sequence
  Description of Artificial Sequence: Synthetic polypeptide
DDSEVASTNPVSTEGYGNVSATNTGQSRVGMQV

SEQ ID NO: 179124 - protein, 36 aa, Artificial Sequence
  Description of Artificial Sequence: Synthetic polypeptide
DEAEIATTNPVATEQYGAVCQTNDQGQQQQGDGEEH

SEQ ID NO: 179125 - protein, 36 aa, Artificial Sequence
  Description of Artificial Sequence: Synthetic polypeptide
DEAEIATTNPVATEQYGCNVAAITNGLEAADIDDSR

SEQ ID NO: 179126 - protein, 33 aa, Artificial Sequence
  Description of Artificial Sequence: Synthetic polypeptide
DEQEIATTNPVATEQWGCNAPAIEPLQAPMENN

SEQ ID NO: 179127 - protein, 37 aa, Artificial Sequence
  Description of Artificial Sequence: Synthetic polypeptide
FEEEIRTTNPVATEQYGSVVTAGVNDNNGQGEFQETD

SEQ ID NO: 179128 - protein, 35 aa, Artificial Sequence
  Description of Artificial Sequence: Synthetic polypeptide
DEQTEIATTNPVAYECWGVVCSTDNGMEQDGDGRR

SEQ ID NO: 179129 - protein, 36 aa, Artificial Sequence
  Description of Artificial Sequence: Synthetic polypeptide
DDEEIRTTNPVATEQYGCVCSWEEHNQESFNSDTQS

SEQ ID NO: 179130 - protein, 36 aa, Artificial Sequence
  Description of Artificial Sequence: Synthetic polypeptide
FEEEIRTTNPVATEQYGSVVVDGFGQENDQEEDAQQ

SEQ ID NO: 179131 - protein, 36 aa, Artificial Sequence
  Description of Artificial Sequence: Synthetic polypeptide
FEEEIRTTNPVATEQYGSVVVDGNFEQENDQEEDGG

SEQ ID NO: 179132 - protein, 36 aa, Artificial Sequence
  Description of Artificial Sequence: Synthetic polypeptide
DDEEIRTTNPVATEQYGCVCSWEEDNAENFGSQTQA

SEQ ID NO: 179133 - protein, 37 aa, Artificial Sequence
  Description of Artificial Sequence: Synthetic polypeptide
FEEEIRTTNPVATEQYGSVVVMGQSNMDDEEGQTGGE

SEQ ID NO: 179134 - protein, 36 aa, Artificial Sequence
  Description of Artificial Sequence: Synthetic polypeptide
FEEEIRTTNPVATEQYGSVVVVGFGQENDQDELDGT

SEQ ID NO: 179135 - protein, 36 aa, Artificial Sequence
  Description of Artificial Sequence: Synthetic polypeptide
FEEEIRTTNPVATEQYGSVVYDGMEGQEGEQEEDDG

SEQ ID NO: 179136 - protein, 39 aa, Artificial Sequence
  Description of Artificial Sequence: Synthetic polypeptide
DEEEIRTTNPVATESYGAVTNLQSGTISTNTNNQEQGNV

SEQ ID NO: 179137 - protein, 36 aa, Artificial Sequence
  Description of Artificial Sequence: Synthetic polypeptide
DDEEIRTTNPVATEQYGCVCSWEEDHNQENFGSDQS

SEQ ID NO: 179138 - protein, 37 aa, Artificial Sequence
  Description of Artificial Sequence: Synthetic polypeptide
DDEEIRTTNPVATEQYGCVCSTWGEDHNEENFNSDQV

SEQ ID NO: 179139 - protein, 39 aa, Artificial Sequence
  Description of Artificial Sequence: Synthetic polypeptide
DEEEIRTTNPVATESYGAVTNLQSGTIGTNQQNQEQGND

SEQ ID NO: 179140 - protein, 31 aa, Artificial Sequence
  Description of Artificial Sequence: Synthetic polypeptide
DDSEVASTNPVSTERYGNVAANTIESRVGQR

SEQ ID NO: 179141 - protein, 38 aa, Artificial Sequence
  Description of Artificial Sequence: Synthetic polypeptide
FEEEIRTTNPVATEQYGSVYTAGVNDNNTGQGEFNEID

SEQ ID NO: 179142 - protein, 35 aa, Artificial Sequence
  Description of Artificial Sequence: Synthetic polypeptide
DEAVEATTNPVAYEQWGCVYSVNNDLGEQGGNEMR

SEQ ID NO: 179143 - protein, 37 aa, Artificial Sequence
  Description of Artificial Sequence: Synthetic polypeptide
FEEEIRTTNPVATEQYGSYSSPHTAEPNSRVGHPPVH

SEQ ID NO: 179144 - protein, 37 aa, Artificial Sequence
  Description of Artificial Sequence: Synthetic polypeptide
FEEEIRTTNPVATEQYGSYSSPITDEPNSRVGHPPGC

SEQ ID NO: 179145 - protein, 34 aa, Artificial Sequence
  Description of Artificial Sequence: Synthetic polypeptide
DEAEIATTNPVATEQYGCVAANGDATMPPGDPKH

SEQ ID NO: 179146 - protein, 34 aa, Artificial Sequence
  Description of Artificial Sequence: Synthetic polypeptide
DEAEIATTNPVATEQYGCVAANHSGDAMNPAEHM

SEQ ID NO: 179147 - protein, 31 aa, Artificial Sequence
  Description of Artificial Sequence: Synthetic polypeptide
QESEIRTTNPIATECYGATAAEDWQHKGPYI

SEQ ID NO: 179148 - protein, 34 aa, Artificial Sequence
  Description of Artificial Sequence: Synthetic polypeptide
DEAEIATTNPVATEQYGCVAANNDATMPPGEGPH

SEQ ID NO: 179149 - protein, 36 aa, Artificial Sequence
  Description of Artificial Sequence: Synthetic polypeptide
DEQTEIATTNPVAYECWGSVATGNMLGDAQGMNNHR

SEQ ID NO: 179150 - protein, 36 aa, Artificial Sequence
  Description of Artificial Sequence: Synthetic polypeptide
FEEEIRTTNPVATEQYGVIVVLNQDGQEQGGQGEGQ

SEQ ID NO: 179151 - protein, 36 aa, Artificial Sequence
  Description of Artificial Sequence: Synthetic polypeptide
DESCIRTTNPVATEQYGSVWMTNNITQPEESQDPDQ

SEQ ID NO: 179152 - protein, 37 aa, Artificial Sequence
  Description of Artificial Sequence: Synthetic polypeptide
DDEEIRTTNPVATEQYGCVCSWGEDHNQEGFGSENQS

SEQ ID NO: 179153 - protein, 37 aa, Artificial Sequence
  Description of Artificial Sequence: Synthetic polypeptide
DEEEIRATNPVATEQYGVVSTVVDQQGTVEQGSTDDE

SEQ ID NO: 179154 - protein, 38 aa, Artificial Sequence
  Description of Artificial Sequence: Synthetic polypeptide
FEEEIRTTNPVATEQYGSVVFNFDDNNDQQGGEGQNET

SEQ ID NO: 179155 - protein, 33 aa, Artificial Sequence
  Description of Artificial Sequence: Synthetic polypeptide
CEEVIACTNPVATEQWGCVAGTNPATMMGETNS

SEQ ID NO: 179156 - protein, 32 aa, Artificial Sequence
  Description of Artificial Sequence: Synthetic polypeptide
CEEVIACTNPVATEQWGCVAGTNPATMPGETL

SEQ ID NO: 179157 - protein, 34 aa, Artificial Sequence
  Description of Artificial Sequence: Synthetic polypeptide
DEAEIATTNPVATEQWGTVCAATDGPVPAEGAND

SEQ ID NO: 179158 - protein, 36 aa, Artificial Sequence
  Description of Artificial Sequence: Synthetic polypeptide
DEAEIATTNPVATEQWGVVAPTDNVQDDQRQGGGTH

SEQ ID NO: 179159 - protein, 36 aa, Artificial Sequence
  Description of Artificial Sequence: Synthetic polypeptide
DDEEIRTTNPVATEQYGCVCSWGEHNQENFNSDTQA

SEQ ID NO: 179160 - protein, 33 aa, Artificial Sequence
  Description of Artificial Sequence: Synthetic polypeptide
DENEIRTTNPIATEQWGDVWANEEDWMEAAGPA

SEQ ID NO: 179161 - protein, 36 aa, Artificial Sequence
  Description of Artificial Sequence: Synthetic polypeptide
DDEEIRTTNPVATEQYGCVCSWGEHNQENFGSETQS

SEQ ID NO: 179162 - protein, 37 aa, Artificial Sequence
  Description of Artificial Sequence: Synthetic polypeptide
FEEEIRTTNPVATEQYGSVVMGMSNEMGDEEGQTGGE

SEQ ID NO: 179163 - protein, 37 aa, Artificial Sequence
  Description of Artificial Sequence: Synthetic polypeptide
FEEEIRTTNPVATEQYGSVVMGTPIEMDGNDDDGQST

SEQ ID NO: 179164 - protein, 34 aa, Artificial Sequence
  Description of Artificial Sequence: Synthetic polypeptide
DESCIRTTNPVAYEQWGEAYNVDLVHGQRGDSPR

SEQ ID NO: 179165 - protein, 33 aa, Artificial Sequence
  Description of Artificial Sequence: Synthetic polypeptide
DENEIRTTNPIATEQWGDVWANEEDWMEAAGDA

SEQ ID NO: 179166 - protein, 32 aa, Artificial Sequence
  Description of Artificial Sequence: Synthetic polypeptide
DDSEVASTNPVSTEQYGSVAATTIQDHVGQDL

SEQ ID NO: 179167 - protein, 32 aa, Artificial Sequence
  Description of Artificial Sequence: Synthetic polypeptide
DENEIRTTNPIATEQWGDVWAEEDWMEAAGDA

SEQ ID NO: 179168 - protein, 33 aa, Artificial Sequence
  Description of Artificial Sequence: Synthetic polypeptide
YEPEIRTTYPVATDGYIYSGYSTNLEIVIHIRD

SEQ ID NO: 179169 - protein, 31 aa, Artificial Sequence
  Description of Artificial Sequence: Synthetic polypeptide
DDSEVASTNPVSTERYGNVAAMTIQSRVGQR

SEQ ID NO: 179170 - protein, 38 aa, Artificial Sequence
  Description of Artificial Sequence: Synthetic polypeptide
FEEEIRTTNPVATEQYGSVVNMDDNNFGQNIGGQSQNG

SEQ ID NO: 179171 - protein, 37 aa, Artificial Sequence
  Description of Artificial Sequence: Synthetic polypeptide
FEEEIRTTNPVATEQYGSVVNNGVNDNNGQGEFNEID

SEQ ID NO: 179172 - protein, 36 aa, Artificial Sequence
  Description of Artificial Sequence: Synthetic polypeptide
FEEEIRTTNPVATEQYGSVVPHEDLASIEVSQADRQ

SEQ ID NO: 179173 - protein, 36 aa, Artificial Sequence
  Description of Artificial Sequence: Synthetic polypeptide
DDEEIRTTNPVATEQYGCVCSWGEHNAENFNSDNQS

SEQ ID NO: 179174 - protein, 37 aa, Artificial Sequence
  Description of Artificial Sequence: Synthetic polypeptide
FEEEIRTTNPVATEQYGSVVQAGVNDNNGQGEFNEMD

SEQ ID NO: 179175 - protein, 37 aa, Artificial Sequence
  Description of Artificial Sequence: Synthetic polypeptide
FEEEIRTTNPVATEQYGSVVQNFDDNIDQQGGGQTET

SEQ ID NO: 179176 - protein, 37 aa, Artificial Sequence
  Description of Artificial Sequence: Synthetic polypeptide
DESCIRTTNPVATEQYGSVWMTVWNITQPEEGADDDQ

SEQ ID NO: 179177 - protein, 32 aa, Artificial Sequence
  Description of Artificial Sequence: Synthetic polypeptide
DENEIRTTNPIATEQWGDTVANEDEANAAGDA

SEQ ID NO: 179178 - protein, 38 aa, Artificial Sequence
  Description of Artificial Sequence: Synthetic polypeptide
FEEEIRTTNPVATEQYGSVVSAGVNDNSNGQGEFNEID

SEQ ID NO: 179179 - protein, 34 aa, Artificial Sequence
  Description of Artificial Sequence: Synthetic polypeptide
DEAEIATTNPVATEQWGTVCAATDGPVEAEGNDM

SEQ ID NO: 179180 - protein, 33 aa, Artificial Sequence
  Description of Artificial Sequence: Synthetic polypeptide
DENEIRTTNPIATEPYGATISNMEDIAEPKGNH

SEQ ID NO: 179181 - protein, 36 aa, Artificial Sequence
  Description of Artificial Sequence: Synthetic polypeptide
DESCIRTTNPVATEQYGSTWMTNNITNQPEEGQDDD

SEQ ID NO: 179182 - protein, 33 aa, Artificial Sequence
  Description of Artificial Sequence: Synthetic polypeptide
DEAVIRTTNPVATEQYGCVCESEPQEYFISDQS

SEQ ID NO: 179183 - protein, 36 aa, Artificial Sequence
  Description of Artificial Sequence: Synthetic polypeptide
DDEEIRTTNPVATEQYGCVCSNWMEHNQENFNSEQA

SEQ ID NO: 179184 - protein, 35 aa, Artificial Sequence
  Description of Artificial Sequence: Synthetic polypeptide
DEAEIATTNPVATEQYGCVCSNTDPEDHEGSETLS

SEQ ID NO: 179185 - protein, 32 aa, Artificial Sequence
  Description of Artificial Sequence: Synthetic polypeptide
DENEIRTTNPIATECWGAVWSEIEMNPAEPYI

SEQ ID NO: 179186 - protein, 31 aa, Artificial Sequence
  Description of Artificial Sequence: Synthetic polypeptide
DENEIRTTNPIATECWGAVWSEIEMNPAEPI

SEQ ID NO: 179187 - protein, 32 aa, Artificial Sequence
  Description of Artificial Sequence: Synthetic polypeptide
DENEIRTTNPIATECWGAVWSEDEMNPAEPYI

SEQ ID NO: 179188 - protein, 32 aa, Artificial Sequence
  Description of Artificial Sequence: Synthetic polypeptide
DENEIRTTNPIATECWGAVWSEDEANPAEPYI

SEQ ID NO: 179189 - protein, 35 aa, Artificial Sequence
  Description of Artificial Sequence: Synthetic polypeptide
DEAEIATTNPVATEQYGCVCSNTDPEDHFGSEDQA

SEQ ID NO: 179190 - protein, 37 aa, Artificial Sequence
  Description of Artificial Sequence: Synthetic polypeptide
DDEEIRTTNPVATEQYGCVCSNWGEHNQEYFGSDNQS

SEQ ID NO: 179191 - protein, 35 aa, Artificial Sequence
  Description of Artificial Sequence: Synthetic polypeptide
DEAVIRTTNPVATEQYGCVCENWEPNQEYFGSEQA

SEQ ID NO: 179192 - protein, 36 aa, Artificial Sequence
  Description of Artificial Sequence: Synthetic polypeptide
DEQEIATTNPVATEQWGSCSATGDLDEDHQGGEDHK

SEQ ID NO: 179193 - protein, 32 aa, Artificial Sequence
  Description of Artificial Sequence: Synthetic polypeptide
DDSEVASTNPVSTEVYGNVAANTIQSRVGQRQ

SEQ ID NO: 179194 - protein, 37 aa, Artificial Sequence
  Description of Artificial Sequence: Synthetic polypeptide
DEEEIRTTNPVATEGYGVVTGNMDEFGQGGDQNNIPG

SEQ ID NO: 179195 - protein, 39 aa, Artificial Sequence
  Description of Artificial Sequence: Synthetic polypeptide
DEEEIRTTNPVATEGYGVVSVGVGTGNVGEEEGEGNDTR

SEQ ID NO: 179196 - protein, 35 aa, Artificial Sequence
  Description of Artificial Sequence: Synthetic polypeptide
DEEEIRTTNPVATEGYGSVCGEGAIHWQSSSQESN

SEQ ID NO: 179197 - protein, 37 aa, Artificial Sequence
  Description of Artificial Sequence: Synthetic polypeptide
DDEEIRTTNPVATEQYGCVCSNWGEHNQENFGSDNQA

SEQ ID NO: 179198 - protein, 34 aa, Artificial Sequence
  Description of Artificial Sequence: Synthetic polypeptide
DEDEIATTNPVTTEHWGSVYCMDNMQDQQRQGDE

SEQ ID NO: 179199 - protein, 32 aa, Artificial Sequence
  Description of Artificial Sequence: Synthetic polypeptide
DENEIRTTNPIATECWGAVANAEDLAEPGPYI

SEQ ID NO: 179200 - protein, 32 aa, Artificial Sequence
  Description of Artificial Sequence: Synthetic polypeptide
DDSEVASTNPVSTEYYGNVAANTHIQSRVGQR

SEQ ID NO: 179201 - protein, 32 aa, Artificial Sequence
  Description of Artificial Sequence: Synthetic polypeptide
DENEIRTTNPIATECWGAVANAEDLAEPGEYI

SEQ ID NO: 179202 - protein, 31 aa, Artificial Sequence
  Description of Artificial Sequence: Synthetic polypeptide
DDSEVASTNPVATEGYGSVAATDIESHEGEL

SEQ ID NO: 179203 - protein, 31 aa, Artificial Sequence
  Description of Artificial Sequence: Synthetic polypeptide
DENEIRTTNPIATECWGAVANADWMNPKEDA

SEQ ID NO: 179204 - protein, 37 aa, Artificial Sequence
  Description of Artificial Sequence: Synthetic polypeptide
DDEEIRTTNPVATEQYGCVCSNWGEHNQEGFGSENQA

SEQ ID NO: 179205 - protein, 33 aa, Artificial Sequence
  Description of Artificial Sequence: Synthetic polypeptide
DENEIRTTNPIATECWGATVWSNADLAPKGPYI

SEQ ID NO: 179206 - protein, 37 aa, Artificial Sequence
  Description of Artificial Sequence: Synthetic polypeptide
DDEEIRTTNPVATEQYGCVCSNWGEHNEENFGSDNQS

SEQ ID NO: 179207 - protein, 35 aa, Artificial Sequence
  Description of Artificial Sequence: Synthetic polypeptide
DEAEIATTNPVATEQYGCVCSNTAPEDHFGSEDLS

SEQ ID NO: 179208 - protein, 33 aa, Artificial Sequence
  Description of Artificial Sequence: Synthetic polypeptide
DENEIRTTNPIATEPWGATISAEDWQQQNGNYI

SEQ ID NO: 179209 - protein, 31 aa, Artificial Sequence
  Description of Artificial Sequence: Synthetic polypeptide
DENEIRTTNPIATECWGDVANAEDLAPEEYI

SEQ ID NO: 179210 - protein, 31 aa, Artificial Sequence
  Description of Artificial Sequence: Synthetic polypeptide
QESEIRSTNPVATEGWGATMWANSDLAHGDI

SEQ ID NO: 179211 - protein, 35 aa, Artificial Sequence
  Description of Artificial Sequence: Synthetic polypeptide
DEAEIATTNPVATEQYGCVAANNGDGAMPMGDGRE

SEQ ID NO: 179212 - protein, 38 aa, Artificial Sequence
  Description of Artificial Sequence: Synthetic polypeptide
DEEEIRATNPVATEQYGVVSSTVNNQQGATEQGSTDDD

SEQ ID NO: 179213 - protein, 37 aa, Artificial Sequence
  Description of Artificial Sequence: Synthetic polypeptide
FEEEIRTTNPVATEQYGVVNDEGTDNLGVNEFGQTGI

SEQ ID NO: 179214 - protein, 34 aa, Artificial Sequence
  Description of Artificial Sequence: Synthetic polypeptide
DEGAEIATTNPVAYEAWGVCSTTNDQHGQGGNQA

SEQ ID NO: 179215 - protein, 35 aa, Artificial Sequence
  Description of Artificial Sequence: Synthetic polypeptide
DEQEIATTNPVATEQWGCTAGNENLEATPDGDNRW

SEQ ID NO: 179216 - protein, 32 aa, Artificial Sequence
  Description of Artificial Sequence: Synthetic polypeptide
DENEIRTTNPIATEPWGAIAMEDIQEQKGNYH

SEQ ID NO: 179217 - protein, 34 aa, Artificial Sequence
  Description of Artificial Sequence: Synthetic polypeptide
DEDEIATVNPVATEQWGCVAGNGLQSNNNSQAEQ

SEQ ID NO: 179218 - protein, 36 aa, Artificial Sequence
  Description of Artificial Sequence: Synthetic polypeptide
FEEEIRTTNPVATEQYGVVNSVNGFNGETGEMDDGQ

SEQ ID NO: 179219 - protein, 32 aa, Artificial Sequence
  Description of Artificial Sequence: Synthetic polypeptide
DDSEVASTNPVSTESYGNVCAANTIQSRVGQR

SEQ ID NO: 179220 - protein, 36 aa, Artificial Sequence
  Description of Artificial Sequence: Synthetic polypeptide
DEEEIRTTNPVATEGYGQCVCSWEEHNQNFNSDTQS

SEQ ID NO: 179221 - protein, 36 aa, Artificial Sequence
  Description of Artificial Sequence: Synthetic polypeptide
DESCIRTTNPVATEQWGSVWMTNNNTQPEEGQDDDQ

SEQ ID NO: 179222 - protein, 37 aa, Artificial Sequence
  Description of Artificial Sequence: Synthetic polypeptide
FEEEIRTTNPVATEQYGVVSILDATGDEDQSEGGDGD

SEQ ID NO: 179223 - protein, 37 aa, Artificial Sequence
  Description of Artificial Sequence: Synthetic polypeptide
FEEEIRTTNPVATEQYGVVSILIATGDEDQGEGGDGF

SEQ ID NO: 179224 - protein, 35 aa, Artificial Sequence
  Description of Artificial Sequence: Synthetic polypeptide
DEGAEIATTNPVAYEQWGVVSGGNMTQLNDQHGGS

SEQ ID NO: 179225 - protein, 36 aa, Artificial Sequence
  Description of Artificial Sequence: Synthetic polypeptide
AEEEIRTTNPVAYEQWGSYWSTIPPNDGEKEGNQND

SEQ ID NO: 179226 - protein, 36 aa, Artificial Sequence
  Description of Artificial Sequence: Synthetic polypeptide
DEEEIRTTNPVATEGYGQCVCSWGEHEQENFGSEQA

SEQ ID NO: 179227 - protein, 37 aa, Artificial Sequence
  Description of Artificial Sequence: Synthetic polypeptide
DEEEIRATNPVATEQYGTVVIGPSVITAQIQPPSLNQ

SEQ ID NO: 179228 - protein, 29 aa, Artificial Sequence
  Description of Artificial Sequence: Synthetic peptide
QESEIRSTNPVGTEGWGVMAATLAHKGDI

SEQ ID NO: 179229 - protein, 31 aa, Artificial Sequence
  Description of Artificial Sequence: Synthetic polypeptide
DENEIRTTNPIATECYGATWSEDWAEHEPYL

SEQ ID NO: 179230 - protein, 36 aa, Artificial Sequence
  Description of Artificial Sequence: Synthetic polypeptide
DEECISTTNPVATEQYSACVCSWGNLNQENFGSDQA

SEQ ID NO: 179231 - protein, 37 aa, Artificial Sequence
  Description of Artificial Sequence: Synthetic polypeptide
FEEEIRTTNPVATEQYGVVVNDTPNNDQGEEFDQGDE

SEQ ID NO: 179232 - protein, 38 aa, Artificial Sequence
  Description of Artificial Sequence: Synthetic polypeptide
FEEEIRTTNPVATESYGSVMGLNVGNLEDEFQGGNTGT

SEQ ID NO: 179233 - protein, 35 aa, Artificial Sequence
  Description of Artificial Sequence: Synthetic polypeptide
CEEEIACTNPVATEQYGSACAATGEANDSMMGTRM

SEQ ID NO: 179234 - protein, 31 aa, Artificial Sequence
  Description of Artificial Sequence: Synthetic polypeptide
DENEIRTTNPIATECWGDVWSEIEMNPAEPI

SEQ ID NO: 179235 - protein, 37 aa, Artificial Sequence
  Description of Artificial Sequence: Synthetic polypeptide
FEEEIRTTNPVATESYGSVVQGTVNGLEAEVNGGGQG

SEQ ID NO: 179236 - protein, 37 aa, Artificial Sequence
  Description of Artificial Sequence: Synthetic polypeptide
FEEEIRTTNPVATEVYGSVSDGMGENLGNNDTGEAGQ

SEQ ID NO: 179237 - protein, 38 aa, Artificial Sequence
  Description of Artificial Sequence: Synthetic polypeptide
DEEEIRTTNPVATESYGMAVATNFLGAGIERHPQVQST

SEQ ID NO: 179238 - protein, 37 aa, Artificial Sequence
  Description of Artificial Sequence: Synthetic polypeptide
DDEEIRTTNPVATEQYGCVTSTWPADNAEYFNSDPQS

SEQ ID NO: 179239 - protein, 36 aa, Artificial Sequence
  Description of Artificial Sequence: Synthetic polypeptide
FEEEIRTTNPVATEQYGSVVAGVNDNNGQGEIQEID

SEQ ID NO: 179240 - protein, 31 aa, Artificial Sequence
  Description of Artificial Sequence: Synthetic polypeptide
YENEIATVNPVSTEPYGVISMDIQQQQNGNQ

SEQ ID NO: 179241 - protein, 36 aa, Artificial Sequence
  Description of Artificial Sequence: Synthetic polypeptide
DDEEIRTTNPVATEQYGQCVCSWEEHNQENFNSDQG

SEQ ID NO: 179242 - protein, 37 aa, Artificial Sequence
  Description of Artificial Sequence: Synthetic polypeptide
DDEEIRTTNPVATEQYGQCVCSWEEHNQEGFNSETQA

SEQ ID NO: 179243 - protein, 34 aa, Artificial Sequence
  Description of Artificial Sequence: Synthetic polypeptide
DESEIRTTNPVATQHWGSVCTIEGHNRHTQQDMD

SEQ ID NO: 179244 - protein, 34 aa, Artificial Sequence
  Description of Artificial Sequence: Synthetic polypeptide
QETEIATTNPCATEQYGATVWANAEDLQEPKGPI

SEQ ID NO: 179245 - protein, 36 aa, Artificial Sequence
  Description of Artificial Sequence: Synthetic polypeptide
DDEEIRTTNPVATEQYGQCVCSWEEHNQEFFGSDQA

SEQ ID NO: 179246 - protein, 36 aa, Artificial Sequence
  Description of Artificial Sequence: Synthetic polypeptide
DEAEIATTNPVATEQWGSVSGQGPALGINHGDNSAM

SEQ ID NO: 179247 - protein, 37 aa, Artificial Sequence
  Description of Artificial Sequence: Synthetic polypeptide
DDEEIRTTNPVATEQYGQCVCSTEEHNEEFFPSDNQA

SEQ ID NO: 179248 - protein, 32 aa, Artificial Sequence
  Description of Artificial Sequence: Synthetic polypeptide
YENEIRSTNPVSTEPYGTISMEDIQQQQNGNH

SEQ ID NO: 179249 - protein, 37 aa, Artificial Sequence
  Description of Artificial Sequence: Synthetic polypeptide
DEEEIRTTNPVATEQYGSCSLGDVEGEKNIVMEPENF

SEQ ID NO: 179250 - protein, 36 aa, Artificial Sequence
  Description of Artificial Sequence: Synthetic polypeptide
DEEEIRTTNPVATEQYGSCSLMPGPLEEEMPVIPEG

SEQ ID NO: 179251 - protein, 34 aa, Artificial Sequence
  Description of Artificial Sequence: Synthetic polypeptide
QETAEIATTNPVAYEQYGSVATHGQQAVPGDSVD

SEQ ID NO: 179252 - protein, 31 aa, Artificial Sequence
  Description of Artificial Sequence: Synthetic polypeptide
DDSEVASTNPVSTEPYGTVSAMTIQSRNGQH

SEQ ID NO: 179253 - protein, 34 aa, Artificial Sequence
  Description of Artificial Sequence: Synthetic polypeptide
DESEIAATNPVATAHWGSVCTWEDQQRQEHGGTR

SEQ ID NO: 179254 - protein, 36 aa, Artificial Sequence
  Description of Artificial Sequence: Synthetic polypeptide
DEEEIRTTNPVATEGYGQCVCSNWEHNQNFNSDNQS

SEQ ID NO: 179255 - protein, 36 aa, Artificial Sequence
  Description of Artificial Sequence: Synthetic polypeptide
DDEEIRTTNPVATEQYGQCVCSNWEHNQENFGSEQA

SEQ ID NO: 179256 - protein, 36 aa, Artificial Sequence
  Description of Artificial Sequence: Synthetic polypeptide
DDEEIRTTNPVATEQYGQCVCSNWEEHNQHFNSEQA

SEQ ID NO: 179257 - protein, 36 aa, Artificial Sequence
  Description of Artificial Sequence: Synthetic polypeptide
DDEEIRTTNPVATEQYGQCVCSNWEEHNQFFNSDQN

SEQ ID NO: 179258 - protein, 30 aa, Artificial Sequence
  Description of Artificial Sequence: Synthetic polypeptide
QESEVASTNPVSTEQYGNAANTIQSHVGQR

SEQ ID NO: 179259 - protein, 30 aa, Artificial Sequence
  Description of Artificial Sequence: Synthetic polypeptide
QESEVASTNPVSTEQYGNAAETIQSHVGQR

SEQ ID NO: 179260 - protein, 30 aa, Artificial Sequence
  Description of Artificial Sequence: Synthetic polypeptide
QESEVASTNPVSTEGYGNVASTIQSHVGQI

SEQ ID NO: 179261 - protein, 30 aa, Artificial Sequence
  Description of Artificial Sequence: Synthetic polypeptide
QESEVASTNPVSTEGYGNVANTIQSHVGQR

SEQ ID NO: 179262 - protein, 38 aa, Artificial Sequence
  Description of Artificial Sequence: Synthetic polypeptide
DDEEIRTTNPVATEQYGQCVCSNTGEHNQEGFGSDNQA

SEQ ID NO: 179263 - protein, 37 aa, Artificial Sequence
  Description of Artificial Sequence: Synthetic polypeptide
DEEEIRTTNPVATESYGSVMGQNVGNLDEFNDGIGDT

SEQ ID NO: 179264 - protein, 33 aa, Artificial Sequence
  Description of Artificial Sequence: Synthetic polypeptide
DEFEIRTTNPVAFEQWGNDVSEIITTMNGMEEA

SEQ ID NO: 179265 - protein, 31 aa, Artificial Sequence
  Description of Artificial Sequence: Synthetic polypeptide
DDSEVASTNPVSTEPYGNVSAMTIQSRNGQH

SEQ ID NO: 179266 - protein, 34 aa, Artificial Sequence
  Description of Artificial Sequence: Synthetic polypeptide
DEFEIRTTNPVAFEQWGQDVSEEIQETMNGMEEA

SEQ ID NO: 179267 - protein, 32 aa, Artificial Sequence
  Description of Artificial Sequence: Synthetic polypeptide
DDSEVASTNPVSTEPYGNVPAANTIQSRVGQR

SEQ ID NO: 179268 - protein, 32 aa, Artificial Sequence
  Description of Artificial Sequence: Synthetic polypeptide
YENEIATVNPVSTEPYGTISMEDLQQQSNGNH

SEQ ID NO: 179269 - protein, 36 aa, Artificial Sequence
  Description of Artificial Sequence: Synthetic polypeptide
DEEEIRTTNPVATEGYGQCAVCSWGEHQNFNSDNQA

SEQ ID NO: 179270 - protein, 36 aa, Artificial Sequence
  Description of Artificial Sequence: Synthetic polypeptide
DEEEIRTTNPVATEGYGQCSCSWGEENQEYSNSDQA

SEQ ID NO: 179271 - protein, 35 aa, Artificial Sequence
  Description of Artificial Sequence: Synthetic polypeptide
DEAEIATTNPVATEQWGSVSAGAHAGNAPMNNAEM

SEQ ID NO: 179272 - protein, 32 aa, Artificial Sequence
  Description of Artificial Sequence: Synthetic polypeptide
DDSEVASTNPVSTEPYGNVAANTQIQSRVGQR

SEQ ID NO: 179273 - protein, 35 aa, Artificial Sequence
  Description of Artificial Sequence: Synthetic polypeptide
CAEEIATTNPVATEQWGTSQSGLATALGQHDDMRN

SEQ ID NO: 179274 - protein, 37 aa, Artificial Sequence
  Description of Artificial Sequence: Synthetic polypeptide
DDEEIRTTNPVATEQYGSVAFGGQTNQGEDDGDQGGE

SEQ ID NO: 179275 - protein, 30 aa, Artificial Sequence
  Description of Artificial Sequence: Synthetic polypeptide
QETEIATTNPVATEQYGATPNEDWAHKEPK

SEQ ID NO: 179276 - protein, 30 aa, Artificial Sequence
  Description of Artificial Sequence: Synthetic polypeptide
QETEIATTNPVATEQYGATPNEDWAHKEPI

SEQ ID NO: 179277 - protein, 32 aa, Artificial Sequence
  Description of Artificial Sequence: Synthetic polypeptide
DEATEIATTNPVAYECWGAVYHEDNQAGQNGA

SEQ ID NO: 179278 - protein, 33 aa, Artificial Sequence
  Description of Artificial Sequence: Synthetic polypeptide
CAEEIATTNPVATEQYGCVAAGEGGGNESEEEK

SEQ ID NO: 179279 - protein, 30 aa, Artificial Sequence
  Description of Artificial Sequence: Synthetic polypeptide
QETEIATTNPVATEQWGATPEEVCQEHEEK

SEQ ID NO: 179280 - protein, 32 aa, Artificial Sequence
  Description of Artificial Sequence: Synthetic polypeptide
DEATEIATTNPVAYECWGTVYHEDNQAQNGGA

SEQ ID NO: 179281 - protein, 37 aa, Artificial Sequence
  Description of Artificial Sequence: Synthetic polypeptide
DEEEIRTTNPVATEGYGQCVCSMTEHNQENFGSETQS

SEQ ID NO: 179282 - protein, 30 aa, Artificial Sequence
  Description of Artificial Sequence: Synthetic polypeptide
QETEIATTNPVATEQWGAAPEEVCQEHEEK

SEQ ID NO: 179283 - protein, 31 aa, Artificial Sequence
  Description of Artificial Sequence: Synthetic polypeptide
DDSEVASTNPVSTEPYGNVACNTIQSRVVQR

SEQ ID NO: 179284 - protein, 33 aa, Artificial Sequence
  Description of Artificial Sequence: Synthetic polypeptide
DDSEVASTNPVSTEPYGNVACNTISQSRVGQNR

SEQ ID NO: 179285 - protein, 36 aa, Artificial Sequence
  Description of Artificial Sequence: Synthetic polypeptide
DDEEIRTTNPVATEQYGSATMMSVVPMARDEVELNG

SEQ ID NO: 179286 - protein, 37 aa, Artificial Sequence
  Description of Artificial Sequence: Synthetic polypeptide
DEEEIRTTNPVATEGYGQCVCSNTEEHNQENFGSDQS

SEQ ID NO: 179287 - protein, 30 aa, Artificial Sequence
  Description of Artificial Sequence: Synthetic polypeptide
QETEIATTNPIATEQYGETAPEVCQHEEYK

SEQ ID NO: 179288 - protein, 34 aa, Artificial Sequence
  Description of Artificial Sequence: Synthetic polypeptide
TTTEIATTNPVATEQYGCVCTIEGQDQHGQNNDQ

SEQ ID NO: 179289 - protein, 36 aa, Artificial Sequence
  Description of Artificial Sequence: Synthetic polypeptide
DEDEIATTNPVAYEQYGTVATENGGNMQNGGQRGEA

SEQ ID NO: 179290 - protein, 32 aa, Artificial Sequence
  Description of Artificial Sequence: Synthetic polypeptide
YENEIATVNPVSTEPYGTISMEDLQQQQNGNH

SEQ ID NO: 179291 - protein, 34 aa, Artificial Sequence
  Description of Artificial Sequence: Synthetic polypeptide
QETEIATTNPIATEQYGATVWANAEDLQEPKGPI

SEQ ID NO: 179292 - protein, 32 aa, Artificial Sequence
  Description of Artificial Sequence: Synthetic polypeptide
QETEIATTNPIATECYGITTWSNAEDLQSGTI

SEQ ID NO: 179293 - protein, 36 aa, Artificial Sequence
  Description of Artificial Sequence: Synthetic polypeptide
DDEEIRTTNPVATEQYGQCVCSWGEHNQEFFNSEQG

SEQ ID NO: 179294 - protein, 31 aa, Artificial Sequence
  Description of Artificial Sequence: Synthetic polypeptide
QETEIATTNPCSTECYGITVSNADWAPGTYR

SEQ ID NO: 179295 - protein, 34 aa, Artificial Sequence
  Description of Artificial Sequence: Synthetic polypeptide
DESEIRTTNPVATQHWGSVCTIEGHNRHTQNDHE

SEQ ID NO: 179296 - protein, 35 aa, Artificial Sequence
  Description of Artificial Sequence: Synthetic polypeptide
DEFEIRTTNPVAFEQWGSDCVSEIQETMNGMEEAN

SEQ ID NO: 179297 - protein, 32 aa, Artificial Sequence
  Description of Artificial Sequence: Synthetic polypeptide
DEEEIRCTNPIATECWGATVWANENWAEPGPI

SEQ ID NO: 179298 - protein, 32 aa, Artificial Sequence
  Description of Artificial Sequence: Synthetic polypeptide
DENEIRTTNPISTYPYGTISMEDIQQQQNGNH

SEQ ID NO: 179299 - protein, 37 aa, Artificial Sequence
  Description of Artificial Sequence: Synthetic polypeptide
DEEEIRATNPVAYEQWGSVSGGEPGNGGNMRNGMNDM

SEQ ID NO: 179300 - protein, 33 aa, Artificial Sequence
  Description of Artificial Sequence: Synthetic polypeptide
DESCISTTNPVAYEQWGESYNVDLHGQRTDNPA

SEQ ID NO: 179301 - protein, 34 aa, Artificial Sequence
  Description of Artificial Sequence: Synthetic polypeptide
DESCISTTNPVAYEQWGESYNVDLHGQRPGQNPA

SEQ ID NO: 179302 - protein, 34 aa, Artificial Sequence
  Description of Artificial Sequence: Synthetic polypeptide
DESCISTTNPVAYEQWGESYNVDLHGQRIGDNEA

SEQ ID NO: 179303 - protein, 33 aa, Artificial Sequence
  Description of Artificial Sequence: Synthetic polypeptide
DENEIRTTNPISTEPYGTTISMEDIQQQQNGNI

SEQ ID NO: 179304 - protein, 33 aa, Artificial Sequence
  Description of Artificial Sequence: Synthetic polypeptide
DENEIRTTNPISTEPYGTTISMEDIQQQQNGNH

SEQ ID NO: 179305 - protein, 34 aa, Artificial Sequence
  Description of Artificial Sequence: Synthetic polypeptide
DEEEIRATNPVAYEQWGMVTGWGNDHQHGQGGDY

SEQ ID NO: 179306 - protein, 33 aa, Artificial Sequence
  Description of Artificial Sequence: Synthetic polypeptide
DENEIRTTNPISTEPYGTTISAEDWQQQQNGNI

SEQ ID NO: 179307 - protein, 33 aa, Artificial Sequence
  Description of Artificial Sequence: Synthetic polypeptide
DENEIRTTNPISTEPYGTTISAEDIQQQQNGNI

SEQ ID NO: 179308 - protein, 31 aa, Artificial Sequence
  Description of Artificial Sequence: Synthetic polypeptide
DENEIRTTNPISTEPYGTIPMEDIQQQKPNH

SEQ ID NO: 179309 - protein, 36 aa, Artificial Sequence
  Description of Artificial Sequence: Synthetic polypeptide
DEQEIATTNPVATEQWGSVAITDHEEATGNQDGENP

SEQ ID NO: 179310 - protein, 35 aa, Artificial Sequence
  Description of Artificial Sequence: Synthetic polypeptide
DEFELCTVNPVATEQYGTVSWTENDQSDQKGGGDH

SEQ ID NO: 179311 - protein, 36 aa, Artificial Sequence
  Description of Artificial Sequence: Synthetic polypeptide
CEEEIACTNPVATEQYGSACAANPQLNPDDQTGGRM

SEQ ID NO: 179312 - protein, 37 aa, Artificial Sequence
  Description of Artificial Sequence: Synthetic polypeptide
FEEEIRTTNPVATEQYGSVTMDTDGQDQEDEGQSEGQ

SEQ ID NO: 179313 - protein, 38 aa, Artificial Sequence
  Description of Artificial Sequence: Synthetic polypeptide
DEEEIRTTNPVATESYGMVVATNFLGAGYTRVPQVQSI

SEQ ID NO: 179314 - protein, 36 aa, Artificial Sequence
  Description of Artificial Sequence: Synthetic polypeptide
DEFETCTVNPVATEQYGSVSWTENDQHDQGGKGDHH

SEQ ID NO: 179315 - protein, 35 aa, Artificial Sequence
  Description of Artificial Sequence: Synthetic polypeptide
YENEITRTTNSVAHESYGEVVSYWHNLNNRMGGER

SEQ ID NO: 179316 - protein, 31 aa, Artificial Sequence
  Description of Artificial Sequence: Synthetic polypeptide
DDSEVASTNPVATEGYGNVAANTIMNRVEQR

SEQ ID NO: 179317 - protein, 36 aa, Artificial Sequence
  Description of Artificial Sequence: Synthetic polypeptide
FEEEIRTTNPVATEQYGSVVAGMNDNNGQGEFTEIW

SEQ ID NO: 179318 - protein, 36 aa, Artificial Sequence
  Description of Artificial Sequence: Synthetic polypeptide
FEEEIRTTNPVATEQYGSVVAGVNDNAGGQGEQTEI

SEQ ID NO: 179319 - protein, 35 aa, Artificial Sequence
  Description of Artificial Sequence: Synthetic polypeptide
YENERIERTTNSVAHESYGEVVSEWMNLNNRGGER

SEQ ID NO: 179320 - protein, 37 aa, Artificial Sequence
  Description of Artificial Sequence: Synthetic polypeptide
FEEEIRTTNPVATEQYGSVVAGVNDNDQIGQGEFTEI

SEQ ID NO: 179321 - protein, 36 aa, Artificial Sequence
  Description of Artificial Sequence: Synthetic polypeptide
FEEEIRTTNPVATEQYGSVVAGVNDNMNGQGEFQEI

SEQ ID NO: 179322 - protein, 34 aa, Artificial Sequence
  Description of Artificial Sequence: Synthetic polypeptide
DESCIRTTNPVAYEQWGESYNVDKRHGQKGDNPA

SEQ ID NO: 179323 - protein, 36 aa, Artificial Sequence
  Description of Artificial Sequence: Synthetic polypeptide
DEFELCTVNPVATEQYGSVSWNENDQRDTQKGTGDH

SEQ ID NO: 179324 - protein, 33 aa, Artificial Sequence
  Description of Artificial Sequence: Synthetic polypeptide
DENEIRTTNPMSTEPYGTISMEDIQQQQNGANH

SEQ ID NO: 179325 - protein, 32 aa, Artificial Sequence
  Description of Artificial Sequence: Synthetic polypeptide
YENEISTTNPVSTEPYGTISMEDIQQQQNGNH

SEQ ID NO: 179326 - protein, 34 aa, Artificial Sequence
  Description of Artificial Sequence: Synthetic polypeptide
QESEIRTTNPVATEPYGCVCHGQMLLTEGGQNEP

SEQ ID NO: 179327 - protein, 32 aa, Artificial Sequence
  Description of Artificial Sequence: Synthetic polypeptide
DEATNSTTNPVAYEQWGVCSTQGINDTNGNSG

SEQ ID NO: 179328 - protein, 35 aa, Artificial Sequence
  Description of Artificial Sequence: Synthetic polypeptide
DEFEIRTTNPVAFEQWGSDVSEMIQETMNGMEAEA

SEQ ID NO: 179329 - protein, 35 aa, Artificial Sequence
  Description of Artificial Sequence: Synthetic polypeptide
DEFEIRTTNPVAFEQWGSDVSVEIQETMNGMEEAY

SEQ ID NO: 179330 - protein, 33 aa, Artificial Sequence
  Description of Artificial Sequence: Synthetic polypeptide
DENEIRTTNPTSTEPYGTISMEDIQQQQNGNWH

SEQ ID NO: 179331 - protein, 37 aa, Artificial Sequence
  Description of Artificial Sequence: Synthetic polypeptide
DEEEIRVTNPVATEQYGSVPLENSVNTEQMQMAESIL

SEQ ID NO: 179332 - protein, 37 aa, Artificial Sequence
  Description of Artificial Sequence: Synthetic polypeptide
DDEEIRTTNPVATEQYGNVIMGNLNTGGNEQTGGGGN

SEQ ID NO: 179333 - protein, 33 aa, Artificial Sequence
  Description of Artificial Sequence: Synthetic polypeptide
DEFEIRTTNPVATEQWGYDVIEIQEMNGMEEAA

SEQ ID NO: 179334 - protein, 37 aa, Artificial Sequence
  Description of Artificial Sequence: Synthetic polypeptide
DDEEIRTTNPVATEQYGNVIMGNLNLGGNGQTGGQGN

SEQ ID NO: 179335 - protein, 34 aa, Artificial Sequence
  Description of Artificial Sequence: Synthetic polypeptide
DEAVEATTNPVAYEQWGCVYSTNNDLGEGGGNQM

SEQ ID NO: 179336 - protein, 37 aa, Artificial Sequence
  Description of Artificial Sequence: Synthetic polypeptide
DDEEIRTTNPVATEQYGNVIMGNLNGGGNGQTGDTGN

SEQ ID NO: 179337 - protein, 31 aa, Artificial Sequence
  Description of Artificial Sequence: Synthetic polypeptide
DDSEVASTNPVSTEQYGNVSAEIEMSRVGQA

SEQ ID NO: 179338 - protein, 38 aa, Artificial Sequence
  Description of Artificial Sequence: Synthetic polypeptide
DDEEIRTTNPVATEQYGMSGTGMEEGNLTDQGGGNGNG

SEQ ID NO: 179339 - protein, 35 aa, Artificial Sequence
  Description of Artificial Sequence: Synthetic polypeptide
DESCIATTNPTATEAYGSTVASCTAMVSAYGGNHR

SEQ ID NO: 179340 - protein, 32 aa, Artificial Sequence
  Description of Artificial Sequence: Synthetic polypeptide
DENEIRTTNPTSTEPWGTISMEDIQQQQNGNH

SEQ ID NO: 179341 - protein, 35 aa, Artificial Sequence
  Description of Artificial Sequence: Synthetic polypeptide
DEAVEATTNPVAYEQWGCVYSTNNDLGEQGGQNNM

SEQ ID NO: 179342 - protein, 36 aa, Artificial Sequence
  Description of Artificial Sequence: Synthetic polypeptide
DDEEIRTTNPVATEQYGDVVVTQMNTGGGQGDDDET

SEQ ID NO: 179343 - protein, 36 aa, Artificial Sequence
  Description of Artificial Sequence: Synthetic polypeptide
DDEEIRTTNPVATEQYGDVVVTQMNTGGGQGDDDEI

SEQ ID NO: 179344 - protein, 34 aa, Artificial Sequence
  Description of Artificial Sequence: Synthetic polypeptide
DEAVEATTNPVAYEQWGCVYSTNNDLGEQGQNEA

SEQ ID NO: 179345 - protein, 37 aa, Artificial Sequence
  Description of Artificial Sequence: Synthetic polypeptide
DDEEIRTTNPVATEQYGDVVSSAQGDQNDGEGEGNEG

SEQ ID NO: 179346 - protein, 34 aa, Artificial Sequence
  Description of Artificial Sequence: Synthetic polypeptide
DEFEIRTTNPVAYECWGTVYQINEDQDRQMMNNG

SEQ ID NO: 179347 - protein, 33 aa, Artificial Sequence
  Description of Artificial Sequence: Synthetic polypeptide
QESEIRTTNPVGTECWGVMSCINEPQDREGEDI

SEQ ID NO: 179348 - protein, 35 aa, Artificial Sequence
  Description of Artificial Sequence: Synthetic polypeptide
QESEIRTTNPVCYEPYGVVSCDPNHSQNRQSGGND

SEQ ID NO: 179349 - protein, 36 aa, Artificial Sequence
  Description of Artificial Sequence: Synthetic polypeptide
DEEEIRTTNPVATESYGSVCSVEIDMAHVDVGDDFQ

SEQ ID NO: 179350 - protein, 32 aa, Artificial Sequence
  Description of Artificial Sequence: Synthetic polypeptide
YENEIRTVNPVSTEPYGTISMEDIQQQQNGNH

SEQ ID NO: 179351 - protein, 32 aa, Artificial Sequence
  Description of Artificial Sequence: Synthetic polypeptide
DEAEIATTNPVATEQWGTNCAAAAHMRSNDAQ

SEQ ID NO: 179352 - protein, 35 aa, Artificial Sequence
  Description of Artificial Sequence: Synthetic polypeptide
DEQSEIATTNPVAYECWGSVATGNMLGDAQGMNHN

SEQ ID NO: 179353 - protein, 30 aa, Artificial Sequence
  Description of Artificial Sequence: Synthetic polypeptide
QESEIRTTNPVGTEGWGVMAATLAHKGDYI

SEQ ID NO: 179354 - protein, 34 aa, Artificial Sequence
  Description of Artificial Sequence: Synthetic polypeptide
ADECISTTNPVATEQYGCVCSWGEHNQRFGSDQS

SEQ ID NO: 179355 - protein, 35 aa, Artificial Sequence
  Description of Artificial Sequence: Synthetic polypeptide
DESAIRTTNPVAYEQWGACYMIETNMDQRDDGGSR

SEQ ID NO: 179356 - protein, 36 aa, Artificial Sequence
  Description of Artificial Sequence: Synthetic polypeptide
DEDEIATTNPVAYEQYGVSVAAANNGEPLDNTGGNT

SEQ ID NO: 179357 - protein, 38 aa, Artificial Sequence
  Description of Artificial Sequence: Synthetic polypeptide
DEEEIRTTNPVAYEQYGQVAVSFQMNDDLQPNGQIPQF

SEQ ID NO: 179358 - protein, 38 aa, Artificial Sequence
  Description of Artificial Sequence: Synthetic polypeptide
DENEIRSTNPVATEQYGSVVTTDGMNNQTGEDENGQET

SEQ ID NO: 179359 - protein, 29 aa, Artificial Sequence
  Description of Artificial Sequence: Synthetic peptide
QESEIATTNPVATEQWGVMAEIEMNHEDI

SEQ ID NO: 179360 - protein, 36 aa, Artificial Sequence
  Description of Artificial Sequence: Synthetic polypeptide
CEEEIACTNPVATEQYGSACSANPQEAEAGIGNADE

SEQ ID NO: 179361 - protein, 37 aa, Artificial Sequence
  Description of Artificial Sequence: Synthetic polypeptide
DEEEIRATNPVATEQYGSVCAATMGEEAGMPMGENAQ

SEQ ID NO: 179362 - protein, 37 aa, Artificial Sequence
  Description of Artificial Sequence: Synthetic polypeptide
HEEEIRTTNPVATEQYGSVSLPVNNTEEHRHLAAPYP

SEQ ID NO: 179363 - protein, 32 aa, Artificial Sequence
  Description of Artificial Sequence: Synthetic polypeptide
YETEIRSTNPVATECYGVVANDDWQESKGPYI

SEQ ID NO: 179364 - protein, 39 aa, Artificial Sequence
  Description of Artificial Sequence: Synthetic polypeptide
DEEEIRTTNPVATEQYGSVVVTVVTNQQGNQQGTTDEED

SEQ ID NO: 179365 - protein, 34 aa, Artificial Sequence
  Description of Artificial Sequence: Synthetic polypeptide
VEDEIACTNPVATEQWGSVSATGDLDNHQGDEDA

SEQ ID NO: 179366 - protein, 35 aa, Artificial Sequence
  Description of Artificial Sequence: Synthetic polypeptide
DEAEIATTNPVATEQYGSTACAVPAEGQNHQDMMM

SEQ ID NO: 179367 - protein, 30 aa, Artificial Sequence
  Description of Artificial Sequence: Synthetic polypeptide
DENEIRSTNPVATEGWGDVANIIMNAAEDA

SEQ ID NO: 179368 - protein, 30 aa, Artificial Sequence
  Description of Artificial Sequence: Synthetic polypeptide
DENEIRSTNPVATEGWGDVAEIEMNAAEDA

SEQ ID NO: 179369 - protein, 33 aa, Artificial Sequence
  Description of Artificial Sequence: Synthetic polypeptide
DEDEIATTNPVAYERWGSVSGMNGNAGEHDGQS

SEQ ID NO: 179370 - protein, 32 aa, Artificial Sequence
  Description of Artificial Sequence: Synthetic polypeptide
VEDEIACTNPVATEQWGSVAQGPPQNHMNEAD

SEQ ID NO: 179371 - protein, 35 aa, Artificial Sequence
  Description of Artificial Sequence: Synthetic polypeptide
DEECISTTNPVAYEHYGQTTVAATNELATMGGERG

SEQ ID NO: 179372 - protein, 36 aa, Artificial Sequence
  Description of Artificial Sequence: Synthetic polypeptide
DEAEIATTNPVATEQYGSTVCAGNNEDGQNHDENGM

SEQ ID NO: 179373 - protein, 34 aa, Artificial Sequence
  Description of Artificial Sequence: Synthetic polypeptide
DEECISTTNPVAYEQWGSTVPSTPELSMTEDQED

SEQ ID NO: 179374 - protein, 32 aa, Artificial Sequence
  Description of Artificial Sequence: Synthetic polypeptide
DEECISTTNPVAYEQWGTCCYRGNDEQQGMMH

SEQ ID NO: 179375 - protein, 33 aa, Artificial Sequence
  Description of Artificial Sequence: Synthetic polypeptide
VEDEIACTNPVATEQWGGCSAGNGLQADHDNSA

SEQ ID NO: 179376 - protein, 38 aa, Artificial Sequence
  Description of Artificial Sequence: Synthetic polypeptide
DEEEIRTTNPVAYEQYGQVAVSFQMNDLLQPNQQIPRF

SEQ ID NO: 179377 - protein, 36 aa, Artificial Sequence
  Description of Artificial Sequence: Synthetic polypeptide
DEEEIRTTNPVATEQYGYVCVHPSPVNMPNAVDMEE

SEQ ID NO: 179378 - protein, 35 aa, Artificial Sequence
  Description of Artificial Sequence: Synthetic polypeptide
DESEIRTTNPVATEVYGETTPSCQNNAHSARGGDS

SEQ ID NO: 179379 - protein, 36 aa, Artificial Sequence
  Description of Artificial Sequence: Synthetic polypeptide
DEEEIRATNPVATEQYGSVCAASNGEEAPMNQENAM

SEQ ID NO: 179380 - protein, 37 aa, Artificial Sequence
  Description of Artificial Sequence: Synthetic polypeptide
DEEEIRATNPVATEQYGSVCAANNGEEAPMNQMENSM

SEQ ID NO: 179381 - protein, 34 aa, Artificial Sequence
  Description of Artificial Sequence: Synthetic polypeptide
YETNTIARTANPEATEQYGHDVSTMPFTRGNNVP

SEQ ID NO: 179382 - protein, 32 aa, Artificial Sequence
  Description of Artificial Sequence: Synthetic polypeptide
YETEIATTNPVATEQYGATWADENWAPKGPYI

SEQ ID NO: 179383 - protein, 37 aa, Artificial Sequence
  Description of Artificial Sequence: Synthetic polypeptide
DEEEIRATNPVATEQYGSVCAANMGEEAPMNQDENTM

SEQ ID NO: 179384 - protein, 37 aa, Artificial Sequence
  Description of Artificial Sequence: Synthetic polypeptide
DEAEIATTNPVATEQYGSACSTNPEQGQEHQDDNNAG

SEQ ID NO: 179385 - protein, 35 aa, Artificial Sequence
  Description of Artificial Sequence: Synthetic polypeptide
DEGEIACTNPVAYEQYGSVAAITNPEEAPDNQEGR

SEQ ID NO: 179386 - protein, 34 aa, Artificial Sequence
  Description of Artificial Sequence: Synthetic polypeptide
VEDEIACTNPVATEQWGCVAGTNGELINMEMNRD

SEQ ID NO: 179387 - protein, 32 aa, Artificial Sequence
  Description of Artificial Sequence: Synthetic polypeptide
YETEIASVNPIATEQWGVTVSNAENLQSKGPI

SEQ ID NO: 179388 - protein, 36 aa, Artificial Sequence
  Description of Artificial Sequence: Synthetic polypeptide
DEAEIATTNPVATEQYGSACAATNPQEADSGMGHFM

SEQ ID NO: 179389 - protein, 35 aa, Artificial Sequence
  Description of Artificial Sequence: Synthetic polypeptide
QESEIATTNPVATEQYGTVCSQTGGEVSEFEGGND

SEQ ID NO: 179390 - protein, 36 aa, Artificial Sequence
  Description of Artificial Sequence: Synthetic polypeptide
DEEEIRATNPVATEQYGSVCAMNNGEPTGGDPGEEG

SEQ ID NO: 179391 - protein, 36 aa, Artificial Sequence
  Description of Artificial Sequence: Synthetic polypeptide
DEAEIATTNPVATEQYGSACATNPDEEGTHGDNDTP

SEQ ID NO: 179392 - protein, 38 aa, Artificial Sequence
  Description of Artificial Sequence: Synthetic polypeptide
DEEEIRTTNPVATEQYGSCVSHAWQPDDDASNEYQEEL

SEQ ID NO: 179393 - protein, 31 aa, Artificial Sequence
  Description of Artificial Sequence: Synthetic polypeptide
DENEIRSTNPVSTEPYGTIAMEDIQQHNGDI

SEQ ID NO: 179394 - protein, 36 aa, Artificial Sequence
  Description of Artificial Sequence: Synthetic polypeptide
DEGEIACTNPVATEQYGSVCAAANPQQEHQDGNKHQ

SEQ ID NO: 179395 - protein, 34 aa, Artificial Sequence
  Description of Artificial Sequence: Synthetic polypeptide
VEDEIACTNPVATEQWGCVAGTNLQTLANDNPYY

SEQ ID NO: 179396 - protein, 36 aa, Artificial Sequence
  Description of Artificial Sequence: Synthetic polypeptide
DEGEIACTNPVATEQYGSVCAATENLDAGTPGDEDA

SEQ ID NO: 179397 - protein, 32 aa, Artificial Sequence
  Description of Artificial Sequence: Synthetic polypeptide
DENEIRSTNPVSTEPYGNIAANTIQQSQNGQH

SEQ ID NO: 179398 - protein, 37 aa, Artificial Sequence
  Description of Artificial Sequence: Synthetic polypeptide
DEEEIRTTNPVAYEQYGSEVTSSEVGLLEVINIGQFQ

SEQ ID NO: 179399 - protein, 32 aa, Artificial Sequence
  Description of Artificial Sequence: Synthetic polypeptide
VEDEIACTNPVATEQWGCVAGTVGLINMMNAD

SEQ ID NO: 179400 - protein, 36 aa, Artificial Sequence
  Description of Artificial Sequence: Synthetic polypeptide
DEGEIACTNPVATEQYGSVCAATENLEAGEQDEEAV

SEQ ID NO: 179401 - protein, 35 aa, Artificial Sequence
  Description of Artificial Sequence: Synthetic polypeptide
CEEEIACTNPVATEQYGSACSANDLDNHADENGHE

SEQ ID NO: 179402 - protein, 36 aa, Artificial Sequence
  Description of Artificial Sequence: Synthetic polypeptide
DEEEIRTTNPVAYEQYGQYASVANQAASVRVNVEEY

SEQ ID NO: 179403 - protein, 34 aa, Artificial Sequence
  Description of Artificial Sequence: Synthetic polypeptide
DEDEIATTNPVAYERWGSVSGMNPGNAGEHGIQR

SEQ ID NO: 179404 - protein, 36 aa, Artificial Sequence
  Description of Artificial Sequence: Synthetic polypeptide
CEEEIACTNPVATEQYGSACSANPHLDEAPMGMGNQ

SEQ ID NO: 179405 - protein, 37 aa, Artificial Sequence
  Description of Artificial Sequence: Synthetic polypeptide
DEGEIACTNPVATEQYGSVCSAGPALGQDHQDGNDNH

SEQ ID NO: 179406 - protein, 34 aa, Artificial Sequence
  Description of Artificial Sequence: Synthetic polypeptide
DEQEIATTNPVATEQWGCVAANQGLPATMNPENH

SEQ ID NO: 179407 - protein, 36 aa, Artificial Sequence
  Description of Artificial Sequence: Synthetic polypeptide
DEGEIACTNPVATEQYGSVCSAPAEGQDHQDGNDHQ

SEQ ID NO: 179408 - protein, 35 aa, Artificial Sequence
  Description of Artificial Sequence: Synthetic polypeptide
DEDEIATTNPVAYERWGSVSGGNADDSRNHGNGND

SEQ ID NO: 179409 - protein, 36 aa, Artificial Sequence
  Description of Artificial Sequence: Synthetic polypeptide
DEGEIACTNPVATEQYGSVSASNPGITNIGNGMEGV

SEQ ID NO: 179410 - protein, 32 aa, Artificial Sequence
  Description of Artificial Sequence: Synthetic polypeptide
YETEIATTNPVATEQYGATWAAENWAPKGPYI

SEQ ID NO: 179411 - protein, 37 aa, Artificial Sequence
  Description of Artificial Sequence: Synthetic polypeptide
DEAEIATTNPVATEQYGSACSMNHNGPLDSGEGNHHM

SEQ ID NO: 179412 - protein, 38 aa, Artificial Sequence
  Description of Artificial Sequence: Synthetic polypeptide
DEEEIRTTNPVATEGYGSVMLDGTGGDTNQDGGTNEGV

SEQ ID NO: 179413 - protein, 36 aa, Artificial Sequence
  Description of Artificial Sequence: Synthetic polypeptide
VEDEIACTNPVATEQWGSVAGATNPPGLEHQDGTNH

SEQ ID NO: 179414 - protein, 37 aa, Artificial Sequence
  Description of Artificial Sequence: Synthetic polypeptide
DEEEIRATNPVATEQYGSVCAANMGEEAGMPMGEHNG

SEQ ID NO: 179415 - protein, 35 aa, Artificial Sequence
  Description of Artificial Sequence: Synthetic polypeptide
DEECISTTNPVAYEQYGCVCSWGEHNQEYFGSDNQ

SEQ ID NO: 179416 - protein, 32 aa, Artificial Sequence
  Description of Artificial Sequence: Synthetic polypeptide
HENEIKTTNPVSTEPYGTISMEDIQQQQNGNH

SEQ ID NO: 179417 - protein, 34 aa, Artificial Sequence
  Description of Artificial Sequence: Synthetic polypeptide
HENEIRTTNPVATEPYGCVCHGQMMLTRGGQDEP

SEQ ID NO: 179418 - protein, 35 aa, Artificial Sequence
  Description of Artificial Sequence: Synthetic polypeptide
DESEIRTTNPVATEYWGCVCSWMNENQDNFGSDQA

SEQ ID NO: 179419 - protein, 37 aa, Artificial Sequence
  Description of Artificial Sequence: Synthetic polypeptide
DEEEIRATNPVATEQYGSVCAAIEGEEAPDNQDGNTM

SEQ ID NO: 179420 - protein, 39 aa, Artificial Sequence
  Description of Artificial Sequence: Synthetic polypeptide
AEEEIRTTNPVATEQYGVVVVVSTTNTNLQAGTEEGVVS

SEQ ID NO: 179421 - protein, 32 aa, Artificial Sequence
  Description of Artificial Sequence: Synthetic polypeptide
YQEEIRTTNPVATEHWGTYSSWNENEFPINKI

SEQ ID NO: 179422 - protein, 31 aa, Artificial Sequence
  Description of Artificial Sequence: Synthetic polypeptide
DDSEVASTNPVSYEGYGNVAANTIQSRVGQR

SEQ ID NO: 179423 - protein, 32 aa, Artificial Sequence
  Description of Artificial Sequence: Synthetic polypeptide
HENEIRTTNPVSTSPYGTISMEDIQQQQNGNH

SEQ ID NO: 179424 - protein, 32 aa, Artificial Sequence
  Description of Artificial Sequence: Synthetic polypeptide
DEGEIAPTNPVSTEPYGTISMEDIQQQQNGNH

SEQ ID NO: 179425 - protein, 29 aa, Artificial Sequence
  Description of Artificial Sequence: Synthetic peptide
DDSEVASVNPVSTEGYGNVANTIQSRGQQ

SEQ ID NO: 179426 - protein, 36 aa, Artificial Sequence
  Description of Artificial Sequence: Synthetic polypeptide
DEEEIRATNPVATEQYGSVCAAIEGEEAMNQDNNPM

SEQ ID NO: 179427 - protein, 32 aa, Artificial Sequence
  Description of Artificial Sequence: Synthetic polypeptide
CAEEIATTNPVGTEQWGGCVAGTGLAMNPDVR

SEQ ID NO: 179428 - protein, 32 aa, Artificial Sequence
  Description of Artificial Sequence: Synthetic polypeptide
DENEIRGTNPVSTEPYGTISMEDIQQQQNGEH

SEQ ID NO: 179429 - protein, 35 aa, Artificial Sequence
  Description of Artificial Sequence: Synthetic polypeptide
DENEIRGTNPVATESYGSVMSNQNNIFQEEMAEGD

SEQ ID NO: 179430 - protein, 35 aa, Artificial Sequence
  Description of Artificial Sequence: Synthetic polypeptide
DENEIRGTNPVATEQYGVVGDDVNNSGMEGNEQGD

SEQ ID NO: 179431 - protein, 35 aa, Artificial Sequence
  Description of Artificial Sequence: Synthetic polypeptide
DENEIRGTNPVATEQYGVISGELDGGGENDDGIGD

SEQ ID NO: 179432 - protein, 38 aa, Artificial Sequence
  Description of Artificial Sequence: Synthetic polypeptide
DEEEIRTTNPVATEQYGSFANSEANPDDLGGSGQEEDG

SEQ ID NO: 179433 - protein, 36 aa, Artificial Sequence
  Description of Artificial Sequence: Synthetic polypeptide
DEEEIRATNPVATEQYGSVCAAIEGEEAIDQMENTM

SEQ ID NO: 179434 - protein, 32 aa, Artificial Sequence
  Description of Artificial Sequence: Synthetic polypeptide
CAEEIATTNPVGTEQWGGCVAGTGLAMNPGDK

SEQ ID NO: 179435 - protein, 39 aa, Artificial Sequence
  Description of Artificial Sequence: Synthetic polypeptide
DEEEIRTTNPVATEQYGSFCVTWSVNDEEQNNEPEIQRV

SEQ ID NO: 179436 - protein, 35 aa, Artificial Sequence
  Description of Artificial Sequence: Synthetic polypeptide
HESETRTTNPVATECWGSVSMCINEPQDREHENMG

SEQ ID NO: 179437 - protein, 38 aa, Artificial Sequence
  Description of Artificial Sequence: Synthetic polypeptide
DEEEIRTTNPVATEQYGSFGNSDLVNELPDEQPTLEWV

SEQ ID NO: 179438 - protein, 34 aa, Artificial Sequence
  Description of Artificial Sequence: Synthetic polypeptide
DEAVIGTTNPVATEQWGCVCSNWEDLQYFGSDQA

SEQ ID NO: 179439 - protein, 37 aa, Artificial Sequence
  Description of Artificial Sequence: Synthetic polypeptide
HSEEIRTTNPVATEQYGSVGILTVNTEEHRKLAGPVD

SEQ ID NO: 179440 - protein, 31 aa, Artificial Sequence
  Description of Artificial Sequence: Synthetic polypeptide
DDSEVASTNPVSYEGYGNVAANTIQSRGGMR

SEQ ID NO: 179441 - protein, 36 aa, Artificial Sequence
  Description of Artificial Sequence: Synthetic polypeptide
DEEEIRATNPVATEQYGSVCAAIEGEEAPMQDENAM

SEQ ID NO: 179442 - protein, 38 aa, Artificial Sequence
  Description of Artificial Sequence: Synthetic polypeptide
DEEEIRTTNPVATEQYGSETYPSVDLSEDPIRQVAENI

SEQ ID NO: 179443 - protein, 36 aa, Artificial Sequence
  Description of Artificial Sequence: Synthetic polypeptide
DEEEIRATNPVATEQYGSVCAAIEGGEEAMQDENTM

SEQ ID NO: 179444 - protein, 31 aa, Artificial Sequence
  Description of Artificial Sequence: Synthetic polypeptide
QESEIATTNPVATECYGSAPCIVCPQDHEEG

SEQ ID NO: 179445 - protein, 32 aa, Artificial Sequence
  Description of Artificial Sequence: Synthetic polypeptide
VEDEIACTNPVATEQWGHCTAGNGLARPDNEW

SEQ ID NO: 179446 - protein, 32 aa, Artificial Sequence
  Description of Artificial Sequence: Synthetic polypeptide
QESEIATTNPVATECYGSAPCINCPQDHEEEG

SEQ ID NO: 179447 - protein, 31 aa, Artificial Sequence
  Description of Artificial Sequence: Synthetic polypeptide
DEGEIAPTNPISSECWGIVSNCNLAESKGTR

SEQ ID NO: 179448 - protein, 31 aa, Artificial Sequence
  Description of Artificial Sequence: Synthetic polypeptide
DDSEVASTNPVSYEGYGNVAANDIQSRVGQR

SEQ ID NO: 179449 - protein, 37 aa, Artificial Sequence
  Description of Artificial Sequence: Synthetic polypeptide
DEEEIRATNPVATEQYGSVCAAIQGPEEAGDQMENTM

SEQ ID NO: 179450 - protein, 37 aa, Artificial Sequence
  Description of Artificial Sequence: Synthetic polypeptide
DEEEIRATNPVATEQYGSVCAAINGEEAGMSQMENTM

SEQ ID NO: 179451 - protein, 38 aa, Artificial Sequence
  Description of Artificial Sequence: Synthetic polypeptide
DEEEIRTTNPVATEGYGSVMSDGTGGDTQDDIGTQEGI

SEQ ID NO: 179452 - protein, 35 aa, Artificial Sequence
  Description of Artificial Sequence: Synthetic polypeptide
DEDEIATTNPVAYERWGSVSGGNADDSRNLGGGNE

SEQ ID NO: 179453 - protein, 38 aa, Artificial Sequence
  Description of Artificial Sequence: Synthetic polypeptide
AEEEIRTTNPVATEQYGVVVVVTTNNQGNLQAGTDEED

SEQ ID NO: 179454 - protein, 31 aa, Artificial Sequence
  Description of Artificial Sequence: Synthetic polypeptide
DDSEVASTNPVSYEGYGNVAANTIQERVGQR

SEQ ID NO: 179455 - protein, 31 aa, Artificial Sequence
  Description of Artificial Sequence: Synthetic polypeptide
DDSEVASTNPVSYEGYGNVAANTIQNRVGSR

SEQ ID NO: 179456 - protein, 39 aa, Artificial Sequence
  Description of Artificial Sequence: Synthetic polypeptide
DEEEIRTTNPVATEQYGSCVIPPAEPLLQEARVNPTWWV

SEQ ID NO: 179457 - protein, 34 aa, Artificial Sequence
  Description of Artificial Sequence: Synthetic polypeptide
DEDEIATTNPVAYERWGSVSGGNPGNAGEDDGND

SEQ ID NO: 179458 - protein, 37 aa, Artificial Sequence
  Description of Artificial Sequence: Synthetic polypeptide
DEREIRTTNPVATEQYGCVCSNTGEHNIENFNSDNQS

SEQ ID NO: 179459 - protein, 34 aa, Artificial Sequence
  Description of Artificial Sequence: Synthetic polypeptide
DEDEIATTNPVAYERWGSVSGGNPGNAGPHDGQR

SEQ ID NO: 179460 - protein, 36 aa, Artificial Sequence
  Description of Artificial Sequence: Synthetic polypeptide
DEEEIRATNPVATEQYGSVCAAIGEEAGMVQGENTM

SEQ ID NO: 179461 - protein, 36 aa, Artificial Sequence
  Description of Artificial Sequence: Synthetic polypeptide
HEMEIRTTNPVATEPYGSVCHPGHQMLLTRGGQNEP

SEQ ID NO: 179462 - protein, 33 aa, Artificial Sequence
  Description of Artificial Sequence: Synthetic polypeptide
HEMEIVTTNPVATEQFGTVCSAVDGPVEFEGND

SEQ ID NO: 179463 - protein, 32 aa, Artificial Sequence
  Description of Artificial Sequence: Synthetic polypeptide
DENEIRPTNPVSTEPYGTISMEDIQQQQNGTH

SEQ ID NO: 179464 - protein, 34 aa, Artificial Sequence
  Description of Artificial Sequence: Synthetic polypeptide
DEAVIGTTNPVATEQWGCVCSTGDDDQYFNSNQS

SEQ ID NO: 179465 - protein, 36 aa, Artificial Sequence
  Description of Artificial Sequence: Synthetic polypeptide
DEEEIRATNPVATEQYGSVCAAIEPEEAMHQDENAM

SEQ ID NO: 179466 - protein, 35 aa, Artificial Sequence
  Description of Artificial Sequence: Synthetic polypeptide
DEAVIGTTNPVATEQWGCVCSNTEDLNQYFGSDQS

SEQ ID NO: 179467 - protein, 35 aa, Artificial Sequence
  Description of Artificial Sequence: Synthetic polypeptide
DEREIATTNPVATEQYGVVPCWDNHGQQQGGKGAN

SEQ ID NO: 179468 - protein, 34 aa, Artificial Sequence
  Description of Artificial Sequence: Synthetic polypeptide
VEDEIACTNPVATEQWGGCVAGTMLQHSDDNGNL

SEQ ID NO: 179469 - protein, 35 aa, Artificial Sequence
  Description of Artificial Sequence: Synthetic polypeptide
DEECISTTNPVAYEQYGCVCSTGEDNQEYFGSEQS

SEQ ID NO: 179470 - protein, 33 aa, Artificial Sequence
  Description of Artificial Sequence: Synthetic polypeptide
QESEIATTNPVATECYGEVPCIVEPQDHEGENK

SEQ ID NO: 179471 - protein, 36 aa, Artificial Sequence
  Description of Artificial Sequence: Synthetic polypeptide
CEEEIRATNPVATEIYGVVTMQDGDNGQRFNDNGNL

SEQ ID NO: 179472 - protein, 38 aa, Artificial Sequence
  Description of Artificial Sequence: Synthetic polypeptide
DEEEIRTTNPVAYEQYGQVAVSFQMDDLLQPRSQIPRP

SEQ ID NO: 179473 - protein, 33 aa, Artificial Sequence
  Description of Artificial Sequence: Synthetic polypeptide
DENEIRSTNPVSTEPYGTISMEDIQDQQNGWNH

SEQ ID NO: 179474 - protein, 34 aa, Artificial Sequence
  Description of Artificial Sequence: Synthetic polypeptide
DEDEIATTNPVAYERWGEVYCTNDLRDQDLMNDK

SEQ ID NO: 179475 - protein, 33 aa, Artificial Sequence
  Description of Artificial Sequence: Synthetic polypeptide
DERENATTNPVAYEQWGSVSGPNGNAGEGGTTN

SEQ ID NO: 179476 - protein, 35 aa, Artificial Sequence
  Description of Artificial Sequence: Synthetic polypeptide
DEGCISTTNPVATEQYGCVFVWINGEQDRKKHGDV

SEQ ID NO: 179477 - protein, 37 aa, Artificial Sequence
  Description of Artificial Sequence: Synthetic polypeptide
DEEEIRATNPVATEQYGSVMGDQPGDGQTGGNDGGVE

SEQ ID NO: 179478 - protein, 35 aa, Artificial Sequence
  Description of Artificial Sequence: Synthetic polypeptide
DEAVIRATNPVATENYGSVYNSELLEFPNYSQNTR

SEQ ID NO: 179479 - protein, 32 aa, Artificial Sequence
  Description of Artificial Sequence: Synthetic polypeptide
DEGCISTTNPVAYEQWGCFSWDNGDFDKGNKT

SEQ ID NO: 179480 - protein, 36 aa, Artificial Sequence
  Description of Artificial Sequence: Synthetic polypeptide
DEEEIRTTNPVATEGYGSVYDDIIDGGQEDDTGEIV

SEQ ID NO: 179481 - protein, 33 aa, Artificial Sequence
  Description of Artificial Sequence: Synthetic polypeptide
DEGCISTTNPVAYEQWGCFSWDNGDFDNGDNGR

SEQ ID NO: 179482 - protein, 32 aa, Artificial Sequence
  Description of Artificial Sequence: Synthetic polypeptide
DEGCISTTNPVAYEQWGCFSWDNGDFDNGNTM

SEQ ID NO: 179483 - protein, 32 aa, Artificial Sequence
  Description of Artificial Sequence: Synthetic polypeptide
QESEIATTNPVSTEPYGTMSSETIQQQHNGDH

SEQ ID NO: 179484 - protein, 30 aa, Artificial Sequence
  Description of Artificial Sequence: Synthetic polypeptide
DDSEVATTNPVATEGWGNVSNIIMNRVEDA

SEQ ID NO: 179485 - protein, 36 aa, Artificial Sequence
  Description of Artificial Sequence: Synthetic polypeptide
FENEIRTTNPVATEQYGSWSVTDLWWGDEHESVQFE

SEQ ID NO: 179486 - protein, 31 aa, Artificial Sequence
  Description of Artificial Sequence: Synthetic polypeptide
DEQVIRTTNPVATEWWGDVSEIEMKAAEDAE

SEQ ID NO: 179487 - protein, 35 aa, Artificial Sequence
  Description of Artificial Sequence: Synthetic polypeptide
FEPEIRTTNPVATEQYGSVCFPHDDETTMNQEQFI

SEQ ID NO: 179488 - protein, 31 aa, Artificial Sequence
  Description of Artificial Sequence: Synthetic polypeptide
QESEIATTNPVSTEGYGTIAMDIQQQHNGNI

SEQ ID NO: 179489 - protein, 33 aa, Artificial Sequence
  Description of Artificial Sequence: Synthetic polypeptide
DEGCISTTNPVAYEQWGCFSWDNGDQDNGKNDE

SEQ ID NO: 179490 - protein, 32 aa, Artificial Sequence
  Description of Artificial Sequence: Synthetic polypeptide
VEDEIACTNPVATEQWGCTAGNGLADGHDNSD

SEQ ID NO: 179491 - protein, 32 aa, Artificial Sequence
  Description of Artificial Sequence: Synthetic polypeptide
DEGCNATTNPIAYEQWGEYYTNLNDHDGGNNR

SEQ ID NO: 179492 - protein, 37 aa, Artificial Sequence
  Description of Artificial Sequence: Synthetic polypeptide
DEEEIRATNPVATEQYGSVDTVMQGNGGDEDEEDGQQ

SEQ ID NO: 179493 - protein, 36 aa, Artificial Sequence
  Description of Artificial Sequence: Synthetic polypeptide
DEGDEIATTNPVAYEQYGTVATENGGQQNGGQRGES

SEQ ID NO: 179494 - protein, 36 aa, Artificial Sequence
  Description of Artificial Sequence: Synthetic polypeptide
DEEEIRTTNPVATEGYGSVVVVGFGQENDQDEADGT

SEQ ID NO: 179495 - protein, 36 aa, Artificial Sequence
  Description of Artificial Sequence: Synthetic polypeptide
DEAEIATTNPVATEQYGCVCSTTDPNEEHFGSETLS

SEQ ID NO: 179496 - protein, 37 aa, Artificial Sequence
  Description of Artificial Sequence: Synthetic polypeptide
FETEIRTTNPVATEQYGSVVDLNNNDLQNIGGGQGGT

SEQ ID NO: 179497 - protein, 37 aa, Artificial Sequence
  Description of Artificial Sequence: Synthetic polypeptide
FETEIRTTNPVATEQYGSVVDMENNDLQNIGGGQGGV

SEQ ID NO: 179498 - protein, 36 aa, Artificial Sequence
  Description of Artificial Sequence: Synthetic polypeptide
FETEIRTTNPVATEQYGVVSVQNQDGQEQGGQGEGQ

SEQ ID NO: 179499 - protein, 36 aa, Artificial Sequence
  Description of Artificial Sequence: Synthetic polypeptide
DEAEIATTNPVATEQYGCVCSTTDLNEEHEGSEDAS

SEQ ID NO: 179500 - protein, 34 aa, Artificial Sequence
  Description of Artificial Sequence: Synthetic polypeptide
DEAVIRATNPTATENYGSVYSALLEFPNNSQNTR

SEQ ID NO: 179501 - protein, 35 aa, Artificial Sequence
  Description of Artificial Sequence: Synthetic polypeptide
DEQEIATTNPVATEQWGHCNVAATNGLPADAPGGF

SEQ ID NO: 179502 - protein, 36 aa, Artificial Sequence
  Description of Artificial Sequence: Synthetic polypeptide
CEEEIACTNPVATEQYGSACATNPQLNPDDQMGSQM

SEQ ID NO: 179503 - protein, 38 aa, Artificial Sequence
  Description of Artificial Sequence: Synthetic polypeptide
DESEIRTTNPVATESYGSVVSDGMEDLTNGEGDQIGDA

SEQ ID NO: 179504 - protein, 36 aa, Artificial Sequence
  Description of Artificial Sequence: Synthetic polypeptide
DEEEIRTTNPVATEQYGCVCQNWGEDNIENFNSEQS

SEQ ID NO: 179505 - protein, 33 aa, Artificial Sequence
  Description of Artificial Sequence: Synthetic polypeptide
VEDEIACTNPVATAQWGGCVASANLDNESGNDT

SEQ ID NO: 179506 - protein, 36 aa, Artificial Sequence
  Description of Artificial Sequence: Synthetic polypeptide
DEEEIRTTNPVATEGYGVVDTDNGMEGQGEDQEAGE

SEQ ID NO: 179507 - protein, 36 aa, Artificial Sequence
  Description of Artificial Sequence: Synthetic polypeptide
DEAEIATTNPVATEQYGCVCSNTDPNEEHEGSETLA

SEQ ID NO: 179508 - protein, 37 aa, Artificial Sequence
  Description of Artificial Sequence: Synthetic polypeptide
DEEEIRTTNPVATEGYGVVDNFTQNNGQEIVGQGQET

SEQ ID NO: 179509 - protein, 35 aa, Artificial Sequence
  Description of Artificial Sequence: Synthetic polypeptide
DEQVIATTNPVATEQYGSVSAMDLNEDHQGLEDEN

SEQ ID NO: 179510 - protein, 36 aa, Artificial Sequence
  Description of Artificial Sequence: Synthetic polypeptide
DEEEIRTTNPVATEGYGVVDNFTQNNGDEDGQGQET

SEQ ID NO: 179511 - protein, 36 aa, Artificial Sequence
  Description of Artificial Sequence: Synthetic polypeptide
DDEEIRTTNPVATEQYGCVCSNWEEHQEHFNSENQA

SEQ ID NO: 179512 - protein, 36 aa, Artificial Sequence
  Description of Artificial Sequence: Synthetic polypeptide
DDEEIRTTNPVATEQYGCVCSNWEEHNQGFNSDTQS

SEQ ID NO: 179513 - protein, 38 aa, Artificial Sequence
  Description of Artificial Sequence: Synthetic polypeptide
DESEIRTTNPVATESYGSVVSDGMQGLTNGEGDQTGDV

SEQ ID NO: 179514 - protein, 35 aa, Artificial Sequence
  Description of Artificial Sequence: Synthetic polypeptide
DEEEIRTTNPVATEGYGVVDIEMGNDGFEDNGEIV

SEQ ID NO: 179515 - protein, 33 aa, Artificial Sequence
  Description of Artificial Sequence: Synthetic polypeptide
DEDEIATTNPVAYERWGCVYCTNDDRPDHTNNA

SEQ ID NO: 179516 - protein, 36 aa, Artificial Sequence
  Description of Artificial Sequence: Synthetic polypeptide
DESAEIATTNPVAYEQWGSVSHTMNDRGNDDGDNDQ

SEQ ID NO: 179517 - protein, 31 aa, Artificial Sequence
  Description of Artificial Sequence: Synthetic polypeptide
DDSEVASTNPVSTHGYGNVAANTIQNRVGQR

SEQ ID NO: 179518 - protein, 37 aa, Artificial Sequence
  Description of Artificial Sequence: Synthetic polypeptide
DEEEIRTTNPVATEQYGCVCQNWGEHNQENFNSENQS

SEQ ID NO: 179519 - protein, 33 aa, Artificial Sequence
  Description of Artificial Sequence: Synthetic polypeptide
VEDEIACTNPVATEMWGSVAATANLENNAPSRS

SEQ ID NO: 179520 - protein, 31 aa, Artificial Sequence
  Description of Artificial Sequence: Synthetic polypeptide
DDSEVASTNPVSTHGYGNVAANTIQSRVGQR

SEQ ID NO: 179521 - protein, 36 aa, Artificial Sequence
  Description of Artificial Sequence: Synthetic polypeptide
DESAEIATTNPVAYEEWGSTSTLNGLNDQNGGTNML

SEQ ID NO: 179522 - protein, 35 aa, Artificial Sequence
  Description of Artificial Sequence: Synthetic polypeptide
DESAEIATTNPVAYECWGSVATGNMLGDAQGMNME

SEQ ID NO: 179523 - protein, 36 aa, Artificial Sequence
  Description of Artificial Sequence: Synthetic polypeptide
DEAEIATTNPVATEQYGCVCSTTALNEEHFGSEDLS

SEQ ID NO: 179524 - protein, 33 aa, Artificial Sequence
  Description of Artificial Sequence: Synthetic polypeptide
VEDEIACTNPVATEPYGSVCAGNNDTTAGGNEQ

SEQ ID NO: 179525 - protein, 32 aa, Artificial Sequence
  Description of Artificial Sequence: Synthetic polypeptide
DDSEVASTNPVATEGYGNVAATDTIESRVGQR

SEQ ID NO: 179526 - protein, 31 aa, Artificial Sequence
  Description of Artificial Sequence: Synthetic polypeptide
DDSEVASTNPVSTIGYGNVAANTIQSRVGQR

SEQ ID NO: 179527 - protein, 31 aa, Artificial Sequence
  Description of Artificial Sequence: Synthetic polypeptide
DDSEVASTNPVSTLGYGNVAANEIQSRVGQR

SEQ ID NO: 179528 - protein, 36 aa, Artificial Sequence
  Description of Artificial Sequence: Synthetic polypeptide
DEAEIATTNPVATEQYGCVCSTTDLNEDHSGSETLS

SEQ ID NO: 179529 - protein, 29 aa, Artificial Sequence
  Description of Artificial Sequence: Synthetic peptide
QESEIATTNPVGTEQWGVMASIEMNHEDI

SEQ ID NO: 179530 - protein, 29 aa, Artificial Sequence
  Description of Artificial Sequence: Synthetic peptide
QESEIATTNPVGTEQWGVMAEIEQNAEDA

SEQ ID NO: 179531 - protein, 37 aa, Artificial Sequence
  Description of Artificial Sequence: Synthetic polypeptide
DEEEIRTTNPVATEGYGSVVQQTDVGDGQEQGGETAT

SEQ ID NO: 179532 - protein, 31 aa, Artificial Sequence
  Description of Artificial Sequence: Synthetic polypeptide
QESEIATTNPVGTEGYGTMAMDIQQQHNGNI

SEQ ID NO: 179533 - protein, 31 aa, Artificial Sequence
  Description of Artificial Sequence: Synthetic polypeptide
QESEIATTNPVGTEGYGTIAMDIQQQHNGNI

SEQ ID NO: 179534 - protein, 33 aa, Artificial Sequence
  Description of Artificial Sequence: Synthetic polypeptide
DERAEIATTNPVAYEQWGSVTGPNGNAGEGDTT

SEQ ID NO: 179535 - protein, 31 aa, Artificial Sequence
  Description of Artificial Sequence: Synthetic polypeptide
DDSEVASTNPVSWEGYGNVAANTIQSRVGQR

SEQ ID NO: 179536 - protein, 35 aa, Artificial Sequence
  Description of Artificial Sequence: Synthetic polypeptide
DEGEIACTNPVATEQYGSACAATGLAPGEQMEGRM

SEQ ID NO: 179537 - protein, 31 aa, Artificial Sequence
  Description of Artificial Sequence: Synthetic polypeptide
GQAEIATTNPVAYEQWGCCGTWDNQGHGNVQ

SEQ ID NO: 179538 - protein, 33 aa, Artificial Sequence
  Description of Artificial Sequence: Synthetic polypeptide
DENEIRSTNPVSTEPYGTISMEDIQQQQNGDNH

SEQ ID NO: 179539 - protein, 31 aa, Artificial Sequence
  Description of Artificial Sequence: Synthetic polypeptide
QESEIATTNPVGTEGYGATTWAAETLQHGDI

SEQ ID NO: 179540 - protein, 29 aa, Artificial Sequence
  Description of Artificial Sequence: Synthetic peptide
QESEIATTNPVGTEGWGVMAETLQNAEDI

SEQ ID NO: 179541 - protein, 34 aa, Artificial Sequence
  Description of Artificial Sequence: Synthetic polypeptide
DEAVIGTTNPVATEQWGCVCSMTEDDQYFGSDQA

SEQ ID NO: 179542 - protein, 32 aa, Artificial Sequence
  Description of Artificial Sequence: Synthetic polypeptide
VEDEIACTNPVATEQWGCTAGNNLQDDEDNSY

SEQ ID NO: 179543 - protein, 32 aa, Artificial Sequence
  Description of Artificial Sequence: Synthetic polypeptide
VEDEIACTNPVATEQWGCVAGTALINMPMGQF

SEQ ID NO: 179544 - protein, 34 aa, Artificial Sequence
  Description of Artificial Sequence: Synthetic polypeptide
DEGEIACTNPVATEQYGSACAATGPAPGEQMEGN

SEQ ID NO: 179545 - protein, 37 aa, Artificial Sequence
  Description of Artificial Sequence: Synthetic polypeptide
DEEEIRTTNPVATEGYGSVMGNMQEGGQGGDQTVAPG

SEQ ID NO: 179546 - protein, 31 aa, Artificial Sequence
  Description of Artificial Sequence: Synthetic polypeptide
QESEIATTNPVGTECYGATTWAAETLQHGDI

SEQ ID NO: 179547 - protein, 34 aa, Artificial Sequence
  Description of Artificial Sequence: Synthetic polypeptide
VEDEIACTNPVATEQWGSVSGQGPPQEAADGQNH

SEQ ID NO: 179548 - protein, 31 aa, Artificial Sequence
  Description of Artificial Sequence: Synthetic polypeptide
DDSEVASTNPVSYEAYGNVACNTIQSRTGQR

SEQ ID NO: 179549 - protein, 31 aa, Artificial Sequence
  Description of Artificial Sequence: Synthetic polypeptide
DDSEVASTNPVSYEGYGGVAANTIQSRVGQR

SEQ ID NO: 179550 - protein, 38 aa, Artificial Sequence
  Description of Artificial Sequence: Synthetic polypeptide
DEEEIRTTNPVATEQYGSCVEPTLMWSELHPVMVSNEN

SEQ ID NO: 179551 - protein, 33 aa, Artificial Sequence
  Description of Artificial Sequence: Synthetic polypeptide
YETEIASTNPIATEQYGAVWADENLQESKGPYQ

SEQ ID NO: 179552 - protein, 30 aa, Artificial Sequence
  Description of Artificial Sequence: Synthetic polypeptide
QESEIATTNPVAYEQWGEAYMVEEQHGSEG

SEQ ID NO: 179553 - protein, 33 aa, Artificial Sequence
  Description of Artificial Sequence: Synthetic polypeptide
VEDEIACTNPVATEQWGCVAGTGELINTMMNRD

SEQ ID NO: 179554 - protein, 32 aa, Artificial Sequence
  Description of Artificial Sequence: Synthetic polypeptide
VEDEIACTNPVATEQWGCVAGTGLINNMEMRG

SEQ ID NO: 179555 - protein, 36 aa, Artificial Sequence
  Description of Artificial Sequence: Synthetic polypeptide
DEEEIRTTNPVAYEQYGSSSESEVGLLEVINIGQFQ

SEQ ID NO: 179556 - protein, 36 aa, Artificial Sequence
  Description of Artificial Sequence: Synthetic polypeptide
DEAEIATTNPVATEQYGCVTSTTELNEEHFGSEDLA

SEQ ID NO: 179557 - protein, 36 aa, Artificial Sequence
  Description of Artificial Sequence: Synthetic polypeptide
DEAEIATTNPVATEQYGCVCSTWELNEEHEGSETLS

SEQ ID NO: 179558 - protein, 36 aa, Artificial Sequence
  Description of Artificial Sequence: Synthetic polypeptide
DENEIRTTNCVATEAYGSVVTNNGQDQQTGGQEGQD

SEQ ID NO: 179559 - protein, 31 aa, Artificial Sequence
  Description of Artificial Sequence: Synthetic polypeptide
VEDEIACTNPVATEQWGCTAGNNLADDEDNQ

SEQ ID NO: 179560 - protein, 36 aa, Artificial Sequence
  Description of Artificial Sequence: Synthetic polypeptide
DENEIRTTNCVATEIYGSVVINTGNDQQTGGQGGAT

SEQ ID NO: 179561 - protein, 31 aa, Artificial Sequence
  Description of Artificial Sequence: Synthetic polypeptide
VEDEIACTNPVATEQWGCTAGNGLADPDNTW

SEQ ID NO: 179562 - protein, 36 aa, Artificial Sequence
  Description of Artificial Sequence: Synthetic polypeptide
DEEEIRTTNPVATEQYGSCTPCPMVGQQIQQVQEED

SEQ ID NO: 179563 - protein, 37 aa, Artificial Sequence
  Description of Artificial Sequence: Synthetic polypeptide
DEEEIRTTNPVATEGYGSVVFDQTDQDEGQTDDDNDN

SEQ ID NO: 179564 - protein, 32 aa, Artificial Sequence
  Description of Artificial Sequence: Synthetic polypeptide
DENEIRTTNPCSYEPYGTTSKEDIQQQQNGNH

SEQ ID NO: 179565 - protein, 34 aa, Artificial Sequence
  Description of Artificial Sequence: Synthetic polypeptide
QESEIATTNPVGTEGYGVMSATTPTLQHNGMNPV

SEQ ID NO: 179566 - protein, 32 aa, Artificial Sequence
  Description of Artificial Sequence: Synthetic polypeptide
DENEIRTTNPCSYEPYGTISMPDIQQQQNGNH

SEQ ID NO: 179567 - protein, 34 aa, Artificial Sequence
  Description of Artificial Sequence: Synthetic polypeptide
QESEIATTNPVGTEGYGVMSATSPTLQHNGMNPV

SEQ ID NO: 179568 - protein, 33 aa, Artificial Sequence
  Description of Artificial Sequence: Synthetic polypeptide
VEDEIACTNPVATEQWGCTAGNGLADRPHGDNS

SEQ ID NO: 179569 - protein, 32 aa, Artificial Sequence
  Description of Artificial Sequence: Synthetic polypeptide
DENEIRTTNPCSTEPYGTISMEDIQQQQNYNH

SEQ ID NO: 179570 - protein, 33 aa, Artificial Sequence
  Description of Artificial Sequence: Synthetic polypeptide
GEEEIATTNPVAYEHYGQSVVNIVHSSDNGGNI

SEQ ID NO: 179571 - protein, 31 aa, Artificial Sequence
  Description of Artificial Sequence: Synthetic polypeptide
DDSEVASTNPVSTSGYGNVAANTIQSRVGQR

SEQ ID NO: 179572 - protein, 31 aa, Artificial Sequence
  Description of Artificial Sequence: Synthetic polypeptide
DDSEVASTNPVSTTGYGNVAANTIQSRVGQR

SEQ ID NO: 179573 - protein, 32 aa, Artificial Sequence
  Description of Artificial Sequence: Synthetic polypeptide
DENEIRSTNPVSTEPYGTIAMEDIQQQQNGNI

SEQ ID NO: 179574 - protein, 31 aa, Artificial Sequence
  Description of Artificial Sequence: Synthetic polypeptide
VEDEIACTNPVATEQWGCTAGNGLAPHDNSS

SEQ ID NO: 179575 - protein, 37 aa, Artificial Sequence
  Description of Artificial Sequence: Synthetic polypeptide
DEEEIRTTNPVATEQYGSVVVDGVFGQENDQDEDQGT

SEQ ID NO: 179576 - protein, 35 aa, Artificial Sequence
  Description of Artificial Sequence: Synthetic polypeptide
DEREISTTNPVATEQYGCVCSWGEHQENFNSDNQS

SEQ ID NO: 179577 - protein, 32 aa, Artificial Sequence
  Description of Artificial Sequence: Synthetic polypeptide
VEDEIACTNPVATEQWGCTAGNGLARMHPDNS

SEQ ID NO: 179578 - protein, 37 aa, Artificial Sequence
  Description of Artificial Sequence: Synthetic polypeptide
GEEEIRTTNPVATEQYGSYSSPITAEPNSPVGHPEVC

SEQ ID NO: 179579 - protein, 31 aa, Artificial Sequence
  Description of Artificial Sequence: Synthetic polypeptide
DDSEVASTNPVSTVGYGNVAANTIQSRVGQR

SEQ ID NO: 179580 - protein, 35 aa, Artificial Sequence
  Description of Artificial Sequence: Synthetic polypeptide
GEEEIRTTNPVAYEQYGQSVVNIVHSSDNGGNNAS

SEQ ID NO: 179581 - protein, 32 aa, Artificial Sequence
  Description of Artificial Sequence: Synthetic polypeptide
DENEIRTTNCVSTEPWGTISMEDIQQQQNGNH

SEQ ID NO: 179582 - protein, 37 aa, Artificial Sequence
  Description of Artificial Sequence: Synthetic polypeptide
DEEEIRTTNPVATEQYGYVYQGSSEFEELEVFEKNQS

SEQ ID NO: 179583 - protein, 32 aa, Artificial Sequence
  Description of Artificial Sequence: Synthetic polypeptide
VEDEIACTNPVATEQWGCTAGNGLARSPDNVW

SEQ ID NO: 179584 - protein, 35 aa, Artificial Sequence
  Description of Artificial Sequence: Synthetic polypeptide
DEEEIRTTNPVATEGYGSVMDMGDGEGFGEDGEEQ

SEQ ID NO: 179585 - protein, 31 aa, Artificial Sequence
  Description of Artificial Sequence: Synthetic polypeptide
VEDEIACTNPVATEQWGCTAGNGLARVDDSL

SEQ ID NO: 179586 - protein, 35 aa, Artificial Sequence
  Description of Artificial Sequence: Synthetic polypeptide
DEAVIGTTNPVATEQWGQCVCSTEDLNQYFGSDQA

SEQ ID NO: 179587 - protein, 37 aa, Artificial Sequence
  Description of Artificial Sequence: Synthetic polypeptide
DEEEIRTTNPVATEQYGSVVVDGVFGQEGDQEDDDGM

SEQ ID NO: 179588 - protein, 31 aa, Artificial Sequence
  Description of Artificial Sequence: Synthetic polypeptide
DDSEVASTNPVSTEPYGNVAANTIQSRVGQH

SEQ ID NO: 179589 - protein, 38 aa, Artificial Sequence
  Description of Artificial Sequence: Synthetic polypeptide
DDEEIRTTNPVATEQYGSVCCPMSLGLQSENILQVCEI

SEQ ID NO: 179590 - protein, 31 aa, Artificial Sequence
  Description of Artificial Sequence: Synthetic polypeptide
DDSEVASTNPVSTEPYGNVAANTIQSRNGQH

SEQ ID NO: 179591 - protein, 37 aa, Artificial Sequence
  Description of Artificial Sequence: Synthetic polypeptide
DEAEIRTTNPVATAQYGSVYCSENFQLDFESLEDENQ

SEQ ID NO: 179592 - protein, 33 aa, Artificial Sequence
  Description of Artificial Sequence: Synthetic polypeptide
RENEIRTTNPVSTEPYGTISMEDIQQQQNGNKH

SEQ ID NO: 179593 - protein, 33 aa, Artificial Sequence
  Description of Artificial Sequence: Synthetic polypeptide
RENEIRTTNPVSTEPYGTISGMEDIQQQQNGNH

SEQ ID NO: 179594 - protein, 37 aa, Artificial Sequence
  Description of Artificial Sequence: Synthetic polypeptide
DEEEIRTTNPVATEGYGMVANGQGTFGQAEGGGDNTG

SEQ ID NO: 179595 - protein, 36 aa, Artificial Sequence
  Description of Artificial Sequence: Synthetic polypeptide
DEEEIRTTNPVATEQYGSCNAPEQTLDVIMQIMVAD

SEQ ID NO: 179596 - protein, 37 aa, Artificial Sequence
  Description of Artificial Sequence: Synthetic polypeptide
DEEEIRTTNPVATEGYGMVANGQGTFGQQEGGGQNTG

SEQ ID NO: 179597 - protein, 31 aa, Artificial Sequence
  Description of Artificial Sequence: Synthetic polypeptide
DDSEVASTNPVSTEGYGTIAANTIQSRVGQR

SEQ ID NO: 179598 - protein, 36 aa, Artificial Sequence
  Description of Artificial Sequence: Synthetic polypeptide
YEESTIRTTSNPVATEGYGGSRVCSTVWITQYLVNQ

SEQ ID NO: 179599 - protein, 40 aa, Artificial Sequence
  Description of Artificial Sequence: Synthetic polypeptide
DEEEIRTTNPVATESYGTVTNLQSGTISTNTQNQEQGNAR

SEQ ID NO: 179600 - protein, 39 aa, Artificial Sequence
  Description of Artificial Sequence: Synthetic polypeptide
DEEEIRTTNPVATESYGTVTNLQSGTISTNTQNQEDGNI

SEQ ID NO: 179601 - protein, 40 aa, Artificial Sequence
  Description of Artificial Sequence: Synthetic polypeptide
DEEEIRTTNPVATESYGTVTNLQSGTISTNTQNNEVGTNR

SEQ ID NO: 179602 - protein, 39 aa, Artificial Sequence
  Description of Artificial Sequence: Synthetic polypeptide
DEEEIRTTNPVATESYGTVTNLQSGTISTNTQNNEGGNT

SEQ ID NO: 179603 - protein, 36 aa, Artificial Sequence
  Description of Artificial Sequence: Synthetic polypeptide
DEEEIRTTNPVATEGYGMVDGMEIAVGQDGNGTGEG

SEQ ID NO: 179604 - protein, 39 aa, Artificial Sequence
  Description of Artificial Sequence: Synthetic polypeptide
DEEEIRTTNPVATESYGTVTNLQSGTISTNTQNEEVGNA

SEQ ID NO: 179605 - protein, 38 aa, Artificial Sequence
  Description of Artificial Sequence: Synthetic polypeptide
FEEEIRTTNPVATEQYGSVCSETEETDMQINNIVAGPY

SEQ ID NO: 179606 - protein, 38 aa, Artificial Sequence
  Description of Artificial Sequence: Synthetic polypeptide
FEEEIRTTNPVATEQYGSVCSETEPTDIQINNIADGPY

SEQ ID NO: 179607 - protein, 37 aa, Artificial Sequence
  Description of Artificial Sequence: Synthetic polypeptide
FEEEIRTTNPVATEQYGSVCSFYEALEEVSPMNVVDY

SEQ ID NO: 179608 - protein, 38 aa, Artificial Sequence
  Description of Artificial Sequence: Synthetic polypeptide
DDEEIRTTNPVATEQYGSVSGQGLGDDEFGNQGQQETA

SEQ ID NO: 179609 - protein, 35 aa, Artificial Sequence
  Description of Artificial Sequence: Synthetic polypeptide
DEAEIRTTNPVASECWGSVMRCINEPQVRDDENLG

SEQ ID NO: 179610 - protein, 36 aa, Artificial Sequence
  Description of Artificial Sequence: Synthetic polypeptide
DEAEIRTTNPVAIEWYGSVSSQINTLEVEPINMISH

SEQ ID NO: 179611 - protein, 39 aa, Artificial Sequence
  Description of Artificial Sequence: Synthetic polypeptide
DEEEIRTTNPVATESYGTVTNLQSGTISTNTQGQEAGNV

SEQ ID NO: 179612 - protein, 39 aa, Artificial Sequence
  Description of Artificial Sequence: Synthetic polypeptide
DEEEIRTTNPVATESYGTVTNLQSGTISTNTQGNEVGNI

SEQ ID NO: 179613 - protein, 39 aa, Artificial Sequence
  Description of Artificial Sequence: Synthetic polypeptide
DEEEIRTTNPVATESYGTVTNLQSGTISTNTNNQGVGNV

SEQ ID NO: 179614 - protein, 39 aa, Artificial Sequence
  Description of Artificial Sequence: Synthetic polypeptide
DEEEIRTTNPVATESYGTVTNLQSGTISTNTNNQEEGND

SEQ ID NO: 179615 - protein, 37 aa, Artificial Sequence
  Description of Artificial Sequence: Synthetic polypeptide
FEEEIRTTNPVATEQYGSVFSPPLMEQQEAPQFTQES

SEQ ID NO: 179616 - protein, 36 aa, Artificial Sequence
  Description of Artificial Sequence: Synthetic polypeptide
DEAEIRTTNPVATAQYGSVYCSENFQMDFESLEDPV

SEQ ID NO: 179617 - protein, 37 aa, Artificial Sequence
  Description of Artificial Sequence: Synthetic polypeptide
FEEEIRTTNPVATEQYGSVGIIENDTQPGFQGVIPQP

SEQ ID NO: 179618 - protein, 33 aa, Artificial Sequence
  Description of Artificial Sequence: Synthetic polypeptide
RENEIRTTNPVSTEPYGTISMEDIQQQQNGQNH

SEQ ID NO: 179619 - protein, 36 aa, Artificial Sequence
  Description of Artificial Sequence: Synthetic polypeptide
DEEEIRTTNPVATEGYGICVCSWGELNQENFISDQG

SEQ ID NO: 179620 - protein, 34 aa, Artificial Sequence
  Description of Artificial Sequence: Synthetic polypeptide
DEQEIATTNPVATECYGSVWSNAEDWAEPEGPYI

SEQ ID NO: 179621 - protein, 33 aa, Artificial Sequence
  Description of Artificial Sequence: Synthetic polypeptide
SAEEIATTNPVATAQWGCVAGTGLPATAGGNDF

SEQ ID NO: 179622 - protein, 39 aa, Artificial Sequence
  Description of Artificial Sequence: Synthetic polypeptide
DEEEIRTTNPVATESYGTVTNLQSGVISTNTNNNEVGNI

SEQ ID NO: 179623 - protein, 32 aa, Artificial Sequence
  Description of Artificial Sequence: Synthetic polypeptide
DDSEVASTNPVSTEGYGRVAANTIIQSRVGQR

SEQ ID NO: 179624 - protein, 36 aa, Artificial Sequence
  Description of Artificial Sequence: Synthetic polypeptide
DEEEIRTTNPVATEGYGICVCSTVEHNAENFISQQS

SEQ ID NO: 179625 - protein, 32 aa, Artificial Sequence
  Description of Artificial Sequence: Synthetic polypeptide
SAEEIATTNPVATAQWGCVAGTGLAAGGGDHS

SEQ ID NO: 179626 - protein, 39 aa, Artificial Sequence
  Description of Artificial Sequence: Synthetic polypeptide
DEEEIRTTNPVATESYGTVTNLQSGVIGTNTQNQEQGNQ

SEQ ID NO: 179627 - protein, 35 aa, Artificial Sequence
  Description of Artificial Sequence: Synthetic polypeptide
DEDEIRCTNPVATEPYGSTSPSCTPAGSVSGGNPS

SEQ ID NO: 179628 - protein, 35 aa, Artificial Sequence
  Description of Artificial Sequence: Synthetic polypeptide
DEDEIRCTNPVATEPYGSTAPSCTPAPSADGGNPS

SEQ ID NO: 179629 - protein, 36 aa, Artificial Sequence
  Description of Artificial Sequence: Synthetic polypeptide
DEDEIRCTNPVATEPYGSTAPSCTPALSVDGGNTPP

SEQ ID NO: 179630 - protein, 32 aa, Artificial Sequence
  Description of Artificial Sequence: Synthetic polypeptide
DDSEVASTNPVSTEGYGSVAANTIQDREGQDL

SEQ ID NO: 179631 - protein, 30 aa, Artificial Sequence
  Description of Artificial Sequence: Synthetic polypeptide
DESEIATTNPIGTEGYGVMAATLAPKGDYI

SEQ ID NO: 179632 - protein, 35 aa, Artificial Sequence
  Description of Artificial Sequence: Synthetic polypeptide
DEDEIRCTNPVATEGYGTTVPSCTPAFSVDGGNPS

SEQ ID NO: 179633 - protein, 39 aa, Artificial Sequence
  Description of Artificial Sequence: Synthetic polypeptide
DEEEIRTTNPVATESYGTVTNLQSGTISTTTQNQEDENR

SEQ ID NO: 179634 - protein, 32 aa, Artificial Sequence
  Description of Artificial Sequence: Synthetic polypeptide
DDSEVASTNPVSTEGYGSVANINIQSRVGEQG

SEQ ID NO: 179635 - protein, 36 aa, Artificial Sequence
  Description of Artificial Sequence: Synthetic polypeptide
DEDEIRCTNPTATEPYGSTVPSCTPALSVEDGGNPS

SEQ ID NO: 179636 - protein, 37 aa, Artificial Sequence
  Description of Artificial Sequence: Synthetic polypeptide
DEEEIRTTNPVATEGYGICVCSTVPHNQENFISDNQS

SEQ ID NO: 179637 - protein, 37 aa, Artificial Sequence
  Description of Artificial Sequence: Synthetic polypeptide
DEEEIRTTNPVATEGYGICVCSTWVEDQENFISDNQS

SEQ ID NO: 179638 - protein, 39 aa, Artificial Sequence
  Description of Artificial Sequence: Synthetic polypeptide
DEEEIRTTNPVATESYGTVTNLQSGTISTNVTNQEGGNV

SEQ ID NO: 179639 - protein, 39 aa, Artificial Sequence
  Description of Artificial Sequence: Synthetic polypeptide
DEEEIRTTNPVATESYGTVTNLQSGTISTNTTNQEVGNN

SEQ ID NO: 179640 - protein, 37 aa, Artificial Sequence
  Description of Artificial Sequence: Synthetic polypeptide
DDEEIRTTNPVATEQYGSVSMVMEPLQEQDQETVLVT

SEQ ID NO: 179641 - protein, 36 aa, Artificial Sequence
  Description of Artificial Sequence: Synthetic polypeptide
DEEEIRTTNPVAYEQYGQCVCSMSEEHNQNFGSDQV

SEQ ID NO: 179642 - protein, 36 aa, Artificial Sequence
  Description of Artificial Sequence: Synthetic polypeptide
DEQEIATTNPVATEFYGSVTSATGDGEDQGGGEDGD

SEQ ID NO: 179643 - protein, 39 aa, Artificial Sequence
  Description of Artificial Sequence: Synthetic polypeptide
DEEEIRTTNPVATESYGTVTNLQSGTISTNTQNSEAGNE

SEQ ID NO: 179644 - protein, 39 aa, Artificial Sequence
  Description of Artificial Sequence: Synthetic polypeptide
DEEEIRTTNPVATESYGTVTNLQSGTISTNTQNQNVGER

SEQ ID NO: 179645 - protein, 36 aa, Artificial Sequence
  Description of Artificial Sequence: Synthetic polypeptide
DEEEIRTTNPVATEGYGICVCSWVEHNTENFISDQA

SEQ ID NO: 179646 - protein, 36 aa, Artificial Sequence
  Description of Artificial Sequence: Synthetic polypeptide
DEEEIRTTNPVATEGYGMVDGMENAVGQIGEGTGGG

SEQ ID NO: 179647 - protein, 32 aa, Artificial Sequence
  Description of Artificial Sequence: Synthetic polypeptide
DDSEVASTNPVSTEGYGTVAANTIMQSRVGQR

SEQ ID NO: 179648 - protein, 36 aa, Artificial Sequence
  Description of Artificial Sequence: Synthetic polypeptide
DEEEIRTTNPVATEGYGMVDGMENDDGIIGQQTNIG

SEQ ID NO: 179649 - protein, 39 aa, Artificial Sequence
  Description of Artificial Sequence: Synthetic polypeptide
DEQEIRTTNPVATEQYGSVVMSVNDLNTGFGGQTGQVGD

SEQ ID NO: 179650 - protein, 34 aa, Artificial Sequence
  Description of Artificial Sequence: Synthetic polypeptide
DEQEIATTNPVATEMWGSVATGNPDNSEHNTGIV

SEQ ID NO: 179651 - protein, 38 aa, Artificial Sequence
  Description of Artificial Sequence: Synthetic polypeptide
DEQEIRTTNPVATEQYGSVVTTDGMNDNQTGEDEQGEM

SEQ ID NO: 179652 - protein, 34 aa, Artificial Sequence
  Description of Artificial Sequence: Synthetic polypeptide
DEDEICTTNPVAYEQWGSVYCEDGNGRQQGGGSD

SEQ ID NO: 179653 - protein, 33 aa, Artificial Sequence
  Description of Artificial Sequence: Synthetic polypeptide
CEEEIRATNPVAYEQWGMVCGWNDHQHKQGMDD

SEQ ID NO: 179654 - protein, 38 aa, Artificial Sequence
  Description of Artificial Sequence: Synthetic polypeptide
DEQEIRTTNPVATEQYGSVYSDIGDNDDEDDEGGNIEV

SEQ ID NO: 179655 - protein, 33 aa, Artificial Sequence
  Description of Artificial Sequence: Synthetic polypeptide
DENEIRTTNPVATECWGDTVSNEEIEMNPAEPI

SEQ ID NO: 179656 - protein, 32 aa, Artificial Sequence
  Description of Artificial Sequence: Synthetic polypeptide
DENEIRTTNPVATECWGAVWSEEIEANAAEPI

SEQ ID NO: 179657 - protein, 37 aa, Artificial Sequence
  Description of Artificial Sequence: Synthetic polypeptide
DEEEIRTTNPVATEQYGSCNCCMSSLPIELEEQEILI

SEQ ID NO: 179658 - protein, 30 aa, Artificial Sequence
  Description of Artificial Sequence: Synthetic polypeptide
DESEIASTNPVSTEQWGNVAEIIQSAVEQA

SEQ ID NO: 179659 - protein, 37 aa, Artificial Sequence
  Description of Artificial Sequence: Synthetic polypeptide
DEEEIRTTNPVATEQYGSCNCCNSELPIEMEEQEFLI

SEQ ID NO: 179660 - protein, 36 aa, Artificial Sequence
  Description of Artificial Sequence: Synthetic polypeptide
DDEEIRTTNPVATEQYGSVNMGGQNDESGEGGGGQG

SEQ ID NO: 179661 - protein, 36 aa, Artificial Sequence
  Description of Artificial Sequence: Synthetic polypeptide
DEEEIRTTNPVATEGYGMVDIMQDTNEFEDTIDGAV

SEQ ID NO: 179662 - protein, 36 aa, Artificial Sequence
  Description of Artificial Sequence: Synthetic polypeptide
DEEEIRTTNPVATEGYGMVDIMQSENEFFDNITGEV

SEQ ID NO: 179663 - protein, 36 aa, Artificial Sequence
  Description of Artificial Sequence: Synthetic polypeptide
DEEEIRTTNPVATEGYGMVNGDENVQGQIGQGTGEG

SEQ ID NO: 179664 - protein, 32 aa, Artificial Sequence
  Description of Artificial Sequence: Synthetic polypeptide
DENEIRTTNPVATECWGAVWSEEIEAEAAEPI

SEQ ID NO: 179665 - protein, 30 aa, Artificial Sequence
  Description of Artificial Sequence: Synthetic polypeptide
DDSEVASTNPVSTEGYGVVAADTIQSSGQR

SEQ ID NO: 179666 - protein, 36 aa, Artificial Sequence
  Description of Artificial Sequence: Synthetic polypeptide
CEEEIRATNPVATEQYGVVTMQDGDNGQRFTDNGQG

SEQ ID NO: 179667 - protein, 37 aa, Artificial Sequence
  Description of Artificial Sequence: Synthetic polypeptide
DEEEIRTTNPVATEQYGSCNCCSSELPIQMEEQEDHI

SEQ ID NO: 179668 - protein, 36 aa, Artificial Sequence
  Description of Artificial Sequence: Synthetic polypeptide
DEEEIRTTNPVATEQYGSCNCCSSEMLIEMEEQEDL

SEQ ID NO: 179669 - protein, 32 aa, Artificial Sequence
  Description of Artificial Sequence: Synthetic polypeptide
DENEIRTTNPVATECWGAVWAAEIWMNPKGPI

SEQ ID NO: 179670 - protein, 37 aa, Artificial Sequence
  Description of Artificial Sequence: Synthetic polypeptide
FEEEIRTTNPVATEQYGSVIVPEEILASIEVSQTGMQ

SEQ ID NO: 179671 - protein, 37 aa, Artificial Sequence
  Description of Artificial Sequence: Synthetic polypeptide
FEEEIRTTNPVATEQYGSVIYNTSMNSTAETVNMPQA

SEQ ID NO: 179672 - protein, 37 aa, Artificial Sequence
  Description of Artificial Sequence: Synthetic polypeptide
DDEEIRTTNPVATEQYGSVMGTMDIQNGEGGGAEEGY

SEQ ID NO: 179673 - protein, 38 aa, Artificial Sequence
  Description of Artificial Sequence: Synthetic polypeptide
DDEEIRTTNPVATEQYGSVMGQTQGDLEVGNGGQEETG

SEQ ID NO: 179674 - protein, 38 aa, Artificial Sequence
  Description of Artificial Sequence: Synthetic polypeptide
DEQEIRTTNPVATEQYGSVVMSNNDNNTGGGQTGQVGD

SEQ ID NO: 179675 - protein, 37 aa, Artificial Sequence
  Description of Artificial Sequence: Synthetic polypeptide
DEQEIATTNPVATEKYGSTVSCTGGGLSEDHEGGENL

SEQ ID NO: 179676 - protein, 39 aa, Artificial Sequence
  Description of Artificial Sequence: Synthetic polypeptide
DEEEIRTTNPVATESYGTVTNLQSGTISTNQQGQEVGNM

SEQ ID NO: 179677 - protein, 36 aa, Artificial Sequence
  Description of Artificial Sequence: Synthetic polypeptide
DEEEIRTTNPVATEQYGSCNCCEWELIPMEEQELLI

SEQ ID NO: 179678 - protein, 36 aa, Artificial Sequence
  Description of Artificial Sequence: Synthetic polypeptide
FEEEIRTTNPVATEQYGSVGPWWITWWSMEDVIENG

SEQ ID NO: 179679 - protein, 36 aa, Artificial Sequence
  Description of Artificial Sequence: Synthetic polypeptide
DEEEIRTTNPVATEGYGMVDGMENDDGITGQQTNEM

SEQ ID NO: 179680 - protein, 36 aa, Artificial Sequence
  Description of Artificial Sequence: Synthetic polypeptide
DEECISTTNPVATEQYGCVCSMWEHNQENFGSDNQS

SEQ ID NO: 179681 - protein, 37 aa, Artificial Sequence
  Description of Artificial Sequence: Synthetic polypeptide
DDEEIRTTNPVATEQYGSVPLENSVNTEGMQFAESIL

SEQ ID NO: 179682 - protein, 37 aa, Artificial Sequence
  Description of Artificial Sequence: Synthetic polypeptide
DEEEIRTTNPVATEGYGMVDGMENDDNIIGLQQTNEG

SEQ ID NO: 179683 - protein, 36 aa, Artificial Sequence
  Description of Artificial Sequence: Synthetic polypeptide
DESEIATTNPCATEQYGTVCSCTGGEYSENFNGGND

SEQ ID NO: 179684 - protein, 39 aa, Artificial Sequence
  Description of Artificial Sequence: Synthetic polypeptide
DEEEIRTTNPVATESYGTVTNLQSGTISTNTGNQEAGNP

SEQ ID NO: 179685 - protein, 39 aa, Artificial Sequence
  Description of Artificial Sequence: Synthetic polypeptide
DEEEIRTTNPVATESYGTVTNLQSGTISTNTANTEVGNR

SEQ ID NO: 179686 - protein, 36 aa, Artificial Sequence
  Description of Artificial Sequence: Synthetic polypeptide
DESEIATTNPCATEQYGTVCSATGGEWSTNMNGGNM

SEQ ID NO: 179687 - protein, 36 aa, Artificial Sequence
  Description of Artificial Sequence: Synthetic polypeptide
DESEIATTNPCATEQYGTVCSATGGEHSENMNGGND

SEQ ID NO: 179688 - protein, 31 aa, Artificial Sequence
  Description of Artificial Sequence: Synthetic polypeptide
DDSEVASTNPVSTEGYGTVAATDTIQRVGQD

SEQ ID NO: 179689 - protein, 36 aa, Artificial Sequence
  Description of Artificial Sequence: Synthetic polypeptide
DEEEIRTTNPVATEGYGMVDGMENQVGNIGNGTGEG

SEQ ID NO: 179690 - protein, 33 aa, Artificial Sequence
  Description of Artificial Sequence: Synthetic polypeptide
DENEIRTTNPVATECWGETTWANEDWAEPKGPR

SEQ ID NO: 179691 - protein, 36 aa, Artificial Sequence
  Description of Artificial Sequence: Synthetic polypeptide
DEEEIRTTNPVATEGYGMVDGMENVVGGIGNGGGEG

SEQ ID NO: 179692 - protein, 35 aa, Artificial Sequence
  Description of Artificial Sequence: Synthetic polypeptide
DEAEIRTTNPVAAECWGSVSRCINEPQVRDDEYPG

SEQ ID NO: 179693 - protein, 30 aa, Artificial Sequence
  Description of Artificial Sequence: Synthetic polypeptide
DDSEVASTNPVATEGWGNVANIIMSRVGDR

SEQ ID NO: 179694 - protein, 37 aa, Artificial Sequence
  Description of Artificial Sequence: Synthetic polypeptide
FEEEIRTTNPVATEQYGSVIDPPLNMEQQEIPQFNTE

SEQ ID NO: 179695 - protein, 37 aa, Artificial Sequence
  Description of Artificial Sequence: Synthetic polypeptide
FEEEIRTTNPVATEQYGSVIECRTSEDLEIQESEDIQ

SEQ ID NO: 179696 - protein, 34 aa, Artificial Sequence
  Description of Artificial Sequence: Synthetic polypeptide
DESEIATTNPAATDQYGVVSTDDEQGGQGEGETA

SEQ ID NO: 179697 - protein, 37 aa, Artificial Sequence
  Description of Artificial Sequence: Synthetic polypeptide
DEEEIRTTNPVATEQYGSCNCCCSENDIEMEEQELLI

SEQ ID NO: 179698 - protein, 31 aa, Artificial Sequence
  Description of Artificial Sequence: Synthetic polypeptide
DDSEVASTNPVATEGYGDVAANIIQSAAGDA

SEQ ID NO: 179699 - protein, 36 aa, Artificial Sequence
  Description of Artificial Sequence: Synthetic polypeptide
CEEEIRCTNPVATEQYGCVCSNTGEHNQNFNSDTQS

SEQ ID NO: 179700 - protein, 34 aa, Artificial Sequence
  Description of Artificial Sequence: Synthetic polypeptide
DEDEICTTNPVAYESWGSVATTLGGNTGADGMDR

SEQ ID NO: 179701 - protein, 37 aa, Artificial Sequence
  Description of Artificial Sequence: Synthetic polypeptide
FEEEIRTTNPVATEQYGSVIMTGIGLGELTEEGQEGI

SEQ ID NO: 179702 - protein, 35 aa, Artificial Sequence
  Description of Artificial Sequence: Synthetic polypeptide
DEQEIATTNPVATEKYGSTVSCCGVSEDHEGGENL

SEQ ID NO: 179703 - protein, 39 aa, Artificial Sequence
  Description of Artificial Sequence: Synthetic polypeptide
DEEEIRTTNPVATESYGTVTNLQSGTISTNQQNQENGNN

SEQ ID NO: 179704 - protein, 37 aa, Artificial Sequence
  Description of Artificial Sequence: Synthetic polypeptide
FEEEIRTTNPVATEQYGSVGYYLMNGEEQMIMNEEEL

SEQ ID NO: 179705 - protein, 37 aa, Artificial Sequence
  Description of Artificial Sequence: Synthetic polypeptide
FEEEIRTTNPVATEQYGSVLWPMQDLEEEQPDTWVRD

SEQ ID NO: 179706 - protein, 31 aa, Artificial Sequence
  Description of Artificial Sequence: Synthetic polypeptide
DDSEVASTNPVSTEGYGQVAARTIQSRVGQR

SEQ ID NO: 179707 - protein, 33 aa, Artificial Sequence
  Description of Artificial Sequence: Synthetic polypeptide
ADNEIACTNPVATEQYGCSCSWNHNQHFGSDQA

SEQ ID NO: 179708 - protein, 36 aa, Artificial Sequence
  Description of Artificial Sequence: Synthetic polypeptide
DEEEIRTTNPVATEGYGCVCSTGEHEEENFGSETQS

SEQ ID NO: 179709 - protein, 37 aa, Artificial Sequence
  Description of Artificial Sequence: Synthetic polypeptide
FEEEIRTTNPVATEQYGAVIVDDLDDEGQTQDGGNNT

SEQ ID NO: 179710 - protein, 37 aa, Artificial Sequence
  Description of Artificial Sequence: Synthetic polypeptide
FEEEIRTTNPVATEQYGAVIVDDLDDNGQTNDGDNNT

SEQ ID NO: 179711 - protein, 37 aa, Artificial Sequence
  Description of Artificial Sequence: Synthetic polypeptide
FEEEIRTTNPVATEQYGAVIVDDLFDEGQTDDGENNL

SEQ ID NO: 179712 - protein, 37 aa, Artificial Sequence
  Description of Artificial Sequence: Synthetic polypeptide
FEEEIRTTNPVATEQYGAVIVDDLQDEGQTDDGGNNQ

SEQ ID NO: 179713 - protein, 37 aa, Artificial Sequence
  Description of Artificial Sequence: Synthetic polypeptide
FEEEIRTTNPVATEQYGAVNSTTPTGPEMGQGENEEN

SEQ ID NO: 179714 - protein, 33 aa, Artificial Sequence
  Description of Artificial Sequence: Synthetic polypeptide
DENEIRTTNPVATECYGATVANAEDWAEHGPYI

SEQ ID NO: 179715 - protein, 37 aa, Artificial Sequence
  Description of Artificial Sequence: Synthetic polypeptide
DEEEIRTTNPVATEAYGTVVDNMTNDTGQEDGQGQET

SEQ ID NO: 179716 - protein, 40 aa, Artificial Sequence
  Description of Artificial Sequence: Synthetic polypeptide
DEEEIRTTNPVATESYGTVTTGQSGTIGTNTQLQEIGTNT

SEQ ID NO: 179717 - protein, 37 aa, Artificial Sequence
  Description of Artificial Sequence: Synthetic polypeptide
DEEEIRTTNPVATEQYGCVCSDSGEHNQENFNSDFQS

SEQ ID NO: 179718 - protein, 35 aa, Artificial Sequence
  Description of Artificial Sequence: Synthetic polypeptide
SAEEIATTNPVATEQWGGCVAGNNNLQTEMQNARN

SEQ ID NO: 179719 - protein, 36 aa, Artificial Sequence
  Description of Artificial Sequence: Synthetic polypeptide
DEEVIRTTNPVATEQYGCVCSSGEHNAENFGSDTQS

SEQ ID NO: 179720 - protein, 35 aa, Artificial Sequence
  Description of Artificial Sequence: Synthetic polypeptide
SAEEIATTNPVATEQWGGCVAGNGLDNDMGENTRN

SEQ ID NO: 179721 - protein, 36 aa, Artificial Sequence
  Description of Artificial Sequence: Synthetic polypeptide
DECEIATTNPVATEQYGAVCQTNDQGQQQQGDGQTN

SEQ ID NO: 179722 - protein, 39 aa, Artificial Sequence
  Description of Artificial Sequence: Synthetic polypeptide
DEEEIRTTNPVATESYGTVTTGQSGTIGTNTQGNEQGNP

SEQ ID NO: 179723 - protein, 39 aa, Artificial Sequence
  Description of Artificial Sequence: Synthetic polypeptide
DEEEIRTTNPVATESYGTVTTGQSGTIGTNTQEQESGNP

SEQ ID NO: 179724 - protein, 38 aa, Artificial Sequence
  Description of Artificial Sequence: Synthetic polypeptide
DEEEIRTTNPVATEQYGSCCQNVDSYDIGQRQEPQSEM

SEQ ID NO: 179725 - protein, 37 aa, Artificial Sequence
  Description of Artificial Sequence: Synthetic polypeptide
FEEEIRTTNPVATEQYGAVVDGFTNDQTNEDGGGQGL

SEQ ID NO: 179726 - protein, 38 aa, Artificial Sequence
  Description of Artificial Sequence: Synthetic polypeptide
DEEEIRTTNPVATEQYGSCCQNVDSYTAGQSQEPVSEM

SEQ ID NO: 179727 - protein, 32 aa, Artificial Sequence
  Description of Artificial Sequence: Synthetic polypeptide
DDSEVASTNPVSTEGYGNVYAANTIQERVGQR

SEQ ID NO: 179728 - protein, 36 aa, Artificial Sequence
  Description of Artificial Sequence: Synthetic polypeptide
FEEEIRTTNPVATEQYGAVVNGFGNGDDTDQTTGFQ

SEQ ID NO: 179729 - protein, 32 aa, Artificial Sequence
  Description of Artificial Sequence: Synthetic polypeptide
DDSEVASTNPVSTEGYGNVYAANTIQSRVGQR

SEQ ID NO: 179730 - protein, 38 aa, Artificial Sequence
  Description of Artificial Sequence: Synthetic polypeptide
DEEEIRTTNPVATEQYGSCCSPEVNTHDQPQQNEDNNI

SEQ ID NO: 179731 - protein, 37 aa, Artificial Sequence
  Description of Artificial Sequence: Synthetic polypeptide
DEEVIRTTNPVATEQYGCVCSTGEDHNDENFGSDTQA

SEQ ID NO: 179732 - protein, 35 aa, Artificial Sequence
  Description of Artificial Sequence: Synthetic polypeptide
DEAEIRTTNPVATECWGAVCQTLDDQDQDGPRGQD

SEQ ID NO: 179733 - protein, 34 aa, Artificial Sequence
  Description of Artificial Sequence: Synthetic polypeptide
SAEEIATTNPVATEQWGSVSGEGNPPDNNSNDAQ

SEQ ID NO: 179734 - protein, 36 aa, Artificial Sequence
  Description of Artificial Sequence: Synthetic polypeptide
FEEEIRTTNPVATEQYGCVCSNWGEDNQNFNSDTQA

SEQ ID NO: 179735 - protein, 34 aa, Artificial Sequence
  Description of Artificial Sequence: Synthetic polypeptide
SAEEIATTNPVATEQWGSVSGNGEPPDNNSNDAD

SEQ ID NO: 179736 - protein, 35 aa, Artificial Sequence
  Description of Artificial Sequence: Synthetic polypeptide
SAEEIATTNPVATEQWGSVSGTGDPPGAEASNDAL

SEQ ID NO: 179737 - protein, 38 aa, Artificial Sequence
  Description of Artificial Sequence: Synthetic polypeptide
DEEEIRCTNPVATEQYGCVCSMTGEDDFQEGFNSDTQS

SEQ ID NO: 179738 - protein, 39 aa, Artificial Sequence
  Description of Artificial Sequence: Synthetic polypeptide
DEEEIRTTNPVATESYGTVTTGQSGTIGTNTQNQEVGNG

SEQ ID NO: 179739 - protein, 35 aa, Artificial Sequence
  Description of Artificial Sequence: Synthetic polypeptide
DEDEIRCTNPVAYEPYGSTWPSCTPALSVDGGNPS

SEQ ID NO: 179740 - protein, 36 aa, Artificial Sequence
  Description of Artificial Sequence: Synthetic polypeptide
DEEEIRTTNPVATEGYGCVCSSGEHNQENFNSETQS

SEQ ID NO: 179741 - protein, 36 aa, Artificial Sequence
  Description of Artificial Sequence: Synthetic polypeptide
DEEEIRTTNPVATEQYGSCCAPEQTLDAIMQGMVAD

SEQ ID NO: 179742 - protein, 35 aa, Artificial Sequence
  Description of Artificial Sequence: Synthetic polypeptide
DESEIRTTNPVAYEAWGISVSVANSSSDREGGMPC

SEQ ID NO: 179743 - protein, 35 aa, Artificial Sequence
  Description of Artificial Sequence: Synthetic polypeptide
SAEEIATTNPVATEQWGSVSPTGAPPPNNAAAQRN

SEQ ID NO: 179744 - protein, 37 aa, Artificial Sequence
  Description of Artificial Sequence: Synthetic polypeptide
FEEEIRTTNPVATEGYGSVVDNFDDNNDQTGGGENED

SEQ ID NO: 179745 - protein, 34 aa, Artificial Sequence
  Description of Artificial Sequence: Synthetic polypeptide
SAEEIATTNPVATEQWGSVSPTGAPPNAANAQFN

SEQ ID NO: 179746 - protein, 33 aa, Artificial Sequence
  Description of Artificial Sequence: Synthetic polypeptide
SAEEIATTNPVATEQWGSVSPEGAPPNAAAQLN

SEQ ID NO: 179747 - protein, 34 aa, Artificial Sequence
  Description of Artificial Sequence: Synthetic polypeptide
SAEEIATTNPVATEQWGSVSGTGPPPDNNSNDAW

SEQ ID NO: 179748 - protein, 36 aa, Artificial Sequence
  Description of Artificial Sequence: Synthetic polypeptide
FEEEIRTTNPVATEGYGSVVNFDDMNDQTGGGGEDM

SEQ ID NO: 179749 - protein, 37 aa, Artificial Sequence
  Description of Artificial Sequence: Synthetic polypeptide
FEEEIRTTNPVATEGYGSVVNGTVNGLEAEENGGGQG

SEQ ID NO: 179750 - protein, 36 aa, Artificial Sequence
  Description of Artificial Sequence: Synthetic polypeptide
FEEEIRTTNPVATEGYGSVVQQTGDENQGEAEQGGT

SEQ ID NO: 179751 - protein, 36 aa, Artificial Sequence
  Description of Artificial Sequence: Synthetic polypeptide
FEEEIRTTNPVATEGYGSVVQTLGGDENQGEGQGQT

SEQ ID NO: 179752 - protein, 36 aa, Artificial Sequence
  Description of Artificial Sequence: Synthetic polypeptide
FEEEIRTTNPVATEGYGSVVQTTGDENEEGEGQGGT

SEQ ID NO: 179753 - protein, 34 aa, Artificial Sequence
  Description of Artificial Sequence: Synthetic polypeptide
DESEIRTTNPVAYEAWGISVSCANSSSDPEGGMG

SEQ ID NO: 179754 - protein, 36 aa, Artificial Sequence
  Description of Artificial Sequence: Synthetic polypeptide
DEEEIRTTNPVAYEQYGQCVCSNSEDDNQYFGSDQF

SEQ ID NO: 179755 - protein, 36 aa, Artificial Sequence
  Description of Artificial Sequence: Synthetic polypeptide
FEEEIRTTNPVATEGYGSVVVDNIIQGGQGEETEQA

SEQ ID NO: 179756 - protein, 36 aa, Artificial Sequence
  Description of Artificial Sequence: Synthetic polypeptide
FEEEIRTTNPVATEGYGSVVYDNIIQGGQGEEDEDA

SEQ ID NO: 179757 - protein, 35 aa, Artificial Sequence
  Description of Artificial Sequence: Synthetic polypeptide
SAEEIATTNPVATEQWGSVSGTGNPPDNNSEEDAQ

SEQ ID NO: 179758 - protein, 39 aa, Artificial Sequence
  Description of Artificial Sequence: Synthetic polypeptide
DEEEIRTTNPVATESYGTVTTGQSGTIGTNTQMEEIGNT

SEQ ID NO: 179759 - protein, 36 aa, Artificial Sequence
  Description of Artificial Sequence: Synthetic polypeptide
DEEEISCTNPVATEQYGCVCSMSEDFQEGFGSNTQA

SEQ ID NO: 179760 - protein, 34 aa, Artificial Sequence
  Description of Artificial Sequence: Synthetic polypeptide
SAEEIATTNPVATEQWGSVSGTGDPPPPADSNDS

SEQ ID NO: 179761 - protein, 35 aa, Artificial Sequence
  Description of Artificial Sequence: Synthetic polypeptide
DESEIRTTNPVAYEAWGISVSAANTSSDREGGMGC

SEQ ID NO: 179762 - protein, 35 aa, Artificial Sequence
  Description of Artificial Sequence: Synthetic polypeptide
SAEEIATTNPVATEQWGSVSGNGGPPDGAGTEGNN

SEQ ID NO: 179763 - protein, 37 aa, Artificial Sequence
  Description of Artificial Sequence: Synthetic polypeptide
DEEEIRCTNPVATEQYGCVCSMTEEDNTEGFGSDTQA

SEQ ID NO: 179764 - protein, 37 aa, Artificial Sequence
  Description of Artificial Sequence: Synthetic polypeptide
DEEEIRTTNPVATEGYGCVCSTTPAHNAEHSGSDPVS

SEQ ID NO: 179765 - protein, 37 aa, Artificial Sequence
  Description of Artificial Sequence: Synthetic polypeptide
DEEEIRTTNPVATEQYGCVCSDSGEEHNQNFSSDNQS

SEQ ID NO: 179766 - protein, 31 aa, Artificial Sequence
  Description of Artificial Sequence: Synthetic polypeptide
DDSEVASTNPVSTEGYGQVAANTIQSRVGQS

SEQ ID NO: 179767 - protein, 37 aa, Artificial Sequence
  Description of Artificial Sequence: Synthetic polypeptide
FEEEIRTTNPVATEQYGDVVIVSDGFNGQQGGGDDDT

SEQ ID NO: 179768 - protein, 36 aa, Artificial Sequence
  Description of Artificial Sequence: Synthetic polypeptide
DEDEIRCTNPVATEPYGTTVPSCTPALSVDLGGNPS

SEQ ID NO: 179769 - protein, 37 aa, Artificial Sequence
  Description of Artificial Sequence: Synthetic polypeptide
FEEEIRTTNPVATEQYGDVVMGTNDNIEGQGNFNEII

SEQ ID NO: 179770 - protein, 37 aa, Artificial Sequence
  Description of Artificial Sequence: Synthetic polypeptide
FEEEIRTTNPVATEQYGDVVMGVNDNNGQQGEFNEIM

SEQ ID NO: 179771 - protein, 37 aa, Artificial Sequence
  Description of Artificial Sequence: Synthetic polypeptide
DEEEIRTTNPVATEQYGSCGPLNPNMLMEMMNFEPTQ

SEQ ID NO: 179772 - protein, 39 aa, Artificial Sequence
  Description of Artificial Sequence: Synthetic polypeptide
DEEEIRTTNPVATESYGTVTTGQAGTISTNTQGQEIGNT

SEQ ID NO: 179773 - protein, 39 aa, Artificial Sequence
  Description of Artificial Sequence: Synthetic polypeptide
DEEEIRTTNPVATESYGTVTTEQSGTISTNTQMQEVGNT

SEQ ID NO: 179774 - protein, 39 aa, Artificial Sequence
  Description of Artificial Sequence: Synthetic polypeptide
DEEEIRTTNPVATESYGTVTTDQSGTISTNTQNQETGNP

SEQ ID NO: 179775 - protein, 39 aa, Artificial Sequence
  Description of Artificial Sequence: Synthetic polypeptide
DEEEIRTTNPVATESYGTVTTDQSGTISTNTQEEEVGNP

SEQ ID NO: 179776 - protein, 31 aa, Artificial Sequence
  Description of Artificial Sequence: Synthetic polypeptide
ADNEIACTNPVSTEGYGNAAAENIQSRVGGR

SEQ ID NO: 179777 - protein, 39 aa, Artificial Sequence
  Description of Artificial Sequence: Synthetic polypeptide
DEEEIRTTNPVATESYGTVTTDQSGTIGTNTQMNEVGNP

SEQ ID NO: 179778 - protein, 34 aa, Artificial Sequence
  Description of Artificial Sequence: Synthetic polypeptide
FEEEIRTTNPVATEQYGIFMSEYDTDEEGLFELI

SEQ ID NO: 179779 - protein, 39 aa, Artificial Sequence
  Description of Artificial Sequence: Synthetic polypeptide
DEEEIRTTNPVATESYGTVTTDQSGTIGTNTNNQEQGNP

SEQ ID NO: 179780 - protein, 37 aa, Artificial Sequence
  Description of Artificial Sequence: Synthetic polypeptide
FEEEIRTTNPVATEQYGMTTIMQTNGGQEDGGENEGN

SEQ ID NO: 179781 - protein, 38 aa, Artificial Sequence
  Description of Artificial Sequence: Synthetic polypeptide
DEEEIRTTNPVATEQYGSCHISPWLYGQQAIENETDEE

SEQ ID NO: 179782 - protein, 35 aa, Artificial Sequence
  Description of Artificial Sequence: Synthetic polypeptide
FEEEIRTTNPVATEQYGMVNIMNGFEGGGGEEGGT

SEQ ID NO: 179783 - protein, 37 aa, Artificial Sequence
  Description of Artificial Sequence: Synthetic polypeptide
FEEEIRTTNPVATEQYGMVNIMTNMDDTVEMGGNETE

SEQ ID NO: 179784 - protein, 34 aa, Artificial Sequence
  Description of Artificial Sequence: Synthetic polypeptide
DESEIATTNPVATAHWGSVCTWEDQQRDTHNKDT

SEQ ID NO: 179785 - protein, 37 aa, Artificial Sequence
  Description of Artificial Sequence: Synthetic polypeptide
DEEEIRTTNPVATEQYGSCIEHCTLEDHNDPEQDEGM

SEQ ID NO: 179786 - protein, 32 aa, Artificial Sequence
  Description of Artificial Sequence: Synthetic polypeptide
DDSEVATTNPVSTECYGNVSACITIQDRVGQG

SEQ ID NO: 179787 - protein, 37 aa, Artificial Sequence
  Description of Artificial Sequence: Synthetic polypeptide
DEEEIRTTNPVATEGYGICVCSTTVNHNQENFISDQS

SEQ ID NO: 179788 - protein, 36 aa, Artificial Sequence
  Description of Artificial Sequence: Synthetic polypeptide
FEEEIRTTNPVATEQYGMVTIMSDGFEGDGGQEGGT

SEQ ID NO: 179789 - protein, 37 aa, Artificial Sequence
  Description of Artificial Sequence: Synthetic polypeptide
FEEEIRTTNPVATEQYGMYVEPANTQAQDLQIGPGDQ

SEQ ID NO: 179790 - protein, 37 aa, Artificial Sequence
  Description of Artificial Sequence: Synthetic polypeptide
DEEEIRTTNPVATEGYGICVCSTVEDNQENFISDNQG

SEQ ID NO: 179791 - protein, 34 aa, Artificial Sequence
  Description of Artificial Sequence: Synthetic polypeptide
DESEIATTNPVATASWGCVSAANNEPTDRGGENQ

SEQ ID NO: 179792 - protein, 34 aa, Artificial Sequence
  Description of Artificial Sequence: Synthetic polypeptide
CEEEISTTNPVAYEQYGQCVCSWEHNQNFGSDQS

SEQ ID NO: 179793 - protein, 37 aa, Artificial Sequence
  Description of Artificial Sequence: Synthetic polypeptide
FEEEIRTTNPVATEQYGDVVCGTQGGQTGDGNGNEDQ

SEQ ID NO: 179794 - protein, 39 aa, Artificial Sequence
  Description of Artificial Sequence: Synthetic polypeptide
DEEEIRTTNPVATESYGTVTTGQAGTISTNTQNQENGNP

SEQ ID NO: 179795 - protein, 37 aa, Artificial Sequence
  Description of Artificial Sequence: Synthetic polypeptide
DEEEIRTTNPVATEGYGCVCSTTPAHNNEYSGSDPVA

SEQ ID NO: 179796 - protein, 32 aa, Artificial Sequence
  Description of Artificial Sequence: Synthetic polypeptide
DESEIATTNPVATECWGATTANADLAEPKGPI

SEQ ID NO: 179797 - protein, 36 aa, Artificial Sequence
  Description of Artificial Sequence: Synthetic polypeptide
FEEEIRTTNPVATEQYGCVCSWGEHNQEYFNSDTQA

SEQ ID NO: 179798 - protein, 37 aa, Artificial Sequence
  Description of Artificial Sequence: Synthetic polypeptide
DEEEIRCTNPVATEQYGCVCSMTEEDDNQGFGSDTQA

SEQ ID NO: 179799 - protein, 34 aa, Artificial Sequence
  Description of Artificial Sequence: Synthetic polypeptide
SAEEIATTNPVATEQWGCVAANNQPADPGENPHN

SEQ ID NO: 179800 - protein, 39 aa, Artificial Sequence
  Description of Artificial Sequence: Synthetic polypeptide
DEEEIRTTNPVATESYGTVTTGQQVTISTNTQMNEVGNV

SEQ ID NO: 179801 - protein, 39 aa, Artificial Sequence
  Description of Artificial Sequence: Synthetic polypeptide
DEEEIRTTNPVATESYGTVTTGQQVTISTNTQEQEGGNT

SEQ ID NO: 179802 - protein, 32 aa, Artificial Sequence
  Description of Artificial Sequence: Synthetic polypeptide
DDSEVASTNPVSTEGYGQVAANTFIQSRVGQR

SEQ ID NO: 179803 - protein, 32 aa, Artificial Sequence
  Description of Artificial Sequence: Synthetic polypeptide
SAEEIATTNPVATASWGCVAGTGLAAPGDDHR

SEQ ID NO: 179804 - protein, 32 aa, Artificial Sequence
  Description of Artificial Sequence: Synthetic polypeptide
DDSEVASTNPVSTEGYGQVAANTIQSRVGAQR

SEQ ID NO: 179805 - protein, 37 aa, Artificial Sequence
  Description of Artificial Sequence: Synthetic polypeptide
FEEEIRTTNPVATEQYGDVGTNMDTPGQLGEGGQGQL

SEQ ID NO: 179806 - protein, 36 aa, Artificial Sequence
  Description of Artificial Sequence: Synthetic polypeptide
DEEEIRTTNPVATEGYGCVCSWGEHNQENFNSENQS

SEQ ID NO: 179807 - protein, 32 aa, Artificial Sequence
  Description of Artificial Sequence: Synthetic polypeptide
SAEEIATTNPVATAQWGCVAGTGNPANADPGN

SEQ ID NO: 179808 - protein, 36 aa, Artificial Sequence
  Description of Artificial Sequence: Synthetic polypeptide
DEEEIRTTNPVATEQYGCVCSDSEHNQENFSSDPQS

SEQ ID NO: 179809 - protein, 39 aa, Artificial Sequence
  Description of Artificial Sequence: Synthetic polypeptide
DEEEIRTTNPVATESYGTVTTGQQGTISTNTTNQEVGNT

SEQ ID NO: 179810 - protein, 37 aa, Artificial Sequence
  Description of Artificial Sequence: Synthetic polypeptide
DEEEIRCTNPVATEQYGCVCSMSGEDFQEGFNSNTQA

SEQ ID NO: 179811 - protein, 37 aa, Artificial Sequence
  Description of Artificial Sequence: Synthetic polypeptide
DEEEIRTTNPVATEQYGSCFAPEQTHDQIMQIGMVAD

SEQ ID NO: 179812 - protein, 39 aa, Artificial Sequence
  Description of Artificial Sequence: Synthetic polypeptide
DEEEIRTTNPVATESYGTVTTGQQGTISTNTQMTEVGNT

SEQ ID NO: 179813 - protein, 39 aa, Artificial Sequence
  Description of Artificial Sequence: Synthetic polypeptide
DEEEIRTTNPVATESYGTVTTGQGVTISTNTQMQEVGNP

SEQ ID NO: 179814 - protein, 36 aa, Artificial Sequence
  Description of Artificial Sequence: Synthetic polypeptide
DEEEIRTTNPVATEQYGSCGEPNMFTDDAQAPIQVL

SEQ ID NO: 179815 - protein, 37 aa, Artificial Sequence
  Description of Artificial Sequence: Synthetic polypeptide
DEEEIRTTNPVATEGYGCVTSTWGEDNAEHFGSDPQS

SEQ ID NO: 179816 - protein, 36 aa, Artificial Sequence
  Description of Artificial Sequence: Synthetic polypeptide
DEEEIRTTNPVATEQYGSCGEPSNAMEMHELGELQD

SEQ ID NO: 179817 - protein, 37 aa, Artificial Sequence
  Description of Artificial Sequence: Synthetic polypeptide
DEEEIRTTNPVATEGYGICVCSNTMNDNQENFISDQA

SEQ ID NO: 179818 - protein, 37 aa, Artificial Sequence
  Description of Artificial Sequence: Synthetic polypeptide
DEEEIRTTNPVATEQYGSCGEPTVAMEMHELGEELQR

SEQ ID NO: 179819 - protein, 34 aa, Artificial Sequence
  Description of Artificial Sequence: Synthetic polypeptide
DESEIATTNPVATASWGCVSANNAEPTDRGGENE

SEQ ID NO: 179820 - protein, 37 aa, Artificial Sequence
  Description of Artificial Sequence: Synthetic polypeptide
DEEEIRTTNPVATEQYGSCGPLEPNMLQQMMMFEPTL

SEQ ID NO: 179821 - protein, 39 aa, Artificial Sequence
  Description of Artificial Sequence: Synthetic polypeptide
DEEEIRTTNPVATESYGTVTTGQQSTISTNTQEQEVGNV

SEQ ID NO: 179822 - protein, 37 aa, Artificial Sequence
  Description of Artificial Sequence: Synthetic polypeptide
DEEEIRTTNPVATEQYGQCVCSWGEDHNAENFNSDQS

SEQ ID NO: 179823 - protein, 35 aa, Artificial Sequence
  Description of Artificial Sequence: Synthetic polypeptide
REAEIRTTNPVATEAYGKTVSCQGNSDQVTGGGTS

SEQ ID NO: 179824 - protein, 38 aa, Artificial Sequence
  Description of Artificial Sequence: Synthetic polypeptide
FEEEIRTTNPVATEQYGSVMGEMTDTIGQGGTGGNQEE

SEQ ID NO: 179825 - protein, 34 aa, Artificial Sequence
  Description of Artificial Sequence: Synthetic polypeptide
DEECISTTNPVATEQYGCVCSWGPHAENFNSEQS

SEQ ID NO: 179826 - protein, 39 aa, Artificial Sequence
  Description of Artificial Sequence: Synthetic polypeptide
DEEEIRTTNPVATESYGTVATGQSNTISTNTQGQEVGNA

SEQ ID NO: 179827 - protein, 35 aa, Artificial Sequence
  Description of Artificial Sequence: Synthetic polypeptide
DENEIRTTNPVATDQYGSVNQTDQAEHPRQAVQDA

SEQ ID NO: 179828 - protein, 39 aa, Artificial Sequence
  Description of Artificial Sequence: Synthetic polypeptide
DEEEIRTTNPVATESYGTVATGQSGTIGTNTQMEEVGNP

SEQ ID NO: 179829 - protein, 39 aa, Artificial Sequence
  Description of Artificial Sequence: Synthetic polypeptide
DEEEIRTTNPVATESYGTVATDQSGTISTNTQMQEVGNP

SEQ ID NO: 179830 - protein, 36 aa, Artificial Sequence
  Description of Artificial Sequence: Synthetic polypeptide
DEEEIRTTNPVATEQYGSCNWPEIPLEDADEKDQRG

SEQ ID NO: 179831 - protein, 35 aa, Artificial Sequence
  Description of Artificial Sequence: Synthetic polypeptide
DEEEIRTTNPVATEQYGSCNWPEIPMLDAEKDSQG

SEQ ID NO: 179832 - protein, 39 aa, Artificial Sequence
  Description of Artificial Sequence: Synthetic polypeptide
DEEEIRTTNPVATESYGTVATDQSGTIGTNTQEQEIGNT

SEQ ID NO: 179833 - protein, 38 aa, Artificial Sequence
  Description of Artificial Sequence: Synthetic polypeptide
DEEEIRTTNPVATEGYGMVNNSGMGNNLQNNNGGGQQV

SEQ ID NO: 179834 - protein, 38 aa, Artificial Sequence
  Description of Artificial Sequence: Synthetic polypeptide
DEANEIATTNPVAYEQYGSVCSPMHNLSNTQAGDNSLH

SEQ ID NO: 179835 - protein, 34 aa, Artificial Sequence
  Description of Artificial Sequence: Synthetic polypeptide
DEEEIRTTNPVAYEQYGQCVCGWEDNQYFDSDQS

SEQ ID NO: 179836 - protein, 31 aa, Artificial Sequence
  Description of Artificial Sequence: Synthetic polypeptide
DDSEVASTNPVSTEGYGWVAIQTIQSRTGVR

SEQ ID NO: 179837 - protein, 37 aa, Artificial Sequence
  Description of Artificial Sequence: Synthetic polypeptide
DEEEIRTTNPVATEGYGMVNNVGMGNLEDNNGGQNQF

SEQ ID NO: 179838 - protein, 33 aa, Artificial Sequence
  Description of Artificial Sequence: Synthetic polypeptide
YENCIRTTNCVATEWYGESASTPADQRDITTFV

SEQ ID NO: 179839 - protein, 37 aa, Artificial Sequence
  Description of Artificial Sequence: Synthetic polypeptide
FEEEIRTTNPVATEQYGSVSLWPMDFEEEQPDTWVRD

SEQ ID NO: 179840 - protein, 36 aa, Artificial Sequence
  Description of Artificial Sequence: Synthetic polypeptide
CEEEIRATNPVATEQYGVVTMQDGDNGQRFNDDGLD

SEQ ID NO: 179841 - protein, 36 aa, Artificial Sequence
  Description of Artificial Sequence: Synthetic polypeptide
DENEIRTTNPVATDQYGSVCNQTMQAEHPRQNVNDA

SEQ ID NO: 179842 - protein, 34 aa, Artificial Sequence
  Description of Artificial Sequence: Synthetic polypeptide
CEEVIACTNPVATEQWGCVAGTNLATMEMGEERW

SEQ ID NO: 179843 - protein, 31 aa, Artificial Sequence
  Description of Artificial Sequence: Synthetic polypeptide
DDSEVASTNPVSTEGYGYVAANTIQSFVGQR

SEQ ID NO: 179844 - protein, 32 aa, Artificial Sequence
  Description of Artificial Sequence: Synthetic polypeptide
DDSEVASTNPVSTEGYGYVAANTIQSRVGDQR

SEQ ID NO: 179845 - protein, 36 aa, Artificial Sequence
  Description of Artificial Sequence: Synthetic polypeptide
DEANEIATTNPVAYEQYGTVATENGGMQNGGRRGEQ

SEQ ID NO: 179846 - protein, 32 aa, Artificial Sequence
  Description of Artificial Sequence: Synthetic polypeptide
DEASIACTNPVATASWGCVAGNGELQDGSNGM

SEQ ID NO: 179847 - protein, 34 aa, Artificial Sequence
  Description of Artificial Sequence: Synthetic polypeptide
DEASIACTNPVATEQYGSACSANPGNPEAEGENH

SEQ ID NO: 179848 - protein, 31 aa, Artificial Sequence
  Description of Artificial Sequence: Synthetic polypeptide
YENEIASTNPVSTEPYGTISMEDIQQQNGNH

SEQ ID NO: 179849 - protein, 37 aa, Artificial Sequence
  Description of Artificial Sequence: Synthetic polypeptide
QEVEIRTTNPVATEQYGSVTTGDGNDQTGEGEEGIGE

SEQ ID NO: 179850 - protein, 35 aa, Artificial Sequence
  Description of Artificial Sequence: Synthetic polypeptide
DEECISTTNPVATEQYGCVCSWGEPQENFNSDTQS

SEQ ID NO: 179851 - protein, 38 aa, Artificial Sequence
  Description of Artificial Sequence: Synthetic polypeptide
QEVEIRTTNPVATEQYGSVTTGDGNDQRIEGEEGIGGP

SEQ ID NO: 179852 - protein, 30 aa, Artificial Sequence
  Description of Artificial Sequence: Synthetic polypeptide
QEWEIATTNPVAYEQYGEAPEVICQHEEEK

SEQ ID NO: 179853 - protein, 32 aa, Artificial Sequence
  Description of Artificial Sequence: Synthetic polypeptide
DDSEVASTNPVSTEGYGWVAANTIMQSRVGQR

SEQ ID NO: 179854 - protein, 30 aa, Artificial Sequence
  Description of Artificial Sequence: Synthetic polypeptide
QEYEIATTNPVGTEQYGEAPHEVCQHPEEK

SEQ ID NO: 179855 - protein, 32 aa, Artificial Sequence
  Description of Artificial Sequence: Synthetic polypeptide
YEMEIASTNPVCTEQYGVVCSADDGPVESGNQ

SEQ ID NO: 179856 - protein, 31 aa, Artificial Sequence
  Description of Artificial Sequence: Synthetic polypeptide
DESEIASTNPVGTEGYGVIAMEDLQQQNGDH

SEQ ID NO: 179857 - protein, 39 aa, Artificial Sequence
  Description of Artificial Sequence: Synthetic polypeptide
DEEEIRTTNPVATESYGTVTNLQAGTISTNTQNQEVGNY

SEQ ID NO: 179858 - protein, 35 aa, Artificial Sequence
  Description of Artificial Sequence: Synthetic polypeptide
DEEVISTTNPVATEQYGCVCSWGEHNDENFGSQQS

SEQ ID NO: 179859 - protein, 39 aa, Artificial Sequence
  Description of Artificial Sequence: Synthetic polypeptide
DEEEIRTTNPVATESYGTVTNDQSGTISTNTQNQEEGNT

SEQ ID NO: 179860 - protein, 37 aa, Artificial Sequence
  Description of Artificial Sequence: Synthetic polypeptide
AEEEISTTNPVATEQYGCVCSTWGEHNQENFGSENQS

SEQ ID NO: 179861 - protein, 39 aa, Artificial Sequence
  Description of Artificial Sequence: Synthetic polypeptide
DEEEIRTTNPVATESYGTVTNDQSGTISTNTQMGEVGNP

SEQ ID NO: 179862 - protein, 33 aa, Artificial Sequence
  Description of Artificial Sequence: Synthetic polypeptide
DECEIATTNPVATEHWGSVCYNNDDQDHDDQDM

SEQ ID NO: 179863 - protein, 39 aa, Artificial Sequence
  Description of Artificial Sequence: Synthetic polypeptide
DEEEIRTTNPVATESYGTVTNDQSGTISTNQQNQEVGNG

SEQ ID NO: 179864 - protein, 36 aa, Artificial Sequence
  Description of Artificial Sequence: Synthetic polypeptide
DEEEIRTTNPVATEQYGSCNWPEILEDSAVEKDSRG

SEQ ID NO: 179865 - protein, 35 aa, Artificial Sequence
  Description of Artificial Sequence: Synthetic polypeptide
DEECISTTNPVATEQYGCVCSWGEDHNQGFNSDQT

SEQ ID NO: 179866 - protein, 33 aa, Artificial Sequence
  Description of Artificial Sequence: Synthetic polypeptide
DEQEIRTTNPVSTEPYGTISMEDQIMQQQNGMI

SEQ ID NO: 179867 - protein, 37 aa, Artificial Sequence
  Description of Artificial Sequence: Synthetic polypeptide
DECEIATTNPVATECWGSVVSTGNSLAQGEQDRQDSE

SEQ ID NO: 179868 - protein, 36 aa, Artificial Sequence
  Description of Artificial Sequence: Synthetic polypeptide
DEEEIRTTNPVATEQYGSCNWPEIPFLDADEKDSNG

SEQ ID NO: 179869 - protein, 35 aa, Artificial Sequence
  Description of Artificial Sequence: Synthetic polypeptide
DEEEIRTTNPVATEQYGSCNWPEIPLDADEHDIEG

SEQ ID NO: 179870 - protein, 32 aa, Artificial Sequence
  Description of Artificial Sequence: Synthetic polypeptide
DESEIASTNPVGTECYGVMSCITEQDHEGENG

SEQ ID NO: 179871 - protein, 35 aa, Artificial Sequence
  Description of Artificial Sequence: Synthetic polypeptide
DEECISTTNPVATEQYGCVCSWGEHDQSFNSENQA

SEQ ID NO: 179872 - protein, 36 aa, Artificial Sequence
  Description of Artificial Sequence: Synthetic polypeptide
DEECISTTNPVATEQYGCVCSWGEHNAENFGSDNQS

SEQ ID NO: 179873 - protein, 36 aa, Artificial Sequence
  Description of Artificial Sequence: Synthetic polypeptide
DEECISTTNPVATEQYGCVCSWGEHNEENFGSDNQS

SEQ ID NO: 179874 - protein, 32 aa, Artificial Sequence
  Description of Artificial Sequence: Synthetic polypeptide
DDSEVASTNPVSTEGYGVVCAVNTIQERFGQR

SEQ ID NO: 179875 - protein, 32 aa, Artificial Sequence
  Description of Artificial Sequence: Synthetic polypeptide
DDSEVASTNPVSTEGYGVVNANTIQSRVGQRD

SEQ ID NO: 179876 - protein, 31 aa, Artificial Sequence
  Description of Artificial Sequence: Synthetic polypeptide
DDSEVASTNPVATEGYGNVAANTIESHEGER

SEQ ID NO: 179877 - protein, 35 aa, Artificial Sequence
  Description of Artificial Sequence: Synthetic polypeptide
DEECISTTNPVATEQYGCVCSWGEHNENFGSETQT

SEQ ID NO: 179878 - protein, 35 aa, Artificial Sequence
  Description of Artificial Sequence: Synthetic polypeptide
DEEEIRTTNPVATEQYGSCNWPEIPLDMAEKDSIE

SEQ ID NO: 179879 - protein, 35 aa, Artificial Sequence
  Description of Artificial Sequence: Synthetic polypeptide
DEECISTTNPVATEQYGCVCSWGEHNQENFNSDQA

SEQ ID NO: 179880 - protein, 35 aa, Artificial Sequence
  Description of Artificial Sequence: Synthetic polypeptide
DENEIRTTNPVATDQYGSANQTFQGEHPRQAVNDA

SEQ ID NO: 179881 - protein, 33 aa, Artificial Sequence
  Description of Artificial Sequence: Synthetic polypeptide
CEEVIACTNPVATEQWGCVAGTNLATMMGEMGE

SEQ ID NO: 179882 - protein, 37 aa, Artificial Sequence
  Description of Artificial Sequence: Synthetic polypeptide
QEVEIRTTNPVATEQYGSVTTGDGNDQGEGEEGIGGG

SEQ ID NO: 179883 - protein, 34 aa, Artificial Sequence
  Description of Artificial Sequence: Synthetic polypeptide
DEAEIATTNPVATEQWGCVSGEGVEMNAAEDNAW

SEQ ID NO: 179884 - protein, 33 aa, Artificial Sequence
  Description of Artificial Sequence: Synthetic polypeptide
QEVEIATTNPVATEQYGAVAGPGEGDGQGENED

SEQ ID NO: 179885 - protein, 32 aa, Artificial Sequence
  Description of Artificial Sequence: Synthetic polypeptide
DDSEVASTNPVSTEMYGNVAANTISQSRVGQR

SEQ ID NO: 179886 - protein, 36 aa, Artificial Sequence
  Description of Artificial Sequence: Synthetic polypeptide
DEEEIRTTNPVATEQYGSCPPSELEVPQGVDTTDVP

SEQ ID NO: 179887 - protein, 36 aa, Artificial Sequence
  Description of Artificial Sequence: Synthetic polypeptide
DEEEIRTTNPVATEGYGMVVDIGGEGIQEGEEGNEL

SEQ ID NO: 179888 - protein, 36 aa, Artificial Sequence
  Description of Artificial Sequence: Synthetic polypeptide
DEDEIATTNPVAYEQYGSVVANANGELQDSKHPNDS

SEQ ID NO: 179889 - protein, 35 aa, Artificial Sequence
  Description of Artificial Sequence: Synthetic polypeptide
DEFEIATTNPVAYEQWGSVCQTFEDRTTNKQGSRN

SEQ ID NO: 179890 - protein, 37 aa, Artificial Sequence
  Description of Artificial Sequence: Synthetic polypeptide
DEEEIRTTNPVATEQYGSCQAPEQTMLDVIAQTMTAQ

SEQ ID NO: 179891 - protein, 34 aa, Artificial Sequence
  Description of Artificial Sequence: Synthetic polypeptide
CEEEIACTNPVATEQYGSCAAPNHQEAENGIMDE

SEQ ID NO: 179892 - protein, 36 aa, Artificial Sequence
  Description of Artificial Sequence: Synthetic polypeptide
DEEEIRTTNPVATEGYGMVVDIGGEGIQEGGEFNEV

SEQ ID NO: 179893 - protein, 36 aa, Artificial Sequence
  Description of Artificial Sequence: Synthetic polypeptide
DEEEIRTTNPVATEGYGMVVGIGNLDNMNGGEDELT

SEQ ID NO: 179894 - protein, 34 aa, Artificial Sequence
  Description of Artificial Sequence: Synthetic polypeptide
DEASIATTNPTAYEQWGSYYSIDNDGKRENGNNR

SEQ ID NO: 179895 - protein, 34 aa, Artificial Sequence
  Description of Artificial Sequence: Synthetic polypeptide
CAEEIATTNPVATEQWGCVAGTGELAQNNSQNEH

SEQ ID NO: 179896 - protein, 31 aa, Artificial Sequence
  Description of Artificial Sequence: Synthetic polypeptide
QETEIRTTNPVATEQWGETPNEEVWAEHGEK

SEQ ID NO: 179897 - protein, 30 aa, Artificial Sequence
  Description of Artificial Sequence: Synthetic polypeptide
DESEIASTNPIGTEGYGVMAATLQPKGDYI

SEQ ID NO: 179898 - protein, 35 aa, Artificial Sequence
  Description of Artificial Sequence: Synthetic polypeptide
CAEEIATTNPVATEQWGSTSGNNGPPDGALTEGNN

SEQ ID NO: 179899 - protein, 36 aa, Artificial Sequence
  Description of Artificial Sequence: Synthetic polypeptide
DEAEIATTNPVATEQWGSVAITNAPEASGDGMNSDD

SEQ ID NO: 179900 - protein, 35 aa, Artificial Sequence
  Description of Artificial Sequence: Synthetic polypeptide
CEEEIACTNPVATEQYGSACAANDLQNHADENAHE

SEQ ID NO: 179901 - protein, 34 aa, Artificial Sequence
  Description of Artificial Sequence: Synthetic polypeptide
DEAVIRTTNPVAYEQYGCVCETEPNQEYFGSEQA

SEQ ID NO: 179902 - protein, 38 aa, Artificial Sequence
  Description of Artificial Sequence: Synthetic polypeptide
DEEEIRTTNPVATEGYGMVVNNSGMGNNLNENNGGNQE

SEQ ID NO: 179903 - protein, 33 aa, Artificial Sequence
  Description of Artificial Sequence: Synthetic polypeptide
QETEIRTTNPIATECWGATVWANAEDWQPKGPR

SEQ ID NO: 179904 - protein, 38 aa, Artificial Sequence
  Description of Artificial Sequence: Synthetic polypeptide
DEEEIRTTNPVATEGYGMVVSGFDLEGEGGGQEGGNTP

SEQ ID NO: 179905 - protein, 32 aa, Artificial Sequence
  Description of Artificial Sequence: Synthetic polypeptide
QETEIRTTNPIATECWGATVSNAEDWQPGPYI

SEQ ID NO: 179906 - protein, 35 aa, Artificial Sequence
  Description of Artificial Sequence: Synthetic polypeptide
CEEEIACTNPVATEQYGSACAANDLQNHADENKVH

SEQ ID NO: 179907 - protein, 31 aa, Artificial Sequence
  Description of Artificial Sequence: Synthetic polypeptide
DDSEVASTNPVSTEPYGNVAANTIQSMVGQR

SEQ ID NO: 179908 - protein, 34 aa, Artificial Sequence
  Description of Artificial Sequence: Synthetic polypeptide
DESEIASTNPVATEGYGNVAATPAIPQMRNGQPV

SEQ ID NO: 179909 - protein, 37 aa, Artificial Sequence
  Description of Artificial Sequence: Synthetic polypeptide
DEEEIRTTNPVATESYGSVSVNTGMGFETGDGETGGG

SEQ ID NO: 179910 - protein, 35 aa, Artificial Sequence
  Description of Artificial Sequence: Synthetic polypeptide
DEECISTTNPVATEQYGQCVCSNWEHQNFGSQTQS

SEQ ID NO: 179911 - protein, 37 aa, Artificial Sequence
  Description of Artificial Sequence: Synthetic polypeptide
DEDEIATTNPVAYEQYGSVVAMANGELQDSKGGNDSN

SEQ ID NO: 179912 - protein, 37 aa, Artificial Sequence
  Description of Artificial Sequence: Synthetic polypeptide
QEVEIRTTNPVATEQYGSVTTGDGNDQGEGEEGEDGP

SEQ ID NO: 179913 - protein, 35 aa, Artificial Sequence
  Description of Artificial Sequence: Synthetic polypeptide
AEEEISTTNPVATEQYGCVCSSGEHNQENFGSDQA

SEQ ID NO: 179914 - protein, 38 aa, Artificial Sequence
  Description of Artificial Sequence: Synthetic polypeptide
QEVEIRTTNPVATEQYGSVTMTGDNDQGGEGEEGINIP

SEQ ID NO: 179915 - protein, 35 aa, Artificial Sequence
  Description of Artificial Sequence: Synthetic polypeptide
AEEEISTTNPVATEQYGCVCSSEHNAEYFNSQFQA

SEQ ID NO: 179916 - protein, 32 aa, Artificial Sequence
  Description of Artificial Sequence: Synthetic polypeptide
DDSEVASTNPVSTEGYGYVAANTIQSRVGQRN

SEQ ID NO: 179917 - protein, 32 aa, Artificial Sequence
  Description of Artificial Sequence: Synthetic polypeptide
DDSEVASTNPVSTEGYGYVAANTVIQSRVGQR

SEQ ID NO: 179918 - protein, 36 aa, Artificial Sequence
  Description of Artificial Sequence: Synthetic polypeptide
DEEEIRTTNPVATEQYGSCNYPEIPLDDADEKDINF

SEQ ID NO: 179919 - protein, 37 aa, Artificial Sequence
  Description of Artificial Sequence: Synthetic polypeptide
QEVEIRTTNPVATEQYGSVNVITGEEGIGQGDDGNVE

SEQ ID NO: 179920 - protein, 36 aa, Artificial Sequence
  Description of Artificial Sequence: Synthetic polypeptide
DENEIRTTNPVATDAYGSVNQTNNGLGQEFDDEEMQ

SEQ ID NO: 179921 - protein, 36 aa, Artificial Sequence
  Description of Artificial Sequence: Synthetic polypeptide
QEVEIRTTNPVATEQYGDVDTGIQNDGGETGNGGGE

SEQ ID NO: 179922 - protein, 31 aa, Artificial Sequence
  Description of Artificial Sequence: Synthetic polypeptide
DDSEVASTNPVSTEHYGNVAANTIQSGVGQR

SEQ ID NO: 179923 - protein, 33 aa, Artificial Sequence
  Description of Artificial Sequence: Synthetic polypeptide
DECEIATTNPCAYEGWGSVYCGDNGRQNDGNNN

SEQ ID NO: 179924 - protein, 35 aa, Artificial Sequence
  Description of Artificial Sequence: Synthetic polypeptide
DEAGEIATTNPVAYEQWGSVCTENKLDDLGGQMDM

SEQ ID NO: 179925 - protein, 34 aa, Artificial Sequence
  Description of Artificial Sequence: Synthetic polypeptide
DECEIATTNPCATEHYGSVCYNNDDQDHNDNDHA

SEQ ID NO: 179926 - protein, 35 aa, Artificial Sequence
  Description of Artificial Sequence: Synthetic polypeptide
QEVEIRTTNPVATECYGSVNTDNMEETGGGQTEQG

SEQ ID NO: 179927 - protein, 31 aa, Artificial Sequence
  Description of Artificial Sequence: Synthetic polypeptide
DDSEVASTNPVSTEKYGNVAAPTIQSRVGQR

SEQ ID NO: 179928 - protein, 38 aa, Artificial Sequence
  Description of Artificial Sequence: Synthetic polypeptide
QEVEIKTTNPVATEQYGSVVSGNGTNDGQLGEGQGENI

SEQ ID NO: 179929 - protein, 34 aa, Artificial Sequence
  Description of Artificial Sequence: Synthetic polypeptide
DEASIATTNPTAYEQWGSYYSFDNDPRMNGGNNR

SEQ ID NO: 179930 - protein, 31 aa, Artificial Sequence
  Description of Artificial Sequence: Synthetic polypeptide
DDSEVASTNPVSTEMYGNCAANTIQSRVGQR

SEQ ID NO: 179931 - protein, 37 aa, Artificial Sequence
  Description of Artificial Sequence: Synthetic polypeptide
QEVEIKTTNPVATEQYGSVVAGGTNDNDLGEGQGTND

SEQ ID NO: 179932 - protein, 35 aa, Artificial Sequence
  Description of Artificial Sequence: Synthetic polypeptide
DEFEIATTNPIATEQWGSIVPTNWDQHEHGQDGSN

SEQ ID NO: 179933 - protein, 34 aa, Artificial Sequence
  Description of Artificial Sequence: Synthetic polypeptide
QEVEIGTTNPVATEQYGVVVAANAGMEQGGEIEG

SEQ ID NO: 179934 - protein, 36 aa, Artificial Sequence
  Description of Artificial Sequence: Synthetic polypeptide
QEVEICTTNPVATEQYGTVVSATDGDDEEGQGGNAN

SEQ ID NO: 179935 - protein, 36 aa, Artificial Sequence
  Description of Artificial Sequence: Synthetic polypeptide
DEEEIRTTNPVATEGYGMVSVEGMGDGGEGQEAENT

SEQ ID NO: 179936 - protein, 39 aa, Artificial Sequence
  Description of Artificial Sequence: Synthetic polypeptide
DEEEIRTTNPVATESYGSVTNLQSGTISTNTNNTEVGNV

SEQ ID NO: 179937 - protein, 36 aa, Artificial Sequence
  Description of Artificial Sequence: Synthetic polypeptide
DEEEIRTTNPVATEGYGMVSVEGMGDGNQGQEAEGT

SEQ ID NO: 179938 - protein, 34 aa, Artificial Sequence
  Description of Artificial Sequence: Synthetic polypeptide
DECEIATTNPCATEHWGSVCYNNDNQDHGDNDHN

SEQ ID NO: 179939 - protein, 34 aa, Artificial Sequence
  Description of Artificial Sequence: Synthetic polypeptide
DEAEISTVNPVATEQYGCVCSWNHNANFNSDNQA

SEQ ID NO: 179940 - protein, 35 aa, Artificial Sequence
  Description of Artificial Sequence: Synthetic polypeptide
DEECISTTNPVATEQYGCVCSWEDNQEFFISDNQA

SEQ ID NO: 179941 - protein, 39 aa, Artificial Sequence
  Description of Artificial Sequence: Synthetic polypeptide
DEEEIRTTNPVATESYGTVTNLQSGSIGTNTQNQEAGNT

SEQ ID NO: 179942 - protein, 33 aa, Artificial Sequence
  Description of Artificial Sequence: Synthetic polypeptide
DENEIRTTNPVATECWGATTANAEDWQEPGPYL

SEQ ID NO: 179943 - protein, 36 aa, Artificial Sequence
  Description of Artificial Sequence: Synthetic polypeptide
DDEEIRTTNPVATEQYGSVMGNNNNDNMDEGGEMGI

SEQ ID NO: 179944 - protein, 34 aa, Artificial Sequence
  Description of Artificial Sequence: Synthetic polypeptide
DEQEIRTTNPVATETWGSFGPCINPPEAREFENG

SEQ ID NO: 179945 - protein, 38 aa, Artificial Sequence
  Description of Artificial Sequence: Synthetic polypeptide
FEEEIRTTNPVATEQYGSVNINNMNTLDQEGGGQEDTT

SEQ ID NO: 179946 - protein, 38 aa, Artificial Sequence
  Description of Artificial Sequence: Synthetic polypeptide
FEEEIRTTNPVATEQYGSVNMDTADGQDQEDEGQNEGQ

SEQ ID NO: 179947 - protein, 36 aa, Artificial Sequence
  Description of Artificial Sequence: Synthetic polypeptide
CEEEIACTNPVATEQYGSVACPTNPQQEHQDGTEMK

SEQ ID NO: 179948 - protein, 32 aa, Artificial Sequence
  Description of Artificial Sequence: Synthetic polypeptide
DDSEVASTNPVSTEGYGVVAANTIIQSRVGQR

SEQ ID NO: 179949 - protein, 38 aa, Artificial Sequence
  Description of Artificial Sequence: Synthetic polypeptide
FEEEIRTTNPVATEQYGSVNMQNMNQDEGQEGGDENGS

SEQ ID NO: 179950 - protein, 36 aa, Artificial Sequence
  Description of Artificial Sequence: Synthetic polypeptide
FEEEIRTTNPVATEQYGSVNMQNNQDQQEEDDEDGD

SEQ ID NO: 179951 - protein, 37 aa, Artificial Sequence
  Description of Artificial Sequence: Synthetic polypeptide
DDEEIRTTNPVATEQYGSVMGENVNNMDTGGQEGDIV

SEQ ID NO: 179952 - protein, 35 aa, Artificial Sequence
  Description of Artificial Sequence: Synthetic polypeptide
DDSEVATTNPVATEGYGNVSATNPTGPNSRNGMNV

SEQ ID NO: 179953 - protein, 35 aa, Artificial Sequence
  Description of Artificial Sequence: Synthetic polypeptide
QSEEIRTTNPVCYEAYGSVHCDPNFSQNRQGGNND

SEQ ID NO: 179954 - protein, 36 aa, Artificial Sequence
  Description of Artificial Sequence: Synthetic polypeptide
DDEEIRTTNPVATEQYGSVMGENVNNMDGGGQGDIT

SEQ ID NO: 179955 - protein, 37 aa, Artificial Sequence
  Description of Artificial Sequence: Synthetic polypeptide
DEEEIRTTNPVATEQYGSCNCVCSELPIEMEEQEDLI

SEQ ID NO: 179956 - protein, 36 aa, Artificial Sequence
  Description of Artificial Sequence: Synthetic polypeptide
DEEEIRTTNPVATEGYGMVNNDEFDLEFGTGGENGI

SEQ ID NO: 179957 - protein, 37 aa, Artificial Sequence
  Description of Artificial Sequence: Synthetic polypeptide
DDEEIRTTNPVATEQYGSVMGENVNFNMDEGGQEGEI

SEQ ID NO: 179958 - protein, 35 aa, Artificial Sequence
  Description of Artificial Sequence: Synthetic polypeptide
YEGEITRTTNSVTTESYGSVVRMWMNLTNRFGQVR

SEQ ID NO: 179959 - protein, 37 aa, Artificial Sequence
  Description of Artificial Sequence: Synthetic polypeptide
DDEEIRTTNPVATEQYGSVMGENVNANMDEGGQQGDI

SEQ ID NO: 179960 - protein, 37 aa, Artificial Sequence
  Description of Artificial Sequence: Synthetic polypeptide
DDEEIRTTNPVATEQYGSVMGENNQDNMDEGGQIGDI

SEQ ID NO: 179961 - protein, 34 aa, Artificial Sequence
  Description of Artificial Sequence: Synthetic polypeptide
DEQEIRTTNPVAYEAYGSACCLGNHSHTEGGTRL

SEQ ID NO: 179962 - protein, 34 aa, Artificial Sequence
  Description of Artificial Sequence: Synthetic polypeptide
CEEPIRCTNPVATEQYGCVTTQNDCTQFMIQSCI

SEQ ID NO: 179963 - protein, 37 aa, Artificial Sequence
  Description of Artificial Sequence: Synthetic polypeptide
DEEEIRTTNPVATEGYGMVNNDEFNDNLEFETGGENG

SEQ ID NO: 179964 - protein, 37 aa, Artificial Sequence
  Description of Artificial Sequence: Synthetic polypeptide
DDEEIRTTNPVATEQYGSVMGDNQPGGQDDEGEGETD

SEQ ID NO: 179965 - protein, 36 aa, Artificial Sequence
  Description of Artificial Sequence: Synthetic polypeptide
DECEIATTNPVATEMWGVVSKTNNPLDDRQNGGGEN

SEQ ID NO: 179966 - protein, 32 aa, Artificial Sequence
  Description of Artificial Sequence: Synthetic polypeptide
DEDEICTTNPVAYEQWGSVCAAAFQHDDTEAE

SEQ ID NO: 179967 - protein, 37 aa, Artificial Sequence
  Description of Artificial Sequence: Synthetic polypeptide
DEEEIRTTNPVATEQYGSVSECEPDIEAARMIVLEDI

SEQ ID NO: 179968 - protein, 36 aa, Artificial Sequence
  Description of Artificial Sequence: Synthetic polypeptide
DEDEICTTNPVAYECWGSVATGNGPLQDDRQQNGVD

SEQ ID NO: 179969 - protein, 37 aa, Artificial Sequence
  Description of Artificial Sequence: Synthetic polypeptide
FEEEIRTTNPVATEQYGSVNEPTLGQMLQAQEQPELS

SEQ ID NO: 179970 - protein, 36 aa, Artificial Sequence
  Description of Artificial Sequence: Synthetic polypeptide
DDEEIRTTNPVATEQYGSVMGNNNNNMDEGGEGTIE

SEQ ID NO: 179971 - protein, 38 aa, Artificial Sequence
  Description of Artificial Sequence: Synthetic polypeptide
FEEEIRTTNPVATEQYGSVMGEMTDTIGQIGNGGNQED

SEQ ID NO: 179972 - protein, 35 aa, Artificial Sequence
  Description of Artificial Sequence: Synthetic polypeptide
DEECISTTNPVATEQYGCVCSNWEPNQEFFGSDQS

SEQ ID NO: 179973 - protein, 37 aa, Artificial Sequence
  Description of Artificial Sequence: Synthetic polypeptide
FEEEIRTTNPVATEQYGSVMGMDNPGGQTNQGEGEGQ

SEQ ID NO: 179974 - protein, 36 aa, Artificial Sequence
  Description of Artificial Sequence: Synthetic polypeptide
REAEIRTTNPVATEAYGKTVSCQGNSDQVKGGNTSW

SEQ ID NO: 179975 - protein, 37 aa, Artificial Sequence
  Description of Artificial Sequence: Synthetic polypeptide
FEEEIRTTNPVATEQYGSVMGNMDTTGQEGEGGEGST

SEQ ID NO: 179976 - protein, 36 aa, Artificial Sequence
  Description of Artificial Sequence: Synthetic polypeptide
DEAEISTVNPVATEQYGQCVCSTELNAENFGSDNQA

SEQ ID NO: 179977 - protein, 36 aa, Artificial Sequence
  Description of Artificial Sequence: Synthetic polypeptide
REAEIRTTNPVATEAYGKTVSCQGGSDQVRGGNTSI

SEQ ID NO: 179978 - protein, 35 aa, Artificial Sequence
  Description of Artificial Sequence: Synthetic polypeptide
DDSEVATTNPVATEGYGNVSATNPTGPQSRNGMQV

SEQ ID NO: 179979 - protein, 37 aa, Artificial Sequence
  Description of Artificial Sequence: Synthetic polypeptide
REAEIRTTNPVATEAYGKTVQSCQGNSDQVRGGNTSL

SEQ ID NO: 179980 - protein, 36 aa, Artificial Sequence
  Description of Artificial Sequence: Synthetic polypeptide
FEEEIRTTNPVATEQYGSVMGQVGGQGQTTEGEGGD

SEQ ID NO: 179981 - protein, 38 aa, Artificial Sequence
  Description of Artificial Sequence: Synthetic polypeptide
FEEEIRTTNPVATEQYGSVMGSIGEQEGETLEEEGGNQ

SEQ ID NO: 179982 - protein, 36 aa, Artificial Sequence
  Description of Artificial Sequence: Synthetic polypeptide
REAEIRTTNPVATEAYGKTVFCQGNSDQVRAGGNTS

SEQ ID NO: 179983 - protein, 36 aa, Artificial Sequence
  Description of Artificial Sequence: Synthetic polypeptide
DDEEIRTTNPVATEQYGSVMGQNVNNMDEGGSEGDI

SEQ ID NO: 179984 - protein, 35 aa, Artificial Sequence
  Description of Artificial Sequence: Synthetic polypeptide
CEEEIACTNPVATEQYGSVASGELTGTEGEMTDLQ

SEQ ID NO: 179985 - protein, 37 aa, Artificial Sequence
  Description of Artificial Sequence: Synthetic polypeptide
FEEEIRTTNPVATEQYGSVMGTDTMGGQTNDGEGEEQ

SEQ ID NO: 179986 - protein, 32 aa, Artificial Sequence
  Description of Artificial Sequence: Synthetic polypeptide
DENEIRTTNPVATECWGAVAEEIWMNPAGPYA

SEQ ID NO: 179987 - protein, 32 aa, Artificial Sequence
  Description of Artificial Sequence: Synthetic polypeptide
DENEIRTTNPVATECWGAVAAEIWMNPAGPYA

SEQ ID NO: 179988 - protein, 36 aa, Artificial Sequence
  Description of Artificial Sequence: Synthetic polypeptide
CEEEIACTNPVATEQYGSVANANNLPQEAPNENMNN

SEQ ID NO: 179989 - protein, 35 aa, Artificial Sequence
  Description of Artificial Sequence: Synthetic polypeptide
CEEEIACTNPVATEQYGSVANANNLDEAANGSAHE

SEQ ID NO: 179990 - protein, 33 aa, Artificial Sequence
  Description of Artificial Sequence: Synthetic polypeptide
DENEIRTTNPVATECWGATTWANEDWAEPKGPR

SEQ ID NO: 179991 - protein, 37 aa, Artificial Sequence
  Description of Artificial Sequence: Synthetic polypeptide
FEEEIRTTNPVATEQYGSVMSINNFDINGEGGEEGEA

SEQ ID NO: 179992 - protein, 32 aa, Artificial Sequence
  Description of Artificial Sequence: Synthetic polypeptide
DDSEVASTNPVSTEGYGVVAANNTIQSRVGQR

SEQ ID NO: 179993 - protein, 36 aa, Artificial Sequence
  Description of Artificial Sequence: Synthetic polypeptide
DDEEIRTTNPVATEQYGSVMGNNNNNMDEGGQGEIV

SEQ ID NO: 179994 - protein, 30 aa, Artificial Sequence
  Description of Artificial Sequence: Synthetic polypeptide
DESEIASTNPVSTEGYGNAAAEVIQHVGQK

SEQ ID NO: 179995 - protein, 30 aa, Artificial Sequence
  Description of Artificial Sequence: Synthetic polypeptide
DESEIASTNPVSTEGYGNAAAETIQHVGQK

SEQ ID NO: 179996 - protein, 36 aa, Artificial Sequence
  Description of Artificial Sequence: Synthetic polypeptide
CEEEIRATNPVATEQYGVVTMQDGDNGQRFNDIGQA

SEQ ID NO: 179997 - protein, 39 aa, Artificial Sequence
  Description of Artificial Sequence: Synthetic polypeptide
DEEEIRTTNPVATESYGTVTNLQSGTISTNNQNNEQGNN

SEQ ID NO: 179998 - protein, 39 aa, Artificial Sequence
  Description of Artificial Sequence: Synthetic polypeptide
DEEEIRTTNPVATESYGTVTNLQSGTISTNNGNQEQGNV

SEQ ID NO: 179999 - protein, 35 aa, Artificial Sequence
  Description of Artificial Sequence: Synthetic polypeptide
AEEEISTTNPVATEQYGCVCSWPEHNQENFNSDQS

SEQ ID NO: 180000 - protein, 40 aa, Artificial Sequence
  Description of Artificial Sequence: Synthetic polypeptide
DEEEIRTTNPVATESYGTVTNLQSGTIGTNTQNQEQGENR

SEQ ID NO: 180001 - protein, 35 aa, Artificial Sequence
  Description of Artificial Sequence: Synthetic polypeptide
AEEEISTTNPVATEQYGCVCSWGEHEQENFGSDQS

SEQ ID NO: 180002 - protein, 34 aa, Artificial Sequence
  Description of Artificial Sequence: Synthetic polypeptide
AEEEISTTNPVATEQYGCVCSWGEHDQGFISEQS

SEQ ID NO: 180003 - protein, 34 aa, Artificial Sequence
  Description of Artificial Sequence: Synthetic polypeptide
ADEEISTTNPVATEQYGCVCSWGEHNQNFNSDQS

SEQ ID NO: 180004 - protein, 30 aa, Artificial Sequence
  Description of Artificial Sequence: Synthetic polypeptide
DDSEVASTNPVSTEGYGVVAANTIQSSGQQ

SEQ ID NO: 180005 - protein, 39 aa, Artificial Sequence
  Description of Artificial Sequence: Synthetic polypeptide
DEEEIRTTNPVATESYGTVTNLQSGTIGTNTQNGEAGNP

SEQ ID NO: 180006 - protein, 31 aa, Artificial Sequence
  Description of Artificial Sequence: Synthetic polypeptide
DDSEVASTNPVSTEGYGVVAANTIQSSVGQR

SEQ ID NO: 180007 - protein, 39 aa, Artificial Sequence
  Description of Artificial Sequence: Synthetic polypeptide
DEEEIRTTNPVATESYGTVTNLQSGTIGTNTQGTEVGNV

SEQ ID NO: 180008 - protein, 34 aa, Artificial Sequence
  Description of Artificial Sequence: Synthetic polypeptide
TTEEISTTNPVAYEQWGSTVASTPELSQTQPDED

SEQ ID NO: 180009 - protein, 35 aa, Artificial Sequence
  Description of Artificial Sequence: Synthetic polypeptide
DEECISTTNPVATEQYGCVCSNWGEHQNFNSDTQS

SEQ ID NO: 180010 - protein, 34 aa, Artificial Sequence
  Description of Artificial Sequence: Synthetic polypeptide
DECEIATTNPVATEHWGSVCYNNDDQDHNQQDQV

SEQ ID NO: 180011 - protein, 34 aa, Artificial Sequence
  Description of Artificial Sequence: Synthetic polypeptide
YEMCIRTTYPVATDGYIYSGCSETNLERGIHIRD

SEQ ID NO: 180012 - protein, 34 aa, Artificial Sequence
  Description of Artificial Sequence: Synthetic polypeptide
CAEEIATTNPVATAQWGCVSGTGNPDNADGNGTN

SEQ ID NO: 180013 - protein, 34 aa, Artificial Sequence
  Description of Artificial Sequence: Synthetic polypeptide
DEAENATTNPVAYEQWGSVTGNGNLGDVGMNQES

SEQ ID NO: 180014 - protein, 34 aa, Artificial Sequence
  Description of Artificial Sequence: Synthetic polypeptide
DECEIATTNPVATEHWGSVCYNNDDQDHGDQDSP

SEQ ID NO: 180015 - protein, 39 aa, Artificial Sequence
  Description of Artificial Sequence: Synthetic polypeptide
DEEEIRTTNPVATESYGTVTNLQSGTIGTNNQNQEQGNF

SEQ ID NO: 180016 - protein, 39 aa, Artificial Sequence
  Description of Artificial Sequence: Synthetic polypeptide
DEEEIRTTNPVATESYGTVTNLQSGTIGTNNNNQEGGNV

SEQ ID NO: 180017 - protein, 39 aa, Artificial Sequence
  Description of Artificial Sequence: Synthetic polypeptide
DEEEIRTTNPVATESYGTVTNLQSGTIGTNLQNQEQGEQ

SEQ ID NO: 180018 - protein, 39 aa, Artificial Sequence
  Description of Artificial Sequence: Synthetic polypeptide
DEEEIRTTNPVATEQYGSVVTVVVSVNNNTEQGSNNQED

SEQ ID NO: 180019 - protein, 39 aa, Artificial Sequence
  Description of Artificial Sequence: Synthetic polypeptide
DEEEIRTTNPVATESYGTVTNLQSGTIGTNGQNSEQGND

SEQ ID NO: 180020 - protein, 35 aa, Artificial Sequence
  Description of Artificial Sequence: Synthetic polypeptide
QEYEISTTNPVATEQYGSVVAANAGMNEGGENGGI

SEQ ID NO: 180021 - protein, 36 aa, Artificial Sequence
  Description of Artificial Sequence: Synthetic polypeptide
DEECISTTNPVATEQYGCVCSTGEHNQESFNSDTQA

SEQ ID NO: 180022 - protein, 36 aa, Artificial Sequence
  Description of Artificial Sequence: Synthetic polypeptide
AEEEISTTNPVATEQYGCVCSWEEPEQENFGSDNQS

SEQ ID NO: 180023 - protein, 39 aa, Artificial Sequence
  Description of Artificial Sequence: Synthetic polypeptide
DEEEIRTTNPVATESYGTVTNLQSGTIGTNAQNNEQGNE

SEQ ID NO: 180024 - protein, 39 aa, Artificial Sequence
  Description of Artificial Sequence: Synthetic polypeptide
DEEEIRTTNPVATESYGTVTNLQSGSISTNGQNQEVGNM

SEQ ID NO: 180025 - protein, 39 aa, Artificial Sequence
  Description of Artificial Sequence: Synthetic polypeptide
DEEEIRTTNPVATESYGTVTNLQSGTIGTNTQNQETGND

SEQ ID NO: 180026 - protein, 35 aa, Artificial Sequence
  Description of Artificial Sequence: Synthetic polypeptide
DEQEIRTTNPVAYESYGSVCCLGGNSSHTEGGERL

SEQ ID NO: 180027 - protein, 39 aa, Artificial Sequence
  Description of Artificial Sequence: Synthetic polypeptide
DEEEIRTTNPVATESYGTVTNLQSGTIGTNTQNQGVGNT

SEQ ID NO: 180028 - protein, 39 aa, Artificial Sequence
  Description of Artificial Sequence: Synthetic polypeptide
DEEEIRTTNPVATESYGTVTNLQSGTIGTNTQQNEQGNQ

SEQ ID NO: 180029 - protein, 39 aa, Artificial Sequence
  Description of Artificial Sequence: Synthetic polypeptide
DEEEIRTTNPVATESYGTVTNLQSGTISTNGQNTEVGNE

SEQ ID NO: 180030 - protein, 39 aa, Artificial Sequence
  Description of Artificial Sequence: Synthetic polypeptide
DEEEIRTTNPVATESYGTVTNLQSGTISTNGNNQETGNM

SEQ ID NO: 180031 - protein, 34 aa, Artificial Sequence
  Description of Artificial Sequence: Synthetic polypeptide
DEAELSTTNPVAYEQWGSTVPSTPELSQTEDQED

SEQ ID NO: 180032 - protein, 36 aa, Artificial Sequence
  Description of Artificial Sequence: Synthetic polypeptide
DEECISTTNPVATEQYGCVCSNWGEHNANFGSENQS

SEQ ID NO: 180033 - protein, 30 aa, Artificial Sequence
  Description of Artificial Sequence: Synthetic polypeptide
DESEIASTNPVGTEGYGVMSSSAGNHGMDV

SEQ ID NO: 180034 - protein, 34 aa, Artificial Sequence
  Description of Artificial Sequence: Synthetic polypeptide
CEEEIACTNPVATEQYGSCVAAGNPDNQDPIVHN

SEQ ID NO: 180035 - protein, 36 aa, Artificial Sequence
  Description of Artificial Sequence: Synthetic polypeptide
AEEEISTTNPVATEQYGCVCSWGNHNQENFNSENQS

SEQ ID NO: 180036 - protein, 32 aa, Artificial Sequence
  Description of Artificial Sequence: Synthetic polypeptide
DESEIASTNPVGTEGYGVMSCITEQDHEGENG

SEQ ID NO: 180037 - protein, 35 aa, Artificial Sequence
  Description of Artificial Sequence: Synthetic polypeptide
AEEEISTTNPVATEQYGCVCSWGEHNQYFGSDTQA

SEQ ID NO: 180038 - protein, 35 aa, Artificial Sequence
  Description of Artificial Sequence: Synthetic polypeptide
AEEEISTTNPVATEQYGCVCSWGEHNQNFGSETQS

SEQ ID NO: 180039 - protein, 38 aa, Artificial Sequence
  Description of Artificial Sequence: Synthetic polypeptide
FEEEIRTTNPVATEQYGSVNVSTTAEGPEMGQGENEEG

SEQ ID NO: 180040 - protein, 37 aa, Artificial Sequence
  Description of Artificial Sequence: Synthetic polypeptide
FEEEIRTTNPVATEQYGSVPELVSNLTPQFQEVELEV

SEQ ID NO: 180041 - protein, 36 aa, Artificial Sequence
  Description of Artificial Sequence: Synthetic polypeptide
AEEEISTTNPVATEQYGCVCSWEDHFQENFGSENQS

SEQ ID NO: 180042 - protein, 36 aa, Artificial Sequence
  Description of Artificial Sequence: Synthetic polypeptide
DENEIRTTNPVATEAYGCVCSWGEHNQENFGSDNQS

SEQ ID NO: 180043 - protein, 37 aa, Artificial Sequence
  Description of Artificial Sequence: Synthetic polypeptide
FEEEIRTTNPVATEQYGSVPIPTITQMILNPINWFEL

SEQ ID NO: 180044 - protein, 37 aa, Artificial Sequence
  Description of Artificial Sequence: Synthetic polypeptide
DDEEIRTTNPVATEQYGSVIDGNMEDGDGGEQDNNDD

SEQ ID NO: 180045 - protein, 36 aa, Artificial Sequence
  Description of Artificial Sequence: Synthetic polypeptide
DEEEIRCTNPVATEQFGSVSSTTPAGPNMYNPMLPV

SEQ ID NO: 180046 - protein, 37 aa, Artificial Sequence
  Description of Artificial Sequence: Synthetic polypeptide
FEEEIRTTNPVATEQYGSVQPNGPVLHMMTEHVNQNE

SEQ ID NO: 180047 - protein, 37 aa, Artificial Sequence
  Description of Artificial Sequence: Synthetic polypeptide
FEEEIRTTNPVATEQYGSVQSEAPLMPHSALAVEENG

SEQ ID NO: 180048 - protein, 39 aa, Artificial Sequence
  Description of Artificial Sequence: Synthetic polypeptide
DEEEIRTTNPVATEQYGSVVTVVVNQNGVTEQGTEQGTD

SEQ ID NO: 180049 - protein, 34 aa, Artificial Sequence
  Description of Artificial Sequence: Synthetic polypeptide
CEEEIACTNPVATEQYGSCVAAGNPDNMNGSVHE

SEQ ID NO: 180050 - protein, 39 aa, Artificial Sequence
  Description of Artificial Sequence: Synthetic polypeptide
DEEEIRTTNPVATESYGTVTNLQSGTIGTTTNNQEQGND

SEQ ID NO: 180051 - protein, 36 aa, Artificial Sequence
  Description of Artificial Sequence: Synthetic polypeptide
FEEEIRTTNPVATEQYGSVQVLGEEQIENTEEANIM

SEQ ID NO: 180052 - protein, 34 aa, Artificial Sequence
  Description of Artificial Sequence: Synthetic polypeptide
CEEEIACTNPVATEQYGSCVAAGNPDNMDGGPEH

SEQ ID NO: 180053 - protein, 40 aa, Artificial Sequence
  Description of Artificial Sequence: Synthetic polypeptide
DEEEIRTTNPVATESYGTVTNLQSGTIGTTNLQNQEQGND

SEQ ID NO: 180054 - protein, 36 aa, Artificial Sequence
  Description of Artificial Sequence: Synthetic polypeptide
DEEEIRTTNPVAYEQYGQCVCSDSEDDNQHFGSDQM

SEQ ID NO: 180055 - protein, 37 aa, Artificial Sequence
  Description of Artificial Sequence: Synthetic polypeptide
FEEEIRTTNPVATEQYGSVPIPQITQMILNPINQNEL

SEQ ID NO: 180056 - protein, 40 aa, Artificial Sequence
  Description of Artificial Sequence: Synthetic polypeptide
EDEIKEEETIRTTNPVATEQYGSVSTVTNATGDEQGNVTG

SEQ ID NO: 180057 - protein, 37 aa, Artificial Sequence
  Description of Artificial Sequence: Synthetic polypeptide
DEEEIRTTNPVATEQYGQCVCSWGEDHNQENFNSDAS

SEQ ID NO: 180058 - protein, 32 aa, Artificial Sequence
  Description of Artificial Sequence: Synthetic polypeptide
AEDEIACTNPVAYEQWGEAFSIENDQDQGGER

SEQ ID NO: 180059 - protein, 35 aa, Artificial Sequence
  Description of Artificial Sequence: Synthetic polypeptide
DEAEISTTNPVATEQYGCVCSTGEHNQENFISDQS

SEQ ID NO: 180060 - protein, 37 aa, Artificial Sequence
  Description of Artificial Sequence: Synthetic polypeptide
DESEIRSTNPVATEPYGSVCIWVQNDQRDQQRGSNGS

SEQ ID NO: 180061 - protein, 36 aa, Artificial Sequence
  Description of Artificial Sequence: Synthetic polypeptide
DEEEIRTTNPVATEQYGFICQCNPNEIGQEQEANNE

SEQ ID NO: 180062 - protein, 37 aa, Artificial Sequence
  Description of Artificial Sequence: Synthetic polypeptide
DESEIRSTNPVATEPYGSVCIWVQNDQRDERRGSNPS

SEQ ID NO: 180063 - protein, 37 aa, Artificial Sequence
  Description of Artificial Sequence: Synthetic polypeptide
DEEEIRTTNPVATEQYGFICQCTLPNEIGQEQEANNQ

SEQ ID NO: 180064 - protein, 37 aa, Artificial Sequence
  Description of Artificial Sequence: Synthetic polypeptide
DEEEIRTTNPVATEQYGFICQCTPNDIGQEQEANAHQ

SEQ ID NO: 180065 - protein, 36 aa, Artificial Sequence
  Description of Artificial Sequence: Synthetic polypeptide
DENEIRTTNPVATEQYGCVDTEENGSVETGEKSQVE

SEQ ID NO: 180066 - protein, 32 aa, Artificial Sequence
  Description of Artificial Sequence: Synthetic polypeptide
DSEDIATTNPVATEQWGCVAGEGHQNPAVGDL

SEQ ID NO: 180067 - protein, 37 aa, Artificial Sequence
  Description of Artificial Sequence: Synthetic polypeptide
DEEEIRTTNPVATEQYGFICQCTPNDIGQEQEENNQQ

SEQ ID NO: 180068 - protein, 37 aa, Artificial Sequence
  Description of Artificial Sequence: Synthetic polypeptide
DESEIRSTNPVATEPYGSVCIWVQNDQDDQRRGDNPS

SEQ ID NO: 180069 - protein, 32 aa, Artificial Sequence
  Description of Artificial Sequence: Synthetic polypeptide
DSEDIATTNPVATEQWGCVAGEGHQPAVANLH

SEQ ID NO: 180070 - protein, 36 aa, Artificial Sequence
  Description of Artificial Sequence: Synthetic polypeptide
DENEIRTTNPVATEQYGCVDTDVENGSVETENSQVE

SEQ ID NO: 180071 - protein, 36 aa, Artificial Sequence
  Description of Artificial Sequence: Synthetic polypeptide
DENEIRTTNPVATEQYGCVDTDLENGSVETEGEQVE

SEQ ID NO: 180072 - protein, 37 aa, Artificial Sequence
  Description of Artificial Sequence: Synthetic polypeptide
DEEEIRTTNPVATEQYGFICQCYTPNDIGQEVEANNQ

SEQ ID NO: 180073 - protein, 36 aa, Artificial Sequence
  Description of Artificial Sequence: Synthetic polypeptide
DENEIRTTNPVATEQYGCVDTDGENGSDLTEESQVE

SEQ ID NO: 180074 - protein, 32 aa, Artificial Sequence
  Description of Artificial Sequence: Synthetic polypeptide
DSEDIATTNPVATEQWGGCVAGEGDQPAVGLY

SEQ ID NO: 180075 - protein, 36 aa, Artificial Sequence
  Description of Artificial Sequence: Synthetic polypeptide
DEAEISTTNPVATEQYGCVCSTMEDHNAEYFGSDQA

SEQ ID NO: 180076 - protein, 32 aa, Artificial Sequence
  Description of Artificial Sequence: Synthetic polypeptide
DSEDIATTNPVATEQWGGCVAGEGHQPAPGGL

SEQ ID NO: 180077 - protein, 33 aa, Artificial Sequence
  Description of Artificial Sequence: Synthetic polypeptide
DSEDIATTNPVATEQWGGCVAGEGHQRVENDLM

SEQ ID NO: 180078 - protein, 32 aa, Artificial Sequence
  Description of Artificial Sequence: Synthetic polypeptide
DSEDIATTNPVATEQWGGCVAGEGHQRVMDLD

SEQ ID NO: 180079 - protein, 33 aa, Artificial Sequence
  Description of Artificial Sequence: Synthetic polypeptide
DSEDIATTNPVATEQWGGCVAGEGNHQPAVGPL

SEQ ID NO: 180080 - protein, 35 aa, Artificial Sequence
  Description of Artificial Sequence: Synthetic polypeptide
DENEIRTTNPVATEQYGCVDTDENGSVETESSQQE

SEQ ID NO: 180081 - protein, 36 aa, Artificial Sequence
  Description of Artificial Sequence: Synthetic polypeptide
DEEAIRTTNPVATEQYGCVCSWGEDHNQENFNSDQA

SEQ ID NO: 180082 - protein, 36 aa, Artificial Sequence
  Description of Artificial Sequence: Synthetic polypeptide
DEEAIRTTNPVATEQYGCVCSWGEHNAENFNSENQP

SEQ ID NO: 180083 - protein, 36 aa, Artificial Sequence
  Description of Artificial Sequence: Synthetic polypeptide
DEAEISTTNPVATEQYGCVCSTWEEHNQENFGSDQS

SEQ ID NO: 180084 - protein, 36 aa, Artificial Sequence
  Description of Artificial Sequence: Synthetic polypeptide
DSECISTTNPVAYEQYGMVSVTGTEHAQTFTGGNRW

SEQ ID NO: 180085 - protein, 36 aa, Artificial Sequence
  Description of Artificial Sequence: Synthetic polypeptide
DECEICTTNPVATEQYGVVSTVNAEQGSTEEQEEDE

SEQ ID NO: 180086 - protein, 36 aa, Artificial Sequence
  Description of Artificial Sequence: Synthetic polypeptide
DEEEIRTTNPVATEQYGFCVYPSPVHMPNVDMPFEG

SEQ ID NO: 180087 - protein, 37 aa, Artificial Sequence
  Description of Artificial Sequence: Synthetic polypeptide
DEEAIRTTNPVATEQYGCVCSTWEEHNQENFNSDNQA

SEQ ID NO: 180088 - protein, 34 aa, Artificial Sequence
  Description of Artificial Sequence: Synthetic polypeptide
DEDEIRGTNPVATEGWGSVSAGMEGQGGEGEQTP

SEQ ID NO: 180089 - protein, 34 aa, Artificial Sequence
  Description of Artificial Sequence: Synthetic polypeptide
DSAEISSTNPVAYEQWGSQISCTGNHGRTGGNNN

SEQ ID NO: 180090 - protein, 34 aa, Artificial Sequence
  Description of Artificial Sequence: Synthetic polypeptide
DSAEISTTNPVAYTQWGSTVPSTPTSMRGGNMGT

SEQ ID NO: 180091 - protein, 32 aa, Artificial Sequence
  Description of Artificial Sequence: Synthetic polypeptide
SEEEIRCTNPTAYECWGCVWGENDMHRTGNSL

SEQ ID NO: 180092 - protein, 33 aa, Artificial Sequence
  Description of Artificial Sequence: Synthetic polypeptide
DEQEIATTNPVSTEPYGTISAMEDLQQQHNGEH

SEQ ID NO: 180093 - protein, 34 aa, Artificial Sequence
  Description of Artificial Sequence: Synthetic polypeptide
DESEIRTTNPVAYESYGHVCCLGNHSHTRGGTEL

SEQ ID NO: 180094 - protein, 36 aa, Artificial Sequence
  Description of Artificial Sequence: Synthetic polypeptide
DEEAIRTTNPVATEQYGCVCSNTGEHEQENFISDQA

SEQ ID NO: 180095 - protein, 35 aa, Artificial Sequence
  Description of Artificial Sequence: Synthetic polypeptide
DEEEIRTTNPCATEGYGQCCCSTGEHNAYFGSDQS

SEQ ID NO: 180096 - protein, 35 aa, Artificial Sequence
  Description of Artificial Sequence: Synthetic polypeptide
DEEEIRTTNPCATEGYGCVCQSGEHNQNFGSDTAS

SEQ ID NO: 180097 - protein, 32 aa, Artificial Sequence
  Description of Artificial Sequence: Synthetic polypeptide
DDSEVASTNPVSTEGYGNVAANTIQSRVGEQR

SEQ ID NO: 180098 - protein, 36 aa, Artificial Sequence
  Description of Artificial Sequence: Synthetic polypeptide
DENEIRTTNPVATEQYGCVRTDHENGSLGTEESQVE

SEQ ID NO: 180099 - protein, 34 aa, Artificial Sequence
  Description of Artificial Sequence: Synthetic polypeptide
DEEEIRTTNPCATEGYGCCCSWEDLAENFGSDQA

SEQ ID NO: 180100 - protein, 34 aa, Artificial Sequence
  Description of Artificial Sequence: Synthetic polypeptide
CEEAIRTTNPCAYEQWGEVAPTWENDQRKGGHEQ

SEQ ID NO: 180101 - protein, 37 aa, Artificial Sequence
  Description of Artificial Sequence: Synthetic polypeptide
DEEEIRTTNPVAYEHYGSLVYACTAAISQNSGMSPRV

SEQ ID NO: 180102 - protein, 36 aa, Artificial Sequence
  Description of Artificial Sequence: Synthetic polypeptide
DEEEIRTTNPVAYEHYGKVPATTPAGPTTRNGGNPV

SEQ ID NO: 180103 - protein, 34 aa, Artificial Sequence
  Description of Artificial Sequence: Synthetic polypeptide
DEEEIRTTNPCATEGYGCCCSTGEDNAYFNSDQS

SEQ ID NO: 180104 - protein, 36 aa, Artificial Sequence
  Description of Artificial Sequence: Synthetic polypeptide
DEEAIRTTNPVATEQYGCVCSNWGEHNANFNSENQA

SEQ ID NO: 180105 - protein, 37 aa, Artificial Sequence
  Description of Artificial Sequence: Synthetic polypeptide
DEEAIRTTNPVATEQYGCVCSNWGEHNQENFGSDNQS

SEQ ID NO: 180106 - protein, 36 aa, Artificial Sequence
  Description of Artificial Sequence: Synthetic polypeptide
DEEAIRTTNPVATEQYGCVCSNWGEHNQENFNSQQS

SEQ ID NO: 180107 - protein, 36 aa, Artificial Sequence
  Description of Artificial Sequence: Synthetic polypeptide
DENEIRTTNPVATEQYGCVHTDENGSVETHEGSQVE

SEQ ID NO: 180108 - protein, 36 aa, Artificial Sequence
  Description of Artificial Sequence: Synthetic polypeptide
CEEEISTTNPVATEQYGCVCSNSGELNQNFNSDTQS

SEQ ID NO: 180109 - protein, 36 aa, Artificial Sequence
  Description of Artificial Sequence: Synthetic polypeptide
DEAEISTTNPVATEQYGCVCSTGEDLNAYFGSDTQS

SEQ ID NO: 180110 - protein, 35 aa, Artificial Sequence
  Description of Artificial Sequence: Synthetic polypeptide
DENEIRTTNPVATEQYGCVFPPIELQANSQQEPHI

SEQ ID NO: 180111 - protein, 34 aa, Artificial Sequence
  Description of Artificial Sequence: Synthetic polypeptide
DEEEIRTTNPCATEGYGCCCSNTGEHAYFGSDQS

SEQ ID NO: 180112 - protein, 36 aa, Artificial Sequence
  Description of Artificial Sequence: Synthetic polypeptide
DEAEISTTNPVATEQYGCVCSTGEEHNAEYFGSDQS

SEQ ID NO: 180113 - protein, 36 aa, Artificial Sequence
  Description of Artificial Sequence: Synthetic polypeptide
DEAEISTTNPVATEQYGCVCSTGEHNAEYFISDNQS

SEQ ID NO: 180114 - protein, 34 aa, Artificial Sequence
  Description of Artificial Sequence: Synthetic polypeptide
SEEEIRCTNPTAYECWGSTVYGENDDHHRNGDNR

SEQ ID NO: 180115 - protein, 37 aa, Artificial Sequence
  Description of Artificial Sequence: Synthetic polypeptide
DECEICTTNPVATEQYGVVSTVNADQQGTTEDEEDEE

SEQ ID NO: 180116 - protein, 34 aa, Artificial Sequence
  Description of Artificial Sequence: Synthetic polypeptide
DEEEIRTTNPCATEEYGCVCQWGEHNTNFGSDAM

SEQ ID NO: 180117 - protein, 38 aa, Artificial Sequence
  Description of Artificial Sequence: Synthetic polypeptide
DECEICTTNPVATEQYGVVSTTVVNQAGNLQQGTDEAT

SEQ ID NO: 180118 - protein, 34 aa, Artificial Sequence
  Description of Artificial Sequence: Synthetic polypeptide
DEEEIRTTNPCATEEYGCVCGWGEHNANFGSDQA

SEQ ID NO: 180119 - protein, 35 aa, Artificial Sequence
  Description of Artificial Sequence: Synthetic polypeptide
TSEEIQTTNPVAWEWWGSTVPSTNAASVNRDGNLV

SEQ ID NO: 180120 - protein, 35 aa, Artificial Sequence
  Description of Artificial Sequence: Synthetic polypeptide
DEEEIRTTNPCATEEYGCVCGTGEHNIHFGSDTAA

SEQ ID NO: 180121 - protein, 35 aa, Artificial Sequence
  Description of Artificial Sequence: Synthetic polypeptide
DEEEIRTTNPCATEEYGCVCGTGEHNGENFNSDAA

SEQ ID NO: 180122 - protein, 34 aa, Artificial Sequence
  Description of Artificial Sequence: Synthetic polypeptide
DEDEIRGTNPVATEGWGSVSAGMEGQGGEDEQGI

SEQ ID NO: 180123 - protein, 32 aa, Artificial Sequence
  Description of Artificial Sequence: Synthetic polypeptide
DDSEVASTNPVSTEGYGNVAANTIQSRVGGQR

SEQ ID NO: 180124 - protein, 35 aa, Artificial Sequence
  Description of Artificial Sequence: Synthetic polypeptide
DSEEIGTTNPVATEQYGKVVHCANAPSHLVVTHNA

SEQ ID NO: 180125 - protein, 36 aa, Artificial Sequence
  Description of Artificial Sequence: Synthetic polypeptide
DEEEIRTTNPCATEEYGCVCGSGEHNTENFGSDNAA

SEQ ID NO: 180126 - protein, 35 aa, Artificial Sequence
  Description of Artificial Sequence: Synthetic polypeptide
DEAEISTTNPVATEQYGCVCSWGEHEINFGSDNQS

SEQ ID NO: 180127 - protein, 37 aa, Artificial Sequence
  Description of Artificial Sequence: Synthetic polypeptide
DECEICTTNPVATEQYGVVSTTNQQQQNNQQGTTTTD

SEQ ID NO: 180128 - protein, 37 aa, Artificial Sequence
  Description of Artificial Sequence: Synthetic polypeptide
DENEIRTTNPVATEQYGCTVTTVCLDDEGENLQIDEI

SEQ ID NO: 180129 - protein, 36 aa, Artificial Sequence
  Description of Artificial Sequence: Synthetic polypeptide
DDNEIRTTNPVATEQYGSVWVLEMSEEQPEGNAIKN

SEQ ID NO: 180130 - protein, 36 aa, Artificial Sequence
  Description of Artificial Sequence: Synthetic polypeptide
DDNEIRTTNPVATEQYGSVVWVLPNDEFPEGNLIKN

SEQ ID NO: 180131 - protein, 37 aa, Artificial Sequence
  Description of Artificial Sequence: Synthetic polypeptide
DENEIRTTNPVATEQYGCSCSVEQPALDEPQIGESID

SEQ ID NO: 180132 - protein, 33 aa, Artificial Sequence
  Description of Artificial Sequence: Synthetic polypeptide
DDNEIRTTNPVATEQYGSCWAEDWGNGMSSQDH

SEQ ID NO: 180133 - protein, 36 aa, Artificial Sequence
  Description of Artificial Sequence: Synthetic polypeptide
DEEEIRTTNPVATEQWGSTWATTPAGPAMRNGMPYV

SEQ ID NO: 180134 - protein, 32 aa, Artificial Sequence
  Description of Artificial Sequence: Synthetic polypeptide
DDSEVASTNPVSTEGYGNVAANTIQSRVGHQR

SEQ ID NO: 180135 - protein, 32 aa, Artificial Sequence
  Description of Artificial Sequence: Synthetic polypeptide
DDSEVASTNPVSTEGYGNVAANTIQSRVGHSR

SEQ ID NO: 180136 - protein, 35 aa, Artificial Sequence
  Description of Artificial Sequence: Synthetic polypeptide
DEEAIRTTNPVATEQYGSWNSTEQIDDDEVEEEEG

SEQ ID NO: 180137 - protein, 36 aa, Artificial Sequence
  Description of Artificial Sequence: Synthetic polypeptide
DENEIRTTNPVATEQYGCCYVADNDVEQLEPGEDTD

SEQ ID NO: 180138 - protein, 36 aa, Artificial Sequence
  Description of Artificial Sequence: Synthetic polypeptide
DENEIRTTNPVATEQYGCCWVAQVLVEQGEPGEDLV

SEQ ID NO: 180139 - protein, 35 aa, Artificial Sequence
  Description of Artificial Sequence: Synthetic polypeptide
DEEAIRTTNPVATEQYGYAVVTLVSHFENTSEEFQ

SEQ ID NO: 180140 - protein, 35 aa, Artificial Sequence
  Description of Artificial Sequence: Synthetic polypeptide
DENEIRTTNPVATEQYGCCWVAQVDVENGEPGEDV

SEQ ID NO: 180141 - protein, 35 aa, Artificial Sequence
  Description of Artificial Sequence: Synthetic polypeptide
DEACISTTNPVATEQYGCVCSTGEHEQENFGSDQS

SEQ ID NO: 180142 - protein, 35 aa, Artificial Sequence
  Description of Artificial Sequence: Synthetic polypeptide
DEAEISTTNPVATEQYGCVCSWEHNQENFNSDTQS

SEQ ID NO: 180143 - protein, 35 aa, Artificial Sequence
  Description of Artificial Sequence: Synthetic polypeptide
DEEEIRTTNPCATEEYGQCVCGSEHNAENFGSDAA

SEQ ID NO: 180144 - protein, 35 aa, Artificial Sequence
  Description of Artificial Sequence: Synthetic polypeptide
DEEEIRTTNPCATEEYGCVCGWNHNTENFGSDNAA

SEQ ID NO: 180145 - protein, 36 aa, Artificial Sequence
  Description of Artificial Sequence: Synthetic polypeptide
DENEIRTTNPVATEQYGCVCSWEEDTEQENFNSEQN

SEQ ID NO: 180146 - protein, 37 aa, Artificial Sequence
  Description of Artificial Sequence: Synthetic polypeptide
DENEIRTTNPVATEQYGCVDTDAENGSDLTQEESQQE

SEQ ID NO: 180147 - protein, 36 aa, Artificial Sequence
  Description of Artificial Sequence: Synthetic polypeptide
DENEIRTTNPVATEQYGCVDTDAENGSDETENSQSE

SEQ ID NO: 180148 - protein, 36 aa, Artificial Sequence
  Description of Artificial Sequence: Synthetic polypeptide
DEEEIRTTNPVAYEEWGCSVSCTTGFSSDSGEGNSA

SEQ ID NO: 180149 - protein, 36 aa, Artificial Sequence
  Description of Artificial Sequence: Synthetic polypeptide
DEEEIRTTNPVAYEEWGCSVACTITGFSQSGEGNSA

SEQ ID NO: 180150 - protein, 30 aa, Artificial Sequence
  Description of Artificial Sequence: Synthetic polypeptide
DDNEVASTNPVSTEPYGNIAMTIQSRVGQR

SEQ ID NO: 180151 - protein, 32 aa, Artificial Sequence
  Description of Artificial Sequence: Synthetic polypeptide
DDSEVASTNPVSTEGYGNVAANTIQSRVGERT

SEQ ID NO: 180152 - protein, 34 aa, Artificial Sequence
  Description of Artificial Sequence: Synthetic polypeptide
DEEEIRTTNPCATEEYGCVCQTGEHNANFNSDAM

SEQ ID NO: 180153 - protein, 34 aa, Artificial Sequence
  Description of Artificial Sequence: Synthetic polypeptide
DEEEIRTTNPCATEEYGCVCQTGEDHAYFGSDAA

SEQ ID NO: 180154 - protein, 36 aa, Artificial Sequence
  Description of Artificial Sequence: Synthetic polypeptide
DSEEIATTNPVAVENWGTVVSCEDNALSQTNGGNQR

SEQ ID NO: 180155 - protein, 36 aa, Artificial Sequence
  Description of Artificial Sequence: Synthetic polypeptide
DENEIRTTNPVATEQYGCVDTDADNGSNETEESQVE

SEQ ID NO: 180156 - protein, 32 aa, Artificial Sequence
  Description of Artificial Sequence: Synthetic polypeptide
DDNEVASTNPVSTEGYGNVAANNTIQSRVGQR

SEQ ID NO: 180157 - protein, 32 aa, Artificial Sequence
  Description of Artificial Sequence: Synthetic polypeptide
DDSEVASTNPVSTEGYGNVAANTIQSRVGFQR

SEQ ID NO: 180158 - protein, 35 aa, Artificial Sequence
  Description of Artificial Sequence: Synthetic polypeptide
DEAEISTTNPVATEQYGCVCSWEDDNAEYFNSDQS

SEQ ID NO: 180159 - protein, 37 aa, Artificial Sequence
  Description of Artificial Sequence: Synthetic polypeptide
DEEAIRTTNPVATEQYGQCVCSWGEHNQENFGSDNQS

SEQ ID NO: 180160 - protein, 36 aa, Artificial Sequence
  Description of Artificial Sequence: Synthetic polypeptide
DENEIRTTNPVATEQYGCVDTDAANGSDETEQSQVE

SEQ ID NO: 180161 - protein, 35 aa, Artificial Sequence
  Description of Artificial Sequence: Synthetic polypeptide
DEEAIRTTNPVATEQYGSGNSTEPWDDDEVEEEEG

SEQ ID NO: 180162 - protein, 37 aa, Artificial Sequence
  Description of Artificial Sequence: Synthetic polypeptide
DEEAIRTTNPVATEQYGSIMNGTETLDDDTGSNGFQI

SEQ ID NO: 180163 - protein, 38 aa, Artificial Sequence
  Description of Artificial Sequence: Synthetic polypeptide
DEEAIRTTNPVATEQYGSIVNGTETLDDFTGSNYEFQI

SEQ ID NO: 180164 - protein, 38 aa, Artificial Sequence
  Description of Artificial Sequence: Synthetic polypeptide
DEEAIRTTNPVATEQYGSIVNGTETLDDNTGSNIGGQI

SEQ ID NO: 180165 - protein, 38 aa, Artificial Sequence
  Description of Artificial Sequence: Synthetic polypeptide
DEEAIRTTNPVATEQYGSIVNGTETLTDSQTDSNEFQI

SEQ ID NO: 180166 - protein, 37 aa, Artificial Sequence
  Description of Artificial Sequence: Synthetic polypeptide
DEEAIRTTNPVATEQYGSIVNSTEQWDDDLRVEEEEG

SEQ ID NO: 180167 - protein, 37 aa, Artificial Sequence
  Description of Artificial Sequence: Synthetic polypeptide
DEEAIRTTNPVATEQYGSIWNGTETHDDQTGSNEFQI

SEQ ID NO: 180168 - protein, 36 aa, Artificial Sequence
  Description of Artificial Sequence: Synthetic polypeptide
CEEEISTTNPVATEQYGCVCSNSMEDQENFGSDNQS

SEQ ID NO: 180169 - protein, 35 aa, Artificial Sequence
  Description of Artificial Sequence: Synthetic polypeptide
DEAEISTTNPVATEQYGCVCSWEEDHQENFGSDQS

SEQ ID NO: 180170 - protein, 36 aa, Artificial Sequence
  Description of Artificial Sequence: Synthetic polypeptide
DEEEIRTTNPVATEQYGGVGYIMEAIANHQMQMSVQ

SEQ ID NO: 180171 - protein, 36 aa, Artificial Sequence
  Description of Artificial Sequence: Synthetic polypeptide
DEEEIRTTNPVATEQYGGVIVAVDEQIENTEEANIM

SEQ ID NO: 180172 - protein, 35 aa, Artificial Sequence
  Description of Artificial Sequence: Synthetic polypeptide
DENEIRTTNPVATEQYGCCTVADVDVEQLEPGIDT

SEQ ID NO: 180173 - protein, 35 aa, Artificial Sequence
  Description of Artificial Sequence: Synthetic polypeptide
SEEEIRCTNPTAYECWGSTVYGETNDIMHRGDNGR

SEQ ID NO: 180174 - protein, 33 aa, Artificial Sequence
  Description of Artificial Sequence: Synthetic polypeptide
SEEEIRCTNPTAYECWGSVYGENDDMERNGDVR

SEQ ID NO: 180175 - protein, 31 aa, Artificial Sequence
  Description of Artificial Sequence: Synthetic polypeptide
DDSEVASTNPVSTEGYGNVAANTIQSRVAQR

SEQ ID NO: 180176 - protein, 36 aa, Artificial Sequence
  Description of Artificial Sequence: Synthetic polypeptide
DEEAICTTNPVATEAYGSVAVTNNNDQQGTEEQEED

SEQ ID NO: 180177 - protein, 31 aa, Artificial Sequence
  Description of Artificial Sequence: Synthetic polypeptide
DDSAVASTNPVSTEGYGNVAANFIQSRVGQR

SEQ ID NO: 180178 - protein, 31 aa, Artificial Sequence
  Description of Artificial Sequence: Synthetic polypeptide
DDSEVASTNPVSTEGYGNVAANTIQSRVDQR

SEQ ID NO: 180179 - protein, 37 aa, Artificial Sequence
  Description of Artificial Sequence: Synthetic polypeptide
DEEEIRTTNPVAYEPYGISVGNTVNSLHPDGGIKDTD

SEQ ID NO: 180180 - protein, 38 aa, Artificial Sequence
  Description of Artificial Sequence: Synthetic polypeptide
DEEEIRTTNPVATEQYGSVTLAHATNDQVSMIAFEQAE

SEQ ID NO: 180181 - protein, 38 aa, Artificial Sequence
  Description of Artificial Sequence: Synthetic polypeptide
DEEEIRTTNPVATEQYGESYSVNTVGVSDVRTENTELN

SEQ ID NO: 180182 - protein, 38 aa, Artificial Sequence
  Description of Artificial Sequence: Synthetic polypeptide
DEEEIRTTNPVATEQYGETCVTPNENVEMQVEGNVELS

SEQ ID NO: 180183 - protein, 37 aa, Artificial Sequence
  Description of Artificial Sequence: Synthetic polypeptide
DEEAICTVNPVATEAYGSVSTVNNQQQENNNGNNNQE

SEQ ID NO: 180184 - protein, 36 aa, Artificial Sequence
  Description of Artificial Sequence: Synthetic polypeptide
DEEAICTVNPVATEAYGSVSTVNQQQNNNNNNNNQD

SEQ ID NO: 180185 - protein, 31 aa, Artificial Sequence
  Description of Artificial Sequence: Synthetic polypeptide
DDSEVASTNPVSTEGYGNVAANTIQSRVEER

SEQ ID NO: 180186 - protein, 36 aa, Artificial Sequence
  Description of Artificial Sequence: Synthetic polypeptide
DEAEISTTNPVATEQYGCVCSTEEDHNQENFGSDQS

SEQ ID NO: 180187 - protein, 37 aa, Artificial Sequence
  Description of Artificial Sequence: Synthetic polypeptide
DEEAICTVNPVATEAYGSVSTVTNNQQGNQQGNNNQE

SEQ ID NO: 180188 - protein, 37 aa, Artificial Sequence
  Description of Artificial Sequence: Synthetic polypeptide
DEEAICTVNPVATEAYGSVSTVVNDQQGNNQGNNDTE

SEQ ID NO: 180189 - protein, 37 aa, Artificial Sequence
  Description of Artificial Sequence: Synthetic polypeptide
DEEAICTVNPVATEAYGVVSTDTNLQQGNNQGTNDEE

SEQ ID NO: 180190 - protein, 35 aa, Artificial Sequence
  Description of Artificial Sequence: Synthetic polypeptide
CEEEIATTNPVATEQYGSACAAANPLAEAEMNGFF

SEQ ID NO: 180191 - protein, 36 aa, Artificial Sequence
  Description of Artificial Sequence: Synthetic polypeptide
DEAEIRTTNPVATEQYGESHSCAVEDLTQETSEDLQ

SEQ ID NO: 180192 - protein, 35 aa, Artificial Sequence
  Description of Artificial Sequence: Synthetic polypeptide
DDQEIATTNPVATEQYGSVTATPDLEDHINIIDLY

SEQ ID NO: 180193 - protein, 35 aa, Artificial Sequence
  Description of Artificial Sequence: Synthetic polypeptide
DDQEIATTNPVATEQYGSVTATPDLEDHIGQQDLY

SEQ ID NO: 180194 - protein, 35 aa, Artificial Sequence
  Description of Artificial Sequence: Synthetic polypeptide
DQEEISTTNPVATCQYGCVCSWEGDNQNFGSDNQS

SEQ ID NO: 180195 - protein, 34 aa, Artificial Sequence
  Description of Artificial Sequence: Synthetic polypeptide
DDQEIATTNPVATEQYGSVTATPDGEDHEGEDKY

SEQ ID NO: 180196 - protein, 38 aa, Artificial Sequence
  Description of Artificial Sequence: Synthetic polypeptide
DECEICTTNPVATEQYGVVSTVNQQGNTQQGTTEENGQ

SEQ ID NO: 180197 - protein, 34 aa, Artificial Sequence
  Description of Artificial Sequence: Synthetic polypeptide
DEQEIATTNPAVATLQYGGSVSATDYEDEEDEDL

SEQ ID NO: 180198 - protein, 37 aa, Artificial Sequence
  Description of Artificial Sequence: Synthetic polypeptide
DEEEIRTTNPVATEQYGETYPPVDLSEDPIRQVDQNI

SEQ ID NO: 180199 - protein, 39 aa, Artificial Sequence
  Description of Artificial Sequence: Synthetic polypeptide
DEEEIRTTNPVATEQYGETYSFPNENVQMQAREGNVELS

SEQ ID NO: 180200 - protein, 36 aa, Artificial Sequence
  Description of Artificial Sequence: Synthetic polypeptide
DEEEIRTTNPVAYEPYGISVSNTVVMLHPDIAIKDT

SEQ ID NO: 180201 - protein, 37 aa, Artificial Sequence
  Description of Artificial Sequence: Synthetic polypeptide
DEEEIRTTNPVATEQYGSVTPISMGFEEVPEGEVPEI

SEQ ID NO: 180202 - protein, 34 aa, Artificial Sequence
  Description of Artificial Sequence: Synthetic polypeptide
DEEAIATTNPVAYERWGQATTNGGDHQGGDNPHR

SEQ ID NO: 180203 - protein, 31 aa, Artificial Sequence
  Description of Artificial Sequence: Synthetic polypeptide
DDSEVASTNPVSTEGYGNVAANTIQSRTSQR

SEQ ID NO: 180204 - protein, 36 aa, Artificial Sequence
  Description of Artificial Sequence: Synthetic polypeptide
DEAEIRTTNPVATEQYGIYSCPTLVLFDNIGEEVID

SEQ ID NO: 180205 - protein, 31 aa, Artificial Sequence
  Description of Artificial Sequence: Synthetic polypeptide
DDSCVASTNPVSTEGYGDVAANTIQSRVGQR

SEQ ID NO: 180206 - protein, 34 aa, Artificial Sequence
  Description of Artificial Sequence: Synthetic polypeptide
DEDEIRGTNPVATEGWGVSVSAGMEGQDGEGEGG

SEQ ID NO: 180207 - protein, 36 aa, Artificial Sequence
  Description of Artificial Sequence: Synthetic polypeptide
DEAEIRTTNPVATEQYGHYYNNVSEETDSDTSGEMD

SEQ ID NO: 180208 - protein, 31 aa, Artificial Sequence
  Description of Artificial Sequence: Synthetic polypeptide
DDSEVASTNPVSTEGYGNVAANTIQSRPGQA

SEQ ID NO: 180209 - protein, 36 aa, Artificial Sequence
  Description of Artificial Sequence: Synthetic polypeptide
DEEAEIATTNPVAYERWGSVSGGNADDSRNGNNGNS

SEQ ID NO: 180210 - protein, 36 aa, Artificial Sequence
  Description of Artificial Sequence: Synthetic polypeptide
DEDEIRGTNPVATEGWGSVSVAINGEGQDGEGENGF

SEQ ID NO: 180211 - protein, 34 aa, Artificial Sequence
  Description of Artificial Sequence: Synthetic polypeptide
DEEAEIATTNPVAYESWGEVAWTDNQQDQQTMDR

SEQ ID NO: 180212 - protein, 36 aa, Artificial Sequence
  Description of Artificial Sequence: Synthetic polypeptide
DEEAEICTTNPVAYEQWGSVCSGEGNQATNGNNGMT

SEQ ID NO: 180213 - protein, 36 aa, Artificial Sequence
  Description of Artificial Sequence: Synthetic polypeptide
AEDEICATNPVATEQYGVVATTNENNQLQLGNTEDD

SEQ ID NO: 180214 - protein, 36 aa, Artificial Sequence
  Description of Artificial Sequence: Synthetic polypeptide
DEEEIRTTNPVATEQYGENCRFPAVEEASTQNVNGD

SEQ ID NO: 180215 - protein, 36 aa, Artificial Sequence
  Description of Artificial Sequence: Synthetic polypeptide
DEEEIRTTNPVATEQYGENSCRSPAVEEASTQEVLD

SEQ ID NO: 180216 - protein, 32 aa, Artificial Sequence
  Description of Artificial Sequence: Synthetic polypeptide
DDSEVASTNPVSTEGYGNVAANTIQSRQGQRE

SEQ ID NO: 180217 - protein, 32 aa, Artificial Sequence
  Description of Artificial Sequence: Synthetic polypeptide
DDSEVASTNPVSTEGYGNVAANTIQSRSGAQR

SEQ ID NO: 180218 - protein, 35 aa, Artificial Sequence
  Description of Artificial Sequence: Synthetic polypeptide
DEEAEIRTTNPVAYEHWGEVSGGNQGNEGGGMGER

SEQ ID NO: 180219 - protein, 36 aa, Artificial Sequence
  Description of Artificial Sequence: Synthetic polypeptide
DENEIRTTNPVATEQYGDVVVDDFNFGQGEGDTSET

SEQ ID NO: 180220 - protein, 31 aa, Artificial Sequence
  Description of Artificial Sequence: Synthetic polypeptide
DESEIRSTNPVGTEGYGVTWANATWAEHGDI

SEQ ID NO: 180221 - protein, 31 aa, Artificial Sequence
  Description of Artificial Sequence: Synthetic polypeptide
DDSAVASTNPVSTEGYGNVAANTIQSRVGQR

SEQ ID NO: 180222 - protein, 37 aa, Artificial Sequence
  Description of Artificial Sequence: Synthetic polypeptide
DEEAEIRTTNPVAYEQWGEVCSTPNNGNHGEGGGGRN

SEQ ID NO: 180223 - protein, 38 aa, Artificial Sequence
  Description of Artificial Sequence: Synthetic polypeptide
DEEEIRTTNPVATEQYGSVTHTTDEDHCYQENYEEDGR

SEQ ID NO: 180224 - protein, 36 aa, Artificial Sequence
  Description of Artificial Sequence: Synthetic polypeptide
DEEAEIRTTNPVAYEQWGSVCYMNDNHDRGGGGDIS

SEQ ID NO: 180225 - protein, 37 aa, Artificial Sequence
  Description of Artificial Sequence: Synthetic polypeptide
DEEAEIRTTNPVAYEQWGSVSGGEPAGPNMRNGGGPV

SEQ ID NO: 180226 - protein, 36 aa, Artificial Sequence
  Description of Artificial Sequence: Synthetic polypeptide
DEEEIRTTNPVAYEPYGISVSNVVVSNHPDRIKDTS

SEQ ID NO: 180227 - protein, 35 aa, Artificial Sequence
  Description of Artificial Sequence: Synthetic polypeptide
DEEAIATTNPVATEPWGISVCSYFIPVSQMGGNNG

SEQ ID NO: 180228 - protein, 36 aa, Artificial Sequence
  Description of Artificial Sequence: Synthetic polypeptide
AEDEICATNPVATEQYGVVATTNENNLNQLGNGEDD

SEQ ID NO: 180229 - protein, 36 aa, Artificial Sequence
  Description of Artificial Sequence: Synthetic polypeptide
DEEEIRTTNPVAYEPYGISVSNTVVSLHPDMIKDTV

SEQ ID NO: 180230 - protein, 34 aa, Artificial Sequence
  Description of Artificial Sequence: Synthetic polypeptide
SEEEIRCTNPTAYECWGSVYGEINDDMHRGDNKR

SEQ ID NO: 180231 - protein, 37 aa, Artificial Sequence
  Description of Artificial Sequence: Synthetic polypeptide
DEEEIRTTNPVATEQYGSVTPLPPVLEAVMIGDVHSI

SEQ ID NO: 180232 - protein, 37 aa, Artificial Sequence
  Description of Artificial Sequence: Synthetic polypeptide
DEEAIRCTNPVATEQYGVISVSVRVLEQDTPNGMQED

SEQ ID NO: 180233 - protein, 36 aa, Artificial Sequence
  Description of Artificial Sequence: Synthetic polypeptide
DENEIRTTNPVATEQYGCVVDTDENGSVETEGSQTE

SEQ ID NO: 180234 - protein, 36 aa, Artificial Sequence
  Description of Artificial Sequence: Synthetic polypeptide
DENEIRTTNPVATEQYGCVVDTDENGEVETEGSQVE

SEQ ID NO: 180235 - protein, 34 aa, Artificial Sequence
  Description of Artificial Sequence: Synthetic polypeptide
SEEEIRCTNPTAYEQWGSTVYGERDMNRGGDNKR

SEQ ID NO: 180236 - protein, 35 aa, Artificial Sequence
  Description of Artificial Sequence: Synthetic polypeptide
SEEEIRCTNPTAYEQWGSTVYGENMDEHRGGDNVR

SEQ ID NO: 180237 - protein, 32 aa, Artificial Sequence
  Description of Artificial Sequence: Synthetic polypeptide
DDSEVASTNPVSTEGYGNVAANTIQSRVGAQR

SEQ ID NO: 180238 - protein, 39 aa, Artificial Sequence
  Description of Artificial Sequence: Synthetic polypeptide
DECEICTTNPVATEQYGVVSTVNNQQQQLQAGTNNNDDD

SEQ ID NO: 180239 - protein, 33 aa, Artificial Sequence
  Description of Artificial Sequence: Synthetic polypeptide
CEDWIATTNPVATAQWGSVPAANNLTEAPGGNH

SEQ ID NO: 180240 - protein, 34 aa, Artificial Sequence
  Description of Artificial Sequence: Synthetic polypeptide
SEEEIRCTNPTAYEQWGSTVYGENHDIHRGDQIR

SEQ ID NO: 180241 - protein, 33 aa, Artificial Sequence
  Description of Artificial Sequence: Synthetic polypeptide
SEEEIRCTNPTAYEQWGSTVYGENHDIHREDRR

SEQ ID NO: 180242 - protein, 34 aa, Artificial Sequence
  Description of Artificial Sequence: Synthetic polypeptide
SEEEIRCTNPTAYEQWGSTVYGENDMNRQQDNGR

SEQ ID NO: 180243 - protein, 34 aa, Artificial Sequence
  Description of Artificial Sequence: Synthetic polypeptide
SEEEIRCTNPTAYEQWGSTVYGENDMHRGGTNVD

SEQ ID NO: 180244 - protein, 36 aa, Artificial Sequence
  Description of Artificial Sequence: Synthetic polypeptide
CEEEISTTNPVATEQYGCVCPNWEHNQENFGSDNQE

SEQ ID NO: 180245 - protein, 34 aa, Artificial Sequence
  Description of Artificial Sequence: Synthetic polypeptide
SEEEIRCTNPTAYEQWGSTVYGENDMHRGGDNEE

SEQ ID NO: 180246 - protein, 34 aa, Artificial Sequence
  Description of Artificial Sequence: Synthetic polypeptide
SEEEIRCTNPTAYEQWGSTVYGENDDHRNGDTKR

SEQ ID NO: 180247 - protein, 31 aa, Artificial Sequence
  Description of Artificial Sequence: Synthetic polypeptide
DDSEVASTNPVSTEGYGNVAANTIQSRVGCD

SEQ ID NO: 180248 - protein, 34 aa, Artificial Sequence
  Description of Artificial Sequence: Synthetic polypeptide
SEEEIRCTNPTAYEQWGSTVYGENDDARGGDKKR

SEQ ID NO: 180249 - protein, 35 aa, Artificial Sequence
  Description of Artificial Sequence: Synthetic polypeptide
CEEEISTTNPVATEQYGCVCSMWEHNQEGFGSDQS

SEQ ID NO: 180250 - protein, 35 aa, Artificial Sequence
  Description of Artificial Sequence: Synthetic polypeptide
CEEEISTTNPVATEQYGCVCSNSEHNQENFGSDAS

SEQ ID NO: 180251 - protein, 35 aa, Artificial Sequence
  Description of Artificial Sequence: Synthetic polypeptide
CEEEISTTNPVATEQYGCVCSNSEHNQNFGSETQS

SEQ ID NO: 180252 - protein, 33 aa, Artificial Sequence
  Description of Artificial Sequence: Synthetic polypeptide
SEEEIRCTNPTAYEQWGCVWGENDMHRTGTNHS

SEQ ID NO: 180253 - protein, 35 aa, Artificial Sequence
  Description of Artificial Sequence: Synthetic polypeptide
DESEIRSTNPVAYEPYGSTVQVCLSQSQNREVNTE

SEQ ID NO: 180254 - protein, 35 aa, Artificial Sequence
  Description of Artificial Sequence: Synthetic polypeptide
DEEAIRTTNPVATEQYGCAIEIIDTQVGGMQEGEQ

SEQ ID NO: 180255 - protein, 33 aa, Artificial Sequence
  Description of Artificial Sequence: Synthetic polypeptide
SEEEIRCTNPTAYECWGSVYGENDDMTRNHDNR

SEQ ID NO: 180256 - protein, 32 aa, Artificial Sequence
  Description of Artificial Sequence: Synthetic polypeptide
DDSEVASTNPVSTEGYGNVAANTIQSRVGDQR

SEQ ID NO: 180257 - protein, 33 aa, Artificial Sequence
  Description of Artificial Sequence: Synthetic polypeptide
SEEEIRCTNPTAYECWGSVYGENDDMHRKGDNG

SEQ ID NO: 180258 - protein, 31 aa, Artificial Sequence
  Description of Artificial Sequence: Synthetic polypeptide
DDSEVASTNPVSTEGYGNVAANTIQSRVEQR

SEQ ID NO: 180259 - protein, 37 aa, Artificial Sequence
  Description of Artificial Sequence: Synthetic polypeptide
DEEAIRCTNPVATEQYGSIVNGTETLDDQQDSNEFQI

SEQ ID NO: 180260 - protein, 35 aa, Artificial Sequence
  Description of Artificial Sequence: Synthetic polypeptide
DDQEIATTNPVATEQYGSVSATPDHSEDHIGEDLY

SEQ ID NO: 180261 - protein, 32 aa, Artificial Sequence
  Description of Artificial Sequence: Synthetic polypeptide
DQSEVASTNPVSTEGYGNVACNTISQSRTGQR

SEQ ID NO: 180262 - protein, 39 aa, Artificial Sequence
  Description of Artificial Sequence: Synthetic polypeptide
DEEEIRTTNPVATEQYGETYSTPNENVEGQAAEGNVELS

SEQ ID NO: 180263 - protein, 37 aa, Artificial Sequence
  Description of Artificial Sequence: Synthetic polypeptide
DEEAIRCTNPVATEQYGVVSVSVNVDEQDTPNGPQED

SEQ ID NO: 180264 - protein, 39 aa, Artificial Sequence
  Description of Artificial Sequence: Synthetic polypeptide
DEEEIRTTNPVATEQYGETYSTPNENVIMPAREGNVELS

SEQ ID NO: 180265 - protein, 33 aa, Artificial Sequence
  Description of Artificial Sequence: Synthetic polypeptide
DEEAIRCTNPVAYEAYGKVVHCTNHAGEPVNGH

SEQ ID NO: 180266 - protein, 35 aa, Artificial Sequence
  Description of Artificial Sequence: Synthetic polypeptide
DQMEISTTNPVATEQYGSVTVTYVDLQEEDDVQMG

SEQ ID NO: 180267 - protein, 38 aa, Artificial Sequence
  Description of Artificial Sequence: Synthetic polypeptide
DEEEIRTTNPVATEQYGETYSTPVEWVERQVEGNVELS

SEQ ID NO: 180268 - protein, 38 aa, Artificial Sequence
  Description of Artificial Sequence: Synthetic polypeptide
DEEEIRTTNPVATEQYGETYSYPNENVEMQVEGNVELS

SEQ ID NO: 180269 - protein, 35 aa, Artificial Sequence
  Description of Artificial Sequence: Synthetic polypeptide
DQQEIATTNPVATEQYGSCVAATPDLEDHIGEDLN

SEQ ID NO: 180270 - protein, 37 aa, Artificial Sequence
  Description of Artificial Sequence: Synthetic polypeptide
DEEEIRTTNPVATEQYGSVTPPPLWLEEVPMGPTEFG

SEQ ID NO: 180271 - protein, 35 aa, Artificial Sequence
  Description of Artificial Sequence: Synthetic polypeptide
DEQEIATTNPAVATLQYVGSVSATDLEDHEDEDLF

SEQ ID NO: 180272 - protein, 35 aa, Artificial Sequence
  Description of Artificial Sequence: Synthetic polypeptide
DEEEIRTTNPCATEPYGSCAATALPATAPGGEMAE

SEQ ID NO: 180273 - protein, 36 aa, Artificial Sequence
  Description of Artificial Sequence: Synthetic polypeptide
DEEEIRTTNPCATEPYGSCAASGNLGTATPGDIEAM

SEQ ID NO: 180274 - protein, 37 aa, Artificial Sequence
  Description of Artificial Sequence: Synthetic polypeptide
DENEIRTTNPVATEQYGDVIMSSDNGDEQGEGQEGGT

SEQ ID NO: 180275 - protein, 37 aa, Artificial Sequence
  Description of Artificial Sequence: Synthetic polypeptide
DEEEIRTTNPCATEPYGSCAAATGNLDQATPGDEMAM

SEQ ID NO: 180276 - protein, 39 aa, Artificial Sequence
  Description of Artificial Sequence: Synthetic polypeptide
DECEICTTNPVATEQYGVVSTVNQNGNLGQQGNTEEGSQ

SEQ ID NO: 180277 - protein, 35 aa, Artificial Sequence
  Description of Artificial Sequence: Synthetic polypeptide
DEEAIRTTNPMAYPAYGSVIAPTDNLPQWTENIEH

SEQ ID NO: 180278 - protein, 35 aa, Artificial Sequence
  Description of Artificial Sequence: Synthetic polypeptide
DEEAIRTTNPVASECYGSLSYTRMAVVDEGSNTQM

SEQ ID NO: 180279 - protein, 35 aa, Artificial Sequence
  Description of Artificial Sequence: Synthetic polypeptide
DEEEIRTTNPCATEPYGNCAATNLPATAPGGEMAN

SEQ ID NO: 180280 - protein, 35 aa, Artificial Sequence
  Description of Artificial Sequence: Synthetic polypeptide
DEAEIRTTNPVATEQYGCYCSWGEDNQNFGSDTQS

SEQ ID NO: 180281 - protein, 35 aa, Artificial Sequence
  Description of Artificial Sequence: Synthetic polypeptide
DEEEIRTTNPCATEPYGNCAASNLPATAPGMNMWH

SEQ ID NO: 180282 - protein, 36 aa, Artificial Sequence
  Description of Artificial Sequence: Synthetic polypeptide
DEEEIRTTNPCATEPYGNCAASGNLGQATPGDETAM

SEQ ID NO: 180283 - protein, 35 aa, Artificial Sequence
  Description of Artificial Sequence: Synthetic polypeptide
DEEEIRTTNPCATEPYGNCAAGTNLPATAPGGEAA

SEQ ID NO: 180284 - protein, 34 aa, Artificial Sequence
  Description of Artificial Sequence: Synthetic polypeptide
DEDEIRGTNPVATEGWGSVSAINEGGDGEGEEGI

SEQ ID NO: 180285 - protein, 35 aa, Artificial Sequence
  Description of Artificial Sequence: Synthetic polypeptide
DENEIRTTNPVATEQYGCVYTDENGTVETEESQVE

SEQ ID NO: 180286 - protein, 35 aa, Artificial Sequence
  Description of Artificial Sequence: Synthetic polypeptide
DEEAIRTTNPVATEQWGCVCGTGEDNQEHFGSDQA

SEQ ID NO: 180287 - protein, 31 aa, Artificial Sequence
  Description of Artificial Sequence: Synthetic polypeptide
DQSEVASTNPVSYEGYGNVAANTIQSRTGQR

SEQ ID NO: 180288 - protein, 34 aa, Artificial Sequence
  Description of Artificial Sequence: Synthetic polypeptide
VEDEIATTNPVAYEQYGSVAAAGDTATGDGNQDD

SEQ ID NO: 180289 - protein, 35 aa, Artificial Sequence
  Description of Artificial Sequence: Synthetic polypeptide
DEEAIRTTNPVAYDPWGCVVSCGNESQDNNDGNRT

SEQ ID NO: 180290 - protein, 35 aa, Artificial Sequence
  Description of Artificial Sequence: Synthetic polypeptide
DENEIRTTNPVATEQYGCCTVADVDVEDLEPGEIT

SEQ ID NO: 180291 - protein, 37 aa, Artificial Sequence
  Description of Artificial Sequence: Synthetic polypeptide
DEEEIRSTNPVATEQYGSVMGDFNFDGNDTGQGGFTG

SEQ ID NO: 180292 - protein, 35 aa, Artificial Sequence
  Description of Artificial Sequence: Synthetic polypeptide
DSEEIRTTNPVGTEQWGCVCSTEHNQENFISVNQS

SEQ ID NO: 180293 - protein, 34 aa, Artificial Sequence
  Description of Artificial Sequence: Synthetic polypeptide
DEACSATTNPIAYEQWGEVCSTWEGLQQNDGNNR

SEQ ID NO: 180294 - protein, 32 aa, Artificial Sequence
  Description of Artificial Sequence: Synthetic polypeptide
DDSEVASTNPVSTEGYGNVAANTIQSRVGQDR

SEQ ID NO: 180295 - protein, 35 aa, Artificial Sequence
  Description of Artificial Sequence: Synthetic polypeptide
DSEEIRTTNPVGTEQWGCVCSTGEDHNQNFGSVQA

SEQ ID NO: 180296 - protein, 36 aa, Artificial Sequence
  Description of Artificial Sequence: Synthetic polypeptide
DEEEIRSTNPVATEQYGSVGDDGNTATGEGGGGQEH

SEQ ID NO: 180297 - protein, 33 aa, Artificial Sequence
  Description of Artificial Sequence: Synthetic polypeptide
DEACSATTNPIAYERWGEVCSTWEGLQHDMGNR

SEQ ID NO: 180298 - protein, 34 aa, Artificial Sequence
  Description of Artificial Sequence: Synthetic polypeptide
DEEAISTTNPVAYEEWGQCATTDGGDHQRGSNMR

SEQ ID NO: 180299 - protein, 39 aa, Artificial Sequence
  Description of Artificial Sequence: Synthetic polypeptide
DEEEIRTTNPVATEQYGMVSVEGGLGDGGQGQENQERGT

SEQ ID NO: 180300 - protein, 34 aa, Artificial Sequence
  Description of Artificial Sequence: Synthetic polypeptide
TSEEIRSTNPVAYEQYGIKISCTENEDMRAEENA

SEQ ID NO: 180301 - protein, 34 aa, Artificial Sequence
  Description of Artificial Sequence: Synthetic polypeptide
DSEEIRTTNPVGTEQWGCVCSWEHNQENFGSDQM

SEQ ID NO: 180302 - protein, 38 aa, Artificial Sequence
  Description of Artificial Sequence: Synthetic polypeptide
DEEEIRTTNPVATEQYGMVSVEGLGDGGQGQDNQEIGT

SEQ ID NO: 180303 - protein, 34 aa, Artificial Sequence
  Description of Artificial Sequence: Synthetic polypeptide
DSEEIRTTNPVGTEQWGCVCSWGEHNQYFNSVQS

SEQ ID NO: 180304 - protein, 35 aa, Artificial Sequence
  Description of Artificial Sequence: Synthetic polypeptide
DSEEIRTTNPVGTEQWGCVCSWMELNQENFGSEQS

SEQ ID NO: 180305 - protein, 34 aa, Artificial Sequence
  Description of Artificial Sequence: Synthetic polypeptide
DENEIRTTNPVATEQWGTCVTSEVEMNIIEDEAN

SEQ ID NO: 180306 - protein, 36 aa, Artificial Sequence
  Description of Artificial Sequence: Synthetic polypeptide
DEEEIRTTNPVATEQYGMVSVEGMGDGGEGQEMEGM

SEQ ID NO: 180307 - protein, 35 aa, Artificial Sequence
  Description of Artificial Sequence: Synthetic polypeptide
DEADEIATTNPVAYEQWGSVTGPNNGNQGGTNGPQ

SEQ ID NO: 180308 - protein, 38 aa, Artificial Sequence
  Description of Artificial Sequence: Synthetic polypeptide
DEEEIRTTNPVATEQYGMVSVEGMGDGGQGEDNQERGT

SEQ ID NO: 180309 - protein, 38 aa, Artificial Sequence
  Description of Artificial Sequence: Synthetic polypeptide
DEEEIRTTNPVATEQYGMVSVEGMGDGGQGNENGERGT

SEQ ID NO: 180310 - protein, 36 aa, Artificial Sequence
  Description of Artificial Sequence: Synthetic polypeptide
DESEIRGTNPVATEQYGVVGDLSNNVEGMEGNEDGD

SEQ ID NO: 180311 - protein, 35 aa, Artificial Sequence
  Description of Artificial Sequence: Synthetic polypeptide
DESEIRGTNPVATEQYGVVGDDVNNSGMEGNEDGT

SEQ ID NO: 180312 - protein, 36 aa, Artificial Sequence
  Description of Artificial Sequence: Synthetic polypeptide
DEEEIRTTNPVATEQWGQCVCSWMYLNAENFGSDQS

SEQ ID NO: 180313 - protein, 34 aa, Artificial Sequence
  Description of Artificial Sequence: Synthetic polypeptide
AETEIRTTNPVATECWGATAWANAEDWQERGPYR

SEQ ID NO: 180314 - protein, 37 aa, Artificial Sequence
  Description of Artificial Sequence: Synthetic polypeptide
DEEEIRTTNPVATEQYGMVSVEGMGDGGQGQEMENQT

SEQ ID NO: 180315 - protein, 37 aa, Artificial Sequence
  Description of Artificial Sequence: Synthetic polypeptide
DEEEIRTTNPVATEQWGQCVCSTGYDNAEHFGSQTQS

SEQ ID NO: 180316 - protein, 34 aa, Artificial Sequence
  Description of Artificial Sequence: Synthetic polypeptide
DSEEIRTTNPVGTEQWGCVCSNWGEDQNFGSVQA

SEQ ID NO: 180317 - protein, 37 aa, Artificial Sequence
  Description of Artificial Sequence: Synthetic polypeptide
DEEEIRTTNPVATEQWGQCQVCSYTNDDNAHFGSQQS

SEQ ID NO: 180318 - protein, 34 aa, Artificial Sequence
  Description of Artificial Sequence: Synthetic polypeptide
DDEPIRTTNPCAYEAYGKVNTMNMHQKAVGVNQC

SEQ ID NO: 180319 - protein, 31 aa, Artificial Sequence
  Description of Artificial Sequence: Synthetic polypeptide
DDSEVASTNPVSTEGYGNVAANTIQSRVGQD

SEQ ID NO: 180320 - protein, 31 aa, Artificial Sequence
  Description of Artificial Sequence: Synthetic polypeptide
DDSEVASTNPVSTEGYGNVAANTIQSRVGQA

SEQ ID NO: 180321 - protein, 34 aa, Artificial Sequence
  Description of Artificial Sequence: Synthetic polypeptide
DEEEIRTTNPVAYEAYGKVVHCINHAGEPKGMGH

SEQ ID NO: 180322 - protein, 34 aa, Artificial Sequence
  Description of Artificial Sequence: Synthetic polypeptide
DEAEIRTTNPVATEQYGCVTLEDVQNVPDEQDQY

SEQ ID NO: 180323 - protein, 34 aa, Artificial Sequence
  Description of Artificial Sequence: Synthetic polypeptide
AENEIACTNPVATEQYGCSCSSELNQNFGSDTQA

SEQ ID NO: 180324 - protein, 34 aa, Artificial Sequence
  Description of Artificial Sequence: Synthetic polypeptide
DEEEIRTTNPVAYEAYGKVVHCIFHAGEPNGNGH

SEQ ID NO: 180325 - protein, 35 aa, Artificial Sequence
  Description of Artificial Sequence: Synthetic polypeptide
DEAEIRTTNPVATEQYGCVTLEDVQNFPEEKNDQD

SEQ ID NO: 180326 - protein, 37 aa, Artificial Sequence
  Description of Artificial Sequence: Synthetic polypeptide
DDETIRTTNPVATEQYGAVVVDTTNEGQERGQDGEDG

SEQ ID NO: 180327 - protein, 32 aa, Artificial Sequence
  Description of Artificial Sequence: Synthetic polypeptide
DDSEVASTNPVSTEGYGNVAANTIQSRVGQAR

SEQ ID NO: 180328 - protein, 36 aa, Artificial Sequence
  Description of Artificial Sequence: Synthetic polypeptide
DDETIRTTNPVATEQYGAVVIADNMGEQRGQSDEGQ

SEQ ID NO: 180329 - protein, 36 aa, Artificial Sequence
  Description of Artificial Sequence: Synthetic polypeptide
DDETIRTTNPVATEQYGAVVDLLNEGQERGQDGEDG

SEQ ID NO: 180330 - protein, 34 aa, Artificial Sequence
  Description of Artificial Sequence: Synthetic polypeptide
DEEEIRTTNPVAYEAWGKVVHCTNHAGTPKDNGF

SEQ ID NO: 180331 - protein, 37 aa, Artificial Sequence
  Description of Artificial Sequence: Synthetic polypeptide
DECEICTTNPVATEQYGVVATVQNQQSATNEEGNNTD

SEQ ID NO: 180332 - protein, 37 aa, Artificial Sequence
  Description of Artificial Sequence: Synthetic polypeptide
DEEEIRSTNPVATEQYGSVYGVDDDTLQDTGGEEGEF

SEQ ID NO: 180333 - protein, 39 aa, Artificial Sequence
  Description of Artificial Sequence: Synthetic polypeptide
DEEEIRSTNPVATEQYGSVVQQGTQNLDGEGQGGQGEDG

SEQ ID NO: 180334 - protein, 38 aa, Artificial Sequence
  Description of Artificial Sequence: Synthetic polypeptide
DEEEIRSTNPVATEQYGSVVQLGQNLDGEGQGGQGEDP

SEQ ID NO: 180335 - protein, 35 aa, Artificial Sequence
  Description of Artificial Sequence: Synthetic polypeptide
AENEIACTNPVATEQYGCSCSMWGNLNQYFGSDQA

SEQ ID NO: 180336 - protein, 35 aa, Artificial Sequence
  Description of Artificial Sequence: Synthetic polypeptide
DEAEIRTTNPVATEQYGCVSVQVPDEQQNFFDEVG

SEQ ID NO: 180337 - protein, 35 aa, Artificial Sequence
  Description of Artificial Sequence: Synthetic polypeptide
DEENIRTTNPVATEQYGSVPPPLIEEEPMSPLEQG

SEQ ID NO: 180338 - protein, 35 aa, Artificial Sequence
  Description of Artificial Sequence: Synthetic polypeptide
TSEEIRSTNPVATEQWGIKISCCENELQRPEQENP

SEQ ID NO: 180339 - protein, 34 aa, Artificial Sequence
  Description of Artificial Sequence: Synthetic polypeptide
DSEEIRTTNPVAYLAYGKVVHCTNHAGTPTGNGF

SEQ ID NO: 180340 - protein, 32 aa, Artificial Sequence
  Description of Artificial Sequence: Synthetic polypeptide
DEACLATTNPVAYEQWGSISKTLEDRQNMQEV

SEQ ID NO: 180341 - protein, 35 aa, Artificial Sequence
  Description of Artificial Sequence: Synthetic polypeptide
DEQEIGTTNPVATEFYGSVVATGQGEDQGGGEDGD

SEQ ID NO: 180342 - protein, 31 aa, Artificial Sequence
  Description of Artificial Sequence: Synthetic polypeptide
DDSEVASTNPVSTEGYGNVAANTIQSRVGQC

SEQ ID NO: 180343 - protein, 31 aa, Artificial Sequence
  Description of Artificial Sequence: Synthetic polypeptide
DDSEVGSTNPVSTEGYGNVAAGTIQSRVGQR

SEQ ID NO: 180344 - protein, 34 aa, Artificial Sequence
  Description of Artificial Sequence: Synthetic polypeptide
DEACSATTNPIAYEQWGEVCSTWEGLQNHDGHNR

SEQ ID NO: 180345 - protein, 37 aa, Artificial Sequence
  Description of Artificial Sequence: Synthetic polypeptide
DEEEIRSTNPVATEQYGSVMGDFNFDGNDTNQGGFDL

SEQ ID NO: 180346 - protein, 37 aa, Artificial Sequence
  Description of Artificial Sequence: Synthetic polypeptide
DEENICTTNPVATEAYGVVSTVVNNLQQLQQGTDDED

SEQ ID NO: 180347 - protein, 37 aa, Artificial Sequence
  Description of Artificial Sequence: Synthetic polypeptide
DEEEIRTTNPVATEQWGQCQVCSYTNALNANFISDFA

SEQ ID NO: 180348 - protein, 38 aa, Artificial Sequence
  Description of Artificial Sequence: Synthetic polypeptide
DEEEIRTTNPVATEQYGMVSVEGMGDGGQGQENQERGS

SEQ ID NO: 180349 - protein, 34 aa, Artificial Sequence
  Description of Artificial Sequence: Synthetic polypeptide
TSGSIQTTNPVATEEWGSVSCVGTSSQPPGGNSR

SEQ ID NO: 180350 - protein, 36 aa, Artificial Sequence
  Description of Artificial Sequence: Synthetic polypeptide
DEAEAEIRTTNPCAYEQWGSVVITPNFENEGNGNDV

SEQ ID NO: 180351 - protein, 31 aa, Artificial Sequence
  Description of Artificial Sequence: Synthetic polypeptide
DDSEVASTNPVSTEGYGNVAANTIQSRVGQF

SEQ ID NO: 180352 - protein, 35 aa, Artificial Sequence
  Description of Artificial Sequence: Synthetic polypeptide
TSEEIRSTNPVAYEQYGIKISCTENELQKAEENGI

SEQ ID NO: 180353 - protein, 36 aa, Artificial Sequence
  Description of Artificial Sequence: Synthetic polypeptide
DEECIATTNPVATEHWGVVCFTNEDQHHRGGTDGNG

SEQ ID NO: 180354 - protein, 38 aa, Artificial Sequence
  Description of Artificial Sequence: Synthetic polypeptide
DEEEIRSTNPVATEQYGMVSVEGMGDNGQGQENNERGQ

SEQ ID NO: 180355 - protein, 36 aa, Artificial Sequence
  Description of Artificial Sequence: Synthetic polypeptide
DEAEIRTTNPVATEQYGCVCSWGEHNQENFNSDNQL

SEQ ID NO: 180356 - protein, 35 aa, Artificial Sequence
  Description of Artificial Sequence: Synthetic polypeptide
DEAEIRTTNPVATEQYGCVCSWGEHNENFNSETQP

SEQ ID NO: 180357 - protein, 32 aa, Artificial Sequence
  Description of Artificial Sequence: Synthetic polypeptide
DDSEVASTNPVSTEGYGNVAANTIQSRVGQFR

SEQ ID NO: 180358 - protein, 31 aa, Artificial Sequence
  Description of Artificial Sequence: Synthetic polypeptide
DDSEVASTNPISTEGYGNVAANTIQSRVGQR

SEQ ID NO: 180359 - protein, 33 aa, Artificial Sequence
  Description of Artificial Sequence: Synthetic polypeptide
AETEIRTTNPVATECWGETWANEEDLARKGPYI

SEQ ID NO: 180360 - protein, 33 aa, Artificial Sequence
  Description of Artificial Sequence: Synthetic polypeptide
DSEEIRTTNPVGYECWGMVPHWNDLGEDAGHER

SEQ ID NO: 180361 - protein, 38 aa, Artificial Sequence
  Description of Artificial Sequence: Synthetic polypeptide
DEEEIRTTNPVATEQWGICQVCSYTGEDLNARFGSDQA

SEQ ID NO: 180362 - protein, 37 aa, Artificial Sequence
  Description of Artificial Sequence: Synthetic polypeptide
DEEEIRTTNPVATEQWGICQVCSYTEDLNINFGSGQS

SEQ ID NO: 180363 - protein, 31 aa, Artificial Sequence
  Description of Artificial Sequence: Synthetic polypeptide
DDSEVASTNPVSTDGYGNVAANTIQSRVGQR

SEQ ID NO: 180364 - protein, 37 aa, Artificial Sequence
  Description of Artificial Sequence: Synthetic polypeptide
DEEEIRTTNPVATEQWGICQVCSTTEDHNANFGSDQA

SEQ ID NO: 180365 - protein, 35 aa, Artificial Sequence
  Description of Artificial Sequence: Synthetic polypeptide
DEEEIRTTNPVAWEQYGCVCSNWEHEENFNSDTQA

SEQ ID NO: 180366 - protein, 35 aa, Artificial Sequence
  Description of Artificial Sequence: Synthetic polypeptide
DENEIRTTNPVATEQWGQKVPSEPIHSMNAAEGDA

SEQ ID NO: 180367 - protein, 37 aa, Artificial Sequence
  Description of Artificial Sequence: Synthetic polypeptide
DEEEIRSTNPVATEQYGDVVQNMNLDGEGQGGQGEDG

SEQ ID NO: 180368 - protein, 35 aa, Artificial Sequence
  Description of Artificial Sequence: Synthetic polypeptide
DSEEIRTTNPVGYEQWGCVRHNNDEQQDRRGGDYR

SEQ ID NO: 180369 - protein, 35 aa, Artificial Sequence
  Description of Artificial Sequence: Synthetic polypeptide
DSEEIRTTNPVGYEQWGCVRHNNDHQNDRRGGDTR

SEQ ID NO: 180370 - protein, 35 aa, Artificial Sequence
  Description of Artificial Sequence: Synthetic polypeptide
DSEEIRTTNPVGYEQWGCVRHQNDDQQERRGGDTR

SEQ ID NO: 180371 - protein, 35 aa, Artificial Sequence
  Description of Artificial Sequence: Synthetic polypeptide
DSEEIRTTNPVGYEQWGCVRWNNDDQQDRRGGDMR

SEQ ID NO: 180372 - protein, 36 aa, Artificial Sequence
  Description of Artificial Sequence: Synthetic polypeptide
DEEEIRSTNPVATEQYGDVVIDDMGLEDQGGDDGTP

SEQ ID NO: 180373 - protein, 37 aa, Artificial Sequence
  Description of Artificial Sequence: Synthetic polypeptide
DEEEIRTTNPVATEQYGNTYPHSIVESGISDQELLLQ

SEQ ID NO: 180374 - protein, 32 aa, Artificial Sequence
  Description of Artificial Sequence: Synthetic polypeptide
DDSEVASTNPVSTEGYGNVAANTIQSRVGQER

SEQ ID NO: 180375 - protein, 37 aa, Artificial Sequence
  Description of Artificial Sequence: Synthetic polypeptide
DEEEIRTTNPVATEQWGQCQVCSTTEAHNAYFGSDQA

SEQ ID NO: 180376 - protein, 36 aa, Artificial Sequence
  Description of Artificial Sequence: Synthetic polypeptide
DEAEAEIATTNPVAYEQWGSVAWNNDNLEGQGGTEQ

SEQ ID NO: 180377 - protein, 36 aa, Artificial Sequence
  Description of Artificial Sequence: Synthetic polypeptide
DEAEIRTTNPVATEQYGCVDTDAVNGSLGTEESQVE

SEQ ID NO: 180378 - protein, 37 aa, Artificial Sequence
  Description of Artificial Sequence: Synthetic polypeptide
DEEEIRTTNPVATEQYGMVSVEGMGDGGQGQENTEGT

SEQ ID NO: 180379 - protein, 36 aa, Artificial Sequence
  Description of Artificial Sequence: Synthetic polypeptide
DEADEIATTNPVAYEQYGTVATEPGGQQNGMQRGEA

SEQ ID NO: 180380 - protein, 36 aa, Artificial Sequence
  Description of Artificial Sequence: Synthetic polypeptide
DEADEIATTNPVAYEQYGTVATSNGGMQNGGQRGQA

SEQ ID NO: 180381 - protein, 36 aa, Artificial Sequence
  Description of Artificial Sequence: Synthetic polypeptide
DEADEIATTNPVAYEQYGTVATSNGGQPNGGQRGEA

SEQ ID NO: 180382 - protein, 36 aa, Artificial Sequence
  Description of Artificial Sequence: Synthetic polypeptide
DEADEIATTNPVAYEQYGTVATSNGGQQQGGQRGES

SEQ ID NO: 180383 - protein, 38 aa, Artificial Sequence
  Description of Artificial Sequence: Synthetic polypeptide
DEEEIRTTNPVATEQYGMVSVTGMGDGGQGQENQETGT

SEQ ID NO: 180384 - protein, 36 aa, Artificial Sequence
  Description of Artificial Sequence: Synthetic polypeptide
DESEIRGTNPVATEQYGSVGDNVNNSGMEGNEQGDE

SEQ ID NO: 180385 - protein, 37 aa, Artificial Sequence
  Description of Artificial Sequence: Synthetic polypeptide
DESEIRGTNPVATEQYGSVGDLVNNSGQMEGNEQGDQ

SEQ ID NO: 180386 - protein, 36 aa, Artificial Sequence
  Description of Artificial Sequence: Synthetic polypeptide
DEEPIATTNPVAYEGWGTVCSTNDLHDQNEGQNHSD

SEQ ID NO: 180387 - protein, 35 aa, Artificial Sequence
  Description of Artificial Sequence: Synthetic polypeptide
DEAEAEIATTNPCAYEQWGSVVITPNWENEGNGDV

SEQ ID NO: 180388 - protein, 36 aa, Artificial Sequence
  Description of Artificial Sequence: Synthetic polypeptide
DEEEIRTTNPVATEQYGMVVIMGNNDIMEGEFTGIF

SEQ ID NO: 180389 - protein, 35 aa, Artificial Sequence
  Description of Artificial Sequence: Synthetic polypeptide
DEAEAEIATTNPVAYEQWGSVAWNNDNLEGGGTES

SEQ ID NO: 180390 - protein, 35 aa, Artificial Sequence
  Description of Artificial Sequence: Synthetic polypeptide
CEEEISTTNPVATEQYGCVCSNTEHQENFISDTQS

SEQ ID NO: 180391 - protein, 38 aa, Artificial Sequence
  Description of Artificial Sequence: Synthetic polypeptide
DEEAIYTTNPVATEQYGSIVNGTETLDDQTGSNEGGQI

SEQ ID NO: 180392 - protein, 36 aa, Artificial Sequence
  Description of Artificial Sequence: Synthetic polypeptide
DEEPIATTNPVAYEQWGTVCSTTNDLHDQNEGQGHG

SEQ ID NO: 180393 - protein, 36 aa, Artificial Sequence
  Description of Artificial Sequence: Synthetic polypeptide
DEEEIRTTNPVATEQYGNCVHPSPVNMPNDVDMFEG

SEQ ID NO: 180394 - protein, 34 aa, Artificial Sequence
  Description of Artificial Sequence: Synthetic polypeptide
DEECEICTTNPVAYECWGSVATTGGNTGADGMTA

SEQ ID NO: 180395 - protein, 33 aa, Artificial Sequence
  Description of Artificial Sequence: Synthetic polypeptide
AETEIRTTNPVATECWGETWANAEDLARKGPYI

SEQ ID NO: 180396 - protein, 37 aa, Artificial Sequence
  Description of Artificial Sequence: Synthetic polypeptide
DEEEIRTTNPVATEQYGNMGDNMQENNGEEGGNQGEI

SEQ ID NO: 180397 - protein, 35 aa, Artificial Sequence
  Description of Artificial Sequence: Synthetic polypeptide
DESEIRGTNPVATEQYGDVTYVGDLGERGLGEEGI

SEQ ID NO: 180398 - protein, 33 aa, Artificial Sequence
  Description of Artificial Sequence: Synthetic polypeptide
DEECIACTNPVAYEWYGSVVSMPEFSTRGGPLM

SEQ ID NO: 180399 - protein, 34 aa, Artificial Sequence
  Description of Artificial Sequence: Synthetic polypeptide
DEDEIRGTNPVATEGWGSVSAGMEGQDGEGEQGL

SEQ ID NO: 180400 - protein, 36 aa, Artificial Sequence
  Description of Artificial Sequence: Synthetic polypeptide
DEECIATTNPCATECYGVVCYKTNDEAQRQPGGMDR

SEQ ID NO: 180401 - protein, 37 aa, Artificial Sequence
  Description of Artificial Sequence: Synthetic polypeptide
DESEIRGTNPVATEQYGDVTTSVGDLGQTRGLGEEFV

SEQ ID NO: 180402 - protein, 31 aa, Artificial Sequence
  Description of Artificial Sequence: Synthetic polypeptide
DDSEVASTNPVSTEGYGNVAANTIQSRVGQE

SEQ ID NO: 180403 - protein, 34 aa, Artificial Sequence
  Description of Artificial Sequence: Synthetic polypeptide
DEDEIRGTNPVATEGWGSVSAGMEGQDGEGEGII

SEQ ID NO: 180404 - protein, 37 aa, Artificial Sequence
  Description of Artificial Sequence: Synthetic polypeptide
DEENICTTNPVATEAYGVVSTVTTNLNQLQIGTDDED

SEQ ID NO: 180405 - protein, 35 aa, Artificial Sequence
  Description of Artificial Sequence: Synthetic polypeptide
DEEAISTTNPVATEQYGCVCSWGEHQENFNSNNQA

SEQ ID NO: 180406 - protein, 37 aa, Artificial Sequence
  Description of Artificial Sequence: Synthetic polypeptide
DEAEIRTTNPVATEQYGCVTSTWEAHNAEHFGSDPVS

SEQ ID NO: 180407 - protein, 37 aa, Artificial Sequence
  Description of Artificial Sequence: Synthetic polypeptide
DENEIRTTNPVATEQYGAVCSVTWPINTEDRFVHEDG

SEQ ID NO: 180408 - protein, 37 aa, Artificial Sequence
  Description of Artificial Sequence: Synthetic polypeptide
DEEEIRTTNHPVAYEEWGCSVSCTATMFSQSGEGNSA

SEQ ID NO: 180409 - protein, 36 aa, Artificial Sequence
  Description of Artificial Sequence: Synthetic polypeptide
DEEEIRTTNPVATEQWGSTTWATTPAGPAERNGPYV

SEQ ID NO: 180410 - protein, 37 aa, Artificial Sequence
  Description of Artificial Sequence: Synthetic polypeptide
DEEEIRTTNPVATEQYGMASDDDDEGGDQDEGEGNGT

SEQ ID NO: 180411 - protein, 36 aa, Artificial Sequence
  Description of Artificial Sequence: Synthetic polypeptide
DEEEIRTTNPVATEQWGSTTWANTEAGPAERNGPYV

SEQ ID NO: 180412 - protein, 36 aa, Artificial Sequence
  Description of Artificial Sequence: Synthetic polypeptide
DEEEIRTTNPVATEQYGMIVEWPTHHQQTFAVQEVA

SEQ ID NO: 180413 - protein, 37 aa, Artificial Sequence
  Description of Artificial Sequence: Synthetic polypeptide
DEEEIRTTNPVATEQWGSTTSANAEDWPNMRNGMPYI

SEQ ID NO: 180414 - protein, 38 aa, Artificial Sequence
  Description of Artificial Sequence: Synthetic polypeptide
DEEEIRTTNCVATEQYGSVVFDNIDTGNGQGQGGATTS

SEQ ID NO: 180415 - protein, 36 aa, Artificial Sequence
  Description of Artificial Sequence: Synthetic polypeptide
DEEAISTTNPVATEQYGCVCSNTGEHNQENFGSDQP

SEQ ID NO: 180416 - protein, 31 aa, Artificial Sequence
  Description of Artificial Sequence: Synthetic polypeptide
DESEIRSTNPIATEGWGATMWANSDLAPGDI

SEQ ID NO: 180417 - protein, 39 aa, Artificial Sequence
  Description of Artificial Sequence: Synthetic polypeptide
DEEEIRTTNPVATEQYGMSIPVLGSMNTEQGIIQGEGDG

SEQ ID NO: 180418 - protein, 37 aa, Artificial Sequence
  Description of Artificial Sequence: Synthetic polypeptide
DEEEIRTTNPVATEQWGSTTSANAEDWPNMRKGMPYI

SEQ ID NO: 180419 - protein, 39 aa, Artificial Sequence
  Description of Artificial Sequence: Synthetic polypeptide
DEEEIRTTNPVATEQYGMSITVLGSMNTEQGIIQGFGDQ

SEQ ID NO: 180420 - protein, 39 aa, Artificial Sequence
  Description of Artificial Sequence: Synthetic polypeptide
DEEEIRTTNPVATEQYGMSIVVLGSMNNEQGIIQGAGDG

SEQ ID NO: 180421 - protein, 39 aa, Artificial Sequence
  Description of Artificial Sequence: Synthetic polypeptide
DEEEIRTTNPVATEQYGMSIVVLGSMNTEQGIEQGEGDE

SEQ ID NO: 180422 - protein, 39 aa, Artificial Sequence
  Description of Artificial Sequence: Synthetic polypeptide
DEEEIRTTNPVATEQYGMSIVVLGSMNTEQGIGQGAGDN

SEQ ID NO: 180423 - protein, 39 aa, Artificial Sequence
  Description of Artificial Sequence: Synthetic polypeptide
DEEEIRTTNPVATEQYGMSIVVLGSMNTEQGIIQDFGDG

SEQ ID NO: 180424 - protein, 39 aa, Artificial Sequence
  Description of Artificial Sequence: Synthetic polypeptide
DEEEIRTTNPVATEQYGMSIVVLGSMNTEQGIIQGQGDS

SEQ ID NO: 180425 - protein, 39 aa, Artificial Sequence
  Description of Artificial Sequence: Synthetic polypeptide
DEEEIRTTNPVATEQYGMSIVVLGSMNTEQGIIQNEGIQ

SEQ ID NO: 180426 - protein, 39 aa, Artificial Sequence
  Description of Artificial Sequence: Synthetic polypeptide
DEEEIRTTNPVATEQYGMSIVVLGSMNTEQGIIQPEGDT

SEQ ID NO: 180427 - protein, 36 aa, Artificial Sequence
  Description of Artificial Sequence: Synthetic polypeptide
DEEEIRTTNPVATEQWGSTTAGNAPSAMPPMGDNQW

SEQ ID NO: 180428 - protein, 39 aa, Artificial Sequence
  Description of Artificial Sequence: Synthetic polypeptide
DEEEIRTTNPVATEQYGMSIVVLGSMNTEQTIIQGEGDQ

SEQ ID NO: 180429 - protein, 37 aa, Artificial Sequence
  Description of Artificial Sequence: Synthetic polypeptide
DEEEIRTTNPVATEQYGMSTTVMTDGFGGDEGGQTTV

SEQ ID NO: 180430 - protein, 34 aa, Artificial Sequence
  Description of Artificial Sequence: Synthetic polypeptide
AENEIACTNPVATEQYGCSCSWNDNQNFNSDTQA

SEQ ID NO: 180431 - protein, 35 aa, Artificial Sequence
  Description of Artificial Sequence: Synthetic polypeptide
DEEEIRTTNCVATEFYGSVGNDDTGQTTEGQGTQD

SEQ ID NO: 180432 - protein, 32 aa, Artificial Sequence
  Description of Artificial Sequence: Synthetic polypeptide
DDSEVASTNPVSTEGYGNVAANTIQSRVGMQR

SEQ ID NO: 180433 - protein, 34 aa, Artificial Sequence
  Description of Artificial Sequence: Synthetic polypeptide
AENEIACTNPVATEQYGCSCSWMELNQYFGSQQS

SEQ ID NO: 180434 - protein, 36 aa, Artificial Sequence
  Description of Artificial Sequence: Synthetic polypeptide
DEEEIRTTNPVATEQWGSTTWATTPAGPAMRNGPYV

SEQ ID NO: 180435 - protein, 34 aa, Artificial Sequence
  Description of Artificial Sequence: Synthetic polypeptide
TSEEIRATNPTATEHYGVVCCENNMLSQGEGNPW

SEQ ID NO: 180436 - protein, 35 aa, Artificial Sequence
  Description of Artificial Sequence: Synthetic polypeptide
DEEAIRTTNPVAYEAYGKVVVHCTNHAGEPGNMGH

SEQ ID NO: 180437 - protein, 37 aa, Artificial Sequence
  Description of Artificial Sequence: Synthetic polypeptide
DEEEIRTTNPCATEAYGVVTVVVTTNTNQAGNTTNTE

SEQ ID NO: 180438 - protein, 39 aa, Artificial Sequence
  Description of Artificial Sequence: Synthetic polypeptide
DEEEIRTTNPCATEAYGVVSTVVVTTNQLQAGTTTNLTE

SEQ ID NO: 180439 - protein, 38 aa, Artificial Sequence
  Description of Artificial Sequence: Synthetic polypeptide
DEEAIRTTNPVAYEQYGQVAVSFQMNDLLQPNGQIPRV

SEQ ID NO: 180440 - protein, 36 aa, Artificial Sequence
  Description of Artificial Sequence: Synthetic polypeptide
DEEEIRTTNPCATEAYGVVATVVNQQGNQQGTDEDD

SEQ ID NO: 180441 - protein, 36 aa, Artificial Sequence
  Description of Artificial Sequence: Synthetic polypeptide
DENEIRTTNPVATEQYGCCMVADNDVEQLEPGEDET

SEQ ID NO: 180442 - protein, 37 aa, Artificial Sequence
  Description of Artificial Sequence: Synthetic polypeptide
DEEEIRTTNPCATEAYGVVATVVNNQQGNQQNTNVAE

SEQ ID NO: 180443 - protein, 37 aa, Artificial Sequence
  Description of Artificial Sequence: Synthetic polypeptide
DEEEIRTTNPCATEAYGVVATVTNLQAGTEQGTTVTE

SEQ ID NO: 180444 - protein, 37 aa, Artificial Sequence
  Description of Artificial Sequence: Synthetic polypeptide
DEEEIRTTNPCATEAYGVVATVQALQAGTEQGTNVAE

SEQ ID NO: 180445 - protein, 37 aa, Artificial Sequence
  Description of Artificial Sequence: Synthetic polypeptide
DEEEIRTTNPCATEAYGVVATTVNNQQGNQQGTEEED

SEQ ID NO: 180446 - protein, 32 aa, Artificial Sequence
  Description of Artificial Sequence: Synthetic polypeptide
DDSEVASTNPVSTEGYGNVAANTIQSRVGIQR

SEQ ID NO: 180447 - protein, 37 aa, Artificial Sequence
  Description of Artificial Sequence: Synthetic polypeptide
DEEEIRTTNPCATEAYGVVATTTNLQAGTEQGTDEDE

SEQ ID NO: 180448 - protein, 37 aa, Artificial Sequence
  Description of Artificial Sequence: Synthetic polypeptide
DEEEIRTTNPCATEAYGVVATTNNNDQGNQQGTNSAE

SEQ ID NO: 180449 - protein, 34 aa, Artificial Sequence
  Description of Artificial Sequence: Synthetic polypeptide
DEDEIRGTNPVATEGWGSVSAGMEGQDGEGGQTG

SEQ ID NO: 180450 - protein, 37 aa, Artificial Sequence
  Description of Artificial Sequence: Synthetic polypeptide
DEEEIRTTNPVATEQYGIHNYNGNLPETDTNTQEQRD

SEQ ID NO: 180451 - protein, 38 aa, Artificial Sequence
  Description of Artificial Sequence: Synthetic polypeptide
DEEEIRTTNPVATEQYGIINYVLENHHVQERQQNEEQF

SEQ ID NO: 180452 - protein, 33 aa, Artificial Sequence
  Description of Artificial Sequence: Synthetic polypeptide
AENEIACTNPVATEQYGCYCSWNHQYFGSGTQA

SEQ ID NO: 180453 - protein, 33 aa, Artificial Sequence
  Description of Artificial Sequence: Synthetic polypeptide
AENEIACTNPVATEQYGCYCSWNDNQYFGSEQA

SEQ ID NO: 180454 - protein, 36 aa, Artificial Sequence
  Description of Artificial Sequence: Synthetic polypeptide
DENEIRTTNPVATEQYGAVTTYWDEWWERYGQEDHQ

SEQ ID NO: 180455 - protein, 37 aa, Artificial Sequence
  Description of Artificial Sequence: Synthetic polypeptide
DEEEIRTTNPVATEQYGIVNATTEVDDLVGTMNEMIA

SEQ ID NO: 180456 - protein, 37 aa, Artificial Sequence
  Description of Artificial Sequence: Synthetic polypeptide
DEEEIRTTNPCATEAYGSVATTTNNNQGNQQGTTEAG

SEQ ID NO: 180457 - protein, 33 aa, Artificial Sequence
  Description of Artificial Sequence: Synthetic polypeptide
AENEIACTNPVATEQYGCYCSWEDLQNFGSDQS

SEQ ID NO: 180458 - protein, 32 aa, Artificial Sequence
  Description of Artificial Sequence: Synthetic polypeptide
DDMEVATTNPVSTEGYGTVCSANGIESFEGQR

SEQ ID NO: 180459 - protein, 35 aa, Artificial Sequence
  Description of Artificial Sequence: Synthetic polypeptide
DENEIRTTNPVATEQYGAVPWDLAVLESEANEDGL

SEQ ID NO: 180460 - protein, 34 aa, Artificial Sequence
  Description of Artificial Sequence: Synthetic polypeptide
AENEIACTNPVATEQYGCYCSNWNLNQNFGSDQS

SEQ ID NO: 180461 - protein, 32 aa, Artificial Sequence
  Description of Artificial Sequence: Synthetic polypeptide
DDSEVASTNPVSTEGYGNVAANTIQSRVGLQR

SEQ ID NO: 180462 - protein, 36 aa, Artificial Sequence
  Description of Artificial Sequence: Synthetic polypeptide
DEEEIRTTNPVATEQYGMTVLIMDDQGTGQDGDGDE

SEQ ID NO: 180463 - protein, 38 aa, Artificial Sequence
  Description of Artificial Sequence: Synthetic polypeptide
DEEEIRTTNPVATEQYGMVAQPTMMEETVLENENTLNR

SEQ ID NO: 180464 - protein, 36 aa, Artificial Sequence
  Description of Artificial Sequence: Synthetic polypeptide
DEEEIRTTNPVATEQYGMVDVIMNNDIMEGEFTGEF

SEQ ID NO: 180465 - protein, 37 aa, Artificial Sequence
  Description of Artificial Sequence: Synthetic polypeptide
DSEEIRTTNPVATEQYGSQWWSFTVEAENLPTDESQI

SEQ ID NO: 180466 - protein, 35 aa, Artificial Sequence
  Description of Artificial Sequence: Synthetic polypeptide
DEQEICTTNPVAYEQWGSVTGENGNSQGNQSGNQQ

SEQ ID NO: 180467 - protein, 33 aa, Artificial Sequence
  Description of Artificial Sequence: Synthetic polypeptide
AENEIACTNPVATEQYGCSCSWEHNINFGSDQM

SEQ ID NO: 180468 - protein, 33 aa, Artificial Sequence
  Description of Artificial Sequence: Synthetic polypeptide
AENEIACTNPVATEQYGCSCSWEHNDYFGSDQS

SEQ ID NO: 180469 - protein, 37 aa, Artificial Sequence
  Description of Artificial Sequence: Synthetic polypeptide
DEEEIRTTNPVATEQYGMVQFPTMGGEQPEPGSVAEI

SEQ ID NO: 180470 - protein, 37 aa, Artificial Sequence
  Description of Artificial Sequence: Synthetic polypeptide
DEEEIRTTNPVATEQYGMVQMITYGEEQPEPGSVAEI

SEQ ID NO: 180471 - protein, 36 aa, Artificial Sequence
  Description of Artificial Sequence: Synthetic polypeptide
DSEEIRTTNPVATEQYGSVAPFMDAEMENFEGSNQH

SEQ ID NO: 180472 - protein, 37 aa, Artificial Sequence
  Description of Artificial Sequence: Synthetic polypeptide
DSEEIRTTNPVATEQYGSVAPFQDAEMLENFNGSNQH

SEQ ID NO: 180473 - protein, 34 aa, Artificial Sequence
  Description of Artificial Sequence: Synthetic polypeptide
DEEAISTTNPVATEQYGCVCSWEEHNQNFFSDQS

SEQ ID NO: 180474 - protein, 33 aa, Artificial Sequence
  Description of Artificial Sequence: Synthetic polypeptide
AENEIACTNPVATEQYGCSCSWEDNIYFGSEQA

SEQ ID NO: 180475 - protein, 34 aa, Artificial Sequence
  Description of Artificial Sequence: Synthetic polypeptide
AENEIACTNPVATEQYGCSCSWEDLNQYFGSEQA

SEQ ID NO: 180476 - protein, 37 aa, Artificial Sequence
  Description of Artificial Sequence: Synthetic polypeptide
DECEICTTNPVATEQYGVVAVTTNQQQGNQQGTTEDE

SEQ ID NO: 180477 - protein, 37 aa, Artificial Sequence
  Description of Artificial Sequence: Synthetic polypeptide
DEEEIRTTNPVATEQYGMVQTITMGEEQPEPGSTAEI

SEQ ID NO: 180478 - protein, 37 aa, Artificial Sequence
  Description of Artificial Sequence: Synthetic polypeptide
DECEICTTNPVATEQYGVVATVVNQQSATETGTNQDD

SEQ ID NO: 180479 - protein, 36 aa, Artificial Sequence
  Description of Artificial Sequence: Synthetic polypeptide
AEDEICATNPVATEQYGVVATSNEGNNLQLGNGEDD

SEQ ID NO: 180480 - protein, 35 aa, Artificial Sequence
  Description of Artificial Sequence: Synthetic polypeptide
DEQEICTVNPVAYETYGKVSCTNELSTEFVGNNKA

SEQ ID NO: 180481 - protein, 33 aa, Artificial Sequence
  Description of Artificial Sequence: Synthetic polypeptide
DENEIRTTNPVATEQWGVVDNEGGEEDGAEGDA

SEQ ID NO: 180482 - protein, 37 aa, Artificial Sequence
  Description of Artificial Sequence: Synthetic polypeptide
DECEICTTNPVATEQYGVVATVTNQQSATEEGNTTDD

SEQ ID NO: 180483 - protein, 37 aa, Artificial Sequence
  Description of Artificial Sequence: Synthetic polypeptide
DEENICTTNPVATEAYGVVSTVTNNLQQLQQGSDDED

SEQ ID NO: 180484 - protein, 37 aa, Artificial Sequence
  Description of Artificial Sequence: Synthetic polypeptide
DEENICTTNPVATEAYGVVSTVTNNLQQLQQNTDEED

SEQ ID NO: 180485 - protein, 35 aa, Artificial Sequence
  Description of Artificial Sequence: Synthetic polypeptide
DEAEIRTTNPVATEQYGCVVTPTMDDVMETENQFD

SEQ ID NO: 180486 - protein, 36 aa, Artificial Sequence
  Description of Artificial Sequence: Synthetic polypeptide
DEEAISTTNPVATEQYGCVCSWGEHNQENFGSENQS

SEQ ID NO: 180487 - protein, 38 aa, Artificial Sequence
  Description of Artificial Sequence: Synthetic polypeptide
DEENICTTNPVATEAYGVVSTVTNNNLNQLQQGSNLED

SEQ ID NO: 180488 - protein, 32 aa, Artificial Sequence
  Description of Artificial Sequence: Synthetic polypeptide
DDSEVASTNPVSTEGYGNVAANTIQSRVGPQR

SEQ ID NO: 180489 - protein, 34 aa, Artificial Sequence
  Description of Artificial Sequence: Synthetic polypeptide
DEAEIRTTNPVATEQYGCVTVQVPDEQQEFDEVG

SEQ ID NO: 180490 - protein, 35 aa, Artificial Sequence
  Description of Artificial Sequence: Synthetic polypeptide
DEAEISTTNPVATEQYGCVCSWGELNAYFNSDTQS

SEQ ID NO: 180491 - protein, 35 aa, Artificial Sequence
  Description of Artificial Sequence: Synthetic polypeptide
DEENICTTNPVATEAYGVVATVVNDQAGTEEAEED

SEQ ID NO: 180492 - protein, 36 aa, Artificial Sequence
  Description of Artificial Sequence: Synthetic polypeptide
DEENICTTNPVATEAYGVVATVNNDEQYGTNEDEED

SEQ ID NO: 180493 - protein, 37 aa, Artificial Sequence
  Description of Artificial Sequence: Synthetic polypeptide
DSEEIRTTNPVATEQYGSFNNSTTPAEPDMENGMNDD

SEQ ID NO: 180494 - protein, 35 aa, Artificial Sequence
  Description of Artificial Sequence: Synthetic polypeptide
AENEIACTNPVATEQYGCSCSWGNLNQEYFGSEQA

SEQ ID NO: 180495 - protein, 34 aa, Artificial Sequence
  Description of Artificial Sequence: Synthetic polypeptide
AENEIACTNPVATEQYGCSCSWGNHNQNFGSDQM

SEQ ID NO: 180496 - protein, 34 aa, Artificial Sequence
  Description of Artificial Sequence: Synthetic polypeptide
AENEIACTNPVATEQYGCSCSWGNDNQHFGSQQA

SEQ ID NO: 180497 - protein, 35 aa, Artificial Sequence
  Description of Artificial Sequence: Synthetic polypeptide
DEAEISTTNPVATEQYGCVCSWGEHNQNFGSETQS

SEQ ID NO: 180498 - protein, 33 aa, Artificial Sequence
  Description of Artificial Sequence: Synthetic polypeptide
AENEIACTNPVATEQYGCSCSWGEDNQYFNSDQ

SEQ ID NO: 180499 - protein, 36 aa, Artificial Sequence
  Description of Artificial Sequence: Synthetic polypeptide
DEEEIRTCNPVATEAYGSVVGTRGGQGQEGQGEGET

SEQ ID NO: 180500 - protein, 35 aa, Artificial Sequence
  Description of Artificial Sequence: Synthetic polypeptide
DEAEISTTNPVATEQYGCVCSWGEHNQNFPSDNQS

SEQ ID NO: 180501 - protein, 36 aa, Artificial Sequence
  Description of Artificial Sequence: Synthetic polypeptide
DSEEIRTTNPVATEQWGWAIWTWPTLLQERGETQQD

SEQ ID NO: 180502 - protein, 36 aa, Artificial Sequence
  Description of Artificial Sequence: Synthetic polypeptide
DSEEIRTTNPVATEQYGAACLTTDDETQEGNFETPA

SEQ ID NO: 180503 - protein, 34 aa, Artificial Sequence
  Description of Artificial Sequence: Synthetic polypeptide
DEQEICTTNPVAYECWGCATTGNLQGNAGEGDGR

SEQ ID NO: 180504 - protein, 37 aa, Artificial Sequence
  Description of Artificial Sequence: Synthetic polypeptide
DSEEIRTTNPVATEQYGAALLTVCTDETQEGNFETGA

SEQ ID NO: 180505 - protein, 36 aa, Artificial Sequence
  Description of Artificial Sequence: Synthetic polypeptide
DSEEIRTTNPVATEQYGAVCMTWVEDEEDPGNPNQD

SEQ ID NO: 180506 - protein, 35 aa, Artificial Sequence
  Description of Artificial Sequence: Synthetic polypeptide
DEEAEIATTNPVAYEQWGVVVHTDNHNQQSGGSGE

SEQ ID NO: 180507 - protein, 36 aa, Artificial Sequence
  Description of Artificial Sequence: Synthetic polypeptide
DEQEICTTNPVAYECWGSVATGNGPLQDDRQENGTD

SEQ ID NO: 180508 - protein, 36 aa, Artificial Sequence
  Description of Artificial Sequence: Synthetic polypeptide
DEENEIATTNPVAYERWGSVSGGNADDSRNNGDGND

SEQ ID NO: 180509 - protein, 32 aa, Artificial Sequence
  Description of Artificial Sequence: Synthetic polypeptide
DDSEVASTNPVSTEGYGNVAANTIQSRVGMRL

SEQ ID NO: 180510 - protein, 36 aa, Artificial Sequence
  Description of Artificial Sequence: Synthetic polypeptide
DEQEICTTNPVAYECWGSVATGNGPLQDDRQQNDHD

SEQ ID NO: 180511 - protein, 36 aa, Artificial Sequence
  Description of Artificial Sequence: Synthetic polypeptide
DEENICTTNPVATEAYGSVATVNNDNQQGTEEQEED

SEQ ID NO: 180512 - protein, 38 aa, Artificial Sequence
  Description of Artificial Sequence: Synthetic polypeptide
DEEEIRTTNPVATEQYGSVTRFHATNDQMSMIVFEQEE

SEQ ID NO: 180513 - protein, 34 aa, Artificial Sequence
  Description of Artificial Sequence: Synthetic polypeptide
AENEIACTNPVATEQYGCSCSWELNQEYFGSDQG

SEQ ID NO: 180514 - protein, 36 aa, Artificial Sequence
  Description of Artificial Sequence: Synthetic polypeptide
DEENICTTNPVATEAYGSVATVNNNQQQGTEEDEED

SEQ ID NO: 180515 - protein, 36 aa, Artificial Sequence
  Description of Artificial Sequence: Synthetic polypeptide
DEENICTTNPVATEAYGSVATVVNDQQGSTEEEEED

SEQ ID NO: 180516 - protein, 36 aa, Artificial Sequence
  Description of Artificial Sequence: Synthetic polypeptide
DEENICTTNPVATEAYGSVATVVNDQQQGTEEEEDD

SEQ ID NO: 180517 - protein, 33 aa, Artificial Sequence
  Description of Artificial Sequence: Synthetic polypeptide
DDSEVASTNPVSTEGYGNVAANTIQSRVGNQRV

SEQ ID NO: 180518 - protein, 35 aa, Artificial Sequence
  Description of Artificial Sequence: Synthetic polypeptide
DEQEICTTNPVAYEQWGSVCSGEGNQALNGPNGMT

SEQ ID NO: 180519 - protein, 35 aa, Artificial Sequence
  Description of Artificial Sequence: Synthetic polypeptide
DEQEICTTNPVAYEQWGSVCSGEGNQTTNGGNGMT

SEQ ID NO: 180520 - protein, 34 aa, Artificial Sequence
  Description of Artificial Sequence: Synthetic polypeptide
TSEEIRSTNPTATEHYGSVGCINNMLSTGEGNPE

SEQ ID NO: 180521 - protein, 32 aa, Artificial Sequence
  Description of Artificial Sequence: Synthetic polypeptide
DDSEVASTNPVSTEGYGNVAANTIQSRNGMQR

SEQ ID NO: 180522 - protein, 32 aa, Artificial Sequence
  Description of Artificial Sequence: Synthetic polypeptide
DDSEVASTNPVSTEGYGNVAANTIQSRLGQRY

SEQ ID NO: 180523 - protein, 36 aa, Artificial Sequence
  Description of Artificial Sequence: Synthetic polypeptide
DQEEIRTTNPVATEQYGVVTVAVNNNMHSQTGGSMS

SEQ ID NO: 180524 - protein, 36 aa, Artificial Sequence
  Description of Artificial Sequence: Synthetic polypeptide
AEDEICATNPVATEQYGVVATVTNNLLQLNGNQEDD

SEQ ID NO: 180525 - protein, 32 aa, Artificial Sequence
  Description of Artificial Sequence: Synthetic polypeptide
DDSEVASTNPVSTEGYGNVAANTIQQSRVGTR

SEQ ID NO: 180526 - protein, 34 aa, Artificial Sequence
  Description of Artificial Sequence: Synthetic polypeptide
VEDEIATTNPVAYEQYGSVANANADTQTDNHNNH

SEQ ID NO: 180527 - protein, 36 aa, Artificial Sequence
  Description of Artificial Sequence: Synthetic polypeptide
DENEIRTTNPVATEQYGSVIDQTDEEDQTPSIEEDP

SEQ ID NO: 180528 - protein, 34 aa, Artificial Sequence
  Description of Artificial Sequence: Synthetic polypeptide
CEAEIATTNPVAYEQYGSCSTGPAGNNHMGMQMN

SEQ ID NO: 180529 - protein, 36 aa, Artificial Sequence
  Description of Artificial Sequence: Synthetic polypeptide
DEEEIRTTNPVATEQYGDIPTTPVTQQTVVVENEMM

SEQ ID NO: 180530 - protein, 36 aa, Artificial Sequence
  Description of Artificial Sequence: Synthetic polypeptide
DEEEIRTTNPVATEQYGDIVTSNGMGGDGEDGEGGV

SEQ ID NO: 180531 - protein, 38 aa, Artificial Sequence
  Description of Artificial Sequence: Synthetic polypeptide
DEEEIRTTNPVATEQYGDSEPRESSQMLAQEIQVNNQT

SEQ ID NO: 180532 - protein, 35 aa, Artificial Sequence
  Description of Artificial Sequence: Synthetic polypeptide
TSEEIQTTNPVAWEHWGSTVPSQTNAASQRGGELV

SEQ ID NO: 180533 - protein, 36 aa, Artificial Sequence
  Description of Artificial Sequence: Synthetic polypeptide
AEDEICATNPVATEQYGVVATVSNNLLQLNGNGEDD

SEQ ID NO: 180534 - protein, 37 aa, Artificial Sequence
  Description of Artificial Sequence: Synthetic polypeptide
DENEIRTTNPVATEQYGSVHPNTELVLENWQGVVQVD

SEQ ID NO: 180535 - protein, 36 aa, Artificial Sequence
  Description of Artificial Sequence: Synthetic polypeptide
DEEEIRTTNPVGTEFYGSVNIMDNIMGMDEGGNDGP

SEQ ID NO: 180536 - protein, 36 aa, Artificial Sequence
  Description of Artificial Sequence: Synthetic polypeptide
AEDEICATNPVATEQYGVVATVNQNNNLQQLGGNDD

SEQ ID NO: 180537 - protein, 34 aa, Artificial Sequence
  Description of Artificial Sequence: Synthetic polypeptide
DMEEIRTTNPVATEQYGCVCNEDDMEQTESTQYW

SEQ ID NO: 180538 - protein, 34 aa, Artificial Sequence
  Description of Artificial Sequence: Synthetic polypeptide
DMEEIRTTNPVATEQYGCVCNVEDMERTESTQEW

SEQ ID NO: 180539 - protein, 35 aa, Artificial Sequence
  Description of Artificial Sequence: Synthetic polypeptide
AEDEICATNPVATEQYGVVATVNQNLQQLNGIGTD

SEQ ID NO: 180540 - protein, 38 aa, Artificial Sequence
  Description of Artificial Sequence: Synthetic polypeptide
DEEEIRTTNPVATEQYGDVFGNVMNNGQQEGGGNDEDD

SEQ ID NO: 180541 - protein, 36 aa, Artificial Sequence
  Description of Artificial Sequence: Synthetic polypeptide
AEDEICATNPVATEQYGVVATVNNNLQALNGNQEDD

SEQ ID NO: 180542 - protein, 37 aa, Artificial Sequence
  Description of Artificial Sequence: Synthetic polypeptide
DENEIRTTNPVATEQYGSVFVTTPDVHNSRQEVSFED

SEQ ID NO: 180543 - protein, 35 aa, Artificial Sequence
  Description of Artificial Sequence: Synthetic polypeptide
DEEEISTTNPVAYEQYGCVCSNWGEHQESFGSDQY

SEQ ID NO: 180544 - protein, 37 aa, Artificial Sequence
  Description of Artificial Sequence: Synthetic polypeptide
DEEEIRTTNPVATEQYGDVGMGNNNNDDQDEGQEEET

SEQ ID NO: 180545 - protein, 34 aa, Artificial Sequence
  Description of Artificial Sequence: Synthetic polypeptide
VEDEIATTNPVAYEQYGSVAITHGEVTRDNDEQN

SEQ ID NO: 180546 - protein, 35 aa, Artificial Sequence
  Description of Artificial Sequence: Synthetic polypeptide
DEEEISTTNPVAYEQYGCVCSNWGPHQENFGSDQL

SEQ ID NO: 180547 - protein, 34 aa, Artificial Sequence
  Description of Artificial Sequence: Synthetic polypeptide
VEDEIATTNPVAYEQYGSVAIANNDTQDNHNNHQ

SEQ ID NO: 180548 - protein, 35 aa, Artificial Sequence
  Description of Artificial Sequence: Synthetic polypeptide
CEAEIACTNPVATEQYGSVCAANPQQEHQDGNQHQ

SEQ ID NO: 180549 - protein, 36 aa, Artificial Sequence
  Description of Artificial Sequence: Synthetic polypeptide
AEDEICATNPVATEQYGVVATVVENLLQLNGNGEDD

SEQ ID NO: 180550 - protein, 37 aa, Artificial Sequence
  Description of Artificial Sequence: Synthetic polypeptide
DEEEIRTTNPVGTEFYGSVNIMDNIGTQPDEGGNDGD

SEQ ID NO: 180551 - protein, 36 aa, Artificial Sequence
  Description of Artificial Sequence: Synthetic polypeptide
AEDEICATNPVATEQYGVVATVVENLQQLNGIGTNF

SEQ ID NO: 180552 - protein, 36 aa, Artificial Sequence
  Description of Artificial Sequence: Synthetic polypeptide
DENEIRTTNPVATEQYGSVIEPAMTQEQDLEMAEVE

SEQ ID NO: 180553 - protein, 37 aa, Artificial Sequence
  Description of Artificial Sequence: Synthetic polypeptide
DEEEIRTTNPVATEQYGCVTSTWPEHNAEHFISDPVA

SEQ ID NO: 180554 - protein, 35 aa, Artificial Sequence
  Description of Artificial Sequence: Synthetic polypeptide
SEEEIRTTNPVATEQYGCYNSESVEDEANYNEESI

SEQ ID NO: 180555 - protein, 37 aa, Artificial Sequence
  Description of Artificial Sequence: Synthetic polypeptide
DENEIRTTNPVATEQYGSVPTTWNPMIQTESSEEHTM

SEQ ID NO: 180556 - protein, 35 aa, Artificial Sequence
  Description of Artificial Sequence: Synthetic polypeptide
TSEEIQTTNPVAWEGWGSTVPSSTNAWSQRGGELN

SEQ ID NO: 180557 - protein, 35 aa, Artificial Sequence
  Description of Artificial Sequence: Synthetic polypeptide
CEAEIRATNPVATEQYGVVTMQDGDNGQRFNDNGI

SEQ ID NO: 180558 - protein, 37 aa, Artificial Sequence
  Description of Artificial Sequence: Synthetic polypeptide
DENEIRTTNPVATEQYGSVPSDWLDSLEGEGGFESIF

SEQ ID NO: 180559 - protein, 37 aa, Artificial Sequence
  Description of Artificial Sequence: Synthetic polypeptide
DENEIRTTNPVATEQYGSVPSDWLASLEGIEGGEESI

SEQ ID NO: 180560 - protein, 37 aa, Artificial Sequence
  Description of Artificial Sequence: Synthetic polypeptide
DENEIRTTNPVATEQYGSVPSDWLASIEGEGGFESIN

SEQ ID NO: 180561 - protein, 37 aa, Artificial Sequence
  Description of Artificial Sequence: Synthetic polypeptide
SEEEIRTTNPVATEQYGCVTSTWGADNAEYFNSDTQS

SEQ ID NO: 180562 - protein, 37 aa, Artificial Sequence
  Description of Artificial Sequence: Synthetic polypeptide
DENEIRTTNPVATEQYGSVPSDWLASGEGPEGAFESI

SEQ ID NO: 180563 - protein, 37 aa, Artificial Sequence
  Description of Artificial Sequence: Synthetic polypeptide
DEAEIRTTNPVATEQYGSCNTSETTMLHEGFYGDTDI

SEQ ID NO: 180564 - protein, 37 aa, Artificial Sequence
  Description of Artificial Sequence: Synthetic polypeptide
SEEEIRTTNPVATEQYGCVTSTTPAHNAEHFGSDPVS

SEQ ID NO: 180565 - protein, 36 aa, Artificial Sequence
  Description of Artificial Sequence: Synthetic polypeptide
DMEEIATTNPVAYETYGSVPTDISLFTVRSGNEEFC

SEQ ID NO: 180566 - protein, 37 aa, Artificial Sequence
  Description of Artificial Sequence: Synthetic polypeptide
DEAEIRTTNPVATEQYGSCLTVSVNSATYTGSMYSDN

SEQ ID NO: 180567 - protein, 35 aa, Artificial Sequence
  Description of Artificial Sequence: Synthetic polypeptide
DEAEIRTTNPVATEQYGSAYTWALIMESESIEDQM

SEQ ID NO: 180568 - protein, 37 aa, Artificial Sequence
  Description of Artificial Sequence: Synthetic polypeptide
DEEEIRTTNPCATEQYGSVIEPHNMHQQITQGEQPAP

SEQ ID NO: 180569 - protein, 31 aa, Artificial Sequence
  Description of Artificial Sequence: Synthetic polypeptide
DDSEVASTNPVSTEGYGNVAANTIQQRVGQH

SEQ ID NO: 180570 - protein, 37 aa, Artificial Sequence
  Description of Artificial Sequence: Synthetic polypeptide
DENEIRTTNPVATEQYGSVMSIGENDNNGQLTAITGD

SEQ ID NO: 180571 - protein, 37 aa, Artificial Sequence
  Description of Artificial Sequence: Synthetic polypeptide
DEAEIRTTNPVATEQYGSAIPWTPPLEENNHQSESRQ

SEQ ID NO: 180572 - protein, 32 aa, Artificial Sequence
  Description of Artificial Sequence: Synthetic polypeptide
DDSEVASTNPVSTEGYGNVAANTIQQSRVGQR

SEQ ID NO: 180573 - protein, 36 aa, Artificial Sequence
  Description of Artificial Sequence: Synthetic polypeptide
DENEIRTTNPVATEQYGSVLYTWDMIQTESSEEHTQ

SEQ ID NO: 180574 - protein, 37 aa, Artificial Sequence
  Description of Artificial Sequence: Synthetic polypeptide
DENEIRTTNPVATEQYGSVKEYAVWLETEGNMMNQQE

SEQ ID NO: 180575 - protein, 37 aa, Artificial Sequence
  Description of Artificial Sequence: Synthetic polypeptide
DENEIRTTNPVATEQYGSVISPDYDEWIDEQEGSQKN

SEQ ID NO: 180576 - protein, 36 aa, Artificial Sequence
  Description of Artificial Sequence: Synthetic polypeptide
SEEEIRTTNPVATEQYGCVCSWGEHNEENFNSDNQS

SEQ ID NO: 180577 - protein, 35 aa, Artificial Sequence
  Description of Artificial Sequence: Synthetic polypeptide
SEEEIRTTNPVATEQYGCVCSWGEHNDEFFSSDQS

SEQ ID NO: 180578 - protein, 35 aa, Artificial Sequence
  Description of Artificial Sequence: Synthetic polypeptide
SEEEIRTTNPVATEQYGCVCSWGEHDQNFISQTQA

SEQ ID NO: 180579 - protein, 37 aa, Artificial Sequence
  Description of Artificial Sequence: Synthetic polypeptide
DEEEIRTTNPVATEQYGCVTSTWPAHNAENFSSDPQF

SEQ ID NO: 180580 - protein, 34 aa, Artificial Sequence
  Description of Artificial Sequence: Synthetic polypeptide
DEEEISTTNPVAYEQYGCVCSSEHNQENFISDQS

SEQ ID NO: 180581 - protein, 34 aa, Artificial Sequence
  Description of Artificial Sequence: Synthetic polypeptide
VEDEIATTNPVAYEQYGSVAATTDGTATGGNQDS

SEQ ID NO: 180582 - protein, 36 aa, Artificial Sequence
  Description of Artificial Sequence: Synthetic polypeptide
DNEEIRTTNPVATEQYGSIVNSAQDESSAEGDQDEV

SEQ ID NO: 180583 - protein, 36 aa, Artificial Sequence
  Description of Artificial Sequence: Synthetic polypeptide
DNEEIRTTNPVATEQYGSIVNSAVEDESSAEGDDEY

SEQ ID NO: 180584 - protein, 36 aa, Artificial Sequence
  Description of Artificial Sequence: Synthetic polypeptide
SEEEIRTTNPVATEQYGCVCGNWGAHNQNFNSDTQS

SEQ ID NO: 180585 - protein, 36 aa, Artificial Sequence
  Description of Artificial Sequence: Synthetic polypeptide
SEEEIRTTNPVATEQYGCVCGNWAHNQENFNSDNQS

SEQ ID NO: 180586 - protein, 31 aa, Artificial Sequence
  Description of Artificial Sequence: Synthetic polypeptide
DDSEVASTNPVSTEGFGNVAANTIQSRVGQR

SEQ ID NO: 180587 - protein, 34 aa, Artificial Sequence
  Description of Artificial Sequence: Synthetic polypeptide
DEQEIATTNPAVAGVQYGGSVSATDLEDLEDEDL

SEQ ID NO: 180588 - protein, 36 aa, Artificial Sequence
  Description of Artificial Sequence: Synthetic polypeptide
SEEEIRTTNPVATEQYGCSCSWGEHNQEHFQSDTQA

SEQ ID NO: 180589 - protein, 38 aa, Artificial Sequence
  Description of Artificial Sequence: Synthetic polypeptide
DNEEIRTTNPVATEQYGSVDCPMSLGFQSENILQNVEI

SEQ ID NO: 180590 - protein, 37 aa, Artificial Sequence
  Description of Artificial Sequence: Synthetic polypeptide
SEEEIRTTNPVATEQYGCSCSTWGEHNQEYFQSDTQS

SEQ ID NO: 180591 - protein, 34 aa, Artificial Sequence
  Description of Artificial Sequence: Synthetic polypeptide
DEEEISTTNPVAYEQYGCVCSWEEHNANFNSDQA

SEQ ID NO: 180592 - protein, 31 aa, Artificial Sequence
  Description of Artificial Sequence: Synthetic polypeptide
DDSEVASTNPVSTEGYGNVAANTIQSDVGQR

SEQ ID NO: 180593 - protein, 38 aa, Artificial Sequence
  Description of Artificial Sequence: Synthetic polypeptide
DNEEIRTTNPVATEQYGSVSCPMSLGAQSEDILQGWEI

SEQ ID NO: 180594 - protein, 35 aa, Artificial Sequence
  Description of Artificial Sequence: Synthetic polypeptide
DEEEISTTNPVAYEQYGCVCSWEEHNQNFNSDTQS

SEQ ID NO: 180595 - protein, 35 aa, Artificial Sequence
  Description of Artificial Sequence: Synthetic polypeptide
DECEICTTNPVATTQYGVVATTQLQQGTESGSTDQ

SEQ ID NO: 180596 - protein, 35 aa, Artificial Sequence
  Description of Artificial Sequence: Synthetic polypeptide
SEEEIRTTNPVATEQYGCMNQLSVLETTRPENKEA

SEQ ID NO: 180597 - protein, 35 aa, Artificial Sequence
  Description of Artificial Sequence: Synthetic polypeptide
SEEEIRTTNPVATEQYGAVVDDDNMVEGDGEGMTS

SEQ ID NO: 180598 - protein, 38 aa, Artificial Sequence
  Description of Artificial Sequence: Synthetic polypeptide
DENEIRTTNPVATEQYGSVCSFTPVVMHNSRQEVSFED

SEQ ID NO: 180599 - protein, 36 aa, Artificial Sequence
  Description of Artificial Sequence: Synthetic polypeptide
SEEEIRTTNPVATEQYGAVSVDQNEMGEENDGGGDE

SEQ ID NO: 180600 - protein, 31 aa, Artificial Sequence
  Description of Artificial Sequence: Synthetic polypeptide
DDSEVASTNPVSTEGYGNVAANTIQSEVGQR

SEQ ID NO: 180601 - protein, 38 aa, Artificial Sequence
  Description of Artificial Sequence: Synthetic polypeptide
SEEEIRTTNPVATEQYGAIMWSTINFIQNVGEEGEGNI

SEQ ID NO: 180602 - protein, 38 aa, Artificial Sequence
  Description of Artificial Sequence: Synthetic polypeptide
SEEEIRTTNPVATEQYGAIMWSTINFIQENGEEGNGEI

SEQ ID NO: 180603 - protein, 38 aa, Artificial Sequence
  Description of Artificial Sequence: Synthetic polypeptide
SEEEIRTTNPVATEQYGAIMWSTINFIQDNGEEDEGNT

SEQ ID NO: 180604 - protein, 38 aa, Artificial Sequence
  Description of Artificial Sequence: Synthetic polypeptide
SEEEIRTTNPVATEQYGAIMWSTINFIQDNDEEGEGND

SEQ ID NO: 180605 - protein, 38 aa, Artificial Sequence
  Description of Artificial Sequence: Synthetic polypeptide
SEEEIRTTNPVATEQYGAIMWSTINFGQDNEEEGNGNI

SEQ ID NO: 180606 - protein, 37 aa, Artificial Sequence
  Description of Artificial Sequence: Synthetic polypeptide
SEEEIRTTNPVATEQYGACGSVDGGDNGQGGEQEQIA

SEQ ID NO: 180607 - protein, 36 aa, Artificial Sequence
  Description of Artificial Sequence: Synthetic polypeptide
DNEEIRTTNPVATEQYGSINNSATEDESSAEGDDEF

SEQ ID NO: 180608 - protein, 35 aa, Artificial Sequence
  Description of Artificial Sequence: Synthetic polypeptide
DEDEIRSTNPVGTEQYGSVCTDDQTGQGEGGQEEE

SEQ ID NO: 180609 - protein, 36 aa, Artificial Sequence
  Description of Artificial Sequence: Synthetic polypeptide
DNEEIRTTNPVATEQYGSICNSATDESSAEGDDEHH

SEQ ID NO: 180610 - protein, 35 aa, Artificial Sequence
  Description of Artificial Sequence: Synthetic polypeptide
TSEEIQTTNPVAWEMWGSTVPAPTNAASQRVGNAV

SEQ ID NO: 180611 - protein, 36 aa, Artificial Sequence
  Description of Artificial Sequence: Synthetic polypeptide
DENEIRTTNPVATEQYGSVEYTWNMIGTESSEEHTQ

SEQ ID NO: 180612 - protein, 36 aa, Artificial Sequence
  Description of Artificial Sequence: Synthetic polypeptide
DEAEIRTTNPVATEQYGQCVCSWGEHNQENFNSDQS

SEQ ID NO: 180613 - protein, 37 aa, Artificial Sequence
  Description of Artificial Sequence: Synthetic polypeptide
DEAEIRTTNPVATEQYGQCVCSWGEHNQENFGSENQA

SEQ ID NO: 180614 - protein, 35 aa, Artificial Sequence
  Description of Artificial Sequence: Synthetic polypeptide
DEAEIRTTNPVATEQYGQCVCSWGEDNQNFPSDQS

SEQ ID NO: 180615 - protein, 36 aa, Artificial Sequence
  Description of Artificial Sequence: Synthetic polypeptide
SEEEIRTTNPVATEQYGCVCSNWMEHNANFGSQTQS

SEQ ID NO: 180616 - protein, 33 aa, Artificial Sequence
  Description of Artificial Sequence: Synthetic polypeptide
DESEIRTTNPIATECWGATSAIDEQERKGEPYI

SEQ ID NO: 180617 - protein, 35 aa, Artificial Sequence
  Description of Artificial Sequence: Synthetic polypeptide
DEEEIRTTNPVATECWGMHCWTMNEQQERRQQDQD

SEQ ID NO: 180618 - protein, 37 aa, Artificial Sequence
  Description of Artificial Sequence: Synthetic polypeptide
DENEIRTTNPVATEQYGSVCYVTWPDLNEDIMGDHEG

SEQ ID NO: 180619 - protein, 35 aa, Artificial Sequence
  Description of Artificial Sequence: Synthetic polypeptide
DEQEIATTNPAATEFYGSVSATGDGEDQEGGELGD

SEQ ID NO: 180620 - protein, 32 aa, Artificial Sequence
  Description of Artificial Sequence: Synthetic polypeptide
DMSEVASTNPVSTEGYGNVAANTIQSRVGIQR

SEQ ID NO: 180621 - protein, 32 aa, Artificial Sequence
  Description of Artificial Sequence: Synthetic polypeptide
DMSEVASTNPVSTEGYGNVAANTIQSRVGQVR

SEQ ID NO: 180622 - protein, 36 aa, Artificial Sequence
  Description of Artificial Sequence: Synthetic polypeptide
SEEEIRTTNPVATEQYGCVCSNTGEHTENFNSDTQN

SEQ ID NO: 180623 - protein, 36 aa, Artificial Sequence
  Description of Artificial Sequence: Synthetic polypeptide
DEEEISTTNPVAYEQYGCVCSSGEHDQEGFISDNQS

SEQ ID NO: 180624 - protein, 33 aa, Artificial Sequence
  Description of Artificial Sequence: Synthetic polypeptide
DESEIRTTNPIATECWGATACINEPADREGENG

SEQ ID NO: 180625 - protein, 33 aa, Artificial Sequence
  Description of Artificial Sequence: Synthetic polypeptide
DESEIRTTNPIATECWGATACENEPADRKGENG

SEQ ID NO: 180626 - protein, 36 aa, Artificial Sequence
  Description of Artificial Sequence: Synthetic polypeptide
SEEEIRTTNPVATEQYGCVCSAGEHNDENFGSDTQS

SEQ ID NO: 180627 - protein, 33 aa, Artificial Sequence
  Description of Artificial Sequence: Synthetic polypeptide
DESEIRTTNPIATECWGATACENEPADREGENG

SEQ ID NO: 180628 - protein, 38 aa, Artificial Sequence
  Description of Artificial Sequence: Synthetic polypeptide
DENEIRTTNPVATEQYGSVCSVTWPINTEDRPFVHEPG

SEQ ID NO: 180629 - protein, 38 aa, Artificial Sequence
  Description of Artificial Sequence: Synthetic polypeptide
DENEIRTTNPVATEQYGSVCSVTWPINQEDRNFVHEGG

SEQ ID NO: 180630 - protein, 31 aa, Artificial Sequence
  Description of Artificial Sequence: Synthetic polypeptide
DDSEVASTNPVSTEGYGNVAANTIQSAVGQR

SEQ ID NO: 180631 - protein, 36 aa, Artificial Sequence
  Description of Artificial Sequence: Synthetic polypeptide
SEEEIRTTNPVATEQYGCVCGWGEHNQENFGSDNQS

SEQ ID NO: 180632 - protein, 36 aa, Artificial Sequence
  Description of Artificial Sequence: Synthetic polypeptide
DNEEIRTTNPVATEQYGCVSTSVNDIEEDDTSIESC

SEQ ID NO: 180633 - protein, 35 aa, Artificial Sequence
  Description of Artificial Sequence: Synthetic polypeptide
SEEEIRTTNPVATEQYGCVCGWGAHNIENFNSDQS

SEQ ID NO: 180634 - protein, 37 aa, Artificial Sequence
  Description of Artificial Sequence: Synthetic polypeptide
DENEIRTTNPVATEQYGSVCSVTWPIDEDRPFVHEGG

SEQ ID NO: 180635 - protein, 35 aa, Artificial Sequence
  Description of Artificial Sequence: Synthetic polypeptide
DEEEISTTNPVAYEQYGCVCSSGEHNIENFGSDQS

SEQ ID NO: 180636 - protein, 36 aa, Artificial Sequence
  Description of Artificial Sequence: Synthetic polypeptide
SEEEIRTTNPVATEQYGCVCGTGADNQENFNSDNQS

SEQ ID NO: 180637 - protein, 31 aa, Artificial Sequence
  Description of Artificial Sequence: Synthetic polypeptide
DISEVASTNPVSTEGYGNVAANTIQSEVGQR

SEQ ID NO: 180638 - protein, 36 aa, Artificial Sequence
  Description of Artificial Sequence: Synthetic polypeptide
DENEIRTTNPVATEQYGSVPYQTDEEDFPGSIEEVP

SEQ ID NO: 180639 - protein, 36 aa, Artificial Sequence
  Description of Artificial Sequence: Synthetic polypeptide
DENEIRTTNPVATEQYGSVPYQTDEEDIPPSIEGVP

SEQ ID NO: 180640 - protein, 36 aa, Artificial Sequence
  Description of Artificial Sequence: Synthetic polypeptide
DEAEIRTTNPVATEQYGSIPWTPPLEENQHSQSEKQ

SEQ ID NO: 180641 - protein, 35 aa, Artificial Sequence
  Description of Artificial Sequence: Synthetic polypeptide
DEDEIRTTNPVAYEQWGSVCYMQNDDQDGGGGGIM

SEQ ID NO: 180642 - protein, 37 aa, Artificial Sequence
  Description of Artificial Sequence: Synthetic polypeptide
DEEEIRTTNPCATEQYGSVIEPVLLHQQITQGFQPAP

SEQ ID NO: 180643 - protein, 34 aa, Artificial Sequence
  Description of Artificial Sequence: Synthetic polypeptide
DESEIRTTNPIATECWGSTTACENWPQDPEGNYI

SEQ ID NO: 180644 - protein, 36 aa, Artificial Sequence
  Description of Artificial Sequence: Synthetic polypeptide
DEAEIRTTNPVATEQYGSIPWTPPLEENQHQSEESP

SEQ ID NO: 180645 - protein, 37 aa, Artificial Sequence
  Description of Artificial Sequence: Synthetic polypeptide
DEEEISTTNPVAYEQWGSVSGNPPGNGGNMRNMEGMS

SEQ ID NO: 180646 - protein, 38 aa, Artificial Sequence
  Description of Artificial Sequence: Synthetic polypeptide
DEEEIRTTNPVATEQYGCVTSTTGADDNAEYFGSDPQS

SEQ ID NO: 180647 - protein, 36 aa, Artificial Sequence
  Description of Artificial Sequence: Synthetic polypeptide
DEAEIRTTNPVATEQYGSIPWTPPLEENFHQSETHQ

SEQ ID NO: 180648 - protein, 36 aa, Artificial Sequence
  Description of Artificial Sequence: Synthetic polypeptide
DEAEIRTTNPVATEQYGSIPWTPPLEANQDHQSEGM

SEQ ID NO: 180649 - protein, 34 aa, Artificial Sequence
  Description of Artificial Sequence: Synthetic polypeptide
DESEIRTTNPIATECWGSTTAAENWPQDPEGNYI

SEQ ID NO: 180650 - protein, 35 aa, Artificial Sequence
  Description of Artificial Sequence: Synthetic polypeptide
DEDEIRTTNPVAYEQWGSVCYNQNDDMDRGGGGIM

SEQ ID NO: 180651 - protein, 37 aa, Artificial Sequence
  Description of Artificial Sequence: Synthetic polypeptide
DEAEIRTTNPVATEQYGSIPWTPNLEENQDHYQSEPM

SEQ ID NO: 180652 - protein, 36 aa, Artificial Sequence
  Description of Artificial Sequence: Synthetic polypeptide
DEAEIRTTNPVATEQYGSIPWTPMLEENQHQSEMHQ

SEQ ID NO: 180653 - protein, 36 aa, Artificial Sequence
  Description of Artificial Sequence: Synthetic polypeptide
CEEEIRTTNPVATEQYGVVVGDTNDDEEEEGGQGET

SEQ ID NO: 180654 - protein, 33 aa, Artificial Sequence
  Description of Artificial Sequence: Synthetic polypeptide
DESEIRTTNPIATECWGSTANCINWADPEGNYG

SEQ ID NO: 180655 - protein, 39 aa, Artificial Sequence
  Description of Artificial Sequence: Synthetic polypeptide
DEEEIRTTNPVATEAYGVVSVTVTDQQGNQQQGTNVATE

SEQ ID NO: 180656 - protein, 35 aa, Artificial Sequence
  Description of Artificial Sequence: Synthetic polypeptide
DEAEIRTTNPVATEQYGSIPWFPPLEENMHQSERQ

SEQ ID NO: 180657 - protein, 35 aa, Artificial Sequence
  Description of Artificial Sequence: Synthetic polypeptide
DEAEIRTTNPVATEQYGSIPWEPLLEENQHQSEHQ

SEQ ID NO: 180658 - protein, 37 aa, Artificial Sequence
  Description of Artificial Sequence: Synthetic polypeptide
DEEEIRTTNPVATEQYGCVTSTTPADNAEHFISEPVA

SEQ ID NO: 180659 - protein, 37 aa, Artificial Sequence
  Description of Artificial Sequence: Synthetic polypeptide
DEAEIRTTNPVATEQYGSIPRTPPLEHNQDHQSEENP

SEQ ID NO: 180660 - protein, 34 aa, Artificial Sequence
  Description of Artificial Sequence: Synthetic polypeptide
VEDEIATTNPVAYEQYGSVCAAGGLDNRDPDNQN

SEQ ID NO: 180661 - protein, 37 aa, Artificial Sequence
  Description of Artificial Sequence: Synthetic polypeptide
DEAEIRTTNPVATEQYGSIPRPPPLEENQDHGQSERP

SEQ ID NO: 180662 - protein, 36 aa, Artificial Sequence
  Description of Artificial Sequence: Synthetic polypeptide
DEAEIRTTNPVATEQYGSIPETPDLEENQDHQSEPM

SEQ ID NO: 180663 - protein, 37 aa, Artificial Sequence
  Description of Artificial Sequence: Synthetic polypeptide
DEAEIRTTNPVATEQYGSIFNWENELDENDSGENFNQ

SEQ ID NO: 180664 - protein, 36 aa, Artificial Sequence
  Description of Artificial Sequence: Synthetic polypeptide
CEEEIRTTNPVATEQYGVVVTGFVGDEGGQTNINNA

SEQ ID NO: 180665 - protein, 36 aa, Artificial Sequence
  Description of Artificial Sequence: Synthetic polypeptide
DEAEIRTTNPVATEQYGSIPWTPPLEENQSHISEHQ

SEQ ID NO: 180666 - protein, 37 aa, Artificial Sequence
  Description of Artificial Sequence: Synthetic polypeptide
DENEIRTTNPVATEQYGSVSPYQYDEEDQTPSIEERP

SEQ ID NO: 180667 - protein, 35 aa, Artificial Sequence
  Description of Artificial Sequence: Synthetic polypeptide
DEDEIRTTNPVAYEQWGSVCYMNDNHDRGGGGAIM

SEQ ID NO: 180668 - protein, 35 aa, Artificial Sequence
  Description of Artificial Sequence: Synthetic polypeptide
DEYEIRTTNPVATEQYGSVPEAPDIQYETVVEVTQ

SEQ ID NO: 180669 - protein, 38 aa, Artificial Sequence
  Description of Artificial Sequence: Synthetic polypeptide
CEEEIRTTNPVATEQYGSYVGPTVPNSSEASEGMENEL

SEQ ID NO: 180670 - protein, 34 aa, Artificial Sequence
  Description of Artificial Sequence: Synthetic polypeptide
DEEEISTTNPVAYEQWGSTVAPTPEFSQTEDQED

SEQ ID NO: 180671 - protein, 36 aa, Artificial Sequence
  Description of Artificial Sequence: Synthetic polypeptide
DEYEIRTTNPVATEQYGCVDTDQENGSVETEGSQVE

SEQ ID NO: 180672 - protein, 35 aa, Artificial Sequence
  Description of Artificial Sequence: Synthetic polypeptide
CEEEIRTTNPVATEQYGTVDGELNDGEGGGEQEGE

SEQ ID NO: 180673 - protein, 35 aa, Artificial Sequence
  Description of Artificial Sequence: Synthetic polypeptide
DEEEISTTNPVAYEQWGSTVASIPELSQYTEDQED

SEQ ID NO: 180674 - protein, 36 aa, Artificial Sequence
  Description of Artificial Sequence: Synthetic polypeptide
DEEEISTTNPVAYEQWGSTVASTPELSQITTEPQED

SEQ ID NO: 180675 - protein, 36 aa, Artificial Sequence
  Description of Artificial Sequence: Synthetic polypeptide
DEAEIRTTNPVATEQYGSIPWTPWLEENQDHQSEPV

SEQ ID NO: 180676 - protein, 37 aa, Artificial Sequence
  Description of Artificial Sequence: Synthetic polypeptide
DEQEIATTNPVAYEQYGSVAAITNNEEAPGNQTEGRP

SEQ ID NO: 180677 - protein, 38 aa, Artificial Sequence
  Description of Artificial Sequence: Synthetic polypeptide
DEEEIRTTNPCATEQYGSVPAVNICLQDIAGQDQATDH

SEQ ID NO: 180678 - protein, 38 aa, Artificial Sequence
  Description of Artificial Sequence: Synthetic polypeptide
CEEEIRTTNPVATEQYGVVSILGATGDNDQDEQGGDGD

SEQ ID NO: 180679 - protein, 36 aa, Artificial Sequence
  Description of Artificial Sequence: Synthetic polypeptide
DEEEIRTTNPCATEQYGSVIEPVSHQQITQGFQVAE

SEQ ID NO: 180680 - protein, 35 aa, Artificial Sequence
  Description of Artificial Sequence: Synthetic polypeptide
VEDEIATTNPVAYEQYGSVCAAGGLGDNRDNDNRN

SEQ ID NO: 180681 - protein, 37 aa, Artificial Sequence
  Description of Artificial Sequence: Synthetic polypeptide
CEEEIRTTNPVATEQYGVVSILIATGDEDLDEGGDDD

SEQ ID NO: 180682 - protein, 37 aa, Artificial Sequence
  Description of Artificial Sequence: Synthetic polypeptide
DEYEIRTTNPVATEQYGSVEQTPLNWAEEHIGDEPQN

SEQ ID NO: 180683 - protein, 37 aa, Artificial Sequence
  Description of Artificial Sequence: Synthetic polypeptide
DEYEIRTTNPVATEQYGSVGIWTENYGEAPEIENEVD

SEQ ID NO: 180684 - protein, 36 aa, Artificial Sequence
  Description of Artificial Sequence: Synthetic polypeptide
DEAEIRTTNPVATEQYGSIPWTPPLHENQHFQSEHQ

SEQ ID NO: 180685 - protein, 37 aa, Artificial Sequence
  Description of Artificial Sequence: Synthetic polypeptide
CEEEIRTTNPVATEQYGVVSILIATGDEDNSEGGDGT

SEQ ID NO: 180686 - protein, 37 aa, Artificial Sequence
  Description of Artificial Sequence: Synthetic polypeptide
CEEEIRTTNPVATEQYGVVSILIATGDEDQIEEGDGD

SEQ ID NO: 180687 - protein, 38 aa, Artificial Sequence
  Description of Artificial Sequence: Synthetic polypeptide
CEEEIATTNPVATEQYGSVCAMNNGELTNPDDQMGNQM

SEQ ID NO: 180688 - protein, 36 aa, Artificial Sequence
  Description of Artificial Sequence: Synthetic polypeptide
DEAEIRTTNPVATEQYGSIPWTPPLETNQMHQSEPQ

SEQ ID NO: 180689 - protein, 37 aa, Artificial Sequence
  Description of Artificial Sequence: Synthetic polypeptide
DEEEIRTTNPCATEQYGSVIEPVNPDQQITQGFQPAP

SEQ ID NO: 180690 - protein, 36 aa, Artificial Sequence
  Description of Artificial Sequence: Synthetic polypeptide
DEAEIRTTNPVATEQYGSIPWTPPLEINQDHQDEPM

SEQ ID NO: 180691 - protein, 38 aa, Artificial Sequence
  Description of Artificial Sequence: Synthetic polypeptide
CEEEIRTTNPVATEQYGVVSILIATGDNDQENGGDPGD

SEQ ID NO: 180692 - protein, 36 aa, Artificial Sequence
  Description of Artificial Sequence: Synthetic polypeptide
DEYEIRTTNPVATEQYGSVPEAGPDEQYNTVVEVRQ

SEQ ID NO: 180693 - protein, 36 aa, Artificial Sequence
  Description of Artificial Sequence: Synthetic polypeptide
DEYEIRTTNPVATEQYGSVPEAPDIQSNTTVVEVMQ

SEQ ID NO: 180694 - protein, 36 aa, Artificial Sequence
  Description of Artificial Sequence: Synthetic polypeptide
DEEEIRTTNPCATEQYGSVIEPVNHQQIQQEFQPAL

SEQ ID NO: 180695 - protein, 39 aa, Artificial Sequence
  Description of Artificial Sequence: Synthetic polypeptide
DEEEIRTTNPVATEAYGVVSVTVVNNQQNNDEGTNVATE

SEQ ID NO: 180696 - protein, 39 aa, Artificial Sequence
  Description of Artificial Sequence: Synthetic polypeptide
SEEEIRTTNPVATEQYGSNIVTWSWNDEEQNPEPEINRV

SEQ ID NO: 180697 - protein, 39 aa, Artificial Sequence
  Description of Artificial Sequence: Synthetic polypeptide
SEEEIRTTNPVATEQYGSNIVTCSINDEEQNNEPEINRV

SEQ ID NO: 180698 - protein, 35 aa, Artificial Sequence
  Description of Artificial Sequence: Synthetic polypeptide
DEAEIRTTNPVATEQYGSFTCEGTPDMLPEESEEQ

SEQ ID NO: 180699 - protein, 35 aa, Artificial Sequence
  Description of Artificial Sequence: Synthetic polypeptide
DEAEIRTTNPVATEQYGSFPYTWLFMESESIEDQM

SEQ ID NO: 180700 - protein, 38 aa, Artificial Sequence
  Description of Artificial Sequence: Synthetic polypeptide
DEEEIRTTNPVATEQYGCVTSTWGAGDNAEYFNSDPQS

SEQ ID NO: 180701 - protein, 31 aa, Artificial Sequence
  Description of Artificial Sequence: Synthetic polypeptide
DDSEVASTNPVSTEGYGNVAANTIQQREGQH

SEQ ID NO: 180702 - protein, 35 aa, Artificial Sequence
  Description of Artificial Sequence: Synthetic polypeptide
DEAEIRTTNPVATEQYGSCYVENMAEYNGSMYSDN

SEQ ID NO: 180703 - protein, 37 aa, Artificial Sequence
  Description of Artificial Sequence: Synthetic polypeptide
SEEEIRTTNPVATEQYGQCVCGNWGAHNQNFGSDNQA

SEQ ID NO: 180704 - protein, 34 aa, Artificial Sequence
  Description of Artificial Sequence: Synthetic polypeptide
DEAEIRTTNPVATEQYGSCYPWLMESMESIEDQM

SEQ ID NO: 180705 - protein, 36 aa, Artificial Sequence
  Description of Artificial Sequence: Synthetic polypeptide
SEEEIRTTNPVATEQYGQCSVTNINAQSTIMEMQEE

SEQ ID NO: 180706 - protein, 32 aa, Artificial Sequence
  Description of Artificial Sequence: Synthetic polypeptide
DGSEVASTNPVSTEGYGNVAANTIAQSRVGQR

SEQ ID NO: 180707 - protein, 31 aa, Artificial Sequence
  Description of Artificial Sequence: Synthetic polypeptide
DGSEVASTNPVSTEGYGNVAANTIGSRVGQR

SEQ ID NO: 180708 - protein, 31 aa, Artificial Sequence
  Description of Artificial Sequence: Synthetic polypeptide
DGSEVASTNPVSYEGYGNVAANTIQPRVGQR

SEQ ID NO: 180709 - protein, 36 aa, Artificial Sequence
  Description of Artificial Sequence: Synthetic polypeptide
DENEIRTTNPVATEQYGSVQVDGEEQIEQTEEANIL

SEQ ID NO: 180710 - protein, 35 aa, Artificial Sequence
  Description of Artificial Sequence: Synthetic polypeptide
CEEEIRTTNPVAYEQYGQCVCSSGEHEQNFGSDQS

SEQ ID NO: 180711 - protein, 37 aa, Artificial Sequence
  Description of Artificial Sequence: Synthetic polypeptide
DEEEIRTTNPVATEQYGCVTSTWGAHNAEHFSSDTVS

SEQ ID NO: 180712 - protein, 35 aa, Artificial Sequence
  Description of Artificial Sequence: Synthetic polypeptide
CEEEIRTTNPVAYEQYGQCVCSWEHEQNFNSDNQS

SEQ ID NO: 180713 - protein, 37 aa, Artificial Sequence
  Description of Artificial Sequence: Synthetic polypeptide
DEEEIRTTNPVATEAYGVVNGFLGEGDQQEEDEGNEN

SEQ ID NO: 180714 - protein, 34 aa, Artificial Sequence
  Description of Artificial Sequence: Synthetic polypeptide
CEEEIRTTNPVAYEQYGQSVVNIVHSSDNGGSIL

SEQ ID NO: 180715 - protein, 36 aa, Artificial Sequence
  Description of Artificial Sequence: Synthetic polypeptide
DENEIRTTNPVATEQYGSVPYQTDEEQITPSIEEVV

SEQ ID NO: 180716 - protein, 32 aa, Artificial Sequence
  Description of Artificial Sequence: Synthetic polypeptide
DHSEVASTNPVSTEGYGNVAANTIQSRVGQER

SEQ ID NO: 180717 - protein, 31 aa, Artificial Sequence
  Description of Artificial Sequence: Synthetic polypeptide
DHSEVASTNPVSTEGYGNVAANTIQSRVGQS

SEQ ID NO: 180718 - protein, 36 aa, Artificial Sequence
  Description of Artificial Sequence: Synthetic polypeptide
DENEIRTTNPVATEQYGSVPYQTDEENIPPSIEEVE

SEQ ID NO: 180719 - protein, 36 aa, Artificial Sequence
  Description of Artificial Sequence: Synthetic polypeptide
DENEIRTTNPVATEQYGSVPYQTDEEHQTPSIEEEP

SEQ ID NO: 180720 - protein, 36 aa, Artificial Sequence
  Description of Artificial Sequence: Synthetic polypeptide
DENEIRTTNPVATEQYGSVPYQTDEEDQTPSIEHVC

SEQ ID NO: 180721 - protein, 37 aa, Artificial Sequence
  Description of Artificial Sequence: Synthetic polypeptide
DENEIRTTNPVATEQYGSVPYQTDEEDQTPISIEERE

SEQ ID NO: 180722 - protein, 36 aa, Artificial Sequence
  Description of Artificial Sequence: Synthetic polypeptide
DENEIRTTNPVATEQYGSVPYQTDEEDQIPSIEEIP

SEQ ID NO: 180723 - protein, 38 aa, Artificial Sequence
  Description of Artificial Sequence: Synthetic polypeptide
DEEEIRTTNPVATEQYGCVTSTWGAAHNAEHFGSDPQS

SEQ ID NO: 180724 - protein, 36 aa, Artificial Sequence
  Description of Artificial Sequence: Synthetic polypeptide
SEEEIRTTNPVATEQYGQCVCSWGEHDQNFGSDTQA

SEQ ID NO: 180725 - protein, 32 aa, Artificial Sequence
  Description of Artificial Sequence: Synthetic polypeptide
DDSEVASTNPVSTEGYGNVAANTIQPRVGQLR

SEQ ID NO: 180726 - protein, 35 aa, Artificial Sequence
  Description of Artificial Sequence: Synthetic polypeptide
DEAEIRTTNPVATEQYGSFWYTWPLMESESIEDQM

SEQ ID NO: 180727 - protein, 34 aa, Artificial Sequence
  Description of Artificial Sequence: Synthetic polypeptide
DESEIRTTNPIATECWGAVWACENWPQEREGPYI

SEQ ID NO: 180728 - protein, 35 aa, Artificial Sequence
  Description of Artificial Sequence: Synthetic polypeptide
DEYEIRTTNPVAYEEWGCSVSCTTGFSHSGEGNSA

SEQ ID NO: 180729 - protein, 36 aa, Artificial Sequence
  Description of Artificial Sequence: Synthetic polypeptide
DEAEIRTTNPVATEQYGSGFYTWLMESMEQSIEDQM

SEQ ID NO: 180730 - protein, 34 aa, Artificial Sequence
  Description of Artificial Sequence: Synthetic polypeptide
DEAEIRTTNPVATEQYGSFYTWYMESEESIEDQM

SEQ ID NO: 180731 - protein, 35 aa, Artificial Sequence
  Description of Artificial Sequence: Synthetic polypeptide
DEAEIRTTNPVATEQYGSFYTWTLMESEFSIEDQC

SEQ ID NO: 180732 - protein, 34 aa, Artificial Sequence
  Description of Artificial Sequence: Synthetic polypeptide
DESEIRTTNPIATECWGAVWACENEPQEREGPYI

SEQ ID NO: 180733 - protein, 34 aa, Artificial Sequence
  Description of Artificial Sequence: Synthetic polypeptide
DESEIRTTNPIATECWGAVWACENEPQEREGPYG

SEQ ID NO: 180734 - protein, 37 aa, Artificial Sequence
  Description of Artificial Sequence: Synthetic polypeptide
DEEEIRTTNPVATEQYGCVCSMTGEDDQENFISETQA

SEQ ID NO: 180735 - protein, 37 aa, Artificial Sequence
  Description of Artificial Sequence: Synthetic polypeptide
DEEEISTTNPVAYEQYGCVCSNTGEDNQENFGSENQA

SEQ ID NO: 180736 - protein, 35 aa, Artificial Sequence
  Description of Artificial Sequence: Synthetic polypeptide
DEAEIRTTNPVATEQYGSFYTWQLAESMESIEDQM

SEQ ID NO: 180737 - protein, 35 aa, Artificial Sequence
  Description of Artificial Sequence: Synthetic polypeptide
DEAEIRTTNPVATEQYGSFYTWLMESMEADIEDQM

SEQ ID NO: 180738 - protein, 35 aa, Artificial Sequence
  Description of Artificial Sequence: Synthetic polypeptide
CEEEIRTTNPVAYEAYGKVVHCTNHAGNPKGNYGF

SEQ ID NO: 180739 - protein, 37 aa, Artificial Sequence
  Description of Artificial Sequence: Synthetic polypeptide
DEQEIATTNPVAYEQYGSVACTPANPHNQEAEIGNDN

SEQ ID NO: 180740 - protein, 39 aa, Artificial Sequence
  Description of Artificial Sequence: Synthetic polypeptide
DEEEIRTTNPVATEAYGVVSVTVVVNQQGNSEQGTVNTE

SEQ ID NO: 180741 - protein, 31 aa, Artificial Sequence
  Description of Artificial Sequence: Synthetic polypeptide
TSEEIASVNPVCYEAYGVVSINELSDSGGNQ

SEQ ID NO: 180742 - protein, 37 aa, Artificial Sequence
  Description of Artificial Sequence: Synthetic polypeptide
DEDEIRTTNPVAYEQWGSVSGGEPGNGGNMRNGMNME

SEQ ID NO: 180743 - protein, 31 aa, Artificial Sequence
  Description of Artificial Sequence: Synthetic polypeptide
AETEIRCTNPIATEQWGETWSNEDWAPKGPR

SEQ ID NO: 180744 - protein, 39 aa, Artificial Sequence
  Description of Artificial Sequence: Synthetic polypeptide
DEEEIRTTNPVATEAYGVVSTNLQNNQANTTEQGTTVTE

SEQ ID NO: 180745 - protein, 35 aa, Artificial Sequence
  Description of Artificial Sequence: Synthetic polypeptide
DEAEIRTTNPVATEQYGSFYTWLGMESLESIEDQM

SEQ ID NO: 180746 - protein, 34 aa, Artificial Sequence
  Description of Artificial Sequence: Synthetic polypeptide
DEAEIRTTNPVATEQYGSFYTWCPMESESIEDQC

SEQ ID NO: 180747 - protein, 34 aa, Artificial Sequence
  Description of Artificial Sequence: Synthetic polypeptide
CEEEIRTTNPVAYEQWGSVCVNWEHGEQDMHQFI

SEQ ID NO: 180748 - protein, 38 aa, Artificial Sequence
  Description of Artificial Sequence: Synthetic polypeptide
DEEEIRTTNPVATEAYGVVTVVVTTNGNNQQGNQNNQD

SEQ ID NO: 180749 - protein, 37 aa, Artificial Sequence
  Description of Artificial Sequence: Synthetic polypeptide
DEEEIRTTNPVATEAYGVVTVVVTTNNEQAGTQGTQD

SEQ ID NO: 180750 - protein, 31 aa, Artificial Sequence
  Description of Artificial Sequence: Synthetic polypeptide
DDSEVASTNPVSTEGYGNVAANTIQNRVGQC

SEQ ID NO: 180751 - protein, 34 aa, Artificial Sequence
  Description of Artificial Sequence: Synthetic polypeptide
DESEIRTTNPIATECWGATVANAINWQEPKGNYI

SEQ ID NO: 180752 - protein, 34 aa, Artificial Sequence
  Description of Artificial Sequence: Synthetic polypeptide
DEAEIRTTNPVATEQYGSFYHWLMESESSIEDQM

SEQ ID NO: 180753 - protein, 36 aa, Artificial Sequence
  Description of Artificial Sequence: Synthetic polypeptide
DEDEIRTTNPVAYEQWGSVSGGEPAGPNMRNGGGPS

SEQ ID NO: 180754 - protein, 34 aa, Artificial Sequence
  Description of Artificial Sequence: Synthetic polypeptide
DENEIRTTNPVATEQWGQCVCSSPEANAFNSDAN

SEQ ID NO: 180755 - protein, 36 aa, Artificial Sequence
  Description of Artificial Sequence: Synthetic polypeptide
DEQEIATTNPVAYEQYGSVAGTGHQGGLDHDGAGRN

SEQ ID NO: 180756 - protein, 37 aa, Artificial Sequence
  Description of Artificial Sequence: Synthetic polypeptide
DENEIRTTNPVATEQYGSVANTAPPLSEVTIGVSEQY

SEQ ID NO: 180757 - protein, 35 aa, Artificial Sequence
  Description of Artificial Sequence: Synthetic polypeptide
DESEIRTTNCVATDFYGSVNTVGNGGQLEGGEGDT

SEQ ID NO: 180758 - protein, 34 aa, Artificial Sequence
  Description of Artificial Sequence: Synthetic polypeptide
DEDEIRTTNPVSTEPYGTTISCMEDISQQQNGNH

SEQ ID NO: 180759 - protein, 37 aa, Artificial Sequence
  Description of Artificial Sequence: Synthetic polypeptide
DEEEIRTTNPVATEQYGDVVENEMNDLGGGGGGGETG

SEQ ID NO: 180760 - protein, 38 aa, Artificial Sequence
  Description of Artificial Sequence: Synthetic polypeptide
DEEEIRTTNPVATEQYGDVVENQEMNDLTGQGGGGETG

SEQ ID NO: 180761 - protein, 36 aa, Artificial Sequence
  Description of Artificial Sequence: Synthetic polypeptide
DEEEISTTNPVAYEQYGQCVCSNWNDDNQNFGSDQS

SEQ ID NO: 180762 - protein, 36 aa, Artificial Sequence
  Description of Artificial Sequence: Synthetic polypeptide
TSEEIQTTNPVAWEMWGTTVPSPTNAASQDRGGNAR

SEQ ID NO: 180763 - protein, 37 aa, Artificial Sequence
  Description of Artificial Sequence: Synthetic polypeptide
DESEIRTTNCVATDAYGSVSNVTRGNVGQLEGGNGNT

SEQ ID NO: 180764 - protein, 36 aa, Artificial Sequence
  Description of Artificial Sequence: Synthetic polypeptide
DESEIRTTNCVATDAYGSVNVTRGNQGQLETGNGDD

SEQ ID NO: 180765 - protein, 36 aa, Artificial Sequence
  Description of Artificial Sequence: Synthetic polypeptide
DEEEIRTTNPVATECWGSTTSANAEDWPNMRKGPYI

SEQ ID NO: 180766 - protein, 34 aa, Artificial Sequence
  Description of Artificial Sequence: Synthetic polypeptide
DEEEISTTNPVAYEQYGQCVCSWEDDNANGSDQA

SEQ ID NO: 180767 - protein, 38 aa, Artificial Sequence
  Description of Artificial Sequence: Synthetic polypeptide
DEDEIRYTNPVATEAYGSVTSNGTNGQADQEGGQNDTP

SEQ ID NO: 180768 - protein, 37 aa, Artificial Sequence
  Description of Artificial Sequence: Synthetic polypeptide
DEEEIRTTNPVATEQYGDVVGSGMGNLTETVTDDDGP

SEQ ID NO: 180769 - protein, 38 aa, Artificial Sequence
  Description of Artificial Sequence: Synthetic polypeptide
DEEEIRTTNPVATEQYGDVVGSGMGNLTQTVTDDQDGT

SEQ ID NO: 180770 - protein, 36 aa, Artificial Sequence
  Description of Artificial Sequence: Synthetic polypeptide
DESEIRTTNCVATDAYGSVNQTNGNQGQLEIGNGDT

SEQ ID NO: 180771 - protein, 36 aa, Artificial Sequence
  Description of Artificial Sequence: Synthetic polypeptide
DEEEIRTTNPVATEQYGDVVNGFGDDQDQEGGDEQT

SEQ ID NO: 180772 - protein, 37 aa, Artificial Sequence
  Description of Artificial Sequence: Synthetic polypeptide
DEEEIRTTNPVATEQYGDVVNGFGQDPNDQDGGDEQT

SEQ ID NO: 180773 - protein, 36 aa, Artificial Sequence
  Description of Artificial Sequence: Synthetic polypeptide
DESEIRTTNCVATDAYGSVNITFGLQGQLEGGNGDT

SEQ ID NO: 180774 - protein, 34 aa, Artificial Sequence
  Description of Artificial Sequence: Synthetic polypeptide
DEDEISTTNPVAYEQWGTTVPSTPELSQTEDQED

SEQ ID NO: 180775 - protein, 36 aa, Artificial Sequence
  Description of Artificial Sequence: Synthetic polypeptide
TSEEIQTTNPVAWEPWGSTVPSPTNEQSIDRGTNAV

SEQ ID NO: 180776 - protein, 35 aa, Artificial Sequence
  Description of Artificial Sequence: Synthetic polypeptide
DEEEISTTNPVAYEQYGQCVCSWGNHQNFISEFQA

SEQ ID NO: 180777 - protein, 31 aa, Artificial Sequence
  Description of Artificial Sequence: Synthetic polypeptide
DDSEVRSTNPVATEQWGNVSAEIEMSAAGDA

SEQ ID NO: 180778 - protein, 33 aa, Artificial Sequence
  Description of Artificial Sequence: Synthetic polypeptide
SEEEIRTTNPIATECWGSTTWANEDWAPKGPYR

SEQ ID NO: 180779 - protein, 35 aa, Artificial Sequence
  Description of Artificial Sequence: Synthetic polypeptide
DEDEIVCTNPVATEPYGTTVPSCTPALSVDGGNPL

SEQ ID NO: 180780 - protein, 36 aa, Artificial Sequence
  Description of Artificial Sequence: Synthetic polypeptide
AEDEICATNPVATEQYGVVATVEQNLQQGNGIGTDE

SEQ ID NO: 180781 - protein, 38 aa, Artificial Sequence
  Description of Artificial Sequence: Synthetic polypeptide
DENEIRTTNPVATEQYGSASPSDNLVSLEGNEGQFESI

SEQ ID NO: 180782 - protein, 36 aa, Artificial Sequence
  Description of Artificial Sequence: Synthetic polypeptide
DENEIRTTNPVATEQYGSCCMYEIVTHTTPQSQIDG

SEQ ID NO: 180783 - protein, 37 aa, Artificial Sequence
  Description of Artificial Sequence: Synthetic polypeptide
DEEEISTTNPVAYEQYGQCVCSWNDDNQEHFGSDNQS

SEQ ID NO: 180784 - protein, 35 aa, Artificial Sequence
  Description of Artificial Sequence: Synthetic polypeptide
DEEEIRTTNPVATEQYGDVVDGFNGEDFTEDDDQA

SEQ ID NO: 180785 - protein, 36 aa, Artificial Sequence
  Description of Artificial Sequence: Synthetic polypeptide
DQAEIRTTNPVATEQYGSVSWASWNEEASNDDLPLQ

SEQ ID NO: 180786 - protein, 37 aa, Artificial Sequence
  Description of Artificial Sequence: Synthetic polypeptide
SEEEIRTTNPVATECYGCVCTIDSNNHNGQQGGGNGS

SEQ ID NO: 180787 - protein, 35 aa, Artificial Sequence
  Description of Artificial Sequence: Synthetic polypeptide
DEEEIRTTNPCATEQYGCVCQWEDHQENFGSDTAS

SEQ ID NO: 180788 - protein, 36 aa, Artificial Sequence
  Description of Artificial Sequence: Synthetic polypeptide
DEEEIRTTNPCATEQYGCVCQTGEHNIENFGSDTAS

SEQ ID NO: 180789 - protein, 35 aa, Artificial Sequence
  Description of Artificial Sequence: Synthetic polypeptide
DEDEIRTTNPVAYESWGCVTGGNDMQQDRNGGNAA

SEQ ID NO: 180790 - protein, 35 aa, Artificial Sequence
  Description of Artificial Sequence: Synthetic polypeptide
DEDEIRTTNPVAYESWGEVCSNDNDDQPGQQGNAH

SEQ ID NO: 180791 - protein, 35 aa, Artificial Sequence
  Description of Artificial Sequence: Synthetic polypeptide
DEDEIRTTNPVAYESWGEVCSNDNDGQTGQQGNEH

SEQ ID NO: 180792 - protein, 35 aa, Artificial Sequence
  Description of Artificial Sequence: Synthetic polypeptide
DEDEIRTTNPVAYESWGEVCSNDNDQQPGQQGNES

SEQ ID NO: 180793 - protein, 31 aa, Artificial Sequence
  Description of Artificial Sequence: Synthetic polypeptide
DDSEVASTNPVSTEGYGNVAANTIQSRAEQR

SEQ ID NO: 180794 - protein, 36 aa, Artificial Sequence
  Description of Artificial Sequence: Synthetic polypeptide
DEEEIRTTNPCATEQYGCVCGWGNHNQENFGSDTQS

SEQ ID NO: 180795 - protein, 32 aa, Artificial Sequence
  Description of Artificial Sequence: Synthetic polypeptide
DDSEVASTNPVSTEGYGNVAANTIQSRAGQRN

SEQ ID NO: 180796 - protein, 35 aa, Artificial Sequence
  Description of Artificial Sequence: Synthetic polypeptide
DEEEIRTTNPCATEQYGCVCGWEDHNQNFGSDTAS

SEQ ID NO: 180797 - protein, 31 aa, Artificial Sequence
  Description of Artificial Sequence: Synthetic polypeptide
DDSEVRSTNPVSTEQWGNVSAEIEMSRVGDA

SEQ ID NO: 180798 - protein, 35 aa, Artificial Sequence
  Description of Artificial Sequence: Synthetic polypeptide
DEEEIRTTNPVATECWGSTSANTEAWPAEPNGPYV

SEQ ID NO: 180799 - protein, 34 aa, Artificial Sequence
  Description of Artificial Sequence: Synthetic polypeptide
SEEEIRTTNPVATASWGCVAGTNGLAAPGDDQDH

SEQ ID NO: 180800 - protein, 31 aa, Artificial Sequence
  Description of Artificial Sequence: Synthetic polypeptide
DDSEVRSTNPVSTEQWGNVSAEIEMSRAGDA

SEQ ID NO: 180801 - protein, 36 aa, Artificial Sequence
  Description of Artificial Sequence: Synthetic polypeptide
DENEIRTTNPVATEQYGSCMPIMLWPENRSNSQQYS

SEQ ID NO: 180802 - protein, 32 aa, Artificial Sequence
  Description of Artificial Sequence: Synthetic polypeptide
SEEEIRTTNPVATASWGCVAGTGGAAPGDDQD

SEQ ID NO: 180803 - protein, 36 aa, Artificial Sequence
  Description of Artificial Sequence: Synthetic polypeptide
DENEIRTTNPVATEQYGSCMPIMLWPENRSISNQTM

SEQ ID NO: 180804 - protein, 33 aa, Artificial Sequence
  Description of Artificial Sequence: Synthetic polypeptide
SEEEIRTTNPVATASWGCVAGNGLAAPGDDQDP

SEQ ID NO: 180805 - protein, 35 aa, Artificial Sequence
  Description of Artificial Sequence: Synthetic polypeptide
DEDEIRTTNPVAYESWGTVCSNDNHDQPGQGGNEA

SEQ ID NO: 180806 - protein, 36 aa, Artificial Sequence
  Description of Artificial Sequence: Synthetic polypeptide
DEEEIRTTNPCATEQYGCVCGNWGEHNQYFNSDTAS

SEQ ID NO: 180807 - protein, 36 aa, Artificial Sequence
  Description of Artificial Sequence: Synthetic polypeptide
DENEIRTTNPVATEQYGSCMPAMLWPENRSISQQTS

SEQ ID NO: 180808 - protein, 36 aa, Artificial Sequence
  Description of Artificial Sequence: Synthetic polypeptide
TSEEIQTTNPVAWEMWGSTVVSPTNEQSTDRGGNAV

SEQ ID NO: 180809 - protein, 33 aa, Artificial Sequence
  Description of Artificial Sequence: Synthetic polypeptide
DEDEIRTTNPVAYESWGVVSGGNHGNTQGDQGK

SEQ ID NO: 180810 - protein, 36 aa, Artificial Sequence
  Description of Artificial Sequence: Synthetic polypeptide
DEEEIRTTNPCATEQYGCVCGNWEHNQENFNSDTAS

SEQ ID NO: 180811 - protein, 35 aa, Artificial Sequence
  Description of Artificial Sequence: Synthetic polypeptide
DEEEIRTTNPVATEQYGDVVDGFNGEDFEDDEIQA

SEQ ID NO: 180812 - protein, 32 aa, Artificial Sequence
  Description of Artificial Sequence: Synthetic polypeptide
DDSEVASTNPVSTEAYGNVAANTIQSRVGIQR

SEQ ID NO: 180813 - protein, 31 aa, Artificial Sequence
  Description of Artificial Sequence: Synthetic polypeptide
DDSEIASTNPVATEGYGNVAANTIMSRAEQA

SEQ ID NO: 180814 - protein, 31 aa, Artificial Sequence
  Description of Artificial Sequence: Synthetic polypeptide
DDSEVASTNPVSTEGYGNVAANTIQSREGQW

SEQ ID NO: 180815 - protein, 35 aa, Artificial Sequence
  Description of Artificial Sequence: Synthetic polypeptide
AEDEICATNPVATEQYGVVATVENLQQLNGIGTDQ

SEQ ID NO: 180816 - protein, 36 aa, Artificial Sequence
  Description of Artificial Sequence: Synthetic polypeptide
DEEEITTTNPVATEQYGSVSPLSVGQSSIPAEEEDI

SEQ ID NO: 180817 - protein, 37 aa, Artificial Sequence
  Description of Artificial Sequence: Synthetic polypeptide
DENEIRTTNPVATEQYGMVGSIMNQLIENGGGEDEEM

SEQ ID NO: 180818 - protein, 37 aa, Artificial Sequence
  Description of Artificial Sequence: Synthetic polypeptide
DENEIRTTNPVATEQYGMVGSIMNQLIEGGGEEDEMG

SEQ ID NO: 180819 - protein, 37 aa, Artificial Sequence
  Description of Artificial Sequence: Synthetic polypeptide
DENEIRTTNPVATEQYGMVGSIMNQLEIEGGGEDEMG

SEQ ID NO: 180820 - protein, 37 aa, Artificial Sequence
  Description of Artificial Sequence: Synthetic polypeptide
DENEIRTTNPVATEQYGMVGSIMNLGIEEGGGEDEFG

SEQ ID NO: 180821 - protein, 36 aa, Artificial Sequence
  Description of Artificial Sequence: Synthetic polypeptide
DENEIRTTNPVATEQYGMVGSIMDTLDEGGGEDIEG

SEQ ID NO: 180822 - protein, 36 aa, Artificial Sequence
  Description of Artificial Sequence: Synthetic polypeptide
DENEIRTTNPVATEQYGMVGSIMDQLDEGGGEDIEG

SEQ ID NO: 180823 - protein, 34 aa, Artificial Sequence
  Description of Artificial Sequence: Synthetic polypeptide
SEEEIRNTNPTAYECWGSTVYGENDDHRGGDNKR

SEQ ID NO: 180824 - protein, 36 aa, Artificial Sequence
  Description of Artificial Sequence: Synthetic polypeptide
DEEEIRTTNPVAYEPYGQSVPSIHEGSTSPPGAPRL

SEQ ID NO: 180825 - protein, 31 aa, Artificial Sequence
  Description of Artificial Sequence: Synthetic polypeptide
DDSEIACTNPVSTEGYGNAAAETIQSRVGQR

SEQ ID NO: 180826 - protein, 36 aa, Artificial Sequence
  Description of Artificial Sequence: Synthetic polypeptide
DEEEIRTTNPVATEQYGEACRFPWVEEASTQEVNDM

SEQ ID NO: 180827 - protein, 32 aa, Artificial Sequence
  Description of Artificial Sequence: Synthetic polypeptide
DDSEVASTNPVSTEGYGNVAANTIQSRKGQER

SEQ ID NO: 180828 - protein, 31 aa, Artificial Sequence
  Description of Artificial Sequence: Synthetic polypeptide
DDSEIACTNPVSTEGYGNAAAETIQSRVGGR

SEQ ID NO: 180829 - protein, 35 aa, Artificial Sequence
  Description of Artificial Sequence: Synthetic polypeptide
DEEAEIATTNPVAYECWGVVAWNENLQEDGRGGDA

SEQ ID NO: 180830 - protein, 34 aa, Artificial Sequence
  Description of Artificial Sequence: Synthetic polypeptide
DEEAEIATTNPVAYEGWGSVAHGDLQDQDQNGGQ

SEQ ID NO: 180831 - protein, 36 aa, Artificial Sequence
  Description of Artificial Sequence: Synthetic polypeptide
DEEAEIATTNPVAYEQWGCVYSVPNNDQIGERQDQV

SEQ ID NO: 180832 - protein, 36 aa, Artificial Sequence
  Description of Artificial Sequence: Synthetic polypeptide
CEEEIATTNPVATEQYGSACSAENPLPAEAPIGDHE

SEQ ID NO: 180833 - protein, 31 aa, Artificial Sequence
  Description of Artificial Sequence: Synthetic polypeptide
DDSEVASTNPVSTDHYGNVAANTIQSRVGQR

SEQ ID NO: 180834 - protein, 31 aa, Artificial Sequence
  Description of Artificial Sequence: Synthetic polypeptide
DDSCVASTNPVSTEGYGNVASNTIQSRVGQR

SEQ ID NO: 180835 - protein, 31 aa, Artificial Sequence
  Description of Artificial Sequence: Synthetic polypeptide
DDSCVASTNPVSTEGYGNVAINTIQSRVGQR

SEQ ID NO: 180836 - protein, 31 aa, Artificial Sequence
  Description of Artificial Sequence: Synthetic polypeptide
DDSCVASTNPVSTEGYGNVAANTIQSRVGQR

SEQ ID NO: 180837 - protein, 31 aa, Artificial Sequence
  Description of Artificial Sequence: Synthetic polypeptide
DDSCVASTNPVSTEGYGNVAANTEQSRVGQR

SEQ ID NO: 180838 - protein, 36 aa, Artificial Sequence
  Description of Artificial Sequence: Synthetic polypeptide
DENEIRTTNPVATEQYGHACAPVLHDLQTGEVEQQY

SEQ ID NO: 180839 - protein, 36 aa, Artificial Sequence
  Description of Artificial Sequence: Synthetic polypeptide
DENEIRTTNPVATEQYGFVTTVWLPDEQENQQIDEI

SEQ ID NO: 180840 - protein, 35 aa, Artificial Sequence
  Description of Artificial Sequence: Synthetic polypeptide
DEDTIRTTNCVATEQYGSVGGGDNGGGDNDQEGGM

SEQ ID NO: 180841 - protein, 37 aa, Artificial Sequence
  Description of Artificial Sequence: Synthetic polypeptide
DENEIRTTNPVATEQYGQTVTTVWLPDEGENLQITEI

SEQ ID NO: 180842 - protein, 34 aa, Artificial Sequence
  Description of Artificial Sequence: Synthetic polypeptide
DEDTIGTTNPVATEQYGSVDVIGGQEGGGQGETG

SEQ ID NO: 180843 - protein, 35 aa, Artificial Sequence
  Description of Artificial Sequence: Synthetic polypeptide
AEDEICATNPVATEQYGVVATVENNLQQLNNIGTD

SEQ ID NO: 180844 - protein, 31 aa, Artificial Sequence
  Description of Artificial Sequence: Synthetic polypeptide
DDSEIASTNPVATEGYGNVAAETIMSRAEQA

SEQ ID NO: 180845 - protein, 37 aa, Artificial Sequence
  Description of Artificial Sequence: Synthetic polypeptide
DENEIRTTNPVATEQYGQCTQNVVELIRPEGNNEATN

SEQ ID NO: 180846 - protein, 35 aa, Artificial Sequence
  Description of Artificial Sequence: Synthetic polypeptide
DEQEIATTNPVAYERWGSVCSGTDNQDRTEGGQEQ

SEQ ID NO: 180847 - protein, 36 aa, Artificial Sequence
  Description of Artificial Sequence: Synthetic polypeptide
DQEEIGTTNPVATEQYGCVYTTLSAMTNEDGNEDFQ

SEQ ID NO: 180848 - protein, 36 aa, Artificial Sequence
  Description of Artificial Sequence: Synthetic polypeptide
DQEEIGTTNPVATEQYGCVYTTVSAMTNEKGNEDNQ

SEQ ID NO: 180849 - protein, 35 aa, Artificial Sequence
  Description of Artificial Sequence: Synthetic polypeptide
DEQEIATTNPVAYERWGSVCSNTDNHDRQDNQEEP

SEQ ID NO: 180850 - protein, 36 aa, Artificial Sequence
  Description of Artificial Sequence: Synthetic polypeptide
DQEEIGTTNPVATEQYGCVYTTWSAMTNEHGNEDQQ

SEQ ID NO: 180851 - protein, 37 aa, Artificial Sequence
  Description of Artificial Sequence: Synthetic polypeptide
DQEEIGTTNPVATEQYGCVYTTWSAMTNQEKGNETFQ

SEQ ID NO: 180852 - protein, 35 aa, Artificial Sequence
  Description of Artificial Sequence: Synthetic polypeptide
DEQEIATTNPVAYERWGSVCSTTDNHNRDGGQEHG

SEQ ID NO: 180853 - protein, 36 aa, Artificial Sequence
  Description of Artificial Sequence: Synthetic polypeptide
DQEEIKTTNPVAYEQYGSTVCSCNNELSSISDNEDC

SEQ ID NO: 180854 - protein, 35 aa, Artificial Sequence
  Description of Artificial Sequence: Synthetic polypeptide
DEDELRCTNPVATEPYGTTVPSCTPALSIDGGNPS

SEQ ID NO: 180855 - protein, 35 aa, Artificial Sequence
  Description of Artificial Sequence: Synthetic polypeptide
DEDENATTNPVAYEQYGTVATEQGGQQNGGQRGEA

SEQ ID NO: 180856 - protein, 34 aa, Artificial Sequence
  Description of Artificial Sequence: Synthetic polypeptide
DEEEISTTNPVCTEHYGCVCSWPEDNQNFGSELS

SEQ ID NO: 180857 - protein, 34 aa, Artificial Sequence
  Description of Artificial Sequence: Synthetic polypeptide
DEQEIATTNPVAYERWGTVPTTNQQGNDAGGNEN

SEQ ID NO: 180858 - protein, 36 aa, Artificial Sequence
  Description of Artificial Sequence: Synthetic polypeptide
DEDESIRTTNPVAYEPWGCVVSCCANEQQGNDGNNR

SEQ ID NO: 180859 - protein, 36 aa, Artificial Sequence
  Description of Artificial Sequence: Synthetic polypeptide
DENEIRTTNPVATEQYGNVVNDDNGDEQEGGESGDG

SEQ ID NO: 180860 - protein, 35 aa, Artificial Sequence
  Description of Artificial Sequence: Synthetic polypeptide
DEEEISTTNPVSTEQYGCVCGNWGEHNQGFGSQQS

SEQ ID NO: 180861 - protein, 37 aa, Artificial Sequence
  Description of Artificial Sequence: Synthetic polypeptide
DQEEIRTTNPVATCQYGCVCSTTGEGDNQNFGSDNQA

SEQ ID NO: 180862 - protein, 36 aa, Artificial Sequence
  Description of Artificial Sequence: Synthetic polypeptide
DQEEIRTTNPVATCQYGCVCSWGEGDNQNFGSNNQA

SEQ ID NO: 180863 - protein, 32 aa, Artificial Sequence
  Description of Artificial Sequence: Synthetic polypeptide
DDSEVGSTNPVSTEGYGNVAANTIQSRVGEQR

SEQ ID NO: 180864 - protein, 36 aa, Artificial Sequence
  Description of Artificial Sequence: Synthetic polypeptide
DEEEISTVNPVATEQYGCVCSTGEHNIEYFNSQTQS

SEQ ID NO: 180865 - protein, 35 aa, Artificial Sequence
  Description of Artificial Sequence: Synthetic polypeptide
DEEEISTVNPVATEQYGCVCSWEEDNQEYFNSQQS

SEQ ID NO: 180866 - protein, 38 aa, Artificial Sequence
  Description of Artificial Sequence: Synthetic polypeptide
DEEEIRTTNPVATEQYGSVTEWMGALVLQYTVTVNEEY

SEQ ID NO: 180867 - protein, 32 aa, Artificial Sequence
  Description of Artificial Sequence: Synthetic polypeptide
DEDSIRTTNPLSTEPYGTISRKDIQQQQNGNH

SEQ ID NO: 180868 - protein, 35 aa, Artificial Sequence
  Description of Artificial Sequence: Synthetic polypeptide
DEEEISTVNPVATEQYGCVCSWGEHNQEYSNSQQS

SEQ ID NO: 180869 - protein, 37 aa, Artificial Sequence
  Description of Artificial Sequence: Synthetic polypeptide
DEEEIRTTNPVATEQYGSVTEWVILPVQQPEVQEQDA

SEQ ID NO: 180870 - protein, 37 aa, Artificial Sequence
  Description of Artificial Sequence: Synthetic polypeptide
SEEEIRTTNPVATECYGCVCTIDSNNHNGQQKGDNGQ

SEQ ID NO: 180871 - protein, 36 aa, Artificial Sequence
  Description of Artificial Sequence: Synthetic polypeptide
CEEEIATTNPVATEQYGSVAAPHDGNQTAMEHGNND

SEQ ID NO: 180872 - protein, 31 aa, Artificial Sequence
  Description of Artificial Sequence: Synthetic polypeptide
DDSEVASTNPVSTEGYGNVAANTIQSQVGQR

SEQ ID NO: 180873 - protein, 33 aa, Artificial Sequence
  Description of Artificial Sequence: Synthetic polypeptide
DNNEIRTTNPVSTEPYGTISMEDIQQQQNGNKH

SEQ ID NO: 180874 - protein, 33 aa, Artificial Sequence
  Description of Artificial Sequence: Synthetic polypeptide
DNNEIRTTNPVSTEPYGTIWSMEDIQQQQNGNH

SEQ ID NO: 180875 - protein, 37 aa, Artificial Sequence
  Description of Artificial Sequence: Synthetic polypeptide
DENEIRTTNPVATEQYGSSCAVTWPINEDRTEVHENG

SEQ ID NO: 180876 - protein, 37 aa, Artificial Sequence
  Description of Artificial Sequence: Synthetic polypeptide
SEEEIRTTNPVATEGYGSVVYDNIIQGGQGNEEDEQA

SEQ ID NO: 180877 - protein, 31 aa, Artificial Sequence
  Description of Artificial Sequence: Synthetic polypeptide
DDSEVASTNPVSTEGYGNVAANTIQSHVGER

SEQ ID NO: 180878 - protein, 36 aa, Artificial Sequence
  Description of Artificial Sequence: Synthetic polypeptide
SEEEIRTTNPVATEGYGQCVCSNTEHNANFGSDTQS

SEQ ID NO: 180879 - protein, 38 aa, Artificial Sequence
  Description of Artificial Sequence: Synthetic polypeptide
DENEIRTTNPVATEQYGSNVWVTTENMEDEQWNGSITE

SEQ ID NO: 180880 - protein, 33 aa, Artificial Sequence
  Description of Artificial Sequence: Synthetic polypeptide
DDSEVASTNPVSTECYGNVSANITEPQSRVGQR

SEQ ID NO: 180881 - protein, 36 aa, Artificial Sequence
  Description of Artificial Sequence: Synthetic polypeptide
DENEIRTTNPVATEQYGSMTMDKGDNESFRENTQIS

SEQ ID NO: 180882 - protein, 35 aa, Artificial Sequence
  Description of Artificial Sequence: Synthetic polypeptide
DESEIRTTNPCAYEEWGSVAMTLNDHSGGRGENGS

SEQ ID NO: 180883 - protein, 34 aa, Artificial Sequence
  Description of Artificial Sequence: Synthetic polypeptide
DEQEIATTNPVAYEQYGSVCAGANNEQDATLTDM

SEQ ID NO: 180884 - protein, 31 aa, Artificial Sequence
  Description of Artificial Sequence: Synthetic polypeptide
DDSEVASTNPVSTEGYGNVAANTIQSHVGQR

SEQ ID NO: 180885 - protein, 31 aa, Artificial Sequence
  Description of Artificial Sequence: Synthetic polypeptide
DDSEVASTNPVSTEGYGNVAANTIQSIVGQR

SEQ ID NO: 180886 - protein, 36 aa, Artificial Sequence
  Description of Artificial Sequence: Synthetic polypeptide
SEEEIRTTNPVATEGYGMVNGQGTNQGEGGNQDFGD

SEQ ID NO: 180887 - protein, 36 aa, Artificial Sequence
  Description of Artificial Sequence: Synthetic polypeptide
SEEEIRTTNPVATEGYGMVNGQGTNQGEGGNEQLGE

SEQ ID NO: 180888 - protein, 32 aa, Artificial Sequence
  Description of Artificial Sequence: Synthetic polypeptide
DNSEVASTNPVSTEGYGNVAANTIQSRVGQRC

SEQ ID NO: 180889 - protein, 36 aa, Artificial Sequence
  Description of Artificial Sequence: Synthetic polypeptide
SEEEIRTTNPVATEGYGMVNGQGTNQGEGGNEQFDY

SEQ ID NO: 180890 - protein, 37 aa, Artificial Sequence
  Description of Artificial Sequence: Synthetic polypeptide
DESEIRTTNPAATEQYGVVSNMNLVGDDQDQEDDDGN

SEQ ID NO: 180891 - protein, 38 aa, Artificial Sequence
  Description of Artificial Sequence: Synthetic polypeptide
SEEEIRTTNPVATEGYGMVNGQGTNEQDEPGGNEQRGD

SEQ ID NO: 180892 - protein, 33 aa, Artificial Sequence
  Description of Artificial Sequence: Synthetic polypeptide
DDSEVASTNPVSTECYGNVSANITEPQDRVGQR

SEQ ID NO: 180893 - protein, 31 aa, Artificial Sequence
  Description of Artificial Sequence: Synthetic polypeptide
DDSEVASTNPVSTEGYGNVAANTIQSKVGQR

SEQ ID NO: 180894 - protein, 36 aa, Artificial Sequence
  Description of Artificial Sequence: Synthetic polypeptide
AEDEICATNPVATEQYGVVATVNENNLLLQLGGNDD

SEQ ID NO: 180895 - protein, 37 aa, Artificial Sequence
  Description of Artificial Sequence: Synthetic polypeptide
DENEIRTTNPVATEQYGSLLQPVMTMLEVSSDNVNLY

SEQ ID NO: 180896 - protein, 37 aa, Artificial Sequence
  Description of Artificial Sequence: Synthetic polypeptide
DECEICTTNPVATEQYGVVSTVVAQQLGNTEENEDED

SEQ ID NO: 180897 - protein, 34 aa, Artificial Sequence
  Description of Artificial Sequence: Synthetic polypeptide
DEAEISTTNPVATEQYGCVCSNWEDNANFNSDQA

SEQ ID NO: 180898 - protein, 33 aa, Artificial Sequence
  Description of Artificial Sequence: Synthetic polypeptide
DNNEIRTTNPVSTEPYGTIPSMEDIQQQQNGNH

SEQ ID NO: 180899 - protein, 36 aa, Artificial Sequence
  Description of Artificial Sequence: Synthetic polypeptide
AEDEICATNPVATEQYGVVATVNENLQAGNENGEDD

SEQ ID NO: 180900 - protein, 37 aa, Artificial Sequence
  Description of Artificial Sequence: Synthetic polypeptide
DNNEIRTTNPVATEQYGSVCSVTWPINEDRMFVHEGG

SEQ ID NO: 180901 - protein, 36 aa, Artificial Sequence
  Description of Artificial Sequence: Synthetic polypeptide
DECEICTTNPVATTQYGVVATTANLQQGTEQGTEDT

SEQ ID NO: 180902 - protein, 36 aa, Artificial Sequence
  Description of Artificial Sequence: Synthetic polypeptide
DENEIRTTNPVATEQYGSVANNADPLDEVTIMVSEQ

SEQ ID NO: 180903 - protein, 36 aa, Artificial Sequence
  Description of Artificial Sequence: Synthetic polypeptide
SEEEIRTTNPVATEQWGSVSGEAMNPGSTGHPMGSS

SEQ ID NO: 180904 - protein, 36 aa, Artificial Sequence
  Description of Artificial Sequence: Synthetic polypeptide
DENEIRTTNPVATEQYGSVAFWPDMHNSRQEVSFED

SEQ ID NO: 180905 - protein, 36 aa, Artificial Sequence
  Description of Artificial Sequence: Synthetic polypeptide
DENEIRTTNPVATEQYGSTSYCSDNIWGNESNEDED

SEQ ID NO: 180906 - protein, 35 aa, Artificial Sequence
  Description of Artificial Sequence: Synthetic polypeptide
DEEEISTTNPVAYEQYGCVCSWGEHNENFGSETQS

SEQ ID NO: 180907 - protein, 35 aa, Artificial Sequence
  Description of Artificial Sequence: Synthetic polypeptide
DEDEIRGTNPVGTEQYGSVCTDQQTGQGEGGQEIE

SEQ ID NO: 180908 - protein, 31 aa, Artificial Sequence
  Description of Artificial Sequence: Synthetic polypeptide
DDSEVASTNPVSTEGYGNVAANTIQSFVGQR

SEQ ID NO: 180909 - protein, 35 aa, Artificial Sequence
  Description of Artificial Sequence: Synthetic polypeptide
DECEICTTNPVATTQYGVVATTQELQQGTESGSTS

SEQ ID NO: 180910 - protein, 36 aa, Artificial Sequence
  Description of Artificial Sequence: Synthetic polypeptide
DECEICTTNPVATTQYGVVATTQALQAGTENGSTDD

SEQ ID NO: 180911 - protein, 35 aa, Artificial Sequence
  Description of Artificial Sequence: Synthetic polypeptide
DEEEISTTNPVAYEQYGCVCSWGEHNQGFNSDNQS

SEQ ID NO: 180912 - protein, 35 aa, Artificial Sequence
  Description of Artificial Sequence: Synthetic polypeptide
SEEEIRTTNPVATEQWGSTTAGNGLPAEAENNMDD

SEQ ID NO: 180913 - protein, 36 aa, Artificial Sequence
  Description of Artificial Sequence: Synthetic polypeptide
DEEEIRTTNPVATEQYGDVMVGGIGQGDPEGGQEDG

SEQ ID NO: 180914 - protein, 36 aa, Artificial Sequence
  Description of Artificial Sequence: Synthetic polypeptide
DEDEIRTTNPVAYEQYGSACCAANNLQDRTTPPDLM

SEQ ID NO: 180915 - protein, 36 aa, Artificial Sequence
  Description of Artificial Sequence: Synthetic polypeptide
SEEEIRTTNPVATEQWGCVAGEGGSGQNHQDDNLAE

SEQ ID NO: 180916 - protein, 32 aa, Artificial Sequence
  Description of Artificial Sequence: Synthetic polypeptide
DDSEVASTNPVSTEEYGNVAANTIQSRVGEQR

SEQ ID NO: 180917 - protein, 37 aa, Artificial Sequence
  Description of Artificial Sequence: Synthetic polypeptide
DENEIRTTNPVATEQYGSSCSVTWPINEDANFVHENG

SEQ ID NO: 180918 - protein, 37 aa, Artificial Sequence
  Description of Artificial Sequence: Synthetic polypeptide
DEEEIRTTNPVATEQYGDVNVSGIGQGDQDEGGQGDG

SEQ ID NO: 180919 - protein, 36 aa, Artificial Sequence
  Description of Artificial Sequence: Synthetic polypeptide
DENEIRTTNPVATEQYGSSCSSSSALDEQMNQMEEV

SEQ ID NO: 180920 - protein, 35 aa, Artificial Sequence
  Description of Artificial Sequence: Synthetic polypeptide
DEQEIATTNPVAYEQYGSVATAHQGGLDHDGAGEN

SEQ ID NO: 180921 - protein, 33 aa, Artificial Sequence
  Description of Artificial Sequence: Synthetic polypeptide
DNMEIVTTNPVATEQYGTVCDAEDGPVEFEGND

SEQ ID NO: 180922 - protein, 36 aa, Artificial Sequence
  Description of Artificial Sequence: Synthetic polypeptide
DEEEIRTTNPCATEQYGSSVSPVSFIVPIAVEVNDE

SEQ ID NO: 180923 - protein, 32 aa, Artificial Sequence
  Description of Artificial Sequence: Synthetic polypeptide
DNNEINTTNPVATECWGSTVSEIQEMNGMEEA

SEQ ID NO: 180924 - protein, 33 aa, Artificial Sequence
  Description of Artificial Sequence: Synthetic polypeptide
DNNEIRTTNPVATECWGSCVSEIQEYMNGMEEA

SEQ ID NO: 180925 - protein, 32 aa, Artificial Sequence
  Description of Artificial Sequence: Synthetic polypeptide
DDSEVASTNPVSTEGYGNVAANTIQSGSGQNR

SEQ ID NO: 180926 - protein, 31 aa, Artificial Sequence
  Description of Artificial Sequence: Synthetic polypeptide
DDSEVASTNPVSTEGYGNVAANTIQSGVGQR

SEQ ID NO: 180927 - protein, 34 aa, Artificial Sequence
  Description of Artificial Sequence: Synthetic polypeptide
DEQEIATTNPVAYEQYGSVCAAANNEQDATLTKD

SEQ ID NO: 180928 - protein, 34 aa, Artificial Sequence
  Description of Artificial Sequence: Synthetic polypeptide
DESEIRTTNPVAYQQYGCVCIWINDDQERQHDPT

SEQ ID NO: 180929 - protein, 36 aa, Artificial Sequence
  Description of Artificial Sequence: Synthetic polypeptide
SEEEIRTTNPVATEGYGMVNGQGNNQDENGNEQFGD

SEQ ID NO: 180930 - protein, 34 aa, Artificial Sequence
  Description of Artificial Sequence: Synthetic polypeptide
CEEEISTTNPVATCQYGCVCSMTGEHTHFNSDQS

SEQ ID NO: 180931 - protein, 36 aa, Artificial Sequence
  Description of Artificial Sequence: Synthetic polypeptide
SEEEIRTTNPVATEGYGCTGSIMNDIGGQRNQEGAG

SEQ ID NO: 180932 - protein, 36 aa, Artificial Sequence
  Description of Artificial Sequence: Synthetic polypeptide
DQAEIRTTNPVATEQYGCCCSNTGELNQHFNSDTQS

SEQ ID NO: 180933 - protein, 37 aa, Artificial Sequence
  Description of Artificial Sequence: Synthetic polypeptide
DEQEIATTNPVAYEQYGTVCSYTDGLNEEVRGQNNES

SEQ ID NO: 180934 - protein, 38 aa, Artificial Sequence
  Description of Artificial Sequence: Synthetic polypeptide
DEQEIATTNPVAYEQYGTVCSYTDGLNEVGQRGQNNES

SEQ ID NO: 180935 - protein, 36 aa, Artificial Sequence
  Description of Artificial Sequence: Synthetic polypeptide
DENEIRTTNPVATEQYGSCYDTDSMPNENGGGSIEM

SEQ ID NO: 180936 - protein, 35 aa, Artificial Sequence
  Description of Artificial Sequence: Synthetic polypeptide
DENEIRTTNPVATEQYGSCYCTDDMPNEGGPSIEM

SEQ ID NO: 180937 - protein, 36 aa, Artificial Sequence
  Description of Artificial Sequence: Synthetic polypeptide
SEEEIRTTNPVATEGYGCTGSIMNDIGDQEGDNGEG

SEQ ID NO: 180938 - protein, 31 aa, Artificial Sequence
  Description of Artificial Sequence: Synthetic polypeptide
DDSEVASTNPVSTEGYGNVAANTIQSNVGQR

SEQ ID NO: 180939 - protein, 36 aa, Artificial Sequence
  Description of Artificial Sequence: Synthetic polypeptide
SEEEIRTTNPVATEGYGCTGSILNDIGDQRGDDGEG

SEQ ID NO: 180940 - protein, 36 aa, Artificial Sequence
  Description of Artificial Sequence: Synthetic polypeptide
DESEIRTTNCVATEQYGVVSVDDNMQGENQGQGEGT

SEQ ID NO: 180941 - protein, 36 aa, Artificial Sequence
  Description of Artificial Sequence: Synthetic polypeptide
SEEEIRTTNPVATEFYGSVSDGMGENFGNDTGEAGQ

SEQ ID NO: 180942 - protein, 37 aa, Artificial Sequence
  Description of Artificial Sequence: Synthetic polypeptide
DENEIRTTNPVATEQYGSCTQNVVEWIPQEGNNEATN

SEQ ID NO: 180943 - protein, 36 aa, Artificial Sequence
  Description of Artificial Sequence: Synthetic polypeptide
DEEEIRTTNPCATEQYGCVCSWGEDNAEHFNSDNQA

SEQ ID NO: 180944 - protein, 36 aa, Artificial Sequence
  Description of Artificial Sequence: Synthetic polypeptide
DENEIRTTNPVATEQYGSCSYWSDNIWENESNEDED

SEQ ID NO: 180945 - protein, 36 aa, Artificial Sequence
  Description of Artificial Sequence: Synthetic polypeptide
DEEEIRTTNPCATEQYGCVCSWEDHNAENFGSDTQS

SEQ ID NO: 180946 - protein, 35 aa, Artificial Sequence
  Description of Artificial Sequence: Synthetic polypeptide
DEDEIRTTNPVAYERWGTVCSNDNDDQAGQGGNEH

SEQ ID NO: 180947 - protein, 37 aa, Artificial Sequence
  Description of Artificial Sequence: Synthetic polypeptide
DENEIRTTNPVATEQYGSCSYCSDNISDQNESNEDED

SEQ ID NO: 180948 - protein, 36 aa, Artificial Sequence
  Description of Artificial Sequence: Synthetic polypeptide
DEEEIRTTNPCATEQYGCVCSNWNHNAENFGSDTQS

SEQ ID NO: 180949 - protein, 35 aa, Artificial Sequence
  Description of Artificial Sequence: Synthetic polypeptide
VEDEIATTNPVAYEQYGSVAATANDPTATGDNQDD

SEQ ID NO: 180950 - protein, 31 aa, Artificial Sequence
  Description of Artificial Sequence: Synthetic polypeptide
DDSEVASTNPVSTEGYGNVAANTIQSPVGQR

SEQ ID NO: 180951 - protein, 37 aa, Artificial Sequence
  Description of Artificial Sequence: Synthetic polypeptide
DEEEIRTTNPCATEQYGCVCSNTGEHNQENFNSDNQL

SEQ ID NO: 180952 - protein, 37 aa, Artificial Sequence
  Description of Artificial Sequence: Synthetic polypeptide
SEEEIRTTNPVATECYGCVCTIIDSGNHNGQQGGDNA

SEQ ID NO: 180953 - protein, 37 aa, Artificial Sequence
  Description of Artificial Sequence: Synthetic polypeptide
SEEEIRTTNPVATECYGCVCTIDSNNMNGQQGGDNEP

SEQ ID NO: 180954 - protein, 37 aa, Artificial Sequence
  Description of Artificial Sequence: Synthetic polypeptide
SEEEIRTTNPVATECYGCVCTIDSNNHNGTQGGDNGD

SEQ ID NO: 180955 - protein, 33 aa, Artificial Sequence
  Description of Artificial Sequence: Synthetic polypeptide
VEDEIATTNPVAYEQYGSVAATAHGAAAPPNNE

SEQ ID NO: 180956 - protein, 36 aa, Artificial Sequence
  Description of Artificial Sequence: Synthetic polypeptide
SEEEIRTTNPVATEGYGCTGSIMNDIGQGEGDNGEF

SEQ ID NO: 180957 - protein, 35 aa, Artificial Sequence
  Description of Artificial Sequence: Synthetic polypeptide
DQAEIRTTNPVATEQYGCCCSNTEDHNQHFGSDQA

SEQ ID NO: 180958 - protein, 36 aa, Artificial Sequence
  Description of Artificial Sequence: Synthetic polypeptide
DENEIRTTNPVATEQYGSFGDFNFDQIGEGGEGTEF

SEQ ID NO: 180959 - protein, 36 aa, Artificial Sequence
  Description of Artificial Sequence: Synthetic polypeptide
SEEEIRTTNPVATEGYGCTGSIMNDIGQGPGDNGQG

SEQ ID NO: 180960 - protein, 36 aa, Artificial Sequence
  Description of Artificial Sequence: Synthetic polypeptide
DEEEIRTTNPVAYEQYGQCVCSNSGEHQNFQSDTQA

SEQ ID NO: 180961 - protein, 35 aa, Artificial Sequence
  Description of Artificial Sequence: Synthetic polypeptide
SEEEIRTTNPVATEGYGCVCSNWNNHANFGSDTQS

SEQ ID NO: 180962 - protein, 35 aa, Artificial Sequence
  Description of Artificial Sequence: Synthetic polypeptide
CEEEISTTNPVATEEYGCVCSNTGEHQNFGSDTQS

SEQ ID NO: 180963 - protein, 31 aa, Artificial Sequence
  Description of Artificial Sequence: Synthetic polypeptide
DDSEVASTNPVSTEGYGNVAANTIQSLVGQR

SEQ ID NO: 180964 - protein, 31 aa, Artificial Sequence
  Description of Artificial Sequence: Synthetic polypeptide
DDSEVASTNPVSTECWGSVSNTEQDREGEQG

SEQ ID NO: 180965 - protein, 31 aa, Artificial Sequence
  Description of Artificial Sequence: Synthetic polypeptide
DDSEVASTNPVSTECWGSVSCTEQDREGEQG

SEQ ID NO: 180966 - protein, 34 aa, Artificial Sequence
  Description of Artificial Sequence: Synthetic polypeptide
CDEEISTTNPVAYEQYGCVCSTGEHNQNFNSDQM

SEQ ID NO: 180967 - protein, 31 aa, Artificial Sequence
  Description of Artificial Sequence: Synthetic polypeptide
DDSEVASTNPVSTEGYGNVAANTIQSMVGQR

SEQ ID NO: 180968 - protein, 38 aa, Artificial Sequence
  Description of Artificial Sequence: Synthetic polypeptide
DENEIRTTNPVATEQYGSHPSDNLVSSEGNEGGFESIA

SEQ ID NO: 180969 - protein, 36 aa, Artificial Sequence
  Description of Artificial Sequence: Synthetic polypeptide
TSEEIQTTNPVAWEMWGSTVPSPTNAASQRIGNNAV

SEQ ID NO: 180970 - protein, 38 aa, Artificial Sequence
  Description of Artificial Sequence: Synthetic polypeptide
DENEIRTTNPVATEQYGSGVWSDTVDALEVGEGGMQQF

SEQ ID NO: 180971 - protein, 37 aa, Artificial Sequence
  Description of Artificial Sequence: Synthetic polypeptide
DENEIRTTNPVATEQYGSGCIQVTAHDLQTGMEEQQY

SEQ ID NO: 180972 - protein, 35 aa, Artificial Sequence
  Description of Artificial Sequence: Synthetic polypeptide
DEEEISTTNPVAYEQYGCVCSWGEHNAENFNSDQL

SEQ ID NO: 180973 - protein, 34 aa, Artificial Sequence
  Description of Artificial Sequence: Synthetic polypeptide
DQAEICTTNPVAYEQYGCTASCIGVELVHGTNNR

SEQ ID NO: 180974 - protein, 36 aa, Artificial Sequence
  Description of Artificial Sequence: Synthetic polypeptide
SEEEIRTTNPVATEGYGCVCSNTEEHNAYFGSDTQS

SEQ ID NO: 180975 - protein, 37 aa, Artificial Sequence
  Description of Artificial Sequence: Synthetic polypeptide
DEEEIRTTNPCATEQYGQCVCSWMEDNAENFGSDNQS

SEQ ID NO: 180976 - protein, 34 aa, Artificial Sequence
  Description of Artificial Sequence: Synthetic polypeptide
DQAEICTTNPVAYEQYGQTAPSCIVELVHGTNNR

SEQ ID NO: 180977 - protein, 35 aa, Artificial Sequence
  Description of Artificial Sequence: Synthetic polypeptide
SEEEIRTTNPVATEGYGCVCSNSGELANFGSDTQS

SEQ ID NO: 180978 - protein, 31 aa, Artificial Sequence
  Description of Artificial Sequence: Synthetic polypeptide
DDSEVASTNPVSTECWGNVAANTIQSRVGQR

SEQ ID NO: 180979 - protein, 36 aa, Artificial Sequence
  Description of Artificial Sequence: Synthetic polypeptide
DEQEIATTNPVAYEQYGTVCSYTDGLNDEKMEGNDG

SEQ ID NO: 180980 - protein, 36 aa, Artificial Sequence
  Description of Artificial Sequence: Synthetic polypeptide
DEEEISTTNPVAYEQYGQCVCSNWEDLNQYFGSEQA

SEQ ID NO: 180981 - protein, 35 aa, Artificial Sequence
  Description of Artificial Sequence: Synthetic polypeptide
SEEEIRTTNPVATEGYGCTSIMNDIGQTEGQSGEG

SEQ ID NO: 180982 - protein, 36 aa, Artificial Sequence
  Description of Artificial Sequence: Synthetic polypeptide
SEEEIRTTNPVATEGYGCTGSIMNDIGQGRGDVGEG

SEQ ID NO: 180983 - protein, 35 aa, Artificial Sequence
  Description of Artificial Sequence: Synthetic polypeptide
DEDEIRTTNPVAYERWGAVCSNDNHDQPGQGGNAH

SEQ ID NO: 180984 - protein, 33 aa, Artificial Sequence
  Description of Artificial Sequence: Synthetic polypeptide
DEDEIRTTNPVAYERWGAVCVNDDAGDRRGDAG

SEQ ID NO: 180985 - protein, 35 aa, Artificial Sequence
  Description of Artificial Sequence: Synthetic polypeptide
DEDEIRTTNPVAYERWGEVCSNDNDDQPGQQGNEG

SEQ ID NO: 180986 - protein, 33 aa, Artificial Sequence
  Description of Artificial Sequence: Synthetic polypeptide
DQAEICTTNPVAYEQYGCTASCIPELVHSTNNR

SEQ ID NO: 180987 - protein, 34 aa, Artificial Sequence
  Description of Artificial Sequence: Synthetic polypeptide
DEDEIRGTNPVATEGWGSVSAGMEGQDGDGEQTI

SEQ ID NO: 180988 - protein, 33 aa, Artificial Sequence
  Description of Artificial Sequence: Synthetic polypeptide
DESSIATTNPVAYECWGSVYNWMNDVQREGHMP

SEQ ID NO: 180989 - protein, 37 aa, Artificial Sequence
  Description of Artificial Sequence: Synthetic polypeptide
DEAEAEIRTTNPVAYEQWGSVAWTDQLNQDQGGDQMK

SEQ ID NO: 180990 - protein, 39 aa, Artificial Sequence
  Description of Artificial Sequence: Synthetic polypeptide
DEEEIRTTNPVATEQYGQCVCSNWNEDHNQEGFNSDNQS

SEQ ID NO: 180991 - protein, 37 aa, Artificial Sequence
  Description of Artificial Sequence: Synthetic polypeptide
DEEEIRTTNPVATEQYGQCVCSSEEDHNQEFFGSDQA

SEQ ID NO: 180992 - protein, 32 aa, Artificial Sequence
  Description of Artificial Sequence: Synthetic polypeptide
DDSEVASTNPVSTEGYGNVAANTTIQSRVGQR

SEQ ID NO: 180993 - protein, 36 aa, Artificial Sequence
  Description of Artificial Sequence: Synthetic polypeptide
DEECIRTTNPVATEHWGVVCFTNEDQHHQGGTKGNH

SEQ ID NO: 180994 - protein, 36 aa, Artificial Sequence
  Description of Artificial Sequence: Synthetic polypeptide
DEECIRTTNPVATEHWGVVCFTNEDQHHTGGQKGNG

SEQ ID NO: 180995 - protein, 36 aa, Artificial Sequence
  Description of Artificial Sequence: Synthetic polypeptide
DEECIRTTNPVATEHWGVVCFTPEDQHERGGTKGNG

SEQ ID NO: 180996 - protein, 36 aa, Artificial Sequence
  Description of Artificial Sequence: Synthetic polypeptide
CEEEIATTNPVATEQWGCVAGNNGLPQTAPGEKFRN

SEQ ID NO: 180997 - protein, 37 aa, Artificial Sequence
  Description of Artificial Sequence: Synthetic polypeptide
DEEEIRTTNPVATEQYGQCVCSSGEDHNQENFGSEQM

SEQ ID NO: 180998 - protein, 35 aa, Artificial Sequence
  Description of Artificial Sequence: Synthetic polypeptide
CEEEIATTNPVATEQWGCVAGNNGLPATAAGEGFR

SEQ ID NO: 180999 - protein, 37 aa, Artificial Sequence
  Description of Artificial Sequence: Synthetic polypeptide
DEEEIRTTNPVATEQYGQCVCSSGEDNQENFNSDNQS

SEQ ID NO: 181000 - protein, 37 aa, Artificial Sequence
  Description of Artificial Sequence: Synthetic polypeptide
DEEEIRTTNPVATEQYGQCVCSSGEDNQENFNSETQA

SEQ ID NO: 181001 - protein, 36 aa, Artificial Sequence
  Description of Artificial Sequence: Synthetic polypeptide
DESEIATTNPVGTEQYGVMSATTPTLPQMHNGMNPV

SEQ ID NO: 181002 - protein, 36 aa, Artificial Sequence
  Description of Artificial Sequence: Synthetic polypeptide
DEEEIRTTNPVATEQYGQCVCSSGEHEQYFISETQS

SEQ ID NO: 181003 - protein, 37 aa, Artificial Sequence
  Description of Artificial Sequence: Synthetic polypeptide
DEEEIRTTNPVATEQYGQCVCSSGEHNAENFNSDFQP

SEQ ID NO: 181004 - protein, 37 aa, Artificial Sequence
  Description of Artificial Sequence: Synthetic polypeptide
DEEEIRTTNPVATEQYGQCVCSSGEHNIENFNSQNQQ

SEQ ID NO: 181005 - protein, 37 aa, Artificial Sequence
  Description of Artificial Sequence: Synthetic polypeptide
DEEEIRTTNPVATEQYGQCVCSSGEHNQENFGSETQS

SEQ ID NO: 181006 - protein, 37 aa, Artificial Sequence
  Description of Artificial Sequence: Synthetic polypeptide
DEEEIRTTNPVATEQYGQCVCSSGEHNQENFNSDTQS

SEQ ID NO: 181007 - protein, 37 aa, Artificial Sequence
  Description of Artificial Sequence: Synthetic polypeptide
DEEEIRTTNPVATEQYGQCVCSSGEHNQEYFNSDNQS

SEQ ID NO: 181008 - protein, 35 aa, Artificial Sequence
  Description of Artificial Sequence: Synthetic polypeptide
SEEEIRCTNPCATEQYGQCVCSWGNHNANFGSNQS

SEQ ID NO: 181009 - protein, 33 aa, Artificial Sequence
  Description of Artificial Sequence: Synthetic polypeptide
AEDEIACTNPVAYEQWGEYYSIENGDQRGEGER

SEQ ID NO: 181010 - protein, 35 aa, Artificial Sequence
  Description of Artificial Sequence: Synthetic polypeptide
SEEEIRCTNPCATEQYGQCVCSWEDNAEYFGSNQA

SEQ ID NO: 181011 - protein, 35 aa, Artificial Sequence
  Description of Artificial Sequence: Synthetic polypeptide
DEECIRTTNPVATEIYGCVCGTTGEDNQNFGSQQS

SEQ ID NO: 181012 - protein, 31 aa, Artificial Sequence
  Description of Artificial Sequence: Synthetic polypeptide
DDSEVASTNPVSTEGYGNVAANTTQSRVGQT

SEQ ID NO: 181013 - protein, 37 aa, Artificial Sequence
  Description of Artificial Sequence: Synthetic polypeptide
DEESIACTNPVATEQYGSVAATHDGNPQTAMEHGNND

SEQ ID NO: 181014 - protein, 37 aa, Artificial Sequence
  Description of Artificial Sequence: Synthetic polypeptide
DEEEIRTTNPVATEQYGQCVCSSGEHNAEFFNSDNQS

SEQ ID NO: 181015 - protein, 36 aa, Artificial Sequence
  Description of Artificial Sequence: Synthetic polypeptide
DEECIRTTNPVATEHWGVVCFTNEDQHHPGGTGMNS

SEQ ID NO: 181016 - protein, 38 aa, Artificial Sequence
  Description of Artificial Sequence: Synthetic polypeptide
DEEEIRTTNPVATEQYGQCVCSNWGETNQENFNSDTQS

SEQ ID NO: 181017 - protein, 38 aa, Artificial Sequence
  Description of Artificial Sequence: Synthetic polypeptide
DEEEIRTTNPVATEQYGQCVCSNWGETNAENFNSDNQS

SEQ ID NO: 181018 - protein, 37 aa, Artificial Sequence
  Description of Artificial Sequence: Synthetic polypeptide
DEEEIRTTNPVATEQYGQCVCSNWGEHNQNFNSDTQS

SEQ ID NO: 181019 - protein, 37 aa, Artificial Sequence
  Description of Artificial Sequence: Synthetic polypeptide
DEEEIRTTNPVATEQYGQCVCSNWGEHNQNFNSETQF

SEQ ID NO: 181020 - protein, 32 aa, Artificial Sequence
  Description of Artificial Sequence: Synthetic polypeptide
DDSEVASTNPVSTEGYGNVAANTSIQSRVGQR

SEQ ID NO: 181021 - protein, 37 aa, Artificial Sequence
  Description of Artificial Sequence: Synthetic polypeptide
DEEEIRTTNPVATEQYGQCVCSNWGEHNQNSNSENQS

SEQ ID NO: 181022 - protein, 37 aa, Artificial Sequence
  Description of Artificial Sequence: Synthetic polypeptide
DEEEIRTTNPVATEQYGQCVCSNWGEHNQSFGSETQS

SEQ ID NO: 181023 - protein, 37 aa, Artificial Sequence
  Description of Artificial Sequence: Synthetic polypeptide
DEEEIRTTNPVATEQYGQCVCSNWGEHNQSFNSDTQA

SEQ ID NO: 181024 - protein, 34 aa, Artificial Sequence
  Description of Artificial Sequence: Synthetic polypeptide
SEEEIRCTNPEATEQYGCVCSWMEHNAYFGSDQS

SEQ ID NO: 181025 - protein, 34 aa, Artificial Sequence
  Description of Artificial Sequence: Synthetic polypeptide
VEDEIATTNPVATEQYGTVCAANDGPAEDDGNND

SEQ ID NO: 181026 - protein, 32 aa, Artificial Sequence
  Description of Artificial Sequence: Synthetic polypeptide
DESEIATTNPVSTEGYGTIAMEDIQQQHNGNI

SEQ ID NO: 181027 - protein, 34 aa, Artificial Sequence
  Description of Artificial Sequence: Synthetic polypeptide
DDSEVATTNPVSTEGYGNVSAANAIPQSRVGMQR

SEQ ID NO: 181028 - protein, 38 aa, Artificial Sequence
  Description of Artificial Sequence: Synthetic polypeptide
DEEEIRTTNPVATEQYGQCVCSNWGEHNTENFGSDNQS

SEQ ID NO: 181029 - protein, 32 aa, Artificial Sequence
  Description of Artificial Sequence: Synthetic polypeptide
DDSEVASTNPVSTEGYGNVAANTSQSRVGQRI

SEQ ID NO: 181030 - protein, 38 aa, Artificial Sequence
  Description of Artificial Sequence: Synthetic polypeptide
DEEEIRTTNPVATEQYGQCVCSNWGEHNTENFNSDNQT

SEQ ID NO: 181031 - protein, 32 aa, Artificial Sequence
  Description of Artificial Sequence: Synthetic polypeptide
DESEIATTNPVSTEGWGNVAAAETIQSRVGPI

SEQ ID NO: 181032 - protein, 33 aa, Artificial Sequence
  Description of Artificial Sequence: Synthetic polypeptide
SEEEIRCTNPCAYEQYGCVCSWEHNAYFGSDQS

SEQ ID NO: 181033 - protein, 32 aa, Artificial Sequence
  Description of Artificial Sequence: Synthetic polypeptide
AEDEIACTNPVAYEQWGEYYTIINDQQGGERH

SEQ ID NO: 181034 - protein, 31 aa, Artificial Sequence
  Description of Artificial Sequence: Synthetic polypeptide
DDSEVASTNPVSTEGYGNVAANTSQSTVGQR

SEQ ID NO: 181035 - protein, 36 aa, Artificial Sequence
  Description of Artificial Sequence: Synthetic polypeptide
DEEEIRTTNPVATEQYGQCVCSNWGEHTEYFGSDQS

SEQ ID NO: 181036 - protein, 38 aa, Artificial Sequence
  Description of Artificial Sequence: Synthetic polypeptide
DEEEIRTTNPVATEQYGQCVCSNWGELNQENFNSDTQS

SEQ ID NO: 181037 - protein, 32 aa, Artificial Sequence
  Description of Artificial Sequence: Synthetic polypeptide
DDSEVATTNPVSTEGYGNVCAANGIQSFEGQR

SEQ ID NO: 181038 - protein, 39 aa, Artificial Sequence
  Description of Artificial Sequence: Synthetic polypeptide
DTEEIRTTNPVATEAYGSVSTTVTNNQQGNQQGTTNEQG

SEQ ID NO: 181039 - protein, 39 aa, Artificial Sequence
  Description of Artificial Sequence: Synthetic polypeptide
DTEEIRTTNPVATEAYGSVSVTVTNQQNNTEQGSTNQQD

SEQ ID NO: 181040 - protein, 38 aa, Artificial Sequence
  Description of Artificial Sequence: Synthetic polypeptide
DTEEIRTTNPVATEAYGVVSTTVTNNQQGNQQGTNQQG

SEQ ID NO: 181041 - protein, 36 aa, Artificial Sequence
  Description of Artificial Sequence: Synthetic polypeptide
DEESIACTNPVATEQWGGCVAGNNNLQTADGHNMRN

SEQ ID NO: 181042 - protein, 38 aa, Artificial Sequence
  Description of Artificial Sequence: Synthetic polypeptide
DEEEIRTTNPVATEQYGQCVCSNWGENNQENFNSDNQS

SEQ ID NO: 181043 - protein, 32 aa, Artificial Sequence
  Description of Artificial Sequence: Synthetic polypeptide
DDSEVASTNPVSTEGYGNVAANTVIQSRVGQR

SEQ ID NO: 181044 - protein, 37 aa, Artificial Sequence
  Description of Artificial Sequence: Synthetic polypeptide
DEEEIRTTNPVATEQYGQCVCSNWGEHNQNFNSDTQA

SEQ ID NO: 181045 - protein, 36 aa, Artificial Sequence
  Description of Artificial Sequence: Synthetic polypeptide
DDEEISTTNPVATEQYGCVCSSGEHNAENFGSDNQS

SEQ ID NO: 181046 - protein, 31 aa, Artificial Sequence
  Description of Artificial Sequence: Synthetic polypeptide
DDSEVATTNPVSTEGYGNVAATTLESHVGQL

SEQ ID NO: 181047 - protein, 37 aa, Artificial Sequence
  Description of Artificial Sequence: Synthetic polypeptide
DEAEIRTTNPVATEQYGAANSVMVNSDFDPNPEDERG

SEQ ID NO: 181048 - protein, 36 aa, Artificial Sequence
  Description of Artificial Sequence: Synthetic polypeptide
DEAEIRTTNPVATEQYGAANSTMVGDFDPNPEDERG

SEQ ID NO: 181049 - protein, 35 aa, Artificial Sequence
  Description of Artificial Sequence: Synthetic polypeptide
DEAEIRTTNPVATEQYGAANSNVPDFDPNPEDEIG

SEQ ID NO: 181050 - protein, 35 aa, Artificial Sequence
  Description of Artificial Sequence: Synthetic polypeptide
SEEEIRCTNPCATEQYGCVCSWGEGHNANFGSNQS

SEQ ID NO: 181051 - protein, 36 aa, Artificial Sequence
  Description of Artificial Sequence: Synthetic polypeptide
VEDEIATTNPVATEQYGSVCAMTNGQGTASDGAQVH

SEQ ID NO: 181052 - protein, 33 aa, Artificial Sequence
  Description of Artificial Sequence: Synthetic polypeptide
AEDEIACTNPVAYEQWGEYYSIENDGQRQPGER

SEQ ID NO: 181053 - protein, 36 aa, Artificial Sequence
  Description of Artificial Sequence: Synthetic polypeptide
DEAEIRTTNPVATEQYGAANSNLHPDFDDNTEDERG

SEQ ID NO: 181054 - protein, 35 aa, Artificial Sequence
  Description of Artificial Sequence: Synthetic polypeptide
DEAEIRTTNPVATEQYGAANSNHPDFDPNTEDERG

SEQ ID NO: 181055 - protein, 38 aa, Artificial Sequence
  Description of Artificial Sequence: Synthetic polypeptide
DTEEIRTTNPVATEQYGSVSTVTNQAIGTEAGTEQGSD

SEQ ID NO: 181056 - protein, 38 aa, Artificial Sequence
  Description of Artificial Sequence: Synthetic polypeptide
DTEEIRTTNPVATEQYGSVSTVTQQAGTEAGTEGQGDD

SEQ ID NO: 181057 - protein, 36 aa, Artificial Sequence
  Description of Artificial Sequence: Synthetic polypeptide
DEAEIRTTNPVATEQYGAANSLVPDFDNPNLEDERG

SEQ ID NO: 181058 - protein, 36 aa, Artificial Sequence
  Description of Artificial Sequence: Synthetic polypeptide
DESEIRTTNPVAYEQWGSVSGGEPAGPNMRNGGNGV

SEQ ID NO: 181059 - protein, 35 aa, Artificial Sequence
  Description of Artificial Sequence: Synthetic polypeptide
DEECIRTTNPVATEPWGVVCFTNEDQHHQGGTDGN

SEQ ID NO: 181060 - protein, 38 aa, Artificial Sequence
  Description of Artificial Sequence: Synthetic polypeptide
DTEEIRTTNPVATEQYGSVSVTTTQAIGTEEGTEQGSD

SEQ ID NO: 181061 - protein, 37 aa, Artificial Sequence
  Description of Artificial Sequence: Synthetic polypeptide
DEEEIRTTNPVATEQYGSVVDLMVGNGQTEEDQEEGD

SEQ ID NO: 181062 - protein, 34 aa, Artificial Sequence
  Description of Artificial Sequence: Synthetic polypeptide
SEEEIRCTNPCATEQYGCVCSWELHNANFGSQQS

SEQ ID NO: 181063 - protein, 37 aa, Artificial Sequence
  Description of Artificial Sequence: Synthetic polypeptide
DTEEIRTTNPVATEQYGSVVVVVVNTNNDEQGTEEED

SEQ ID NO: 181064 - protein, 34 aa, Artificial Sequence
  Description of Artificial Sequence: Synthetic polypeptide
SEEEIRCTNPCATEQYGCVCSWEDNANFGSDPQS

SEQ ID NO: 181065 - protein, 36 aa, Artificial Sequence
  Description of Artificial Sequence: Synthetic polypeptide
CEEEIRTTNCVATEQYGSVYNDDTGQTTEGQGNNEG

SEQ ID NO: 181066 - protein, 36 aa, Artificial Sequence
  Description of Artificial Sequence: Synthetic polypeptide
DEEEIRTTNPVATEQYGSVVEMVWEYVPITQGEEED

SEQ ID NO: 181067 - protein, 36 aa, Artificial Sequence
  Description of Artificial Sequence: Synthetic polypeptide
DEAEIRTTNPVATEQYGAANSLVPDDFDPNPEDENG

SEQ ID NO: 181068 - protein, 35 aa, Artificial Sequence
  Description of Artificial Sequence: Synthetic polypeptide
DEAEIRTTNPVATEQYGAANSLVPDDDPNEEDERG

SEQ ID NO: 181069 - protein, 32 aa, Artificial Sequence
  Description of Artificial Sequence: Synthetic polypeptide
AEDEIACTNPVAYEQWGEYAPIENNQRGEGDR

SEQ ID NO: 181070 - protein, 38 aa, Artificial Sequence
  Description of Artificial Sequence: Synthetic polypeptide
DEEEIRTTNPVATEQYGSVVFDDNDNDEGQTGDEDFDN

SEQ ID NO: 181071 - protein, 34 aa, Artificial Sequence
  Description of Artificial Sequence: Synthetic polypeptide
SEEEIRCTNPCATEQYGCVCSWELNAENFISDQS

SEQ ID NO: 181072 - protein, 37 aa, Artificial Sequence
  Description of Artificial Sequence: Synthetic polypeptide
CEEEISTTNPVATEQYGCVCSNTGEDNIENFGSDNQS

SEQ ID NO: 181073 - protein, 35 aa, Artificial Sequence
  Description of Artificial Sequence: Synthetic polypeptide
DEAEIRTTNPVATEQYGAANTMVDDFDPNPEDERG

SEQ ID NO: 181074 - protein, 34 aa, Artificial Sequence
  Description of Artificial Sequence: Synthetic polypeptide
SEEEIRCTNPCATEQYGCVCSWGELAENFGSDQS

SEQ ID NO: 181075 - protein, 34 aa, Artificial Sequence
  Description of Artificial Sequence: Synthetic polypeptide
DEECIRTTNPVATEIYGCVCGWEEHNQNFGSEQA

SEQ ID NO: 181076 - protein, 35 aa, Artificial Sequence
  Description of Artificial Sequence: Synthetic polypeptide
DEESIACTNPVATEQYGSVCAANPALGTHNDEDAH

SEQ ID NO: 181077 - protein, 36 aa, Artificial Sequence
  Description of Artificial Sequence: Synthetic polypeptide
DEAEIRTTNPVATEQYGCICSWGETNQEYFGSDTQS

SEQ ID NO: 181078 - protein, 34 aa, Artificial Sequence
  Description of Artificial Sequence: Synthetic polypeptide
TSGSINTTNPVATEEWGSVSCEGNSSGRPQGNPR

SEQ ID NO: 181079 - protein, 34 aa, Artificial Sequence
  Description of Artificial Sequence: Synthetic polypeptide
DEECIRTTNPVATEIYGCVCGWGEDNQNFNSQQS

SEQ ID NO: 181080 - protein, 33 aa, Artificial Sequence
  Description of Artificial Sequence: Synthetic polypeptide
SEEEIRCTNPCATEQYGCVCSWNHNAHFISDQA

SEQ ID NO: 181081 - protein, 36 aa, Artificial Sequence
  Description of Artificial Sequence: Synthetic polypeptide
DEESIACTNPVATEQYGSVCAATNNSEEDDGANDNN

SEQ ID NO: 181082 - protein, 36 aa, Artificial Sequence
  Description of Artificial Sequence: Synthetic polypeptide
DEESIACTNPVATEQYGSVCAATNNSEMDDGANDAF

SEQ ID NO: 181083 - protein, 37 aa, Artificial Sequence
  Description of Artificial Sequence: Synthetic polypeptide
VEDEIATTNPVATEQYGSVCSVDTAGPTDHQDGNSMD

SEQ ID NO: 181084 - protein, 34 aa, Artificial Sequence
  Description of Artificial Sequence: Synthetic polypeptide
SEEEIRCTNPCATEQYGCVCSWMELNANFGSDTQ

SEQ ID NO: 181085 - protein, 35 aa, Artificial Sequence
  Description of Artificial Sequence: Synthetic polypeptide
SEEEIRCTNPCATEQYGCVCSWMEHNAHFGSDNQS

SEQ ID NO: 181086 - protein, 35 aa, Artificial Sequence
  Description of Artificial Sequence: Synthetic polypeptide
DESEIATTNPVGTEGYGVMSATTPTLQMHNGMNPV

SEQ ID NO: 181087 - protein, 35 aa, Artificial Sequence
  Description of Artificial Sequence: Synthetic polypeptide
DESEIRTTNPVAYEQWGSVSGGNGNEAGPEGSGES

SEQ ID NO: 181088 - protein, 34 aa, Artificial Sequence
  Description of Artificial Sequence: Synthetic polypeptide
SEEEIRCTNPCATEQYGCVCSWGNHNAYFGSEQA

SEQ ID NO: 181089 - protein, 34 aa, Artificial Sequence
  Description of Artificial Sequence: Synthetic polypeptide
DESEIATTNPVGTEGYGVMSATTPTGNMRGMNPI

SEQ ID NO: 181090 - protein, 35 aa, Artificial Sequence
  Description of Artificial Sequence: Synthetic polypeptide
DEECIRTTNPVATEIYGCVCQTWEHNQENFGSDQA

SEQ ID NO: 181091 - protein, 34 aa, Artificial Sequence
  Description of Artificial Sequence: Synthetic polypeptide
SEEEIRCTNPCATEQYGCVCSWGNHAEYFGSDQA

SEQ ID NO: 181092 - protein, 32 aa, Artificial Sequence
  Description of Artificial Sequence: Synthetic polypeptide
DDSEVASTNPVSTEGYGNVAANTYIQSRVGQR

SEQ ID NO: 181093 - protein, 31 aa, Artificial Sequence
  Description of Artificial Sequence: Synthetic polypeptide
DDSEVASTNPVSTEGYGNVAANVIQSRVGQC

SEQ ID NO: 181094 - protein, 32 aa, Artificial Sequence
  Description of Artificial Sequence: Synthetic polypeptide
DDSEVASTNPVSTEGYGNVAANVPIQSRVGQR

SEQ ID NO: 181095 - protein, 33 aa, Artificial Sequence
  Description of Artificial Sequence: Synthetic polypeptide
YEEEIRCTNPAATEQYGVVVSEGGMGGGEEGEV

SEQ ID NO: 181096 - protein, 35 aa, Artificial Sequence
  Description of Artificial Sequence: Synthetic polypeptide
DEAEIRTTNPVATEQYGCFCSWGEHNQHFGSDTQS

SEQ ID NO: 181097 - protein, 33 aa, Artificial Sequence
  Description of Artificial Sequence: Synthetic polypeptide
SEEEIRCTNPCATEQYGCVCSWGNDANFISDQS

SEQ ID NO: 181098 - protein, 37 aa, Artificial Sequence
  Description of Artificial Sequence: Synthetic polypeptide
DEEEIRTTNPVATEQYGSVTYVHIEEQIENTEEDTDM

SEQ ID NO: 181099 - protein, 32 aa, Artificial Sequence
  Description of Artificial Sequence: Synthetic polypeptide
AEDEIACTNPVAYEQWGEYYSIENDQRQNGES

SEQ ID NO: 181100 - protein, 32 aa, Artificial Sequence
  Description of Artificial Sequence: Synthetic polypeptide
DDSEVASTNPVSTEGYGNVAANTWIQSRVGQR

SEQ ID NO: 181101 - protein, 37 aa, Artificial Sequence
  Description of Artificial Sequence: Synthetic polypeptide
DEEEIRTTNPVATEQYGQCVCSNWGEHNQNFGSEFQM

SEQ ID NO: 181102 - protein, 35 aa, Artificial Sequence
  Description of Artificial Sequence: Synthetic polypeptide
DEQEIATTNPVATEQWGSVSATGDMPADHGGGEDH

SEQ ID NO: 181103 - protein, 37 aa, Artificial Sequence
  Description of Artificial Sequence: Synthetic polypeptide
DEEEIRTTNPVATEQYGQCVCSNWGEHNQNFGSDTQG

SEQ ID NO: 181104 - protein, 35 aa, Artificial Sequence
  Description of Artificial Sequence: Synthetic polypeptide
DEDEIRGTNPVATEFWGSCSAINGEGQDGQGGNTG

SEQ ID NO: 181105 - protein, 31 aa, Artificial Sequence
  Description of Artificial Sequence: Synthetic polypeptide
DDSEVASTNPVSTEGYGNVAANTITSRVGQR

SEQ ID NO: 181106 - protein, 36 aa, Artificial Sequence
  Description of Artificial Sequence: Synthetic polypeptide
DEEEIRTTNPVATEFYGQVDVVGDIGQSEDVGGNGE

SEQ ID NO: 181107 - protein, 36 aa, Artificial Sequence
  Description of Artificial Sequence: Synthetic polypeptide
DEQEIRTTNPVATEFYGSVYDLNDIFDEDGQAEGGN

SEQ ID NO: 181108 - protein, 36 aa, Artificial Sequence
  Description of Artificial Sequence: Synthetic polypeptide
DEECIRTTNPCAYEEWGSVACTNNGLQDHQQDNQRG

SEQ ID NO: 181109 - protein, 36 aa, Artificial Sequence
  Description of Artificial Sequence: Synthetic polypeptide
DEQEIRTTNPVATEGYGSVMGQFIGGQENGNGQGQE

SEQ ID NO: 181110 - protein, 35 aa, Artificial Sequence
  Description of Artificial Sequence: Synthetic polypeptide
DEAEIRTTNPVATEQYGCTCSWGEHNQEHFNSDQS

SEQ ID NO: 181111 - protein, 36 aa, Artificial Sequence
  Description of Artificial Sequence: Synthetic polypeptide
VEDEIATTNPVAYEPQWGQSVATHNDLTQDGMGARE

SEQ ID NO: 181112 - protein, 37 aa, Artificial Sequence
  Description of Artificial Sequence: Synthetic polypeptide
DEEEIRTTNPVATEQYGQCVCSNWGEHDQEGFISDQA

SEQ ID NO: 181113 - protein, 35 aa, Artificial Sequence
  Description of Artificial Sequence: Synthetic polypeptide
DEAEIRTTNPVATEQYGCTCSWGEDHNANFGSDQS

SEQ ID NO: 181114 - protein, 32 aa, Artificial Sequence
  Description of Artificial Sequence: Synthetic polypeptide
DDSEVASTNPVSTEGYGNVAANTIVQSRDGQR

SEQ ID NO: 181115 - protein, 35 aa, Artificial Sequence
  Description of Artificial Sequence: Synthetic polypeptide
DSEEIRTTNPVGYETWGCVRHNNDKQNDRRGGDNR

SEQ ID NO: 181116 - protein, 37 aa, Artificial Sequence
  Description of Artificial Sequence: Synthetic polypeptide
DEQEIRTTNPVATEGYGSVMGQFNVGGQENGNGGDQE

SEQ ID NO: 181117 - protein, 33 aa, Artificial Sequence
  Description of Artificial Sequence: Synthetic polypeptide
AEMHIVTTNPVATEQWGTVCSATDGPVEFEGND

SEQ ID NO: 181118 - protein, 37 aa, Artificial Sequence
  Description of Artificial Sequence: Synthetic polypeptide
DEQEIRTTNPVATEGYGSVMGQSVVGGQEGGNGGNQE

SEQ ID NO: 181119 - protein, 32 aa, Artificial Sequence
  Description of Artificial Sequence: Synthetic polypeptide
DEAEIACTNPVATEQWGTNCSAAAHMRNSNDS

SEQ ID NO: 181120 - protein, 38 aa, Artificial Sequence
  Description of Artificial Sequence: Synthetic polypeptide
DEQEIRTTNPVATEGYGSVVSNMNLVGDDQDQEDDDGN

SEQ ID NO: 181121 - protein, 36 aa, Artificial Sequence
  Description of Artificial Sequence: Synthetic polypeptide
DEAEIRTTNPVATEQYGCTCSTGEDHNQEYFGSDQA

SEQ ID NO: 181122 - protein, 37 aa, Artificial Sequence
  Description of Artificial Sequence: Synthetic polypeptide
DTEEIRTTNPCATEAYGVVSTVTNANLEQGTEEGTDE

SEQ ID NO: 181123 - protein, 37 aa, Artificial Sequence
  Description of Artificial Sequence: Synthetic polypeptide
DTEEIRTTNPCATEAYGVVSTVTNGNLQQGTEEGTTE

SEQ ID NO: 181124 - protein, 36 aa, Artificial Sequence
  Description of Artificial Sequence: Synthetic polypeptide
DEQEIRTTNPVATEGYGSVYGQFVGGQEGGNGGGQE

SEQ ID NO: 181125 - protein, 37 aa, Artificial Sequence
  Description of Artificial Sequence: Synthetic polypeptide
DTEEIRTTNPCATEAYGVVSTVTNLQLLQGTETGSDE

SEQ ID NO: 181126 - protein, 37 aa, Artificial Sequence
  Description of Artificial Sequence: Synthetic polypeptide
DTEEIRTTNPCATEAYGVVSTVTNNLNQQGTEEGEDE

SEQ ID NO: 181127 - protein, 35 aa, Artificial Sequence
  Description of Artificial Sequence: Synthetic polypeptide
DEEEIRTTNPVATEFYGQVVDQVNENFGEGGGEED

SEQ ID NO: 181128 - protein, 38 aa, Artificial Sequence
  Description of Artificial Sequence: Synthetic polypeptide
DEEEIRTTNPVATEQYGQCVCSNWGEHNAEGFGSENQS

SEQ ID NO: 181129 - protein, 36 aa, Artificial Sequence
  Description of Artificial Sequence: Synthetic polypeptide
DEAEIACTNPVATEQWGSVSMTGNPEPGGNQMENVV

SEQ ID NO: 181130 - protein, 32 aa, Artificial Sequence
  Description of Artificial Sequence: Synthetic polypeptide
DDSEVASTNPVSTEGYGNVAANTITQSRVGQR

SEQ ID NO: 181131 - protein, 35 aa, Artificial Sequence
  Description of Artificial Sequence: Synthetic polypeptide
DEQEIRTTNPVATECYWGSFGPCINEPEAREFENG

SEQ ID NO: 181132 - protein, 34 aa, Artificial Sequence
  Description of Artificial Sequence: Synthetic polypeptide
SEEEIRCTNPIATEQWGSTTWSNAENWMEPKGPR

SEQ ID NO: 181133 - protein, 32 aa, Artificial Sequence
  Description of Artificial Sequence: Synthetic polypeptide
DDSEVASTNPVSTEGYGNVAANTIQVRVGQVR

SEQ ID NO: 181134 - protein, 35 aa, Artificial Sequence
  Description of Artificial Sequence: Synthetic polypeptide
DEDEIRGTNPVATEFWGVVSAANGEGQRGQGGDGD

SEQ ID NO: 181135 - protein, 37 aa, Artificial Sequence
  Description of Artificial Sequence: Synthetic polypeptide
DEEEIRTTNPVATEQYGCVCSMSEEDHNQENFGSDQA

SEQ ID NO: 181136 - protein, 36 aa, Artificial Sequence
  Description of Artificial Sequence: Synthetic polypeptide
DEEEISCTNPVATEQYGCVCSWGEHNQENFGSENQA

SEQ ID NO: 181137 - protein, 35 aa, Artificial Sequence
  Description of Artificial Sequence: Synthetic polypeptide
DEDEIRGTNPVATEFWGVVSAANGEGQRGQGEQGL

SEQ ID NO: 181138 - protein, 37 aa, Artificial Sequence
  Description of Artificial Sequence: Synthetic polypeptide
DEEEIRTTNPVATEQYGQCVCSNWGEDHNQHFNSDQS

SEQ ID NO: 181139 - protein, 32 aa, Artificial Sequence
  Description of Artificial Sequence: Synthetic polypeptide
DDSEVASTNPVSTEGYGNVAANTISQSRVGQR

SEQ ID NO: 181140 - protein, 37 aa, Artificial Sequence
  Description of Artificial Sequence: Synthetic polypeptide
DEEEIRTTNPVATEQYGQCVCSNWGEDHNQNFNSDQS

SEQ ID NO: 181141 - protein, 35 aa, Artificial Sequence
  Description of Artificial Sequence: Synthetic polypeptide
AEDEIATTNPVATECWGSVCFTNEDVQDGQRGGTD

SEQ ID NO: 181142 - protein, 35 aa, Artificial Sequence
  Description of Artificial Sequence: Synthetic polypeptide
CEEEIATTNPVATEQWGGCVAGNGELADNNSGNME

SEQ ID NO: 181143 - protein, 33 aa, Artificial Sequence
  Description of Artificial Sequence: Synthetic polypeptide
VEDEIATTNPVAYEQWGCVAATNDTATGNVQDD

SEQ ID NO: 181144 - protein, 31 aa, Artificial Sequence
  Description of Artificial Sequence: Synthetic polypeptide
DDSEVASTNPVSTEGYGNVAANTISSRVGQR

SEQ ID NO: 181145 - protein, 34 aa, Artificial Sequence
  Description of Artificial Sequence: Synthetic polypeptide
DEAEIRTTNPVATEQYGCVCQWEAHINFMSDTQA

SEQ ID NO: 181146 - protein, 34 aa, Artificial Sequence
  Description of Artificial Sequence: Synthetic polypeptide
DEAEIRTTNPVATEQYGCVCQWADHIENFMSDQA

SEQ ID NO: 181147 - protein, 37 aa, Artificial Sequence
  Description of Artificial Sequence: Synthetic polypeptide
DEEEIRTTNPVATEQYGQCVCSNWGEDLQENFISDQA

SEQ ID NO: 181148 - protein, 34 aa, Artificial Sequence
  Description of Artificial Sequence: Synthetic polypeptide
DEAEIACTNPVATEQWGSVSAGPPGANGAGMGQD

SEQ ID NO: 181149 - protein, 36 aa, Artificial Sequence
  Description of Artificial Sequence: Synthetic polypeptide
VEDEIATTNPVAYEPQWGQSVATNNDLTQDDGMGDR

SEQ ID NO: 181150 - protein, 35 aa, Artificial Sequence
  Description of Artificial Sequence: Synthetic polypeptide
DEAEIACTNPVATEQWGSVSGENPNPEANGSENAW

SEQ ID NO: 181151 - protein, 37 aa, Artificial Sequence
  Description of Artificial Sequence: Synthetic polypeptide
DEEEIRTTNPVATEQYGQCVCSNWGEDNENFNSDNQS

SEQ ID NO: 181152 - protein, 36 aa, Artificial Sequence
  Description of Artificial Sequence: Synthetic polypeptide
DEECIRTTNPCATECYGVVCYKTNDETQMQGGDDSR

SEQ ID NO: 181153 - protein, 39 aa, Artificial Sequence
  Description of Artificial Sequence: Synthetic polypeptide
DECEICTTNPVATEQYGSVSTVNNQQLNNLQQIGTESGS

SEQ ID NO: 181154 - protein, 36 aa, Artificial Sequence
  Description of Artificial Sequence: Synthetic polypeptide
DEECIRTTNPCATECYGVVCYKTNDETQRQGGGDDS

SEQ ID NO: 181155 - protein, 35 aa, Artificial Sequence
  Description of Artificial Sequence: Synthetic polypeptide
DEDEIRGTNPVATEFWGSVSAINGEGQDGQGGEGD

SEQ ID NO: 181156 - protein, 32 aa, Artificial Sequence
  Description of Artificial Sequence: Synthetic polypeptide
DDSEVASTNPVSTEGYGNVAANTITQPRVGDR

SEQ ID NO: 181157 - protein, 37 aa, Artificial Sequence
  Description of Artificial Sequence: Synthetic polypeptide
DTEEIRTTNPCATEAYGVVSTVTNQNLQQGTEEGTDN

SEQ ID NO: 181158 - protein, 37 aa, Artificial Sequence
  Description of Artificial Sequence: Synthetic polypeptide
DTEEIRTTNPCATEAYGVVSTVTQGNLQQGTEEGTDD

SEQ ID NO: 181159 - protein, 37 aa, Artificial Sequence
  Description of Artificial Sequence: Synthetic polypeptide
DTEEIRTTNPCATEAYGVVSTVTQGNLQQGTEQGTVE

SEQ ID NO: 181160 - protein, 37 aa, Artificial Sequence
  Description of Artificial Sequence: Synthetic polypeptide
DTEEIRTTNPCATEAYGVVSTVTTNGNQQGTEENEDE

SEQ ID NO: 181161 - protein, 32 aa, Artificial Sequence
  Description of Artificial Sequence: Synthetic polypeptide
DDSEVASTNPVSTEGYGNVAANTPQSRVGQRD

SEQ ID NO: 181162 - protein, 38 aa, Artificial Sequence
  Description of Artificial Sequence: Synthetic polypeptide
DEEEIRTTNPVATEQYGQCVCSNWGEHNIEYFGSDNQS

SEQ ID NO: 181163 - protein, 38 aa, Artificial Sequence
  Description of Artificial Sequence: Synthetic polypeptide
DEEEIRTTNPVATEQYGQCVCSNWGEHNQEFFGSDNQS

SEQ ID NO: 181164 - protein, 37 aa, Artificial Sequence
  Description of Artificial Sequence: Synthetic polypeptide
DEEEIRTTNPVATEQYGQCVCSNWGEHNQEFFGSDQA

SEQ ID NO: 181165 - protein, 38 aa, Artificial Sequence
  Description of Artificial Sequence: Synthetic polypeptide
DEEEIRTTNPVATEQYGQCVCSNWGEHNQEGFNSDTQS

SEQ ID NO: 181166 - protein, 38 aa, Artificial Sequence
  Description of Artificial Sequence: Synthetic polypeptide
DEEEIRTTNPVATEQYGQCVCSNWGEHNQEGFNSQTQS

SEQ ID NO: 181167 - protein, 33 aa, Artificial Sequence
  Description of Artificial Sequence: Synthetic polypeptide
TSETEIATTNPVAYERWGTCSTDNDQHQQGNEP

SEQ ID NO: 181168 - protein, 37 aa, Artificial Sequence
  Description of Artificial Sequence: Synthetic polypeptide
DEEEIRTTNPVATEQYGQCVCSNWGEHNQENFGSDQP

SEQ ID NO: 181169 - protein, 32 aa, Artificial Sequence
  Description of Artificial Sequence: Synthetic polypeptide
DDSEVASTNPVSTEGYGNVAANTQIGSRVGQR

SEQ ID NO: 181170 - protein, 33 aa, Artificial Sequence
  Description of Artificial Sequence: Synthetic polypeptide
DESEIATTNPVSTEPYGTISAMEDIQQSRVGQH

SEQ ID NO: 181171 - protein, 36 aa, Artificial Sequence
  Description of Artificial Sequence: Synthetic polypeptide
DEEEIRTTNPVATEQFGQCVCSWGEDNAHFGSQTQS

SEQ ID NO: 181172 - protein, 37 aa, Artificial Sequence
  Description of Artificial Sequence: Synthetic polypeptide
DEEEIRTTNPVATEQYGQCVCSNWGEHNQENFNSDQF

SEQ ID NO: 181173 - protein, 32 aa, Artificial Sequence
  Description of Artificial Sequence: Synthetic polypeptide
AEDEIACTNPVAYEQWGMAYIENDMQDRGGER

SEQ ID NO: 181174 - protein, 37 aa, Artificial Sequence
  Description of Artificial Sequence: Synthetic polypeptide
DEEEIRTTNPVATEQYGQCVCSNWGEHNQENFNSEQS

SEQ ID NO: 181175 - protein, 35 aa, Artificial Sequence
  Description of Artificial Sequence: Synthetic polypeptide
DEDEIRGTNPVATEFWGNVSAANGEGQRGEGEQGD

SEQ ID NO: 181176 - protein, 37 aa, Artificial Sequence
  Description of Artificial Sequence: Synthetic polypeptide
DEEEIRTTNPVATEQYGQCVCSNWGEHNQENFNSQQA

SEQ ID NO: 181177 - protein, 32 aa, Artificial Sequence
  Description of Artificial Sequence: Synthetic polypeptide
DDSEVASTNPVSTEGYGNVAANTQIQSRVGQR

SEQ ID NO: 181178 - protein, 32 aa, Artificial Sequence
  Description of Artificial Sequence: Synthetic polypeptide
AEDEIACTNPVAYEQWGHYYSIENDQRGQGES

SEQ ID NO: 181179 - protein, 31 aa, Artificial Sequence
  Description of Artificial Sequence: Synthetic polypeptide
DDSEVASTNPVSTEGYGNVAANTQQSRVGQT

SEQ ID NO: 181180 - protein, 36 aa, Artificial Sequence
  Description of Artificial Sequence: Synthetic polypeptide
DEESIACTNPVATEQWGGCVAGMNPLQTAMGHNMRD

SEQ ID NO: 181181 - protein, 32 aa, Artificial Sequence
  Description of Artificial Sequence: Synthetic polypeptide
VEDEIATTNPVATESYGCIAGTTDQAMADNNF

SEQ ID NO: 181182 - protein, 35 aa, Artificial Sequence
  Description of Artificial Sequence: Synthetic polypeptide
CEEEIATTNPVATEQWGGCCTAAAGNLDDGMGNDA

SEQ ID NO: 181183 - protein, 37 aa, Artificial Sequence
  Description of Artificial Sequence: Synthetic polypeptide
DEEEIRTTNPVATEQYGQCVCSNWGEHNQEYFNSDQG

SEQ ID NO: 181184 - protein, 31 aa, Artificial Sequence
  Description of Artificial Sequence: Synthetic polypeptide
DDSEVASTNPVSTAGYGNVAANTIQSRLGQR

SEQ ID NO: 181185 - protein, 36 aa, Artificial Sequence
  Description of Artificial Sequence: Synthetic polypeptide
DEQEIATTNPVATEQWGSVSATGDMPEDHEGGEDNP

SEQ ID NO: 181186 - protein, 38 aa, Artificial Sequence
  Description of Artificial Sequence: Synthetic polypeptide
DEEEIRTTNPVATEQYGQCVCSNWGEHNIENFGSENQD

SEQ ID NO: 181187 - protein, 38 aa, Artificial Sequence
  Description of Artificial Sequence: Synthetic polypeptide
DTEEIRTTNPVATEQYGVVSTTNNQNGGTQAGTEQGSD

SEQ ID NO: 181188 - protein, 32 aa, Artificial Sequence
  Description of Artificial Sequence: Synthetic polypeptide
DDSEVATTNPVSTEGYGNVSACITIQDRVGQG

SEQ ID NO: 181189 - protein, 31 aa, Artificial Sequence
  Description of Artificial Sequence: Synthetic polypeptide
SEEEIRCTNPIATECWGATVWAENWAEPGPI

SEQ ID NO: 181190 - protein, 37 aa, Artificial Sequence
  Description of Artificial Sequence: Synthetic polypeptide
DTEEIRTTNPCATEAYGVVSTVTTNLQQQGTEQGEDE

SEQ ID NO: 181191 - protein, 32 aa, Artificial Sequence
  Description of Artificial Sequence: Synthetic polypeptide
DDSEVASTNPVSTEGYGNVAANTIVQSRVGQR

SEQ ID NO: 181192 - protein, 36 aa, Artificial Sequence
  Description of Artificial Sequence: Synthetic polypeptide
DEAEIRTTNPVATEQYGCTCSNWGENNQENFGSDQS

SEQ ID NO: 181193 - protein, 31 aa, Artificial Sequence
  Description of Artificial Sequence: Synthetic polypeptide
DDSEVASTNPVSTEGYGNVAANTIVSRVGQR

SEQ ID NO: 181194 - protein, 36 aa, Artificial Sequence
  Description of Artificial Sequence: Synthetic polypeptide
DEAEIRTTNPVATEQYGCTCSNTGEHNQHFGSDTQS

SEQ ID NO: 181195 - protein, 36 aa, Artificial Sequence
  Description of Artificial Sequence: Synthetic polypeptide
CEEEISTTNPVATEQYGCVCSNTGEDNAENFGSEQA

SEQ ID NO: 181196 - protein, 37 aa, Artificial Sequence
  Description of Artificial Sequence: Synthetic polypeptide
DEEEIRTTNPVATEQYGSVTTTMNMVMPPVHEEPDMS

SEQ ID NO: 181197 - protein, 32 aa, Artificial Sequence
  Description of Artificial Sequence: Synthetic polypeptide
DDSEVASTNPVSTEGYGNVAANTIYQSRVGQR

SEQ ID NO: 181198 - protein, 35 aa, Artificial Sequence
  Description of Artificial Sequence: Synthetic polypeptide
DEAEIRTTNPVATEQYGCSFYTWLMESWESIEDQM

SEQ ID NO: 181199 - protein, 31 aa, Artificial Sequence
  Description of Artificial Sequence: Synthetic polypeptide
DDSEVASTNPVSTEGYGNVAANTIYSRVGQR

SEQ ID NO: 181200 - protein, 31 aa, Artificial Sequence
  Description of Artificial Sequence: Synthetic polypeptide
DDSEVASTNPVSTAGYGNVAANTIQSRVGQR

SEQ ID NO: 181201 - protein, 31 aa, Artificial Sequence
  Description of Artificial Sequence: Synthetic polypeptide
DDSEVASTNPVSTEGYGNVAANTKQSSVGQR

SEQ ID NO: 181202 - protein, 32 aa, Artificial Sequence
  Description of Artificial Sequence: Synthetic polypeptide
DDSEVASTNPVSTEGYGNVAANTMIQSRVGQR

SEQ ID NO: 181203 - protein, 35 aa, Artificial Sequence
  Description of Artificial Sequence: Synthetic polypeptide
DEECIRTTNPVATEGYGCSCSWGEEQEYFNSDNQA

SEQ ID NO: 181204 - protein, 34 aa, Artificial Sequence
  Description of Artificial Sequence: Synthetic polypeptide
DDSEVATTNPVSTEGYGNVSATNPTIQSRNGMQV

SEQ ID NO: 181205 - protein, 33 aa, Artificial Sequence
  Description of Artificial Sequence: Synthetic polypeptide
DEQEIRTTNPVATEQWGATWAATDWEEHEGEDL

SEQ ID NO: 181206 - protein, 32 aa, Artificial Sequence
  Description of Artificial Sequence: Synthetic polypeptide
DDSEVASTNPVSTEGYGNVAANTNIQSDEGQR

SEQ ID NO: 181207 - protein, 34 aa, Artificial Sequence
  Description of Artificial Sequence: Synthetic polypeptide
DEECIRTTNPVATEGYGCVCGWEHNQENFGSQQA

SEQ ID NO: 181208 - protein, 37 aa, Artificial Sequence
  Description of Artificial Sequence: Synthetic polypeptide
DEAEIRTTNPVATEQYGCSCSTWGEHNAENFNSDTQS

SEQ ID NO: 181209 - protein, 34 aa, Artificial Sequence
  Description of Artificial Sequence: Synthetic polypeptide
DEECIRTTNPVATEGYGCVCGWGEDNQNFGSEQS

SEQ ID NO: 181210 - protein, 37 aa, Artificial Sequence
  Description of Artificial Sequence: Synthetic polypeptide
DEEEIRTTNPVATEQYGQCVCSNWGEHNAGFNSDTQS

SEQ ID NO: 181211 - protein, 32 aa, Artificial Sequence
  Description of Artificial Sequence: Synthetic polypeptide
DDSEVASTNPVSTEGYGNVAANTPIQSRVGGR

SEQ ID NO: 181212 - protein, 32 aa, Artificial Sequence
  Description of Artificial Sequence: Synthetic polypeptide
DDSEVASTNPVSTEGYGNVAANTPIQSRVGQR

SEQ ID NO: 181213 - protein, 32 aa, Artificial Sequence
  Description of Artificial Sequence: Synthetic polypeptide
DDSEVASTNPVSTEGYGNVAANTPNQSRVGQR

SEQ ID NO: 181214 - protein, 37 aa, Artificial Sequence
  Description of Artificial Sequence: Synthetic polypeptide
DEEEIRTTNPVATEQYGQCVCSNWGEHNEENFNSDVS

SEQ ID NO: 181215 - protein, 37 aa, Artificial Sequence
  Description of Artificial Sequence: Synthetic polypeptide
DEEEIRTTNPVATEQYGQCVCSNWGEHNENFGSETQT

SEQ ID NO: 181216 - protein, 35 aa, Artificial Sequence
  Description of Artificial Sequence: Synthetic polypeptide
DEQEIRTTNPVATECYGSTTWANTEDLAEHKGPDI

SEQ ID NO: 181217 - protein, 35 aa, Artificial Sequence
  Description of Artificial Sequence: Synthetic polypeptide
SEEEIRCTNPCATEQYGCVCSTWGEHNANFGSQQS

SEQ ID NO: 181218 - protein, 32 aa, Artificial Sequence
  Description of Artificial Sequence: Synthetic polypeptide
DDSEVASTNPVSTEGYGNVAANVSIQSRVGQR

SEQ ID NO: 181219 - protein, 31 aa, Artificial Sequence
  Description of Artificial Sequence: Synthetic polypeptide
DDSEVASTNPVSTEGYGNVAAWTIQSRVGQR

SEQ ID NO: 181220 - protein, 38 aa, Artificial Sequence
  Description of Artificial Sequence: Synthetic polypeptide
DEEEIRTTNPVATEQYGQCVCSTWEEHNIENFNSDNQA

SEQ ID NO: 181221 - protein, 37 aa, Artificial Sequence
  Description of Artificial Sequence: Synthetic polypeptide
DEEEIRTTNPVATEQYGQCVCSTWEEHNQENFISDQA

SEQ ID NO: 181222 - protein, 35 aa, Artificial Sequence
  Description of Artificial Sequence: Synthetic polypeptide
VEDEIATTNPVATEQYGSVCAAANGLDNDDNDNEN

SEQ ID NO: 181223 - protein, 35 aa, Artificial Sequence
  Description of Artificial Sequence: Synthetic polypeptide
DESEIATTNPVAYEQWGSVSINGAPGEDERGGDDH

SEQ ID NO: 181224 - protein, 31 aa, Artificial Sequence
  Description of Artificial Sequence: Synthetic polypeptide
DDSEVASTNPVSTEGYGNVAAYTIQSRVGQR

SEQ ID NO: 181225 - protein, 35 aa, Artificial Sequence
  Description of Artificial Sequence: Synthetic polypeptide
DESEIATTNPVAYEQWGSVSGGNGNESGLNGDGTK

SEQ ID NO: 181226 - protein, 39 aa, Artificial Sequence
  Description of Artificial Sequence: Synthetic polypeptide
DEEEIRTTNPVATEQYGQCVCSTWGEDHNQENFGSDNQD

SEQ ID NO: 181227 - protein, 31 aa, Artificial Sequence
  Description of Artificial Sequence: Synthetic polypeptide
AEMEIACTNPCSYEQYGCVCSNWNHQSGSEQ

SEQ ID NO: 181228 - protein, 34 aa, Artificial Sequence
  Description of Artificial Sequence: Synthetic polypeptide
DESEIATTNPVAYEQWGSVSGGNGNESGEGMGTG

SEQ ID NO: 181229 - protein, 36 aa, Artificial Sequence
  Description of Artificial Sequence: Synthetic polypeptide
VEDEIATTNPVATEQYGSVCAAAGGLSDNDDPDNRN

SEQ ID NO: 181230 - protein, 31 aa, Artificial Sequence
  Description of Artificial Sequence: Synthetic polypeptide
DTSEVASTNPVSTEGYVNVAANTIQSRVGQR

SEQ ID NO: 181231 - protein, 38 aa, Artificial Sequence
  Description of Artificial Sequence: Synthetic polypeptide
DEEEIRTTNPVATEQYGQCVCSTWGEHNAENFNSDFQS

SEQ ID NO: 181232 - protein, 34 aa, Artificial Sequence
  Description of Artificial Sequence: Synthetic polypeptide
CEEEIATTNPVATAQWGSVSATGAGGTAPQDATF

SEQ ID NO: 181233 - protein, 36 aa, Artificial Sequence
  Description of Artificial Sequence: Synthetic polypeptide
DEECIRTTNPVATEQYGCVCSTGEDNQEFFISETQA

SEQ ID NO: 181234 - protein, 38 aa, Artificial Sequence
  Description of Artificial Sequence: Synthetic polypeptide
DEEEIRTTNPVATEQYGQCVCSTWGEHNQENFNSDTQS

SEQ ID NO: 181235 - protein, 38 aa, Artificial Sequence
  Description of Artificial Sequence: Synthetic polypeptide
DEEEIRTTNPVATEQYGQCVCSTWGEHNQENFNSETQS

SEQ ID NO: 181236 - protein, 38 aa, Artificial Sequence
  Description of Artificial Sequence: Synthetic polypeptide
DEEEIRTTNPVATEQYGQCVCSTWGEHNQENFNSQTQS

SEQ ID NO: 181237 - protein, 38 aa, Artificial Sequence
  Description of Artificial Sequence: Synthetic polypeptide
DEEEIRTTNPVATEQYGQCVCSTWGETNAENFNSENQS

SEQ ID NO: 181238 - protein, 34 aa, Artificial Sequence
  Description of Artificial Sequence: Synthetic polypeptide
SEEEICTTNPVATEQYGCMNMSVLETREPEEKEA

SEQ ID NO: 181239 - protein, 38 aa, Artificial Sequence
  Description of Artificial Sequence: Synthetic polypeptide
DEEEIRTTNPVATEQYGQCVCSVSGEDDNQENFNSDQS

SEQ ID NO: 181240 - protein, 37 aa, Artificial Sequence
  Description of Artificial Sequence: Synthetic polypeptide
DEEEIRTTNPVATEQYGQCVCSWEDHNQEYFGSDTQA

SEQ ID NO: 181241 - protein, 33 aa, Artificial Sequence
  Description of Artificial Sequence: Synthetic polypeptide
DENEIRTTNPVATEQWGDVANEEDWANAAEDYI

SEQ ID NO: 181242 - protein, 33 aa, Artificial Sequence
  Description of Artificial Sequence: Synthetic polypeptide
DENEIRTTNPVATEQWGDVANEEDWANAAEDYA

SEQ ID NO: 181243 - protein, 38 aa, Artificial Sequence
  Description of Artificial Sequence: Synthetic polypeptide
DEEEIRTTNPVATEQYGQCVCSTWGEHNAENFNSDTQS

SEQ ID NO: 181244 - protein, 32 aa, Artificial Sequence
  Description of Artificial Sequence: Synthetic polypeptide
DTSEVASTNPVSTEGYGNVVAANTIQSRVGQR

SEQ ID NO: 181245 - protein, 31 aa, Artificial Sequence
  Description of Artificial Sequence: Synthetic polypeptide
DDSEVASTNPVSTEGYGNVAAWTIQDRGGQR

SEQ ID NO: 181246 - protein, 32 aa, Artificial Sequence
  Description of Artificial Sequence: Synthetic polypeptide
DTSEVASTNPVSTEGYGNVAANTISQSRVGQR

SEQ ID NO: 181247 - protein, 37 aa, Artificial Sequence
  Description of Artificial Sequence: Synthetic polypeptide
DEEEIRGTNPVATEQYGSVVGDLDNNGENIEENEGQG

SEQ ID NO: 181248 - protein, 31 aa, Artificial Sequence
  Description of Artificial Sequence: Synthetic polypeptide
DDSEVASTNPVSTEGYGNVAAVTIQERVGQR

SEQ ID NO: 181249 - protein, 38 aa, Artificial Sequence
  Description of Artificial Sequence: Synthetic polypeptide
DEEEIRGTNPVATEQYGSVVDGFGNGEDDEEQDDGNQS

SEQ ID NO: 181250 - protein, 37 aa, Artificial Sequence
  Description of Artificial Sequence: Synthetic polypeptide
DEEEIRGTNPVATEQYGSVVDGFENGENDEEDNGNQT

SEQ ID NO: 181251 - protein, 31 aa, Artificial Sequence
  Description of Artificial Sequence: Synthetic polypeptide
DDSEVASTNPVSTEGYGNVAAVTIQSRVGQR

SEQ ID NO: 181252 - protein, 33 aa, Artificial Sequence
  Description of Artificial Sequence: Synthetic polypeptide
DTNEIRATNPVATWHYGSVSTMGQEVVETEEDF

SEQ ID NO: 181253 - protein, 36 aa, Artificial Sequence
  Description of Artificial Sequence: Synthetic polypeptide
DEECIRTTNPVATEQYGCVCSSGEDENAENFGSDQS

SEQ ID NO: 181254 - protein, 32 aa, Artificial Sequence
  Description of Artificial Sequence: Synthetic polypeptide
DTNEIRTTNPGSTEPYGTISMEDIQQQQNGNH

SEQ ID NO: 181255 - protein, 36 aa, Artificial Sequence
  Description of Artificial Sequence: Synthetic polypeptide
DTNEIRTTNPVATEQYGTVTTSWLPDEGENLQSDEI

SEQ ID NO: 181256 - protein, 36 aa, Artificial Sequence
  Description of Artificial Sequence: Synthetic polypeptide
DTNEIRTTNPVATEQYGTVTTVWGPDEGENLQIDEI

SEQ ID NO: 181257 - protein, 35 aa, Artificial Sequence
  Description of Artificial Sequence: Synthetic polypeptide
DESEIATTNPVAYEQWGSVTGLNENDQQGNMGNQK

SEQ ID NO: 181258 - protein, 38 aa, Artificial Sequence
  Description of Artificial Sequence: Synthetic polypeptide
DEEEIRTTNPVATEQYGQCVCSTTGEDDQEYFNSENQS

SEQ ID NO: 181259 - protein, 36 aa, Artificial Sequence
  Description of Artificial Sequence: Synthetic polypeptide
DDEEISTTNPVATEQYGCVCSNTGEHNQENFGSQQS

SEQ ID NO: 181260 - protein, 33 aa, Artificial Sequence
  Description of Artificial Sequence: Synthetic polypeptide
DTNEIRTTNPVSTEPYGMTISMEDIQQQDNGNH

SEQ ID NO: 181261 - protein, 33 aa, Artificial Sequence
  Description of Artificial Sequence: Synthetic polypeptide
DTNEIRTTNPVSTEPYGTISMEDIQQQQNGNHL

SEQ ID NO: 181262 - protein, 36 aa, Artificial Sequence
  Description of Artificial Sequence: Synthetic polypeptide
DEECIRTTNPVATEQYGCVCSSGEHNAEYFGSDTQS

SEQ ID NO: 181263 - protein, 37 aa, Artificial Sequence
  Description of Artificial Sequence: Synthetic polypeptide
DDEEISTTNPVATEQYGCVCSNTGEDNQENFGSENQS

SEQ ID NO: 181264 - protein, 35 aa, Artificial Sequence
  Description of Artificial Sequence: Synthetic polypeptide
DDEEISTTNPVATEQYGCVCSNTEEDAEHFNSDQS

SEQ ID NO: 181265 - protein, 35 aa, Artificial Sequence
  Description of Artificial Sequence: Synthetic polypeptide
DEAEIACTNPVATEQYGSVAATNEEADPHQANEQA

SEQ ID NO: 181266 - protein, 33 aa, Artificial Sequence
  Description of Artificial Sequence: Synthetic polypeptide
AEMEIACTNPCSYEQYGCVCSTWNLQSFGSEQS

SEQ ID NO: 181267 - protein, 38 aa, Artificial Sequence
  Description of Artificial Sequence: Synthetic polypeptide
SEEEICTTNPVATEQYGSVSGNTMNDGEGQNEEQDEDQ

SEQ ID NO: 181268 - protein, 38 aa, Artificial Sequence
  Description of Artificial Sequence: Synthetic polypeptide
DEEEIRTTNPVATEQYGQCVCSTTPAHNIEYSGSDPVS

SEQ ID NO: 181269 - protein, 38 aa, Artificial Sequence
  Description of Artificial Sequence: Synthetic polypeptide
DEEEIRTTNPVATWQYGSVALTESTAVEPNTLLVEVAG

SEQ ID NO: 181270 - protein, 31 aa, Artificial Sequence
  Description of Artificial Sequence: Synthetic polypeptide
DTSEVASTNPFSTECYGNVAANTIQSRVGQR

SEQ ID NO: 181271 - protein, 31 aa, Artificial Sequence
  Description of Artificial Sequence: Synthetic polypeptide
DTSEVASTNPVSTEGFGNVAANTIQSRVGQR

SEQ ID NO: 181272 - protein, 37 aa, Artificial Sequence
  Description of Artificial Sequence: Synthetic polypeptide
DTTEIRTTNPVATEQYGVVNVVVTNVNNDQAGNEEQD

SEQ ID NO: 181273 - protein, 35 aa, Artificial Sequence
  Description of Artificial Sequence: Synthetic polypeptide
DESEIATTNPVAYEQWGVVCSNQNDGNQQRQGEDS

SEQ ID NO: 181274 - protein, 37 aa, Artificial Sequence
  Description of Artificial Sequence: Synthetic polypeptide
DTTEIRTTNPVATEQYGVVNVVVTNVNNQLAGNEEQS

SEQ ID NO: 181275 - protein, 37 aa, Artificial Sequence
  Description of Artificial Sequence: Synthetic polypeptide
DEECIRTTNPVATEQYGCVCSTSPAHNAENSGSDPQS

SEQ ID NO: 181276 - protein, 33 aa, Artificial Sequence
  Description of Artificial Sequence: Synthetic polypeptide
EANEIATTNPVAYEQWGSVTWTEGDQGRGTTEP

SEQ ID NO: 181277 - protein, 37 aa, Artificial Sequence
  Description of Artificial Sequence: Synthetic polypeptide
DEEEIRTTNPVATEQYGQCVCSWEEMHQESFNSDNQA

SEQ ID NO: 181278 - protein, 35 aa, Artificial Sequence
  Description of Artificial Sequence: Synthetic polypeptide
DDEEISTTNPVATEQYGCVCSMTEHNANFNSDTQA

SEQ ID NO: 181279 - protein, 39 aa, Artificial Sequence
  Description of Artificial Sequence: Synthetic polypeptide
DEEEIRTTNPVATEQYGSVVMGDMNNDNEQFTQGDNEED

SEQ ID NO: 181280 - protein, 38 aa, Artificial Sequence
  Description of Artificial Sequence: Synthetic polypeptide
DEEEIRTTNPVATEQYGSVVMGDMNNDNEQFTQGVGTD

SEQ ID NO: 181281 - protein, 36 aa, Artificial Sequence
  Description of Artificial Sequence: Synthetic polypeptide
EDAEIRTTNPVATEQYGSVISPDKTNVTDEIQVNPD

SEQ ID NO: 181282 - protein, 36 aa, Artificial Sequence
  Description of Artificial Sequence: Synthetic polypeptide
DEECIRTTNPVATEQYGCVCSWEEHNAENFISQNQS

SEQ ID NO: 181283 - protein, 36 aa, Artificial Sequence
  Description of Artificial Sequence: Synthetic polypeptide
DEECIRTTNPVATEQYGCVCSWEEHNQENFNSDTQS

SEQ ID NO: 181284 - protein, 36 aa, Artificial Sequence
  Description of Artificial Sequence: Synthetic polypeptide
EDEEICTTNPVATEQWGTVSTTNNNNLLEQGTNQEQ

SEQ ID NO: 181285 - protein, 36 aa, Artificial Sequence
  Description of Artificial Sequence: Synthetic polypeptide
SEEEICTTNPEAYTTEPVWGSVATNLQHAGGTNGVM

SEQ ID NO: 181286 - protein, 36 aa, Artificial Sequence
  Description of Artificial Sequence: Synthetic polypeptide
DEECIRTTNPVATEQYGCVCSWGEDNQENFGSETQA

SEQ ID NO: 181287 - protein, 34 aa, Artificial Sequence
  Description of Artificial Sequence: Synthetic polypeptide
DESEIATTNPVAYEQWGSVCYNNDQDQDHGEDQE

SEQ ID NO: 181288 - protein, 36 aa, Artificial Sequence
  Description of Artificial Sequence: Synthetic polypeptide
DEECIRTTNPVATEQYGCVCSWGEENAENFISQNQS

SEQ ID NO: 181289 - protein, 36 aa, Artificial Sequence
  Description of Artificial Sequence: Synthetic polypeptide
DDEEISTTNPVATEQYGCVCSDWGEHNQNFGSDNQS

SEQ ID NO: 181290 - protein, 36 aa, Artificial Sequence
  Description of Artificial Sequence: Synthetic polypeptide
DEECIRTTNPVATEQYGCVCSWGEHNEENFNSDNQA

SEQ ID NO: 181291 - protein, 34 aa, Artificial Sequence
  Description of Artificial Sequence: Synthetic polypeptide
DDEEISTTNPVATEQYGCVCPWGEHQENFGSDQS

SEQ ID NO: 181292 - protein, 37 aa, Artificial Sequence
  Description of Artificial Sequence: Synthetic polypeptide
EDEEICTTNPVATEQYGVVSTVVNEQNQNQQGNNTDD

SEQ ID NO: 181293 - protein, 35 aa, Artificial Sequence
  Description of Artificial Sequence: Synthetic polypeptide
EDEEICTTNPVATTQYGSVATTQQGNTQQGTTEQG

SEQ ID NO: 181294 - protein, 37 aa, Artificial Sequence
  Description of Artificial Sequence: Synthetic polypeptide
DEECIRTTNPVATEQYGCVTSTTPADNAEYFGSDPQS

SEQ ID NO: 181295 - protein, 34 aa, Artificial Sequence
  Description of Artificial Sequence: Synthetic polypeptide
EDEEICTTNPVATTQYGTVATTQQGTEQGTNQQP

SEQ ID NO: 181296 - protein, 32 aa, Artificial Sequence
  Description of Artificial Sequence: Synthetic polypeptide
DDSEVASTNPVSTEGYGNVACNETIQDREGQR

SEQ ID NO: 181297 - protein, 37 aa, Artificial Sequence
  Description of Artificial Sequence: Synthetic polypeptide
DEEEIRTTNPVATEQYGQCVCSWGEDDNQENFNSDQS

SEQ ID NO: 181298 - protein, 37 aa, Artificial Sequence
  Description of Artificial Sequence: Synthetic polypeptide
DEEEIRTTNPVATEQYGQCVCSWGEDHETENFGSDQQ

SEQ ID NO: 181299 - protein, 33 aa, Artificial Sequence
  Description of Artificial Sequence: Synthetic polypeptide
DESEIATTNPVAYEQWGSVCTIEMDDGHGGGVQ

SEQ ID NO: 181300 - protein, 36 aa, Artificial Sequence
  Description of Artificial Sequence: Synthetic polypeptide
DEECIRTTNPVATEQYGCVCSWGEENIENFNSDNQS

SEQ ID NO: 181301 - protein, 36 aa, Artificial Sequence
  Description of Artificial Sequence: Synthetic polypeptide
DEESIEATTNPVAYECWGSVATGNGLNMNDQGGESR

SEQ ID NO: 181302 - protein, 36 aa, Artificial Sequence
  Description of Artificial Sequence: Synthetic polypeptide
DDEEISTTNPVATEQYGCVCSMTGEHNINFGSDTQS

SEQ ID NO: 181303 - protein, 34 aa, Artificial Sequence
  Description of Artificial Sequence: Synthetic polypeptide
DESEIATTNPVAYEQWGSVCYNNDQDQGEGEDIK

SEQ ID NO: 181304 - protein, 35 aa, Artificial Sequence
  Description of Artificial Sequence: Synthetic polypeptide
DENEIRTTNPVATEQWGDTVSVPILEQMIAVEITE

SEQ ID NO: 181305 - protein, 34 aa, Artificial Sequence
  Description of Artificial Sequence: Synthetic polypeptide
DENEIRTTNPVATEQWGDTVSVIEQMIAVEVSGT

SEQ ID NO: 181306 - protein, 37 aa, Artificial Sequence
  Description of Artificial Sequence: Synthetic polypeptide
DTTEIRTTNPVATEQYGVVSTTNNQQQLLLQGEEEDE

SEQ ID NO: 181307 - protein, 35 aa, Artificial Sequence
  Description of Artificial Sequence: Synthetic polypeptide
VEDEIATTNPVATEQYGSVCAAAGGLDNDDNDNRH

SEQ ID NO: 181308 - protein, 32 aa, Artificial Sequence
  Description of Artificial Sequence: Synthetic polypeptide
DENEIRTTNPVATEQWGDTTWSEIWMEAAEPI

SEQ ID NO: 181309 - protein, 32 aa, Artificial Sequence
  Description of Artificial Sequence: Synthetic polypeptide
DENEIRTTNPVATEQWGDTTWSEIEMNAAEPI

SEQ ID NO: 181310 - protein, 37 aa, Artificial Sequence
  Description of Artificial Sequence: Synthetic polypeptide
DTTEIRTTNPVATEQYGVVTVVVTNVNNAQAGNEEQS

SEQ ID NO: 181311 - protein, 37 aa, Artificial Sequence
  Description of Artificial Sequence: Synthetic polypeptide
DEEEIRTTNPVATEQYGQCVCSWEEDHNQNFNSDNQP

SEQ ID NO: 181312 - protein, 36 aa, Artificial Sequence
  Description of Artificial Sequence: Synthetic polypeptide
DTTTICTTNPVATEQYGSVSTVTTTNGEQGSVNVDT

SEQ ID NO: 181313 - protein, 32 aa, Artificial Sequence
  Description of Artificial Sequence: Synthetic polypeptide
DDSEVATTNPVSTEGYGNVAANTIQSHVGQDR

SEQ ID NO: 181314 - protein, 37 aa, Artificial Sequence
  Description of Artificial Sequence: Synthetic polypeptide
DEEEIRTTNPVATEQYGQCVCSWEEHNAENFNSDTQA

SEQ ID NO: 181315 - protein, 34 aa, Artificial Sequence
  Description of Artificial Sequence: Synthetic polypeptide
DESEIATTNPVAYEQWGSVCYNNDQDSGHQEDQE

SEQ ID NO: 181316 - protein, 37 aa, Artificial Sequence
  Description of Artificial Sequence: Synthetic polypeptide
DEEEIRTTNPVATEQYGQCVCSWEEHNIEFFNSDNQA

SEQ ID NO: 181317 - protein, 37 aa, Artificial Sequence
  Description of Artificial Sequence: Synthetic polypeptide
DEEEIRTTNPVATEQYGQCVCSWEEHNIEFFNSDNQS

SEQ ID NO: 181318 - protein, 37 aa, Artificial Sequence
  Description of Artificial Sequence: Synthetic polypeptide
DEEEIRTTNPVATEQYGQCVCSWEEHNQEHFNSDNQS

SEQ ID NO: 181319 - protein, 37 aa, Artificial Sequence
  Description of Artificial Sequence: Synthetic polypeptide
DEEEIRTTNPVATEQYGQCVCSWEEHNQEHFNSDTQS

SEQ ID NO: 181320 - protein, 35 aa, Artificial Sequence
  Description of Artificial Sequence: Synthetic polypeptide
DESEIATTNPVAYEQWGSVCYNNDQDQLGHNEDQD

SEQ ID NO: 181321 - protein, 37 aa, Artificial Sequence
  Description of Artificial Sequence: Synthetic polypeptide
DEEEIRTTNPVATEQYGQCVCSWEEHNQENFNSQTQA

SEQ ID NO: 181322 - protein, 34 aa, Artificial Sequence
  Description of Artificial Sequence: Synthetic polypeptide
DESEIATTNPVAYEQWGSVCYNNDQDQGHGEPME

SEQ ID NO: 181323 - protein, 37 aa, Artificial Sequence
  Description of Artificial Sequence: Synthetic polypeptide
DEECIRTTNPVATEQYGCVCSTWGEDNQEFFNSETQA

SEQ ID NO: 181324 - protein, 37 aa, Artificial Sequence
  Description of Artificial Sequence: Synthetic polypeptide
DEECIRTTNPVATEQYGCVCSTWGEHNAENFNSDTQS

SEQ ID NO: 181325 - protein, 33 aa, Artificial Sequence
  Description of Artificial Sequence: Synthetic polypeptide
DENEIRTTNPVATEQWGDTTSNAIEMNAKEDYI

SEQ ID NO: 181326 - protein, 33 aa, Artificial Sequence
  Description of Artificial Sequence: Synthetic polypeptide
DENEIRTTNPVATEQWGDTTANAIEMNAKEDYI

SEQ ID NO: 181327 - protein, 37 aa, Artificial Sequence
  Description of Artificial Sequence: Synthetic polypeptide
DEEEIRTTNPVATEQYGQCVCSWEEHNQEYFNSENQA

SEQ ID NO: 181328 - protein, 31 aa, Artificial Sequence
  Description of Artificial Sequence: Synthetic polypeptide
DDSEVASTNPVSIEGYGNVAANTIQSRVGQR

SEQ ID NO: 181329 - protein, 37 aa, Artificial Sequence
  Description of Artificial Sequence: Synthetic polypeptide
DTTEIRTTNPVATEQYGVVNVVVTTTNNQQAGNEEQS

SEQ ID NO: 181330 - protein, 35 aa, Artificial Sequence
  Description of Artificial Sequence: Synthetic polypeptide
TSGSIQTTNPVATEEWGSVSCVGNSSQNRPNGNPR

SEQ ID NO: 181331 - protein, 33 aa, Artificial Sequence
  Description of Artificial Sequence: Synthetic polypeptide
DESEIATTNPVAYEQWGVVSGGNGNESGEGDTQ

SEQ ID NO: 181332 - protein, 37 aa, Artificial Sequence
  Description of Artificial Sequence: Synthetic polypeptide
DEEEIRGTNPVATEQYGSVVVDNDNNGENIEENEGQE

SEQ ID NO: 181333 - protein, 32 aa, Artificial Sequence
  Description of Artificial Sequence: Synthetic polypeptide
AEDEIACTNPVAYEQWGEAYIELNDQRGGERN

SEQ ID NO: 181334 - protein, 37 aa, Artificial Sequence
  Description of Artificial Sequence: Synthetic polypeptide
DTEEIRTTNPVATEQYGVVSTVTNTNQQQATTTTTDE

SEQ ID NO: 181335 - protein, 36 aa, Artificial Sequence
  Description of Artificial Sequence: Synthetic polypeptide
DEESIACTNPVATEQYGSVCATNNSEMDDDQAGDAT

SEQ ID NO: 181336 - protein, 36 aa, Artificial Sequence
  Description of Artificial Sequence: Synthetic polypeptide
DEESIACTNPVATEQYGSVCATNNSENPDDGANADD

SEQ ID NO: 181337 - protein, 36 aa, Artificial Sequence
  Description of Artificial Sequence: Synthetic polypeptide
DEECIRTTNPVATEQWGCVCQWNEHNQEGFISENQS

SEQ ID NO: 181338 - protein, 32 aa, Artificial Sequence
  Description of Artificial Sequence: Synthetic polypeptide
DDSEVASTNPVSTEGYGNVAANYNIQSRVGQR

SEQ ID NO: 181339 - protein, 36 aa, Artificial Sequence
  Description of Artificial Sequence: Synthetic polypeptide
CEEEISTTNPVATEQYGCVCSNTGEDQENFNSDTQS

SEQ ID NO: 181340 - protein, 36 aa, Artificial Sequence
  Description of Artificial Sequence: Synthetic polypeptide
CEEEISTTNPVATEQYGCVCSNTGEDQENFSSDNQS

SEQ ID NO: 181341 - protein, 32 aa, Artificial Sequence
  Description of Artificial Sequence: Synthetic polypeptide
DDSEVASTNPVSTEGYGNVAANYTIQSRVGQR

SEQ ID NO: 181342 - protein, 36 aa, Artificial Sequence
  Description of Artificial Sequence: Synthetic polypeptide
DEESIACTNPVATEQYGSVCATNPSENPDDGANDNH

SEQ ID NO: 181343 - protein, 38 aa, Artificial Sequence
  Description of Artificial Sequence: Synthetic polypeptide
DTEEIRTTNPVATEQYGVVSTVVSTQQAGNQQGTEEED

SEQ ID NO: 181344 - protein, 38 aa, Artificial Sequence
  Description of Artificial Sequence: Synthetic polypeptide
DTEEIRTTNPVATEQYGVVSTVTNTNQNQQATNNATNQ

SEQ ID NO: 181345 - protein, 37 aa, Artificial Sequence
  Description of Artificial Sequence: Synthetic polypeptide
DEEEIRTTNPVATEQYGSVVLGINPVTPEQPEQEPTN

SEQ ID NO: 181346 - protein, 35 aa, Artificial Sequence
  Description of Artificial Sequence: Synthetic polypeptide
DEESIACTNPVATEQYGSVCSAPADNGAHNDEDAH

SEQ ID NO: 181347 - protein, 37 aa, Artificial Sequence
  Description of Artificial Sequence: Synthetic polypeptide
DEQEIRTTNPVATEQYGSHVSCVVDSLNQPNSQIDEQ

SEQ ID NO: 181348 - protein, 34 aa, Artificial Sequence
  Description of Artificial Sequence: Synthetic polypeptide
DEAEIACTNPVATEQYGCVATTHGPMTAGEGNDE

SEQ ID NO: 181349 - protein, 37 aa, Artificial Sequence
  Description of Artificial Sequence: Synthetic polypeptide
DTEEIRTTNPVATEQYGVVSVTVVTTNNQQNEEDTED

SEQ ID NO: 181350 - protein, 31 aa, Artificial Sequence
  Description of Artificial Sequence: Synthetic polypeptide
DDSEVASTNPVSTEGYGNVAAPTIQSRVGQR

SEQ ID NO: 181351 - protein, 32 aa, Artificial Sequence
  Description of Artificial Sequence: Synthetic polypeptide
AEDEIACTNPVAYEQWGEAWSIENDQDIGGER

SEQ ID NO: 181352 - protein, 35 aa, Artificial Sequence
  Description of Artificial Sequence: Synthetic polypeptide
DEAEISTTNPVATEQYGQCVCSWGEHQENFGSDQA

SEQ ID NO: 181353 - protein, 34 aa, Artificial Sequence
  Description of Artificial Sequence: Synthetic polypeptide
DEAEIACTNPVATEQYGSACAANHAPMAGMMNNA

SEQ ID NO: 181354 - protein, 34 aa, Artificial Sequence
  Description of Artificial Sequence: Synthetic polypeptide
TSGSIQTTNPVATEEWGSVSCSGNSSDRNVGNPR

SEQ ID NO: 181355 - protein, 31 aa, Artificial Sequence
  Description of Artificial Sequence: Synthetic polypeptide
DDSEVASTNPVSTEGYGNVAAQTIQSRVGQR

SEQ ID NO: 181356 - protein, 36 aa, Artificial Sequence
  Description of Artificial Sequence: Synthetic polypeptide
DEAEIACTNPVATEQYGSACSAANPLAEAEMGNGMF

SEQ ID NO: 181357 - protein, 36 aa, Artificial Sequence
  Description of Artificial Sequence: Synthetic polypeptide
DEESIACTNPVATEQYGSVCATNPSENPDDGANEDT

SEQ ID NO: 181358 - protein, 38 aa, Artificial Sequence
  Description of Artificial Sequence: Synthetic polypeptide
DTEEIRTTNPVATEQYGVVSTVTNQAGNTEQGETTTAE

SEQ ID NO: 181359 - protein, 37 aa, Artificial Sequence
  Description of Artificial Sequence: Synthetic polypeptide
DEEEIRTTNPVATEQYGQCVCSTEEDHNQENFISDQM

SEQ ID NO: 181360 - protein, 35 aa, Artificial Sequence
  Description of Artificial Sequence: Synthetic polypeptide
CEEEIACTNPVATEQWGCNVATNNLENGMGEEGRA

SEQ ID NO: 181361 - protein, 37 aa, Artificial Sequence
  Description of Artificial Sequence: Synthetic polypeptide
DTEEIRTTNPVATEQYGVVSTTSTQAGTEAGTEQGSD

SEQ ID NO: 181362 - protein, 35 aa, Artificial Sequence
  Description of Artificial Sequence: Synthetic polypeptide
DEQEIATTNPEVATEQYFQSVSATDDLEDHEAEDL

SEQ ID NO: 181363 - protein, 35 aa, Artificial Sequence
  Description of Artificial Sequence: Synthetic polypeptide
DEECIRTTNPVATEQWGCVCGWNEDHNQGFGSEQS

SEQ ID NO: 181364 - protein, 34 aa, Artificial Sequence
  Description of Artificial Sequence: Synthetic polypeptide
SEEEIRCTNPCATEQYGCVCSNWELNAHFGSDQS

SEQ ID NO: 181365 - protein, 32 aa, Artificial Sequence
  Description of Artificial Sequence: Synthetic polypeptide
DDSEVASTNPVSTEGYGNVAANVTIQSRVGQR

SEQ ID NO: 181366 - protein, 38 aa, Artificial Sequence
  Description of Artificial Sequence: Synthetic polypeptide
DTEEIRTTNPVATEQYGVVSTTTNQAGTEAGTEQQGSD

SEQ ID NO: 181367 - protein, 32 aa, Artificial Sequence
  Description of Artificial Sequence: Synthetic polypeptide
DDSEVATTNPVSTEGYGNVAATTIQDHEGQDR

SEQ ID NO: 181368 - protein, 33 aa, Artificial Sequence
  Description of Artificial Sequence: Synthetic polypeptide
AEDEIACTNPVAYEQWGEAYYIENLQDRGEGER

SEQ ID NO: 181369 - protein, 37 aa, Artificial Sequence
  Description of Artificial Sequence: Synthetic polypeptide
DTEEIRTTNPVATEQYGVVSTTTTQAGTEQGTEQGSQ

SEQ ID NO: 181370 - protein, 35 aa, Artificial Sequence
  Description of Artificial Sequence: Synthetic polypeptide
DEAEISTTNPVATEQYGQCVCSWGEHNAYFGSDQA

SEQ ID NO: 181371 - protein, 31 aa, Artificial Sequence
  Description of Artificial Sequence: Synthetic polypeptide
DDSEVASTNPVSTEGYGNVAANWIQHRVGQL

SEQ ID NO: 181372 - protein, 39 aa, Artificial Sequence
  Description of Artificial Sequence: Synthetic polypeptide
DEEEIRTTNPVATEQYGSVVGSGQEDQIETDGEGEGNEE

SEQ ID NO: 181373 - protein, 38 aa, Artificial Sequence
  Description of Artificial Sequence: Synthetic polypeptide
DTEEIRTTNPVATEQYGVVSTVNNQQQGTDEQGTEEDE

SEQ ID NO: 181374 - protein, 32 aa, Artificial Sequence
  Description of Artificial Sequence: Synthetic polypeptide
DDSEVASTNPVSTEGYGNVAANWTIQSRVGDR

SEQ ID NO: 181375 - protein, 38 aa, Artificial Sequence
  Description of Artificial Sequence: Synthetic polypeptide
DTEEIRTTNPVATEQYGVVSTVNQAGNNEQGSTNNNQD

SEQ ID NO: 181376 - protein, 32 aa, Artificial Sequence
  Description of Artificial Sequence: Synthetic polypeptide
DDSEVASTNPVSTEGYGNVAANWTIQSRVGQR

SEQ ID NO: 181377 - protein, 38 aa, Artificial Sequence
  Description of Artificial Sequence: Synthetic polypeptide
DTEEIRTTNPVATEQYGVVSTVTNANQDEQATNNATNE

SEQ ID NO: 181378 - protein, 38 aa, Artificial Sequence
  Description of Artificial Sequence: Synthetic polypeptide
DTEEIRTTNPVATEQYGVVSTVTNGNQTQEATNNATNE

SEQ ID NO: 181379 - protein, 35 aa, Artificial Sequence
  Description of Artificial Sequence: Synthetic polypeptide
DEECIRTTNPVATEQWGCVCQNTNEHNQGFISDQS

SEQ ID NO: 181380 - protein, 35 aa, Artificial Sequence
  Description of Artificial Sequence: Synthetic polypeptide
CEEEIACTNPVATEQWGCNVATNNLENGMGDEDRN

SEQ ID NO: 181381 - protein, 37 aa, Artificial Sequence
  Description of Artificial Sequence: Synthetic polypeptide
YEEEIRSTNPVATEQYGSVGDGQGNQGQGEGGENQEI

SEQ ID NO: 181382 - protein, 32 aa, Artificial Sequence
  Description of Artificial Sequence: Synthetic polypeptide
AEDEIACTNPVAYEQWGEAYIENDQDRGEERS

SEQ ID NO: 181383 - protein, 36 aa, Artificial Sequence
  Description of Artificial Sequence: Synthetic polypeptide
DEECIRTTNPVATEQWGCVCQTWNEHNQGFNSDNQS

SEQ ID NO: 181384 - protein, 34 aa, Artificial Sequence
  Description of Artificial Sequence: Synthetic polypeptide
SEEEIRCTNPCATEGYGCVCSWELNANFGSDNQS

SEQ ID NO: 181385 - protein, 35 aa, Artificial Sequence
  Description of Artificial Sequence: Synthetic polypeptide
DESEIATTNPVAYEQYGTVCSATDGPSEFEGGNND

SEQ ID NO: 181386 - protein, 32 aa, Artificial Sequence
  Description of Artificial Sequence: Synthetic polypeptide
DDSEVASTNPVSTEGYGNVAAQTMIQSRVGQR

SEQ ID NO: 181387 - protein, 38 aa, Artificial Sequence
  Description of Artificial Sequence: Synthetic polypeptide
DEEEIRGTNPVATEQYGVVVMGNTNDQELLATEQTGEQ

SEQ ID NO: 181388 - protein, 36 aa, Artificial Sequence
  Description of Artificial Sequence: Synthetic polypeptide
DEEEIRGTNPVATEQYGVVVDGFNGESDEEDDGNQS

SEQ ID NO: 181389 - protein, 37 aa, Artificial Sequence
  Description of Artificial Sequence: Synthetic polypeptide
DEQEIRTTNPVATEQYGSSNIPVTSGLNEQETVTEEN

SEQ ID NO: 181390 - protein, 32 aa, Artificial Sequence
  Description of Artificial Sequence: Synthetic polypeptide
DDSEVASTNPVSTEGYGNVAATDTIQSRVGQR

SEQ ID NO: 181391 - protein, 33 aa, Artificial Sequence
  Description of Artificial Sequence: Synthetic polypeptide
DEESIATTNPVAYECWGSVYDWHNDVQRQDQMM

SEQ ID NO: 181392 - protein, 31 aa, Artificial Sequence
  Description of Artificial Sequence: Synthetic polypeptide
DDSEVASTNPVSTEGYGNVAATTIEDRVGQR

SEQ ID NO: 181393 - protein, 36 aa, Artificial Sequence
  Description of Artificial Sequence: Synthetic polypeptide
DEECIRTTNPVATEQYGCVCSNWGEDNDENFGSDQM

SEQ ID NO: 181394 - protein, 34 aa, Artificial Sequence
  Description of Artificial Sequence: Synthetic polypeptide
DEESIATTNPVAYECWGSVYNIMNDVEQREGHHM

SEQ ID NO: 181395 - protein, 36 aa, Artificial Sequence
  Description of Artificial Sequence: Synthetic polypeptide
DEAEISTTNPVAYECWGSVATGNGPLQDDRQEEGTD

SEQ ID NO: 181396 - protein, 30 aa, Artificial Sequence
  Description of Artificial Sequence: Synthetic polypeptide
DDSEVASTNPVSSEGYGNVANTIQSRVGQR

SEQ ID NO: 181397 - protein, 36 aa, Artificial Sequence
  Description of Artificial Sequence: Synthetic polypeptide
DEECIRTTNPVATEQYGCVCSNWGEHNQENFNSDQS

SEQ ID NO: 181398 - protein, 34 aa, Artificial Sequence
  Description of Artificial Sequence: Synthetic polypeptide
AEMEIACTNPVATEQYGCSCSWGELNQYFGSDQS

SEQ ID NO: 181399 - protein, 32 aa, Artificial Sequence
  Description of Artificial Sequence: Synthetic polypeptide
AEMEIACTNPCSYEQYGCVSWNLNQESFGSEQ

SEQ ID NO: 181400 - protein, 37 aa, Artificial Sequence
  Description of Artificial Sequence: Synthetic polypeptide
DEECIRTTNPVATEQYGCVCSNWGEPNQEYFGSDNQS

SEQ ID NO: 181401 - protein, 37 aa, Artificial Sequence
  Description of Artificial Sequence: Synthetic polypeptide
DEEEIRGTNPVATEQYGVISNLQIVNFDEQEGGENDT

SEQ ID NO: 181402 - protein, 36 aa, Artificial Sequence
  Description of Artificial Sequence: Synthetic polypeptide
DEQEIATTNPVATEQWGSVSATGDMGEDHQDEEDNP

SEQ ID NO: 181403 - protein, 31 aa, Artificial Sequence
  Description of Artificial Sequence: Synthetic polypeptide
DDSEVASTNPVSTEGYGNVAATTIQSRVGQE

SEQ ID NO: 181404 - protein, 32 aa, Artificial Sequence
  Description of Artificial Sequence: Synthetic polypeptide
AEMEIACTNPCSYEQYGCVCSWNLQESGSEQS

SEQ ID NO: 181405 - protein, 32 aa, Artificial Sequence
  Description of Artificial Sequence: Synthetic polypeptide
DEESIATTNPVAYECWGVVYNWNNDHQFEQNM

SEQ ID NO: 181406 - protein, 33 aa, Artificial Sequence
  Description of Artificial Sequence: Synthetic polypeptide
DEESIATTNPVAYECWGVVYNWPQNDHQREQNM

SEQ ID NO: 181407 - protein, 31 aa, Artificial Sequence
  Description of Artificial Sequence: Synthetic polypeptide
DDSEVASTNPVSTEGYGNVAATTIQSRVTQR

SEQ ID NO: 181408 - protein, 32 aa, Artificial Sequence
  Description of Artificial Sequence: Synthetic polypeptide
AEMEIACTNPCSYEQYGCVCSWNLNQSGSETQ

SEQ ID NO: 181409 - protein, 31 aa, Artificial Sequence
  Description of Artificial Sequence: Synthetic polypeptide
DDSEVASTNPVSTEGYGNVAAVDIQSRVGQR

SEQ ID NO: 181410 - protein, 37 aa, Artificial Sequence
  Description of Artificial Sequence: Synthetic polypeptide
VEDEIATTNPVATEQYGSVCAAANPELQEHQDGNQHQ

SEQ ID NO: 181411 - protein, 36 aa, Artificial Sequence
  Description of Artificial Sequence: Synthetic polypeptide
DEEEIRGTNPVATEQYGSVYVAIEEQIENTEEDNDM

SEQ ID NO: 181412 - protein, 32 aa, Artificial Sequence
  Description of Artificial Sequence: Synthetic polypeptide
AEMEIACTNPCSYEQYGCVCSWNDLQSFGSEQ

SEQ ID NO: 181413 - protein, 34 aa, Artificial Sequence
  Description of Artificial Sequence: Synthetic polypeptide
DEESIATTNPVAYEGWGSVATTNPGGDRTQGDGD

SEQ ID NO: 181414 - protein, 38 aa, Artificial Sequence
  Description of Artificial Sequence: Synthetic polypeptide
DEEEIRGTNPVATEQYGSVYGNQNLPNQGQEGGQTGGQ

SEQ ID NO: 181415 - protein, 36 aa, Artificial Sequence
  Description of Artificial Sequence: Synthetic polypeptide
DEDEIRGTNPVATEFWGIVSAANGQGQRGQNEQNGD

SEQ ID NO: 181416 - protein, 35 aa, Artificial Sequence
  Description of Artificial Sequence: Synthetic polypeptide
DEAEIRTTNPVATEQYGAANSDVPDFDPNTEDERI

SEQ ID NO: 181417 - protein, 31 aa, Artificial Sequence
  Description of Artificial Sequence: Synthetic polypeptide
DDSEVASTNPVSTEGYGNVAATDTIQRVGQD

SEQ ID NO: 181418 - protein, 34 aa, Artificial Sequence
  Description of Artificial Sequence: Synthetic polypeptide
DEAEIACTNPVATEQYGSCAATNNDHPSGEDGEN

SEQ ID NO: 181419 - protein, 32 aa, Artificial Sequence
  Description of Artificial Sequence: Synthetic polypeptide
CEEEIATTNPVATASWGCIATTAAEQVTGDNF

SEQ ID NO: 181420 - protein, 34 aa, Artificial Sequence
  Description of Artificial Sequence: Synthetic polypeptide
SEEEIRCTNPAATEQYGCVCSWGELNANFGSDQS

SEQ ID NO: 181421 - protein, 36 aa, Artificial Sequence
  Description of Artificial Sequence: Synthetic polypeptide
DTEEIRTTNPVATTQYGSVATEAGTNQNNNNTNNDE

SEQ ID NO: 181422 - protein, 31 aa, Artificial Sequence
  Description of Artificial Sequence: Synthetic polypeptide
DDSEVASTNPVSTEGYGNVAASTIQSRVGQI

SEQ ID NO: 181423 - protein, 38 aa, Artificial Sequence
  Description of Artificial Sequence: Synthetic polypeptide
DEEEIRTTNPVATEQYGSVVMGDMNNDNEQFTQGDDTE

SEQ ID NO: 181424 - protein, 36 aa, Artificial Sequence
  Description of Artificial Sequence: Synthetic polypeptide
VEDEIATTNPVATEQYGSVCADTNNPEQQANQTEGT

SEQ ID NO: 181425 - protein, 37 aa, Artificial Sequence
  Description of Artificial Sequence: Synthetic polypeptide
DEQEIRTTNPVATEQYGSTNIPVTSGLNEQEDVCEEN

SEQ ID NO: 181426 - protein, 36 aa, Artificial Sequence
  Description of Artificial Sequence: Synthetic polypeptide
DEQEIRTTNPVATEQYGSTSSWAQWDLVDSGQDEMG

SEQ ID NO: 181427 - protein, 38 aa, Artificial Sequence
  Description of Artificial Sequence: Synthetic polypeptide
DEEEIRTTNPVATEQYGQCVCSTGEDHNQENFNSDPQS

SEQ ID NO: 181428 - protein, 37 aa, Artificial Sequence
  Description of Artificial Sequence: Synthetic polypeptide
DEEEIRTTNPVATEQYGQCVCSTGEDHQENFISDTQA

SEQ ID NO: 181429 - protein, 36 aa, Artificial Sequence
  Description of Artificial Sequence: Synthetic polypeptide
DEAEIACTNPVATEQYGSACSATNHQNGAPMGITPN

SEQ ID NO: 181430 - protein, 36 aa, Artificial Sequence
  Description of Artificial Sequence: Synthetic polypeptide
DEECIRTTNPVATEQYGCVCSDTGEHNQNFSSDTQA

SEQ ID NO: 181431 - protein, 36 aa, Artificial Sequence
  Description of Artificial Sequence: Synthetic polypeptide
DEECIRTTNPVATEQYGCVCSMSGEHNQNFNSDTQS

SEQ ID NO: 181432 - protein, 37 aa, Artificial Sequence
  Description of Artificial Sequence: Synthetic polypeptide
DEECIRTTNPVATEQYGCVCSMTGEDHNQENFGSDQS

SEQ ID NO: 181433 - protein, 37 aa, Artificial Sequence
  Description of Artificial Sequence: Synthetic polypeptide
DEECIRTTNPVATEQYGCVCSMWEDDNQEFFGSDNQA

SEQ ID NO: 181434 - protein, 38 aa, Artificial Sequence
  Description of Artificial Sequence: Synthetic polypeptide
DEEEIRTTNPVATEQYGQCVCSTGEDPEQENFGSETQA

SEQ ID NO: 181435 - protein, 37 aa, Artificial Sequence
  Description of Artificial Sequence: Synthetic polypeptide
DEECIRTTNPVATEQYGCVCSMWGEHNTENFNSDNQS

SEQ ID NO: 181436 - protein, 36 aa, Artificial Sequence
  Description of Artificial Sequence: Synthetic polypeptide
DEAEIACTNPVATEQYGSACSTNPELGQEHQDDEAE

SEQ ID NO: 181437 - protein, 37 aa, Artificial Sequence
  Description of Artificial Sequence: Synthetic polypeptide
DEEEIRTTNPVATEQYGQCVCSTGEHNQENFFSDTQS

SEQ ID NO: 181438 - protein, 36 aa, Artificial Sequence
  Description of Artificial Sequence: Synthetic polypeptide
DEECIRTTNPVATEQYGCVCSNSGEHNQENFGSEQA

SEQ ID NO: 181439 - protein, 35 aa, Artificial Sequence
  Description of Artificial Sequence: Synthetic polypeptide
DEESIATTNPVATEPWGISVCSYSPMVSQMGGNNG

SEQ ID NO: 181440 - protein, 33 aa, Artificial Sequence
  Description of Artificial Sequence: Synthetic polypeptide
DEAEIACTNPVATEQYGSCAAPQGGDGEGGPRE

SEQ ID NO: 181441 - protein, 36 aa, Artificial Sequence
  Description of Artificial Sequence: Synthetic polypeptide
DEECIRTTNPVATEQYGCVCSNTGEHQENFISDTQA

SEQ ID NO: 181442 - protein, 37 aa, Artificial Sequence
  Description of Artificial Sequence: Synthetic polypeptide
DEEEIRGTNPVATEQYGVIVNLQNVNFDEQEGGENDN

SEQ ID NO: 181443 - protein, 36 aa, Artificial Sequence
  Description of Artificial Sequence: Synthetic polypeptide
DEECIRTTNPVATEQYGCVCSNWEDDNQEFFGSEQA

SEQ ID NO: 181444 - protein, 35 aa, Artificial Sequence
  Description of Artificial Sequence: Synthetic polypeptide
DDEEISTTNPVATEQYGCVCSNWEHNQNFGSDTQS

SEQ ID NO: 181445 - protein, 35 aa, Artificial Sequence
  Description of Artificial Sequence: Synthetic polypeptide
DEQEIRTTNPVATECYGSTTWANTEDLADHKGPDI

SEQ ID NO: 181446 - protein, 37 aa, Artificial Sequence
  Description of Artificial Sequence: Synthetic polypeptide
DEEEIRTTNPVATEQYGQCVCSNWGEDTQYFNSETQS

SEQ ID NO: 181447 - protein, 32 aa, Artificial Sequence
  Description of Artificial Sequence: Synthetic polypeptide
DDSEVASTNPVSTEGYGNVAANTIQVRVGDQR

SEQ ID NO: 181448 - protein, 38 aa, Artificial Sequence
  Description of Artificial Sequence: Synthetic polypeptide
DEEEIRTTNPVATEQYGQCVCSMWGEDDNQNFGSENQS

SEQ ID NO: 181449 - protein, 32 aa, Artificial Sequence
  Description of Artificial Sequence: Synthetic polypeptide
DSSEVASTNPVSTEPYGNVAANTISQSRAGQR

SEQ ID NO: 181450 - protein, 37 aa, Artificial Sequence
  Description of Artificial Sequence: Synthetic polypeptide
DEEEIRTTNPVATEQYGQCVCSMWGEDHNQNFGSDQS

SEQ ID NO: 181451 - protein, 35 aa, Artificial Sequence
  Description of Artificial Sequence: Synthetic polypeptide
DEQEIRGTNPVATEAWGSVTSAGMEGQDGEGENGG

SEQ ID NO: 181452 - protein, 37 aa, Artificial Sequence
  Description of Artificial Sequence: Synthetic polypeptide
DEEEIRTTNPVATEQYGQCVCSMWGEDNQENFNSDQP

SEQ ID NO: 181453 - protein, 37 aa, Artificial Sequence
  Description of Artificial Sequence: Synthetic polypeptide
DEEEIRTTNPVATEQYGQCVCSMWGEHDQENFGSDQA

SEQ ID NO: 181454 - protein, 32 aa, Artificial Sequence
  Description of Artificial Sequence: Synthetic polypeptide
DDSEVASTNPVSTEGYGNVAANTIQSRVGQRL

SEQ ID NO: 181455 - protein, 38 aa, Artificial Sequence
  Description of Artificial Sequence: Synthetic polypeptide
DEEEIRTTNPVATEQYGQCVCSMWGEHNQEGFGSENQG

SEQ ID NO: 181456 - protein, 32 aa, Artificial Sequence
  Description of Artificial Sequence: Synthetic polypeptide
DDSEVASTNPVSTEGYGNVAANTIQSRVGQRM

SEQ ID NO: 181457 - protein, 33 aa, Artificial Sequence
  Description of Artificial Sequence: Synthetic polypeptide
DESEIRACNPVATECWGSFGCINGPEAREGENG

SEQ ID NO: 181458 - protein, 32 aa, Artificial Sequence
  Description of Artificial Sequence: Synthetic polypeptide
DDSEVASTNPVSTEGYGNVAANTIQSRVGQRN

SEQ ID NO: 181459 - protein, 36 aa, Artificial Sequence
  Description of Artificial Sequence: Synthetic polypeptide
DEEEIRTTNPVATEQYGQCVCSMWEHQENFSSDTQS

SEQ ID NO: 181460 - protein, 32 aa, Artificial Sequence
  Description of Artificial Sequence: Synthetic polypeptide
DDSEVASTNPVSTEGYGNVAANTIQSRVGQRP

SEQ ID NO: 181461 - protein, 37 aa, Artificial Sequence
  Description of Artificial Sequence: Synthetic polypeptide
DEEEIRTTNPVATEQYGQCVCSMWGEHNQHFNSETQA

SEQ ID NO: 181462 - protein, 37 aa, Artificial Sequence
  Description of Artificial Sequence: Synthetic polypeptide
DEEEIRTTNPVATEQYGQCVCSMWGEHQENFGSDTQA

SEQ ID NO: 181463 - protein, 32 aa, Artificial Sequence
  Description of Artificial Sequence: Synthetic polypeptide
DDSEVASTNPVSTEGYGNVAANTIQSRVGQRS

SEQ ID NO: 181464 - protein, 37 aa, Artificial Sequence
  Description of Artificial Sequence: Synthetic polypeptide
DEEEIRTTNPVATEQYGQCVCSNAGEHQENFGSDTDM

SEQ ID NO: 181465 - protein, 38 aa, Artificial Sequence
  Description of Artificial Sequence: Synthetic polypeptide
DEEEIRTTNPVATEQYGQCVCSNSEEHNQEFFGSDNQD

SEQ ID NO: 181466 - protein, 37 aa, Artificial Sequence
  Description of Artificial Sequence: Synthetic polypeptide
DEEEIRTTNPVATEQYGQCVCSNSEEHNQEGFGSEQF

SEQ ID NO: 181467 - protein, 32 aa, Artificial Sequence
  Description of Artificial Sequence: Synthetic polypeptide
DDSEVASTNPVSTEGYGNVAANTIQSRVGQRT

SEQ ID NO: 181468 - protein, 32 aa, Artificial Sequence
  Description of Artificial Sequence: Synthetic polypeptide
DDSEVASTNPVSTEGYGNVAANTIQSRVGQRV

SEQ ID NO: 181469 - protein, 38 aa, Artificial Sequence
  Description of Artificial Sequence: Synthetic polypeptide
DEQEIRSTNPVATEFYGSVSNMNLVGDDQDQEDDDGNP

SEQ ID NO: 181470 - protein, 38 aa, Artificial Sequence
  Description of Artificial Sequence: Synthetic polypeptide
DEEEIRTTNPVATEQYGQCVCSNSGEDHNQNFGSENQD

SEQ ID NO: 181471 - protein, 37 aa, Artificial Sequence
  Description of Artificial Sequence: Synthetic polypeptide
DEEEIRTTNPVATEQYGQCVCSNSGEDQEYFNSDTQS

SEQ ID NO: 181472 - protein, 32 aa, Artificial Sequence
  Description of Artificial Sequence: Synthetic polypeptide
DDSEVASTNPVSTEGYGNVAANTIQSRVGQRQ

SEQ ID NO: 181473 - protein, 31 aa, Artificial Sequence
  Description of Artificial Sequence: Synthetic polypeptide
DSSEVASTNPVSTEGYGNVACCTIQSRVGQR

SEQ ID NO: 181474 - protein, 37 aa, Artificial Sequence
  Description of Artificial Sequence: Synthetic polypeptide
DEEEIRTTNPVATEQYGQCVCSMWEHNQENFNSQNQA

SEQ ID NO: 181475 - protein, 37 aa, Artificial Sequence
  Description of Artificial Sequence: Synthetic polypeptide
DEEEIRTTNPVATEQYGQCVCSMWEHNIENFGSETQS

SEQ ID NO: 181476 - protein, 34 aa, Artificial Sequence
  Description of Artificial Sequence: Synthetic polypeptide
DSSEIRTTNPVATEQYGKTVPTREDSQPTVSQAV

SEQ ID NO: 181477 - protein, 35 aa, Artificial Sequence
  Description of Artificial Sequence: Synthetic polypeptide
DSSEIRTTNPVATEQYGKTVPTRELSQEPTPMYEV

SEQ ID NO: 181478 - protein, 34 aa, Artificial Sequence
  Description of Artificial Sequence: Synthetic polypeptide
DSSEIRTTNPVATEQYGKTVPTRESSQPTVLLDV

SEQ ID NO: 181479 - protein, 34 aa, Artificial Sequence
  Description of Artificial Sequence: Synthetic polypeptide
DSSEIRTTNPVATEQYGVTVPTREDSQPTVMDAV

SEQ ID NO: 181480 - protein, 32 aa, Artificial Sequence
  Description of Artificial Sequence: Synthetic polypeptide
AEVEIATTNPVAYEQWGCLSCFEHDQRQDGES

SEQ ID NO: 181481 - protein, 35 aa, Artificial Sequence
  Description of Artificial Sequence: Synthetic polypeptide
DENEIRTTNPVATEQWGKVPSEGESMNAAEGDPAC

SEQ ID NO: 181482 - protein, 37 aa, Artificial Sequence
  Description of Artificial Sequence: Synthetic polypeptide
CEEEIATTNPVATEQWGSVSMSGDTPTNNDDLDGNQV

SEQ ID NO: 181483 - protein, 35 aa, Artificial Sequence
  Description of Artificial Sequence: Synthetic polypeptide
DEECIATTNPVAYEQWGTVCYNINDLHDQNGDNHS

SEQ ID NO: 181484 - protein, 37 aa, Artificial Sequence
  Description of Artificial Sequence: Synthetic polypeptide
DEEEIRTTNPVATEQYGCVCSMTEEHNQENFISETQS

SEQ ID NO: 181485 - protein, 36 aa, Artificial Sequence
  Description of Artificial Sequence: Synthetic polypeptide
DESEIRATNPVATEQYGSVGNNVDNPGQLGPGGQGD

SEQ ID NO: 181486 - protein, 37 aa, Artificial Sequence
  Description of Artificial Sequence: Synthetic polypeptide
DESEIRATNPVATEPYGSVCIWVQNDQRDQRTGGNHS

SEQ ID NO: 181487 - protein, 37 aa, Artificial Sequence
  Description of Artificial Sequence: Synthetic polypeptide
DESEIRATNPVATEPYGSVCIWVQNDQRDQRGGDNTS

SEQ ID NO: 181488 - protein, 32 aa, Artificial Sequence
  Description of Artificial Sequence: Synthetic polypeptide
DDSEVASTNPVSTEGYGNVAANTIQSRVGQRH

SEQ ID NO: 181489 - protein, 37 aa, Artificial Sequence
  Description of Artificial Sequence: Synthetic polypeptide
DESEIRATNPVATEPYGSVCIWVQNDQQDQERGGNTS

SEQ ID NO: 181490 - protein, 37 aa, Artificial Sequence
  Description of Artificial Sequence: Synthetic polypeptide
DESEIRATNPVATEPYGSVCIWVQNDQDDQRRGSNTI

SEQ ID NO: 181491 - protein, 38 aa, Artificial Sequence
  Description of Artificial Sequence: Synthetic polypeptide
DEEEIRTTNPVATEQYGQCVCSMTGEDHNQENFGSDQA

SEQ ID NO: 181492 - protein, 38 aa, Artificial Sequence
  Description of Artificial Sequence: Synthetic polypeptide
DEEEIRTTNPVATEQYGQCVCSMTGEHNQENFGSQTQP

SEQ ID NO: 181493 - protein, 38 aa, Artificial Sequence
  Description of Artificial Sequence: Synthetic polypeptide
DEEEIRTTNPVATEQYGQCVCSMTGEHNQEYFNSETQS

SEQ ID NO: 181494 - protein, 32 aa, Artificial Sequence
  Description of Artificial Sequence: Synthetic polypeptide
DSSEVASTNPVSTEEYGNVVAANTIQSRVGQR

SEQ ID NO: 181495 - protein, 31 aa, Artificial Sequence
  Description of Artificial Sequence: Synthetic polypeptide
DSSEVASTNPVSTEGYGNIAANTIQSRVGQR

SEQ ID NO: 181496 - protein, 38 aa, Artificial Sequence
  Description of Artificial Sequence: Synthetic polypeptide
DEEEIRTTNPVATEQYGQCVCSMWEDHNQENFGSDNQP

SEQ ID NO: 181497 - protein, 33 aa, Artificial Sequence
  Description of Artificial Sequence: Synthetic polypeptide
DSSEVASTNPVSTEGYGNTVACNTIQSRVGSNR

SEQ ID NO: 181498 - protein, 32 aa, Artificial Sequence
  Description of Artificial Sequence: Synthetic polypeptide
DDSEVASTNPVSTEGYGNVAANTIQSRVGQRI

SEQ ID NO: 181499 - protein, 31 aa, Artificial Sequence
  Description of Artificial Sequence: Synthetic polypeptide
DSSEVASTNPVSTEGYGNVAAATIQSRVGQR

SEQ ID NO: 181500 - protein, 31 aa, Artificial Sequence
  Description of Artificial Sequence: Synthetic polypeptide
DSSEVASTNPVSTEGYGNVAANTIQSQVGQR

SEQ ID NO: 181501 - protein, 32 aa, Artificial Sequence
  Description of Artificial Sequence: Synthetic polypeptide
DDSEVASTNPVSTEGYGNVAANTIQSRVGQRW

SEQ ID NO: 181502 - protein, 38 aa, Artificial Sequence
  Description of Artificial Sequence: Synthetic polypeptide
DEEEIRTTNPVATEQYGQCVCSNSGEHEQEGFNSDTQS

SEQ ID NO: 181503 - protein, 37 aa, Artificial Sequence
  Description of Artificial Sequence: Synthetic polypeptide
DEEEIRTTNPVATEQYGQCVCSNSGEHNAEFFNSDQD

SEQ ID NO: 181504 - protein, 37 aa, Artificial Sequence
  Description of Artificial Sequence: Synthetic polypeptide
DEEEIRTTNPVATEQYGQCVCSNSGEHNAEFFNSQQP

SEQ ID NO: 181505 - protein, 33 aa, Artificial Sequence
  Description of Artificial Sequence: Synthetic polypeptide
DTEEIRCTNPVAYEQWGCSYQMDNNHQQNDTSR

SEQ ID NO: 181506 - protein, 39 aa, Artificial Sequence
  Description of Artificial Sequence: Synthetic polypeptide
DEEEIRTTNPVATEQYGQCVCSNTGEDHNAEFFGSDNQS

SEQ ID NO: 181507 - protein, 39 aa, Artificial Sequence
  Description of Artificial Sequence: Synthetic polypeptide
DEEEIRTTNPVATEQYGQCVCSNTGEDHNAENFGSDNQS

SEQ ID NO: 181508 - protein, 36 aa, Artificial Sequence
  Description of Artificial Sequence: Synthetic polypeptide
DESEIKTTNPVATEQYGDVVDDNNEQITGGQNGGSI

SEQ ID NO: 181509 - protein, 34 aa, Artificial Sequence
  Description of Artificial Sequence: Synthetic polypeptide
DEQEIRTTNPIATEQYGATWSATEDWADHEGEDL

SEQ ID NO: 181510 - protein, 32 aa, Artificial Sequence
  Description of Artificial Sequence: Synthetic polypeptide
DDSEVATTNPVSTEPYGTISAMETIQSQNGNH

SEQ ID NO: 181511 - protein, 31 aa, Artificial Sequence
  Description of Artificial Sequence: Synthetic polypeptide
DDSEVASTNPVSTEGYGNVAANTIQSRVGQY

SEQ ID NO: 181512 - protein, 38 aa, Artificial Sequence
  Description of Artificial Sequence: Synthetic polypeptide
DEEEIRTTNPVATEQYGQCVCSNTGEDHNQENFGSDQS

SEQ ID NO: 181513 - protein, 38 aa, Artificial Sequence
  Description of Artificial Sequence: Synthetic polypeptide
DEEEIRTTNPVATEQYGQCVCSNTGEDNQENFNSNNQS

SEQ ID NO: 181514 - protein, 39 aa, Artificial Sequence
  Description of Artificial Sequence: Synthetic polypeptide
DEEEIRTTNPVATEQYGQCVCSNTGEGHNQEGFNSDTQA

SEQ ID NO: 181515 - protein, 37 aa, Artificial Sequence
  Description of Artificial Sequence: Synthetic polypeptide
DEEEIRTTNPVATEQYGQCVCSNTGEHDQGFISDTQA

SEQ ID NO: 181516 - protein, 32 aa, Artificial Sequence
  Description of Artificial Sequence: Synthetic polypeptide
DDSEVASTNPVSTEGYGNVAANTIQSRVGQYR

SEQ ID NO: 181517 - protein, 32 aa, Artificial Sequence
  Description of Artificial Sequence: Synthetic polypeptide
DDSEVASTNPVSTEGYGNVAANTIQSRVGSQR

SEQ ID NO: 181518 - protein, 35 aa, Artificial Sequence
  Description of Artificial Sequence: Synthetic polypeptide
DEEEIRTTNPVATEQWGCVAGEGEHNQNHPVDNVD

SEQ ID NO: 181519 - protein, 37 aa, Artificial Sequence
  Description of Artificial Sequence: Synthetic polypeptide
DEEEIRTTNPVATEQYGQCVCSNTGEHEAESFGSDQG

SEQ ID NO: 181520 - protein, 35 aa, Artificial Sequence
  Description of Artificial Sequence: Synthetic polypeptide
DDEEISTTNPVATEQYGCVCSWGPHNIENFNSEQS

SEQ ID NO: 181521 - protein, 38 aa, Artificial Sequence
  Description of Artificial Sequence: Synthetic polypeptide
DEEEIRTTNPVATEQYGQCVCSNTGEHNAENFNSDPQL

SEQ ID NO: 181522 - protein, 37 aa, Artificial Sequence
  Description of Artificial Sequence: Synthetic polypeptide
DEEEIRTTNPVATEQYGQCVCSNTGEHNAFFNSDTQP

SEQ ID NO: 181523 - protein, 36 aa, Artificial Sequence
  Description of Artificial Sequence: Synthetic polypeptide
DDEEISTTNPVATEQYGCVCSWGETNQEFFNSETQS

SEQ ID NO: 181524 - protein, 38 aa, Artificial Sequence
  Description of Artificial Sequence: Synthetic polypeptide
DEEEIRTTNPVATEQYGQCVCSNTGEHNQEFFNSQFQS

SEQ ID NO: 181525 - protein, 38 aa, Artificial Sequence
  Description of Artificial Sequence: Synthetic polypeptide
DEEEIRTTNPVATEQYGQCVCSNTGEHNQENFGSDTQS

SEQ ID NO: 181526 - protein, 35 aa, Artificial Sequence
  Description of Artificial Sequence: Synthetic polypeptide
DDEEISTTNPVATEQYGCVCSWGEHNQNFNSDTQG

SEQ ID NO: 181527 - protein, 38 aa, Artificial Sequence
  Description of Artificial Sequence: Synthetic polypeptide
DEEEIRTTNPVATEQYGQCVCSNTGEHNQENFGSETQS

SEQ ID NO: 181528 - protein, 37 aa, Artificial Sequence
  Description of Artificial Sequence: Synthetic polypeptide
DEEEIRTTNPVATEQYGQCVCSNTGEHNQENFISDQA

SEQ ID NO: 181529 - protein, 35 aa, Artificial Sequence
  Description of Artificial Sequence: Synthetic polypeptide
DDEEISTTNPVATEQYGCVCSWGEHNQNFGSDPQS

SEQ ID NO: 181530 - protein, 34 aa, Artificial Sequence
  Description of Artificial Sequence: Synthetic polypeptide
DEQEIRTTNPIATEQWGAVWANTEDLEEPKGEYI

SEQ ID NO: 181531 - protein, 34 aa, Artificial Sequence
  Description of Artificial Sequence: Synthetic polypeptide
DSSEIRTTNPVATEQYGKTVPTREDSQPTVQLEV

SEQ ID NO: 181532 - protein, 39 aa, Artificial Sequence
  Description of Artificial Sequence: Synthetic polypeptide
DEEEIRTTNPVATEQYGQCVCSNTGEAHNQENFGSDNQE

SEQ ID NO: 181533 - protein, 37 aa, Artificial Sequence
  Description of Artificial Sequence: Synthetic polypeptide
TSEEIRTTNPVATEQYGSVGILTVNSTEEHRLAGPVS

SEQ ID NO: 181534 - protein, 32 aa, Artificial Sequence
  Description of Artificial Sequence: Synthetic polypeptide
DDSEVASTNPVSTEGYGNVAANTIQSRVGQRY

SEQ ID NO: 181535 - protein, 37 aa, Artificial Sequence
  Description of Artificial Sequence: Synthetic polypeptide
CEEEIATTNPVATEQWGSVSMSGDTPTNNDDGMGNQM

SEQ ID NO: 181536 - protein, 37 aa, Artificial Sequence
  Description of Artificial Sequence: Synthetic polypeptide
DEEEIRTTNPVAYESYGSVPATTGAGPTTRNGGNPVE

SEQ ID NO: 181537 - protein, 36 aa, Artificial Sequence
  Description of Artificial Sequence: Synthetic polypeptide
DEQEIRTTNPAATEQYGSVVYDGFGQEGDQEEDNGP

SEQ ID NO: 181538 - protein, 36 aa, Artificial Sequence
  Description of Artificial Sequence: Synthetic polypeptide
CEEEIATTNPVATEQWGSVSGTGDPPPQANASNDSW

SEQ ID NO: 181539 - protein, 31 aa, Artificial Sequence
  Description of Artificial Sequence: Synthetic polypeptide
DDSEVASTNPVSTEGYGNVAANTIQSRVGQS

SEQ ID NO: 181540 - protein, 38 aa, Artificial Sequence
  Description of Artificial Sequence: Synthetic polypeptide
DEEEIRTTNPVATEQYGQCVCSNSGEHNQEGFGSDNQS

SEQ ID NO: 181541 - protein, 36 aa, Artificial Sequence
  Description of Artificial Sequence: Synthetic polypeptide
DEEEIRTTNPVAYESWGSVPATTPAGPTTRNGGNDV

SEQ ID NO: 181542 - protein, 38 aa, Artificial Sequence
  Description of Artificial Sequence: Synthetic polypeptide
DEEEIRTTNPVATEQYGQCVCSNSGEHNQEHFGSDNQA

SEQ ID NO: 181543 - protein, 37 aa, Artificial Sequence
  Description of Artificial Sequence: Synthetic polypeptide
DEEEIRTTNPVATEQYGQCVCSNSGEHNQENFGSEQS

SEQ ID NO: 181544 - protein, 32 aa, Artificial Sequence
  Description of Artificial Sequence: Synthetic polypeptide
DDSEVASTNPVSTEGYGNVAANTIQSRVGQSR

SEQ ID NO: 181545 - protein, 31 aa, Artificial Sequence
  Description of Artificial Sequence: Synthetic polypeptide
DDSEVASTNPVSTEGYGNVAANTIQSRVGQT

SEQ ID NO: 181546 - protein, 37 aa, Artificial Sequence
  Description of Artificial Sequence: Synthetic polypeptide
DEEEIRTTNPVATEQYGQCVCSNSGEHNQESFGSDQS

SEQ ID NO: 181547 - protein, 31 aa, Artificial Sequence
  Description of Artificial Sequence: Synthetic polypeptide
DDSEVASTNPVSTCGYGNVAANTIQSRTGQR

SEQ ID NO: 181548 - protein, 36 aa, Artificial Sequence
  Description of Artificial Sequence: Synthetic polypeptide
DESEIKTTNPVAYECWGSVVSCCGNEPQDREGENNG

SEQ ID NO: 181549 - protein, 32 aa, Artificial Sequence
  Description of Artificial Sequence: Synthetic polypeptide
DDSEVASTNPVSTEGYGNVAANTIQSRVGQTR

SEQ ID NO: 181550 - protein, 31 aa, Artificial Sequence
  Description of Artificial Sequence: Synthetic polypeptide
DDSEVASTNPVSTEGYGNVAANTIQSRVGQV

SEQ ID NO: 181551 - protein, 36 aa, Artificial Sequence
  Description of Artificial Sequence: Synthetic polypeptide
DESEIKTTNPVATEQYGTVVSATDGDDEEGEGNQQT

SEQ ID NO: 181552 - protein, 31 aa, Artificial Sequence
  Description of Artificial Sequence: Synthetic polypeptide
DDSEVATTNPVSTEPYGTISAMTIQSRNGQH

SEQ ID NO: 181553 - protein, 31 aa, Artificial Sequence
  Description of Artificial Sequence: Synthetic polypeptide
DDSEVATTNPVSTEPYGTISAMTIQSQNGQH

SEQ ID NO: 181554 - protein, 32 aa, Artificial Sequence
  Description of Artificial Sequence: Synthetic polypeptide
DDSEVASTNPVSTEGYGNVAANTIQSRVGQVR

SEQ ID NO: 181555 - protein, 39 aa, Artificial Sequence
  Description of Artificial Sequence: Synthetic polypeptide
DEEEIRTTNPVATEQYGQCVCSNTEEDHNEEHFGSDNQA

SEQ ID NO: 181556 - protein, 39 aa, Artificial Sequence
  Description of Artificial Sequence: Synthetic polypeptide
DEEEIRTTNPVATEQYGQCVCSNTEEDLEQENFGSETQN

SEQ ID NO: 181557 - protein, 38 aa, Artificial Sequence
  Description of Artificial Sequence: Synthetic polypeptide
DEEEIRTTNPVATEQYGQCVCSNTEEHNQENFQSDTQA

SEQ ID NO: 181558 - protein, 31 aa, Artificial Sequence
  Description of Artificial Sequence: Synthetic polypeptide
DDSEVASTNPVSTEGYGNVAANTIQSRVGQW

SEQ ID NO: 181559 - protein, 34 aa, Artificial Sequence
  Description of Artificial Sequence: Synthetic polypeptide
DEQEIRTTNPIATEQWGAVWANTEDLEEHKGEYI

SEQ ID NO: 181560 - protein, 35 aa, Artificial Sequence
  Description of Artificial Sequence: Synthetic polypeptide
DENEIRTTNPVATEQWGKVPSEQIAHSDNAAFGDA

SEQ ID NO: 181561 - protein, 35 aa, Artificial Sequence
  Description of Artificial Sequence: Synthetic polypeptide
DENEIRTTNPVATEQWGKVPSEQIAHSMNAAEGTV

SEQ ID NO: 181562 - protein, 32 aa, Artificial Sequence
  Description of Artificial Sequence: Synthetic polypeptide
DDSEVASTNPVSTEGYGNVAANTIQSRVGQRG

SEQ ID NO: 181563 - protein, 34 aa, Artificial Sequence
  Description of Artificial Sequence: Synthetic polypeptide
DEECIATTNPVAYEGWGSVATTNLGGNDTQGQDS

SEQ ID NO: 181564 - protein, 33 aa, Artificial Sequence
  Description of Artificial Sequence: Synthetic polypeptide
AETEIRTTNPVATEQYGETAWANEENWAEPGGI

SEQ ID NO: 181565 - protein, 36 aa, Artificial Sequence
  Description of Artificial Sequence: Synthetic polypeptide
DEEEIRTTNPVATEQYGQCPCNPSMMLGEQMQVQIV

SEQ ID NO: 181566 - protein, 36 aa, Artificial Sequence
  Description of Artificial Sequence: Synthetic polypeptide
DEQEIKTTNPVATEQYGVVVTTDGMNNQTGEDEGGE

SEQ ID NO: 181567 - protein, 37 aa, Artificial Sequence
  Description of Artificial Sequence: Synthetic polypeptide
DEEEIRTTNPVATEQYGQCQSMTVPHEQSTLAVEQSG

SEQ ID NO: 181568 - protein, 31 aa, Artificial Sequence
  Description of Artificial Sequence: Synthetic polypeptide
DDSEVASTNPVSTEGYGNVAANTIQSRVGQG

SEQ ID NO: 181569 - protein, 32 aa, Artificial Sequence
  Description of Artificial Sequence: Synthetic polypeptide
DDSEVASTNPVSTEGYGNVAANTIQSRVGQGR

SEQ ID NO: 181570 - protein, 35 aa, Artificial Sequence
  Description of Artificial Sequence: Synthetic polypeptide
DEEQIACTNPVATAQWGSVASGHTPLGAPGGNGYQ

SEQ ID NO: 181571 - protein, 35 aa, Artificial Sequence
  Description of Artificial Sequence: Synthetic polypeptide
DSGEIATTNPVATEQYGSSFSATDTLEPHEKEDTR

SEQ ID NO: 181572 - protein, 31 aa, Artificial Sequence
  Description of Artificial Sequence: Synthetic polypeptide
DDSEVASTNPVSTEGYGNVAANTIQSRVGQH

SEQ ID NO: 181573 - protein, 35 aa, Artificial Sequence
  Description of Artificial Sequence: Synthetic polypeptide
DSGEICTTNPVAYEQYGSVVCSTVMLSGNGGMTGS

SEQ ID NO: 181574 - protein, 31 aa, Artificial Sequence
  Description of Artificial Sequence: Synthetic polypeptide
DDSEVASTNPVSTEGYGNVAANTIQSRVGQI

SEQ ID NO: 181575 - protein, 32 aa, Artificial Sequence
  Description of Artificial Sequence: Synthetic polypeptide
DDSEVASTNPVSTEGYGNVAANTIQSRVGQIR

SEQ ID NO: 181576 - protein, 38 aa, Artificial Sequence
  Description of Artificial Sequence: Synthetic polypeptide
DEEEIRTTNPVATEQYGQCSCSTGEPHNAENFISDNQA

SEQ ID NO: 181577 - protein, 35 aa, Artificial Sequence
  Description of Artificial Sequence: Synthetic polypeptide
DSGEICTTNPVAYERYGSVVCSTVALSQNTGMDQK

SEQ ID NO: 181578 - protein, 35 aa, Artificial Sequence
  Description of Artificial Sequence: Synthetic polypeptide
DEEQIACTNPVATAQWGSVSTAHGPLANPGGNPHQ

SEQ ID NO: 181579 - protein, 34 aa, Artificial Sequence
  Description of Artificial Sequence: Synthetic polypeptide
DEEQIACTNPVATAQWGSVSTHGPLANPGGFDHQ

SEQ ID NO: 181580 - protein, 34 aa, Artificial Sequence
  Description of Artificial Sequence: Synthetic polypeptide
DEEQIACTNPVATAQWGSVSTHGPLGAPGGEMTN

SEQ ID NO: 181581 - protein, 31 aa, Artificial Sequence
  Description of Artificial Sequence: Synthetic polypeptide
DDSEVASTNPVSTEGYGNVAANTIQSRVGQK

SEQ ID NO: 181582 - protein, 34 aa, Artificial Sequence
  Description of Artificial Sequence: Synthetic polypeptide
DSGEIRTTNPVATEQWGKVSCYHEESMNAAEGDD

SEQ ID NO: 181583 - protein, 37 aa, Artificial Sequence
  Description of Artificial Sequence: Synthetic polypeptide
DEEEIRTTNPVATECYGSVYGQMMNFNGQEGDGGGEG

SEQ ID NO: 181584 - protein, 34 aa, Artificial Sequence
  Description of Artificial Sequence: Synthetic polypeptide
DEDEIRGTNPVATEGWGSISAINEGGDGEGENGE

SEQ ID NO: 181585 - protein, 35 aa, Artificial Sequence
  Description of Artificial Sequence: Synthetic polypeptide
CEECIACTNPVATEQYGTVSWNEGEQERQRHNGED

SEQ ID NO: 181586 - protein, 38 aa, Artificial Sequence
  Description of Artificial Sequence: Synthetic polypeptide
DECEICTTNPVATEQYGTVSTVTNGTNLEAGTTDNEDQ

SEQ ID NO: 181587 - protein, 31 aa, Artificial Sequence
  Description of Artificial Sequence: Synthetic polypeptide
CEECIATTNPVAYEQWGCVYQVDWQDHGIEA

SEQ ID NO: 181588 - protein, 34 aa, Artificial Sequence
  Description of Artificial Sequence: Synthetic polypeptide
DEEQIACTNPVATAQWGSVANSGHGPLGAPGGNT

SEQ ID NO: 181589 - protein, 36 aa, Artificial Sequence
  Description of Artificial Sequence: Synthetic polypeptide
DEEEIRTTNPVCTEGYGCVCSWPEHNQENFGSNTQA

SEQ ID NO: 181590 - protein, 34 aa, Artificial Sequence
  Description of Artificial Sequence: Synthetic polypeptide
DEECIATTNPVAYEGWGSVATTNLGGNDTGGDMS

SEQ ID NO: 181591 - protein, 35 aa, Artificial Sequence
  Description of Artificial Sequence: Synthetic polypeptide
DEAEIRTTNPVATEQYGCVCSWEEDDNANFNSDQA

SEQ ID NO: 181592 - protein, 33 aa, Artificial Sequence
  Description of Artificial Sequence: Synthetic polypeptide
DEECIATTNPVAYEGWGSVACVENGGDTQGNAD

SEQ ID NO: 181593 - protein, 37 aa, Artificial Sequence
  Description of Artificial Sequence: Synthetic polypeptide
DEEEIRSTNPVATEGYGSVNQDNVNENTDQDEGENIG

SEQ ID NO: 181594 - protein, 36 aa, Artificial Sequence
  Description of Artificial Sequence: Synthetic polypeptide
DEEEIRSTNPVATEGYGMVNDNDDDQEGGQDEERGD

SEQ ID NO: 181595 - protein, 33 aa, Artificial Sequence
  Description of Artificial Sequence: Synthetic polypeptide
DEECIATTNPVAYEGWGSVATDNNGGDTQGDEQ

SEQ ID NO: 181596 - protein, 34 aa, Artificial Sequence
  Description of Artificial Sequence: Synthetic polypeptide
DEDEIRGTNPVATEGWGSVSAGMEGGQDGEGEQG

SEQ ID NO: 181597 - protein, 34 aa, Artificial Sequence
  Description of Artificial Sequence: Synthetic polypeptide
DEECIATTNPVAYEGWGSVATENLGGNDTQGDGE

SEQ ID NO: 181598 - protein, 36 aa, Artificial Sequence
  Description of Artificial Sequence: Synthetic polypeptide
DEEEIRTTNPVCTEHYGCVCSNWPEHNQNFGSNTQA

SEQ ID NO: 181599 - protein, 33 aa, Artificial Sequence
  Description of Artificial Sequence: Synthetic polypeptide
DEECIATTNPVAYEGWGSVATGPNGGDTQGDGQ

SEQ ID NO: 181600 - protein, 33 aa, Artificial Sequence
  Description of Artificial Sequence: Synthetic polypeptide
DEECIATTNPVAYEGWGSVATNNNGGDTQGDLD

SEQ ID NO: 181601 - protein, 31 aa, Artificial Sequence
  Description of Artificial Sequence: Synthetic polypeptide
DDSEVASTNPVSTCGYGNVAANTIQSRVGQR

SEQ ID NO: 181602 - protein, 34 aa, Artificial Sequence
  Description of Artificial Sequence: Synthetic polypeptide
DEECIATTNPVAYEGWGSVATTGLGGNDQQGDHM

SEQ ID NO: 181603 - protein, 36 aa, Artificial Sequence
  Description of Artificial Sequence: Synthetic polypeptide
DEEEIRTTNPVCTEHYGCVCSNWGELNQNFGSDTQA

SEQ ID NO: 181604 - protein, 33 aa, Artificial Sequence
  Description of Artificial Sequence: Synthetic polypeptide
DEECIATTNPVAYEGWGSVATTLNGGDKQGDSD

SEQ ID NO: 181605 - protein, 34 aa, Artificial Sequence
  Description of Artificial Sequence: Synthetic polypeptide
DEEQEIATTNPVAYEAWGVCATNDLNGDAGNGSD

SEQ ID NO: 181606 - protein, 34 aa, Artificial Sequence
  Description of Artificial Sequence: Synthetic polypeptide
DSEEISTTNPVAYERWGSTVLSTPELSQTEDQED

SEQ ID NO: 181607 - protein, 34 aa, Artificial Sequence
  Description of Artificial Sequence: Synthetic polypeptide
DSEEISTTNPVAYNQWGSTVPSQPPSTRGGNMGT

SEQ ID NO: 181608 - protein, 34 aa, Artificial Sequence
  Description of Artificial Sequence: Synthetic polypeptide
DSEEISTTNPVAYTAFGSTVVSTNPSMAGGNNGT

SEQ ID NO: 181609 - protein, 34 aa, Artificial Sequence
  Description of Artificial Sequence: Synthetic polypeptide
DEECIATTNPVAYEGWGSVATTNLGGEDTQGQSD

SEQ ID NO: 181610 - protein, 38 aa, Artificial Sequence
  Description of Artificial Sequence: Synthetic polypeptide
DEEEIRTTNPVATEQYGQCAVCSWGEHNTENFNSENQF

SEQ ID NO: 181611 - protein, 34 aa, Artificial Sequence
  Description of Artificial Sequence: Synthetic polypeptide
DSEEISTTNPVAYTQWGSTVPSQAQSMRGGNMDV

SEQ ID NO: 181612 - protein, 38 aa, Artificial Sequence
  Description of Artificial Sequence: Synthetic polypeptide
DEEEIRTTNPVATEQYGQCICSNTGEHNQENFGSDNQS

SEQ ID NO: 181613 - protein, 36 aa, Artificial Sequence
  Description of Artificial Sequence: Synthetic polypeptide
DEAEIRTTNPVATEQYGCVCSWEEHNQENFNSDTQS

SEQ ID NO: 181614 - protein, 36 aa, Artificial Sequence
  Description of Artificial Sequence: Synthetic polypeptide
DEAEIRTTNPVATEQYGCVCSWEEDHNQENFNSDQS

SEQ ID NO: 181615 - protein, 36 aa, Artificial Sequence
  Description of Artificial Sequence: Synthetic polypeptide
DEAEIRTTNPVATEQYGCVCSWEEDHNQENFGSEQS

SEQ ID NO: 181616 - protein, 35 aa, Artificial Sequence
  Description of Artificial Sequence: Synthetic polypeptide
DEECIATTNPVAYEGWGSVATTNLGGNDRNQGDGS

SEQ ID NO: 181617 - protein, 35 aa, Artificial Sequence
  Description of Artificial Sequence: Synthetic polypeptide
DEECIATTNPVAYEGWGSVATTNLGGNDRTQGDVQ

SEQ ID NO: 181618 - protein, 36 aa, Artificial Sequence
  Description of Artificial Sequence: Synthetic polypeptide
DESEIITTNPVAYEQYGASVMETIPDELDWRGIEQD

SEQ ID NO: 181619 - protein, 37 aa, Artificial Sequence
  Description of Artificial Sequence: Synthetic polypeptide
DEEEIRTTNPVATEQYGQCTCSMTEEDNQENIGSDQG

SEQ ID NO: 181620 - protein, 36 aa, Artificial Sequence
  Description of Artificial Sequence: Synthetic polypeptide
DSGEIRTTNPVAYEQYGSTVCSTVMVSGATGGGTRL

SEQ ID NO: 181621 - protein, 36 aa, Artificial Sequence
  Description of Artificial Sequence: Synthetic polypeptide
DSNEIRTTNPVATEQYGSVCSVTWPIYEDMFVQEGQ

SEQ ID NO: 181622 - protein, 33 aa, Artificial Sequence
  Description of Artificial Sequence: Synthetic polypeptide
AEVEIATTNPVATTQWGCVRTWDQHQQRQNDVL

SEQ ID NO: 181623 - protein, 35 aa, Artificial Sequence
  Description of Artificial Sequence: Synthetic polypeptide
DSNEIRTTNPVATEQYGSVSVWPTIETGEIWDDKV

SEQ ID NO: 181624 - protein, 33 aa, Artificial Sequence
  Description of Artificial Sequence: Synthetic polypeptide
DSNEIRTTNPVSTEPYGTIISMEDIQQQQNGNH

SEQ ID NO: 181625 - protein, 32 aa, Artificial Sequence
  Description of Artificial Sequence: Synthetic polypeptide
DSNEIRTTNPVSTLPYGTISMEDIQQQQNGNH

SEQ ID NO: 181626 - protein, 37 aa, Artificial Sequence
  Description of Artificial Sequence: Synthetic polypeptide
DEEEIRTTNPVATEQYGQCVCSDWGEHNTENFNSNQP

SEQ ID NO: 181627 - protein, 32 aa, Artificial Sequence
  Description of Artificial Sequence: Synthetic polypeptide
DDSEVASTNPVSTEGYGNVAANTIQSRVGQQR

SEQ ID NO: 181628 - protein, 32 aa, Artificial Sequence
  Description of Artificial Sequence: Synthetic polypeptide
AEVEIATTNPVATTQWGMVRTWDQHQQDQGDH

SEQ ID NO: 181629 - protein, 37 aa, Artificial Sequence
  Description of Artificial Sequence: Synthetic polypeptide
DEEEIRTTNPVATEQYGQCVCSMSEEHNQNFISDNQV

SEQ ID NO: 181630 - protein, 34 aa, Artificial Sequence
  Description of Artificial Sequence: Synthetic polypeptide
TSEEIRTTNPTATEHYGVVCCENRMLSDGEGNPE

SEQ ID NO: 181631 - protein, 37 aa, Artificial Sequence
  Description of Artificial Sequence: Synthetic polypeptide
DEEEIRTTNPVATEQYGQCVCSMSGAHNQENFNSDQS

SEQ ID NO: 181632 - protein, 32 aa, Artificial Sequence
  Description of Artificial Sequence: Synthetic polypeptide
DDSEVASTNPVSTEGYGNVAANTIQSRVGQRA

SEQ ID NO: 181633 - protein, 37 aa, Artificial Sequence
  Description of Artificial Sequence: Synthetic polypeptide
CEEEIATTNPVATEQWGSVSMSGDTPTNNDDLMGNSH

SEQ ID NO: 181634 - protein, 32 aa, Artificial Sequence
  Description of Artificial Sequence: Synthetic polypeptide
DDSEVASTNPVSTEGYGNVAANTIQSRVGQRD

SEQ ID NO: 181635 - protein, 35 aa, Artificial Sequence
  Description of Artificial Sequence: Synthetic polypeptide
DENEIRTTNPVATEQWGKVVSEHENSMNAAEGDPA

SEQ ID NO: 181636 - protein, 35 aa, Artificial Sequence
  Description of Artificial Sequence: Synthetic polypeptide
DENEIRTTNPVATEQWGKVVPSEGESMNAAEGDAI

SEQ ID NO: 181637 - protein, 36 aa, Artificial Sequence
  Description of Artificial Sequence: Synthetic polypeptide
DSQEIRTTNPVATEQYGSVCSVTWPINEDMFVEEWQ

SEQ ID NO: 181638 - protein, 37 aa, Artificial Sequence
  Description of Artificial Sequence: Synthetic polypeptide
DEEEIRTTNPVATEQYGQCVCSMSGEHQEYFGSDTQT

SEQ ID NO: 181639 - protein, 38 aa, Artificial Sequence
  Description of Artificial Sequence: Synthetic polypeptide
DEEEIRTTNPVATEQYGQCVCSMTEDHNQENFISDNQA

SEQ ID NO: 181640 - protein, 32 aa, Artificial Sequence
  Description of Artificial Sequence: Synthetic polypeptide
DDSEVASTNPVSTEGYGNVAANTIQSRVGQRE

SEQ ID NO: 181641 - protein, 33 aa, Artificial Sequence
  Description of Artificial Sequence: Synthetic polypeptide
DDEEISTTNPVAYCQYGCVCSTGEPAHFGSDQS

SEQ ID NO: 181642 - protein, 35 aa, Artificial Sequence
  Description of Artificial Sequence: Synthetic polypeptide
DDEEISTTNPVATEQYGQCVCSWGEHNQNFNSDQS

SEQ ID NO: 181643 - protein, 32 aa, Artificial Sequence
  Description of Artificial Sequence: Synthetic polypeptide
DDSEVASTNPVSTEGYGNVAANTIQSRVGQRF

SEQ ID NO: 181644 - protein, 36 aa, Artificial Sequence
  Description of Artificial Sequence: Synthetic polypeptide
DENEIRTTNPVATEQWGKVPSEQIAHSMNHAEGDAR

SEQ ID NO: 181645 - protein, 35 aa, Artificial Sequence
  Description of Artificial Sequence: Synthetic polypeptide
DENEIRTTNPVATEQWGKVPSEQIAHSMNFAEGDY

SEQ ID NO: 181646 - protein, 31 aa, Artificial Sequence
  Description of Artificial Sequence: Synthetic polypeptide
DDSEVASTNPVSTEGYGNVAANTIQSRVGQQ

SEQ ID NO: 181647 - protein, 34 aa, Artificial Sequence
  Description of Artificial Sequence: Synthetic polypeptide
TSEEIRTTNPTATEHYGSVACINNMFSQGEGKPE

SEQ ID NO: 181648 - protein, 36 aa, Artificial Sequence
  Description of Artificial Sequence: Synthetic polypeptide
DSNEIRTTNPVATEQYGSVCSVTWPIYEDMFQEEDQ

SEQ ID NO: 181649 - protein, 38 aa, Artificial Sequence
  Description of Artificial Sequence: Synthetic polypeptide
DEEEIRTTNPVATEQYGQCVCSDTEEHNQENFNSDTQS

SEQ ID NO: 181650 - protein, 35 aa, Artificial Sequence
  Description of Artificial Sequence: Synthetic polypeptide
DEEEIRTTNPVCTEGYGCVCSNWPEHNQNFGSDLS

SEQ ID NO: 181651 - protein, 31 aa, Artificial Sequence
  Description of Artificial Sequence: Synthetic polypeptide
DDSEVASTNPVSTEGYGNVAANTIQSRVGQL

SEQ ID NO: 181652 - protein, 34 aa, Artificial Sequence
  Description of Artificial Sequence: Synthetic polypeptide
DENEIRTTNPVATEQWGNCVSEAVIEMNIFEDEA

SEQ ID NO: 181653 - protein, 37 aa, Artificial Sequence
  Description of Artificial Sequence: Synthetic polypeptide
DEEEIRTTNPVATEQYGQCVCCNTGEHNIENFGSDQA

SEQ ID NO: 181654 - protein, 37 aa, Artificial Sequence
  Description of Artificial Sequence: Synthetic polypeptide
DEEEIRTTNPVATEQYGQCVCETGEHNQENFNSETQP

SEQ ID NO: 181655 - protein, 32 aa, Artificial Sequence
  Description of Artificial Sequence: Synthetic polypeptide
DDSEVASTNPVSTEGYGNVAANTIQSRVGQLR

SEQ ID NO: 181656 - protein, 37 aa, Artificial Sequence
  Description of Artificial Sequence: Synthetic polypeptide
DECEICTTNPVATEQYGTVSTVTNGNNVEEGEGNNDT

SEQ ID NO: 181657 - protein, 37 aa, Artificial Sequence
  Description of Artificial Sequence: Synthetic polypeptide
DEEEIRTTNPVATEQYGQCVCGNSGEDAENFGSDNQS

SEQ ID NO: 181658 - protein, 38 aa, Artificial Sequence
  Description of Artificial Sequence: Synthetic polypeptide
DEEEIRTTNPVATEQYGQCVCGNSGEHNIENFGSDNQA

SEQ ID NO: 181659 - protein, 37 aa, Artificial Sequence
  Description of Artificial Sequence: Synthetic polypeptide
DEEEIRTTNPVATEQYGQCVCGNTGAHNIENFGSDQS

SEQ ID NO: 181660 - protein, 31 aa, Artificial Sequence
  Description of Artificial Sequence: Synthetic polypeptide
DDSEVASTNPVSTEGYGNVAANTIQSRVGQM

SEQ ID NO: 181661 - protein, 34 aa, Artificial Sequence
  Description of Artificial Sequence: Synthetic polypeptide
DENEIRTTNPVATEQWGNCRVSEVEMNIAEDEAD

SEQ ID NO: 181662 - protein, 32 aa, Artificial Sequence
  Description of Artificial Sequence: Synthetic polypeptide
DDSEVASTNPVSTEGYGNVAANTIQSRVGQMR

SEQ ID NO: 181663 - protein, 34 aa, Artificial Sequence
  Description of Artificial Sequence: Synthetic polypeptide
DSNEIRTTNPVATEQYGCYSIWGNEMQEVQDDDL

SEQ ID NO: 181664 - protein, 37 aa, Artificial Sequence
  Description of Artificial Sequence: Synthetic polypeptide
DEEEIRTTNPVATEQYGQCVCGNWGEHNQENFNSDQD

SEQ ID NO: 181665 - protein, 31 aa, Artificial Sequence
  Description of Artificial Sequence: Synthetic polypeptide
DDSEVASTNPVSTEGYGNVAANTIQSRVGQN

SEQ ID NO: 181666 - protein, 36 aa, Artificial Sequence
  Description of Artificial Sequence: Synthetic polypeptide
CEECIRTTNPCATECYGVVCYKTNDETQMQGGGDNR

SEQ ID NO: 181667 - protein, 31 aa, Artificial Sequence
  Description of Artificial Sequence: Synthetic polypeptide
DDSEVASTNPVSTEGYGNVAANTIQSRVGQP

SEQ ID NO: 181668 - protein, 35 aa, Artificial Sequence
  Description of Artificial Sequence: Synthetic polypeptide
DSNEIRTTNPVATEQYGSLSSVNVENNMDDNSIQY

SEQ ID NO: 181669 - protein, 37 aa, Artificial Sequence
  Description of Artificial Sequence: Synthetic polypeptide
DEEEIRTTNPVATEQYGQCVCQNTMEHNIENFGSDQS

SEQ ID NO: 181670 - protein, 37 aa, Artificial Sequence
  Description of Artificial Sequence: Synthetic polypeptide
DEEEIRTTNPVATEQYGQCVCQNWGEHNQENFNSDQS

SEQ ID NO: 181671 - protein, 37 aa, Artificial Sequence
  Description of Artificial Sequence: Synthetic polypeptide
DSNEIRTTNPVATEQYGSVCSVTWPINEDMSFVEEGN

SEQ ID NO: 181672 - protein, 36 aa, Artificial Sequence
  Description of Artificial Sequence: Synthetic polypeptide
DSNEIRTTNPVATEQYGSVCSVTWPINEDNFVEEGQ

SEQ ID NO: 181673 - protein, 32 aa, Artificial Sequence
  Description of Artificial Sequence: Synthetic polypeptide
DDSEVASTNPVSTEGYGNVAANTIQSRVGQPR

SEQ ID NO: 181674 - protein, 37 aa, Artificial Sequence
  Description of Artificial Sequence: Synthetic polypeptide
DEEEIRTTNPVATEQYGQCVCSDSEHNQENSNSETQS

SEQ ID NO: 181675 - protein, 36 aa, Artificial Sequence
  Description of Artificial Sequence: Synthetic polypeptide
DSNEIRTTNPVATEQYGSVCSVTWPIYEDMFNEQAT

SEQ ID NO: 181676 - protein, 38 aa, Artificial Sequence
  Description of Artificial Sequence: Synthetic polypeptide
DECEICTTNPVATEQYGTVATVTNLQRATNEEGATTTQ

SEQ ID NO: 181677 - protein, 38 aa, Artificial Sequence
  Description of Artificial Sequence: Synthetic polypeptide
DEEEIRTTNPVATEQYGQCVCSNTGEDDQENFGSETQP

SEQ ID NO: 181678 - protein, 35 aa, Artificial Sequence
  Description of Artificial Sequence: Synthetic polypeptide
DEQEIRTTNPVATECYGSTTWANAEDLAEHKGPDI

SEQ ID NO: 181679 - protein, 31 aa, Artificial Sequence
  Description of Artificial Sequence: Synthetic polypeptide
DDSEVASTNPVSTEGYGNVAANTIQSRVPQR

SEQ ID NO: 181680 - protein, 38 aa, Artificial Sequence
  Description of Artificial Sequence: Synthetic polypeptide
DEEEIRTTNPVATEQYGQCVCSNWEEHNAEGFGSENQG

SEQ ID NO: 181681 - protein, 35 aa, Artificial Sequence
  Description of Artificial Sequence: Synthetic polypeptide
DEECIRCTNPVATEQYGQCVCSWEEDNQYFGSDQS

SEQ ID NO: 181682 - protein, 37 aa, Artificial Sequence
  Description of Artificial Sequence: Synthetic polypeptide
DEEEIRTTNPVATEQYGQCVCSNWEHNAENFGSETQS

SEQ ID NO: 181683 - protein, 37 aa, Artificial Sequence
  Description of Artificial Sequence: Synthetic polypeptide
DEEEIRTTNPVATEQYGCVCSMSGEDHQEYFGSDTQS

SEQ ID NO: 181684 - protein, 31 aa, Artificial Sequence
  Description of Artificial Sequence: Synthetic polypeptide
DDSEVASTNPVSTEGYGNVAANTIQSRVQQR

SEQ ID NO: 181685 - protein, 37 aa, Artificial Sequence
  Description of Artificial Sequence: Synthetic polypeptide
DEEEIRTTNPVATEQYGQCVCSNWEEHNAENFGSDQA

SEQ ID NO: 181686 - protein, 38 aa, Artificial Sequence
  Description of Artificial Sequence: Synthetic polypeptide
DEEEIRTTNPVATEQYGQCVCSNWEETNQENFGSETQA

SEQ ID NO: 181687 - protein, 32 aa, Artificial Sequence
  Description of Artificial Sequence: Synthetic polypeptide
DDSEVASTNPVSTEGYGNVAANTIQSRVSNQR

SEQ ID NO: 181688 - protein, 32 aa, Artificial Sequence
  Description of Artificial Sequence: Synthetic polypeptide
DDSEVASTNPVSTEGYGNVAANTIQSRVNNQR

SEQ ID NO: 181689 - protein, 34 aa, Artificial Sequence
  Description of Artificial Sequence: Synthetic polypeptide
SEEEIRCTNPIATEQYGCVCSWGNDAENFGSDQA

SEQ ID NO: 181690 - protein, 31 aa, Artificial Sequence
  Description of Artificial Sequence: Synthetic polypeptide
DDSEVASTNPVSTEGYGNVAANTIQSRVSQR

SEQ ID NO: 181691 - protein, 33 aa, Artificial Sequence
  Description of Artificial Sequence: Synthetic polypeptide
DENEIRTTNPVATEQWGDVVDQIEQMDIAEMDA

SEQ ID NO: 181692 - protein, 35 aa, Artificial Sequence
  Description of Artificial Sequence: Synthetic polypeptide
DEECIRCTNPVATEQYGCVCSWMEHNQESFGSDQS

SEQ ID NO: 181693 - protein, 33 aa, Artificial Sequence
  Description of Artificial Sequence: Synthetic polypeptide
SEEEIRCTNPIATEQYGCVCSWGELANFISDQS

SEQ ID NO: 181694 - protein, 38 aa, Artificial Sequence
  Description of Artificial Sequence: Synthetic polypeptide
DEEEIRTTNPVATEQYGQCVCSNWEELNQENFNSDTQL

SEQ ID NO: 181695 - protein, 34 aa, Artificial Sequence
  Description of Artificial Sequence: Synthetic polypeptide
DENEIRTTNPVATEQWGDVVDNEEGEEMNAGEDG

SEQ ID NO: 181696 - protein, 31 aa, Artificial Sequence
  Description of Artificial Sequence: Synthetic polypeptide
DDSEVASTNPVSTEGYGNVAANTIQSRVTQR

SEQ ID NO: 181697 - protein, 31 aa, Artificial Sequence
  Description of Artificial Sequence: Synthetic polypeptide
DDSEVASTNPVSTEGYGNVAANTIQSSDGQR

SEQ ID NO: 181698 - protein, 34 aa, Artificial Sequence
  Description of Artificial Sequence: Synthetic polypeptide
DDSEVATTNPVSTEGYGNVSATNTINSRVGMQPR

SEQ ID NO: 181699 - protein, 34 aa, Artificial Sequence
  Description of Artificial Sequence: Synthetic polypeptide
CEEEIACTNPVATAQWGSVSLAGNGDEAGNNMNN

SEQ ID NO: 181700 - protein, 37 aa, Artificial Sequence
  Description of Artificial Sequence: Synthetic polypeptide
DEEEIRTTNPVATEQYGCVCSMSMEHNQENFNSDTQS

SEQ ID NO: 181701 - protein, 37 aa, Artificial Sequence
  Description of Artificial Sequence: Synthetic polypeptide
DEEEIRTTNPVATEQYGQCVCSNWEHNAENFNSDNQP

SEQ ID NO: 181702 - protein, 33 aa, Artificial Sequence
  Description of Artificial Sequence: Synthetic polypeptide
SEEEIRCTNPIATEQYGCVCSWGPDANFGSDQS

SEQ ID NO: 181703 - protein, 32 aa, Artificial Sequence
  Description of Artificial Sequence: Synthetic polypeptide
DEECIATTNPVAYERWGQCTTGGDHDRGSNQE

SEQ ID NO: 181704 - protein, 38 aa, Artificial Sequence
  Description of Artificial Sequence: Synthetic polypeptide
DTEEIRATNPVATEQYGVVSTVVNNQQQQLQQGTTDDN

SEQ ID NO: 181705 - protein, 35 aa, Artificial Sequence
  Description of Artificial Sequence: Synthetic polypeptide
DEESEIATTNPVAYEQWGSVSGGNGNESGPGDGTS

SEQ ID NO: 181706 - protein, 32 aa, Artificial Sequence
  Description of Artificial Sequence: Synthetic polypeptide
AENEIACTNPIATEQWGAAWANEEDLQPKGPR

SEQ ID NO: 181707 - protein, 38 aa, Artificial Sequence
  Description of Artificial Sequence: Synthetic polypeptide
DTEEIRATNPVATEQYGVVSTVVANQQQQLQQGTTDTT

SEQ ID NO: 181708 - protein, 35 aa, Artificial Sequence
  Description of Artificial Sequence: Synthetic polypeptide
AEDEIATTNPVAYEQWGSVCSTEPDQRNDTQNGDA

SEQ ID NO: 181709 - protein, 36 aa, Artificial Sequence
  Description of Artificial Sequence: Synthetic polypeptide
DEEEIRTTNPVATEEYGQCVCSTEEHTEFFGSDTQL

SEQ ID NO: 181710 - protein, 37 aa, Artificial Sequence
  Description of Artificial Sequence: Synthetic polypeptide
DTEEIRATNPVATEQYGVVSTVTNNQQQANNNNQQND

SEQ ID NO: 181711 - protein, 36 aa, Artificial Sequence
  Description of Artificial Sequence: Synthetic polypeptide
DEAEIRTTNPVATEQYGCVCSMWGEHNQEFFNSDQS

SEQ ID NO: 181712 - protein, 39 aa, Artificial Sequence
  Description of Artificial Sequence: Synthetic polypeptide
DTEEIRATNPVATEQYGSVVVTVTNNNLQQGNNGTTNDT

SEQ ID NO: 181713 - protein, 35 aa, Artificial Sequence
  Description of Artificial Sequence: Synthetic polypeptide
DEDEIRGTNPVATEFWGWVSAANGEGQRGQGEGGE

SEQ ID NO: 181714 - protein, 32 aa, Artificial Sequence
  Description of Artificial Sequence: Synthetic polypeptide
DDSEVASTNPVSTEGYGNVAANTIQSRVGYQR

SEQ ID NO: 181715 - protein, 36 aa, Artificial Sequence
  Description of Artificial Sequence: Synthetic polypeptide
DEAEIRTTNPVATEQYGCVCSMWGEHNQENFNSEQE

SEQ ID NO: 181716 - protein, 34 aa, Artificial Sequence
  Description of Artificial Sequence: Synthetic polypeptide
DENEIRTTNPVATEQWGDVYSEIEMNAAMADCAG

SEQ ID NO: 181717 - protein, 36 aa, Artificial Sequence
  Description of Artificial Sequence: Synthetic polypeptide
DEAEIRTTNPVATEQYGCVCSMWGEHNQNFNSDFQS

SEQ ID NO: 181718 - protein, 37 aa, Artificial Sequence
  Description of Artificial Sequence: Synthetic polypeptide
DEEEIRTTNPVATEQYGQCVCSNWEEDNQNFNSDNQL

SEQ ID NO: 181719 - protein, 34 aa, Artificial Sequence
  Description of Artificial Sequence: Synthetic polypeptide
DENEIRTTNPVATEQWGDVSNEAIEMNAAEDDDA

SEQ ID NO: 181720 - protein, 36 aa, Artificial Sequence
  Description of Artificial Sequence: Synthetic polypeptide
DEECIATVNPVATEAYGSVTSCDNEPSEETGGNNDR

SEQ ID NO: 181721 - protein, 36 aa, Artificial Sequence
  Description of Artificial Sequence: Synthetic polypeptide
DEECIATVNPVATECYGSVVCIDINQDGERQGHNTR

SEQ ID NO: 181722 - protein, 35 aa, Artificial Sequence
  Description of Artificial Sequence: Synthetic polypeptide
DEQEIRTTNPVATECWGSYFGPSINEPEARETENG

SEQ ID NO: 181723 - protein, 37 aa, Artificial Sequence
  Description of Artificial Sequence: Synthetic polypeptide
DEEEIRTTNPVATEQYGQCVCSNWEHNAENFNSDNQS

SEQ ID NO: 181724 - protein, 35 aa, Artificial Sequence
  Description of Artificial Sequence: Synthetic polypeptide
DEECIRCTNPVATEQYGCVCSWGEDNQNFNSNNQS

SEQ ID NO: 181725 - protein, 35 aa, Artificial Sequence
  Description of Artificial Sequence: Synthetic polypeptide
AEDEIATTNPVAYEQYGTVATEPGGQQNGHQRGEA

SEQ ID NO: 181726 - protein, 31 aa, Artificial Sequence
  Description of Artificial Sequence: Synthetic polypeptide
DDSEVASTNPVSTEGYGNVAANTIQSSVGQR

SEQ ID NO: 181727 - protein, 35 aa, Artificial Sequence
  Description of Artificial Sequence: Synthetic polypeptide
DEECIRCTNPVATEQYGCVCSWEEDNQNFNSDNLS

SEQ ID NO: 181728 - protein, 33 aa, Artificial Sequence
  Description of Artificial Sequence: Synthetic polypeptide
SEEEIRCTNPIATEQYGCVCSNWEHAYFGSDQA

SEQ ID NO: 181729 - protein, 35 aa, Artificial Sequence
  Description of Artificial Sequence: Synthetic polypeptide
SEEEIRCTNPIATEQYGCVCSNWGEHNAHFGSNQS

SEQ ID NO: 181730 - protein, 36 aa, Artificial Sequence
  Description of Artificial Sequence: Synthetic polypeptide
DEAEIRTTNPVATEQYGCVCSSGEDHNQENFNSDQG

SEQ ID NO: 181731 - protein, 34 aa, Artificial Sequence
  Description of Artificial Sequence: Synthetic polypeptide
SEEEIRCTNPIATEQYGCVCSTWGEHANFGSDQS

SEQ ID NO: 181732 - protein, 35 aa, Artificial Sequence
  Description of Artificial Sequence: Synthetic polypeptide
DEQEIATTNPAVATVQYHGSVSATDLDEDHEDEDL

SEQ ID NO: 181733 - protein, 35 aa, Artificial Sequence
  Description of Artificial Sequence: Synthetic polypeptide
SEEEIRCTNPIATEQYGCVCSTWEHNAENFGSDQS

SEQ ID NO: 181734 - protein, 33 aa, Artificial Sequence
  Description of Artificial Sequence: Synthetic polypeptide
DEESIACTNPVATASWGCVAGTGELPQDSGNMV

SEQ ID NO: 181735 - protein, 37 aa, Artificial Sequence
  Description of Artificial Sequence: Synthetic polypeptide
DEEEIRTTNPVATEQYGQCVCSNWEEHNQEYFNSEQQ

SEQ ID NO: 181736 - protein, 32 aa, Artificial Sequence
  Description of Artificial Sequence: Synthetic polypeptide
DEESIACTNPVATASWGCVAGTGELPQQDSNS

SEQ ID NO: 181737 - protein, 34 aa, Artificial Sequence
  Description of Artificial Sequence: Synthetic polypeptide
TSEEIRTTNPVAYEQYGIQVSNTGNEWSVAVTEF

SEQ ID NO: 181738 - protein, 32 aa, Artificial Sequence
  Description of Artificial Sequence: Synthetic polypeptide
AENEIACTNPIATEQWGAAWANAEDLQPKGPR

SEQ ID NO: 181739 - protein, 36 aa, Artificial Sequence
  Description of Artificial Sequence: Synthetic polypeptide
DEAEIRTTNPVATEQYGCVCSNWGEHNQEYFGSDQS

SEQ ID NO: 181740 - protein, 31 aa, Artificial Sequence
  Description of Artificial Sequence: Synthetic polypeptide
DDSEVASTNPVSTEGYGNVAANTIQSVNGQR

SEQ ID NO: 181741 - protein, 36 aa, Artificial Sequence
  Description of Artificial Sequence: Synthetic polypeptide
DEAEIRTTNPVATEQYGCVCSNWGEHNQENFGSEQS

SEQ ID NO: 181742 - protein, 36 aa, Artificial Sequence
  Description of Artificial Sequence: Synthetic polypeptide
DEAEIRTTNPVATEQYGCVCSNWGEHNQEFFNSDQS

SEQ ID NO: 181743 - protein, 36 aa, Artificial Sequence
  Description of Artificial Sequence: Synthetic polypeptide
DESEIRTTNPVAYEQWGVVCSTDNGGNQGQAGKGDN

SEQ ID NO: 181744 - protein, 31 aa, Artificial Sequence
  Description of Artificial Sequence: Synthetic polypeptide
DDSEVASTNPVSTEGYGNVAANTIQSVVGQR

SEQ ID NO: 181745 - protein, 36 aa, Artificial Sequence
  Description of Artificial Sequence: Synthetic polypeptide
DEECIRCTNPVATEQYGCVCSTWGEHNAEYFNSDQS

SEQ ID NO: 181746 - protein, 37 aa, Artificial Sequence
  Description of Artificial Sequence: Synthetic polypeptide
DESEIRTTNPVAYEQWGVVCPTDNHGLQNGQKGNDQK

SEQ ID NO: 181747 - protein, 36 aa, Artificial Sequence
  Description of Artificial Sequence: Synthetic polypeptide
DEAEIRTTNPVATEQYGCVCSNWEHNQENFNSETQS

SEQ ID NO: 181748 - protein, 37 aa, Artificial Sequence
  Description of Artificial Sequence: Synthetic polypeptide
DEAEIRTTNPVATEQYGCVCSNWGEHNTENFPSDNQS

SEQ ID NO: 181749 - protein, 39 aa, Artificial Sequence
  Description of Artificial Sequence: Synthetic polypeptide
DTEEIRATNPVATEQYGSVSTNQNGNNQNQNQQGTNNNE

SEQ ID NO: 181750 - protein, 31 aa, Artificial Sequence
  Description of Artificial Sequence: Synthetic polypeptide
DDSEVASTNPVSTEGYGNVAANTIQSTVGQR

SEQ ID NO: 181751 - protein, 33 aa, Artificial Sequence
  Description of Artificial Sequence: Synthetic polypeptide
SEEEIRCTNPIATEQYGCVCSWAHANFGSDTQS

SEQ ID NO: 181752 - protein, 34 aa, Artificial Sequence
  Description of Artificial Sequence: Synthetic polypeptide
SEEEIRCTNPIATEQYGCVCSWELNANFNSDTQS

SEQ ID NO: 181753 - protein, 37 aa, Artificial Sequence
  Description of Artificial Sequence: Synthetic polypeptide
DEEEIRTTNPVATEQYGCVCSMSGEPNQENFNSDNQT

SEQ ID NO: 181754 - protein, 31 aa, Artificial Sequence
  Description of Artificial Sequence: Synthetic polypeptide
DDSEVASTNPVSTEGYGNVAANTIQSSVGSR

SEQ ID NO: 181755 - protein, 38 aa, Artificial Sequence
  Description of Artificial Sequence: Synthetic polypeptide
DEEEIRTTNPVATEQYGQCVCSNWEEHNQENFGSDNQQ

SEQ ID NO: 181756 - protein, 35 aa, Artificial Sequence
  Description of Artificial Sequence: Synthetic polypeptide
DEECIRCTNPVATEQYGCVCSWEEDNQEYFNSDQS

SEQ ID NO: 181757 - protein, 33 aa, Artificial Sequence
  Description of Artificial Sequence: Synthetic polypeptide
VEDEIATTNPVAYEQWGSVAATGDTATGDNQDS

SEQ ID NO: 181758 - protein, 38 aa, Artificial Sequence
  Description of Artificial Sequence: Synthetic polypeptide
DEEEIRTTNPVATEQYGQCVCSNWEEHNQENFGSDNQS

SEQ ID NO: 181759 - protein, 37 aa, Artificial Sequence
  Description of Artificial Sequence: Synthetic polypeptide
DEEEIRTTNPVATEQYGCVCSMSGEHNQEFFISDNQD

SEQ ID NO: 181760 - protein, 33 aa, Artificial Sequence
  Description of Artificial Sequence: Synthetic polypeptide
SEEEIRCTNPIATEQYGCVCSWEDDANFGSDQS

SEQ ID NO: 181761 - protein, 34 aa, Artificial Sequence
  Description of Artificial Sequence: Synthetic polypeptide
DEECIGTTNPVAYEQWGTYVYNQDSDNDDRGEDN

SEQ ID NO: 181762 - protein, 35 aa, Artificial Sequence
  Description of Artificial Sequence: Synthetic polypeptide
DEECIKTTNPMAYENYGSLVPACTNGSQRSLDNVN

SEQ ID NO: 181763 - protein, 36 aa, Artificial Sequence
  Description of Artificial Sequence: Synthetic polypeptide
DEEEIRTTNPVATEQYGCVCSMSGEHAESFGSETQA

SEQ ID NO: 181764 - protein, 34 aa, Artificial Sequence
  Description of Artificial Sequence: Synthetic polypeptide
DEECIKTTNPMAYETWGSLVACTNGSQRSTDNVE

SEQ ID NO: 181765 - protein, 31 aa, Artificial Sequence
  Description of Artificial Sequence: Synthetic polypeptide
AENEIACTNPIATECYGATTANENWQPKGGR

SEQ ID NO: 181766 - protein, 35 aa, Artificial Sequence
  Description of Artificial Sequence: Synthetic polypeptide
DEECIKTTNPMAYETYGSLVACTNGSQRASTDNSN

SEQ ID NO: 181767 - protein, 34 aa, Artificial Sequence
  Description of Artificial Sequence: Synthetic polypeptide
DEECIKTTNPMAYETYGSLVACTNLSAMSTDNVN

SEQ ID NO: 181768 - protein, 39 aa, Artificial Sequence
  Description of Artificial Sequence: Synthetic polypeptide
DTEEIRATNPVATEQYGSVSTVTTNNNNQQNQIGTNNNE

SEQ ID NO: 181769 - protein, 35 aa, Artificial Sequence
  Description of Artificial Sequence: Synthetic polypeptide
DEECIKTTNPMAYETYGSLVPACTNGSQRSTDNVF

SEQ ID NO: 181770 - protein, 31 aa, Artificial Sequence
  Description of Artificial Sequence: Synthetic polypeptide
DEECIKTTNPVAYEQWGCVYQVDAQDHTIEH

SEQ ID NO: 181771 - protein, 37 aa, Artificial Sequence
  Description of Artificial Sequence: Synthetic polypeptide
DEEEIRTTNPVATEQYGQCVCSNWEEHNQNFGSETQA

SEQ ID NO: 181772 - protein, 36 aa, Artificial Sequence
  Description of Artificial Sequence: Synthetic polypeptide
DEECINTTNPVAYEHYGQTTVACVTNELATRGGERG

SEQ ID NO: 181773 - protein, 38 aa, Artificial Sequence
  Description of Artificial Sequence: Synthetic polypeptide
DEEEIRTTNPVATEQYGQCVCSNWEEHNTESFGSENQG

SEQ ID NO: 181774 - protein, 34 aa, Artificial Sequence
  Description of Artificial Sequence: Synthetic polypeptide
DTEAEIATTNPVAYEPYGEVAAMANDQVSNDTPR

SEQ ID NO: 181775 - protein, 37 aa, Artificial Sequence
  Description of Artificial Sequence: Synthetic polypeptide
DEEEIRTTNPVATEQYGSVSLVMNMFMPPVSEEEDMF

SEQ ID NO: 181776 - protein, 34 aa, Artificial Sequence
  Description of Artificial Sequence: Synthetic polypeptide
DEQEIRTTNPVATECWGSMGPCINQPEARETENG

SEQ ID NO: 181777 - protein, 33 aa, Artificial Sequence
  Description of Artificial Sequence: Synthetic polypeptide
DEQEIRTTNPVATECWGATWANADLADHKGPDI

SEQ ID NO: 181778 - protein, 34 aa, Artificial Sequence
  Description of Artificial Sequence: Synthetic polypeptide
AEDEIATTNPVAYEHWGSVAPTDNDQHQQQSGNH

SEQ ID NO: 181779 - protein, 38 aa, Artificial Sequence
  Description of Artificial Sequence: Synthetic polypeptide
DEEEIRTTNPVATEQYGQCVCSNTGENNAENFNSENQA

SEQ ID NO: 181780 - protein, 34 aa, Artificial Sequence
  Description of Artificial Sequence: Synthetic polypeptide
DEAEIRTTNPVATEQYGCVCQWVAHIENFMSDQS

SEQ ID NO: 181781 - protein, 32 aa, Artificial Sequence
  Description of Artificial Sequence: Synthetic polypeptide
DDSEVASTNPVSTEGYGNVAANTIQSRVGVQR

SEQ ID NO: 181782 - protein, 32 aa, Artificial Sequence
  Description of Artificial Sequence: Synthetic polypeptide
DEESIACTNPVATASWGCVAGTTGELPQDSNM

SEQ ID NO: 181783 - protein, 35 aa, Artificial Sequence
  Description of Artificial Sequence: Synthetic polypeptide
DSWEIRTTNPVAYEQYGCICSVEGPESERGGNNLA

SEQ ID NO: 181784 - protein, 35 aa, Artificial Sequence
  Description of Artificial Sequence: Synthetic polypeptide
DSWEIRTTNPVAYEQYGSICSVIGPESERGGVNLA

SEQ ID NO: 181785 - protein, 37 aa, Artificial Sequence
  Description of Artificial Sequence: Synthetic polypeptide
AENEAEIRTTNPVAYEQWGSVCSTDNGNQNDTKSGEH

SEQ ID NO: 181786 - protein, 35 aa, Artificial Sequence
  Description of Artificial Sequence: Synthetic polypeptide
DSWEIRTTNPVAYEQYGSICSVIGPHSERTGNNLA

SEQ ID NO: 181787 - protein, 33 aa, Artificial Sequence
  Description of Artificial Sequence: Synthetic polypeptide
DEESIACTNPVATASWGCVAGTNELQDDSNGAW

SEQ ID NO: 181788 - protein, 35 aa, Artificial Sequence
  Description of Artificial Sequence: Synthetic polypeptide
DSWEIRTTNPVAYEQYGSVCSVIGPESEHGGINLA

SEQ ID NO: 181789 - protein, 35 aa, Artificial Sequence
  Description of Artificial Sequence: Synthetic polypeptide
DSYEIRTTNPVATEQYGSCNSMDMIAGQEGTQDLY

SEQ ID NO: 181790 - protein, 35 aa, Artificial Sequence
  Description of Artificial Sequence: Synthetic polypeptide
DENEIRTTNPVATEQWGKVPSCEGESMNAAEGDIA

SEQ ID NO: 181791 - protein, 34 aa, Artificial Sequence
  Description of Artificial Sequence: Synthetic polypeptide
DEQEIRTTNPVATECWGSTGPCINEPEVRETENG

SEQ ID NO: 181792 - protein, 35 aa, Artificial Sequence
  Description of Artificial Sequence: Synthetic polypeptide
DEECIATTNPVAYEQWGVVCFTIEDGQERQINGNT

SEQ ID NO: 181793 - protein, 31 aa, Artificial Sequence
  Description of Artificial Sequence: Synthetic polypeptide
DDSEVASTNPVSTEGYGNVAANTIQSYVGQR

SEQ ID NO: 181794 - protein, 35 aa, Artificial Sequence
  Description of Artificial Sequence: Synthetic polypeptide
CEEEIACTNPVATAQWGSVSVSGNPLENTRGVEEM

SEQ ID NO: 181795 - protein, 37 aa, Artificial Sequence
  Description of Artificial Sequence: Synthetic polypeptide
DEEEIRTTNPVATEQYGSVSMESVMWSDDPNVLEHEI

SEQ ID NO: 181796 - protein, 37 aa, Artificial Sequence
  Description of Artificial Sequence: Synthetic polypeptide
DEQEIRTTNPVATDQYGSVNTTDGQNNQTGEDEQGET

SEQ ID NO: 181797 - protein, 35 aa, Artificial Sequence
  Description of Artificial Sequence: Synthetic polypeptide
DENEIRTTNPVATEQWGKVPSAEGEESMNAAEGDA

SEQ ID NO: 181798 - protein, 33 aa, Artificial Sequence
  Description of Artificial Sequence: Synthetic polypeptide
DEESIACTNPVATASWGCVATNELPQDDSNGMW

SEQ ID NO: 181799 - protein, 36 aa, Artificial Sequence
  Description of Artificial Sequence: Synthetic polypeptide
CEEEIATTNPVATEQWGGCVAGNGELAQNNSGNNHE

SEQ ID NO: 181800 - protein, 38 aa, Artificial Sequence
  Description of Artificial Sequence: Synthetic polypeptide
DEEEIRTTNPVATEQYGQCVCSNTGEHNQENFNSNPQS

SEQ ID NO: 181801 - protein, 31 aa, Artificial Sequence
  Description of Artificial Sequence: Synthetic polypeptide
DDSEVASTNPVSTEGYGNVAANTIQVAVGQR

SEQ ID NO: 181802 - protein, 38 aa, Artificial Sequence
  Description of Artificial Sequence: Synthetic polypeptide
DECEICTTNPVATEQYGTVATVTNLQRATNEEGATQDN

SEQ ID NO: 181803 - protein, 38 aa, Artificial Sequence
  Description of Artificial Sequence: Synthetic polypeptide
DECEICTTNPVATEQYGTVATVTNLQPGTTEAGSTNDD

SEQ ID NO: 181804 - protein, 35 aa, Artificial Sequence
  Description of Artificial Sequence: Synthetic polypeptide
CEEEIACTNPVATECYGSVCAGTGELQDSNPSDEW

SEQ ID NO: 181805 - protein, 36 aa, Artificial Sequence
  Description of Artificial Sequence: Synthetic polypeptide
DEECIATTNPVAYEQWGTVCYTINDLHDQNAGQNHS

SEQ ID NO: 181806 - protein, 38 aa, Artificial Sequence
  Description of Artificial Sequence: Synthetic polypeptide
DECEICTTNPVATEQYGTVATVTNLQNATTEEGNNNDD

SEQ ID NO: 181807 - protein, 35 aa, Artificial Sequence
  Description of Artificial Sequence: Synthetic polypeptide
CEEEIATTNPVATEQWGHVVSPTQDPPGDNMPMNM

SEQ ID NO: 181808 - protein, 35 aa, Artificial Sequence
  Description of Artificial Sequence: Synthetic polypeptide
DECEICTTNPVATEQYGTVATVTIGTVEDEGNNTD

SEQ ID NO: 181809 - protein, 36 aa, Artificial Sequence
  Description of Artificial Sequence: Synthetic polypeptide
DDEEISTTNPVATEQYGCVCSWGEHNQEHFGSDNQS

SEQ ID NO: 181810 - protein, 35 aa, Artificial Sequence
  Description of Artificial Sequence: Synthetic polypeptide
DECEICTTNPVATEQYGTVATVTDGGTDENEEGND

SEQ ID NO: 181811 - protein, 36 aa, Artificial Sequence
  Description of Artificial Sequence: Synthetic polypeptide
DEEEIRTTNPVATEEYGCVCSWGEHNQENFNSDNQT

SEQ ID NO: 181812 - protein, 35 aa, Artificial Sequence
  Description of Artificial Sequence: Synthetic polypeptide
DEECIATTNPVAYEQWGTVCYTVNDQHDQNGQNHS

SEQ ID NO: 181813 - protein, 31 aa, Artificial Sequence
  Description of Artificial Sequence: Synthetic polypeptide
DDSEVASTNPVSTEGYGNVAANTIQTRVGQN

SEQ ID NO: 181814 - protein, 31 aa, Artificial Sequence
  Description of Artificial Sequence: Synthetic polypeptide
AEVEIATTNPVAYEQWGTVSKEIEMNGKEDH

SEQ ID NO: 181815 - protein, 36 aa, Artificial Sequence
  Description of Artificial Sequence: Synthetic polypeptide
DEEEIRTTNPVATEQYGQCVCSNWGEDAENFNSDQS

SEQ ID NO: 181816 - protein, 38 aa, Artificial Sequence
  Description of Artificial Sequence: Synthetic polypeptide
DECEICTTNPVATEQYGTVATVGNLQRATNEEGATTDY

SEQ ID NO: 181817 - protein, 38 aa, Artificial Sequence
  Description of Artificial Sequence: Synthetic polypeptide
DECEICTTNPVATEQYGTVATVDNLQSATNEEGSNNDD

SEQ ID NO: 181818 - protein, 35 aa, Artificial Sequence
  Description of Artificial Sequence: Synthetic polypeptide
DSWEIRTTNPVAYEAYGSVCSQIGPESERGGPNLA

SEQ ID NO: 181819 - protein, 32 aa, Artificial Sequence
  Description of Artificial Sequence: Synthetic polypeptide
DDSEVASTNPVSTEGYGNVAANTIQSRVGTQR

SEQ ID NO: 181820 - protein, 37 aa, Artificial Sequence
  Description of Artificial Sequence: Synthetic polypeptide
DEEEIRTTNPVATEQYGSVSLAFIWPEHEVPGEPSMN

SEQ ID NO: 181821 - protein, 35 aa, Artificial Sequence
  Description of Artificial Sequence: Synthetic polypeptide
DEEEIRTTNPVATEQWGATTWANAEDGNMPKGPYI

SEQ ID NO: 181822 - protein, 37 aa, Artificial Sequence
  Description of Artificial Sequence: Synthetic polypeptide
DEAEIRTTNPVATEQYGCVCSMTGEHNQENFNSDNQA

SEQ ID NO: 181823 - protein, 34 aa, Artificial Sequence
  Description of Artificial Sequence: Synthetic polypeptide
DTEEIRATNPVAYEQWGCSYWNIDNDRLNGGQDR

SEQ ID NO: 181824 - protein, 36 aa, Artificial Sequence
  Description of Artificial Sequence: Synthetic polypeptide
DDEEISTTNPVATEQYGCVCSTSGEHNQENFGSDQS

SEQ ID NO: 181825 - protein, 38 aa, Artificial Sequence
  Description of Artificial Sequence: Synthetic polypeptide
DEEEIRTTNPVATEQYGQCVCSNTPEHNQEFFGSDTQS

SEQ ID NO: 181826 - protein, 36 aa, Artificial Sequence
  Description of Artificial Sequence: Synthetic polypeptide
DDEEISTTNPVATEQYGCVCSTMEHNQEFFNSDTQG

SEQ ID NO: 181827 - protein, 32 aa, Artificial Sequence
  Description of Artificial Sequence: Synthetic polypeptide
DDSEVASTNPVSTCGYGNVAANTIQARVGQNR

SEQ ID NO: 181828 - protein, 38 aa, Artificial Sequence
  Description of Artificial Sequence: Synthetic polypeptide
DTEEIRATNPVATEQYGVVVVTVTTNLQQGNNGTTDDE

SEQ ID NO: 181829 - protein, 35 aa, Artificial Sequence
  Description of Artificial Sequence: Synthetic polypeptide
DEDEIRGTNPVATEFWGWVSAATGEGQRGQGDQGD

SEQ ID NO: 181830 - protein, 36 aa, Artificial Sequence
  Description of Artificial Sequence: Synthetic polypeptide
DDEEISTTNPVATEQYGCVCSTGEHNTESFNSDTQS

SEQ ID NO: 181831 - protein, 38 aa, Artificial Sequence
  Description of Artificial Sequence: Synthetic polypeptide
DTEEIRATNPVATEQYGVVVVTVTNNLQQGNNQDTTDT

SEQ ID NO: 181832 - protein, 33 aa, Artificial Sequence
  Description of Artificial Sequence: Synthetic polypeptide
DEEEIRTTNPVATEQWGATAWAAEDWAEPKGPK

SEQ ID NO: 181833 - protein, 34 aa, Artificial Sequence
  Description of Artificial Sequence: Synthetic polypeptide
DEQEIRTTNPVATECWGSFGPCINEPEARETGTG

SEQ ID NO: 181834 - protein, 38 aa, Artificial Sequence
  Description of Artificial Sequence: Synthetic polypeptide
DTEEIRATNPVATEQYGVVVVTVTNNLQQGNNADTQDT

SEQ ID NO: 181835 - protein, 37 aa, Artificial Sequence
  Description of Artificial Sequence: Synthetic polypeptide
DEEEIRTTNPVATEQYGQCVCSNWEHNQENFGSDTQT

SEQ ID NO: 181836 - protein, 37 aa, Artificial Sequence
  Description of Artificial Sequence: Synthetic polypeptide
DECEICTTNPVATEQYGSVSTVVNNNQNEEEETTEDE

SEQ ID NO: 181837 - protein, 36 aa, Artificial Sequence
  Description of Artificial Sequence: Synthetic polypeptide
DEEEIRTTNPVATEQYGQCVCSNWEDHQENFMSDQS

SEQ ID NO: 181838 - protein, 37 aa, Artificial Sequence
  Description of Artificial Sequence: Synthetic polypeptide
DEEEIRTTNPVATEQYGQCVCSNWEHNQEHFNSDNQA

SEQ ID NO: 181839 - protein, 37 aa, Artificial Sequence
  Description of Artificial Sequence: Synthetic polypeptide
DTEEIRATNPVATEQYGVVSTVVTTQLQQLNQGTDDT

SEQ ID NO: 181840 - protein, 37 aa, Artificial Sequence
  Description of Artificial Sequence: Synthetic polypeptide
DTEEIRATNPVATEQYGVVSTVVTNTGQAGSTQQQDD

SEQ ID NO: 181841 - protein, 37 aa, Artificial Sequence
  Description of Artificial Sequence: Synthetic polypeptide
DEEEIRTTNPVATEQYGQCVCSNWEDNQENFNSDNQS

SEQ ID NO: 181842 - protein, 31 aa, Artificial Sequence
  Description of Artificial Sequence: Synthetic polypeptide
DDSEVATTNPVSTEGYGTVCSANTPEFVGQD

SEQ ID NO: 181843 - protein, 38 aa, Artificial Sequence
  Description of Artificial Sequence: Synthetic polypeptide
DTEEIRATNPVATEQYGVVVVTVTNNLQQGNNGGTTDE

SEQ ID NO: 181844 - protein, 35 aa, Artificial Sequence
  Description of Artificial Sequence: Synthetic polypeptide
CEEEIACTNPVATAQWGSVSVSGNLENTRGVGEFE

SEQ ID NO: 181845 - protein, 34 aa, Artificial Sequence
  Description of Artificial Sequence: Synthetic polypeptide
DTEEIRATNPVAYEQWGCSYINQDNDRQNGRQDR

SEQ ID NO: 181846 - protein, 34 aa, Artificial Sequence
  Description of Artificial Sequence: Synthetic polypeptide
DTEEIRATNPVAYEQWGCSYNEIDNPLGQDNGTQ

SEQ ID NO: 181847 - protein, 35 aa, Artificial Sequence
  Description of Artificial Sequence: Synthetic polypeptide
DEEEIRTTNPVATEQWGATTWANAEDGNMPKGNYI

SEQ ID NO: 181848 - protein, 34 aa, Artificial Sequence
  Description of Artificial Sequence: Synthetic polypeptide
DTEEIRATNPVAYEQWGCSYQPIDNDRQNGREDR

SEQ ID NO: 181849 - protein, 38 aa, Artificial Sequence
  Description of Artificial Sequence: Synthetic polypeptide
DEEEIRTTNPVATEQYGQCVCSNTGYHNQENFNSDTQY

SEQ ID NO: 181850 - protein, 34 aa, Artificial Sequence
  Description of Artificial Sequence: Synthetic polypeptide
DTEEIRATNPVAYEQWGCSYQNIDQERQNDRQDR

SEQ ID NO: 181851 - protein, 36 aa, Artificial Sequence
  Description of Artificial Sequence: Synthetic polypeptide
DDEEISTTNPVATEQYGCVCSWEEDHNQHFGSENQA

SEQ ID NO: 181852 - protein, 36 aa, Artificial Sequence
  Description of Artificial Sequence: Synthetic polypeptide
DEEEIRTTNPVATEQYGQCVCSNWEHNQENFISDQE

SEQ ID NO: 181853 - protein, 35 aa, Artificial Sequence
  Description of Artificial Sequence: Synthetic polypeptide
DEEQIRTTNPVAYDPWGCVVSIANESQDNNSGNRW

SEQ ID NO: 181854 - protein, 36 aa, Artificial Sequence
  Description of Artificial Sequence: Synthetic polypeptide
DDEEISTTNPVATEQYGCVCSTWGEHNQNFNSDTQN

SEQ ID NO: 181855 - protein, 33 aa, Artificial Sequence
  Description of Artificial Sequence: Synthetic polypeptide
AENEIACTNPVATEGYGCSCSSNHNQNFGSDQA

SEQ ID NO: 181856 - protein, 33 aa, Artificial Sequence
  Description of Artificial Sequence: Synthetic polypeptide
DEEEIRTTNPVATEQWGATAWAAEDWQEHKEPK

SEQ ID NO: 181857 - protein, 36 aa, Artificial Sequence
  Description of Artificial Sequence: Synthetic polypeptide
DEAEIRTTNPVATEQYGCVCSNWEEHNQNFNSDTQS

SEQ ID NO: 181858 - protein, 34 aa, Artificial Sequence
  Description of Artificial Sequence: Synthetic polypeptide
DTEEIRATNPVAYEQWGCSYQNIDQDRLNGRQDD

SEQ ID NO: 181859 - protein, 33 aa, Artificial Sequence
  Description of Artificial Sequence: Synthetic polypeptide
DTEEIRATNPVAYEQWGCSYQMDNHQQENDTSQ

SEQ ID NO: 181860 - protein, 36 aa, Artificial Sequence
  Description of Artificial Sequence: Synthetic polypeptide
VEEEIACTNPVATEQYGSACATNHGPLDSMGGDDAH

SEQ ID NO: 181861 - protein, 31 aa, Artificial Sequence
  Description of Artificial Sequence: Synthetic polypeptide
QEHEIASTNPVGTEGYGVCNASTLESHGDIP

SEQ ID NO: 181862 - protein, 35 aa, Artificial Sequence
  Description of Artificial Sequence: Synthetic polypeptide
VEEEIACTNPVATEQWGGCTVAGTGGLIDNMGMNV

SEQ ID NO: 181863 - protein, 35 aa, Artificial Sequence
  Description of Artificial Sequence: Synthetic polypeptide
VEEEIACTNPVATEQWGGCSATPHLTQPDAQGGFM

SEQ ID NO: 181864 - protein, 37 aa, Artificial Sequence
  Description of Artificial Sequence: Synthetic polypeptide
VEDEIATTNPVAYEQYGSVCSATNAGTQNHQDGAEMK

SEQ ID NO: 181865 - protein, 38 aa, Artificial Sequence
  Description of Artificial Sequence: Synthetic polypeptide
DEEEIRTTNPVATEAYGTVVTSGNSTIGTTSISTTGNT

SEQ ID NO: 181866 - protein, 35 aa, Artificial Sequence
  Description of Artificial Sequence: Synthetic polypeptide
VEDEIATTNPVATASWGSVSVANNEPTDRGGENTG

SEQ ID NO: 181867 - protein, 34 aa, Artificial Sequence
  Description of Artificial Sequence: Synthetic polypeptide
VEDEIATVNPVATEQWGCVAGNGLADAPYGNLHN

SEQ ID NO: 181868 - protein, 39 aa, Artificial Sequence
  Description of Artificial Sequence: Synthetic polypeptide
DEEEIRTTNPVATEAYGTVVTQYGNSEQGTTTIGTTGNT

SEQ ID NO: 181869 - protein, 33 aa, Artificial Sequence
  Description of Artificial Sequence: Synthetic polypeptide
VEDEIATTNPVATEQWGCVAGEGENANAAEDNA

SEQ ID NO: 181870 - protein, 36 aa, Artificial Sequence
  Description of Artificial Sequence: Synthetic polypeptide
VEDEIATTNPVAYEQYGSVCSANPALGQEHEDLTAM

SEQ ID NO: 181871 - protein, 34 aa, Artificial Sequence
  Description of Artificial Sequence: Synthetic polypeptide
VEDEVATTNPVAYEQWGSTCSMWEHMDYQRHGER

SEQ ID NO: 181872 - protein, 34 aa, Artificial Sequence
  Description of Artificial Sequence: Synthetic polypeptide
VEDEIATTNPVATEPYGVVCAGNNDTTAGGNEQN

SEQ ID NO: 181873 - protein, 34 aa, Artificial Sequence
  Description of Artificial Sequence: Synthetic polypeptide
VEDEIACTNPVATEQWGGCVAGTMLQHSDDNTPE

SEQ ID NO: 181874 - protein, 33 aa, Artificial Sequence
  Description of Artificial Sequence: Synthetic polypeptide
DCSEVASTNPVSTEGYGNVVACNTISQSRVGQR

SEQ ID NO: 181875 - protein, 39 aa, Artificial Sequence
  Description of Artificial Sequence: Synthetic polypeptide
DEEEIRTTNPVATEAYGVVSTNGNNDTIGTTSISTTGNT

SEQ ID NO: 181876 - protein, 34 aa, Artificial Sequence
  Description of Artificial Sequence: Synthetic polypeptide
VEDEIATVNPVATEQWGCVAGNGLADAPGVNNHW

SEQ ID NO: 181877 - protein, 33 aa, Artificial Sequence
  Description of Artificial Sequence: Synthetic polypeptide
QEHEIRCTNGVAYCQYGSVSLQHNNGNANQGEQ

SEQ ID NO: 181878 - protein, 36 aa, Artificial Sequence
  Description of Artificial Sequence: Synthetic polypeptide
DCVCIATTNPVATEPYGAVPSTQNEDSTDLTGGNED

SEQ ID NO: 181879 - protein, 39 aa, Artificial Sequence
  Description of Artificial Sequence: Synthetic polypeptide
DEEEIRTTNPVATEAYGVVSTNGNSTVIGTTSISTTGNT

SEQ ID NO: 181880 - protein, 34 aa, Artificial Sequence
  Description of Artificial Sequence: Synthetic polypeptide
VEDEIATTNPVAYEQWGSITSAANQGLDSNNPPP

SEQ ID NO: 181881 - protein, 34 aa, Artificial Sequence
  Description of Artificial Sequence: Synthetic polypeptide
VEEEIACTNPVATEQWGGCSAAMHLQPDAQGGFM

SEQ ID NO: 181882 - protein, 38 aa, Artificial Sequence
  Description of Artificial Sequence: Synthetic polypeptide
DEEEIRTTNPVAYEQYGQCVCSNTGEHNAENFNSDFQS

SEQ ID NO: 181883 - protein, 37 aa, Artificial Sequence
  Description of Artificial Sequence: Synthetic polypeptide
VEEEIACTNPVATEQWGSVAMNGDTPTNPDDQMGNEM

SEQ ID NO: 181884 - protein, 32 aa, Artificial Sequence
  Description of Artificial Sequence: Synthetic polypeptide
VEEEIATTNPVATASWGCIATTNAEQDTDHEN

SEQ ID NO: 181885 - protein, 30 aa, Artificial Sequence
  Description of Artificial Sequence: Synthetic polypeptide
QEHEIASTNPVGTEGYGVMAWTLESHGDIM

SEQ ID NO: 181886 - protein, 33 aa, Artificial Sequence
  Description of Artificial Sequence: Synthetic polypeptide
VEDEIATVNPVATEQWGCVAGNGLADAPGGFTH

SEQ ID NO: 181887 - protein, 33 aa, Artificial Sequence
  Description of Artificial Sequence: Synthetic polypeptide
VEDEVATTNPVAYEQWGSTCVGWEHMDRRVGER

SEQ ID NO: 181888 - protein, 32 aa, Artificial Sequence
  Description of Artificial Sequence: Synthetic polypeptide
VEDEIACTNPVAYEQWGCTAGNGLARMPDNSW

SEQ ID NO: 181889 - protein, 33 aa, Artificial Sequence
  Description of Artificial Sequence: Synthetic polypeptide
VEDEVATTNPVAYEQWGSTCVTWEHMDRRAGNK

SEQ ID NO: 181890 - protein, 33 aa, Artificial Sequence
  Description of Artificial Sequence: Synthetic polypeptide
VEDEVATTNPVAYEQWGTTCVTGEHMDRRVGNR

SEQ ID NO: 181891 - protein, 38 aa, Artificial Sequence
  Description of Artificial Sequence: Synthetic polypeptide
DEEEIRTTNPVATEQYGCVCGNWGEDHNQENFNSDTQP

SEQ ID NO: 181892 - protein, 32 aa, Artificial Sequence
  Description of Artificial Sequence: Synthetic polypeptide
DDSEVASTNPVSTEGWGNVAANTIQSRVGQRN

SEQ ID NO: 181893 - protein, 33 aa, Artificial Sequence
  Description of Artificial Sequence: Synthetic polypeptide
VEDEIRCTNPTAYECWGSVYGENDDMHRGDDDR

SEQ ID NO: 181894 - protein, 32 aa, Artificial Sequence
  Description of Artificial Sequence: Synthetic polypeptide
DDSEVASTNPVSTEGFGNVAANTPIQSRVGQR

SEQ ID NO: 181895 - protein, 32 aa, Artificial Sequence
  Description of Artificial Sequence: Synthetic polypeptide
DDSEVASTNPVATEGYGSVAATDIEDHEGEDL

SEQ ID NO: 181896 - protein, 36 aa, Artificial Sequence
  Description of Artificial Sequence: Synthetic polypeptide
VEEEIACTNPVATEQYGSVCAAGPLGFATMGDNQGM

SEQ ID NO: 181897 - protein, 34 aa, Artificial Sequence
  Description of Artificial Sequence: Synthetic polypeptide
VEDEVATTNPVAYEQWGSTCSTWEQMDLQGRNES

SEQ ID NO: 181898 - protein, 37 aa, Artificial Sequence
  Description of Artificial Sequence: Synthetic polypeptide
DEEEIRTVNPVATEQYGQCVCSSGEHNQEYFNSQNQA

SEQ ID NO: 181899 - protein, 32 aa, Artificial Sequence
  Description of Artificial Sequence: Synthetic polypeptide
DDSEVASTNPVSTEGWGAVANNTWQSRVGPYR

SEQ ID NO: 181900 - protein, 34 aa, Artificial Sequence
  Description of Artificial Sequence: Synthetic polypeptide
VEDEIATTNPVATEQWGGCVAGTGQLAINMEMND

SEQ ID NO: 181901 - protein, 38 aa, Artificial Sequence
  Description of Artificial Sequence: Synthetic polypeptide
VEDEIRTTNPVATEIYGVVSNMNLVGDDQDQEDDDGNP

SEQ ID NO: 181902 - protein, 34 aa, Artificial Sequence
  Description of Artificial Sequence: Synthetic polypeptide
VEDEVATTNPVAYEQWGVTCSTWEHIDQRVGNDK

SEQ ID NO: 181903 - protein, 35 aa, Artificial Sequence
  Description of Artificial Sequence: Synthetic polypeptide
VEDEVATTNPVAYEQWGSTCSTWEQMDLQGGSNEL

SEQ ID NO: 181904 - protein, 34 aa, Artificial Sequence
  Description of Artificial Sequence: Synthetic polypeptide
VEDEIATTNPVAYEQWGTVCAATAGELPDSDSNR

SEQ ID NO: 181905 - protein, 37 aa, Artificial Sequence
  Description of Artificial Sequence: Synthetic polypeptide
DEEEIRTTNPVAYEQYGQCVCSNTEEHIESFGSETQS

SEQ ID NO: 181906 - protein, 37 aa, Artificial Sequence
  Description of Artificial Sequence: Synthetic polypeptide
VEDEIATTNPVAYEQYGSVCSTNAPGPQVHQDGAEMN

SEQ ID NO: 181907 - protein, 31 aa, Artificial Sequence
  Description of Artificial Sequence: Synthetic polypeptide
DDSEVASTNPVSTEGWGNVAANTIQSRVGQG

SEQ ID NO: 181908 - protein, 30 aa, Artificial Sequence
  Description of Artificial Sequence: Synthetic polypeptide
QEHEIASTNPVGTEGYGVCCASTLESHRDI

SEQ ID NO: 181909 - protein, 31 aa, Artificial Sequence
  Description of Artificial Sequence: Synthetic polypeptide
QEHEIAPTNPCSYEQWGIVWCNDQGNGDTDR

SEQ ID NO: 181910 - protein, 37 aa, Artificial Sequence
  Description of Artificial Sequence: Synthetic polypeptide
DEEEIRTTNPVAYEQYGQCVCSNSGEHNQENFNSDQS

SEQ ID NO: 181911 - protein, 32 aa, Artificial Sequence
  Description of Artificial Sequence: Synthetic polypeptide
DDSEVASTNPVSTEGWGNVAANTIGQSRVGQR

SEQ ID NO: 181912 - protein, 38 aa, Artificial Sequence
  Description of Artificial Sequence: Synthetic polypeptide
VEDEIATTNPVATEQYGSVCAMTNNQGPADSGDGNAVH

SEQ ID NO: 181913 - protein, 31 aa, Artificial Sequence
  Description of Artificial Sequence: Synthetic polypeptide
QEHEIAPTNPCSYEQWGIVRCWNDHQSGDTR

SEQ ID NO: 181914 - protein, 37 aa, Artificial Sequence
  Description of Artificial Sequence: Synthetic polypeptide
VEDEIATTNPVATEQYGSVCAMNNGNLEPTRDLNNAD

SEQ ID NO: 181915 - protein, 33 aa, Artificial Sequence
  Description of Artificial Sequence: Synthetic polypeptide
VEDEIATTNPVATEQWGGCVAAKANHDMMNPNN

SEQ ID NO: 181916 - protein, 36 aa, Artificial Sequence
  Description of Artificial Sequence: Synthetic polypeptide
VEDEIRGTNPVATEAYGSVVDNTNDLEMDGGGQQQG

SEQ ID NO: 181917 - protein, 32 aa, Artificial Sequence
  Description of Artificial Sequence: Synthetic polypeptide
QEMEIACTNPCSYEQYGCVCSWNHQSFNSEQS

SEQ ID NO: 181918 - protein, 36 aa, Artificial Sequence
  Description of Artificial Sequence: Synthetic polypeptide
DEEEIRTVNPVATEQYGQCVCSNWGEHNANFNSQQS

SEQ ID NO: 181919 - protein, 38 aa, Artificial Sequence
  Description of Artificial Sequence: Synthetic polypeptide
DEEEIRTVNPVATEQYGQCVCSNTGEHNQEYFNSQTQS

SEQ ID NO: 181920 - protein, 35 aa, Artificial Sequence
  Description of Artificial Sequence: Synthetic polypeptide
VEDEIATTNPVAYEQYGSVCSMNNGNEAMPTDGAV

SEQ ID NO: 181921 - protein, 31 aa, Artificial Sequence
  Description of Artificial Sequence: Synthetic polypeptide
DDSEVASTNPVSTEGWGNVAANTIQSPVGQR

SEQ ID NO: 181922 - protein, 32 aa, Artificial Sequence
  Description of Artificial Sequence: Synthetic polypeptide
DDSEVASTNPVSTDGYGNVAANYTIQSRVGQR

SEQ ID NO: 181923 - protein, 35 aa, Artificial Sequence
  Description of Artificial Sequence: Synthetic polypeptide
VEDEIACTNPVATEQYGSVCATPPMQPDNQTEGTM

SEQ ID NO: 181924 - protein, 36 aa, Artificial Sequence
  Description of Artificial Sequence: Synthetic polypeptide
VEDEIACTNPVATEQYGSVCAMANNQDNDSPGNQVH

SEQ ID NO: 181925 - protein, 37 aa, Artificial Sequence
  Description of Artificial Sequence: Synthetic polypeptide
VEDEIATTNPVATEQYGSVSATTPAGTNQGNGMEPVE

SEQ ID NO: 181926 - protein, 34 aa, Artificial Sequence
  Description of Artificial Sequence: Synthetic polypeptide
DCEEISTTNPVAYEQWGSVCVNWEHGEQDMHIPP

SEQ ID NO: 181927 - protein, 31 aa, Artificial Sequence
  Description of Artificial Sequence: Synthetic polypeptide
DDSEVASTNPVSTEGFGNAAANTIQSRVGQR

SEQ ID NO: 181928 - protein, 37 aa, Artificial Sequence
  Description of Artificial Sequence: Synthetic polypeptide
DEEEIRTTNPVAYEQYGQCVCSNWEEDQEHFNSDFQS

SEQ ID NO: 181929 - protein, 32 aa, Artificial Sequence
  Description of Artificial Sequence: Synthetic polypeptide
DDSEVASTNPVSTEGWGAVAANTWQSRVGPYR

SEQ ID NO: 181930 - protein, 33 aa, Artificial Sequence
  Description of Artificial Sequence: Synthetic polypeptide
DDSEVASTNPVSTEAYGNVACCTISQSRTGGQR

SEQ ID NO: 181931 - protein, 37 aa, Artificial Sequence
  Description of Artificial Sequence: Synthetic polypeptide
VEDEIATTNPVAYEQYGSVCSMANPGQQEHQDGNAAK

SEQ ID NO: 181932 - protein, 36 aa, Artificial Sequence
  Description of Artificial Sequence: Synthetic polypeptide
VEDEIATTNPVAYEQYGSVANPNQGLDQATPQDENN

SEQ ID NO: 181933 - protein, 33 aa, Artificial Sequence
  Description of Artificial Sequence: Synthetic polypeptide
VEDEIATTNPVATEQWGGCVAAKANDMMPGGTP

SEQ ID NO: 181934 - protein, 34 aa, Artificial Sequence
  Description of Artificial Sequence: Synthetic polypeptide
VEDEVATTNPVAYEQWGSTCSTWEHMDLQGADER

SEQ ID NO: 181935 - protein, 36 aa, Artificial Sequence
  Description of Artificial Sequence: Synthetic polypeptide
DEEEIRTTNPVATEAYGVVFGVFEDDEGGNIQEEID

SEQ ID NO: 181936 - protein, 35 aa, Artificial Sequence
  Description of Artificial Sequence: Synthetic polypeptide
VEDEIATTNPVATEQWGSVSGQGPPQPHQMDNGDE

SEQ ID NO: 181937 - protein, 33 aa, Artificial Sequence
  Description of Artificial Sequence: Synthetic polypeptide
VEDEIATVNPVATEQWGCTAGNGLADAPGGENH

SEQ ID NO: 181938 - protein, 35 aa, Artificial Sequence
  Description of Artificial Sequence: Synthetic polypeptide
VEDEIATTNPVATEQYGCVAANNGDTADSMADGNM

SEQ ID NO: 181939 - protein, 36 aa, Artificial Sequence
  Description of Artificial Sequence: Synthetic polypeptide
VEDEIATTNPVAYEQYGSVANPNQGLDAATAGDENN

SEQ ID NO: 181940 - protein, 31 aa, Artificial Sequence
  Description of Artificial Sequence: Synthetic polypeptide
DDSEVASTNPVCTEGYGVVAADTIQSRVGQQ

SEQ ID NO: 181941 - protein, 35 aa, Artificial Sequence
  Description of Artificial Sequence: Synthetic polypeptide
VEDEIATTNPVAYEQYGSVCAQAGPGDNEMNDNRN

SEQ ID NO: 181942 - protein, 37 aa, Artificial Sequence
  Description of Artificial Sequence: Synthetic polypeptide
DEEEIRTTNPVATEAYGVVNGFIGQEEGDTEEDEFNE

SEQ ID NO: 181943 - protein, 34 aa, Artificial Sequence
  Description of Artificial Sequence: Synthetic polypeptide
VEDEVATTNPVAYEQWGSTCSTWEHMDGQVGQER

SEQ ID NO: 181944 - protein, 37 aa, Artificial Sequence
  Description of Artificial Sequence: Synthetic polypeptide
DEEEIRTTNPVATEAYGVVNGFLGEGDQIEEDEFNET

SEQ ID NO: 181945 - protein, 35 aa, Artificial Sequence
  Description of Artificial Sequence: Synthetic polypeptide
VEDEVATTNPVAYEQWGSTCSTWEHMDDQGGQNER

SEQ ID NO: 181946 - protein, 37 aa, Artificial Sequence
  Description of Artificial Sequence: Synthetic polypeptide
DEEEIRTTNPVATEQYGCVCGWEEDHNQENFNSDFQS

SEQ ID NO: 181947 - protein, 32 aa, Artificial Sequence
  Description of Artificial Sequence: Synthetic polypeptide
DDSEVASTNPVSTEGWGNVAANDIQSRDGGQR

SEQ ID NO: 181948 - protein, 32 aa, Artificial Sequence
  Description of Artificial Sequence: Synthetic polypeptide
DDSEVASTNPVSTEGWGNVAANDTIQSRQGQR

SEQ ID NO: 181949 - protein, 30 aa, Artificial Sequence
  Description of Artificial Sequence: Synthetic polypeptide
QEHEIASTNPVGTEGYGVMASTLESHSQDI

SEQ ID NO: 181950 - protein, 33 aa, Artificial Sequence
  Description of Artificial Sequence: Synthetic polypeptide
DDSEVASTNPVSTEAYGNVACNTEIQSRVGGQR

SEQ ID NO: 181951 - protein, 31 aa, Artificial Sequence
  Description of Artificial Sequence: Synthetic polypeptide
DDSEVASTNPVSTEGWGNVAAATIAERVGQR

SEQ ID NO: 181952 - protein, 34 aa, Artificial Sequence
  Description of Artificial Sequence: Synthetic polypeptide
VEEAIATTNPVAYEEWGQCCTTDGGDHQRGSNDR

SEQ ID NO: 181953 - protein, 35 aa, Artificial Sequence
  Description of Artificial Sequence: Synthetic polypeptide
VEDEIATTNPVATEQYGSVCAMANPAEDNMALNHH

SEQ ID NO: 181954 - protein, 38 aa, Artificial Sequence
  Description of Artificial Sequence: Synthetic polypeptide
DEEEIRTTNPVAYEQYGQCVCSNWEEDDNQSFGSDNQA

SEQ ID NO: 181955 - protein, 30 aa, Artificial Sequence
  Description of Artificial Sequence: Synthetic polypeptide
DDSEVASTNPVSTEGWGNVANIIMSRVGDR

SEQ ID NO: 181956 - protein, 32 aa, Artificial Sequence
  Description of Artificial Sequence: Synthetic polypeptide
DDSEVASTNPVSTEGWGNVAANDTRQDRVGQR

SEQ ID NO: 181957 - protein, 34 aa, Artificial Sequence
  Description of Artificial Sequence: Synthetic polypeptide
VEDEIATTNPVAYEQWGSVCAAGGLDNDDNDGRN

SEQ ID NO: 181958 - protein, 31 aa, Artificial Sequence
  Description of Artificial Sequence: Synthetic polypeptide
DDSEVASTNPVSTEGWGNVAANDIQSNMGQR

SEQ ID NO: 181959 - protein, 35 aa, Artificial Sequence
  Description of Artificial Sequence: Synthetic polypeptide
VEDEVATTNPVAYEQWGSTCSTWEHTDQRMGTNDE

SEQ ID NO: 181960 - protein, 35 aa, Artificial Sequence
  Description of Artificial Sequence: Synthetic polypeptide
VEDEIATTNPVAYEQYGSVAITNHGEATIDGDTQM

SEQ ID NO: 181961 - protein, 34 aa, Artificial Sequence
  Description of Artificial Sequence: Synthetic polypeptide
VEDEVATTNPVAYEQWGSTCSTWEHMDLQGGQEI

SEQ ID NO: 181962 - protein, 38 aa, Artificial Sequence
  Description of Artificial Sequence: Synthetic polypeptide
DEEEIRTTNPVATEQYGCVCGNWGEDHNTENFNSDNQS

SEQ ID NO: 181963 - protein, 36 aa, Artificial Sequence
  Description of Artificial Sequence: Synthetic polypeptide
VEDEIATTNPVAYEQYGSVCSVDNGPNDSPDGNENH

SEQ ID NO: 181964 - protein, 35 aa, Artificial Sequence
  Description of Artificial Sequence: Synthetic polypeptide
VEDEVATTNPVAYEQWGSTCSTWEHMDLQGQNERE

SEQ ID NO: 181965 - protein, 35 aa, Artificial Sequence
  Description of Artificial Sequence: Synthetic polypeptide
VEDEIATTNPVAYEQYGSVAITPHGEQTRNPPDEQ

SEQ ID NO: 181966 - protein, 36 aa, Artificial Sequence
  Description of Artificial Sequence: Synthetic polypeptide
VEDEIATTNPVATEQWGSVSATWPAGTNQGNGMEPV

SEQ ID NO: 181967 - protein, 36 aa, Artificial Sequence
  Description of Artificial Sequence: Synthetic polypeptide
VEECISTTNPVAYEQWGWVACTNNGLQDDTQDNRVM

SEQ ID NO: 181968 - protein, 37 aa, Artificial Sequence
  Description of Artificial Sequence: Synthetic polypeptide
VEEEIACTNPVATEQYGSACAATNGEEAPGEQMENRH

SEQ ID NO: 181969 - protein, 33 aa, Artificial Sequence
  Description of Artificial Sequence: Synthetic polypeptide
VEDEIATTNPVAYEQYGSVAAAHDTASGGDDDA

SEQ ID NO: 181970 - protein, 37 aa, Artificial Sequence
  Description of Artificial Sequence: Synthetic polypeptide
VEDEIATTNPVAYEQYGSVCAMTNGELPTASGGNQVH

SEQ ID NO: 181971 - protein, 35 aa, Artificial Sequence
  Description of Artificial Sequence: Synthetic polypeptide
VEDEIACTNPVATEQWGSVSGQGPPQEAPDGTTNK

SEQ ID NO: 181972 - protein, 34 aa, Artificial Sequence
  Description of Artificial Sequence: Synthetic polypeptide
VEDEIATVNPVATEQWGCVAGNGLADAPGGNNYM

SEQ ID NO: 181973 - protein, 35 aa, Artificial Sequence
  Description of Artificial Sequence: Synthetic polypeptide
AEDEICATNPVATEQYGVVAVVNEGNLQQGEGTDD

SEQ ID NO: 181974 - protein, 37 aa, Artificial Sequence
  Description of Artificial Sequence: Synthetic polypeptide
DEEEIRTTNPVATEQYGCVAAGCNGEHPAAAGSGIEM

SEQ ID NO: 181975 - protein, 33 aa, Artificial Sequence
  Description of Artificial Sequence: Synthetic polypeptide
DDSEVASTNPVSTEGYGNVAANTIQSRVGWQQR

SEQ ID NO: 181976 - protein, 31 aa, Artificial Sequence
  Description of Artificial Sequence: Synthetic polypeptide
DDSEVASTNPVSTEGYGNVAANTIQSRVLQE

SEQ ID NO: 181977 - protein, 32 aa, Artificial Sequence
  Description of Artificial Sequence: Synthetic polypeptide
DDSEVASTNPVSTEGYGNVAANTIQSSVGQYR

SEQ ID NO: 181978 - protein, 32 aa, Artificial Sequence
  Description of Artificial Sequence: Synthetic polypeptide
DDSEVASTNPVSTEGYGNVAANTIQSTVGQPR

SEQ ID NO: 181979 - protein, 32 aa, Artificial Sequence
  Description of Artificial Sequence: Synthetic polypeptide
DDSEVASTNPVSTEGYGNVAANTIQSTVGQQR

SEQ ID NO: 181980 - protein, 32 aa, Artificial Sequence
  Description of Artificial Sequence: Synthetic polypeptide
DDSEVASTNPVSTEGYGNVAANTIQSVIGEQR

SEQ ID NO: 181981 - protein, 37 aa, Artificial Sequence
  Description of Artificial Sequence: Synthetic polypeptide
DEEEIRTTNPVATEFYGDVINLNGMTGEQGGQGTEGT

SEQ ID NO: 181982 - protein, 35 aa, Artificial Sequence
  Description of Artificial Sequence: Synthetic polypeptide
AEDEIATTNPVAYEHWGSVAPTENDVGQQQSGNHG

SEQ ID NO: 181983 - protein, 31 aa, Artificial Sequence
  Description of Artificial Sequence: Synthetic polypeptide
DDSEVASTNPVSTEGYGNVAANTIQSVVYQR

SEQ ID NO: 181984 - protein, 31 aa, Artificial Sequence
  Description of Artificial Sequence: Synthetic polypeptide
DDSEVASTNPVSTEGYGNVAANTIQSYVGQL

SEQ ID NO: 181985 - protein, 32 aa, Artificial Sequence
  Description of Artificial Sequence: Synthetic polypeptide
DDSEVASTNPVSTEGYGNVAANTIQSYVGQQR

SEQ ID NO: 181986 - protein, 38 aa, Artificial Sequence
  Description of Artificial Sequence: Synthetic polypeptide
DEEEIRTTNPVATEFYGMVSVEGMGDRGQGQEATENGF

SEQ ID NO: 181987 - protein, 37 aa, Artificial Sequence
  Description of Artificial Sequence: Synthetic polypeptide
AEDEIATTNPVATEQYGSVSWNEGDQQVQEQGGQGDS

SEQ ID NO: 181988 - protein, 37 aa, Artificial Sequence
  Description of Artificial Sequence: Synthetic polypeptide
DEEEIRTTNPVATEFYGMVSVEGMGDSGQGQEAQEGQ

SEQ ID NO: 181989 - protein, 38 aa, Artificial Sequence
  Description of Artificial Sequence: Synthetic polypeptide
DEEEIRTTNPVATEFYGNVMTGVGDQDGEDTGGNNQPT

SEQ ID NO: 181990 - protein, 32 aa, Artificial Sequence
  Description of Artificial Sequence: Synthetic polypeptide
DDSEVASTNPVSTEGYGNVAANTIRQSRVEQR

SEQ ID NO: 181991 - protein, 32 aa, Artificial Sequence
  Description of Artificial Sequence: Synthetic polypeptide
DDSEVASTNPVSTEGYGNVAANTISSRVGQLR

SEQ ID NO: 181992 - protein, 34 aa, Artificial Sequence
  Description of Artificial Sequence: Synthetic polypeptide
AEDEIATTNPVATECWGAVCYNNDQQDHGGQNDA

SEQ ID NO: 181993 - protein, 33 aa, Artificial Sequence
  Description of Artificial Sequence: Synthetic polypeptide
DDSEVASTNPVSTEGYGNVAANTITQGRVGQGR

SEQ ID NO: 181994 - protein, 32 aa, Artificial Sequence
  Description of Artificial Sequence: Synthetic polypeptide
AEDEIATTNPVAYEQWGCTWNDNHNMEDGNTQ

SEQ ID NO: 181995 - protein, 33 aa, Artificial Sequence
  Description of Artificial Sequence: Synthetic polypeptide
DEEEIRTTNPVATEQWGATAWAAEDWAEHKEPK

SEQ ID NO: 181996 - protein, 33 aa, Artificial Sequence
  Description of Artificial Sequence: Synthetic polypeptide
DEEEIRTTNPVATEQWGATAWAAEDWAEPKEPK

SEQ ID NO: 181997 - protein, 35 aa, Artificial Sequence
  Description of Artificial Sequence: Synthetic polypeptide
DAEEIATTNPVAYEQYGSVCAMANHADSKAPPDRN

SEQ ID NO: 181998 - protein, 31 aa, Artificial Sequence
  Description of Artificial Sequence: Synthetic polypeptide
DDSEVGSTNPVSTEGYGMVAANTIVDGVGQR

SEQ ID NO: 181999 - protein, 36 aa, Artificial Sequence
  Description of Artificial Sequence: Synthetic polypeptide
DEEEIRTTNPVCTEHYGCVCSWPEDHNQENFGSQQS

SEQ ID NO: 182000 - protein, 37 aa, Artificial Sequence
  Description of Artificial Sequence: Synthetic polypeptide
DEEEIRTTNPVATEQWGICQVCSYWEDHNANFGSEQA

SEQ ID NO: 182001 - protein, 37 aa, Artificial Sequence
  Description of Artificial Sequence: Synthetic polypeptide
DEEEIRTTNPVCTEHYGCVCSTWGEHNQENFNSDTQS

SEQ ID NO: 182002 - protein, 37 aa, Artificial Sequence
  Description of Artificial Sequence: Synthetic polypeptide
DEEEIRTTNPVATEQWGICQVCSYTEDDNANFNSDQA

SEQ ID NO: 182003 - protein, 37 aa, Artificial Sequence
  Description of Artificial Sequence: Synthetic polypeptide
DEEEIRTTNPVATEQWGICQVCSNWNDHNAHFGSDQA

SEQ ID NO: 182004 - protein, 37 aa, Artificial Sequence
  Description of Artificial Sequence: Synthetic polypeptide
DEEEIRTTNPVATEQWGICQVCSNWEDPNANFGSDFS

SEQ ID NO: 182005 - protein, 38 aa, Artificial Sequence
  Description of Artificial Sequence: Synthetic polypeptide
DEEEIRTTNPVATEQWGICQVCSNTGEDDNANFGSDQA

SEQ ID NO: 182006 - protein, 36 aa, Artificial Sequence
  Description of Artificial Sequence: Synthetic polypeptide
DEEEIRTTNPVCTEHYGCVCSNWGEDNQENFNSDQA

SEQ ID NO: 182007 - protein, 32 aa, Artificial Sequence
  Description of Artificial Sequence: Synthetic polypeptide
DDSEVASTNPVSTEGYGNVAANTITSRVGGQR

SEQ ID NO: 182008 - protein, 32 aa, Artificial Sequence
  Description of Artificial Sequence: Synthetic polypeptide
DDSEVASTNPVSTEGYGNVAANTIQSRVGQKI

SEQ ID NO: 182009 - protein, 36 aa, Artificial Sequence
  Description of Artificial Sequence: Synthetic polypeptide
DAEEIATTNPVAYEQYGSVCWPTPGPNDSGDGMGMN

SEQ ID NO: 182010 - protein, 33 aa, Artificial Sequence
  Description of Artificial Sequence: Synthetic polypeptide
DDSEVASTNPVSTEGYGNVAANTIQSRVGQQGR

SEQ ID NO: 182011 - protein, 33 aa, Artificial Sequence
  Description of Artificial Sequence: Synthetic polypeptide
DDSEVASTNPVSTEGYGNVAANTIQSRVGQQRY

SEQ ID NO: 182012 - protein, 32 aa, Artificial Sequence
  Description of Artificial Sequence: Synthetic polypeptide
DDSEVASTNPVSTEGYGNVAANTIQSRVGQQW

SEQ ID NO: 182013 - protein, 37 aa, Artificial Sequence
  Description of Artificial Sequence: Synthetic polypeptide
DEEEIRTTNPVATEEYGCVCGNSGEHNAENFNSDTQA

SEQ ID NO: 182014 - protein, 37 aa, Artificial Sequence
  Description of Artificial Sequence: Synthetic polypeptide
DEEEIRTTNPVATEEYGCVCSMWEDHNQENFNSENQS

SEQ ID NO: 182015 - protein, 32 aa, Artificial Sequence
  Description of Artificial Sequence: Synthetic polypeptide
DDSEVASTNPVSTEGYGNVAANTIQSRVGQTN

SEQ ID NO: 182016 - protein, 32 aa, Artificial Sequence
  Description of Artificial Sequence: Synthetic polypeptide
DDSEVATTNPVSTEPYGTISAMETIQSQNGQH

SEQ ID NO: 182017 - protein, 37 aa, Artificial Sequence
  Description of Artificial Sequence: Synthetic polypeptide
DAEEIATTNPVAYEQYGSVCAPDNHGPLDSGEGNDHN

SEQ ID NO: 182018 - protein, 36 aa, Artificial Sequence
  Description of Artificial Sequence: Synthetic polypeptide
DEEEIRTTNPVCTEGYGCVCSWMEHNQENFGSDTQS

SEQ ID NO: 182019 - protein, 31 aa, Artificial Sequence
  Description of Artificial Sequence: Synthetic polypeptide
QEGEIAPTNPCSTEQWGAVSADWQESKGTYI

SEQ ID NO: 182020 - protein, 38 aa, Artificial Sequence
  Description of Artificial Sequence: Synthetic polypeptide
DEEEIRTTNPVATEFYGQVNMQGINNMDNQTGEFTENG

SEQ ID NO: 182021 - protein, 37 aa, Artificial Sequence
  Description of Artificial Sequence: Synthetic polypeptide
DEEEIRTTNPVATEQFGQCVCSWMYDHNANFGSETQS

SEQ ID NO: 182022 - protein, 36 aa, Artificial Sequence
  Description of Artificial Sequence: Synthetic polypeptide
DEHEIRTTNPVAYESWGCVCSGLNGEDERNGMNGES

SEQ ID NO: 182023 - protein, 35 aa, Artificial Sequence
  Description of Artificial Sequence: Synthetic polypeptide
DEHEIRTTNPVAYESWGCVSGGNGEDERNMNNGEE

SEQ ID NO: 182024 - protein, 31 aa, Artificial Sequence
  Description of Artificial Sequence: Synthetic polypeptide
DDSEVASTNPVSTEGYGNVAAWTIQSVVGQR

SEQ ID NO: 182025 - protein, 33 aa, Artificial Sequence
  Description of Artificial Sequence: Synthetic polypeptide
DDSEVASTNPVSTEGYGNVACNDTIQDRHGQDR

SEQ ID NO: 182026 - protein, 32 aa, Artificial Sequence
  Description of Artificial Sequence: Synthetic polypeptide
DDSEVASTNPVSTEGYGNVACNDTIQDRVGQA

SEQ ID NO: 182027 - protein, 34 aa, Artificial Sequence
  Description of Artificial Sequence: Synthetic polypeptide
DDSEVASTNPVSTEGYGNVACNDTIQDRVGQQNR

SEQ ID NO: 182028 - protein, 32 aa, Artificial Sequence
  Description of Artificial Sequence: Synthetic polypeptide
DDSEVATTNPVSTEGYGNVAANTIQSHVGQDL

SEQ ID NO: 182029 - protein, 34 aa, Artificial Sequence
  Description of Artificial Sequence: Synthetic polypeptide
DEHEIRTTNPVAYESWGCVTGNNGEDERNMNNAA

SEQ ID NO: 182030 - protein, 35 aa, Artificial Sequence
  Description of Artificial Sequence: Synthetic polypeptide
DEHEIRTTNPVAYESWGSVCYNNDENQDQDNQKED

SEQ ID NO: 182031 - protein, 33 aa, Artificial Sequence
  Description of Artificial Sequence: Synthetic polypeptide
DDSEVATTNPVSTEGYGNVAANTINSRVGMQPR

SEQ ID NO: 182032 - protein, 34 aa, Artificial Sequence
  Description of Artificial Sequence: Synthetic polypeptide
DDSEVASTNPVSTEGYGNVACNTISQSRTGGSNR

SEQ ID NO: 182033 - protein, 33 aa, Artificial Sequence
  Description of Artificial Sequence: Synthetic polypeptide
DDSEVASTNPVSTEGYGNVACQTISQSRVGGQR

SEQ ID NO: 182034 - protein, 32 aa, Artificial Sequence
  Description of Artificial Sequence: Synthetic polypeptide
DDSEVASTNPVSTEGYGNVAECITIQSRVGER

SEQ ID NO: 182035 - protein, 32 aa, Artificial Sequence
  Description of Artificial Sequence: Synthetic polypeptide
DDSEVASTNPVSTEGYGNVAEGTIQSRVGERE

SEQ ID NO: 182036 - protein, 33 aa, Artificial Sequence
  Description of Artificial Sequence: Synthetic polypeptide
DDSEVASTNPVSTEGYGNVAENTIQQSRVGERN

SEQ ID NO: 182037 - protein, 39 aa, Artificial Sequence
  Description of Artificial Sequence: Synthetic polypeptide
DEEEIRTTNPVATEFYGSVVGSGVEDQEEQEGEGEGNGE

SEQ ID NO: 182038 - protein, 37 aa, Artificial Sequence
  Description of Artificial Sequence: Synthetic polypeptide
DEEEIRTTNPVATEFYGSVVMPQGDEPEMTGGLDDGT

SEQ ID NO: 182039 - protein, 38 aa, Artificial Sequence
  Description of Artificial Sequence: Synthetic polypeptide
DEEEIATTNPVATEQYGSVCGNAGFPLPLDSAIENMSE

SEQ ID NO: 182040 - protein, 34 aa, Artificial Sequence
  Description of Artificial Sequence: Synthetic polypeptide
DEHEIRTTNPVAYESWGTVCYNNDEQDQDNGHED

SEQ ID NO: 182041 - protein, 31 aa, Artificial Sequence
  Description of Artificial Sequence: Synthetic polypeptide
DDSEVASTNPVSTEGYGNVAATTIQSHVGQL

SEQ ID NO: 182042 - protein, 34 aa, Artificial Sequence
  Description of Artificial Sequence: Synthetic polypeptide
DEHEIRTTNPVAYESWGCVCGGNGEDERNMNGTD

SEQ ID NO: 182043 - protein, 32 aa, Artificial Sequence
  Description of Artificial Sequence: Synthetic polypeptide
DDSEVASTNPVSTEGYGNVAATDTIQSRVGQD

SEQ ID NO: 182044 - protein, 32 aa, Artificial Sequence
  Description of Artificial Sequence: Synthetic polypeptide
DDSEVASTNPVSTEGYGNVAATDTIESRVGQR

SEQ ID NO: 182045 - protein, 36 aa, Artificial Sequence
  Description of Artificial Sequence: Synthetic polypeptide
DEEEIRTTNPVATEQFGQCVCSWGEHNAHFNSDTQS

SEQ ID NO: 182046 - protein, 32 aa, Artificial Sequence
  Description of Artificial Sequence: Synthetic polypeptide
DDSEVASTNPVSTEGYGNVAANTQIQSRVGQM

SEQ ID NO: 182047 - protein, 32 aa, Artificial Sequence
  Description of Artificial Sequence: Synthetic polypeptide
DDSEVASTNPVSTEGYGNVAANTRIQSVVGQR

SEQ ID NO: 182048 - protein, 38 aa, Artificial Sequence
  Description of Artificial Sequence: Synthetic polypeptide
DEEEIRTTNPVATEQFGQCVCSNWMYDNTEHFGSDNQS

SEQ ID NO: 182049 - protein, 34 aa, Artificial Sequence
  Description of Artificial Sequence: Synthetic polypeptide
DDSEVATTNPVSTEGYGNVSAANTINSRVGMQPR

SEQ ID NO: 182050 - protein, 32 aa, Artificial Sequence
  Description of Artificial Sequence: Synthetic polypeptide
DDSEVASTNPVSTEGYGNVAANTSIQSRVDQR

SEQ ID NO: 182051 - protein, 38 aa, Artificial Sequence
  Description of Artificial Sequence: Synthetic polypeptide
DEEEIRTTNPVATEFYGSVMGQIVNIGQEDQEGEAATD

SEQ ID NO: 182052 - protein, 33 aa, Artificial Sequence
  Description of Artificial Sequence: Synthetic polypeptide
AEDEIACTNPVAYEQWGEYYSIENDRQRGPGDS

SEQ ID NO: 182053 - protein, 37 aa, Artificial Sequence
  Description of Artificial Sequence: Synthetic polypeptide
DEEEIRTTNPVATEFYGSVNIVGMGQNQNMTNDTGEG

SEQ ID NO: 182054 - protein, 32 aa, Artificial Sequence
  Description of Artificial Sequence: Synthetic polypeptide
DDSEVASTNPVSTEGYGNVAANTIYSSRVGQR

SEQ ID NO: 182055 - protein, 34 aa, Artificial Sequence
  Description of Artificial Sequence: Synthetic polypeptide
YEEEIRCTNPAATEQYGDVVVVSEGGMGGEGGQT

SEQ ID NO: 182056 - protein, 32 aa, Artificial Sequence
  Description of Artificial Sequence: Synthetic polypeptide
DDSEVATTNPVSTEGYGNVAATTIQSHVGQDL

SEQ ID NO: 182057 - protein, 33 aa, Artificial Sequence
  Description of Artificial Sequence: Synthetic polypeptide
AEDEIACTNPVAYEQWGEYYSIENDQRGLGESM

SEQ ID NO: 182058 - protein, 32 aa, Artificial Sequence
  Description of Artificial Sequence: Synthetic polypeptide
AEDEIACTNPVAYEQWGEYYSIENDQIGPGED

SEQ ID NO: 182059 - protein, 37 aa, Artificial Sequence
  Description of Artificial Sequence: Synthetic polypeptide
DAEEIATTNPVAYEQYGSVCAINNNEEAPDNQGEGNP

SEQ ID NO: 182060 - protein, 33 aa, Artificial Sequence
  Description of Artificial Sequence: Synthetic polypeptide
AEDEIACTNPVAYEQWGEYYSIENDDQRRPGES

SEQ ID NO: 182061 - protein, 34 aa, Artificial Sequence
  Description of Artificial Sequence: Synthetic polypeptide
AEDEIACTNPVAYEQWGEYYSIEHNDQRQPGERS

SEQ ID NO: 182062 - protein, 33 aa, Artificial Sequence
  Description of Artificial Sequence: Synthetic polypeptide
DDSEVASTNPVSTEGYGNVAANVTIDQSRVGQR

SEQ ID NO: 182063 - protein, 32 aa, Artificial Sequence
  Description of Artificial Sequence: Synthetic polypeptide
DDSEVASTNPVSTEGYGNVAAPTIQSRVGQRV

SEQ ID NO: 182064 - protein, 32 aa, Artificial Sequence
  Description of Artificial Sequence: Synthetic polypeptide
DDSEVASTNPVSTEGYGNVAAQFTIQSRVGQR

SEQ ID NO: 182065 - protein, 34 aa, Artificial Sequence
  Description of Artificial Sequence: Synthetic polypeptide
AEDEIACTNPVAYEQWGEYYSIENDQTRNGPGER

SEQ ID NO: 182066 - protein, 33 aa, Artificial Sequence
  Description of Artificial Sequence: Synthetic polypeptide
DDSEVASTNPVSTEGYGNVAANTIQSRVGQDRL

SEQ ID NO: 182067 - protein, 38 aa, Artificial Sequence
  Description of Artificial Sequence: Synthetic polypeptide
DEEEIRTTNPVATEQWGQCVCSTWMYDNAEHFNSQTQS

SEQ ID NO: 182068 - protein, 36 aa, Artificial Sequence
  Description of Artificial Sequence: Synthetic polypeptide
DEEEIRTTNPVCTEHYGQCVCSWPEPNQENFGSDQS

SEQ ID NO: 182069 - protein, 37 aa, Artificial Sequence
  Description of Artificial Sequence: Synthetic polypeptide
DEEEIRTTNPVGTEQWGCVSGNANELGGEHGMDIEAM

SEQ ID NO: 182070 - protein, 36 aa, Artificial Sequence
  Description of Artificial Sequence: Synthetic polypeptide
DEEEIRTTNPVATEAYGVVVNGFGMEGDQEEDEFNE

SEQ ID NO: 182071 - protein, 37 aa, Artificial Sequence
  Description of Artificial Sequence: Synthetic polypeptide
AEDEICATNPVATEQYGVVATVVNSNQLQLNGNGEDD

SEQ ID NO: 182072 - protein, 37 aa, Artificial Sequence
  Description of Artificial Sequence: Synthetic polypeptide
DEEEIRTTNPVGTEHWGSVYCWIPNDQDDTRQGMDSI

SEQ ID NO: 182073 - protein, 37 aa, Artificial Sequence
  Description of Artificial Sequence: Synthetic polypeptide
DEEEIRTTNPVGTEHWGSVYCWIPNDQDDQRQLGDSG

SEQ ID NO: 182074 - protein, 35 aa, Artificial Sequence
  Description of Artificial Sequence: Synthetic polypeptide
DEEEIRTTNPVATECWGATSANTEAWPAEPNGPYV

SEQ ID NO: 182075 - protein, 35 aa, Artificial Sequence
  Description of Artificial Sequence: Synthetic polypeptide
DEEEIRTTNPVATECWGATSANTEDWPAEPNGPYV

SEQ ID NO: 182076 - protein, 37 aa, Artificial Sequence
  Description of Artificial Sequence: Synthetic polypeptide
DEEEIRTTNPVGTEHWGSVYCWIPNDQDDQRQGGDKY

SEQ ID NO: 182077 - protein, 36 aa, Artificial Sequence
  Description of Artificial Sequence: Synthetic polypeptide
DEEEIRTTNPVGTEGYGCVCSSGEDHNINFGSDTQA

SEQ ID NO: 182078 - protein, 31 aa, Artificial Sequence
  Description of Artificial Sequence: Synthetic polypeptide
QEGEIAPTNPCSYEQWGIVAKCNDNQSGDTR

SEQ ID NO: 182079 - protein, 36 aa, Artificial Sequence
  Description of Artificial Sequence: Synthetic polypeptide
AEDEICATNPVATEQYGVVATVTENLQQLQNGIGTD

SEQ ID NO: 182080 - protein, 30 aa, Artificial Sequence
  Description of Artificial Sequence: Synthetic polypeptide
QEGEIAPTNPCSYEQWGITYCIELQSGDTR

SEQ ID NO: 182081 - protein, 29 aa, Artificial Sequence
  Description of Artificial Sequence: Synthetic peptide
QEGEIAPTNPCSYEQWGINYCDDQSGDTR

SEQ ID NO: 182082 - protein, 37 aa, Artificial Sequence
  Description of Artificial Sequence: Synthetic polypeptide
AEDEICATNPVATEQYGVVATVNNANLQAGNQNGEDD

SEQ ID NO: 182083 - protein, 37 aa, Artificial Sequence
  Description of Artificial Sequence: Synthetic polypeptide
AEDEICATNPVATEQYGVVATVNGQNLQAGNQAGEDD

SEQ ID NO: 182084 - protein, 37 aa, Artificial Sequence
  Description of Artificial Sequence: Synthetic polypeptide
AEDEICATNPVATEQYGVVATVNGNQLQAGNQNGEDD

SEQ ID NO: 182085 - protein, 37 aa, Artificial Sequence
  Description of Artificial Sequence: Synthetic polypeptide
AEDEICATNPVATEQYGVVATVNGNLDQAGNNNGEDD

SEQ ID NO: 182086 - protein, 36 aa, Artificial Sequence
  Description of Artificial Sequence: Synthetic polypeptide
DEEEIRTTNPVGTEFYGAVNIMDLIMQGDEGGEDGD

SEQ ID NO: 182087 - protein, 35 aa, Artificial Sequence
  Description of Artificial Sequence: Synthetic polypeptide
DEEEIRTTNPVGTEFYGAVNAMDNIMVDEGPEDGD

SEQ ID NO: 182088 - protein, 31 aa, Artificial Sequence
  Description of Artificial Sequence: Synthetic polypeptide
QEGEIAPTNPCSYEQWGIVWCNDHQSGDGDR

SEQ ID NO: 182089 - protein, 31 aa, Artificial Sequence
  Description of Artificial Sequence: Synthetic polypeptide
QEGEIAPTNPCSYEQWGIVWCNDQSSGDTDR

SEQ ID NO: 182090 - protein, 39 aa, Artificial Sequence
  Description of Artificial Sequence: Synthetic polypeptide
DEEEIRTTNPVATEAYGVVTTNIGTTEQGSTNDEGNTET

SEQ ID NO: 182091 - protein, 39 aa, Artificial Sequence
  Description of Artificial Sequence: Synthetic polypeptide
DEEEIRTTNPVATEAYGVVSVVVTTQQGNTEQGTNNNNE

SEQ ID NO: 182092 - protein, 33 aa, Artificial Sequence
  Description of Artificial Sequence: Synthetic polypeptide
QEGEIAPTNPCSYEQYGVTVSCCNMLSSIGGTR

SEQ ID NO: 182093 - protein, 36 aa, Artificial Sequence
  Description of Artificial Sequence: Synthetic polypeptide
AEDEICATNPVATEQYGVVAVVNNQNQLQQGEGNDD

SEQ ID NO: 182094 - protein, 31 aa, Artificial Sequence
  Description of Artificial Sequence: Synthetic polypeptide
DDSEVRTTNPVSTEQWGNVSAEIEMNAAEDA

SEQ ID NO: 182095 - protein, 33 aa, Artificial Sequence
  Description of Artificial Sequence: Synthetic polypeptide
VEDEIACTNPVATEQWGGCVAGTMLQHSDDLQP

SEQ ID NO: 182096 - protein, 39 aa, Artificial Sequence
  Description of Artificial Sequence: Synthetic polypeptide
DEEEIRTTNPVATEQWGYLNVQACMFNELQHQRPGQGQT

SEQ ID NO: 182097 - protein, 39 aa, Artificial Sequence
  Description of Artificial Sequence: Synthetic polypeptide
DEEEIRTTNPVATEQWGYANVAAMVNELQHQRPMQGLEV

SEQ ID NO: 182098 - protein, 38 aa, Artificial Sequence
  Description of Artificial Sequence: Synthetic polypeptide
DEEEIRTTNPVATEQWGYANVAAMFNELQHQGPGQLQT

SEQ ID NO: 182099 - protein, 36 aa, Artificial Sequence
  Description of Artificial Sequence: Synthetic polypeptide
DEEEIRTTNPVGTEQYGCVCSNSEDHNAENFISDQA

SEQ ID NO: 182100 - protein, 38 aa, Artificial Sequence
  Description of Artificial Sequence: Synthetic polypeptide
DEEEIRTTNPVGTEQWGSVVSGNANELGGENGGDIEAM

SEQ ID NO: 182101 - protein, 37 aa, Artificial Sequence
  Description of Artificial Sequence: Synthetic polypeptide
AEDEICATNPVATEQYGVVATVNGENLQAGNQNGTDD

SEQ ID NO: 182102 - protein, 31 aa, Artificial Sequence
  Description of Artificial Sequence: Synthetic polypeptide
DDSEVASTNPVSTEGYGNVAANTIQNHVGQS

SEQ ID NO: 182103 - protein, 39 aa, Artificial Sequence
  Description of Artificial Sequence: Synthetic polypeptide
DEEEIRTTNPVATEAYGVVSTVVTNQAGTEAGTVNDEVD

SEQ ID NO: 182104 - protein, 39 aa, Artificial Sequence
  Description of Artificial Sequence: Synthetic polypeptide
DEEEIRTTNPVATEAYGVVSTVVTNQAGTEAGTVTNTDE

SEQ ID NO: 182105 - protein, 39 aa, Artificial Sequence
  Description of Artificial Sequence: Synthetic polypeptide
DEEEIRTTNPVATEAYGVVSTVVTTQALGTEQGTNQQQD

SEQ ID NO: 182106 - protein, 39 aa, Artificial Sequence
  Description of Artificial Sequence: Synthetic polypeptide
DEEEIRTTNPVATEAYGVVSTVVVTNNQLQGTEEEEEEA

SEQ ID NO: 182107 - protein, 37 aa, Artificial Sequence
  Description of Artificial Sequence: Synthetic polypeptide
DEEEIRTTNPVGTEQWGSVSGTAIEPGGEHGGDIEAM

SEQ ID NO: 182108 - protein, 37 aa, Artificial Sequence
  Description of Artificial Sequence: Synthetic polypeptide
DEEEIRTTNPVGTEQWGSVAGTANEPGGEHHGDIEAM

SEQ ID NO: 182109 - protein, 39 aa, Artificial Sequence
  Description of Artificial Sequence: Synthetic polypeptide
DEEEIRTTNPVATEAYGVVSVTVTQNQNNTEEGTNVATE

SEQ ID NO: 182110 - protein, 39 aa, Artificial Sequence
  Description of Artificial Sequence: Synthetic polypeptide
DEEEIRTTNPVATEAYGVVSVTVVVNQAGTTEQGNDEDE

SEQ ID NO: 182111 - protein, 39 aa, Artificial Sequence
  Description of Artificial Sequence: Synthetic polypeptide
DEEEIRTTNPVATEAYGVVSVVVTTQNGNVEQGTNNNSE

SEQ ID NO: 182112 - protein, 31 aa, Artificial Sequence
  Description of Artificial Sequence: Synthetic polypeptide
QEGEIAPTNPCSYEQYGKVACNEGSQSVTNS

SEQ ID NO: 182113 - protein, 32 aa, Artificial Sequence
  Description of Artificial Sequence: Synthetic polypeptide
DDSEVASTNPVSTEGYGNVAANTIQSAVGQRL

SEQ ID NO: 182114 - protein, 37 aa, Artificial Sequence
  Description of Artificial Sequence: Synthetic polypeptide
DEEEIRTTNPVGTAQWGSVSGTAIEPGGERGSPIDAM

SEQ ID NO: 182115 - protein, 35 aa, Artificial Sequence
  Description of Artificial Sequence: Synthetic polypeptide
DEEEIRTTNPVGTAQWGNVSTPPGSAGTPIDLDAM

SEQ ID NO: 182116 - protein, 35 aa, Artificial Sequence
  Description of Artificial Sequence: Synthetic polypeptide
AEDEICATNPVATEQYGVVATVEDNNQQLNGIGTD

SEQ ID NO: 182117 - protein, 36 aa, Artificial Sequence
  Description of Artificial Sequence: Synthetic polypeptide
DEEEIRTTNPVATECYGATVWSNAEDWPAEPKGPPI

SEQ ID NO: 182118 - protein, 32 aa, Artificial Sequence
  Description of Artificial Sequence: Synthetic polypeptide
DDSEVASTNPVSTEGYGNVAANTIQSRPGQDA

SEQ ID NO: 182119 - protein, 32 aa, Artificial Sequence
  Description of Artificial Sequence: Synthetic polypeptide
DDSEVASTNPVSTEGYGNVAANTIQSRVDQRR

SEQ ID NO: 182120 - protein, 32 aa, Artificial Sequence
  Description of Artificial Sequence: Synthetic polypeptide
DDSEVASTNPVSTEGYGNVAANTIQSRVEMQR

SEQ ID NO: 182121 - protein, 31 aa, Artificial Sequence
  Description of Artificial Sequence: Synthetic polypeptide
DDSEVASTNPVSTEGYGNVAANTIQSRVEQA

SEQ ID NO: 182122 - protein, 31 aa, Artificial Sequence
  Description of Artificial Sequence: Synthetic polypeptide
DDSEVASTNPVSTEGYGNVAANTIQSRVEQL

SEQ ID NO: 182123 - protein, 32 aa, Artificial Sequence
  Description of Artificial Sequence: Synthetic polypeptide
DDSEVASTNPVSTEGYGNVAANTIQSRVEQQR

SEQ ID NO: 182124 - protein, 33 aa, Artificial Sequence
  Description of Artificial Sequence: Synthetic polypeptide
DDSEVASTNPVSTEGYGNVAANTIQSRVGDQRN

SEQ ID NO: 182125 - protein, 32 aa, Artificial Sequence
  Description of Artificial Sequence: Synthetic polypeptide
DDSEVASTNPVSTEGYGNVAANTIQSREGQSE

SEQ ID NO: 182126 - protein, 32 aa, Artificial Sequence
  Description of Artificial Sequence: Synthetic polypeptide
DDSEVASTNPVSTEGYGNVAANTIQSRVGEQG

SEQ ID NO: 182127 - protein, 32 aa, Artificial Sequence
  Description of Artificial Sequence: Synthetic polypeptide
DDSEVASTNPVSTEGYGNVAANTIQSRVGFQV

SEQ ID NO: 182128 - protein, 38 aa, Artificial Sequence
  Description of Artificial Sequence: Synthetic polypeptide
DEEEIRTTNPVATECYGSVGDMEDNVDTQGQGGQDEEG

SEQ ID NO: 182129 - protein, 37 aa, Artificial Sequence
  Description of Artificial Sequence: Synthetic polypeptide
DEEEIRTTNPVATECYGSVQDDQGGDDDQQDEGDVDS

SEQ ID NO: 182130 - protein, 32 aa, Artificial Sequence
  Description of Artificial Sequence: Synthetic polypeptide
DDSEVASTNPVSTEGYGNVAANTIQSRVGIQW

SEQ ID NO: 182131 - protein, 32 aa, Artificial Sequence
  Description of Artificial Sequence: Synthetic polypeptide
DDSEVASTNPVSTEGYGNVAANTIQSRVGIYQ

SEQ ID NO: 182132 - protein, 32 aa, Artificial Sequence
  Description of Artificial Sequence: Synthetic polypeptide
DDSEVASTNPVSTEGYGNVAANTIQSRVGLQG

SEQ ID NO: 182133 - protein, 32 aa, Artificial Sequence
  Description of Artificial Sequence: Synthetic polypeptide
DDSEVASTNPVSTEGYGNVAANTIQSRVGMQV

SEQ ID NO: 182134 - protein, 38 aa, Artificial Sequence
  Description of Artificial Sequence: Synthetic polypeptide
DAEEIKTTNPVATEQYGSFVINSLNQYMELEQAVVPDA

SEQ ID NO: 182135 - protein, 33 aa, Artificial Sequence
  Description of Artificial Sequence: Synthetic polypeptide
DDSEVASTNPVSTEGYGNVAANTIQSRVGQARP

SEQ ID NO: 182136 - protein, 37 aa, Artificial Sequence
  Description of Artificial Sequence: Synthetic polypeptide
DAEEIRTTNPVAYEQYGIVVPHCSSMLSQSSGGPMQS

SEQ ID NO: 182137 - protein, 37 aa, Artificial Sequence
  Description of Artificial Sequence: Synthetic polypeptide
DEEEIATTNPVATEQYGSVCAVPHQGPLDSMIENMAD

SEQ ID NO: 182138 - protein, 37 aa, Artificial Sequence
  Description of Artificial Sequence: Synthetic polypeptide
DEEEIRTTNPVATECWGSTTSANAEDWPNMRKGMPYI

SEQ ID NO: 182139 - protein, 31 aa, Artificial Sequence
  Description of Artificial Sequence: Synthetic polypeptide
DDSEVASTNPVSTEGYGNVAANTIQSRAEQA

SEQ ID NO: 182140 - protein, 32 aa, Artificial Sequence
  Description of Artificial Sequence: Synthetic polypeptide
DDSEVASTNPVSTEGYGNVAANTIQSDVGGQR

SEQ ID NO: 182141 - protein, 33 aa, Artificial Sequence
  Description of Artificial Sequence: Synthetic polypeptide
QEGEIAPTNPCSYAQYGTTVSCCNMLSQSGGTR

SEQ ID NO: 182142 - protein, 32 aa, Artificial Sequence
  Description of Artificial Sequence: Synthetic polypeptide
DDSEVASTNPVSTEGYGNVAANTIQSEVGQRR

SEQ ID NO: 182143 - protein, 37 aa, Artificial Sequence
  Description of Artificial Sequence: Synthetic polypeptide
DEHEIRTTNPVAYEQWGSVCYSTLNEGEHGEKGDGHI

SEQ ID NO: 182144 - protein, 32 aa, Artificial Sequence
  Description of Artificial Sequence: Synthetic polypeptide
DDSEVASTNPVSTEGYGNVAANTIQSFVGQRF

SEQ ID NO: 182145 - protein, 35 aa, Artificial Sequence
  Description of Artificial Sequence: Synthetic polypeptide
DEHEIRTTNPVAYEQWGSVCYTGEGEHGETEDGDQ

SEQ ID NO: 182146 - protein, 32 aa, Artificial Sequence
  Description of Artificial Sequence: Synthetic polypeptide
DDSEVASTNPVSTEGYGNVAANTIQSHVGQDR

SEQ ID NO: 182147 - protein, 31 aa, Artificial Sequence
  Description of Artificial Sequence: Synthetic polypeptide
DDSEVASTNPVSTEGYGNVAANTIQSHVGQL

SEQ ID NO: 182148 - protein, 32 aa, Artificial Sequence
  Description of Artificial Sequence: Synthetic polypeptide
DDSEVASTNPVSTEGYGNVAANTIQSKVGQQR

SEQ ID NO: 182149 - protein, 33 aa, Artificial Sequence
  Description of Artificial Sequence: Synthetic polypeptide
DDSEVASTNPVSTEGYGNVAANTIQSRDGGQDR

SEQ ID NO: 182150 - protein, 31 aa, Artificial Sequence
  Description of Artificial Sequence: Synthetic polypeptide
DDSEVASTNPVSTEGYGNVAANTIQSLVGQA

SEQ ID NO: 182151 - protein, 32 aa, Artificial Sequence
  Description of Artificial Sequence: Synthetic polypeptide
DDSEVASTNPVSTEGYGNVAANTIQSLVGQRD

SEQ ID NO: 182152 - protein, 32 aa, Artificial Sequence
  Description of Artificial Sequence: Synthetic polypeptide
DDSEVASTNPVSTEGYGNVAANTIQSLVGQRK

SEQ ID NO: 182153 - protein, 31 aa, Artificial Sequence
  Description of Artificial Sequence: Synthetic polypeptide
DDSEVASTNPVSTEGYGNVAANTIQSLVGQW

SEQ ID NO: 182154 - protein, 31 aa, Artificial Sequence
  Description of Artificial Sequence: Synthetic polypeptide
DDSEVASTNPVSTEGYGNVAANTIQSMVGQT

SEQ ID NO: 182155 - protein, 32 aa, Artificial Sequence
  Description of Artificial Sequence: Synthetic polypeptide
DDSEVASTNPVSTEGYGNVAANTIQSNVGQGR

SEQ ID NO: 182156 - protein, 31 aa, Artificial Sequence
  Description of Artificial Sequence: Synthetic polypeptide
DDSEVASTNPVSTEGYGNVAANTIQSNVGQH

SEQ ID NO: 182157 - protein, 31 aa, Artificial Sequence
  Description of Artificial Sequence: Synthetic polypeptide
DDSEVASTNPVSTEGYGNVAANTIQSNVGQM

SEQ ID NO: 182158 - protein, 32 aa, Artificial Sequence
  Description of Artificial Sequence: Synthetic polypeptide
DDSEVASTNPVSTEGYGNVAANTIQSNVGQRD

SEQ ID NO: 182159 - protein, 31 aa, Artificial Sequence
  Description of Artificial Sequence: Synthetic polypeptide
DDSEVASTNPVSTEGYGNVAANTIQSQVGQA

SEQ ID NO: 182160 - protein, 32 aa, Artificial Sequence
  Description of Artificial Sequence: Synthetic polypeptide
DDSEVASTNPVSTEGYGNVAANTIQSLVGQMR

SEQ ID NO: 182161 - protein, 39 aa, Artificial Sequence
  Description of Artificial Sequence: Synthetic polypeptide
AECEICTTNPVATEAYGSVYTVSTEEIGTNLQIGTNVEM

SEQ ID NO: 182162 - protein, 33 aa, Artificial Sequence
  Description of Artificial Sequence: Synthetic polypeptide
DEHEIRTTNPVAYMQWGAAPTWEQDQQHQGGDK

SEQ ID NO: 182163 - protein, 36 aa, Artificial Sequence
  Description of Artificial Sequence: Synthetic polypeptide
DEEEIRTTNPVATEFYGTVVDGGETDEGDEDGGGEG

SEQ ID NO: 182164 - protein, 37 aa, Artificial Sequence
  Description of Artificial Sequence: Synthetic polypeptide
DEEEIRTTNPVATEGYGMVVIEDGQGGEEGGGQGINV

SEQ ID NO: 182165 - protein, 31 aa, Artificial Sequence
  Description of Artificial Sequence: Synthetic polypeptide
DDSEVASTNPVSTEPYGNVAANTIQNPVGAM

SEQ ID NO: 182166 - protein, 37 aa, Artificial Sequence
  Description of Artificial Sequence: Synthetic polypeptide
DEEEIRTTNPVATEGYGQCAVCSWGEDHQNFNSDTQS

SEQ ID NO: 182167 - protein, 36 aa, Artificial Sequence
  Description of Artificial Sequence: Synthetic polypeptide
DEEEIRTTNPVATEGYGQCVCFWEDDNTENFGSDQS

SEQ ID NO: 182168 - protein, 37 aa, Artificial Sequence
  Description of Artificial Sequence: Synthetic polypeptide
DEEEIRTTNPVATEGYGQCVCSDWGEHNQNFSSDNQS

SEQ ID NO: 182169 - protein, 37 aa, Artificial Sequence
  Description of Artificial Sequence: Synthetic polypeptide
DEEEIRTTNPVATEGYGQCVCSNWEEHNAENFNSEQS

SEQ ID NO: 182170 - protein, 32 aa, Artificial Sequence
  Description of Artificial Sequence: Synthetic polypeptide
YENEIATVNPVSTEPYGTISMEDIQQQQNGNH

SEQ ID NO: 182171 - protein, 37 aa, Artificial Sequence
  Description of Artificial Sequence: Synthetic polypeptide
YENEIKTTNPVATEQYGSVNNDNNQNGLGQQEGEGED

SEQ ID NO: 182172 - protein, 36 aa, Artificial Sequence
  Description of Artificial Sequence: Synthetic polypeptide
ADEEIRTTNPVATEQYGCVCSWMEHNAENFGSDTQS

SEQ ID NO: 182173 - protein, 36 aa, Artificial Sequence
  Description of Artificial Sequence: Synthetic polypeptide
ADEEIRTTNPVATEQYGCVCSNWEDNQENFGSDTQS

SEQ ID NO: 182174 - protein, 37 aa, Artificial Sequence
  Description of Artificial Sequence: Synthetic polypeptide
DEKELATTNPVAYEQYGTVCSYTDGLVEGVQRNNGES

SEQ ID NO: 182175 - protein, 38 aa, Artificial Sequence
  Description of Artificial Sequence: Synthetic polypeptide
DEEEIRTTNPVATEGYGQCVCSNWGEHDQENFGSDNQS

SEQ ID NO: 182176 - protein, 36 aa, Artificial Sequence
  Description of Artificial Sequence: Synthetic polypeptide
DELEIATTNPCATECYGVVCYKTNDEGQRQQMGDMS

SEQ ID NO: 182177 - protein, 38 aa, Artificial Sequence
  Description of Artificial Sequence: Synthetic polypeptide
DEEEIRTTNPVATEGYGQCVCSNWGEHNEENFGSDNQS

SEQ ID NO: 182178 - protein, 37 aa, Artificial Sequence
  Description of Artificial Sequence: Synthetic polypeptide
DEEEIRTTNPVATEGYGQCVCSTGEDHNQENFMSDQS

SEQ ID NO: 182179 - protein, 37 aa, Artificial Sequence
  Description of Artificial Sequence: Synthetic polypeptide
DEEEIATTNPVATEQYGSVCAMNNGVSEPPDDQMEGA

SEQ ID NO: 182180 - protein, 39 aa, Artificial Sequence
  Description of Artificial Sequence: Synthetic polypeptide
DEEEIRTTNPVATEGYGVVDVGVGTGNVGQEEGEGQNTE

SEQ ID NO: 182181 - protein, 37 aa, Artificial Sequence
  Description of Artificial Sequence: Synthetic polypeptide
YEQEICTTNPVATEQYGSVVNNGNNNGLGQQEGEGEG

SEQ ID NO: 182182 - protein, 38 aa, Artificial Sequence
  Description of Artificial Sequence: Synthetic polypeptide
YEQEIKTTNPVATEQYGSVVNSGNNNNGLGQQEGEGED

SEQ ID NO: 182183 - protein, 31 aa, Artificial Sequence
  Description of Artificial Sequence: Synthetic polypeptide
DDSEVASTNPVSTEPYGNVAAMTIQSRNGQH

SEQ ID NO: 182184 - protein, 38 aa, Artificial Sequence
  Description of Artificial Sequence: Synthetic polypeptide
DEKEIATTNPVAYEQYGTVCSYTDGLVEGVQRPENGES

SEQ ID NO: 182185 - protein, 32 aa, Artificial Sequence
  Description of Artificial Sequence: Synthetic polypeptide
DDSEVASTNPVSTEGYGYASAANTIQSRVITR

SEQ ID NO: 182186 - protein, 36 aa, Artificial Sequence
  Description of Artificial Sequence: Synthetic polypeptide
DEIVEIATTNPVAYEAWGSVYCSNNLGEDMGNKGEG

SEQ ID NO: 182187 - protein, 32 aa, Artificial Sequence
  Description of Artificial Sequence: Synthetic polypeptide
DDSEVASTNPVSTEGYGSVANITIQSRVGEQG

SEQ ID NO: 182188 - protein, 37 aa, Artificial Sequence
  Description of Artificial Sequence: Synthetic polypeptide
DEEEIRTTNPVATEGYGICVCSTWVEHNQENFISDQG

SEQ ID NO: 182189 - protein, 37 aa, Artificial Sequence
  Description of Artificial Sequence: Synthetic polypeptide
DEEEIRTTNPVATEGYGICVCSWGEDNIENFISDNQA

SEQ ID NO: 182190 - protein, 36 aa, Artificial Sequence
  Description of Artificial Sequence: Synthetic polypeptide
DEEEIRTTNPVATEGYGMVDIGFEGINEGGEFNDEG

SEQ ID NO: 182191 - protein, 35 aa, Artificial Sequence
  Description of Artificial Sequence: Synthetic polypeptide
DAEEIATTNPVAYEQYGSTTAGNNGLPQSDDSMEN

SEQ ID NO: 182192 - protein, 36 aa, Artificial Sequence
  Description of Artificial Sequence: Synthetic polypeptide
DEEEIRTTNPVATEGYGMVDIGGDGLEEGGQGELEL

SEQ ID NO: 182193 - protein, 36 aa, Artificial Sequence
  Description of Artificial Sequence: Synthetic polypeptide
DAEEIATTNPVAYEQYGSTTAGNNGLPQDSNGQDEH

SEQ ID NO: 182194 - protein, 34 aa, Artificial Sequence
  Description of Artificial Sequence: Synthetic polypeptide
DAEEIATTNPVAYEQYGSTTAGNNGLPESDDQEN

SEQ ID NO: 182195 - protein, 36 aa, Artificial Sequence
  Description of Artificial Sequence: Synthetic polypeptide
DEEEIRTTNPVATEGYGMVDIGGEDGINEGGEVGEL

SEQ ID NO: 182196 - protein, 39 aa, Artificial Sequence
  Description of Artificial Sequence: Synthetic polypeptide
DEEEIRTTNPVATEGYGVVDVGVGTGNVGQEEGEENFTI

SEQ ID NO: 182197 - protein, 37 aa, Artificial Sequence
  Description of Artificial Sequence: Synthetic polypeptide
DEEEIRTTNPVATEGYGMVDIGGETGINEMGEENDEL

SEQ ID NO: 182198 - protein, 32 aa, Artificial Sequence
  Description of Artificial Sequence: Synthetic polypeptide
DDSEVASTNPVSTEGYGTVCAANTPQSRVGQD

SEQ ID NO: 182199 - protein, 31 aa, Artificial Sequence
  Description of Artificial Sequence: Synthetic polypeptide
DDSEVASTNPVSTEGYGVVAADTIQSSVGQR

SEQ ID NO: 182200 - protein, 35 aa, Artificial Sequence
  Description of Artificial Sequence: Synthetic polypeptide
DDSEVATTNPVATEGYGNVSATNPTGPNSRNGMQV

SEQ ID NO: 182201 - protein, 38 aa, Artificial Sequence
  Description of Artificial Sequence: Synthetic polypeptide
DEIEIRTTNPVATEQYGSVCVPSIAWEVEPNDLALFSQ

SEQ ID NO: 182202 - protein, 38 aa, Artificial Sequence
  Description of Artificial Sequence: Synthetic polypeptide
DEIEIRTTNPVATEQYGSVQVPSIAPEVEPNDLALFAQ

SEQ ID NO: 182203 - protein, 34 aa, Artificial Sequence
  Description of Artificial Sequence: Synthetic polypeptide
DAEEIATTNPVAYEQWGCNTAGTNGLTAEDEMNN

SEQ ID NO: 182204 - protein, 35 aa, Artificial Sequence
  Description of Artificial Sequence: Synthetic polypeptide
ADEEISTTNPVATEQYGCVCSNWGEHNQNFGSDQS

SEQ ID NO: 182205 - protein, 39 aa, Artificial Sequence
  Description of Artificial Sequence: Synthetic polypeptide
DEEEIRTTNPVATEQYGSVDGDMNGNADIAGQEGGGQEM

SEQ ID NO: 182206 - protein, 37 aa, Artificial Sequence
  Description of Artificial Sequence: Synthetic polypeptide
DEISEISTTNPVAYECWGSVATGNGPLNDDRGQNGTD

SEQ ID NO: 182207 - protein, 36 aa, Artificial Sequence
  Description of Artificial Sequence: Synthetic polypeptide
DAEEIATTNPVAYEQYGSTCAMNNGLPDIGGDNEQW

SEQ ID NO: 182208 - protein, 39 aa, Artificial Sequence
  Description of Artificial Sequence: Synthetic polypeptide
DEEEIRTTNPVATEGYGVVDVGVGTGNDGQQEGEGNDTY

SEQ ID NO: 182209 - protein, 39 aa, Artificial Sequence
  Description of Artificial Sequence: Synthetic polypeptide
DEEEIRTTNPVATEGYGVVDVGLGTGNVGQNEGEGNDTS

SEQ ID NO: 182210 - protein, 31 aa, Artificial Sequence
  Description of Artificial Sequence: Synthetic polypeptide
DDSEVASTNPVSTFGYGNVAANTIQSAVGQR

SEQ ID NO: 182211 - protein, 32 aa, Artificial Sequence
  Description of Artificial Sequence: Synthetic polypeptide
YETEIASVNPIATEQWGVTVSNAENWQSKGPI

SEQ ID NO: 182212 - protein, 33 aa, Artificial Sequence
  Description of Artificial Sequence: Synthetic polypeptide
YETEIATTNPICTEQWGATWSNAENLAEPKGNQ

SEQ ID NO: 182213 - protein, 36 aa, Artificial Sequence
  Description of Artificial Sequence: Synthetic polypeptide
DEEEIRTTNPVAYEQYGQYASVANQAASVREVEVEY

SEQ ID NO: 182214 - protein, 38 aa, Artificial Sequence
  Description of Artificial Sequence: Synthetic polypeptide
DEEEIATTNPVATEQYGSVCAMNNGNGEPGADIPNDAV

SEQ ID NO: 182215 - protein, 33 aa, Artificial Sequence
  Description of Artificial Sequence: Synthetic polypeptide
YETEIATTNPVATEQYGATWAAENWAEPKGPYI

SEQ ID NO: 182216 - protein, 37 aa, Artificial Sequence
  Description of Artificial Sequence: Synthetic polypeptide
DAEEIATTNPVATEQYGSVCSPVGDGNHNIDAMGEGA

SEQ ID NO: 182217 - protein, 38 aa, Artificial Sequence
  Description of Artificial Sequence: Synthetic polypeptide
DEEEIRTTNPVAYEQYGQVAVSFQMNDLLQPNAQFPKF

SEQ ID NO: 182218 - protein, 39 aa, Artificial Sequence
  Description of Artificial Sequence: Synthetic polypeptide
DEEEIRTTNPVAYEQYGQVAVSFQMNDLLQPNNGQSPYF

SEQ ID NO: 182219 - protein, 34 aa, Artificial Sequence
  Description of Artificial Sequence: Synthetic polypeptide
YETEIRTTNPIATEQWGATTWANAENLAEPKGNI

SEQ ID NO: 182220 - protein, 38 aa, Artificial Sequence
  Description of Artificial Sequence: Synthetic polypeptide
DEEEIRTTNPVAYEQYGQVAVSFQMEDLEQPNGQIPYF

SEQ ID NO: 182221 - protein, 33 aa, Artificial Sequence
  Description of Artificial Sequence: Synthetic polypeptide
YETEIRTTNPVATEQWGATWAAENWAEPKGPYI

SEQ ID NO: 182222 - protein, 37 aa, Artificial Sequence
  Description of Artificial Sequence: Synthetic polypeptide
YEVEIVTTNPVATEQYGSVDQDTNEGQNLDSNDGDQE

SEQ ID NO: 182223 - protein, 37 aa, Artificial Sequence
  Description of Artificial Sequence: Synthetic polypeptide
DAEEIATTNPVATEQYGSVCSPVDNNHNIDAMGEGAE

SEQ ID NO: 182224 - protein, 31 aa, Artificial Sequence
  Description of Artificial Sequence: Synthetic polypeptide
DDSEVASTNPVSYEGYGNVAANTDQSRVGQE

SEQ ID NO: 182225 - protein, 37 aa, Artificial Sequence
  Description of Artificial Sequence: Synthetic polypeptide
DEMAIATTNPVATEQYGCVCSTWGEHNEEHFGSENQS

SEQ ID NO: 182226 - protein, 38 aa, Artificial Sequence
  Description of Artificial Sequence: Synthetic polypeptide
DEEEIRTTNPVAYEQYGQVAVSFQMNDVLQPNPQIPYF

SEQ ID NO: 182227 - protein, 38 aa, Artificial Sequence
  Description of Artificial Sequence: Synthetic polypeptide
DEEEIRTTNPVAYEQYGQVAVSFQMSDLLQPNGQIHYF

SEQ ID NO: 182228 - protein, 32 aa, Artificial Sequence
  Description of Artificial Sequence: Synthetic polypeptide
YQECIRTTNPVATEHWGTYSSWNETEVPINKT

SEQ ID NO: 182229 - protein, 31 aa, Artificial Sequence
  Description of Artificial Sequence: Synthetic polypeptide
DDSEVASTNPVSYEGYGNVAANTIQSYVGQR

SEQ ID NO: 182230 - protein, 32 aa, Artificial Sequence
  Description of Artificial Sequence: Synthetic polypeptide
DDSEVASTNPVSYEPYGNVAANTISQSRTGQR

SEQ ID NO: 182231 - protein, 37 aa, Artificial Sequence
  Description of Artificial Sequence: Synthetic polypeptide
YEVEIRSTNPVATEQYGSVITDNNAGNDEGEGGNQGG

SEQ ID NO: 182232 - protein, 36 aa, Artificial Sequence
  Description of Artificial Sequence: Synthetic polypeptide
DAEEIATTNPVAYEQYGSVAAAPNGLATETNGGSVG

SEQ ID NO: 182233 - protein, 34 aa, Artificial Sequence
  Description of Artificial Sequence: Synthetic polypeptide
YETEIASTNPIATEQYGAVWANDENLQESKGPYQ

SEQ ID NO: 182234 - protein, 31 aa, Artificial Sequence
  Description of Artificial Sequence: Synthetic polypeptide
DDSEVASTNPVSYEAYGNVAACTIQSRVGQR

SEQ ID NO: 182235 - protein, 39 aa, Artificial Sequence
  Description of Artificial Sequence: Synthetic polypeptide
DEEEIRTTNPVATEGYGVVDVGLGTGNVGQEEGEGNTTE

SEQ ID NO: 182236 - protein, 32 aa, Artificial Sequence
  Description of Artificial Sequence: Synthetic polypeptide
DDSEVASTNPVSTFGYGNVAANTIQSRVGQTR

SEQ ID NO: 182237 - protein, 31 aa, Artificial Sequence
  Description of Artificial Sequence: Synthetic polypeptide
DDSEVASTNPVSTGGYGNVAANTIQSEVGQR

SEQ ID NO: 182238 - protein, 31 aa, Artificial Sequence
  Description of Artificial Sequence: Synthetic polypeptide
DDSEVASTNPVSTHGYGNVAANTIQSRVGQM

SEQ ID NO: 182239 - protein, 37 aa, Artificial Sequence
  Description of Artificial Sequence: Synthetic polypeptide
DEEEIRTTNPVATEQYGSVDQPIKGTEQPEMMEAEEN

SEQ ID NO: 182240 - protein, 37 aa, Artificial Sequence
  Description of Artificial Sequence: Synthetic polypeptide
DEEEIRTTNPVATEGYGVMGSNMDNGIGQIVGGGQTT

SEQ ID NO: 182241 - protein, 37 aa, Artificial Sequence
  Description of Artificial Sequence: Synthetic polypeptide
DEEEIRTTNPVATEGYGTIVDDLFTGDGEGQGEGEII

SEQ ID NO: 182242 - protein, 32 aa, Artificial Sequence
  Description of Artificial Sequence: Synthetic polypeptide
DDSEVASTNPVSTMGYGNVAANTDIQSRVGQR

SEQ ID NO: 182243 - protein, 32 aa, Artificial Sequence
  Description of Artificial Sequence: Synthetic polypeptide
DDSEVASTNPVSTMGYGNVAANTIQSRVGQRE

SEQ ID NO: 182244 - protein, 34 aa, Artificial Sequence
  Description of Artificial Sequence: Synthetic polypeptide
YETEIASTNPIATEQYGAVWANDENLQESKGPYI

SEQ ID NO: 182245 - protein, 37 aa, Artificial Sequence
  Description of Artificial Sequence: Synthetic polypeptide
DEEEIRTTNPVATEGYGSVVWDGDGEFNQEGGGDQEQ

SEQ ID NO: 182246 - protein, 32 aa, Artificial Sequence
  Description of Artificial Sequence: Synthetic polypeptide
DDSEVASTNPVSTNGYGNVAANTIQSRVGQRD

SEQ ID NO: 182247 - protein, 31 aa, Artificial Sequence
  Description of Artificial Sequence: Synthetic polypeptide
DDSEVASTNPVSTQGYGNVAANTIQSRVGQL

SEQ ID NO: 182248 - protein, 31 aa, Artificial Sequence
  Description of Artificial Sequence: Synthetic polypeptide
DDSEVASTNPVSTVGYGNVAANTIQSRVGQQ

SEQ ID NO: 182249 - protein, 38 aa, Artificial Sequence
  Description of Artificial Sequence: Synthetic polypeptide
DEEEIRTTNPVATEGYGSVSVVSAGFGTGQTDDDNNDT

SEQ ID NO: 182250 - protein, 38 aa, Artificial Sequence
  Description of Artificial Sequence: Synthetic polypeptide
DEEEIRTTNPVAYEQYGSTVCAVTEAGGAQASGGDMQM

SEQ ID NO: 182251 - protein, 32 aa, Artificial Sequence
  Description of Artificial Sequence: Synthetic polypeptide
DDSEVASTNPVSTVGYGNVAANTSIQSRVGQR

SEQ ID NO: 182252 - protein, 32 aa, Artificial Sequence
  Description of Artificial Sequence: Synthetic polypeptide
DDSEVASTNPVSWEGYGNVAANTIDQSRVGQR

SEQ ID NO: 182253 - protein, 39 aa, Artificial Sequence
  Description of Artificial Sequence: Synthetic polypeptide
DEEEIRTTNPVAYEQYGQVAHPSFQMNDALQPNGQIPYF

SEQ ID NO: 182254 - protein, 38 aa, Artificial Sequence
  Description of Artificial Sequence: Synthetic polypeptide
DEEEIRTTNPVAYEQYGQVAHSFQMNDLLQPNAQIEYF

SEQ ID NO: 182255 - protein, 31 aa, Artificial Sequence
  Description of Artificial Sequence: Synthetic polypeptide
QEGEIAPTNPCATEQWGAVAADWQESKGTYI

SEQ ID NO: 182256 - protein, 35 aa, Artificial Sequence
  Description of Artificial Sequence: Synthetic polypeptide
DEHEIRTTNPVAYEQWGCVAGIPNGNHQNTGDTDN

SEQ ID NO: 182257 - protein, 33 aa, Artificial Sequence
  Description of Artificial Sequence: Synthetic polypeptide
DDSEVASTNPVSTEGYGSVAANITIQSRVGEQG

SEQ ID NO: 182258 - protein, 33 aa, Artificial Sequence
  Description of Artificial Sequence: Synthetic polypeptide
DDSEVASTNPVSTEGYGRVAANVTVQSRVGSQR

SEQ ID NO: 182259 - protein, 33 aa, Artificial Sequence
  Description of Artificial Sequence: Synthetic polypeptide
DDSEVASTNPVSTEGYGNVCYNTDIQNRVGEQR

SEQ ID NO: 182260 - protein, 34 aa, Artificial Sequence
  Description of Artificial Sequence: Synthetic polypeptide
DDSEVASTNPVSTEGYGNVCYNTIDQDRHGGQNR

SEQ ID NO: 182261 - protein, 34 aa, Artificial Sequence
  Description of Artificial Sequence: Synthetic polypeptide
DDSEVASTNPVSTEGYGNVCYNTIDQDRVGQNRK

SEQ ID NO: 182262 - protein, 37 aa, Artificial Sequence
  Description of Artificial Sequence: Synthetic polypeptide
YEEEIRTTNPVATEQYGSVVYDGMFGQEGEQEEDDGQ

SEQ ID NO: 182263 - protein, 36 aa, Artificial Sequence
  Description of Artificial Sequence: Synthetic polypeptide
DEEEIRTTNPVATEGYGCVCFNWGEDHNTNFGSDQS

SEQ ID NO: 182264 - protein, 36 aa, Artificial Sequence
  Description of Artificial Sequence: Synthetic polypeptide
DEEEIRTTNPVATEGYGCVCFNWGEHNTNFISDTQS

SEQ ID NO: 182265 - protein, 32 aa, Artificial Sequence
  Description of Artificial Sequence: Synthetic polypeptide
DDSEVASTNPVSTEGYGNVCYNTINQSDVGQR

SEQ ID NO: 182266 - protein, 32 aa, Artificial Sequence
  Description of Artificial Sequence: Synthetic polypeptide
DDSEVASTNPVSTEGYGNVFAANTIESRVGQR

SEQ ID NO: 182267 - protein, 32 aa, Artificial Sequence
  Description of Artificial Sequence: Synthetic polypeptide
DDSEVASTNPVSTEGYGNVFAANTIQSRVGQI

SEQ ID NO: 182268 - protein, 32 aa, Artificial Sequence
  Description of Artificial Sequence: Synthetic polypeptide
DDSEVASTNPVSTEGYGNVGAANTQQSRVSQR

SEQ ID NO: 182269 - protein, 37 aa, Artificial Sequence
  Description of Artificial Sequence: Synthetic polypeptide
DEHEISTTNPVAYEQWGSVCSTFDDGERQQNGGGDDR

SEQ ID NO: 182270 - protein, 33 aa, Artificial Sequence
  Description of Artificial Sequence: Synthetic polypeptide
DDSEVASTNPVSTEGYGNVPAANTIQSRVGQRT

SEQ ID NO: 182271 - protein, 37 aa, Artificial Sequence
  Description of Artificial Sequence: Synthetic polypeptide
DEEEIRTTNPVATEGYGCVCFTWGEHNTENFNSDTQA

SEQ ID NO: 182272 - protein, 35 aa, Artificial Sequence
  Description of Artificial Sequence: Synthetic polypeptide
DEHEISTTNPVAYEQWGVVCSTDHEDQHQKGDSDK

SEQ ID NO: 182273 - protein, 33 aa, Artificial Sequence
  Description of Artificial Sequence: Synthetic polypeptide
DDSEVASTNPVSTEGYGNVSAANTGQSRVGMQV

SEQ ID NO: 182274 - protein, 33 aa, Artificial Sequence
  Description of Artificial Sequence: Synthetic polypeptide
DDSEVASTNPVSTEGYGNVSAANTIPSRVGLAR

SEQ ID NO: 182275 - protein, 32 aa, Artificial Sequence
  Description of Artificial Sequence: Synthetic polypeptide
DDSEVASTNPVSTEGYGNVSACITIQDRVGQG

SEQ ID NO: 182276 - protein, 37 aa, Artificial Sequence
  Description of Artificial Sequence: Synthetic polypeptide
DEEEIRTTNPVATEGYGCVCGNWGEHNTENFGSDNQS

SEQ ID NO: 182277 - protein, 37 aa, Artificial Sequence
  Description of Artificial Sequence: Synthetic polypeptide
DEEEIRTTNPVATEGYGCVCSMWGEHNAENFNSENQA

SEQ ID NO: 182278 - protein, 33 aa, Artificial Sequence
  Description of Artificial Sequence: Synthetic polypeptide
DDSEVASTNPVSTEGYGNVCYNTDINQSRGGQR

SEQ ID NO: 182279 - protein, 36 aa, Artificial Sequence
  Description of Artificial Sequence: Synthetic polypeptide
DEHEISTTNPVATEAWGISVRTWNDDQQDRRQKSEN

SEQ ID NO: 182280 - protein, 36 aa, Artificial Sequence
  Description of Artificial Sequence: Synthetic polypeptide
DEHEISTTNPCAYEEWGSVAWTWNDHQGDRQNGNAQ

SEQ ID NO: 182281 - protein, 34 aa, Artificial Sequence
  Description of Artificial Sequence: Synthetic polypeptide
AEAENATTNPVAYEQWGSVYGGLDDQPQGNQNGQ

SEQ ID NO: 182282 - protein, 35 aa, Artificial Sequence
  Description of Artificial Sequence: Synthetic polypeptide
AECEIATTNPVAYEEWGSVATVGGNTGNAGNDNQR

SEQ ID NO: 182283 - protein, 33 aa, Artificial Sequence
  Description of Artificial Sequence: Synthetic polypeptide
AECEIACTNPVAYEQWGEYYSIEHNDQRGPGES

SEQ ID NO: 182284 - protein, 31 aa, Artificial Sequence
  Description of Artificial Sequence: Synthetic polypeptide
DDSEVASTNPVSTEGYGNVANTEQDREGEQG

SEQ ID NO: 182285 - protein, 36 aa, Artificial Sequence
  Description of Artificial Sequence: Synthetic polypeptide
DEEEIRTTNPVATEFYGVVDGGMEQDEGDEDGGGEF

SEQ ID NO: 182286 - protein, 38 aa, Artificial Sequence
  Description of Artificial Sequence: Synthetic polypeptide
DEEEIRTTNPVATEFYGVVNMFGINNMDNQTGEFTNEG

SEQ ID NO: 182287 - protein, 30 aa, Artificial Sequence
  Description of Artificial Sequence: Synthetic polypeptide
DDSEVASTNPVSTEGYGNVANTIQSRVEQA

SEQ ID NO: 182288 - protein, 36 aa, Artificial Sequence
  Description of Artificial Sequence: Synthetic polypeptide
DAEEIATTNPVAYEQYGSVATPADITQGTHGDEAAP

SEQ ID NO: 182289 - protein, 37 aa, Artificial Sequence
  Description of Artificial Sequence: Synthetic polypeptide
YEEEIRTTNPVATEQYGDVVDFEMNEGNQGNFNNVAV

SEQ ID NO: 182290 - protein, 37 aa, Artificial Sequence
  Description of Artificial Sequence: Synthetic polypeptide
AEANEIATTNPVAYEQWGSVCSTDNGEDRAEGGNNGI

SEQ ID NO: 182291 - protein, 37 aa, Artificial Sequence
  Description of Artificial Sequence: Synthetic polypeptide
DEEEIRTTNPVATEGYGCVCSMWGEHNAENFNSENQS

SEQ ID NO: 182292 - protein, 32 aa, Artificial Sequence
  Description of Artificial Sequence: Synthetic polypeptide
DDSEVASTNPVSTEGYGNVAYNTIDQSGMGQR

SEQ ID NO: 182293 - protein, 37 aa, Artificial Sequence
  Description of Artificial Sequence: Synthetic polypeptide
DEEEIRTTNPVATEGWGCVTSTWGAHNAENFGSDPQA

SEQ ID NO: 182294 - protein, 33 aa, Artificial Sequence
  Description of Artificial Sequence: Synthetic polypeptide
DDSEVASTNPVSTEGYGNVCAANTEIQSRVGQR

SEQ ID NO: 182295 - protein, 32 aa, Artificial Sequence
  Description of Artificial Sequence: Synthetic polypeptide
DDSEVASTNPVSTEGYGNVCAANTIQSRVGQD

SEQ ID NO: 182296 - protein, 32 aa, Artificial Sequence
  Description of Artificial Sequence: Synthetic polypeptide
DDSEVASTNPVSTEGYGNVCAANTIQSRVPQR

SEQ ID NO: 182297 - protein, 32 aa, Artificial Sequence
  Description of Artificial Sequence: Synthetic polypeptide
DDSEVASTNPVSTEGYGNVCAANTPQSRVGQD

SEQ ID NO: 182298 - protein, 37 aa, Artificial Sequence
  Description of Artificial Sequence: Synthetic polypeptide
DEEEIRTTNPVATEGYGCSCSNWEEDNAEYFNSDTQA

SEQ ID NO: 182299 - protein, 37 aa, Artificial Sequence
  Description of Artificial Sequence: Synthetic polypeptide
DEEEIRTTNPVATEGYGCSCSNWGAHNAEYFNSDTQA

SEQ ID NO: 182300 - protein, 37 aa, Artificial Sequence
  Description of Artificial Sequence: Synthetic polypeptide
DEEEIRTTNPVATEGYGCSCSSGEPHNAENFNSDNQA

SEQ ID NO: 182301 - protein, 34 aa, Artificial Sequence
  Description of Artificial Sequence: Synthetic polypeptide
AEAENATTNPVAYEQWGSVYGGLDDQPQGSNGQM

SEQ ID NO: 182302 - protein, 37 aa, Artificial Sequence
  Description of Artificial Sequence: Synthetic polypeptide
DEEEIRTTNPVATEFYGYVVDNDQGTIQEEMGEDDEG

SEQ ID NO: 182303 - protein, 37 aa, Artificial Sequence
  Description of Artificial Sequence: Synthetic polypeptide
DEEEIRTTNPVATEGYGCVCSMWGEHNIENFNSDNQS

SEQ ID NO: 182304 - protein, 37 aa, Artificial Sequence
  Description of Artificial Sequence: Synthetic polypeptide
DEEEIRTTNPVATEGYGCVCSMWGEHNQENFNSENQS

SEQ ID NO: 182305 - protein, 37 aa, Artificial Sequence
  Description of Artificial Sequence: Synthetic polypeptide
AEAEIRTTNPVATEQYGCVCSNWMEHNQENFGSDNQS

SEQ ID NO: 182306 - protein, 38 aa, Artificial Sequence
  Description of Artificial Sequence: Synthetic polypeptide
DEEEIRTTNPVATEGYGCVCSNWGEDHNQEYFGSDNQS

SEQ ID NO: 182307 - protein, 31 aa, Artificial Sequence
  Description of Artificial Sequence: Synthetic polypeptide
ADSEIACTNPVSTEGYGNAAAETIQSRVGGR

SEQ ID NO: 182308 - protein, 37 aa, Artificial Sequence
  Description of Artificial Sequence: Synthetic polypeptide
DEEEIRTTNPVATEGYGCVCSNWGEHNEENFNSETQT

SEQ ID NO: 182309 - protein, 37 aa, Artificial Sequence
  Description of Artificial Sequence: Synthetic polypeptide
DEEEIRTTNPVATEGYGCVCSNWGEHNQENFNSDNQS

SEQ ID NO: 182310 - protein, 35 aa, Artificial Sequence
  Description of Artificial Sequence: Synthetic polypeptide
DEIAEIATTNPVATEPWGVVCFTNEDHQDLGGTSK

SEQ ID NO: 182311 - protein, 37 aa, Artificial Sequence
  Description of Artificial Sequence: Synthetic polypeptide
DEEEIRTTNPVATEGYGCVCSSGEDHNQENFNSDNQL

SEQ ID NO: 182312 - protein, 30 aa, Artificial Sequence
  Description of Artificial Sequence: Synthetic polypeptide
DDSEVASTNPVSTEGYGNVSNCIQSHVEEL

SEQ ID NO: 182313 - protein, 30 aa, Artificial Sequence
  Description of Artificial Sequence: Synthetic polypeptide
DDSEVASTNPVSTEGYGNVSNTIQSHVEEL

SEQ ID NO: 182314 - protein, 33 aa, Artificial Sequence
  Description of Artificial Sequence: Synthetic polypeptide
DDSEVASTNPVSTEGYGNVVAANTEIQSRVGQR

SEQ ID NO: 182315 - protein, 36 aa, Artificial Sequence
  Description of Artificial Sequence: Synthetic polypeptide
AEAAEIATTNPVAYEQWGSVYGGWNDDQPDQGNRGQ

SEQ ID NO: 182316 - protein, 36 aa, Artificial Sequence
  Description of Artificial Sequence: Synthetic polypeptide
DEIAEIATTNPVATEPWGVVCFTNEDRGDLGGNTSI

SEQ ID NO: 182317 - protein, 36 aa, Artificial Sequence
  Description of Artificial Sequence: Synthetic polypeptide
DEIAEIATTNPVATEPWGVVCFTNEDRTDLGGNHSD

SEQ ID NO: 182318 - protein, 36 aa, Artificial Sequence
  Description of Artificial Sequence: Synthetic polypeptide
DEIAEIATTNPVATEPWGVVCFTNEDWNDLGGNGSR

SEQ ID NO: 182319 - protein, 32 aa, Artificial Sequence
  Description of Artificial Sequence: Synthetic polypeptide
DDSEVASTNPVSTEGYGNVVAANTIQSRVGQP

SEQ ID NO: 182320 - protein, 33 aa, Artificial Sequence
  Description of Artificial Sequence: Synthetic polypeptide
DDSEVASTNPVSTEGYGNVWAANETIQSRVGPR

SEQ ID NO: 182321 - protein, 32 aa, Artificial Sequence
  Description of Artificial Sequence: Synthetic polypeptide
DDSEVASTNPVSTEGYGNVYANPTIQSTVGQR

SEQ ID NO: 182322 - protein, 37 aa, Artificial Sequence
  Description of Artificial Sequence: Synthetic polypeptide
DEEEIRTTNPVATEGYGCVCSWGEDHNEENFNSETQA

SEQ ID NO: 182323 - protein, 38 aa, Artificial Sequence
  Description of Artificial Sequence: Synthetic polypeptide
DEEEIRTTNPVATEGYGCVTSTWGADPNAENFGSDPQA

SEQ ID NO: 182324 - protein, 31 aa, Artificial Sequence
  Description of Artificial Sequence: Synthetic polypeptide
ADNEIACTNPVSTEGYGNAAAETIQSRVGGR

SEQ ID NO: 182325 - protein, 32 aa, Artificial Sequence
  Description of Artificial Sequence: Synthetic polypeptide
DDSEVASTNPVSTEGYGRVAANETIQVRVGQA

SEQ ID NO: 182326 - protein, 36 aa, Artificial Sequence
  Description of Artificial Sequence: Synthetic polypeptide
DEIAEIATTNPVATEPWGVVCFTNEDRQDVGGNTSP

SEQ ID NO: 182327 - protein, 37 aa, Artificial Sequence
  Description of Artificial Sequence: Synthetic polypeptide
DEEEIRTTNPVATEGYGICVCSTVEHNQENFISETQA

SEQ ID NO: 182328 - protein, 36 aa, Artificial Sequence
  Description of Artificial Sequence: Synthetic polypeptide
AEAAEIATTNPVAYEQYGTVATMNGGQQNGGQRGEA

SEQ ID NO: 182329 - protein, 38 aa, Artificial Sequence
  Description of Artificial Sequence: Synthetic polypeptide
DEEEIRTTNPVATEQYGSVCTPWPMVVGQQIQQTQEED

SEQ ID NO: 182330 - protein, 34 aa, Artificial Sequence
  Description of Artificial Sequence: Synthetic polypeptide
AEAEIRTTNPVATEQYGCVCQWAHIENFMSDTQA

SEQ ID NO: 182331 - protein, 36 aa, Artificial Sequence
  Description of Artificial Sequence: Synthetic polypeptide
AEAEIRTTNPVATEQYGCCVYPAPVIELQETSNEQM

SEQ ID NO: 182332 - protein, 35 aa, Artificial Sequence
  Description of Artificial Sequence: Synthetic polypeptide
AEAEICTTNPVAYEQWGSVCSGEGNQATNGGNGMQ

SEQ ID NO: 182333 - protein, 34 aa, Artificial Sequence
  Description of Artificial Sequence: Synthetic polypeptide
AEAEIATTNPVAYGAYGQTVPSCELSQKGTNNQI

SEQ ID NO: 182334 - protein, 35 aa, Artificial Sequence
  Description of Artificial Sequence: Synthetic polypeptide
AEAEIATTNPVAYEQWGSVYGGWNDDQPQGNNGQA

SEQ ID NO: 182335 - protein, 35 aa, Artificial Sequence
  Description of Artificial Sequence: Synthetic polypeptide
AEAEIATTNPVAYEQWGSVYGGWNDDQPNQNNRGQ

SEQ ID NO: 182336 - protein, 35 aa, Artificial Sequence
  Description of Artificial Sequence: Synthetic polypeptide
AEAEIATTNPVAYEQWGSVYGGWNDDQPNQGNNGG

SEQ ID NO: 182337 - protein, 36 aa, Artificial Sequence
  Description of Artificial Sequence: Synthetic polypeptide
AEAEIATTNPVAYEQWGSVYGGWNDDDQPKQGNRGQ

SEQ ID NO: 182338 - protein, 35 aa, Artificial Sequence
  Description of Artificial Sequence: Synthetic polypeptide
AEAEIATTNPVAYEQWGSVYGGINDDQPQGNKNGQ

SEQ ID NO: 182339 - protein, 37 aa, Artificial Sequence
  Description of Artificial Sequence: Synthetic polypeptide
DEEEIATTNPVATEQYGSVCAMTVAGTADDPLHENSH

SEQ ID NO: 182340 - protein, 34 aa, Artificial Sequence
  Description of Artificial Sequence: Synthetic polypeptide
AEAEIATTNPVAYEPWGSVYGGWNDDQPQGRNGQ

SEQ ID NO: 182341 - protein, 35 aa, Artificial Sequence
  Description of Artificial Sequence: Synthetic polypeptide
AEAEIATTNPVATECWGMHCWTMNEQQRGQDNHDD

SEQ ID NO: 182342 - protein, 37 aa, Artificial Sequence
  Description of Artificial Sequence: Synthetic polypeptide
DEEEIRTTNPVATEGYGCVCSNWEDHNQENFGSDTQS

SEQ ID NO: 182343 - protein, 37 aa, Artificial Sequence
  Description of Artificial Sequence: Synthetic polypeptide
DEEEIRTTNPVATEGYGCVCSNWEEHNQENFNSDTQA

SEQ ID NO: 182344 - protein, 37 aa, Artificial Sequence
  Description of Artificial Sequence: Synthetic polypeptide
DEEEIRTTNPVATEGYGCVCSNWEEHNQENFNSDTQS

SEQ ID NO: 182345 - protein, 37 aa, Artificial Sequence
  Description of Artificial Sequence: Synthetic polypeptide
DEEEIRTTNPVATEGYGCVCSNWGEDHEQNFNSETQN

SEQ ID NO: 182346 - protein, 36 aa, Artificial Sequence
  Description of Artificial Sequence: Synthetic polypeptide
DEHELATTNPVAYEQWGSVCSTQDRQNEDTGQKGDQ

SEQ ID NO: 182347 - protein, 34 aa, Artificial Sequence
  Description of Artificial Sequence: Synthetic polypeptide
AEAEIACTNPVATEQYGCSCSWGEHNQYFGSEQA

SEQ ID NO: 182348 - protein, 32 aa, Artificial Sequence
  Description of Artificial Sequence: Synthetic polypeptide
DDSEVASTNPVSTEGYGNVSATDLEDHEGEDL

SEQ ID NO: 182349 - protein, 35 aa, Artificial Sequence
  Description of Artificial Sequence: Synthetic polypeptide
DEHENATTNPVAYEQWGSVTGGNGGNQGAGQNGML

SEQ ID NO: 182350 - protein, 35 aa, Artificial Sequence
  Description of Artificial Sequence: Synthetic polypeptide
AEAEIATTNPVATEGYGCVCSWELNQEHFISENLA

SEQ ID NO: 182351 - protein, 37 aa, Artificial Sequence
  Description of Artificial Sequence: Synthetic polypeptide
AEDEICATNPVATEQYGVVSTTNQNLNQQLQGTDEDD

SEQ ID NO: 182352 - protein, 32 aa, Artificial Sequence
  Description of Artificial Sequence: Synthetic polypeptide
DDSEVASTNPVSTEGYGNVAANTINSRVGQVR

SEQ ID NO: 182353 - protein, 36 aa, Artificial Sequence
  Description of Artificial Sequence: Synthetic polypeptide
DEHEIRTTNPVAYEPWGSVSGEGNGNHGNNGKNGNQ

SEQ ID NO: 182354 - protein, 35 aa, Artificial Sequence
  Description of Artificial Sequence: Synthetic polypeptide
DCEEIRATNPVAYEQWGSSYYDEHMHQLREGQNDT

SEQ ID NO: 182355 - protein, 39 aa, Artificial Sequence
  Description of Artificial Sequence: Synthetic polypeptide
DEEEIRTTNPVATEQYGVVSTVVATQQAGQQGTTETGSE

SEQ ID NO: 182356 - protein, 36 aa, Artificial Sequence
  Description of Artificial Sequence: Synthetic polypeptide
AEECISTTNPVATEQYGCVCSTWEHNIENFGSDTQS

SEQ ID NO: 182357 - protein, 36 aa, Artificial Sequence
  Description of Artificial Sequence: Synthetic polypeptide
AEECISTTNPVATEQYGCVCSNWGEHNQSFGSDNQS

SEQ ID NO: 182358 - protein, 29 aa, Artificial Sequence
  Description of Artificial Sequence: Synthetic peptide
DDSEVASTNPVSTEGYGNAAAETIQREEK

SEQ ID NO: 182359 - protein, 36 aa, Artificial Sequence
  Description of Artificial Sequence: Synthetic polypeptide
QEGEIATTNPVATEQYGSVCANMNNEEAPDNQEGSH

SEQ ID NO: 182360 - protein, 37 aa, Artificial Sequence
  Description of Artificial Sequence: Synthetic polypeptide
QEGEIATTNPVATEQYGSISFSLPDTLREPHEGEDKR

SEQ ID NO: 182361 - protein, 37 aa, Artificial Sequence
  Description of Artificial Sequence: Synthetic polypeptide
QEGEIATTNPVATEQYGSISFSIPDTLREPQEGEDTR

SEQ ID NO: 182362 - protein, 35 aa, Artificial Sequence
  Description of Artificial Sequence: Synthetic polypeptide
DEEEIATTNPVAYEQWGSICAAANGLQDSAEVDDS

SEQ ID NO: 182363 - protein, 34 aa, Artificial Sequence
  Description of Artificial Sequence: Synthetic polypeptide
DEEEIATTNPVAYEQWGSICAAANGDQSEHQPDS

SEQ ID NO: 182364 - protein, 39 aa, Artificial Sequence
  Description of Artificial Sequence: Synthetic polypeptide
DEEEIRTTNPVATEQYGVVSTVVATNNTEQGTEEEEEED

SEQ ID NO: 182365 - protein, 29 aa, Artificial Sequence
  Description of Artificial Sequence: Synthetic peptide
DDSEVASTNPVSTEGYGNAAAEVIQREEK

SEQ ID NO: 182366 - protein, 36 aa, Artificial Sequence
  Description of Artificial Sequence: Synthetic polypeptide
DEEEIRTTNPVATEQYGCFCSWGEDHNQYFDSDTQS

SEQ ID NO: 182367 - protein, 39 aa, Artificial Sequence
  Description of Artificial Sequence: Synthetic polypeptide
DEEEIRTTNPVATEAYGVVSTTVVVDQQGNSEQGTVATE

SEQ ID NO: 182368 - protein, 32 aa, Artificial Sequence
  Description of Artificial Sequence: Synthetic polypeptide
DDSEVASTNPVSTEGYGNAAANTIQSRVGQLR

SEQ ID NO: 182369 - protein, 39 aa, Artificial Sequence
  Description of Artificial Sequence: Synthetic polypeptide
DEEEIRTTNPVATEAYGVVSTVIGNTEQGSTNDEQNTED

SEQ ID NO: 182370 - protein, 31 aa, Artificial Sequence
  Description of Artificial Sequence: Synthetic polypeptide
DDSEVASTNPVSTEGYGNCAANAIQSHVGQR

SEQ ID NO: 182371 - protein, 39 aa, Artificial Sequence
  Description of Artificial Sequence: Synthetic polypeptide
DEEEIRTTNPVATEAYGVVSTVIGTTEQGSTNDEENNVD

SEQ ID NO: 182372 - protein, 31 aa, Artificial Sequence
  Description of Artificial Sequence: Synthetic polypeptide
DDSEVASTNPVSTEGYGNCAANTIGSRVGQR

SEQ ID NO: 182373 - protein, 35 aa, Artificial Sequence
  Description of Artificial Sequence: Synthetic polypeptide
AEECISTTNPVATEQYGCVCSWMEHNQHFNSDTQS

SEQ ID NO: 182374 - protein, 34 aa, Artificial Sequence
  Description of Artificial Sequence: Synthetic polypeptide
DCEEIRATNPVAYEQWGSSYYDEHMHQRPNDNKN

SEQ ID NO: 182375 - protein, 36 aa, Artificial Sequence
  Description of Artificial Sequence: Synthetic polypeptide
AEECISTTNPVATEQYGCVCSWNEHNQENFGSDTQS

SEQ ID NO: 182376 - protein, 32 aa, Artificial Sequence
  Description of Artificial Sequence: Synthetic polypeptide
DDSEVASTNPVSTEGYGMVAANTIQESRVGLS

SEQ ID NO: 182377 - protein, 38 aa, Artificial Sequence
  Description of Artificial Sequence: Synthetic polypeptide
DEEEIRTTNPVATEQYGCSCSMWEEDDNQENIGSDTQG

SEQ ID NO: 182378 - protein, 33 aa, Artificial Sequence
  Description of Artificial Sequence: Synthetic polypeptide
DDSEVASTNPVSTEGYGCVTANWEIQERSGSQR

SEQ ID NO: 182379 - protein, 33 aa, Artificial Sequence
  Description of Artificial Sequence: Synthetic polypeptide
DDSEVASTNPVSTEGYGCVTETWTIQERFGSQR

SEQ ID NO: 182380 - protein, 37 aa, Artificial Sequence
  Description of Artificial Sequence: Synthetic polypeptide
DCEEIRGTNPVATEQYGSSSLAPALIAQQEISPESNG

SEQ ID NO: 182381 - protein, 31 aa, Artificial Sequence
  Description of Artificial Sequence: Synthetic polypeptide
DDSEVASTNPVSTEGYGDVAANIIQSAAGDA

SEQ ID NO: 182382 - protein, 31 aa, Artificial Sequence
  Description of Artificial Sequence: Synthetic polypeptide
DDSEVASTNPVSTEGYGDVAANIIQSAAGQA

SEQ ID NO: 182383 - protein, 39 aa, Artificial Sequence
  Description of Artificial Sequence: Synthetic polypeptide
DEEEIRTTNPVATEAYGVVSTTNQQNQANTTEQGTVVTD

SEQ ID NO: 182384 - protein, 38 aa, Artificial Sequence
  Description of Artificial Sequence: Synthetic polypeptide
DEEEIATTNPVAYEQWGSVSGGLPAEGGNMRNGMGDVN

SEQ ID NO: 182385 - protein, 37 aa, Artificial Sequence
  Description of Artificial Sequence: Synthetic polypeptide
VEEEIRTTNPVATEQYGSVSLSPWLEMVSMTPEEQLM

SEQ ID NO: 182386 - protein, 35 aa, Artificial Sequence
  Description of Artificial Sequence: Synthetic polypeptide
DCEEIATTNPVAYEQWGSVCSNWEHDGEQDMEHNP

SEQ ID NO: 182387 - protein, 38 aa, Artificial Sequence
  Description of Artificial Sequence: Synthetic polypeptide
DEEEIRTTNPVATEQYGCQVCSNWGEHNQENFNSDNQS

SEQ ID NO: 182388 - protein, 36 aa, Artificial Sequence
  Description of Artificial Sequence: Synthetic polypeptide
DCEEIRATNPVAYEQWGSSYYRTPEVGDQRQGKNDT

SEQ ID NO: 182389 - protein, 35 aa, Artificial Sequence
  Description of Artificial Sequence: Synthetic polypeptide
AEECISTTNPVATEQYGQCVCSWGEHNQSFGSDQS

SEQ ID NO: 182390 - protein, 35 aa, Artificial Sequence
  Description of Artificial Sequence: Synthetic polypeptide
AEECISTTNPVATEQYGQCVCSWEHNQHFGSDTQS

SEQ ID NO: 182391 - protein, 34 aa, Artificial Sequence
  Description of Artificial Sequence: Synthetic polypeptide
DCEEIRATNPVAYEQWGSSYYPDEHMHQREDNVE

SEQ ID NO: 182392 - protein, 34 aa, Artificial Sequence
  Description of Artificial Sequence: Synthetic polypeptide
DCEEIRATNPVAYEQWGSSYYPDEHMHQKQGQNK

SEQ ID NO: 182393 - protein, 33 aa, Artificial Sequence
  Description of Artificial Sequence: Synthetic polypeptide
DDSEVASTNPVSTEGYGIVAANTIQSRVGQQRF

SEQ ID NO: 182394 - protein, 38 aa, Artificial Sequence
  Description of Artificial Sequence: Synthetic polypeptide
DEEEIRTTNPVATEAYGVVSTTTNANNDEQGTTDEEED

SEQ ID NO: 182395 - protein, 37 aa, Artificial Sequence
  Description of Artificial Sequence: Synthetic polypeptide
DEEEIRTTNPVAYEQYGQCVCSWEDDNQENFNSDNQF

SEQ ID NO: 182396 - protein, 34 aa, Artificial Sequence
  Description of Artificial Sequence: Synthetic polypeptide
DCEEIRATNPVAYEQWGSSYYPDEHMHMRQGQNV

SEQ ID NO: 182397 - protein, 38 aa, Artificial Sequence
  Description of Artificial Sequence: Synthetic polypeptide
DEEEIRTTNPVATEQYGCQVCSNWGEDHNQENFNSDQS

SEQ ID NO: 182398 - protein, 32 aa, Artificial Sequence
  Description of Artificial Sequence: Synthetic polypeptide
DDSEVASTNPVSTEGYGNCAENTIQSRPGERN

SEQ ID NO: 182399 - protein, 32 aa, Artificial Sequence
  Description of Artificial Sequence: Synthetic polypeptide
DDSEVASTNPVSTEGYGNCVAANTIQSRVGQI

SEQ ID NO: 182400 - protein, 35 aa, Artificial Sequence
  Description of Artificial Sequence: Synthetic polypeptide
DEEEIATTNPVAYEQWGSFACAAANGLDSAEGDDS

SEQ ID NO: 182401 - protein, 33 aa, Artificial Sequence
  Description of Artificial Sequence: Synthetic polypeptide
DDSEVASTNPVSTEGYGNVAAANTVQARVGQRI

SEQ ID NO: 182402 - protein, 34 aa, Artificial Sequence
  Description of Artificial Sequence: Synthetic polypeptide
QEGEIATTNPVATAQWGSVSATGAGGTAPQDAEF

SEQ ID NO: 182403 - protein, 36 aa, Artificial Sequence
  Description of Artificial Sequence: Synthetic polypeptide
QEGEIATTNPVASEQYGSVSSTTPAGPNMRNGMTPV

SEQ ID NO: 182404 - protein, 37 aa, Artificial Sequence
  Description of Artificial Sequence: Synthetic polypeptide
DEEEIRTTNPVSTEQYGSVNLPWNNEGQIQQAMQPQI

SEQ ID NO: 182405 - protein, 40 aa, Artificial Sequence
  Description of Artificial Sequence: Synthetic polypeptide
DEEEIRTTNPVATEQYGVVSTVTQNNQQSATNEEGVTQQQ

SEQ ID NO: 182406 - protein, 35 aa, Artificial Sequence
  Description of Artificial Sequence: Synthetic polypeptide
DEEEIATTNPVAYEQWGHNNVYYWEEQQHRPTGEE

SEQ ID NO: 182407 - protein, 37 aa, Artificial Sequence
  Description of Artificial Sequence: Synthetic polypeptide
DAVEIATTNPVATEQYGSACAATNPQEAGDSLMGNGM

SEQ ID NO: 182408 - protein, 32 aa, Artificial Sequence
  Description of Artificial Sequence: Synthetic polypeptide
DDSEVASTNPVSTEGYGNVAADTIQSRVGIQR

SEQ ID NO: 182409 - protein, 35 aa, Artificial Sequence
  Description of Artificial Sequence: Synthetic polypeptide
DATEIATTNPVAYEQWGSARCTENQDQDPLHGDQR

SEQ ID NO: 182410 - protein, 31 aa, Artificial Sequence
  Description of Artificial Sequence: Synthetic polypeptide
DDSEVASTNPVSTEGYGNTAANTIQSDVGQR

SEQ ID NO: 182411 - protein, 35 aa, Artificial Sequence
  Description of Artificial Sequence: Synthetic polypeptide
QEGEIATTNPIATEQYGATVWSNCEDLQEPKGTYI

SEQ ID NO: 182412 - protein, 37 aa, Artificial Sequence
  Description of Artificial Sequence: Synthetic polypeptide
DEEEIATTNPVAYEQWGEVCSTPNQGNHGEAGNDGTN

SEQ ID NO: 182413 - protein, 37 aa, Artificial Sequence
  Description of Artificial Sequence: Synthetic polypeptide
DEEEIRTTNPVATEQYGAVVYDGMFGQTGEQEEDQDG

SEQ ID NO: 182414 - protein, 35 aa, Artificial Sequence
  Description of Artificial Sequence: Synthetic polypeptide
DATEIATTNPVAYEQWGSARCTENNDQDDLHNAMR

SEQ ID NO: 182415 - protein, 35 aa, Artificial Sequence
  Description of Artificial Sequence: Synthetic polypeptide
DATEIATTNPVAYEQWGSARCTENKDQDDGHGDLR

SEQ ID NO: 182416 - protein, 35 aa, Artificial Sequence
  Description of Artificial Sequence: Synthetic polypeptide
DATEIATTNPVAYEQWGSAACTENKDQDDLGGDGR

SEQ ID NO: 182417 - protein, 37 aa, Artificial Sequence
  Description of Artificial Sequence: Synthetic polypeptide
DEEEIRTTNPVATEQYGAVVVNGFGQGQQDTDQTTGF

SEQ ID NO: 182418 - protein, 32 aa, Artificial Sequence
  Description of Artificial Sequence: Synthetic polypeptide
DDSEVASTNPVSTEGYGNVAADTIQSRVGQSR

SEQ ID NO: 182419 - protein, 31 aa, Artificial Sequence
  Description of Artificial Sequence: Synthetic polypeptide
DDSEVASTNPVSTEGYGNVAAETIMSRVGQA

SEQ ID NO: 182420 - protein, 31 aa, Artificial Sequence
  Description of Artificial Sequence: Synthetic polypeptide
DDSEVASTNPVSTEGYGNVAAETIQSAAGQR

SEQ ID NO: 182421 - protein, 35 aa, Artificial Sequence
  Description of Artificial Sequence: Synthetic polypeptide
AEECIATTNPVATEQYGCVCSWEDHNQENFNSDQS

SEQ ID NO: 182422 - protein, 33 aa, Artificial Sequence
  Description of Artificial Sequence: Synthetic polypeptide
DDSEVASTNPVSTEGYGCVQTWTIQERFGSQRG

SEQ ID NO: 182423 - protein, 39 aa, Artificial Sequence
  Description of Artificial Sequence: Synthetic polypeptide
DEEEIRTTNPVATEQYGCAVCSNWGEDDNTENFNSENQS

SEQ ID NO: 182424 - protein, 37 aa, Artificial Sequence
  Description of Artificial Sequence: Synthetic polypeptide
DAVEIATTNPVAYEQWGSNCASTTEGLPEARGGENRD

SEQ ID NO: 182425 - protein, 39 aa, Artificial Sequence
  Description of Artificial Sequence: Synthetic polypeptide
DEEEIRTTNPVATEQYGCAVCSTWGEDHNTENFNSENQF

SEQ ID NO: 182426 - protein, 37 aa, Artificial Sequence
  Description of Artificial Sequence: Synthetic polypeptide
DEEEIATTNPVAYEQWGSACSAANPGPLDSMIGNDNT

SEQ ID NO: 182427 - protein, 39 aa, Artificial Sequence
  Description of Artificial Sequence: Synthetic polypeptide
VEEEIRTTNPVATEQYGSVVNNVTMDGTNEFTDGEQENG

SEQ ID NO: 182428 - protein, 35 aa, Artificial Sequence
  Description of Artificial Sequence: Synthetic polypeptide
DEEEIATTNPVAYEQWGSACAANGPMQAHEMGSDD

SEQ ID NO: 182429 - protein, 32 aa, Artificial Sequence
  Description of Artificial Sequence: Synthetic polypeptide
QEGEIATTNPVATEQYGEAAEPEVCQPHQEKM

SEQ ID NO: 182430 - protein, 32 aa, Artificial Sequence
  Description of Artificial Sequence: Synthetic polypeptide
DDSEVASTNPVSTEGYGNIAANTSIQSRVGQR

SEQ ID NO: 182431 - protein, 38 aa, Artificial Sequence
  Description of Artificial Sequence: Synthetic polypeptide
VEEEIRTTNPVATEQYGSVVYDGPNNEQENEMGEGGGN

SEQ ID NO: 182432 - protein, 38 aa, Artificial Sequence
  Description of Artificial Sequence: Synthetic polypeptide
VEEEIRTTNPVATEQYGSVVYDGQDNVQENENGEGGGN

SEQ ID NO: 182433 - protein, 38 aa, Artificial Sequence
  Description of Artificial Sequence: Synthetic polypeptide
VEEEIRTTNPVATEQYGSVVYDGTDQEQENETGEGGGN

SEQ ID NO: 182434 - protein, 37 aa, Artificial Sequence
  Description of Artificial Sequence: Synthetic polypeptide
VEEEIRTTNPVATEQYGVVVSNGFIGQQEEGQEEGGN

SEQ ID NO: 182435 - protein, 39 aa, Artificial Sequence
  Description of Artificial Sequence: Synthetic polypeptide
VEEEIRTTNPVATEQYGSVVYDQTDNPEQENEMGEGGGQ

SEQ ID NO: 182436 - protein, 35 aa, Artificial Sequence
  Description of Artificial Sequence: Synthetic polypeptide
DCEEIAATNPVAYEQWGSSYYRTPEHMAQRGTNMF

SEQ ID NO: 182437 - protein, 37 aa, Artificial Sequence
  Description of Artificial Sequence: Synthetic polypeptide
VEEEIRTTNPVATEQYGSYSSPSTAEPMSPVGHFPVI

SEQ ID NO: 182438 - protein, 37 aa, Artificial Sequence
  Description of Artificial Sequence: Synthetic polypeptide
DEEEIRTTNPVAYEQYGQCVCSWGEDEQENFNSETQA

SEQ ID NO: 182439 - protein, 38 aa, Artificial Sequence
  Description of Artificial Sequence: Synthetic polypeptide
DEEEIRTTNPVAYEQYGQCVCSWGEDHNQEYFGSQNQA

SEQ ID NO: 182440 - protein, 38 aa, Artificial Sequence
  Description of Artificial Sequence: Synthetic polypeptide
DEEEIRTTNPVATEQYGCAVCSNWGEDHDQENFNSNQL

SEQ ID NO: 182441 - protein, 31 aa, Artificial Sequence
  Description of Artificial Sequence: Synthetic polypeptide
DDSEVASTNPVSTEGYGNIAAPTIQSRVGQR

SEQ ID NO: 182442 - protein, 34 aa, Artificial Sequence
  Description of Artificial Sequence: Synthetic polypeptide
DEEEIATTNPVAYEQWGSACAAANGLLDSEQDDS

SEQ ID NO: 182443 - protein, 34 aa, Artificial Sequence
  Description of Artificial Sequence: Synthetic polypeptide
DEEEIATTNPVAYEQWGSACAAANGLDSAEVFDS

SEQ ID NO: 182444 - protein, 36 aa, Artificial Sequence
  Description of Artificial Sequence: Synthetic polypeptide
DAVEIATTNPVAYEQYGSVCAINNGEEAPDNQEGNH

SEQ ID NO: 182445 - protein, 37 aa, Artificial Sequence
  Description of Artificial Sequence: Synthetic polypeptide
VEEEIRTTNPVATEQYGSYCADTVIEVAERNQLGDID

SEQ ID NO: 182446 - protein, 31 aa, Artificial Sequence
  Description of Artificial Sequence: Synthetic polypeptide
DDSEVASTNPVSTEGYGNVAAETIQSAVGQR

SEQ ID NO: 182447 - protein, 37 aa, Artificial Sequence
  Description of Artificial Sequence: Synthetic polypeptide
DCEEIRGTNPVATEQYGSSSLHPAYNAQQEISPESNG

SEQ ID NO: 182448 - protein, 32 aa, Artificial Sequence
  Description of Artificial Sequence: Synthetic polypeptide
DDSEVASTNPVSTEGYGCVGTSTIQNRFGSQQ

SEQ ID NO: 182449 - protein, 32 aa, Artificial Sequence
  Description of Artificial Sequence: Synthetic polypeptide
DDSEVASTNPVSTEGYGCVANWTDQERSGSQR

SEQ ID NO: 182450 - protein, 38 aa, Artificial Sequence
  Description of Artificial Sequence: Synthetic polypeptide
VEEEIRTTNPVATDQYGSVNMNLIDQNQLQEENGQAED

SEQ ID NO: 182451 - protein, 39 aa, Artificial Sequence
  Description of Artificial Sequence: Synthetic polypeptide
VEEEIRTTNPVATDQYGSVNMNLIMQNDLQGEENGQAEG

SEQ ID NO: 182452 - protein, 38 aa, Artificial Sequence
  Description of Artificial Sequence: Synthetic polypeptide
VEEEIRTTNPVATDQYGSVNMNLIMQNDQQDDEGQTEQ

SEQ ID NO: 182453 - protein, 38 aa, Artificial Sequence
  Description of Artificial Sequence: Synthetic polypeptide
VEEEIRTTNPVATDQYGSVNMNLIMQNDVQIDNGQTEQ

SEQ ID NO: 182454 - protein, 38 aa, Artificial Sequence
  Description of Artificial Sequence: Synthetic polypeptide
VEEEIRTTNPVATDQYGSVNMNLIMQNPDILDNGQTEQ

SEQ ID NO: 182455 - protein, 39 aa, Artificial Sequence
  Description of Artificial Sequence: Synthetic polypeptide
VEEEIRTTNPVATDQYGSVNMNLIMQNQLGQEENGQEEG

SEQ ID NO: 182456 - protein, 37 aa, Artificial Sequence
  Description of Artificial Sequence: Synthetic polypeptide
VEEEIRTTNPVATDQYGVVNDNSIGQNQGQTDNNEDQ

SEQ ID NO: 182457 - protein, 36 aa, Artificial Sequence
  Description of Artificial Sequence: Synthetic polypeptide
VEEEIRTTNPVATDQYGVVVTDTGQQEVGQSEEDGE

SEQ ID NO: 182458 - protein, 37 aa, Artificial Sequence
  Description of Artificial Sequence: Synthetic polypeptide
VEEEIRTTNPVATDQYGVVVTDTGQQEVGQSEENEGS

SEQ ID NO: 182459 - protein, 36 aa, Artificial Sequence
  Description of Artificial Sequence: Synthetic polypeptide
AEEEIACTNPVATEQWGCVAIMTNLTNPDDGMGDRH

SEQ ID NO: 182460 - protein, 34 aa, Artificial Sequence
  Description of Artificial Sequence: Synthetic polypeptide
AEEEIACTNPVATEQWGCVAGTGQLDNPMGGALI

SEQ ID NO: 182461 - protein, 37 aa, Artificial Sequence
  Description of Artificial Sequence: Synthetic polypeptide
DEEEIRTTNPVATEQYGCTCSMWEEDNQENINSDTQG

SEQ ID NO: 182462 - protein, 37 aa, Artificial Sequence
  Description of Artificial Sequence: Synthetic polypeptide
DEEEIRTTNPVATEQYGCTCSMWEEDHNQEYIGSEQS

SEQ ID NO: 182463 - protein, 32 aa, Artificial Sequence
  Description of Artificial Sequence: Synthetic polypeptide
DDSEVASTNPVSTEGYGCVATWEIQERIGSQQ

SEQ ID NO: 182464 - protein, 38 aa, Artificial Sequence
  Description of Artificial Sequence: Synthetic polypeptide
DEEEIRTTNPVYTESGCGTSMVITTHEGLEFPRDNQRE

SEQ ID NO: 182465 - protein, 33 aa, Artificial Sequence
  Description of Artificial Sequence: Synthetic polypeptide
DDSEVASTNPVSTEGYGCVATWTDQERFGSQRA

SEQ ID NO: 182466 - protein, 38 aa, Artificial Sequence
  Description of Artificial Sequence: Synthetic polypeptide
VEEEIRTTNPVATEQWGYANVAPMFNELQHQRPGQGQV

SEQ ID NO: 182467 - protein, 37 aa, Artificial Sequence
  Description of Artificial Sequence: Synthetic polypeptide
VEEEIRTTNPVATEQYGAVITTTDGNGNDLEGEEEQV

SEQ ID NO: 182468 - protein, 38 aa, Artificial Sequence
  Description of Artificial Sequence: Synthetic polypeptide
VEEEIRTTNCVATEQYGVVVTGGEENLDQGQEGQTGEN

SEQ ID NO: 182469 - protein, 37 aa, Artificial Sequence
  Description of Artificial Sequence: Synthetic polypeptide
VEEEIRGTNPVATEQYGVVVNPGFGELDQQRGEMGDT

SEQ ID NO: 182470 - protein, 38 aa, Artificial Sequence
  Description of Artificial Sequence: Synthetic polypeptide
VEEEIRCTNPVATDQYGSVNMNLIMQNQGQEENGSAEG

SEQ ID NO: 182471 - protein, 31 aa, Artificial Sequence
  Description of Artificial Sequence: Synthetic polypeptide
DDSEVASTNPVSTEGYGCVADWTIQERFGQL

SEQ ID NO: 182472 - protein, 36 aa, Artificial Sequence
  Description of Artificial Sequence: Synthetic polypeptide
VEEEIATTNPVATEQWGSVSGEGGPLGINHDDLSAA

SEQ ID NO: 182473 - protein, 37 aa, Artificial Sequence
  Description of Artificial Sequence: Synthetic polypeptide
VEEEIATTNPVATEQWGSVSMSGDTPTNNDDGMGGQA

SEQ ID NO: 182474 - protein, 37 aa, Artificial Sequence
  Description of Artificial Sequence: Synthetic polypeptide
DEEEIRTTNPVATEQYGCVAAGCGELPAAAGSGIEHE

SEQ ID NO: 182475 - protein, 32 aa, Artificial Sequence
  Description of Artificial Sequence: Synthetic polypeptide
DDSEVASTNPVSTEGYGAVAANGTIQSGVGQR

SEQ ID NO: 182476 - protein, 36 aa, Artificial Sequence
  Description of Artificial Sequence: Synthetic polypeptide
VEEEIATTNPVATEQYGSVCAGMGPVEDNEMNENDN

SEQ ID NO: 182477 - protein, 35 aa, Artificial Sequence
  Description of Artificial Sequence: Synthetic polypeptide
DCEEISTTNPVAYEQWGSVCSNWEHGEQDMTHNPQ

SEQ ID NO: 182478 - protein, 36 aa, Artificial Sequence
  Description of Artificial Sequence: Synthetic polypeptide
VEEEIATTNPVATEQYGSVCAGVGGVLDNEMNENDN

SEQ ID NO: 182479 - protein, 38 aa, Artificial Sequence
  Description of Artificial Sequence: Synthetic polypeptide
VEEEIATTNPVATEQYGSVCAMNNGELTNPDDQMENPM

SEQ ID NO: 182480 - protein, 38 aa, Artificial Sequence
  Description of Artificial Sequence: Synthetic polypeptide
VEEEIATTNPVATEQYGSVCAMNNGEPTNPDDQGEGTM

SEQ ID NO: 182481 - protein, 37 aa, Artificial Sequence
  Description of Artificial Sequence: Synthetic polypeptide
VEEEIRTTNPVATEQYGAVQTTTDGNGNDLEDEFEEI

SEQ ID NO: 182482 - protein, 32 aa, Artificial Sequence
  Description of Artificial Sequence: Synthetic polypeptide
DDSEVASTNPVSTEGYGAVAANTDIESRVGER

SEQ ID NO: 182483 - protein, 36 aa, Artificial Sequence
  Description of Artificial Sequence: Synthetic polypeptide
VEEEIATTNPVAYEQWGSVSGGEPAGPNMRNGGGTS

SEQ ID NO: 182484 - protein, 36 aa, Artificial Sequence
  Description of Artificial Sequence: Synthetic polypeptide
VEEEIATTNPVAYEQWGTVSATPNPEPDTRGGPLMT

SEQ ID NO: 182485 - protein, 36 aa, Artificial Sequence
  Description of Artificial Sequence: Synthetic polypeptide
VEEEIATTNPVAYEQYGHLCACTYEQSQRPGTMPQR

SEQ ID NO: 182486 - protein, 37 aa, Artificial Sequence
  Description of Artificial Sequence: Synthetic polypeptide
DEEEIRTTNPVATEQYGCTCSWGEDHNQENFISDNQS

SEQ ID NO: 182487 - protein, 36 aa, Artificial Sequence
  Description of Artificial Sequence: Synthetic polypeptide
DEEEIRTVNPVATEAYGVVVNGTRGGQQEGQGEGET

SEQ ID NO: 182488 - protein, 38 aa, Artificial Sequence
  Description of Artificial Sequence: Synthetic polypeptide
DEEEIRTTNPVATEQYGCTCSTWGEDHNAENFNSDTQS

SEQ ID NO: 182489 - protein, 39 aa, Artificial Sequence
  Description of Artificial Sequence: Synthetic polypeptide
VEEEICTTNPVATEQYGSVSGNDTTNDGEGQNEEQDEDQ

SEQ ID NO: 182490 - protein, 36 aa, Artificial Sequence
  Description of Artificial Sequence: Synthetic polypeptide
QEGEIRTTNPVATEQYGCVYPDSNDDNQDEEGLEMP

SEQ ID NO: 182491 - protein, 36 aa, Artificial Sequence
  Description of Artificial Sequence: Synthetic polypeptide
VEEEIRATNPVATEQYGSVQVAVEEQIENTEEANDM

SEQ ID NO: 182492 - protein, 37 aa, Artificial Sequence
  Description of Artificial Sequence: Synthetic polypeptide
VEEEIATTNPVATEQYGSVCAMNNGLLEPPDDQANGA

SEQ ID NO: 182493 - protein, 37 aa, Artificial Sequence
  Description of Artificial Sequence: Synthetic polypeptide
DEEEIRTTNPVATEQYGCTAMPMTMPLVPSVTEINCN

SEQ ID NO: 182494 - protein, 36 aa, Artificial Sequence
  Description of Artificial Sequence: Synthetic polypeptide
VEEEIRTTNPVATEQYGAVVNGFGQGGQDDSETTGF

SEQ ID NO: 182495 - protein, 37 aa, Artificial Sequence
  Description of Artificial Sequence: Synthetic polypeptide
VEEEIRTTNPVATEQYGAVVTQTDGNGNDLEDEQEQV

SEQ ID NO: 182496 - protein, 37 aa, Artificial Sequence
  Description of Artificial Sequence: Synthetic polypeptide
DEEEIRTTNPVAYEQYGQCVCSNWMEDDNQGFGSDQA

SEQ ID NO: 182497 - protein, 37 aa, Artificial Sequence
  Description of Artificial Sequence: Synthetic polypeptide
DEEEIRTTNPVAYEQYGQCVCSNWMEDDNQSFNSDQS

SEQ ID NO: 182498 - protein, 37 aa, Artificial Sequence
  Description of Artificial Sequence: Synthetic polypeptide
VEEEIRTTNPVATEQYGSVINMDDFTGQGGTGEGDEQ

SEQ ID NO: 182499 - protein, 36 aa, Artificial Sequence
  Description of Artificial Sequence: Synthetic polypeptide
DEEEIRTTNPVAYEQYGQCVCSSGEDHIENFGSDQA

SEQ ID NO: 182500 - protein, 38 aa, Artificial Sequence
  Description of Artificial Sequence: Synthetic polypeptide
DEEEIRTTNPVAYEQYGQCVCSSGEDHNAENFGSENQS

SEQ ID NO: 182501 - protein, 32 aa, Artificial Sequence
  Description of Artificial Sequence: Synthetic polypeptide
DDSEVASTNPVSTEGYGCVCPTWTIQERIGQQ

SEQ ID NO: 182502 - protein, 38 aa, Artificial Sequence
  Description of Artificial Sequence: Synthetic polypeptide
VEEEIRTTNPVATEQYGSVMEDNVNGGNQQDEFEGGDG

SEQ ID NO: 182503 - protein, 38 aa, Artificial Sequence
  Description of Artificial Sequence: Synthetic polypeptide
VEEEIRTTNPVATEQYGSVMEMNVNGGNQQDEFTGIDG

SEQ ID NO: 182504 - protein, 38 aa, Artificial Sequence
  Description of Artificial Sequence: Synthetic polypeptide
VEEEIRTTNPVATEQYGSVMEMNVNGGNQQDEQEQTDG

SEQ ID NO: 182505 - protein, 38 aa, Artificial Sequence
  Description of Artificial Sequence: Synthetic polypeptide
DEEEIRTTNPVAYEQYGQCVCSNWGNDDNQSFNSDTQS

SEQ ID NO: 182506 - protein, 38 aa, Artificial Sequence
  Description of Artificial Sequence: Synthetic polypeptide
VEEEIRTTNPVATEQYGSVMVLGIADMTMEEIEQEGTP

SEQ ID NO: 182507 - protein, 38 aa, Artificial Sequence
  Description of Artificial Sequence: Synthetic polypeptide
VEEEIRTTNPVATEQYGSVNEASAAQQEQVMTLNPVDC

SEQ ID NO: 182508 - protein, 32 aa, Artificial Sequence
  Description of Artificial Sequence: Synthetic polypeptide
DDSEVASTNPVSTEGYGCVCQTWEDQERFGQQ

SEQ ID NO: 182509 - protein, 37 aa, Artificial Sequence
  Description of Artificial Sequence: Synthetic polypeptide
DEEEIRTTNPVAYEQYGQCVCSTEDHNQEYFISETQA

SEQ ID NO: 182510 - protein, 32 aa, Artificial Sequence
  Description of Artificial Sequence: Synthetic polypeptide
DDSEVASTNPVSTEGYGCVFAWTIQERSGSQR

SEQ ID NO: 182511 - protein, 32 aa, Artificial Sequence
  Description of Artificial Sequence: Synthetic polypeptide
DDSEVASTNPVSTEGYGCVGDWTIQERFGGQR

SEQ ID NO: 182512 - protein, 36 aa, Artificial Sequence
  Description of Artificial Sequence: Synthetic polypeptide
VEEEIRTTNPVATEQYGSVPPPLWLEEVPMTPLEFG

SEQ ID NO: 182513 - protein, 37 aa, Artificial Sequence
  Description of Artificial Sequence: Synthetic polypeptide
DEEEIRTTNPVATEQYGCSCSNWPEDHNQYFDSETQS

SEQ ID NO: 182514 - protein, 38 aa, Artificial Sequence
  Description of Artificial Sequence: Synthetic polypeptide
DEEEIRTTNPVATEQYGCSCSNWPEDHNQENFQSDTQS

SEQ ID NO: 182515 - protein, 37 aa, Artificial Sequence
  Description of Artificial Sequence: Synthetic polypeptide
DEEEIRTTNPVATEQYGCSCSNWPEDHNANFNSDTQS

SEQ ID NO: 182516 - protein, 38 aa, Artificial Sequence
  Description of Artificial Sequence: Synthetic polypeptide
VEEEIRTTNPVATEQYGSVNCASAFYQEQVMTLNPVDF

SEQ ID NO: 182517 - protein, 32 aa, Artificial Sequence
  Description of Artificial Sequence: Synthetic polypeptide
DDSEVASTNPVSTEGYGCVGTWTIQENFGSQR

SEQ ID NO: 182518 - protein, 38 aa, Artificial Sequence
  Description of Artificial Sequence: Synthetic polypeptide
DEEEIRTTNPVAYEQYGQCVCSNWGETNQENFNSETQA

SEQ ID NO: 182519 - protein, 34 aa, Artificial Sequence
  Description of Artificial Sequence: Synthetic polypeptide
DEEEIRTTNPVSYEAYGIVSTFKHETETEHQQTK

SEQ ID NO: 182520 - protein, 38 aa, Artificial Sequence
  Description of Artificial Sequence: Synthetic polypeptide
VEEEIRTTNPVATEQYGAVVTTITDGNGNDLEGEGEQV

SEQ ID NO: 182521 - protein, 37 aa, Artificial Sequence
  Description of Artificial Sequence: Synthetic polypeptide
VEEEIRTTNPVATEQYGAVVTTQDGNGNDDEDENEQV

SEQ ID NO: 182522 - protein, 38 aa, Artificial Sequence
  Description of Artificial Sequence: Synthetic polypeptide
VEEEIRTTNPVATEQYGAVVTTSTDGNGNDLEGEFEQE

SEQ ID NO: 182523 - protein, 37 aa, Artificial Sequence
  Description of Artificial Sequence: Synthetic polypeptide
VEEEIRTTNPVATEQYGAVVTTTDGNGNDLEDEVEQP

SEQ ID NO: 182524 - protein, 37 aa, Artificial Sequence
  Description of Artificial Sequence: Synthetic polypeptide
VEEEIRTTNPVATEQYGAVVVTTDGNGNDLEDEFEQI

SEQ ID NO: 182525 - protein, 37 aa, Artificial Sequence
  Description of Artificial Sequence: Synthetic polypeptide
DEEEIRTTNPVTTEHWGSVYCWEPNDQDDQRQGGDSM

SEQ ID NO: 182526 - protein, 37 aa, Artificial Sequence
  Description of Artificial Sequence: Synthetic polypeptide
DEEEIRTTNPVTTECWGSVYCWIPNDQDDQRNGGDSI

SEQ ID NO: 182527 - protein, 38 aa, Artificial Sequence
  Description of Artificial Sequence: Synthetic polypeptide
DEEEIRTTNPVAYEQYGQCVCSNWGEHNQEGFNSDNQG

SEQ ID NO: 182528 - protein, 38 aa, Artificial Sequence
  Description of Artificial Sequence: Synthetic polypeptide
DEEEIRTTNPVAYEQYGQCVCSNWGEHNQENFGSDNQD

SEQ ID NO: 182529 - protein, 37 aa, Artificial Sequence
  Description of Artificial Sequence: Synthetic polypeptide
VEEEIRTTNPVATEQYGSVCQVLEEHEGTDQGPPMQE

SEQ ID NO: 182530 - protein, 37 aa, Artificial Sequence
  Description of Artificial Sequence: Synthetic polypeptide
VEEEIRTTNPVATEQYGDVVNGFGTGQDQEGGDEQTC

SEQ ID NO: 182531 - protein, 37 aa, Artificial Sequence
  Description of Artificial Sequence: Synthetic polypeptide
VEEEIRTTNPVATEQYGDVVNMTMNQDEFDTGGGGET

SEQ ID NO: 182532 - protein, 37 aa, Artificial Sequence
  Description of Artificial Sequence: Synthetic polypeptide
DEEEIRTTNPVSYEQYGCVCGNWGEHNQEGFNSQTQS

SEQ ID NO: 182533 - protein, 36 aa, Artificial Sequence
  Description of Artificial Sequence: Synthetic polypeptide
DEEEIRTTNPVSYEQWGSCYTIDNHGQNGGGQTGKD

SEQ ID NO: 182534 - protein, 36 aa, Artificial Sequence
  Description of Artificial Sequence: Synthetic polypeptide
DEEEIRTTNPVSYEQWGSCYTIDNHGQNGGGKDGDS

SEQ ID NO: 182535 - protein, 37 aa, Artificial Sequence
  Description of Artificial Sequence: Synthetic polypeptide
VEEEIRTTNPVATEQYGQVVDDFENVEQNQGGGEETP

SEQ ID NO: 182536 - protein, 37 aa, Artificial Sequence
  Description of Artificial Sequence: Synthetic polypeptide
VEEEIRTTNPVATEQYGSAVCPWMNITEVPINNNDIS

SEQ ID NO: 182537 - protein, 39 aa, Artificial Sequence
  Description of Artificial Sequence: Synthetic polypeptide
VEEEIRTTNPVATEQYGSFVINSTMNEGFEPIQGELEAF

SEQ ID NO: 182538 - protein, 37 aa, Artificial Sequence
  Description of Artificial Sequence: Synthetic polypeptide
DEEEIRTTNPVAYEQYGQCVCSNWGEHNQNFFSENQA

SEQ ID NO: 182539 - protein, 33 aa, Artificial Sequence
  Description of Artificial Sequence: Synthetic polypeptide
DEEEIRTTNPVSYEAYGMVRTFVHETETEQQTK

SEQ ID NO: 182540 - protein, 37 aa, Artificial Sequence
  Description of Artificial Sequence: Synthetic polypeptide
VEEEIRTTNPVATEQYGDVVNGFGTQQDQNEGGDEQT

SEQ ID NO: 182541 - protein, 36 aa, Artificial Sequence
  Description of Artificial Sequence: Synthetic polypeptide
VEEEIATTNPVATEQWGGCCTAAAGNLDDGMPHNHQ

SEQ ID NO: 182542 - protein, 32 aa, Artificial Sequence
  Description of Artificial Sequence: Synthetic polypeptide
VEGEIACTNPVATEQWGCVAGTGLIDNMMTDD

SEQ ID NO: 182543 - protein, 37 aa, Artificial Sequence
  Description of Artificial Sequence: Synthetic polypeptide
DEEEIRTTNPVAYEQYGQCVCSWGEHNAENFNSDNQS

SEQ ID NO: 182544 - protein, 38 aa, Artificial Sequence
  Description of Artificial Sequence: Synthetic polypeptide
AEDEICTTNPVATEAYGSVSTVVTEQIGNNLETGNETM

SEQ ID NO: 182545 - protein, 39 aa, Artificial Sequence
  Description of Artificial Sequence: Synthetic polypeptide
AEDEICTTNPVATEAYGSVSTVVTEQAGNLQQGTGNETM

SEQ ID NO: 182546 - protein, 32 aa, Artificial Sequence
  Description of Artificial Sequence: Synthetic polypeptide
DDSEVASTNPVSTEGYGNVAANTEQDREGEQG

SEQ ID NO: 182547 - protein, 32 aa, Artificial Sequence
  Description of Artificial Sequence: Synthetic polypeptide
DDSEVASTNPVSTEGYGNVAANTEQSREGEQG

SEQ ID NO: 182548 - protein, 38 aa, Artificial Sequence
  Description of Artificial Sequence: Synthetic polypeptide
AEDEICTTNPVATEAYGSVSTVVTELQQGNTQTGNETM

SEQ ID NO: 182549 - protein, 32 aa, Artificial Sequence
  Description of Artificial Sequence: Synthetic polypeptide
DDSEVASTNPVSTEGYGNVAANTFIQSAVGQR

SEQ ID NO: 182550 - protein, 39 aa, Artificial Sequence
  Description of Artificial Sequence: Synthetic polypeptide
AEDEICTTNPVATEAYGSVSTVVTELQAGSNLQTGNETM

SEQ ID NO: 182551 - protein, 39 aa, Artificial Sequence
  Description of Artificial Sequence: Synthetic polypeptide
AEDEICTTNPVATEAYGSVSTVVTEDEIGTNLQIGNEEM

SEQ ID NO: 182552 - protein, 39 aa, Artificial Sequence
  Description of Artificial Sequence: Synthetic polypeptide
AEDEICTTNPVATEAYGSVSTVVNTEEIGTNLQIGNEEM

SEQ ID NO: 182553 - protein, 39 aa, Artificial Sequence
  Description of Artificial Sequence: Synthetic polypeptide
AEDEICTTNPVATEAYGSVSTVNTENGIGTNLQIGNEEM

SEQ ID NO: 182554 - protein, 39 aa, Artificial Sequence
  Description of Artificial Sequence: Synthetic polypeptide
AEDEICTTNPVATEAYGSVSTVNTEEIGTNLQIGNNEEM

SEQ ID NO: 182555 - protein, 38 aa, Artificial Sequence
  Description of Artificial Sequence: Synthetic polypeptide
AEDEICTTNPVATEAYGSVSTVNTEEIGNNQIGTNEEM

SEQ ID NO: 182556 - protein, 39 aa, Artificial Sequence
  Description of Artificial Sequence: Synthetic polypeptide
AEDEICTTNPVATEAYGSVSTVNTDQEIGTNLQIGNEEM

SEQ ID NO: 182557 - protein, 39 aa, Artificial Sequence
  Description of Artificial Sequence: Synthetic polypeptide
AEDEICTTNPVATEAYGSVSTVNQEGEIGTNLQIGNEEM

SEQ ID NO: 182558 - protein, 33 aa, Artificial Sequence
  Description of Artificial Sequence: Synthetic polypeptide
DDSEVASTNPVSTEGYGNVAANTGIQSRVGQSR

SEQ ID NO: 182559 - protein, 39 aa, Artificial Sequence
  Description of Artificial Sequence: Synthetic polypeptide
AEDEICTTNPVATEAYGSVATVSTEQEIGTNLQLGNEEM

SEQ ID NO: 182560 - protein, 39 aa, Artificial Sequence
  Description of Artificial Sequence: Synthetic polypeptide
AEDEICTTNPVATEAYGSVATVSTEEIGTNLQAGTNEEM

SEQ ID NO: 182561 - protein, 32 aa, Artificial Sequence
  Description of Artificial Sequence: Synthetic polypeptide
DDSEVASTNPVSTEGYGNVAANTGQSRVGMQV

SEQ ID NO: 182562 - protein, 35 aa, Artificial Sequence
  Description of Artificial Sequence: Synthetic polypeptide
DEHEIRTTNPVAYECWGTVYHQVNENQDRQNMNNG

SEQ ID NO: 182563 - protein, 32 aa, Artificial Sequence
  Description of Artificial Sequence: Synthetic polypeptide
DDSEVASTNPVSTEGYGNVAANTEIQSRVFQR

SEQ ID NO: 182564 - protein, 39 aa, Artificial Sequence
  Description of Artificial Sequence: Synthetic polypeptide
AEDEICTTNPVATEAYGSVSTVVTEQNGNNLQTGNNETM

SEQ ID NO: 182565 - protein, 38 aa, Artificial Sequence
  Description of Artificial Sequence: Synthetic polypeptide
AEDEICTTNPVATEAYGSVSTVVTEQNGNNNQTGNETM

SEQ ID NO: 182566 - protein, 38 aa, Artificial Sequence
  Description of Artificial Sequence: Synthetic polypeptide
AEDEICTTNPVATEAYGSVSTVVTEQQGNNQTGTNETM

SEQ ID NO: 182567 - protein, 35 aa, Artificial Sequence
  Description of Artificial Sequence: Synthetic polypeptide
DEHEIRTTNPVAYECWGCVFGGNGEEQNNMGNGQQ

SEQ ID NO: 182568 - protein, 35 aa, Artificial Sequence
  Description of Artificial Sequence: Synthetic polypeptide
DEHEIRTTNPVAYECWGCVFGGNGEERNNMGNGNA

SEQ ID NO: 182569 - protein, 34 aa, Artificial Sequence
  Description of Artificial Sequence: Synthetic polypeptide
DEHEIRTTNPVAYECWGCVFGGNGEERNNMNGDS

SEQ ID NO: 182570 - protein, 32 aa, Artificial Sequence
  Description of Artificial Sequence: Synthetic polypeptide
DDSEVASTNPVSTEGYGNVAANGTIPSRVGQR

SEQ ID NO: 182571 - protein, 32 aa, Artificial Sequence
  Description of Artificial Sequence: Synthetic polypeptide
DDSEVASTNPVSTEGYGNVAANGTIQSRVGQH

SEQ ID NO: 182572 - protein, 33 aa, Artificial Sequence
  Description of Artificial Sequence: Synthetic polypeptide
DDSEVASTNPVSTEGYGNVAANGTIYQSRVGQR

SEQ ID NO: 182573 - protein, 32 aa, Artificial Sequence
  Description of Artificial Sequence: Synthetic polypeptide
DDSVVASTNPVSTEGYGNVAANTIQSRVGQHR

SEQ ID NO: 182574 - protein, 36 aa, Artificial Sequence
  Description of Artificial Sequence: Synthetic polypeptide
DEHEIRTTNPVAYECWGSTVYTIPNQGNDDPGGDER

SEQ ID NO: 182575 - protein, 39 aa, Artificial Sequence
  Description of Artificial Sequence: Synthetic polypeptide
AEDEICTTNPVATEAYGSVYTVSTEEIGTNLQQGTNTEM

SEQ ID NO: 182576 - protein, 35 aa, Artificial Sequence
  Description of Artificial Sequence: Synthetic polypeptide
DEHEIRTTNPVAYECWGTVYMQINENQDRQMMNAG

SEQ ID NO: 182577 - protein, 31 aa, Artificial Sequence
  Description of Artificial Sequence: Synthetic polypeptide
DDSVVASTNPVSTEGYGNVAANTIQSRVGQE

SEQ ID NO: 182578 - protein, 32 aa, Artificial Sequence
  Description of Artificial Sequence: Synthetic polypeptide
DDSEVASTNPVSTEGYGNVAANITIQSRVGQG

SEQ ID NO: 182579 - protein, 32 aa, Artificial Sequence
  Description of Artificial Sequence: Synthetic polypeptide
DDSEVASTNPVSTEGYGNVAANMTIGSRVGER

SEQ ID NO: 182580 - protein, 32 aa, Artificial Sequence
  Description of Artificial Sequence: Synthetic polypeptide
DDSTVASTNPVSTEGYGNVAANTIDQSRVGQR

SEQ ID NO: 182581 - protein, 37 aa, Artificial Sequence
  Description of Artificial Sequence: Synthetic polypeptide
DEEEIRTTNPVATEQYGAVIFISMGEEVPEVGEDPEI

SEQ ID NO: 182582 - protein, 33 aa, Artificial Sequence
  Description of Artificial Sequence: Synthetic polypeptide
DDSEVASTNPVSTEGYGNVAANSTIQSRVGQQR

SEQ ID NO: 182583 - protein, 32 aa, Artificial Sequence
  Description of Artificial Sequence: Synthetic polypeptide
DDSEVASTNPVSTEGYGNVAANTDIQSGVGER

SEQ ID NO: 182584 - protein, 32 aa, Artificial Sequence
  Description of Artificial Sequence: Synthetic polypeptide
DDSEVASTNPVSTEGYGNVAANTDIQSRVKQR

SEQ ID NO: 182585 - protein, 33 aa, Artificial Sequence
  Description of Artificial Sequence: Synthetic polypeptide
DDSEVASTNPVSTEGYGNVAANTDIRQSRVGQR

SEQ ID NO: 182586 - protein, 39 aa, Artificial Sequence
  Description of Artificial Sequence: Synthetic polypeptide
AEDEICTTNPVATEAYGSVSTVVTEQQGSNLQTGNNETM

SEQ ID NO: 182587 - protein, 31 aa, Artificial Sequence
  Description of Artificial Sequence: Synthetic polypeptide
DDSVVASTNPVSTEGYGNVAANTIMSRVGQR

SEQ ID NO: 182588 - protein, 35 aa, Artificial Sequence
  Description of Artificial Sequence: Synthetic polypeptide
DEHEIRTTNPVAYECWGTVYQINDENQDRQHMNNG

SEQ ID NO: 182589 - protein, 34 aa, Artificial Sequence
  Description of Artificial Sequence: Synthetic polypeptide
DEHEIRTTNPVAYECWGTVYQINENQDHQMMNTG

SEQ ID NO: 182590 - protein, 38 aa, Artificial Sequence
  Description of Artificial Sequence: Synthetic polypeptide
AEDEICTTNPVATEAYGSVATVNDEEIGTNLQIGNEEM

SEQ ID NO: 182591 - protein, 33 aa, Artificial Sequence
  Description of Artificial Sequence: Synthetic polypeptide
DDSEVASTNPVSTEGYGNVAANTIIQSRVGPQR

SEQ ID NO: 182592 - protein, 40 aa, Artificial Sequence
  Description of Artificial Sequence: Synthetic polypeptide
DEEEIRTTNPVATEQYGVVSTVTNNNQQSATNEEGVVAVD

SEQ ID NO: 182593 - protein, 40 aa, Artificial Sequence
  Description of Artificial Sequence: Synthetic polypeptide
DEEEIRTTNPVATEQYGVVSTVTNNNQQSATNEEGTTDQQ

SEQ ID NO: 182594 - protein, 35 aa, Artificial Sequence
  Description of Artificial Sequence: Synthetic polypeptide
DEHEIRTTNPVAYEEWGCVYSGLNGEDERNMNGAD

SEQ ID NO: 182595 - protein, 36 aa, Artificial Sequence
  Description of Artificial Sequence: Synthetic polypeptide
DEHEIRTTNPVAYEEWGSTVYQINENQDRRMMNNGD

SEQ ID NO: 182596 - protein, 39 aa, Artificial Sequence
  Description of Artificial Sequence: Synthetic polypeptide
DEEEIRTTNPVATEQYGASTFCVTPAMVSVQRQASENEI

SEQ ID NO: 182597 - protein, 37 aa, Artificial Sequence
  Description of Artificial Sequence: Synthetic polypeptide
DEEEIRTTNPVATEQYGASCNWPEIPLEDADEKDSRE

SEQ ID NO: 182598 - protein, 32 aa, Artificial Sequence
  Description of Artificial Sequence: Synthetic polypeptide
DDSEVASTNPVSTEGYGNVAANTIISRVGQRS

SEQ ID NO: 182599 - protein, 31 aa, Artificial Sequence
  Description of Artificial Sequence: Synthetic polypeptide
DDSLVASTNPVSTEGYGNVAANTIQSQVGQR

SEQ ID NO: 182600 - protein, 36 aa, Artificial Sequence
  Description of Artificial Sequence: Synthetic polypeptide
DANEIATTNPVAYEQYGSVAITNHADEQTGELGEQM

SEQ ID NO: 182601 - protein, 32 aa, Artificial Sequence
  Description of Artificial Sequence: Synthetic polypeptide
DDSEVASTNPVSTEGYGNVAANTIKQSTVGQR

SEQ ID NO: 182602 - protein, 37 aa, Artificial Sequence
  Description of Artificial Sequence: Synthetic polypeptide
DEEEIRTTNPVATEQYGAIFNATPEVDDEVGMNENEE

SEQ ID NO: 182603 - protein, 38 aa, Artificial Sequence
  Description of Artificial Sequence: Synthetic polypeptide
DEEEIRTTNPVATEQYGAFYMNSLNQNMELEQAVVPTA

SEQ ID NO: 182604 - protein, 39 aa, Artificial Sequence
  Description of Artificial Sequence: Synthetic polypeptide
DEEEIRTTNPVATEQYGAFVINSLNQNMTELEQAVVPTA

SEQ ID NO: 182605 - protein, 36 aa, Artificial Sequence
  Description of Artificial Sequence: Synthetic polypeptide
DEEEIRTTNPVATEQYGACTPWPLVGQQIQQTQEED

SEQ ID NO: 182606 - protein, 31 aa, Artificial Sequence
  Description of Artificial Sequence: Synthetic polypeptide
DDSEVASTNPVSTEGYGNVAANTIMNRVEQR

SEQ ID NO: 182607 - protein, 31 aa, Artificial Sequence
  Description of Artificial Sequence: Synthetic polypeptide
DDSEVASTNPVSTEGYGNVAANTIMSAVGQR

SEQ ID NO: 182608 - protein, 37 aa, Artificial Sequence
  Description of Artificial Sequence: Synthetic polypeptide
DEEEIRTTNPVGTEQYGQCVCSWGEDHNANFISQNQS

SEQ ID NO: 182609 - protein, 37 aa, Artificial Sequence
  Description of Artificial Sequence: Synthetic polypeptide
AEDEICATNPVATEQYGVVSTVNENGNQAGNGNDEDD

SEQ ID NO: 182610 - protein, 32 aa, Artificial Sequence
  Description of Artificial Sequence: Synthetic polypeptide
DDSEVASTNPVSTEGYGNVAANTINQSMVGQR

SEQ ID NO: 182611 - protein, 37 aa, Artificial Sequence
  Description of Artificial Sequence: Synthetic polypeptide
DEEEIRTTNPVATEQYGAIREAPTNVVSPIGMEDIEY

SEQ ID NO: 182612 - protein, 29 aa, Artificial Sequence
  Description of Artificial Sequence: Synthetic peptide
QEGEIASTNPCSYEQWGCGYCNDQSGDTH

SEQ ID NO: 182613 - protein, 32 aa, Artificial Sequence
  Description of Artificial Sequence: Synthetic polypeptide
DDSEVASTNPVSTEGYGNVAANTIGQSPCGQR

SEQ ID NO: 182614 - protein, 32 aa, Artificial Sequence
  Description of Artificial Sequence: Synthetic polypeptide
DDSSVASTNPVSTEGYGNVAANPTIQSRVGQR

SEQ ID NO: 182615 - protein, 32 aa, Artificial Sequence
  Description of Artificial Sequence: Synthetic polypeptide
DDSEVASTNPVSTEGYGNVAANTICSRVGQRC

SEQ ID NO: 182616 - protein, 33 aa, Artificial Sequence
  Description of Artificial Sequence: Synthetic polypeptide
DDSEVASTNPVSTEGYGNVAANTIDQSRVGIQR

SEQ ID NO: 182617 - protein, 32 aa, Artificial Sequence
  Description of Artificial Sequence: Synthetic polypeptide
DDSEVASTNPVSTEGYGNVAANTIENSRVGQR

SEQ ID NO: 182618 - protein, 32 aa, Artificial Sequence
  Description of Artificial Sequence: Synthetic polypeptide
DDSEVASTNPVSTEGYGNVAANTIEQSRVGQF

SEQ ID NO: 182619 - protein, 35 aa, Artificial Sequence
  Description of Artificial Sequence: Synthetic polypeptide
DEHEIRTTNPVAYECWGTVYQINENQDRRNMNNGD

SEQ ID NO: 182620 - protein, 38 aa, Artificial Sequence
  Description of Artificial Sequence: Synthetic polypeptide
DEEEIRTTNPVATEQYGATVSEEIVAGVAENPQVQVST

SEQ ID NO: 182621 - protein, 35 aa, Artificial Sequence
  Description of Artificial Sequence: Synthetic polypeptide
DEHEIRTTNPVAYECWGTVYWDNENQDRQMGTDGN

SEQ ID NO: 182622 - protein, 31 aa, Artificial Sequence
  Description of Artificial Sequence: Synthetic polypeptide
DDSEVASTNPVSTEGYGNVAANTIESHVGQR

SEQ ID NO: 182623 - protein, 35 aa, Artificial Sequence
  Description of Artificial Sequence: Synthetic polypeptide
DEHEIRTTNPVAYECWGTVYWINEDNQDRQMMNDG

SEQ ID NO: 182624 - protein, 33 aa, Artificial Sequence
  Description of Artificial Sequence: Synthetic polypeptide
DDSEVASTNPVSTEGYGNVAANTIFQSRVGQGR

SEQ ID NO: 182625 - protein, 34 aa, Artificial Sequence
  Description of Artificial Sequence: Synthetic polypeptide
DEHEIRTTNPVAYECWGTVYWINENQDEQMMNDA

SEQ ID NO: 182626 - protein, 34 aa, Artificial Sequence
  Description of Artificial Sequence: Synthetic polypeptide
DEHEIRTTNPVAYECWGTVYWINENQDMQMVNDG

SEQ ID NO: 182627 - protein, 32 aa, Artificial Sequence
  Description of Artificial Sequence: Synthetic polypeptide
DDSEVASTNPVSTEGYGNVAANTIESRVGIQR

SEQ ID NO: 182628 - protein, 32 aa, Artificial Sequence
  Description of Artificial Sequence: Synthetic polypeptide
DDSSVASTNPVSTEGYGNVAANTIQQSRVGQR

SEQ ID NO: 182629 - protein, 34 aa, Artificial Sequence
  Description of Artificial Sequence: Synthetic polypeptide
DEHEIRTTNPVAYECWGTVYWIPENQDRQMNNDG

SEQ ID NO: 182630 - protein, 38 aa, Artificial Sequence
  Description of Artificial Sequence: Synthetic polypeptide
DEEEIRTTNPVATEQYGATCMSEEIVMGVAENPQVQVS

SEQ ID NO: 182631 - protein, 31 aa, Artificial Sequence
  Description of Artificial Sequence: Synthetic polypeptide
DDSEVASTNPVSTEGYGNVAANTIESRVGQG

SEQ ID NO: 182632 - protein, 31 aa, Artificial Sequence
  Description of Artificial Sequence: Synthetic polypeptide
DDSEVASTNPVSTEGYGNVAANTIESRVGQP

SEQ ID NO: 182633 - protein, 33 aa, Artificial Sequence
  Description of Artificial Sequence: Synthetic polypeptide
DDSEVASTNPVSTEGYGNVAANTIFQSRVGEQR

SEQ ID NO: 182634 - protein, 32 aa, Artificial Sequence
  Description of Artificial Sequence: Synthetic polypeptide
DDSSVASTNPVSTEGYGNVAANSTIQSRVGQR

SEQ ID NO: 182635 - protein, 34 aa, Artificial Sequence
  Description of Artificial Sequence: Synthetic polypeptide
DEHEIRTTNPVAYECWGTVYWINENQDKQATHNS

SEQ ID NO: 182636 - protein, 31 aa, Artificial Sequence
  Description of Artificial Sequence: Synthetic polypeptide
DDSEVASTNPVSTEGYGNVAAETIQSRVEQR

SEQ ID NO: 182637 - protein, 33 aa, Artificial Sequence
  Description of Artificial Sequence: Synthetic polypeptide
DDSEVASTNPVSTEGYGNVAANFTIEQSRVGQR

SEQ ID NO: 182638 - protein, 35 aa, Artificial Sequence
  Description of Artificial Sequence: Synthetic polypeptide
DEHEIRTTNPVAYECWGCVFGANGEERNNMGGGNQ

SEQ ID NO: 182639 - protein, 37 aa, Artificial Sequence
  Description of Artificial Sequence: Synthetic polypeptide
DEEEIRTTNPVAYEQYGQCVCSWGEHNQENFNSDNQN

SEQ ID NO: 182640 - protein, 31 aa, Artificial Sequence
  Description of Artificial Sequence: Synthetic polypeptide
DDSEVASTNPVSTEGYGNVAAMTIQSHNGQR

SEQ ID NO: 182641 - protein, 36 aa, Artificial Sequence
  Description of Artificial Sequence: Synthetic polypeptide
DEEEIRTTNPVSTEQYGQCVCGWGEDHNQGFGSQQS

SEQ ID NO: 182642 - protein, 34 aa, Artificial Sequence
  Description of Artificial Sequence: Synthetic polypeptide
AEDEVATTNPVAYEQWGSTCSTWEHMDSQGHNER

SEQ ID NO: 182643 - protein, 33 aa, Artificial Sequence
  Description of Artificial Sequence: Synthetic polypeptide
AEDETACTNPVAYEQWGEYYSIENDQRTPGESR

SEQ ID NO: 182644 - protein, 36 aa, Artificial Sequence
  Description of Artificial Sequence: Synthetic polypeptide
DEEEIRTTNPVAYEQYGQCVCSWMEDHNQENFISQQ

SEQ ID NO: 182645 - protein, 31 aa, Artificial Sequence
  Description of Artificial Sequence: Synthetic polypeptide
DDSEVASTNPVSTEGYGNVAAMTIQSRNGQH

SEQ ID NO: 182646 - protein, 31 aa, Artificial Sequence
  Description of Artificial Sequence: Synthetic polypeptide
DDSEVASTNPVSTEGYGNVAAMTIQSRVGQH

SEQ ID NO: 182647 - protein, 32 aa, Artificial Sequence
  Description of Artificial Sequence: Synthetic polypeptide
DDSEVASTNPVSTEGYGNVAANANITSRVGQR

SEQ ID NO: 182648 - protein, 33 aa, Artificial Sequence
  Description of Artificial Sequence: Synthetic polypeptide
DDSEVASTNPVSTEGYGNVAANATIQSRVGQGR

SEQ ID NO: 182649 - protein, 31 aa, Artificial Sequence
  Description of Artificial Sequence: Synthetic polypeptide
DDSEVASTNPVSTEGYGNVAANCIQSRVEQL

SEQ ID NO: 182650 - protein, 37 aa, Artificial Sequence
  Description of Artificial Sequence: Synthetic polypeptide
DEEEIRTTNPVSTEQYGCVCGNWGNDHNQEGFGSQQS

SEQ ID NO: 182651 - protein, 37 aa, Artificial Sequence
  Description of Artificial Sequence: Synthetic polypeptide
DEEEIRTTNPVSTEQYGCVCGNWGEHNTEGFGSQNQA

SEQ ID NO: 182652 - protein, 37 aa, Artificial Sequence
  Description of Artificial Sequence: Synthetic polypeptide
DEEEIRTTNPVSTEQYGCVCGNWGEDNQEGFGSDTQS

SEQ ID NO: 182653 - protein, 38 aa, Artificial Sequence
  Description of Artificial Sequence: Synthetic polypeptide
DEEEIRTTNPVAYEQYGQCVTSTWEADNAEYFGSDPQS

SEQ ID NO: 182654 - protein, 38 aa, Artificial Sequence
  Description of Artificial Sequence: Synthetic polypeptide
DEEEIRTTNPVAYEQYGQCVTSTWPAHNAEHFNSDPQS

SEQ ID NO: 182655 - protein, 39 aa, Artificial Sequence
  Description of Artificial Sequence: Synthetic polypeptide
DEEEIRTTNPVATEAYGVVSTVTANNNQQGTEQGTEEED

SEQ ID NO: 182656 - protein, 36 aa, Artificial Sequence
  Description of Artificial Sequence: Synthetic polypeptide
DEEEIRTTNPVAYEQYGQSASVANQAASVIEEVEEY

SEQ ID NO: 182657 - protein, 37 aa, Artificial Sequence
  Description of Artificial Sequence: Synthetic polypeptide
DEEEIRTTNPVAYEQYGQSASVANQAASVTVNVEAEY

SEQ ID NO: 182658 - protein, 36 aa, Artificial Sequence
  Description of Artificial Sequence: Synthetic polypeptide
DEEEIRTTNPVSTEQYGSAPAPWGNEEIQQVMQPQI

SEQ ID NO: 182659 - protein, 36 aa, Artificial Sequence
  Description of Artificial Sequence: Synthetic polypeptide
DEEEIRTTNPVSTEQYGSAPPPWKNEQIQQLMQPAI

SEQ ID NO: 182660 - protein, 37 aa, Artificial Sequence
  Description of Artificial Sequence: Synthetic polypeptide
DEEEIRTTNPVSTEQYGSAPTPWQKNEQIQQVMQPQI

SEQ ID NO: 182661 - protein, 35 aa, Artificial Sequence
  Description of Artificial Sequence: Synthetic polypeptide
DEEEIATTNPVAYEKWGCVYNLNDNHNGQLGNGSN

SEQ ID NO: 182662 - protein, 31 aa, Artificial Sequence
  Description of Artificial Sequence: Synthetic polypeptide
DDSEVASTNPVSTEGYGNVAAETIQSRVGQA

SEQ ID NO: 182663 - protein, 31 aa, Artificial Sequence
  Description of Artificial Sequence: Synthetic polypeptide
DDSEVASTNPVSTEGYGNVAAETIQSRVGQK

SEQ ID NO: 182664 - protein, 32 aa, Artificial Sequence
  Description of Artificial Sequence: Synthetic polypeptide
DDSEVASTNPVSTEGYGNVAAETIQSRVGYQR

SEQ ID NO: 182665 - protein, 39 aa, Artificial Sequence
  Description of Artificial Sequence: Synthetic polypeptide
VENEIRTTNPVATEFYGSVSTTDGGNNLLSEEDEGNEQP

SEQ ID NO: 182666 - protein, 36 aa, Artificial Sequence
  Description of Artificial Sequence: Synthetic polypeptide
DASEIRTTNPVATERYGQVHVPCLGNQSQQGGNNAM

SEQ ID NO: 182667 - protein, 31 aa, Artificial Sequence
  Description of Artificial Sequence: Synthetic polypeptide
DDSEVASTNPVSTEGYGNVAAFTHQSDVGQR

SEQ ID NO: 182668 - protein, 32 aa, Artificial Sequence
  Description of Artificial Sequence: Synthetic polypeptide
DDSEVASTNPVSTEGYGNVAAFTIQSRVGGQR

SEQ ID NO: 182669 - protein, 31 aa, Artificial Sequence
  Description of Artificial Sequence: Synthetic polypeptide
DDSEVASTNPVSTEGYGNVAAFTIQSRVGQH

SEQ ID NO: 182670 - protein, 36 aa, Artificial Sequence
  Description of Artificial Sequence: Synthetic polypeptide
VENEIRTTNPVATEQYGMVSVEGMGGGQGQEGEQGY

SEQ ID NO: 182671 - protein, 33 aa, Artificial Sequence
  Description of Artificial Sequence: Synthetic polypeptide
YEDEIRCTNPAATEQYGVIVVSEGGMGGEGGET

SEQ ID NO: 182672 - protein, 36 aa, Artificial Sequence
  Description of Artificial Sequence: Synthetic polypeptide
DEEEIATTNPVAYEPQWGQSSAQNDLVQTAGDITGN

SEQ ID NO: 182673 - protein, 32 aa, Artificial Sequence
  Description of Artificial Sequence: Synthetic polypeptide
DDSEVASTNPVSTEGYGNVAAHTIQSRVGQRL

SEQ ID NO: 182674 - protein, 36 aa, Artificial Sequence
  Description of Artificial Sequence: Synthetic polypeptide
DEEEIATTNPVAYEKWGCVYYNLNDNHNGNQLGNGD

SEQ ID NO: 182675 - protein, 31 aa, Artificial Sequence
  Description of Artificial Sequence: Synthetic polypeptide
DDSEVASTNPVSTEGYGNVAAKTIQSRVGQC

SEQ ID NO: 182676 - protein, 31 aa, Artificial Sequence
  Description of Artificial Sequence: Synthetic polypeptide
DDSEVASTNPVSTEGYGNVAAKTIQSTVGQR

SEQ ID NO: 182677 - protein, 37 aa, Artificial Sequence
  Description of Artificial Sequence: Synthetic polypeptide
DEEEIRTTNPVAYEQYGQCVCSWGEHNIENFNSDNQL

SEQ ID NO: 182678 - protein, 34 aa, Artificial Sequence
  Description of Artificial Sequence: Synthetic polypeptide
DEEEIATTNPVAYEKWGCVYNVNDNHNGQLENGD

SEQ ID NO: 182679 - protein, 37 aa, Artificial Sequence
  Description of Artificial Sequence: Synthetic polypeptide
DASEIRTTNPVATERYGQQHVPSLGNQSERPGGNNAG

SEQ ID NO: 182680 - protein, 37 aa, Artificial Sequence
  Description of Artificial Sequence: Synthetic polypeptide
DEEEIRTTNPVATEQYGAVVNGFGQGGQDDDQMTGFE

SEQ ID NO: 182681 - protein, 36 aa, Artificial Sequence
  Description of Artificial Sequence: Synthetic polypeptide
WEEEIACTNPVATEQWGCVAGTNGLPQTAPGEDFDQ

SEQ ID NO: 182682 - protein, 33 aa, Artificial Sequence
  Description of Artificial Sequence: Synthetic polypeptide
VENEIRTTNPVSTEPYGTITVEDEQQPQSGQHN

SEQ ID NO: 182683 - protein, 32 aa, Artificial Sequence
  Description of Artificial Sequence: Synthetic polypeptide
YEDEIRCTNPAATEQYGVVVAEGGMGGEGGEQ

SEQ ID NO: 182684 - protein, 36 aa, Artificial Sequence
  Description of Artificial Sequence: Synthetic polypeptide
YEDEIRSTNPVATEQYGSVNDDGNLNFNEGGGGQEN

SEQ ID NO: 182685 - protein, 39 aa, Artificial Sequence
  Description of Artificial Sequence: Synthetic polypeptide
DEEEIRTTNPVATEAYGVVSTVTGNQAGTEAGTVTNEDE

SEQ ID NO: 182686 - protein, 39 aa, Artificial Sequence
  Description of Artificial Sequence: Synthetic polypeptide
DEEEIRTTNPVATEAYGVVSTVTVNQAGTEAGSVQNAVD

SEQ ID NO: 182687 - protein, 39 aa, Artificial Sequence
  Description of Artificial Sequence: Synthetic polypeptide
DEEEIRTTNPVATEAYGVVSTVVANQAGTEAGSVQNPVD

SEQ ID NO: 182688 - protein, 39 aa, Artificial Sequence
  Description of Artificial Sequence: Synthetic polypeptide
DEEEIRTTNPVATEAYGVVSTVVANQAGTEAGTVTNEVE

SEQ ID NO: 182689 - protein, 31 aa, Artificial Sequence
  Description of Artificial Sequence: Synthetic polypeptide
DDSVVASTNPVSTIGYGNVAANTIQSRVGQR

SEQ ID NO: 182690 - protein, 34 aa, Artificial Sequence
  Description of Artificial Sequence: Synthetic polypeptide
DEHEIRTTNPVAYEAWGVVTGGNANEDLKGGDSA

SEQ ID NO: 182691 - protein, 32 aa, Artificial Sequence
  Description of Artificial Sequence: Synthetic polypeptide
DDSVVASTNPVSTEGYGNVAANTYQIRVGQER

SEQ ID NO: 182692 - protein, 39 aa, Artificial Sequence
  Description of Artificial Sequence: Synthetic polypeptide
DEEEIRTTNPVATEAYGVVSTVVNNQAGTEAGTVTEEDE

SEQ ID NO: 182693 - protein, 32 aa, Artificial Sequence
  Description of Artificial Sequence: Synthetic polypeptide
DDSEVASTNPVSTEGYGNVAANETIQSKVGQR

SEQ ID NO: 182694 - protein, 39 aa, Artificial Sequence
  Description of Artificial Sequence: Synthetic polypeptide
DEEEIRTTNPVAYEQYGQSVCSERLNDDTDTQSGQILKN

SEQ ID NO: 182695 - protein, 32 aa, Artificial Sequence
  Description of Artificial Sequence: Synthetic polypeptide
QEGEIASTNPVGYEGPYGVMASNDLTQHGNDI

SEQ ID NO: 182696 - protein, 35 aa, Artificial Sequence
  Description of Artificial Sequence: Synthetic polypeptide
DEHEIRTTNPVAYECWGCVAGGGNMGNGRGNGDKT

SEQ ID NO: 182697 - protein, 36 aa, Artificial Sequence
  Description of Artificial Sequence: Synthetic polypeptide
DEHEIRTTNPVAYECWGCVASGGNMGNERGGEGDTR

SEQ ID NO: 182698 - protein, 30 aa, Artificial Sequence
  Description of Artificial Sequence: Synthetic polypeptide
QEGEIASTNPCSYEQWGYTYCPNDQSGDMR

SEQ ID NO: 182699 - protein, 30 aa, Artificial Sequence
  Description of Artificial Sequence: Synthetic polypeptide
QEGEIASTNPCSYEQWGYTYCNDSQSGDTR

SEQ ID NO: 182700 - protein, 39 aa, Artificial Sequence
  Description of Artificial Sequence: Synthetic polypeptide
DEEEIRTTNPVAYEQYGQSVCSNQLGDLLDAQSGQITKN

SEQ ID NO: 182701 - protein, 31 aa, Artificial Sequence
  Description of Artificial Sequence: Synthetic polypeptide
QEGEIASTNPCSYEQWGYTYCNDQSQGDTNR

SEQ ID NO: 182702 - protein, 32 aa, Artificial Sequence
  Description of Artificial Sequence: Synthetic polypeptide
DDSVVASTNPVSTEGYGNVAANTIQSRVGSQR

SEQ ID NO: 182703 - protein, 32 aa, Artificial Sequence
  Description of Artificial Sequence: Synthetic polypeptide
DDSEVASTNPVSTEGYGNVAANETIQSRVGQH

SEQ ID NO: 182704 - protein, 30 aa, Artificial Sequence
  Description of Artificial Sequence: Synthetic polypeptide
QEGEIASTNPCSYEQWGYTYCNDDQHGDTR

SEQ ID NO: 182705 - protein, 32 aa, Artificial Sequence
  Description of Artificial Sequence: Synthetic polypeptide
DDSEVASTNPVSTEGYGNVAANETIQSRVGQI

SEQ ID NO: 182706 - protein, 37 aa, Artificial Sequence
  Description of Artificial Sequence: Synthetic polypeptide
DEHEIRTTNPVAYECWGCVAGGGNMGNQPRDGEGDNR

SEQ ID NO: 182707 - protein, 30 aa, Artificial Sequence
  Description of Artificial Sequence: Synthetic polypeptide
QEGEIASTNPCSYEQWGIGYCNDQEGGDTR

SEQ ID NO: 182708 - protein, 39 aa, Artificial Sequence
  Description of Artificial Sequence: Synthetic polypeptide
DEEEIRTTNPVATEAYGVVSTVTTNQAGTEQGTVNQQQE

SEQ ID NO: 182709 - protein, 39 aa, Artificial Sequence
  Description of Artificial Sequence: Synthetic polypeptide
DEEEIRTTNPVATEAYGVVSTVTTNQAGTEAGTVNQETD

SEQ ID NO: 182710 - protein, 36 aa, Artificial Sequence
  Description of Artificial Sequence: Synthetic polypeptide
DEEEIRTTNPVAYEQYGQSATVANDAASVFTVEWDI

SEQ ID NO: 182711 - protein, 32 aa, Artificial Sequence
  Description of Artificial Sequence: Synthetic polypeptide
DDSEVASTNPVSTEGYGNVAANDTIGDRVGER

SEQ ID NO: 182712 - protein, 35 aa, Artificial Sequence
  Description of Artificial Sequence: Synthetic polypeptide
DEEEIATTNPVAYEAWGVVTGGNANEDLKGGDSNA

SEQ ID NO: 182713 - protein, 32 aa, Artificial Sequence
  Description of Artificial Sequence: Synthetic polypeptide
DDSEVASTNPVSTEGYGNVAANDTIQSFVGQR

SEQ ID NO: 182714 - protein, 32 aa, Artificial Sequence
  Description of Artificial Sequence: Synthetic polypeptide
DDSEVASTNPVSTEGYGNVAANDTIQSGGGQR

SEQ ID NO: 182715 - protein, 39 aa, Artificial Sequence
  Description of Artificial Sequence: Synthetic polypeptide
DEEEIRTTNPVATEAYGVVSTVTNNNQQQGTEQGTEDEE

SEQ ID NO: 182716 - protein, 39 aa, Artificial Sequence
  Description of Artificial Sequence: Synthetic polypeptide
DEEEIRTTNPVATEAYGVVSTVTNNNQQQGTEQGTEEQD

SEQ ID NO: 182717 - protein, 39 aa, Artificial Sequence
  Description of Artificial Sequence: Synthetic polypeptide
DEEEIRTTNPVATEAYGVVSTVTNNQAGTEAGTVTDEDD

SEQ ID NO: 182718 - protein, 39 aa, Artificial Sequence
  Description of Artificial Sequence: Synthetic polypeptide
DEEEIRTTNPVATEAYGVVSTVTNNQAGTEAGTVTQDDE

SEQ ID NO: 182719 - protein, 39 aa, Artificial Sequence
  Description of Artificial Sequence: Synthetic polypeptide
DEEEIRTTNPVATEAYGVVSTVTTNQAGTEAGVVNQQVE

SEQ ID NO: 182720 - protein, 38 aa, Artificial Sequence
  Description of Artificial Sequence: Synthetic polypeptide
DEEEIRTTNPVAYEQYGQSCCSILNDLLDAQSDQITKN

SEQ ID NO: 182721 - protein, 39 aa, Artificial Sequence
  Description of Artificial Sequence: Synthetic polypeptide
DEEEIRTTNPVATEAYGVVSTVTNQQAGTEAGTVTTEDE

SEQ ID NO: 182722 - protein, 33 aa, Artificial Sequence
  Description of Artificial Sequence: Synthetic polypeptide
DDTEIATTNPVATEGWGATANNEDWQSPKGPYR

SEQ ID NO: 182723 - protein, 39 aa, Artificial Sequence
  Description of Artificial Sequence: Synthetic polypeptide
DEEEIRTTNPVATEAYGVVSTVTQLQAGTEAGTVTEEDE

SEQ ID NO: 182724 - protein, 39 aa, Artificial Sequence
  Description of Artificial Sequence: Synthetic polypeptide
DEEEIRTTNPVATEAYGVVSTVTQLQLQQGTEQGTEEEQ

SEQ ID NO: 182725 - protein, 39 aa, Artificial Sequence
  Description of Artificial Sequence: Synthetic polypeptide
DEEEIRTTNPVATEAYGVVSTVTQQQLQQGTEQGTVEEE

SEQ ID NO: 182726 - protein, 39 aa, Artificial Sequence
  Description of Artificial Sequence: Synthetic polypeptide
DEEEIRTTNPVATEAYGVVSTVTTLQAGTEAGTVTVEVE

SEQ ID NO: 182727 - protein, 39 aa, Artificial Sequence
  Description of Artificial Sequence: Synthetic polypeptide
DEEEIRTTNPVATEAYGVVSTVTTLQAGTEAGVVTDEDE

SEQ ID NO: 182728 - protein, 33 aa, Artificial Sequence
  Description of Artificial Sequence: Synthetic polypeptide
AEDEIRCTNPTAYECWGSVYYENDDRHRGDIHR

SEQ ID NO: 182729 - protein, 39 aa, Artificial Sequence
  Description of Artificial Sequence: Synthetic polypeptide
DEEEIRTTNPVATEAYGVVSTVTTNQAGTEAGSTQGNVD

SEQ ID NO: 182730 - protein, 39 aa, Artificial Sequence
  Description of Artificial Sequence: Synthetic polypeptide
DEEEIRTTNPVATEAYGVVSTVTNQNNQQGTEQGTEESD

SEQ ID NO: 182731 - protein, 34 aa, Artificial Sequence
  Description of Artificial Sequence: Synthetic polypeptide
VEDEIACTNPVATEQWGGCVAGTGLQHSDDNNPM

SEQ ID NO: 182732 - protein, 37 aa, Artificial Sequence
  Description of Artificial Sequence: Synthetic polypeptide
DEEEISTTNPVATEQYGCVCSWEEDHNQESFNSDTQS

SEQ ID NO: 182733 - protein, 34 aa, Artificial Sequence
  Description of Artificial Sequence: Synthetic polypeptide
VEDEIACTNPVATEQWGGCVAGNMLQHSDDNFPP

SEQ ID NO: 182734 - protein, 38 aa, Artificial Sequence
  Description of Artificial Sequence: Synthetic polypeptide
DEEEIRTTNPVATEQYGQCSCVWPAGGAMIGNDDSPPE

SEQ ID NO: 182735 - protein, 38 aa, Artificial Sequence
  Description of Artificial Sequence: Synthetic polypeptide
DEEEIRTTNPVATEQYGQCTCSTWGEHNAENFNSDTQA

SEQ ID NO: 182736 - protein, 38 aa, Artificial Sequence
  Description of Artificial Sequence: Synthetic polypeptide
DDEEIRTTNPVATEAYGAVVDNTNMQNDQEGNNQNDDE

SEQ ID NO: 182737 - protein, 38 aa, Artificial Sequence
  Description of Artificial Sequence: Synthetic polypeptide
DEEEIRTTNPVATEQYGQCTCSWGEDHNQENFGSDNQA

SEQ ID NO: 182738 - protein, 37 aa, Artificial Sequence
  Description of Artificial Sequence: Synthetic polypeptide
DEEEIRTTNPVATEQYGQCTCSWGEHNAENFNSDNQS

SEQ ID NO: 182739 - protein, 36 aa, Artificial Sequence
  Description of Artificial Sequence: Synthetic polypeptide
DEEQIATTNPVATEQWGGCVAITNNLENGMGGVGDW

SEQ ID NO: 182740 - protein, 37 aa, Artificial Sequence
  Description of Artificial Sequence: Synthetic polypeptide
DEEEIRTTNPVATEQYGQCVCEWGEHDQENFNSDNQS

SEQ ID NO: 182741 - protein, 33 aa, Artificial Sequence
  Description of Artificial Sequence: Synthetic polypeptide
QESEIASTNPVGTECWGSVACINEPQDHEGENG

SEQ ID NO: 182742 - protein, 37 aa, Artificial Sequence
  Description of Artificial Sequence: Synthetic polypeptide
DEEEIRTTNPVATEQYGQCSCSWGEPHQENFISDTQS

SEQ ID NO: 182743 - protein, 39 aa, Artificial Sequence
  Description of Artificial Sequence: Synthetic polypeptide
DEEEIRTTNPVATEQYGQCVCGNWGEDHNQEGFNSDTQA

SEQ ID NO: 182744 - protein, 38 aa, Artificial Sequence
  Description of Artificial Sequence: Synthetic polypeptide
DEEEIRTTNPVATEQYGQCVCQNTGEHNQENFGSETQA

SEQ ID NO: 182745 - protein, 37 aa, Artificial Sequence
  Description of Artificial Sequence: Synthetic polypeptide
DEGEIRTTNPVATEQYGSFVFFASPDESHYSTEDDRQ

SEQ ID NO: 182746 - protein, 37 aa, Artificial Sequence
  Description of Artificial Sequence: Synthetic polypeptide
DEEEIRTTNPVATEQYGQCVCQWGEHNAENFNSENQS

SEQ ID NO: 182747 - protein, 38 aa, Artificial Sequence
  Description of Artificial Sequence: Synthetic polypeptide
DEEEIRTTNPVATEQYGQCVCSDWEDHNQENFNSDTQA

SEQ ID NO: 182748 - protein, 35 aa, Artificial Sequence
  Description of Artificial Sequence: Synthetic polypeptide
DEAEIACTNPVATEQWGAVCSANPPVNTAGNPEGT

SEQ ID NO: 182749 - protein, 38 aa, Artificial Sequence
  Description of Artificial Sequence: Synthetic polypeptide
DEEEIRTTNPVATEQYGQCVCSMSEAHNQENFNSETQS

SEQ ID NO: 182750 - protein, 38 aa, Artificial Sequence
  Description of Artificial Sequence: Synthetic polypeptide
DEEEIRTTNPVATEQYGQCVCSMSEEDHNQNFGSDTQA

SEQ ID NO: 182751 - protein, 37 aa, Artificial Sequence
  Description of Artificial Sequence: Synthetic polypeptide
DEGEIRTTNPVATEQYGSCVIMPWEHDEQPEVENDQE

SEQ ID NO: 182752 - protein, 37 aa, Artificial Sequence
  Description of Artificial Sequence: Synthetic polypeptide
DEEEIRTTNPVATEQYGQCVCGWGEHNQENFNSDTQS

SEQ ID NO: 182753 - protein, 38 aa, Artificial Sequence
  Description of Artificial Sequence: Synthetic polypeptide
DEEEIRTTNPVATEQYGQCSCSWGEDHNQEYFDSDNQS

SEQ ID NO: 182754 - protein, 38 aa, Artificial Sequence
  Description of Artificial Sequence: Synthetic polypeptide
DEGEIRTTNPVATEQYGSIVNYTEMNYEDVNNQMEAIA

SEQ ID NO: 182755 - protein, 38 aa, Artificial Sequence
  Description of Artificial Sequence: Synthetic polypeptide
DEEEIRTTNPVATEQYGQCSCSWGEDDNAEYFNSDTQS

SEQ ID NO: 182756 - protein, 38 aa, Artificial Sequence
  Description of Artificial Sequence: Synthetic polypeptide
DEEEIRSTNPVATEQYGMVSAEGMGDGGQGQENQERGF

SEQ ID NO: 182757 - protein, 37 aa, Artificial Sequence
  Description of Artificial Sequence: Synthetic polypeptide
DEGEIRTTNPVATEQYGSTYMSYASEDQVMSDNDEIQ

SEQ ID NO: 182758 - protein, 37 aa, Artificial Sequence
  Description of Artificial Sequence: Synthetic polypeptide
DEEPIRMTNPVAYEAYGETVPSCTEELSQMTDEHNRH

SEQ ID NO: 182759 - protein, 36 aa, Artificial Sequence
  Description of Artificial Sequence: Synthetic polypeptide
DEEEIRSTNPVATEQYGMSGNGQGDEGQGGGEEIQT

SEQ ID NO: 182760 - protein, 35 aa, Artificial Sequence
  Description of Artificial Sequence: Synthetic polypeptide
DEEPIRTTNPCAYARYGESVAYTANEHSGIGGNYG

SEQ ID NO: 182761 - protein, 36 aa, Artificial Sequence
  Description of Artificial Sequence: Synthetic polypeptide
DEAEAEIRTTNPCAYEQWGSVVITPNWENEGSGGDV

SEQ ID NO: 182762 - protein, 37 aa, Artificial Sequence
  Description of Artificial Sequence: Synthetic polypeptide
DEEPIRTTNPVAYEPPYYQGVNSNTNDLLQPRSIEKH

SEQ ID NO: 182763 - protein, 35 aa, Artificial Sequence
  Description of Artificial Sequence: Synthetic polypeptide
DEAEEATTNPVAYERWGSVSGGNADDSRNNGNGNA

SEQ ID NO: 182764 - protein, 38 aa, Artificial Sequence
  Description of Artificial Sequence: Synthetic polypeptide
DEEEIRTTNPVATEQYGNVVGGPSNNNVESLENNVDQL

SEQ ID NO: 182765 - protein, 38 aa, Artificial Sequence
  Description of Artificial Sequence: Synthetic polypeptide
DEEEIRTTNPVATEQYGNVVMGDMNNDNEQFTQGDQTD

SEQ ID NO: 182766 - protein, 35 aa, Artificial Sequence
  Description of Artificial Sequence: Synthetic polypeptide
DEEQIACTNPVATAQWGSVASGHGPLGAPAGNGAQ

SEQ ID NO: 182767 - protein, 34 aa, Artificial Sequence
  Description of Artificial Sequence: Synthetic polypeptide
DEEQIACTNPVATAQWGSVASGHGPLGAPGGGTS

SEQ ID NO: 182768 - protein, 38 aa, Artificial Sequence
  Description of Artificial Sequence: Synthetic polypeptide
DEEEIRTTNPVATEQYGQCQSYPTVNHEQSTLAVEQSG

SEQ ID NO: 182769 - protein, 35 aa, Artificial Sequence
  Description of Artificial Sequence: Synthetic polypeptide
DEEQIACTNPVATAQWGSVASGHGPLNAPGGNEHQ

SEQ ID NO: 182770 - protein, 38 aa, Artificial Sequence
  Description of Artificial Sequence: Synthetic polypeptide
DEEEIRTTNPVATEQYGQCSCSNWGEPHNQENFNSDQA

SEQ ID NO: 182771 - protein, 38 aa, Artificial Sequence
  Description of Artificial Sequence: Synthetic polypeptide
DEEEIRTTNPVATEQYGQCSCSSGEPHNAENFNSDTQA

SEQ ID NO: 182772 - protein, 35 aa, Artificial Sequence
  Description of Artificial Sequence: Synthetic polypeptide
DEEQIACTNPVATAQWGSVATGHGPLANPGGNNHM

SEQ ID NO: 182773 - protein, 30 aa, Artificial Sequence
  Description of Artificial Sequence: Synthetic polypeptide
QESEIASTNPVGTEAWGVCAPTDRDQHGDQ

SEQ ID NO: 182774 - protein, 39 aa, Artificial Sequence
  Description of Artificial Sequence: Synthetic polypeptide
DEGEIRTTNPVATEQYGSLSITWCQAQENDEHEQSHANP

SEQ ID NO: 182775 - protein, 38 aa, Artificial Sequence
  Description of Artificial Sequence: Synthetic polypeptide
DEEEIRTTNPVATEQYGQCVCSMSGEDHNTENFISDQS

SEQ ID NO: 182776 - protein, 38 aa, Artificial Sequence
  Description of Artificial Sequence: Synthetic polypeptide
DEEEIRSTNPVATEQYGMVSVEGMGDGGQGEENEERGS

SEQ ID NO: 182777 - protein, 37 aa, Artificial Sequence
  Description of Artificial Sequence: Synthetic polypeptide
DEGEIRTTNPVATEQYGSCSTSEDTMDEHFYGEDKID

SEQ ID NO: 182778 - protein, 38 aa, Artificial Sequence
  Description of Artificial Sequence: Synthetic polypeptide
DEEEIRTTNPVATEQYGQCVCSMTEDHNQENFISDTQA

SEQ ID NO: 182779 - protein, 37 aa, Artificial Sequence
  Description of Artificial Sequence: Synthetic polypeptide
DEEEIRTTNPVATEQYGQCVCSNSGEHAEFFGSDTQD

SEQ ID NO: 182780 - protein, 38 aa, Artificial Sequence
  Description of Artificial Sequence: Synthetic polypeptide
DEEEIRTTNPVATEQYGQCVCSNSGEHNAEYFNSDNQS

SEQ ID NO: 182781 - protein, 38 aa, Artificial Sequence
  Description of Artificial Sequence: Synthetic polypeptide
DEEEIRTTNPVATEQYGQCVCSNSGEHNAEYFNSETQS

SEQ ID NO: 182782 - protein, 38 aa, Artificial Sequence
  Description of Artificial Sequence: Synthetic polypeptide
DEEEIRTTNPVATEQYGQCVCSNSGEHNIEFFNSDTQA

SEQ ID NO: 182783 - protein, 38 aa, Artificial Sequence
  Description of Artificial Sequence: Synthetic polypeptide
DEEEIRTTNPVATEQYGQCVCSNSGEHNQEFFISDNQS

SEQ ID NO: 182784 - protein, 30 aa, Artificial Sequence
  Description of Artificial Sequence: Synthetic polypeptide
QESEIASTNPVGTEGWGAMWANSTLAHGDI

SEQ ID NO: 182785 - protein, 31 aa, Artificial Sequence
  Description of Artificial Sequence: Synthetic polypeptide
QESEIASTNPVGTEGWGATMWASTLQHGDYI

SEQ ID NO: 182786 - protein, 38 aa, Artificial Sequence
  Description of Artificial Sequence: Synthetic polypeptide
DEEEIRTTNPVATEQYGQCVCSNSGEHNQEGFGSDTQA

SEQ ID NO: 182787 - protein, 39 aa, Artificial Sequence
  Description of Artificial Sequence: Synthetic polypeptide
DEEEIRTTNPVATEQYGQCVCSNSGEDHNQENFGSDNQS

SEQ ID NO: 182788 - protein, 38 aa, Artificial Sequence
  Description of Artificial Sequence: Synthetic polypeptide
DEEEIRTTNPVATEQYGQCVCSNSGEHNQENFGSQTQS

SEQ ID NO: 182789 - protein, 30 aa, Artificial Sequence
  Description of Artificial Sequence: Synthetic polypeptide
QESEIASTNPVGTEGWGVCAPTDDQHGDTE

SEQ ID NO: 182790 - protein, 38 aa, Artificial Sequence
  Description of Artificial Sequence: Synthetic polypeptide
DEEEIRTTNPVATEQYGQCVCSNSGEPNQEFFNSDNQS

SEQ ID NO: 182791 - protein, 38 aa, Artificial Sequence
  Description of Artificial Sequence: Synthetic polypeptide
DEEEIRTTNPVATEQYGQCVCSNSGETEAENFNSDTQN

SEQ ID NO: 182792 - protein, 30 aa, Artificial Sequence
  Description of Artificial Sequence: Synthetic polypeptide
QESEIASTNPVGTEGWGVCAPTDNQHGDIE

SEQ ID NO: 182793 - protein, 31 aa, Artificial Sequence
  Description of Artificial Sequence: Synthetic polypeptide
QESEIASTNPVGTEGWGVCAWTDNQQHQGDI

SEQ ID NO: 182794 - protein, 38 aa, Artificial Sequence
  Description of Artificial Sequence: Synthetic polypeptide
DEEEIRTTNPVATEQYGQCVCSNSGPHNAENFNSDNQA

SEQ ID NO: 182795 - protein, 39 aa, Artificial Sequence
  Description of Artificial Sequence: Synthetic polypeptide
DEEEIRTTNPVATEQYGQCVCSNSPEDHNQENFGSDNQS

SEQ ID NO: 182796 - protein, 38 aa, Artificial Sequence
  Description of Artificial Sequence: Synthetic polypeptide
DEEEIRTTNPVATEQYGQCVCSNSPEHNAENFNSDTQS

SEQ ID NO: 182797 - protein, 33 aa, Artificial Sequence
  Description of Artificial Sequence: Synthetic polypeptide
QESEIASTNPVGTEGWGSVACINEPQDHEGENI

SEQ ID NO: 182798 - protein, 39 aa, Artificial Sequence
  Description of Artificial Sequence: Synthetic polypeptide
DEEEIRTTNPVATEQYGQCVCSNSGEDHNAENFGSENQS

SEQ ID NO: 182799 - protein, 39 aa, Artificial Sequence
  Description of Artificial Sequence: Synthetic polypeptide
DEEEIRTTNPVATEQYGQCVCSNSGEDHEQEYFGSENQN

SEQ ID NO: 182800 - protein, 38 aa, Artificial Sequence
  Description of Artificial Sequence: Synthetic polypeptide
DEEEIRTTNPVATEQYGQCVCSMWMEHNQENFNSDTQA

SEQ ID NO: 182801 - protein, 36 aa, Artificial Sequence
  Description of Artificial Sequence: Synthetic polypeptide
DDEEISTTNPVATEQYGQCVCSWEEHNQHFGSETQA

SEQ ID NO: 182802 - protein, 40 aa, Artificial Sequence
  Description of Artificial Sequence: Synthetic polypeptide
DEEEIRTTNPVATEQYGVVSTVVVTTNNQEQGTEEEEDED

SEQ ID NO: 182803 - protein, 40 aa, Artificial Sequence
  Description of Artificial Sequence: Synthetic polypeptide
DEEEIRTTNPVATEQYGVVSTVVVTTNNQQQGTTEEEEED

SEQ ID NO: 182804 - protein, 40 aa, Artificial Sequence
  Description of Artificial Sequence: Synthetic polypeptide
DEEEIRTTNPVATEQYGVVSTVVVTTNNTEQGTNEEEEED

SEQ ID NO: 182805 - protein, 37 aa, Artificial Sequence
  Description of Artificial Sequence: Synthetic polypeptide
DDEEISTTNPVATEQYGQCVCSWEEHNQEYFGSDNQS

SEQ ID NO: 182806 - protein, 38 aa, Artificial Sequence
  Description of Artificial Sequence: Synthetic polypeptide
DEGEIRTTNPVATEQYGSCNNDSYNPEIIIRDGSQFDD

SEQ ID NO: 182807 - protein, 32 aa, Artificial Sequence
  Description of Artificial Sequence: Synthetic polypeptide
QESEIASTNPVGTECYGVVSSITEQDHEGEDG

SEQ ID NO: 182808 - protein, 37 aa, Artificial Sequence
  Description of Artificial Sequence: Synthetic polypeptide
DDEEISTTNPVATEQYGQCVCSWEEHNAEFFGSDNQA

SEQ ID NO: 182809 - protein, 39 aa, Artificial Sequence
  Description of Artificial Sequence: Synthetic polypeptide
DEEEIRTTNPVATEQYGQCVCSMTGEDHNAENFGSDTQP

SEQ ID NO: 182810 - protein, 39 aa, Artificial Sequence
  Description of Artificial Sequence: Synthetic polypeptide
DEEEIRTTNPVATEQYGQCVCSMTGEDHNQENFGSDFQI

SEQ ID NO: 182811 - protein, 36 aa, Artificial Sequence
  Description of Artificial Sequence: Synthetic polypeptide
DEGEIRTTNPVATEQYGSCNNAYDEVNPRYGEEVHQ

SEQ ID NO: 182812 - protein, 38 aa, Artificial Sequence
  Description of Artificial Sequence: Synthetic polypeptide
DEEEIRTTNPVATEQYGQCVCSMWEEHNQENFNSDNQS

SEQ ID NO: 182813 - protein, 38 aa, Artificial Sequence
  Description of Artificial Sequence: Synthetic polypeptide
DEEEIRTTNPVATEQYGQCVCSMWGEDHNQNFNSDFQI

SEQ ID NO: 182814 - protein, 38 aa, Artificial Sequence
  Description of Artificial Sequence: Synthetic polypeptide
DEEEIRTTNPVATEQYGQCVCSMWGEHNAENFGSETQA

SEQ ID NO: 182815 - protein, 38 aa, Artificial Sequence
  Description of Artificial Sequence: Synthetic polypeptide
DEEEIRTTNPVATEQYGQCVCSMWGEHNQEHFNSDTQL

SEQ ID NO: 182816 - protein, 38 aa, Artificial Sequence
  Description of Artificial Sequence: Synthetic polypeptide
DEEEIRTTNPVATEQYGQCVCSMWGEHNQEHFNSDTQS

SEQ ID NO: 182817 - protein, 38 aa, Artificial Sequence
  Description of Artificial Sequence: Synthetic polypeptide
DEEEIRTTNPVATEQYGQCVCSMWGEHNQENFNSDPQS

SEQ ID NO: 182818 - protein, 38 aa, Artificial Sequence
  Description of Artificial Sequence: Synthetic polypeptide
DEEEIRTTNPVATEQYGQCVCSMWGEHNQENFNSDTQA

SEQ ID NO: 182819 - protein, 39 aa, Artificial Sequence
  Description of Artificial Sequence: Synthetic polypeptide
DEEEIRTTNPVATEQYGVVSTVVVTTNQNQGTEEEEEED

SEQ ID NO: 182820 - protein, 35 aa, Artificial Sequence
  Description of Artificial Sequence: Synthetic polypeptide
DDEEIRTTNPVATEAYGVVDGGETEGDEDGEGGEI

SEQ ID NO: 182821 - protein, 38 aa, Artificial Sequence
  Description of Artificial Sequence: Synthetic polypeptide
DEEEIRSTNPVATEQYGMVSVEGMGDGGQGFENQERGG

SEQ ID NO: 182822 - protein, 38 aa, Artificial Sequence
  Description of Artificial Sequence: Synthetic polypeptide
DEEEIRSTNPVATEQYGMVSVEGMGDPGEGQENQERGS

SEQ ID NO: 182823 - protein, 38 aa, Artificial Sequence
  Description of Artificial Sequence: Synthetic polypeptide
DEEEIRSTNPVATEQYGMVSVEGMGLGGQGQENQEDGS

SEQ ID NO: 182824 - protein, 39 aa, Artificial Sequence
  Description of Artificial Sequence: Synthetic polypeptide
DEEEIRTTNPVATEQYGHFWNVNPNLPDEDIEPSNYDRM

SEQ ID NO: 182825 - protein, 39 aa, Artificial Sequence
  Description of Artificial Sequence: Synthetic polypeptide
DEEEIRTTNPVATEQYGHNIVTWSVWDEEQNNEPEINRV

SEQ ID NO: 182826 - protein, 36 aa, Artificial Sequence
  Description of Artificial Sequence: Synthetic polypeptide
DEEEIRTTNPCATEEYGCVCGNTGEHNTENFGSDAA

SEQ ID NO: 182827 - protein, 37 aa, Artificial Sequence
  Description of Artificial Sequence: Synthetic polypeptide
DEEEIRTTNPVATEQYGSIEITAPAGVEGQQALLDPT

SEQ ID NO: 182828 - protein, 37 aa, Artificial Sequence
  Description of Artificial Sequence: Synthetic polypeptide
DEEESIRTCQNYAIYTEAQKYDFVSSHWNWLERLGNR

SEQ ID NO: 182829 - protein, 37 aa, Artificial Sequence
  Description of Artificial Sequence: Synthetic polypeptide
DEEEIRTTNPCATEAYGVVATTTQLQAGTEQGTTVVE

SEQ ID NO: 182830 - protein, 37 aa, Artificial Sequence
  Description of Artificial Sequence: Synthetic polypeptide
DEEEIRTTNPVAYECWGSVSGGEPANGPNMRNGGGVV

SEQ ID NO: 182831 - protein, 37 aa, Artificial Sequence
  Description of Artificial Sequence: Synthetic polypeptide
DEEEIRTTNPVATEQYGIVCVHPSPVNMPNIVDMFET

SEQ ID NO: 182832 - protein, 35 aa, Artificial Sequence
  Description of Artificial Sequence: Synthetic polypeptide
DEEEIRTTNPCATEEYGCVCGNWGEHNANFNSDAA

SEQ ID NO: 182833 - protein, 32 aa, Artificial Sequence
  Description of Artificial Sequence: Synthetic polypeptide
DDMEVATTNPVSTEGYGTVCSANGIESFEGQD

SEQ ID NO: 182834 - protein, 36 aa, Artificial Sequence
  Description of Artificial Sequence: Synthetic polypeptide
DEEEIRTTNPCATCQYGCVCPWGEDNQEYFGSDNQA

SEQ ID NO: 182835 - protein, 37 aa, Artificial Sequence
  Description of Artificial Sequence: Synthetic polypeptide
DEEEIRTTNPVATEQYGLVCPAFNAVTEERELVEMEA

SEQ ID NO: 182836 - protein, 40 aa, Artificial Sequence
  Description of Artificial Sequence: Synthetic polypeptide
DEEEIRTTNPVATEQYGVVSTVVVTQAGNNDETEEENTET

SEQ ID NO: 182837 - protein, 37 aa, Artificial Sequence
  Description of Artificial Sequence: Synthetic polypeptide
DEEEIRTTNPVATEQYGMAQFITMGEEQPEPGSVTEI

SEQ ID NO: 182838 - protein, 38 aa, Artificial Sequence
  Description of Artificial Sequence: Synthetic polypeptide
DEEEIRTTNPVATEQYGMCGEPTHNAMEMHELGEELQR

SEQ ID NO: 182839 - protein, 38 aa, Artificial Sequence
  Description of Artificial Sequence: Synthetic polypeptide
DEEEIRTTNPVATEQYGMMGYDGSGNMNDIMAEGGTNT

SEQ ID NO: 182840 - protein, 35 aa, Artificial Sequence
  Description of Artificial Sequence: Synthetic polypeptide
DDMEIRTTNPVATEQYGCCSCPQNMQEDSESQQDE

SEQ ID NO: 182841 - protein, 40 aa, Artificial Sequence
  Description of Artificial Sequence: Synthetic polypeptide
DEEEIRTTNPVATEQYGVVSTVVVTQAGNNDGTEEEENEQ

SEQ ID NO: 182842 - protein, 36 aa, Artificial Sequence
  Description of Artificial Sequence: Synthetic polypeptide
DDMEIVTTNPVATEQYGCVCSNTGEPNEEFFGSDQS

SEQ ID NO: 182843 - protein, 37 aa, Artificial Sequence
  Description of Artificial Sequence: Synthetic polypeptide
DEEEIRTTNPVATEQYGSIETTTPAGVEIQQALLDPT

SEQ ID NO: 182844 - protein, 38 aa, Artificial Sequence
  Description of Artificial Sequence: Synthetic polypeptide
DEGEIRTTNPVATEQYGSVFETVTPWEEGTENGQDHMI

SEQ ID NO: 182845 - protein, 36 aa, Artificial Sequence
  Description of Artificial Sequence: Synthetic polypeptide
DDNEISTTNPVATEQYGCVCSNTEEHNQENFNSDQS

SEQ ID NO: 182846 - protein, 38 aa, Artificial Sequence
  Description of Artificial Sequence: Synthetic polypeptide
DEGEIRTTNPVATEQYGSVISVPWNYDESPFFGQDQHA

SEQ ID NO: 182847 - protein, 35 aa, Artificial Sequence
  Description of Artificial Sequence: Synthetic polypeptide
DEEEIRTTNPCATEGYGCCCSNWEEHNAYFGSDQS

SEQ ID NO: 182848 - protein, 36 aa, Artificial Sequence
  Description of Artificial Sequence: Synthetic polypeptide
DEEEIRTTNPVAYEGYGQCVCSWGEHEQENFNSEQF

SEQ ID NO: 182849 - protein, 38 aa, Artificial Sequence
  Description of Artificial Sequence: Synthetic polypeptide
DEEEIRTTNPVATEQYGEWCVVPEYLSTTEAQENVIEQ

SEQ ID NO: 182850 - protein, 35 aa, Artificial Sequence
  Description of Artificial Sequence: Synthetic polypeptide
DEEEIRTTNPVATEQYGFCNWPEIPDDADEKDIRF

SEQ ID NO: 182851 - protein, 37 aa, Artificial Sequence
  Description of Artificial Sequence: Synthetic polypeptide
DEGEIRTTNPVATEQYGSVIPVPWNYDESPFGQDQDA

SEQ ID NO: 182852 - protein, 38 aa, Artificial Sequence
  Description of Artificial Sequence: Synthetic polypeptide
DEEEIRTTNPVATEQYGFICQCCTPNEIGQEQEANNQV

SEQ ID NO: 182853 - protein, 38 aa, Artificial Sequence
  Description of Artificial Sequence: Synthetic polypeptide
DEEEIRTTNPVATEQYGFICQCQTPNEIGQEQEAFNWQ

SEQ ID NO: 182854 - protein, 37 aa, Artificial Sequence
  Description of Artificial Sequence: Synthetic polypeptide
DEEEIRTTNPVATEQYGSIGEPIMFTDDSAQIPIQVL

SEQ ID NO: 182855 - protein, 37 aa, Artificial Sequence
  Description of Artificial Sequence: Synthetic polypeptide
DEEEIRTTNPVAYEGYGCVTSTWGAHNAEHFNSDPQA

SEQ ID NO: 182856 - protein, 38 aa, Artificial Sequence
  Description of Artificial Sequence: Synthetic polypeptide
DEEEIRTTNPVATEQYGFICQTTPNEIGQEQEANNWQF

SEQ ID NO: 182857 - protein, 37 aa, Artificial Sequence
  Description of Artificial Sequence: Synthetic polypeptide
DEEEIRTTNPVAYEGYGCSCSTWGEHNQEYFNSDTQA

SEQ ID NO: 182858 - protein, 37 aa, Artificial Sequence
  Description of Artificial Sequence: Synthetic polypeptide
DEEEIRTTNPVATEQYGFVCVHPSPVWMPNVVMQDEL

SEQ ID NO: 182859 - protein, 36 aa, Artificial Sequence
  Description of Artificial Sequence: Synthetic polypeptide
DEACISTTNPVATEQYGCVCSNWGEHEQNFGSDNQS

SEQ ID NO: 182860 - protein, 31 aa, Artificial Sequence
  Description of Artificial Sequence: Synthetic polypeptide
DDNEVASTNPVSTEGWGNVAANTIQSRVGQA

SEQ ID NO: 182861 - protein, 37 aa, Artificial Sequence
  Description of Artificial Sequence: Synthetic polypeptide
DEEEIRTTNPVATEQYGSIFYPPEPVVQLQGLMVDQN

SEQ ID NO: 182862 - protein, 37 aa, Artificial Sequence
  Description of Artificial Sequence: Synthetic polypeptide
DEEEIRTTNPVATEQYGGVCVHPSPVHMPNYVDMVEG

SEQ ID NO: 182863 - protein, 31 aa, Artificial Sequence
  Description of Artificial Sequence: Synthetic polypeptide
QESEIASTNPVATEGYGTMCAASDTPEFGDD

SEQ ID NO: 182864 - protein, 32 aa, Artificial Sequence
  Description of Artificial Sequence: Synthetic polypeptide
QESEIASTNPVATEGYGTMCAASDTPVEFGDD

SEQ ID NO: 182865 - protein, 39 aa, Artificial Sequence
  Description of Artificial Sequence: Synthetic polypeptide
DEEEIRTTNPVATEQYGMSIVVLGSMNTEQGIIQTFDDQ

SEQ ID NO: 182866 - protein, 37 aa, Artificial Sequence
  Description of Artificial Sequence: Synthetic polypeptide
DEEEIRTTNPVATEQYGMVGALPHQYQDAQRFMQAEI

SEQ ID NO: 182867 - protein, 38 aa, Artificial Sequence
  Description of Artificial Sequence: Synthetic polypeptide
DDIEIRTTNPVATEQYGSNVNVTPLWEDQMEYDEIDNN

SEQ ID NO: 182868 - protein, 37 aa, Artificial Sequence
  Description of Artificial Sequence: Synthetic polypeptide
DDGEIRTTNPVATEQYGSTWAGAVMTDDGQHFFDENI

SEQ ID NO: 182869 - protein, 34 aa, Artificial Sequence
  Description of Artificial Sequence: Synthetic polypeptide
DEACSATTNPIAYEQWGEVCSTWEGLQQPDKNER

SEQ ID NO: 182870 - protein, 39 aa, Artificial Sequence
  Description of Artificial Sequence: Synthetic polypeptide
DEEEIRTTNPVATEQYGMVSVEGGMGDEGQGQENQERGV

SEQ ID NO: 182871 - protein, 37 aa, Artificial Sequence
  Description of Artificial Sequence: Synthetic polypeptide
DEEEIRTTNPVATEQYGMVSVEGMGDGGQGQEAAEDG

SEQ ID NO: 182872 - protein, 38 aa, Artificial Sequence
  Description of Artificial Sequence: Synthetic polypeptide
DEEEIRTTNPVATEQYGMVSVEGMGDGGQGQEAQENDT

SEQ ID NO: 182873 - protein, 37 aa, Artificial Sequence
  Description of Artificial Sequence: Synthetic polypeptide
DEEEIRTTNPVATEQYGMVSVEGMGDGGQGQEAQVGT

SEQ ID NO: 182874 - protein, 37 aa, Artificial Sequence
  Description of Artificial Sequence: Synthetic polypeptide
DEEEIRTTNPVATEQYGMVSVEGMGDGGQGQEMEAEP

SEQ ID NO: 182875 - protein, 36 aa, Artificial Sequence
  Description of Artificial Sequence: Synthetic polypeptide
DEADEIATTNPVAYEQWGVVSGGNGLNQQDHPNMGS

SEQ ID NO: 182876 - protein, 35 aa, Artificial Sequence
  Description of Artificial Sequence: Synthetic polypeptide
DEENIVCTTNPVAYEPYGQVVNCTSEASQASGNVV

SEQ ID NO: 182877 - protein, 37 aa, Artificial Sequence
  Description of Artificial Sequence: Synthetic polypeptide
DEEEIRTTNPVATEQYGMVSVEGMGDGGQGQEMPEGG

SEQ ID NO: 182878 - protein, 38 aa, Artificial Sequence
  Description of Artificial Sequence: Synthetic polypeptide
DEEEIRTTNPVATEQYGMVSVEGMGDGGQGQENQEQNT

SEQ ID NO: 182879 - protein, 34 aa, Artificial Sequence
  Description of Artificial Sequence: Synthetic polypeptide
DEADEIATTNPVAYERWGCVCVNDQAMDHRGDLD

SEQ ID NO: 182880 - protein, 35 aa, Artificial Sequence
  Description of Artificial Sequence: Synthetic polypeptide
DEAEAEIATTNPCAYEQWGSVVITPNFENEGSGDS

SEQ ID NO: 182881 - protein, 38 aa, Artificial Sequence
  Description of Artificial Sequence: Synthetic polypeptide
DEEEIRSTNPVATEQYGMVSVVGMGDGGQGQENQERGT

SEQ ID NO: 182882 - protein, 38 aa, Artificial Sequence
  Description of Artificial Sequence: Synthetic polypeptide
DEEEIRTTNPVATEQYGNMGDNMQENNGNQNGQGDGEE

SEQ ID NO: 182883 - protein, 38 aa, Artificial Sequence
  Description of Artificial Sequence: Synthetic polypeptide
DEEEIRTTNPVATEQYGNMGDNMQENNGNQQGLGEGEE

SEQ ID NO: 182884 - protein, 39 aa, Artificial Sequence
  Description of Artificial Sequence: Synthetic polypeptide
DEEEIRSTNPVATEQYGMVSVENGMGDGGQGQENEERGL

SEQ ID NO: 182885 - protein, 39 aa, Artificial Sequence
  Description of Artificial Sequence: Synthetic polypeptide
DEEEIRSTNPVATEQYGMVSVENGMGDGDQGQENQERGQ

SEQ ID NO: 182886 - protein, 37 aa, Artificial Sequence
  Description of Artificial Sequence: Synthetic polypeptide
DDEEIRTTNPVATDQYGSVVGFGNNNDDQQEGIETED

SEQ ID NO: 182887 - protein, 38 aa, Artificial Sequence
  Description of Artificial Sequence: Synthetic polypeptide
DEAEAEIRTTNPCAYEQWGSVVITPNDFERNERNGNDV

SEQ ID NO: 182888 - protein, 36 aa, Artificial Sequence
  Description of Artificial Sequence: Synthetic polypeptide
DDEPIRTTNPLAYEAYGKVSCTMPEHQSRNVGNNPN

SEQ ID NO: 182889 - protein, 37 aa, Artificial Sequence
  Description of Artificial Sequence: Synthetic polypeptide
DDEEISTTNPVATEQYGQCVCSNWEHNQENFGSENQS

SEQ ID NO: 182890 - protein, 33 aa, Artificial Sequence
  Description of Artificial Sequence: Synthetic polypeptide
DEACSATTNPIAYEQWGEVCSTWEGLQHDQNVD

SEQ ID NO: 182891 - protein, 34 aa, Artificial Sequence
  Description of Artificial Sequence: Synthetic polypeptide
DEACSATTNPIAYEQWGEVCSTWEGLDQHDMNNR

SEQ ID NO: 182892 - protein, 38 aa, Artificial Sequence
  Description of Artificial Sequence: Synthetic polypeptide
DDGEIRTTNPVATEQYGCTISNAVMTDDGQHIGFDENI

SEQ ID NO: 182893 - protein, 37 aa, Artificial Sequence
  Description of Artificial Sequence: Synthetic polypeptide
DDGEIRATNPVATEQYGCTISSAVMTDDGQHGFDENI

SEQ ID NO: 182894 - protein, 36 aa, Artificial Sequence
  Description of Artificial Sequence: Synthetic polypeptide
DEENEIATTNPVAYERWGVCVTTNPGNQGEVGNGDY

SEQ ID NO: 182895 - protein, 38 aa, Artificial Sequence
  Description of Artificial Sequence: Synthetic polypeptide
DEEEIRTTNPVATEQYGMVIAGPLEGVGPEHQAPPYRT

SEQ ID NO: 182896 - protein, 36 aa, Artificial Sequence
  Description of Artificial Sequence: Synthetic polypeptide
DEEEIRATNPVATEQWGGCVAITNHDEFAPMENNNN

SEQ ID NO: 182897 - protein, 38 aa, Artificial Sequence
  Description of Artificial Sequence: Synthetic polypeptide
DEEEIRTTNPVATEQYGSIASSYEWSQAMDNSEESSQE

SEQ ID NO: 182898 - protein, 38 aa, Artificial Sequence
  Description of Artificial Sequence: Synthetic polypeptide
DEENICTTNPVATEAYGSVVVTVTNQLQQLQQGTDEED

SEQ ID NO: 182899 - protein, 36 aa, Artificial Sequence
  Description of Artificial Sequence: Synthetic polypeptide
DEENICTTNPVATEAYGVVATVVNDQQQGTEEDEED

SEQ ID NO: 182900 - protein, 38 aa, Artificial Sequence
  Description of Artificial Sequence: Synthetic polypeptide
DEEEIRTTNPVATEQYGMVQFITMGNEEQPEPKSVAEI

SEQ ID NO: 182901 - protein, 37 aa, Artificial Sequence
  Description of Artificial Sequence: Synthetic polypeptide
DEEEIRTTNPVATEQYGSIASSYESQTDISEEISEQE

SEQ ID NO: 182902 - protein, 37 aa, Artificial Sequence
  Description of Artificial Sequence: Synthetic polypeptide
DEEEIRTTNPVATEQYGSIASSYESNTDDISEESEQE

SEQ ID NO: 182903 - protein, 38 aa, Artificial Sequence
  Description of Artificial Sequence: Synthetic polypeptide
DEEEIRTTNPVATEQYGMVQYPTMGFEEQPEPGSVAEI

SEQ ID NO: 182904 - protein, 38 aa, Artificial Sequence
  Description of Artificial Sequence: Synthetic polypeptide
DEENICTTNPVATEAYGVVSTVNANQLQQLQQGTDEED

SEQ ID NO: 182905 - protein, 38 aa, Artificial Sequence
  Description of Artificial Sequence: Synthetic polypeptide
DEEEIRTTNPVATEQYGSIAEPTFFGHEQYMNTNGEFH

SEQ ID NO: 182906 - protein, 38 aa, Artificial Sequence
  Description of Artificial Sequence: Synthetic polypeptide
DEENICTTNPVATEAYGVVSTVTNNNQQQLQQGEEDED

SEQ ID NO: 182907 - protein, 38 aa, Artificial Sequence
  Description of Artificial Sequence: Synthetic polypeptide
DEENICTTNPVATEAYGVVSTVVVNNLQQLQQGEEDED

SEQ ID NO: 182908 - protein, 36 aa, Artificial Sequence
  Description of Artificial Sequence: Synthetic polypeptide
DEEEIRSTNPVATESYGSVTVNGNMDIDGQGEDEEG

SEQ ID NO: 182909 - protein, 37 aa, Artificial Sequence
  Description of Artificial Sequence: Synthetic polypeptide
DEEEIRSTNPVATEQYGSYTIPWEEVNVTHAQYQLDI

SEQ ID NO: 182910 - protein, 36 aa, Artificial Sequence
  Description of Artificial Sequence: Synthetic polypeptide
DEENIRTTNPVATEQYGSVPWPPLIEEVPMMPLEQG

SEQ ID NO: 182911 - protein, 34 aa, Artificial Sequence
  Description of Artificial Sequence: Synthetic polypeptide
DEACSATTNPIAYEQWGEVCSTWEGLQEHDDNNR

SEQ ID NO: 182912 - protein, 35 aa, Artificial Sequence
  Description of Artificial Sequence: Synthetic polypeptide
DEEEIRTTNPCATEGYGCCCSWGEHNAENFQSDQA

SEQ ID NO: 182913 - protein, 37 aa, Artificial Sequence
  Description of Artificial Sequence: Synthetic polypeptide
DDEEISTTNPVATEQYGQCVCSMWGEHNQNFGSDNQS

SEQ ID NO: 182914 - protein, 37 aa, Artificial Sequence
  Description of Artificial Sequence: Synthetic polypeptide
DDEEISTTNPVATEQYGQCVCSMTGEPNQNFGSDTQS

SEQ ID NO: 182915 - protein, 38 aa, Artificial Sequence
  Description of Artificial Sequence: Synthetic polypeptide
DEEEIRTTNPVATEQYGQCVCSNWGEHNAENFNSETQA

SEQ ID NO: 182916 - protein, 38 aa, Artificial Sequence
  Description of Artificial Sequence: Synthetic polypeptide
DEEEIRTTNPVATEQYGQCVCSNWGEHNAENFNSNNQL

SEQ ID NO: 182917 - protein, 35 aa, Artificial Sequence
  Description of Artificial Sequence: Synthetic polypeptide
DEESIACTNPVATEQWGAVCSQNPVQETAGEPTGT

SEQ ID NO: 182918 - protein, 38 aa, Artificial Sequence
  Description of Artificial Sequence: Synthetic polypeptide
DEEEIRTTNPVATEQYGQCVCSNWGEHNEEHFNSDPQA

SEQ ID NO: 182919 - protein, 38 aa, Artificial Sequence
  Description of Artificial Sequence: Synthetic polypeptide
DEEEIRTTNPVATEQYGQCVCSNWGEHNEENFGSDTQS

SEQ ID NO: 182920 - protein, 38 aa, Artificial Sequence
  Description of Artificial Sequence: Synthetic polypeptide
DEEEIRTTNPVATEQYGQCVCSNWGEHNEENFNSDNQS

SEQ ID NO: 182921 - protein, 38 aa, Artificial Sequence
  Description of Artificial Sequence: Synthetic polypeptide
DEEEIRTTNPVATEQYGQCVCSNWGEHNIEFFNSDTQQ

SEQ ID NO: 182922 - protein, 38 aa, Artificial Sequence
  Description of Artificial Sequence: Synthetic polypeptide
DEEEIRTTNPVATEQYGQCVCSNWGEHNIENFNSDTQS

SEQ ID NO: 182923 - protein, 32 aa, Artificial Sequence
  Description of Artificial Sequence: Synthetic polypeptide
QESEIASTNPVGTEGYGVIACITELSQHGGDD

SEQ ID NO: 182924 - protein, 38 aa, Artificial Sequence
  Description of Artificial Sequence: Synthetic polypeptide
DEEEIRTTNPVATEQYGQCVCSNWGEHNQEHFNSDTQS

SEQ ID NO: 182925 - protein, 38 aa, Artificial Sequence
  Description of Artificial Sequence: Synthetic polypeptide
DEEEIRTTNPVATEQYGQCVCSNWGEHNQENFISDNQA

SEQ ID NO: 182926 - protein, 38 aa, Artificial Sequence
  Description of Artificial Sequence: Synthetic polypeptide
DEEEIRTTNPVATEQYGQCVCSNWGEHNQENFISENQA

SEQ ID NO: 182927 - protein, 38 aa, Artificial Sequence
  Description of Artificial Sequence: Synthetic polypeptide
DEEEIRTTNPVATEQYGQCVCSNWGEHNQENFNSDNQF

SEQ ID NO: 182928 - protein, 38 aa, Artificial Sequence
  Description of Artificial Sequence: Synthetic polypeptide
DEEEIRTTNPVATEQYGQCVCSNWGEHNQENFNSDTQA

SEQ ID NO: 182929 - protein, 38 aa, Artificial Sequence
  Description of Artificial Sequence: Synthetic polypeptide
DEEEIRTTNPVATEQYGQCVCSNWGEHNQENFNSETQA

SEQ ID NO: 182930 - protein, 38 aa, Artificial Sequence
  Description of Artificial Sequence: Synthetic polypeptide
DEEEIRTTNPVATEQYGQCVCSNWGEHNQENFSSDNQS

SEQ ID NO: 182931 - protein, 38 aa, Artificial Sequence
  Description of Artificial Sequence: Synthetic polypeptide
DEEEIRTTNPVATEQYGQCVCSNWGEHNQESFISDNQS

SEQ ID NO: 182932 - protein, 38 aa, Artificial Sequence
  Description of Artificial Sequence: Synthetic polypeptide
DEEEIRTTNPVATEQYGQCVCSNWGEHNQESFNSDNQA

SEQ ID NO: 182933 - protein, 38 aa, Artificial Sequence
  Description of Artificial Sequence: Synthetic polypeptide
DEEEIRTTNPVATEQYGQCVCSNWGEHNQENFGSDTQA

SEQ ID NO: 182934 - protein, 38 aa, Artificial Sequence
  Description of Artificial Sequence: Synthetic polypeptide
DEEEIRTTNPVATEQYGQCVCSNWGEHNAENFNSDTQY

SEQ ID NO: 182935 - protein, 38 aa, Artificial Sequence
  Description of Artificial Sequence: Synthetic polypeptide
DEEEIRTTNPVATEQYGQCVCSNWGEHNAENFNSDTQS

SEQ ID NO: 182936 - protein, 38 aa, Artificial Sequence
  Description of Artificial Sequence: Synthetic polypeptide
DEEEIRTTNPVATEQYGQCVCSNWGEHNAENFNSDTQN

SEQ ID NO: 182937 - protein, 38 aa, Artificial Sequence
  Description of Artificial Sequence: Synthetic polypeptide
DEEEIRTTNPVATEQYGQCVCSNWGEDNQEFFNSDNQS

SEQ ID NO: 182938 - protein, 38 aa, Artificial Sequence
  Description of Artificial Sequence: Synthetic polypeptide
DEEEIRTTNPVATEQYGQCVCSNWGEDNQENFNSDTQS

SEQ ID NO: 182939 - protein, 38 aa, Artificial Sequence
  Description of Artificial Sequence: Synthetic polypeptide
DEEEIRTTNPVATEQYGQCVCSNWGEDNQENFNSETQS

SEQ ID NO: 182940 - protein, 39 aa, Artificial Sequence
  Description of Artificial Sequence: Synthetic polypeptide
DEEEIRTTNPVATEQYGQCVCSNWGEDTNQENFNSDNQA

SEQ ID NO: 182941 - protein, 38 aa, Artificial Sequence
  Description of Artificial Sequence: Synthetic polypeptide
DDEEIRTTNPVATEFYGSVSIVNMDQGQQGEFDDFEQF

SEQ ID NO: 182942 - protein, 36 aa, Artificial Sequence
  Description of Artificial Sequence: Synthetic polypeptide
DEAEIACTNPVATEQWGSVSPQGNDINTAGDENDPD

SEQ ID NO: 182943 - protein, 39 aa, Artificial Sequence
  Description of Artificial Sequence: Synthetic polypeptide
DEEEIRTTNPVATEQYGQCVCSNWGEGHNQENFGSDNQS

SEQ ID NO: 182944 - protein, 38 aa, Artificial Sequence
  Description of Artificial Sequence: Synthetic polypeptide
DEEEIRTTNPVATEQYGQCVCSNWGEHDAEGFNSDTQA

SEQ ID NO: 182945 - protein, 38 aa, Artificial Sequence
  Description of Artificial Sequence: Synthetic polypeptide
DEEEIRTTNPVATEQYGQCVCSNWGEHDIEGFNSDTQG

SEQ ID NO: 182946 - protein, 38 aa, Artificial Sequence
  Description of Artificial Sequence: Synthetic polypeptide
DEEEIRTTNPVATEQYGQCVCSNWGEHDQEFFFSDNQS

SEQ ID NO: 182947 - protein, 38 aa, Artificial Sequence
  Description of Artificial Sequence: Synthetic polypeptide
DEEEIRTTNPVATEQYGQCVCSNWGEHEQEGFGSETQS

SEQ ID NO: 182948 - protein, 38 aa, Artificial Sequence
  Description of Artificial Sequence: Synthetic polypeptide
DEEEIRTTNPVATEQYGQCVCSNWGEHNAEFFNSDNQS

SEQ ID NO: 182949 - protein, 38 aa, Artificial Sequence
  Description of Artificial Sequence: Synthetic polypeptide
DEEEIRTTNPVATEQYGQCVCSNWGEHNAEHFNSDNQS

SEQ ID NO: 182950 - protein, 38 aa, Artificial Sequence
  Description of Artificial Sequence: Synthetic polypeptide
DEEEIRTTNPVATEQYGQCVCSNWGEHNAENFISDNQP

SEQ ID NO: 182951 - protein, 38 aa, Artificial Sequence
  Description of Artificial Sequence: Synthetic polypeptide
DDEEIRTTNPVATEFYGSVSIVNMTPGQQQEFDDNEQF

SEQ ID NO: 182952 - protein, 38 aa, Artificial Sequence
  Description of Artificial Sequence: Synthetic polypeptide
DEEEIRTTNPVATEQYGQCVCSNWGEHNAENFISDNQS

SEQ ID NO: 182953 - protein, 38 aa, Artificial Sequence
  Description of Artificial Sequence: Synthetic polypeptide
DEEEIRTTNPVATEQYGQCVCSNWGEHNAENFNSDTQA

SEQ ID NO: 182954 - protein, 39 aa, Artificial Sequence
  Description of Artificial Sequence: Synthetic polypeptide
DDEEIRTTNPVATEFYGSVSIVVNMDHGQQGEFDDNEQF

SEQ ID NO: 182955 - protein, 38 aa, Artificial Sequence
  Description of Artificial Sequence: Synthetic polypeptide
DEEEIRTTNPVATEQYGQCVCSNWGEHNAENFNSDTQF

SEQ ID NO: 182956 - protein, 38 aa, Artificial Sequence
  Description of Artificial Sequence: Synthetic polypeptide
DEEEIRTTNPVATEQYGQCVCSNWGEHNQEYFNSDNQA

SEQ ID NO: 182957 - protein, 38 aa, Artificial Sequence
  Description of Artificial Sequence: Synthetic polypeptide
DEEEIRTTNPVATEQYGQCVCSNWGEDNQEFFNSDNQA

SEQ ID NO: 182958 - protein, 38 aa, Artificial Sequence
  Description of Artificial Sequence: Synthetic polypeptide
DEEEIRTTNPVATEQYGQCVCSNWGEHNQEYFNSDNQL

SEQ ID NO: 182959 - protein, 38 aa, Artificial Sequence
  Description of Artificial Sequence: Synthetic polypeptide
DEEEIRTTNPVATEQYGQCVCSNWGEHNQEYFNSENQS

SEQ ID NO: 182960 - protein, 35 aa, Artificial Sequence
  Description of Artificial Sequence: Synthetic polypeptide
SEEEIRCTNPCATEQYGCVCSWMEDNAENFNSDQS

SEQ ID NO: 182961 - protein, 38 aa, Artificial Sequence
  Description of Artificial Sequence: Synthetic polypeptide
DEGEICTTNPVAYEQWGSCVYSDEINDGQHRMSQGMKR

SEQ ID NO: 182962 - protein, 30 aa, Artificial Sequence
  Description of Artificial Sequence: Synthetic polypeptide
QESEIASTNPVGTEGYGVMAMEDIQQHGDH

SEQ ID NO: 182963 - protein, 30 aa, Artificial Sequence
  Description of Artificial Sequence: Synthetic polypeptide
QESEIASTNPVGTEGYGVMAMEDIQQHGDI

SEQ ID NO: 182964 - protein, 30 aa, Artificial Sequence
  Description of Artificial Sequence: Synthetic polypeptide
QESEIASTNPVGTEGYGVMAMEDIQQQGDH

SEQ ID NO: 182965 - protein, 37 aa, Artificial Sequence
  Description of Artificial Sequence: Synthetic polypeptide
DEGEICTTNPVAYEQWGSCVYSDEINDGQHRESQGDV

SEQ ID NO: 182966 - protein, 37 aa, Artificial Sequence
  Description of Artificial Sequence: Synthetic polypeptide
DDEEIRTTNPVATEFYGTVANMTQNNDLEGFNGEGEN

SEQ ID NO: 182967 - protein, 35 aa, Artificial Sequence
  Description of Artificial Sequence: Synthetic polypeptide
SEEEIRCTNPCATEQYGCVCSWGELHNAYFGSDQS

SEQ ID NO: 182968 - protein, 37 aa, Artificial Sequence
  Description of Artificial Sequence: Synthetic polypeptide
DEGEICTTNPVAYEQWGSCVYSDEINDGQKRMSQGEV

SEQ ID NO: 182969 - protein, 34 aa, Artificial Sequence
  Description of Artificial Sequence: Synthetic polypeptide
SEEEIRCTNPCATEQYGCVCSWGEHNANFNSDQS

SEQ ID NO: 182970 - protein, 37 aa, Artificial Sequence
  Description of Artificial Sequence: Synthetic polypeptide
DDEEIRTTNPVATEFYGTVVNNQQNNDLEGFNGEGET

SEQ ID NO: 182971 - protein, 37 aa, Artificial Sequence
  Description of Artificial Sequence: Synthetic polypeptide
DEESIACTNPVATEQYGSVCAATNNSENPDDGANDHD

SEQ ID NO: 182972 - protein, 37 aa, Artificial Sequence
  Description of Artificial Sequence: Synthetic polypeptide
DEESIACTNPVATEQYGSVCAATNNSENPDDGMNDAV

SEQ ID NO: 182973 - protein, 35 aa, Artificial Sequence
  Description of Artificial Sequence: Synthetic polypeptide
SEEEIRCTNPCATEQYGCVCSWEDDNAENFGSDQS

SEQ ID NO: 182974 - protein, 35 aa, Artificial Sequence
  Description of Artificial Sequence: Synthetic polypeptide
DEGEIATVNPVATAQWGGCVAGNGLQSRANNQGEE

SEQ ID NO: 182975 - protein, 37 aa, Artificial Sequence
  Description of Artificial Sequence: Synthetic polypeptide
DEESIACTNPVATEQYGSVCAMNNNSENPDDQMEGDN

SEQ ID NO: 182976 - protein, 36 aa, Artificial Sequence
  Description of Artificial Sequence: Synthetic polypeptide
SEEEIRCTNPCATEQYGCVCSNWGEHNAENFGSNQS

SEQ ID NO: 182977 - protein, 35 aa, Artificial Sequence
  Description of Artificial Sequence: Synthetic polypeptide
SEEEIRCTNPCATEQYGCVCSNWEHNAENFNSDQS

SEQ ID NO: 182978 - protein, 35 aa, Artificial Sequence
  Description of Artificial Sequence: Synthetic polypeptide
SEEEIRCTNPCATEQYGCVCSWGEGLNAHFGSDQS

SEQ ID NO: 182979 - protein, 36 aa, Artificial Sequence
  Description of Artificial Sequence: Synthetic polypeptide
DEESIACTNPVATEQYGSVCAATNNSENDDQANDAT

SEQ ID NO: 182980 - protein, 37 aa, Artificial Sequence
  Description of Artificial Sequence: Synthetic polypeptide
DEGEICTTNPVAYEQWGSCVYSDEWNDGQHRDDQGMN

SEQ ID NO: 182981 - protein, 36 aa, Artificial Sequence
  Description of Artificial Sequence: Synthetic polypeptide
DEESIACTNPVATEQYGSVCAATEVLEANGEQEEAD

SEQ ID NO: 182982 - protein, 39 aa, Artificial Sequence
  Description of Artificial Sequence: Synthetic polypeptide
DDEEIRTTNPVATEFYGSVSVVNNMDPGQQGEFDDNEQF

SEQ ID NO: 182983 - protein, 37 aa, Artificial Sequence
  Description of Artificial Sequence: Synthetic polypeptide
DEEEIRTTNPVATEQYGQCVCSNWGEHNQNFPSETQS

SEQ ID NO: 182984 - protein, 38 aa, Artificial Sequence
  Description of Artificial Sequence: Synthetic polypeptide
DEEEIRTTNPVATEQYGQCVCSNWGEHNTEHFNSDTQA

SEQ ID NO: 182985 - protein, 38 aa, Artificial Sequence
  Description of Artificial Sequence: Synthetic polypeptide
DEEEIRTTNPVATEQYGQCVCSNWGEHNTEHFNSDTQS

SEQ ID NO: 182986 - protein, 38 aa, Artificial Sequence
  Description of Artificial Sequence: Synthetic polypeptide
DDEEIRTTNPVATEFYGSVTVNMTGLQEDQDEGGETLQ

SEQ ID NO: 182987 - protein, 38 aa, Artificial Sequence
  Description of Artificial Sequence: Synthetic polypeptide
DEEEIRTTNPVATEQYGQCVCSNWGEHNTENFISDTQS

SEQ ID NO: 182988 - protein, 34 aa, Artificial Sequence
  Description of Artificial Sequence: Synthetic polypeptide
SEEEIRCTNPCAYEQYGCVCSWGEPNANFGSDQS

SEQ ID NO: 182989 - protein, 38 aa, Artificial Sequence
  Description of Artificial Sequence: Synthetic polypeptide
DEEEIRTTNPVATEQYGQCVCSNWGEHNTENFNSDTQA

SEQ ID NO: 182990 - protein, 38 aa, Artificial Sequence
  Description of Artificial Sequence: Synthetic polypeptide
DEEEIRTTNPVATEQYGQCVCSNWGEHNTEYFNSDNQS

SEQ ID NO: 182991 - protein, 36 aa, Artificial Sequence
  Description of Artificial Sequence: Synthetic polypeptide
DDEEIRTTNPVATEFYGSVVIVNMDGQGEFDDQEQA

SEQ ID NO: 182992 - protein, 38 aa, Artificial Sequence
  Description of Artificial Sequence: Synthetic polypeptide
DEEEIRTTNPVATEQYGQCVCSNWGPDHNQFFNSDNQS

SEQ ID NO: 182993 - protein, 35 aa, Artificial Sequence
  Description of Artificial Sequence: Synthetic polypeptide
DEESIACTNPVATEQWGSVSAGPPGANGAGMGTED

SEQ ID NO: 182994 - protein, 38 aa, Artificial Sequence
  Description of Artificial Sequence: Synthetic polypeptide
DEEEIRTTNPVATEQYGQCVCSSGADHNQENFNSDNQS

SEQ ID NO: 182995 - protein, 38 aa, Artificial Sequence
  Description of Artificial Sequence: Synthetic polypeptide
DDEEIRTTNPVATEFYGSVVSTDGFGTEQGENGQGTTN

SEQ ID NO: 182996 - protein, 35 aa, Artificial Sequence
  Description of Artificial Sequence: Synthetic polypeptide
SEEEIRCTNPCATEQYGQCVCSWGEDNAHFGSDQS

SEQ ID NO: 182997 - protein, 36 aa, Artificial Sequence
  Description of Artificial Sequence: Synthetic polypeptide
DEESIACTNPVATEQYGSCASGAPLFDNQAPEEGAE

SEQ ID NO: 182998 - protein, 36 aa, Artificial Sequence
  Description of Artificial Sequence: Synthetic polypeptide
DDEEISTTNPVATEQYGCVCSSGEHNQENFGSDTQQ

SEQ ID NO: 182999 - protein, 36 aa, Artificial Sequence
  Description of Artificial Sequence: Synthetic polypeptide
DEESIACTNPVATEQYGSVCAAMNNSEMDDGMNDDA

SEQ ID NO: 183000 - protein, 35 aa, Artificial Sequence
  Description of Artificial Sequence: Synthetic polypeptide
DEGEICTTNPVAYEQWGSCVYVDEWNDGQHRDQGH

SEQ ID NO: 183001 - protein, 38 aa, Artificial Sequence
  Description of Artificial Sequence: Synthetic polypeptide
DEEEIRTTNPVATEQYGQCVCSNWGEHNQEYFNSDTQS

SEQ ID NO: 183002 - protein, 38 aa, Artificial Sequence
  Description of Artificial Sequence: Synthetic polypeptide
DEEEIRTTNPVATEQYGQCVCSNWGEDNAENFNSENQA

SEQ ID NO: 183003 - protein, 39 aa, Artificial Sequence
  Description of Artificial Sequence: Synthetic polypeptide
DEEEIRTTNPVATEQYGQCVCSNWGEDHNTENFQSETQS

SEQ ID NO: 183004 - protein, 35 aa, Artificial Sequence
  Description of Artificial Sequence: Synthetic polypeptide
DEGEIRTTNPIATEQWGATTWANAEDLQEPKGTYI

SEQ ID NO: 183005 - protein, 37 aa, Artificial Sequence
  Description of Artificial Sequence: Synthetic polypeptide
DDEEISTTNPVATEQYGCVCSWGEDHNAENFGSDNQS

SEQ ID NO: 183006 - protein, 40 aa, Artificial Sequence
  Description of Artificial Sequence: Synthetic polypeptide
DEEEIRTTNPVATEQYGVVSTVVVVTQNQLQGEEEEEEED

SEQ ID NO: 183007 - protein, 38 aa, Artificial Sequence
  Description of Artificial Sequence: Synthetic polypeptide
DDEEIRTTNPVATEFYGMVSIVNMDNGQQGEFDDNEQF

SEQ ID NO: 183008 - protein, 36 aa, Artificial Sequence
  Description of Artificial Sequence: Synthetic polypeptide
DDEEISTTNPVATEQYGCVCSWEEDHNAEHFNSEQA

SEQ ID NO: 183009 - protein, 37 aa, Artificial Sequence
  Description of Artificial Sequence: Synthetic polypeptide
DDEEISTTNPVATEQYGCVCSTWGEHNAENFNSQNQL

SEQ ID NO: 183010 - protein, 38 aa, Artificial Sequence
  Description of Artificial Sequence: Synthetic polypeptide
DEEEIRTTNPVATEQYGQCVCSNWEDHNAEFFNSDTQS

SEQ ID NO: 183011 - protein, 38 aa, Artificial Sequence
  Description of Artificial Sequence: Synthetic polypeptide
DDEEIRTTNPVATEFYGQVNDNMDLQLDQGGGNGEQGD

SEQ ID NO: 183012 - protein, 38 aa, Artificial Sequence
  Description of Artificial Sequence: Synthetic polypeptide
DEEEIRTTNPVATEQYGQCVCSNWEDHNAENFNSDTQA

SEQ ID NO: 183013 - protein, 37 aa, Artificial Sequence
  Description of Artificial Sequence: Synthetic polypeptide
DDEEISTTNPVATEQYGCVCSWGEDHNEENFGSDNQM

SEQ ID NO: 183014 - protein, 37 aa, Artificial Sequence
  Description of Artificial Sequence: Synthetic polypeptide
DDEEIRTTNPVATEFYGQVNFNMDLQLDEGGGGETGT

SEQ ID NO: 183015 - protein, 38 aa, Artificial Sequence
  Description of Artificial Sequence: Synthetic polypeptide
DEEEIRTTNPVATEQYGQCVCSNWEEDDQENFGSDTQP

SEQ ID NO: 183016 - protein, 39 aa, Artificial Sequence
  Description of Artificial Sequence: Synthetic polypeptide
DEEEIRTTNPVATEQYGQCVCSNWEEDHNAENFGSDNQV

SEQ ID NO: 183017 - protein, 39 aa, Artificial Sequence
  Description of Artificial Sequence: Synthetic polypeptide
DEEEIRTTNPVATEQYGQCVCSNWEEDHNQEFFGSQNQA

SEQ ID NO: 183018 - protein, 38 aa, Artificial Sequence
  Description of Artificial Sequence: Synthetic polypeptide
DEEEIRTTNPVATEQYGQCVCSNWEEDHNQSFNSDTQA

SEQ ID NO: 183019 - protein, 39 aa, Artificial Sequence
  Description of Artificial Sequence: Synthetic polypeptide
DEEEIRTTNPVATEQYGQCVCSNWEEDHNTENFGSDNQS

SEQ ID NO: 183020 - protein, 35 aa, Artificial Sequence
  Description of Artificial Sequence: Synthetic polypeptide
DEESEIATTNPVAYERWGVCATTNLDPGDHPNNAE

SEQ ID NO: 183021 - protein, 38 aa, Artificial Sequence
  Description of Artificial Sequence: Synthetic polypeptide
DEEEIRTTNPVATEQYGQCVCSNWEEDNQENFNSDNQA

SEQ ID NO: 183022 - protein, 35 aa, Artificial Sequence
  Description of Artificial Sequence: Synthetic polypeptide
DEESEIATTNPVAYERWGVVYTTNGNQGEEVNGDD

SEQ ID NO: 183023 - protein, 38 aa, Artificial Sequence
  Description of Artificial Sequence: Synthetic polypeptide
DDEEIRTTNPVATEFYGQVNFNMDLQLDLGGGGGERGD

SEQ ID NO: 183024 - protein, 37 aa, Artificial Sequence
  Description of Artificial Sequence: Synthetic polypeptide
DDEEISTTNPVATEQYGCVCSWGEDHNQEFFGSDNQA

SEQ ID NO: 183025 - protein, 40 aa, Artificial Sequence
  Description of Artificial Sequence: Synthetic polypeptide
DEEEIRTTNPVATEQYGVVSTVVVVTNNTEQGTEENEEED

SEQ ID NO: 183026 - protein, 40 aa, Artificial Sequence
  Description of Artificial Sequence: Synthetic polypeptide
DEEEIRTTNPVATEQYGVVSTVVVVTNNQQQGTEGEEEEE

SEQ ID NO: 183027 - protein, 38 aa, Artificial Sequence
  Description of Artificial Sequence: Synthetic polypeptide
DEEEIRTTNPVATEQYGQCVCSNTGEDHNAENFISDQA

SEQ ID NO: 183028 - protein, 36 aa, Artificial Sequence
  Description of Artificial Sequence: Synthetic polypeptide
SEEEIRCTNPIATEQYGQCVCSWGELNANFGSDNQS

SEQ ID NO: 183029 - protein, 34 aa, Artificial Sequence
  Description of Artificial Sequence: Synthetic polypeptide
SEEEIRCTNPIATEQYGQCVCSWGEHANFGSDQA

SEQ ID NO: 183030 - protein, 39 aa, Artificial Sequence
  Description of Artificial Sequence: Synthetic polypeptide
DEEEIRTTNPVATEQYGQCVCSNTGEDHNAEYFMSDNQS

SEQ ID NO: 183031 - protein, 38 aa, Artificial Sequence
  Description of Artificial Sequence: Synthetic polypeptide
DEEEIRTTNPVATEQYGQCVCSNTGEHEAEGFGSDTQS

SEQ ID NO: 183032 - protein, 40 aa, Artificial Sequence
  Description of Artificial Sequence: Synthetic polypeptide
DEEEIRTTNPVATEQYGVVSTVVVVNNNQEQGTEEEEQED

SEQ ID NO: 183033 - protein, 31 aa, Artificial Sequence
  Description of Artificial Sequence: Synthetic polypeptide
QESEIASTNPVGTEGWGVMWANSTLQHKGDI

SEQ ID NO: 183034 - protein, 39 aa, Artificial Sequence
  Description of Artificial Sequence: Synthetic polypeptide
DEEEIRTTNPVATEQYGVVSTVVVVTNDEQGTEEEEETD

SEQ ID NO: 183035 - protein, 38 aa, Artificial Sequence
  Description of Artificial Sequence: Synthetic polypeptide
DEEEIRTTNPVATEQYGQCVCSNTGEHNQENFISDTQP

SEQ ID NO: 183036 - protein, 36 aa, Artificial Sequence
  Description of Artificial Sequence: Synthetic polypeptide
DDEEISTTNPVATEQYGCVCSWGEHNQENFNSENQS

SEQ ID NO: 183037 - protein, 40 aa, Artificial Sequence
  Description of Artificial Sequence: Synthetic polypeptide
DEEEIRTTNPVATEQYGVVSTVVVVTNNNQQGTEEEEEGD

SEQ ID NO: 183038 - protein, 36 aa, Artificial Sequence
  Description of Artificial Sequence: Synthetic polypeptide
DDEEISTTNPVATEQYGCVCSWGEHNQENFFSENQS

SEQ ID NO: 183039 - protein, 40 aa, Artificial Sequence
  Description of Artificial Sequence: Synthetic polypeptide
DEEEIRTTNPVATEQYGVVSTVVVVTNNQLQGTDEEEEET

SEQ ID NO: 183040 - protein, 40 aa, Artificial Sequence
  Description of Artificial Sequence: Synthetic polypeptide
DEEEIRTTNPVATEQYGVVSTVVVVTNNQNQGTDEEEEGD

SEQ ID NO: 183041 - protein, 36 aa, Artificial Sequence
  Description of Artificial Sequence: Synthetic polypeptide
DDEEISTTNPVATEQYGCVCSWGEHNAENFNSDTQA

SEQ ID NO: 183042 - protein, 36 aa, Artificial Sequence
  Description of Artificial Sequence: Synthetic polypeptide
DDEEISTTNPVATEQYGCVCSWGEDNQENFNSDNQS

SEQ ID NO: 183043 - protein, 37 aa, Artificial Sequence
  Description of Artificial Sequence: Synthetic polypeptide
DDEEISTTNPVATEQYGCVCSWGEDHNQEGFNSETQA

SEQ ID NO: 183044 - protein, 37 aa, Artificial Sequence
  Description of Artificial Sequence: Synthetic polypeptide
DDEEISTTNPVATEQYGCVCSWGEDHNQEFFGSENQG

SEQ ID NO: 183045 - protein, 40 aa, Artificial Sequence
  Description of Artificial Sequence: Synthetic polypeptide
DEEEIRTTNPVATEQYGVVSTVVVVTNNQQQGTEEEEEDT

SEQ ID NO: 183046 - protein, 38 aa, Artificial Sequence
  Description of Artificial Sequence: Synthetic polypeptide
DEEEIRTTNPVATEQYGSGYSLGFVEGEKNIVGEPENG

SEQ ID NO: 183047 - protein, 38 aa, Artificial Sequence
  Description of Artificial Sequence: Synthetic polypeptide
DEEEIRTTNPVATEQYGQCVCSNWEEHDQENFGSDTQD

SEQ ID NO: 183048 - protein, 35 aa, Artificial Sequence
  Description of Artificial Sequence: Synthetic polypeptide
DEESIACTNPVATAQWGSVAISGHGPLGAPGGNNS

SEQ ID NO: 183049 - protein, 34 aa, Artificial Sequence
  Description of Artificial Sequence: Synthetic polypeptide
DEESIACTNPVATAQWGSVANSGHGPLGAPLGDA

SEQ ID NO: 183050 - protein, 35 aa, Artificial Sequence
  Description of Artificial Sequence: Synthetic polypeptide
DEGEIRTTNPVATECWGSKFGPCINEPEARETENG

SEQ ID NO: 183051 - protein, 38 aa, Artificial Sequence
  Description of Artificial Sequence: Synthetic polypeptide
DDEEIRTTNPVATEFYGSVSGQGQGDLEVGNGGQETTA

SEQ ID NO: 183052 - protein, 34 aa, Artificial Sequence
  Description of Artificial Sequence: Synthetic polypeptide
DEESIACTNPVATASWGCVAGTGNLGPDDSGNEA

SEQ ID NO: 183053 - protein, 38 aa, Artificial Sequence
  Description of Artificial Sequence: Synthetic polypeptide
DEEEIRTTNPVATEQYGQCVCSNWEPHNQENFNSQNQS

SEQ ID NO: 183054 - protein, 38 aa, Artificial Sequence
  Description of Artificial Sequence: Synthetic polypeptide
DEEEIRTTNPVATEQYGQCVCSNWGEDDQENFNSDTQY

SEQ ID NO: 183055 - protein, 39 aa, Artificial Sequence
  Description of Artificial Sequence: Synthetic polypeptide
DEEEIRTTNPVATEQYGQCVCSNWGEDHNAENFGSDNQA

SEQ ID NO: 183056 - protein, 39 aa, Artificial Sequence
  Description of Artificial Sequence: Synthetic polypeptide
DEEEIRTTNPVATEQYGQCVCSNWGEDHNAENFGSDNQP

SEQ ID NO: 183057 - protein, 39 aa, Artificial Sequence
  Description of Artificial Sequence: Synthetic polypeptide
DEEEIRTTNPVATEQYGQCVCSNWGEDHNAENFGSDNQS

SEQ ID NO: 183058 - protein, 38 aa, Artificial Sequence
  Description of Artificial Sequence: Synthetic polypeptide
DEEEIRTTNPVATEQYGQCVCSNWGEDHNAENFGSDQS

SEQ ID NO: 183059 - protein, 39 aa, Artificial Sequence
  Description of Artificial Sequence: Synthetic polypeptide
DEEEIRTTNPVATEQYGQCVCSNWGEDHNIENFGSENQM

SEQ ID NO: 183060 - protein, 34 aa, Artificial Sequence
  Description of Artificial Sequence: Synthetic polypeptide
SEEEIRCTNPIATEQWGSTTWSNAENWMEPKGPI

SEQ ID NO: 183061 - protein, 39 aa, Artificial Sequence
  Description of Artificial Sequence: Synthetic polypeptide
DEEEIRTTNPVATEQYGQCVCSNWGEDHNQEGFGSDNQS

SEQ ID NO: 183062 - protein, 39 aa, Artificial Sequence
  Description of Artificial Sequence: Synthetic polypeptide
DEEEIRTTNPVATEQYGQCVCSNWGEDHNQEGFNSDTQS

SEQ ID NO: 183063 - protein, 39 aa, Artificial Sequence
  Description of Artificial Sequence: Synthetic polypeptide
DEEEIRTTNPVATEQYGQCVCSNWGEDHNQEGFNSENQA

SEQ ID NO: 183064 - protein, 38 aa, Artificial Sequence
  Description of Artificial Sequence: Synthetic polypeptide
DEEEIRTTNPVATEQYGQCVCSNWGEDHNQENFNSDQD

SEQ ID NO: 183065 - protein, 38 aa, Artificial Sequence
  Description of Artificial Sequence: Synthetic polypeptide
DEEEIRTTNPVATEQYGQCVCSNWGEDHNQGFGSETQA

SEQ ID NO: 183066 - protein, 38 aa, Artificial Sequence
  Description of Artificial Sequence: Synthetic polypeptide
DEEEIRTTNPVATEQYGQCVCSNWGEDHNQNFGSDTQL

SEQ ID NO: 183067 - protein, 38 aa, Artificial Sequence
  Description of Artificial Sequence: Synthetic polypeptide
DEEEIRTTNPVATEQYGQCVCSNWGEDHNQNFNSDTAS

SEQ ID NO: 183068 - protein, 39 aa, Artificial Sequence
  Description of Artificial Sequence: Synthetic polypeptide
DEEEIRTTNPVATEQYGQCVCSNWGEDHNTENFGSDNQA

SEQ ID NO: 183069 - protein, 39 aa, Artificial Sequence
  Description of Artificial Sequence: Synthetic polypeptide
DEEEIRTTNPVATEQYGQCVCSNWEEWHNQENFGSDNQS

SEQ ID NO: 183070 - protein, 36 aa, Artificial Sequence
  Description of Artificial Sequence: Synthetic polypeptide
DDEEISTTNPVATEQYGQCVCSMWGEDQNFGSDTQS

SEQ ID NO: 183071 - protein, 38 aa, Artificial Sequence
  Description of Artificial Sequence: Synthetic polypeptide
DEEEIRTTNPVATEQYGQCVCSNWEEPNEENFNSDTQA

SEQ ID NO: 183072 - protein, 35 aa, Artificial Sequence
  Description of Artificial Sequence: Synthetic polypeptide
SEEEIRCTNPIATEQYGCVCSNWEEHNANFGSDQS

SEQ ID NO: 183073 - protein, 38 aa, Artificial Sequence
  Description of Artificial Sequence: Synthetic polypeptide
DEEEIRTTNPVATEQYGQCVCSNWEEHEQEFFGSDTQD

SEQ ID NO: 183074 - protein, 35 aa, Artificial Sequence
  Description of Artificial Sequence: Synthetic polypeptide
DEGEIRTTNPVATEQYGCFCYVPVNEDKIESQQPL

SEQ ID NO: 183075 - protein, 34 aa, Artificial Sequence
  Description of Artificial Sequence: Synthetic polypeptide
DEESIACTNPVATAQWGSVASGHGPAGAPGGNHQ

SEQ ID NO: 183076 - protein, 38 aa, Artificial Sequence
  Description of Artificial Sequence: Synthetic polypeptide
DEEEIRTTNPVATEQYGQCVCSNWEEHNAENFNSDTQS

SEQ ID NO: 183077 - protein, 37 aa, Artificial Sequence
  Description of Artificial Sequence: Synthetic polypeptide
DEGEIRTTNPVATEQYGCFCYVPTNEDEKIEPQQLPM

SEQ ID NO: 183078 - protein, 34 aa, Artificial Sequence
  Description of Artificial Sequence: Synthetic polypeptide
DEESIACTNPVATAQWGSVASGHGPLGAPLGSHA

SEQ ID NO: 183079 - protein, 35 aa, Artificial Sequence
  Description of Artificial Sequence: Synthetic polypeptide
SEEEIRCTNPIATEQYGCVCSWGEDLANFGSDTQS

SEQ ID NO: 183080 - protein, 38 aa, Artificial Sequence
  Description of Artificial Sequence: Synthetic polypeptide
DEEEIRTTNPVATEQYGQCVCSNWEEHNAEYFNSDNQS

SEQ ID NO: 183081 - protein, 38 aa, Artificial Sequence
  Description of Artificial Sequence: Synthetic polypeptide
DEEEIRTTNPVATEQYGQCVCSNWEEHNQEHFNSDTQA

SEQ ID NO: 183082 - protein, 38 aa, Artificial Sequence
  Description of Artificial Sequence: Synthetic polypeptide
DEEEIRTTNPVATEQYGQCVCSNWEEHNQEHFNSDTQF

SEQ ID NO: 183083 - protein, 32 aa, Artificial Sequence
  Description of Artificial Sequence: Synthetic polypeptide
DEESIACTNPVATASWGCVAGTGELADNSDNN

SEQ ID NO: 183084 - protein, 36 aa, Artificial Sequence
  Description of Artificial Sequence: Synthetic polypeptide
DEGEIRTTNPVATEQYGCFCFTPTNEDTIEPQQNPL

SEQ ID NO: 183085 - protein, 31 aa, Artificial Sequence
  Description of Artificial Sequence: Synthetic polypeptide
DEESIACTNPVATASWGCVAGTGELADTSGM

SEQ ID NO: 183086 - protein, 38 aa, Artificial Sequence
  Description of Artificial Sequence: Synthetic polypeptide
DEEEIRTTNPVATEQYGQCVCSNWEEHNQENFSSDNQS

SEQ ID NO: 183087 - protein, 37 aa, Artificial Sequence
  Description of Artificial Sequence: Synthetic polypeptide
DDEEIRTTNPVATEFYGQVNFNMDLQMIGGGGGQTGT

SEQ ID NO: 183088 - protein, 32 aa, Artificial Sequence
  Description of Artificial Sequence: Synthetic polypeptide
DEESIACTNPVATASWGCVAGTGELQDNSHMM

SEQ ID NO: 183089 - protein, 37 aa, Artificial Sequence
  Description of Artificial Sequence: Synthetic polypeptide
DDEEIRTTNPVATEFYGQVNFNMDLQTIGGEGGETGT

SEQ ID NO: 183090 - protein, 37 aa, Artificial Sequence
  Description of Artificial Sequence: Synthetic polypeptide
DDEEIRTTNPVATEFYGQVNFNMDLQVIGGGGDETGT

SEQ ID NO: 183091 - protein, 34 aa, Artificial Sequence
  Description of Artificial Sequence: Synthetic polypeptide
DEESIACTNPVATASWGCVAGTGELQPNDSGNPN

SEQ ID NO: 183092 - protein, 33 aa, Artificial Sequence
  Description of Artificial Sequence: Synthetic polypeptide
DEESIACTNPVATASWGCVAGTGELQPNNSMNM

SEQ ID NO: 183093 - protein, 34 aa, Artificial Sequence
  Description of Artificial Sequence: Synthetic polypeptide
DEEEIRTTNPCATEGYGQCCCSWEHAEYFGSDQS

SEQ ID NO: 183094 - protein, 35 aa, Artificial Sequence
  Description of Artificial Sequence: Synthetic polypeptide
DEEEIRTTNPCATEGYGQCCCSWGNHANFGSDTQA

SEQ ID NO: 183095 - protein, 33 aa, Artificial Sequence
  Description of Artificial Sequence: Synthetic polypeptide
SEEEIRCTNPTAYECWGSSYGENDDMHRNGDNK

SEQ ID NO: 183096 - protein, 34 aa, Artificial Sequence
  Description of Artificial Sequence: Synthetic polypeptide
DEEEIRTTNPIATECWGATTWANADWMEPKGNYI

SEQ ID NO: 183097 - protein, 33 aa, Artificial Sequence
  Description of Artificial Sequence: Synthetic polypeptide
DEEEIRTTNPIATECWGATTWANADWAEPKGPI

SEQ ID NO: 183098 - protein, 37 aa, Artificial Sequence
  Description of Artificial Sequence: Synthetic polypeptide
DEEEISTTNPVATEQYGQCVCSWMEDHQESFNSDTQA

SEQ ID NO: 183099 - protein, 37 aa, Artificial Sequence
  Description of Artificial Sequence: Synthetic polypeptide
DEEEISTTNPVATEQYGQCVCSWMEHNQEFFNSDTQE

SEQ ID NO: 183100 - protein, 36 aa, Artificial Sequence
  Description of Artificial Sequence: Synthetic polypeptide
DEEEISTTNPVATEQYGQCVCSWMEHNQENFFSEQS

SEQ ID NO: 183101 - protein, 37 aa, Artificial Sequence
  Description of Artificial Sequence: Synthetic polypeptide
DEEEISTTNPVATEQYGQCVCSWMEHNQESFNSDNQA

SEQ ID NO: 183102 - protein, 37 aa, Artificial Sequence
  Description of Artificial Sequence: Synthetic polypeptide
DEEEISTTNPVATEQYGQCVCSWPEHNAENFNSDNQS

SEQ ID NO: 183103 - protein, 36 aa, Artificial Sequence
  Description of Artificial Sequence: Synthetic polypeptide
DEEEISTTNPVATEQYGQCYCSNTGEDHANFNSDQS

SEQ ID NO: 183104 - protein, 33 aa, Artificial Sequence
  Description of Artificial Sequence: Synthetic polypeptide
DEEEIRTTNPIATECWGATTWANAEDWAPGPYK

SEQ ID NO: 183105 - protein, 33 aa, Artificial Sequence
  Description of Artificial Sequence: Synthetic polypeptide
DEEEIRTTNPIATECWGATTWAEEDWAERGPYI

SEQ ID NO: 183106 - protein, 32 aa, Artificial Sequence
  Description of Artificial Sequence: Synthetic polypeptide
DEEEIRTTNPIATECWGATANAEVWAHKGPYI

SEQ ID NO: 183107 - protein, 32 aa, Artificial Sequence
  Description of Artificial Sequence: Synthetic polypeptide
DEEEIRTTNPIATECWGATANAEDWAPKGPYI

SEQ ID NO: 183108 - protein, 32 aa, Artificial Sequence
  Description of Artificial Sequence: Synthetic polypeptide
DEEEIRTTNPIATECWGATANAEDWAHKGPYI

SEQ ID NO: 183109 - protein, 36 aa, Artificial Sequence
  Description of Artificial Sequence: Synthetic polypeptide
DEEEIRTTNPGAYEHYGSVYACTAAISQNKGGSPHV

SEQ ID NO: 183110 - protein, 35 aa, Artificial Sequence
  Description of Artificial Sequence: Synthetic polypeptide
DEEEIRTTNPVAYEQWGHNNVYYWEEQQHQEGGTG

SEQ ID NO: 183111 - protein, 36 aa, Artificial Sequence
  Description of Artificial Sequence: Synthetic polypeptide
DEEEIRTTNPVAYEQWGHNNVYYWEEQQDRPTEGHE

SEQ ID NO: 183112 - protein, 36 aa, Artificial Sequence
  Description of Artificial Sequence: Synthetic polypeptide
DEACIRTTNPVATEQYGCVCSNWGEDNAEFFNSDQS

SEQ ID NO: 183113 - protein, 36 aa, Artificial Sequence
  Description of Artificial Sequence: Synthetic polypeptide
DEEEIRTTNPEATEQYGCVCGWMEHNAEYFNSDTQS

SEQ ID NO: 183114 - protein, 35 aa, Artificial Sequence
  Description of Artificial Sequence: Synthetic polypeptide
DEEEISTTNPVATEQYGQCYCSNWGEHINFNSDQS

SEQ ID NO: 183115 - protein, 36 aa, Artificial Sequence
  Description of Artificial Sequence: Synthetic polypeptide
DEEEISTTNPVATEQYGQCVCSWGPHQENFISEFQA

SEQ ID NO: 183116 - protein, 34 aa, Artificial Sequence
  Description of Artificial Sequence: Synthetic polypeptide
DEEEIRTTNPIATECWGATTWANANWMEPKGNYI

SEQ ID NO: 183117 - protein, 38 aa, Artificial Sequence
  Description of Artificial Sequence: Synthetic polypeptide
SEEEIRTTNPVATEQYGTVYISYTLIMHQMQSIQDENQ

SEQ ID NO: 183118 - protein, 37 aa, Artificial Sequence
  Description of Artificial Sequence: Synthetic polypeptide
DEEEIRTTNPIATECYGSTVSSNAPDWPAMPNGMPPI

SEQ ID NO: 183119 - protein, 34 aa, Artificial Sequence
  Description of Artificial Sequence: Synthetic polypeptide
DEGEIRTTNPVAYESYGSVCCLGGHSVTEGGTKH

SEQ ID NO: 183120 - protein, 35 aa, Artificial Sequence
  Description of Artificial Sequence: Synthetic polypeptide
DEEEIRTTNPIATECYGATWATAEAWAERNGMPYI

SEQ ID NO: 183121 - protein, 36 aa, Artificial Sequence
  Description of Artificial Sequence: Synthetic polypeptide
DEEEIRTTNPIATECWGAVWATTPDGPAERKGMNPV

SEQ ID NO: 183122 - protein, 35 aa, Artificial Sequence
  Description of Artificial Sequence: Synthetic polypeptide
DEEEIRTTNPIATECWGATWATTPDGPAERKGNPV

SEQ ID NO: 183123 - protein, 36 aa, Artificial Sequence
  Description of Artificial Sequence: Synthetic polypeptide
QEPEISTTNPVATEQYGDVITNDQNIGGEDGGGQEG

SEQ ID NO: 183124 - protein, 30 aa, Artificial Sequence
  Description of Artificial Sequence: Synthetic polypeptide
QEQEIAATNPCSYEQWGCGYCNWDQSGDTR

SEQ ID NO: 183125 - protein, 34 aa, Artificial Sequence
  Description of Artificial Sequence: Synthetic polypeptide
DEEEIRTTNPIATECWGATWANTPAGAEPNGPPV

SEQ ID NO: 183126 - protein, 33 aa, Artificial Sequence
  Description of Artificial Sequence: Synthetic polypeptide
DEEEIRTTNPIATECWGATWANAEDWAPKGPYI

SEQ ID NO: 183127 - protein, 34 aa, Artificial Sequence
  Description of Artificial Sequence: Synthetic polypeptide
DEEEIRTTNPIATECWGATVWANAEDWAEPKGPI

SEQ ID NO: 183128 - protein, 36 aa, Artificial Sequence
  Description of Artificial Sequence: Synthetic polypeptide
SEEEIRTTNPVATESWGSVFVNENDGHERQGHDQGH

SEQ ID NO: 183129 - protein, 37 aa, Artificial Sequence
  Description of Artificial Sequence: Synthetic polypeptide
DEEEISTTNPVATEQYGQCVCSWGETNQENFFSETQS

SEQ ID NO: 183130 - protein, 36 aa, Artificial Sequence
  Description of Artificial Sequence: Synthetic polypeptide
SEEEIRTTNPVATESWGSVFHNENDMHERNGGDQES

SEQ ID NO: 183131 - protein, 37 aa, Artificial Sequence
  Description of Artificial Sequence: Synthetic polypeptide
SEEEIRTTNPVATESWGAVFWNENLDEHEKQRMGQSP

SEQ ID NO: 183132 - protein, 36 aa, Artificial Sequence
  Description of Artificial Sequence: Synthetic polypeptide
SEEEIRTTNPVATESWGAVFWNEDDDHEKQRMGQSK

SEQ ID NO: 183133 - protein, 35 aa, Artificial Sequence
  Description of Artificial Sequence: Synthetic polypeptide
SEEEIRTTNPVATESWGAVFVNENDDHERQGTDQN

SEQ ID NO: 183134 - protein, 36 aa, Artificial Sequence
  Description of Artificial Sequence: Synthetic polypeptide
SEEEIRTTNPVATESWGAVFVNENDDHERQGMGQNQ

SEQ ID NO: 183135 - protein, 38 aa, Artificial Sequence
  Description of Artificial Sequence: Synthetic polypeptide
SEEEIRTTNPVATEQYGVVVNVTDNIAGGNLEGGEEGA

SEQ ID NO: 183136 - protein, 38 aa, Artificial Sequence
  Description of Artificial Sequence: Synthetic polypeptide
SEEEIRTTNPVATEQYGVVVDLNFDDEEGQEGGGNNID

SEQ ID NO: 183137 - protein, 36 aa, Artificial Sequence
  Description of Artificial Sequence: Synthetic polypeptide
DEEEIRTTNPEATCQYGQCVCPTGEDNQEYFGSDQA

SEQ ID NO: 183138 - protein, 37 aa, Artificial Sequence
  Description of Artificial Sequence: Synthetic polypeptide
DEEEIRTTNPIATECYGSTVSSNAPDWPAMPNGMPPV

SEQ ID NO: 183139 - protein, 36 aa, Artificial Sequence
  Description of Artificial Sequence: Synthetic polypeptide
DEEEIRTTNPEATCQYGCVCPWGELNQENFGSDTQA

SEQ ID NO: 183140 - protein, 36 aa, Artificial Sequence
  Description of Artificial Sequence: Synthetic polypeptide
DEEEIRTTNPEATCQYGCVCGWGEHNQENFGSDNQA

SEQ ID NO: 183141 - protein, 36 aa, Artificial Sequence
  Description of Artificial Sequence: Synthetic polypeptide
DEEEISTTNPVAWEQYGCVCSWGEHNQENFNSETQA

SEQ ID NO: 183142 - protein, 37 aa, Artificial Sequence
  Description of Artificial Sequence: Synthetic polypeptide
DEGEIRTTNPVATEQYGSVTWVPVVWLENPNTWEGGN

SEQ ID NO: 183143 - protein, 36 aa, Artificial Sequence
  Description of Artificial Sequence: Synthetic polypeptide
DEEEISTTNPVAWEQYGQCVCSWEEHNAENFNSDQS

SEQ ID NO: 183144 - protein, 39 aa, Artificial Sequence
  Description of Artificial Sequence: Synthetic polypeptide
DEEEIRTTNPCATEQYGVVSTVVANQAGNQLQGTTEAGE

SEQ ID NO: 183145 - protein, 39 aa, Artificial Sequence
  Description of Artificial Sequence: Synthetic polypeptide
DEEEIRTTNPCATEQYGVVSTVVAAQAGNQEQGTTETGQ

SEQ ID NO: 183146 - protein, 38 aa, Artificial Sequence
  Description of Artificial Sequence: Synthetic polypeptide
DEEEIRTTNPCATEQYGVVSTVTGTQAGTEQGTTEAGQ

SEQ ID NO: 183147 - protein, 38 aa, Artificial Sequence
  Description of Artificial Sequence: Synthetic polypeptide
DEEEIRTTNPCATEQYGVVSTVTANEAGTEQGTTEAGQ

SEQ ID NO: 183148 - protein, 38 aa, Artificial Sequence
  Description of Artificial Sequence: Synthetic polypeptide
DEEEIRTTNPCATEQYGVVSTVNQNAAGTEQGTTEAGQ

SEQ ID NO: 183149 - protein, 37 aa, Artificial Sequence
  Description of Artificial Sequence: Synthetic polypeptide
DEEEISTTNPVAWEQYGCVCSNSEEHNQENFGSENQQ

SEQ ID NO: 183150 - protein, 38 aa, Artificial Sequence
  Description of Artificial Sequence: Synthetic polypeptide
DEEEIRTTNPCATEQYGVVSTVNGSEAGTEQGTTEAGQ

SEQ ID NO: 183151 - protein, 39 aa, Artificial Sequence
  Description of Artificial Sequence: Synthetic polypeptide
DEEEIRTTNPVATEQYGVVSTVVTVGTQAGTTESGVTVE

SEQ ID NO: 183152 - protein, 39 aa, Artificial Sequence
  Description of Artificial Sequence: Synthetic polypeptide
DEEEIRTTNPVATEQYGVVSTVVTVGTQQGTTEAGSTSE

SEQ ID NO: 183153 - protein, 39 aa, Artificial Sequence
  Description of Artificial Sequence: Synthetic polypeptide
DEEEIRTTNPCATEQYGVVSTVNATEQGNTQQGTTEQGQ

SEQ ID NO: 183154 - protein, 39 aa, Artificial Sequence
  Description of Artificial Sequence: Synthetic polypeptide
DEEEIRTTNPCATEQYGVVSTVNATEAGNSEQGTTEAGQ

SEQ ID NO: 183155 - protein, 39 aa, Artificial Sequence
  Description of Artificial Sequence: Synthetic polypeptide
DEEEIRTTNPVATEQYGVVSTVVTVTNNEQGTEEEEEET

SEQ ID NO: 183156 - protein, 39 aa, Artificial Sequence
  Description of Artificial Sequence: Synthetic polypeptide
DEEEIRTTNPVATEQYGVVSTVVTVTTQAGTTEQGSTVE

SEQ ID NO: 183157 - protein, 38 aa, Artificial Sequence
  Description of Artificial Sequence: Synthetic polypeptide
SEEEIRTTNPVATEQYGSVMYPTFDDMNNNGNEELNME

SEQ ID NO: 183158 - protein, 39 aa, Artificial Sequence
  Description of Artificial Sequence: Synthetic polypeptide
DEEEIRTTNPVATEQYGVVSTVVVNNNAEQGTTEEEEED

SEQ ID NO: 183159 - protein, 39 aa, Artificial Sequence
  Description of Artificial Sequence: Synthetic polypeptide
DEEEIRTTNPVATEQYGVVSTVVTVGNQAGTTEAGSTVE

SEQ ID NO: 183160 - protein, 35 aa, Artificial Sequence
  Description of Artificial Sequence: Synthetic polypeptide
DEACIRTTNPVAYEQYGCVCETGEPNQEYFGSDQS

SEQ ID NO: 183161 - protein, 39 aa, Artificial Sequence
  Description of Artificial Sequence: Synthetic polypeptide
DEEEIRTTNPVATEQYGVVSTVVTTNNSEQGTEEEEEET

SEQ ID NO: 183162 - protein, 31 aa, Artificial Sequence
  Description of Artificial Sequence: Synthetic polypeptide
DDSEIASTNPVSTEGYGEVAAEVCQSHVEQR

SEQ ID NO: 183163 - protein, 35 aa, Artificial Sequence
  Description of Artificial Sequence: Synthetic polypeptide
DEEEIRTTNPCSYEQWGSCYTIDNHDQNGGGKAGE

SEQ ID NO: 183164 - protein, 36 aa, Artificial Sequence
  Description of Artificial Sequence: Synthetic polypeptide
DEEEIRTTNPCAYEQYGCVCSWGEHNAEYFISDNQS

SEQ ID NO: 183165 - protein, 33 aa, Artificial Sequence
  Description of Artificial Sequence: Synthetic polypeptide
DDSEIASTNPVSTEPYGNVSAMEDIQQSQVGQR

SEQ ID NO: 183166 - protein, 33 aa, Artificial Sequence
  Description of Artificial Sequence: Synthetic polypeptide
DDSEIASTNPVSTEGYGNVWAANETIQSRKGQI

SEQ ID NO: 183167 - protein, 33 aa, Artificial Sequence
  Description of Artificial Sequence: Synthetic polypeptide
DDSEIASTNPVSTEGYGNVWAANEDIQSRKGQI

SEQ ID NO: 183168 - protein, 33 aa, Artificial Sequence
  Description of Artificial Sequence: Synthetic polypeptide
DDSEIASTNPVSTEGYGNVCSANTIVESFVGQR

SEQ ID NO: 183169 - protein, 40 aa, Artificial Sequence
  Description of Artificial Sequence: Synthetic polypeptide
DEEEIRTTNPVATEQYGVVSTVVTNTNNQQQGTEEEEEED

SEQ ID NO: 183170 - protein, 39 aa, Artificial Sequence
  Description of Artificial Sequence: Synthetic polypeptide
DEEEIRTTNPVATEQYGVVSTVVTQGTQAGTTEAGSTVS

SEQ ID NO: 183171 - protein, 36 aa, Artificial Sequence
  Description of Artificial Sequence: Synthetic polypeptide
DEGEIRTTNPVATEWYGSWPVADVSNEEEIGSTQED

SEQ ID NO: 183172 - protein, 36 aa, Artificial Sequence
  Description of Artificial Sequence: Synthetic polypeptide
DEEEIRTTNPCAYEPYGSCAAGTNLPATAPGGEMWH

SEQ ID NO: 183173 - protein, 36 aa, Artificial Sequence
  Description of Artificial Sequence: Synthetic polypeptide
DEEEIRTTNPCAYEPYGNCAASGNLGQATPGDIQAM

SEQ ID NO: 183174 - protein, 34 aa, Artificial Sequence
  Description of Artificial Sequence: Synthetic polypeptide
DEEEIRTTNPCAYEPYGNCAAGSGNHMNPQIEAM

SEQ ID NO: 183175 - protein, 37 aa, Artificial Sequence
  Description of Artificial Sequence: Synthetic polypeptide
DEEEIRTTNPVATEQYGSIVCPMPMQIQMLAIVPTDE

SEQ ID NO: 183176 - protein, 35 aa, Artificial Sequence
  Description of Artificial Sequence: Synthetic polypeptide
DEEEIRTTNPCAYEGYGCSCSWGEHNAENFGSDQA

SEQ ID NO: 183177 - protein, 32 aa, Artificial Sequence
  Description of Artificial Sequence: Synthetic polypeptide
DDSEIASTNPVSTEGYGNVAAMETIQSRVGQH

SEQ ID NO: 183178 - protein, 32 aa, Artificial Sequence
  Description of Artificial Sequence: Synthetic polypeptide
DDSEIASTNPVSTEGYGNVAAMEDIQSRVGQH

SEQ ID NO: 183179 - protein, 31 aa, Artificial Sequence
  Description of Artificial Sequence: Synthetic polypeptide
DDSEIASTNPVSTEGYGNAAANTCQSHVGEK

SEQ ID NO: 183180 - protein, 37 aa, Artificial Sequence
  Description of Artificial Sequence: Synthetic polypeptide
DDEEIRSTNPVATEQYGCVCSTWGEHNQENSNSQNQS

SEQ ID NO: 183181 - protein, 35 aa, Artificial Sequence
  Description of Artificial Sequence: Synthetic polypeptide
DEEEIRTTNPCAYAEYGCIVAYTANEHSGIGGNGY

SEQ ID NO: 183182 - protein, 36 aa, Artificial Sequence
  Description of Artificial Sequence: Synthetic polypeptide
DEEEIRTTNPEATCQYGCVCPNTGEHNQEYFGSDFS

SEQ ID NO: 183183 - protein, 37 aa, Artificial Sequence
  Description of Artificial Sequence: Synthetic polypeptide
DEEEIRTTNPIATECYGSTVSSNTPDWPAMPNGMPPV

SEQ ID NO: 183184 - protein, 36 aa, Artificial Sequence
  Description of Artificial Sequence: Synthetic polypeptide
QEPEIRGTNPVATEQYGSVVMGMGINFNNNDQEGGG

SEQ ID NO: 183185 - protein, 37 aa, Artificial Sequence
  Description of Artificial Sequence: Synthetic polypeptide
DEEEIRTTNPIATECYGSTVSSTTPDGPAMPNGMPPV

SEQ ID NO: 183186 - protein, 38 aa, Artificial Sequence
  Description of Artificial Sequence: Synthetic polypeptide
DEEEISTTNPVATEQYGQCVCSWEEDHNQENFGSDNQP

SEQ ID NO: 183187 - protein, 39 aa, Artificial Sequence
  Description of Artificial Sequence: Synthetic polypeptide
DEEEIRTTNPVATEQYGVVSTVVTNNNNEQGTEDEETEA

SEQ ID NO: 183188 - protein, 37 aa, Artificial Sequence
  Description of Artificial Sequence: Synthetic polypeptide
DEEEISTTNPVATEQYGQCVCSWEEHNAENFNSDTQA

SEQ ID NO: 183189 - protein, 35 aa, Artificial Sequence
  Description of Artificial Sequence: Synthetic polypeptide
SEEEIRTTNPVAYEQWGHNNVYYWEEQQHRPGDHE

SEQ ID NO: 183190 - protein, 37 aa, Artificial Sequence
  Description of Artificial Sequence: Synthetic polypeptide
DEEEISTTNPVATEQYGQCVCSWEEHNQEHFGSDTQG

SEQ ID NO: 183191 - protein, 37 aa, Artificial Sequence
  Description of Artificial Sequence: Synthetic polypeptide
DEEEISTTNPVATEQYGQCVCSWEEHNQEYFGSETQA

SEQ ID NO: 183192 - protein, 37 aa, Artificial Sequence
  Description of Artificial Sequence: Synthetic polypeptide
DEEEIRTTNPVATEQYGSLTSVMMDVAEVSEQQIELQ

SEQ ID NO: 183193 - protein, 36 aa, Artificial Sequence
  Description of Artificial Sequence: Synthetic polypeptide
DDEEIRCTNPVATEQYGQCSCSWGEDNTENFGSDQS

SEQ ID NO: 183194 - protein, 38 aa, Artificial Sequence
  Description of Artificial Sequence: Synthetic polypeptide
DEEEIRTTNPVATEQYGSMAIYPPNTQNQVQENVELGA

SEQ ID NO: 183195 - protein, 38 aa, Artificial Sequence
  Description of Artificial Sequence: Synthetic polypeptide
DEEEIKTTNPVATEQYGVVSVGQAEQNDGQGEGQEQIE

SEQ ID NO: 183196 - protein, 36 aa, Artificial Sequence
  Description of Artificial Sequence: Synthetic polypeptide
DDEEIRCTNPVATEQYGQCSCSWGEHNAENFGSQQS

SEQ ID NO: 183197 - protein, 37 aa, Artificial Sequence
  Description of Artificial Sequence: Synthetic polypeptide
DEEEISTTNPVATEQYGQCVCSWGEDHNQNFNSDPQS

SEQ ID NO: 183198 - protein, 36 aa, Artificial Sequence
  Description of Artificial Sequence: Synthetic polypeptide
DEEEISTTNPVATEQYGQCVCSWGEDHNQNFPSDQG

SEQ ID NO: 183199 - protein, 37 aa, Artificial Sequence
  Description of Artificial Sequence: Synthetic polypeptide
DEEEIRTTNPVATEQYGSLCPADNDEIVQNITQVEVT

SEQ ID NO: 183200 - protein, 37 aa, Artificial Sequence
  Description of Artificial Sequence: Synthetic polypeptide
DEEEISTTNPVATEQYGQCVCSWGEDNEENFNSDTQS

SEQ ID NO: 183201 - protein, 37 aa, Artificial Sequence
  Description of Artificial Sequence: Synthetic polypeptide
DEEEISTTNPVATEQYGQCVCSWGEDNQENFGSDFQS

SEQ ID NO: 183202 - protein, 37 aa, Artificial Sequence
  Description of Artificial Sequence: Synthetic polypeptide
DEEEISTTNPVATEQYGQCVCSWGEDNQENFGSETQA

SEQ ID NO: 183203 - protein, 37 aa, Artificial Sequence
  Description of Artificial Sequence: Synthetic polypeptide
DEEEISTTNPVATEQYGQCVCSWGEDNQENFNSDNQQ

SEQ ID NO: 183204 - protein, 38 aa, Artificial Sequence
  Description of Artificial Sequence: Synthetic polypeptide
DEEEIKTTNPVATEQYGVVSVGQAEQNDQTGEGQEGIT

SEQ ID NO: 183205 - protein, 38 aa, Artificial Sequence
  Description of Artificial Sequence: Synthetic polypeptide
DEEEISTTNPVATEQYGQCVCSTWGPHNIENFNSETQS

SEQ ID NO: 183206 - protein, 37 aa, Artificial Sequence
  Description of Artificial Sequence: Synthetic polypeptide
DEGELATVNPVATEQYGSVSWTENDQHMQQKGGGGHS

SEQ ID NO: 183207 - protein, 38 aa, Artificial Sequence
  Description of Artificial Sequence: Synthetic polypeptide
DEEEISTTNPVATEQYGQCVCSTWGETNAENFNSDNQA

SEQ ID NO: 183208 - protein, 35 aa, Artificial Sequence
  Description of Artificial Sequence: Synthetic polypeptide
SEEEIRTTNPVAYEQYGCVCGWGAHNQENFNSDQA

SEQ ID NO: 183209 - protein, 35 aa, Artificial Sequence
  Description of Artificial Sequence: Synthetic polypeptide
QENEIRTTNPVATEQWGKVPSEQIHSMNAAVGDAN

SEQ ID NO: 183210 - protein, 37 aa, Artificial Sequence
  Description of Artificial Sequence: Synthetic polypeptide
DEEEIRTTNPVATEQYGSMPEWMVLAYENENTEETDQ

SEQ ID NO: 183211 - protein, 39 aa, Artificial Sequence
  Description of Artificial Sequence: Synthetic polypeptide
DEEEISTTNPVATEQYGQCVCSTWGEDHNAENFGSDNQQ

SEQ ID NO: 183212 - protein, 39 aa, Artificial Sequence
  Description of Artificial Sequence: Synthetic polypeptide
DEEEISTTNPVATEQYGQCVCSTWGEDHNQENFGSENQS

SEQ ID NO: 183213 - protein, 39 aa, Artificial Sequence
  Description of Artificial Sequence: Synthetic polypeptide
DEEEISTTNPVATEQYGQCVCSTWGEDHNTENFGSDNQI

SEQ ID NO: 183214 - protein, 37 aa, Artificial Sequence
  Description of Artificial Sequence: Synthetic polypeptide
SEEEIRTTNPVAYEQWGSVSGGEPANGPNMGNGGGKT

SEQ ID NO: 183215 - protein, 37 aa, Artificial Sequence
  Description of Artificial Sequence: Synthetic polypeptide
SEEEIRTTNPVAYEQWGSVSGGEPAGPNMQNGGGEVD

SEQ ID NO: 183216 - protein, 38 aa, Artificial Sequence
  Description of Artificial Sequence: Synthetic polypeptide
QENEIRTTNPVATEQYGSVNSTMPDGGPEMGQGEGEEG

SEQ ID NO: 183217 - protein, 38 aa, Artificial Sequence
  Description of Artificial Sequence: Synthetic polypeptide
QENEIRTTNPVATEQYGSVNSTVPAGGPEMGQGEGEEE

SEQ ID NO: 183218 - protein, 38 aa, Artificial Sequence
  Description of Artificial Sequence: Synthetic polypeptide
DEEEISTTNPVATEQYGQCVCSTWGEDNAENFNSETQA

SEQ ID NO: 183219 - protein, 38 aa, Artificial Sequence
  Description of Artificial Sequence: Synthetic polypeptide
DEEEISTTNPVATEQYGQCVCSTWGEHNAEHFNSENQS

SEQ ID NO: 183220 - protein, 38 aa, Artificial Sequence
  Description of Artificial Sequence: Synthetic polypeptide
DEEEISTTNPVATEQYGQCVCSTWGEHNAENFGSDFQP

SEQ ID NO: 183221 - protein, 38 aa, Artificial Sequence
  Description of Artificial Sequence: Synthetic polypeptide
DEEEISTTNPVATEQYGQCVCSTWGEHNAENFGSETQA

SEQ ID NO: 183222 - protein, 38 aa, Artificial Sequence
  Description of Artificial Sequence: Synthetic polypeptide
DEEEISTTNPVATEQYGQCVCSTWGEHNAENFNSDPQS

SEQ ID NO: 183223 - protein, 36 aa, Artificial Sequence
  Description of Artificial Sequence: Synthetic polypeptide
QENEIRTTNPVATEQYGSVSWCGVAEIPFSHQEDET

SEQ ID NO: 183224 - protein, 37 aa, Artificial Sequence
  Description of Artificial Sequence: Synthetic polypeptide
DEEEIRTTNPVATEQYGSMCQLTVFEVQTPQMMELEA

SEQ ID NO: 183225 - protein, 35 aa, Artificial Sequence
  Description of Artificial Sequence: Synthetic polypeptide
DEGENATTNPVAYEQWGSVSGDNGNGDDRQDGGEG

SEQ ID NO: 183226 - protein, 38 aa, Artificial Sequence
  Description of Artificial Sequence: Synthetic polypeptide
DEEEISTTNPVATEQYGQCVCSTWGEHNQENFNSDTQG

SEQ ID NO: 183227 - protein, 37 aa, Artificial Sequence
  Description of Artificial Sequence: Synthetic polypeptide
DEEEISTTNPVATEQYGQCVCSWGEDPQEHFQSENQE

SEQ ID NO: 183228 - protein, 38 aa, Artificial Sequence
  Description of Artificial Sequence: Synthetic polypeptide
DEEEISTTNPVATEQYGQCVCSWGEDTNQENFNSDTQA

SEQ ID NO: 183229 - protein, 36 aa, Artificial Sequence
  Description of Artificial Sequence: Synthetic polypeptide
DEEEISTTNPVATEQYGQCVCSWGEHAENFGSDTQP

SEQ ID NO: 183230 - protein, 37 aa, Artificial Sequence
  Description of Artificial Sequence: Synthetic polypeptide
DEEEISTTNPVATEQYGQCVCSWGEHDAENFGSDNQA

SEQ ID NO: 183231 - protein, 32 aa, Artificial Sequence
  Description of Artificial Sequence: Synthetic polypeptide
QEPEIATTNPVATEQYGAAGDDEGGQGEEFDL

SEQ ID NO: 183232 - protein, 37 aa, Artificial Sequence
  Description of Artificial Sequence: Synthetic polypeptide
DEEEISTTNPVATEQYGQCVCSWGEHNQENFISDNQA

SEQ ID NO: 183233 - protein, 37 aa, Artificial Sequence
  Description of Artificial Sequence: Synthetic polypeptide
DEEEISTTNPVATEQYGQCVCSWGEHNQENFISDNQG

SEQ ID NO: 183234 - protein, 37 aa, Artificial Sequence
  Description of Artificial Sequence: Synthetic polypeptide
DEEEISTTNPVATEQYGQCVCSWGEHNQENFISDNQI

SEQ ID NO: 183235 - protein, 37 aa, Artificial Sequence
  Description of Artificial Sequence: Synthetic polypeptide
DEEEISTTNPVATEQYGQCVCSWGEHNQENFLSDTQS

SEQ ID NO: 183236 - protein, 37 aa, Artificial Sequence
  Description of Artificial Sequence: Synthetic polypeptide
DEEEISTTNPVATEQYGQCVCSWGEHNQENFNSDTQS

SEQ ID NO: 183237 - protein, 37 aa, Artificial Sequence
  Description of Artificial Sequence: Synthetic polypeptide
DEEEISTTNPVATEQYGQCVCSWGEHNQENFNSETQS

SEQ ID NO: 183238 - protein, 35 aa, Artificial Sequence
  Description of Artificial Sequence: Synthetic polypeptide
DEGEIRTTNPVAYMQWGSAAPTWEKDQQMQGNKDK

SEQ ID NO: 183239 - protein, 33 aa, Artificial Sequence
  Description of Artificial Sequence: Synthetic polypeptide
DEGEIRTTNPVAYMQWGAAPTWEGDQQMQGGDK

SEQ ID NO: 183240 - protein, 37 aa, Artificial Sequence
  Description of Artificial Sequence: Synthetic polypeptide
DEEEISTTNPVATEQYGQCVCSWGEHNQENFSSDNQS

SEQ ID NO: 183241 - protein, 37 aa, Artificial Sequence
  Description of Artificial Sequence: Synthetic polypeptide
DEEEISTTNPVATEQYGQCVCSWGEHNQENFSSENQS

SEQ ID NO: 183242 - protein, 37 aa, Artificial Sequence
  Description of Artificial Sequence: Synthetic polypeptide
DEEEISTTNPVATEQYGQCVCSWGEHNQESFISDNQS

SEQ ID NO: 183243 - protein, 37 aa, Artificial Sequence
  Description of Artificial Sequence: Synthetic polypeptide
DEEEISTTNPVATEQYGQCVCSWGEHNQESSNSENQS

SEQ ID NO: 183244 - protein, 36 aa, Artificial Sequence
  Description of Artificial Sequence: Synthetic polypeptide
QEPEIKTTNPVATEFYGSVSATGDTGEDQEGGEDGD

SEQ ID NO: 183245 - protein, 37 aa, Artificial Sequence
  Description of Artificial Sequence: Synthetic polypeptide
DEEEISTTNPVATEQYGQCVCSWGEHNQEYFNSETQA

SEQ ID NO: 183246 - protein, 36 aa, Artificial Sequence
  Description of Artificial Sequence: Synthetic polypeptide
DEEEISTTNPVATEQYGQCVCSWGEHNQNFMSDTQS

SEQ ID NO: 183247 - protein, 35 aa, Artificial Sequence
  Description of Artificial Sequence: Synthetic polypeptide
DEEEIRTTNPIATEQWGATTWANEEDWQEPKGPYI

SEQ ID NO: 183248 - protein, 38 aa, Artificial Sequence
  Description of Artificial Sequence: Synthetic polypeptide
DEEEIRTTNPVATEQYGSIYTSLCPNLEDVSSVAMWED

SEQ ID NO: 183249 - protein, 34 aa, Artificial Sequence
  Description of Artificial Sequence: Synthetic polypeptide
QEPEIRCTNPVATEPYGCVCHGQMLLTLGGQNEP

SEQ ID NO: 183250 - protein, 38 aa, Artificial Sequence
  Description of Artificial Sequence: Synthetic polypeptide
DEEEIRTTNPVATEQYGSIYVAHASQPDDDSNEYDEEL

SEQ ID NO: 183251 - protein, 38 aa, Artificial Sequence
  Description of Artificial Sequence: Synthetic polypeptide
DEEEIRTTNPCATEQYGTVLSVWSHTETAIFPINEPQN

SEQ ID NO: 183252 - protein, 37 aa, Artificial Sequence
  Description of Artificial Sequence: Synthetic polypeptide
DEEEISTTNPVATEQYGQCVCSWGEHNQENFGSDTQI

SEQ ID NO: 183253 - protein, 37 aa, Artificial Sequence
  Description of Artificial Sequence: Synthetic polypeptide
DEEEISTTNPVATEQYGQCVCSWGEHNQEHFNSDNQS

SEQ ID NO: 183254 - protein, 37 aa, Artificial Sequence
  Description of Artificial Sequence: Synthetic polypeptide
DEEEISTTNPVATEQYGQCVCSWGEHDQEGFISETQS

SEQ ID NO: 183255 - protein, 37 aa, Artificial Sequence
  Description of Artificial Sequence: Synthetic polypeptide
DEEEISTTNPVATEQYGQCVCSWGEHNAEGFNSDTQA

SEQ ID NO: 183256 - protein, 37 aa, Artificial Sequence
  Description of Artificial Sequence: Synthetic polypeptide
DEEEISTTNPVATEQYGQCVCSWGEHNAEHFNSDTQA

SEQ ID NO: 183257 - protein, 37 aa, Artificial Sequence
  Description of Artificial Sequence: Synthetic polypeptide
DEEEISTTNPVATEQYGQCVCSWGEHNAEHFNSDTQS

SEQ ID NO: 183258 - protein, 37 aa, Artificial Sequence
  Description of Artificial Sequence: Synthetic polypeptide
DEEEISTTNPVATEQYGQCVCSWGEHNAENFFSDNQA

SEQ ID NO: 183259 - protein, 37 aa, Artificial Sequence
  Description of Artificial Sequence: Synthetic polypeptide
DEEEISTTNPVATEQYGQCVCSWGEHNAENFGSDTQS

SEQ ID NO: 183260 - protein, 37 aa, Artificial Sequence
  Description of Artificial Sequence: Synthetic polypeptide
DEEEISTTNPVATEQYGQCVCSWGEHNAENFGSETQA

SEQ ID NO: 183261 - protein, 37 aa, Artificial Sequence
  Description of Artificial Sequence: Synthetic polypeptide
DEEEISTTNPVATEQYGQCVCSWGEHNAENFGSETQS

SEQ ID NO: 183262 - protein, 39 aa, Artificial Sequence
  Description of Artificial Sequence: Synthetic polypeptide
DEEEIRTTNPVATEQYGSLAIYLIPNTQNCVGENVELGA

SEQ ID NO: 183263 - protein, 39 aa, Artificial Sequence
  Description of Artificial Sequence: Synthetic polypeptide
DEEEIRTTNPVATEQYGSLAIYIPPNTQNTVRENVELGA

SEQ ID NO: 183264 - protein, 37 aa, Artificial Sequence
  Description of Artificial Sequence: Synthetic polypeptide
DEEEISTTNPVATEQYGQCVCSWGEHNAENFNSDNQS

SEQ ID NO: 183265 - protein, 37 aa, Artificial Sequence
  Description of Artificial Sequence: Synthetic polypeptide
DEEEISTTNPVATEQYGQCVCSWGEHNAENFNSDTQA

SEQ ID NO: 183266 - protein, 37 aa, Artificial Sequence
  Description of Artificial Sequence: Synthetic polypeptide
DEEEISTTNPVATEQYGQCVCSWGEHNAENFNSDTQM

SEQ ID NO: 183267 - protein, 37 aa, Artificial Sequence
  Description of Artificial Sequence: Synthetic polypeptide
DEEEISTTNPVATEQYGQCVCSWGEHNAENFNSETQS

SEQ ID NO: 183268 - protein, 37 aa, Artificial Sequence
  Description of Artificial Sequence: Synthetic polypeptide
DEEEISTTNPVATEQYGQCVCSWGEHNAENSNSENQS

SEQ ID NO: 183269 - protein, 37 aa, Artificial Sequence
  Description of Artificial Sequence: Synthetic polypeptide
DEEEISTTNPVATEQYGQCVCSWGEHNEENFGSDTQA

SEQ ID NO: 183270 - protein, 37 aa, Artificial Sequence
  Description of Artificial Sequence: Synthetic polypeptide
DEEEISTTNPVATEQYGQCVCSWGEHNIENFISENQA

SEQ ID NO: 183271 - protein, 37 aa, Artificial Sequence
  Description of Artificial Sequence: Synthetic polypeptide
DEEEISTTNPVATEQYGQCVCSWGEHNIENFNSDTQA

SEQ ID NO: 183272 - protein, 37 aa, Artificial Sequence
  Description of Artificial Sequence: Synthetic polypeptide
DEEEISTTNPVATEQYGQCVCSWGEHNQEGFGSDTQA

SEQ ID NO: 183273 - protein, 37 aa, Artificial Sequence
  Description of Artificial Sequence: Synthetic polypeptide
DEEEISTTNPVATEQYGQCVCSWGEHNQENFGSDTQG

SEQ ID NO: 183274 - protein, 37 aa, Artificial Sequence
  Description of Artificial Sequence: Synthetic polypeptide
SEEEIRTTNPVATEQYGSVEPNTPMMAGPSQGPEPQS

SEQ ID NO: 183275 - protein, 37 aa, Artificial Sequence
  Description of Artificial Sequence: Synthetic polypeptide
DEEEIRTTNPCATEQYGSVSPVSLSLIAEIPHVEMDE

SEQ ID NO: 183276 - protein, 37 aa, Artificial Sequence
  Description of Artificial Sequence: Synthetic polypeptide
DEEEIRTTNPCATEQYGSVPSVDSHEVAIFPINEPQN

SEQ ID NO: 183277 - protein, 36 aa, Artificial Sequence
  Description of Artificial Sequence: Synthetic polypeptide
DEEEIRTTNPCATEQYGEVCRFPAVEEASTQEVNDD

SEQ ID NO: 183278 - protein, 36 aa, Artificial Sequence
  Description of Artificial Sequence: Synthetic polypeptide
DEEEIRTTNPCATEQYGCVCSNWGEHNAEYFISQQS

SEQ ID NO: 183279 - protein, 37 aa, Artificial Sequence
  Description of Artificial Sequence: Synthetic polypeptide
DEEEIRTTNPCATEQYGCVCSNWGEHNAEHFISDNQA

SEQ ID NO: 183280 - protein, 37 aa, Artificial Sequence
  Description of Artificial Sequence: Synthetic polypeptide
DEEEIRTTNPVATEQYGSILCPADNDEIVIIAQAEQT

SEQ ID NO: 183281 - protein, 37 aa, Artificial Sequence
  Description of Artificial Sequence: Synthetic polypeptide
DDEEIRTTNPVATCQYGCVCSWGEGDNQENFGSDNQM

SEQ ID NO: 183282 - protein, 36 aa, Artificial Sequence
  Description of Artificial Sequence: Synthetic polypeptide
DDEEIRTTNPVATCQYGCVCSWGEGDNQNFGSDTQA

SEQ ID NO: 183283 - protein, 37 aa, Artificial Sequence
  Description of Artificial Sequence: Synthetic polypeptide
DEEEIRATNPVATEQWGGCNAITNHQDENTGMENNFQ

SEQ ID NO: 183284 - protein, 37 aa, Artificial Sequence
  Description of Artificial Sequence: Synthetic polypeptide
DEEEIRTTNPCATEQYGCVCQDSGEHNQENFGSDTAS

SEQ ID NO: 183285 - protein, 36 aa, Artificial Sequence
  Description of Artificial Sequence: Synthetic polypeptide
SEEEIRTTNPVATEGYGCTGSIMGDIGQQRGDGGEG

SEQ ID NO: 183286 - protein, 36 aa, Artificial Sequence
  Description of Artificial Sequence: Synthetic polypeptide
DEEEIRATNPVATEQWGGCNAITNPDENTGMENNNQ

SEQ ID NO: 183287 - protein, 37 aa, Artificial Sequence
  Description of Artificial Sequence: Synthetic polypeptide
DDEEIRTTNPVATDAYGSVSGNNNGGEEDNDGGNNTD

SEQ ID NO: 183288 - protein, 37 aa, Artificial Sequence
  Description of Artificial Sequence: Synthetic polypeptide
DDEEIRTTNPVATDQYGSVCGNNNNGGEEDNEGGNNT

SEQ ID NO: 183289 - protein, 37 aa, Artificial Sequence
  Description of Artificial Sequence: Synthetic polypeptide
SEEEIRTTNPTATECYGCVCTIDSNNHNGQQGGDNGV

SEQ ID NO: 183290 - protein, 38 aa, Artificial Sequence
  Description of Artificial Sequence: Synthetic polypeptide
DEEEISTTNPVAYEQYGQCVCSNWGETNAENFGSENQQ

SEQ ID NO: 183291 - protein, 36 aa, Artificial Sequence
  Description of Artificial Sequence: Synthetic polypeptide
DEEEISTTNPVAYEQYGQCVCSSEDDNQHFGSDTQM

SEQ ID NO: 183292 - protein, 36 aa, Artificial Sequence
  Description of Artificial Sequence: Synthetic polypeptide
DEEEISTTNPVAYEQYGQCVCSSEEHNQENFGSEQA

SEQ ID NO: 183293 - protein, 37 aa, Artificial Sequence
  Description of Artificial Sequence: Synthetic polypeptide
DEEEISTTNPVAYEQYGQCVCSTEDDNQEHFGSETQA

SEQ ID NO: 183294 - protein, 37 aa, Artificial Sequence
  Description of Artificial Sequence: Synthetic polypeptide
DEEEISTTNPVAYEQYGQCVCSTGEDHNQHFNSDFQS

SEQ ID NO: 183295 - protein, 37 aa, Artificial Sequence
  Description of Artificial Sequence: Synthetic polypeptide
SEEEIRTTNPVATDQYGSVVVADVNDNNGQGEFNEID

SEQ ID NO: 183296 - protein, 37 aa, Artificial Sequence
  Description of Artificial Sequence: Synthetic polypeptide
DEEEIRTTNPVATEQYGSINGWANPEEFALTGEIEDT

SEQ ID NO: 183297 - protein, 36 aa, Artificial Sequence
  Description of Artificial Sequence: Synthetic polypeptide
SEEEIRTTNPVATEGYGCTGSIMNDIGDQDGDIGEG

SEQ ID NO: 183298 - protein, 36 aa, Artificial Sequence
  Description of Artificial Sequence: Synthetic polypeptide
SEEEIRTTNPVATEGYGCTGSIMNDIGDQGGDEGAG

SEQ ID NO: 183299 - protein, 36 aa, Artificial Sequence
  Description of Artificial Sequence: Synthetic polypeptide
SEEEIRTTNPVATEGYGMVNGQGTNQGEGQDEEFGT

SEQ ID NO: 183300 - protein, 37 aa, Artificial Sequence
  Description of Artificial Sequence: Synthetic polypeptide
SEEEIRTTNPVATEGYGMVNGQGTNQDIPGGNEQTGG

SEQ ID NO: 183301 - protein, 38 aa, Artificial Sequence
  Description of Artificial Sequence: Synthetic polypeptide
SEEEIRTTNPVATEGYGMVNGQGTNAQGEQGDNEQFGD

SEQ ID NO: 183302 - protein, 36 aa, Artificial Sequence
  Description of Artificial Sequence: Synthetic polypeptide
SEEEIRTTNPVATEGYGMVNGQGTGQGEGNDEQAGE

SEQ ID NO: 183303 - protein, 37 aa, Artificial Sequence
  Description of Artificial Sequence: Synthetic polypeptide
SEEEIRTTNPVATEGYGMVNGQGTGPGEQGGDEQNGE

SEQ ID NO: 183304 - protein, 36 aa, Artificial Sequence
  Description of Artificial Sequence: Synthetic polypeptide
SEEEIRTTNPVATEGYGMVNGQGTFNGEGGQEQFQS

SEQ ID NO: 183305 - protein, 37 aa, Artificial Sequence
  Description of Artificial Sequence: Synthetic polypeptide
SEEEIRTTNPVATEGYGMVNGQGTDNQGEGGNEQFGD

SEQ ID NO: 183306 - protein, 35 aa, Artificial Sequence
  Description of Artificial Sequence: Synthetic polypeptide
SEEEIRTTNPVATEGYGMVNGQGTAQEGGGEQGGQ

SEQ ID NO: 183307 - protein, 37 aa, Artificial Sequence
  Description of Artificial Sequence: Synthetic polypeptide
SEEEIRTTNPVATEGYGMVNGQGNNQDEPGNNEQFGG

SEQ ID NO: 183308 - protein, 38 aa, Artificial Sequence
  Description of Artificial Sequence: Synthetic polypeptide
DEEEISTTNPVAYEQYGQCVCSMTGEHNQENFGSDNQA

SEQ ID NO: 183309 - protein, 37 aa, Artificial Sequence
  Description of Artificial Sequence: Synthetic polypeptide
SEEEIRTTNPVATEGYGCVCSNWGEHNAEHFGSDNQA

SEQ ID NO: 183310 - protein, 35 aa, Artificial Sequence
  Description of Artificial Sequence: Synthetic polypeptide
SEEEIRTTNPVATEGYGCVCSNWGEHANFSSDTQS

SEQ ID NO: 183311 - protein, 35 aa, Artificial Sequence
  Description of Artificial Sequence: Synthetic polypeptide
SEEEIRTTNPVATEGYGCVCSNWGEHANFGSDQQA

SEQ ID NO: 183312 - protein, 35 aa, Artificial Sequence
  Description of Artificial Sequence: Synthetic polypeptide
SEEEIRTTNPVATEGYGCVCSNWEHAEYFNSDTQS

SEQ ID NO: 183313 - protein, 37 aa, Artificial Sequence
  Description of Artificial Sequence: Synthetic polypeptide
DEEEISTTNPVAYEQYGQCVCSNSEEHNQNFGSDNQA

SEQ ID NO: 183314 - protein, 36 aa, Artificial Sequence
  Description of Artificial Sequence: Synthetic polypeptide
SEEEIRTTNPVATEGYGCVCSNTGEDAENFISDTQS

SEQ ID NO: 183315 - protein, 36 aa, Artificial Sequence
  Description of Artificial Sequence: Synthetic polypeptide
SEEEIRTTNPVATEGYGCVCGNWGAHNQENFNSDQA

SEQ ID NO: 183316 - protein, 35 aa, Artificial Sequence
  Description of Artificial Sequence: Synthetic polypeptide
SEEEIRTTNPVATEGYGCVCGNTGEHAYFGSDTQS

SEQ ID NO: 183317 - protein, 36 aa, Artificial Sequence
  Description of Artificial Sequence: Synthetic polypeptide
SEEEIRTTNPVATEGYGCTGSIMNDIGDQNDDDGEG

SEQ ID NO: 183318 - protein, 36 aa, Artificial Sequence
  Description of Artificial Sequence: Synthetic polypeptide
DEEEIRTTNPVATEQYGDVVMGIEMDDEGGQDEMEE

SEQ ID NO: 183319 - protein, 35 aa, Artificial Sequence
  Description of Artificial Sequence: Synthetic polypeptide
DEEEISTTNPVAYEQYGQCVCSWGEHQYFISEFQS

SEQ ID NO: 183320 - protein, 37 aa, Artificial Sequence
  Description of Artificial Sequence: Synthetic polypeptide
DEEEISTTNPVAYEQYGQCVCSWGETNAENFNSETQA

SEQ ID NO: 183321 - protein, 34 aa, Artificial Sequence
  Description of Artificial Sequence: Synthetic polypeptide
SEEEIRTTNPIATECWGSTTWANEEDWAPKGPYR

SEQ ID NO: 183322 - protein, 31 aa, Artificial Sequence
  Description of Artificial Sequence: Synthetic polypeptide
DDSAVASTNPVSTEGYGNVAANTINSRVGQR

SEQ ID NO: 183323 - protein, 36 aa, Artificial Sequence
  Description of Artificial Sequence: Synthetic polypeptide
DDREIATTNPVATEQYGIVCTPTEVMHQVHQGAGRN

SEQ ID NO: 183324 - protein, 36 aa, Artificial Sequence
  Description of Artificial Sequence: Synthetic polypeptide
DEEEIVTTNPVATEQYGEIYEEPVAINEEVNGPFLL

SEQ ID NO: 183325 - protein, 36 aa, Artificial Sequence
  Description of Artificial Sequence: Synthetic polypeptide
DEEEIRTTNPVAYEPYGISSSNVVISWHPDRAIKDT

SEQ ID NO: 183326 - protein, 31 aa, Artificial Sequence
  Description of Artificial Sequence: Synthetic polypeptide
QESEIASTNPIATECWGVTMANSTLQHKGDI

SEQ ID NO: 183327 - protein, 39 aa, Artificial Sequence
  Description of Artificial Sequence: Synthetic polypeptide
DEEEIRTTNPVATEQYGETVNTQLVNYEEQIIIDPTQNS

SEQ ID NO: 183328 - protein, 38 aa, Artificial Sequence
  Description of Artificial Sequence: Synthetic polypeptide
DEEEIRTTNPVATEQYGETYNTPNENVEMEVEGNVELS

SEQ ID NO: 183329 - protein, 29 aa, Artificial Sequence
  Description of Artificial Sequence: Synthetic peptide
QESEIASTNPIGTECYGVMAAEDWQPGDI

SEQ ID NO: 183330 - protein, 37 aa, Artificial Sequence
  Description of Artificial Sequence: Synthetic polypeptide
DEEEIRTTNPVATEQYGEVCRFPAIVEEASTQEVNDM

SEQ ID NO: 183331 - protein, 36 aa, Artificial Sequence
  Description of Artificial Sequence: Synthetic polypeptide
DEEEIRTTNPCATEPYGNCAATNNLPATAPGGEMWH

SEQ ID NO: 183332 - protein, 35 aa, Artificial Sequence
  Description of Artificial Sequence: Synthetic polypeptide
DEEEIRTTNPCATEPYGNCAAASNLATAPGMEMWH

SEQ ID NO: 183333 - protein, 38 aa, Artificial Sequence
  Description of Artificial Sequence: Synthetic polypeptide
DEEEIRTTNPVAYEMYGQSVVSPEFWDALQFTSIENTP

SEQ ID NO: 183334 - protein, 37 aa, Artificial Sequence
  Description of Artificial Sequence: Synthetic polypeptide
DEEEIRTTNPVAYEMYGQSVVSPEFWDALHTSIENPP

SEQ ID NO: 183335 - protein, 34 aa, Artificial Sequence
  Description of Artificial Sequence: Synthetic polypeptide
SEEEIRCTNPTAYEQWGSTVYGENKDIKRDGDQP

SEQ ID NO: 183336 - protein, 34 aa, Artificial Sequence
  Description of Artificial Sequence: Synthetic polypeptide
SEEEIRCTNPTAYEQWGSTVYGENKDIHRSGDPP

SEQ ID NO: 183337 - protein, 33 aa, Artificial Sequence
  Description of Artificial Sequence: Synthetic polypeptide
SEEEIRCTNPTAYEQWGSTVYGENKDIHRKDQE

SEQ ID NO: 183338 - protein, 35 aa, Artificial Sequence
  Description of Artificial Sequence: Synthetic polypeptide
SEEEIRCTNPTAYEQWGSTVYGENDDHRGGDNKHE

SEQ ID NO: 183339 - protein, 34 aa, Artificial Sequence
  Description of Artificial Sequence: Synthetic polypeptide
SEEEIRCTNPTAYEQWGCVWGENDDMHRRGMNTK

SEQ ID NO: 183340 - protein, 34 aa, Artificial Sequence
  Description of Artificial Sequence: Synthetic polypeptide
SEEEIRCTNPTAYECWGSVYGENDDMHRNGDEDR

SEQ ID NO: 183341 - protein, 37 aa, Artificial Sequence
  Description of Artificial Sequence: Synthetic polypeptide
DEEEIRTTNPVAYEPYGISVSNTVVSWHPDRAIKDVT

SEQ ID NO: 183342 - protein, 37 aa, Artificial Sequence
  Description of Artificial Sequence: Synthetic polypeptide
SEEEIRTTNPVATEGYGMVNGQGTNQGENGGDEQRGE

SEQ ID NO: 183343 - protein, 37 aa, Artificial Sequence
  Description of Artificial Sequence: Synthetic polypeptide
DEEEIRTTNPVAYEPYGISVSNVVVSLHPDRHIKDTQ

SEQ ID NO: 183344 - protein, 37 aa, Artificial Sequence
  Description of Artificial Sequence: Synthetic polypeptide
DEEEIRTTNPVATEQYGSIHADAENMPQNVMEPEQGE

SEQ ID NO: 183345 - protein, 36 aa, Artificial Sequence
  Description of Artificial Sequence: Synthetic polypeptide
DEEEISTTNPVAYEQYGQCVCSWMEHNQENFNSDQS

SEQ ID NO: 183346 - protein, 37 aa, Artificial Sequence
  Description of Artificial Sequence: Synthetic polypeptide
SEEEIRTTNPAATEQYGSVVAGDDNQTAQGQGGEGET

SEQ ID NO: 183347 - protein, 36 aa, Artificial Sequence
  Description of Artificial Sequence: Synthetic polypeptide
SEEEIRTTNPAATEQYGAVNAGDDNQTGQGQGEGET

SEQ ID NO: 183348 - protein, 36 aa, Artificial Sequence
  Description of Artificial Sequence: Synthetic polypeptide
DEGEIRTTNPVATEQYGSVPYQTDEEDITPSIEEVP

SEQ ID NO: 183349 - protein, 36 aa, Artificial Sequence
  Description of Artificial Sequence: Synthetic polypeptide
DEEEISTTNPVAYESYGQETVASYQNGSGRVSNPHD

SEQ ID NO: 183350 - protein, 35 aa, Artificial Sequence
  Description of Artificial Sequence: Synthetic polypeptide
DEEEISTTNPVCTEHYGCVCSWPEHNQENFGSDQA

SEQ ID NO: 183351 - protein, 36 aa, Artificial Sequence
  Description of Artificial Sequence: Synthetic polypeptide
DEEEISTVNPVATEQYGCVCSNWEEHNAEYFNSQQA

SEQ ID NO: 183352 - protein, 36 aa, Artificial Sequence
  Description of Artificial Sequence: Synthetic polypeptide
DEEEISTVNPVATEQYGCVCSWMEDHNAENFNSQQS

SEQ ID NO: 183353 - protein, 32 aa, Artificial Sequence
  Description of Artificial Sequence: Synthetic polypeptide
DDSEIASTNPISTECWGNTVAANTWQSRVGPR

SEQ ID NO: 183354 - protein, 38 aa, Artificial Sequence
  Description of Artificial Sequence: Synthetic polypeptide
DEEEIRTTNPVATEQYGEAHEHAPGVSNENVSTTPGSE

SEQ ID NO: 183355 - protein, 37 aa, Artificial Sequence
  Description of Artificial Sequence: Synthetic polypeptide
DEEEITTTNPVATEQYGSYSSPHPVTVEVAANHQDQY

SEQ ID NO: 183356 - protein, 38 aa, Artificial Sequence
  Description of Artificial Sequence: Synthetic polypeptide
DEEEIRTTNPVATEQYGSIIGSDPMNGNIVNEVSEDED

SEQ ID NO: 183357 - protein, 37 aa, Artificial Sequence
  Description of Artificial Sequence: Synthetic polypeptide
DEEEIRTTNPVATEQYGEAVQPFASQYHAPTVSVQNQ

SEQ ID NO: 183358 - protein, 38 aa, Artificial Sequence
  Description of Artificial Sequence: Synthetic polypeptide
DEEEIRTTNPVATEQYGECIISNSSVEVQEFLMENDVG

SEQ ID NO: 183359 - protein, 37 aa, Artificial Sequence
  Description of Artificial Sequence: Synthetic polypeptide
DEEEIRTTNPVATEQYGEHCRFPAVEEASTQEVNFDD

SEQ ID NO: 183360 - protein, 37 aa, Artificial Sequence
  Description of Artificial Sequence: Synthetic polypeptide
DEEEIRTTNPVATEQYGEIYEENVAINEYEVNEPFLL

SEQ ID NO: 183361 - protein, 37 aa, Artificial Sequence
  Description of Artificial Sequence: Synthetic polypeptide
DEEEIRTTNPVATEQYGENCRFPAAVEEASTQEVNDT

SEQ ID NO: 183362 - protein, 37 aa, Artificial Sequence
  Description of Artificial Sequence: Synthetic polypeptide
DEEEIRTTNPVATEQYGENCRFPARVGEASTQEVNDM

SEQ ID NO: 183363 - protein, 37 aa, Artificial Sequence
  Description of Artificial Sequence: Synthetic polypeptide
DEEEIRTTNPVATEQYGENYCRSPAGVEEASTQEVFD

SEQ ID NO: 183364 - protein, 37 aa, Artificial Sequence
  Description of Artificial Sequence: Synthetic polypeptide
DEEEIRTTNPVATEQYGENYCRSPAQEEASTQEVNDY

SEQ ID NO: 183365 - protein, 35 aa, Artificial Sequence
  Description of Artificial Sequence: Synthetic polypeptide
SEEEIRCTNPCATEQYGCVCSNWEGDNANFGSDQS

SEQ ID NO: 183366 - protein, 38 aa, Artificial Sequence
  Description of Artificial Sequence: Synthetic polypeptide
SEEEIRTTNPVATEGYGMVNGQGTNQQDEPGGNEQFQD

SEQ ID NO: 183367 - protein, 37 aa, Artificial Sequence
  Description of Artificial Sequence: Synthetic polypeptide
SEEEIRTTNPVATEGYGMVNLQGTNQGEPGGNEQFGG

SEQ ID NO: 183368 - protein, 36 aa, Artificial Sequence
  Description of Artificial Sequence: Synthetic polypeptide
DEEEISTTNPVAYEQYGCVCSNWEHNQENFFSENQA

SEQ ID NO: 183369 - protein, 37 aa, Artificial Sequence
  Description of Artificial Sequence: Synthetic polypeptide
SEEEIRTTNPVATEQYGQCVCSWGEHNQENFNSDFQS

SEQ ID NO: 183370 - protein, 38 aa, Artificial Sequence
  Description of Artificial Sequence: Synthetic polypeptide
SEEEIRTTNPVATEQYGQCVCSNWGEHNEENFGSDNQS

SEQ ID NO: 183371 - protein, 36 aa, Artificial Sequence
  Description of Artificial Sequence: Synthetic polypeptide
QESAICTTNPVATEQYGSVFTWTYNPQTQFQDNQIM

SEQ ID NO: 183372 - protein, 38 aa, Artificial Sequence
  Description of Artificial Sequence: Synthetic polypeptide
DEEEIRTTNPVATEQYGCVTSTWGEDDNAEHFSSDPQS

SEQ ID NO: 183373 - protein, 37 aa, Artificial Sequence
  Description of Artificial Sequence: Synthetic polypeptide
SEEEIRTTNPVATEQYGECVVYTVETPLEDGDESIQE

SEQ ID NO: 183374 - protein, 35 aa, Artificial Sequence
  Description of Artificial Sequence: Synthetic polypeptide
QESCIRTTNPVATEQYGCVIFWPNNNSIRIDDQNL

SEQ ID NO: 183375 - protein, 35 aa, Artificial Sequence
  Description of Artificial Sequence: Synthetic polypeptide
DDEEIRTTNPCATEHYGCVCSWEEHNQEYFNSNQS

SEQ ID NO: 183376 - protein, 36 aa, Artificial Sequence
  Description of Artificial Sequence: Synthetic polypeptide
DEEEISTTNPVAYEQYGCVCSNWEHNQEGFGSETQS

SEQ ID NO: 183377 - protein, 38 aa, Artificial Sequence
  Description of Artificial Sequence: Synthetic polypeptide
SEEEIRTTNPVATEQYGCVTSTWGADDNAEHFNSDPQS

SEQ ID NO: 183378 - protein, 36 aa, Artificial Sequence
  Description of Artificial Sequence: Synthetic polypeptide
DEEEISTTNPVAYEQYGCVCSNWGEDHQEHFGSQQS

SEQ ID NO: 183379 - protein, 38 aa, Artificial Sequence
  Description of Artificial Sequence: Synthetic polypeptide
DEEEISTTNPVAYEQYGCVCSNWGEDLNQENFGSENQS

SEQ ID NO: 183380 - protein, 35 aa, Artificial Sequence
  Description of Artificial Sequence: Synthetic polypeptide
DEEEISTTNPVAYEQYGCVCSNWGEHAENFGSQQA

SEQ ID NO: 183381 - protein, 36 aa, Artificial Sequence
  Description of Artificial Sequence: Synthetic polypeptide
SEEEIRTTNPVATEQYGCVCSWGEDHNAHFNSEFQA

SEQ ID NO: 183382 - protein, 37 aa, Artificial Sequence
  Description of Artificial Sequence: Synthetic polypeptide
DEEEISTTNPVAYEQYGCVCSNWGEHNAENFGSDNQA

SEQ ID NO: 183383 - protein, 38 aa, Artificial Sequence
  Description of Artificial Sequence: Synthetic polypeptide
DEEEIRTTNPVATEQYGDAWVNGIVEISGDSLQDSIVQ

SEQ ID NO: 183384 - protein, 38 aa, Artificial Sequence
  Description of Artificial Sequence: Synthetic polypeptide
DEEEIRTTNPVATEQYGDFAFYPTDGTSVVEHGQENNE

SEQ ID NO: 183385 - protein, 35 aa, Artificial Sequence
  Description of Artificial Sequence: Synthetic polypeptide
DEEEIRATNPVATEQWGCVAGEGGGADTAGGNGQD

SEQ ID NO: 183386 - protein, 37 aa, Artificial Sequence
  Description of Artificial Sequence: Synthetic polypeptide
DEEEIRTTNPCATEQYGSVIEPFPAHQAITQGFQPAP

SEQ ID NO: 183387 - protein, 39 aa, Artificial Sequence
  Description of Artificial Sequence: Synthetic polypeptide
DEEEIRTTNPVATEQYGVVSTVVVSNGSNVEQGSTDQDD

SEQ ID NO: 183388 - protein, 35 aa, Artificial Sequence
  Description of Artificial Sequence: Synthetic polypeptide
DDEEIRTTNPCATEHYGCVCSNWEPNQENFNSDQS

SEQ ID NO: 183389 - protein, 37 aa, Artificial Sequence
  Description of Artificial Sequence: Synthetic polypeptide
DEEEISTTNPVAYEQYGCVCSNWEEHNQENFGSQNQA

SEQ ID NO: 183390 - protein, 38 aa, Artificial Sequence
  Description of Artificial Sequence: Synthetic polypeptide
DEEEIRTTNPCATEQYGSVPCVNTSLLDTAGQVQATQC

SEQ ID NO: 183391 - protein, 37 aa, Artificial Sequence
  Description of Artificial Sequence: Synthetic polypeptide
DEEEIRTTNPCATEQYGSVIEPVNYHQQITQTFQPAE

SEQ ID NO: 183392 - protein, 38 aa, Artificial Sequence
  Description of Artificial Sequence: Synthetic polypeptide
DEEEISTTNPVAYEQWGSVSGGNPGNGGNMRMMEGMSD

SEQ ID NO: 183393 - protein, 37 aa, Artificial Sequence
  Description of Artificial Sequence: Synthetic polypeptide
DEEEISTTNPVAYEQWGSVSGGPPGNGGNMRDMQGMS

SEQ ID NO: 183394 - protein, 35 aa, Artificial Sequence
  Description of Artificial Sequence: Synthetic polypeptide
DEEEISTTNPVAYEQYGCVCQWGEHNQYFDSDNQS

SEQ ID NO: 183395 - protein, 37 aa, Artificial Sequence
  Description of Artificial Sequence: Synthetic polypeptide
DEEEISTTNPVAYEQYGCVCSMSGEHNQENFGSDNQD

SEQ ID NO: 183396 - protein, 37 aa, Artificial Sequence
  Description of Artificial Sequence: Synthetic polypeptide
DEEEISTTNPVAYEQYGCVCSMTGEHNQENFNSDTQA

SEQ ID NO: 183397 - protein, 36 aa, Artificial Sequence
  Description of Artificial Sequence: Synthetic polypeptide
DEEEISTTNPVAYEQYGCVCSNSGEHNQEHFGSDQS

SEQ ID NO: 183398 - protein, 37 aa, Artificial Sequence
  Description of Artificial Sequence: Synthetic polypeptide
DEEEISTTNPVAYEQYGCVCSNTGEDHNQENFGSEQS

SEQ ID NO: 183399 - protein, 39 aa, Artificial Sequence
  Description of Artificial Sequence: Synthetic polypeptide
SEEEIRTTNPVATEQYGSNCVTWSVNDQEQNNEPEINIV

SEQ ID NO: 183400 - protein, 38 aa, Artificial Sequence
  Description of Artificial Sequence: Synthetic polypeptide
DEEEIRATNPVATEAYGTVSTTQGNQIGNTEQGTTNVE

SEQ ID NO: 183401 - protein, 38 aa, Artificial Sequence
  Description of Artificial Sequence: Synthetic polypeptide
SEEEIRTTNPVATEQYGSMGMDGENEMDDQGDGGNQGQ

SEQ ID NO: 183402 - protein, 37 aa, Artificial Sequence
  Description of Artificial Sequence: Synthetic polypeptide
DEEEISTTNPVAYEQYGCVCSNTGEDNAENFNSEFQG

SEQ ID NO: 183403 - protein, 36 aa, Artificial Sequence
  Description of Artificial Sequence: Synthetic polypeptide
DEEEISTTNPVAYEQYGCVCSNTGEHQENFPSDPQT

SEQ ID NO: 183404 - protein, 37 aa, Artificial Sequence
  Description of Artificial Sequence: Synthetic polypeptide
SEEEIRTTNPVATEQYGSCNSATTGEEAEEGQDTDKI

SEQ ID NO: 183405 - protein, 38 aa, Artificial Sequence
  Description of Artificial Sequence: Synthetic polypeptide
QEQEICTTNPVATEQYGSVNNTGNNQNGLGQQEGEGEE

SEQ ID NO: 183406 - protein, 38 aa, Artificial Sequence
  Description of Artificial Sequence: Synthetic polypeptide
QEQEICTTNPVATEQYGSVNQTGNNDNGLGQQEGEGED

SEQ ID NO: 183407 - protein, 39 aa, Artificial Sequence
  Description of Artificial Sequence: Synthetic polypeptide
DEEEIRATNPVATEAYGVVSTVTNDNQQGTEQYGTTNQD

SEQ ID NO: 183408 - protein, 36 aa, Artificial Sequence
  Description of Artificial Sequence: Synthetic polypeptide
DDEEIRTTNPCATEGYGCVCSWGELNQENFNSDNQS

SEQ ID NO: 183409 - protein, 37 aa, Artificial Sequence
  Description of Artificial Sequence: Synthetic polypeptide
DEEEIRTTNPVATEQYGDFGEVQSGEVDAHAEGDPMT

SEQ ID NO: 183410 - protein, 37 aa, Artificial Sequence
  Description of Artificial Sequence: Synthetic polypeptide
DEEEISTTNPVAYEQYGCVCSNWGEHNQENFGSDNQA

SEQ ID NO: 183411 - protein, 37 aa, Artificial Sequence
  Description of Artificial Sequence: Synthetic polypeptide
DEEEISTTNPVAYEQYGCVCSNWGEHNQENFGSDNQL

SEQ ID NO: 183412 - protein, 37 aa, Artificial Sequence
  Description of Artificial Sequence: Synthetic polypeptide
DEEEIRTTNPVATEQYGDTAFYPTGVSVVEHGQEADD

SEQ ID NO: 183413 - protein, 35 aa, Artificial Sequence
  Description of Artificial Sequence: Synthetic polypeptide
DEEEISTTNPVAYEQYGCVCSWEEHNQENFFSEQA

SEQ ID NO: 183414 - protein, 37 aa, Artificial Sequence
  Description of Artificial Sequence: Synthetic polypeptide
DEEEISTTNPVAYEQYGCVCSWEEPHNTENFNSDNQA

SEQ ID NO: 183415 - protein, 36 aa, Artificial Sequence
  Description of Artificial Sequence: Synthetic polypeptide
DEEEISTTNPVAYEQYGCVCSWGEDDNQENFNSEQS

SEQ ID NO: 183416 - protein, 37 aa, Artificial Sequence
  Description of Artificial Sequence: Synthetic polypeptide
DEEEISTTNPVAYEQYGCVCSWGEDHNQENFGSENQA

SEQ ID NO: 183417 - protein, 36 aa, Artificial Sequence
  Description of Artificial Sequence: Synthetic polypeptide
DEEEISTTNPVAYEQYGCVCSWGEHNAENFNSDNQA

SEQ ID NO: 183418 - protein, 36 aa, Artificial Sequence
  Description of Artificial Sequence: Synthetic polypeptide
DEEEISTTNPVAYEQYGCVCSWGEHNIEHFNSEFQA

SEQ ID NO: 183419 - protein, 36 aa, Artificial Sequence
  Description of Artificial Sequence: Synthetic polypeptide
DEEEISTTNPVAYEQYGCVCSWGEHNIESFNSDNQS

SEQ ID NO: 183420 - protein, 36 aa, Artificial Sequence
  Description of Artificial Sequence: Synthetic polypeptide
DEEEISTTNPVAYEQYGCVCSWGEHNQENFNSDTQA

SEQ ID NO: 183421 - protein, 36 aa, Artificial Sequence
  Description of Artificial Sequence: Synthetic polypeptide
DEEEISTTNPVAYEQYGCVCSWGEHNQENFPSDNQS

SEQ ID NO: 183422 - protein, 36 aa, Artificial Sequence
  Description of Artificial Sequence: Synthetic polypeptide
DEEEISTTNPVAYEQYGCVCSWGEHNQEYFNSDNQS

SEQ ID NO: 183423 - protein, 37 aa, Artificial Sequence
  Description of Artificial Sequence: Synthetic polypeptide
DEEEISTTNPVAYEQYGCVTSTWPAHNAEHFGSDPQS

SEQ ID NO: 183424 - protein, 35 aa, Artificial Sequence
  Description of Artificial Sequence: Synthetic polypeptide
DDEEIRTTNPCATEQYGCVCGWEHNQENFGSDTAS

SEQ ID NO: 183425 - protein, 37 aa, Artificial Sequence
  Description of Artificial Sequence: Synthetic polypeptide
DEEEISTTNPVAYEQYGQCQVCSDTGYHQENFNSEQA

SEQ ID NO: 183426 - protein, 40 aa, Artificial Sequence
  Description of Artificial Sequence: Synthetic polypeptide
DEEEIRTTNPVATEQYGDVSNMQDTGNMINNANEGGNETT

SEQ ID NO: 183427 - protein, 36 aa, Artificial Sequence
  Description of Artificial Sequence: Synthetic polypeptide
DEEEISTTNPVAYEQYGQCVCGSGEHNQNFNSDTQS

SEQ ID NO: 183428 - protein, 38 aa, Artificial Sequence
  Description of Artificial Sequence: Synthetic polypeptide
DEEEIRTTNPVATEQYGSIPCVTSMMQGEVQMIPQTIV

SEQ ID NO: 183429 - protein, 38 aa, Artificial Sequence
  Description of Artificial Sequence: Synthetic polypeptide
SEEEIRTTNPVATEHYGCVVCMDNGQDMQRGTQGDSDR

SEQ ID NO: 183430 - protein, 36 aa, Artificial Sequence
  Description of Artificial Sequence: Synthetic polypeptide
DEEEIRTTNPCATEQYGSACAAANPDATAHLGEMAD

SEQ ID NO: 183431 - protein, 37 aa, Artificial Sequence
  Description of Artificial Sequence: Synthetic polypeptide
SEEEIRTTNPVATEGYGMVSDGQGTGQGEGGDEQNGE

SEQ ID NO: 183432 - protein, 36 aa, Artificial Sequence
  Description of Artificial Sequence: Synthetic polypeptide
DEEEISTTNPVAYEQYGCVCSWEEHEAENFGSDNQS

SEQ ID NO: 183433 - protein, 37 aa, Artificial Sequence
  Description of Artificial Sequence: Synthetic polypeptide
SEEEIRTTNPVATEGYGMVNGQITNGQGEGQDEQFGE

SEQ ID NO: 183434 - protein, 36 aa, Artificial Sequence
  Description of Artificial Sequence: Synthetic polypeptide
DEEEISTTNPVAYEQYGCVCSWEEDHNQEHFNSDQA

SEQ ID NO: 183435 - protein, 37 aa, Artificial Sequence
  Description of Artificial Sequence: Synthetic polypeptide
DEEEISTTNPVAYEQYGCVCSTWGEHNQENFNSDPQS

SEQ ID NO: 183436 - protein, 37 aa, Artificial Sequence
  Description of Artificial Sequence: Synthetic polypeptide
DEEEISTTNPVAYEQYGCVCSNWGEHNQENFGSENQA

SEQ ID NO: 183437 - protein, 38 aa, Artificial Sequence
  Description of Artificial Sequence: Synthetic polypeptide
DEEEIRTTNPVATEQYGDVCVQGIADMTMEEPEQEGTP

SEQ ID NO: 183438 - protein, 36 aa, Artificial Sequence
  Description of Artificial Sequence: Synthetic polypeptide
DEEEISTTNPVAYEQYGCVCSNWGEHNQESFGSDQS

SEQ ID NO: 183439 - protein, 37 aa, Artificial Sequence
  Description of Artificial Sequence: Synthetic polypeptide
DEEEISTTNPVAYEQYGCVCSNWGEHNTENFGSDNQT

SEQ ID NO: 183440 - protein, 38 aa, Artificial Sequence
  Description of Artificial Sequence: Synthetic polypeptide
DEEEISTTNPVAYEQYGCVCSNWGELHNQENFGSDNQS

SEQ ID NO: 183441 - protein, 37 aa, Artificial Sequence
  Description of Artificial Sequence: Synthetic polypeptide
DEEEISTTNPVAYEQYGCVCSNWGETNAENFNSETQA

SEQ ID NO: 183442 - protein, 36 aa, Artificial Sequence
  Description of Artificial Sequence: Synthetic polypeptide
DEEEISTTNPVAYEQYGCVCSNWPEHNQENFNSDQS

SEQ ID NO: 183443 - protein, 37 aa, Artificial Sequence
  Description of Artificial Sequence: Synthetic polypeptide
DEEEISTTNPVAYEQYGCVCSSEEDHNAENFGSDNQS

SEQ ID NO: 183444 - protein, 35 aa, Artificial Sequence
  Description of Artificial Sequence: Synthetic polypeptide
DDEEIRTTNPCATEHYGCVCSWGPHNQENFNSDQS

SEQ ID NO: 183445 - protein, 36 aa, Artificial Sequence
  Description of Artificial Sequence: Synthetic polypeptide
DEEEISTTNPVAYEQYGCVCSSGEDEQENFNSDFQS

SEQ ID NO: 183446 - protein, 37 aa, Artificial Sequence
  Description of Artificial Sequence: Synthetic polypeptide
DEEEISTTNPVAYEQYGCVCSSGEDHNQENFGSDNQS

SEQ ID NO: 183447 - protein, 37 aa, Artificial Sequence
  Description of Artificial Sequence: Synthetic polypeptide
SEEEIRTTNPVATEQYGCVCSNWGPHNAENFNSDFQA

SEQ ID NO: 183448 - protein, 35 aa, Artificial Sequence
  Description of Artificial Sequence: Synthetic polypeptide
DEEEIRATNPVATEQWGGCCAITNHDEFAMMEENN

SEQ ID NO: 183449 - protein, 37 aa, Artificial Sequence
  Description of Artificial Sequence: Synthetic polypeptide
DEEEIRTTNPVATEQYGDVMGGDPDEGGGDDDDEGNQ

SEQ ID NO: 183450 - protein, 36 aa, Artificial Sequence
  Description of Artificial Sequence: Synthetic polypeptide
DEEEIRATNPVATEQWGGCCAITNHDENTGMENNNN

SEQ ID NO: 183451 - protein, 36 aa, Artificial Sequence
  Description of Artificial Sequence: Synthetic polypeptide
DEEEISTTNPVAYEQYGCVCSSGEHNAEFFNSDFQS

SEQ ID NO: 183452 - protein, 35 aa, Artificial Sequence
  Description of Artificial Sequence: Synthetic polypeptide
DEEEIRATNPVATEQWGGCNAINNGEEAAGMEGAR

SEQ ID NO: 183453 - protein, 36 aa, Artificial Sequence
  Description of Artificial Sequence: Synthetic polypeptide
SEEEIRTTNPVATEQYGCVCGWGEHNQEYFGSDTQA

SEQ ID NO: 183454 - protein, 36 aa, Artificial Sequence
  Description of Artificial Sequence: Synthetic polypeptide
SEEEIRTTNPVATEQYGCVCGTGAHNQENFISDTQA

SEQ ID NO: 183455 - protein, 37 aa, Artificial Sequence
  Description of Artificial Sequence: Synthetic polypeptide
DEEEISTTNPVAYEQYGCVCSWEEDDNQENFGSENQS

SEQ ID NO: 183456 - protein, 39 aa, Artificial Sequence
  Description of Artificial Sequence: Synthetic polypeptide
DEEEISTTNPVATEQYGQCVCSTWGEDHNAEHFGSENQS

SEQ ID NO: 183457 - protein, 34 aa, Artificial Sequence
  Description of Artificial Sequence: Synthetic polypeptide
SEEEIRCTNPCATEQYGCVCSMWEHAENFGSDQS

SEQ ID NO: 183458 - protein, 37 aa, Artificial Sequence
  Description of Artificial Sequence: Synthetic polypeptide
DEESIACTNPVATEQYGSVCAMTNNSENPDDQMEGDN

SEQ ID NO: 183459 - protein, 40 aa, Artificial Sequence
  Description of Artificial Sequence: Synthetic polypeptide
DEEEIRTTNPVATESYGTVTNLQSGTIGTNTGNQEQGTND

SEQ ID NO: 183460 - protein, 40 aa, Artificial Sequence
  Description of Artificial Sequence: Synthetic polypeptide
DEEEIRTTNPVATESYGTVTNLQSGTIGTNNTQNQEQGER

SEQ ID NO: 183461 - protein, 35 aa, Artificial Sequence
  Description of Artificial Sequence: Synthetic polypeptide
QEYEIGTTNPVATEAYGAVSTANAGMEEGGGFEEG

SEQ ID NO: 183462 - protein, 36 aa, Artificial Sequence
  Description of Artificial Sequence: Synthetic polypeptide
DEEVISTTNPVATEQYGCVCSSGEHNDENFGSDTQA

SEQ ID NO: 183463 - protein, 40 aa, Artificial Sequence
  Description of Artificial Sequence: Synthetic polypeptide
DEEEIRTTNPVATESYGTVTNLQSGSIGTNNTQNQEQGND

SEQ ID NO: 183464 - protein, 39 aa, Artificial Sequence
  Description of Artificial Sequence: Synthetic polypeptide
DEEEIRTTNPVATEQYGVVVSTVNVATNVATEEGTTDDD

SEQ ID NO: 183465 - protein, 39 aa, Artificial Sequence
  Description of Artificial Sequence: Synthetic polypeptide
DEEEIRTTNPVATEQYGVVVTVTVNQNGTTEQGTEQGTD

SEQ ID NO: 183466 - protein, 38 aa, Artificial Sequence
  Description of Artificial Sequence: Synthetic polypeptide
DEEEIRTTNPVATEQYGSGCSPTIYAGMEPEQQPEAET

SEQ ID NO: 183467 - protein, 36 aa, Artificial Sequence
  Description of Artificial Sequence: Synthetic polypeptide
DEGEIATTNPVATEQYGCVAGTGQSTGPDDEMGSED

SEQ ID NO: 183468 - protein, 32 aa, Artificial Sequence
  Description of Artificial Sequence: Synthetic polypeptide
QESEIASTNPVGTEGYGVSCASALQHFGSDIS

SEQ ID NO: 183469 - protein, 39 aa, Artificial Sequence
  Description of Artificial Sequence: Synthetic polypeptide
DEEEIRTTNPVATEQYGVVVTVVVNQQGNTEQGTEQGTD

SEQ ID NO: 183470 - protein, 40 aa, Artificial Sequence
  Description of Artificial Sequence: Synthetic polypeptide
DEEEIRTTNPVATEQYGVVVVTSTTNNQAGTEQGSTQDDE

SEQ ID NO: 183471 - protein, 30 aa, Artificial Sequence
  Description of Artificial Sequence: Synthetic polypeptide
QEWEIATTNPVAYERWGEAYMVEQHDLNEG

SEQ ID NO: 183472 - protein, 33 aa, Artificial Sequence
  Description of Artificial Sequence: Synthetic polypeptide
QEVSIATTNPVAYDPWGMVPSCTAEHSQRSNRP

SEQ ID NO: 183473 - protein, 40 aa, Artificial Sequence
  Description of Artificial Sequence: Synthetic polypeptide
DEEEIRTTNPVATEQYGVVVVVVVVVNLQQGNTTNDTEDD

SEQ ID NO: 183474 - protein, 35 aa, Artificial Sequence
  Description of Artificial Sequence: Synthetic polypeptide
QEVEIVTTNPVATEQYGVVALGPSEGEGGQGENED

SEQ ID NO: 183475 - protein, 35 aa, Artificial Sequence
  Description of Artificial Sequence: Synthetic polypeptide
QEVEIVTTNPVATEQYGTVVSAVDGDDEEGEGGNQ

SEQ ID NO: 183476 - protein, 36 aa, Artificial Sequence
  Description of Artificial Sequence: Synthetic polypeptide
QEVEIVTTNPVATEQYGTVVSATDGDDEEGEGGNTF

SEQ ID NO: 183477 - protein, 39 aa, Artificial Sequence
  Description of Artificial Sequence: Synthetic polypeptide
DEEEIRTTNPVATEQYGVVVTVVVNQNGTTQQGTEQGTD

SEQ ID NO: 183478 - protein, 37 aa, Artificial Sequence
  Description of Artificial Sequence: Synthetic polypeptide
DEEEIRTTNPVATEQYGVVVPDDDEMEQGNFGGDEGG

SEQ ID NO: 183479 - protein, 39 aa, Artificial Sequence
  Description of Artificial Sequence: Synthetic polypeptide
DEEEIRTTNPVATESYGTVTNLQSGTIGTNTNNSEQGNV

SEQ ID NO: 183480 - protein, 39 aa, Artificial Sequence
  Description of Artificial Sequence: Synthetic polypeptide
DEEEIRTTNPVATESYGTVTNLQSGTIGTNTNNTEAGNT

SEQ ID NO: 183481 - protein, 37 aa, Artificial Sequence
  Description of Artificial Sequence: Synthetic polypeptide
DEEEIRTTNPVATEQYGSCNCPESELDIEMEEQEDLI

SEQ ID NO: 183482 - protein, 38 aa, Artificial Sequence
  Description of Artificial Sequence: Synthetic polypeptide
DEEEIRTTNPVATEQYGVVTVVVTQAGNNDETEEEEGT

SEQ ID NO: 183483 - protein, 38 aa, Artificial Sequence
  Description of Artificial Sequence: Synthetic polypeptide
DEEEIRTTNPVATEQYGVVTVVVTQQGNNDETNEEEDE

SEQ ID NO: 183484 - protein, 38 aa, Artificial Sequence
  Description of Artificial Sequence: Synthetic polypeptide
DEEEIRTTNPVATEQYGVVTVVVTQQGNNDTEEEEEDE

SEQ ID NO: 183485 - protein, 38 aa, Artificial Sequence
  Description of Artificial Sequence: Synthetic polypeptide
DDEEIRTTNPVATEQYGSVMGENNNENMDEGGQIGDIT

SEQ ID NO: 183486 - protein, 40 aa, Artificial Sequence
  Description of Artificial Sequence: Synthetic polypeptide
DEEEIRTTNPVATESYGTVTNLQSGTISTNNTQNNEVGNN

SEQ ID NO: 183487 - protein, 40 aa, Artificial Sequence
  Description of Artificial Sequence: Synthetic polypeptide
DEEEIRTTNPVATESYGTVTNLQSGTISTNNTQNGEQGNA

SEQ ID NO: 183488 - protein, 39 aa, Artificial Sequence
  Description of Artificial Sequence: Synthetic polypeptide
DEEEIRTTNPVATESYGTVTNLQSGTISTNNTNTEVGNV

SEQ ID NO: 183489 - protein, 39 aa, Artificial Sequence
  Description of Artificial Sequence: Synthetic polypeptide
DEEEIRTTNPVATESYGTVTNLQSGTISTNANNTEVGNA

SEQ ID NO: 183490 - protein, 38 aa, Artificial Sequence
  Description of Artificial Sequence: Synthetic polypeptide
DEEEIRTTNPVATEQYGVVTVVVVNNQNQNQNQQEGTD

SEQ ID NO: 183491 - protein, 39 aa, Artificial Sequence
  Description of Artificial Sequence: Synthetic polypeptide
DEEEIRTTNPVATESYGTVTNLQSGTISTNANNNENGNT

SEQ ID NO: 183492 - protein, 40 aa, Artificial Sequence
  Description of Artificial Sequence: Synthetic polypeptide
DEEEIRTTNPVATEQYGVVTVVVVSNNDQQGTNTTTTTES

SEQ ID NO: 183493 - protein, 39 aa, Artificial Sequence
  Description of Artificial Sequence: Synthetic polypeptide
DEEEIRTTNPVATESYGTVTNLQSGTIGTTTQNQENGNT

SEQ ID NO: 183494 - protein, 40 aa, Artificial Sequence
  Description of Artificial Sequence: Synthetic polypeptide
DEEEIRTTNPVATESYGTVTNLQSGTIGTTNTNNQEQGNF

SEQ ID NO: 183495 - protein, 39 aa, Artificial Sequence
  Description of Artificial Sequence: Synthetic polypeptide
DEEEIRTTNPVATEQYGVVVGSGQEDQEEQDGGQEGNGV

SEQ ID NO: 183496 - protein, 39 aa, Artificial Sequence
  Description of Artificial Sequence: Synthetic polypeptide
DEEEIRTTNPVATEQYGVVVGSGQIDQEEQDGPGEGNGV

SEQ ID NO: 183497 - protein, 40 aa, Artificial Sequence
  Description of Artificial Sequence: Synthetic polypeptide
DEEEIRTTNPVATESYGTVTNLQSGTIGTNTQNNEQGTNN

SEQ ID NO: 183498 - protein, 40 aa, Artificial Sequence
  Description of Artificial Sequence: Synthetic polypeptide
DEEEIRTTNPVATESYGTVTNLQSGTIGTNTQNGTEQGNA

SEQ ID NO: 183499 - protein, 39 aa, Artificial Sequence
  Description of Artificial Sequence: Synthetic polypeptide
DEEEIRTTNPVATESYGTVTNLQSGTIGTNTQNEEQGTQ

SEQ ID NO: 183500 - protein, 36 aa, Artificial Sequence
  Description of Artificial Sequence: Synthetic polypeptide
QEVEITTTNPVATEQYGTVVSATDGDDEEGNGGNDE

SEQ ID NO: 183501 - protein, 40 aa, Artificial Sequence
  Description of Artificial Sequence: Synthetic polypeptide
DEEEIRTTNPVATESYGTVTNLQSGTISTNNTQNQEAGNT

SEQ ID NO: 183502 - protein, 37 aa, Artificial Sequence
  Description of Artificial Sequence: Synthetic polypeptide
DEEEIRTTNPVATEQYGSCNWPEIPMLEDADEKDIRI

SEQ ID NO: 183503 - protein, 38 aa, Artificial Sequence
  Description of Artificial Sequence: Synthetic polypeptide
QEVEIRTTNPVATEQYGSVTYTNDGNDQGEGEEGIGGP

SEQ ID NO: 183504 - protein, 38 aa, Artificial Sequence
  Description of Artificial Sequence: Synthetic polypeptide
QETEIRTTNPVATEQYGSVVTTDGMNDNQTGEDEEGME

SEQ ID NO: 183505 - protein, 33 aa, Artificial Sequence
  Description of Artificial Sequence: Synthetic polypeptide
DEFEIATTNPVSTEPYGVCYCEDGQQQQNGNET

SEQ ID NO: 183506 - protein, 33 aa, Artificial Sequence
  Description of Artificial Sequence: Synthetic polypeptide
QETEIRTTNPVATEQWGATWANEEVWAEPKGPK

SEQ ID NO: 183507 - protein, 33 aa, Artificial Sequence
  Description of Artificial Sequence: Synthetic polypeptide
QETEIRTTNPVATEQWGATWANEEDWAEPKGPK

SEQ ID NO: 183508 - protein, 36 aa, Artificial Sequence
  Description of Artificial Sequence: Synthetic polypeptide
DEGEIATTNPVATEQYGCCPAANHLEAEMPQGGAHQ

SEQ ID NO: 183509 - protein, 32 aa, Artificial Sequence
  Description of Artificial Sequence: Synthetic polypeptide
QETEIRTTNPIATECWGITTWSNAEDWQSGPI

SEQ ID NO: 183510 - protein, 35 aa, Artificial Sequence
  Description of Artificial Sequence: Synthetic polypeptide
DEGEIATTNPVATEQYGASFAAADTLEPHEGEDTG

SEQ ID NO: 183511 - protein, 34 aa, Artificial Sequence
  Description of Artificial Sequence: Synthetic polypeptide
QETEIRTTNPIATECWGATVWANAEDWQEPKGPR

SEQ ID NO: 183512 - protein, 37 aa, Artificial Sequence
  Description of Artificial Sequence: Synthetic polypeptide
DEEEIRTTNPVATEQYGSCQLVMNCDEEHVIAPVNEV

SEQ ID NO: 183513 - protein, 33 aa, Artificial Sequence
  Description of Artificial Sequence: Synthetic polypeptide
QETEIRTTNPIATECWGATTWANAEDLQPKGPI

SEQ ID NO: 183514 - protein, 34 aa, Artificial Sequence
  Description of Artificial Sequence: Synthetic polypeptide
DEGEIATTNPVATEQWGTNCAATDGGVETEIGND

SEQ ID NO: 183515 - protein, 34 aa, Artificial Sequence
  Description of Artificial Sequence: Synthetic polypeptide
DEGEIATTNPVATEQWGTNCAATDGEEEGMEIND

SEQ ID NO: 183516 - protein, 33 aa, Artificial Sequence
  Description of Artificial Sequence: Synthetic polypeptide
DEGEIATTNPVATEQWGTNCAANDGPVEMEIND

SEQ ID NO: 183517 - protein, 37 aa, Artificial Sequence
  Description of Artificial Sequence: Synthetic polypeptide
QETEIRSTNPVATEQYGSVMDPEGGDTTGNGQQGDSG

SEQ ID NO: 183518 - protein, 34 aa, Artificial Sequence
  Description of Artificial Sequence: Synthetic polypeptide
QETEIRGTNCVATEQYGVVVGDNGGDQEDGEFEA

SEQ ID NO: 183519 - protein, 38 aa, Artificial Sequence
  Description of Artificial Sequence: Synthetic polypeptide
DDEEIRTTNPVATEQYGSVAGQGQGDDEFGNTGQEGTA

SEQ ID NO: 183520 - protein, 38 aa, Artificial Sequence
  Description of Artificial Sequence: Synthetic polypeptide
DDEEIRTTNPVATEQYGSVAGQGQGDDEFGNGDQEQTA

SEQ ID NO: 183521 - protein, 38 aa, Artificial Sequence
  Description of Artificial Sequence: Synthetic polypeptide
DDEEIRTTNPVATEQYGSSMISTSANMMIEPNNTSVGD

SEQ ID NO: 183522 - protein, 37 aa, Artificial Sequence
  Description of Artificial Sequence: Synthetic polypeptide
DEEEIRATNPVATEQYGDVVNGFGEENDIQEGGDEMT

SEQ ID NO: 183523 - protein, 34 aa, Artificial Sequence
  Description of Artificial Sequence: Synthetic polypeptide
DEGEIATTNPVATEQYGCVAAAAGPAEAMTNGED

SEQ ID NO: 183524 - protein, 40 aa, Artificial Sequence
  Description of Artificial Sequence: Synthetic polypeptide
DEEEIRTTNPVATEQYGVVVVVVVVVVNNLQQNGNEEEEE

SEQ ID NO: 183525 - protein, 35 aa, Artificial Sequence
  Description of Artificial Sequence: Synthetic polypeptide
DEFEIATTNPVAYEQWGSVCQNFEDRKTRDGGSEQ

SEQ ID NO: 183526 - protein, 38 aa, Artificial Sequence
  Description of Artificial Sequence: Synthetic polypeptide
DEEEIRTTNPVATEQYGSGANSGINVHDDDDSDENIMM

SEQ ID NO: 183527 - protein, 37 aa, Artificial Sequence
  Description of Artificial Sequence: Synthetic polypeptide
DEEEIRTTNPVATEQYGSGAIYDNTPETVLVNPEMLN

SEQ ID NO: 183528 - protein, 37 aa, Artificial Sequence
  Description of Artificial Sequence: Synthetic polypeptide
QEVEIRTTNPVATEQYGSVTYGDGNDQGEEEEGIGGP

SEQ ID NO: 183529 - protein, 38 aa, Artificial Sequence
  Description of Artificial Sequence: Synthetic polypeptide
QEVEIRTTNPVATEQYGSVTTGDGNDQVGEGEEGIQGP

SEQ ID NO: 183530 - protein, 37 aa, Artificial Sequence
  Description of Artificial Sequence: Synthetic polypeptide
QEVEIRTTNPVATEQYGSVTLGDGNDQEEGEEGIGGP

SEQ ID NO: 183531 - protein, 36 aa, Artificial Sequence
  Description of Artificial Sequence: Synthetic polypeptide
DEEEIRTTNPVATEQYGSCNWPEIPWLDADEKDIFE

SEQ ID NO: 183532 - protein, 36 aa, Artificial Sequence
  Description of Artificial Sequence: Synthetic polypeptide
QEVEIRTTNPVATEQYGAVVNVVGNSGEFTNTEGQG

SEQ ID NO: 183533 - protein, 37 aa, Artificial Sequence
  Description of Artificial Sequence: Synthetic polypeptide
QEVEIRTTNPVATEQYGAVTTGDGNDQFGEGEEGIGP

SEQ ID NO: 183534 - protein, 38 aa, Artificial Sequence
  Description of Artificial Sequence: Synthetic polypeptide
QEVEIRTTNPVATEFYGQVVISDEFGTNDQIINGGGNA

SEQ ID NO: 183535 - protein, 37 aa, Artificial Sequence
  Description of Artificial Sequence: Synthetic polypeptide
QEVEIRTTNPVATECYGSVTTGDGNNQGEGEEGIGGP

SEQ ID NO: 183536 - protein, 38 aa, Artificial Sequence
  Description of Artificial Sequence: Synthetic polypeptide
QEVEIRGTNPVATEQYGSVVINGNLNLEGGGQTEGENG

SEQ ID NO: 183537 - protein, 37 aa, Artificial Sequence
  Description of Artificial Sequence: Synthetic polypeptide
DEEEIRTTNPVATEQYGSFYCWAMTVQPMSEQEQEYE

SEQ ID NO: 183538 - protein, 38 aa, Artificial Sequence
  Description of Artificial Sequence: Synthetic polypeptide
DEEEIRTTNPVATEQYGSFYCWAMTVQPGNKQEQEYVN

SEQ ID NO: 183539 - protein, 37 aa, Artificial Sequence
  Description of Artificial Sequence: Synthetic polypeptide
QEVEICTTNPVATEQYGSVTTGDGNDQGEGEEDIGGP

SEQ ID NO: 183540 - protein, 37 aa, Artificial Sequence
  Description of Artificial Sequence: Synthetic polypeptide
QEVEIATTNPVATEQYGSVTTGMGNDQGEGEEGIGGP

SEQ ID NO: 183541 - protein, 39 aa, Artificial Sequence
  Description of Artificial Sequence: Synthetic polypeptide
DEEEIRTTNPVATEQYGSFVTNSTFQGMCEPEQMVVPTQ

SEQ ID NO: 183542 - protein, 34 aa, Artificial Sequence
  Description of Artificial Sequence: Synthetic polypeptide
DEAEIATTNPVATEQWGCVAGEGVEMNAAEEDNA

SEQ ID NO: 183543 - protein, 35 aa, Artificial Sequence
  Description of Artificial Sequence: Synthetic polypeptide
DEFEIATTNPVAYEQWGSVCQCFEDRTGQKGGSAR

SEQ ID NO: 183544 - protein, 35 aa, Artificial Sequence
  Description of Artificial Sequence: Synthetic polypeptide
QEVEIATTNPVATDQYGVVSSTGDEGGNGQGEETD

SEQ ID NO: 183545 - protein, 34 aa, Artificial Sequence
  Description of Artificial Sequence: Synthetic polypeptide
DEAEIATTNPVATEQWGCIAANQGLEATMNPENH

SEQ ID NO: 183546 - protein, 37 aa, Artificial Sequence
  Description of Artificial Sequence: Synthetic polypeptide
DEEEIRTTNPVATEQYGSCNCIMSMLPIEMEEQEILI

SEQ ID NO: 183547 - protein, 31 aa, Artificial Sequence
  Description of Artificial Sequence: Synthetic polypeptide
QSSEIASTNPVGYEAYGVIASTELSQHGGDI

SEQ ID NO: 183548 - protein, 37 aa, Artificial Sequence
  Description of Artificial Sequence: Synthetic polypeptide
DEEEIRTTNPVATEQYGSCNCHCSELPIEMEEQEILP

SEQ ID NO: 183549 - protein, 38 aa, Artificial Sequence
  Description of Artificial Sequence: Synthetic polypeptide
DEGEIATTNPVATEQYGSVACANANHGPLDSMGGNDNG

SEQ ID NO: 183550 - protein, 33 aa, Artificial Sequence
  Description of Artificial Sequence: Synthetic polypeptide
SAEEIATTNPVATAQWGCVAGTGMPDNADPGGA

SEQ ID NO: 183551 - protein, 37 aa, Artificial Sequence
  Description of Artificial Sequence: Synthetic polypeptide
DEEEIRTTNPVATEQYGSCIHWCGLEDHNDPEGDEGM

SEQ ID NO: 183552 - protein, 34 aa, Artificial Sequence
  Description of Artificial Sequence: Synthetic polypeptide
SAEEIATTNPVATAQWGCVAGTGLATAGPPNDFQ

SEQ ID NO: 183553 - protein, 33 aa, Artificial Sequence
  Description of Artificial Sequence: Synthetic polypeptide
SAEEIATTNPVATAQWGCVAGTGLADAGGGDFF

SEQ ID NO: 183554 - protein, 39 aa, Artificial Sequence
  Description of Artificial Sequence: Synthetic polypeptide
DEEEIRTTNPVATESYGTVTNLQSGTISTTTQNTEVGNV

SEQ ID NO: 183555 - protein, 32 aa, Artificial Sequence
  Description of Artificial Sequence: Synthetic polypeptide
SAEEIATTNPVATAQWGCNVAGAGPQTAGGGF

SEQ ID NO: 183556 - protein, 33 aa, Artificial Sequence
  Description of Artificial Sequence: Synthetic polypeptide
SAEEIATTNPVATAQWGCNVAGAGNQTAGGNGF

SEQ ID NO: 183557 - protein, 34 aa, Artificial Sequence
  Description of Artificial Sequence: Synthetic polypeptide
SAEEIATTNPVATAQWGCVAGTGNPDNADPHGVR

SEQ ID NO: 183558 - protein, 37 aa, Artificial Sequence
  Description of Artificial Sequence: Synthetic polypeptide
DEGEIATTNPVATEQYGSTVCAANNNEEAPDNQEGMD

SEQ ID NO: 183559 - protein, 36 aa, Artificial Sequence
  Description of Artificial Sequence: Synthetic polypeptide
DEGEIATTNPVATEQYGSTSFSAADTLEPHEGEETG

SEQ ID NO: 183560 - protein, 40 aa, Artificial Sequence
  Description of Artificial Sequence: Synthetic polypeptide
DEEEIRTTNPVATESYGTVTNLQSGTISTTNTQNQEVGNV

SEQ ID NO: 183561 - protein, 36 aa, Artificial Sequence
  Description of Artificial Sequence: Synthetic polypeptide
DEGEIATTNPVATEQYGSSSFSAYDTLEPHEGEDTG

SEQ ID NO: 183562 - protein, 32 aa, Artificial Sequence
  Description of Artificial Sequence: Synthetic polypeptide
SAAEIATTNPVATASWGCNVAGAGLQTAGDNF

SEQ ID NO: 183563 - protein, 35 aa, Artificial Sequence
  Description of Artificial Sequence: Synthetic polypeptide
RSSEIRTTNPVATEQYGSVPALVTQEHTFEASNQE

SEQ ID NO: 183564 - protein, 39 aa, Artificial Sequence
  Description of Artificial Sequence: Synthetic polypeptide
DEEEIRTTNPVATESYGTVTNLQSGTISTNTTNNEIGNV

SEQ ID NO: 183565 - protein, 39 aa, Artificial Sequence
  Description of Artificial Sequence: Synthetic polypeptide
DEEEIRTTNPVATESYGTVTNLQSGTISTNTQNSEVGTV

SEQ ID NO: 183566 - protein, 36 aa, Artificial Sequence
  Description of Artificial Sequence: Synthetic polypeptide
DEEEIRTTNPVATEQYGSCLWPEILELDAVEKDSSG

SEQ ID NO: 183567 - protein, 37 aa, Artificial Sequence
  Description of Artificial Sequence: Synthetic polypeptide
DEGEIATTNPVATEQYGSTSFSAPDTLREPHEGFDTR

SEQ ID NO: 183568 - protein, 33 aa, Artificial Sequence
  Description of Artificial Sequence: Synthetic polypeptide
SAEEIATTNPVATAQWGCVAGTGNPDNANPHGF

SEQ ID NO: 183569 - protein, 38 aa, Artificial Sequence
  Description of Artificial Sequence: Synthetic polypeptide
DEEEIRTTNPVATEQYGSCIHHCSLEDHMDPEGNEHGM

SEQ ID NO: 183570 - protein, 40 aa, Artificial Sequence
  Description of Artificial Sequence: Synthetic polypeptide
DEEEIRTTNPVATESYGTVTNLQSGVISTTTQNQEQGTNN

SEQ ID NO: 183571 - protein, 36 aa, Artificial Sequence
  Description of Artificial Sequence: Synthetic polypeptide
SAEEIATTNPVATEQWGGCTVAGNNNLQTEMGNGNN

SEQ ID NO: 183572 - protein, 38 aa, Artificial Sequence
  Description of Artificial Sequence: Synthetic polypeptide
DEEEIRTTNPVATEQYGSCCQPVNSYAIGQYQHPVSEM

SEQ ID NO: 183573 - protein, 40 aa, Artificial Sequence
  Description of Artificial Sequence: Synthetic polypeptide
DEEEIRTTNPVATESYGTVTTGQSGTIGTNNTQEQEIGNT

SEQ ID NO: 183574 - protein, 40 aa, Artificial Sequence
  Description of Artificial Sequence: Synthetic polypeptide
DEEEIRTTNPVATESYGTVTTGQSGNTISTNTQMQEVGNA

SEQ ID NO: 183575 - protein, 39 aa, Artificial Sequence
  Description of Artificial Sequence: Synthetic polypeptide
DEEEIRTTNPVATESYGTVTTGQSATISTTTQEQEVGNT

SEQ ID NO: 183576 - protein, 39 aa, Artificial Sequence
  Description of Artificial Sequence: Synthetic polypeptide
DEEEIRTTNPVATESYGTVTTGQQVTISTTTQGQEVGNT

SEQ ID NO: 183577 - protein, 35 aa, Artificial Sequence
  Description of Artificial Sequence: Synthetic polypeptide
SAEEIATTNPVATEQWGCVAGTGLPENNTGGNMEN

SEQ ID NO: 183578 - protein, 40 aa, Artificial Sequence
  Description of Artificial Sequence: Synthetic polypeptide
DEEEIRTTNPVATESYGTVTTGQQVTISTNNTQMQEVGNT

SEQ ID NO: 183579 - protein, 32 aa, Artificial Sequence
  Description of Artificial Sequence: Synthetic polypeptide
SAEEIATTNPVATASWGCVAGTGLAAADDQRH

SEQ ID NO: 183580 - protein, 33 aa, Artificial Sequence
  Description of Artificial Sequence: Synthetic polypeptide
SAEEIATTNPVATASWGCNVAGAGLQTAGGNHT

SEQ ID NO: 183581 - protein, 33 aa, Artificial Sequence
  Description of Artificial Sequence: Synthetic polypeptide
SAEEIATTNPVATASWGCNVAGAGLQTAGDGNF

SEQ ID NO: 183582 - protein, 33 aa, Artificial Sequence
  Description of Artificial Sequence: Synthetic polypeptide
SAEEIATTNPVATASWGCNVAGAGLQEAGGNNH

SEQ ID NO: 183583 - protein, 37 aa, Artificial Sequence
  Description of Artificial Sequence: Synthetic polypeptide
DDEEIRTTNPVATEQWGQCVTSTWGEHNQENFGSDAS

SEQ ID NO: 183584 - protein, 39 aa, Artificial Sequence
  Description of Artificial Sequence: Synthetic polypeptide
DEEEIRTTNPVATESYGTVTTGQAGTISTTTQEQEVGNP

SEQ ID NO: 183585 - protein, 37 aa, Artificial Sequence
  Description of Artificial Sequence: Synthetic polypeptide
DEEEIRCTNPVATEQYGCVCSDWGEDHNQNFSSDNQS

SEQ ID NO: 183586 - protein, 39 aa, Artificial Sequence
  Description of Artificial Sequence: Synthetic polypeptide
DEEEIRTTNPVATEQYGVVTVVVNTQQGEQQGTVNVATE

SEQ ID NO: 183587 - protein, 39 aa, Artificial Sequence
  Description of Artificial Sequence: Synthetic polypeptide
DEEEIRTTNPVATEQYGVVTVVVSNNNNNDEQGSNQQDD

SEQ ID NO: 183588 - protein, 39 aa, Artificial Sequence
  Description of Artificial Sequence: Synthetic polypeptide
DEEEIRTTNPVATEQYGVVTVVVSVTNNADEQGSTDEDD

SEQ ID NO: 183589 - protein, 39 aa, Artificial Sequence
  Description of Artificial Sequence: Synthetic polypeptide
DEEEIRTTNPVATESYGTVTTDQSGTIGTTTQNQEVGNP

SEQ ID NO: 183590 - protein, 39 aa, Artificial Sequence
  Description of Artificial Sequence: Synthetic polypeptide
DEEEIRTTNPVATESYGTVTNLQSGTISTNTQNQEVGGM

SEQ ID NO: 183591 - protein, 36 aa, Artificial Sequence
  Description of Artificial Sequence: Synthetic polypeptide
DEEEIRTTNPVATEQYGSCNAPEILEFDAVEKDSQG

SEQ ID NO: 183592 - protein, 40 aa, Artificial Sequence
  Description of Artificial Sequence: Synthetic polypeptide
DEEEIRTTNPVATESYGTVTNLQSGTISTNTQNQEQGTNF

SEQ ID NO: 183593 - protein, 37 aa, Artificial Sequence
  Description of Artificial Sequence: Synthetic polypeptide
DEGEIATTNPVATEQYGSSFLATYDTLEPHEGYEDTR

SEQ ID NO: 183594 - protein, 37 aa, Artificial Sequence
  Description of Artificial Sequence: Synthetic polypeptide
DEEEIRTTNPVATEQYGSCNCCMSELPIEQEEQEDLI

SEQ ID NO: 183595 - protein, 37 aa, Artificial Sequence
  Description of Artificial Sequence: Synthetic polypeptide
DEEEIRTTNPVATEQYGSCNCCMSELPIRMEEQEQLI

SEQ ID NO: 183596 - protein, 37 aa, Artificial Sequence
  Description of Artificial Sequence: Synthetic polypeptide
DEGEIATTNPVATEQYGSCAATGAALPQATMDINETE

SEQ ID NO: 183597 - protein, 38 aa, Artificial Sequence
  Description of Artificial Sequence: Synthetic polypeptide
DEEEIRTTNPVATEQYGSCNCCMSESLKIEMEEQEILI

SEQ ID NO: 183598 - protein, 37 aa, Artificial Sequence
  Description of Artificial Sequence: Synthetic polypeptide
DEGEIATTNPVATEQYGSCAAATGNGLTNPDDGIDSL

SEQ ID NO: 183599 - protein, 37 aa, Artificial Sequence
  Description of Artificial Sequence: Synthetic polypeptide
DEEEIRTTNPVATEQYGSCNCCPSELPIEMEEQAILI

SEQ ID NO: 183600 - protein, 40 aa, Artificial Sequence
  Description of Artificial Sequence: Synthetic polypeptide
DEEEIRTTNPVATESYGTVTNLQSGTISTNNTQNQNVGNL

SEQ ID NO: 183601 - protein, 37 aa, Artificial Sequence
  Description of Artificial Sequence: Synthetic polypeptide
DEEEIRTTNPVATEQYGSCNCCPSELPIMMEEQEDLI

SEQ ID NO: 183602 - protein, 40 aa, Artificial Sequence
  Description of Artificial Sequence: Synthetic polypeptide
DEEEIRTTNPVATESYGTVTNLQSGTISTNNTQNQEVGTR

SEQ ID NO: 183603 - protein, 37 aa, Artificial Sequence
  Description of Artificial Sequence: Synthetic polypeptide
DEEEIRTTNPVATEQYGSCNCCRPELPIEMEEQEDLI

SEQ ID NO: 183604 - protein, 37 aa, Artificial Sequence
  Description of Artificial Sequence: Synthetic polypeptide
DEGEIATTNPVATEQYGSACSAANPAEADAEIGNGTQ

SEQ ID NO: 183605 - protein, 37 aa, Artificial Sequence
  Description of Artificial Sequence: Synthetic polypeptide
DEGEIATTNPVATEQYGSACATNPELGQLHQDDSLAN

SEQ ID NO: 183606 - protein, 37 aa, Artificial Sequence
  Description of Artificial Sequence: Synthetic polypeptide
DEGEIATTNPVATEQYGSACAATNPQEANDSGMGEKM

SEQ ID NO: 183607 - protein, 37 aa, Artificial Sequence
  Description of Artificial Sequence: Synthetic polypeptide
DEGEIATTNPVATEQYGSACAATNPEEAGDSGMGNED

SEQ ID NO: 183608 - protein, 38 aa, Artificial Sequence
  Description of Artificial Sequence: Synthetic polypeptide
DDEEIRTTNPVATEQYGSVMGQGQGDLEVGNGDQEETA

SEQ ID NO: 183609 - protein, 34 aa, Artificial Sequence
  Description of Artificial Sequence: Synthetic polypeptide
QTNEIRCTNPVATEPYGCVCPGQMLLTRGGQNEP

SEQ ID NO: 183610 - protein, 38 aa, Artificial Sequence
  Description of Artificial Sequence: Synthetic polypeptide
DDEEIRTTNPVATEQYGSVMGQGLGDGEFGNGGQEETA

SEQ ID NO: 183611 - protein, 37 aa, Artificial Sequence
  Description of Artificial Sequence: Synthetic polypeptide
DEEEIRTTNPVATEQYGSCNCCWSELPIEMGEQEILI

SEQ ID NO: 183612 - protein, 38 aa, Artificial Sequence
  Description of Artificial Sequence: Synthetic polypeptide
DEEEIRTTNPVATEQYGSCNCCWSEQLLIEDEEQEDLI

SEQ ID NO: 183613 - protein, 37 aa, Artificial Sequence
  Description of Artificial Sequence: Synthetic polypeptide
DEEEIRTTNPVATEQYGSCNCCMSELPEEMEEQEMLI

SEQ ID NO: 183614 - protein, 31 aa, Artificial Sequence
  Description of Artificial Sequence: Synthetic polypeptide
QETEIATTNPVATEQWGATPEEVCQEHKEEK

SEQ ID NO: 183615 - protein, 40 aa, Artificial Sequence
  Description of Artificial Sequence: Synthetic polypeptide
DEEEIRTTNPVATESYGTVTNLQSGTISTNNTQNTEEGNE

SEQ ID NO: 183616 - protein, 38 aa, Artificial Sequence
  Description of Artificial Sequence: Synthetic polypeptide
DEEEIRTTNPVATEQYGSCNCCMSEDLPIEMEEQEILD

SEQ ID NO: 183617 - protein, 39 aa, Artificial Sequence
  Description of Artificial Sequence: Synthetic polypeptide
DEEEIRTTNPVATESYGTVTNLQSGTISTNTQNQEQGTA

SEQ ID NO: 183618 - protein, 35 aa, Artificial Sequence
  Description of Artificial Sequence: Synthetic polypeptide
REMEICTTNPVATEQYGTVCTARDGSPVEFEGPNE

SEQ ID NO: 183619 - protein, 39 aa, Artificial Sequence
  Description of Artificial Sequence: Synthetic polypeptide
DEEEIRTTNPVATESYGTVTNLQSGTISTNTNNQEDENT

SEQ ID NO: 183620 - protein, 39 aa, Artificial Sequence
  Description of Artificial Sequence: Synthetic polypeptide
DEEEIRTTNPVATESYGTVTNLQSGTISTNTNNNESGNM

SEQ ID NO: 183621 - protein, 39 aa, Artificial Sequence
  Description of Artificial Sequence: Synthetic polypeptide
DEEEIRTTNPVATESYGTVTNLQSGTISTNTNNEEMGNV

SEQ ID NO: 183622 - protein, 38 aa, Artificial Sequence
  Description of Artificial Sequence: Synthetic polypeptide
DDEEIRTTNPVATEQYGSVQAQGQGDDEFGNGGNEEIA

SEQ ID NO: 183623 - protein, 37 aa, Artificial Sequence
  Description of Artificial Sequence: Synthetic polypeptide
DEGEIATTNPVATEQYGSISHSAPDTLREPHEGEDTR

SEQ ID NO: 183624 - protein, 40 aa, Artificial Sequence
  Description of Artificial Sequence: Synthetic polypeptide
DEEEIRTTNPVATESYGTVTNLQSGTISTNTGNQEVGTNV

SEQ ID NO: 183625 - protein, 37 aa, Artificial Sequence
  Description of Artificial Sequence: Synthetic polypeptide
DEEEIRTTNPVATEQYGSCNCCASELPIEMEEQEILS

SEQ ID NO: 183626 - protein, 37 aa, Artificial Sequence
  Description of Artificial Sequence: Synthetic polypeptide
DEEEIRTTNPVATEQYGSCNCCCAESLIEMEEQEDLI

SEQ ID NO: 183627 - protein, 37 aa, Artificial Sequence
  Description of Artificial Sequence: Synthetic polypeptide
DEEEIRTTNPVATEQYGSCNCCCSEGPIEMEEQEDLT

SEQ ID NO: 183628 - protein, 38 aa, Artificial Sequence
  Description of Artificial Sequence: Synthetic polypeptide
DEEEIRTTNPVATEQYGSCNCCCSEKLPIESEEQEDLI

SEQ ID NO: 183629 - protein, 37 aa, Artificial Sequence
  Description of Artificial Sequence: Synthetic polypeptide
DEEEIRTTNPVATEQYGSCNCCCSELDVEMEEQELLI

SEQ ID NO: 183630 - protein, 37 aa, Artificial Sequence
  Description of Artificial Sequence: Synthetic polypeptide
DEEEIRTTNPVATEQYGSCNCCCSELPIEMEEQEISI

SEQ ID NO: 183631 - protein, 37 aa, Artificial Sequence
  Description of Artificial Sequence: Synthetic polypeptide
DEEEIRTTNPVATEQYGSCNCCCSELQIEMEEQELLQ

SEQ ID NO: 183632 - protein, 38 aa, Artificial Sequence
  Description of Artificial Sequence: Synthetic polypeptide
DEEEIRTTNPVATEQYGSCNCCCSEVKLIEMEEQEILI

SEQ ID NO: 183633 - protein, 37 aa, Artificial Sequence
  Description of Artificial Sequence: Synthetic polypeptide
DEEEIRTTNPVATEQYGSCNCCCSEVPIEMEEQEKLI

SEQ ID NO: 183634 - protein, 37 aa, Artificial Sequence
  Description of Artificial Sequence: Synthetic polypeptide
DEEEIRTTNPVATEQYGSCNCCCSEWPIEAEEQEDLI

SEQ ID NO: 183635 - protein, 37 aa, Artificial Sequence
  Description of Artificial Sequence: Synthetic polypeptide
DEEEIRTTNPVATEQYGSCNCCCSGLDIEMEEQEDLI

SEQ ID NO: 183636 - protein, 37 aa, Artificial Sequence
  Description of Artificial Sequence: Synthetic polypeptide
DEEEIRTTNPVATEQYGSCNCCMSEIPIEMEEQEILI

SEQ ID NO: 183637 - protein, 36 aa, Artificial Sequence
  Description of Artificial Sequence: Synthetic polypeptide
SAEEIATTNPVATEQWGGCVAGNPGLQNEMAENTRN

SEQ ID NO: 183638 - protein, 32 aa, Artificial Sequence
  Description of Artificial Sequence: Synthetic polypeptide
QETEIATTNPVATEQWGATANEEVCQEPKGPK

SEQ ID NO: 183639 - protein, 38 aa, Artificial Sequence
  Description of Artificial Sequence: Synthetic polypeptide
DDEEIRTTNPVATEQYGSLAIYPDATQNQVRENVELGA

SEQ ID NO: 183640 - protein, 38 aa, Artificial Sequence
  Description of Artificial Sequence: Synthetic polypeptide
DEEEIRTTNPVATEQYGYVTEMGNNNNDDQDEGGGEET

SEQ ID NO: 183641 - protein, 37 aa, Artificial Sequence
  Description of Artificial Sequence: Synthetic polypeptide
DEEEIRTTNPVATEQYGSCTPWPMVGQQIQQTLEDED

SEQ ID NO: 183642 - protein, 33 aa, Artificial Sequence
  Description of Artificial Sequence: Synthetic polypeptide
DEGEIATTNPVATAQWGGCCAPVGGDERDGNPH

SEQ ID NO: 183643 - protein, 37 aa, Artificial Sequence
  Description of Artificial Sequence: Synthetic polypeptide
DEEEIRTTNPVATEQYGSCTQLGNEEGEKAIVPEPEN

SEQ ID NO: 183644 - protein, 29 aa, Artificial Sequence
  Description of Artificial Sequence: Synthetic peptide
QESEIATTNPVGTEGWGVMAETEQNAEDI

SEQ ID NO: 183645 - protein, 29 aa, Artificial Sequence
  Description of Artificial Sequence: Synthetic peptide
QESEIATTNPVGTEGWGVMAETEQNAEDA

SEQ ID NO: 183646 - protein, 37 aa, Artificial Sequence
  Description of Artificial Sequence: Synthetic polypeptide
DEEEIRTTNPVATEQYGSCTYPHEPLEALVDGLVIID

SEQ ID NO: 183647 - protein, 37 aa, Artificial Sequence
  Description of Artificial Sequence: Synthetic polypeptide
DEGEIACTNPVATEQYGSACAATNGIEAPGEQMEGNH

SEQ ID NO: 183648 - protein, 38 aa, Artificial Sequence
  Description of Artificial Sequence: Synthetic polypeptide
DEEEIRTTNPVATEQYGYVYQGSSEFEEEQVCHEMNQG

SEQ ID NO: 183649 - protein, 31 aa, Artificial Sequence
  Description of Artificial Sequence: Synthetic polypeptide
QESEIATTNPVGTECWGATTWAAETLQHGDI

SEQ ID NO: 183650 - protein, 31 aa, Artificial Sequence
  Description of Artificial Sequence: Synthetic polypeptide
QESEIASTNPVGYEPYGVIACSTLSQHGGDI

SEQ ID NO: 183651 - protein, 31 aa, Artificial Sequence
  Description of Artificial Sequence: Synthetic polypeptide
QESEIASTNPVGYERYGVIAITLSQHGGDNI

SEQ ID NO: 183652 - protein, 36 aa, Artificial Sequence
  Description of Artificial Sequence: Synthetic polypeptide
DEGEIACTNPVATEQYGSACSANPAEADAEIGNDHA

SEQ ID NO: 183653 - protein, 37 aa, Artificial Sequence
  Description of Artificial Sequence: Synthetic polypeptide
DEGEIACTNPVATEQYGSACSPVGNDQNDSGNDQMQH

SEQ ID NO: 183654 - protein, 38 aa, Artificial Sequence
  Description of Artificial Sequence: Synthetic polypeptide
DEEEIRTTNPVATEQYGSCVEPTLWYAELHPVMVSPEN

SEQ ID NO: 183655 - protein, 37 aa, Artificial Sequence
  Description of Artificial Sequence: Synthetic polypeptide
DDEEIRTTNPVATEQYGCVCSNTGEHNQENFISDTQP

SEQ ID NO: 183656 - protein, 38 aa, Artificial Sequence
  Description of Artificial Sequence: Synthetic polypeptide
DDEEIRTTNPVATEQYGCVCSNTGEDHNEENFNSDTQV

SEQ ID NO: 183657 - protein, 36 aa, Artificial Sequence
  Description of Artificial Sequence: Synthetic polypeptide
DEAEIATTNPVATEQYGSACAANPELGQLHQDDQAH

SEQ ID NO: 183658 - protein, 36 aa, Artificial Sequence
  Description of Artificial Sequence: Synthetic polypeptide
DEGEIACTNPVATEQYGSACSAANPGAEAEMGNGKF

SEQ ID NO: 183659 - protein, 33 aa, Artificial Sequence
  Description of Artificial Sequence: Synthetic polypeptide
DEGEIACTNPVATEQWGTVCAATDGGVEDESND

SEQ ID NO: 183660 - protein, 37 aa, Artificial Sequence
  Description of Artificial Sequence: Synthetic polypeptide
DEEEIRTTNPVATEQYGSCTPWPMVGNQIQQTQEKED

SEQ ID NO: 183661 - protein, 34 aa, Artificial Sequence
  Description of Artificial Sequence: Synthetic polypeptide
DEGEIACTNPVATEQWGCVAGTGQLDNPMGGTLA

SEQ ID NO: 183662 - protein, 37 aa, Artificial Sequence
  Description of Artificial Sequence: Synthetic polypeptide
DDEEIRTTNPVATEQYGCVCSNWEEHNAENFNSDNQA

SEQ ID NO: 183663 - protein, 37 aa, Artificial Sequence
  Description of Artificial Sequence: Synthetic polypeptide
DDEEIRTTNPVATEQYGCVCSNWEEHNAEFFNSDNQP

SEQ ID NO: 183664 - protein, 33 aa, Artificial Sequence
  Description of Artificial Sequence: Synthetic polypeptide
DEGCISTTNPVAYEQWGCFSWDNGDFDKGNAAM

SEQ ID NO: 183665 - protein, 33 aa, Artificial Sequence
  Description of Artificial Sequence: Synthetic polypeptide
DEGCISTTNPVAYEQWGCFSWDNGDFDKHNAER

SEQ ID NO: 183666 - protein, 32 aa, Artificial Sequence
  Description of Artificial Sequence: Synthetic polypeptide
QESEIATTNPVSTEPYGTMSSEDIQQQHNGDH

SEQ ID NO: 183667 - protein, 33 aa, Artificial Sequence
  Description of Artificial Sequence: Synthetic polypeptide
DEGCISTTNPVAYEQWGCFSWDNGDFQNEKNAE

SEQ ID NO: 183668 - protein, 34 aa, Artificial Sequence
  Description of Artificial Sequence: Synthetic polypeptide
DEGCISTTNPVAYEQWGCFSWDNNRGDFDKGNAR

SEQ ID NO: 183669 - protein, 35 aa, Artificial Sequence
  Description of Artificial Sequence: Synthetic polypeptide
DEGDEIATTNPVAYERWGSVSGGNPGNAGEDNGQD

SEQ ID NO: 183670 - protein, 30 aa, Artificial Sequence
  Description of Artificial Sequence: Synthetic polypeptide
QESEIATTNPVGTEQWGVVAEIEMNAAEDA

SEQ ID NO: 183671 - protein, 30 aa, Artificial Sequence
  Description of Artificial Sequence: Synthetic polypeptide
QESEIATTNPVGTEQWGVMAEIEQNAAEDA

SEQ ID NO: 183672 - protein, 35 aa, Artificial Sequence
  Description of Artificial Sequence: Synthetic polypeptide
DEGEIATTNPVATAQWGGCVAISNALTQPDGDTDM

SEQ ID NO: 183673 - protein, 37 aa, Artificial Sequence
  Description of Artificial Sequence: Synthetic polypeptide
DEAEIATTNPVATEQYGCVCSTTGELNEEHEGSEDLS

SEQ ID NO: 183674 - protein, 35 aa, Artificial Sequence
  Description of Artificial Sequence: Synthetic polypeptide
DEGEIACTNPVATAQWGGCTVAITNALTQDGGDDM

SEQ ID NO: 183675 - protein, 32 aa, Artificial Sequence
  Description of Artificial Sequence: Synthetic polypeptide
QESEIASTNPVGYEAYGVVCASNGLSQHVGDI

SEQ ID NO: 183676 - protein, 38 aa, Artificial Sequence
  Description of Artificial Sequence: Synthetic polypeptide
DEEEIRTTNPVATEQYGYVYQGSSEYEEEQVHFEKNQS

SEQ ID NO: 183677 - protein, 34 aa, Artificial Sequence
  Description of Artificial Sequence: Synthetic polypeptide
DEGEIACTNPVATEQWGAVCAQNPVNTAGNPTGQ

SEQ ID NO: 183678 - protein, 35 aa, Artificial Sequence
  Description of Artificial Sequence: Synthetic polypeptide
DEGEIACTNPVATEQWGCSANMTHLNPDDGMGDRA

SEQ ID NO: 183679 - protein, 37 aa, Artificial Sequence
  Description of Artificial Sequence: Synthetic polypeptide
DEEEIRTTNPVATEQYGSCTPWPMQSGQQIQQTQEED

SEQ ID NO: 183680 - protein, 31 aa, Artificial Sequence
  Description of Artificial Sequence: Synthetic polypeptide
QESEIASTNPVGYEGYGVIAITELSQHGGDS

SEQ ID NO: 183681 - protein, 35 aa, Artificial Sequence
  Description of Artificial Sequence: Synthetic polypeptide
DEGEIATTNPVATAQWGGCCAISNALTQDDGNPDM

SEQ ID NO: 183682 - protein, 37 aa, Artificial Sequence
  Description of Artificial Sequence: Synthetic polypeptide
DDEEIRTTNPVATEQYGCVCSNWEEHNAENFNSDTQA

SEQ ID NO: 183683 - protein, 34 aa, Artificial Sequence
  Description of Artificial Sequence: Synthetic polypeptide
QESEIATTNPVATEQYGETAPCEVTSQHPEGENK

SEQ ID NO: 183684 - protein, 38 aa, Artificial Sequence
  Description of Artificial Sequence: Synthetic polypeptide
DEEEIRTTNPVATEQYGYGCTITPNIDMGEVVQEACRN

SEQ ID NO: 183685 - protein, 37 aa, Artificial Sequence
  Description of Artificial Sequence: Synthetic polypeptide
DDEEIRTTNPVATEQYGCVCSNSGEHNAEFFNSDNQD

SEQ ID NO: 183686 - protein, 37 aa, Artificial Sequence
  Description of Artificial Sequence: Synthetic polypeptide
DDEEIRTTNPVATEQYGCVCSNSGEDNQENFNSDTQA

SEQ ID NO: 183687 - protein, 38 aa, Artificial Sequence
  Description of Artificial Sequence: Synthetic polypeptide
DDEEIRTTNPVATEQYGCVCSNSGEDHNQEFFGSDNQS

SEQ ID NO: 183688 - protein, 37 aa, Artificial Sequence
  Description of Artificial Sequence: Synthetic polypeptide
DEEEIRTTNPVATEQYGYSAFQCPLDDEGQEEQEQYL

SEQ ID NO: 183689 - protein, 37 aa, Artificial Sequence
  Description of Artificial Sequence: Synthetic polypeptide
DEEEIRTTNPVATEQYGYSAFQCPTDVEGQEEQEQLL

SEQ ID NO: 183690 - protein, 33 aa, Artificial Sequence
  Description of Artificial Sequence: Synthetic polypeptide
QESEIATTNPVATECYGEVPCIVEPQDHEGEEK

SEQ ID NO: 183691 - protein, 38 aa, Artificial Sequence
  Description of Artificial Sequence: Synthetic polypeptide
DEEEIRTTNPVATEQYGYSAFQSPTFTEGEPEQELDIF

SEQ ID NO: 183692 - protein, 37 aa, Artificial Sequence
  Description of Artificial Sequence: Synthetic polypeptide
DEEEIRATNPVATEQYGSVCAAIEGPEEAGMQGEGTM

SEQ ID NO: 183693 - protein, 37 aa, Artificial Sequence
  Description of Artificial Sequence: Synthetic polypeptide
DDEEIRTTNPVATEQYGCVCSNSGEHNAENFNSDTQS

SEQ ID NO: 183694 - protein, 37 aa, Artificial Sequence
  Description of Artificial Sequence: Synthetic polypeptide
DEEEIRATNPVATEQYGSVCAAIEGGEEAPMNQENTM

SEQ ID NO: 183695 - protein, 37 aa, Artificial Sequence
  Description of Artificial Sequence: Synthetic polypeptide
DEEEIRATNPVATEQYGSVCAAIEGEEAPMNQANNTM

SEQ ID NO: 183696 - protein, 38 aa, Artificial Sequence
  Description of Artificial Sequence: Synthetic polypeptide
DEEEIRTTNPVATEQYGYSAFQVPTTEGEPEEQELDIF

SEQ ID NO: 183697 - protein, 36 aa, Artificial Sequence
  Description of Artificial Sequence: Synthetic polypeptide
DEEEIRTTNPVATEQYGYSAMQCPTTEGEEEIELFI

SEQ ID NO: 183698 - protein, 38 aa, Artificial Sequence
  Description of Artificial Sequence: Synthetic polypeptide
DEEEIRTTNPVATEQYGSFLCPADNDEIVEVIGQVNVT

SEQ ID NO: 183699 - protein, 39 aa, Artificial Sequence
  Description of Artificial Sequence: Synthetic polypeptide
DEEEIRTTNPVATEQYGSFGTNSPFQGMCELEQSVVPTQ

SEQ ID NO: 183700 - protein, 38 aa, Artificial Sequence
  Description of Artificial Sequence: Synthetic polypeptide
DEEEIRTTNPVATEQYGYSCFQSPTTEGETEEQELDIF

SEQ ID NO: 183701 - protein, 38 aa, Artificial Sequence
  Description of Artificial Sequence: Synthetic polypeptide
DDEEIRTTNPVATEQYGCVCSMWGEDHNQENFGSDNQA

SEQ ID NO: 183702 - protein, 32 aa, Artificial Sequence
  Description of Artificial Sequence: Synthetic polypeptide
QESEIATTNPIATECWGATMWASEDLQPKGPI

SEQ ID NO: 183703 - protein, 38 aa, Artificial Sequence
  Description of Artificial Sequence: Synthetic polypeptide
DEEEIRTTNPVATEQYGSFPCFSLSNDQMTAVTQLVWK

SEQ ID NO: 183704 - protein, 37 aa, Artificial Sequence
  Description of Artificial Sequence: Synthetic polypeptide
DDEEIRTTNPVATEQYGCVCSNSGEHNQENFGSDFQS

SEQ ID NO: 183705 - protein, 37 aa, Artificial Sequence
  Description of Artificial Sequence: Synthetic polypeptide
DEEEIRTTNPVATEQYGYNCRFPAVEEASTQEVNPDD

SEQ ID NO: 183706 - protein, 32 aa, Artificial Sequence
  Description of Artificial Sequence: Synthetic polypeptide
QESEIATTNPVATECYGSAPCIVCPQDHEEEG

SEQ ID NO: 183707 - protein, 36 aa, Artificial Sequence
  Description of Artificial Sequence: Synthetic polypeptide
DEGEIATTNPTATEAYGSTVASCANMTSADYGGNHF

SEQ ID NO: 183708 - protein, 36 aa, Artificial Sequence
  Description of Artificial Sequence: Synthetic polypeptide
DEGEIACTNPVATEQYGSVCAATEVLEAGEQGEEAD

SEQ ID NO: 183709 - protein, 35 aa, Artificial Sequence
  Description of Artificial Sequence: Synthetic polypeptide
DEGEIACTNPVATEQYGSVCAPTGPGHVDDPGQDN

SEQ ID NO: 183710 - protein, 33 aa, Artificial Sequence
  Description of Artificial Sequence: Synthetic polypeptide
DEGEIATTNPISTECYGAVWANCNLAEPKGTYI

SEQ ID NO: 183711 - protein, 37 aa, Artificial Sequence
  Description of Artificial Sequence: Synthetic polypeptide
DEGEIACTNPVATEQYGSVSASNPGIENIGNGMEPVH

SEQ ID NO: 183712 - protein, 36 aa, Artificial Sequence
  Description of Artificial Sequence: Synthetic polypeptide
DEGEIACTNPVAYEQYGSVAAITNGEEAPDNQEGVM

SEQ ID NO: 183713 - protein, 35 aa, Artificial Sequence
  Description of Artificial Sequence: Synthetic polypeptide
DEGEIATTNPIATEQWGATVWSNAEDLQEPKGTYI

SEQ ID NO: 183714 - protein, 35 aa, Artificial Sequence
  Description of Artificial Sequence: Synthetic polypeptide
DEGEIATTNPIATEQWGATVWANAEDLQEPKGTYI

SEQ ID NO: 183715 - protein, 36 aa, Artificial Sequence
  Description of Artificial Sequence: Synthetic polypeptide
DEAEIATTNPVATEQYGSCAAGGNGLTNPDDGIDHN

SEQ ID NO: 183716 - protein, 37 aa, Artificial Sequence
  Description of Artificial Sequence: Synthetic polypeptide
DEAEIATTNPVATEQYGSCAAGMNGDTQAGMGGNSVD

SEQ ID NO: 183717 - protein, 37 aa, Artificial Sequence
  Description of Artificial Sequence: Synthetic polypeptide
DEEEIRATNPVATEQYGSVCAATMGEEAGMDMDEGAM

SEQ ID NO: 183718 - protein, 32 aa, Artificial Sequence
  Description of Artificial Sequence: Synthetic polypeptide
DEGEIAPTNPCATEQWGAVANADWQEPKGTYI

SEQ ID NO: 183719 - protein, 32 aa, Artificial Sequence
  Description of Artificial Sequence: Synthetic polypeptide
DEGEIAPTNPCATEQWGAVANADWQESKGTYI

SEQ ID NO: 183720 - protein, 37 aa, Artificial Sequence
  Description of Artificial Sequence: Synthetic polypeptide
DEEEIRTTNPVATEQYGYVDMQVMVIEEGQNGQPMDN

SEQ ID NO: 183721 - protein, 37 aa, Artificial Sequence
  Description of Artificial Sequence: Synthetic polypeptide
DEEEIRTTNPVATEQYGYVCVHPSPVNMSNAVDMAFE

SEQ ID NO: 183722 - protein, 37 aa, Artificial Sequence
  Description of Artificial Sequence: Synthetic polypeptide
DEEEIRTTNPVATEQYGYVCVHPSPVNMENAVDMFFP

SEQ ID NO: 183723 - protein, 37 aa, Artificial Sequence
  Description of Artificial Sequence: Synthetic polypeptide
DEEEIRATNPVATEQYGSVCAANNGEEAGMDMGEGEM

SEQ ID NO: 183724 - protein, 37 aa, Artificial Sequence
  Description of Artificial Sequence: Synthetic polypeptide
DEEEIRATNPVATEQYGSVCAANMGEEAGMVMGEEVG

SEQ ID NO: 183725 - protein, 37 aa, Artificial Sequence
  Description of Artificial Sequence: Synthetic polypeptide
DEEEIRTTNPVATEQYGSEHCCSSPGIEAIHNTVSQS

SEQ ID NO: 183726 - protein, 34 aa, Artificial Sequence
  Description of Artificial Sequence: Synthetic polypeptide
DEGEIATTNPVATAPWGSVAGSGNPANPNPGAQP

SEQ ID NO: 183727 - protein, 35 aa, Artificial Sequence
  Description of Artificial Sequence: Synthetic polypeptide
QESEIGTTNPVATEQYGAVCSAWDGPVEFEGNNES

SEQ ID NO: 183728 - protein, 36 aa, Artificial Sequence
  Description of Artificial Sequence: Synthetic polypeptide
DEGEIATTNPVATAQWGSVSVSGEPGENTRGVNDFD

SEQ ID NO: 183729 - protein, 33 aa, Artificial Sequence
  Description of Artificial Sequence: Synthetic polypeptide
DEGCIATTNPVAYEQWGCFSWDNGDFDKGNAEE

SEQ ID NO: 183730 - protein, 37 aa, Artificial Sequence
  Description of Artificial Sequence: Synthetic polypeptide
DEFELCTVNPVATEQYGSVSWNENDQRDTQGGKGDHN

SEQ ID NO: 183731 - protein, 37 aa, Artificial Sequence
  Description of Artificial Sequence: Synthetic polypeptide
DEEEIRATNPVAYEQWGSVSGGEPANGPNMRNGGGSQ

SEQ ID NO: 183732 - protein, 36 aa, Artificial Sequence
  Description of Artificial Sequence: Synthetic polypeptide
DEEEIRATNPVAYEQWGSVCAANGEEAPMNQMENTM

SEQ ID NO: 183733 - protein, 35 aa, Artificial Sequence
  Description of Artificial Sequence: Synthetic polypeptide
DEEEIRATNPVAYEQWGMVTGWNDHQHGQGGGSDL

SEQ ID NO: 183734 - protein, 36 aa, Artificial Sequence
  Description of Artificial Sequence: Synthetic polypeptide
DEFELCTVNPVATEQYGTVSWNENDQHDQKGGGDHR

SEQ ID NO: 183735 - protein, 36 aa, Artificial Sequence
  Description of Artificial Sequence: Synthetic polypeptide
DEFETCTVNPVATEQYGSVAWTENDQHDQDGKGDQQ

SEQ ID NO: 183736 - protein, 36 aa, Artificial Sequence
  Description of Artificial Sequence: Synthetic polypeptide
DEEEIRTTNPVATESYGMVSVEGMGDGGQGQEAEGF

SEQ ID NO: 183737 - protein, 38 aa, Artificial Sequence
  Description of Artificial Sequence: Synthetic polypeptide
DEEEIRTTNPVATESYGMGCVSCTFWMEAEEQMQENDN

SEQ ID NO: 183738 - protein, 34 aa, Artificial Sequence
  Description of Artificial Sequence: Synthetic polypeptide
DEGEIATTNPVATEQWGGCCAGTGELAQNNSQMD

SEQ ID NO: 183739 - protein, 36 aa, Artificial Sequence
  Description of Artificial Sequence: Synthetic polypeptide
DEGEIATTNPVATEQWGCVNAGNNGLQTQAGDQMAE

SEQ ID NO: 183740 - protein, 29 aa, Artificial Sequence
  Description of Artificial Sequence: Synthetic peptide
QESEIASTNPVGTEQWGVMASIEQNHEDI

SEQ ID NO: 183741 - protein, 34 aa, Artificial Sequence
  Description of Artificial Sequence: Synthetic polypeptide
DEGEIATTNPVATEQWGCVAGENGVEMNAAEDNA

SEQ ID NO: 183742 - protein, 35 aa, Artificial Sequence
  Description of Artificial Sequence: Synthetic polypeptide
DEGEIATTNPVATEQWGCVAGEGVEMNAAEMGNAM

SEQ ID NO: 183743 - protein, 35 aa, Artificial Sequence
  Description of Artificial Sequence: Synthetic polypeptide
DEGEIATTNPVATEQWGCVAGEGGELGNHQVDGEV

SEQ ID NO: 183744 - protein, 34 aa, Artificial Sequence
  Description of Artificial Sequence: Synthetic polypeptide
DEGEIATTNPVATEQWGCVAGEGEANAASLDNAW

SEQ ID NO: 183745 - protein, 36 aa, Artificial Sequence
  Description of Artificial Sequence: Synthetic polypeptide
DEGEIATTNPVATEQWGCVAATTNSNATPDGDENGD

SEQ ID NO: 183746 - protein, 37 aa, Artificial Sequence
  Description of Artificial Sequence: Synthetic polypeptide
DDEEIRTTNPVATEQYGCVCSWGEDHNAENFNSETQA

SEQ ID NO: 183747 - protein, 39 aa, Artificial Sequence
  Description of Artificial Sequence: Synthetic polypeptide
DEEEIRTTNPVATESYGAVTNLQSGTISTTTQNQEQGNN

SEQ ID NO: 183748 - protein, 38 aa, Artificial Sequence
  Description of Artificial Sequence: Synthetic polypeptide
DEEEIRTTNPVATESYGMAVATNFLGAGQTEVPQVQST

SEQ ID NO: 183749 - protein, 35 aa, Artificial Sequence
  Description of Artificial Sequence: Synthetic polypeptide
DEAEIATTNPVATEQWGTHCSAAADHGMNRSNDSW

SEQ ID NO: 183750 - protein, 37 aa, Artificial Sequence
  Description of Artificial Sequence: Synthetic polypeptide
DEEEIRTTNPVATEQYGSCSPWIAAPWFPDEMEVNVT

SEQ ID NO: 183751 - protein, 31 aa, Artificial Sequence
  Description of Artificial Sequence: Synthetic polypeptide
QESEIRTTNPVGTEGWGVMAAETLAHKGDYI

SEQ ID NO: 183752 - protein, 37 aa, Artificial Sequence
  Description of Artificial Sequence: Synthetic polypeptide
DDEEIRTTNPVATEQYGSCVQVAVDEQIENTEEANIM

SEQ ID NO: 183753 - protein, 30 aa, Artificial Sequence
  Description of Artificial Sequence: Synthetic polypeptide
QETEIATTNPVATECYGATPNEDWAHKEPI

SEQ ID NO: 183754 - protein, 32 aa, Artificial Sequence
  Description of Artificial Sequence: Synthetic polypeptide
QETEIATTNPIATEQYGEAWPNEEVCQEPEEK

SEQ ID NO: 183755 - protein, 32 aa, Artificial Sequence
  Description of Artificial Sequence: Synthetic polypeptide
QETEIATTNPIATEQYGEAWPNEEVCQEHEEK

SEQ ID NO: 183756 - protein, 31 aa, Artificial Sequence
  Description of Artificial Sequence: Synthetic polypeptide
QETEIATTNPIATEQYGEAPNEEVCQEHEEK

SEQ ID NO: 183757 - protein, 32 aa, Artificial Sequence
  Description of Artificial Sequence: Synthetic polypeptide
QETEIATTNPIATECWGITTWSNAEDLQSGTI

SEQ ID NO: 183758 - protein, 37 aa, Artificial Sequence
  Description of Artificial Sequence: Synthetic polypeptide
DDEEIRTTNPVATEQYGQCVCSWGEHNQEFFNSDFQS

SEQ ID NO: 183759 - protein, 32 aa, Artificial Sequence
  Description of Artificial Sequence: Synthetic polypeptide
QESEIASTNPVGTEHWGVIACSTELSQHGGDI

SEQ ID NO: 183760 - protein, 37 aa, Artificial Sequence
  Description of Artificial Sequence: Synthetic polypeptide
DDEEIRTTNPVATEQYGQCVCSWGEHNAENFNSDTQS

SEQ ID NO: 183761 - protein, 37 aa, Artificial Sequence
  Description of Artificial Sequence: Synthetic polypeptide
DDEEIRTTNPVATEQYGQCVCSWEEHNQEFFNSDTQA

SEQ ID NO: 183762 - protein, 37 aa, Artificial Sequence
  Description of Artificial Sequence: Synthetic polypeptide
DDEEIRTTNPVATEQYGQCVCSSGEHNQEFFGSETQG

SEQ ID NO: 183763 - protein, 38 aa, Artificial Sequence
  Description of Artificial Sequence: Synthetic polypeptide
DDEEIRTTNPVATEQYGQCVCSNWGEHNAENFGSENQA

SEQ ID NO: 183764 - protein, 37 aa, Artificial Sequence
  Description of Artificial Sequence: Synthetic polypeptide
DEGEIATTNPVATEQWGSVSGTGNPPPDANPMENGMA

SEQ ID NO: 183765 - protein, 36 aa, Artificial Sequence
  Description of Artificial Sequence: Synthetic polypeptide
DEEEIRTTNPVATEQYGSCSLMPGPSAEEMPHIPEG

SEQ ID NO: 183766 - protein, 36 aa, Artificial Sequence
  Description of Artificial Sequence: Synthetic polypeptide
DEGEIATTNPVATEQWGSVSATGDPGGTAHQGDEDN

SEQ ID NO: 183767 - protein, 39 aa, Artificial Sequence
  Description of Artificial Sequence: Synthetic polypeptide
DEEEIRCTNPAATEQYGSVSDPEVNTDGEQNEGGQGNQD

SEQ ID NO: 183768 - protein, 35 aa, Artificial Sequence
  Description of Artificial Sequence: Synthetic polypeptide
DEFEIRTTNPVAFEQWGYDVSEQIQETMNGMEEAN

SEQ ID NO: 183769 - protein, 36 aa, Artificial Sequence
  Description of Artificial Sequence: Synthetic polypeptide
DEGEIATTNPVATEQWGGCVAGTGELAQPNNQQNDH

SEQ ID NO: 183770 - protein, 37 aa, Artificial Sequence
  Description of Artificial Sequence: Synthetic polypeptide
DDEEIRTTNPVATEQYGMVSVENGMGDGGQGQEMEGT

SEQ ID NO: 183771 - protein, 35 aa, Artificial Sequence
  Description of Artificial Sequence: Synthetic polypeptide
DEGEIATTNPVATEQWGCVAATPHEEANGNSESNM

SEQ ID NO: 183772 - protein, 35 aa, Artificial Sequence
  Description of Artificial Sequence: Synthetic polypeptide
DEAEIATTNPVATEQYGCTCSWGEHNQENFGSDQS

SEQ ID NO: 183773 - protein, 37 aa, Artificial Sequence
  Description of Artificial Sequence: Synthetic polypeptide
DEAEIATTNPVATEQYGCVAADHNDNNQTAGGGEGRN

SEQ ID NO: 183774 - protein, 38 aa, Artificial Sequence
  Description of Artificial Sequence: Synthetic polypeptide
DEEEIRTTNPVATEQYGSFVNCWINANVIESHGPEFET

SEQ ID NO: 183775 - protein, 35 aa, Artificial Sequence
  Description of Artificial Sequence: Synthetic polypeptide
DEGEIATTNPVATECYGSVCAAGEWLEATDNNNPN

SEQ ID NO: 183776 - protein, 38 aa, Artificial Sequence
  Description of Artificial Sequence: Synthetic polypeptide
DDEEIRTTNPVATEQYGCVCSNWGEDHNQENFGSDNQD

SEQ ID NO: 183777 - protein, 38 aa, Artificial Sequence
  Description of Artificial Sequence: Synthetic polypeptide
DDEEIRTTNPVATEQYGCVCSNWGEDHNQEGFNSDTQG

SEQ ID NO: 183778 - protein, 38 aa, Artificial Sequence
  Description of Artificial Sequence: Synthetic polypeptide
DDEEIRTTNPVATEQYGCVCSNWGEDHNEENFGSDNQG

SEQ ID NO: 183779 - protein, 35 aa, Artificial Sequence
  Description of Artificial Sequence: Synthetic polypeptide
DEGEIATTNPVATECYGSVCAAGEGLEADNLMDNN

SEQ ID NO: 183780 - protein, 35 aa, Artificial Sequence
  Description of Artificial Sequence: Synthetic polypeptide
DEAEIATTNPVATEQYGCVCSNWDPEDHFGSETLA

SEQ ID NO: 183781 - protein, 38 aa, Artificial Sequence
  Description of Artificial Sequence: Synthetic polypeptide
DDEEIRTTNPVATEQYGCVCSNWGEDHNAENFGSENQS

SEQ ID NO: 183782 - protein, 35 aa, Artificial Sequence
  Description of Artificial Sequence: Synthetic polypeptide
DEGEIATTNPVATECYGSVCAAGEGGEATDNNNNP

SEQ ID NO: 183783 - protein, 38 aa, Artificial Sequence
  Description of Artificial Sequence: Synthetic polypeptide
DEEEIRTTNPVATEQYGSFTLAHATNDQQSLIVFEQDE

SEQ ID NO: 183784 - protein, 37 aa, Artificial Sequence
  Description of Artificial Sequence: Synthetic polypeptide
DDEEIRTTNPVATEQYGCVCSNWEEHNQENFNSDTQA

SEQ ID NO: 183785 - protein, 37 aa, Artificial Sequence
  Description of Artificial Sequence: Synthetic polypeptide
DEEEIRATNPVATEQYGSACAAGPPLDNDASGNGHNH

SEQ ID NO: 183786 - protein, 37 aa, Artificial Sequence
  Description of Artificial Sequence: Synthetic polypeptide
DEEEIRATNPVATEQYGSACAAGPPLDNDASPAGMNM

SEQ ID NO: 183787 - protein, 37 aa, Artificial Sequence
  Description of Artificial Sequence: Synthetic polypeptide
DEEEIRATNPVATEQYGSVQVAVDMEQIENTEEANIM

SEQ ID NO: 183788 - protein, 37 aa, Artificial Sequence
  Description of Artificial Sequence: Synthetic polypeptide
DDEEIRTTNPVATEQYGCVCSNWEEHNQENFGSDTQS

SEQ ID NO: 183789 - protein, 37 aa, Artificial Sequence
  Description of Artificial Sequence: Synthetic polypeptide
DEEEIRATNPVATEQYGSVPQVDVEEQIENTEEANDM

SEQ ID NO: 183790 - protein, 34 aa, Artificial Sequence
  Description of Artificial Sequence: Synthetic polypeptide
DEGEIATTNPVATASWGCVSAANNEPTDNGGENE

SEQ ID NO: 183791 - protein, 35 aa, Artificial Sequence
  Description of Artificial Sequence: Synthetic polypeptide
DEGEIATTNPVATASWGCVSAANGVEPLDNGGENG

SEQ ID NO: 183792 - protein, 37 aa, Artificial Sequence
  Description of Artificial Sequence: Synthetic polypeptide
DEGCEIATTNPVAYEQYGTVATQNGGQQQNGGQRGEA

SEQ ID NO: 183793 - protein, 35 aa, Artificial Sequence
  Description of Artificial Sequence: Synthetic polypeptide
DEGCEIATTNPVAYERWGVCVTTNGNQGEWGNGDY

SEQ ID NO: 183794 - protein, 36 aa, Artificial Sequence
  Description of Artificial Sequence: Synthetic polypeptide
DEEEIRATNPVATEQYGSACAAGPPLDNDASGDGMD

SEQ ID NO: 183795 - protein, 32 aa, Artificial Sequence
  Description of Artificial Sequence: Synthetic polypeptide
QETEIATTNPVATEQWGATANEEVCQEPKGEK

SEQ ID NO: 183796 - protein, 37 aa, Artificial Sequence
  Description of Artificial Sequence: Synthetic polypeptide
DDEEIRTTNPVATEQYGCVCSNWGEHNAENFNSDTQS

SEQ ID NO: 183797 - protein, 38 aa, Artificial Sequence
  Description of Artificial Sequence: Synthetic polypeptide
QESEIRGTNPVATEQYGSVVYTGNLNLEGGGQTEGEDG

SEQ ID NO: 183798 - protein, 34 aa, Artificial Sequence
  Description of Artificial Sequence: Synthetic polypeptide
DEGAEIATTNPVAYEPWGITYTNDLIDRAGEDDS

SEQ ID NO: 183799 - protein, 35 aa, Artificial Sequence
  Description of Artificial Sequence: Synthetic polypeptide
DEGEIATTNPVATEQWGCVAATANGAEAPIGDDQN

SEQ ID NO: 183800 - protein, 37 aa, Artificial Sequence
  Description of Artificial Sequence: Synthetic polypeptide
DEEEIRATNPVATEQYGVVATVQAQQSATEEGSTEDD

SEQ ID NO: 183801 - protein, 35 aa, Artificial Sequence
  Description of Artificial Sequence: Synthetic polypeptide
DEGAEIATTNPVAYEQWGVVCSAEILGDHGQNQSD

SEQ ID NO: 183802 - protein, 39 aa, Artificial Sequence
  Description of Artificial Sequence: Synthetic polypeptide
DEEEIRATNPVATEQYGVIFPESPVVNTDEQAQEQTGNN

SEQ ID NO: 183803 - protein, 36 aa, Artificial Sequence
  Description of Artificial Sequence: Synthetic polypeptide
DEAEIATTNPVATEQYGCVAANNGWDVTTDDGNPEQ

SEQ ID NO: 183804 - protein, 37 aa, Artificial Sequence
  Description of Artificial Sequence: Synthetic polypeptide
DEEEIRATNPVATEQYGSVVYDGMFGQEGDQEEDDGG

SEQ ID NO: 183805 - protein, 33 aa, Artificial Sequence
  Description of Artificial Sequence: Synthetic polypeptide
DEGEIATTNPVATEQWGCNAGIEPGQAPMENNQ

SEQ ID NO: 183806 - protein, 37 aa, Artificial Sequence
  Description of Artificial Sequence: Synthetic polypeptide
DDEEIRTTNPVATEQYGCVCSNWGEHNQENFNSENQG

SEQ ID NO: 183807 - protein, 38 aa, Artificial Sequence
  Description of Artificial Sequence: Synthetic polypeptide
DEEEIRTTNPVATEQYGSFVIEPLSNSQEVAEQLTPKF

SEQ ID NO: 183808 - protein, 37 aa, Artificial Sequence
  Description of Artificial Sequence: Synthetic polypeptide
DDEEIRTTNPVATEQYGCVCSNWGEHNQENFNSDTQS

SEQ ID NO: 183809 - protein, 37 aa, Artificial Sequence
  Description of Artificial Sequence: Synthetic polypeptide
DDEEIRTTNPVATEQYGCVCSNWGEHNQENFISDNQA

SEQ ID NO: 183810 - protein, 37 aa, Artificial Sequence
  Description of Artificial Sequence: Synthetic polypeptide
DEEEIRTTNPVATEQYGSFVIEPLSFEEVAEELTPKF

SEQ ID NO: 183811 - protein, 37 aa, Artificial Sequence
  Description of Artificial Sequence: Synthetic polypeptide
DEEEIRTTNPVATEQYGSFVIELSNQEVAEMTLTDKF

SEQ ID NO: 183812 - protein, 37 aa, Artificial Sequence
  Description of Artificial Sequence: Synthetic polypeptide
DDEEIRTTNPVATEQYGAVMGQGTDQLIDEGEGGFGT

SEQ ID NO: 183813 - protein, 38 aa, Artificial Sequence
  Description of Artificial Sequence: Synthetic polypeptide
DDEEIRTTNPVATEQYGAVNLGQTGDNGQGTGGQEDQV

SEQ ID NO: 183814 - protein, 37 aa, Artificial Sequence
  Description of Artificial Sequence: Synthetic polypeptide
DDEEIRTTNPVATEQYGCVCSNWGEHNQENFGSDFQP

SEQ ID NO: 183815 - protein, 37 aa, Artificial Sequence
  Description of Artificial Sequence: Synthetic polypeptide
DDEEIRTTNPVATEQYGCVCSNWGEHNIENFNSDTQA

SEQ ID NO: 183816 - protein, 36 aa, Artificial Sequence
  Description of Artificial Sequence: Synthetic polypeptide
DEGEIATTNPVATECYGSVCAAVANLADTPPEEGRN

SEQ ID NO: 183817 - protein, 37 aa, Artificial Sequence
  Description of Artificial Sequence: Synthetic polypeptide
DDEEIRTTNPVATEQYGCVCSNWGEHNAENFNSEPQS

SEQ ID NO: 183818 - protein, 36 aa, Artificial Sequence
  Description of Artificial Sequence: Synthetic polypeptide
DDEEIRTTNPVATEQWGCVTSWGEDHNQENFNSDAS

SEQ ID NO: 183819 - protein, 36 aa, Artificial Sequence
  Description of Artificial Sequence: Synthetic polypeptide
SAEEIATTNPVATEQWGSVAITNNPEDTGEGGEPRN

SEQ ID NO: 183820 - protein, 35 aa, Artificial Sequence
  Description of Artificial Sequence: Synthetic polypeptide
SAEEIATTNPVATEQWGSVSATGAPPNAHATAQDN

SEQ ID NO: 183821 - protein, 39 aa, Artificial Sequence
  Description of Artificial Sequence: Synthetic polypeptide
DEEEIRTTNPVATEQYGQSAWVNGNVEISGDSENQDSIV

SEQ ID NO: 183822 - protein, 38 aa, Artificial Sequence
  Description of Artificial Sequence: Synthetic polypeptide
DEETIKTTNPVATEQYGSFVINSLNQNMELKQAVVPTA

SEQ ID NO: 183823 - protein, 36 aa, Artificial Sequence
  Description of Artificial Sequence: Synthetic polypeptide
DDEEISTTNPVATCQYGQCVCSWGEPNIENFGSNQA

SEQ ID NO: 183824 - protein, 37 aa, Artificial Sequence
  Description of Artificial Sequence: Synthetic polypeptide
DEGEIATTNPVAYEQYGSACSVANPHLNEAPMGEWRN

SEQ ID NO: 183825 - protein, 35 aa, Artificial Sequence
  Description of Artificial Sequence: Synthetic polypeptide
SEEEIATTNPVATAQWGCVAGTNQGLEATANGEFG

SEQ ID NO: 183826 - protein, 34 aa, Artificial Sequence
  Description of Artificial Sequence: Synthetic polypeptide
SEEEIATTNPVATAQWGCVAGTGHGLEATANGED

SEQ ID NO: 183827 - protein, 37 aa, Artificial Sequence
  Description of Artificial Sequence: Synthetic polypeptide
DEGEIATTNPVAYEQYGSACSAANPGPLDSMIGNENE

SEQ ID NO: 183828 - protein, 36 aa, Artificial Sequence
  Description of Artificial Sequence: Synthetic polypeptide
DDEEISTTNPVATCQYGQCVCSSGEPNAHFGSDNQA

SEQ ID NO: 183829 - protein, 35 aa, Artificial Sequence
  Description of Artificial Sequence: Synthetic polypeptide
SEEEIATTNPVATEAYGISTHCVNEHDTSSTNNRM

SEQ ID NO: 183830 - protein, 38 aa, Artificial Sequence
  Description of Artificial Sequence: Synthetic polypeptide
DEEEIRGTNPVATEQYGSVMNFNNEDQSELEGGGDTEG

SEQ ID NO: 183831 - protein, 38 aa, Artificial Sequence
  Description of Artificial Sequence: Synthetic polypeptide
DEEEIRGTNPVATEQYGSVIVFNSDGPEEGGQDDNGQP

SEQ ID NO: 183832 - protein, 37 aa, Artificial Sequence
  Description of Artificial Sequence: Synthetic polypeptide
DEAEIACTNPVATEQYGSVCAMNNGVLPEGADGGNDQ

SEQ ID NO: 183833 - protein, 36 aa, Artificial Sequence
  Description of Artificial Sequence: Synthetic polypeptide
DEAEIACTNPVATEQYGSVCAMTNNEPTGGDLEEGA

SEQ ID NO: 183834 - protein, 33 aa, Artificial Sequence
  Description of Artificial Sequence: Synthetic polypeptide
DDEEISTTNPVATCQYGCVCSWGEPAHFISDQS

SEQ ID NO: 183835 - protein, 34 aa, Artificial Sequence
  Description of Artificial Sequence: Synthetic polypeptide
DDEEISTTNPVATCQYGCVCSWGEPAENFISDQA

SEQ ID NO: 183836 - protein, 38 aa, Artificial Sequence
  Description of Artificial Sequence: Synthetic polypeptide
DEEEIRGTNPVATEQYGSIVIFPTLMLDPQEVEQDIIF

SEQ ID NO: 183837 - protein, 36 aa, Artificial Sequence
  Description of Artificial Sequence: Synthetic polypeptide
DEGEIATTNPVAYEQYGSACAAVATGVNTAGGDTAH

SEQ ID NO: 183838 - protein, 35 aa, Artificial Sequence
  Description of Artificial Sequence: Synthetic polypeptide
DDEEISTTNPVATCQYGCVCSTTGEPANFGSDTQA

SEQ ID NO: 183839 - protein, 36 aa, Artificial Sequence
  Description of Artificial Sequence: Synthetic polypeptide
DEGEIATTNPVAYEQYGSACATNPPMQPDNQTEGMM

SEQ ID NO: 183840 - protein, 36 aa, Artificial Sequence
  Description of Artificial Sequence: Synthetic polypeptide
DEGEIATTNPVAYEQYGSCAAATGHGQDSPDGSENW

SEQ ID NO: 183841 - protein, 37 aa, Artificial Sequence
  Description of Artificial Sequence: Synthetic polypeptide
DEETICTTNPVATEFYGVVVNTQDNTGEQDEFGGNGV

SEQ ID NO: 183842 - protein, 36 aa, Artificial Sequence
  Description of Artificial Sequence: Synthetic polypeptide
DEGEIATTNPVAYEQYGSTACAGANGLQDSDGSEID

SEQ ID NO: 183843 - protein, 36 aa, Artificial Sequence
  Description of Artificial Sequence: Synthetic polypeptide
SEEEIATTNPVATEQYGSACSATMPGAEAPPEDGHN

SEQ ID NO: 183844 - protein, 36 aa, Artificial Sequence
  Description of Artificial Sequence: Synthetic polypeptide
SEEEIATTNPVATEQYGISTTHCINEHDTSSTNNRM

SEQ ID NO: 183845 - protein, 37 aa, Artificial Sequence
  Description of Artificial Sequence: Synthetic polypeptide
DEEEIRGTNPVATEQYGSVQPPIMFTGEEQQSMDSGL

SEQ ID NO: 183846 - protein, 35 aa, Artificial Sequence
  Description of Artificial Sequence: Synthetic polypeptide
SEEEIATTNPVATEQYGCSCQWEDNQEHFSSENQA

SEQ ID NO: 183847 - protein, 33 aa, Artificial Sequence
  Description of Artificial Sequence: Synthetic polypeptide
SEEEIATTNPVATEQYGCFCPWEDQEHFISEQM

SEQ ID NO: 183848 - protein, 39 aa, Artificial Sequence
  Description of Artificial Sequence: Synthetic polypeptide
DEEEIRTTNPVATEQYGQCVTSTTPADHNAEHFGSDPVS

SEQ ID NO: 183849 - protein, 38 aa, Artificial Sequence
  Description of Artificial Sequence: Synthetic polypeptide
DEETICTTNPVATEFYGSVVINETDNTGEQDEFGGNII

SEQ ID NO: 183850 - protein, 37 aa, Artificial Sequence
  Description of Artificial Sequence: Synthetic polypeptide
DEETICTTNPVATEFYGSVVNETDQTGEQDEFGGNTI

SEQ ID NO: 183851 - protein, 36 aa, Artificial Sequence
  Description of Artificial Sequence: Synthetic polypeptide
DEETICTTNPVATEFYGSVVNNTDETGEQDEFGGGV

SEQ ID NO: 183852 - protein, 37 aa, Artificial Sequence
  Description of Artificial Sequence: Synthetic polypeptide
SEEEIATTNPVATEQWGSVSGTDGPPPAGTANGDPLS

SEQ ID NO: 183853 - protein, 37 aa, Artificial Sequence
  Description of Artificial Sequence: Synthetic polypeptide
DEETICTTNPVATEFYGSVVNTQDNTGEEDEFGGNSV

SEQ ID NO: 183854 - protein, 36 aa, Artificial Sequence
  Description of Artificial Sequence: Synthetic polypeptide
DEETICTTNPVATEFYGSVVNTTDETGEQDEFTGEV

SEQ ID NO: 183855 - protein, 38 aa, Artificial Sequence
  Description of Artificial Sequence: Synthetic polypeptide
DEETICTTNPVATEFYGSVVVNETDNTGEQDEQGGNIQ

SEQ ID NO: 183856 - protein, 36 aa, Artificial Sequence
  Description of Artificial Sequence: Synthetic polypeptide
DEETICTTNPVATEFYGVVDNTDNTGEQDEGGGGIT

SEQ ID NO: 183857 - protein, 39 aa, Artificial Sequence
  Description of Artificial Sequence: Synthetic polypeptide
DEEEIRTTNPVATEQYGQCVTSTWGADDNAENFGSDPVG

SEQ ID NO: 183858 - protein, 36 aa, Artificial Sequence
  Description of Artificial Sequence: Synthetic polypeptide
SEEEIATTNPVATEQWGHLIACTYEQSQRPGTMPQR

SEQ ID NO: 183859 - protein, 36 aa, Artificial Sequence
  Description of Artificial Sequence: Synthetic polypeptide
SEEEIATTNPVATEQWGANRTTAANEHQLAGMGNNH

SEQ ID NO: 183860 - protein, 39 aa, Artificial Sequence
  Description of Artificial Sequence: Synthetic polypeptide
DEEEIRTTNPVATEQYGQCVTSTWGALHNAEHFNSDPQS

SEQ ID NO: 183861 - protein, 36 aa, Artificial Sequence
  Description of Artificial Sequence: Synthetic polypeptide
DEGEIATTNPVAYEQYGSTACAGANGLQDSQDGSHY

SEQ ID NO: 183862 - protein, 35 aa, Artificial Sequence
  Description of Artificial Sequence: Synthetic polypeptide
DEGEIATTNPVAYEQYGSACAATNGEANDTGDTDM

SEQ ID NO: 183863 - protein, 36 aa, Artificial Sequence
  Description of Artificial Sequence: Synthetic polypeptide
DEETICTTNPVATEAYGVVTVTVTNDQQGTEEQEED

SEQ ID NO: 183864 - protein, 38 aa, Artificial Sequence
  Description of Artificial Sequence: Synthetic polypeptide
DEEEIRGTNPVATEQYGMVSVEGMGDGGQGQENEERGT

SEQ ID NO: 183865 - protein, 39 aa, Artificial Sequence
  Description of Artificial Sequence: Synthetic polypeptide
DEEEIRTTNPVATEQYGVVSVVVTTGTQAGTTEQGSTVE

SEQ ID NO: 183866 - protein, 36 aa, Artificial Sequence
  Description of Artificial Sequence: Synthetic polypeptide
DDEEISCTNPVATEQYGCSCSWGNHNQENFGSDTQS

SEQ ID NO: 183867 - protein, 39 aa, Artificial Sequence
  Description of Artificial Sequence: Synthetic polypeptide
DEEEIRTTNPVATEQYGVVSVVVTVGTQAGTTEQGSTDQ

SEQ ID NO: 183868 - protein, 36 aa, Artificial Sequence
  Description of Artificial Sequence: Synthetic polypeptide
DDEEISCTNPVATEQYGCSCSNWGNDNQENFGSDQS

SEQ ID NO: 183869 - protein, 36 aa, Artificial Sequence
  Description of Artificial Sequence: Synthetic polypeptide
DEAEIACTNPVAYEQYGSVCASNDLPQEHQDGTEAE

SEQ ID NO: 183870 - protein, 37 aa, Artificial Sequence
  Description of Artificial Sequence: Synthetic polypeptide
DEEEIRGTNPVATEFYGMVGINGLGDQEGEGEDGQQN

SEQ ID NO: 183871 - protein, 36 aa, Artificial Sequence
  Description of Artificial Sequence: Synthetic polypeptide
DEEEIRGTNPVATEAYGSVVDGFNGEDDEEDDGVQS

SEQ ID NO: 183872 - protein, 37 aa, Artificial Sequence
  Description of Artificial Sequence: Synthetic polypeptide
DEEEIRGTNPVATEAYGQYGVNDTGMGQDEGNEGFEN

SEQ ID NO: 183873 - protein, 37 aa, Artificial Sequence
  Description of Artificial Sequence: Synthetic polypeptide
DEEEIRGTNPVATDQYGVVNDNSIGQNGGQEDNSNDS

SEQ ID NO: 183874 - protein, 37 aa, Artificial Sequence
  Description of Artificial Sequence: Synthetic polypeptide
DDEEISCTNPVATEQYGCVCSTWGEHNQENSGSQNQS

SEQ ID NO: 183875 - protein, 38 aa, Artificial Sequence
  Description of Artificial Sequence: Synthetic polypeptide
DEEEIRGTNPVATDQYGNVVMGNTNDQELLATGQTGEQ

SEQ ID NO: 183876 - protein, 37 aa, Artificial Sequence
  Description of Artificial Sequence: Synthetic polypeptide
DEEEIRTTNPVATEQYGQVQFPTMGSEQPEPDSVAEI

SEQ ID NO: 183877 - protein, 38 aa, Artificial Sequence
  Description of Artificial Sequence: Synthetic polypeptide
DEEEIRTTNPVATEQYGQVQFPTPGVEEQPEPGEVAES

SEQ ID NO: 183878 - protein, 36 aa, Artificial Sequence
  Description of Artificial Sequence: Synthetic polypeptide
DEEEIRCTNPVAYEQWGHKTVVYTVALSGGPGGNDV

SEQ ID NO: 183879 - protein, 37 aa, Artificial Sequence
  Description of Artificial Sequence: Synthetic polypeptide
DEEEIRCTNPVATEQYGVVVNFGMTDQEQENNDNGQG

SEQ ID NO: 183880 - protein, 36 aa, Artificial Sequence
  Description of Artificial Sequence: Synthetic polypeptide
DEAEIATTNPCATECYGCVVCTDNHLDQDQQGGSGM

SEQ ID NO: 183881 - protein, 37 aa, Artificial Sequence
  Description of Artificial Sequence: Synthetic polypeptide
DEEEIRCTNPVATEQYGSVTVNGNMDINGQGEQDEEG

SEQ ID NO: 183882 - protein, 39 aa, Artificial Sequence
  Description of Artificial Sequence: Synthetic polypeptide
DEEEIRTTNPVATEQYGQVVNLSQNMNTEMEDEGQEGGQ

SEQ ID NO: 183883 - protein, 36 aa, Artificial Sequence
  Description of Artificial Sequence: Synthetic polypeptide
SEEEIACTNPVATEQYGSACSVADGLQEDAGEGKMN

SEQ ID NO: 183884 - protein, 38 aa, Artificial Sequence
  Description of Artificial Sequence: Synthetic polypeptide
DEEEIRTTNPVATEQYGQVQFPSPGVFEQPEPGSVAEI

SEQ ID NO: 183885 - protein, 39 aa, Artificial Sequence
  Description of Artificial Sequence: Synthetic polypeptide
DEEEIRTTNPVATEQYGVVSVVVTVGTQAGTTEAGSTTD

SEQ ID NO: 183886 - protein, 35 aa, Artificial Sequence
  Description of Artificial Sequence: Synthetic polypeptide
DDEEISCTNPVATEQYGCVCSWGEHNQENSNSQQA

SEQ ID NO: 183887 - protein, 35 aa, Artificial Sequence
  Description of Artificial Sequence: Synthetic polypeptide
SEEEIACTNPVATEQYGSVCAAGPLGFATMGDIET

SEQ ID NO: 183888 - protein, 38 aa, Artificial Sequence
  Description of Artificial Sequence: Synthetic polypeptide
DEEEIRGTNPVATEQYGMISVSLDGFGQGQEEGEGEED

SEQ ID NO: 183889 - protein, 34 aa, Artificial Sequence
  Description of Artificial Sequence: Synthetic polypeptide
DEGEIATTNPVAYEQYGCVANNGVTTAENPNEKT

SEQ ID NO: 183890 - protein, 33 aa, Artificial Sequence
  Description of Artificial Sequence: Synthetic polypeptide
SEEEIASVNPVCTEQYGVVCSWEHQESFGSQQS

SEQ ID NO: 183891 - protein, 33 aa, Artificial Sequence
  Description of Artificial Sequence: Synthetic polypeptide
SEEEIASVNPVCTEQYGVVCSSEHNQSFGSQQS

SEQ ID NO: 183892 - protein, 37 aa, Artificial Sequence
  Description of Artificial Sequence: Synthetic polypeptide
DEAEIACTNPVAYEQYGSVAAITNNEEAPGNQMEGRA

SEQ ID NO: 183893 - protein, 34 aa, Artificial Sequence
  Description of Artificial Sequence: Synthetic polypeptide
SEEEIASVNPVCTEQYGCVCSWEHNQSFGSNTQA

SEQ ID NO: 183894 - protein, 33 aa, Artificial Sequence
  Description of Artificial Sequence: Synthetic polypeptide
SEEEIASVNPVCTEQYGCVCSWEDQESFGSDQA

SEQ ID NO: 183895 - protein, 38 aa, Artificial Sequence
  Description of Artificial Sequence: Synthetic polypeptide
DEEEIRGTNPVATEQWGVVNVDTNENFLQHEGEGQGDI

SEQ ID NO: 183896 - protein, 36 aa, Artificial Sequence
  Description of Artificial Sequence: Synthetic polypeptide
DEGEIATTNPVAYEQYGCVAAITNHEEAPDNQEGRM

SEQ ID NO: 183897 - protein, 34 aa, Artificial Sequence
  Description of Artificial Sequence: Synthetic polypeptide
DEGEIATTNPVAYEQWGTVCAATDGGVEDESGND

SEQ ID NO: 183898 - protein, 35 aa, Artificial Sequence
  Description of Artificial Sequence: Synthetic polypeptide
DEGEIATTNPVAYEQWGSVSQGPPPQQATPDGSEN

SEQ ID NO: 183899 - protein, 35 aa, Artificial Sequence
  Description of Artificial Sequence: Synthetic polypeptide
DEGEIATTNPVAYEQWGSVSGQGPPQQATPDGSEH

SEQ ID NO: 183900 - protein, 36 aa, Artificial Sequence
  Description of Artificial Sequence: Synthetic polypeptide
DEETIRTTNPCATEQYGSVIEPAVHQQITQGFQPAP

SEQ ID NO: 183901 - protein, 37 aa, Artificial Sequence
  Description of Artificial Sequence: Synthetic polypeptide
DEEEIRGTNPVATEQWGSSIVANAGGQLIRGGGQDGQ

SEQ ID NO: 183902 - protein, 36 aa, Artificial Sequence
  Description of Artificial Sequence: Synthetic polypeptide
DEAEIACTNPVAYEQYGSVANTNNLEAEAPPDNLAQ

SEQ ID NO: 183903 - protein, 33 aa, Artificial Sequence
  Description of Artificial Sequence: Synthetic polypeptide
DEGEIATTNPVAYEQWGCVAGTTGGEAQAPDDP

SEQ ID NO: 183904 - protein, 36 aa, Artificial Sequence
  Description of Artificial Sequence: Synthetic polypeptide
DEAEIACTNPVAYEQYGSVANTNNLEAETPPDNLHK

SEQ ID NO: 183905 - protein, 36 aa, Artificial Sequence
  Description of Artificial Sequence: Synthetic polypeptide
DEEEIRGTNPVATEQWGDCVAVGGQTLIAGGGNDGD

SEQ ID NO: 183906 - protein, 38 aa, Artificial Sequence
  Description of Artificial Sequence: Synthetic polypeptide
SEEEIACTNPVATEQYGSVCAMTNGELTNPDDQMEHNM

SEQ ID NO: 183907 - protein, 39 aa, Artificial Sequence
  Description of Artificial Sequence: Synthetic polypeptide
DEEEIRGTNPVATEQYGMSIVVLGSMNTEQGIIQGEGGE

SEQ ID NO: 183908 - protein, 38 aa, Artificial Sequence
  Description of Artificial Sequence: Synthetic polypeptide
DEETICTTNPVATEAYGVVSTVTNNNLQQLQQGEDDED

SEQ ID NO: 183909 - protein, 37 aa, Artificial Sequence
  Description of Artificial Sequence: Synthetic polypeptide
SEEEIATTNPVATEQYGSTACATNGEEAPDDQDGTHP

SEQ ID NO: 183910 - protein, 36 aa, Artificial Sequence
  Description of Artificial Sequence: Synthetic polypeptide
DEETICTTNPVATEAYGVVATVVNNQQIGTEEQEED

SEQ ID NO: 183911 - protein, 36 aa, Artificial Sequence
  Description of Artificial Sequence: Synthetic polypeptide
DDEEISTTNPVATEQYGCVCSNWGEHNQGFNSDTQI

SEQ ID NO: 183912 - protein, 36 aa, Artificial Sequence
  Description of Artificial Sequence: Synthetic polypeptide
DDEEISTTNPVATEQYGCVCSNWEHNAEGFNSETQA

SEQ ID NO: 183913 - protein, 34 aa, Artificial Sequence
  Description of Artificial Sequence: Synthetic polypeptide
DEESIATTNPVAYEAWGSVYYWHNDVQRQDQITM

SEQ ID NO: 183914 - protein, 36 aa, Artificial Sequence
  Description of Artificial Sequence: Synthetic polypeptide
DDEEISTTNPVATEQYGCVCSNWEEPNTENFGSEQS

SEQ ID NO: 183915 - protein, 36 aa, Artificial Sequence
  Description of Artificial Sequence: Synthetic polypeptide
SEEEIGTTNPVATEQYGCVCSWEDHNAENFNSDFQA

SEQ ID NO: 183916 - protein, 37 aa, Artificial Sequence
  Description of Artificial Sequence: Synthetic polypeptide
DEGEIATTNPVAYEQYGSVSSTGEPGINPRDIMEKVY

SEQ ID NO: 183917 - protein, 35 aa, Artificial Sequence
  Description of Artificial Sequence: Synthetic polypeptide
DEESIATTNPVAYECWGSVYNWEPNDVQKREGHHM

SEQ ID NO: 183918 - protein, 36 aa, Artificial Sequence
  Description of Artificial Sequence: Synthetic polypeptide
DEEEIRGTNPVATEQYGVCVHPSPVHMPNSVDMFEG

SEQ ID NO: 183919 - protein, 35 aa, Artificial Sequence
  Description of Artificial Sequence: Synthetic polypeptide
DEESIATTNPVATASWGCVAGTVNELGPDDSGNMQ

SEQ ID NO: 183920 - protein, 34 aa, Artificial Sequence
  Description of Artificial Sequence: Synthetic polypeptide
DEESIATTNPVAYECWGVVYNWANDHQREQFNAM

SEQ ID NO: 183921 - protein, 36 aa, Artificial Sequence
  Description of Artificial Sequence: Synthetic polypeptide
DDEEISTTNPVATEQYGCVCSNWEEHNQNFGSDTQA

SEQ ID NO: 183922 - protein, 36 aa, Artificial Sequence
  Description of Artificial Sequence: Synthetic polypeptide
DEGEIATTNPVAYEQYGSVPAIAHADQTGQDGMNDN

SEQ ID NO: 183923 - protein, 38 aa, Artificial Sequence
  Description of Artificial Sequence: Synthetic polypeptide
DEEEIRGTNPVATEQYGSVVNNMNMPNAGEENGQTGGQ

SEQ ID NO: 183924 - protein, 37 aa, Artificial Sequence
  Description of Artificial Sequence: Synthetic polypeptide
DEGEIATTNPVAYEQYGSVCSVDHQLPQDSMDGMEGW

SEQ ID NO: 183925 - protein, 35 aa, Artificial Sequence
  Description of Artificial Sequence: Synthetic polypeptide
DEAEIACTNPVATEQYGSCSAGENPDENGMDIGES

SEQ ID NO: 183926 - protein, 35 aa, Artificial Sequence
  Description of Artificial Sequence: Synthetic polypeptide
DDEEISTTNPVATEQYGCVCSNWEEHNQHFISEQA

SEQ ID NO: 183927 - protein, 36 aa, Artificial Sequence
  Description of Artificial Sequence: Synthetic polypeptide
DEAEIACTNPVATEQYGSVAAITNNDENTAGETTQN

SEQ ID NO: 183928 - protein, 37 aa, Artificial Sequence
  Description of Artificial Sequence: Synthetic polypeptide
DDEEISTTNPVATEQYGCVCSNWEEDNQENFGSENQA

SEQ ID NO: 183929 - protein, 39 aa, Artificial Sequence
  Description of Artificial Sequence: Synthetic polypeptide
DEEEIRGTNPVATEQYGTVVMGNNTNDQELLATGQGGEQ

SEQ ID NO: 183930 - protein, 39 aa, Artificial Sequence
  Description of Artificial Sequence: Synthetic polypeptide
DEEEIRGTNPVATEQYGVVNMGPDTNDQELLAEGQTGGQ

SEQ ID NO: 183931 - protein, 32 aa, Artificial Sequence
  Description of Artificial Sequence: Synthetic polypeptide
QESEIASTNPVGTEGYGVMASITEQDHEGENI

SEQ ID NO: 183932 - protein, 36 aa, Artificial Sequence
  Description of Artificial Sequence: Synthetic polypeptide
DEESIACTNPVAYEQYGSVANTNNLEAEAPPDNMAE

SEQ ID NO: 183933 - protein, 32 aa, Artificial Sequence
  Description of Artificial Sequence: Synthetic polypeptide
DEGEIATTNPVSTEPYGVCYCEDGQQQQNGLE

SEQ ID NO: 183934 - protein, 36 aa, Artificial Sequence
  Description of Artificial Sequence: Synthetic polypeptide
DDEEIRTTNPVATEGYGCVCSNWGEHNQEFFNSEQG

SEQ ID NO: 183935 - protein, 39 aa, Artificial Sequence
  Description of Artificial Sequence: Synthetic polypeptide
DEEEIRGTNPVATEQYGVVVMTPNTIDQELLAEGQTGGQ

SEQ ID NO: 183936 - protein, 33 aa, Artificial Sequence
  Description of Artificial Sequence: Synthetic polypeptide
SEEEIRCTNPCATEGYGCVCSWGEHANFGSDQS

SEQ ID NO: 183937 - protein, 37 aa, Artificial Sequence
  Description of Artificial Sequence: Synthetic polypeptide
DEESIACTNPVATEQYGSVCATNGVSEMTDDGANEIT

SEQ ID NO: 183938 - protein, 34 aa, Artificial Sequence
  Description of Artificial Sequence: Synthetic polypeptide
SEEEIRCTNPCATEGYGCVCSWEHNAENFGSDQS

SEQ ID NO: 183939 - protein, 37 aa, Artificial Sequence
  Description of Artificial Sequence: Synthetic polypeptide
DEESIACTNPVATEQYGSVCATNNQSENPDDGAGDHT

SEQ ID NO: 183940 - protein, 40 aa, Artificial Sequence
  Description of Artificial Sequence: Synthetic polypeptide
DEEEIRTTNPVATEQYGVVSVVTNNNQQSATNEEGSTTQQ

SEQ ID NO: 183941 - protein, 36 aa, Artificial Sequence
  Description of Artificial Sequence: Synthetic polypeptide
DEESIACTNPVATEQYGSVCATNNSENPDDGMGDMT

SEQ ID NO: 183942 - protein, 36 aa, Artificial Sequence
  Description of Artificial Sequence: Synthetic polypeptide
DEESIACTNPVATEQYGSVCATNNSENPDDQMEADT

SEQ ID NO: 183943 - protein, 35 aa, Artificial Sequence
  Description of Artificial Sequence: Synthetic polypeptide
DEESIACTNPVATEQYGSVCSAPGAEGTHQDEDAH

SEQ ID NO: 183944 - protein, 36 aa, Artificial Sequence
  Description of Artificial Sequence: Synthetic polypeptide
DEESIACTNPVATEQYGSVCSVGDDINIDALMENVD

SEQ ID NO: 183945 - protein, 36 aa, Artificial Sequence
  Description of Artificial Sequence: Synthetic polypeptide
DDEEIRTTNPVATEGYGCVCSWEEDHNQENFNSDQS

SEQ ID NO: 183946 - protein, 37 aa, Artificial Sequence
  Description of Artificial Sequence: Synthetic polypeptide
DEESIACTNPVATEQYGSVSGTGEPGINPRDGMEKVH

SEQ ID NO: 183947 - protein, 39 aa, Artificial Sequence
  Description of Artificial Sequence: Synthetic polypeptide
DEEEIRGTNPVATEQYGVVVMGVDTNDQELLQEGQTGGQ

SEQ ID NO: 183948 - protein, 36 aa, Artificial Sequence
  Description of Artificial Sequence: Synthetic polypeptide
DEAEIACTNPVATEQYGSACATNPDEAGAHQDNDAP

SEQ ID NO: 183949 - protein, 37 aa, Artificial Sequence
  Description of Artificial Sequence: Synthetic polypeptide
DEAEIACTNPVATEQYGSACSAANPGPLDSMGGNDDQ

SEQ ID NO: 183950 - protein, 37 aa, Artificial Sequence
  Description of Artificial Sequence: Synthetic polypeptide
DDEEISTTNPVATEQYGCVCSNWGETNAENFNSETQS

SEQ ID NO: 183951 - protein, 36 aa, Artificial Sequence
  Description of Artificial Sequence: Synthetic polypeptide
DEEEIRGTNPVATEQYGVVVDGFNGEMDEEDGGDTG

SEQ ID NO: 183952 - protein, 36 aa, Artificial Sequence
  Description of Artificial Sequence: Synthetic polypeptide
DEESICTTNPVATEAYGSVATTVNNDEQGTEETEED

SEQ ID NO: 183953 - protein, 39 aa, Artificial Sequence
  Description of Artificial Sequence: Synthetic polypeptide
DEEEIRTTNPVATEQYGQCVCSTWEEDHNQESFNSDTQS

SEQ ID NO: 183954 - protein, 39 aa, Artificial Sequence
  Description of Artificial Sequence: Synthetic polypeptide
DEEEIRTTNPVATEQYGQCVCSTWGEDHDQENFGSDTQS

SEQ ID NO: 183955 - protein, 39 aa, Artificial Sequence
  Description of Artificial Sequence: Synthetic polypeptide
DEEEIRTTNPVATEQYGQCVCSTWGEDHNAEGFNSENQS

SEQ ID NO: 183956 - protein, 36 aa, Artificial Sequence
  Description of Artificial Sequence: Synthetic polypeptide
DEGEIATTNPVAYEQYGSVATTGHGPLDSMENTHDD

SEQ ID NO: 183957 - protein, 38 aa, Artificial Sequence
  Description of Artificial Sequence: Synthetic polypeptide
DEEEIRTTNPVATEQYGQCVCSWGEDHNQENFGSDTQA

SEQ ID NO: 183958 - protein, 36 aa, Artificial Sequence
  Description of Artificial Sequence: Synthetic polypeptide
DEGEIATTNPVAYEQYGSVATTGHGPLDSMENNIAD

SEQ ID NO: 183959 - protein, 38 aa, Artificial Sequence
  Description of Artificial Sequence: Synthetic polypeptide
DEEEIRTTNPVATEQYGQCVCSWGEDHNQENFGSDTQS

SEQ ID NO: 183960 - protein, 37 aa, Artificial Sequence
  Description of Artificial Sequence: Synthetic polypeptide
DEEEIRTTNPVATEQYGQCVCSWGEDHNQENFISDQS

SEQ ID NO: 183961 - protein, 38 aa, Artificial Sequence
  Description of Artificial Sequence: Synthetic polypeptide
DEEEIRTTNPVATEQYGQCVCSWGEDHNQENFNSDTQS

SEQ ID NO: 183962 - protein, 36 aa, Artificial Sequence
  Description of Artificial Sequence: Synthetic polypeptide
DDEEISTTNPVATEQWGCVTSNTGEDNQENFGSDAS

SEQ ID NO: 183963 - protein, 38 aa, Artificial Sequence
  Description of Artificial Sequence: Synthetic polypeptide
DEEEIRTTNPVATEQYGQCVCSWGEDPNQENFNSDNQA

SEQ ID NO: 183964 - protein, 37 aa, Artificial Sequence
  Description of Artificial Sequence: Synthetic polypeptide
DEEEIRTTNPVATEQYGQCVCSWGEHNQENFISDTQS

SEQ ID NO: 183965 - protein, 37 aa, Artificial Sequence
  Description of Artificial Sequence: Synthetic polypeptide
SEEEIATTNPVATEQYGSVCAHNSVETATASIDNSDM

SEQ ID NO: 183966 - protein, 38 aa, Artificial Sequence
  Description of Artificial Sequence: Synthetic polypeptide
SEEEIATTNPVATEQYGSVCAGHNNAEEAPDNQIEGNH

SEQ ID NO: 183967 - protein, 36 aa, Artificial Sequence
  Description of Artificial Sequence: Synthetic polypeptide
SEEEIATTNPVATEQYGSVCAANMGEEAPDDLMGDA

SEQ ID NO: 183968 - protein, 38 aa, Artificial Sequence
  Description of Artificial Sequence: Synthetic polypeptide
DEESIRTTNPVAYEPNYYQSLVNSNTNDLLQPGSIEKH

SEQ ID NO: 183969 - protein, 36 aa, Artificial Sequence
  Description of Artificial Sequence: Synthetic polypeptide
DEESIRTTNPVAYEPYYQDVNNNTNDLLQPRSIEKH

SEQ ID NO: 183970 - protein, 35 aa, Artificial Sequence
  Description of Artificial Sequence: Synthetic polypeptide
DEESISTTNPVSYEQWGSCYTIDNHDQRGGGKTGT

SEQ ID NO: 183971 - protein, 36 aa, Artificial Sequence
  Description of Artificial Sequence: Synthetic polypeptide
DEETEIATTNPVAYEAWGSVYTGPGNAGETGMQNES

SEQ ID NO: 183972 - protein, 38 aa, Artificial Sequence
  Description of Artificial Sequence: Synthetic polypeptide
DEEEIRTTNPVATEQYGQCVCSWMEDHNAEYFNSQNQA

SEQ ID NO: 183973 - protein, 38 aa, Artificial Sequence
  Description of Artificial Sequence: Synthetic polypeptide
DEEEIRTTNPVATEQYGQCVCSWMEDHNIENFNSDNQS

SEQ ID NO: 183974 - protein, 37 aa, Artificial Sequence
  Description of Artificial Sequence: Synthetic polypeptide
DDEEISTTNPVATEGYGCVCSMTGEHNQENFGSDNQA

SEQ ID NO: 183975 - protein, 35 aa, Artificial Sequence
  Description of Artificial Sequence: Synthetic polypeptide
SEEEIATTNPVAYEPYRGQSVAINEPSTSMPGAPR

SEQ ID NO: 183976 - protein, 36 aa, Artificial Sequence
  Description of Artificial Sequence: Synthetic polypeptide
SEEEIACTNPVATEQYGSACPAGENGQEAEIGNEND

SEQ ID NO: 183977 - protein, 34 aa, Artificial Sequence
  Description of Artificial Sequence: Synthetic polypeptide
SEEEIATTNPVAYEQWGHTYWIDIDVQMRGMGHR

SEQ ID NO: 183978 - protein, 38 aa, Artificial Sequence
  Description of Artificial Sequence: Synthetic polypeptide
DEEEIRTTNPVATEQYGQCVCSWGEDHNIENFNSDTQS

SEQ ID NO: 183979 - protein, 39 aa, Artificial Sequence
  Description of Artificial Sequence: Synthetic polypeptide
DEEEIRTTNPVATEQYGQCVCSTWGEDHNAENFNSDTQS

SEQ ID NO: 183980 - protein, 39 aa, Artificial Sequence
  Description of Artificial Sequence: Synthetic polypeptide
DEEEIRTTNPVATEQYGQCVCSTWGEDHNAENFNSENQS

SEQ ID NO: 183981 - protein, 38 aa, Artificial Sequence
  Description of Artificial Sequence: Synthetic polypeptide
DEEEIRTTNPVATEQYGQCVCSTWGEDHNQENFMSDQS

SEQ ID NO: 183982 - protein, 38 aa, Artificial Sequence
  Description of Artificial Sequence: Synthetic polypeptide
DEEEIRTTNPVATEQYGQCVCSTWGEHDAENFNSDTQS

SEQ ID NO: 183983 - protein, 38 aa, Artificial Sequence
  Description of Artificial Sequence: Synthetic polypeptide
DEEEIRTTNPVATEQYGQCVCSTWGEHNEENFISETQP

SEQ ID NO: 183984 - protein, 38 aa, Artificial Sequence
  Description of Artificial Sequence: Synthetic polypeptide
DEEEIRTTNPVATEQYGQCVCSWEEDHNQENFISDNQA

SEQ ID NO: 183985 - protein, 37 aa, Artificial Sequence
  Description of Artificial Sequence: Synthetic polypeptide
DDEEISTTNPVATEQYGCVCSMWGEDDQENFGSDNQA

SEQ ID NO: 183986 - protein, 36 aa, Artificial Sequence
  Description of Artificial Sequence: Synthetic polypeptide
DDEEISTTNPVATEQYGCVCSMWEEHNQNFGSQTQS

SEQ ID NO: 183987 - protein, 37 aa, Artificial Sequence
  Description of Artificial Sequence: Synthetic polypeptide
DEEEIRTTNPVATEQYGQCVCSWEEHNQENFISDTQA

SEQ ID NO: 183988 - protein, 36 aa, Artificial Sequence
  Description of Artificial Sequence: Synthetic polypeptide
DEGEIATTNPVAYEQYGSVCAAPENLENDDLMGAQH

SEQ ID NO: 183989 - protein, 37 aa, Artificial Sequence
  Description of Artificial Sequence: Synthetic polypeptide
DDEEISTTNPVATEQYGCVCSMWEEHNAEHFGSENQA

SEQ ID NO: 183990 - protein, 37 aa, Artificial Sequence
  Description of Artificial Sequence: Synthetic polypeptide
DEESICTVNPVATEAYGSVSTVTNLAGNQQEATTTTD

SEQ ID NO: 183991 - protein, 37 aa, Artificial Sequence
  Description of Artificial Sequence: Synthetic polypeptide
SEEEICTTNPVATEGYGMVNGQGTNQGEQGGNEQFGD

SEQ ID NO: 183992 - protein, 35 aa, Artificial Sequence
  Description of Artificial Sequence: Synthetic polypeptide
DDEEISTTNPVATEQWGQCVTSWGEHNQNFGSDAS

SEQ ID NO: 183993 - protein, 35 aa, Artificial Sequence
  Description of Artificial Sequence: Synthetic polypeptide
SEEEIATVNPVATAQWGGCVAGNGLQSRANMSGEN

SEQ ID NO: 183994 - protein, 37 aa, Artificial Sequence
  Description of Artificial Sequence: Synthetic polypeptide
DEEEIRTTNPVATEQYGQCVCSWGEDHIESFNSDTQS

SEQ ID NO: 183995 - protein, 38 aa, Artificial Sequence
  Description of Artificial Sequence: Synthetic polypeptide
DEEEIRTTNPVATEQYGQCVCSWGEDHNAENFNSDNQA

SEQ ID NO: 183996 - protein, 35 aa, Artificial Sequence
  Description of Artificial Sequence: Synthetic polypeptide
DDEEISTTNPVATEQWGCVTSWGEHNAENFNSDAA

SEQ ID NO: 183997 - protein, 38 aa, Artificial Sequence
  Description of Artificial Sequence: Synthetic polypeptide
DEEEIRTTNPVATEQYGQCVCSWGEDHNAENFNSDTQA

SEQ ID NO: 183998 - protein, 36 aa, Artificial Sequence
  Description of Artificial Sequence: Synthetic polypeptide
SEEEIATTNPVAYEQYGHLVACTYEQSQRPSTMPQR

SEQ ID NO: 183999 - protein, 36 aa, Artificial Sequence
  Description of Artificial Sequence: Synthetic polypeptide
DDEEIRTTNPVATEQWGCVTSNWGEDNTENFNSDAS

SEQ ID NO: 184000 - protein, 36 aa, Artificial Sequence
  Description of Artificial Sequence: Synthetic polypeptide
SEEEIACTNPVATEQYGSACATNPQENPDDQMGSEM

SEQ ID NO: 184001 - protein, 36 aa, Artificial Sequence
  Description of Artificial Sequence: Synthetic polypeptide
SEEEIACTNPVATEQYGSACAPNPQLNPDDQMGGEM

SEQ ID NO: 184002 - protein, 37 aa, Artificial Sequence
  Description of Artificial Sequence: Synthetic polypeptide
DEEEIRCTNPVATEQYGCVCSNWGEDHNDHFGSDTQS

SEQ ID NO: 184003 - protein, 37 aa, Artificial Sequence
  Description of Artificial Sequence: Synthetic polypeptide
SEAEIATTNPVATEQYGSVCAMNNGVLNQTASGPMEN

SEQ ID NO: 184004 - protein, 36 aa, Artificial Sequence
  Description of Artificial Sequence: Synthetic polypeptide
SEAEIATTNPVATEQYGSVCAMAGPLGFATMGDNEG

SEQ ID NO: 184005 - protein, 36 aa, Artificial Sequence
  Description of Artificial Sequence: Synthetic polypeptide
SEAEIATTNPVATEQYGSVCAAGPLGFATMGDNSGV

SEQ ID NO: 184006 - protein, 35 aa, Artificial Sequence
  Description of Artificial Sequence: Synthetic polypeptide
SEAEIATTNPVATEQYGSVCAAGPLGFATMGDEEW

SEQ ID NO: 184007 - protein, 34 aa, Artificial Sequence
  Description of Artificial Sequence: Synthetic polypeptide
DEEVIATTNPDATEGYGSCSSQPLGARYMQEYDG

SEQ ID NO: 184008 - protein, 37 aa, Artificial Sequence
  Description of Artificial Sequence: Synthetic polypeptide
SEAEIATTNPVATEQYGSTACATNPEEAPDDQDGTNP

SEQ ID NO: 184009 - protein, 35 aa, Artificial Sequence
  Description of Artificial Sequence: Synthetic polypeptide
SEAEIATTNPVATEQYGCVAATSGLPPAEEPNNHH

SEQ ID NO: 184010 - protein, 34 aa, Artificial Sequence
  Description of Artificial Sequence: Synthetic polypeptide
SEAEIATTNPVAYCAYGQTVPSCNLSPKGTNNQD

SEQ ID NO: 184011 - protein, 37 aa, Artificial Sequence
  Description of Artificial Sequence: Synthetic polypeptide
DEEEIRCTNPVATEQYGCVCSNSGEHNQENFNSDTQA

SEQ ID NO: 184012 - protein, 36 aa, Artificial Sequence
  Description of Artificial Sequence: Synthetic polypeptide
SEAEIACTNPVATEQYGSVCAMTNPQLEATDGTEGN

SEQ ID NO: 184013 - protein, 37 aa, Artificial Sequence
  Description of Artificial Sequence: Synthetic polypeptide
DEEEIRCTNPVATEQYGCVCSMWGEDFIEGFNSDNQA

SEQ ID NO: 184014 - protein, 39 aa, Artificial Sequence
  Description of Artificial Sequence: Synthetic polypeptide
DEEEIRTTNPVATESYGVVTNLQSGTISTNTNNNETGNT

SEQ ID NO: 184015 - protein, 39 aa, Artificial Sequence
  Description of Artificial Sequence: Synthetic polypeptide
DEEEIRTTNPVATEQYGSAWVNDIAMISGDSLHQDSIVG

SEQ ID NO: 184016 - protein, 39 aa, Artificial Sequence
  Description of Artificial Sequence: Synthetic polypeptide
DEEEIRTTNPVATEQYGSAWVNGIAMISGDSLEQDSIEH

SEQ ID NO: 184017 - protein, 39 aa, Artificial Sequence
  Description of Artificial Sequence: Synthetic polypeptide
DEEEIRTTNPVATEQYGSAWVNGIVEISGDSLNQDSIVD

SEQ ID NO: 184018 - protein, 35 aa, Artificial Sequence
  Description of Artificial Sequence: Synthetic polypeptide
SEAEIACTNPVATEQYGSCAATNNSHPSGEDGENA

SEQ ID NO: 184019 - protein, 38 aa, Artificial Sequence
  Description of Artificial Sequence: Synthetic polypeptide
DEEEIRTTNPVATEQYGSAWVNGNVMISGDSEGTDSIV

SEQ ID NO: 184020 - protein, 37 aa, Artificial Sequence
  Description of Artificial Sequence: Synthetic polypeptide
DEEEIRCTNPVATEQYGCVCSMWGEHNQENFNSDNQS

SEQ ID NO: 184021 - protein, 36 aa, Artificial Sequence
  Description of Artificial Sequence: Synthetic polypeptide
DEEEIRTTNPVATETYGSCVTWVVPIHESGTTDEMQ

SEQ ID NO: 184022 - protein, 36 aa, Artificial Sequence
  Description of Artificial Sequence: Synthetic polypeptide
DEEEIRTTNPVATETYGSVCSVEVDMAHVDVLDDQQ

SEQ ID NO: 184023 - protein, 36 aa, Artificial Sequence
  Description of Artificial Sequence: Synthetic polypeptide
DEEEIRTTNPVATETYGSVCVVEKMAHVDVGDDQQY

SEQ ID NO: 184024 - protein, 38 aa, Artificial Sequence
  Description of Artificial Sequence: Synthetic polypeptide
SEAEIRTTNPVATEQYGSYVSCSGIMIEELMNGNEEVF

SEQ ID NO: 184025 - protein, 37 aa, Artificial Sequence
  Description of Artificial Sequence: Synthetic polypeptide
SEAEIRTTNPVATEQYGSVMYPTFVDMNNNGLELNMV

SEQ ID NO: 184026 - protein, 36 aa, Artificial Sequence
  Description of Artificial Sequence: Synthetic polypeptide
SEAEIRTTNPVATEQYGSSYPCSTYEGFMGTEDVEQ

SEQ ID NO: 184027 - protein, 36 aa, Artificial Sequence
  Description of Artificial Sequence: Synthetic polypeptide
SEAEIRTTNPVATEQYGSMFSVENEDVEGGHDGIIE

SEQ ID NO: 184028 - protein, 35 aa, Artificial Sequence
  Description of Artificial Sequence: Synthetic polypeptide
SEAEIRTTNPVATEQYGSITMMQDDNTDDEGLDTD

SEQ ID NO: 184029 - protein, 36 aa, Artificial Sequence
  Description of Artificial Sequence: Synthetic polypeptide
SEAEIRTTNPVATEQYGSIFTTMQDDNTDEYEDTDG

SEQ ID NO: 184030 - protein, 37 aa, Artificial Sequence
  Description of Artificial Sequence: Synthetic polypeptide
DDEEIRTTNPVATEQYGSVVLDIMGNGEGTTNNTGDG

SEQ ID NO: 184031 - protein, 36 aa, Artificial Sequence
  Description of Artificial Sequence: Synthetic polypeptide
SEAEIRTTNPVATEQYGCTCSWGEHNQENFGSDNQS

SEQ ID NO: 184032 - protein, 35 aa, Artificial Sequence
  Description of Artificial Sequence: Synthetic polypeptide
SEAEIRTTNPVATEQYGCAMVTVPALEDQEIQELN

SEQ ID NO: 184033 - protein, 34 aa, Artificial Sequence
  Description of Artificial Sequence: Synthetic polypeptide
SEAEIRTTNPVATEGYGCVCSNWEHANFGSDTQS

SEQ ID NO: 184034 - protein, 36 aa, Artificial Sequence
  Description of Artificial Sequence: Synthetic polypeptide
SEAEIRTTNPVATECYGCVCTIDSNNHNGQQGGDDK

SEQ ID NO: 184035 - protein, 37 aa, Artificial Sequence
  Description of Artificial Sequence: Synthetic polypeptide
DEEEIRTTNPVATEQYGSAVQPAAVPHDIMIEPVNIL

SEQ ID NO: 184036 - protein, 35 aa, Artificial Sequence
  Description of Artificial Sequence: Synthetic polypeptide
SEAEIRCTNPVATEQYGCVCEWGEDNQEHFGSNQA

SEQ ID NO: 184037 - protein, 38 aa, Artificial Sequence
  Description of Artificial Sequence: Synthetic polypeptide
DDEEIRTTNPVATEQYGSVVDLMVNQTGQLEDDQTEGD

SEQ ID NO: 184038 - protein, 35 aa, Artificial Sequence
  Description of Artificial Sequence: Synthetic polypeptide
SEAEICTTNPVAYEQWGSVYWGNDNFEGEQGGDSR

SEQ ID NO: 184039 - protein, 36 aa, Artificial Sequence
  Description of Artificial Sequence: Synthetic polypeptide
SEAEICTTNPVAYECWGSVATGNGPLNDSRGQNGTD

SEQ ID NO: 184040 - protein, 35 aa, Artificial Sequence
  Description of Artificial Sequence: Synthetic polypeptide
SEAEIATTNPVAYERWGSVSGGNADDERNNGNGNP

SEQ ID NO: 184041 - protein, 36 aa, Artificial Sequence
  Description of Artificial Sequence: Synthetic polypeptide
DEAEIATTNPVATEPWGSVCPTDNDNQDEGGQHGMD

SEQ ID NO: 184042 - protein, 35 aa, Artificial Sequence
  Description of Artificial Sequence: Synthetic polypeptide
DEEVIACTNPVATAQWGSVASGIGPLGAPGGNAHQ

SEQ ID NO: 184043 - protein, 37 aa, Artificial Sequence
  Description of Artificial Sequence: Synthetic polypeptide
DEGEIATTNPVATEQYGSVCAANNGDENGMDINEDDN

SEQ ID NO: 184044 - protein, 36 aa, Artificial Sequence
  Description of Artificial Sequence: Synthetic polypeptide
DEGEIATTNPVATEQYGSVCAANNGDENGMDIIDFA

SEQ ID NO: 184045 - protein, 32 aa, Artificial Sequence
  Description of Artificial Sequence: Synthetic polypeptide
SEAEIACTNPVATASWGCVAGTGLARPGDQDP

SEQ ID NO: 184046 - protein, 36 aa, Artificial Sequence
  Description of Artificial Sequence: Synthetic polypeptide
DEEVIATTNPVAYEQWGVVAEAIDGGAQTRPGPNPR

SEQ ID NO: 184047 - protein, 35 aa, Artificial Sequence
  Description of Artificial Sequence: Synthetic polypeptide
SCEEIATTNPVATEQYGISTHCTGGASTSSTNNRP

SEQ ID NO: 184048 - protein, 36 aa, Artificial Sequence
  Description of Artificial Sequence: Synthetic polypeptide
SCEEIATTNPVATEQYGISTCHCTNGASTSSTNNRH

SEQ ID NO: 184049 - protein, 35 aa, Artificial Sequence
  Description of Artificial Sequence: Synthetic polypeptide
SCEEIATTNPVATEAYGISTHCTNEADTSSTNNRC

SEQ ID NO: 184050 - protein, 38 aa, Artificial Sequence
  Description of Artificial Sequence: Synthetic polypeptide
DEEEIRTTNPVATEQYGSCADQNTNTHPETENGPPHED

SEQ ID NO: 184051 - protein, 37 aa, Artificial Sequence
  Description of Artificial Sequence: Synthetic polypeptide
SAEEIRTTNPVATDAYGSVVISDTLGMGQTRGQGAFD

SEQ ID NO: 184052 - protein, 37 aa, Artificial Sequence
  Description of Artificial Sequence: Synthetic polypeptide
SAEEIATTNPVATEQYGSVCSANPALGIDHPDDTRAE

SEQ ID NO: 184053 - protein, 36 aa, Artificial Sequence
  Description of Artificial Sequence: Synthetic polypeptide
SAEEIATTNPVATEQYGSVCAANNGLADAPGDEMDH

SEQ ID NO: 184054 - protein, 36 aa, Artificial Sequence
  Description of Artificial Sequence: Synthetic polypeptide
SAEEIATTNPVATEQYGSVCAANMGEEQPDDQANHM

SEQ ID NO: 184055 - protein, 40 aa, Artificial Sequence
  Description of Artificial Sequence: Synthetic polypeptide
DEEEIRTTNPVATESYGTVTTGQSGTISTNNTQMNEVGNP

SEQ ID NO: 184056 - protein, 40 aa, Artificial Sequence
  Description of Artificial Sequence: Synthetic polypeptide
DEEEIRTTNPVATESYGTVTTGQSGTISTNNTQEQETGNP

SEQ ID NO: 184057 - protein, 39 aa, Artificial Sequence
  Description of Artificial Sequence: Synthetic polypeptide
DEEEIRTTNPVATESYGTVTTGQSGTIGTTTQQNEVGNP

SEQ ID NO: 184058 - protein, 32 aa, Artificial Sequence
  Description of Artificial Sequence: Synthetic polypeptide
SAEEIATTNPVATEQWGTNCSAAAHMDNSNDS

SEQ ID NO: 184059 - protein, 39 aa, Artificial Sequence
  Description of Artificial Sequence: Synthetic polypeptide
DEEEIRTTNPVATEQYGVVSVVVVTTQQNAEQGTTEEGS

SEQ ID NO: 184060 - protein, 35 aa, Artificial Sequence
  Description of Artificial Sequence: Synthetic polypeptide
SAEEIATTNPVATEQWGSVSVGDGPGGPDNLSNDN

SEQ ID NO: 184061 - protein, 36 aa, Artificial Sequence
  Description of Artificial Sequence: Synthetic polypeptide
SAEEIATTNPVATEQWGSVSGTGNPPPDDNGSPDAW

SEQ ID NO: 184062 - protein, 35 aa, Artificial Sequence
  Description of Artificial Sequence: Synthetic polypeptide
SAEEIATTNPVATEQWGSVSGTGNPPPDATSPDSW

SEQ ID NO: 184063 - protein, 36 aa, Artificial Sequence
  Description of Artificial Sequence: Synthetic polypeptide
SAEEIATTNPVATEQWGSVSGTGNPPPDANPSIDSW

SEQ ID NO: 184064 - protein, 36 aa, Artificial Sequence
  Description of Artificial Sequence: Synthetic polypeptide
SAEEIATTNPVATEQWGSVSGTGDPPPQANASNDSD

SEQ ID NO: 184065 - protein, 35 aa, Artificial Sequence
  Description of Artificial Sequence: Synthetic polypeptide
SAEEIATTNPVATEQWGSVSGTGDPPPDNNSNDAM

SEQ ID NO: 184066 - protein, 35 aa, Artificial Sequence
  Description of Artificial Sequence: Synthetic polypeptide
SCEEIATTNPVATEQYGITTHCTNAASTSSTNNRH

SEQ ID NO: 184067 - protein, 34 aa, Artificial Sequence
  Description of Artificial Sequence: Synthetic polypeptide
SEASIATTNPTAYEQWGSYYSFDNDLERSNGGSR

SEQ ID NO: 184068 - protein, 35 aa, Artificial Sequence
  Description of Artificial Sequence: Synthetic polypeptide
SCQEIATTNPVATEQYGSVSAPDLNEDHQGLEDEN

SEQ ID NO: 184069 - protein, 39 aa, Artificial Sequence
  Description of Artificial Sequence: Synthetic polypeptide
DEEEIRTTNPVATESYGTVTTGQSGTISTTTQMEEVGNT

SEQ ID NO: 184070 - protein, 36 aa, Artificial Sequence
  Description of Artificial Sequence: Synthetic polypeptide
DEGEIATTNPVATEQYGSVCAANMGEEAPDSGGEAH

SEQ ID NO: 184071 - protein, 36 aa, Artificial Sequence
  Description of Artificial Sequence: Synthetic polypeptide
DEGEIATTNPVATEQYGSVCAANMGEEAPDAQMEMM

SEQ ID NO: 184072 - protein, 36 aa, Artificial Sequence
  Description of Artificial Sequence: Synthetic polypeptide
DEGEIATTNPVATEQYGSVCAANMGEEANDDGGEDA

SEQ ID NO: 184073 - protein, 36 aa, Artificial Sequence
  Description of Artificial Sequence: Synthetic polypeptide
DEGEIATTNPVATEQYGSVCAANMGEEANDAGMEGH

SEQ ID NO: 184074 - protein, 35 aa, Artificial Sequence
  Description of Artificial Sequence: Synthetic polypeptide
SDEEIRTTNPVATHQYGCVCSWGEHNQEHFGSDFS

SEQ ID NO: 184075 - protein, 36 aa, Artificial Sequence
  Description of Artificial Sequence: Synthetic polypeptide
SDEEIRTTNPVATHQYGCVCSSGEDNQEYFGSDNQS

SEQ ID NO: 184076 - protein, 39 aa, Artificial Sequence
  Description of Artificial Sequence: Synthetic polypeptide
DEEEIRTTNPVATESYGTVTTGQSNTISTTTQNQEVGND

SEQ ID NO: 184077 - protein, 37 aa, Artificial Sequence
  Description of Artificial Sequence: Synthetic polypeptide
DEEEIRCTNPVATEQYGCVCSMWEEDNIEGFNSDTQA

SEQ ID NO: 184078 - protein, 35 aa, Artificial Sequence
  Description of Artificial Sequence: Synthetic polypeptide
SDEEIRTTNPVATEQWGCVCSNWEHNAEHFGSDQA

SEQ ID NO: 184079 - protein, 35 aa, Artificial Sequence
  Description of Artificial Sequence: Synthetic polypeptide
SDEEIRTTNPVATCQYGCVCSWMEHNQENFGSDFS

SEQ ID NO: 184080 - protein, 35 aa, Artificial Sequence
  Description of Artificial Sequence: Synthetic polypeptide
SDEEIRTTNPVATCQYGCVCSWGEHNQEYFGSDFA

SEQ ID NO: 184081 - protein, 36 aa, Artificial Sequence
  Description of Artificial Sequence: Synthetic polypeptide
SDEEIRTTNPVATCQYGCVCSWGEDNIEYFGSDNQS

SEQ ID NO: 184082 - protein, 37 aa, Artificial Sequence
  Description of Artificial Sequence: Synthetic polypeptide
DEGEIATTNPVATEQYGSVCAAMIHGQQDSMDGNDAH

SEQ ID NO: 184083 - protein, 38 aa, Artificial Sequence
  Description of Artificial Sequence: Synthetic polypeptide
DEEEIRTTNPVATEQYGSAYVSHASPPDDDSNEYDEED

SEQ ID NO: 184084 - protein, 39 aa, Artificial Sequence
  Description of Artificial Sequence: Synthetic polypeptide
DEEEIRTTNPVATESYGTVTTGQSNTISTNTEMGEVGNN

SEQ ID NO: 184085 - protein, 34 aa, Artificial Sequence
  Description of Artificial Sequence: Synthetic polypeptide
SDEEIRCTNPCATEQYGCVCSWGNDNANFGSDQS

SEQ ID NO: 184086 - protein, 37 aa, Artificial Sequence
  Description of Artificial Sequence: Synthetic polypeptide
DEEEIRCTNPVATEQYGCVCSMWEEDFQENFGSDTQA

SEQ ID NO: 184087 - protein, 34 aa, Artificial Sequence
  Description of Artificial Sequence: Synthetic polypeptide
SDECIATTNPVATEQWGQVCSTWEDHQQKSNGHG

SEQ ID NO: 184088 - protein, 40 aa, Artificial Sequence
  Description of Artificial Sequence: Synthetic polypeptide
DEEEIRTTNPVATESYGTVTTGQSGTTISTNTQGTEVGNT

SEQ ID NO: 184089 - protein, 35 aa, Artificial Sequence
  Description of Artificial Sequence: Synthetic polypeptide
SDECIATTNPVATEQWGKVCSTWEDHQQKSGNGET

SEQ ID NO: 184090 - protein, 36 aa, Artificial Sequence
  Description of Artificial Sequence: Synthetic polypeptide
DEESIACTNPVATEQYGSVCAMNNSENPDDGAEDDT

SEQ ID NO: 184091 - protein, 37 aa, Artificial Sequence
  Description of Artificial Sequence: Synthetic polypeptide
DEGEIATTNPVATEQYGSVCADHNHPEENGMPMEQNW

SEQ ID NO: 184092 - protein, 38 aa, Artificial Sequence
  Description of Artificial Sequence: Synthetic polypeptide
DEEEIRTTNPVATEQYGSAVGLPWNNHENTTQQEELFQ

SEQ ID NO: 184093 - protein, 34 aa, Artificial Sequence
  Description of Artificial Sequence: Synthetic polypeptide
DEAEIATTNPVATAQWGSVVAAGAGNPDNGEGME

SEQ ID NO: 184094 - protein, 34 aa, Artificial Sequence
  Description of Artificial Sequence: Synthetic polypeptide
SEEEIACTNPCATEQYGCVCSWGEDNANFGSDQS

SEQ ID NO: 184095 - protein, 36 aa, Artificial Sequence
  Description of Artificial Sequence: Synthetic polypeptide
DEAEIATTNPVATCQYGCVCSNSGADNQNFGSDNQS

SEQ ID NO: 184096 - protein, 38 aa, Artificial Sequence
  Description of Artificial Sequence: Synthetic polypeptide
DDEEIRTTNPVATEQYGSVYGQGQGDLEVGNGGQEFTA

SEQ ID NO: 184097 - protein, 38 aa, Artificial Sequence
  Description of Artificial Sequence: Synthetic polypeptide
DDEEIRTTNPVATEQYGSVYGQGQGDLEVGNGGFEEDA

SEQ ID NO: 184098 - protein, 38 aa, Artificial Sequence
  Description of Artificial Sequence: Synthetic polypeptide
DDEEIRTTNPVATEQYGSVYGQGQGDLEVGNGGEETTI

SEQ ID NO: 184099 - protein, 36 aa, Artificial Sequence
  Description of Artificial Sequence: Synthetic polypeptide
DEAEIATTNPVATCQYGCVCSTGADHNAENFGSDQS

SEQ ID NO: 184100 - protein, 36 aa, Artificial Sequence
  Description of Artificial Sequence: Synthetic polypeptide
DEAEIATTNPVATCQYGCVCSTGAHNAENFISDNQS

SEQ ID NO: 184101 - protein, 38 aa, Artificial Sequence
  Description of Artificial Sequence: Synthetic polypeptide
DDEEIRTTNPVATEQYGSVYGVGPGDLEVGNGGQEETF

SEQ ID NO: 184102 - protein, 35 aa, Artificial Sequence
  Description of Artificial Sequence: Synthetic polypeptide
SEECIRTTNPVATESWGAVFWNENDDHEKQRKGTS

SEQ ID NO: 184103 - protein, 38 aa, Artificial Sequence
  Description of Artificial Sequence: Synthetic polypeptide
DDEEIRTTNPVATEQYGSVYGQGQGDLEFGNGGQEEEQ

SEQ ID NO: 184104 - protein, 38 aa, Artificial Sequence
  Description of Artificial Sequence: Synthetic polypeptide
DDEEIRTTNPVATEQYGSVYGQGQGDDTFGNGTNEEIA

SEQ ID NO: 184105 - protein, 38 aa, Artificial Sequence
  Description of Artificial Sequence: Synthetic polypeptide
DDEEIRTTNPVATEQYGSVYGQGQGDDEPGNGGQEEDA

SEQ ID NO: 184106 - protein, 33 aa, Artificial Sequence
  Description of Artificial Sequence: Synthetic polypeptide
SEECIRCTNPCATEQYGCVCSWGEDANFGSDQS

SEQ ID NO: 184107 - protein, 35 aa, Artificial Sequence
  Description of Artificial Sequence: Synthetic polypeptide
SEECIATTNPVATEQYGISTHCTDEHDTSSTNNRM

SEQ ID NO: 184108 - protein, 38 aa, Artificial Sequence
  Description of Artificial Sequence: Synthetic polypeptide
DDEEIRTTNPVATEQYGSVYGQGQGDDEFGNQGNEETA

SEQ ID NO: 184109 - protein, 38 aa, Artificial Sequence
  Description of Artificial Sequence: Synthetic polypeptide
DDEEIRTTNPVATEQYGSVYGQGQGDDEFGNGQQETTA

SEQ ID NO: 184110 - protein, 37 aa, Artificial Sequence
  Description of Artificial Sequence: Synthetic polypeptide
DEEEIRCTNPVATEQYGQCVCSWGNDNDENFGSETQS

SEQ ID NO: 184111 - protein, 36 aa, Artificial Sequence
  Description of Artificial Sequence: Synthetic polypeptide
SEECIRTTNPVATEQWGCVCQNWGEHNQGFGSDNQS

SEQ ID NO: 184112 - protein, 38 aa, Artificial Sequence
  Description of Artificial Sequence: Synthetic polypeptide
DDEEIRTTNPVATEQYGSVYGVGQGDLEEGNGGQEATA

SEQ ID NO: 184113 - protein, 37 aa, Artificial Sequence
  Description of Artificial Sequence: Synthetic polypeptide
DDEEIRTTNPVATEQYGVVIVGGTDQNDGEGMEGVEG

SEQ ID NO: 184114 - protein, 37 aa, Artificial Sequence
  Description of Artificial Sequence: Synthetic polypeptide
DEEEIRTTNPVATEQYGSANSEAYPDDVGGSGQEEIG

SEQ ID NO: 184115 - protein, 37 aa, Artificial Sequence
  Description of Artificial Sequence: Synthetic polypeptide
DEEEIRTTNPVATEQYGQYLYPSMPVELKMLNGVEGW

SEQ ID NO: 184116 - protein, 36 aa, Artificial Sequence
  Description of Artificial Sequence: Synthetic polypeptide
DDEEIRTTNPVGTEQWGCVCSWGEHNIEYFGSVNQS

SEQ ID NO: 184117 - protein, 35 aa, Artificial Sequence
  Description of Artificial Sequence: Synthetic polypeptide
DDEEIRTTNPVGTEQWGCVCSWEHNQENFNSVTQS

SEQ ID NO: 184118 - protein, 37 aa, Artificial Sequence
  Description of Artificial Sequence: Synthetic polypeptide
DDEEIRTTNPVGTEQWGCVCSTWGEDNAENFGSQNQS

SEQ ID NO: 184119 - protein, 35 aa, Artificial Sequence
  Description of Artificial Sequence: Synthetic polypeptide
DDEEIRTTNPVGTEQWGCVCSNWMEHNQYFGSVQS

SEQ ID NO: 184120 - protein, 36 aa, Artificial Sequence
  Description of Artificial Sequence: Synthetic polypeptide
DDEEIRTTNPVAYEQYGQCVCSSGEDHNQYFGSQQA

SEQ ID NO: 184121 - protein, 36 aa, Artificial Sequence
  Description of Artificial Sequence: Synthetic polypeptide
DDEEIRTTNPVAYEQYGCVCSWGEHNQEFFNSENQG

SEQ ID NO: 184122 - protein, 38 aa, Artificial Sequence
  Description of Artificial Sequence: Synthetic polypeptide
DEGEIATTNPVATEQYGSVSSMTPAGGTNQGNGMEPVH

SEQ ID NO: 184123 - protein, 37 aa, Artificial Sequence
  Description of Artificial Sequence: Synthetic polypeptide
DEAEIATTNPCATEQYGTVCSATGGEPSENFNGGNDD

SEQ ID NO: 184124 - protein, 38 aa, Artificial Sequence
  Description of Artificial Sequence: Synthetic polypeptide
DEGEIATTNPVATEQYGSVSASTPAGITNIGNGMEPVH

SEQ ID NO: 184125 - protein, 37 aa, Artificial Sequence
  Description of Artificial Sequence: Synthetic polypeptide
DDEEIRTTNPVATHQYGCVCSWGEGHNAENFGSDNQS

SEQ ID NO: 184126 - protein, 37 aa, Artificial Sequence
  Description of Artificial Sequence: Synthetic polypeptide
DEEEIRTTNPVATEQYGSAMQLEVFEVQTAQMVELEE

SEQ ID NO: 184127 - protein, 37 aa, Artificial Sequence
  Description of Artificial Sequence: Synthetic polypeptide
DEEEIRTTNPVATEQYGSAMQLEVYEVQTPQPMETEE

SEQ ID NO: 184128 - protein, 37 aa, Artificial Sequence
  Description of Artificial Sequence: Synthetic polypeptide
DEEEIRTTNPVATEQYGSANSEADYPDDEGSGQEEIG

SEQ ID NO: 184129 - protein, 37 aa, Artificial Sequence
  Description of Artificial Sequence: Synthetic polypeptide
DEGEIATTNPVATEQYGSVCSPMPNQNNEAMIGDGFA

SEQ ID NO: 184130 - protein, 37 aa, Artificial Sequence
  Description of Artificial Sequence: Synthetic polypeptide
DEGEIATTNPVATEQYGSVCSPMPNQNNEAMIGDAVN

SEQ ID NO: 184131 - protein, 37 aa, Artificial Sequence
  Description of Artificial Sequence: Synthetic polypeptide
DEGEIATTNPVATEQYGSVCSPMPNQNNEAMIGAGAN

SEQ ID NO: 184132 - protein, 37 aa, Artificial Sequence
  Description of Artificial Sequence: Synthetic polypeptide
DEGEIATTNPVATEQYGSVCSPMPNQNNEAGIGDGKN

SEQ ID NO: 184133 - protein, 38 aa, Artificial Sequence
  Description of Artificial Sequence: Synthetic polypeptide
DEGEIATTNPVATEQYGSVCSPAGNHEGFATVGDQSNP

SEQ ID NO: 184134 - protein, 38 aa, Artificial Sequence
  Description of Artificial Sequence: Synthetic polypeptide
DDEEIRTTNPVATEQYGSVYGQGQGDDEFGNGGQEETF

SEQ ID NO: 184135 - protein, 38 aa, Artificial Sequence
  Description of Artificial Sequence: Synthetic polypeptide
DDEEIRTTNPVATEQYGSVYGQGQGDDEFGNGGNDEIA

SEQ ID NO: 184136 - protein, 38 aa, Artificial Sequence
  Description of Artificial Sequence: Synthetic polypeptide
DDEEIRTTNPVATEQYGSVYGQGQGDDEFGIGGQEENQ

SEQ ID NO: 184137 - protein, 38 aa, Artificial Sequence
  Description of Artificial Sequence: Synthetic polypeptide
DDEEIRTTNPVATEQYGSVYGQGLGNDEFGNGGQEETN

SEQ ID NO: 184138 - protein, 38 aa, Artificial Sequence
  Description of Artificial Sequence: Synthetic polypeptide
DEGEIATTNPVATEQYGSVCAMNNGQLEPPDDQAEGAE

SEQ ID NO: 184139 - protein, 37 aa, Artificial Sequence
  Description of Artificial Sequence: Synthetic polypeptide
DEGEIATTNPVATEQYGSVCAMNNGLNPTAPGPMESG

SEQ ID NO: 184140 - protein, 37 aa, Artificial Sequence
  Description of Artificial Sequence: Synthetic polypeptide
DEGEIATTNPVATEQYGSVCAMNNGLLEPPADIANDA

SEQ ID NO: 184141 - protein, 38 aa, Artificial Sequence
  Description of Artificial Sequence: Synthetic polypeptide
DEGEIATTNPVATEQYGSVCAMNNGHLEPPDDQANGAA

SEQ ID NO: 184142 - protein, 38 aa, Artificial Sequence
  Description of Artificial Sequence: Synthetic polypeptide
DEGEIATTNPVATEQYGSVCAMNNGELTNPDDQMENEM

SEQ ID NO: 184143 - protein, 33 aa, Artificial Sequence
  Description of Artificial Sequence: Synthetic polypeptide
SEDEIACTNPVATEQWGGCSAGTGLAAMDNGTL

SEQ ID NO: 184144 - protein, 37 aa, Artificial Sequence
  Description of Artificial Sequence: Synthetic polypeptide
SEDEAEIRTTNPVAYEQWGSVCVMDLIDNQDGRGTAI

SEQ ID NO: 184145 - protein, 40 aa, Artificial Sequence
  Description of Artificial Sequence: Synthetic polypeptide
DEETIRTTNPVATEQYGVVSTVVNTEQGNNAQQGTESGND

SEQ ID NO: 184146 - protein, 40 aa, Artificial Sequence
  Description of Artificial Sequence: Synthetic polypeptide
DEETIRTTNPVATEQYGVVSTVVNTEQGNNLQQGTETGSD

SEQ ID NO: 184147 - protein, 37 aa, Artificial Sequence
  Description of Artificial Sequence: Synthetic polypeptide
DEGEIATTNPVATEQYGSVCAGMTHGGAEAPIGDNQK

SEQ ID NO: 184148 - protein, 40 aa, Artificial Sequence
  Description of Artificial Sequence: Synthetic polypeptide
DEETIRTTNPVATEQYGVVSTVVSNQQAGNTEQGTTQNNE

SEQ ID NO: 184149 - protein, 39 aa, Artificial Sequence
  Description of Artificial Sequence: Synthetic polypeptide
DEETIRTTNPVATEQYGVVSTVVSTNNNANDEQGDEEDE

SEQ ID NO: 184150 - protein, 39 aa, Artificial Sequence
  Description of Artificial Sequence: Synthetic polypeptide
DEETIRTTNPVATEQYGVVSTVVSTNNNNNDEQGDEEDE

SEQ ID NO: 184151 - protein, 40 aa, Artificial Sequence
  Description of Artificial Sequence: Synthetic polypeptide
DEETIRTTNPVATEQYGVVSTVVSTNNNNNNQQLGDEEAE

SEQ ID NO: 184152 - protein, 40 aa, Artificial Sequence
  Description of Artificial Sequence: Synthetic polypeptide
DEETIRTTNPVATEQYGVVSTVVTNQQAGNNQQGTEEDED

SEQ ID NO: 184153 - protein, 37 aa, Artificial Sequence
  Description of Artificial Sequence: Synthetic polypeptide
DEGEIATTNPVATEQYGSVCADHNHPVENGMPMEENN

SEQ ID NO: 184154 - protein, 40 aa, Artificial Sequence
  Description of Artificial Sequence: Synthetic polypeptide
DEETIRTTNPVATEQYGVVSTVVTTNNNLQQLQQGDEEDE

SEQ ID NO: 184155 - protein, 37 aa, Artificial Sequence
  Description of Artificial Sequence: Synthetic polypeptide
DEGEIATTNPVATEQYGSVCADHNHPPENGMPMENLH

SEQ ID NO: 184156 - protein, 40 aa, Artificial Sequence
  Description of Artificial Sequence: Synthetic polypeptide
DEETIRTTNPVATEQYGVVSTVVVTNNNLQLQLQGDEEDE

SEQ ID NO: 184157 - protein, 38 aa, Artificial Sequence
  Description of Artificial Sequence: Synthetic polypeptide
DEGEIATTNPVATEQYGSVCAMSNDALPQDHQDGTEAE

SEQ ID NO: 184158 - protein, 40 aa, Artificial Sequence
  Description of Artificial Sequence: Synthetic polypeptide
DEETIRTTNPVATEQYGVVSTVVVTNNNNQQLQIGDEEDE

SEQ ID NO: 184159 - protein, 37 aa, Artificial Sequence
  Description of Artificial Sequence: Synthetic polypeptide
SEDEIATTNPVATEQYGSVVITPNEQDQHQQGKGDGM

SEQ ID NO: 184160 - protein, 40 aa, Artificial Sequence
  Description of Artificial Sequence: Synthetic polypeptide
DEETIRTTNPVATEQYGVVSTVTANTEQGNNEQGTESGND

SEQ ID NO: 184161 - protein, 38 aa, Artificial Sequence
  Description of Artificial Sequence: Synthetic polypeptide
DDEEIRTTNPVATEQYGSVYGQGLGDGEFGNGGQEEFV

SEQ ID NO: 184162 - protein, 38 aa, Artificial Sequence
  Description of Artificial Sequence: Synthetic polypeptide
DDEEIRTTNPVATEQYGSVYGQGLGDGEFGNGGNEETQ

SEQ ID NO: 184163 - protein, 38 aa, Artificial Sequence
  Description of Artificial Sequence: Synthetic polypeptide
DDEEIRTTNPVATEQYGSVYGQGLGDDEFGNLGQEEQS

SEQ ID NO: 184164 - protein, 38 aa, Artificial Sequence
  Description of Artificial Sequence: Synthetic polypeptide
DDEEIRTTNPVATEQYGSVYGQGLGDDEFGNGGQEMTL

SEQ ID NO: 184165 - protein, 38 aa, Artificial Sequence
  Description of Artificial Sequence: Synthetic polypeptide
DDEEIRTTNPVATEQYGSVYGQGLGDDEFGNGGDEETP

SEQ ID NO: 184166 - protein, 38 aa, Artificial Sequence
  Description of Artificial Sequence: Synthetic polypeptide
DDEEIRTTNPVATEQYGSVYGQGLGDDEEGNGGQQEQA

SEQ ID NO: 184167 - protein, 38 aa, Artificial Sequence
  Description of Artificial Sequence: Synthetic polypeptide
DDEEIRTTNPVATEQYGSVYGQEQGDDEFGNGGDEETA

SEQ ID NO: 184168 - protein, 37 aa, Artificial Sequence
  Description of Artificial Sequence: Synthetic polypeptide
DDEEIRTTNPVATEQYGSVWSYAMGDEAHQSTQLEEG

SEQ ID NO: 184169 - protein, 38 aa, Artificial Sequence
  Description of Artificial Sequence: Synthetic polypeptide
DDEEIRTTNPVATEQYGSVVYDIMQNGEGTTTNNTGDG

SEQ ID NO: 184170 - protein, 38 aa, Artificial Sequence
  Description of Artificial Sequence: Synthetic polypeptide
DDEEIRTTNPVATEQYGSVVYDIMNNGEGTTNNTGDDG

SEQ ID NO: 184171 - protein, 36 aa, Artificial Sequence
  Description of Artificial Sequence: Synthetic polypeptide
SEEAISTTNPVATEAYGSIVPWTYLVTISGSNESQD

SEQ ID NO: 184172 - protein, 34 aa, Artificial Sequence
  Description of Artificial Sequence: Synthetic polypeptide
SEEAEIATTNPVAYEGWGSVAHGDQQDQDGNNQH

SEQ ID NO: 184173 - protein, 38 aa, Artificial Sequence
  Description of Artificial Sequence: Synthetic polypeptide
DEEEIRCTNPVATEQYGMVSVEGMGDGGQGQENQERTQ

SEQ ID NO: 184174 - protein, 35 aa, Artificial Sequence
  Description of Artificial Sequence: Synthetic polypeptide
SEDEIRTTNPVAYEQWGCVAITGDDHQQAGNGGTD

SEQ ID NO: 184175 - protein, 34 aa, Artificial Sequence
  Description of Artificial Sequence: Synthetic polypeptide
SEDEIRTTNPVAYEEWGSVAYEGGNHQPQGGDDS

SEQ ID NO: 184176 - protein, 36 aa, Artificial Sequence
  Description of Artificial Sequence: Synthetic polypeptide
DEAEIATTNPVATCQYGQCVCSTGAHNQNFGSDTQS

SEQ ID NO: 184177 - protein, 37 aa, Artificial Sequence
  Description of Artificial Sequence: Synthetic polypeptide
SEDEIRTTNPVATENYGCVVCMDNGDMQRGTQGDNNK

SEQ ID NO: 184178 - protein, 36 aa, Artificial Sequence
  Description of Artificial Sequence: Synthetic polypeptide
SEDEIRTTNPVATECYGCVCTIDSNNHNGQQGGHDA

SEQ ID NO: 184179 - protein, 36 aa, Artificial Sequence
  Description of Artificial Sequence: Synthetic polypeptide
DEAEIATTNPVATECWGVVSWVNNLEMADNGQKGEH

SEQ ID NO: 184180 - protein, 40 aa, Artificial Sequence
  Description of Artificial Sequence: Synthetic polypeptide
DEETIRTTNPVATEQYGVVSTVTNNSEAGNNQQGTESGNQ

SEQ ID NO: 184181 - protein, 33 aa, Artificial Sequence
  Description of Artificial Sequence: Synthetic polypeptide
VEDEIACTNPVATEQWGGCVAGTAMLQHQDDAP

SEQ ID NO: 184182 - protein, 38 aa, Artificial Sequence
  Description of Artificial Sequence: Synthetic polypeptide
DEEEISTTNPVATEQYGQCVCSTWEEHNQEGFGSDPQS

SEQ ID NO: 184183 - protein, 37 aa, Artificial Sequence
  Description of Artificial Sequence: Synthetic polypeptide
DEEEISTTNPVATEQYGQCVCSTWEEHNANFISEFQS

SEQ ID NO: 184184 - protein, 39 aa, Artificial Sequence
  Description of Artificial Sequence: Synthetic polypeptide
DEEEIRTTNPVATEAYGTVSTNGNSDNIGTTEISTTGNT

SEQ ID NO: 184185 - protein, 37 aa, Artificial Sequence
  Description of Artificial Sequence: Synthetic polypeptide
DEEEISTTNPVATEQYGCVCSMWGEHNAENFGSDTQS

SEQ ID NO: 184186 - protein, 37 aa, Artificial Sequence
  Description of Artificial Sequence: Synthetic polypeptide
DEEEISTTNPVATEQYGCVCSMWGEHNAENFNSDNQL

SEQ ID NO: 184187 - protein, 37 aa, Artificial Sequence
  Description of Artificial Sequence: Synthetic polypeptide
DEEEISTTNPVATEQYGCVCSMWGEHNAENFSSENQS

SEQ ID NO: 184188 - protein, 36 aa, Artificial Sequence
  Description of Artificial Sequence: Synthetic polypeptide
DEEEISTTNPVATEQYGCVCSMWGEHNAYFNSETQS

SEQ ID NO: 184189 - protein, 37 aa, Artificial Sequence
  Description of Artificial Sequence: Synthetic polypeptide
DEEEISTTNPVATEQYGCVCSMWGEHNIENFNSDNQA

SEQ ID NO: 184190 - protein, 37 aa, Artificial Sequence
  Description of Artificial Sequence: Synthetic polypeptide
DEEEISTTNPVATEQYGCVCSMWGEHNQENFGSDTQS

SEQ ID NO: 184191 - protein, 36 aa, Artificial Sequence
  Description of Artificial Sequence: Synthetic polypeptide
DEEEISTTNPVATEQYGCVCSMWGEHNQENFSSDQS

SEQ ID NO: 184192 - protein, 39 aa, Artificial Sequence
  Description of Artificial Sequence: Synthetic polypeptide
DEEEIRTTNPVATEAYGTVSTNGNSDTIGTTSISTEGNT

SEQ ID NO: 184193 - protein, 37 aa, Artificial Sequence
  Description of Artificial Sequence: Synthetic polypeptide
DEEEISTTNPVATEQYGCVCSMWGEHNQEYFNSDNQS

SEQ ID NO: 184194 - protein, 37 aa, Artificial Sequence
  Description of Artificial Sequence: Synthetic polypeptide
DEEEISTTNPVATEQYGCVCSMWGEPNQENFNSDTQA

SEQ ID NO: 184195 - protein, 38 aa, Artificial Sequence
  Description of Artificial Sequence: Synthetic polypeptide
DEEEISTTNPVATEQYGCVCSMWGESHNQENFGSENQA

SEQ ID NO: 184196 - protein, 39 aa, Artificial Sequence
  Description of Artificial Sequence: Synthetic polypeptide
AEEEICTTNPVATEQYGVVSVTNSLEQGTEQGSTTDQDD

SEQ ID NO: 184197 - protein, 36 aa, Artificial Sequence
  Description of Artificial Sequence: Synthetic polypeptide
DDECIRTTNPVATEQYGQCVCSWGEHNQNFNSDTLA

SEQ ID NO: 184198 - protein, 37 aa, Artificial Sequence
  Description of Artificial Sequence: Synthetic polypeptide
DEEEISTTNPVATEQYGCVCSNSEDHNQEFFGSDTQA

SEQ ID NO: 184199 - protein, 37 aa, Artificial Sequence
  Description of Artificial Sequence: Synthetic polypeptide
DEEEISTTNPVATEQYGCVCSNSEEHNAESFNSDTQS

SEQ ID NO: 184200 - protein, 40 aa, Artificial Sequence
  Description of Artificial Sequence: Synthetic polypeptide
DEEEIRTTNPVATEAYGTVSTNGNNDNQIGTTSISTTGNT

SEQ ID NO: 184201 - protein, 37 aa, Artificial Sequence
  Description of Artificial Sequence: Synthetic polypeptide
DEEEISTTNPVATEQYGCVCSNSEEHNQEGFGSETQF

SEQ ID NO: 184202 - protein, 38 aa, Artificial Sequence
  Description of Artificial Sequence: Synthetic polypeptide
AEEEICTTNPVATEQYGVVSTVNNQQGEQQIGTEDEQE

SEQ ID NO: 184203 - protein, 37 aa, Artificial Sequence
  Description of Artificial Sequence: Synthetic polypeptide
DEEEISTTNPVATEQYGCVCSMWGEDHNQNFNSDNQA

SEQ ID NO: 184204 - protein, 37 aa, Artificial Sequence
  Description of Artificial Sequence: Synthetic polypeptide
TEEEIRTTNPVATEQYGSVYLPFLELQQPVISSEQVL

SEQ ID NO: 184205 - protein, 38 aa, Artificial Sequence
  Description of Artificial Sequence: Synthetic polypeptide
TEEEIRTTNPVATEQYGSYVQEPSFSTQSGIVHQFEPL

SEQ ID NO: 184206 - protein, 37 aa, Artificial Sequence
  Description of Artificial Sequence: Synthetic polypeptide
DEEEISTTNPVATEQYGCVCSMTGEDHNTENFISDQS

SEQ ID NO: 184207 - protein, 37 aa, Artificial Sequence
  Description of Artificial Sequence: Synthetic polypeptide
AEEEICTTNPVATEQYGVVATVNNQQGEQAGTEDEEY

SEQ ID NO: 184208 - protein, 37 aa, Artificial Sequence
  Description of Artificial Sequence: Synthetic polypeptide
AEEEICTTNPVATEQYGVVATVNNQQGEQQGTTDEDE

SEQ ID NO: 184209 - protein, 37 aa, Artificial Sequence
  Description of Artificial Sequence: Synthetic polypeptide
AEEEICTTNPVATEQYGVVATVNNQQNEQQGTEDEEV

SEQ ID NO: 184210 - protein, 37 aa, Artificial Sequence
  Description of Artificial Sequence: Synthetic polypeptide
AEEEICTTNPVATEQYGVVATVNQQQGEQQGTEDEET

SEQ ID NO: 184211 - protein, 36 aa, Artificial Sequence
  Description of Artificial Sequence: Synthetic polypeptide
TEEEIRTTNPVATESWGAVFWNENDQHERQGGDQED

SEQ ID NO: 184212 - protein, 37 aa, Artificial Sequence
  Description of Artificial Sequence: Synthetic polypeptide
AEEEICTTNPVATEQYGVVATVNQQQGEQQGTEGEGE

SEQ ID NO: 184213 - protein, 36 aa, Artificial Sequence
  Description of Artificial Sequence: Synthetic polypeptide
AEEEICTTNPVATEQYGVVATVQENVGEQGTEDEEE

SEQ ID NO: 184214 - protein, 36 aa, Artificial Sequence
  Description of Artificial Sequence: Synthetic polypeptide
AEEEICTTNPVATEQYGVVATVTENVGEQGTEDEET

SEQ ID NO: 184215 - protein, 37 aa, Artificial Sequence
  Description of Artificial Sequence: Synthetic polypeptide
DEEEISTTNPVATEQYGCVCSMWEEDHNQENFGSEQA

SEQ ID NO: 184216 - protein, 37 aa, Artificial Sequence
  Description of Artificial Sequence: Synthetic polypeptide
DEEEISTTNPVATEQYGCVCSMWEEDNAENFNSETQA

SEQ ID NO: 184217 - protein, 39 aa, Artificial Sequence
  Description of Artificial Sequence: Synthetic polypeptide
DEEEIRTTNPVATEAYGTVSTQYGNSESGTTSIQTTNNT

SEQ ID NO: 184218 - protein, 39 aa, Artificial Sequence
  Description of Artificial Sequence: Synthetic polypeptide
DEEEIRTTNPVATEAYGTVSTQAGNSESGTTSISTTGNT

SEQ ID NO: 184219 - protein, 36 aa, Artificial Sequence
  Description of Artificial Sequence: Synthetic polypeptide
AEEEICTTNPVATEQYGVVATVVEQVGEEQEEEEED

SEQ ID NO: 184220 - protein, 36 aa, Artificial Sequence
  Description of Artificial Sequence: Synthetic polypeptide
AEEEICTTNPVATEQYGVVATVVNNVTEQGTEDEEE

SEQ ID NO: 184221 - protein, 39 aa, Artificial Sequence
  Description of Artificial Sequence: Synthetic polypeptide
DEEEIRTTNPVATEAYGTVSTNNNSDSIGTTSISTTGNT

SEQ ID NO: 184222 - protein, 39 aa, Artificial Sequence
  Description of Artificial Sequence: Synthetic polypeptide
DEEEIRTTNPVATEAYGTVSTNGNSNSIGTTTISTTGNT

SEQ ID NO: 184223 - protein, 36 aa, Artificial Sequence
  Description of Artificial Sequence: Synthetic polypeptide
AEEEICTTNPVATEQYGVVATVVNVGEQGTEDEEEE

SEQ ID NO: 184224 - protein, 37 aa, Artificial Sequence
  Description of Artificial Sequence: Synthetic polypeptide
TEEEIRTTNPVATEQYGSYVSPDVSKAQIMHVEHPPI

SEQ ID NO: 184225 - protein, 37 aa, Artificial Sequence
  Description of Artificial Sequence: Synthetic polypeptide
DEEEISTTNPVATEQYGCVCSNSEEPNQENFGSEFQG

SEQ ID NO: 184226 - protein, 37 aa, Artificial Sequence
  Description of Artificial Sequence: Synthetic polypeptide
DEEEISTTNPVATEQYGCVCSMSGEHNQEYFNSDTQA

SEQ ID NO: 184227 - protein, 38 aa, Artificial Sequence
  Description of Artificial Sequence: Synthetic polypeptide
DEEEIRTTNPVATEQYGCVCSNWEEDHNAENFNSDNQS

SEQ ID NO: 184228 - protein, 38 aa, Artificial Sequence
  Description of Artificial Sequence: Synthetic polypeptide
DEEEIRTTNPVATEQYGCVCSNWEEDHNEEYFNSDNQA

SEQ ID NO: 184229 - protein, 37 aa, Artificial Sequence
  Description of Artificial Sequence: Synthetic polypeptide
DEEEISTTNPVATEQYGCVCSNSGEHNQEGFGSDTQV

SEQ ID NO: 184230 - protein, 37 aa, Artificial Sequence
  Description of Artificial Sequence: Synthetic polypeptide
DEEEISTTNPVATEQYGCVCSNSGEHNQENFNSDFQS

SEQ ID NO: 184231 - protein, 37 aa, Artificial Sequence
  Description of Artificial Sequence: Synthetic polypeptide
DEEEISTTNPVATEQYGCVCSNSGEHNQENFNSDPQS

SEQ ID NO: 184232 - protein, 37 aa, Artificial Sequence
  Description of Artificial Sequence: Synthetic polypeptide
DEEEISTTNPVATEQYGCVCSNSGEHNQENFNSDTQA

SEQ ID NO: 184233 - protein, 37 aa, Artificial Sequence
  Description of Artificial Sequence: Synthetic polypeptide
DEEEISTTNPVATEQYGCVCSNSGEHNQESFGSDTQS

SEQ ID NO: 184234 - protein, 37 aa, Artificial Sequence
  Description of Artificial Sequence: Synthetic polypeptide
DEEEISTTNPVATEQYGCVCSNSGEHNQESFNSDNQS

SEQ ID NO: 184235 - protein, 37 aa, Artificial Sequence
  Description of Artificial Sequence: Synthetic polypeptide
DEEEISTTNPVATEQYGCVCSNSGEHNQEYFNSDNQS

SEQ ID NO: 184236 - protein, 37 aa, Artificial Sequence
  Description of Artificial Sequence: Synthetic polypeptide
DEEEISTTNPVATEQYGCVCSNSMEHNQENFNSDNQS

SEQ ID NO: 184237 - protein, 37 aa, Artificial Sequence
  Description of Artificial Sequence: Synthetic polypeptide
DEEEISTTNPVATEQYGCVCSNSGEHNQEFFNSDTQA

SEQ ID NO: 184238 - protein, 34 aa, Artificial Sequence
  Description of Artificial Sequence: Synthetic polypeptide
DEEEICCTNPEAYTTAAWGSSATNLQHAGGTEAM

SEQ ID NO: 184239 - protein, 38 aa, Artificial Sequence
  Description of Artificial Sequence: Synthetic polypeptide
DEEEIRTTNPVATEQYGCVCSNWGEAHNQENFNSENQS

SEQ ID NO: 184240 - protein, 38 aa, Artificial Sequence
  Description of Artificial Sequence: Synthetic polypeptide
DEEEIRTTNPVATEQYGCVCSNWGEDDNQENFNSDNQS

SEQ ID NO: 184241 - protein, 38 aa, Artificial Sequence
  Description of Artificial Sequence: Synthetic polypeptide
DEEEIRTTNPVATEQYGSVASVYMMEIEELRIAHPLIN

SEQ ID NO: 184242 - protein, 36 aa, Artificial Sequence
  Description of Artificial Sequence: Synthetic polypeptide
DEEEICTTNPMATETYGSVPTLPDPMQHVSSEAFNG

SEQ ID NO: 184243 - protein, 38 aa, Artificial Sequence
  Description of Artificial Sequence: Synthetic polypeptide
DEEEIRTTNPVATEQYGCVCSNWGEDHETENFISDTQG

SEQ ID NO: 184244 - protein, 38 aa, Artificial Sequence
  Description of Artificial Sequence: Synthetic polypeptide
DEEEIRTTNPVATEQYGCVCSNWGEDHNAEHFNSENQA

SEQ ID NO: 184245 - protein, 38 aa, Artificial Sequence
  Description of Artificial Sequence: Synthetic polypeptide
DEEEIRTTNPVATEQYGCVCSNWGEDHNAENFNSDNQA

SEQ ID NO: 184246 - protein, 38 aa, Artificial Sequence
  Description of Artificial Sequence: Synthetic polypeptide
DEEEIRTTNPVATEQYGCVCSNWGEDHNAENFNSDNQD

SEQ ID NO: 184247 - protein, 38 aa, Artificial Sequence
  Description of Artificial Sequence: Synthetic polypeptide
DEEEICEECTTATNPVATEQYGVVVTVNNEGGTDTNDE

SEQ ID NO: 184248 - protein, 37 aa, Artificial Sequence
  Description of Artificial Sequence: Synthetic polypeptide
DEEEISTTNPVATEQYGCVCSNSGEHNAENSNSDTQS

SEQ ID NO: 184249 - protein, 37 aa, Artificial Sequence
  Description of Artificial Sequence: Synthetic polypeptide
DEEEISTTNPVATEQYGCVCSNSGEHNAEHFNSDNQS

SEQ ID NO: 184250 - protein, 37 aa, Artificial Sequence
  Description of Artificial Sequence: Synthetic polypeptide
DEEEISTTNPVATEQYGCVCSNSGEHNAEGFNSDTQS

SEQ ID NO: 184251 - protein, 38 aa, Artificial Sequence
  Description of Artificial Sequence: Synthetic polypeptide
DEEEIRTTNPVATEQYGCVCSNWEEDHNIENFNSQNQL

SEQ ID NO: 184252 - protein, 36 aa, Artificial Sequence
  Description of Artificial Sequence: Synthetic polypeptide
DEEEISTTNPVATEQYGCVCSNSGEDAENFGSDTQS

SEQ ID NO: 184253 - protein, 40 aa, Artificial Sequence
  Description of Artificial Sequence: Synthetic polypeptide
AEEEICTTNPVATEQYGVVSVVVVTNTNLQQNGTENGEDD

SEQ ID NO: 184254 - protein, 37 aa, Artificial Sequence
  Description of Artificial Sequence: Synthetic polypeptide
DEEEISTTNPVATEQYGCVCSNSGEDHEQNFGSETQN

SEQ ID NO: 184255 - protein, 36 aa, Artificial Sequence
  Description of Artificial Sequence: Synthetic polypeptide
AEEEIGTTNPVATEQYGCVCSWGEDHNQENFGSDQA

SEQ ID NO: 184256 - protein, 38 aa, Artificial Sequence
  Description of Artificial Sequence: Synthetic polypeptide
DEEEIRTTNPVATEQYGCVCSNWEEDHNQENFGSDTQG

SEQ ID NO: 184257 - protein, 38 aa, Artificial Sequence
  Description of Artificial Sequence: Synthetic polypeptide
DEEEIRTTNPVATEQYGCVCSNWEEDHNQENFGSDTQS

SEQ ID NO: 184258 - protein, 38 aa, Artificial Sequence
  Description of Artificial Sequence: Synthetic polypeptide
DEEEISTTNPVATEQYGCVCSNSGEDHNAENFGSENQS

SEQ ID NO: 184259 - protein, 38 aa, Artificial Sequence
  Description of Artificial Sequence: Synthetic polypeptide
DEEEISTTNPVATEQYGCVCSNSGEDHNAESFGSENQD

SEQ ID NO: 184260 - protein, 37 aa, Artificial Sequence
  Description of Artificial Sequence: Synthetic polypeptide
DEEEIRTTNPVATEQYGCVCSNWEEHNQENFISDTQS

SEQ ID NO: 184261 - protein, 37 aa, Artificial Sequence
  Description of Artificial Sequence: Synthetic polypeptide
DEHEIRTTNPVATEAWGISVRTWNDDQQDIRQKEEHV

SEQ ID NO: 184262 - protein, 38 aa, Artificial Sequence
  Description of Artificial Sequence: Synthetic polypeptide
DEEEISTTNPVATEQYGCVCSNSGEDHNQENFGSDNQA

SEQ ID NO: 184263 - protein, 38 aa, Artificial Sequence
  Description of Artificial Sequence: Synthetic polypeptide
DEEEISTTNPVATEQYGCVCSNSGEDHNQENFGSDNQS

SEQ ID NO: 184264 - protein, 37 aa, Artificial Sequence
  Description of Artificial Sequence: Synthetic polypeptide
DEEEISTTNPVATEQYGCVCSNSGEDNAENFNSDNQS

SEQ ID NO: 184265 - protein, 37 aa, Artificial Sequence
  Description of Artificial Sequence: Synthetic polypeptide
DEEEISTTNPVATEQYGCVCSNSGEDNAENFNSETQG

SEQ ID NO: 184266 - protein, 37 aa, Artificial Sequence
  Description of Artificial Sequence: Synthetic polypeptide
DEEEISTTNPVATEQYGCVCSNSGEDNAENFNSETQS

SEQ ID NO: 184267 - protein, 37 aa, Artificial Sequence
  Description of Artificial Sequence: Synthetic polypeptide
DEEEISTTNPVATEQYGCVCSNSGEDNQENFNSQTQS

SEQ ID NO: 184268 - protein, 38 aa, Artificial Sequence
  Description of Artificial Sequence: Synthetic polypeptide
DEEEIRTTNPVATEQYGCVCSNWEEPHNQENFNSDNQS

SEQ ID NO: 184269 - protein, 37 aa, Artificial Sequence
  Description of Artificial Sequence: Synthetic polypeptide
DEEEISTTNPVATEQYGCVCSNSGEHNAEFFNSDNQS

SEQ ID NO: 184270 - protein, 38 aa, Artificial Sequence
  Description of Artificial Sequence: Synthetic polypeptide
DEEEIRTTNPVATEQYGCVCSNWEEDHNAENFNSQNQS

SEQ ID NO: 184271 - protein, 37 aa, Artificial Sequence
  Description of Artificial Sequence: Synthetic polypeptide
DEEEISTTNPVATEQYGCVCSMSGEHNQENFNSDTQS

SEQ ID NO: 184272 - protein, 37 aa, Artificial Sequence
  Description of Artificial Sequence: Synthetic polypeptide
DEEEISTTNPVATEQYGCVCSMSGEHNQENFGSQTQP

SEQ ID NO: 184273 - protein, 37 aa, Artificial Sequence
  Description of Artificial Sequence: Synthetic polypeptide
DEEEISTTNPVATEQYGCVCSMSGEHNAEYFNSDNQA

SEQ ID NO: 184274 - protein, 37 aa, Artificial Sequence
  Description of Artificial Sequence: Synthetic polypeptide
AEEEIATTNPVATEQYGSVCAQAGPLGFATMGDNEGA

SEQ ID NO: 184275 - protein, 36 aa, Artificial Sequence
  Description of Artificial Sequence: Synthetic polypeptide
DEEEISTTNPVATEGYGQCVCSWEHEQENFISENQF

SEQ ID NO: 184276 - protein, 37 aa, Artificial Sequence
  Description of Artificial Sequence: Synthetic polypeptide
DEEEISTTNPVATEGYGQCVCSWGEHDQEGFNSDTQS

SEQ ID NO: 184277 - protein, 36 aa, Artificial Sequence
  Description of Artificial Sequence: Synthetic polypeptide
DEEEISTTNPVATEQWGCVCSWGEHNQENFNSDNQS

SEQ ID NO: 184278 - protein, 35 aa, Artificial Sequence
  Description of Artificial Sequence: Synthetic polypeptide
TEEEISTTNPVATEQYGCVCNWGEHNQYFISDNQA

SEQ ID NO: 184279 - protein, 37 aa, Artificial Sequence
  Description of Artificial Sequence: Synthetic polypeptide
DEEEISTTNPVATEQWGICQVCSYTEDLNANFGSDQA

SEQ ID NO: 184280 - protein, 35 aa, Artificial Sequence
  Description of Artificial Sequence: Synthetic polypeptide
TEEEIRTTNPVSYEQWGSCYTIDNHGQNGGPKDGM

SEQ ID NO: 184281 - protein, 35 aa, Artificial Sequence
  Description of Artificial Sequence: Synthetic polypeptide
TEEEIRTTNPVSYEQWGSCYTIDNHGQNGGGGDGV

SEQ ID NO: 184282 - protein, 37 aa, Artificial Sequence
  Description of Artificial Sequence: Synthetic polypeptide
AEEEIATTNPVATEQYGSTACAMNPEEAPDDQDGTNP

SEQ ID NO: 184283 - protein, 37 aa, Artificial Sequence
  Description of Artificial Sequence: Synthetic polypeptide
DEEEISTTNPVATEQYGCAVCSNWGEDNQENFNSDQS

SEQ ID NO: 184284 - protein, 37 aa, Artificial Sequence
  Description of Artificial Sequence: Synthetic polypeptide
DEEEISTTNPVATEQYGCAVCSWGEHNAENFNSDTQS

SEQ ID NO: 184285 - protein, 37 aa, Artificial Sequence
  Description of Artificial Sequence: Synthetic polypeptide
DEEEISTTNPVATEQYGCIVCSMTGEHNTNFNSETQS

SEQ ID NO: 184286 - protein, 37 aa, Artificial Sequence
  Description of Artificial Sequence: Synthetic polypeptide
DEEEISTTNPVATEQYGCIVCSNWGEHNAENFNSEQS

SEQ ID NO: 184287 - protein, 38 aa, Artificial Sequence
  Description of Artificial Sequence: Synthetic polypeptide
DEEEIRTTNPVATEQYGCVCSNTGEDHNQEFFISDTQS

SEQ ID NO: 184288 - protein, 38 aa, Artificial Sequence
  Description of Artificial Sequence: Synthetic polypeptide
DEEEIRTTNPVATEQYGCVCSNTGEDHNQENFPSDTQS

SEQ ID NO: 184289 - protein, 37 aa, Artificial Sequence
  Description of Artificial Sequence: Synthetic polypeptide
DEEEISTTNPVATEQYGCQVCSSGEHNQENFNSETQS

SEQ ID NO: 184290 - protein, 32 aa, Artificial Sequence
  Description of Artificial Sequence: Synthetic polypeptide
AEEEIATTNPVAYEQWGCNVAGEGLAADPPQG

SEQ ID NO: 184291 - protein, 38 aa, Artificial Sequence
  Description of Artificial Sequence: Synthetic polypeptide
DEEEISTTNPVATEQYGCQVCSWGEDHNQENFGSENQS

SEQ ID NO: 184292 - protein, 37 aa, Artificial Sequence
  Description of Artificial Sequence: Synthetic polypeptide
DEEEISTTNPVATEQYGCAVCSSGEDHDQENFGSDQL

SEQ ID NO: 184293 - protein, 36 aa, Artificial Sequence
  Description of Artificial Sequence: Synthetic polypeptide
AEEEIATTNPVATEQYGQCSCPSGEDNQEHFNSEQG

SEQ ID NO: 184294 - protein, 34 aa, Artificial Sequence
  Description of Artificial Sequence: Synthetic polypeptide
AEEEIATTNPVATEQYGEYCPWGEDNQHFNSEQA

SEQ ID NO: 184295 - protein, 34 aa, Artificial Sequence
  Description of Artificial Sequence: Synthetic polypeptide
AEEEIATTNPVATEQYGCYCPWMEDNQHSNSEQS

SEQ ID NO: 184296 - protein, 36 aa, Artificial Sequence
  Description of Artificial Sequence: Synthetic polypeptide
AEEEIATTNPVATEQYGCSCQNSGEDNAEHFNSEQS

SEQ ID NO: 184297 - protein, 39 aa, Artificial Sequence
  Description of Artificial Sequence: Synthetic polypeptide
DEEEIRTTNPVATEAYGTVTNLQSGTISTNTNNDEVGNV

SEQ ID NO: 184298 - protein, 38 aa, Artificial Sequence
  Description of Artificial Sequence: Synthetic polypeptide
DEEEISTTNPVATEGYGCVCSTWGEDHNQENFGSENQS

SEQ ID NO: 184299 - protein, 40 aa, Artificial Sequence
  Description of Artificial Sequence: Synthetic polypeptide
DEEEIRTTNPVATEAYGTVTNLQSGTISTNNTQNQEEGNV

SEQ ID NO: 184300 - protein, 36 aa, Artificial Sequence
  Description of Artificial Sequence: Synthetic polypeptide
DEEEISTTNPVATEGYGCVCSWEEHNQENFNSDTQS

SEQ ID NO: 184301 - protein, 37 aa, Artificial Sequence
  Description of Artificial Sequence: Synthetic polypeptide
AEEEIATTNPVATEQYGCVCSMWGEHNAEGFGSDNQA

SEQ ID NO: 184302 - protein, 37 aa, Artificial Sequence
  Description of Artificial Sequence: Synthetic polypeptide
DEEEISTTNPVATEGYGCVCSWGEDHNEENFGSDNQS

SEQ ID NO: 184303 - protein, 35 aa, Artificial Sequence
  Description of Artificial Sequence: Synthetic polypeptide
DEEEISTTNPVATEGYGCVCSWGEHAENFNSDTQS

SEQ ID NO: 184304 - protein, 36 aa, Artificial Sequence
  Description of Artificial Sequence: Synthetic polypeptide
DEEEISTTNPVATEGYGCVCSWGEHNAENFNSDNQS

SEQ ID NO: 184305 - protein, 36 aa, Artificial Sequence
  Description of Artificial Sequence: Synthetic polypeptide
DEEEISTTNPVATEGYGCVCSWGEHNQEFFNSDNQA

SEQ ID NO: 184306 - protein, 33 aa, Artificial Sequence
  Description of Artificial Sequence: Synthetic polypeptide
TEEPIASVNPVCYEPYGVTVSINLSQSSGGNNQ

SEQ ID NO: 184307 - protein, 36 aa, Artificial Sequence
  Description of Artificial Sequence: Synthetic polypeptide
DEEEISTTNPVATEGYGCVCSWGEHNQENFNSDFQE

SEQ ID NO: 184308 - protein, 35 aa, Artificial Sequence
  Description of Artificial Sequence: Synthetic polypeptide
AEEEIATTNPVATEQYGCYCPNWEDNQHFNSDTQA

SEQ ID NO: 184309 - protein, 34 aa, Artificial Sequence
  Description of Artificial Sequence: Synthetic polypeptide
AEEEIATTNPVATEQYGCYCPWEDNQHFNSENQN

SEQ ID NO: 184310 - protein, 37 aa, Artificial Sequence
  Description of Artificial Sequence: Synthetic polypeptide
DEEEISTTNPVATEGYGCVTSTWGEHNAENFGSDPQA

SEQ ID NO: 184311 - protein, 38 aa, Artificial Sequence
  Description of Artificial Sequence: Synthetic polypeptide
TEEMEIRRSTNPVAYEQYGEVVVSCTNMLSSRTGGTSE

SEQ ID NO: 184312 - protein, 33 aa, Artificial Sequence
  Description of Artificial Sequence: Synthetic polypeptide
AEEEIATTNPVATEQYGCYCPWEDNTHFNSEQA

SEQ ID NO: 184313 - protein, 33 aa, Artificial Sequence
  Description of Artificial Sequence: Synthetic polypeptide
AEEEIATTNPVATEQYGCYCPWEEDNQHNSEQA

SEQ ID NO: 184314 - protein, 36 aa, Artificial Sequence
  Description of Artificial Sequence: Synthetic polypeptide
TEEHIRTTNPVCYEPYGVVVSCDPNHSQNRQGGGND

SEQ ID NO: 184315 - protein, 33 aa, Artificial Sequence
  Description of Artificial Sequence: Synthetic polypeptide
DDSEVACTNPVSTEGYGNVCYNTDQQSRDGDGR

SEQ ID NO: 184316 - protein, 33 aa, Artificial Sequence
  Description of Artificial Sequence: Synthetic polypeptide
AEEEIATTNPVAYEQYGEAWCEVEISQHAEGEK

SEQ ID NO: 184317 - protein, 36 aa, Artificial Sequence
  Description of Artificial Sequence: Synthetic polypeptide
DEEEISTTNPVATEQYGCTCSMWEEDNQEYINSDQA

SEQ ID NO: 184318 - protein, 36 aa, Artificial Sequence
  Description of Artificial Sequence: Synthetic polypeptide
DEEEISTTNPVATEQYGCTCSMWEEHNQYIGSETQS

SEQ ID NO: 184319 - protein, 36 aa, Artificial Sequence
  Description of Artificial Sequence: Synthetic polypeptide
AEEEICTTNPVATEQYGVVATVEQQGAEQGTEDETE

SEQ ID NO: 184320 - protein, 36 aa, Artificial Sequence
  Description of Artificial Sequence: Synthetic polypeptide
AEEEICTTNPVATEQYGVVATVEQQGEQQGTEDEDE

SEQ ID NO: 184321 - protein, 36 aa, Artificial Sequence
  Description of Artificial Sequence: Synthetic polypeptide
DEEEISTTNPVATEQYGCVCPNWGEHNAENFNSDQS

SEQ ID NO: 184322 - protein, 37 aa, Artificial Sequence
  Description of Artificial Sequence: Synthetic polypeptide
DEEEISTTNPVATEQYGCVCQNSGEHNAENFNSDNQA

SEQ ID NO: 184323 - protein, 34 aa, Artificial Sequence
  Description of Artificial Sequence: Synthetic polypeptide
DEAAIRTTNPVASLCWGSVSRWINEPQVTDGEVG

SEQ ID NO: 184324 - protein, 36 aa, Artificial Sequence
  Description of Artificial Sequence: Synthetic polypeptide
DEEEISTTNPVATEQYGCVCQNWEHNAEFFNSENQS

SEQ ID NO: 184325 - protein, 37 aa, Artificial Sequence
  Description of Artificial Sequence: Synthetic polypeptide
DEEEISTTNPVATEQYGCVCQNWGEDHNQENFNSEQP

SEQ ID NO: 184326 - protein, 35 aa, Artificial Sequence
  Description of Artificial Sequence: Synthetic polypeptide
AEEEICTTNPVATEQYGVVATVEVGEEQGTEDEED

SEQ ID NO: 184327 - protein, 37 aa, Artificial Sequence
  Description of Artificial Sequence: Synthetic polypeptide
DEEEISTTNPVATEQYGCVCQNWGEHNQENSNSDNQG

SEQ ID NO: 184328 - protein, 36 aa, Artificial Sequence
  Description of Artificial Sequence: Synthetic polypeptide
DEEEISTTNPVATEQYGCVCQWGEDHNQHFNSENQP

SEQ ID NO: 184329 - protein, 36 aa, Artificial Sequence
  Description of Artificial Sequence: Synthetic polypeptide
DEEEISTTNPVATEQYGCVCQWGEDTQENFNSDTQL

SEQ ID NO: 184330 - protein, 35 aa, Artificial Sequence
  Description of Artificial Sequence: Synthetic polypeptide
DEEEIATTNPVAYERWGVCATNNLDPGDHPNNNDI

SEQ ID NO: 184331 - protein, 35 aa, Artificial Sequence
  Description of Artificial Sequence: Synthetic polypeptide
DEEEIATTNPVAYERWGVCATTNLDPGDHPNGSAE

SEQ ID NO: 184332 - protein, 35 aa, Artificial Sequence
  Description of Artificial Sequence: Synthetic polypeptide
DEEEIATTNPVAYESWGCVCTIDSNMDRNDQNKEE

SEQ ID NO: 184333 - protein, 37 aa, Artificial Sequence
  Description of Artificial Sequence: Synthetic polypeptide
DEEEISTTNPVATEQYGCVCSDWGEDHNQNFISDNQS

SEQ ID NO: 184334 - protein, 38 aa, Artificial Sequence
  Description of Artificial Sequence: Synthetic polypeptide
AEEEICTTNPVATEQYGVVATVNLQQGEQQIGTEDEEE

SEQ ID NO: 184335 - protein, 37 aa, Artificial Sequence
  Description of Artificial Sequence: Synthetic polypeptide
DEEEISTTNPVATEQYGCVCSDWGEHNQEHFNSETQS

SEQ ID NO: 184336 - protein, 37 aa, Artificial Sequence
  Description of Artificial Sequence: Synthetic polypeptide
DEEEISTTNPVATEQYGCVCSDWGEHNQENFNSDTQA

SEQ ID NO: 184337 - protein, 37 aa, Artificial Sequence
  Description of Artificial Sequence: Synthetic polypeptide
DEEEISTTNPVATEQYGCVCSMSGEHNAENFGSDPQS

SEQ ID NO: 184338 - protein, 36 aa, Artificial Sequence
  Description of Artificial Sequence: Synthetic polypeptide
DEEEISTTNPVATEQYGCVCGWGEHNAENFNSENQS

SEQ ID NO: 184339 - protein, 37 aa, Artificial Sequence
  Description of Artificial Sequence: Synthetic polypeptide
TEEEIRTTNPVATEQYGSVQTTIPTVQAAAPLLPMSY

SEQ ID NO: 184340 - protein, 36 aa, Artificial Sequence
  Description of Artificial Sequence: Synthetic polypeptide
DEEEISTTNPVATEQYGCVCGWGEHNAEHFNSENQA

SEQ ID NO: 184341 - protein, 36 aa, Artificial Sequence
  Description of Artificial Sequence: Synthetic polypeptide
DEEEIATTNPVAYEQYGVTACAANDGEPLGSEGNNH

SEQ ID NO: 184342 - protein, 37 aa, Artificial Sequence
  Description of Artificial Sequence: Synthetic polypeptide
AEEEIATTNPVAYEQYGSTVAPQGNGNQTAMGHNMNQ

SEQ ID NO: 184343 - protein, 31 aa, Artificial Sequence
  Description of Artificial Sequence: Synthetic polypeptide
AEEEIATTNPVAYERWGEAYMVEQSHDEGEG

SEQ ID NO: 184344 - protein, 36 aa, Artificial Sequence
  Description of Artificial Sequence: Synthetic polypeptide
DEEEISTTNPVATEQYGCTCSWNEHNAENFISDNQS

SEQ ID NO: 184345 - protein, 39 aa, Artificial Sequence
  Description of Artificial Sequence: Synthetic polypeptide
AEEEICTTNPVATEQYGSVVVSNNLQQGTEQGSTTQQAD

SEQ ID NO: 184346 - protein, 37 aa, Artificial Sequence
  Description of Artificial Sequence: Synthetic polypeptide
DEEEISTTNPVATEQYGCVCGNSGEHNAENFISDNQS

SEQ ID NO: 184347 - protein, 37 aa, Artificial Sequence
  Description of Artificial Sequence: Synthetic polypeptide
DEEEISTTNPVATEQYGCVCGNTGEDHNAEFFGSEQS

SEQ ID NO: 184348 - protein, 37 aa, Artificial Sequence
  Description of Artificial Sequence: Synthetic polypeptide
DEEEISTTNPVATEQYGCVCGNTGEDHNIENFGSDQA

SEQ ID NO: 184349 - protein, 37 aa, Artificial Sequence
  Description of Artificial Sequence: Synthetic polypeptide
DEEEISTTNPVATEQYGCVCGNWGEHNAEGFNSDNQS

SEQ ID NO: 184350 - protein, 37 aa, Artificial Sequence
  Description of Artificial Sequence: Synthetic polypeptide
DEEEISTTNPVATEQYGCVCGNWGEHNQENFGSDTQA

SEQ ID NO: 184351 - protein, 37 aa, Artificial Sequence
  Description of Artificial Sequence: Synthetic polypeptide
DEEEISTTNPVATEQYGCVCGNWGEHNQENFGSDTQS

SEQ ID NO: 184352 - protein, 36 aa, Artificial Sequence
  Description of Artificial Sequence: Synthetic polypeptide
DEEEISTTNPVATEQYGCVCGNWGEHNQENFISDQD

SEQ ID NO: 184353 - protein, 37 aa, Artificial Sequence
  Description of Artificial Sequence: Synthetic polypeptide
TEEEIRTTNPVAYEQWGSVSGGEPANGPNMRNGGGDQ

SEQ ID NO: 184354 - protein, 37 aa, Artificial Sequence
  Description of Artificial Sequence: Synthetic polypeptide
DEEEISTTNPVATEQYGCVCGNWGEHNQENFNSDNQS

SEQ ID NO: 184355 - protein, 37 aa, Artificial Sequence
  Description of Artificial Sequence: Synthetic polypeptide
DEEEIATTNPVAYEQYGVSTVCAMIEGLGPPRGPSQM

SEQ ID NO: 184356 - protein, 37 aa, Artificial Sequence
  Description of Artificial Sequence: Synthetic polypeptide
DEEEISTTNPVATEQYGCVCGNWGEHNQENFNSDTQS

SEQ ID NO: 184357 - protein, 36 aa, Artificial Sequence
  Description of Artificial Sequence: Synthetic polypeptide
AEEEICTTNPVATEQYGVVATTAEQGAEQGTEEEDE

SEQ ID NO: 184358 - protein, 36 aa, Artificial Sequence
  Description of Artificial Sequence: Synthetic polypeptide
AEEEICTTNPVATEQYGVVATTAEQGAEQYGEVEDE

SEQ ID NO: 184359 - protein, 36 aa, Artificial Sequence
  Description of Artificial Sequence: Synthetic polypeptide
AEEEICTTNPVATEQYGVVATTDEQGAEQGEEEDET

SEQ ID NO: 184360 - protein, 36 aa, Artificial Sequence
  Description of Artificial Sequence: Synthetic polypeptide
DEEEISTTNPVATEQYGCVCGWEEHNAENFNSDNQA

SEQ ID NO: 184361 - protein, 36 aa, Artificial Sequence
  Description of Artificial Sequence: Synthetic polypeptide
DEEEISTTNPVATEQYGCVCGWGEDNQENFNSENQA

SEQ ID NO: 184362 - protein, 34 aa, Artificial Sequence
  Description of Artificial Sequence: Synthetic polypeptide
TEEVIATTNPVATQEYGIICCCNELSTRPGGNNV

SEQ ID NO: 184363 - protein, 38 aa, Artificial Sequence
  Description of Artificial Sequence: Synthetic polypeptide
DEEEIRTTNPVATEQYGCVCSNWGEDHNAENFNSDNQQ

SEQ ID NO: 184364 - protein, 38 aa, Artificial Sequence
  Description of Artificial Sequence: Synthetic polypeptide
DEEEIRTTNPVATEQYGCVCSNWGEDHNAENFNSDTQS

SEQ ID NO: 184365 - protein, 37 aa, Artificial Sequence
  Description of Artificial Sequence: Synthetic polypeptide
DEEEISTTNPVATEQYGCVCSNWEEWHNAENFNSDQG

SEQ ID NO: 184366 - protein, 36 aa, Artificial Sequence
  Description of Artificial Sequence: Synthetic polypeptide
DEEEISTTNPVATEQYGCVCSNWEHNQENFISDTQE

SEQ ID NO: 184367 - protein, 37 aa, Artificial Sequence
  Description of Artificial Sequence: Synthetic polypeptide
TEEEIRTTNPVATEGYGMVNGQGTNQGEMGGNEQFGD

SEQ ID NO: 184368 - protein, 37 aa, Artificial Sequence
  Description of Artificial Sequence: Synthetic polypeptide
DEEEIRTTNPVATEQYGCVCSNWMEDHNANFISQTQS

SEQ ID NO: 184369 - protein, 37 aa, Artificial Sequence
  Description of Artificial Sequence: Synthetic polypeptide
DEEEISTTNPVATEQYGCVCSNWGAHNQENFNSQNQA

SEQ ID NO: 184370 - protein, 37 aa, Artificial Sequence
  Description of Artificial Sequence: Synthetic polypeptide
DEEEISTTNPVATEQYGCVCSNWGEDDNEENFGSDQS

SEQ ID NO: 184371 - protein, 35 aa, Artificial Sequence
  Description of Artificial Sequence: Synthetic polypeptide
DEHEIRTTNPCVYECWGSVATPNGNQQLEGDHGQR

SEQ ID NO: 184372 - protein, 38 aa, Artificial Sequence
  Description of Artificial Sequence: Synthetic polypeptide
DEEEISTTNPVATEQYGCVCSNWGEDDNQEGFNSDFQS

SEQ ID NO: 184373 - protein, 37 aa, Artificial Sequence
  Description of Artificial Sequence: Synthetic polypeptide
DEEEISTTNPVATEQYGCVCSNWEEHNQEYFNSDNQL

SEQ ID NO: 184374 - protein, 37 aa, Artificial Sequence
  Description of Artificial Sequence: Synthetic polypeptide
DEEEISTTNPVATEQYGCVCSNWGEDDNQENFNSQQS

SEQ ID NO: 184375 - protein, 37 aa, Artificial Sequence
  Description of Artificial Sequence: Synthetic polypeptide
DEEEISTTNPVATEQYGCVCSNWGEDDQENFISDNQS

SEQ ID NO: 184376 - protein, 37 aa, Artificial Sequence
  Description of Artificial Sequence: Synthetic polypeptide
DEEEISTTNPVATEQYGCVCSNWGEDDQENFNSENQP

SEQ ID NO: 184377 - protein, 37 aa, Artificial Sequence
  Description of Artificial Sequence: Synthetic polypeptide
DEEEISTTNPVATEQYGCVCSNWGEDEQENFNSDTQS

SEQ ID NO: 184378 - protein, 37 aa, Artificial Sequence
  Description of Artificial Sequence: Synthetic polypeptide
DEEEISTTNPVATEQYGCVCSNWGEDHDQGFISDNQA

SEQ ID NO: 184379 - protein, 38 aa, Artificial Sequence
  Description of Artificial Sequence: Synthetic polypeptide
DEEEISTTNPVATEQYGCVCSNWGEDHNAEHFGSENQS

SEQ ID NO: 184380 - protein, 37 aa, Artificial Sequence
  Description of Artificial Sequence: Synthetic polypeptide
DEEEISTTNPVATEQYGCVCSNWGEDHNAEHFNSDQD

SEQ ID NO: 184381 - protein, 38 aa, Artificial Sequence
  Description of Artificial Sequence: Synthetic polypeptide
DEEEISTTNPVATEQYGCVCSNWGEDHNAENFGSDNQA

SEQ ID NO: 184382 - protein, 38 aa, Artificial Sequence
  Description of Artificial Sequence: Synthetic polypeptide
DEEEISTTNPVATEQYGCVCSNWGEDHNAENFGSDNQP

SEQ ID NO: 184383 - protein, 37 aa, Artificial Sequence
  Description of Artificial Sequence: Synthetic polypeptide
DEEEISTTNPVATEQYGCVCSNWGEDDNQNFNSQNQS

SEQ ID NO: 184384 - protein, 37 aa, Artificial Sequence
  Description of Artificial Sequence: Synthetic polypeptide
DEEEISTTNPVATEQYGCVCSNWEEHNQEYFGSETQS

SEQ ID NO: 184385 - protein, 37 aa, Artificial Sequence
  Description of Artificial Sequence: Synthetic polypeptide
DEEEISTTNPVATEQYGCVCSNWEEHNQESFGSDTQA

SEQ ID NO: 184386 - protein, 37 aa, Artificial Sequence
  Description of Artificial Sequence: Synthetic polypeptide
DEEEISTTNPVATEQYGCVCSNWEEHNQENFQSDTQA

SEQ ID NO: 184387 - protein, 37 aa, Artificial Sequence
  Description of Artificial Sequence: Synthetic polypeptide
DEEEISTTNPVATEQYGCVCSNWEDHNQENFISENQS

SEQ ID NO: 184388 - protein, 37 aa, Artificial Sequence
  Description of Artificial Sequence: Synthetic polypeptide
DEEEISTTNPVATEQYGCVCSNWEEDHNQENFGSQQD

SEQ ID NO: 184389 - protein, 37 aa, Artificial Sequence
  Description of Artificial Sequence: Synthetic polypeptide
DEEEISTTNPVATEQYGCVCSNWEEDHNQNFNSDTQS

SEQ ID NO: 184390 - protein, 38 aa, Artificial Sequence
  Description of Artificial Sequence: Synthetic polypeptide
DEEEISTTNPVATEQYGCVCSNWEEDHNTENFPSENQL

SEQ ID NO: 184391 - protein, 37 aa, Artificial Sequence
  Description of Artificial Sequence: Synthetic polypeptide
DEEEISTTNPVATEQYGCVCSNWEEDNAENFNSETQA

SEQ ID NO: 184392 - protein, 37 aa, Artificial Sequence
  Description of Artificial Sequence: Synthetic polypeptide
DEEEISTTNPVATEQYGCVCSNWEEDNIENFNSEFQG

SEQ ID NO: 184393 - protein, 37 aa, Artificial Sequence
  Description of Artificial Sequence: Synthetic polypeptide
DEEEISTTNPVATEQYGCVCSNWEEDPQEGFGSDTQA

SEQ ID NO: 184394 - protein, 37 aa, Artificial Sequence
  Description of Artificial Sequence: Synthetic polypeptide
DEEEISTTNPVATEQYGCVCSNWEEHNAEGFNSDTQN

SEQ ID NO: 184395 - protein, 37 aa, Artificial Sequence
  Description of Artificial Sequence: Synthetic polypeptide
DEEEISTTNPVATEQYGCVCSNWEEHNAEGFNSDTQS

SEQ ID NO: 184396 - protein, 36 aa, Artificial Sequence
  Description of Artificial Sequence: Synthetic polypeptide
DEEEISTTNPVATEQYGCVCSNWEEHNAENFFSEQA

SEQ ID NO: 184397 - protein, 37 aa, Artificial Sequence
  Description of Artificial Sequence: Synthetic polypeptide
DEEEISTTNPVATEQYGCVCSNWEEHNAENFGSDTQA

SEQ ID NO: 184398 - protein, 37 aa, Artificial Sequence
  Description of Artificial Sequence: Synthetic polypeptide
DEEEISTTNPVATEQYGCVCSNWEEHNAENFNSDTQA

SEQ ID NO: 184399 - protein, 37 aa, Artificial Sequence
  Description of Artificial Sequence: Synthetic polypeptide
DEEEISTTNPVATEQYGCVCSNWEEHNAENFNSENQA

SEQ ID NO: 184400 - protein, 37 aa, Artificial Sequence
  Description of Artificial Sequence: Synthetic polypeptide
DEEEISTTNPVATEQYGCVCSNWEEHNAENFNSETQF

SEQ ID NO: 184401 - protein, 37 aa, Artificial Sequence
  Description of Artificial Sequence: Synthetic polypeptide
DEEEISTTNPVATEQYGCVCSNWEEHNQEHFNSDTQG

SEQ ID NO: 184402 - protein, 37 aa, Artificial Sequence
  Description of Artificial Sequence: Synthetic polypeptide
DEEEISTTNPVATEQYGCVCSNWEEHNQENFGSDTQN

SEQ ID NO: 184403 - protein, 37 aa, Artificial Sequence
  Description of Artificial Sequence: Synthetic polypeptide
DEEEISTTNPVATEQYGCVCSNWEEHNQENFGSDTQS

SEQ ID NO: 184404 - protein, 37 aa, Artificial Sequence
  Description of Artificial Sequence: Synthetic polypeptide
DEEEISTTNPVATEQYGCVCSNWEEHNQENFISQNQS

SEQ ID NO: 184405 - protein, 37 aa, Artificial Sequence
  Description of Artificial Sequence: Synthetic polypeptide
DEEEISTTNPVATEQYGCVCSNWEEHNQENFNSENQS

SEQ ID NO: 184406 - protein, 38 aa, Artificial Sequence
  Description of Artificial Sequence: Synthetic polypeptide
DEEEISTTNPVATEQYGCVCSNWGEDHNAENFGSDNQT

SEQ ID NO: 184407 - protein, 37 aa, Artificial Sequence
  Description of Artificial Sequence: Synthetic polypeptide
DEEEISTTNPVATEQYGCVCSNWEDHNQENFGSDTQS

SEQ ID NO: 184408 - protein, 38 aa, Artificial Sequence
  Description of Artificial Sequence: Synthetic polypeptide
DEEEISTTNPVATEQYGCVCSNWGEDHNAENFGSQNQS

SEQ ID NO: 184409 - protein, 39 aa, Artificial Sequence
  Description of Artificial Sequence: Synthetic polypeptide
DEEEIRTTNPVATEAYGTVSTNGNGDEIGTTTISTTGNT

SEQ ID NO: 184410 - protein, 36 aa, Artificial Sequence
  Description of Artificial Sequence: Synthetic polypeptide
DEEEISTTNPVATEQYGCVCSNWGEHAEHFGSDTQA

SEQ ID NO: 184411 - protein, 36 aa, Artificial Sequence
  Description of Artificial Sequence: Synthetic polypeptide
DEEEISTTNPVATEQYGCVCSNWGEHAENFGSQFQG

SEQ ID NO: 184412 - protein, 37 aa, Artificial Sequence
  Description of Artificial Sequence: Synthetic polypeptide
DEEEISTTNPVATEQYGCVCSNWGEHDQEYFGSETQS

SEQ ID NO: 184413 - protein, 35 aa, Artificial Sequence
  Description of Artificial Sequence: Synthetic polypeptide
DEEEISTTNPVATEQYGCVCSNWGEHEEHFISQQN

SEQ ID NO: 184414 - protein, 37 aa, Artificial Sequence
  Description of Artificial Sequence: Synthetic polypeptide
DEEEISTTNPVATEQYGCVCSNWGEHETENFGSDTQQ

SEQ ID NO: 184415 - protein, 39 aa, Artificial Sequence
  Description of Artificial Sequence: Synthetic polypeptide
DEEEIRTTNPVATEAYGTVSTIGNSDEIGTNSISTTGNT

SEQ ID NO: 184416 - protein, 39 aa, Artificial Sequence
  Description of Artificial Sequence: Synthetic polypeptide
DEEEIRTTNPVATEAYGTVSTEGNSDIGTTSISTTNNTE

SEQ ID NO: 184417 - protein, 37 aa, Artificial Sequence
  Description of Artificial Sequence: Synthetic polypeptide
DEEEISTTNPVATEQYGCVCSNWGEHFQENFSSDNQA

SEQ ID NO: 184418 - protein, 37 aa, Artificial Sequence
  Description of Artificial Sequence: Synthetic polypeptide
DEEEISTTNPVATEQYGCVCSNWGEGHNQENFGSEQS

SEQ ID NO: 184419 - protein, 37 aa, Artificial Sequence
  Description of Artificial Sequence: Synthetic polypeptide
DEEEISTTNPVATEQYGCVCSNWGEHNAEGFNSDNQA

SEQ ID NO: 184420 - protein, 37 aa, Artificial Sequence
  Description of Artificial Sequence: Synthetic polypeptide
DEEEISTTNPVATEQYGCVCSNWGEHNAEHFNSDTQL

SEQ ID NO: 184421 - protein, 37 aa, Artificial Sequence
  Description of Artificial Sequence: Synthetic polypeptide
DEEEISTTNPVATEQYGCVCSNWGEHNAEHFNSDTQS

SEQ ID NO: 184422 - protein, 37 aa, Artificial Sequence
  Description of Artificial Sequence: Synthetic polypeptide
DEEEISTTNPVATEQYGCVCSNWGEHNAENFGSDTQA

SEQ ID NO: 184423 - protein, 35 aa, Artificial Sequence
  Description of Artificial Sequence: Synthetic polypeptide
DEHEIRTTNPCAYEQWGSVCGDNNNDRRGQDTGDD

SEQ ID NO: 184424 - protein, 37 aa, Artificial Sequence
  Description of Artificial Sequence: Synthetic polypeptide
DEEEISTTNPVATEQYGCVCSNWGEHNAENFGSDTQS

SEQ ID NO: 184425 - protein, 37 aa, Artificial Sequence
  Description of Artificial Sequence: Synthetic polypeptide
DEEEISTTNPVATEQYGCVCSNWGEHNAENFISDNQA

SEQ ID NO: 184426 - protein, 37 aa, Artificial Sequence
  Description of Artificial Sequence: Synthetic polypeptide
DEEEISTTNPVATEQYGCVCSNWGEHNAENFNSDNQF

SEQ ID NO: 184427 - protein, 37 aa, Artificial Sequence
  Description of Artificial Sequence: Synthetic polypeptide
DEEEISTTNPVATEQYGCVCSNWGEHNAENFNSDNQS

SEQ ID NO: 184428 - protein, 37 aa, Artificial Sequence
  Description of Artificial Sequence: Synthetic polypeptide
DEEEISTTNPVATEQYGCVCSNWGEHNAEHFNSDNQA

SEQ ID NO: 184429 - protein, 37 aa, Artificial Sequence
  Description of Artificial Sequence: Synthetic polypeptide
DEEEISTTNPVATEQYGCVCSNWGEGHNIENFNSDQS

SEQ ID NO: 184430 - protein, 38 aa, Artificial Sequence
  Description of Artificial Sequence: Synthetic polypeptide
DEEEISTTNPVATEQYGCVCSNWGEEHNQEGFNSDTQA

SEQ ID NO: 184431 - protein, 38 aa, Artificial Sequence
  Description of Artificial Sequence: Synthetic polypeptide
DEEEISTTNPVATEQYGCVCSNWGEDTNQENFNSQTQS

SEQ ID NO: 184432 - protein, 39 aa, Artificial Sequence
  Description of Artificial Sequence: Synthetic polypeptide
DEEEIRTTNPVATEAYGTVSTNANSAVIGTTSISTTGNT

SEQ ID NO: 184433 - protein, 36 aa, Artificial Sequence
  Description of Artificial Sequence: Synthetic polypeptide
DEEEISTTNPVATEQYGCVCSNWGEDHNANFNSDQE

SEQ ID NO: 184434 - protein, 36 aa, Artificial Sequence
  Description of Artificial Sequence: Synthetic polypeptide
DEEEISTTNPVATEQYGCVCSNWGEDHNANFNSDQS

SEQ ID NO: 184435 - protein, 37 aa, Artificial Sequence
  Description of Artificial Sequence: Synthetic polypeptide
DEEEIRTTNPVATEQYGCVCSSEEDHNAENFMSDTQS

SEQ ID NO: 184436 - protein, 38 aa, Artificial Sequence
  Description of Artificial Sequence: Synthetic polypeptide
DEEEISTTNPVATEQYGCVCSNWGEDHNEENFGSQNQN

SEQ ID NO: 184437 - protein, 37 aa, Artificial Sequence
  Description of Artificial Sequence: Synthetic polypeptide
DEEEISTTNPVATEQYGCVCSNWGEDHNEHFGSDTQS

SEQ ID NO: 184438 - protein, 38 aa, Artificial Sequence
  Description of Artificial Sequence: Synthetic polypeptide
DEEEISTTNPVATEQYGCVCSNWGEDHNIEFFGSDNQS

SEQ ID NO: 184439 - protein, 37 aa, Artificial Sequence
  Description of Artificial Sequence: Synthetic polypeptide
DEEEISTTNPVATEQYGCVCSNWGEDHNIENFGSDQA

SEQ ID NO: 184440 - protein, 37 aa, Artificial Sequence
  Description of Artificial Sequence: Synthetic polypeptide
DEEEISTTNPVATEQYGCVCSNWGEDHNQEGFGSEQA

SEQ ID NO: 184441 - protein, 38 aa, Artificial Sequence
  Description of Artificial Sequence: Synthetic polypeptide
DEEEISTTNPVATEQYGCVCSNWGEDHNQEHFGSDNQA

SEQ ID NO: 184442 - protein, 37 aa, Artificial Sequence
  Description of Artificial Sequence: Synthetic polypeptide
DEEEISTTNPVATEQYGCVCSNWGEDHNQENFGSDQS

SEQ ID NO: 184443 - protein, 38 aa, Artificial Sequence
  Description of Artificial Sequence: Synthetic polypeptide
TEEEIRTTNPVATDQYGSVNMGNQGDGQTNGGNGLEDQ

SEQ ID NO: 184444 - protein, 36 aa, Artificial Sequence
  Description of Artificial Sequence: Synthetic polypeptide
TEEEIRTTNPMCYEPYGVVVSCDPNHSQNRQGGGNN

SEQ ID NO: 184445 - protein, 38 aa, Artificial Sequence
  Description of Artificial Sequence: Synthetic polypeptide
DEEEISTTNPVATEQYGCVCSNWGEDHNQESFGSDNQS

SEQ ID NO: 184446 - protein, 38 aa, Artificial Sequence
  Description of Artificial Sequence: Synthetic polypeptide
DEEEISTTNPVATEQYGCVCSNWGEDHNQEYFGSDNQS

SEQ ID NO: 184447 - protein, 37 aa, Artificial Sequence
  Description of Artificial Sequence: Synthetic polypeptide
DEEEISTTNPVATEQYGCVCSNWGEDHNQNFGSDTQT

SEQ ID NO: 184448 - protein, 37 aa, Artificial Sequence
  Description of Artificial Sequence: Synthetic polypeptide
DEEEISTTNPVATEQYGCVCSNWGEDNAEGFNSENQA

SEQ ID NO: 184449 - protein, 37 aa, Artificial Sequence
  Description of Artificial Sequence: Synthetic polypeptide
DEEEISTTNPVATEQYGCVCSNWGEDNQENFNSDTQA

SEQ ID NO: 184450 - protein, 36 aa, Artificial Sequence
  Description of Artificial Sequence: Synthetic polypeptide
DEEEISTTNPVATEQYGCVCSNWGEDQENFFSEFQG

SEQ ID NO: 184451 - protein, 39 aa, Artificial Sequence
  Description of Artificial Sequence: Synthetic polypeptide
DEEEIRTTNPVATEAYGTVSTNGNGDVIGTNSISTTGNT

SEQ ID NO: 184452 - protein, 37 aa, Artificial Sequence
  Description of Artificial Sequence: Synthetic polypeptide
DEEEISTTNPVATEQYGCVCSNWEDHNAEFFNSDTQA

SEQ ID NO: 184453 - protein, 37 aa, Artificial Sequence
  Description of Artificial Sequence: Synthetic polypeptide
DEEEISTTNPVATEQYGCVCSNWEDHFAENFGSENQS

SEQ ID NO: 184454 - protein, 37 aa, Artificial Sequence
  Description of Artificial Sequence: Synthetic polypeptide
DEEEISTTNPVATEQYGCVCSNWEDHEQEHFGSDTQD

SEQ ID NO: 184455 - protein, 37 aa, Artificial Sequence
  Description of Artificial Sequence: Synthetic polypeptide
TEEEIRTTNPVATEQYGSVGDFGGNDGQENDDQDEGT

SEQ ID NO: 184456 - protein, 37 aa, Artificial Sequence
  Description of Artificial Sequence: Synthetic polypeptide
DEEEIRTTNPVATEQYGCVCSNWGEDHNQENFISDQS

SEQ ID NO: 184457 - protein, 37 aa, Artificial Sequence
  Description of Artificial Sequence: Synthetic polypeptide
DEEEISTTNPVATEQYGCVCSNTGEHNQENSISEFQG

SEQ ID NO: 184458 - protein, 38 aa, Artificial Sequence
  Description of Artificial Sequence: Synthetic polypeptide
DEEEIRTTNPVATEQYGCVCSNWGEDHNQENFNSDNQA

SEQ ID NO: 184459 - protein, 38 aa, Artificial Sequence
  Description of Artificial Sequence: Synthetic polypeptide
DEEEIRTTNPVATEQYGCVCSNWGEDHNQENFNSDNQD

SEQ ID NO: 184460 - protein, 38 aa, Artificial Sequence
  Description of Artificial Sequence: Synthetic polypeptide
DEEEIRTTNPVATEQYGCVCSNWGEDHNQENFNSDTQS

SEQ ID NO: 184461 - protein, 38 aa, Artificial Sequence
  Description of Artificial Sequence: Synthetic polypeptide
DEEEIRTTNPVATEQYGCVCSNWGEDHNQESFNSDTQS

SEQ ID NO: 184462 - protein, 37 aa, Artificial Sequence
  Description of Artificial Sequence: Synthetic polypeptide
DEEEIRTTNPVATEQYGCVCSNWGEDHNQEYFISDQA

SEQ ID NO: 184463 - protein, 37 aa, Artificial Sequence
  Description of Artificial Sequence: Synthetic polypeptide
DEEEIRTTNPVATEQYGCVCSNWGEDHNQENFISDQG

SEQ ID NO: 184464 - protein, 37 aa, Artificial Sequence
  Description of Artificial Sequence: Synthetic polypeptide
TEEEIRTTNPVATEQYGSVCGNMNEVAIQDEHQLQSQ

SEQ ID NO: 184465 - protein, 36 aa, Artificial Sequence
  Description of Artificial Sequence: Synthetic polypeptide
AEEEIRATNPVATEQYGCVAGNPGPEGPADGGNNHE

SEQ ID NO: 184466 - protein, 35 aa, Artificial Sequence
  Description of Artificial Sequence: Synthetic polypeptide
AEEEIRATNPVATEQYGCVAGNPGPEGPADGSGPD

SEQ ID NO: 184467 - protein, 37 aa, Artificial Sequence
  Description of Artificial Sequence: Synthetic polypeptide
DEEEISTTNPVATEQYGCVCSNTGEHNTESFISDTQS

SEQ ID NO: 184468 - protein, 37 aa, Artificial Sequence
  Description of Artificial Sequence: Synthetic polypeptide
AEEEIRATNPVATEQYGSVCAANNGEEAGTDQGENTM

SEQ ID NO: 184469 - protein, 38 aa, Artificial Sequence
  Description of Artificial Sequence: Synthetic polypeptide
DEEEIRTTNPVATEQYGCVCSNWGEDTEQENFNSETQN

SEQ ID NO: 184470 - protein, 37 aa, Artificial Sequence
  Description of Artificial Sequence: Synthetic polypeptide
DEAAIRTTNPVATEQYGCFCSTWEEHNIENFGSDNQS

SEQ ID NO: 184471 - protein, 37 aa, Artificial Sequence
  Description of Artificial Sequence: Synthetic polypeptide
TEEEIRTTNPVATEQYGSTITHTTLEDHNDEGSDEEQ

SEQ ID NO: 184472 - protein, 39 aa, Artificial Sequence
  Description of Artificial Sequence: Synthetic polypeptide
TEEEIRTTNPVATEQYGSNWVTWSVNDEETNNEPEIQRV

SEQ ID NO: 184473 - protein, 37 aa, Artificial Sequence
  Description of Artificial Sequence: Synthetic polypeptide
TEEEIRTTNPVATEQYGSVCCNTEDMQTEEVLEVEPP

SEQ ID NO: 184474 - protein, 37 aa, Artificial Sequence
  Description of Artificial Sequence: Synthetic polypeptide
DEEEISTTNPVATEQYGCVCSNTGEHNIENFPSDTQP

SEQ ID NO: 184475 - protein, 38 aa, Artificial Sequence
  Description of Artificial Sequence: Synthetic polypeptide
DEEEIRTTNPVATEQYGCVCSNWGEDHNQENFISDNQS

SEQ ID NO: 184476 - protein, 38 aa, Artificial Sequence
  Description of Artificial Sequence: Synthetic polypeptide
DEEEIRTTNPVATEQYGCVCSNWGEDHNQENFISDNQL

SEQ ID NO: 184477 - protein, 38 aa, Artificial Sequence
  Description of Artificial Sequence: Synthetic polypeptide
DEEEIRTTNPVATEQYGCVCSNWGEDHNAENFNSETQA

SEQ ID NO: 184478 - protein, 38 aa, Artificial Sequence
  Description of Artificial Sequence: Synthetic polypeptide
DEEEIRTTNPVATEQYGCVCSNWGEDHNAENFNSETQS

SEQ ID NO: 184479 - protein, 38 aa, Artificial Sequence
  Description of Artificial Sequence: Synthetic polypeptide
DEEEIRTTNPVATEQYGCVCSNWGEDHNEENFISDNQS

SEQ ID NO: 184480 - protein, 38 aa, Artificial Sequence
  Description of Artificial Sequence: Synthetic polypeptide
DEEEIRTTNPVAYEQYGESMVSPSVTLEQTQIVIEPVD

SEQ ID NO: 184481 - protein, 37 aa, Artificial Sequence
  Description of Artificial Sequence: Synthetic polypeptide
TEEEIRTTNPVATEQYGSVPPVAQMVKVEGVEPEQGD

SEQ ID NO: 184482 - protein, 37 aa, Artificial Sequence
  Description of Artificial Sequence: Synthetic polypeptide
DEEEIRTTNPVATEQYGCVCSNWGEDHNESFNSDTQS

SEQ ID NO: 184483 - protein, 38 aa, Artificial Sequence
  Description of Artificial Sequence: Synthetic polypeptide
DEEEIRTTNPVATEQYGCVCSNWGEDHNIENFISENQA

SEQ ID NO: 184484 - protein, 38 aa, Artificial Sequence
  Description of Artificial Sequence: Synthetic polypeptide
DEEEIRTTNPVATEQYGCVCSNWGEDHNIENFNSDNQS

SEQ ID NO: 184485 - protein, 38 aa, Artificial Sequence
  Description of Artificial Sequence: Synthetic polypeptide
DEEEIRTTNPVATEQYGCVCSNWGEDHNIENFNSDTQS

SEQ ID NO: 184486 - protein, 38 aa, Artificial Sequence
  Description of Artificial Sequence: Synthetic polypeptide
DEEEIRTTNPVATEQYGCVCSNWGEDHNIENFNSENQS

SEQ ID NO: 184487 - protein, 38 aa, Artificial Sequence
  Description of Artificial Sequence: Synthetic polypeptide
DEEEISTTNPVATEQYGCVCSNTGEDHNQEYFNSDTQD

SEQ ID NO: 184488 - protein, 35 aa, Artificial Sequence
  Description of Artificial Sequence: Synthetic polypeptide
DEEEICTTNPMATETYGSVPTPDPMQHVSSEAFIV

SEQ ID NO: 184489 - protein, 35 aa, Artificial Sequence
  Description of Artificial Sequence: Synthetic polypeptide
DDECISTTNPVATEQYGCVCSWEHNQEYFNSDTQA

SEQ ID NO: 184490 - protein, 38 aa, Artificial Sequence
  Description of Artificial Sequence: Synthetic polypeptide
TEEEIRTTNPVATEQYGSVNEVSAPQQEQVMTLNPVDF

SEQ ID NO: 184491 - protein, 38 aa, Artificial Sequence
  Description of Artificial Sequence: Synthetic polypeptide
DEEEIRTTNPVATEQYGCVCSNWGEDHNQEHFNSDNQA

SEQ ID NO: 184492 - protein, 38 aa, Artificial Sequence
  Description of Artificial Sequence: Synthetic polypeptide
DEEEIRTTNPVATEQYGCVCSNWGEDHNQEHFNSDTQS

SEQ ID NO: 184493 - protein, 38 aa, Artificial Sequence
  Description of Artificial Sequence: Synthetic polypeptide
DEEEIRTTNPVATEQYGCVCSNWGEDHNQENFGSDTQA

SEQ ID NO: 184494 - protein, 38 aa, Artificial Sequence
  Description of Artificial Sequence: Synthetic polypeptide
DEEEIRTTNPVATEQYGCVCSNWGEDHNQENFGSDTQS

SEQ ID NO: 184495 - protein, 37 aa, Artificial Sequence
  Description of Artificial Sequence: Synthetic polypeptide
AEEEIRATNPCATEQYGVVATVNNQQGNQQIGTNATD

SEQ ID NO: 184496 - protein, 38 aa, Artificial Sequence
  Description of Artificial Sequence: Synthetic polypeptide
TEEEIRTTNPVATEQYGSMCVPETAVMIQEVELQLPIA

SEQ ID NO: 184497 - protein, 38 aa, Artificial Sequence
  Description of Artificial Sequence: Synthetic polypeptide
DEEEISTTNPVATEQYGCVCSNTGESHNQENFGSETQA

SEQ ID NO: 184498 - protein, 38 aa, Artificial Sequence
  Description of Artificial Sequence: Synthetic polypeptide
TEEEIRTTNPVATEQYGSIPEPTLIIDQELAQIEANDI

SEQ ID NO: 184499 - protein, 37 aa, Artificial Sequence
  Description of Artificial Sequence: Synthetic polypeptide
TEEEIRTTNPVATEQYGSCVPETAVMIQEVEHQLPIT

SEQ ID NO: 184500 - protein, 38 aa, Artificial Sequence
  Description of Artificial Sequence: Synthetic polypeptide
AEEEIRTTNPCATEQYGVVSTVVSTQQNATEAGTTDDE

SEQ ID NO: 184501 - protein, 38 aa, Artificial Sequence
  Description of Artificial Sequence: Synthetic polypeptide
TEEEIRTTNPVATEQYGETQPSVVKMSEDPSRQVLENY

SEQ ID NO: 184502 - protein, 38 aa, Artificial Sequence
  Description of Artificial Sequence: Synthetic polypeptide
AEEEIRTTNPCATEQYGVVSTVVSTQQNATEQGTTDEP

SEQ ID NO: 184503 - protein, 38 aa, Artificial Sequence
  Description of Artificial Sequence: Synthetic polypeptide
AEEEIRTTNPCATEQYGVVSTVVVTNNATEQLGTTDQE

SEQ ID NO: 184504 - protein, 37 aa, Artificial Sequence
  Description of Artificial Sequence: Synthetic polypeptide
TEEEIRTTNPVATEQYGCVCQNWGEDNQEYFNSDNQA

SEQ ID NO: 184505 - protein, 36 aa, Artificial Sequence
  Description of Artificial Sequence: Synthetic polypeptide
TEEEIRTTNPVATEQYGCVCNWGEHNQENFSSNNQS

SEQ ID NO: 184506 - protein, 36 aa, Artificial Sequence
  Description of Artificial Sequence: Synthetic polypeptide
DEAAIRTTNPVATEQYGQCFCSWEHNIENFGSDNQS

SEQ ID NO: 184507 - protein, 36 aa, Artificial Sequence
  Description of Artificial Sequence: Synthetic polypeptide
TEEEIRTTNPVATEQYGCVCGWMEHNQENFISDNQA

SEQ ID NO: 184508 - protein, 39 aa, Artificial Sequence
  Description of Artificial Sequence: Synthetic polypeptide
TEEEIRTTNPVATEQYGAVMTGMITNLIQFSEGEMGIGG

SEQ ID NO: 184509 - protein, 39 aa, Artificial Sequence
  Description of Artificial Sequence: Synthetic polypeptide
TEEEIRTTNPVATEQWGYANVSAAMFNELQHQRPGQLQT

SEQ ID NO: 184510 - protein, 37 aa, Artificial Sequence
  Description of Artificial Sequence: Synthetic polypeptide
DEEEIRTTNPVATEQYGCVCSNWGEHNQENFISDTQS

SEQ ID NO: 184511 - protein, 38 aa, Artificial Sequence
  Description of Artificial Sequence: Synthetic polypeptide
AEEEIRTTNPCATEQYGVVVTVTNQQQNATEAGTNDTQ

SEQ ID NO: 184512 - protein, 38 aa, Artificial Sequence
  Description of Artificial Sequence: Synthetic polypeptide
AEEEIRTTNPCATEQYGVVVTVVNQQQNATEAGTNDGD

SEQ ID NO: 184513 - protein, 38 aa, Artificial Sequence
  Description of Artificial Sequence: Synthetic polypeptide
AEEEIRTTNPCATEQYGVVVTVVNQQQNATESGTNQTD

SEQ ID NO: 184514 - protein, 37 aa, Artificial Sequence
  Description of Artificial Sequence: Synthetic polypeptide
DEEEIRTTNPVATEQYGCVCSNWGEHNQENFPSEFQP

SEQ ID NO: 184515 - protein, 37 aa, Artificial Sequence
  Description of Artificial Sequence: Synthetic polypeptide
DEEEIRTTNPVAYEQYGCVCSWGEDHNQENFNSDTQS

SEQ ID NO: 184516 - protein, 37 aa, Artificial Sequence
  Description of Artificial Sequence: Synthetic polypeptide
DEEEIRTTNPVAYEQYGCVCSWGEDHNQENFNSDTQA

SEQ ID NO: 184517 - protein, 37 aa, Artificial Sequence
  Description of Artificial Sequence: Synthetic polypeptide
DEEEIRTTNPVAYEQYGCVCSWGEDHNQENFNSDNQS

SEQ ID NO: 184518 - protein, 37 aa, Artificial Sequence
  Description of Artificial Sequence: Synthetic polypeptide
DEEEISTTNPVATEQYGCVCSNWEDDNQENFNSDNQS

SEQ ID NO: 184519 - protein, 37 aa, Artificial Sequence
  Description of Artificial Sequence: Synthetic polypeptide
TEEEIRTTNPVATEQYGETYPSVNLSEDPIRQVTESI

SEQ ID NO: 184520 - protein, 38 aa, Artificial Sequence
  Description of Artificial Sequence: Synthetic polypeptide
DEEEIRTTNPVATEQYGCVCSNWGEDHNAENFNSDNQS

SEQ ID NO: 184521 - protein, 37 aa, Artificial Sequence
  Description of Artificial Sequence: Synthetic polypeptide
TEEEIRTTNPVATEQYGETYPSVNMSEDPIYQVNETI

SEQ ID NO: 184522 - protein, 38 aa, Artificial Sequence
  Description of Artificial Sequence: Synthetic polypeptide
TEEEIRTTNPVATEQYGETYPSVVLMSSDPIRQVLENI

SEQ ID NO: 184523 - protein, 37 aa, Artificial Sequence
  Description of Artificial Sequence: Synthetic polypeptide
TEEEIRTTNPVATEQYGSCVPETAVMIDEVEEQLPIA

SEQ ID NO: 184524 - protein, 38 aa, Artificial Sequence
  Description of Artificial Sequence: Synthetic polypeptide
TEEEIRTTNPVATEQYGSCVPETAFMIQEVEEGQLPIA

SEQ ID NO: 184525 - protein, 37 aa, Artificial Sequence
  Description of Artificial Sequence: Synthetic polypeptide
TEEEIRTTNPVATEQYGSCIFHTTLEDHNDEGSDEQV

SEQ ID NO: 184526 - protein, 35 aa, Artificial Sequence
  Description of Artificial Sequence: Synthetic polypeptide
DEAAIRTTNPVATEQYGCFCSWGEHNIENFNSNQS

SEQ ID NO: 184527 - protein, 38 aa, Artificial Sequence
  Description of Artificial Sequence: Synthetic polypeptide
AEEEIRTTNPCATEQYGSVVTVVVTNNNATEAGTNDTT

SEQ ID NO: 184528 - protein, 38 aa, Artificial Sequence
  Description of Artificial Sequence: Synthetic polypeptide
TEEEIRTTNPVATEQYGQCVCSMWMEHNQENFGSDNQS

SEQ ID NO: 184529 - protein, 36 aa, Artificial Sequence
  Description of Artificial Sequence: Synthetic polypeptide
TEEEIRTTNPVATEQYGQCVCNWGEHNQYFNSDTQS

SEQ ID NO: 184530 - protein, 38 aa, Artificial Sequence
  Description of Artificial Sequence: Synthetic polypeptide
TEEEIRTTNPVATEQYGMTVIALSPNIEHQCQGMVSFP

SEQ ID NO: 184531 - protein, 38 aa, Artificial Sequence
  Description of Artificial Sequence: Synthetic polypeptide
AEEEIRTTNPCATEQYGVVSTVNQQQNATNEQGSTTLE

SEQ ID NO: 184532 - protein, 38 aa, Artificial Sequence
  Description of Artificial Sequence: Synthetic polypeptide
AEEEIRTTNPCATEQYGVVSTVTNAQQNATEAGTTDQP

SEQ ID NO: 184533 - protein, 38 aa, Artificial Sequence
  Description of Artificial Sequence: Synthetic polypeptide
AEEEIRTTNPCATEQYGVVSTVTNTQQNATEAGTTDTD

SEQ ID NO: 184534 - protein, 38 aa, Artificial Sequence
  Description of Artificial Sequence: Synthetic polypeptide
AEEEIRTTNPCATEQYGVVSTVVNGQQNATEQGTTDQP

SEQ ID NO: 184535 - protein, 38 aa, Artificial Sequence
  Description of Artificial Sequence: Synthetic polypeptide
AEEEIRTTNPCATEQYGVVSTVVNNQQNATEAGTTVTD

SEQ ID NO: 184536 - protein, 39 aa, Artificial Sequence
  Description of Artificial Sequence: Synthetic polypeptide
AEEEIRTTNPCATEQYGVVSTVVNQQQNATEAYGTNNTD

SEQ ID NO: 184537 - protein, 38 aa, Artificial Sequence
  Description of Artificial Sequence: Synthetic polypeptide
AEEEIRTTNPCATEQYGVVSTVVNTQQNATEAGTTDQT

SEQ ID NO: 184538 - protein, 38 aa, Artificial Sequence
  Description of Artificial Sequence: Synthetic polypeptide
AEEEIRTTNPCATEQYGVVSTVVNTQQNATEAGTTQED

SEQ ID NO: 184539 - protein, 38 aa, Artificial Sequence
  Description of Artificial Sequence: Synthetic polypeptide
AEEEIRTTNPCATEQYGVVSTVVNTQQNATEAGTVETD

SEQ ID NO: 184540 - protein, 38 aa, Artificial Sequence
  Description of Artificial Sequence: Synthetic polypeptide
TEEEIRTTNPVATEQYGETYPSWVNMSEDPIGQVLENI

SEQ ID NO: 184541 - protein, 38 aa, Artificial Sequence
  Description of Artificial Sequence: Synthetic polypeptide
TEEEIRTTNPVATEQYGETYPSVVQMSEDPIDQVLENI

SEQ ID NO: 184542 - protein, 38 aa, Artificial Sequence
  Description of Artificial Sequence: Synthetic polypeptide
TEEEIRTTNPVATEQYGETYPSVNMSFDPIRQQVNENI

SEQ ID NO: 184543 - protein, 36 aa, Artificial Sequence
  Description of Artificial Sequence: Synthetic polypeptide
AEEEIATTNPVATEQYGCSCQNSEDNQEHFNSETQA

SEQ ID NO: 184544 - protein, 36 aa, Artificial Sequence
  Description of Artificial Sequence: Synthetic polypeptide
TEEVICTTNPVAYECYGISVPSCYNMSSNPRGGINA

SEQ ID NO: 184545 - protein, 36 aa, Artificial Sequence
  Description of Artificial Sequence: Synthetic polypeptide
DEEEISTTNPVATEGYGCVCSNWGEHTEGFNSDTQA

SEQ ID NO: 184546 - protein, 35 aa, Artificial Sequence
  Description of Artificial Sequence: Synthetic polypeptide
TSEEISTTNPVAWEGWGLTVPSTTNAASQRGGELN

SEQ ID NO: 184547 - protein, 36 aa, Artificial Sequence
  Description of Artificial Sequence: Synthetic polypeptide
DEEEISCTNPVATEQYGCVCSWMEHNDEHFGSDTQA

SEQ ID NO: 184548 - protein, 37 aa, Artificial Sequence
  Description of Artificial Sequence: Synthetic polypeptide
DEEEIRTTNPVATEQYGCVCSMSGEHNQENFISDTQL

SEQ ID NO: 184549 - protein, 37 aa, Artificial Sequence
  Description of Artificial Sequence: Synthetic polypeptide
DEEEISCTNPVATEQYGQCVCSMWEDFQEGFGSDNQA

SEQ ID NO: 184550 - protein, 36 aa, Artificial Sequence
  Description of Artificial Sequence: Synthetic polypeptide
AEEEIACTNPVATEQYGSVCAAGPLGFATMGDNEQG

SEQ ID NO: 184551 - protein, 36 aa, Artificial Sequence
  Description of Artificial Sequence: Synthetic polypeptide
AEEEIACTNPVATEQYGSVCAAGPLGFATMGDNIGF

SEQ ID NO: 184552 - protein, 36 aa, Artificial Sequence
  Description of Artificial Sequence: Synthetic polypeptide
TSEEIRTTNPVATEQYGSIHNTTLEDTNGESDEDQC

SEQ ID NO: 184553 - protein, 34 aa, Artificial Sequence
  Description of Artificial Sequence: Synthetic polypeptide
TSEEIRTTNPTATEHYGVVCCENNMLSMGEGPPE

SEQ ID NO: 184554 - protein, 35 aa, Artificial Sequence
  Description of Artificial Sequence: Synthetic polypeptide
DEEEISCTNPVATEQYGCVCSWGEDNDYFNSQTQS

SEQ ID NO: 184555 - protein, 40 aa, Artificial Sequence
  Description of Artificial Sequence: Synthetic polypeptide
DEEEIRTTNPVATEQYGVVSTVVNNNQQSATNEEGVTTQQ

SEQ ID NO: 184556 - protein, 36 aa, Artificial Sequence
  Description of Artificial Sequence: Synthetic polypeptide
DDAEIRTTNPVATEQYGCVCSWEEDHNAESFGSDQA

SEQ ID NO: 184557 - protein, 35 aa, Artificial Sequence
  Description of Artificial Sequence: Synthetic polypeptide
TSEEIQTTNPVSWEWWGSTVPSTNAASQNRGGQLV

SEQ ID NO: 184558 - protein, 36 aa, Artificial Sequence
  Description of Artificial Sequence: Synthetic polypeptide
TSEEIQTTNPVAWEWWGSTVPSTTNAASQRKGGELN

SEQ ID NO: 184559 - protein, 36 aa, Artificial Sequence
  Description of Artificial Sequence: Synthetic polypeptide
DDAEIRTTNPVATEQYGCVCSWGEDHNQHFGSDTQA

SEQ ID NO: 184560 - protein, 36 aa, Artificial Sequence
  Description of Artificial Sequence: Synthetic polypeptide
TSEEIQTTNPVAWEWWGSTVPSIWNAASQNRGGNLV

SEQ ID NO: 184561 - protein, 35 aa, Artificial Sequence
  Description of Artificial Sequence: Synthetic polypeptide
TSEEIQTTNPVAWEWWGKTLPSTNAASQNRGGNLV

SEQ ID NO: 184562 - protein, 36 aa, Artificial Sequence
  Description of Artificial Sequence: Synthetic polypeptide
TSEEIQTTNPVAWETWGSTVPSPTNAPSIDRGGNAV

SEQ ID NO: 184563 - protein, 35 aa, Artificial Sequence
  Description of Artificial Sequence: Synthetic polypeptide
TSEEIQTTNPVAWEMWGSTVPSTTNANSQMGGELN

SEQ ID NO: 184564 - protein, 37 aa, Artificial Sequence
  Description of Artificial Sequence: Synthetic polypeptide
DDAEIRTTNPVATEQYGCVCSTWGEDHNAESFNSDQS

SEQ ID NO: 184565 - protein, 37 aa, Artificial Sequence
  Description of Artificial Sequence: Synthetic polypeptide
TSEEIVTTNPVAWEMWGSTVPSPTANAASQDRGGNAV

SEQ ID NO: 184566 - protein, 35 aa, Artificial Sequence
  Description of Artificial Sequence: Synthetic polypeptide
TSEQIQTTNPVAWEMWGSTVPSTTNAESQRGGELN

SEQ ID NO: 184567 - protein, 35 aa, Artificial Sequence
  Description of Artificial Sequence: Synthetic polypeptide
TSFEIQTTNPVAWEGWGSTVPSTTNAASQRGGLLN

SEQ ID NO: 184568 - protein, 35 aa, Artificial Sequence
  Description of Artificial Sequence: Synthetic polypeptide
TSGSIQTTNPVATEEWGSVSCVGNSSVRPGGNPRV

SEQ ID NO: 184569 - protein, 35 aa, Artificial Sequence
  Description of Artificial Sequence: Synthetic polypeptide
TSGSIQTTNPVATEEWGSVSCVGNSSTHRPGGNPR

SEQ ID NO: 184570 - protein, 35 aa, Artificial Sequence
  Description of Artificial Sequence: Synthetic polypeptide
TSGSIQTTNPVATEEWGSVSCVGNSSQRPGGLPRD

SEQ ID NO: 184571 - protein, 34 aa, Artificial Sequence
  Description of Artificial Sequence: Synthetic polypeptide
TSGSIQTTNPVATEEWGSVSCVGNSSQGPGGNPQ

SEQ ID NO: 184572 - protein, 35 aa, Artificial Sequence
  Description of Artificial Sequence: Synthetic polypeptide
TSGSIQTTNPVATEEWGSVSCVGNMSSQFPGGNSR

SEQ ID NO: 184573 - protein, 35 aa, Artificial Sequence
  Description of Artificial Sequence: Synthetic polypeptide
TSGSIQTTNPVATEEWGSVSCVGGSSQRPGGNSRM

SEQ ID NO: 184574 - protein, 34 aa, Artificial Sequence
  Description of Artificial Sequence: Synthetic polypeptide
TSGSIQTTNPVATEEWGSVSCVGDFSQRPGGNPM

SEQ ID NO: 184575 - protein, 35 aa, Artificial Sequence
  Description of Artificial Sequence: Synthetic polypeptide
TSGSIQTTNPVATEEWGSVSCEGNPSQRPGGNPNM

SEQ ID NO: 184576 - protein, 34 aa, Artificial Sequence
  Description of Artificial Sequence: Synthetic polypeptide
TSGSIQTTNPVATEEWGSVSCEGNISDRPGGNPG

SEQ ID NO: 184577 - protein, 35 aa, Artificial Sequence
  Description of Artificial Sequence: Synthetic polypeptide
TSGSIQTTNPVATEEWGSVSCEGDSSQRPGGNPRW

SEQ ID NO: 184578 - protein, 34 aa, Artificial Sequence
  Description of Artificial Sequence: Synthetic polypeptide
TSGSIQTTNPVATEEWGSVHCVGNSSQRPGGNPM

SEQ ID NO: 184579 - protein, 34 aa, Artificial Sequence
  Description of Artificial Sequence: Synthetic polypeptide
TSGSIQTTNPVATEEWGSTSCEGNSSQRPGGNEN

SEQ ID NO: 184580 - protein, 34 aa, Artificial Sequence
  Description of Artificial Sequence: Synthetic polypeptide
TSGSIQTTNPCATEEWGSVSCEGNSSDRPGGNPR

SEQ ID NO: 184581 - protein, 34 aa, Artificial Sequence
  Description of Artificial Sequence: Synthetic polypeptide
TSGSIQATNPVATEEWGSVSCEGNSSQFPGGNPR

SEQ ID NO: 184582 - protein, 35 aa, Artificial Sequence
  Description of Artificial Sequence: Synthetic polypeptide
TSGQIQTTNPVATERWGSVTSCVNSSSQAPGGNPR

SEQ ID NO: 184583 - protein, 34 aa, Artificial Sequence
  Description of Artificial Sequence: Synthetic polypeptide
TSGQIQTTNPVATERWGSVTCVNSSSQSPGGNPR

SEQ ID NO: 184584 - protein, 34 aa, Artificial Sequence
  Description of Artificial Sequence: Synthetic polypeptide
TSGQIQTTNPVATERWGSVSCVNSSSQFPGGNPY

SEQ ID NO: 184585 - protein, 35 aa, Artificial Sequence
  Description of Artificial Sequence: Synthetic polypeptide
TSGQIATTNPVATERWGSVSCVNSSSQSPGGNPRK

SEQ ID NO: 184586 - protein, 35 aa, Artificial Sequence
  Description of Artificial Sequence: Synthetic polypeptide
TSGEICTTNPVAYENYGSVVCSTVMLSQNTSMTRP

SEQ ID NO: 184587 - protein, 35 aa, Artificial Sequence
  Description of Artificial Sequence: Synthetic polypeptide
TSEEIQTTNPVAWEMWGSTVPSTTNAASARGGELT

SEQ ID NO: 184588 - protein, 34 aa, Artificial Sequence
  Description of Artificial Sequence: Synthetic polypeptide
TSGSIQTTNPVATEEWGSVSCVGSSSQRPGGNPT

SEQ ID NO: 184589 - protein, 35 aa, Artificial Sequence
  Description of Artificial Sequence: Synthetic polypeptide
TSEEIQTTNPVAWEMWGSTVPSTNAASMNFGGNLV

SEQ ID NO: 184590 - protein, 36 aa, Artificial Sequence
  Description of Artificial Sequence: Synthetic polypeptide
TSEEIQTTNPVAWEMWGSTVPSPTNEFSIDRGGNSV

SEQ ID NO: 184591 - protein, 35 aa, Artificial Sequence
  Description of Artificial Sequence: Synthetic polypeptide
TSEEIQTTNPVAWEGWGSTVPSTTNAASMRGGELH

SEQ ID NO: 184592 - protein, 35 aa, Artificial Sequence
  Description of Artificial Sequence: Synthetic polypeptide
TSEEIQTTNPVAWEGWGSTVPSTTIASSQRGGELN

SEQ ID NO: 184593 - protein, 35 aa, Artificial Sequence
  Description of Artificial Sequence: Synthetic polypeptide
TSEEIQTTNPVAWEGWGSTVPSTDDAASQRGGELN

SEQ ID NO: 184594 - protein, 37 aa, Artificial Sequence
  Description of Artificial Sequence: Synthetic polypeptide
TSEEIQTTNPVAWEGWGSTVPSPTENAASQDRGGNAV

SEQ ID NO: 184595 - protein, 35 aa, Artificial Sequence
  Description of Artificial Sequence: Synthetic polypeptide
TSEEIQTTNPVAWEDWGSTVPSTTNAASQGGGELN

SEQ ID NO: 184596 - protein, 35 aa, Artificial Sequence
  Description of Artificial Sequence: Synthetic polypeptide
TSEEIQTTNPVAWAGWGSTVPSTTNAASQRGGELN

SEQ ID NO: 184597 - protein, 35 aa, Artificial Sequence
  Description of Artificial Sequence: Synthetic polypeptide
TSEEIQATNPVAWEMWGSTVPSTQNAASQRGGELV

SEQ ID NO: 184598 - protein, 35 aa, Artificial Sequence
  Description of Artificial Sequence: Synthetic polypeptide
TSEEINTTNPVAWENWGSTVPSTTDAASQRGGELN

SEQ ID NO: 184599 - protein, 37 aa, Artificial Sequence
  Description of Artificial Sequence: Synthetic polypeptide
DEEEIATTNPVAYEQYGSACAPVNPAEGQNHQDGMMW

SEQ ID NO: 184600 - protein, 36 aa, Artificial Sequence
  Description of Artificial Sequence: Synthetic polypeptide
TSEEICTTNPVAWEWWGSTVPSPTNAASIDRGGNAV

SEQ ID NO: 184601 - protein, 36 aa, Artificial Sequence
  Description of Artificial Sequence: Synthetic polypeptide
TSECIQTTNPVAWEMWGSTVPSPTINAASQRGGNLV

SEQ ID NO: 184602 - protein, 38 aa, Artificial Sequence
  Description of Artificial Sequence: Synthetic polypeptide
DDAEIRTTNPVATEQYGSYVSPSGIMLEELENGNEEVF

SEQ ID NO: 184603 - protein, 35 aa, Artificial Sequence
  Description of Artificial Sequence: Synthetic polypeptide
TSEAIQTTNPVAWEMWGSTVPSPTGAASQRGGNLV

SEQ ID NO: 184604 - protein, 35 aa, Artificial Sequence
  Description of Artificial Sequence: Synthetic polypeptide
TSAEIQTTNPVAWEGWGSTVPSTTNAASQRGGEIN

SEQ ID NO: 184605 - protein, 35 aa, Artificial Sequence
  Description of Artificial Sequence: Synthetic polypeptide
TSAEIATTNPVAYCAYGQIVPSTNLFQNGGTNNPD

SEQ ID NO: 184606 - protein, 39 aa, Artificial Sequence
  Description of Artificial Sequence: Synthetic polypeptide
DEEEISGTNPVATEQYGSFVTNSTFQNMDELEQAVVPGQ

SEQ ID NO: 184607 - protein, 38 aa, Artificial Sequence
  Description of Artificial Sequence: Synthetic polypeptide
DEEEIATTNPVAYEQYGSACSAANPNGPLDSMIGNDNQ

SEQ ID NO: 184608 - protein, 36 aa, Artificial Sequence
  Description of Artificial Sequence: Synthetic polypeptide
DEEEIATTNPVAYEQYGSACSAAPHLNEAPGGEAAL

SEQ ID NO: 184609 - protein, 38 aa, Artificial Sequence
  Description of Artificial Sequence: Synthetic polypeptide
DDAEIRTTNPVATEQYGSVTYPTDNSLIETTYISMNEE

SEQ ID NO: 184610 - protein, 36 aa, Artificial Sequence
  Description of Artificial Sequence: Synthetic polypeptide
TSEEIQTTNPVAWEGWGSTVPSTTNAASQERGGEQN

SEQ ID NO: 184611 - protein, 35 aa, Artificial Sequence
  Description of Artificial Sequence: Synthetic polypeptide
TSEEIQTTNPVAWEGWGSTVPSTTWAASQRGGESN

SEQ ID NO: 184612 - protein, 36 aa, Artificial Sequence
  Description of Artificial Sequence: Synthetic polypeptide
DDAEIRTTNPVATEQYGSVGPDWENGMPTTNKPQEE

SEQ ID NO: 184613 - protein, 36 aa, Artificial Sequence
  Description of Artificial Sequence: Synthetic polypeptide
TSEEIQTTNPVAWEMWGSTVPSPTNANSQDEGGNAV

SEQ ID NO: 184614 - protein, 37 aa, Artificial Sequence
  Description of Artificial Sequence: Synthetic polypeptide
DEEEIATTNPVAYEQYGSACAAANPGPLDSMGGNDNQ

SEQ ID NO: 184615 - protein, 36 aa, Artificial Sequence
  Description of Artificial Sequence: Synthetic polypeptide
DDAEIRTTNPVATEQYGSIPWTPPEEENQDHQSEPP

SEQ ID NO: 184616 - protein, 36 aa, Artificial Sequence
  Description of Artificial Sequence: Synthetic polypeptide
DDAEIRTTNPVATEQYGSIPWTPPLEENQHQSEEHQ

SEQ ID NO: 184617 - protein, 35 aa, Artificial Sequence
  Description of Artificial Sequence: Synthetic polypeptide
TSEEIQTTNPVAWEMWGSTVPSPTGAASQVGGNMV

SEQ ID NO: 184618 - protein, 36 aa, Artificial Sequence
  Description of Artificial Sequence: Synthetic polypeptide
TSEEIQTTNPVAWEMWGSTVPSPTGAASQQRGGNLM

SEQ ID NO: 184619 - protein, 36 aa, Artificial Sequence
  Description of Artificial Sequence: Synthetic polypeptide
DDAEIRTTNPVATEQYGSVGCDFENGMDTTNGPQEE

SEQ ID NO: 184620 - protein, 36 aa, Artificial Sequence
  Description of Artificial Sequence: Synthetic polypeptide
TSEEIQTTNPVAWEMWGSTVPSPTDAASQRGGNTAV

SEQ ID NO: 184621 - protein, 35 aa, Artificial Sequence
  Description of Artificial Sequence: Synthetic polypeptide
TSEEIQTTNPVAWEMWGSTVPSPTDAASQRGGDLV

SEQ ID NO: 184622 - protein, 36 aa, Artificial Sequence
  Description of Artificial Sequence: Synthetic polypeptide
TSEEIQTTNPVAWEMWGSTVPSGTNAASIDRGGNAV

SEQ ID NO: 184623 - protein, 36 aa, Artificial Sequence
  Description of Artificial Sequence: Synthetic polypeptide
TSEEIQTTNPVAWEMWGSTVPSDTNAASQDRGGTAV

SEQ ID NO: 184624 - protein, 36 aa, Artificial Sequence
  Description of Artificial Sequence: Synthetic polypeptide
TSEEIQTTNPVAWEMWGSTVPSATIAASQDRGGNAV

SEQ ID NO: 184625 - protein, 36 aa, Artificial Sequence
  Description of Artificial Sequence: Synthetic polypeptide
TSEEIQTTNPVAWEMWGSTVPQPTNAASQDRGGNDV

SEQ ID NO: 184626 - protein, 35 aa, Artificial Sequence
  Description of Artificial Sequence: Synthetic polypeptide
TSEEIQTTNPVAWEMWGSTVPPTPNAASQRGGELN

SEQ ID NO: 184627 - protein, 35 aa, Artificial Sequence
  Description of Artificial Sequence: Synthetic polypeptide
TSEEIQTTNPVAWEMWGNTVPSTTNAASQRGGEWN

SEQ ID NO: 184628 - protein, 34 aa, Artificial Sequence
  Description of Artificial Sequence: Synthetic polypeptide
TSEEIQTTNPVAWEMWGITVPSTNAASMRGGELV

SEQ ID NO: 184629 - protein, 37 aa, Artificial Sequence
  Description of Artificial Sequence: Synthetic polypeptide
TSEEIQTTNPVAWEMWGESTVPSPTNAASQRGGNYLV

SEQ ID NO: 184630 - protein, 35 aa, Artificial Sequence
  Description of Artificial Sequence: Synthetic polypeptide
TSEEIQTTNPVAWEMWGATVPSPTGEASQRGGNLV

SEQ ID NO: 184631 - protein, 36 aa, Artificial Sequence
  Description of Artificial Sequence: Synthetic polypeptide
DDAEIRTTNPVATEQYGSVGPDFENGYDDTNKPQEE

SEQ ID NO: 184632 - protein, 36 aa, Artificial Sequence
  Description of Artificial Sequence: Synthetic polypeptide
TSEEIQTTNPVAWEMWGSTVPSTMNAASQRSGGELN

SEQ ID NO: 184633 - protein, 34 aa, Artificial Sequence
  Description of Artificial Sequence: Synthetic polypeptide
TSGSIQTTNPVATEPWGIVSCVGNSSQRPGGNPM

SEQ ID NO: 184634 - protein, 34 aa, Artificial Sequence
  Description of Artificial Sequence: Synthetic polypeptide
TSGSIQTTNPVATEPWGSVSCVGNSSQVPGGESR

SEQ ID NO: 184635 - protein, 35 aa, Artificial Sequence
  Description of Artificial Sequence: Synthetic polypeptide
TSGSIQTTNPVATESWGSVSCEGNSSQRPGGNPNY

SEQ ID NO: 184636 - protein, 34 aa, Artificial Sequence
  Description of Artificial Sequence: Synthetic polypeptide
TTTEICTTNPVAYEQWGSVAWTEIDQQDNGGDNI

SEQ ID NO: 184637 - protein, 36 aa, Artificial Sequence
  Description of Artificial Sequence: Synthetic polypeptide
TTTEIATTNPVAYERWGSAVSWGGNLQDDRQHQGNH

SEQ ID NO: 184638 - protein, 34 aa, Artificial Sequence
  Description of Artificial Sequence: Synthetic polypeptide
TTTEIATTNPVAYEQWGSVAWTEIDTQDRGGDIN

SEQ ID NO: 184639 - protein, 34 aa, Artificial Sequence
  Description of Artificial Sequence: Synthetic polypeptide
TTTEIATTNPVAYEQWGSVAWTEIDQQDNGRDAI

SEQ ID NO: 184640 - protein, 31 aa, Artificial Sequence
  Description of Artificial Sequence: Synthetic polypeptide
DDSEVASTNPVATEGYGNVAANTIMNRVEQA

SEQ ID NO: 184641 - protein, 34 aa, Artificial Sequence
  Description of Artificial Sequence: Synthetic polypeptide
TTGEIATTNPVAYECWGSVSGGLNDDRQENGNHS

SEQ ID NO: 184642 - protein, 35 aa, Artificial Sequence
  Description of Artificial Sequence: Synthetic polypeptide
TTGEEIATTNPVAYECWGSVSGGLNDDRQEQGNHM

SEQ ID NO: 184643 - protein, 34 aa, Artificial Sequence
  Description of Artificial Sequence: Synthetic polypeptide
TTGDEIATTNPVAYEQWGEVTGGNQQDREGDNQP

SEQ ID NO: 184644 - protein, 37 aa, Artificial Sequence
  Description of Artificial Sequence: Synthetic polypeptide
VEDCIRTTNPVATEQWGSQVATTGNMESDYNEGSNRN

SEQ ID NO: 184645 - protein, 34 aa, Artificial Sequence
  Description of Artificial Sequence: Synthetic polypeptide
TTGAEIATTNPVAYECWGSVSGGLNDDRQENGNH

SEQ ID NO: 184646 - protein, 32 aa, Artificial Sequence
  Description of Artificial Sequence: Synthetic polypeptide
DDSEVASTNPTSTEGYGNVAANTIQSRVGQRE

SEQ ID NO: 184647 - protein, 37 aa, Artificial Sequence
  Description of Artificial Sequence: Synthetic polypeptide
DEEEIRTTNPVATEQYGCVCSDSGEDHNQENFSSDQS

SEQ ID NO: 184648 - protein, 34 aa, Artificial Sequence
  Description of Artificial Sequence: Synthetic polypeptide
DEEEISATNPVAYEQWGMVTGWNMDHQEGQGGDL

SEQ ID NO: 184649 - protein, 35 aa, Artificial Sequence
  Description of Artificial Sequence: Synthetic polypeptide
DEAAEIATTNPVAYECWGSVYHPNNDDQNGGDNEA

SEQ ID NO: 184650 - protein, 37 aa, Artificial Sequence
  Description of Artificial Sequence: Synthetic polypeptide
DEEEISCTNPVATEQYGCVCSMTGEDFQEGFGSDTQS

SEQ ID NO: 184651 - protein, 37 aa, Artificial Sequence
  Description of Artificial Sequence: Synthetic polypeptide
DEEEISCTNPVATEQYGCVCSMWGEDNQEGFNSDTQG

SEQ ID NO: 184652 - protein, 35 aa, Artificial Sequence
  Description of Artificial Sequence: Synthetic polypeptide
TTEEICTTNPAATDAYGSVVNTEGPGEQRGDGNGQ

SEQ ID NO: 184653 - protein, 36 aa, Artificial Sequence
  Description of Artificial Sequence: Synthetic polypeptide
DDAEIGTTNPVATEQYGCVCSTGEDHNQESFGSDQS

SEQ ID NO: 184654 - protein, 31 aa, Artificial Sequence
  Description of Artificial Sequence: Synthetic polypeptide
DDSEVASTNPVATEGYGNVAANIIMNRVEQA

SEQ ID NO: 184655 - protein, 33 aa, Artificial Sequence
  Description of Artificial Sequence: Synthetic polypeptide
VEDEIACTNPVATAQWGGCNVASANLQDNESED

SEQ ID NO: 184656 - protein, 33 aa, Artificial Sequence
  Description of Artificial Sequence: Synthetic polypeptide
VEDEIACTNPVATAQWGGCVASANDDANGSNMD

SEQ ID NO: 184657 - protein, 33 aa, Artificial Sequence
  Description of Artificial Sequence: Synthetic polypeptide
VEDEIACTNPVATAQWGGCVASANDDGAGNSDI

SEQ ID NO: 184658 - protein, 33 aa, Artificial Sequence
  Description of Artificial Sequence: Synthetic polypeptide
QEMEIAPTNPCSYEQYGVTVSCCNMQSQSGGTR

SEQ ID NO: 184659 - protein, 34 aa, Artificial Sequence
  Description of Artificial Sequence: Synthetic polypeptide
VEDEIACTNPVATEQWGGCVAGNMLQHQDDNTPQ

SEQ ID NO: 184660 - protein, 33 aa, Artificial Sequence
  Description of Artificial Sequence: Synthetic polypeptide
VEDEIACTNPVATEQWGGCVAATANGNMEPGET

SEQ ID NO: 184661 - protein, 33 aa, Artificial Sequence
  Description of Artificial Sequence: Synthetic polypeptide
VEDEIACTNPVATEQWGGCVAATANGEMPGGMT

SEQ ID NO: 184662 - protein, 34 aa, Artificial Sequence
  Description of Artificial Sequence: Synthetic polypeptide
VEDEIACTNPVATEQWGGCVAATANGATMPGNTD

SEQ ID NO: 184663 - protein, 33 aa, Artificial Sequence
  Description of Artificial Sequence: Synthetic polypeptide
VEDEIACTNPVATEQWGGCVAATANGAMPYNQT

SEQ ID NO: 184664 - protein, 32 aa, Artificial Sequence
  Description of Artificial Sequence: Synthetic polypeptide
VEDEIACTNPVATEQWGGCVAATANGAMPETD

SEQ ID NO: 184665 - protein, 35 aa, Artificial Sequence
  Description of Artificial Sequence: Synthetic polypeptide
VEDEIACTNPVATEQWGGCSAGNGLVQTRMHEDNS

SEQ ID NO: 184666 - protein, 35 aa, Artificial Sequence
  Description of Artificial Sequence: Synthetic polypeptide
VEDEIACTNPVATEQWGGCSAGNGLDATRGHDNSV

SEQ ID NO: 184667 - protein, 35 aa, Artificial Sequence
  Description of Artificial Sequence: Synthetic polypeptide
VEDEIACTNPVATEQWGGCSAGNGLAERGHSDNSV

SEQ ID NO: 184668 - protein, 36 aa, Artificial Sequence
  Description of Artificial Sequence: Synthetic polypeptide
VEDEIACTNPVATEQWGGCSAATNHLQPDPQMGKRN

SEQ ID NO: 184669 - protein, 33 aa, Artificial Sequence
  Description of Artificial Sequence: Synthetic polypeptide
VEDEIACTNPVATEQWGCVAGTANLISNMEMGD

SEQ ID NO: 184670 - protein, 34 aa, Artificial Sequence
  Description of Artificial Sequence: Synthetic polypeptide
DEEEIATTNPVAYEQWGTACAAANGLQDSEEDDS

SEQ ID NO: 184671 - protein, 33 aa, Artificial Sequence
  Description of Artificial Sequence: Synthetic polypeptide
VEDEIACTNPVATEQWGCTAGNGLAAMPGDNVW

SEQ ID NO: 184672 - protein, 32 aa, Artificial Sequence
  Description of Artificial Sequence: Synthetic polypeptide
VEDEIACTNPVATEQWGCTAGNGHADRPDNSW

SEQ ID NO: 184673 - protein, 34 aa, Artificial Sequence
  Description of Artificial Sequence: Synthetic polypeptide
VEDEIACTNPVATAQWGSVSATGAGGTAPQDANF

SEQ ID NO: 184674 - protein, 34 aa, Artificial Sequence
  Description of Artificial Sequence: Synthetic polypeptide
DEEEIATTNPVAYEQWGTNCAAGAGQDPDSGPNT

SEQ ID NO: 184675 - protein, 33 aa, Artificial Sequence
  Description of Artificial Sequence: Synthetic polypeptide
VEDEIACTNPVATAQWGGCVASANLQDNESMTD

SEQ ID NO: 184676 - protein, 34 aa, Artificial Sequence
  Description of Artificial Sequence: Synthetic polypeptide
VEDEIACTNPVATAQWGGCVASANDQDAEGNSDE

SEQ ID NO: 184677 - protein, 37 aa, Artificial Sequence
  Description of Artificial Sequence: Synthetic polypeptide
DEEEISCTNPVATEQYGCVCSNSGEHNQENFGSDNQS

SEQ ID NO: 184678 - protein, 33 aa, Artificial Sequence
  Description of Artificial Sequence: Synthetic polypeptide
TTDEIATTNPVAYECWGSVSGGLNDDRQEGGVH

SEQ ID NO: 184679 - protein, 34 aa, Artificial Sequence
  Description of Artificial Sequence: Synthetic polypeptide
TTAEIRTTNPVATEQYGMTTAGVGLQHMGPGVGE

SEQ ID NO: 184680 - protein, 39 aa, Artificial Sequence
  Description of Artificial Sequence: Synthetic polypeptide
DEEEIRTTNPVATEAYGTVTTVGNSNQIGTTSISTTGNT

SEQ ID NO: 184681 - protein, 36 aa, Artificial Sequence
  Description of Artificial Sequence: Synthetic polypeptide
DDAEIRTTNPVATEQYGCCCSNWGEHNAHFGSNTQA

SEQ ID NO: 184682 - protein, 36 aa, Artificial Sequence
  Description of Artificial Sequence: Synthetic polypeptide
DEEEISCTNPVATEQYGCVCSNWGEHNQNFISENQL

SEQ ID NO: 184683 - protein, 34 aa, Artificial Sequence
  Description of Artificial Sequence: Synthetic polypeptide
TTAEIATTNPVATECWGSCSGGLNDDRQEQGNHK

SEQ ID NO: 184684 - protein, 35 aa, Artificial Sequence
  Description of Artificial Sequence: Synthetic polypeptide
QEMEICTTNPVATEQYGAVCSAWDGSPVEFEGNEF

SEQ ID NO: 184685 - protein, 34 aa, Artificial Sequence
  Description of Artificial Sequence: Synthetic polypeptide
TTAEIATTNPVATECWGEVSGGLNDDRQEQGNHS

SEQ ID NO: 184686 - protein, 36 aa, Artificial Sequence
  Description of Artificial Sequence: Synthetic polypeptide
TSTAIRSTNPVAYENYGQSVVSTNNEWTQSVGNTRN

SEQ ID NO: 184687 - protein, 35 aa, Artificial Sequence
  Description of Artificial Sequence: Synthetic polypeptide
TSSSIQTTNPVATERWGESVSCEGNSSQRPGGNPN

SEQ ID NO: 184688 - protein, 38 aa, Artificial Sequence
  Description of Artificial Sequence: Synthetic polypeptide
DDAEIRTTNPVATEQYGCTWSGAVMTDDGQHGGFDENI

SEQ ID NO: 184689 - protein, 32 aa, Artificial Sequence
  Description of Artificial Sequence: Synthetic polypeptide
TSSEVASTNPVSTEAYGNVAANTIQSRVGGQR

SEQ ID NO: 184690 - protein, 34 aa, Artificial Sequence
  Description of Artificial Sequence: Synthetic polypeptide
TSSEIRTTNPTAYEAWGHTVACTANLAQDYGGNH

SEQ ID NO: 184691 - protein, 34 aa, Artificial Sequence
  Description of Artificial Sequence: Synthetic polypeptide
TSSEIATTNPTAYEAWGSTVGAWANLAQRTGGNY

SEQ ID NO: 184692 - protein, 34 aa, Artificial Sequence
  Description of Artificial Sequence: Synthetic polypeptide
TSSEIATTNPTAYEAWGSTVGATPNLASRTGGNY

SEQ ID NO: 184693 - protein, 34 aa, Artificial Sequence
  Description of Artificial Sequence: Synthetic polypeptide
TSSEIATTNPTAYEAWGSTVATAWLAQVRTGGNY

SEQ ID NO: 184694 - protein, 35 aa, Artificial Sequence
  Description of Artificial Sequence: Synthetic polypeptide
TSNEIQTTNPVAWEMWGSTVPSTTNSASQRGGELV

SEQ ID NO: 184695 - protein, 34 aa, Artificial Sequence
  Description of Artificial Sequence: Synthetic polypeptide
TSMEIATTNPTAYEAWGSTVGATANLAQFTGGNY

SEQ ID NO: 184696 - protein, 35 aa, Artificial Sequence
  Description of Artificial Sequence: Synthetic polypeptide
TSGVIQTTNPVATEEWGSVSCVGNSSQRPGGGPRV

SEQ ID NO: 184697 - protein, 34 aa, Artificial Sequence
  Description of Artificial Sequence: Synthetic polypeptide
TSGSIYTTNPVAYEEWGSVSCVGNSSGRPGGNSR

SEQ ID NO: 184698 - protein, 34 aa, Artificial Sequence
  Description of Artificial Sequence: Synthetic polypeptide
TSGSIQTTNPVSTEEWGSVACEGNSSQRPGGNPR

SEQ ID NO: 184699 - protein, 35 aa, Artificial Sequence
  Description of Artificial Sequence: Synthetic polypeptide
TSGSIQTTNPVATETWGSVSCVGNSSQDPGGNPRH

SEQ ID NO: 184700 - protein, 38 aa, Artificial Sequence
  Description of Artificial Sequence: Synthetic polypeptide
DEEEIRTTNPVATEQYGCVCSDWEEDHNQEHFNSDNQS

SEQ ID NO: 184701 - protein, 34 aa, Artificial Sequence
  Description of Artificial Sequence: Synthetic polypeptide
AEEEIASVNPVCTEQYGCVCSWEPHNQSFGSNQA

SEQ ID NO: 184702 - protein, 34 aa, Artificial Sequence
  Description of Artificial Sequence: Synthetic polypeptide
TTAEIATTNPVAYECWGSTVSGGDNDDRQEQGNQ

SEQ ID NO: 184703 - protein, 34 aa, Artificial Sequence
  Description of Artificial Sequence: Synthetic polypeptide
TTAEIATTNPVAYECWGSVSGDLNDDRQHQGNHM

SEQ ID NO: 184704 - protein, 32 aa, Artificial Sequence
  Description of Artificial Sequence: Synthetic polypeptide
TTAEIATTNPVAYERWGTCSTDDQHQQGPREP

SEQ ID NO: 184705 - protein, 33 aa, Artificial Sequence
  Description of Artificial Sequence: Synthetic polypeptide
TTAEIATTNPVAYERWGSVTGGLNDDRNRQGNH

SEQ ID NO: 184706 - protein, 36 aa, Artificial Sequence
  Description of Artificial Sequence: Synthetic polypeptide
DDAEIRCTNPVATEQYGCVESWVVYNHEQEGFGGQM

SEQ ID NO: 184707 - protein, 34 aa, Artificial Sequence
  Description of Artificial Sequence: Synthetic polypeptide
DEEEIATTNPVAYEQWGVVCPIEELNGEDKGDQE

SEQ ID NO: 184708 - protein, 34 aa, Artificial Sequence
  Description of Artificial Sequence: Synthetic polypeptide
TTAEIATTNPVAYERWGSAVSGGLNDDRQNQGNH

SEQ ID NO: 184709 - protein, 35 aa, Artificial Sequence
  Description of Artificial Sequence: Synthetic polypeptide
TTAEIATTNPVAYEQWGSVYRTDNQEQPNHGDNNY

SEQ ID NO: 184710 - protein, 35 aa, Artificial Sequence
  Description of Artificial Sequence: Synthetic polypeptide
TTAEIATTNPVAYEQWGSVYGTDNQEQPNHGDDQR

SEQ ID NO: 184711 - protein, 33 aa, Artificial Sequence
  Description of Artificial Sequence: Synthetic polypeptide
TTAEIATTNPVAYECWGSVTGGLNDDRQPEGNH

SEQ ID NO: 184712 - protein, 34 aa, Artificial Sequence
  Description of Artificial Sequence: Synthetic polypeptide
TTAEIATTNPVAYECWGSVSGQGLNDDRQPQGNH

SEQ ID NO: 184713 - protein, 33 aa, Artificial Sequence
  Description of Artificial Sequence: Synthetic polypeptide
TTAEIATTNPVAYECWGSVSGGNNDDRQEQTNH

SEQ ID NO: 184714 - protein, 34 aa, Artificial Sequence
  Description of Artificial Sequence: Synthetic polypeptide
TTAEIATTNPVAYECWGSVSGGMLNDDRQHNGNH

SEQ ID NO: 184715 - protein, 34 aa, Artificial Sequence
  Description of Artificial Sequence: Synthetic polypeptide
TTAEIATTNPVAYECWGSVSGGLNDNRQEQGNHG

SEQ ID NO: 184716 - protein, 34 aa, Artificial Sequence
  Description of Artificial Sequence: Synthetic polypeptide
TTAEIATTNPVAYECWGSVSGGLNDDRQVQGNSM

SEQ ID NO: 184717 - protein, 34 aa, Artificial Sequence
  Description of Artificial Sequence: Synthetic polypeptide
TTAEIATTNPVAYECWGSVSGGLNDDRQPEGNSG

SEQ ID NO: 184718 - protein, 34 aa, Artificial Sequence
  Description of Artificial Sequence: Synthetic polypeptide
TTAEIATTNPVAYECWGSVSGGLNDDRQEQGNGI

SEQ ID NO: 184719 - protein, 33 aa, Artificial Sequence
  Description of Artificial Sequence: Synthetic polypeptide
TTAEIATTNPVAYECWGSVSGGLNDDRQENGKP

SEQ ID NO: 184720 - protein, 34 aa, Artificial Sequence
  Description of Artificial Sequence: Synthetic polypeptide
TTAEIATTNPVAYECWGSVSGGLNDDRQEMGNPV

SEQ ID NO: 184721 - protein, 34 aa, Artificial Sequence
  Description of Artificial Sequence: Synthetic polypeptide
TTAEIATTNPVAYECWGSVSGGLNDDRQDQGNHK

SEQ ID NO: 184722 - protein, 34 aa, Artificial Sequence
  Description of Artificial Sequence: Synthetic polypeptide
TTAEIATTNPVAYECWGSVSGGINDDRQEQGNHT

SEQ ID NO: 184723 - protein, 34 aa, Artificial Sequence
  Description of Artificial Sequence: Synthetic polypeptide
TTAEIATTNPVAYECWGSVCSGGLNDDQQEQGNH

SEQ ID NO: 184724 - protein, 35 aa, Artificial Sequence
  Description of Artificial Sequence: Synthetic polypeptide
AEEEIASVNPVCTEQYGCVCSWGNDHNQSFGSNQA

SEQ ID NO: 184725 - protein, 34 aa, Artificial Sequence
  Description of Artificial Sequence: Synthetic polypeptide
AEEEIASVNPVCTEQYGCVCSWGNHNQNFGSDQA

SEQ ID NO: 184726 - protein, 37 aa, Artificial Sequence
  Description of Artificial Sequence: Synthetic polypeptide
DEEEISTTNPCATEQYGCVCGNWGELNQENFGSDTAS

SEQ ID NO: 184727 - protein, 36 aa, Artificial Sequence
  Description of Artificial Sequence: Synthetic polypeptide
DDECIRTTNPVATEQYGCVCSNWGEHNQYFNSDNQS

SEQ ID NO: 184728 - protein, 36 aa, Artificial Sequence
  Description of Artificial Sequence: Synthetic polypeptide
TESCIRATNPVAYEQYGTTVSCTQNAVSVLSSGDNH

SEQ ID NO: 184729 - protein, 34 aa, Artificial Sequence
  Description of Artificial Sequence: Synthetic polypeptide
TESCINTTNPVAYEQYGTTVSCAQNVSQLSSGDN

SEQ ID NO: 184730 - protein, 34 aa, Artificial Sequence
  Description of Artificial Sequence: Synthetic polypeptide
TESAEIATTNPVAYERWGVCATNLPGDHGENSGR

SEQ ID NO: 184731 - protein, 35 aa, Artificial Sequence
  Description of Artificial Sequence: Synthetic polypeptide
TESAEIATTNPVAYEQWGCVSTTLDLGEDERNGTA

SEQ ID NO: 184732 - protein, 38 aa, Artificial Sequence
  Description of Artificial Sequence: Synthetic polypeptide
TEQEIRTTNPVATEQYGSVVMSVNDNNEGGFQTGQVGD

SEQ ID NO: 184733 - protein, 36 aa, Artificial Sequence
  Description of Artificial Sequence: Synthetic polypeptide
TEQEIRTTNPVATEQYGSIHNTTLEDHNGEDSDEQC

SEQ ID NO: 184734 - protein, 38 aa, Artificial Sequence
  Description of Artificial Sequence: Synthetic polypeptide
TEQEIRTTNPVATEFYGVVSNMNLVGDDQDQEDDDGNP

SEQ ID NO: 184735 - protein, 35 aa, Artificial Sequence
  Description of Artificial Sequence: Synthetic polypeptide
DDECIRTTNPVATEQYGCVCSNWEHNQEYFISDQS

SEQ ID NO: 184736 - protein, 34 aa, Artificial Sequence
  Description of Artificial Sequence: Synthetic polypeptide
TEQEIRTTNPVATECWGSFGPCINEPEARESENG

SEQ ID NO: 184737 - protein, 34 aa, Artificial Sequence
  Description of Artificial Sequence: Synthetic polypeptide
TEQEIATTNPVAYEQWGSCQPTDNNEHQDDRKDA

SEQ ID NO: 184738 - protein, 36 aa, Artificial Sequence
  Description of Artificial Sequence: Synthetic polypeptide
DEEEISTTNPVATEEYGCVCSMWEHNQENFISENQA

SEQ ID NO: 184739 - protein, 34 aa, Artificial Sequence
  Description of Artificial Sequence: Synthetic polypeptide
TEQEIATTNPVATEQYGCVAANGDATMPPGDPHH

SEQ ID NO: 184740 - protein, 38 aa, Artificial Sequence
  Description of Artificial Sequence: Synthetic polypeptide
DEEEIRTTNPVATEQYGCVCSNSGEDHNAENFGSETQA

SEQ ID NO: 184741 - protein, 34 aa, Artificial Sequence
  Description of Artificial Sequence: Synthetic polypeptide
TEQEIATTNPEATDQYGQVCCCDQDQKREGDGMR

SEQ ID NO: 184742 - protein, 33 aa, Artificial Sequence
  Description of Artificial Sequence: Synthetic polypeptide
TEQDEIATTNPVAYEAWGVCATNLNGDTGNGSD

SEQ ID NO: 184743 - protein, 36 aa, Artificial Sequence
  Description of Artificial Sequence: Synthetic polypeptide
DEEEISTTNPVATEEYGCVCSNWGEHEQNFGSETQA

SEQ ID NO: 184744 - protein, 37 aa, Artificial Sequence
  Description of Artificial Sequence: Synthetic polypeptide
DEEEISTTNPVATEEYGCVCSNWGEHNQENFGSENQA

SEQ ID NO: 184745 - protein, 35 aa, Artificial Sequence
  Description of Artificial Sequence: Synthetic polypeptide
TEQEIATTNPVAYEQWGSCSPTDNINEHQDDRKDG

SEQ ID NO: 184746 - protein, 36 aa, Artificial Sequence
  Description of Artificial Sequence: Synthetic polypeptide
DDECIRTTNPVATEQYGCVCSMWEHNQENFNSDTLS

SEQ ID NO: 184747 - protein, 35 aa, Artificial Sequence
  Description of Artificial Sequence: Synthetic polypeptide
TESCIRTTNPLAYEQYGTTVSCEQNVSQLSSGDNH

SEQ ID NO: 184748 - protein, 35 aa, Artificial Sequence
  Description of Artificial Sequence: Synthetic polypeptide
DDECIRTTNPVATEQWGCVTSWGEHNQNFNSDTAS

SEQ ID NO: 184749 - protein, 33 aa, Artificial Sequence
  Description of Artificial Sequence: Synthetic polypeptide
TESEIASTNPVGTEGYGVIASTELSQSTGGDAP

SEQ ID NO: 184750 - protein, 33 aa, Artificial Sequence
  Description of Artificial Sequence: Synthetic polypeptide
TESEIASTNPVGTEGYGVIASTELSQDSTGGDK

SEQ ID NO: 184751 - protein, 32 aa, Artificial Sequence
  Description of Artificial Sequence: Synthetic polypeptide
TESEIASTNPVGTEGYGVIASTELSGSTGGDP

SEQ ID NO: 184752 - protein, 33 aa, Artificial Sequence
  Description of Artificial Sequence: Synthetic polypeptide
TESEIASTNPVGTEGYGVIAQSTELSQSTGGDV

SEQ ID NO: 184753 - protein, 33 aa, Artificial Sequence
  Description of Artificial Sequence: Synthetic polypeptide
TESEIASTNPVGTEGYGVIACSTELSQSTDGDI

SEQ ID NO: 184754 - protein, 30 aa, Artificial Sequence
  Description of Artificial Sequence: Synthetic polypeptide
TESEIASTNPVGTEGWGVCAPTDRDQHGTQ

SEQ ID NO: 184755 - protein, 31 aa, Artificial Sequence
  Description of Artificial Sequence: Synthetic polypeptide
TESEIASTNPVGTEGWGVCAPTDLQQHHGDA

SEQ ID NO: 184756 - protein, 31 aa, Artificial Sequence
  Description of Artificial Sequence: Synthetic polypeptide
TESEIASTNPVGTEGWGVCAPTDLQNHGQDA

SEQ ID NO: 184757 - protein, 31 aa, Artificial Sequence
  Description of Artificial Sequence: Synthetic polypeptide
TESEIASTNPVGTEGWGVCAPTDLQNHGDTI

SEQ ID NO: 184758 - protein, 31 aa, Artificial Sequence
  Description of Artificial Sequence: Synthetic polypeptide
TESEIASTNPVGTEGWGVCAPTDLQHHGDSA

SEQ ID NO: 184759 - protein, 31 aa, Artificial Sequence
  Description of Artificial Sequence: Synthetic polypeptide
TESEIASTNPVGTEGWGVCAPTDLQHGGDTA

SEQ ID NO: 184760 - protein, 31 aa, Artificial Sequence
  Description of Artificial Sequence: Synthetic polypeptide
TESEIASTNPVGTEGWGVCAPTDLQHGDTED

SEQ ID NO: 184761 - protein, 31 aa, Artificial Sequence
  Description of Artificial Sequence: Synthetic polypeptide
TESEIASTNPVGTEGWGVCAPTDLQDTGDTE

SEQ ID NO: 184762 - protein, 31 aa, Artificial Sequence
  Description of Artificial Sequence: Synthetic polypeptide
TESEIASTNPVGTEGWGVCAPTDLDQHGMDA

SEQ ID NO: 184763 - protein, 32 aa, Artificial Sequence
  Description of Artificial Sequence: Synthetic polypeptide
TESEIASTNPLGTERYGVIASTELSQSTGGDI

SEQ ID NO: 184764 - protein, 33 aa, Artificial Sequence
  Description of Artificial Sequence: Synthetic polypeptide
TESEIAATNPVGTEGYGVIASTELSQSTGGDQI

SEQ ID NO: 184765 - protein, 37 aa, Artificial Sequence
  Description of Artificial Sequence: Synthetic polypeptide
TESCIRTTNPVAYEQYGTTVSCTQNVSQLSSGTDFNA

SEQ ID NO: 184766 - protein, 36 aa, Artificial Sequence
  Description of Artificial Sequence: Synthetic polypeptide
TESCIRTTNPVAYENYGTTVSCTQNSSQLSSGDQNA

SEQ ID NO: 184767 - protein, 34 aa, Artificial Sequence
  Description of Artificial Sequence: Synthetic polypeptide
DDECIRTTNPVATEIYGCVCGWEHNQENFGSDQA

SEQ ID NO: 184768 - protein, 33 aa, Artificial Sequence
  Description of Artificial Sequence: Synthetic polypeptide
TENEIRTTNPVSYEPYGTISLEDEQQQQNGNHY

SEQ ID NO: 184769 - protein, 34 aa, Artificial Sequence
  Description of Artificial Sequence: Synthetic polypeptide
TENEIRTTNPVSTEPYGTISMEDEISQQQNGGNQ

SEQ ID NO: 184770 - protein, 37 aa, Artificial Sequence
  Description of Artificial Sequence: Synthetic polypeptide
DEEEIRTTNPVATEQYGCVCSNSGEDHNANFNSDFQS

SEQ ID NO: 184771 - protein, 37 aa, Artificial Sequence
  Description of Artificial Sequence: Synthetic polypeptide
TENEIRTTNPVATEQYGKVPNCESNELSQDIVTNYEG

SEQ ID NO: 184772 - protein, 36 aa, Artificial Sequence
  Description of Artificial Sequence: Synthetic polypeptide
TEGEIRTTNPVATEQYGSSSHPIEMEYLENDNEEEL

SEQ ID NO: 184773 - protein, 35 aa, Artificial Sequence
  Description of Artificial Sequence: Synthetic polypeptide
AEEEIATTNPVATEQYGCSCGNWEDNQEHFISENQ

SEQ ID NO: 184774 - protein, 36 aa, Artificial Sequence
  Description of Artificial Sequence: Synthetic polypeptide
DEEEISTTNPVATEGYGCVCSNWEHNQENFISENQS

SEQ ID NO: 184775 - protein, 37 aa, Artificial Sequence
  Description of Artificial Sequence: Synthetic polypeptide
DEEEISTTNPVATEGYGCVCSNWGEDHQENFGSDNQI

SEQ ID NO: 184776 - protein, 37 aa, Artificial Sequence
  Description of Artificial Sequence: Synthetic polypeptide
DEEEISTTNPVATEGYGCVCSNWGEHNAENFGSENQA

SEQ ID NO: 184777 - protein, 37 aa, Artificial Sequence
  Description of Artificial Sequence: Synthetic polypeptide
DEEEISTTNPVATEGYGCVCSNWGEHNAENFGSENQP

SEQ ID NO: 184778 - protein, 36 aa, Artificial Sequence
  Description of Artificial Sequence: Synthetic polypeptide
DEEEISTTNPVATEGYGCVCSNWGEHNAENFNSDQP

SEQ ID NO: 184779 - protein, 34 aa, Artificial Sequence
  Description of Artificial Sequence: Synthetic polypeptide
TEGEEIATTNPVAYERWGVCATNLPGDHGNNSGL

SEQ ID NO: 184780 - protein, 34 aa, Artificial Sequence
  Description of Artificial Sequence: Synthetic polypeptide
TEGEEIATTNPVAYERWGVCATNLPGDHGNGSGL

SEQ ID NO: 184781 - protein, 36 aa, Artificial Sequence
  Description of Artificial Sequence: Synthetic polypeptide
TEGEEIATTNPVAYEQWGVVCYTNAQWDGHMGGDHR

SEQ ID NO: 184782 - protein, 37 aa, Artificial Sequence
  Description of Artificial Sequence: Synthetic polypeptide
TEGEEIATTNPVAYEQWGSCVQNGGNAGEMQRNEGNP

SEQ ID NO: 184783 - protein, 36 aa, Artificial Sequence
  Description of Artificial Sequence: Synthetic polypeptide
TEGAEIATTNPVAYEQWGSVCSTDNGEWMEGGMNGQ

SEQ ID NO: 184784 - protein, 36 aa, Artificial Sequence
  Description of Artificial Sequence: Synthetic polypeptide
TEGAEIATTNPVAYEQWGSTCSTNIQGNDAGQNNEQ

SEQ ID NO: 184785 - protein, 36 aa, Artificial Sequence
  Description of Artificial Sequence: Synthetic polypeptide
DEEEISTTNPVATEGYGCVCSNWGEHNQESFGSEQP

SEQ ID NO: 184786 - protein, 36 aa, Artificial Sequence
  Description of Artificial Sequence: Synthetic polypeptide
DEEEISTTNPVATEGYGCVCSNWGEHNQNFNSDTQA

SEQ ID NO: 184787 - protein, 36 aa, Artificial Sequence
  Description of Artificial Sequence: Synthetic polypeptide
AEEEIATTNPVATEQYGCSCPSEADNQEHFNSETQA

SEQ ID NO: 184788 - protein, 36 aa, Artificial Sequence
  Description of Artificial Sequence: Synthetic polypeptide
DEEEISTTNPVATEGYGCVCSNWGEHQENFGSDTQA

SEQ ID NO: 184789 - protein, 36 aa, Artificial Sequence
  Description of Artificial Sequence: Synthetic polypeptide
AEEEIATTNPVATEQYGCSCPTSGEDNQEHFNSEQA

SEQ ID NO: 184790 - protein, 35 aa, Artificial Sequence
  Description of Artificial Sequence: Synthetic polypeptide
DDECIRTTNPVATEQYGCVCSWGEDHNQNFISDQA

SEQ ID NO: 184791 - protein, 35 aa, Artificial Sequence
  Description of Artificial Sequence: Synthetic polypeptide
AEEEIATTNPVATEQYGCQYCPNWEDNQHFNSEQA

SEQ ID NO: 184792 - protein, 33 aa, Artificial Sequence
  Description of Artificial Sequence: Synthetic polypeptide
TESEIASTNPVGTEGYGVIASTMLSQSTGGDID

SEQ ID NO: 184793 - protein, 33 aa, Artificial Sequence
  Description of Artificial Sequence: Synthetic polypeptide
TEHEIASVNPVCYEPYGCTVSSINLSQSGGNNQ

SEQ ID NO: 184794 - protein, 37 aa, Artificial Sequence
  Description of Artificial Sequence: Synthetic polypeptide
DEEEISTTNPVATEGYGCVCSNSEEHNAENFGSDNQS

SEQ ID NO: 184795 - protein, 31 aa, Artificial Sequence
  Description of Artificial Sequence: Synthetic polypeptide
TENEIATTNPVAYERWGTVSKEIEMNGKEDH

SEQ ID NO: 184796 - protein, 36 aa, Artificial Sequence
  Description of Artificial Sequence: Synthetic polypeptide
DDECIRTTNPVATEQYGCVCSWEDHNQEHFNSDTQA

SEQ ID NO: 184797 - protein, 32 aa, Artificial Sequence
  Description of Artificial Sequence: Synthetic polypeptide
TENEIATTNPVAYEQWGTVWSKEIEMNGKEDA

SEQ ID NO: 184798 - protein, 33 aa, Artificial Sequence
  Description of Artificial Sequence: Synthetic polypeptide
TENEIATTNPVAYEQWGCLTCFEGDGQRQNTDR

SEQ ID NO: 184799 - protein, 34 aa, Artificial Sequence
  Description of Artificial Sequence: Synthetic polypeptide
TENEIATTNPVAYEQWGCLSCFEGDQERGQNGSG

SEQ ID NO: 184800 - protein, 34 aa, Artificial Sequence
  Description of Artificial Sequence: Synthetic polypeptide
TENEIATTNPVAYEQWGCLNCFEGDGQRGQNGDR

SEQ ID NO: 184801 - protein, 35 aa, Artificial Sequence
  Description of Artificial Sequence: Synthetic polypeptide
DDECIRTTNPVATEQYGCVCSWEEHNQYFISDTQS

SEQ ID NO: 184802 - protein, 34 aa, Artificial Sequence
  Description of Artificial Sequence: Synthetic polypeptide
TENEIATTNPVATEGYGCVCSWEHNQHFISENLA

SEQ ID NO: 184803 - protein, 38 aa, Artificial Sequence
  Description of Artificial Sequence: Synthetic polypeptide
DEEEIRTTNPVATEQYGCVCSNSGEDHNQENFNSDNQS

SEQ ID NO: 184804 - protein, 37 aa, Artificial Sequence
  Description of Artificial Sequence: Synthetic polypeptide
DEEEIRTTNPVATEQYGCVCSNSGEHDAENFNSETQP

SEQ ID NO: 184805 - protein, 37 aa, Artificial Sequence
  Description of Artificial Sequence: Synthetic polypeptide
DEEEIRTTNPVATEQYGCVCSNSGEHEAESFNSDNQG

SEQ ID NO: 184806 - protein, 36 aa, Artificial Sequence
  Description of Artificial Sequence: Synthetic polypeptide
DEEEISTTNPVATEGYGCVCFNWEHNTENFGSDNQS

SEQ ID NO: 184807 - protein, 34 aa, Artificial Sequence
  Description of Artificial Sequence: Synthetic polypeptide
AEEEIATTNPVATEQWGCVAANHSGDAMNPAEGH

SEQ ID NO: 184808 - protein, 37 aa, Artificial Sequence
  Description of Artificial Sequence: Synthetic polypeptide
DEEEIRTTNPVATEQYGCVCSNSGEHNQENFISDTQL

SEQ ID NO: 184809 - protein, 34 aa, Artificial Sequence
  Description of Artificial Sequence: Synthetic polypeptide
AEEEIATTNPVATEQWGGCCTAAAGNPDNMDPNH

SEQ ID NO: 184810 - protein, 36 aa, Artificial Sequence
  Description of Artificial Sequence: Synthetic polypeptide
AEEEIATTNPVATEQWGHCNVAANAGEDSTDSGNPR

SEQ ID NO: 184811 - protein, 35 aa, Artificial Sequence
  Description of Artificial Sequence: Synthetic polypeptide
TEIDEIATTNPVAYEPWGVVATGGNQQDRTGDNEP

SEQ ID NO: 184812 - protein, 36 aa, Artificial Sequence
  Description of Artificial Sequence: Synthetic polypeptide
TEHPIRSTNPVAYEQYGQSVVVSTNYEWTSVGNPIN

SEQ ID NO: 184813 - protein, 37 aa, Artificial Sequence
  Description of Artificial Sequence: Synthetic polypeptide
DEEEISTTNPVATEGYGCVCSMWGEHNIENFGSDNQS

SEQ ID NO: 184814 - protein, 37 aa, Artificial Sequence
  Description of Artificial Sequence: Synthetic polypeptide
DEEEISTTNPVATEGYGCVCSNTEEHNQENFGSQTQS

SEQ ID NO: 184815 - protein, 37 aa, Artificial Sequence
  Description of Artificial Sequence: Synthetic polypeptide
DEEEISTTNPVATEQYGCVCSNWGEHNAENFNSDTQA

SEQ ID NO: 184816 - protein, 33 aa, Artificial Sequence
  Description of Artificial Sequence: Synthetic polypeptide
TESEIASTNPVGTEGYGVIPASTELSQTTLGDI

SEQ ID NO: 184817 - protein, 31 aa, Artificial Sequence
  Description of Artificial Sequence: Synthetic polypeptide
TESEIASTNPVGYEGYGVCACSTLSQKGGDH

SEQ ID NO: 184818 - protein, 37 aa, Artificial Sequence
  Description of Artificial Sequence: Synthetic polypeptide
DEAAEICTTNPVAYECWGSVATGNGPLNDDRGQNGTS

SEQ ID NO: 184819 - protein, 38 aa, Artificial Sequence
  Description of Artificial Sequence: Synthetic polypeptide
DEEEIATTNPVAYEQYGSTVCAVTEAGGAQARGSEMQM

SEQ ID NO: 184820 - protein, 39 aa, Artificial Sequence
  Description of Artificial Sequence: Synthetic polypeptide
DEEEIATTNPVAYEQYGSTVCAVTEAGGAQARGSENSMD

SEQ ID NO: 184821 - protein, 36 aa, Artificial Sequence
  Description of Artificial Sequence: Synthetic polypeptide
DEAAEISTTNPVAYEQYGTVATSNGGQQNGGQTGEA

SEQ ID NO: 184822 - protein, 33 aa, Artificial Sequence
  Description of Artificial Sequence: Synthetic polypeptide
AEEEIASVNPVCTEQYGVVCSWNHQESFISQQA

SEQ ID NO: 184823 - protein, 37 aa, Artificial Sequence
  Description of Artificial Sequence: Synthetic polypeptide
DEEEIATTNPVAYEQYGSVAACAGNPLATETPGGSEN

SEQ ID NO: 184824 - protein, 35 aa, Artificial Sequence
  Description of Artificial Sequence: Synthetic polypeptide
TNEEIATTNPVATEAYGCVCPTNDNQDQNGQGGDM

SEQ ID NO: 184825 - protein, 37 aa, Artificial Sequence
  Description of Artificial Sequence: Synthetic polypeptide
DEEEIATTNPVAYEQYGSVAACPYNPLATETNGGSVE

SEQ ID NO: 184826 - protein, 36 aa, Artificial Sequence
  Description of Artificial Sequence: Synthetic polypeptide
DEEEIATTNPVAYEQYGSTACAVATAEMTTGGDQSL

SEQ ID NO: 184827 - protein, 36 aa, Artificial Sequence
  Description of Artificial Sequence: Synthetic polypeptide
DEEEISTTNPCATEQYGCVCPTWEHNAENFNSDTQA

SEQ ID NO: 184828 - protein, 33 aa, Artificial Sequence
  Description of Artificial Sequence: Synthetic polypeptide
TNAEIATTNPVAYECWGSVSGGLNDDRQEQGVH

SEQ ID NO: 184829 - protein, 37 aa, Artificial Sequence
  Description of Artificial Sequence: Synthetic polypeptide
DEEEIRTTNPVATEQYGCVCSMWEDHEAENFNSDPQS

SEQ ID NO: 184830 - protein, 35 aa, Artificial Sequence
  Description of Artificial Sequence: Synthetic polypeptide
TIPDEIATTNPVAYEPWGVVATGGNQQDRTGDNER

SEQ ID NO: 184831 - protein, 34 aa, Artificial Sequence
  Description of Artificial Sequence: Synthetic polypeptide
TGQSEIATTNPVAYEQWGSVYYGETNDNQNGHDD

SEQ ID NO: 184832 - protein, 38 aa, Artificial Sequence
  Description of Artificial Sequence: Synthetic polypeptide
DEEEIRTTNPVATEQYGCVCSMWEEDHNQEHFNSDTQA

SEQ ID NO: 184833 - protein, 35 aa, Artificial Sequence
  Description of Artificial Sequence: Synthetic polypeptide
DEEEISTTNPCATEQYGCVCQWEHNQENFGSDTQA

SEQ ID NO: 184834 - protein, 35 aa, Artificial Sequence
  Description of Artificial Sequence: Synthetic polypeptide
DEEEISTTNPCATEQYGCVCQWMEHNQNFGSDTAA

SEQ ID NO: 184835 - protein, 35 aa, Artificial Sequence
  Description of Artificial Sequence: Synthetic polypeptide
TGEEIATTNPVAYEQWGSVTGGNAGEDLREGNQPM

SEQ ID NO: 184836 - protein, 36 aa, Artificial Sequence
  Description of Artificial Sequence: Synthetic polypeptide
DEEEISTTNPCATEQYGCVCPWEDHNAENFGSNTQA

SEQ ID NO: 184837 - protein, 38 aa, Artificial Sequence
  Description of Artificial Sequence: Synthetic polypeptide
DEEEIRTTNPVATEAYGTVTQYGNSEQGTTSIGTTNNT

SEQ ID NO: 184838 - protein, 34 aa, Artificial Sequence
  Description of Artificial Sequence: Synthetic polypeptide
AEEEIASVNPVCTEQYGVVCSTSEHNQSFGSDQS

SEQ ID NO: 184839 - protein, 37 aa, Artificial Sequence
  Description of Artificial Sequence: Synthetic polypeptide
DEEEIATTNPVAYEQYGSTACAANDGLPLGSGEGNQH

SEQ ID NO: 184840 - protein, 34 aa, Artificial Sequence
  Description of Artificial Sequence: Synthetic polypeptide
DDAEIRTTNPVAYEQYGCICSWNHNEENFPSDQA

SEQ ID NO: 184841 - protein, 37 aa, Artificial Sequence
  Description of Artificial Sequence: Synthetic polypeptide
TQAEIRTTNPVATEQYGACCVCSTPLGPNYPGQVPNI

SEQ ID NO: 184842 - protein, 36 aa, Artificial Sequence
  Description of Artificial Sequence: Synthetic polypeptide
DEEEIATTNPVAYEQYGSACSPAGEGGVGMGDQTNH

SEQ ID NO: 184843 - protein, 37 aa, Artificial Sequence
  Description of Artificial Sequence: Synthetic polypeptide
DEEEISTTNPCATEQYGCVCPNWEDHNQEYFGSDNQS

SEQ ID NO: 184844 - protein, 35 aa, Artificial Sequence
  Description of Artificial Sequence: Synthetic polypeptide
TNSEIRTTNPVATEQYGSVSVSAEDEVEGQFEDIQ

SEQ ID NO: 184845 - protein, 34 aa, Artificial Sequence
  Description of Artificial Sequence: Synthetic polypeptide
TNSEIATTNPVAYEHWGEVATGQLQGDIQGGDNR

SEQ ID NO: 184846 - protein, 38 aa, Artificial Sequence
  Description of Artificial Sequence: Synthetic polypeptide
TNRETEIATTNPVAYEQWGSVSHTQNGLDQGGPGGDNG

SEQ ID NO: 184847 - protein, 37 aa, Artificial Sequence
  Description of Artificial Sequence: Synthetic polypeptide
DEEEIATTNPVAYEQYGSACSVANPHGNEAPGGEARH

SEQ ID NO: 184848 - protein, 37 aa, Artificial Sequence
  Description of Artificial Sequence: Synthetic polypeptide
DEEEIATTNPVAYEQYGSACSVANPHLNEAPGGEAHN

SEQ ID NO: 184849 - protein, 37 aa, Artificial Sequence
  Description of Artificial Sequence: Synthetic polypeptide
DEEEISTTNPCATEQYGCVCPNWEELNQEYFGSDTQS

SEQ ID NO: 184850 - protein, 36 aa, Artificial Sequence
  Description of Artificial Sequence: Synthetic polypeptide
DEEEIATTNPVAYEQYGSACSVAPHGNEAPGGEAVN

SEQ ID NO: 184851 - protein, 36 aa, Artificial Sequence
  Description of Artificial Sequence: Synthetic polypeptide
DEEEIATTNPVAYEQYGSACSVAPHLNEAPDGEAAN

SEQ ID NO: 184852 - protein, 39 aa, Artificial Sequence
  Description of Artificial Sequence: Synthetic polypeptide
DEEEIRTTNPVATEAYGTVTTQAGNSEQGTTSIGTTGNT

SEQ ID NO: 184853 - protein, 36 aa, Artificial Sequence
  Description of Artificial Sequence: Synthetic polypeptide
DEEEIATTNPVAYEQYGSACSVAPHLNEAPNGEAFQ

SEQ ID NO: 184854 - protein, 36 aa, Artificial Sequence
  Description of Artificial Sequence: Synthetic polypeptide
DEEEISTTNPCATEQYGCVCPNWGEHQEYFGSDTQA

SEQ ID NO: 184855 - protein, 34 aa, Artificial Sequence
  Description of Artificial Sequence: Synthetic polypeptide
AEEEIASVNPVCTEQYGVVCSNWNHNQSFNSDQA

SEQ ID NO: 184856 - protein, 33 aa, Artificial Sequence
  Description of Artificial Sequence: Synthetic polypeptide
AEEEIASVNPVCTEQYGVVCSSEHNQESFGSDQ

SEQ ID NO: 184857 - protein, 36 aa, Artificial Sequence
  Description of Artificial Sequence: Synthetic polypeptide
DEHEIRTTNPVATEQYGSVPYQPDEENQTPSIEEQP

SEQ ID NO: 184858 - protein, 33 aa, Artificial Sequence
  Description of Artificial Sequence: Synthetic polypeptide
AEEEIASVNPVCTEQYGVVCSSEPNQSFGSDQA

SEQ ID NO: 184859 - protein, 37 aa, Artificial Sequence
  Description of Artificial Sequence: Synthetic polypeptide
TGEEIATTNPVAYEQWGSCVQNGGNAGEDLQREGNPQ

SEQ ID NO: 184860 - protein, 33 aa, Artificial Sequence
  Description of Artificial Sequence: Synthetic polypeptide
TGEEIATTNPVAYEQWGHVSGEGNGNHGEGDTS

SEQ ID NO: 184861 - protein, 36 aa, Artificial Sequence
  Description of Artificial Sequence: Synthetic polypeptide
DEEEISTTNPCATEQYGCVCSWGEDNAEYFNSDTQA

SEQ ID NO: 184862 - protein, 33 aa, Artificial Sequence
  Description of Artificial Sequence: Synthetic polypeptide
TGAEEATTNPVAYECWGSVSGGLNDDRQPQGNH

SEQ ID NO: 184863 - protein, 36 aa, Artificial Sequence
  Description of Artificial Sequence: Synthetic polypeptide
TESEIRTTNPVATESWGSVVSCGHEFSQDREGEEGW

SEQ ID NO: 184864 - protein, 33 aa, Artificial Sequence
  Description of Artificial Sequence: Synthetic polypeptide
QENEIATTNPVATECYGATTANEECWQEHGEYL

SEQ ID NO: 184865 - protein, 31 aa, Artificial Sequence
  Description of Artificial Sequence: Synthetic polypeptide
QENEIATTNPVATECYGATVAAECWAEHEPL

SEQ ID NO: 184866 - protein, 38 aa, Artificial Sequence
  Description of Artificial Sequence: Synthetic polypeptide
DEEEIRTTNPVATEQYGCVCSMWGEPHNIENFNSENQS

SEQ ID NO: 184867 - protein, 36 aa, Artificial Sequence
  Description of Artificial Sequence: Synthetic polypeptide
DEEEIATTNPVAYEQYGSVCAGNGGLADAPIDEMAM

SEQ ID NO: 184868 - protein, 35 aa, Artificial Sequence
  Description of Artificial Sequence: Synthetic polypeptide
DDAVIRTTNPVATEQYGCVCETGEPNQEYFGSDQS

SEQ ID NO: 184869 - protein, 37 aa, Artificial Sequence
  Description of Artificial Sequence: Synthetic polypeptide
DEHEIRTTNPVATEQYGCVDTDAENGSAETQEESQVE

SEQ ID NO: 184870 - protein, 31 aa, Artificial Sequence
  Description of Artificial Sequence: Synthetic polypeptide
DDCEVASTNPVSTEGYGAVAYNTIVSGVGQR

SEQ ID NO: 184871 - protein, 37 aa, Artificial Sequence
  Description of Artificial Sequence: Synthetic polypeptide
TESEIRTTNPVATEEWGSVVSCGHEFSQDREGEVNGW

SEQ ID NO: 184872 - protein, 35 aa, Artificial Sequence
  Description of Artificial Sequence: Synthetic polypeptide
DDEAIRTTNPVATEQWGCVTSWGEHNQENFGSDAS

SEQ ID NO: 184873 - protein, 35 aa, Artificial Sequence
  Description of Artificial Sequence: Synthetic polypeptide
DEEEISTTNPEATCQYGCVCPTGEDNQNFGSDTFS

SEQ ID NO: 184874 - protein, 36 aa, Artificial Sequence
  Description of Artificial Sequence: Synthetic polypeptide
TESEIRTTNPVATECWGCSVVSCGHEFSQDREGEMG

SEQ ID NO: 184875 - protein, 37 aa, Artificial Sequence
  Description of Artificial Sequence: Synthetic polypeptide
TESEIRTTNPVATEAWGSVVSQGHEFSQDREGENSGW

SEQ ID NO: 184876 - protein, 37 aa, Artificial Sequence
  Description of Artificial Sequence: Synthetic polypeptide
TESEIRTTNPVATEAWGSVVSLCGFEFSQDREGENGW

SEQ ID NO: 184877 - protein, 37 aa, Artificial Sequence
  Description of Artificial Sequence: Synthetic polypeptide
TESEIRTTNPVATEAWGSVVSAHGHEFSQDREGENGW

SEQ ID NO: 184878 - protein, 35 aa, Artificial Sequence
  Description of Artificial Sequence: Synthetic polypeptide
DDEAISTTNPVATEQYGCVCSWGEHNQNFNSDTQA

SEQ ID NO: 184879 - protein, 36 aa, Artificial Sequence
  Description of Artificial Sequence: Synthetic polypeptide
TESEIATTNPCATEQYGTVCSDTGEEWSENENGGND

SEQ ID NO: 184880 - protein, 36 aa, Artificial Sequence
  Description of Artificial Sequence: Synthetic polypeptide
TESEIATTNPCATEQYGTVCSATGEEWSENMNGGNL

SEQ ID NO: 184881 - protein, 31 aa, Artificial Sequence
  Description of Artificial Sequence: Synthetic polypeptide
TESEIASTNPVGYEGYGVTIASTLSQHGGDI

SEQ ID NO: 184882 - protein, 32 aa, Artificial Sequence
  Description of Artificial Sequence: Synthetic polypeptide
DDSEVASTNPCSTEGYGNVAANTTIQSRVGQR

SEQ ID NO: 184883 - protein, 32 aa, Artificial Sequence
  Description of Artificial Sequence: Synthetic polypeptide
TESEIASTNPVGYEAYGCVMACSTLSQHGGDI

SEQ ID NO: 184884 - protein, 31 aa, Artificial Sequence
  Description of Artificial Sequence: Synthetic polypeptide
DDSEVASTNPIATEGYGNVANATIQSRKGQI

SEQ ID NO: 184885 - protein, 38 aa, Artificial Sequence
  Description of Artificial Sequence: Synthetic polypeptide
DEEEIRTTNPVATEQYGSVCCMLLMNAMEPAQDEMFYD

SEQ ID NO: 184886 - protein, 36 aa, Artificial Sequence
  Description of Artificial Sequence: Synthetic polypeptide
DEEEISTTNPCATEQYGCVCSWGEHNAEYFNSDNQS

SEQ ID NO: 184887 - protein, 36 aa, Artificial Sequence
  Description of Artificial Sequence: Synthetic polypeptide
DEEEISTTNPCATEQYGCVCSWMEDNAENFGSDTQS

SEQ ID NO: 184888 - protein, 38 aa, Artificial Sequence
  Description of Artificial Sequence: Synthetic polypeptide
DEEEIRTTNPVATEQYGCVCSMWGEAHNQENFNSENQA

SEQ ID NO: 184889 - protein, 38 aa, Artificial Sequence
  Description of Artificial Sequence: Synthetic polypeptide
DEEEIRTTNPVATEQYGCVCSMWGEDHNAENFGSDTQA

SEQ ID NO: 184890 - protein, 38 aa, Artificial Sequence
  Description of Artificial Sequence: Synthetic polypeptide
DEEEIRTTNPVATEQYGCVCSMWGEDHNEENFNSDTQA

SEQ ID NO: 184891 - protein, 38 aa, Artificial Sequence
  Description of Artificial Sequence: Synthetic polypeptide
DEEEIRTTNPVATEQYGCVCSMWGEDHNQEHFNSENQA

SEQ ID NO: 184892 - protein, 30 aa, Artificial Sequence
  Description of Artificial Sequence: Synthetic polypeptide
QENEIASTNPVGTEGYGVIAMEDIQQQGDH

SEQ ID NO: 184893 - protein, 38 aa, Artificial Sequence
  Description of Artificial Sequence: Synthetic polypeptide
DEEEIRTTNPVATEQYGCVCSMWGEDHNQENFNSDFQF

SEQ ID NO: 184894 - protein, 35 aa, Artificial Sequence
  Description of Artificial Sequence: Synthetic polypeptide
DDAEISTTNPVATEQYGCVCSWEDHNQESFGSDQA

SEQ ID NO: 184895 - protein, 36 aa, Artificial Sequence
  Description of Artificial Sequence: Synthetic polypeptide
DDAEISTTNPVATEQYGCVCSWEEHNQENFGSDNQS

SEQ ID NO: 184896 - protein, 38 aa, Artificial Sequence
  Description of Artificial Sequence: Synthetic polypeptide
DEEEIRTTNPVATEQYGCVCSMWGEDHNQENFNSDTQS

SEQ ID NO: 184897 - protein, 35 aa, Artificial Sequence
  Description of Artificial Sequence: Synthetic polypeptide
DDAEISTTNPVATEQYGCVCSWGEHEQENFGSDQS

SEQ ID NO: 184898 - protein, 35 aa, Artificial Sequence
  Description of Artificial Sequence: Synthetic polypeptide
TETPIRSTNPVAYEQYGQTVVVSTNYEWTSVGNSN

SEQ ID NO: 184899 - protein, 35 aa, Artificial Sequence
  Description of Artificial Sequence: Synthetic polypeptide
DEEEISTTNPCATEQYGQCVCPWEDQENFGSDTQA

SEQ ID NO: 184900 - protein, 33 aa, Artificial Sequence
  Description of Artificial Sequence: Synthetic polypeptide
QENEIATTNPVATASWGCVAGNNNLQTDAGGGH

SEQ ID NO: 184901 - protein, 34 aa, Artificial Sequence
  Description of Artificial Sequence: Synthetic polypeptide
TETEIATTNPVAYEQWGCLYCFEGNDGQRQNGDR

SEQ ID NO: 184902 - protein, 36 aa, Artificial Sequence
  Description of Artificial Sequence: Synthetic polypeptide
DEEEISTTNPCATEQYGQCVCSNSGEHNQNFGSDQS

SEQ ID NO: 184903 - protein, 32 aa, Artificial Sequence
  Description of Artificial Sequence: Synthetic polypeptide
TESEISSTNPVGTEGYGVIAQTELSQHTGGDI

SEQ ID NO: 184904 - protein, 38 aa, Artificial Sequence
  Description of Artificial Sequence: Synthetic polypeptide
DEEEIRTTNPVATEQYGSVCCMLMMNAPEPAQDEMQFD

SEQ ID NO: 184905 - protein, 36 aa, Artificial Sequence
  Description of Artificial Sequence: Synthetic polypeptide
DEEEISTTNPCATEQYGQCVCSWGEHNQENFNSDQL

SEQ ID NO: 184906 - protein, 34 aa, Artificial Sequence
  Description of Artificial Sequence: Synthetic polypeptide
DEGNEIATTNPVAYEQWGCVYSIEIEMNQREMDH

SEQ ID NO: 184907 - protein, 37 aa, Artificial Sequence
  Description of Artificial Sequence: Synthetic polypeptide
DEEEISTTNPVATEQYGCVCSNWGEHNAENFNSDTQS

SEQ ID NO: 184908 - protein, 37 aa, Artificial Sequence
  Description of Artificial Sequence: Synthetic polypeptide
DEEEISTTNPVATEQYGCVCSNWGEHNAENFNSQTQP

SEQ ID NO: 184909 - protein, 36 aa, Artificial Sequence
  Description of Artificial Sequence: Synthetic polypeptide
DEEEISTTNPVATEQYGQCVCQWGEDNQENFNSEQP

SEQ ID NO: 184910 - protein, 36 aa, Artificial Sequence
  Description of Artificial Sequence: Synthetic polypeptide
SEQEIATTNPVATAQWGSVSATGTPGTDHQGDEDNR

SEQ ID NO: 184911 - protein, 37 aa, Artificial Sequence
  Description of Artificial Sequence: Synthetic polypeptide
DEEEIGTTNPVATEQYGCVCSWEEDHNQENFNSDTQS

SEQ ID NO: 184912 - protein, 36 aa, Artificial Sequence
  Description of Artificial Sequence: Synthetic polypeptide
SEQEIATTNPVATAQWGSVSATGDLEADTPPGEDNN

SEQ ID NO: 184913 - protein, 34 aa, Artificial Sequence
  Description of Artificial Sequence: Synthetic polypeptide
SEPEIQTTNPVAYESYGSVCCLGSHSHTRGGTEL

SEQ ID NO: 184914 - protein, 35 aa, Artificial Sequence
  Description of Artificial Sequence: Synthetic polypeptide
SEPEIATTNPVATEQYGNVSAMDLNEDHQGLEDEN

SEQ ID NO: 184915 - protein, 36 aa, Artificial Sequence
  Description of Artificial Sequence: Synthetic polypeptide
DEEEISTTNPVATEQYGQCVCSDWGEDQENFISDQP

SEQ ID NO: 184916 - protein, 37 aa, Artificial Sequence
  Description of Artificial Sequence: Synthetic polypeptide
DEEEISTTNPVATEQYGQCVCSDWGEHNQESFNSDQP

SEQ ID NO: 184917 - protein, 38 aa, Artificial Sequence
  Description of Artificial Sequence: Synthetic polypeptide
DEEEISTTNPVATEQYGQCVCQNWGEHNQENFGSDNQS

SEQ ID NO: 184918 - protein, 35 aa, Artificial Sequence
  Description of Artificial Sequence: Synthetic polypeptide
DDEEIKTTNPVATEQYGAVSDGVEGEEDGGQGEED

SEQ ID NO: 184919 - protein, 38 aa, Artificial Sequence
  Description of Artificial Sequence: Synthetic polypeptide
DEEEISTTNPVATEQYGQCVCSMSGELNQENFGSDTQS

SEQ ID NO: 184920 - protein, 37 aa, Artificial Sequence
  Description of Artificial Sequence: Synthetic polypeptide
DEEEISTTNPVATEQYGQCVCSMSMEDHNQNFGSDQA

SEQ ID NO: 184921 - protein, 37 aa, Artificial Sequence
  Description of Artificial Sequence: Synthetic polypeptide
SENEIRTTNPVATEQYGTVYNSYTLMGMHQELQEDTL

SEQ ID NO: 184922 - protein, 38 aa, Artificial Sequence
  Description of Artificial Sequence: Synthetic polypeptide
DEEEISTTNPVATEQYGQCVCSMTGEDNQENFGSDTQN

SEQ ID NO: 184923 - protein, 38 aa, Artificial Sequence
  Description of Artificial Sequence: Synthetic polypeptide
DEEEISTTNPVATEQYGQCVCSMTGEHNQEYFGSETQA

SEQ ID NO: 184924 - protein, 37 aa, Artificial Sequence
  Description of Artificial Sequence: Synthetic polypeptide
DEEEISTTNPVATEQYGQCVCSMWEEHNQEHFGSDQS

SEQ ID NO: 184925 - protein, 37 aa, Artificial Sequence
  Description of Artificial Sequence: Synthetic polypeptide
DEEEISTTNPVATEQYGQCVCSMWGEHNQENFNSDQA

SEQ ID NO: 184926 - protein, 36 aa, Artificial Sequence
  Description of Artificial Sequence: Synthetic polypeptide
SENEIRTTNPVATEQYGSVFYPWADMDNNGFENNML

SEQ ID NO: 184927 - protein, 38 aa, Artificial Sequence
  Description of Artificial Sequence: Synthetic polypeptide
DEEEISTTNPVATEQYGQCVCSMSGEHNAENFGSDNQA

SEQ ID NO: 184928 - protein, 36 aa, Artificial Sequence
  Description of Artificial Sequence: Synthetic polypeptide
SEQEIATTNPVATEQYGSVVAPSDLNEDHQGLEDEN

SEQ ID NO: 184929 - protein, 39 aa, Artificial Sequence
  Description of Artificial Sequence: Synthetic polypeptide
DDEEIKTTNPVATEQYGAVNMTNLTIIQEGDQEEGGNQI

SEQ ID NO: 184930 - protein, 36 aa, Artificial Sequence
  Description of Artificial Sequence: Synthetic polypeptide
DEEEISTTNPVATEQYGQCVCPWEEHEQNFGSDTQN

SEQ ID NO: 184931 - protein, 37 aa, Artificial Sequence
  Description of Artificial Sequence: Synthetic polypeptide
DEEEIGTTNPVATEQYGCVCSTGEDHNQENFMSQTQS

SEQ ID NO: 184932 - protein, 37 aa, Artificial Sequence
  Description of Artificial Sequence: Synthetic polypeptide
DEEEISTTNPVATEQYGQCVCGNWEHNQENFNSDTQS

SEQ ID NO: 184933 - protein, 33 aa, Artificial Sequence
  Description of Artificial Sequence: Synthetic polypeptide
SESEIACTNPVAYEGYGEYCSCENLSQTVGIDD

SEQ ID NO: 184934 - protein, 33 aa, Artificial Sequence
  Description of Artificial Sequence: Synthetic polypeptide
SESEIACTNPVAYEGYGEACSCENLSQTVGGQM

SEQ ID NO: 184935 - protein, 37 aa, Artificial Sequence
  Description of Artificial Sequence: Synthetic polypeptide
DDEEIGTTNPVATEQYGCVCSNWGEHDQENFGSENQS

SEQ ID NO: 184936 - protein, 33 aa, Artificial Sequence
  Description of Artificial Sequence: Synthetic polypeptide
SESEIACTNPVAYDGYGEACSCENLSQAVGGNT

SEQ ID NO: 184937 - protein, 37 aa, Artificial Sequence
  Description of Artificial Sequence: Synthetic polypeptide
DDEEIKTTNPVATDQYGSVSVDQQGGEQGNEGGNGNG

SEQ ID NO: 184938 - protein, 36 aa, Artificial Sequence
  Description of Artificial Sequence: Synthetic polypeptide
DEEEIRTTNPTAVEQYGSVCSSVKHSSETPMGSIPN

SEQ ID NO: 184939 - protein, 38 aa, Artificial Sequence
  Description of Artificial Sequence: Synthetic polypeptide
DEEEISTTNPVATEQYGQCVCGNWGEHNQENFGSDNQD

SEQ ID NO: 184940 - protein, 38 aa, Artificial Sequence
  Description of Artificial Sequence: Synthetic polypeptide
DDEEIKTTNPVATEQYGAVNMTNEIQQEGDQEEGGNEI

SEQ ID NO: 184941 - protein, 38 aa, Artificial Sequence
  Description of Artificial Sequence: Synthetic polypeptide
DDEEIKTTNPVATEQYGAVNMTNIIQQEGDQQEGGNQI

SEQ ID NO: 184942 - protein, 34 aa, Artificial Sequence
  Description of Artificial Sequence: Synthetic polypeptide
SESCIRCTNPVATEQYGCVFWPNNNSIRIDDQNL

SEQ ID NO: 184943 - protein, 35 aa, Artificial Sequence
  Description of Artificial Sequence: Synthetic polypeptide
SESAEEIATTNPVAYECWGSVATGDDRQGTGQDQR

SEQ ID NO: 184944 - protein, 35 aa, Artificial Sequence
  Description of Artificial Sequence: Synthetic polypeptide
SEREIRTTNPVATEQYGCVCGWEHNAEYFGSDTQS

SEQ ID NO: 184945 - protein, 36 aa, Artificial Sequence
  Description of Artificial Sequence: Synthetic polypeptide
DEEEISTTNPVATEQYGQCVCGSEEHNANFNSDTQS

SEQ ID NO: 184946 - protein, 37 aa, Artificial Sequence
  Description of Artificial Sequence: Synthetic polypeptide
DEEEISTTNPVATEQYGQCVCGTGEHNQENFGSQTQS

SEQ ID NO: 184947 - protein, 36 aa, Artificial Sequence
  Description of Artificial Sequence: Synthetic polypeptide
DEEEISTTNPVATEQYGQCVCGWGEHNAENFNSDQA

SEQ ID NO: 184948 - protein, 37 aa, Artificial Sequence
  Description of Artificial Sequence: Synthetic polypeptide
DEEEISTTNPVATEQYGQCVCPNWEHNQENFNSDTQN

SEQ ID NO: 184949 - protein, 37 aa, Artificial Sequence
  Description of Artificial Sequence: Synthetic polypeptide
DEEEISTTNPVATEQYGQCVCPNWGEHNQENFGSDQS

SEQ ID NO: 184950 - protein, 37 aa, Artificial Sequence
  Description of Artificial Sequence: Synthetic polypeptide
SENEIRTTNPVATEQYGSVFYPTSADMDNNGFENNMP

SEQ ID NO: 184951 - protein, 37 aa, Artificial Sequence
  Description of Artificial Sequence: Synthetic polypeptide
DEEEISTTNPVATEQYGQCVCGNSGEPNQNFNSDTQS

SEQ ID NO: 184952 - protein, 38 aa, Artificial Sequence
  Description of Artificial Sequence: Synthetic polypeptide
DEEEIRTTNPVATEQYGSSVCTDPMDIILFTEVEPVAS

SEQ ID NO: 184953 - protein, 37 aa, Artificial Sequence
  Description of Artificial Sequence: Synthetic polypeptide
DEHEIATTNPVATEQYGSVCAMNNGLLEPPDDQAEGA

SEQ ID NO: 184954 - protein, 38 aa, Artificial Sequence
  Description of Artificial Sequence: Synthetic polypeptide
DEEEIGTTNPVATEQYGQCVCSWGEDHDQENFGSENQS

SEQ ID NO: 184955 - protein, 37 aa, Artificial Sequence
  Description of Artificial Sequence: Synthetic polypeptide
SENEIRTTNPVATEQYGCVITATDMDIQMRDNSPQQS

SEQ ID NO: 184956 - protein, 37 aa, Artificial Sequence
  Description of Artificial Sequence: Synthetic polypeptide
DEEEIGTTNPVATEQYGQCVCSWGEDHNQEGFGSEQS

SEQ ID NO: 184957 - protein, 37 aa, Artificial Sequence
  Description of Artificial Sequence: Synthetic polypeptide
SENEIRTTNPVATEQYGCVAVTGNEMIMLEYGQETHI

SEQ ID NO: 184958 - protein, 36 aa, Artificial Sequence
  Description of Artificial Sequence: Synthetic polypeptide
SENEIRTTNPVATEQYGCTCSTLEVLEQVTPPEDSI

SEQ ID NO: 184959 - protein, 35 aa, Artificial Sequence
  Description of Artificial Sequence: Synthetic polypeptide
SENEIRTTNPVATEQYGCCSTTHVLELLTPFEDSY

SEQ ID NO: 184960 - protein, 38 aa, Artificial Sequence
  Description of Artificial Sequence: Synthetic polypeptide
DEEEISTTNPVATEQYGQCVCSNSGEDNQEGFGSENQS

SEQ ID NO: 184961 - protein, 38 aa, Artificial Sequence
  Description of Artificial Sequence: Synthetic polypeptide
DEEEISTTNPVATEQYGQCVCSNSGEHNAEFFGSDNQP

SEQ ID NO: 184962 - protein, 37 aa, Artificial Sequence
  Description of Artificial Sequence: Synthetic polypeptide
DEEEIGTTNPVATEQYGQCVCSWEDHNAENFGSDTQA

SEQ ID NO: 184963 - protein, 35 aa, Artificial Sequence
  Description of Artificial Sequence: Synthetic polypeptide
DEHEIATTNPVATEQWGATVCAATDGPEEAEGNND

SEQ ID NO: 184964 - protein, 37 aa, Artificial Sequence
  Description of Artificial Sequence: Synthetic polypeptide
DEEEISTTNPVATEQYGQCVCSNSGEHNQENFSSNQT

SEQ ID NO: 184965 - protein, 37 aa, Artificial Sequence
  Description of Artificial Sequence: Synthetic polypeptide
DEEEIGTTNPVATEQYGQCVCSWGEHNQEFFNSDTQA

SEQ ID NO: 184966 - protein, 37 aa, Artificial Sequence
  Description of Artificial Sequence: Synthetic polypeptide
DDEEIKTTNPVATEQYGSVYGGNTTAGQEGEGQGAED

SEQ ID NO: 184967 - protein, 38 aa, Artificial Sequence
  Description of Artificial Sequence: Synthetic polypeptide
DEEEISTTNPVATEQYGQCVCSNSGEHNQEYFGSDNQS

SEQ ID NO: 184968 - protein, 37 aa, Artificial Sequence
  Description of Artificial Sequence: Synthetic polypeptide
DEEEISTTNPVATEQYGQCVCSNTEHNQENFISQTQS

SEQ ID NO: 184969 - protein, 39 aa, Artificial Sequence
  Description of Artificial Sequence: Synthetic polypeptide
DEEEIRTTNPVATEQYGSQVVSCIAVIDDSTNYEITHIS

SEQ ID NO: 184970 - protein, 37 aa, Artificial Sequence
  Description of Artificial Sequence: Synthetic polypeptide
DDEEIKTTNPVATEQYGSVYGQGQGDQEVGNGGEENA

SEQ ID NO: 184971 - protein, 36 aa, Artificial Sequence
  Description of Artificial Sequence: Synthetic polypeptide
DDEEIKTTNPVATEQYGSVYGQNTTDGEEGEGQGEG

SEQ ID NO: 184972 - protein, 37 aa, Artificial Sequence
  Description of Artificial Sequence: Synthetic polypeptide
DEEEIGTTNPVATEQYGQCVCSWGEDHNQEYFGSQQS

SEQ ID NO: 184973 - protein, 37 aa, Artificial Sequence
  Description of Artificial Sequence: Synthetic polypeptide
DEEEISTTNPVATEQYGQCVCSNSEHNQENFQSDTQD

SEQ ID NO: 184974 - protein, 36 aa, Artificial Sequence
  Description of Artificial Sequence: Synthetic polypeptide
DEHEIATTNPVATEQYGCVYVWEMNDIQDQVQDNHV

SEQ ID NO: 184975 - protein, 36 aa, Artificial Sequence
  Description of Artificial Sequence: Synthetic polypeptide
DEHEIATTNPVATEQYGCVYVWEMNDIQQTQHNHGG

SEQ ID NO: 184976 - protein, 38 aa, Artificial Sequence
  Description of Artificial Sequence: Synthetic polypeptide
SENEIRTTNPVATEQYGSSCWWVTMDIEQIQGSNDGRV

SEQ ID NO: 184977 - protein, 39 aa, Artificial Sequence
  Description of Artificial Sequence: Synthetic polypeptide
SENEIRTTNPVATEQYGSSCIWVPMNIEMQIQGSNDGRV

SEQ ID NO: 184978 - protein, 36 aa, Artificial Sequence
  Description of Artificial Sequence: Synthetic polypeptide
SENEIRTTNPVATEQYGSLFCNEWHDENRPEDSQRE

SEQ ID NO: 184979 - protein, 38 aa, Artificial Sequence
  Description of Artificial Sequence: Synthetic polypeptide
DEEEISTTNPVATEQYGQCVCSMWGEHNTENFGSDNQS

SEQ ID NO: 184980 - protein, 36 aa, Artificial Sequence
  Description of Artificial Sequence: Synthetic polypeptide
SENEIRTTNPVATEQYGSGFANWHHDENRPEDSQIE

SEQ ID NO: 184981 - protein, 37 aa, Artificial Sequence
  Description of Artificial Sequence: Synthetic polypeptide
DEEEIGTTNPVATEQYGQCVCSNWEDHNQENFGSDQS

SEQ ID NO: 184982 - protein, 36 aa, Artificial Sequence
  Description of Artificial Sequence: Synthetic polypeptide
SENEIRTTNPVATEQYGSGFANESWDENRPEDSQRE

SEQ ID NO: 184983 - protein, 37 aa, Artificial Sequence
  Description of Artificial Sequence: Synthetic polypeptide
DEHEIATTNPVATEQYGSVCAANMGEEAPDAQMEGKD

SEQ ID NO: 184984 - protein, 39 aa, Artificial Sequence
  Description of Artificial Sequence: Synthetic polypeptide
DDEEIKTTNPVATEQYGSVNMTNTINQEAGQEEGGNTTP

SEQ ID NO: 184985 - protein, 36 aa, Artificial Sequence
  Description of Artificial Sequence: Synthetic polypeptide
SENEIRTTNPVATEQYGSGFANEHSIENRPEDSQRE

SEQ ID NO: 184986 - protein, 36 aa, Artificial Sequence
  Description of Artificial Sequence: Synthetic polypeptide
SENEIRTTNPVATEQYGSGFANEHHDENRPEYSQEE

SEQ ID NO: 184987 - protein, 36 aa, Artificial Sequence
  Description of Artificial Sequence: Synthetic polypeptide
SENEIRTTNPVATEQYGSGFACNEHDENRPEDSQQE

SEQ ID NO: 184988 - protein, 37 aa, Artificial Sequence
  Description of Artificial Sequence: Synthetic polypeptide
DDEEIKTTNPVATEQYGSVVIMDNGGEGDEFNENDQE

SEQ ID NO: 184989 - protein, 38 aa, Artificial Sequence
  Description of Artificial Sequence: Synthetic polypeptide
SENEIRTTNPVATEQYGSFVSVSSLVDTQMEGGIEKFG

SEQ ID NO: 184990 - protein, 37 aa, Artificial Sequence
  Description of Artificial Sequence: Synthetic polypeptide
DEHEIATTNPVATEQYGSACAATNPEEAGDSQMGHTM

SEQ ID NO: 184991 - protein, 36 aa, Artificial Sequence
  Description of Artificial Sequence: Synthetic polypeptide
SENEIRTTNPVATEQYGSFFANEHHDENSPEDSQRE

SEQ ID NO: 184992 - protein, 36 aa, Artificial Sequence
  Description of Artificial Sequence: Synthetic polypeptide
SENEIRTTNPVATEQYGSCMYPTADMDNNGFESNMV

SEQ ID NO: 184993 - protein, 38 aa, Artificial Sequence
  Description of Artificial Sequence: Synthetic polypeptide
DEEEIGTTNPVATEQYGQCVCSNWGEHNQENFGSDNQS

SEQ ID NO: 184994 - protein, 38 aa, Artificial Sequence
  Description of Artificial Sequence: Synthetic polypeptide
DEEEISTTNPVATEQYGQCVCSMWGETNAEAFNSENQS

SEQ ID NO: 184995 - protein, 36 aa, Artificial Sequence
  Description of Artificial Sequence: Synthetic polypeptide
SENEIRTTNPVATEQYGSVAEYAPPLEVTIGVSEQD

SEQ ID NO: 184996 - protein, 39 aa, Artificial Sequence
  Description of Artificial Sequence: Synthetic polypeptide
DEEEIRTTNPVAFEFYGVVNVANDQEGDLGQRGGQRGDQ

SEQ ID NO: 184997 - protein, 33 aa, Artificial Sequence
  Description of Artificial Sequence: Synthetic polypeptide
SESEIASTNPVGTEGYGVSCGSEDLNQHFGSDI

SEQ ID NO: 184998 - protein, 32 aa, Artificial Sequence
  Description of Artificial Sequence: Synthetic polypeptide
SESEIASTNPVGTEGYGVSCGSELQHFGSDIM

SEQ ID NO: 184999 - protein, 37 aa, Artificial Sequence
  Description of Artificial Sequence: Synthetic polypeptide
SNEEIRTTNPVATEQYGSVWPAQDSLVEGVDEINNND

SEQ ID NO: 185000 - protein, 38 aa, Artificial Sequence
  Description of Artificial Sequence: Synthetic polypeptide
SNEEIRTTNPVATEQYGSVMYPTFDDMNNNGLEALNMV

SEQ ID NO: 185001 - protein, 36 aa, Artificial Sequence
  Description of Artificial Sequence: Synthetic polypeptide
SNEEIRTTNPVATEQWGVCSSELCIVTEQNEGQNPC

SEQ ID NO: 185002 - protein, 36 aa, Artificial Sequence
  Description of Artificial Sequence: Synthetic polypeptide
SNEEIRTTNPVATEQWGVCSELCNVTELNEGQNDPC

SEQ ID NO: 185003 - protein, 34 aa, Artificial Sequence
  Description of Artificial Sequence: Synthetic polypeptide
DEHEIATTNPVAYECWGCVSGWNGEERQNMQGDA

SEQ ID NO: 185004 - protein, 35 aa, Artificial Sequence
  Description of Artificial Sequence: Synthetic polypeptide
DEHEIATTNPVAYECWGCVSGGNGEVERNNMNGNA

SEQ ID NO: 185005 - protein, 34 aa, Artificial Sequence
  Description of Artificial Sequence: Synthetic polypeptide
DEHEIATTNPVAYECWGCVSGDNGEERNNMVGDA

SEQ ID NO: 185006 - protein, 36 aa, Artificial Sequence
  Description of Artificial Sequence: Synthetic polypeptide
DEHEIATTNPVAYEAWGVVYSGGNDTEQRQGGGGTR

SEQ ID NO: 185007 - protein, 37 aa, Artificial Sequence
  Description of Artificial Sequence: Synthetic polypeptide
SNEEIRTTNPVATEQYGSVWPAQDSMVEGHEEIMNRH

SEQ ID NO: 185008 - protein, 37 aa, Artificial Sequence
  Description of Artificial Sequence: Synthetic polypeptide
DEHEIATTNPVAYEAWGVVYSGGNDTEQRGGGQGGNR

SEQ ID NO: 185009 - protein, 36 aa, Artificial Sequence
  Description of Artificial Sequence: Synthetic polypeptide
SMEEIRTTNPVATEQYGLSAVAPLEHNDMETQIPVV

SEQ ID NO: 185010 - protein, 35 aa, Artificial Sequence
  Description of Artificial Sequence: Synthetic polypeptide
DEHEIATTNPVAYEAWGCVSGWNGEDERNNMQGNA

SEQ ID NO: 185011 - protein, 38 aa, Artificial Sequence
  Description of Artificial Sequence: Synthetic polypeptide
DEEEIRTTNPVATEAYGAVQTNGNNDEIGTSISTTGNT

SEQ ID NO: 185012 - protein, 34 aa, Artificial Sequence
  Description of Artificial Sequence: Synthetic polypeptide
DEHEIATTNPVAYEAWGCVSGDNGETRNNMQGDA

SEQ ID NO: 185013 - protein, 33 aa, Artificial Sequence
  Description of Artificial Sequence: Synthetic polypeptide
QENEIATTNPVATEPYGNTVSGEHIQHMDESLH

SEQ ID NO: 185014 - protein, 34 aa, Artificial Sequence
  Description of Artificial Sequence: Synthetic polypeptide
QENEIATTNPVATEPYGNTVSGEHLQHQMIEKLN

SEQ ID NO: 185015 - protein, 34 aa, Artificial Sequence
  Description of Artificial Sequence: Synthetic polypeptide
QENEIATTNPVATEPYGNVPSGEHLNQHMIMQLN

SEQ ID NO: 185016 - protein, 35 aa, Artificial Sequence
  Description of Artificial Sequence: Synthetic polypeptide
QENEIATTNPVATEPYGNVPSGEHLNQNHMEMGLY

SEQ ID NO: 185017 - protein, 37 aa, Artificial Sequence
  Description of Artificial Sequence: Synthetic polypeptide
SMEEIRTTNPVATEQYGSVMYPSFDDMNNNGLELNMV

SEQ ID NO: 185018 - protein, 38 aa, Artificial Sequence
  Description of Artificial Sequence: Synthetic polypeptide
AEEEIRTTNPVATEQYGSVQSLSMNNTEVEGMAPPELI

SEQ ID NO: 185019 - protein, 35 aa, Artificial Sequence
  Description of Artificial Sequence: Synthetic polypeptide
DEHEIATTNPVAYECWGSVAWTDDQDDRNQGGDES

SEQ ID NO: 185020 - protein, 35 aa, Artificial Sequence
  Description of Artificial Sequence: Synthetic polypeptide
SNEEIRTTNPVAVEQWGCVSVLVNTYTEGVQNGPP

SEQ ID NO: 185021 - protein, 37 aa, Artificial Sequence
  Description of Artificial Sequence: Synthetic polypeptide
DEEEIGTTNPVATEQYGCVCSNWGEDHNQENSNSEQQ

SEQ ID NO: 185022 - protein, 36 aa, Artificial Sequence
  Description of Artificial Sequence: Synthetic polypeptide
DEEEIGTTNPVATEQYGCVCSNWGEHDQENFISEQS

SEQ ID NO: 185023 - protein, 37 aa, Artificial Sequence
  Description of Artificial Sequence: Synthetic polypeptide
DEEEIGTTNPVATEQYGCVCSNWGEHNAENFNSDNQA

SEQ ID NO: 185024 - protein, 35 aa, Artificial Sequence
  Description of Artificial Sequence: Synthetic polypeptide
DEHEIATTNPVAYEEWGCVSGWNGEERNNMDNGNA

SEQ ID NO: 185025 - protein, 34 aa, Artificial Sequence
  Description of Artificial Sequence: Synthetic polypeptide
DEHEIATTNPVAYECWGTVYWTNENQDRQDIHVY

SEQ ID NO: 185026 - protein, 34 aa, Artificial Sequence
  Description of Artificial Sequence: Synthetic polypeptide
DEHEIATTNPVAYECWGTVYWINENQDRQMGHLG

SEQ ID NO: 185027 - protein, 34 aa, Artificial Sequence
  Description of Artificial Sequence: Synthetic polypeptide
SQAEIRTTNPVATEQYGSMWVPWLDMERNEVYQE

SEQ ID NO: 185028 - protein, 34 aa, Artificial Sequence
  Description of Artificial Sequence: Synthetic polypeptide
DEHEIATTNPVAYECWGTVYRINENQDRREDSNG

SEQ ID NO: 185029 - protein, 39 aa, Artificial Sequence
  Description of Artificial Sequence: Synthetic polypeptide
DEEEIRTTNPVATEQYGSTPNTQLVNYEEQIIILPTQNS

SEQ ID NO: 185030 - protein, 35 aa, Artificial Sequence
  Description of Artificial Sequence: Synthetic polypeptide
SQAEIRTTNPVATEQYGSCSAPIEHIQLESQNTSQ

SEQ ID NO: 185031 - protein, 35 aa, Artificial Sequence
  Description of Artificial Sequence: Synthetic polypeptide
SQAEIRTTNPVATEQYGMCCSYIVDLQHSGQDSKQ

SEQ ID NO: 185032 - protein, 35 aa, Artificial Sequence
  Description of Artificial Sequence: Synthetic polypeptide
SQAEIRTTNPVATEQYGMCCSISVPEQHSGQDSKQ

SEQ ID NO: 185033 - protein, 36 aa, Artificial Sequence
  Description of Artificial Sequence: Synthetic polypeptide
DEEEISTTNPVATEQYGCVCSWGEHNQENFISDTQA

SEQ ID NO: 185034 - protein, 36 aa, Artificial Sequence
  Description of Artificial Sequence: Synthetic polypeptide
DEEEISTTNPVATEQYGCVCSWGEHNQENFISDTQS

SEQ ID NO: 185035 - protein, 36 aa, Artificial Sequence
  Description of Artificial Sequence: Synthetic polypeptide
SNSEIRTTNPVATEQYGSYSCSAESVTTESNTQSLN

SEQ ID NO: 185036 - protein, 37 aa, Artificial Sequence
  Description of Artificial Sequence: Synthetic polypeptide
SNNEIRTTNPVATEQYGSVTMTPDNLWNETIGPEDQG

SEQ ID NO: 185037 - protein, 36 aa, Artificial Sequence
  Description of Artificial Sequence: Synthetic polypeptide
DEEEISTTNPVATEQYGCVCSWGEHNQENFISETQA

SEQ ID NO: 185038 - protein, 34 aa, Artificial Sequence
  Description of Artificial Sequence: Synthetic polypeptide
DEHEIATTNPVAYECWGSVAWTDDTDDRNGGDSM

SEQ ID NO: 185039 - protein, 34 aa, Artificial Sequence
  Description of Artificial Sequence: Synthetic polypeptide
SNEEIRTTNPVAVEQWGCVTLANTYTEGVQNHPP

SEQ ID NO: 185040 - protein, 35 aa, Artificial Sequence
  Description of Artificial Sequence: Synthetic polypeptide
QENEIATTNPVATEPYGNVPSGEHLPQAHGMMQQN

SEQ ID NO: 185041 - protein, 35 aa, Artificial Sequence
  Description of Artificial Sequence: Synthetic polypeptide
SEYEIRCTNPVATEQYGCVCETEDHNQEHFGSDQS

SEQ ID NO: 185042 - protein, 38 aa, Artificial Sequence
  Description of Artificial Sequence: Synthetic polypeptide
DEEEISTTNPVATEQYGCVCYNWGEDHNQENFGSENQS

SEQ ID NO: 185043 - protein, 36 aa, Artificial Sequence
  Description of Artificial Sequence: Synthetic polypeptide
SEVEIATTNPVATEQYGSTACAANDGLPLGSEGNNH

SEQ ID NO: 185044 - protein, 35 aa, Artificial Sequence
  Description of Artificial Sequence: Synthetic polypeptide
DEACIRTTNPVATEIYGCVCGTGEHNQENFGSQQA

SEQ ID NO: 185045 - protein, 37 aa, Artificial Sequence
  Description of Artificial Sequence: Synthetic polypeptide
DEEEISTTNPVATEQYGCVTSTTPAHNAEHFISDPVS

SEQ ID NO: 185046 - protein, 38 aa, Artificial Sequence
  Description of Artificial Sequence: Synthetic polypeptide
DEEEISTTNPVATEQYGCVTSTWPADHNAEHFNSDPQS

SEQ ID NO: 185047 - protein, 39 aa, Artificial Sequence
  Description of Artificial Sequence: Synthetic polypeptide
DEEEIRTTNPVATEQYGSTGMSAIVYGFEELTQLLNPLE

SEQ ID NO: 185048 - protein, 36 aa, Artificial Sequence
  Description of Artificial Sequence: Synthetic polypeptide
DEEEISTTNPVATEQYGCVVCSNSGEHENFNSDTQL

SEQ ID NO: 185049 - protein, 34 aa, Artificial Sequence
  Description of Artificial Sequence: Synthetic polypeptide
SESEIRTTNPVATAHWGSVCTWEDQQRDQHDTEE

SEQ ID NO: 185050 - protein, 36 aa, Artificial Sequence
  Description of Artificial Sequence: Synthetic polypeptide
DEEEIRTTNPVAIEAYGTTCMTEAWLSQQTIPSNAE

SEQ ID NO: 185051 - protein, 37 aa, Artificial Sequence
  Description of Artificial Sequence: Synthetic polypeptide
DEEEISTTNPVATEQYGQCAVCSNWGEHNANFGSDQS

SEQ ID NO: 185052 - protein, 38 aa, Artificial Sequence
  Description of Artificial Sequence: Synthetic polypeptide
DEEEIRTTNPVATEQYGSTGHWSMEDGEIGVTINPISQ

SEQ ID NO: 185053 - protein, 38 aa, Artificial Sequence
  Description of Artificial Sequence: Synthetic polypeptide
DEEEISTTNPVATEQYGQCAVCSWGEHNIENFGSDNQS

SEQ ID NO: 185054 - protein, 37 aa, Artificial Sequence
  Description of Artificial Sequence: Synthetic polypeptide
DEEEIRTTNPVAFYEQYGITTPSTGEHSTKEGGNNMA

SEQ ID NO: 185055 - protein, 38 aa, Artificial Sequence
  Description of Artificial Sequence: Synthetic polypeptide
DEEEISTTNPVATEQYGQCIVCSNWEHNTENFNSENQA

SEQ ID NO: 185056 - protein, 38 aa, Artificial Sequence
  Description of Artificial Sequence: Synthetic polypeptide
DEEEISTTNPVATEQYGQCIVCSTGEHNTENFNSETQS

SEQ ID NO: 185057 - protein, 33 aa, Artificial Sequence
  Description of Artificial Sequence: Synthetic polypeptide
SESEIRCTNPTAYECWGSVYGENDDMHRNGGVR

SEQ ID NO: 185058 - protein, 37 aa, Artificial Sequence
  Description of Artificial Sequence: Synthetic polypeptide
DEEEISTTNPVATEQYGQCSCSWGEPHNQYFNSDTQS

SEQ ID NO: 185059 - protein, 36 aa, Artificial Sequence
  Description of Artificial Sequence: Synthetic polypeptide
DEEEISTTNPVATEQYGQCVCFNWGEHQNFISETQS

SEQ ID NO: 185060 - protein, 38 aa, Artificial Sequence
  Description of Artificial Sequence: Synthetic polypeptide
DEEEISTTNPVATEQYGQCVCGNSGEHNAENFGSDNQS

SEQ ID NO: 185061 - protein, 38 aa, Artificial Sequence
  Description of Artificial Sequence: Synthetic polypeptide
DEEEISTTNPVATEQYGQCVCGNSGEHNTENFGSDNQS

SEQ ID NO: 185062 - protein, 35 aa, Artificial Sequence
  Description of Artificial Sequence: Synthetic polypeptide
SESEIATTNPVATECYGISTHCTNEHDTSSTNNRH

SEQ ID NO: 185063 - protein, 35 aa, Artificial Sequence
  Description of Artificial Sequence: Synthetic polypeptide
SESEIRTTNPVATEQYGSSYPCTHYEGMGTEDVEQ

SEQ ID NO: 185064 - protein, 38 aa, Artificial Sequence
  Description of Artificial Sequence: Synthetic polypeptide
DEEEISTTNPVATEQYGQCVCSNTGAHNQENFNSDTQS

SEQ ID NO: 185065 - protein, 36 aa, Artificial Sequence
  Description of Artificial Sequence: Synthetic polypeptide
DEEEIRTTNPVATDAYGSVFGVFEDDEGGEIQENID

SEQ ID NO: 185066 - protein, 37 aa, Artificial Sequence
  Description of Artificial Sequence: Synthetic polypeptide
SESEIRTTNPVAYEQWGTVCPTDNHGMVNGQRGNDGP

SEQ ID NO: 185067 - protein, 36 aa, Artificial Sequence
  Description of Artificial Sequence: Synthetic polypeptide
SEVEIATTNPVATEQYGCVAATSGNPQAEAEPNHHH

SEQ ID NO: 185068 - protein, 38 aa, Artificial Sequence
  Description of Artificial Sequence: Synthetic polypeptide
DEEEIRTTNPVATEQYGSTIISYELNEQEHAIAVEIEN

SEQ ID NO: 185069 - protein, 35 aa, Artificial Sequence
  Description of Artificial Sequence: Synthetic polypeptide
SETEIRTTNPVATESWGSVFVNENDHERQGHDQGS

SEQ ID NO: 185070 - protein, 36 aa, Artificial Sequence
  Description of Artificial Sequence: Synthetic polypeptide
SETEIRTTNPVATECYGCVCTIDSNEHNGQQQGDDA

SEQ ID NO: 185071 - protein, 33 aa, Artificial Sequence
  Description of Artificial Sequence: Synthetic polypeptide
SETEIRTTNPIATECWGSTTWANADWMEPGPYR

SEQ ID NO: 185072 - protein, 32 aa, Artificial Sequence
  Description of Artificial Sequence: Synthetic polypeptide
SETEIRTTNPIATECWGATTANADWAPKGNYI

SEQ ID NO: 185073 - protein, 38 aa, Artificial Sequence
  Description of Artificial Sequence: Synthetic polypeptide
DEEEIRTTNPVATDQYGVVNDNSIGQNQGEQLDNNEDQ

SEQ ID NO: 185074 - protein, 38 aa, Artificial Sequence
  Description of Artificial Sequence: Synthetic polypeptide
DEEEIRTTNPVATDQYGVVNDNSIGQGQGQTDNFNEDQ

SEQ ID NO: 185075 - protein, 37 aa, Artificial Sequence
  Description of Artificial Sequence: Synthetic polypeptide
DDSEIRTTNPVATEQYGSVNNTDTSYEQENFFDNNQE

SEQ ID NO: 185076 - protein, 34 aa, Artificial Sequence
  Description of Artificial Sequence: Synthetic polypeptide
DEACIRTTNPLATEQFGCVCSWGEHNQSFGSQQA

SEQ ID NO: 185077 - protein, 38 aa, Artificial Sequence
  Description of Artificial Sequence: Synthetic polypeptide
DDSEIRTTNPVATEQYGSVFTETYNDDETHGGGNNHFI

SEQ ID NO: 185078 - protein, 36 aa, Artificial Sequence
  Description of Artificial Sequence: Synthetic polypeptide
SETEAEIRTTNPVAYEPWGSVCSGWNDHEGQGNNDQ

SEQ ID NO: 185079 - protein, 39 aa, Artificial Sequence
  Description of Artificial Sequence: Synthetic polypeptide
DEEEIRTTNPVATEQYGSTIISLETLNEQEHAIALEDEN

SEQ ID NO: 185080 - protein, 38 aa, Artificial Sequence
  Description of Artificial Sequence: Synthetic polypeptide
DEEEIRTTNPVATDQYGSVCTPLAFHVFEGSFVDEPFE

SEQ ID NO: 185081 - protein, 38 aa, Artificial Sequence
  Description of Artificial Sequence: Synthetic polypeptide
DEEEIRTTNPVATEQYGSTIISLELNEQEHAEALEIEN

SEQ ID NO: 185082 - protein, 38 aa, Artificial Sequence
  Description of Artificial Sequence: Synthetic polypeptide
DEEEIRTTNPVATDQYGMVSVVGMGDGGQGQDNQERGT

SEQ ID NO: 185083 - protein, 33 aa, Artificial Sequence
  Description of Artificial Sequence: Synthetic polypeptide
QENEIATTNPVATEQWGCVAGEGVEMNAAEDNN

SEQ ID NO: 185084 - protein, 34 aa, Artificial Sequence
  Description of Artificial Sequence: Synthetic polypeptide
QENEIATTNPVATEQWGCVSGEGEGMNAAEDNAW

SEQ ID NO: 185085 - protein, 34 aa, Artificial Sequence
  Description of Artificial Sequence: Synthetic polypeptide
QENEIATTNPVATEQWGCVSGEGVEMNAAEDNAQ

SEQ ID NO: 185086 - protein, 38 aa, Artificial Sequence
  Description of Artificial Sequence: Synthetic polypeptide
DEEEIRTTNPVATEQYGSTIFSLELNGQEHAIALEIEN

SEQ ID NO: 185087 - protein, 37 aa, Artificial Sequence
  Description of Artificial Sequence: Synthetic polypeptide
DEEEIGTTNPVATEQYGCVCSNWGEDHNQENFGSEQS

SEQ ID NO: 185088 - protein, 38 aa, Artificial Sequence
  Description of Artificial Sequence: Synthetic polypeptide
DEEEISTTNPVATEQYGQCVCSNTGEGHNQNFGSDTQP

SEQ ID NO: 185089 - protein, 38 aa, Artificial Sequence
  Description of Artificial Sequence: Synthetic polypeptide
DEEEIRTTNPVATEQYGSQTVTYYIAEEDSSYGGNIDG

SEQ ID NO: 185090 - protein, 37 aa, Artificial Sequence
  Description of Artificial Sequence: Synthetic polypeptide
DDEEIRCTNPVATEQYGCSCSTWGEHNQENFNSDTQS

SEQ ID NO: 185091 - protein, 38 aa, Artificial Sequence
  Description of Artificial Sequence: Synthetic polypeptide
DEEEISTTNPVATEQYGQCVCSNWMEHNQEGFNSDNQS

SEQ ID NO: 185092 - protein, 38 aa, Artificial Sequence
  Description of Artificial Sequence: Synthetic polypeptide
DEEEISTTNPVATEQYGQCVCSNWNEHEAEGFISDNQS

SEQ ID NO: 185093 - protein, 35 aa, Artificial Sequence
  Description of Artificial Sequence: Synthetic polypeptide
DEGVEIATTNPVAYEQWGSVAGPNAGNQGAMNGGD

SEQ ID NO: 185094 - protein, 35 aa, Artificial Sequence
  Description of Artificial Sequence: Synthetic polypeptide
DEGVEIATTNPVAYEQWGCVYNVDGNHGQHTGDER

SEQ ID NO: 185095 - protein, 36 aa, Artificial Sequence
  Description of Artificial Sequence: Synthetic polypeptide
DEEEISTTNPVATEQYGQCVCSSEDHNQHFISEFQS

SEQ ID NO: 185096 - protein, 35 aa, Artificial Sequence
  Description of Artificial Sequence: Synthetic polypeptide
DEGVEIATTNPVAYEQWGCVYNTNLDGNENGGHQE

SEQ ID NO: 185097 - protein, 33 aa, Artificial Sequence
  Description of Artificial Sequence: Synthetic polypeptide
DEGVEIATTNPVAYEQWGCVYNMDSQMNGGHSQ

SEQ ID NO: 185098 - protein, 35 aa, Artificial Sequence
  Description of Artificial Sequence: Synthetic polypeptide
SEEEVRTTNPVATEQYGCVCSNSGEHDQNIISDQA

SEQ ID NO: 185099 - protein, 35 aa, Artificial Sequence
  Description of Artificial Sequence: Synthetic polypeptide
DEGVEIATTNPVAYEEWGVVATGGNTGNAGNDNQR

SEQ ID NO: 185100 - protein, 39 aa, Artificial Sequence
  Description of Artificial Sequence: Synthetic polypeptide
DEEEIRTTNPVATEQYGSNIVTWTPNDEEVNPSPEIMEH

SEQ ID NO: 185101 - protein, 39 aa, Artificial Sequence
  Description of Artificial Sequence: Synthetic polypeptide
DEEEIRTTNPVATEQYGSNIVTWTPNDEATNPEPEIMEV

SEQ ID NO: 185102 - protein, 38 aa, Artificial Sequence
  Description of Artificial Sequence: Synthetic polypeptide
DEEEISTTNPVATEQYGQCVCSSGEDHNQENFGSDNQA

SEQ ID NO: 185103 - protein, 36 aa, Artificial Sequence
  Description of Artificial Sequence: Synthetic polypeptide
DEEEISTTNPVATEQYGQCVCSSGEDQEYFISEFQS

SEQ ID NO: 185104 - protein, 37 aa, Artificial Sequence
  Description of Artificial Sequence: Synthetic polypeptide
DEEEISTTNPVATEQYGQCVCSSGEHNAENFNSDTQQ

SEQ ID NO: 185105 - protein, 37 aa, Artificial Sequence
  Description of Artificial Sequence: Synthetic polypeptide
DEEEISTTNPVATEQYGQCVCSSGEHNQENFGSDTQS

SEQ ID NO: 185106 - protein, 39 aa, Artificial Sequence
  Description of Artificial Sequence: Synthetic polypeptide
DEEEIRTTNPVATEQYGSNIVTWSVNDEEQNNYPEIFEV

SEQ ID NO: 185107 - protein, 39 aa, Artificial Sequence
  Description of Artificial Sequence: Synthetic polypeptide
DEEEIRTTNPVATEQYGSNIVTWSVNDEEQNNETEIQAV

SEQ ID NO: 185108 - protein, 35 aa, Artificial Sequence
  Description of Artificial Sequence: Synthetic polypeptide
DEGVEIACTNPVAYEQYGSVCAAPLNHDNGLGNDQ

SEQ ID NO: 185109 - protein, 32 aa, Artificial Sequence
  Description of Artificial Sequence: Synthetic polypeptide
QENEIATTNPVSTEPYGTISEECIQQQQNENL

SEQ ID NO: 185110 - protein, 37 aa, Artificial Sequence
  Description of Artificial Sequence: Synthetic polypeptide
DEEEISTTNPVATEQYGQCVCSNWGPHNAENFNSEQG

SEQ ID NO: 185111 - protein, 36 aa, Artificial Sequence
  Description of Artificial Sequence: Synthetic polypeptide
DEEEISTTNPVATEQYGQCVCSNWGPDAENFNSEQS

SEQ ID NO: 185112 - protein, 37 aa, Artificial Sequence
  Description of Artificial Sequence: Synthetic polypeptide
DEEEISTTNPVATEQYGQCVCSNWGEHNEGFLSETQA

SEQ ID NO: 185113 - protein, 30 aa, Artificial Sequence
  Description of Artificial Sequence: Synthetic polypeptide
QENEIATTNPVGTEQWGVVAEIEMNAAEDA

SEQ ID NO: 185114 - protein, 38 aa, Artificial Sequence
  Description of Artificial Sequence: Synthetic polypeptide
DEEEISTTNPVATEQYGQCVCSNWGEHNIENFGSENQS

SEQ ID NO: 185115 - protein, 37 aa, Artificial Sequence
  Description of Artificial Sequence: Synthetic polypeptide
DEEEISTTNPVATEQYGQCVCSNWGEHNQEHFGSEQQ

SEQ ID NO: 185116 - protein, 38 aa, Artificial Sequence
  Description of Artificial Sequence: Synthetic polypeptide
DEEEISTTNPVATEQYGQCVCSNWGEHNQENFGSDNQD

SEQ ID NO: 185117 - protein, 38 aa, Artificial Sequence
  Description of Artificial Sequence: Synthetic polypeptide
DEEEISTTNPVATEQYGQCVCSNWGEHNQENFGSDNQS

SEQ ID NO: 185118 - protein, 32 aa, Artificial Sequence
  Description of Artificial Sequence: Synthetic polypeptide
QENEIATTNPVSSEPYGIISMENIQQQQNGTH

SEQ ID NO: 185119 - protein, 37 aa, Artificial Sequence
  Description of Artificial Sequence: Synthetic polypeptide
DEEEISTTNPVATEQYGQCVCSNWGEHNQESFGSDQS

SEQ ID NO: 185120 - protein, 34 aa, Artificial Sequence
  Description of Artificial Sequence: Synthetic polypeptide
SEESIATTNPVAYECWGSVYHWPNDVQRQDQIMR

SEQ ID NO: 185121 - protein, 36 aa, Artificial Sequence
  Description of Artificial Sequence: Synthetic polypeptide
DEEEISTTNPVATEQYGQCVCSNWGEHNQFFSSDQS

SEQ ID NO: 185122 - protein, 36 aa, Artificial Sequence
  Description of Artificial Sequence: Synthetic polypeptide
DEEEISTTNPVATEQYGQCVCSNWGEHQNFISEFQS

SEQ ID NO: 185123 - protein, 38 aa, Artificial Sequence
  Description of Artificial Sequence: Synthetic polypeptide
DEEEISTTNPVATEQYGQCVCSNWGELNQENFNSQTQA

SEQ ID NO: 185124 - protein, 38 aa, Artificial Sequence
  Description of Artificial Sequence: Synthetic polypeptide
DEEEISTTNPVATEQYGQCVCSNWGEPNAENFGSDNQS

SEQ ID NO: 185125 - protein, 38 aa, Artificial Sequence
  Description of Artificial Sequence: Synthetic polypeptide
DEEEISTTNPVATEQYGQCVCSNWGETNAENFNSDNQQ

SEQ ID NO: 185126 - protein, 38 aa, Artificial Sequence
  Description of Artificial Sequence: Synthetic polypeptide
DEEEISTTNPVATEQYGQCVCSNWGETNAENFNSETQA

SEQ ID NO: 185127 - protein, 38 aa, Artificial Sequence
  Description of Artificial Sequence: Synthetic polypeptide
DEEEIKTTNPVATEFYGVVINMQTNQEGQGEEGAEENT

SEQ ID NO: 185128 - protein, 38 aa, Artificial Sequence
  Description of Artificial Sequence: Synthetic polypeptide
DEEEIKTTNPVATEFYGVVINMQTNQEGQGEQGNEENM

SEQ ID NO: 185129 - protein, 35 aa, Artificial Sequence
  Description of Artificial Sequence: Synthetic polypeptide
DDEEIRATNPVAYEQWGCSYWLNIDNDRQNGDQDR

SEQ ID NO: 185130 - protein, 38 aa, Artificial Sequence
  Description of Artificial Sequence: Synthetic polypeptide
DEEEISTTNPVATEQYGQCVCSNWGETNQENFNSDTQS

SEQ ID NO: 185131 - protein, 37 aa, Artificial Sequence
  Description of Artificial Sequence: Synthetic polypeptide
DEEEISTTNPVATEQYGQCVCSSGEHNQENFISDNQD

SEQ ID NO: 185132 - protein, 30 aa, Artificial Sequence
  Description of Artificial Sequence: Synthetic polypeptide
QENEIATTNPVGTEQWGDVAEIEMNAAEDA

SEQ ID NO: 185133 - protein, 37 aa, Artificial Sequence
  Description of Artificial Sequence: Synthetic polypeptide
DEEEISTTNPVATEQYGQCVCSSGEHNQENFQSDTQA

SEQ ID NO: 185134 - protein, 39 aa, Artificial Sequence
  Description of Artificial Sequence: Synthetic polypeptide
DEEEIRTTNPVATEQYGSNIVTWSVNDEEANNEPEINIS

SEQ ID NO: 185135 - protein, 34 aa, Artificial Sequence
  Description of Artificial Sequence: Synthetic polypeptide
SEEEISCTNPCATEQYGCVCSWGEHNAHFGSDQS

SEQ ID NO: 185136 - protein, 37 aa, Artificial Sequence
  Description of Artificial Sequence: Synthetic polypeptide
DEGSEICTTNPVAYECWGSVATGNGPLNDDRGQNGTD

SEQ ID NO: 185137 - protein, 38 aa, Artificial Sequence
  Description of Artificial Sequence: Synthetic polypeptide
DEEEIRTTNPVATEQYGSMVQPNENYIVMMTEHVEQNE

SEQ ID NO: 185138 - protein, 37 aa, Artificial Sequence
  Description of Artificial Sequence: Synthetic polypeptide
DEACIRTTNPVATEQYGCVCETGEDPNQEYFGSDNQS

SEQ ID NO: 185139 - protein, 37 aa, Artificial Sequence
  Description of Artificial Sequence: Synthetic polypeptide
DEEEISTTNPVATEQYGQCVCSTGEDHNQENFISDQA

SEQ ID NO: 185140 - protein, 37 aa, Artificial Sequence
  Description of Artificial Sequence: Synthetic polypeptide
DEEEIKTTNPVATEQYGNVMGTDQEVGQSGEDDGEQD

SEQ ID NO: 185141 - protein, 33 aa, Artificial Sequence
  Description of Artificial Sequence: Synthetic polypeptide
SEEEIRTTNPVSTEAYGITSTFYHETETEQQTK

SEQ ID NO: 185142 - protein, 36 aa, Artificial Sequence
  Description of Artificial Sequence: Synthetic polypeptide
QENEIRTTNPVATECYGSVVNTDNMFETGGGQTEQG

SEQ ID NO: 185143 - protein, 38 aa, Artificial Sequence
  Description of Artificial Sequence: Synthetic polypeptide
DEEEIKTTNPVATEQYGDVVNDQDNNDEQIGGQNGGTG

SEQ ID NO: 185144 - protein, 38 aa, Artificial Sequence
  Description of Artificial Sequence: Synthetic polypeptide
DEEEIKTTNPVATEQYGSFVINPLNQNMELEQAVVKTQ

SEQ ID NO: 185145 - protein, 38 aa, Artificial Sequence
  Description of Artificial Sequence: Synthetic polypeptide
DEEEIKTTNPVATEQYGSFVINSLNQNMEQKQAVVKTA

SEQ ID NO: 185146 - protein, 38 aa, Artificial Sequence
  Description of Artificial Sequence: Synthetic polypeptide
DEEEIKTTNPVATEQYGSFVINSLNQNMEREQMVVPTA

SEQ ID NO: 185147 - protein, 36 aa, Artificial Sequence
  Description of Artificial Sequence: Synthetic polypeptide
DEGQEIATTNPVAYERWGSVSGGNADDSRNNGNGNP

SEQ ID NO: 185148 - protein, 35 aa, Artificial Sequence
  Description of Artificial Sequence: Synthetic polypeptide
SEEEIRTTNPVGTAQWGSVSTPDGSAGTPIDLDAM

SEQ ID NO: 185149 - protein, 37 aa, Artificial Sequence
  Description of Artificial Sequence: Synthetic polypeptide
DEGQEIATTNPVAYEQWGSVSWGNNGLEPNGHEGGRN

SEQ ID NO: 185150 - protein, 36 aa, Artificial Sequence
  Description of Artificial Sequence: Synthetic polypeptide
DEGNEIATTNPVAYERWGSVSGGNADDERNNGNGNE

SEQ ID NO: 185151 - protein, 39 aa, Artificial Sequence
  Description of Artificial Sequence: Synthetic polypeptide
DEEEISTTNPVATEQYGQCVCSTTGEDDNQENFGSDNQA

SEQ ID NO: 185152 - protein, 34 aa, Artificial Sequence
  Description of Artificial Sequence: Synthetic polypeptide
DEGNEIATTNPVAYEQWGGVYSIEIEMNQREDHQ

SEQ ID NO: 185153 - protein, 39 aa, Artificial Sequence
  Description of Artificial Sequence: Synthetic polypeptide
DEEEIKTTNPVATEQYGSFVINSLNQNMAELEQAEVKTA

SEQ ID NO: 185154 - protein, 37 aa, Artificial Sequence
  Description of Artificial Sequence: Synthetic polypeptide
SEEEISTTNPVATEQYGCVCGTWGAHNAENFGSDNQS

SEQ ID NO: 185155 - protein, 34 aa, Artificial Sequence
  Description of Artificial Sequence: Synthetic polypeptide
SEEEISTTNPVATEQYGCVCGWAHNQENFISDQS

SEQ ID NO: 185156 - protein, 37 aa, Artificial Sequence
  Description of Artificial Sequence: Synthetic polypeptide
SEEEISTTNPVATEQYGCVCSMWGEHNQENFGSDNQA

SEQ ID NO: 185157 - protein, 37 aa, Artificial Sequence
  Description of Artificial Sequence: Synthetic polypeptide
DEEEISTTNPVATEQYGQCVCSSGEHNTESFNSDTQS

SEQ ID NO: 185158 - protein, 33 aa, Artificial Sequence
  Description of Artificial Sequence: Synthetic polypeptide
QENEIKTTNPVATEFYGNVVVTEGGDEFEGEEG

SEQ ID NO: 185159 - protein, 35 aa, Artificial Sequence
  Description of Artificial Sequence: Synthetic polypeptide
DEACIRTTNPVATEQYGCVCESGEPNAEYFISDQS

SEQ ID NO: 185160 - protein, 37 aa, Artificial Sequence
  Description of Artificial Sequence: Synthetic polypeptide
SEEEISTTNPVATEQYGQCVCSWGEHNQENFGSENQS

SEQ ID NO: 185161 - protein, 37 aa, Artificial Sequence
  Description of Artificial Sequence: Synthetic polypeptide
SEEEISTTNPVATEQYGQCVCSNWEHNQEGFNSDTQA

SEQ ID NO: 185162 - protein, 37 aa, Artificial Sequence
  Description of Artificial Sequence: Synthetic polypeptide
SEEEISTTNPVATEQYGCVTSTWGAHNAENFGSDPVA

SEQ ID NO: 185163 - protein, 39 aa, Artificial Sequence
  Description of Artificial Sequence: Synthetic polypeptide
DEEEIRTTNPVATEQYGSNIVTWNPNDEEQTNEPEIERV

SEQ ID NO: 185164 - protein, 39 aa, Artificial Sequence
  Description of Artificial Sequence: Synthetic polypeptide
DEEEIRTTNPVATEQYGSNIVTWDVNDEEQNAEPEIQRV

SEQ ID NO: 185165 - protein, 36 aa, Artificial Sequence
  Description of Artificial Sequence: Synthetic polypeptide
SEEEISTTNPVATEQYGCVCSWGEHNQENFNSDTQS

SEQ ID NO: 185166 - protein, 37 aa, Artificial Sequence
  Description of Artificial Sequence: Synthetic polypeptide
SEEEISTTNPVATEQYGCVCSWGEDHNQENFGSENQS

SEQ ID NO: 185167 - protein, 36 aa, Artificial Sequence
  Description of Artificial Sequence: Synthetic polypeptide
SEEEISTTNPVATEQYGCVCSWEEHNAENFNSDFQA

SEQ ID NO: 185168 - protein, 37 aa, Artificial Sequence
  Description of Artificial Sequence: Synthetic polypeptide
SEEEISTTNPVATEQYGCVCSVWGEHNQEGFNSDTQM

SEQ ID NO: 185169 - protein, 37 aa, Artificial Sequence
  Description of Artificial Sequence: Synthetic polypeptide
SEEEISTTNPVATEQYGCVCSTGEDHNQENFGSETQS

SEQ ID NO: 185170 - protein, 36 aa, Artificial Sequence
  Description of Artificial Sequence: Synthetic polypeptide
SEEEISTTNPVATEQYGCVCSNWNHNAENFNSDFQA

SEQ ID NO: 185171 - protein, 36 aa, Artificial Sequence
  Description of Artificial Sequence: Synthetic polypeptide
DEACIRTTNPVATEQYGCVCESGEPNQEYFGSQTQS

SEQ ID NO: 185172 - protein, 36 aa, Artificial Sequence
  Description of Artificial Sequence: Synthetic polypeptide
SEEEISTTNPVATEQYGCVCSNWGEHNQENFNSEAS

SEQ ID NO: 185173 - protein, 37 aa, Artificial Sequence
  Description of Artificial Sequence: Synthetic polypeptide
SEEEISTTNPVATEQYGCVCSNWGEHNQENFGSDNQA

SEQ ID NO: 185174 - protein, 37 aa, Artificial Sequence
  Description of Artificial Sequence: Synthetic polypeptide
SEEEISTTNPVATEQYGCVCSNTGEHEQENFGSDTQQ

SEQ ID NO: 185175 - protein, 39 aa, Artificial Sequence
  Description of Artificial Sequence: Synthetic polypeptide
DEEEIRTTNPVATEQYGSMYTMENTNVQEINLVHENLGE

SEQ ID NO: 185176 - protein, 37 aa, Artificial Sequence
  Description of Artificial Sequence: Synthetic polypeptide
DEEEISTTNPVATEQYGQCVCSSGEHNQESSNSDTQA

SEQ ID NO: 185177 - protein, 38 aa, Artificial Sequence
  Description of Artificial Sequence: Synthetic polypeptide
DEEEISTTNPVATEQYGQCVCSNWGEHNEENFGSDNQS

SEQ ID NO: 185178 - protein, 38 aa, Artificial Sequence
  Description of Artificial Sequence: Synthetic polypeptide
DEEEISTTNPVATEQYGQCVCSNWGEHNAESFGSDNQS

SEQ ID NO: 185179 - protein, 31 aa, Artificial Sequence
  Description of Artificial Sequence: Synthetic polypeptide
SEGEIACTNPVGTAGWGGVSASGTLQHGDDI

SEQ ID NO: 185180 - protein, 33 aa, Artificial Sequence
  Description of Artificial Sequence: Synthetic polypeptide
SENEIATTNPVATEGYGCVCSWEDNQHFISDQA

SEQ ID NO: 185181 - protein, 34 aa, Artificial Sequence
  Description of Artificial Sequence: Synthetic polypeptide
SENEIATTNPVATEGYGCVCSWEDNIHFISENQA

SEQ ID NO: 185182 - protein, 34 aa, Artificial Sequence
  Description of Artificial Sequence: Synthetic polypeptide
SENEIATTNPVATEGYGCVCSWEDLNQHFSSELA

SEQ ID NO: 185183 - protein, 34 aa, Artificial Sequence
  Description of Artificial Sequence: Synthetic polypeptide
SENEIATTNPVATEGYGCVCSSGELNQHFESELA

SEQ ID NO: 185184 - protein, 34 aa, Artificial Sequence
  Description of Artificial Sequence: Synthetic polypeptide
SENEIATTNPVATEGYGCVCSSELNQHFSSETLA

SEQ ID NO: 185185 - protein, 33 aa, Artificial Sequence
  Description of Artificial Sequence: Synthetic polypeptide
SENEIATTNPVATEGYGCVCSNWEHNQHSSELA

SEQ ID NO: 185186 - protein, 37 aa, Artificial Sequence
  Description of Artificial Sequence: Synthetic polypeptide
DEEEISTTNPVATEQYGQCVCSNWEHNAEFFNSDTQP

SEQ ID NO: 185187 - protein, 37 aa, Artificial Sequence
  Description of Artificial Sequence: Synthetic polypeptide
DEEEISTTNPVATEQYGQCVCSNWEHNAENFGSDTQS

SEQ ID NO: 185188 - protein, 37 aa, Artificial Sequence
  Description of Artificial Sequence: Synthetic polypeptide
DEEEIRTTNPVATEQYGSQCCALLMNAEEPAQDEDYD

SEQ ID NO: 185189 - protein, 37 aa, Artificial Sequence
  Description of Artificial Sequence: Synthetic polypeptide
DEEEISTTNPVATEQYGQCVCSNWEHNAENFNSDNQA

SEQ ID NO: 185190 - protein, 37 aa, Artificial Sequence
  Description of Artificial Sequence: Synthetic polypeptide
DEEEISTTNPVATEQYGQCVCSNWEHNQEGFGSDTQA

SEQ ID NO: 185191 - protein, 37 aa, Artificial Sequence
  Description of Artificial Sequence: Synthetic polypeptide
DEEEISTTNPVATEQYGQCVCSNWEHNQENFGSDTQA

SEQ ID NO: 185192 - protein, 37 aa, Artificial Sequence
  Description of Artificial Sequence: Synthetic polypeptide
DEEEISTTNPVATEQYGQCVCSNWEHNQENFGSDTQS

SEQ ID NO: 185193 - protein, 36 aa, Artificial Sequence
  Description of Artificial Sequence: Synthetic polypeptide
DEEEISTTNPVATEQYGQCVCSNWEHNQNFISEFQI

SEQ ID NO: 185194 - protein, 39 aa, Artificial Sequence
  Description of Artificial Sequence: Synthetic polypeptide
DEEEIRTTNPVATEQYGSNWVTWSVQDEEQNNEPEINEV

SEQ ID NO: 185195 - protein, 39 aa, Artificial Sequence
  Description of Artificial Sequence: Synthetic polypeptide
DEEEIRTTNPVATEQYGSNWVTWSVEDEEQNNEPEIQRV

SEQ ID NO: 185196 - protein, 37 aa, Artificial Sequence
  Description of Artificial Sequence: Synthetic polypeptide
DEEEIRTTNPVATEQYGSNWNYNIHESEDPSNNDSLE

SEQ ID NO: 185197 - protein, 37 aa, Artificial Sequence
  Description of Artificial Sequence: Synthetic polypeptide
DEEEIRTTNPVATEQYGSNWNNNINESWDVSNMDSLE

SEQ ID NO: 185198 - protein, 36 aa, Artificial Sequence
  Description of Artificial Sequence: Synthetic polypeptide
DEEEISTTNPVATEQYGQCVCSNWEHNANFNSDTQS

SEQ ID NO: 185199 - protein, 33 aa, Artificial Sequence
  Description of Artificial Sequence: Synthetic polypeptide
SENEIATTNPVATEGYGCVCSWEHNQHISETLA

SEQ ID NO: 185200 - protein, 33 aa, Artificial Sequence
  Description of Artificial Sequence: Synthetic polypeptide
SENEIATTNPVATEGYGCVCSWEHQHFESETLA

SEQ ID NO: 185201 - protein, 33 aa, Artificial Sequence
  Description of Artificial Sequence: Synthetic polypeptide
SENEIATTNPVATEGYGCVCSWEPNQHFSSEQA

SEQ ID NO: 185202 - protein, 37 aa, Artificial Sequence
  Description of Artificial Sequence: Synthetic polypeptide
DDEEIRATNPVATEAYGSVADDTLNDGQAENGGQDGE

SEQ ID NO: 185203 - protein, 37 aa, Artificial Sequence
  Description of Artificial Sequence: Synthetic polypeptide
DEHEIATTNPVATEAWGISVRTWNDDQQDPRQKEERL

SEQ ID NO: 185204 - protein, 38 aa, Artificial Sequence
  Description of Artificial Sequence: Synthetic polypeptide
DDEEIRATNPVATEAYGSVADDTLNDLGQAENGGQDGT

SEQ ID NO: 185205 - protein, 38 aa, Artificial Sequence
  Description of Artificial Sequence: Synthetic polypeptide
DEEEISTTNPVATEQYGQCVCSNTGEPNQENFGSDTQA

SEQ ID NO: 185206 - protein, 38 aa, Artificial Sequence
  Description of Artificial Sequence: Synthetic polypeptide
DEEEISTTNPVATEQYGQCVCSNWEDHNAENFGSENQS

SEQ ID NO: 185207 - protein, 36 aa, Artificial Sequence
  Description of Artificial Sequence: Synthetic polypeptide
DEEEISTTNPVATEQYGQCVCSNWEDIENFGSEFQG

SEQ ID NO: 185208 - protein, 37 aa, Artificial Sequence
  Description of Artificial Sequence: Synthetic polypeptide
DEEEISTTNPVATEQYGQCVCSNWEDNQENFNSDTQA

SEQ ID NO: 185209 - protein, 38 aa, Artificial Sequence
  Description of Artificial Sequence: Synthetic polypeptide
DEEEIRTTNPVATEQYGSQCHATMGKLIELDSEVEVGN

SEQ ID NO: 185210 - protein, 37 aa, Artificial Sequence
  Description of Artificial Sequence: Synthetic polypeptide
DEEEISTTNPVATEQYGQCVCSNWEEDNQENFGSEQQ

SEQ ID NO: 185211 - protein, 35 aa, Artificial Sequence
  Description of Artificial Sequence: Synthetic polypeptide
DEHEIATTNPCAYEQWGSVCGDGNMDQRGQQTGDD

SEQ ID NO: 185212 - protein, 35 aa, Artificial Sequence
  Description of Artificial Sequence: Synthetic polypeptide
SENEIRATNPVATEQYGCVITTDDDIARDNSNQQS

SEQ ID NO: 185213 - protein, 32 aa, Artificial Sequence
  Description of Artificial Sequence: Synthetic polypeptide
SENEIATTNPVAYEGYGCVCSWEDQHFSSELA

SEQ ID NO: 185214 - protein, 37 aa, Artificial Sequence
  Description of Artificial Sequence: Synthetic polypeptide
DEEEIRTTNPVATEQYGSQCHAMGALIELASEPEVGN

SEQ ID NO: 185215 - protein, 38 aa, Artificial Sequence
  Description of Artificial Sequence: Synthetic polypeptide
DEEEISTTNPVATEQYGQCVCSNWEELNQENFGSETQA

SEQ ID NO: 185216 - protein, 38 aa, Artificial Sequence
  Description of Artificial Sequence: Synthetic polypeptide
DEEEISTTNPVATEQYGQCVCSNWEETNIENFGSDTQS

SEQ ID NO: 185217 - protein, 35 aa, Artificial Sequence
  Description of Artificial Sequence: Synthetic polypeptide
DEHEIATTNPCAYEHWGSVCSTWEGDQDRQNDNEN

SEQ ID NO: 185218 - protein, 34 aa, Artificial Sequence
  Description of Artificial Sequence: Synthetic polypeptide
SENEIATTNPVATEGYGCVCSWGELNQHFSSEVA

SEQ ID NO: 185219 - protein, 37 aa, Artificial Sequence
  Description of Artificial Sequence: Synthetic polypeptide
DEEEIRTTNPVATEQYGSQCCHLLMNAEPAQDEMLYD

SEQ ID NO: 185220 - protein, 37 aa, Artificial Sequence
  Description of Artificial Sequence: Synthetic polypeptide
DEEEIRTTNPVATEQYGSQCCAWLMNAHEPAQDEMYD

SEQ ID NO: 185221 - protein, 37 aa, Artificial Sequence
  Description of Artificial Sequence: Synthetic polypeptide
DEEEIRTTNPVATEQYGSNWNNNINESWDNSNNDSAE

SEQ ID NO: 185222 - protein, 36 aa, Artificial Sequence
  Description of Artificial Sequence: Synthetic polypeptide
SEMEITTTNPVATEQYGTVCSATSGTPVEFQHENLD

SEQ ID NO: 185223 - protein, 35 aa, Artificial Sequence
  Description of Artificial Sequence: Synthetic polypeptide
SEMEIRTTNPVATEQYGTSFYPCTYEGMGTEDVEQ

SEQ ID NO: 185224 - protein, 35 aa, Artificial Sequence
  Description of Artificial Sequence: Synthetic polypeptide
SEMEIRTTNPVATEQYGSSYPCTYYEGMGTEDVKQ

SEQ ID NO: 185225 - protein, 36 aa, Artificial Sequence
  Description of Artificial Sequence: Synthetic polypeptide
SEIEIRTTNPVATEQYGSCNYAENTYNDESLFELEV

SEQ ID NO: 185226 - protein, 37 aa, Artificial Sequence
  Description of Artificial Sequence: Synthetic polypeptide
SEGEIRTTNPVATEQYGSSFSTWETEDVEGGHDGRFE

SEQ ID NO: 185227 - protein, 36 aa, Artificial Sequence
  Description of Artificial Sequence: Synthetic polypeptide
SEGEIRTTNPVATEQYGSSCYSSLENVNIEEIQNDL

SEQ ID NO: 185228 - protein, 36 aa, Artificial Sequence
  Description of Artificial Sequence: Synthetic polypeptide
SEGEIRTTNPVATEQYGSSCYSSHNLNIEESIQDIL

SEQ ID NO: 185229 - protein, 39 aa, Artificial Sequence
  Description of Artificial Sequence: Synthetic polypeptide
DEEEIRTTNPVATEQYGSNVQPITPMDMPLSFQMEEQVT

SEQ ID NO: 185230 - protein, 36 aa, Artificial Sequence
  Description of Artificial Sequence: Synthetic polypeptide
SEGEIRTTNPVATEQWGQTSCSTLNEDNSNDMYDFQ

SEQ ID NO: 185231 - protein, 33 aa, Artificial Sequence
  Description of Artificial Sequence: Synthetic polypeptide
DEGVVIASVNPVAYEPYGSVSNAGNLEMNMNNA

SEQ ID NO: 185232 - protein, 37 aa, Artificial Sequence
  Description of Artificial Sequence: Synthetic polypeptide
SEGEIRTTNPVATEQWGDQTSCSTLLDEQGNDMYDFQ

SEQ ID NO: 185233 - protein, 38 aa, Artificial Sequence
  Description of Artificial Sequence: Synthetic polypeptide
DEEEISTTNPVATEQYGQCVCSNWGEDNQEGFGSDNQS

SEQ ID NO: 185234 - protein, 38 aa, Artificial Sequence
  Description of Artificial Sequence: Synthetic polypeptide
DEEEISTTNPVATEQYGQCVCSNWGEDNQENFGSDNQS

SEQ ID NO: 185235 - protein, 37 aa, Artificial Sequence
  Description of Artificial Sequence: Synthetic polypeptide
DEEEISTTNPVATEQYGQCVCSNWGEDNQENFNSEQA

SEQ ID NO: 185236 - protein, 37 aa, Artificial Sequence
  Description of Artificial Sequence: Synthetic polypeptide
DEEEISTTNPVATEQYGQCVCSNWGEGHQGFISDNQP

SEQ ID NO: 185237 - protein, 36 aa, Artificial Sequence
  Description of Artificial Sequence: Synthetic polypeptide
DDEEIRATNPVATEQYGSVVDLMVNTGQQEDQTEGD

SEQ ID NO: 185238 - protein, 38 aa, Artificial Sequence
  Description of Artificial Sequence: Synthetic polypeptide
DEEEIRTTNPVATEQYGSNVQPIHPMGMPLDQNETQVT

SEQ ID NO: 185239 - protein, 37 aa, Artificial Sequence
  Description of Artificial Sequence: Synthetic polypeptide
DEEEISTTNPVATEQYGQCVCSNWGEHETENFGSDQQ

SEQ ID NO: 185240 - protein, 38 aa, Artificial Sequence
  Description of Artificial Sequence: Synthetic polypeptide
DEEEISTTNPVATEQYGQCVCSNWGEHNAEHFGSDNQS

SEQ ID NO: 185241 - protein, 38 aa, Artificial Sequence
  Description of Artificial Sequence: Synthetic polypeptide
DEEEISTTNPVATEQYGQCVCSNWGEHNAENFGSDNQA

SEQ ID NO: 185242 - protein, 38 aa, Artificial Sequence
  Description of Artificial Sequence: Synthetic polypeptide
DEEEISTTNPVATEQYGQCVCSNWGEHNAENFGSDNQD

SEQ ID NO: 185243 - protein, 38 aa, Artificial Sequence
  Description of Artificial Sequence: Synthetic polypeptide
DEEEISTTNPVATEQYGQCVCSNWGEHNAENFGSDNQS

SEQ ID NO: 185244 - protein, 31 aa, Artificial Sequence
  Description of Artificial Sequence: Synthetic polypeptide
SEMEIACTNPCSYEGYGCVCSWELQSFGSDQ

SEQ ID NO: 185245 - protein, 38 aa, Artificial Sequence
  Description of Artificial Sequence: Synthetic polypeptide
DEEEISTTNPVATEQYGQCVCSNTGEHNAENFGSDTQQ

SEQ ID NO: 185246 - protein, 38 aa, Artificial Sequence
  Description of Artificial Sequence: Synthetic polypeptide
DEEEIRTTNPVATEQYGSNVQPITPMQMPEDQMEEQVT

SEQ ID NO: 185247 - protein, 32 aa, Artificial Sequence
  Description of Artificial Sequence: Synthetic polypeptide
SEMEIACTNPCSYEQYGCVCSWELQSFGSETQ

SEQ ID NO: 185248 - protein, 35 aa, Artificial Sequence
  Description of Artificial Sequence: Synthetic polypeptide
SEMEIRTTNPVATEQYGSSYPCTYEGCTGTEDVEQ

SEQ ID NO: 185249 - protein, 35 aa, Artificial Sequence
  Description of Artificial Sequence: Synthetic polypeptide
SEMEIRTTNPVATEQYGSSYPCTIYETMGTEDVEQ

SEQ ID NO: 185250 - protein, 35 aa, Artificial Sequence
  Description of Artificial Sequence: Synthetic polypeptide
SEMEIRTTNPVATEQYGSSYPCTAWEGMGTEDVEQ

SEQ ID NO: 185251 - protein, 35 aa, Artificial Sequence
  Description of Artificial Sequence: Synthetic polypeptide
SEMEIRTTNPVATEQYGSSYPCLTYENMGTEDVEQ

SEQ ID NO: 185252 - protein, 36 aa, Artificial Sequence
  Description of Artificial Sequence: Synthetic polypeptide
SEMEIRTTNPVATEQYGSISYPCTIYEGQGTEDVEQ

SEQ ID NO: 185253 - protein, 33 aa, Artificial Sequence
  Description of Artificial Sequence: Synthetic polypeptide
DEHCISTTNPVAYEQWGCFSWDNDDHDKGDNQK

SEQ ID NO: 185254 - protein, 32 aa, Artificial Sequence
  Description of Artificial Sequence: Synthetic polypeptide
QENEIATTNPVAYEPYGNPSGEHLNQHMMQLN

SEQ ID NO: 185255 - protein, 33 aa, Artificial Sequence
  Description of Artificial Sequence: Synthetic polypeptide
QENEIATTNPVAYEPYGNTVAGEGHLQAHMNMK

SEQ ID NO: 185256 - protein, 34 aa, Artificial Sequence
  Description of Artificial Sequence: Synthetic polypeptide
QENEIATTNPVAYEPYGNTVSGEEHLQHMNYTLN

SEQ ID NO: 185257 - protein, 36 aa, Artificial Sequence
  Description of Artificial Sequence: Synthetic polypeptide
SEMEIRTTNPVATEQYGSCSYPCTTYEGMGTEDCEQ

SEQ ID NO: 185258 - protein, 34 aa, Artificial Sequence
  Description of Artificial Sequence: Synthetic polypeptide
SEMEIRCTNPVATEQYGCVCEWGEHNAHFGSDQS

SEQ ID NO: 185259 - protein, 33 aa, Artificial Sequence
  Description of Artificial Sequence: Synthetic polypeptide
SEMEIACTNPCSYEQYGQCVCSWNLQSFGSDQN

SEQ ID NO: 185260 - protein, 31 aa, Artificial Sequence
  Description of Artificial Sequence: Synthetic polypeptide
SEMEIACTNPCSYEQYGCVCSWPDQSFGSDQ

SEQ ID NO: 185261 - protein, 32 aa, Artificial Sequence
  Description of Artificial Sequence: Synthetic polypeptide
SEMEIACTNPCSYEQYGCVCSWNTQSFGSDQL

SEQ ID NO: 185262 - protein, 32 aa, Artificial Sequence
  Description of Artificial Sequence: Synthetic polypeptide
SEMEIACTNPCSYEQYGCVCSWNLTSFGSDQS

SEQ ID NO: 185263 - protein, 33 aa, Artificial Sequence
  Description of Artificial Sequence: Synthetic polypeptide
SEMEIACTNPCSYEQYGCVCSWNLEQSFGSEQS

SEQ ID NO: 185264 - protein, 34 aa, Artificial Sequence
  Description of Artificial Sequence: Synthetic polypeptide
QENEIATTNPVAYEPYGQNTVSGEHLQHMNPKLN

SEQ ID NO: 185265 - protein, 32 aa, Artificial Sequence
  Description of Artificial Sequence: Synthetic polypeptide
SEMEIACTNPCSYEQYGCVCSWNDPQSFGSDQ

SEQ ID NO: 185266 - protein, 32 aa, Artificial Sequence
  Description of Artificial Sequence: Synthetic polypeptide
SEMEIACTNPCSYEQYGCVCSWELQSGSEFQS

SEQ ID NO: 185267 - protein, 33 aa, Artificial Sequence
  Description of Artificial Sequence: Synthetic polypeptide
SEMEIACTNPCSYEQYGCVCSTWGELQSFGSDQ

SEQ ID NO: 185268 - protein, 37 aa, Artificial Sequence
  Description of Artificial Sequence: Synthetic polypeptide
DEEEIGTTNPVATEQYGCVCSNWGEDDNIENFGSDQS

SEQ ID NO: 185269 - protein, 37 aa, Artificial Sequence
  Description of Artificial Sequence: Synthetic polypeptide
DEEEIGTTNPVATEQYGCVCSNWGEDDNAENFNSQQS

SEQ ID NO: 185270 - protein, 36 aa, Artificial Sequence
  Description of Artificial Sequence: Synthetic polypeptide
DEHEIATTNPVAYEEWGSVCVTNPLMQGEQDHNGQS

SEQ ID NO: 185271 - protein, 38 aa, Artificial Sequence
  Description of Artificial Sequence: Synthetic polypeptide
DEEEISTTNPVATEQYGCVCSNWNEDHNQENFNSDTQA

SEQ ID NO: 185272 - protein, 37 aa, Artificial Sequence
  Description of Artificial Sequence: Synthetic polypeptide
DEEEISTTNPVATEQYGCVCSNWPEHNQENFNSETQS

SEQ ID NO: 185273 - protein, 37 aa, Artificial Sequence
  Description of Artificial Sequence: Synthetic polypeptide
DEEEISTTNPVATEQYGCVCSNWPEHNQEYFNSDNQS

SEQ ID NO: 185274 - protein, 36 aa, Artificial Sequence
  Description of Artificial Sequence: Synthetic polypeptide
AEEEIRTTNPVATEEYGCSCSNSGEDNQNFNSDTQS

SEQ ID NO: 185275 - protein, 36 aa, Artificial Sequence
  Description of Artificial Sequence: Synthetic polypeptide
DEEEISTTNPVATEQYGCVCSSEDHNQENFMSDTQS

SEQ ID NO: 185276 - protein, 37 aa, Artificial Sequence
  Description of Artificial Sequence: Synthetic polypeptide
AEEEIRTTNPVATEEYGCSCSNWGEDNTENFNSDNQA

SEQ ID NO: 185277 - protein, 34 aa, Artificial Sequence
  Description of Artificial Sequence: Synthetic polypeptide
TEEEIATTNPVATAQWGCVAGTEHGLEATANGEF

SEQ ID NO: 185278 - protein, 37 aa, Artificial Sequence
  Description of Artificial Sequence: Synthetic polypeptide
DEEEIRTTNPVAYEQYGCVCSWEEDHNQENFNSDTQD

SEQ ID NO: 185279 - protein, 39 aa, Artificial Sequence
  Description of Artificial Sequence: Synthetic polypeptide
DEEEIRTTNPVATEAYGTVANLGNSNVISTTSISTTGNT

SEQ ID NO: 185280 - protein, 38 aa, Artificial Sequence
  Description of Artificial Sequence: Synthetic polypeptide
DEEEIRTTNPVAYEQYGCVCSTWGEDHNQENFNSETQS

SEQ ID NO: 185281 - protein, 37 aa, Artificial Sequence
  Description of Artificial Sequence: Synthetic polypeptide
DEEEISTTNPVATEQYGCVCSSGEDHDQEGFISDTQS

SEQ ID NO: 185282 - protein, 37 aa, Artificial Sequence
  Description of Artificial Sequence: Synthetic polypeptide
DEEEISTTNPVATEQYGCVCSSGEDHNQEFFNSDFQS

SEQ ID NO: 185283 - protein, 34 aa, Artificial Sequence
  Description of Artificial Sequence: Synthetic polypeptide
TEEEIASVNPVCYEQYGCVVVSVDNLSDSGGNNQ

SEQ ID NO: 185284 - protein, 37 aa, Artificial Sequence
  Description of Artificial Sequence: Synthetic polypeptide
DEEEISTTNPVATEQYGCVCSSGEDHNTESFNSDTQY

SEQ ID NO: 185285 - protein, 35 aa, Artificial Sequence
  Description of Artificial Sequence: Synthetic polypeptide
TEEEIASVNPVCYEPYGVTVSTINLSQNSNGGKNV

SEQ ID NO: 185286 - protein, 35 aa, Artificial Sequence
  Description of Artificial Sequence: Synthetic polypeptide
TEEEIASVNPVCYEPYGVTVSTINLSQESAGGNNS

SEQ ID NO: 185287 - protein, 34 aa, Artificial Sequence
  Description of Artificial Sequence: Synthetic polypeptide
TEEEIASVNPVCYEPYGVTVSTINLSGSNGGNNY

SEQ ID NO: 185288 - protein, 35 aa, Artificial Sequence
  Description of Artificial Sequence: Synthetic polypeptide
TEEEIASVNPVCYEPYGVTVSTINLSEQSNGGNNV

SEQ ID NO: 185289 - protein, 34 aa, Artificial Sequence
  Description of Artificial Sequence: Synthetic polypeptide
TEEEIASVNPVGYDPYGVTVSTINLSQSNGGNNV

SEQ ID NO: 185290 - protein, 35 aa, Artificial Sequence
  Description of Artificial Sequence: Synthetic polypeptide
TEEEIATTNPVATEQYGETAPCEVCSQHPEGENKK

SEQ ID NO: 185291 - protein, 38 aa, Artificial Sequence
  Description of Artificial Sequence: Synthetic polypeptide
DEEEIRTTNPVATEAYGTVATAGNSDEGTTSISTTGNT

SEQ ID NO: 185292 - protein, 37 aa, Artificial Sequence
  Description of Artificial Sequence: Synthetic polypeptide
DEEEISTTNPVATEQYGCVCSNWMEHNQENSNSDNQS

SEQ ID NO: 185293 - protein, 39 aa, Artificial Sequence
  Description of Artificial Sequence: Synthetic polypeptide
DEEEIRTTNPVATEAYGTVNQLGNSDEIGTTSIQTTGNT

SEQ ID NO: 185294 - protein, 37 aa, Artificial Sequence
  Description of Artificial Sequence: Synthetic polypeptide
DEEEISTTNPVATEQYGCVCSNWGYHNQENFNSNNQS

SEQ ID NO: 185295 - protein, 38 aa, Artificial Sequence
  Description of Artificial Sequence: Synthetic polypeptide
DEEEIRTTNPVATEAYGTVATVVNNDNGTTSISTTGNT

SEQ ID NO: 185296 - protein, 39 aa, Artificial Sequence
  Description of Artificial Sequence: Synthetic polypeptide
DEEEIRTTNPVATEAYGTVATVVGNSQAGTTSISTTGNT

SEQ ID NO: 185297 - protein, 38 aa, Artificial Sequence
  Description of Artificial Sequence: Synthetic polypeptide
DEEEIRTTNPVATEAYGTVATVTNSDVGTTEISTTGNT

SEQ ID NO: 185298 - protein, 39 aa, Artificial Sequence
  Description of Artificial Sequence: Synthetic polypeptide
DEEEIRTTNPVATEAYGTVATVNNSDQGTTSISTTGQNT

SEQ ID NO: 185299 - protein, 39 aa, Artificial Sequence
  Description of Artificial Sequence: Synthetic polypeptide
DEEEIRTTNPVATEAYGTVATVNGNSQVGTNSISTTGNT

SEQ ID NO: 185300 - protein, 38 aa, Artificial Sequence
  Description of Artificial Sequence: Synthetic polypeptide
DEEEISTTNPVATEQYGCVCSNWMEDHNQENFGSDNQS

SEQ ID NO: 185301 - protein, 37 aa, Artificial Sequence
  Description of Artificial Sequence: Synthetic polypeptide
DEEEISTTNPVATEQYGCVCSNWMEDNAESFNSQTQS

SEQ ID NO: 185302 - protein, 37 aa, Artificial Sequence
  Description of Artificial Sequence: Synthetic polypeptide
DEEEISTTNPVATEQYGCVCSNWMEHNAENFNSDTQS

SEQ ID NO: 185303 - protein, 39 aa, Artificial Sequence
  Description of Artificial Sequence: Synthetic polypeptide
DEEEIRTTNPVATEAYGTVATVGNSQIGTTSISTTTGNT

SEQ ID NO: 185304 - protein, 38 aa, Artificial Sequence
  Description of Artificial Sequence: Synthetic polypeptide
DEEEIRTTNPVATEAYGTVATVGNSDTGTTSISTTNNT

SEQ ID NO: 185305 - protein, 38 aa, Artificial Sequence
  Description of Artificial Sequence: Synthetic polypeptide
DEEEIRTTNPVATEAYGTVATSGNGDVGTTSISTTGNT

SEQ ID NO: 185306 - protein, 38 aa, Artificial Sequence
  Description of Artificial Sequence: Synthetic polypeptide
DEEEIRTTNPVATEAYGTVATNGNSDEITESISTTGNT

SEQ ID NO: 185307 - protein, 37 aa, Artificial Sequence
  Description of Artificial Sequence: Synthetic polypeptide
DEEEISTTNPVATEQYGCVCSNWMEHNAEYFNSDTQA

SEQ ID NO: 185308 - protein, 38 aa, Artificial Sequence
  Description of Artificial Sequence: Synthetic polypeptide
DEEEIRTTNPVATEAYGTVATEGNSDIGTTTISTTNNT

SEQ ID NO: 185309 - protein, 38 aa, Artificial Sequence
  Description of Artificial Sequence: Synthetic polypeptide
DEEEIRTTNPVATEAYGTVATEGGSDIGTTSISTTGNT

SEQ ID NO: 185310 - protein, 36 aa, Artificial Sequence
  Description of Artificial Sequence: Synthetic polypeptide
DEEEISTTNPVATEQYGCVCSNWMEHNANFNSQTQS

SEQ ID NO: 185311 - protein, 37 aa, Artificial Sequence
  Description of Artificial Sequence: Synthetic polypeptide
DEEEISTTNPVATEQYGCVCSNWMEHNQEFFNSDNQT

SEQ ID NO: 185312 - protein, 33 aa, Artificial Sequence
  Description of Artificial Sequence: Synthetic polypeptide
TEEEIASVNPVCYEPYGVTVSINTSQSAGGNNQ

SEQ ID NO: 185313 - protein, 37 aa, Artificial Sequence
  Description of Artificial Sequence: Synthetic polypeptide
DEEEISTTNPVATEQYGCVCSNWGPHNAENFNSDNQS

SEQ ID NO: 185314 - protein, 33 aa, Artificial Sequence
  Description of Artificial Sequence: Synthetic polypeptide
TEEEIASVNPVCYEPYGVTVCINLSQSHGGNNV

SEQ ID NO: 185315 - protein, 34 aa, Artificial Sequence
  Description of Artificial Sequence: Synthetic polypeptide
TEEEIASVNPVCYEPYGVTASTINLSQSNEGNNV

SEQ ID NO: 185316 - protein, 37 aa, Artificial Sequence
  Description of Artificial Sequence: Synthetic polypeptide
DEEEIRTTNPVAYEQYGCVCSNWEEHNAENFNSDFQA

SEQ ID NO: 185317 - protein, 36 aa, Artificial Sequence
  Description of Artificial Sequence: Synthetic polypeptide
DEHEICTTNPVAYEQWGSVCPNDQDRNMDDHQNNEQ

SEQ ID NO: 185318 - protein, 36 aa, Artificial Sequence
  Description of Artificial Sequence: Synthetic polypeptide
TEECIRTTNPVATEQYGCVCSWGEHNAENFLSDNQS

SEQ ID NO: 185319 - protein, 35 aa, Artificial Sequence
  Description of Artificial Sequence: Synthetic polypeptide
TEECIRTTNPVATEQYGCVCSWGEDNAHFISDTQS

SEQ ID NO: 185320 - protein, 35 aa, Artificial Sequence
  Description of Artificial Sequence: Synthetic polypeptide
TEECIRTTNPVATEQYGCVCSWEEHNAEYFSSDQS

SEQ ID NO: 185321 - protein, 36 aa, Artificial Sequence
  Description of Artificial Sequence: Synthetic polypeptide
TEECIRTTNPVATEQYGCVCSTWGEHNAYFNSDTQS

SEQ ID NO: 185322 - protein, 37 aa, Artificial Sequence
  Description of Artificial Sequence: Synthetic polypeptide
DEEEICTTNPVATEMWGVVSHTNNNPNDDRQNGHGDH

SEQ ID NO: 185323 - protein, 37 aa, Artificial Sequence
  Description of Artificial Sequence: Synthetic polypeptide
DEEEIRTTNPVAYEQYGCVCSNTEEHNEENFISDTQA

SEQ ID NO: 185324 - protein, 37 aa, Artificial Sequence
  Description of Artificial Sequence: Synthetic polypeptide
DEEEIRTTNPVAYEQYGCVCSNWEEHNQENFNSETQA

SEQ ID NO: 185325 - protein, 36 aa, Artificial Sequence
  Description of Artificial Sequence: Synthetic polypeptide
TEECIRTTNPVATEQYGCVCSNWEHNAEYFNSDNQS

SEQ ID NO: 185326 - protein, 37 aa, Artificial Sequence
  Description of Artificial Sequence: Synthetic polypeptide
DEEEIRTTNPVAYEQYGCVCSNSGEHNAENFNSDTQS

SEQ ID NO: 185327 - protein, 37 aa, Artificial Sequence
  Description of Artificial Sequence: Synthetic polypeptide
DEEEIRTTNPVAYEQYGCVCSNSGEHNAEFFNSDNQS

SEQ ID NO: 185328 - protein, 37 aa, Artificial Sequence
  Description of Artificial Sequence: Synthetic polypeptide
TEECIRTTNPTATEQYGQCVSCTQEEPSQFKGGNNDP

SEQ ID NO: 185329 - protein, 37 aa, Artificial Sequence
  Description of Artificial Sequence: Synthetic polypeptide
DEEEIRTTNPVAYEQYGCVCSMWGEHNAENFNSETQA

SEQ ID NO: 185330 - protein, 37 aa, Artificial Sequence
  Description of Artificial Sequence: Synthetic polypeptide
DEEEIRTTNPVAYEQYGCVCSMWEEHNIENFNSDTQS

SEQ ID NO: 185331 - protein, 36 aa, Artificial Sequence
  Description of Artificial Sequence: Synthetic polypeptide
DEHEIATTNPVAYESWGSVPYVDNHQEQLGNQDGNV

SEQ ID NO: 185332 - protein, 34 aa, Artificial Sequence
  Description of Artificial Sequence: Synthetic polypeptide
DEHEIATTNPVAYESWGSVCYNGDEQDQDNQHES

SEQ ID NO: 185333 - protein, 37 aa, Artificial Sequence
  Description of Artificial Sequence: Synthetic polypeptide
TEECIRATNPVAYEQYGICTVSCTLNEVSQFLGGNDC

SEQ ID NO: 185334 - protein, 37 aa, Artificial Sequence
  Description of Artificial Sequence: Synthetic polypeptide
DEEEIRTTNPVAYEQYGCVCSNSGEHNQENFNSDTQL

SEQ ID NO: 185335 - protein, 36 aa, Artificial Sequence
  Description of Artificial Sequence: Synthetic polypeptide
AEEEIRTTNPVATEGYGICVCSTVEHNQENFISQQA

SEQ ID NO: 185336 - protein, 37 aa, Artificial Sequence
  Description of Artificial Sequence: Synthetic polypeptide
AEEEIRTTNPVATEGYGCVTSTWPAHNAEHFNSDPQA

SEQ ID NO: 185337 - protein, 35 aa, Artificial Sequence
  Description of Artificial Sequence: Synthetic polypeptide
TEECIRTTNPVATEQYGQCVCSNWEHNAYFLSDQS

SEQ ID NO: 185338 - protein, 33 aa, Artificial Sequence
  Description of Artificial Sequence: Synthetic polypeptide
TEEEIASVNPVCYEPYGQVTVSIDLSQSGGNNQ

SEQ ID NO: 185339 - protein, 33 aa, Artificial Sequence
  Description of Artificial Sequence: Synthetic polypeptide
TEEEIASVNPVCYEPYGKTVSINLSTSMGGNNV

SEQ ID NO: 185340 - protein, 35 aa, Artificial Sequence
  Description of Artificial Sequence: Synthetic polypeptide
DEHEIRTTNPCATECWGNVCTIDGGDRQGQGGMNP

SEQ ID NO: 185341 - protein, 39 aa, Artificial Sequence
  Description of Artificial Sequence: Synthetic polypeptide
DEEEIRTTNPVATEAYGSVVVTVVTNQAGTEAGTVTNEV

SEQ ID NO: 185342 - protein, 36 aa, Artificial Sequence
  Description of Artificial Sequence: Synthetic polypeptide
DEEEISTTNPVATEQYGCVCSSGEHNTESFISETQS

SEQ ID NO: 185343 - protein, 37 aa, Artificial Sequence
  Description of Artificial Sequence: Synthetic polypeptide
DEEEISTTNPVATEQYGCVCSSGELHNAENFNSDNQS

SEQ ID NO: 185344 - protein, 33 aa, Artificial Sequence
  Description of Artificial Sequence: Synthetic polypeptide
TEEEIASVNPTCYEPYGVTVSINLSQSTGGNNV

SEQ ID NO: 185345 - protein, 37 aa, Artificial Sequence
  Description of Artificial Sequence: Synthetic polypeptide
AEEEIRTTNPVATEEYGCSCSTWEEHNAENFGSDTQA

SEQ ID NO: 185346 - protein, 37 aa, Artificial Sequence
  Description of Artificial Sequence: Synthetic polypeptide
AEEEIRTTNPVATEEYGCSCSTWGEDNQENFNSDTQA

SEQ ID NO: 185347 - protein, 37 aa, Artificial Sequence
  Description of Artificial Sequence: Synthetic polypeptide
DEEEISTTNPVATEQYGCVCSSMEDHNAENFMSDNQS

SEQ ID NO: 185348 - protein, 37 aa, Artificial Sequence
  Description of Artificial Sequence: Synthetic polypeptide
DEEEIRTTNPVAYEQYGCVCSNWGEHNQENFNSDTQS

SEQ ID NO: 185349 - protein, 37 aa, Artificial Sequence
  Description of Artificial Sequence: Synthetic polypeptide
DEEEIRTTNPVAYEQYGCVCSNWGEHNQENFNSDNQA

SEQ ID NO: 185350 - protein, 37 aa, Artificial Sequence
  Description of Artificial Sequence: Synthetic polypeptide
DEEEIRTTNPVAYEQYGCVCSNWGEHNIENFNSDNQA

SEQ ID NO: 185351 - protein, 37 aa, Artificial Sequence
  Description of Artificial Sequence: Synthetic polypeptide
DEEEIRTTNPVAYEQYGCVCSNWGEHNEENFNSDNQS

SEQ ID NO: 185352 - protein, 37 aa, Artificial Sequence
  Description of Artificial Sequence: Synthetic polypeptide
DEEEIRTTNPVAYEQYGCVCSNWGEHNAENFNSENQA

SEQ ID NO: 185353 - protein, 38 aa, Artificial Sequence
  Description of Artificial Sequence: Synthetic polypeptide
DEEEIRTTNPVAYEQYGCVCSNWGEDHNQENFGSDNQS

SEQ ID NO: 185354 - protein, 39 aa, Artificial Sequence
  Description of Artificial Sequence: Synthetic polypeptide
DEEEIRTTNPVATEAYGSVTTTIGTTEQGSTNDEQGQED

SEQ ID NO: 185355 - protein, 39 aa, Artificial Sequence
  Description of Artificial Sequence: Synthetic polypeptide
DEEEIRTTNPVATEAYGSVTTQIGTTEQGSTNNEQEEED

SEQ ID NO: 185356 - protein, 39 aa, Artificial Sequence
  Description of Artificial Sequence: Synthetic polypeptide
DEEEIRTTNPVATEAYGSVTTNIGTTEQGSTNDEEGQET

SEQ ID NO: 185357 - protein, 33 aa, Artificial Sequence
  Description of Artificial Sequence: Synthetic polypeptide
TEEEIASVNPVCYEPYGVTISINLSQSNGGNNV

SEQ ID NO: 185358 - protein, 38 aa, Artificial Sequence
  Description of Artificial Sequence: Synthetic polypeptide
DEEEIRTTNPVATEAYGTVNTNGNGDEIGTVISTTGNT

SEQ ID NO: 185359 - protein, 37 aa, Artificial Sequence
  Description of Artificial Sequence: Synthetic polypeptide
DEEEISTTNPVATEQYGCVCSNWGNHNAENFNSENQE

SEQ ID NO: 185360 - protein, 37 aa, Artificial Sequence
  Description of Artificial Sequence: Synthetic polypeptide
DEEEISTTNPVATEQYGCVCSNWGEPNQENFNSDNQS

SEQ ID NO: 185361 - protein, 37 aa, Artificial Sequence
  Description of Artificial Sequence: Synthetic polypeptide
DEEEISTTNPVATEQYGCVCSNWGEHNIENFGSDPQS

SEQ ID NO: 185362 - protein, 37 aa, Artificial Sequence
  Description of Artificial Sequence: Synthetic polypeptide
DEEEISTTNPVATEQYGCVCSNWGEHNIENFISENQA

SEQ ID NO: 185363 - protein, 37 aa, Artificial Sequence
  Description of Artificial Sequence: Synthetic polypeptide
DEEEISTTNPVATEQYGCVCSNWGEHNIENFNSDNQI

SEQ ID NO: 185364 - protein, 37 aa, Artificial Sequence
  Description of Artificial Sequence: Synthetic polypeptide
DEEEISTTNPVATEQYGCVCSNWGEHNIENFNSDTQM

SEQ ID NO: 185365 - protein, 37 aa, Artificial Sequence
  Description of Artificial Sequence: Synthetic polypeptide
DEEEISTTNPVATEQYGCVCSNWGEHNIENFNSDTQS

SEQ ID NO: 185366 - protein, 37 aa, Artificial Sequence
  Description of Artificial Sequence: Synthetic polypeptide
DEEEISTTNPVATEQYGCVCSNWGEHNIEYFNSDTQS

SEQ ID NO: 185367 - protein, 36 aa, Artificial Sequence
  Description of Artificial Sequence: Synthetic polypeptide
DEEEISTTNPVATEQYGCVCSNWGEHNINFNSDTQA

SEQ ID NO: 185368 - protein, 36 aa, Artificial Sequence
  Description of Artificial Sequence: Synthetic polypeptide
DEEEISTTNPVATEQYGCVCSNWGEHNINFNSDTQG

SEQ ID NO: 185369 - protein, 37 aa, Artificial Sequence
  Description of Artificial Sequence: Synthetic polypeptide
DEEEISTTNPVATEQYGCVCSNWGEHNIENFFSDNQQ

SEQ ID NO: 185370 - protein, 37 aa, Artificial Sequence
  Description of Artificial Sequence: Synthetic polypeptide
DEEEISTTNPVATEQYGCVCSNWGEHNQEFFNSDTQS

SEQ ID NO: 185371 - protein, 37 aa, Artificial Sequence
  Description of Artificial Sequence: Synthetic polypeptide
DEEEISTTNPVATEQYGCVCSNWGEHNQEGFISDTQS

SEQ ID NO: 185372 - protein, 37 aa, Artificial Sequence
  Description of Artificial Sequence: Synthetic polypeptide
DEEEISTTNPVATEQYGCVCSNWGEHNQEHFNSDTQA

SEQ ID NO: 185373 - protein, 36 aa, Artificial Sequence
  Description of Artificial Sequence: Synthetic polypeptide
DEEEISTTNPVATEQYGCVCSNWGEHNQENFFSEQA

SEQ ID NO: 185374 - protein, 37 aa, Artificial Sequence
  Description of Artificial Sequence: Synthetic polypeptide
DEEEISTTNPVATEQYGCVCSNWGEHNQENFGSEFQM

SEQ ID NO: 185375 - protein, 37 aa, Artificial Sequence
  Description of Artificial Sequence: Synthetic polypeptide
DEEEISTTNPVATEQYGCVCSNWGEHNQENFGSETQM

SEQ ID NO: 185376 - protein, 37 aa, Artificial Sequence
  Description of Artificial Sequence: Synthetic polypeptide
DEEEISTTNPVATEQYGCVCSNWGEHNQENFISDNQA

SEQ ID NO: 185377 - protein, 37 aa, Artificial Sequence
  Description of Artificial Sequence: Synthetic polypeptide
DEEEISTTNPVATEQYGCVCSNWGEHNQENFISDNQF

SEQ ID NO: 185378 - protein, 37 aa, Artificial Sequence
  Description of Artificial Sequence: Synthetic polypeptide
DEEEISTTNPVATEQYGCVCSNWGEHNQENFISDNQS

SEQ ID NO: 185379 - protein, 37 aa, Artificial Sequence
  Description of Artificial Sequence: Synthetic polypeptide
DEEEISTTNPVATEQYGCVCSNWGEHNQEGFGSETQN

SEQ ID NO: 185380 - protein, 37 aa, Artificial Sequence
  Description of Artificial Sequence: Synthetic polypeptide
DEEEISTTNPVATEQYGCVCSNWGEHNIEHFNSDTQS

SEQ ID NO: 185381 - protein, 37 aa, Artificial Sequence
  Description of Artificial Sequence: Synthetic polypeptide
DEEEISTTNPVATEQYGCVCSNWGEHNEEYFNSDPQA

SEQ ID NO: 185382 - protein, 37 aa, Artificial Sequence
  Description of Artificial Sequence: Synthetic polypeptide
DEEEISTTNPVATEQYGCVCSNWGEHNEEHFNSQTQA

SEQ ID NO: 185383 - protein, 37 aa, Artificial Sequence
  Description of Artificial Sequence: Synthetic polypeptide
DEEEISTTNPVATEQYGCVCSNWGEHNAENFPSENQA

SEQ ID NO: 185384 - protein, 35 aa, Artificial Sequence
  Description of Artificial Sequence: Synthetic polypeptide
DEHEIRTTNPCAYEEWGSVAWTWNDHQGDTQIGSD

SEQ ID NO: 185385 - protein, 37 aa, Artificial Sequence
  Description of Artificial Sequence: Synthetic polypeptide
DEHEIRTTNPCAYEEWGSVAWTWNDHQGDRQHQGNAQ

SEQ ID NO: 185386 - protein, 36 aa, Artificial Sequence
  Description of Artificial Sequence: Synthetic polypeptide
DEHEIRTTNPCAYEEWGSVAWTWNDHQGDRQGGGPQ

SEQ ID NO: 185387 - protein, 37 aa, Artificial Sequence
  Description of Artificial Sequence: Synthetic polypeptide
DEHEIRTTNPCAYEEWGSVAWTWNDHQGDRQGEGNKQ

SEQ ID NO: 185388 - protein, 35 aa, Artificial Sequence
  Description of Artificial Sequence: Synthetic polypeptide
DEHEIRTTNPCAYEEWGSVAWTWNDHQGDIQGGQD

SEQ ID NO: 185389 - protein, 37 aa, Artificial Sequence
  Description of Artificial Sequence: Synthetic polypeptide
DEEEISTTNPVATEQYGCVCSNWGEHNAENFSSENQS

SEQ ID NO: 185390 - protein, 35 aa, Artificial Sequence
  Description of Artificial Sequence: Synthetic polypeptide
DEHEIRTTNPCAYEEWGSVATQNGNQQLEGDGGQQ

SEQ ID NO: 185391 - protein, 37 aa, Artificial Sequence
  Description of Artificial Sequence: Synthetic polypeptide
DEEEISTTNPVATEQYGCVCSNWGEHNAEYFNSDNQA

SEQ ID NO: 185392 - protein, 37 aa, Artificial Sequence
  Description of Artificial Sequence: Synthetic polypeptide
DEEEISTTNPVATEQYGCVCSNWGEHNAEYFNSENQS

SEQ ID NO: 185393 - protein, 36 aa, Artificial Sequence
  Description of Artificial Sequence: Synthetic polypeptide
DEHEIRTTNPCAYEEWGSVAPTWNDHQGDRQGTGAQ

SEQ ID NO: 185394 - protein, 37 aa, Artificial Sequence
  Description of Artificial Sequence: Synthetic polypeptide
DEEEISTTNPVATEQYGCVCSNWGEHNAEYFNSETQP

SEQ ID NO: 185395 - protein, 37 aa, Artificial Sequence
  Description of Artificial Sequence: Synthetic polypeptide
DEEEISTTNPVATEQYGCVCSNWGEHNAEYFNSETQS

SEQ ID NO: 185396 - protein, 36 aa, Artificial Sequence
  Description of Artificial Sequence: Synthetic polypeptide
DEHEIRTTNPCAYEEWGSTVATPNGNQQNEGDGGQR

SEQ ID NO: 185397 - protein, 37 aa, Artificial Sequence
  Description of Artificial Sequence: Synthetic polypeptide
DEEEISTTNPVATEQYGCVCSNWGEHNAEYFSSDNQA

SEQ ID NO: 185398 - protein, 35 aa, Artificial Sequence
  Description of Artificial Sequence: Synthetic polypeptide
DEHEIRTTNPCAYECWGSVATPNGNQQLEGDHGGA

SEQ ID NO: 185399 - protein, 36 aa, Artificial Sequence
  Description of Artificial Sequence: Synthetic polypeptide
DEEEISTTNPVATEQYGCVCSNWGEHNANFNSDTQS

SEQ ID NO: 185400 - protein, 36 aa, Artificial Sequence
  Description of Artificial Sequence: Synthetic polypeptide
DEEEISTTNPVATEQYGCVCSNWGEHNANFPSETQS

SEQ ID NO: 185401 - protein, 36 aa, Artificial Sequence
  Description of Artificial Sequence: Synthetic polypeptide
DEEEISTTNPVATEQYGCVCSNWGEHNASFNSDTQS

SEQ ID NO: 185402 - protein, 37 aa, Artificial Sequence
  Description of Artificial Sequence: Synthetic polypeptide
DEEEISTTNPVATEQYGCVCSNWGEHNQENFISDNQT

SEQ ID NO: 185403 - protein, 37 aa, Artificial Sequence
  Description of Artificial Sequence: Synthetic polypeptide
DEEEISTTNPVATEQYGCVCSNWGEHNQENFISDNQV

SEQ ID NO: 185404 - protein, 37 aa, Artificial Sequence
  Description of Artificial Sequence: Synthetic polypeptide
DEEEISTTNPVATEQYGCVCSNWGEHNQENFISENQP

SEQ ID NO: 185405 - protein, 37 aa, Artificial Sequence
  Description of Artificial Sequence: Synthetic polypeptide
DEEEISTTNPVATEQYGCVCSNWGEHNQENFNSDNQL

SEQ ID NO: 185406 - protein, 37 aa, Artificial Sequence
  Description of Artificial Sequence: Synthetic polypeptide
DEEEISTTNPVATEQYGCVCSNWGEHNQEYFNSDNQS

SEQ ID NO: 185407 - protein, 39 aa, Artificial Sequence
  Description of Artificial Sequence: Synthetic polypeptide
DEEEIRTTNPVATEQYGVVSTVVQVGTQAGTTEAGSTVG

SEQ ID NO: 185408 - protein, 37 aa, Artificial Sequence
  Description of Artificial Sequence: Synthetic polypeptide
DEEEISTTNPVATEQYGCVCSNWGEHNQEYFNSDTQA

SEQ ID NO: 185409 - protein, 38 aa, Artificial Sequence
  Description of Artificial Sequence: Synthetic polypeptide
DEEEIRTTNPVATEAYGTVQTSGNNDIGTTSISTTGNT

SEQ ID NO: 185410 - protein, 36 aa, Artificial Sequence
  Description of Artificial Sequence: Synthetic polypeptide
DEEEISTTNPVATEQYGCVCSNWGEHNQNFISDTQL

SEQ ID NO: 185411 - protein, 38 aa, Artificial Sequence
  Description of Artificial Sequence: Synthetic polypeptide
DEEEIRTTNPVATEAYGTVQTNGNSDEIGTSISTTNNT

SEQ ID NO: 185412 - protein, 37 aa, Artificial Sequence
  Description of Artificial Sequence: Synthetic polypeptide
DEEEISTTNPVATEQYGCVCSNWGEHNTEHFNSDTQA

SEQ ID NO: 185413 - protein, 37 aa, Artificial Sequence
  Description of Artificial Sequence: Synthetic polypeptide
DEEEISTTNPVATEQYGCVCSNWGEHNTENFGSDTQA

SEQ ID NO: 185414 - protein, 37 aa, Artificial Sequence
  Description of Artificial Sequence: Synthetic polypeptide
DEEEISTTNPVATEQYGCVCSNWGEHNTENFISDTQS

SEQ ID NO: 185415 - protein, 33 aa, Artificial Sequence
  Description of Artificial Sequence: Synthetic polypeptide
TEEEIATTNPVAYEQYGEAPCEVECSQHAEGSK

SEQ ID NO: 185416 - protein, 34 aa, Artificial Sequence
  Description of Artificial Sequence: Synthetic polypeptide
TEEEIATTNPVAYEQWGCNTAGNGLQAAPDGSAE

SEQ ID NO: 185417 - protein, 37 aa, Artificial Sequence
  Description of Artificial Sequence: Synthetic polypeptide
TEEEIATTNPVAYEQDGSVVSIANELSQDQVGDQYMN

SEQ ID NO: 185418 - protein, 39 aa, Artificial Sequence
  Description of Artificial Sequence: Synthetic polypeptide
DEEEIRTTNPVATEAYGTVQNYGNLDEIRTTTISTTGNT

SEQ ID NO: 185419 - protein, 31 aa, Artificial Sequence
  Description of Artificial Sequence: Synthetic polypeptide
TEEEIATTNPVAYEPWGEAYMVEQHDEGMGI

SEQ ID NO: 185420 - protein, 38 aa, Artificial Sequence
  Description of Artificial Sequence: Synthetic polypeptide
DEEEIRTTNPVATEAYGTVNTTGNSDIGTTSISTTGNT

SEQ ID NO: 185421 - protein, 37 aa, Artificial Sequence
  Description of Artificial Sequence: Synthetic polypeptide
DEEEISTTNPVATEQYGCVCSNWGEPNAENFNSETQD

SEQ ID NO: 185422 - protein, 37 aa, Artificial Sequence
  Description of Artificial Sequence: Synthetic polypeptide
DEEEISTTNPVATEQYGCVCSNWGEPNQEHFNSDNQE

SEQ ID NO: 185423 - protein, 36 aa, Artificial Sequence
  Description of Artificial Sequence: Synthetic polypeptide
TEEEIATTNPVAYEADGSVHTANEHSQDQFGDNYMN

SEQ ID NO: 185424 - protein, 37 aa, Artificial Sequence
  Description of Artificial Sequence: Synthetic polypeptide
TEEEIATTNPVAYEADGSTVSTANEMSQDQFGDNYMN

SEQ ID NO: 185425 - protein, 37 aa, Artificial Sequence
  Description of Artificial Sequence: Synthetic polypeptide
DEEEISTTNPVATEQYGCVCSNWGEHNQESFNSVNQA

SEQ ID NO: 185426 - protein, 35 aa, Artificial Sequence
  Description of Artificial Sequence: Synthetic polypeptide
DEHEIATTNPVAYESWGCVSGGNGEDERNMGNGEA

SEQ ID NO: 185427 - protein, 40 aa, Artificial Sequence
  Description of Artificial Sequence: Synthetic polypeptide
DEEEIRTTNPVATEQYGVVSTVVNVTNNQQQGTEETEEED

SEQ ID NO: 185428 - protein, 37 aa, Artificial Sequence
  Description of Artificial Sequence: Synthetic polypeptide
DEEEISTTNPVATEQYGCVCSNWGEHNQESFNSQTQS

SEQ ID NO: 185429 - protein, 37 aa, Artificial Sequence
  Description of Artificial Sequence: Synthetic polypeptide
DEEEISTTNPVATEQYGCVCSNWGEHNQENFNSDNQS

SEQ ID NO: 185430 - protein, 37 aa, Artificial Sequence
  Description of Artificial Sequence: Synthetic polypeptide
DEEEISTTNPVATEQYGCVCSNWGEHNQENFNSDTQA

SEQ ID NO: 185431 - protein, 37 aa, Artificial Sequence
  Description of Artificial Sequence: Synthetic polypeptide
DEEEISTTNPVATEQYGCVCSNWGEHNQENFNSDTQS

SEQ ID NO: 185432 - protein, 37 aa, Artificial Sequence
  Description of Artificial Sequence: Synthetic polypeptide
DEEEISTTNPVATEQYGCVCSNWGEHNQENFNSENQD

SEQ ID NO: 185433 - protein, 37 aa, Artificial Sequence
  Description of Artificial Sequence: Synthetic polypeptide
DEEEISTTNPVATEQYGCVCSNWGEHNQENFNSENQS

SEQ ID NO: 185434 - protein, 37 aa, Artificial Sequence
  Description of Artificial Sequence: Synthetic polypeptide
DEEEISTTNPVATEQYGCVCSNWGEHNQENFNSEPAE

SEQ ID NO: 185435 - protein, 37 aa, Artificial Sequence
  Description of Artificial Sequence: Synthetic polypeptide
DEEEISTTNPVATEQYGCVCSNWGEHNQENFNSETQS

SEQ ID NO: 185436 - protein, 37 aa, Artificial Sequence
  Description of Artificial Sequence: Synthetic polypeptide
AEEEIRTTNPVATEAYGVVSTTTDNGNNVEQGTEDED

SEQ ID NO: 185437 - protein, 37 aa, Artificial Sequence
  Description of Artificial Sequence: Synthetic polypeptide
DEEEISTTNPVATEQYGCVCSNWGEHNQENFSSDNQA

SEQ ID NO: 185438 - protein, 36 aa, Artificial Sequence
  Description of Artificial Sequence: Synthetic polypeptide
DEEEISTTNPVATEQYGCVCSNWGEHNQENFSSDQA

SEQ ID NO: 185439 - protein, 37 aa, Artificial Sequence
  Description of Artificial Sequence: Synthetic polypeptide
DEEEISTTNPVATEQYGCVCSNWGEHNQENMNSDNQS

SEQ ID NO: 185440 - protein, 37 aa, Artificial Sequence
  Description of Artificial Sequence: Synthetic polypeptide
DEEEISTTNPVATEQYGCVCSNWGEHNQENSGSETQA

SEQ ID NO: 185441 - protein, 31 aa, Artificial Sequence
  Description of Artificial Sequence: Synthetic polypeptide
TEEEIATTNPVAYERWGEAYMVEQQDEGEGI

SEQ ID NO: 185442 - protein, 32 aa, Artificial Sequence
  Description of Artificial Sequence: Synthetic polypeptide
TEEEIATTNPVAYERWGEAYMVEQNHDEGEGI

SEQ ID NO: 185443 - protein, 31 aa, Artificial Sequence
  Description of Artificial Sequence: Synthetic polypeptide
TEEEIATTNPVAYERWGEAYMVEQHDTGHGI

SEQ ID NO: 185444 - protein, 31 aa, Artificial Sequence
  Description of Artificial Sequence: Synthetic polypeptide
TEEEIATTNPVAYERWGEAYMVEQHDQGEGA

SEQ ID NO: 185445 - protein, 37 aa, Artificial Sequence
  Description of Artificial Sequence: Synthetic polypeptide
DEEEISTTNPVATEQYGCVCSNWGEHNQENSNSDTQS

SEQ ID NO: 185446 - protein, 40 aa, Artificial Sequence
  Description of Artificial Sequence: Synthetic polypeptide
DEEEIRTTNPVATEQYGVVSTVVNVTNNQLQGTEEEEETD

SEQ ID NO: 185447 - protein, 37 aa, Artificial Sequence
  Description of Artificial Sequence: Synthetic polypeptide
DEEEISTTNPVATEQYGCVCSNWGEHNQESFNSDNQS

SEQ ID NO: 185448 - protein, 40 aa, Artificial Sequence
  Description of Artificial Sequence: Synthetic polypeptide
DEEEIRTTNPVATEQYGVVSTVVNVTNNQQQGEEEEEEEE

SEQ ID NO: 185449 - protein, 34 aa, Artificial Sequence
  Description of Artificial Sequence: Synthetic polypeptide
DEHEIATTNPVAYESWGCVSGENGEDERNMNGAD

SEQ ID NO: 185450 - protein, 34 aa, Artificial Sequence
  Description of Artificial Sequence: Synthetic polypeptide
TEDGIQTTNPVAYEAYGCTVACTSLTMMVGNDRT

SEQ ID NO: 185451 - protein, 36 aa, Artificial Sequence
  Description of Artificial Sequence: Synthetic polypeptide
DEEEIRTTNPVAYEQYGCVCQNWGNHNQEYFDSDQS

SEQ ID NO: 185452 - protein, 37 aa, Artificial Sequence
  Description of Artificial Sequence: Synthetic polypeptide
DEEEISTTNPVATEQYGCVCSWEEDHNAENFGSDTQS

SEQ ID NO: 185453 - protein, 35 aa, Artificial Sequence
  Description of Artificial Sequence: Synthetic polypeptide
SSEEIRTTNPVATCQYGCVCSNWEHNAENFGSDQA

SEQ ID NO: 185454 - protein, 37 aa, Artificial Sequence
  Description of Artificial Sequence: Synthetic polypeptide
DEEEISTTNPVATEQYGCVCSWEEDHNAESFNSDTQL

SEQ ID NO: 185455 - protein, 37 aa, Artificial Sequence
  Description of Artificial Sequence: Synthetic polypeptide
DEEEISTTNPVATEQYGCVCSWEEDHNQENFFSENQS

SEQ ID NO: 185456 - protein, 37 aa, Artificial Sequence
  Description of Artificial Sequence: Synthetic polypeptide
DEEEISTTNPVATEQYGCVCSWEEDHNQENFGSDTQA

SEQ ID NO: 185457 - protein, 39 aa, Artificial Sequence
  Description of Artificial Sequence: Synthetic polypeptide
DEEEIRTTNPVATEQYGVVSTVVSVGTQQGTTEQGSTVE

SEQ ID NO: 185458 - protein, 36 aa, Artificial Sequence
  Description of Artificial Sequence: Synthetic polypeptide
SSEEIATTNPVAYHQYGSVVQHSVAHSQERGGINFQ

SEQ ID NO: 185459 - protein, 36 aa, Artificial Sequence
  Description of Artificial Sequence: Synthetic polypeptide
DEHEIATTNPVAYEQWGSVMGAPNGNHQNTGDGNDM

SEQ ID NO: 185460 - protein, 37 aa, Artificial Sequence
  Description of Artificial Sequence: Synthetic polypeptide
DEEEISTTNPVATEQYGCVCSWEEDHNAEHFNSDTQS

SEQ ID NO: 185461 - protein, 34 aa, Artificial Sequence
  Description of Artificial Sequence: Synthetic polypeptide
SSEEIATTNPVAYHQYGKVVHCVHSQERQGINFQ

SEQ ID NO: 185462 - protein, 38 aa, Artificial Sequence
  Description of Artificial Sequence: Synthetic polypeptide
AEEEIRTTNPVATEQYGQCVCSVSGEHNQENFNSDTQS

SEQ ID NO: 185463 - protein, 32 aa, Artificial Sequence
  Description of Artificial Sequence: Synthetic polypeptide
SQENIRTTNPVATEHWGTYSSWNETEVAINKT

SEQ ID NO: 185464 - protein, 37 aa, Artificial Sequence
  Description of Artificial Sequence: Synthetic polypeptide
AEEEIRTTNPVATEQYGQCVCSWEEHNQEFFNSDTQA

SEQ ID NO: 185465 - protein, 38 aa, Artificial Sequence
  Description of Artificial Sequence: Synthetic polypeptide
AEEEIRTTNPVATEQYGQCVCSWGEDHNQEGFGSENQS

SEQ ID NO: 185466 - protein, 36 aa, Artificial Sequence
  Description of Artificial Sequence: Synthetic polypeptide
AEEEIRTTNPVATEQYGQCVCSWGEDHQFFISEPQS

SEQ ID NO: 185467 - protein, 37 aa, Artificial Sequence
  Description of Artificial Sequence: Synthetic polypeptide
AEEEIRTTNPVATEQYGQCVCSWGEHEQENFNSDTQS

SEQ ID NO: 185468 - protein, 37 aa, Artificial Sequence
  Description of Artificial Sequence: Synthetic polypeptide
AEEEIRTTNPVATEQYGQCVCSWGEHNQENFNSDTQV

SEQ ID NO: 185469 - protein, 36 aa, Artificial Sequence
  Description of Artificial Sequence: Synthetic polypeptide
DEHEIATTNPVAYEQWGSVAGGPPGNHQNTGDNDHI

SEQ ID NO: 185470 - protein, 36 aa, Artificial Sequence
  Description of Artificial Sequence: Synthetic polypeptide
SQGEIRTTNPVATEQYGSVAMPTPLDIIDSNGSQIE

SEQ ID NO: 185471 - protein, 35 aa, Artificial Sequence
  Description of Artificial Sequence: Synthetic polypeptide
SSEEIRTTNPVATCQYGCVCSWMEHNQENFNSDQS

SEQ ID NO: 185472 - protein, 37 aa, Artificial Sequence
  Description of Artificial Sequence: Synthetic polypeptide
AEEEIRTTNPVATEQYGQCVCSNWGEHNQENFGSEQM

SEQ ID NO: 185473 - protein, 38 aa, Artificial Sequence
  Description of Artificial Sequence: Synthetic polypeptide
AEEEIRTTNPVATEQYGQCVCSNWGEHNQENFGSDNQS

SEQ ID NO: 185474 - protein, 38 aa, Artificial Sequence
  Description of Artificial Sequence: Synthetic polypeptide
DEEEISTTNPVATEQYGCVCSTWGEDDNAENFNSENQS

SEQ ID NO: 185475 - protein, 38 aa, Artificial Sequence
  Description of Artificial Sequence: Synthetic polypeptide
DEEEISTTNPVATEQYGCVCSTWGEDHDQENFGSDTQS

SEQ ID NO: 185476 - protein, 38 aa, Artificial Sequence
  Description of Artificial Sequence: Synthetic polypeptide
DEEEISTTNPVATEQYGCVCSTWGEDHEQENFGSDTQQ

SEQ ID NO: 185477 - protein, 38 aa, Artificial Sequence
  Description of Artificial Sequence: Synthetic polypeptide
DEEEISTTNPVATEQYGCVCSTWGEDHNAEFFNSDTQP

SEQ ID NO: 185478 - protein, 38 aa, Artificial Sequence
  Description of Artificial Sequence: Synthetic polypeptide
DEEEISTTNPVATEQYGCVCSTWGEDHNAENFNSDNQS

SEQ ID NO: 185479 - protein, 38 aa, Artificial Sequence
  Description of Artificial Sequence: Synthetic polypeptide
DEEEISTTNPVATEQYGCVCSTWGEDHNAENFNSDTQA

SEQ ID NO: 185480 - protein, 38 aa, Artificial Sequence
  Description of Artificial Sequence: Synthetic polypeptide
DEEEISTTNPVATEQYGCVCSTWGEDHNAENFNSDTQP

SEQ ID NO: 185481 - protein, 38 aa, Artificial Sequence
  Description of Artificial Sequence: Synthetic polypeptide
DEEEISTTNPVATEQYGCVCSTWGEDHNAENFNSETQI

SEQ ID NO: 185482 - protein, 37 aa, Artificial Sequence
  Description of Artificial Sequence: Synthetic polypeptide
DEEEISTTNPVATEQYGCVCSTWGEDHNQENFFSEQS

SEQ ID NO: 185483 - protein, 38 aa, Artificial Sequence
  Description of Artificial Sequence: Synthetic polypeptide
DEEEISTTNPVATEQYGCVCSTWGEDHNQENFNSDTQL

SEQ ID NO: 185484 - protein, 38 aa, Artificial Sequence
  Description of Artificial Sequence: Synthetic polypeptide
DEEEISTTNPVATEQYGCVCSTWGEDHNQESFNSDNQE

SEQ ID NO: 185485 - protein, 38 aa, Artificial Sequence
  Description of Artificial Sequence: Synthetic polypeptide
DEEEISTTNPVATEQYGCVCSTWGEDHNQEYFMSDNQS

SEQ ID NO: 185486 - protein, 35 aa, Artificial Sequence
  Description of Artificial Sequence: Synthetic polypeptide
DEEEICTTNPVAYEQWGSVCANAAFPQHPDDTEAW

SEQ ID NO: 185487 - protein, 37 aa, Artificial Sequence
  Description of Artificial Sequence: Synthetic polypeptide
DEEEISTTNPVATEQYGCVCSTWGEHDAENFGSETQS

SEQ ID NO: 185488 - protein, 36 aa, Artificial Sequence
  Description of Artificial Sequence: Synthetic polypeptide
SSEEIRTTNPVATEQYGKVVHCANAPSHPRVTHNAY

SEQ ID NO: 185489 - protein, 38 aa, Artificial Sequence
  Description of Artificial Sequence: Synthetic polypeptide
AEEEIRTTNPVATEQYGQCQVCSNTEEHEQENFGSDQA

SEQ ID NO: 185490 - protein, 38 aa, Artificial Sequence
  Description of Artificial Sequence: Synthetic polypeptide
AEEEIRTTNPVATEQYGQCVCSNWGEHNIENFGSENQS

SEQ ID NO: 185491 - protein, 37 aa, Artificial Sequence
  Description of Artificial Sequence: Synthetic polypeptide
DEEEISTTNPVATEQYGCVCSVWEEDHAENFNSDNQD

SEQ ID NO: 185492 - protein, 38 aa, Artificial Sequence
  Description of Artificial Sequence: Synthetic polypeptide
AEEEIRTTNPVATEQYGQCVCSNWGEHNQENFGSDNQA

SEQ ID NO: 185493 - protein, 40 aa, Artificial Sequence
  Description of Artificial Sequence: Synthetic polypeptide
DEEEIRTTNPVATEQYGVVSTVVSVTNNAEQGTEETEEED

SEQ ID NO: 185494 - protein, 35 aa, Artificial Sequence
  Description of Artificial Sequence: Synthetic polypeptide
DEHEIATTNPVAYEQWGSAMTMPNGNLGEHNDGGE

SEQ ID NO: 185495 - protein, 37 aa, Artificial Sequence
  Description of Artificial Sequence: Synthetic polypeptide
DEHEIATTNPVAYEQWGMVSIPNAGDDTQDRQGDDGR

SEQ ID NO: 185496 - protein, 37 aa, Artificial Sequence
  Description of Artificial Sequence: Synthetic polypeptide
DEEEISTTNPVATEQYGCVCSWGEDHNAEGFNSDNQA

SEQ ID NO: 185497 - protein, 37 aa, Artificial Sequence
  Description of Artificial Sequence: Synthetic polypeptide
DEEEISTTNPVATEQYGCVCSWGEDHNQEYFNSDTQS

SEQ ID NO: 185498 - protein, 34 aa, Artificial Sequence
  Description of Artificial Sequence: Synthetic polypeptide
QENEIATTNPVATEGYGCVCSWEELNQHFISEQA

SEQ ID NO: 185499 - protein, 34 aa, Artificial Sequence
  Description of Artificial Sequence: Synthetic polypeptide
QENEIATTNPVATEGYGCVCSWEHQEHFSSENLA

SEQ ID NO: 185500 - protein, 35 aa, Artificial Sequence
  Description of Artificial Sequence: Synthetic polypeptide
DEHEIATTNPVAYEPWGVVSHMWNNDQDGEQKENQ

SEQ ID NO: 185501 - protein, 34 aa, Artificial Sequence
  Description of Artificial Sequence: Synthetic polypeptide
QENEIATTNPVATEGYGCVCSWGEHQEHFNSELA

SEQ ID NO: 185502 - protein, 33 aa, Artificial Sequence
  Description of Artificial Sequence: Synthetic polypeptide
QENEIATTNPVATEGYGCVCSWGEHQHFESEQA

SEQ ID NO: 185503 - protein, 35 aa, Artificial Sequence
  Description of Artificial Sequence: Synthetic polypeptide
SQEEIRTTNPVATEQWGCVCSWGEDHNQHFGSDQA

SEQ ID NO: 185504 - protein, 34 aa, Artificial Sequence
  Description of Artificial Sequence: Synthetic polypeptide
SQEEIRTTNPVATEQWGCVCSWEEHNQNFISDQA

SEQ ID NO: 185505 - protein, 37 aa, Artificial Sequence
  Description of Artificial Sequence: Synthetic polypeptide
DEEEISTTNPVATEQYGCVCSWGEDPNQENFNSENQS

SEQ ID NO: 185506 - protein, 37 aa, Artificial Sequence
  Description of Artificial Sequence: Synthetic polypeptide
DEEEISTTNPVATEQYGCVCSWGEDPNQENFNSETQA

SEQ ID NO: 185507 - protein, 37 aa, Artificial Sequence
  Description of Artificial Sequence: Synthetic polypeptide
DEEEISTTNPVATEQYGCVCSWGEEHNQENFNSDTQS

SEQ ID NO: 185508 - protein, 37 aa, Artificial Sequence
  Description of Artificial Sequence: Synthetic polypeptide
DEEEIGTTNPVATEQYGCVCSNTGEDHNANFNSDTQS

SEQ ID NO: 185509 - protein, 34 aa, Artificial Sequence
  Description of Artificial Sequence: Synthetic polypeptide
DEHEIATTNPVAYEHWGCVSGDNGEERNNMQNDA

SEQ ID NO: 185510 - protein, 36 aa, Artificial Sequence
  Description of Artificial Sequence: Synthetic polypeptide
DEEEISTTNPVATEQYGCVCSWGEHDAENFGSETQS

SEQ ID NO: 185511 - protein, 33 aa, Artificial Sequence
  Description of Artificial Sequence: Synthetic polypeptide
SQEEIRTTNPVATEHWGTYSYWNETEVPINNKT

SEQ ID NO: 185512 - protein, 33 aa, Artificial Sequence
  Description of Artificial Sequence: Synthetic polypeptide
SQEEIRTTNPVATEHWGTYSSWNETEQVPIVKT

SEQ ID NO: 185513 - protein, 38 aa, Artificial Sequence
  Description of Artificial Sequence: Synthetic polypeptide
DEEEIGTTNPVATEQYGCVCSNWGEDDNAENFGSDNQA

SEQ ID NO: 185514 - protein, 36 aa, Artificial Sequence
  Description of Artificial Sequence: Synthetic polypeptide
DEEEISTTNPVATEQYGCVCSWGEHDQEFFISDTQA

SEQ ID NO: 185515 - protein, 36 aa, Artificial Sequence
  Description of Artificial Sequence: Synthetic polypeptide
DEEEISTTNPVATEQYGCVCSWGEHEIEFFGSDTQD

SEQ ID NO: 185516 - protein, 37 aa, Artificial Sequence
  Description of Artificial Sequence: Synthetic polypeptide
DEEEISTTNPVATEQYGCVCSWGEDHNQENFNSQTQS

SEQ ID NO: 185517 - protein, 38 aa, Artificial Sequence
  Description of Artificial Sequence: Synthetic polypeptide
DEEEISTTNPVATEQYGCVCSTWGADHNAEHFGSDPQS

SEQ ID NO: 185518 - protein, 37 aa, Artificial Sequence
  Description of Artificial Sequence: Synthetic polypeptide
DEEEISTTNPVATEQYGCVCSWGEDHNQENFNSDNQS

SEQ ID NO: 185519 - protein, 37 aa, Artificial Sequence
  Description of Artificial Sequence: Synthetic polypeptide
DEEEISTTNPVATEQYGCVCSWGEDHNQENFNSDNQA

SEQ ID NO: 185520 - protein, 37 aa, Artificial Sequence
  Description of Artificial Sequence: Synthetic polypeptide
DEHEIATTNPVAYEQWGEVCSTPNQGNLGEANGDGRN

SEQ ID NO: 185521 - protein, 36 aa, Artificial Sequence
  Description of Artificial Sequence: Synthetic polypeptide
DEHEIATTNPVAYEQWGEVCSTPNQGNHPEEGQGRN

SEQ ID NO: 185522 - protein, 36 aa, Artificial Sequence
  Description of Artificial Sequence: Synthetic polypeptide
DEHEIATTNPVAYEQWGEVCSTPNQGNHGPAGDGRQ

SEQ ID NO: 185523 - protein, 36 aa, Artificial Sequence
  Description of Artificial Sequence: Synthetic polypeptide
DEHEIATTNPVAYEQWGEVCSTPNQGNHGEEGDGRL

SEQ ID NO: 185524 - protein, 37 aa, Artificial Sequence
  Description of Artificial Sequence: Synthetic polypeptide
DEEEISTTNPVATEQYGCVCSWGEDHNAENFGSETQS

SEQ ID NO: 185525 - protein, 36 aa, Artificial Sequence
  Description of Artificial Sequence: Synthetic polypeptide
DEHEIATTNPVAYEQWGEVCSTPNHGNHGEAGDGRG

SEQ ID NO: 185526 - protein, 35 aa, Artificial Sequence
  Description of Artificial Sequence: Synthetic polypeptide
DEEEIGTTNPCAYAEYGESVAYTTNEHSGIGGNYG

SEQ ID NO: 185527 - protein, 37 aa, Artificial Sequence
  Description of Artificial Sequence: Synthetic polypeptide
DEEEISTTNPVATEQYGCVCSWGEDHNAENFNSDTQG

SEQ ID NO: 185528 - protein, 37 aa, Artificial Sequence
  Description of Artificial Sequence: Synthetic polypeptide
DEEEISTTNPVATEQYGCVCSWGEDHNAENFNSENQL

SEQ ID NO: 185529 - protein, 36 aa, Artificial Sequence
  Description of Artificial Sequence: Synthetic polypeptide
DEHEIATTNPVAYEQWGEVCSTMNQGNHGEQGDGSN

SEQ ID NO: 185530 - protein, 36 aa, Artificial Sequence
  Description of Artificial Sequence: Synthetic polypeptide
DEEEISTTNPVATEQYGCVCSWGEDHNANFNSDTQG

SEQ ID NO: 185531 - protein, 37 aa, Artificial Sequence
  Description of Artificial Sequence: Synthetic polypeptide
DEEEISTTNPVATEQYGCVCSWGEDHNQEGFGSDTQS

SEQ ID NO: 185532 - protein, 38 aa, Artificial Sequence
  Description of Artificial Sequence: Synthetic polypeptide
DEEEIGTTNPVATEQYGCVCSMTGEDHNQENFGSDTQA

SEQ ID NO: 185533 - protein, 38 aa, Artificial Sequence
  Description of Artificial Sequence: Synthetic polypeptide
DEEEIGTTNPVATEQYGCVCSMTGEDHNQENFGSDTQS

SEQ ID NO: 185534 - protein, 36 aa, Artificial Sequence
  Description of Artificial Sequence: Synthetic polypeptide
DEHEIATTNPVAYEQWGCVSIPNAGDDQDRQGDSGS

SEQ ID NO: 185535 - protein, 37 aa, Artificial Sequence
  Description of Artificial Sequence: Synthetic polypeptide
DEEEISTTNPVATEQYGCVCSWGEDHNQEHFNSDFQS

SEQ ID NO: 185536 - protein, 37 aa, Artificial Sequence
  Description of Artificial Sequence: Synthetic polypeptide
DEEEISTTNPVATEQYGCVCSWGEDHNQENFGSDTQS

SEQ ID NO: 185537 - protein, 35 aa, Artificial Sequence
  Description of Artificial Sequence: Synthetic polypeptide
SQEEIRTTNPVATEQWGQCVCSWGEHNQYFNSDQA

SEQ ID NO: 185538 - protein, 37 aa, Artificial Sequence
  Description of Artificial Sequence: Synthetic polypeptide
DEEEIGTTNPVATEQYGCVCSMWGEHNAENFNSDNQA

SEQ ID NO: 185539 - protein, 37 aa, Artificial Sequence
  Description of Artificial Sequence: Synthetic polypeptide
DEEEIGTTNPVATEQYGCVCSNSGEHNAENFNSDTQS

SEQ ID NO: 185540 - protein, 37 aa, Artificial Sequence
  Description of Artificial Sequence: Synthetic polypeptide
DEEEISTTNPVATEQYGCVCSNWGEHNAENFNSENQS

SEQ ID NO: 185541 - protein, 37 aa, Artificial Sequence
  Description of Artificial Sequence: Synthetic polypeptide
AEEEIRTTNPVATEQYGCVCSWEEDHNQENFNSDNQG

SEQ ID NO: 185542 - protein, 38 aa, Artificial Sequence
  Description of Artificial Sequence: Synthetic polypeptide
DEEEISTTNPVATEQYGCVCSTTGEDHNAEYFNSENQS

SEQ ID NO: 185543 - protein, 37 aa, Artificial Sequence
  Description of Artificial Sequence: Synthetic polypeptide
AEEEIRTTNPVATEQYGCVCSNWEEHNQEFFNSDTQS

SEQ ID NO: 185544 - protein, 39 aa, Artificial Sequence
  Description of Artificial Sequence: Synthetic polypeptide
DEEEIRTTNPVATEAYGSVSTVIGTTEQGSTNDEQGDTD

SEQ ID NO: 185545 - protein, 37 aa, Artificial Sequence
  Description of Artificial Sequence: Synthetic polypeptide
AEEEIRTTNPVATEQYGCVCSNWEEHNQENFNSDNQA

SEQ ID NO: 185546 - protein, 36 aa, Artificial Sequence
  Description of Artificial Sequence: Synthetic polypeptide
TEAEICTTNPVAYECWGSVATGNGNLNDDRGQNGTN

SEQ ID NO: 185547 - protein, 35 aa, Artificial Sequence
  Description of Artificial Sequence: Synthetic polypeptide
TEAEIATTNPVSYCAYGQTVISTPNLSQKGTNNQD

SEQ ID NO: 185548 - protein, 36 aa, Artificial Sequence
  Description of Artificial Sequence: Synthetic polypeptide
TEAEIATTNPVAYMAYGQIVPSTANLAQNKGTNNPD

SEQ ID NO: 185549 - protein, 34 aa, Artificial Sequence
  Description of Artificial Sequence: Synthetic polypeptide
TEAEIATTNPVAYEQWGCLYCFELDEQNRQNGSR

SEQ ID NO: 185550 - protein, 33 aa, Artificial Sequence
  Description of Artificial Sequence: Synthetic polypeptide
TEAEIATTNPVAYEQWGCLSCFEGDQQPQNGSR

SEQ ID NO: 185551 - protein, 38 aa, Artificial Sequence
  Description of Artificial Sequence: Synthetic polypeptide
AEEEIRTTNPVATEQYGCVCSNWEEDTNQENFNSETQS

SEQ ID NO: 185552 - protein, 35 aa, Artificial Sequence
  Description of Artificial Sequence: Synthetic polypeptide
TEAEIATTNPVAYCAYGQTVPSTVLSQKKGTNNQD

SEQ ID NO: 185553 - protein, 34 aa, Artificial Sequence
  Description of Artificial Sequence: Synthetic polypeptide
TEAEIATTNPVAYCAYGQTVPITCLSQKGTNNQD

SEQ ID NO: 185554 - protein, 34 aa, Artificial Sequence
  Description of Artificial Sequence: Synthetic polypeptide
TEAEIATTNPVAYCAYGQTVISTNFSGKGTNNQD

SEQ ID NO: 185555 - protein, 35 aa, Artificial Sequence
  Description of Artificial Sequence: Synthetic polypeptide
TEAEIATTNPVAYCAYGQTVISLGNLSQKGTNNQD

SEQ ID NO: 185556 - protein, 35 aa, Artificial Sequence
  Description of Artificial Sequence: Synthetic polypeptide
TEAEIATTNPVAYCAYGQNVPSTYALAQKGTNNPD

SEQ ID NO: 185557 - protein, 35 aa, Artificial Sequence
  Description of Artificial Sequence: Synthetic polypeptide
TEAEIATTNPVAYCAYGQIVPSTNWSQKDGTNNPD

SEQ ID NO: 185558 - protein, 35 aa, Artificial Sequence
  Description of Artificial Sequence: Synthetic polypeptide
TEAEIATTNPVAYCAYGQIVPSTNLAQQKVTNNPM

SEQ ID NO: 185559 - protein, 34 aa, Artificial Sequence
  Description of Artificial Sequence: Synthetic polypeptide
TEAEIATTNPVAYCAYGQIVPSTNHAGKGTNNPD

SEQ ID NO: 185560 - protein, 35 aa, Artificial Sequence
  Description of Artificial Sequence: Synthetic polypeptide
TEAEIATTNPVAYCAYGQIVPSTNGAQNKGTNNPS

SEQ ID NO: 185561 - protein, 35 aa, Artificial Sequence
  Description of Artificial Sequence: Synthetic polypeptide
TEAEIATTNPVAYCAYGQTVPSTNYSQLKGTNNQD

SEQ ID NO: 185562 - protein, 35 aa, Artificial Sequence
  Description of Artificial Sequence: Synthetic polypeptide
DEHEIATTNPVAYEQYGSCPAANGEPAQMQHQQER

SEQ ID NO: 185563 - protein, 38 aa, Artificial Sequence
  Description of Artificial Sequence: Synthetic polypeptide
DEEEIRTTNPVAYEQYGCSCSNTGEPHNQEYFNSDTQS

SEQ ID NO: 185564 - protein, 32 aa, Artificial Sequence
  Description of Artificial Sequence: Synthetic polypeptide
DDSEVACTNPVSTEGYGCVCATWEIQERFGQQ

SEQ ID NO: 185565 - protein, 36 aa, Artificial Sequence
  Description of Artificial Sequence: Synthetic polypeptide
AEEEIRTTNPVATEQYGCVCNWGEDNQEYFNSDTQS

SEQ ID NO: 185566 - protein, 36 aa, Artificial Sequence
  Description of Artificial Sequence: Synthetic polypeptide
DEEEIRTTNPVAYEQYGCVCGWGEAHNQYFDSDNQS

SEQ ID NO: 185567 - protein, 35 aa, Artificial Sequence
  Description of Artificial Sequence: Synthetic polypeptide
DEEEIRTTNPVAYEQYGCVCGWEDHNQYFDSDTQS

SEQ ID NO: 185568 - protein, 33 aa, Artificial Sequence
  Description of Artificial Sequence: Synthetic polypeptide
TEDEIRCTNPTAYECWGSVYYENDDRHRGDDRH

SEQ ID NO: 185569 - protein, 36 aa, Artificial Sequence
  Description of Artificial Sequence: Synthetic polypeptide
DEEEIRTTNPVAYEQYGCVCGSMEDNQENFDSDTQS

SEQ ID NO: 185570 - protein, 35 aa, Artificial Sequence
  Description of Artificial Sequence: Synthetic polypeptide
TEDEICTTNPVAYECWGMVSGGNMGNQGGRGGGNM

SEQ ID NO: 185571 - protein, 34 aa, Artificial Sequence
  Description of Artificial Sequence: Synthetic polypeptide
TEDEIATTNPVAYERWGSVCVNDDEGDRQGGDMR

SEQ ID NO: 185572 - protein, 34 aa, Artificial Sequence
  Description of Artificial Sequence: Synthetic polypeptide
TEDEIASVNPVCYEPYGVTVSTINLSQSAGGNNV

SEQ ID NO: 185573 - protein, 32 aa, Artificial Sequence
  Description of Artificial Sequence: Synthetic polypeptide
TEDEIASVNPVCYEPYGVTVSINFSQSGGNNQ

SEQ ID NO: 185574 - protein, 37 aa, Artificial Sequence
  Description of Artificial Sequence: Synthetic polypeptide
TEDCIRTTNPVATEQWGSQVATNGNMESDYNGGNNRN

SEQ ID NO: 185575 - protein, 32 aa, Artificial Sequence
  Description of Artificial Sequence: Synthetic polypeptide
TEDAEIATTNPVAYERWGTCSTDDQHQQGQEP

SEQ ID NO: 185576 - protein, 37 aa, Artificial Sequence
  Description of Artificial Sequence: Synthetic polypeptide
DEEEIRTTNPVAYEQYGCVCGNWMEHNQEYFNSDTQS

SEQ ID NO: 185577 - protein, 35 aa, Artificial Sequence
  Description of Artificial Sequence: Synthetic polypeptide
TECEIATTNPVAYEEWGSVATGGNTGNAGNDNQRD

SEQ ID NO: 185578 - protein, 34 aa, Artificial Sequence
  Description of Artificial Sequence: Synthetic polypeptide
TECEIATTNPEATDQYGQVCCCDQDQKREGGTSR

SEQ ID NO: 185579 - protein, 39 aa, Artificial Sequence
  Description of Artificial Sequence: Synthetic polypeptide
DEEEIRTTNPVATEQYGSTVTGPHDNNYSEMAQNEDNTQ

SEQ ID NO: 185580 - protein, 34 aa, Artificial Sequence
  Description of Artificial Sequence: Synthetic polypeptide
TEASLATTNPVAYCAYGQTVPSTNLSQKGTNNQD

SEQ ID NO: 185581 - protein, 33 aa, Artificial Sequence
  Description of Artificial Sequence: Synthetic polypeptide
TEAQEIATTNPVAYEAWGVCATNLNGDTGNGSN

SEQ ID NO: 185582 - protein, 35 aa, Artificial Sequence
  Description of Artificial Sequence: Synthetic polypeptide
TEANEIATTNPVAYERWGSVYSITNDQGDLDNDAH

SEQ ID NO: 185583 - protein, 37 aa, Artificial Sequence
  Description of Artificial Sequence: Synthetic polypeptide
AEEEIRTTNPVATEQYGCVCSNSGEHNAEFFNSEFQS

SEQ ID NO: 185584 - protein, 35 aa, Artificial Sequence
  Description of Artificial Sequence: Synthetic polypeptide
TEAEIATTNPVAYCAYGQIVPSTHLAQNTGTNNPD

SEQ ID NO: 185585 - protein, 35 aa, Artificial Sequence
  Description of Artificial Sequence: Synthetic polypeptide
TEAEIATTNPVAYCAYGQIVPSTENLAQKVTNNQD

SEQ ID NO: 185586 - protein, 35 aa, Artificial Sequence
  Description of Artificial Sequence: Synthetic polypeptide
TEAEIATTNPVAYCAYGQIVPPTNMLAQKGTNNPD

SEQ ID NO: 185587 - protein, 35 aa, Artificial Sequence
  Description of Artificial Sequence: Synthetic polypeptide
TEAEIATTNPVAYCAYGQIVPATNLAQKAGTNNPD

SEQ ID NO: 185588 - protein, 35 aa, Artificial Sequence
  Description of Artificial Sequence: Synthetic polypeptide
TAEEIATTNPVATEPYGCVCPTNDNQDQDGQQGDD

SEQ ID NO: 185589 - protein, 34 aa, Artificial Sequence
  Description of Artificial Sequence: Synthetic polypeptide
DEACIACTNPVAYENYGSVVSMNEFSTERGGPLM

SEQ ID NO: 185590 - protein, 34 aa, Artificial Sequence
  Description of Artificial Sequence: Synthetic polypeptide
TAEEEIATTNPVAYERWGVCATNLPGDHGENNGQ

SEQ ID NO: 185591 - protein, 34 aa, Artificial Sequence
  Description of Artificial Sequence: Synthetic polypeptide
TAEEEIATTNPVAYERWGVCATNLPGDHGENDAT

SEQ ID NO: 185592 - protein, 39 aa, Artificial Sequence
  Description of Artificial Sequence: Synthetic polypeptide
DEEEIRTTNPVATEAYGSVSTQIGTTEQGSTNDEQSEED

SEQ ID NO: 185593 - protein, 35 aa, Artificial Sequence
  Description of Artificial Sequence: Synthetic polypeptide
TADEIATTNPVATEAYGCVCPTNDNQQQDGRGGDS

SEQ ID NO: 185594 - protein, 36 aa, Artificial Sequence
  Description of Artificial Sequence: Synthetic polypeptide
TACEIATTNPVATEAYGCVCPTNDNQQDRDGQNGDQ

SEQ ID NO: 185595 - protein, 35 aa, Artificial Sequence
  Description of Artificial Sequence: Synthetic polypeptide
TAAEIATTNPVAYCAYGQTVPSTNLSQKYGTNNQD

SEQ ID NO: 185596 - protein, 38 aa, Artificial Sequence
  Description of Artificial Sequence: Synthetic polypeptide
STEEIRTTNPVATEQYGSVMYPTFDDMNNNTLEELNME

SEQ ID NO: 185597 - protein, 39 aa, Artificial Sequence
  Description of Artificial Sequence: Synthetic polypeptide
DEEEIRTTNPVATEAYGSVQTIGNSNGIGTTSISTTGNT

SEQ ID NO: 185598 - protein, 34 aa, Artificial Sequence
  Description of Artificial Sequence: Synthetic polypeptide
STEEICTTNPAATDAYGSVVTTEGGQQRGQGEGQ

SEQ ID NO: 185599 - protein, 35 aa, Artificial Sequence
  Description of Artificial Sequence: Synthetic polypeptide
STEEICTTNPAATDAYGSVVNTEGLGEQEGQGNGQ

SEQ ID NO: 185600 - protein, 34 aa, Artificial Sequence
  Description of Artificial Sequence: Synthetic polypeptide
STEEICTTNPAATDAYGSVVNTEGGEQDGQGNGN

SEQ ID NO: 185601 - protein, 35 aa, Artificial Sequence
  Description of Artificial Sequence: Synthetic polypeptide
SSSEIRTTNPVATEQYGASAVVAVVNHIEGEEDQE

SEQ ID NO: 185602 - protein, 35 aa, Artificial Sequence
  Description of Artificial Sequence: Synthetic polypeptide
SSSEIRTTNPVATEQYGASAVVATVHHIEGTESQE

SEQ ID NO: 185603 - protein, 35 aa, Artificial Sequence
  Description of Artificial Sequence: Synthetic polypeptide
SSSEIRTTNPVATEQYGAIAVVATVNEIEGTESQE

SEQ ID NO: 185604 - protein, 39 aa, Artificial Sequence
  Description of Artificial Sequence: Synthetic polypeptide
DEEEIRTTNPVATEAYGSVATVIGTTEQGSTNDEQDEET

SEQ ID NO: 185605 - protein, 38 aa, Artificial Sequence
  Description of Artificial Sequence: Synthetic polypeptide
DEEEISTTNPVATEQYGCVCSTSGEDHNAENFNSDTQS

SEQ ID NO: 185606 - protein, 38 aa, Artificial Sequence
  Description of Artificial Sequence: Synthetic polypeptide
DEEEIRTTNPVATEAYGSLVYSETQDDMAADVTLQEEP

SEQ ID NO: 185607 - protein, 36 aa, Artificial Sequence
  Description of Artificial Sequence: Synthetic polypeptide
DEHEIATTNPVAYEQWGTVCSTPNQGNHGESGDGRN

SEQ ID NO: 185608 - protein, 38 aa, Artificial Sequence
  Description of Artificial Sequence: Synthetic polypeptide
DEEEIRTTNPVAYEQWGSVSGGQPGNGGNMRNGMGDVN

SEQ ID NO: 185609 - protein, 34 aa, Artificial Sequence
  Description of Artificial Sequence: Synthetic polypeptide
DEHEIATTNPVAYEQWGTVSGGNGNEAGGDGMTQ

SEQ ID NO: 185610 - protein, 38 aa, Artificial Sequence
  Description of Artificial Sequence: Synthetic polypeptide
AEEEIRTTNPVATEQYGCVCSNWMEAHNAENFGSDNQS

SEQ ID NO: 185611 - protein, 35 aa, Artificial Sequence
  Description of Artificial Sequence: Synthetic polypeptide
TEAEIATTNPVAYCAYGQIVCSTGELAQKGTNNQD

SEQ ID NO: 185612 - protein, 36 aa, Artificial Sequence
  Description of Artificial Sequence: Synthetic polypeptide
TEAEIATTNPVAYCAYGQILVPSTNLAQNKGTNNSD

SEQ ID NO: 185613 - protein, 35 aa, Artificial Sequence
  Description of Artificial Sequence: Synthetic polypeptide
TEAEIATTNPVAYCAFGQTVISTNLSQNKGTNNQD

SEQ ID NO: 185614 - protein, 35 aa, Artificial Sequence
  Description of Artificial Sequence: Synthetic polypeptide
TEAEIATTNPVAYCADGQIVPSTNLAQNAGTNNPD

SEQ ID NO: 185615 - protein, 35 aa, Artificial Sequence
  Description of Artificial Sequence: Synthetic polypeptide
TEAEIATTNPVATECWGMHCWTMNEQQRGQDNHEK

SEQ ID NO: 185616 - protein, 34 aa, Artificial Sequence
  Description of Artificial Sequence: Synthetic polypeptide
TEAEIATTNCVAYCAYGQTVPSTNSSQKGTNNQD

SEQ ID NO: 185617 - protein, 34 aa, Artificial Sequence
  Description of Artificial Sequence: Synthetic polypeptide
TEAEEIATTNPCAYEHWGSVCYNNDDQDHGQNDH

SEQ ID NO: 185618 - protein, 35 aa, Artificial Sequence
  Description of Artificial Sequence: Synthetic polypeptide
TEADEIATTNPVAYEQWGSVSGGPGNQQGEHNQSS

SEQ ID NO: 185619 - protein, 37 aa, Artificial Sequence
  Description of Artificial Sequence: Synthetic polypeptide
AEEEIRTTNPVATEQYGCVCSNWGEHNAENFNSDNQS

SEQ ID NO: 185620 - protein, 34 aa, Artificial Sequence
  Description of Artificial Sequence: Synthetic polypeptide
TEACIRTTNPVATEQYGCVCSSGEHNAYFLSDQS

SEQ ID NO: 185621 - protein, 35 aa, Artificial Sequence
  Description of Artificial Sequence: Synthetic polypeptide
TEAAEIATTNPVAYEQWGSVCSTGDNHENHHGEDQ

SEQ ID NO: 185622 - protein, 35 aa, Artificial Sequence
  Description of Artificial Sequence: Synthetic polypeptide
TEAAEIATTNPVAYEHWGEVATGQLQGDIQGGNNR

SEQ ID NO: 185623 - protein, 36 aa, Artificial Sequence
  Description of Artificial Sequence: Synthetic polypeptide
TDESEIATTNPVAYEHWGEVATGQLQGDIQGGNQNR

SEQ ID NO: 185624 - protein, 37 aa, Artificial Sequence
  Description of Artificial Sequence: Synthetic polypeptide
TDEEISTTNPVATEQYGSVVESANQQEQVMTLNPVDN

SEQ ID NO: 185625 - protein, 37 aa, Artificial Sequence
  Description of Artificial Sequence: Synthetic polypeptide
AEEEIRTTNPVATEQYGCVCSNWGEHNQENFNSETQD

SEQ ID NO: 185626 - protein, 34 aa, Artificial Sequence
  Description of Artificial Sequence: Synthetic polypeptide
TDEAEIATTNPVAYERWGVCATNLPGDHGENDGK

SEQ ID NO: 185627 - protein, 33 aa, Artificial Sequence
  Description of Artificial Sequence: Synthetic polypeptide
DEHEIATTNPVAYEQWGVAYYGNGNLGEHHGGE

SEQ ID NO: 185628 - protein, 36 aa, Artificial Sequence
  Description of Artificial Sequence: Synthetic polypeptide
DEHEIATTNPVAYEQWGVACSGGNDTEQRNGGGGDR

SEQ ID NO: 185629 - protein, 37 aa, Artificial Sequence
  Description of Artificial Sequence: Synthetic polypeptide
DEHEIATTNPVAYEQWGVACSGGGNDTEQRGNGGGDR

SEQ ID NO: 185630 - protein, 35 aa, Artificial Sequence
  Description of Artificial Sequence: Synthetic polypeptide
TCEECIATTNPVAYEQWGSVSKTNPEDGMGKKGEQ

SEQ ID NO: 185631 - protein, 38 aa, Artificial Sequence
  Description of Artificial Sequence: Synthetic polypeptide
DEEEIATTNPVATEQYGSVCAMNNGEPTNPDDQMEHGM

SEQ ID NO: 185632 - protein, 36 aa, Artificial Sequence
  Description of Artificial Sequence: Synthetic polypeptide
CEEEIACTNPVATEQYGSACSVADGLQEDAGEGDMM

SEQ ID NO: 185633 - protein, 37 aa, Artificial Sequence
  Description of Artificial Sequence: Synthetic polypeptide
DEAEIRTTNPVATEQYGSLIWSYDQEINDLEINMDQE

SEQ ID NO: 185634 - protein, 37 aa, Artificial Sequence
  Description of Artificial Sequence: Synthetic polypeptide
DEECIRTTNPVATEQYGCVCSNWGEHNQENFNSDNQQ

SEQ ID NO: 185635 - protein, 37 aa, Artificial Sequence
  Description of Artificial Sequence: Synthetic polypeptide
DEECIRTTNPVATEQYGCVCSNWGEHNQENFNSDNQS

SEQ ID NO: 185636 - protein, 34 aa, Artificial Sequence
  Description of Artificial Sequence: Synthetic polypeptide
AEMEIACTNPVATEQYGCSCSWEDNQNFGSDTQA

SEQ ID NO: 185637 - protein, 37 aa, Artificial Sequence
  Description of Artificial Sequence: Synthetic polypeptide
DEECIRTTNPVATEQYGCVCSNWGEHNQENFNSDTQP

SEQ ID NO: 185638 - protein, 35 aa, Artificial Sequence
  Description of Artificial Sequence: Synthetic polypeptide
DTETEIATTNPVAYEQWGSVSQGPPQQATPDGSEH

SEQ ID NO: 185639 - protein, 32 aa, Artificial Sequence
  Description of Artificial Sequence: Synthetic polypeptide
AEMEIACTNPCSYEQYGCVCSWNHNQSGSEQA

SEQ ID NO: 185640 - protein, 32 aa, Artificial Sequence
  Description of Artificial Sequence: Synthetic polypeptide
AEMEIACTNPCSYEQYGCVCSWNDQSFGSEQM

SEQ ID NO: 185641 - protein, 36 aa, Artificial Sequence
  Description of Artificial Sequence: Synthetic polypeptide
DTGEIATTNPVAYEQYGSTACAGANGLQDSDGNAQS

SEQ ID NO: 185642 - protein, 32 aa, Artificial Sequence
  Description of Artificial Sequence: Synthetic polypeptide
AEMEIACTNPCSYEQYGCVCSWGNHQSFGSEQ

SEQ ID NO: 185643 - protein, 32 aa, Artificial Sequence
  Description of Artificial Sequence: Synthetic polypeptide
AEMEIACTNPCSYEQYGCVCSWGELQSGSEQS

SEQ ID NO: 185644 - protein, 37 aa, Artificial Sequence
  Description of Artificial Sequence: Synthetic polypeptide
DTNEIRTTNPVATEQYGTVTTVWLDVDEGENLQIDEI

SEQ ID NO: 185645 - protein, 32 aa, Artificial Sequence
  Description of Artificial Sequence: Synthetic polypeptide
DTSEVASTNPVSTEGYGNVAAPTIQSRVGSQR

SEQ ID NO: 185646 - protein, 38 aa, Artificial Sequence
  Description of Artificial Sequence: Synthetic polypeptide
DYEDEWEIYCTLTNKYVACYEQVYPVVTSTSELQRPNR

SEQ ID NO: 185647 - protein, 35 aa, Artificial Sequence
  Description of Artificial Sequence: Synthetic polypeptide
EACEICTTNPVAYEQWGSVCSTPNGNQGEEQNQGD

SEQ ID NO: 185648 - protein, 34 aa, Artificial Sequence
  Description of Artificial Sequence: Synthetic polypeptide
EAEAEIATTNPVAYEQWGSVAGIDPGGQTNGNTE

SEQ ID NO: 185649 - protein, 37 aa, Artificial Sequence
  Description of Artificial Sequence: Synthetic polypeptide
EDAEIRTTNPVATEQYGSVISPDKISVTDEIQGNPDD

SEQ ID NO: 185650 - protein, 36 aa, Artificial Sequence
  Description of Artificial Sequence: Synthetic polypeptide
DEECIRTTNPVATEQYGCVCSWGEHNDENFMSDTQA

SEQ ID NO: 185651 - protein, 36 aa, Artificial Sequence
  Description of Artificial Sequence: Synthetic polypeptide
EDETICTTNPVATEQWGTVSTNNNLNGSEQGTNEED

SEQ ID NO: 185652 - protein, 36 aa, Artificial Sequence
  Description of Artificial Sequence: Synthetic polypeptide
EDETICTTNPVATEQWGTVSTTNNEQGSEEGTNTED

SEQ ID NO: 185653 - protein, 36 aa, Artificial Sequence
  Description of Artificial Sequence: Synthetic polypeptide
EDETICTTNPVATEQWGTVSTTNNLNNSEQGTNVED

SEQ ID NO: 185654 - protein, 36 aa, Artificial Sequence
  Description of Artificial Sequence: Synthetic polypeptide
EDETICTTNPVATEQWGTVSTTVNNQQLQQGTTDES

SEQ ID NO: 185655 - protein, 35 aa, Artificial Sequence
  Description of Artificial Sequence: Synthetic polypeptide
EDETICTTNPVATEQWGTVSTVNNQQLEQGTEDEQ

SEQ ID NO: 185656 - protein, 35 aa, Artificial Sequence
  Description of Artificial Sequence: Synthetic polypeptide
EDETICTTNPVATEQWGTVSTVNTQQLEQGTEEGT

SEQ ID NO: 185657 - protein, 37 aa, Artificial Sequence
  Description of Artificial Sequence: Synthetic polypeptide
DEECIRTTNPVATEQYGCVCSNWGEHNQENFNSDNQA

SEQ ID NO: 185658 - protein, 37 aa, Artificial Sequence
  Description of Artificial Sequence: Synthetic polypeptide
EDETICTTNPVATEQWGTVSTVVNNLQGSEQGTNTTD

SEQ ID NO: 185659 - protein, 37 aa, Artificial Sequence
  Description of Artificial Sequence: Synthetic polypeptide
DEECIRTTNPVATEQYGCVCSNWGEDNTENFGSDTQA

SEQ ID NO: 185660 - protein, 37 aa, Artificial Sequence
  Description of Artificial Sequence: Synthetic polypeptide
DEECIRTTNPVATEQYGCVCSNWEEHNQENFNSDTQS

SEQ ID NO: 185661 - protein, 36 aa, Artificial Sequence
  Description of Artificial Sequence: Synthetic polypeptide
DEECIRTTNPVATEQWGCVCQWGEHNQEGFGSDNQA

SEQ ID NO: 185662 - protein, 37 aa, Artificial Sequence
  Description of Artificial Sequence: Synthetic polypeptide
CEEEISTTNPVATEQYGCVCSNTGEDNQENFISDNQA

SEQ ID NO: 185663 - protein, 37 aa, Artificial Sequence
  Description of Artificial Sequence: Synthetic polypeptide
DEAEIRTTNPVATEQWGICQVCSYTNDHNANFGSDQA

SEQ ID NO: 185664 - protein, 38 aa, Artificial Sequence
  Description of Artificial Sequence: Synthetic polypeptide
DTEEIRTTNPVATEQYGVVSTVVTTNNDGEEQGTEDED

SEQ ID NO: 185665 - protein, 38 aa, Artificial Sequence
  Description of Artificial Sequence: Synthetic polypeptide
DTEEIRTTNPVATEQYGVVSVTTNQNNGTEAGTEQGAD

SEQ ID NO: 185666 - protein, 38 aa, Artificial Sequence
  Description of Artificial Sequence: Synthetic polypeptide
DTEEIRTTNPVATEQYGVVSVTTTQNGTTEAGTEQGTD

SEQ ID NO: 185667 - protein, 38 aa, Artificial Sequence
  Description of Artificial Sequence: Synthetic polypeptide
DTEEIRTTNPVATEQYGVVSVTTTQNTGTEAGTEQGTT

SEQ ID NO: 185668 - protein, 38 aa, Artificial Sequence
  Description of Artificial Sequence: Synthetic polypeptide
DTEEIRTTNPVATEQYGVVSVTTTQQGGTEAGTEQGSD

SEQ ID NO: 185669 - protein, 39 aa, Artificial Sequence
  Description of Artificial Sequence: Synthetic polypeptide
DTEEIRTTNPVATEQYGVVSVVVVVVTNNQQQNATNDTE

SEQ ID NO: 185670 - protein, 37 aa, Artificial Sequence
  Description of Artificial Sequence: Synthetic polypeptide
DTEEIRTTNPVATEQYGVVVTVVTTNNDEEIGTEDED

SEQ ID NO: 185671 - protein, 37 aa, Artificial Sequence
  Description of Artificial Sequence: Synthetic polypeptide
DTEEIRTTNPVATEQYGVVVTVVTTNNNDEQGTEEED

SEQ ID NO: 185672 - protein, 38 aa, Artificial Sequence
  Description of Artificial Sequence: Synthetic polypeptide
DTEEIRTTNPVATEQYGVVVTVVTTNNTNEQIGTEEED

SEQ ID NO: 185673 - protein, 37 aa, Artificial Sequence
  Description of Artificial Sequence: Synthetic polypeptide
DTEEIRTTNPVATEQYGVVVVTVVTTNQQNNEEDEED

SEQ ID NO: 185674 - protein, 37 aa, Artificial Sequence
  Description of Artificial Sequence: Synthetic polypeptide
DTEEIRTTNPVATEQYGVVVVVVNTNNDEQGTTEDED

SEQ ID NO: 185675 - protein, 39 aa, Artificial Sequence
  Description of Artificial Sequence: Synthetic polypeptide
DTEEIRTTNPVATESYGTVTNLQSGTISTNTQNQEQGNN

SEQ ID NO: 185676 - protein, 39 aa, Artificial Sequence
  Description of Artificial Sequence: Synthetic polypeptide
DTEEIRTTNPVATESYGTVTTGQSGTISTNTQEQEVGNP

SEQ ID NO: 185677 - protein, 37 aa, Artificial Sequence
  Description of Artificial Sequence: Synthetic polypeptide
DEECIRTTNPVATEQWGQCVCQWNEDHNQGFGSDNQS

SEQ ID NO: 185678 - protein, 35 aa, Artificial Sequence
  Description of Artificial Sequence: Synthetic polypeptide
DEECIRTTNPVATEQYGCMCFNALNEIETSDETVF

SEQ ID NO: 185679 - protein, 37 aa, Artificial Sequence
  Description of Artificial Sequence: Synthetic polypeptide
DEECIRTTNPVATEQYGCVCSMSGEHNQENFNSETQA

SEQ ID NO: 185680 - protein, 37 aa, Artificial Sequence
  Description of Artificial Sequence: Synthetic polypeptide
AEMEIATTNPVATEQYGCVCSTWGEHNAEHFGSENQS

SEQ ID NO: 185681 - protein, 36 aa, Artificial Sequence
  Description of Artificial Sequence: Synthetic polypeptide
AEMEIATTNPVATEQYGCVCSNWDHNEEHFGSENQS

SEQ ID NO: 185682 - protein, 34 aa, Artificial Sequence
  Description of Artificial Sequence: Synthetic polypeptide
AEMEIATTNPVATEQYGCSCGWMEDNQHFNSEQA

SEQ ID NO: 185683 - protein, 37 aa, Artificial Sequence
  Description of Artificial Sequence: Synthetic polypeptide
DEECIRTTNPVATEQYGCVCSNSGEHNQEFFNSDTQS

SEQ ID NO: 185684 - protein, 37 aa, Artificial Sequence
  Description of Artificial Sequence: Synthetic polypeptide
DEECIRTTNPVATEQYGCVCSNWGEDHNQENFGSEQS

SEQ ID NO: 185685 - protein, 36 aa, Artificial Sequence
  Description of Artificial Sequence: Synthetic polypeptide
EDETICTTNPVATESYGVVSTVDQGGNNDQTGTNVT

SEQ ID NO: 185686 - protein, 36 aa, Artificial Sequence
  Description of Artificial Sequence: Synthetic polypeptide
EDETICTTNPVATESYGVVSTVDQGGNNNQTGTNVN

SEQ ID NO: 185687 - protein, 36 aa, Artificial Sequence
  Description of Artificial Sequence: Synthetic polypeptide
EDETICTTNPVATESYGVVSTVDQQGNNQTGTNDTD

SEQ ID NO: 185688 - protein, 38 aa, Artificial Sequence
  Description of Artificial Sequence: Synthetic polypeptide
EEEEIRSTNPVATEQYGSVTQWNMELYQEQDPELNLVQ

SEQ ID NO: 185689 - protein, 37 aa, Artificial Sequence
  Description of Artificial Sequence: Synthetic polypeptide
EEEEIRTTNPVATDQYGSVPCPPNTADQPMLEVELNE

SEQ ID NO: 185690 - protein, 37 aa, Artificial Sequence
  Description of Artificial Sequence: Synthetic polypeptide
EEEEIRTTNPVATDQYGSVPGPPNTADQPNLGVELIE

SEQ ID NO: 185691 - protein, 39 aa, Artificial Sequence
  Description of Artificial Sequence: Synthetic polypeptide
EEEEIRTTNPVATEAYGVVSTTNNQNGNQQLGNNNTTDE

SEQ ID NO: 185692 - protein, 39 aa, Artificial Sequence
  Description of Artificial Sequence: Synthetic polypeptide
EEEEIRTTNPVATEAYGVVSTVVTNQQQLNQNGEEEEDE

SEQ ID NO: 185693 - protein, 39 aa, Artificial Sequence
  Description of Artificial Sequence: Synthetic polypeptide
EEEEIRTTNPVATEIYGSVNNSTGPENGPEMGQGENEEG

SEQ ID NO: 185694 - protein, 37 aa, Artificial Sequence
  Description of Artificial Sequence: Synthetic polypeptide
EEEEIRTTNPVATEQWGYSNQAASNELPHTNVGQGFV

SEQ ID NO: 185695 - protein, 36 aa, Artificial Sequence
  Description of Artificial Sequence: Synthetic polypeptide
DEECIRTTNPVATEQYSACVCSNWEHNQENFGSDQS

SEQ ID NO: 185696 - protein, 35 aa, Artificial Sequence
  Description of Artificial Sequence: Synthetic polypeptide
AEHEEIATTNPVAYEEWGVVATGGNTGNAGNDNQR

SEQ ID NO: 185697 - protein, 38 aa, Artificial Sequence
  Description of Artificial Sequence: Synthetic polypeptide
EEEEIRTTNPVATEQYGETYCTPNENVEMQVEGNVELS

SEQ ID NO: 185698 - protein, 36 aa, Artificial Sequence
  Description of Artificial Sequence: Synthetic polypeptide
EEEEIRTTNPVATEQYGGCVHPSPVHMPNFVDMFEG

SEQ ID NO: 185699 - protein, 37 aa, Artificial Sequence
  Description of Artificial Sequence: Synthetic polypeptide
EEEEIRTTNPVATEQYGNVYYSPEPTEEPNTGEPSVD

SEQ ID NO: 185700 - protein, 36 aa, Artificial Sequence
  Description of Artificial Sequence: Synthetic polypeptide
AEGQEIATTNPVAYEQWGSVSTGGNAGEHQTGDTDE

SEQ ID NO: 185701 - protein, 37 aa, Artificial Sequence
  Description of Artificial Sequence: Synthetic polypeptide
EEEEIRTTNPVATEQYGSCATCTTPVTLIQLQDAEDI

SEQ ID NO: 185702 - protein, 38 aa, Artificial Sequence
  Description of Artificial Sequence: Synthetic polypeptide
EEEEIRTTNPVATEQYGSCFPPAINPILTPEGQMVGIQ

SEQ ID NO: 185703 - protein, 36 aa, Artificial Sequence
  Description of Artificial Sequence: Synthetic polypeptide
AEGEIRTTNPVATEQYGSHNYYDNNNDQEIGEETQL

SEQ ID NO: 185704 - protein, 38 aa, Artificial Sequence
  Description of Artificial Sequence: Synthetic polypeptide
EEEEIRTTNPVATEQYGSMCVLGIADMTMEEPEQEGTP

SEQ ID NO: 185705 - protein, 38 aa, Artificial Sequence
  Description of Artificial Sequence: Synthetic polypeptide
AEGEICTTNPVATEAYGVVVVVSTEQIGTNLQEGNEDM

SEQ ID NO: 185706 - protein, 39 aa, Artificial Sequence
  Description of Artificial Sequence: Synthetic polypeptide
AEGEICTTNPVATEAYGSVYTVSTEEIGTNLQIGTNNVM

SEQ ID NO: 185707 - protein, 36 aa, Artificial Sequence
  Description of Artificial Sequence: Synthetic polypeptide
DEECIRTTNPVATEQYSACVCSSGEHNQEYFGSDQS

SEQ ID NO: 185708 - protein, 39 aa, Artificial Sequence
  Description of Artificial Sequence: Synthetic polypeptide
AEGEICTTNPVATEAYGSVVVVVSTEQIGTNLQEGNENM

SEQ ID NO: 185709 - protein, 38 aa, Artificial Sequence
  Description of Artificial Sequence: Synthetic polypeptide
AEGEICTTNPVATEAYGSVATVVTEGIGTNLQTGNEEM

SEQ ID NO: 185710 - protein, 39 aa, Artificial Sequence
  Description of Artificial Sequence: Synthetic polypeptide
AEGEICTTNPVATEAYGSVATVVSTEQIGTNLQEGNETM

SEQ ID NO: 185711 - protein, 35 aa, Artificial Sequence
  Description of Artificial Sequence: Synthetic polypeptide
EEEEIRCTNPTAYEQWGSTVYGENDDHQLGDGKNH

SEQ ID NO: 185712 - protein, 37 aa, Artificial Sequence
  Description of Artificial Sequence: Synthetic polypeptide
DEECIRTTNPVATEQYGQCVCSWMEDNQEFFNSDNQA

SEQ ID NO: 185713 - protein, 37 aa, Artificial Sequence
  Description of Artificial Sequence: Synthetic polypeptide
DEECIRTTNPVATEQYGQCVCSWGEHNQENFNSDTQS

SEQ ID NO: 185714 - protein, 37 aa, Artificial Sequence
  Description of Artificial Sequence: Synthetic polypeptide
DEECIRTTNPVATEQYGQCVCSWGEHNDENFGSQTQS

SEQ ID NO: 185715 - protein, 36 aa, Artificial Sequence
  Description of Artificial Sequence: Synthetic polypeptide
EDETICTTNPVATESYGVVSTVVDGGNNQTGTTNVQ

SEQ ID NO: 185716 - protein, 36 aa, Artificial Sequence
  Description of Artificial Sequence: Synthetic polypeptide
EDETICTTNPVATESYGVVSTVVDQGGNNQTGTNVQ

SEQ ID NO: 185717 - protein, 34 aa, Artificial Sequence
  Description of Artificial Sequence: Synthetic polypeptide
EEAAEIATTNPVAYECWGSVYHPNNDTQNGGNEA

SEQ ID NO: 185718 - protein, 37 aa, Artificial Sequence
  Description of Artificial Sequence: Synthetic polypeptide
EEAEEICTTNPVAYECWGSVATGNGPLNDDRGQNGTD

SEQ ID NO: 185719 - protein, 34 aa, Artificial Sequence
  Description of Artificial Sequence: Synthetic polypeptide
EEAEIATTNPVATECYGCVYVWENGIQKQNGDTS

SEQ ID NO: 185720 - protein, 34 aa, Artificial Sequence
  Description of Artificial Sequence: Synthetic polypeptide
EEAEIATTNPVAYCAYGQTVPSCVLSQIGTNNQD

SEQ ID NO: 185721 - protein, 31 aa, Artificial Sequence
  Description of Artificial Sequence: Synthetic polypeptide
EEAEIATTNPVAYECWGCVYYEHLQEHEEDA

SEQ ID NO: 185722 - protein, 35 aa, Artificial Sequence
  Description of Artificial Sequence: Synthetic polypeptide
EEAEIATTNPVAYECWGSVSGGNADDSRNGGNGPA

SEQ ID NO: 185723 - protein, 34 aa, Artificial Sequence
  Description of Artificial Sequence: Synthetic polypeptide
EEAEIATTNPVAYEQWGHYTIQPNEGDQQGQGNR

SEQ ID NO: 185724 - protein, 37 aa, Artificial Sequence
  Description of Artificial Sequence: Synthetic polypeptide
EEAEIRTTNPVATEQYGSTSNVYPGAFTQEGVNEESI

SEQ ID NO: 185725 - protein, 35 aa, Artificial Sequence
  Description of Artificial Sequence: Synthetic polypeptide
EEAEIRTTNPVAYEQWGVYTIQPNEGDQQQEGQER

SEQ ID NO: 185726 - protein, 39 aa, Artificial Sequence
  Description of Artificial Sequence: Synthetic polypeptide
DEEEIRTTNPVATEQYGSVVGWGQEDQIEQDGEGEGNGD

SEQ ID NO: 185727 - protein, 33 aa, Artificial Sequence
  Description of Artificial Sequence: Synthetic polypeptide
EECEIATTNPCAYEQWGSVCYNIELRDQDNEDS

SEQ ID NO: 185728 - protein, 36 aa, Artificial Sequence
  Description of Artificial Sequence: Synthetic polypeptide
DENEIRTTNPVATEQWGCVTSWGEENTENFISDTQS

SEQ ID NO: 185729 - protein, 35 aa, Artificial Sequence
  Description of Artificial Sequence: Synthetic polypeptide
DENEIRTTNPVATEQWGCVTSWEENTEHFISDTAS

SEQ ID NO: 185730 - protein, 35 aa, Artificial Sequence
  Description of Artificial Sequence: Synthetic polypeptide
EECEIATTNPVAYERWGSVSGGNADDSRNNGNGND

SEQ ID NO: 185731 - protein, 36 aa, Artificial Sequence
  Description of Artificial Sequence: Synthetic polypeptide
EECEIRTTNPVAYEQWGVVYMIDDQNLQDQGDSDRK

SEQ ID NO: 185732 - protein, 36 aa, Artificial Sequence
  Description of Artificial Sequence: Synthetic polypeptide
EECNEIATTNPVAYEQYGTVATSNGGMQNGGQRGEA

SEQ ID NO: 185733 - protein, 38 aa, Artificial Sequence
  Description of Artificial Sequence: Synthetic polypeptide
DEECIRTTNPVATEQYGQCVCSNWGEHNAEYFGSDNQA

SEQ ID NO: 185734 - protein, 38 aa, Artificial Sequence
  Description of Artificial Sequence: Synthetic polypeptide
DEECIRTTNPVATEQYGQCVCSNWGEHNQEGFNSDTQS

SEQ ID NO: 185735 - protein, 37 aa, Artificial Sequence
  Description of Artificial Sequence: Synthetic polypeptide
DEECIRTTNPVATEQYGQCVCSNWGEHNQNFNSDTQL

SEQ ID NO: 185736 - protein, 35 aa, Artificial Sequence
  Description of Artificial Sequence: Synthetic polypeptide
EEEEIATTNPVAYEQWGSVYHPINDHAQKTKGKES

SEQ ID NO: 185737 - protein, 38 aa, Artificial Sequence
  Description of Artificial Sequence: Synthetic polypeptide
DEECIRTTNPVATEQYGQCVCSWGEDENAENFGSQNQS

SEQ ID NO: 185738 - protein, 36 aa, Artificial Sequence
  Description of Artificial Sequence: Synthetic polypeptide
DEECIRTTNPVATEQYGQCVCSWGEENAENFISDQS

SEQ ID NO: 185739 - protein, 35 aa, Artificial Sequence
  Description of Artificial Sequence: Synthetic polypeptide
EECEIATTNPVAYEAWGSVYTGPGNAGETGMQNER

SEQ ID NO: 185740 - protein, 39 aa, Artificial Sequence
  Description of Artificial Sequence: Synthetic polypeptide
DEEEIRTTNPVATEQYGSVVGWGQEDQEEQDGEQEGNGE

SEQ ID NO: 185741 - protein, 35 aa, Artificial Sequence
  Description of Artificial Sequence: Synthetic polypeptide
DEECIRTTNPVATEQWGCVCQWGEDHNQGFGSDQS

SEQ ID NO: 185742 - protein, 37 aa, Artificial Sequence
  Description of Artificial Sequence: Synthetic polypeptide
DEECIRTTNPVATEQWGCVCQNWNEDNQEGFNSETQS

SEQ ID NO: 185743 - protein, 35 aa, Artificial Sequence
  Description of Artificial Sequence: Synthetic polypeptide
DSWEIRTTNPVAYEQYGSTCSVIGPESEEGGNNLA

SEQ ID NO: 185744 - protein, 36 aa, Artificial Sequence
  Description of Artificial Sequence: Synthetic polypeptide
DENEIRTTNPVATEQWGKVPSAEAGESMNAAEGDYA

SEQ ID NO: 185745 - protein, 33 aa, Artificial Sequence
  Description of Artificial Sequence: Synthetic polypeptide
AENEIACTNPVATEGYGCYCSWNDNQNFGSDQS

SEQ ID NO: 185746 - protein, 33 aa, Artificial Sequence
  Description of Artificial Sequence: Synthetic polypeptide
AENEIACTNPVATEGYGCSCSWEHNQYFGSQQA

SEQ ID NO: 185747 - protein, 36 aa, Artificial Sequence
  Description of Artificial Sequence: Synthetic polypeptide
DTAEIRTTNPVATEQYGSVGPDFELGMDTTNKPQEE

SEQ ID NO: 185748 - protein, 35 aa, Artificial Sequence
  Description of Artificial Sequence: Synthetic polypeptide
DTDEIATTNPVATTQWGVVAWTENGDQDQREENSD

SEQ ID NO: 185749 - protein, 34 aa, Artificial Sequence
  Description of Artificial Sequence: Synthetic polypeptide
DTDEIRATNPVAYEQWGCSYQNIDNDRQNQRQDR

SEQ ID NO: 185750 - protein, 36 aa, Artificial Sequence
  Description of Artificial Sequence: Synthetic polypeptide
DENEIRTTNPVATEQWGEVDNEEGEEMNAGEGDNGE

SEQ ID NO: 185751 - protein, 37 aa, Artificial Sequence
  Description of Artificial Sequence: Synthetic polypeptide
DTEEICATNPVATEEYGSVSTVISTTNNNDEQGNVTL

SEQ ID NO: 185752 - protein, 37 aa, Artificial Sequence
  Description of Artificial Sequence: Synthetic polypeptide
DTEEICATNPVATEEYGSVSTVISTTNNTDEIGNSTL

SEQ ID NO: 185753 - protein, 34 aa, Artificial Sequence
  Description of Artificial Sequence: Synthetic polypeptide
DEECIATVNPVATEGYGCVCSWGEHNENFNSNQS

SEQ ID NO: 185754 - protein, 34 aa, Artificial Sequence
  Description of Artificial Sequence: Synthetic polypeptide
DENEIRTTNPVATEQWGDVVDQIMQMNAAEMEAN

SEQ ID NO: 185755 - protein, 36 aa, Artificial Sequence
  Description of Artificial Sequence: Synthetic polypeptide
DEECICTTNPVAYEQWGSVACTNNGLQDLQQDHEEH

SEQ ID NO: 185756 - protein, 37 aa, Artificial Sequence
  Description of Artificial Sequence: Synthetic polypeptide
DEECIGMTNPVAYEAYGSTVPSCTGELSQMTAEQNRT

SEQ ID NO: 185757 - protein, 37 aa, Artificial Sequence
  Description of Artificial Sequence: Synthetic polypeptide
DEECIGMTNPVAYERYGSTVPSCTEELSQMTAEQNRI

SEQ ID NO: 185758 - protein, 37 aa, Artificial Sequence
  Description of Artificial Sequence: Synthetic polypeptide
DEECIGMTNPVAYESYGSTVPSCTEELSQMTSEQNRD

SEQ ID NO: 185759 - protein, 37 aa, Artificial Sequence
  Description of Artificial Sequence: Synthetic polypeptide
DEECIGSTNPVAYENYGSTVPSCTDELSQPTAEQNRD

SEQ ID NO: 185760 - protein, 33 aa, Artificial Sequence
  Description of Artificial Sequence: Synthetic polypeptide
DEECINTVNPVATEWYGCSVLMDNNMYEIVATS

SEQ ID NO: 185761 - protein, 36 aa, Artificial Sequence
  Description of Artificial Sequence: Synthetic polypeptide
DEECIRCTNPVATEGYGCVCSNWEHNQEYFGSDNQS

SEQ ID NO: 185762 - protein, 36 aa, Artificial Sequence
  Description of Artificial Sequence: Synthetic polypeptide
DEECIRCTNPVATEGYGQCVCSWGEDNQNFGSDNQS

SEQ ID NO: 185763 - protein, 37 aa, Artificial Sequence
  Description of Artificial Sequence: Synthetic polypeptide
DEAEIRTTNPVATEQYGCVCSNWGEHNQENFISDNQA

SEQ ID NO: 185764 - protein, 37 aa, Artificial Sequence
  Description of Artificial Sequence: Synthetic polypeptide
DEAEIRTTNPVATEQYGCVCSNWEEHNEESFNSDNQA

SEQ ID NO: 185765 - protein, 37 aa, Artificial Sequence
  Description of Artificial Sequence: Synthetic polypeptide
DEAEIRTTNPVATEQYGCVCSNWEEHNEEGFNSENQA

SEQ ID NO: 185766 - protein, 36 aa, Artificial Sequence
  Description of Artificial Sequence: Synthetic polypeptide
DSWEIRTTNPVAYEQYGEEVCSVIGPESERGGNNLA

SEQ ID NO: 185767 - protein, 35 aa, Artificial Sequence
  Description of Artificial Sequence: Synthetic polypeptide
DSWEIRTTNPVAYEPYGSICSYIGPESHRGGNNLA

SEQ ID NO: 185768 - protein, 35 aa, Artificial Sequence
  Description of Artificial Sequence: Synthetic polypeptide
DSWEIRTTNPVAYEPYGSICSVIGPGSERGGNNLI

SEQ ID NO: 185769 - protein, 35 aa, Artificial Sequence
  Description of Artificial Sequence: Synthetic polypeptide
DSWEIRTTNPVAYEGYGSICSVIGPESERGGNNLW

SEQ ID NO: 185770 - protein, 35 aa, Artificial Sequence
  Description of Artificial Sequence: Synthetic polypeptide
DENEIRTTNPVATEQWGNCVSEASEEENIAEFDEA

SEQ ID NO: 185771 - protein, 35 aa, Artificial Sequence
  Description of Artificial Sequence: Synthetic polypeptide
DENEIRTTNPVATEQWGNCVSAEAVEEMNIAEDEA

SEQ ID NO: 185772 - protein, 35 aa, Artificial Sequence
  Description of Artificial Sequence: Synthetic polypeptide
DENEIRTTNPVATEQWGNCVMSKEVEMNIAEFDEA

SEQ ID NO: 185773 - protein, 36 aa, Artificial Sequence
  Description of Artificial Sequence: Synthetic polypeptide
DSNEIRTTNPVATEQYGSLSNSWVNENNMTDNSDQY

SEQ ID NO: 185774 - protein, 37 aa, Artificial Sequence
  Description of Artificial Sequence: Synthetic polypeptide
DSNEIRTTNPVATEQYGSVCSVTWPINIEDMFVEEWN

SEQ ID NO: 185775 - protein, 36 aa, Artificial Sequence
  Description of Artificial Sequence: Synthetic polypeptide
DSNEIRTTNPVATEQYGSVCSVTWPIWEDMFVEETQ

SEQ ID NO: 185776 - protein, 36 aa, Artificial Sequence
  Description of Artificial Sequence: Synthetic polypeptide
DSNEIRTTNPVATEQYGSVCSVTWPIYEDIFVEEAD

SEQ ID NO: 185777 - protein, 36 aa, Artificial Sequence
  Description of Artificial Sequence: Synthetic polypeptide
DSNEIRTTNPVATEQYGSVCSVTWPIYEDMDVEEGV

SEQ ID NO: 185778 - protein, 36 aa, Artificial Sequence
  Description of Artificial Sequence: Synthetic polypeptide
DSNEIRTTNPVATEQYGSVCSVTWPIYEDMFVEPQQ

SEQ ID NO: 185779 - protein, 37 aa, Artificial Sequence
  Description of Artificial Sequence: Synthetic polypeptide
DSNEIRTTNPVATEQYGSVCSVTWPIYEDRSFVHEGE

SEQ ID NO: 185780 - protein, 36 aa, Artificial Sequence
  Description of Artificial Sequence: Synthetic polypeptide
DEECIATTNPVAYEQWGSVACTNNGLQDDQQDHESK

SEQ ID NO: 185781 - protein, 38 aa, Artificial Sequence
  Description of Artificial Sequence: Synthetic polypeptide
DEAEIRTTNPVATEQYGCVCSNWEEDHNQENFGSDNQS

SEQ ID NO: 185782 - protein, 36 aa, Artificial Sequence
  Description of Artificial Sequence: Synthetic polypeptide
DENEIRTTNPVATEQWGKVPSEQPAHSMNAAEGDAP

SEQ ID NO: 185783 - protein, 33 aa, Artificial Sequence
  Description of Artificial Sequence: Synthetic polypeptide
DSSEVASTNPVSTEGYGNVACATISQSRTGGQR

SEQ ID NO: 185784 - protein, 32 aa, Artificial Sequence
  Description of Artificial Sequence: Synthetic polypeptide
DSSEVASTNPVSYEAYGNTVACNTIQSRVGQR

SEQ ID NO: 185785 - protein, 33 aa, Artificial Sequence
  Description of Artificial Sequence: Synthetic polypeptide
DSSEVASTNPVSYEAYGNVAANTHQSRTGGQNR

SEQ ID NO: 185786 - protein, 31 aa, Artificial Sequence
  Description of Artificial Sequence: Synthetic polypeptide
DSSEVASTNPVSYEAYGNVAANTIQSRVVQR

SEQ ID NO: 185787 - protein, 32 aa, Artificial Sequence
  Description of Artificial Sequence: Synthetic polypeptide
DSSEVASTNPVSYEGYGNVACNGTIQSRVGQR

SEQ ID NO: 185788 - protein, 32 aa, Artificial Sequence
  Description of Artificial Sequence: Synthetic polypeptide
DSSEVASTNPVSYEGYGNVACNTHSQSRVGQR

SEQ ID NO: 185789 - protein, 32 aa, Artificial Sequence
  Description of Artificial Sequence: Synthetic polypeptide
DSSEVASTNPVSYEGYGNVACNTIQSRTGTQR

SEQ ID NO: 185790 - protein, 32 aa, Artificial Sequence
  Description of Artificial Sequence: Synthetic polypeptide
DSSEVASTNPVSYEGYGNVAVNTIQSRVGGQR

SEQ ID NO: 185791 - protein, 32 aa, Artificial Sequence
  Description of Artificial Sequence: Synthetic polypeptide
DSSEVASTNPVSYEPYGNVACITISQSRVGQR

SEQ ID NO: 185792 - protein, 35 aa, Artificial Sequence
  Description of Artificial Sequence: Synthetic polypeptide
DSWEIRSTNPVAYEQYGSICSCIGPESERGGNNLA

SEQ ID NO: 185793 - protein, 35 aa, Artificial Sequence
  Description of Artificial Sequence: Synthetic polypeptide
DSWEIRTTNPVAYEEYGMVCSVIGPESERGGNNLA

SEQ ID NO: 185794 - protein, 32 aa, Artificial Sequence
  Description of Artificial Sequence: Synthetic polypeptide
DSSEVASTNPVSTEGYGNVAAQTIQSRVGGQR

SEQ ID NO: 185795 - protein, 35 aa, Artificial Sequence
  Description of Artificial Sequence: Synthetic polypeptide
DENEIRTTNPVATEQWGCVCSSPENAENFISDTAA

SEQ ID NO: 185796 - protein, 36 aa, Artificial Sequence
  Description of Artificial Sequence: Synthetic polypeptide
DEECIRCTNPVATEQYGCVCSWEEDDNQNFGSDTQS

SEQ ID NO: 185797 - protein, 36 aa, Artificial Sequence
  Description of Artificial Sequence: Synthetic polypeptide
DEECIRCTNPVATEQYGCVCSWEEDNQENFISDNQS

SEQ ID NO: 185798 - protein, 39 aa, Artificial Sequence
  Description of Artificial Sequence: Synthetic polypeptide
DTEEIRTTNPVATEAYGVVSTTVTNQQQNTEQGSVNQQD

SEQ ID NO: 185799 - protein, 36 aa, Artificial Sequence
  Description of Artificial Sequence: Synthetic polypeptide
DEECIRTTNPVATEIYGCVCGNWGEHNQENFNSQQA

SEQ ID NO: 185800 - protein, 36 aa, Artificial Sequence
  Description of Artificial Sequence: Synthetic polypeptide
DEECIRTTNPVATEIYGCVCGTEEHNQEYFGSDTQS

SEQ ID NO: 185801 - protein, 37 aa, Artificial Sequence
  Description of Artificial Sequence: Synthetic polypeptide
DTEEIRTTNPVATEQYGSGCWPESDILHQEYPQEDEQ

SEQ ID NO: 185802 - protein, 37 aa, Artificial Sequence
  Description of Artificial Sequence: Synthetic polypeptide
DTEEIRTTNPVATEQYGSGCWPETDILFSEYPQEDEQ

SEQ ID NO: 185803 - protein, 38 aa, Artificial Sequence
  Description of Artificial Sequence: Synthetic polypeptide
DTEEIRTTNPVATEQYGSGCWPETDILIQVEGPQEDEQ

SEQ ID NO: 185804 - protein, 37 aa, Artificial Sequence
  Description of Artificial Sequence: Synthetic polypeptide
DTEEIRTTNPVATEQYGSGCWPETDILITEHPQEDEQ

SEQ ID NO: 185805 - protein, 37 aa, Artificial Sequence
  Description of Artificial Sequence: Synthetic polypeptide
DTEEIRTTNPVATEQYGSVQVAIEEEQIENTEEANDM

SEQ ID NO: 185806 - protein, 36 aa, Artificial Sequence
  Description of Artificial Sequence: Synthetic polypeptide
DEAEIRTTNPVATEQYGCFVNGTAPDFDYPIGQEID

SEQ ID NO: 185807 - protein, 35 aa, Artificial Sequence
  Description of Artificial Sequence: Synthetic polypeptide
DEECIRTTNPVATEIYGCVCQWEHNQENFNSDTQA

SEQ ID NO: 185808 - protein, 39 aa, Artificial Sequence
  Description of Artificial Sequence: Synthetic polypeptide
DEAEIRTTNPVATEQYGASYVSCSGILLEELMNGNEEVF

SEQ ID NO: 185809 - protein, 35 aa, Artificial Sequence
  Description of Artificial Sequence: Synthetic polypeptide
DEAEIRTTNPVATEQYGAANTLVPDFDPNTEDEWG

SEQ ID NO: 185810 - protein, 36 aa, Artificial Sequence
  Description of Artificial Sequence: Synthetic polypeptide
DEAEIRTTNPVATEQYGAANSTLVPDFDPNPEDEMG

SEQ ID NO: 185811 - protein, 36 aa, Artificial Sequence
  Description of Artificial Sequence: Synthetic polypeptide
AEMEIRTTNPVATEQYGSISSVNASTEQAETDDEGK

SEQ ID NO: 185812 - protein, 36 aa, Artificial Sequence
  Description of Artificial Sequence: Synthetic polypeptide
DEAEIRTTNPVATEQYGAANSLVPDFDMPNTEDERA

SEQ ID NO: 185813 - protein, 35 aa, Artificial Sequence
  Description of Artificial Sequence: Synthetic polypeptide
DEAEIRTTNPVATEQYGAANSLHPDFDLNTEDEHG

SEQ ID NO: 185814 - protein, 35 aa, Artificial Sequence
  Description of Artificial Sequence: Synthetic polypeptide
DEAEIRTTNPVATEQYGAANSDDPDFDPNTEDEDG

SEQ ID NO: 185815 - protein, 39 aa, Artificial Sequence
  Description of Artificial Sequence: Synthetic polypeptide
DEEEIRTTNPVATEQYGSVVGFGQEDQEEEDGEGEGNGE

SEQ ID NO: 185816 - protein, 37 aa, Artificial Sequence
  Description of Artificial Sequence: Synthetic polypeptide
CEEEISTTNPVATEQYGCVCSNTGEDNIENFNSDTQA

SEQ ID NO: 185817 - protein, 38 aa, Artificial Sequence
  Description of Artificial Sequence: Synthetic polypeptide
DTEEIRTTNPVATEQYGVVSTTTQQAGTEAGTEEQGSD

SEQ ID NO: 185818 - protein, 38 aa, Artificial Sequence
  Description of Artificial Sequence: Synthetic polypeptide
DTEEIRTTNPVATEQYGVVSTTTTQAGGTEAGTEQGSE

SEQ ID NO: 185819 - protein, 38 aa, Artificial Sequence
  Description of Artificial Sequence: Synthetic polypeptide
DTEEIRTTNPVATEQYGVVSTTTTQLNGTEAGTEQGSD

SEQ ID NO: 185820 - protein, 39 aa, Artificial Sequence
  Description of Artificial Sequence: Synthetic polypeptide
DEEEIRTTNPVATEQYGSVVGSGQEDEEEVDGEGEGNGE

SEQ ID NO: 185821 - protein, 35 aa, Artificial Sequence
  Description of Artificial Sequence: Synthetic polypeptide
DEECIRTTNPVATEGYGCVCQWGEHNQENFNSDQA

SEQ ID NO: 185822 - protein, 35 aa, Artificial Sequence
  Description of Artificial Sequence: Synthetic polypeptide
DEECIRTTNPVATEGYGCVCFWEEHNTENFGSDQS

SEQ ID NO: 185823 - protein, 36 aa, Artificial Sequence
  Description of Artificial Sequence: Synthetic polypeptide
DEECIRTTNPVATEGYGCSCSWGEHNQEYFNSDTFA

SEQ ID NO: 185824 - protein, 38 aa, Artificial Sequence
  Description of Artificial Sequence: Synthetic polypeptide
DEAEIRTTNPVATEQYGCSSSCSGILCEELMNGNEEVF

SEQ ID NO: 185825 - protein, 36 aa, Artificial Sequence
  Description of Artificial Sequence: Synthetic polypeptide
DEAEIRTTNPVATEQYGCVCSNSGEHNQENFPSDQS

SEQ ID NO: 185826 - protein, 38 aa, Artificial Sequence
  Description of Artificial Sequence: Synthetic polypeptide
DEAEIRTTNPVATEQYGCVCSNSGEDHNQENFGSENQD

SEQ ID NO: 185827 - protein, 36 aa, Artificial Sequence
  Description of Artificial Sequence: Synthetic polypeptide
DEECIRCTNPVATEQYGQCVCSWEEDNAENFGSDQS

SEQ ID NO: 185828 - protein, 37 aa, Artificial Sequence
  Description of Artificial Sequence: Synthetic polypeptide
DEECIRCTNPVATEQYGQCVCSWGEDNQENFGSNNQS

SEQ ID NO: 185829 - protein, 38 aa, Artificial Sequence
  Description of Artificial Sequence: Synthetic polypeptide
DTEEIRATNPVATEQYGVVSTVVVTQQQQLQQGTTDDT

SEQ ID NO: 185830 - protein, 38 aa, Artificial Sequence
  Description of Artificial Sequence: Synthetic polypeptide
DTEEIRATNPVATEQYGVVSVTVVTQLQQLQQGSTDDE

SEQ ID NO: 185831 - protein, 37 aa, Artificial Sequence
  Description of Artificial Sequence: Synthetic polypeptide
DEAEIRTTNPVATEQYGCVCSMWGEHNEENFNSDTQS

SEQ ID NO: 185832 - protein, 34 aa, Artificial Sequence
  Description of Artificial Sequence: Synthetic polypeptide
DTEEIRATNPVAYEQWGCSYNEIDNLDLDNKGDH

SEQ ID NO: 185833 - protein, 36 aa, Artificial Sequence
  Description of Artificial Sequence: Synthetic polypeptide
DTEEIRATNPVAYEQWGCSYQINIDQDRANRGRQDR

SEQ ID NO: 185834 - protein, 35 aa, Artificial Sequence
  Description of Artificial Sequence: Synthetic polypeptide
DTEEIRATNPVAYEQWGCSYQLNIDNDRQNHRQDR

SEQ ID NO: 185835 - protein, 35 aa, Artificial Sequence
  Description of Artificial Sequence: Synthetic polypeptide
DTEEIRATNPVAYEQWGCSYQNIDQDRMNGRQDRG

SEQ ID NO: 185836 - protein, 31 aa, Artificial Sequence
  Description of Artificial Sequence: Synthetic polypeptide
AENEIACTNPIATECYGATTANENWAPKGGR

SEQ ID NO: 185837 - protein, 35 aa, Artificial Sequence
  Description of Artificial Sequence: Synthetic polypeptide
DTEEIRATNPVAYEQWGCSYWNNDDNDRQNGRQDR

SEQ ID NO: 185838 - protein, 37 aa, Artificial Sequence
  Description of Artificial Sequence: Synthetic polypeptide
DEAEIRTTNPVATEQYGCVCSDSGEHNAENFSSDNQS

SEQ ID NO: 185839 - protein, 36 aa, Artificial Sequence
  Description of Artificial Sequence: Synthetic polypeptide
DEAEIRTTNPVATEQYGCVCQTWADHNIENFMSDQS

SEQ ID NO: 185840 - protein, 33 aa, Artificial Sequence
  Description of Artificial Sequence: Synthetic polypeptide
AENCIACTNPVATEQYGCSCSWEHNQHFGSDQA

SEQ ID NO: 185841 - protein, 36 aa, Artificial Sequence
  Description of Artificial Sequence: Synthetic polypeptide
DEECIRTTNPCATECYGVVCYKTNDETQPQGGGDSQ

SEQ ID NO: 185842 - protein, 36 aa, Artificial Sequence
  Description of Artificial Sequence: Synthetic polypeptide
DEECIRTTNPCAYEEWGSVACTNNGLQDDQADNKDG

SEQ ID NO: 185843 - protein, 36 aa, Artificial Sequence
  Description of Artificial Sequence: Synthetic polypeptide
DEECIRTTNPCAYEEWGSVACTNNGLQDDQQDFERG

SEQ ID NO: 185844 - protein, 36 aa, Artificial Sequence
  Description of Artificial Sequence: Synthetic polypeptide
DEAEIRTTNPVATEQYGCVCQNWGAHIENFMSDTQA

SEQ ID NO: 185845 - protein, 36 aa, Artificial Sequence
  Description of Artificial Sequence: Synthetic polypeptide
DEAEIRTTNPVATEQYGCTCSTWGEHNAENFISDQS

SEQ ID NO: 185846 - protein, 37 aa, Artificial Sequence
  Description of Artificial Sequence: Synthetic polypeptide
DTEEIRTTNPCATEAYGVVATVTNGNLQQGTEEGTDM

SEQ ID NO: 185847 - protein, 37 aa, Artificial Sequence
  Description of Artificial Sequence: Synthetic polypeptide
DTEEIRTTNPCATEAYGVVSTVTNNNGQQGTEEGEDD

SEQ ID NO: 185848 - protein, 35 aa, Artificial Sequence
  Description of Artificial Sequence: Synthetic polypeptide
DEAEIRTTNPVATEQYGCTCSSGEHNQEYFISDQA

SEQ ID NO: 185849 - protein, 36 aa, Artificial Sequence
  Description of Artificial Sequence: Synthetic polypeptide
AENEEIATTNPVAYEQWGWVSTGGNQGEHQGHGDEP

SEQ ID NO: 185850 - protein, 37 aa, Artificial Sequence
  Description of Artificial Sequence: Synthetic polypeptide
DEECIRTTNPVATEQYSACVCSTWGEHNQENFGSDQA

SEQ ID NO: 185851 - protein, 36 aa, Artificial Sequence
  Description of Artificial Sequence: Synthetic polypeptide
DEECIRTTNPVATEQYSAQCVCSWGEDNQNFGSDQA

SEQ ID NO: 185852 - protein, 38 aa, Artificial Sequence
  Description of Artificial Sequence: Synthetic polypeptide
DEECIRTTNPVATEQYYACVCSNWGELNQENFGSDNQA

SEQ ID NO: 185853 - protein, 31 aa, Artificial Sequence
  Description of Artificial Sequence: Synthetic polypeptide
EEVEIATTNPVAYECWGCVYYNEDIMQHEDA

SEQ ID NO: 185854 - protein, 31 aa, Artificial Sequence
  Description of Artificial Sequence: Synthetic polypeptide
EEVEIATTNPVAYECWGCVYYSEDIHQHMDA

SEQ ID NO: 185855 - protein, 31 aa, Artificial Sequence
  Description of Artificial Sequence: Synthetic polypeptide
EEVEIATTNPVAYECWGEVYYVEDRHGHEEA

SEQ ID NO: 185856 - protein, 31 aa, Artificial Sequence
  Description of Artificial Sequence: Synthetic polypeptide
EEVEIATTNPVAYEHWGCVYYSEDIHQHEDM

SEQ ID NO: 185857 - protein, 30 aa, Artificial Sequence
  Description of Artificial Sequence: Synthetic polypeptide
EEVEIATTNPVAYERWGVAYECLQHHEHEQ

SEQ ID NO: 185858 - protein, 35 aa, Artificial Sequence
  Description of Artificial Sequence: Synthetic polypeptide
EEVEIRCTNPTAYEQWGSTVYGEDDLDQRGGDNKH

SEQ ID NO: 185859 - protein, 36 aa, Artificial Sequence
  Description of Artificial Sequence: Synthetic polypeptide
EEVEIRCTNPTAYEQWGSTVYGEGDLDQRGGDNKRD

SEQ ID NO: 185860 - protein, 36 aa, Artificial Sequence
  Description of Artificial Sequence: Synthetic polypeptide
EEVEIRCTNPTAYEQWGSTVYGENDLDQRGGDNKKA

SEQ ID NO: 185861 - protein, 36 aa, Artificial Sequence
  Description of Artificial Sequence: Synthetic polypeptide
EEVEIRCTNPTAYEQWGSTVYGENKDLDQRGGDNKD

SEQ ID NO: 185862 - protein, 36 aa, Artificial Sequence
  Description of Artificial Sequence: Synthetic polypeptide
EEVEIRCTNPTAYEQWGSTVYGENMDLDQRGGDTSR

SEQ ID NO: 185863 - protein, 36 aa, Artificial Sequence
  Description of Artificial Sequence: Synthetic polypeptide
EEVEIRCTNPTAYEQWGSTVYGPNMDLDQRGGDNKI

SEQ ID NO: 185864 - protein, 31 aa, Artificial Sequence
  Description of Artificial Sequence: Synthetic polypeptide
EGAEIATTNPVAYEQWGCCGTWDQGGTSDGN

SEQ ID NO: 185865 - protein, 31 aa, Artificial Sequence
  Description of Artificial Sequence: Synthetic polypeptide
EGAEIATTNPVAYEQWGCCGTWDQGHGSDEN

SEQ ID NO: 185866 - protein, 30 aa, Artificial Sequence
  Description of Artificial Sequence: Synthetic polypeptide
EGAEIATTNPVAYEQWGCCGTWDQGMMSDN

SEQ ID NO: 185867 - protein, 30 aa, Artificial Sequence
  Description of Artificial Sequence: Synthetic polypeptide
EGAEIATTNPVAYEQWGCCGTWDQQHTSDN

SEQ ID NO: 185868 - protein, 35 aa, Artificial Sequence
  Description of Artificial Sequence: Synthetic polypeptide
EGEEEIATTNPVAYEQWGSVTWTEGDQQKHGTTKN

SEQ ID NO: 185869 - protein, 35 aa, Artificial Sequence
  Description of Artificial Sequence: Synthetic polypeptide
EGEEIATTNPVATENYGCVVCMDNGDMQRGTQGEE

SEQ ID NO: 185870 - protein, 34 aa, Artificial Sequence
  Description of Artificial Sequence: Synthetic polypeptide
EGEEIATTNPVAYEQWGMVYWENEGDGKMRGKTR

SEQ ID NO: 185871 - protein, 30 aa, Artificial Sequence
  Description of Artificial Sequence: Synthetic polypeptide
EGQEIATTNPVAYEQWGCCGTWDQGHHSDN

SEQ ID NO: 185872 - protein, 35 aa, Artificial Sequence
  Description of Artificial Sequence: Synthetic polypeptide
EGTEIATTNPVATEVWGSVCYTNDGQQDDQGGNHQ

SEQ ID NO: 185873 - protein, 31 aa, Artificial Sequence
  Description of Artificial Sequence: Synthetic polypeptide
EGTEIATTNPVAYEQWGCCGTWDQGHQSGPI

SEQ ID NO: 185874 - protein, 35 aa, Artificial Sequence
  Description of Artificial Sequence: Synthetic polypeptide
ENAEIRTTNPVAYEQWGCVSGGGNAGNDRQGDNSG

SEQ ID NO: 185875 - protein, 32 aa, Artificial Sequence
  Description of Artificial Sequence: Synthetic polypeptide
ENDEIATTNPVAYERWGVVYTNNQGDHGPTDS

SEQ ID NO: 185876 - protein, 31 aa, Artificial Sequence
  Description of Artificial Sequence: Synthetic polypeptide
EEVEIATTNPVAYECWGCVYYNEDIHGHEEA

SEQ ID NO: 185877 - protein, 30 aa, Artificial Sequence
  Description of Artificial Sequence: Synthetic polypeptide
EEVEIATTNPVAYECWGCVYYGEHRQHETA

SEQ ID NO: 185878 - protein, 30 aa, Artificial Sequence
  Description of Artificial Sequence: Synthetic polypeptide
EEVEIATTNPVAYECWGCVYYEDIHQQEET

SEQ ID NO: 185879 - protein, 35 aa, Artificial Sequence
  Description of Artificial Sequence: Synthetic polypeptide
DEAEIRTTNPVATEGWGCVCSWGAENQEYFGSDQG

SEQ ID NO: 185880 - protein, 36 aa, Artificial Sequence
  Description of Artificial Sequence: Synthetic polypeptide
CEEEISTTNPVATEQYGCVCSWMEHNQENFNSDNAS

SEQ ID NO: 185881 - protein, 35 aa, Artificial Sequence
  Description of Artificial Sequence: Synthetic polypeptide
EENEIRTTNPVATDQYGSVNILQQEVHMQANSGDG

SEQ ID NO: 185882 - protein, 35 aa, Artificial Sequence
  Description of Artificial Sequence: Synthetic polypeptide
EENEIRTTNPVATDQYGSVNIMQQEVHAQANSDDG

SEQ ID NO: 185883 - protein, 34 aa, Artificial Sequence
  Description of Artificial Sequence: Synthetic polypeptide
EENEIRTTNPVATDQYGSVNIMQQEVHEQAVSDG

SEQ ID NO: 185884 - protein, 35 aa, Artificial Sequence
  Description of Artificial Sequence: Synthetic polypeptide
EENEIRTTNPVATDQYGSVNIMQQEVHVQANSNDN

SEQ ID NO: 185885 - protein, 35 aa, Artificial Sequence
  Description of Artificial Sequence: Synthetic polypeptide
EENEIRTTNPVATDQYGSVNIMQSQEVHPQANSDG

SEQ ID NO: 185886 - protein, 34 aa, Artificial Sequence
  Description of Artificial Sequence: Synthetic polypeptide
EENEIRTTNPVATDQYGSYCNIMQQEVHQQANSD

SEQ ID NO: 185887 - protein, 36 aa, Artificial Sequence
  Description of Artificial Sequence: Synthetic polypeptide
EENEIRTTNPVATEQYGAIGLSFTETEIVREMQLRG

SEQ ID NO: 185888 - protein, 36 aa, Artificial Sequence
  Description of Artificial Sequence: Synthetic polypeptide
EENNEIATTNPVAYEQYGTVATQNGGQQNGGQRGEN

SEQ ID NO: 185889 - protein, 37 aa, Artificial Sequence
  Description of Artificial Sequence: Synthetic polypeptide
EEPEIRTTNPVATEQYGSVCGPETYEEQEENGFPVGI

SEQ ID NO: 185890 - protein, 37 aa, Artificial Sequence
  Description of Artificial Sequence: Synthetic polypeptide
EEPEIRTTNPVATEQYGSVNGPVTYEDQEINGQPVSL

SEQ ID NO: 185891 - protein, 37 aa, Artificial Sequence
  Description of Artificial Sequence: Synthetic polypeptide
AEEEISTTNPVATEQYGQCVCSWGEHNQENFGSDNQA

SEQ ID NO: 185892 - protein, 38 aa, Artificial Sequence
  Description of Artificial Sequence: Synthetic polypeptide
EEPEIRTTNPVATEQYGSVNGPVTYELDQEINTQPVGL

SEQ ID NO: 185893 - protein, 34 aa, Artificial Sequence
  Description of Artificial Sequence: Synthetic polypeptide
EEQEIRTTNPVATECWGSFGPCINEPEAREFING

SEQ ID NO: 185894 - protein, 34 aa, Artificial Sequence
  Description of Artificial Sequence: Synthetic polypeptide
EESAEIATTNPVAYEGWGSVAHDDLQDQGGNNTS

SEQ ID NO: 185895 - protein, 34 aa, Artificial Sequence
  Description of Artificial Sequence: Synthetic polypeptide
EESAEIATTNPVAYEQWGVVAWTDNQETDQHGAH

SEQ ID NO: 185896 - protein, 36 aa, Artificial Sequence
  Description of Artificial Sequence: Synthetic polypeptide
EESEIATTNPVATERYGTVCSATGGEPSENFNGGND

SEQ ID NO: 185897 - protein, 36 aa, Artificial Sequence
  Description of Artificial Sequence: Synthetic polypeptide
DEECISCTNPVATEQYGCVCSWEEDNAENFGSDNQS

SEQ ID NO: 185898 - protein, 37 aa, Artificial Sequence
  Description of Artificial Sequence: Synthetic polypeptide
CEEEISTTNPVATEQYGQCVCSNWEHNQENFGSDNQA

SEQ ID NO: 185899 - protein, 35 aa, Artificial Sequence
  Description of Artificial Sequence: Synthetic polypeptide
EESEIRTTNPVAYEAWGISVSCANSSSDREGGMVG

SEQ ID NO: 185900 - protein, 37 aa, Artificial Sequence
  Description of Artificial Sequence: Synthetic polypeptide
CEEEISTTNPVATEQYGQCVCSNWEHNQENFGSNTQS

SEQ ID NO: 185901 - protein, 37 aa, Artificial Sequence
  Description of Artificial Sequence: Synthetic polypeptide
EETEIATTNPVATENYGCVSCTLNGLNDHEGGRGDAD

SEQ ID NO: 185902 - protein, 33 aa, Artificial Sequence
  Description of Artificial Sequence: Synthetic polypeptide
EETEIATTNPVAYEQWGNVSGGEMQQQTGQGDM

SEQ ID NO: 185903 - protein, 35 aa, Artificial Sequence
  Description of Artificial Sequence: Synthetic polypeptide
DEAEIRTTNPVATEGWGCVCSWGEDNQEYSGSDQA

SEQ ID NO: 185904 - protein, 38 aa, Artificial Sequence
  Description of Artificial Sequence: Synthetic polypeptide
EEPEIRTTNPVATEQYGSVNGPVTYELIQEINGQPVIL

SEQ ID NO: 185905 - protein, 36 aa, Artificial Sequence
  Description of Artificial Sequence: Synthetic polypeptide
CEEEISTTNPVATEQYGCVCSWGELNEENFNSDTQS

SEQ ID NO: 185906 - protein, 34 aa, Artificial Sequence
  Description of Artificial Sequence: Synthetic polypeptide
ENEEIATTNPVAYEQWGCYYIITNDQHEHGMDRH

SEQ ID NO: 185907 - protein, 33 aa, Artificial Sequence
  Description of Artificial Sequence: Synthetic polypeptide
ENEEIATTNPVAYEQWGVYATWDDQGDHGPNTP

SEQ ID NO: 185908 - protein, 36 aa, Artificial Sequence
  Description of Artificial Sequence: Synthetic polypeptide
DEECISTTNPVATEGYGCVCNTEEAHNQYFGSDNQA

SEQ ID NO: 185909 - protein, 37 aa, Artificial Sequence
  Description of Artificial Sequence: Synthetic polypeptide
FEEEIRATNPVATEQYGDVGVNVDPDPGQRGEGGQEG

SEQ ID NO: 185910 - protein, 36 aa, Artificial Sequence
  Description of Artificial Sequence: Synthetic polypeptide
DENEIRTTNPVATEGWGCVCSWMEENQENFGSDNQA

SEQ ID NO: 185911 - protein, 36 aa, Artificial Sequence
  Description of Artificial Sequence: Synthetic polypeptide
FEEEIRATNPVATEQYGSVMGNFNNNNGQQEQEEQE

SEQ ID NO: 185912 - protein, 37 aa, Artificial Sequence
  Description of Artificial Sequence: Synthetic polypeptide
FEEEIRATNPVATEQYGSVMGNFNQNNGDQGQEQEQE

SEQ ID NO: 185913 - protein, 36 aa, Artificial Sequence
  Description of Artificial Sequence: Synthetic polypeptide
DENEIRTTNPVATEFYGVVVGMGGNNQNVGEEGEMN

SEQ ID NO: 185914 - protein, 36 aa, Artificial Sequence
  Description of Artificial Sequence: Synthetic polypeptide
DENEIRTTNPVATEFYGTVVLDLINMDQSTGEGEFG

SEQ ID NO: 185915 - protein, 35 aa, Artificial Sequence
  Description of Artificial Sequence: Synthetic polypeptide
DEECISTTNPVATEGYGCVCNTTEAHNQYFGSDQA

SEQ ID NO: 185916 - protein, 36 aa, Artificial Sequence
  Description of Artificial Sequence: Synthetic polypeptide
FEEEIRGTNPVATEQYGSIARMDPVSYAETLEELFE

SEQ ID NO: 185917 - protein, 39 aa, Artificial Sequence
  Description of Artificial Sequence: Synthetic polypeptide
FEEEIRGTNPVATEQYGSVVSVDLMMEQGQGEGDGNDEG

SEQ ID NO: 185918 - protein, 38 aa, Artificial Sequence
  Description of Artificial Sequence: Synthetic polypeptide
FEEEIRSTNPAATEQYGTVIVTNTDLQGEGGQNVDGDT

SEQ ID NO: 185919 - protein, 37 aa, Artificial Sequence
  Description of Artificial Sequence: Synthetic polypeptide
FEEEIRSTNPVATEQYGAVVDGTMEFNGQGEGGQDEI

SEQ ID NO: 185920 - protein, 37 aa, Artificial Sequence
  Description of Artificial Sequence: Synthetic polypeptide
DENEIRTTNPVATEFYGSVMGNTVNIGQEDQEFEATQ

SEQ ID NO: 185921 - protein, 36 aa, Artificial Sequence
  Description of Artificial Sequence: Synthetic polypeptide
FEEEIRSTNPVATEQYGVVVSGFGQIGQGGEQEGQT

SEQ ID NO: 185922 - protein, 36 aa, Artificial Sequence
  Description of Artificial Sequence: Synthetic polypeptide
FEEEIRSTNPVATEQYGVVVSGGGQIGQGGEQQTGT

SEQ ID NO: 185923 - protein, 36 aa, Artificial Sequence
  Description of Artificial Sequence: Synthetic polypeptide
FEEEIRSTNPVATEQYGVVVSGQGQIGQGGEQEIQG

SEQ ID NO: 185924 - protein, 37 aa, Artificial Sequence
  Description of Artificial Sequence: Synthetic polypeptide
FEEEIRTTNCVATEGYGSVVMNFDDNNDQTGGETNED

SEQ ID NO: 185925 - protein, 37 aa, Artificial Sequence
  Description of Artificial Sequence: Synthetic polypeptide
FEEEIRTTNPVATDQYGVVNDNSIGQNQGQLDNNEMQ

SEQ ID NO: 185926 - protein, 36 aa, Artificial Sequence
  Description of Artificial Sequence: Synthetic polypeptide
DEECISTTNPVATEGYGCVCNWGEGLNQYFGSDNQS

SEQ ID NO: 185927 - protein, 37 aa, Artificial Sequence
  Description of Artificial Sequence: Synthetic polypeptide
FEEEIRTTNPVATEFYGSVDDEENDQGGDGEETTQGD

SEQ ID NO: 185928 - protein, 38 aa, Artificial Sequence
  Description of Artificial Sequence: Synthetic polypeptide
FEEEIRTTNPVATEFYGSVNMGLENLIGFGNGGQDTDV

SEQ ID NO: 185929 - protein, 36 aa, Artificial Sequence
  Description of Artificial Sequence: Synthetic polypeptide
CEEEISTTNPVATEQYGQCVCSWGEDNAENFNSEQT

SEQ ID NO: 185930 - protein, 35 aa, Artificial Sequence
  Description of Artificial Sequence: Synthetic polypeptide
CEEEISTTNPVATEQYGQCVCSWGEHAEYFGSDQS

SEQ ID NO: 185931 - protein, 38 aa, Artificial Sequence
  Description of Artificial Sequence: Synthetic polypeptide
FEDEIRTTNPVATEQYGSVVVAGVNDNQNGQGEFNEID

SEQ ID NO: 185932 - protein, 36 aa, Artificial Sequence
  Description of Artificial Sequence: Synthetic polypeptide
DENEIRTTNPVATEGYGCVCSWGEDHNQNFGSDTQA

SEQ ID NO: 185933 - protein, 37 aa, Artificial Sequence
  Description of Artificial Sequence: Synthetic polypeptide
FEDEIRTTNPVATEQYGSVMGEDNQEQGTGGGQDEQA

SEQ ID NO: 185934 - protein, 36 aa, Artificial Sequence
  Description of Artificial Sequence: Synthetic polypeptide
FEDEIRTTNPVATEFYGSVVPGEGGEGNGQDTGEGA

SEQ ID NO: 185935 - protein, 33 aa, Artificial Sequence
  Description of Artificial Sequence: Synthetic polypeptide
ENEEIATTNPVAYEQWGVYATWDQGDLGPGRPG

SEQ ID NO: 185936 - protein, 32 aa, Artificial Sequence
  Description of Artificial Sequence: Synthetic polypeptide
ENEEIATTNPVAYERWGVVYTMPQGDHGPTDS

SEQ ID NO: 185937 - protein, 33 aa, Artificial Sequence
  Description of Artificial Sequence: Synthetic polypeptide
ENEEIATTNPVAYERWGVVYTNVQGDHGPTDST

SEQ ID NO: 185938 - protein, 38 aa, Artificial Sequence
  Description of Artificial Sequence: Synthetic polypeptide
AEEEISTTNPVATEQYGQCVCSTWGEHNQEGFNSDTQA

SEQ ID NO: 185939 - protein, 30 aa, Artificial Sequence
  Description of Artificial Sequence: Synthetic polypeptide
ESAEIATTNPVAYEQWGCCVTWDQGHTSDI

SEQ ID NO: 185940 - protein, 31 aa, Artificial Sequence
  Description of Artificial Sequence: Synthetic polypeptide
ESCEIATTNPVAYECWGCVYYSEDNHQHEKA

SEQ ID NO: 185941 - protein, 36 aa, Artificial Sequence
  Description of Artificial Sequence: Synthetic polypeptide
ESEAEIRATNPVAYEQWGSVCSTDNGDQQDVGGDQN

SEQ ID NO: 185942 - protein, 37 aa, Artificial Sequence
  Description of Artificial Sequence: Synthetic polypeptide
ESEAEIRATNPVAYEQWGSVCSTTDNGDQQDVGGDNA

SEQ ID NO: 185943 - protein, 33 aa, Artificial Sequence
  Description of Artificial Sequence: Synthetic polypeptide
ETAEIATTNPVAYECWGVVSGGLNDDRQTQGNH

SEQ ID NO: 185944 - protein, 34 aa, Artificial Sequence
  Description of Artificial Sequence: Synthetic polypeptide
ETAEIATTNPVAYEQWGCVNFTENHDRNQGGNDM

SEQ ID NO: 185945 - protein, 35 aa, Artificial Sequence
  Description of Artificial Sequence: Synthetic polypeptide
ETAEIATTNPVAYEQWGSVCDNDNMNGQRGQGGGR

SEQ ID NO: 185946 - protein, 36 aa, Artificial Sequence
  Description of Artificial Sequence: Synthetic polypeptide
DENEIRTTNPVATEIYGCVCSWGEDHNQENFNSDQA

SEQ ID NO: 185947 - protein, 35 aa, Artificial Sequence
  Description of Artificial Sequence: Synthetic polypeptide
ETAEIRTTNPVAYEQWGSVCSTMDRDNQGGEGKHE

SEQ ID NO: 185948 - protein, 33 aa, Artificial Sequence
  Description of Artificial Sequence: Synthetic polypeptide
ETEEIATTNPCAYEEWGCVYYIVDEQDRGDGNR

SEQ ID NO: 185949 - protein, 36 aa, Artificial Sequence
  Description of Artificial Sequence: Synthetic polypeptide
CEEEISTTNPVATEQYGQCVCSSGEHEQEYFGSDQA

SEQ ID NO: 185950 - protein, 32 aa, Artificial Sequence
  Description of Artificial Sequence: Synthetic polypeptide
ETNEIATTNPCAYEEWGSVYYVDEQRQQGNGY

SEQ ID NO: 185951 - protein, 35 aa, Artificial Sequence
  Description of Artificial Sequence: Synthetic polypeptide
ETNEIRGTNPVATEQWGATVISTNLEQQEDVPEGP

SEQ ID NO: 185952 - protein, 34 aa, Artificial Sequence
  Description of Artificial Sequence: Synthetic polypeptide
ETTEIATTNPVAYEQWGMVSGPNSGNQGGMNGDD

SEQ ID NO: 185953 - protein, 34 aa, Artificial Sequence
  Description of Artificial Sequence: Synthetic polypeptide
ETTEIATTNPVAYEQWGSVAWTEIDQPDGGHNSI

SEQ ID NO: 185954 - protein, 34 aa, Artificial Sequence
  Description of Artificial Sequence: Synthetic polypeptide
ETTEIATTNPVAYEQYGTVHHTDQHQQDHGGTNG

SEQ ID NO: 185955 - protein, 34 aa, Artificial Sequence
  Description of Artificial Sequence: Synthetic polypeptide
ETTEIATTNPVAYEQYGTVHHTDQHQQDRGGDPG

SEQ ID NO: 185956 - protein, 35 aa, Artificial Sequence
  Description of Artificial Sequence: Synthetic polypeptide
ETVEIRTTNPVATEQWGATVCTNQLEMQEDVPEGP

SEQ ID NO: 185957 - protein, 37 aa, Artificial Sequence
  Description of Artificial Sequence: Synthetic polypeptide
FEDEIRTTNCVATEQYGSVVSGGMGELGEEENGQENG

SEQ ID NO: 185958 - protein, 38 aa, Artificial Sequence
  Description of Artificial Sequence: Synthetic polypeptide
FEDEIRTTNPVATEFYGQVVISDEFGTNDQIGNGGGNA

SEQ ID NO: 185959 - protein, 34 aa, Artificial Sequence
  Description of Artificial Sequence: Synthetic polypeptide
ETDEIATTNPVAYECWGSVSGGLNDDRQEQGNHI

SEQ ID NO: 185960 - protein, 35 aa, Artificial Sequence
  Description of Artificial Sequence: Synthetic polypeptide
DENEIRTTNPVATEQWGNCVSEAVEEMNIAEDQAP

SEQ ID NO: 185961 - protein, 35 aa, Artificial Sequence
  Description of Artificial Sequence: Synthetic polypeptide
CEEEISTTNPVATEQYGCVCSWGEHNANFNSDTQS

SEQ ID NO: 185962 - protein, 36 aa, Artificial Sequence
  Description of Artificial Sequence: Synthetic polypeptide
CEEEISTTNPVATEQYGCVCSWGEHNAEYFNSETQS

SEQ ID NO: 185963 - protein, 37 aa, Artificial Sequence
  Description of Artificial Sequence: Synthetic polypeptide
EEEEIRTTNPVATEQYGSVQCTTTTPELEVAMETVQL

SEQ ID NO: 185964 - protein, 35 aa, Artificial Sequence
  Description of Artificial Sequence: Synthetic polypeptide
DENEIRTTNPVATEQWGCVCSSEEHNANASISDAS

SEQ ID NO: 185965 - protein, 36 aa, Artificial Sequence
  Description of Artificial Sequence: Synthetic polypeptide
DEECIRTTNPVAYEHWGSVACTNNGLQDLQQDHEQH

SEQ ID NO: 185966 - protein, 36 aa, Artificial Sequence
  Description of Artificial Sequence: Synthetic polypeptide
DENEIRTTNPVATEQWGCVCSNSMPENINAFNSDAA

SEQ ID NO: 185967 - protein, 34 aa, Artificial Sequence
  Description of Artificial Sequence: Synthetic polypeptide
AEEVIATTNPVATQPYGHICCCNELSTRPGGNNV

SEQ ID NO: 185968 - protein, 37 aa, Artificial Sequence
  Description of Artificial Sequence: Synthetic polypeptide
EEEEIRTTNPVATEQYGSVSEMHSGEYESQQNSVEIV

SEQ ID NO: 185969 - protein, 35 aa, Artificial Sequence
  Description of Artificial Sequence: Synthetic polypeptide
DENEIRTTNPVATEQWGCVCSNSGPEANAFSSDAA

SEQ ID NO: 185970 - protein, 38 aa, Artificial Sequence
  Description of Artificial Sequence: Synthetic polypeptide
DEECIRTTNPVAYEPYYQGSNSNTRNDLLQPRSIEKHA

SEQ ID NO: 185971 - protein, 34 aa, Artificial Sequence
  Description of Artificial Sequence: Synthetic polypeptide
DEECIRTTNPVAYEQWGAYWSLDNDLAKKKVDTW

SEQ ID NO: 185972 - protein, 34 aa, Artificial Sequence
  Description of Artificial Sequence: Synthetic polypeptide
DEECIRTTNPVAYEQWGAYWSLDNDLRVAKVDMG

SEQ ID NO: 185973 - protein, 34 aa, Artificial Sequence
  Description of Artificial Sequence: Synthetic polypeptide
DEECIRTTNPVAYEQWGAYWSLDPDLAKRKVDPD

SEQ ID NO: 185974 - protein, 35 aa, Artificial Sequence
  Description of Artificial Sequence: Synthetic polypeptide
DENEIRTTNPVATEQWGCVCSNSAEAEAFNSDTAS

SEQ ID NO: 185975 - protein, 35 aa, Artificial Sequence
  Description of Artificial Sequence: Synthetic polypeptide
DENEIRTTNPVATEQWGCAVTSEVNEMNIAEDEAN

SEQ ID NO: 185976 - protein, 35 aa, Artificial Sequence
  Description of Artificial Sequence: Synthetic polypeptide
DENEIRTTNPVATEQWGAVDNEEGEEMNAGNGDGE

SEQ ID NO: 185977 - protein, 35 aa, Artificial Sequence
  Description of Artificial Sequence: Synthetic polypeptide
DENEIRTTNPVATEQWGAVDNEEGEEMNAGEGGDG

SEQ ID NO: 185978 - protein, 33 aa, Artificial Sequence
  Description of Artificial Sequence: Synthetic polypeptide
DENEIRTTNPVATEQWGATTAEEDWAEPKGPYI

SEQ ID NO: 185979 - protein, 35 aa, Artificial Sequence
  Description of Artificial Sequence: Synthetic polypeptide
DEECIRTTNPVAYEQWGHNNVYYWEEQHHRPTGHE

SEQ ID NO: 185980 - protein, 35 aa, Artificial Sequence
  Description of Artificial Sequence: Synthetic polypeptide
DEECIRTTNPVAYEQWGHNNVYYWEEQQHRPGEGE

SEQ ID NO: 185981 - protein, 35 aa, Artificial Sequence
  Description of Artificial Sequence: Synthetic polypeptide
DENEIRTTNPVATEQWGACVSEAVEEMNIAEFDEA

SEQ ID NO: 185982 - protein, 36 aa, Artificial Sequence
  Description of Artificial Sequence: Synthetic polypeptide
CEEEISTTNPVATEQYGCVCSNTGEHNANFISQTQS

SEQ ID NO: 185983 - protein, 35 aa, Artificial Sequence
  Description of Artificial Sequence: Synthetic polypeptide
DEAEIRTTNPVATEQWGCVCSSGPENANAFISDAA

SEQ ID NO: 185984 - protein, 38 aa, Artificial Sequence
  Description of Artificial Sequence: Synthetic polypeptide
AEENIRTTNPVATEQYGVVSTVVNNQQQIIGTTEQGEE

SEQ ID NO: 185985 - protein, 38 aa, Artificial Sequence
  Description of Artificial Sequence: Synthetic polypeptide
AEENIRTTNPVATEQYGVVSTVNQNQQQIIGTTEQGSE

SEQ ID NO: 185986 - protein, 37 aa, Artificial Sequence
  Description of Artificial Sequence: Synthetic polypeptide
EEEEIRTTNPVATEQYGSVQCTTPTPELESAMETVQS

SEQ ID NO: 185987 - protein, 37 aa, Artificial Sequence
  Description of Artificial Sequence: Synthetic polypeptide
AEGEEIATTNPVAYEQWGSVSTTGGNAGEHQHGETDE

SEQ ID NO: 185988 - protein, 35 aa, Artificial Sequence
  Description of Artificial Sequence: Synthetic polypeptide
DENEIRTTNPVATEQWGCVCSSEHNAEASSSDTAS

SEQ ID NO: 185989 - protein, 36 aa, Artificial Sequence
  Description of Artificial Sequence: Synthetic polypeptide
AEGEEIATTNPVAYEQWGWVSTGGNAGEEQHGGDGS

SEQ ID NO: 185990 - protein, 36 aa, Artificial Sequence
  Description of Artificial Sequence: Synthetic polypeptide
DEECIRTTNPVATEQYYACVCSWEDHNQENFGSDQA

SEQ ID NO: 185991 - protein, 36 aa, Artificial Sequence
  Description of Artificial Sequence: Synthetic polypeptide
DENEIRTTNPVATEQWGCVCSSMPDNANAFNSDTAA

SEQ ID NO: 185992 - protein, 35 aa, Artificial Sequence
  Description of Artificial Sequence: Synthetic polypeptide
DENEIRTTNPVATEQWGCVCSSMEENANNSISDAS

SEQ ID NO: 185993 - protein, 35 aa, Artificial Sequence
  Description of Artificial Sequence: Synthetic polypeptide
DENEIRTTNPVATEQWGCVCSSMEENAEYSSSDAS

SEQ ID NO: 185994 - protein, 38 aa, Artificial Sequence
  Description of Artificial Sequence: Synthetic polypeptide
EEEEIRTTNPVATEQYGSVAVLGIHDVTQEQPEQEGEP

SEQ ID NO: 185995 - protein, 33 aa, Artificial Sequence
  Description of Artificial Sequence: Synthetic polypeptide
AEGEIACTNPVAYEQWGYAFQIENDQRPGSGER

SEQ ID NO: 185996 - protein, 37 aa, Artificial Sequence
  Description of Artificial Sequence: Synthetic polypeptide
EEEEIRTTNPVATEQYGSVCQVLEEHEGTTQHPPMQE

SEQ ID NO: 185997 - protein, 35 aa, Artificial Sequence
  Description of Artificial Sequence: Synthetic polypeptide
DENEIRTTNPVATEQWGCVCSSGPENAEYFISDAA

SEQ ID NO: 185998 - protein, 37 aa, Artificial Sequence
  Description of Artificial Sequence: Synthetic polypeptide
EEEEIRTTNPVATEQYGSVCVFPTVEEMTEVLEEMDF

SEQ ID NO: 185999 - protein, 37 aa, Artificial Sequence
  Description of Artificial Sequence: Synthetic polypeptide
EEEEIRTTNPVATEQYGSVCVFTTVEAEEVLEEMDEQ

SEQ ID NO: 186000 - protein, 37 aa, Artificial Sequence
  Description of Artificial Sequence: Synthetic polypeptide
EEEEIRTTNPVATEQYGSVCVFTTVEEHEEVLENMDE

SEQ ID NO: 186001 - protein, 36 aa, Artificial Sequence
  Description of Artificial Sequence: Synthetic polypeptide
AEEEVSTTNPVATEQYGCVCSWGEHNIEYIGSDNQS

SEQ ID NO: 186002 - protein, 38 aa, Artificial Sequence
  Description of Artificial Sequence: Synthetic polypeptide
EEEEIRTTNPVATEQYGSVCVLGIADMTMIEPEQEGTP

SEQ ID NO: 186003 - protein, 35 aa, Artificial Sequence
  Description of Artificial Sequence: Synthetic polypeptide
DENEIRTTNPVATEQWGCVCSSGPDEANAFNSDAS

SEQ ID NO: 186004 - protein, 36 aa, Artificial Sequence
  Description of Artificial Sequence: Synthetic polypeptide
DENEIRTTNPVATEQWGCVCSSGPDEANAFISDNAA

SEQ ID NO: 186005 - protein, 35 aa, Artificial Sequence
  Description of Artificial Sequence: Synthetic polypeptide
DENEIRTTNPVATEQWGCVCSSGEENIEAISSDAA

SEQ ID NO: 186006 - protein, 35 aa, Artificial Sequence
  Description of Artificial Sequence: Synthetic polypeptide
DENEIRTTNPVATEQWGCVCSSGEENANYSISDQA

SEQ ID NO: 186007 - protein, 36 aa, Artificial Sequence
  Description of Artificial Sequence: Synthetic polypeptide
DENEIRTTNPVATEQWGCVCSSGEENAEASQSDTAS

SEQ ID NO: 186008 - protein, 36 aa, Artificial Sequence
  Description of Artificial Sequence: Synthetic polypeptide
DEECIRTTNPVAYEAYGSTVVSCQERGFDRGGQTEF

SEQ ID NO: 186009 - protein, 36 aa, Artificial Sequence
  Description of Artificial Sequence: Synthetic polypeptide
DENEIRTTNPVATEQWGCVCSSGEENAEASMSDNAA

SEQ ID NO: 186010 - protein, 35 aa, Artificial Sequence
  Description of Artificial Sequence: Synthetic polypeptide
DENEIRTTNPVATEQWGCVCSSGEDNAEYSISDAS

SEQ ID NO: 186011 - protein, 38 aa, Artificial Sequence
  Description of Artificial Sequence: Synthetic polypeptide
EEEEIRTTNPVATEQYGSVISIDTVSINDVSPVAMITH

SEQ ID NO: 186012 - protein, 37 aa, Artificial Sequence
  Description of Artificial Sequence: Synthetic polypeptide
EEEEIRTTNPVATEQYGSVISNSWPAEIEHDFMNSGE

SEQ ID NO: 186013 - protein, 36 aa, Artificial Sequence
  Description of Artificial Sequence: Synthetic polypeptide
AEGEEIATTNPVAYEQWGWVSTGGNAGNEQHEGDDH

SEQ ID NO: 186014 - protein, 36 aa, Artificial Sequence
  Description of Artificial Sequence: Synthetic polypeptide
DENEIRTTNPVATEQWGCVCSSGPDNANNFISDNAA

SEQ ID NO: 186015 - protein, 35 aa, Artificial Sequence
  Description of Artificial Sequence: Synthetic polypeptide
CEEEISTTNPVATEQYGCVCSWGEHNAHFNSETQT

SEQ ID NO: 186016 - protein, 36 aa, Artificial Sequence
  Description of Artificial Sequence: Synthetic polypeptide
AEEEVSTTNPVATEQYGCVCSNSGEHDQYIGSDNQS

SEQ ID NO: 186017 - protein, 36 aa, Artificial Sequence
  Description of Artificial Sequence: Synthetic polypeptide
AEEEVIATTNPVAYEQWGSVASGALPEATADGNQNN

SEQ ID NO: 186018 - protein, 39 aa, Artificial Sequence
  Description of Artificial Sequence: Synthetic polypeptide
EEEEIRTTNPVATEQYGVVSVTVNNQNQQQGTEQGSTTS

SEQ ID NO: 186019 - protein, 40 aa, Artificial Sequence
  Description of Artificial Sequence: Synthetic polypeptide
EEEEIRTTNPVATEQYGVVSVVVVTNLQAGTEQGTTTDQE

SEQ ID NO: 186020 - protein, 36 aa, Artificial Sequence
  Description of Artificial Sequence: Synthetic polypeptide
CEEEISTTNPVATEQYGCVCSNWGEDDQNFGSDTQS

SEQ ID NO: 186021 - protein, 37 aa, Artificial Sequence
  Description of Artificial Sequence: Synthetic polypeptide
EEEEIRTTNPVATESYGSVSLHVLEEIHAPVGQFQYV

SEQ ID NO: 186022 - protein, 37 aa, Artificial Sequence
  Description of Artificial Sequence: Synthetic polypeptide
EEEEIRTTNPVATESYGSVSLHVLEEIHAPVQQFQMA

SEQ ID NO: 186023 - protein, 38 aa, Artificial Sequence
  Description of Artificial Sequence: Synthetic polypeptide
DENEIRTTNPVATEIYGSVVDSVDNNDEGQTGGQTGQT

SEQ ID NO: 186024 - protein, 37 aa, Artificial Sequence
  Description of Artificial Sequence: Synthetic polypeptide
EEEEIRTTNPVATESYGSVTLNVLEEIHAPVGQFQMP

SEQ ID NO: 186025 - protein, 36 aa, Artificial Sequence
  Description of Artificial Sequence: Synthetic polypeptide
CEEEISTTNPVATEQYGCVCSNWGEDNQNFNSDTQS

SEQ ID NO: 186026 - protein, 36 aa, Artificial Sequence
  Description of Artificial Sequence: Synthetic polypeptide
DEAEIRTTNPVATEGYGCSCSWGEHNQEYFNSDTQA

SEQ ID NO: 186027 - protein, 37 aa, Artificial Sequence
  Description of Artificial Sequence: Synthetic polypeptide
EEEEIRTTNPVAVEQYGSVVLGIADMTMEEPEQEGTP

SEQ ID NO: 186028 - protein, 37 aa, Artificial Sequence
  Description of Artificial Sequence: Synthetic polypeptide
CEEEISTTNPVATEQYGCVCSNWGEHNQENFGSDNQS

SEQ ID NO: 186029 - protein, 36 aa, Artificial Sequence
  Description of Artificial Sequence: Synthetic polypeptide
CEEEISTTNPVATEQYGCVCSNWGEHNQYFNSQNQS

SEQ ID NO: 186030 - protein, 36 aa, Artificial Sequence
  Description of Artificial Sequence: Synthetic polypeptide
EEEEIVTTNPVATEQYGSVPADGMGGEGNVGGEDGM

SEQ ID NO: 186031 - protein, 36 aa, Artificial Sequence
  Description of Artificial Sequence: Synthetic polypeptide
DEECIRTTNPVAYEQYGQCVCSWGEDHNQYFGSDQS

SEQ ID NO: 186032 - protein, 36 aa, Artificial Sequence
  Description of Artificial Sequence: Synthetic polypeptide
CEEEISTTNPVATEQYGCVCSNWMEHNQEYFNSEQS

SEQ ID NO: 186033 - protein, 37 aa, Artificial Sequence
  Description of Artificial Sequence: Synthetic polypeptide
CEEEISTTNPVATEQYGCVCSNWNEHNQEYFNSDNQA

SEQ ID NO: 186034 - protein, 35 aa, Artificial Sequence
  Description of Artificial Sequence: Synthetic polypeptide
DEECIRTTNPVAYEQYYACVCSWGEHNANFGSDQS

SEQ ID NO: 186035 - protein, 37 aa, Artificial Sequence
  Description of Artificial Sequence: Synthetic polypeptide
DEECIRTTNPVTTEHWGSVYCWMPNDQDDQRQGGNSA

SEQ ID NO: 186036 - protein, 35 aa, Artificial Sequence
  Description of Artificial Sequence: Synthetic polypeptide
EEGEIACTNPTAYEQWGSTVYGENDLDQSGGDNKR

SEQ ID NO: 186037 - protein, 30 aa, Artificial Sequence
  Description of Artificial Sequence: Synthetic polypeptide
EEGEIASTNPCSYEQWGITYCNDQSQGDTR

SEQ ID NO: 186038 - protein, 36 aa, Artificial Sequence
  Description of Artificial Sequence: Synthetic polypeptide
CEEEISTTNPVATEQYGCVCSWEEHDQENFGSDTQF

SEQ ID NO: 186039 - protein, 35 aa, Artificial Sequence
  Description of Artificial Sequence: Synthetic polypeptide
CEEEISTTNPVATEQYGCVCSWGEHDIEHFNSDQT

SEQ ID NO: 186040 - protein, 36 aa, Artificial Sequence
  Description of Artificial Sequence: Synthetic polypeptide
CEEEISTTNPVATEQYGCVCSWGEHNAESFNSETQS

SEQ ID NO: 186041 - protein, 39 aa, Artificial Sequence
  Description of Artificial Sequence: Synthetic polypeptide
EEEEIRTTNPVATEQYGVVSTVVVTTQGQQQGTTNVATE

SEQ ID NO: 186042 - protein, 39 aa, Artificial Sequence
  Description of Artificial Sequence: Synthetic polypeptide
EEEEIRTTNPVATEQYGVVSTVVVTQQGQEQATTNVATE

SEQ ID NO: 186043 - protein, 40 aa, Artificial Sequence
  Description of Artificial Sequence: Synthetic polypeptide
EEEEIRTTNPVATEQYGVVSTVVTNGNQQAGTEEGTTNQD

SEQ ID NO: 186044 - protein, 39 aa, Artificial Sequence
  Description of Artificial Sequence: Synthetic polypeptide
EEEEIRTTNPVATEQYGVVSTVVNNNNQQGTQEETDEDQ

SEQ ID NO: 186045 - protein, 35 aa, Artificial Sequence
  Description of Artificial Sequence: Synthetic polypeptide
AEEEVIATTNPVAYEQWGSVASGALPEATADGMHN

SEQ ID NO: 186046 - protein, 36 aa, Artificial Sequence
  Description of Artificial Sequence: Synthetic polypeptide
AEEELRTTNPVATEQYGCVCSWGEHDQEYIGSDTQS

SEQ ID NO: 186047 - protein, 34 aa, Artificial Sequence
  Description of Artificial Sequence: Synthetic polypeptide
DEECIRTTNPVAYEQWGTYVYNQDSDRDRGEDDA

SEQ ID NO: 186048 - protein, 36 aa, Artificial Sequence
  Description of Artificial Sequence: Synthetic polypeptide
DEECIRTTNPVAYEQWGVVCFTIERDGERQQTGGNQ

SEQ ID NO: 186049 - protein, 36 aa, Artificial Sequence
  Description of Artificial Sequence: Synthetic polypeptide
CEEEISTTNPVATEQYGCVCSNWEEHNAENFGSDQA

SEQ ID NO: 186050 - protein, 38 aa, Artificial Sequence
  Description of Artificial Sequence: Synthetic polypeptide
EEEEIRTTNPVATEQYGSVTVLGILDMTMEEPEQEGTP

SEQ ID NO: 186051 - protein, 36 aa, Artificial Sequence
  Description of Artificial Sequence: Synthetic polypeptide
CEEEISTTNPVATEQYGCVCSNWEHNQENFNSDFQA

SEQ ID NO: 186052 - protein, 37 aa, Artificial Sequence
  Description of Artificial Sequence: Synthetic polypeptide
DEECIRTTNPVAYEQYGCVCSNWGEENIENFGSDNQS

SEQ ID NO: 186053 - protein, 36 aa, Artificial Sequence
  Description of Artificial Sequence: Synthetic polypeptide
DEECIRTTNPVAYEQYGCVCSNWGEHNQEYFNSQQA

SEQ ID NO: 186054 - protein, 36 aa, Artificial Sequence
  Description of Artificial Sequence: Synthetic polypeptide
CEEEISTTNPVATEQYGCVCSNWGEDAENFGSDNQA

SEQ ID NO: 186055 - protein, 37 aa, Artificial Sequence
  Description of Artificial Sequence: Synthetic polypeptide
EEEEIRTTNPVATEQYGSVVLGIADMTMEEPEQVFTP

SEQ ID NO: 186056 - protein, 36 aa, Artificial Sequence
  Description of Artificial Sequence: Synthetic polypeptide
AEEEVIATTNPVAYEQWGSVSAGAGPEATADGNTRN

SEQ ID NO: 186057 - protein, 37 aa, Artificial Sequence
  Description of Artificial Sequence: Synthetic polypeptide
EEEEIRTTNPVATEQYGSVVLGIADMTMQEPEQEETP

SEQ ID NO: 186058 - protein, 36 aa, Artificial Sequence
  Description of Artificial Sequence: Synthetic polypeptide
DEECIRTTNPVAYEQYGCVCSWGEDNQEFFNSETQS

SEQ ID NO: 186059 - protein, 37 aa, Artificial Sequence
  Description of Artificial Sequence: Synthetic polypeptide
EEEEIRTTNPVATEQYGSVYMEAPILEIQVNSQMQPD

SEQ ID NO: 186060 - protein, 38 aa, Artificial Sequence
  Description of Artificial Sequence: Synthetic polypeptide
EEEEIRTTNPVATEQYGSYYSMPTFPGQEVQVHVNEPM

SEQ ID NO: 186061 - protein, 38 aa, Artificial Sequence
  Description of Artificial Sequence: Synthetic polypeptide
EEEEIRTTNPVATEQYGTVGISTDALTEEVVSTADNLG

SEQ ID NO: 186062 - protein, 38 aa, Artificial Sequence
  Description of Artificial Sequence: Synthetic polypeptide
EEEEIRTTNPVATEQYGTVGISTDALTEHVISTALDNL

SEQ ID NO: 186063 - protein, 37 aa, Artificial Sequence
  Description of Artificial Sequence: Synthetic polypeptide
EEEEIRTTNPVATEQYGVVATTQQQQQQATNNAEQGQ

SEQ ID NO: 186064 - protein, 36 aa, Artificial Sequence
  Description of Artificial Sequence: Synthetic polypeptide
DEAEIRTTNPVATEIYGCVCSWGEHNQENFNSDTQS

SEQ ID NO: 186065 - protein, 33 aa, Artificial Sequence
  Description of Artificial Sequence: Synthetic polypeptide
DENEIRTTNPVATEPWGATTAMEDWQAQQKGPI

SEQ ID NO: 186066 - protein, 33 aa, Artificial Sequence
  Description of Artificial Sequence: Synthetic polypeptide
DENEIRTTNPVATEPWGATTAMEDWQAQPKGPI

SEQ ID NO: 186067 - protein, 37 aa, Artificial Sequence
  Description of Artificial Sequence: Synthetic polypeptide
DENEIRTTNPVATEMYGSVTDNFGQNNGQEDGQGQET

SEQ ID NO: 186068 - protein, 39 aa, Artificial Sequence
  Description of Artificial Sequence: Synthetic polypeptide
EEEEIRTTNPVATEQYGVVSTVTNNQNNQQGTEQGSTDD

SEQ ID NO: 186069 - protein, 37 aa, Artificial Sequence
  Description of Artificial Sequence: Synthetic polypeptide
EEEEIRTTNPVATEQYGSVVQPWMPQTEQQENDTPFE

SEQ ID NO: 186070 - protein, 33 aa, Artificial Sequence
  Description of Artificial Sequence: Synthetic polypeptide
DEECIATTNPVAYEPWGQCTTDGGDHQRASNMS

SEQ ID NO: 186071 - protein, 34 aa, Artificial Sequence
  Description of Artificial Sequence: Synthetic polypeptide
DEECIATTNPVAYEGWGSVATTQNNGGDTQGDSD

SEQ ID NO: 186072 - protein, 34 aa, Artificial Sequence
  Description of Artificial Sequence: Synthetic polypeptide
DEECIATTNPVAYEGWGSVATTPNGGNDTQGDDD

SEQ ID NO: 186073 - protein, 36 aa, Artificial Sequence
  Description of Artificial Sequence: Synthetic polypeptide
DENEIRTTNPVATEQYGSVPYQEDEEDQTPSIEETP

SEQ ID NO: 186074 - protein, 36 aa, Artificial Sequence
  Description of Artificial Sequence: Synthetic polypeptide
DENEIRTTNPVATEQYGSVPYQEDEEDFTPSIEDRP

SEQ ID NO: 186075 - protein, 38 aa, Artificial Sequence
  Description of Artificial Sequence: Synthetic polypeptide
DENEIRTTNPVATEQYGSVPSDWLASGEGYEGGFESFT

SEQ ID NO: 186076 - protein, 35 aa, Artificial Sequence
  Description of Artificial Sequence: Synthetic polypeptide
DEAEIRTTNPVATEQYGSCNWPEIPLDADEKDIEE

SEQ ID NO: 186077 - protein, 38 aa, Artificial Sequence
  Description of Artificial Sequence: Synthetic polypeptide
DMAEIRATNPVATEQYGSVCYSDWNNLQDERQSDTQQE

SEQ ID NO: 186078 - protein, 37 aa, Artificial Sequence
  Description of Artificial Sequence: Synthetic polypeptide
DEAEIRTTNPVATEQYGSANWPANPDDLGGSGQEEIG

SEQ ID NO: 186079 - protein, 37 aa, Artificial Sequence
  Description of Artificial Sequence: Synthetic polypeptide
DEAEIRTTNPVATEQYGSANWEVTPDDLGGSGQEEIG

SEQ ID NO: 186080 - protein, 37 aa, Artificial Sequence
  Description of Artificial Sequence: Synthetic polypeptide
DEAEIRTTNPVATEQYGSANWEANPDELNGSGQEEIG

SEQ ID NO: 186081 - protein, 37 aa, Artificial Sequence
  Description of Artificial Sequence: Synthetic polypeptide
DEAEIRTTNPVATEQYGSANWEANPDDLGGSGQETIL

SEQ ID NO: 186082 - protein, 37 aa, Artificial Sequence
  Description of Artificial Sequence: Synthetic polypeptide
DEAEIRTTNPVATEQYGSANWEANPDDLEGSGQEEIE

SEQ ID NO: 186083 - protein, 37 aa, Artificial Sequence
  Description of Artificial Sequence: Synthetic polypeptide
DEAEIRTTNPVATEQYGSAIPWTPPLEENQHQSEDKQ

SEQ ID NO: 186084 - protein, 38 aa, Artificial Sequence
  Description of Artificial Sequence: Synthetic polypeptide
DEAEIRTTNPVATEQYGQYWSCSGIMLEELMNGNEEVF

SEQ ID NO: 186085 - protein, 38 aa, Artificial Sequence
  Description of Artificial Sequence: Synthetic polypeptide
DENEIRTTNPVATEQYGSVISESPIELAMASFDENQFE

SEQ ID NO: 186086 - protein, 37 aa, Artificial Sequence
  Description of Artificial Sequence: Synthetic polypeptide
DENEIRTTNPVATEQYGSVGYVASEEQHENTEEDTDM

SEQ ID NO: 186087 - protein, 37 aa, Artificial Sequence
  Description of Artificial Sequence: Synthetic polypeptide
DENEIRTTNPVATEQYGSVGYVAIEEQQENTETDTQM

SEQ ID NO: 186088 - protein, 37 aa, Artificial Sequence
  Description of Artificial Sequence: Synthetic polypeptide
DENEIRTTNPVATEQYGSVGYVAIEEQIENTEEDPDM

SEQ ID NO: 186089 - protein, 37 aa, Artificial Sequence
  Description of Artificial Sequence: Synthetic polypeptide
DENEIRTTNPVATEQYGSVGYARIEEQQENTEEDPDM

SEQ ID NO: 186090 - protein, 38 aa, Artificial Sequence
  Description of Artificial Sequence: Synthetic polypeptide
DENEIRTTNPVATEQYGSVFYTTWNPMIRTESSEEHTQ

SEQ ID NO: 186091 - protein, 37 aa, Artificial Sequence
  Description of Artificial Sequence: Synthetic polypeptide
DEAEIRTTNPVATEQYGQSCMWNNGTLWDEDSQEDDM

SEQ ID NO: 186092 - protein, 37 aa, Artificial Sequence
  Description of Artificial Sequence: Synthetic polypeptide
DMEEIRTTNPVATEQYGSVWSYSMGPEAHQSTQLEEG

SEQ ID NO: 186093 - protein, 39 aa, Artificial Sequence
  Description of Artificial Sequence: Synthetic polypeptide
DMEMYEIIVTMTNIPYAAMEQPLSVLSFTNWLDQRGNRI

SEQ ID NO: 186094 - protein, 36 aa, Artificial Sequence
  Description of Artificial Sequence: Synthetic polypeptide
DMGEIRTTNPVATEQYGSCSVTAVEHKDEENFEEHD

SEQ ID NO: 186095 - protein, 36 aa, Artificial Sequence
  Description of Artificial Sequence: Synthetic polypeptide
DMGEIRTTNPVATEQYGSCSVTAVEQADEELFEEHV

SEQ ID NO: 186096 - protein, 36 aa, Artificial Sequence
  Description of Artificial Sequence: Synthetic polypeptide
DENEIRTTNPVATEQYGSVPYQPDEEDFTPSIETRF

SEQ ID NO: 186097 - protein, 31 aa, Artificial Sequence
  Description of Artificial Sequence: Synthetic polypeptide
DISEVASTNPVSYEGYGNVAANTIQSRVGQA

SEQ ID NO: 186098 - protein, 37 aa, Artificial Sequence
  Description of Artificial Sequence: Synthetic polypeptide
DENEIRTTNPVATEQYGSVPYQPDEENQTYTSIEERP

SEQ ID NO: 186099 - protein, 36 aa, Artificial Sequence
  Description of Artificial Sequence: Synthetic polypeptide
DENEIRTTNPVATEQYGSVPYQTDEEDSPPSIEEVY

SEQ ID NO: 186100 - protein, 37 aa, Artificial Sequence
  Description of Artificial Sequence: Synthetic polypeptide
DEAEIRTTNPVATEQYGSIPWTPFLEENQDHQSEPFP

SEQ ID NO: 186101 - protein, 36 aa, Artificial Sequence
  Description of Artificial Sequence: Synthetic polypeptide
DEDEIRTTNPVAYEQWGSVCYTMQNDDMDKGGGGIM

SEQ ID NO: 186102 - protein, 36 aa, Artificial Sequence
  Description of Artificial Sequence: Synthetic polypeptide
DEAEIRTTNPVATEQYGSIPWPPPLEENQDHQSEPQ

SEQ ID NO: 186103 - protein, 37 aa, Artificial Sequence
  Description of Artificial Sequence: Synthetic polypeptide
DEAEIRTTNPVATEQYGSIPRTPPLVENQDHQSEETP

SEQ ID NO: 186104 - protein, 37 aa, Artificial Sequence
  Description of Artificial Sequence: Synthetic polypeptide
DEAEIRTTNPVATEQYGSIPRTPPLEENQDHQMEEPP

SEQ ID NO: 186105 - protein, 37 aa, Artificial Sequence
  Description of Artificial Sequence: Synthetic polypeptide
DEAEIRTTNPVATEQYGSIPRTPFLEENQPHQSEEMP

SEQ ID NO: 186106 - protein, 37 aa, Artificial Sequence
  Description of Artificial Sequence: Synthetic polypeptide
DEDEIRTTNPVAYEQWGSVSGDEPANGPNMRNGGGKQ

SEQ ID NO: 186107 - protein, 38 aa, Artificial Sequence
  Description of Artificial Sequence: Synthetic polypeptide
DEYEIRTTNPVATEQYGSVYIPYAVWLETEGNHMNQQE

SEQ ID NO: 186108 - protein, 38 aa, Artificial Sequence
  Description of Artificial Sequence: Synthetic polypeptide
DEAEIRTTNPVATEQYGSHVMHPDEHDEQPEGVENDTG

SEQ ID NO: 186109 - protein, 37 aa, Artificial Sequence
  Description of Artificial Sequence: Synthetic polypeptide
DENEIRTTNPVATEQYGSVSPYQTDEEDTTPSIEEVP

SEQ ID NO: 186110 - protein, 37 aa, Artificial Sequence
  Description of Artificial Sequence: Synthetic polypeptide
DEAEIRTTNPVATEQYGSHISWSIDTLDETGGEMEDN

SEQ ID NO: 186111 - protein, 38 aa, Artificial Sequence
  Description of Artificial Sequence: Synthetic polypeptide
DMGEIRTTNPVATEQYGSVCSEEVPVSNEQQMEVNLND

SEQ ID NO: 186112 - protein, 37 aa, Artificial Sequence
  Description of Artificial Sequence: Synthetic polypeptide
DEAEIRTTNPVATEQYGSHGPWSVFTLDETGGEMEDN

SEQ ID NO: 186113 - protein, 37 aa, Artificial Sequence
  Description of Artificial Sequence: Synthetic polypeptide
DEYEISTTNPVATEFYGSVSATGDQGQEDDEGGETGD

SEQ ID NO: 186114 - protein, 37 aa, Artificial Sequence
  Description of Artificial Sequence: Synthetic polypeptide
DEYEISTTNPVATEFYGSVSTTGDQGQEDQETGEDGD

SEQ ID NO: 186115 - protein, 37 aa, Artificial Sequence
  Description of Artificial Sequence: Synthetic polypeptide
DEYEITTTNPVATEFYGSVSATGDQGDEDLEGGGDGD

SEQ ID NO: 186116 - protein, 35 aa, Artificial Sequence
  Description of Artificial Sequence: Synthetic polypeptide
DEYFIAAVNSEATEEYGSKVSTWNNVNPQRGNTMC

SEQ ID NO: 186117 - protein, 37 aa, Artificial Sequence
  Description of Artificial Sequence: Synthetic polypeptide
DEDEIRTTNPVAYEQWGSVSGGEPANGPNMRNGGGTV

SEQ ID NO: 186118 - protein, 37 aa, Artificial Sequence
  Description of Artificial Sequence: Synthetic polypeptide
DEDEIRTTNPVAYEQWGSVSGGEPGNGGNMRNMMESM

SEQ ID NO: 186119 - protein, 37 aa, Artificial Sequence
  Description of Artificial Sequence: Synthetic polypeptide
CEEEIRTTNPVAYEQYGCVCSNSGEHNQEGFGSDNQE

SEQ ID NO: 186120 - protein, 36 aa, Artificial Sequence
  Description of Artificial Sequence: Synthetic polypeptide
CEEEIRTTNPVAYEQYGCVCSSGEHNQENFNSDNQD

SEQ ID NO: 186121 - protein, 37 aa, Artificial Sequence
  Description of Artificial Sequence: Synthetic polypeptide
DEAEIRTTNPVATEQYGSFNWEANPDDLGGSGQEHIG

SEQ ID NO: 186122 - protein, 37 aa, Artificial Sequence
  Description of Artificial Sequence: Synthetic polypeptide
CEEEIRTTNPVGTEQWGSVSGTANEPGGETGGDIEAM

SEQ ID NO: 186123 - protein, 37 aa, Artificial Sequence
  Description of Artificial Sequence: Synthetic polypeptide
DEAEIRTTNPVATEQYGSCPMPNMLWPENSSISQQTS

SEQ ID NO: 186124 - protein, 37 aa, Artificial Sequence
  Description of Artificial Sequence: Synthetic polypeptide
DEYEISTTNPVATEFYGSVSATGDFGQEDNEGGEDGD

SEQ ID NO: 186125 - protein, 37 aa, Artificial Sequence
  Description of Artificial Sequence: Synthetic polypeptide
DEAEIRTTNPVATEQYGSIPWTPLLEENQEHIQSEHQ

SEQ ID NO: 186126 - protein, 37 aa, Artificial Sequence
  Description of Artificial Sequence: Synthetic polypeptide
DEAEIRTTNPVATEQYGQCVCSWGEDHNQENFGSEQS

SEQ ID NO: 186127 - protein, 38 aa, Artificial Sequence
  Description of Artificial Sequence: Synthetic polypeptide
DENEIRTTNPVATEQYGSVCSVTWPIITEDRTFVHEGG

SEQ ID NO: 186128 - protein, 34 aa, Artificial Sequence
  Description of Artificial Sequence: Synthetic polypeptide
DQAEICTTNPVAYEQYGQCTASCIVELGHGTANP

SEQ ID NO: 186129 - protein, 35 aa, Artificial Sequence
  Description of Artificial Sequence: Synthetic polypeptide
DQAEIKTTNPVAYEQYGQCTASCIEELVHGGANRT

SEQ ID NO: 186130 - protein, 35 aa, Artificial Sequence
  Description of Artificial Sequence: Synthetic polypeptide
DEDEIRTTNPVAYERWGEVCSNDQHDQPGQGGNEQ

SEQ ID NO: 186131 - protein, 37 aa, Artificial Sequence
  Description of Artificial Sequence: Synthetic polypeptide
DQAEIRTTNPVATEQYGCCCSTWEEHNQEHFGSDNQS

SEQ ID NO: 186132 - protein, 37 aa, Artificial Sequence
  Description of Artificial Sequence: Synthetic polypeptide
DENEIRTTNPVATEQYGSCWMPINPWPENRSISQQTS

SEQ ID NO: 186133 - protein, 37 aa, Artificial Sequence
  Description of Artificial Sequence: Synthetic polypeptide
DENEIRTTNPVATEQYGSCWMPIMLSPENRSISQQTS

SEQ ID NO: 186134 - protein, 37 aa, Artificial Sequence
  Description of Artificial Sequence: Synthetic polypeptide
DENEIRTTNPVATEQYGSCTSGTCDMENDRPEVSFED

SEQ ID NO: 186135 - protein, 37 aa, Artificial Sequence
  Description of Artificial Sequence: Synthetic polypeptide
DENEIRTTNPVATEQYGSCTMPIQLWPENRSISQQTS

SEQ ID NO: 186136 - protein, 36 aa, Artificial Sequence
  Description of Artificial Sequence: Synthetic polypeptide
DEDEIRTTNPVAYERWGTVCSNDNHDQPGQGGNKEH

SEQ ID NO: 186137 - protein, 36 aa, Artificial Sequence
  Description of Artificial Sequence: Synthetic polypeptide
CEEEISTTNPVATEGYGCVCSNTGEHNQNFGSQTQS

SEQ ID NO: 186138 - protein, 35 aa, Artificial Sequence
  Description of Artificial Sequence: Synthetic polypeptide
DEDEIRTTNPVAYERWGTVCSNDQHDQPGQDGNVH

SEQ ID NO: 186139 - protein, 35 aa, Artificial Sequence
  Description of Artificial Sequence: Synthetic polypeptide
DEDEIRTTNPVAYERWGTVCSNDQHDQPGQGNNEI

SEQ ID NO: 186140 - protein, 35 aa, Artificial Sequence
  Description of Artificial Sequence: Synthetic polypeptide
DEDEIRTTNPVAYESWGCVCANDNDDQPGQQGNEG

SEQ ID NO: 186141 - protein, 36 aa, Artificial Sequence
  Description of Artificial Sequence: Synthetic polypeptide
DEDEIRTTNPVAYESWGEVCSNDNHDQSGQQGNSEH

SEQ ID NO: 186142 - protein, 37 aa, Artificial Sequence
  Description of Artificial Sequence: Synthetic polypeptide
DEAEIRTTNPVATEQYGQCAVCSTEEHQENFFSETQA

SEQ ID NO: 186143 - protein, 37 aa, Artificial Sequence
  Description of Artificial Sequence: Synthetic polypeptide
DENEIRTTNPVATEQYGSCNCTDNMPNENGGGTSIEM

SEQ ID NO: 186144 - protein, 36 aa, Artificial Sequence
  Description of Artificial Sequence: Synthetic polypeptide
DENEIRTTNPVATEQYGSCMPIMWIPENRSISQQTS

SEQ ID NO: 186145 - protein, 37 aa, Artificial Sequence
  Description of Artificial Sequence: Synthetic polypeptide
DENEIRTTNPVATEQYGSCMPIHMLGPENRSISQQTS

SEQ ID NO: 186146 - protein, 35 aa, Artificial Sequence
  Description of Artificial Sequence: Synthetic polypeptide
DEDEIRTTNPVAYESWGTVCLNDNHDQPGQQGNEH

SEQ ID NO: 186147 - protein, 38 aa, Artificial Sequence
  Description of Artificial Sequence: Synthetic polypeptide
DQAEIRTTNPVATEQYGSISIWEWNELDENGSGENFAY

SEQ ID NO: 186148 - protein, 36 aa, Artificial Sequence
  Description of Artificial Sequence: Synthetic polypeptide
DQAEIRTTNPVATEQYGSVGNDFENGMDTTNKPQEE

SEQ ID NO: 186149 - protein, 34 aa, Artificial Sequence
  Description of Artificial Sequence: Synthetic polypeptide
DEDEIRTTNPVSTEPWGCIAPEDQQQQQQRGGNS

SEQ ID NO: 186150 - protein, 35 aa, Artificial Sequence
  Description of Artificial Sequence: Synthetic polypeptide
DEDEIRTTNPVSYEQWGSCYTIDNHGQNGQGKDGW

SEQ ID NO: 186151 - protein, 34 aa, Artificial Sequence
  Description of Artificial Sequence: Synthetic polypeptide
DQAEICPTNPVAYEQYGCTASCIPVELGHGTNNR

SEQ ID NO: 186152 - protein, 36 aa, Artificial Sequence
  Description of Artificial Sequence: Synthetic polypeptide
CEEEISTTNPVATCQYGCVCSNTGEHQEHFNSDTQS

SEQ ID NO: 186153 - protein, 37 aa, Artificial Sequence
  Description of Artificial Sequence: Synthetic polypeptide
DENEIRTTNPVATEQYGSLLQNVMYSLEVSSDVVGTY

SEQ ID NO: 186154 - protein, 35 aa, Artificial Sequence
  Description of Artificial Sequence: Synthetic polypeptide
DNTEIATTNPVAYEQWGSARCTENHDQDDLHGDQR

SEQ ID NO: 186155 - protein, 36 aa, Artificial Sequence
  Description of Artificial Sequence: Synthetic polypeptide
DNEEIRTTNPVATEQYGCYNCETVLIENGGGELFDG

SEQ ID NO: 186156 - protein, 36 aa, Artificial Sequence
  Description of Artificial Sequence: Synthetic polypeptide
DNEEIRTTNPVATEQYGHIVNIATEDESSAEGDDEL

SEQ ID NO: 186157 - protein, 38 aa, Artificial Sequence
  Description of Artificial Sequence: Synthetic polypeptide
DEAEIRTTNPVATEQYGQCVCSNWGEHNIENFGSENQS

SEQ ID NO: 186158 - protein, 37 aa, Artificial Sequence
  Description of Artificial Sequence: Synthetic polypeptide
DEAEIRTTNPVATEQYGQCVCSNWGEHNAENFNSDQS

SEQ ID NO: 186159 - protein, 38 aa, Artificial Sequence
  Description of Artificial Sequence: Synthetic polypeptide
DNEEIRTTNPVATEQYGSVGCPMSLGFQSENIEQNSEI

SEQ ID NO: 186160 - protein, 38 aa, Artificial Sequence
  Description of Artificial Sequence: Synthetic polypeptide
DENEIRTTNPVATEQYGSVCSESPNELAMASFDETQFW

SEQ ID NO: 186161 - protein, 37 aa, Artificial Sequence
  Description of Artificial Sequence: Synthetic polypeptide
DEAEIRTTNPVATEQYGQCVCSNWEEHNQNFNSDFQS

SEQ ID NO: 186162 - protein, 36 aa, Artificial Sequence
  Description of Artificial Sequence: Synthetic polypeptide
DEAEIRTTNPVATEQYGQCVCSNWEDNANFNSDTQA

SEQ ID NO: 186163 - protein, 36 aa, Artificial Sequence
  Description of Artificial Sequence: Synthetic polypeptide
DNEEIRTTNPVATEQYGSYWNYAMSTSDVIEESEVE

SEQ ID NO: 186164 - protein, 37 aa, Artificial Sequence
  Description of Artificial Sequence: Synthetic polypeptide
DNEEIRTTNPVATEQYGVIVNSATDESSAEGDEDEMH

SEQ ID NO: 186165 - protein, 36 aa, Artificial Sequence
  Description of Artificial Sequence: Synthetic polypeptide
DENEIRTTNPVATEQYGSVANVAPPHEVTHGVSEQI

SEQ ID NO: 186166 - protein, 38 aa, Artificial Sequence
  Description of Artificial Sequence: Synthetic polypeptide
DNEEIRTTNPVATEQYGCSIVNSATDESSAEGDQDEVI

SEQ ID NO: 186167 - protein, 35 aa, Artificial Sequence
  Description of Artificial Sequence: Synthetic polypeptide
DENEIRTTNPVATEQYGSVANIAPPHEVTIIVSEQ

SEQ ID NO: 186168 - protein, 36 aa, Artificial Sequence
  Description of Artificial Sequence: Synthetic polypeptide
DENEIRTTNPVATEQYGSTMPIMLWPESRSISQQTS

SEQ ID NO: 186169 - protein, 38 aa, Artificial Sequence
  Description of Artificial Sequence: Synthetic polypeptide
DENEIRTTNPVATEQYGSTIPWTPPLEENQVHSQIGMQ

SEQ ID NO: 186170 - protein, 38 aa, Artificial Sequence
  Description of Artificial Sequence: Synthetic polypeptide
DENEIRTTNPVATEQYGSSSCSVQWPINEDRDFVHENG

SEQ ID NO: 186171 - protein, 38 aa, Artificial Sequence
  Description of Artificial Sequence: Synthetic polypeptide
DENEIRTTNPVATEQYGSSPSDNLVSLEGVEGGFESIA

SEQ ID NO: 186172 - protein, 38 aa, Artificial Sequence
  Description of Artificial Sequence: Synthetic polypeptide
DENEIRTTNPVATEQYGSSPSDNLVILENNEGGFESIM

SEQ ID NO: 186173 - protein, 37 aa, Artificial Sequence
  Description of Artificial Sequence: Synthetic polypeptide
DENEIRTTNPVATEQYGSSPMPIMLWPENRSISQQTS

SEQ ID NO: 186174 - protein, 37 aa, Artificial Sequence
  Description of Artificial Sequence: Synthetic polypeptide
DENEIRTTNPVATEQYGSSCAVTWPMNIEDLFVHEGG

SEQ ID NO: 186175 - protein, 37 aa, Artificial Sequence
  Description of Artificial Sequence: Synthetic polypeptide
DENEIRTTNPVATEQYGSSCAVTWPINIEDRFVHEVH

SEQ ID NO: 186176 - protein, 37 aa, Artificial Sequence
  Description of Artificial Sequence: Synthetic polypeptide
DENEIRTTNPVATEQYGSSCAVTWPINEDRFFEHEGG

SEQ ID NO: 186177 - protein, 37 aa, Artificial Sequence
  Description of Artificial Sequence: Synthetic polypeptide
DENEIRTTNPVATEQYGSSCAVDWIINIEDRFVHEGG

SEQ ID NO: 186178 - protein, 36 aa, Artificial Sequence
  Description of Artificial Sequence: Synthetic polypeptide
DENEIRTTNPVATEQYGSNAMGTLMFDSDIDVNNEE

SEQ ID NO: 186179 - protein, 37 aa, Artificial Sequence
  Description of Artificial Sequence: Synthetic polypeptide
DENEIRTTNPVATEQYGSTSSWAQWDLVGDSLQDEYI

SEQ ID NO: 186180 - protein, 35 aa, Artificial Sequence
  Description of Artificial Sequence: Synthetic polypeptide
DQAEISTTNPVATEQYGCCCSNTEHNQHFGSQTQA

SEQ ID NO: 186181 - protein, 37 aa, Artificial Sequence
  Description of Artificial Sequence: Synthetic polypeptide
DEAEIRTTNPVATEQYGSIPWTPPEEENQDHQSEPHP

SEQ ID NO: 186182 - protein, 38 aa, Artificial Sequence
  Description of Artificial Sequence: Synthetic polypeptide
DEAEIRTTNPVATEQYGSIPWTPPLEENQDHDQSEVRP

SEQ ID NO: 186183 - protein, 37 aa, Artificial Sequence
  Description of Artificial Sequence: Synthetic polypeptide
DEVEIRTTNPVATEQYGSVVDLMVNGTGQTEDQTEGD

SEQ ID NO: 186184 - protein, 38 aa, Artificial Sequence
  Description of Artificial Sequence: Synthetic polypeptide
DEVEIRTTNPVATEQYGSVVDNNAMGQNEMTENEFGGE

SEQ ID NO: 186185 - protein, 38 aa, Artificial Sequence
  Description of Artificial Sequence: Synthetic polypeptide
DEVEIRTTNPVATEQYGSVVFDDNDNDEGQTDDNDNAF

SEQ ID NO: 186186 - protein, 37 aa, Artificial Sequence
  Description of Artificial Sequence: Synthetic polypeptide
DEVEIRTTNPVATEQYGSVVFDVGNDEGQTDDEVEDQ

SEQ ID NO: 186187 - protein, 38 aa, Artificial Sequence
  Description of Artificial Sequence: Synthetic polypeptide
DEVEIRTTNPVATEQYGSVVMGFNFNIELNEDGGEGGT

SEQ ID NO: 186188 - protein, 38 aa, Artificial Sequence
  Description of Artificial Sequence: Synthetic polypeptide
DENEIRTTNPVATEQYGSVWSDVVDALEVGEGGMQQFH

SEQ ID NO: 186189 - protein, 38 aa, Artificial Sequence
  Description of Artificial Sequence: Synthetic polypeptide
DEVEIRTTNPVATEQYGVVMSNNDNFTEGPGQTGQTGD

SEQ ID NO: 186190 - protein, 39 aa, Artificial Sequence
  Description of Artificial Sequence: Synthetic polypeptide
CEEEIRTTNPVATEQYGSTMQPKESAELQPDRLLEFENG

SEQ ID NO: 186191 - protein, 38 aa, Artificial Sequence
  Description of Artificial Sequence: Synthetic polypeptide
DENEIRTTNPVATEQYGSVTSMWDGVNEEKDEGSDTEH

SEQ ID NO: 186192 - protein, 37 aa, Artificial Sequence
  Description of Artificial Sequence: Synthetic polypeptide
DENEIRTTNPVATEQYGSVTPYQTDEEDILPSIEEVP

SEQ ID NO: 186193 - protein, 40 aa, Artificial Sequence
  Description of Artificial Sequence: Synthetic polypeptide
DEEEIRTTNPVATEQYGSVSVVVVTVGTQAGTTEAGSTVD

SEQ ID NO: 186194 - protein, 38 aa, Artificial Sequence
  Description of Artificial Sequence: Synthetic polypeptide
DEAEIRTTNPVATEQYGSQVIYWDIKDENTGNLSQIED

SEQ ID NO: 186195 - protein, 37 aa, Artificial Sequence
  Description of Artificial Sequence: Synthetic polypeptide
DEVEISTTNPVATEQYGVIVDDLTQIMNGGDDGGEND

SEQ ID NO: 186196 - protein, 35 aa, Artificial Sequence
  Description of Artificial Sequence: Synthetic polypeptide
DEVEIVATNPVATEQYGTVVSATDGDDEEGEGGGI

SEQ ID NO: 186197 - protein, 38 aa, Artificial Sequence
  Description of Artificial Sequence: Synthetic polypeptide
DEVEIVTTNPVATEQYGSVVDFDTNEGQNQNDENIDQE

SEQ ID NO: 186198 - protein, 37 aa, Artificial Sequence
  Description of Artificial Sequence: Synthetic polypeptide
DEVEIVTTNPVATEQYGTVVSATDGDDEEAGEGGNIS

SEQ ID NO: 186199 - protein, 37 aa, Artificial Sequence
  Description of Artificial Sequence: Synthetic polypeptide
DEVEIVTTNPVATEQYGTVVSATDGDDEEGEGGNGTP

SEQ ID NO: 186200 - protein, 37 aa, Artificial Sequence
  Description of Artificial Sequence: Synthetic polypeptide
DEVEIVTTNPVATEQYGTVVSATDGDDEEGEGGNNII

SEQ ID NO: 186201 - protein, 37 aa, Artificial Sequence
  Description of Artificial Sequence: Synthetic polypeptide
DEVEIVTTNPVATEQYGTVVSATDGDDEEGGEGNGTV

SEQ ID NO: 186202 - protein, 38 aa, Artificial Sequence
  Description of Artificial Sequence: Synthetic polypeptide
CEEEIRTTNPVATEQYGSVNEPTYGEMNWQAQEQPELF

SEQ ID NO: 186203 - protein, 35 aa, Artificial Sequence
  Description of Artificial Sequence: Synthetic polypeptide
DEVNEIATTNPVAYEHWGVVYCSNGDDEDQGGNQR

SEQ ID NO: 186204 - protein, 34 aa, Artificial Sequence
  Description of Artificial Sequence: Synthetic polypeptide
DEVNEIATTNPVAYERWGVVYTTNGNQGEVGGDM

SEQ ID NO: 186205 - protein, 35 aa, Artificial Sequence
  Description of Artificial Sequence: Synthetic polypeptide
DEVSEIATTNPVAYEQWGSVCYNNDQDQHHGEDIE

SEQ ID NO: 186206 - protein, 37 aa, Artificial Sequence
  Description of Artificial Sequence: Synthetic polypeptide
DEVEIRTTNPVATEQYGSVVDFDFGEGQDEQTNEIAP

SEQ ID NO: 186207 - protein, 37 aa, Artificial Sequence
  Description of Artificial Sequence: Synthetic polypeptide
DEVEIRTTNPVATEQYGSVVDFDFGEGQDEETGEIAL

SEQ ID NO: 186208 - protein, 36 aa, Artificial Sequence
  Description of Artificial Sequence: Synthetic polypeptide
DENEIRTTNPVATEQYGSVWYQTDEEDITPSIEEEP

SEQ ID NO: 186209 - protein, 38 aa, Artificial Sequence
  Description of Artificial Sequence: Synthetic polypeptide
DENEIRTTNPVATEQYGSVYHESPVELATASPDENQFE

SEQ ID NO: 186210 - protein, 39 aa, Artificial Sequence
  Description of Artificial Sequence: Synthetic polypeptide
DENEIRTTNPVATEQYGVVSVDNTVNMDGQNDIGGGEGT

SEQ ID NO: 186211 - protein, 37 aa, Artificial Sequence
  Description of Artificial Sequence: Synthetic polypeptide
DEAEIRTTNPVATEQYGSTIPGTPPLEENPHSQIEMQ

SEQ ID NO: 186212 - protein, 37 aa, Artificial Sequence
  Description of Artificial Sequence: Synthetic polypeptide
DEAEIRTTNPVATEQYGSTCPWTPCLEENQHSQIEMQ

SEQ ID NO: 186213 - protein, 38 aa, Artificial Sequence
  Description of Artificial Sequence: Synthetic polypeptide
CEEEIRTTNPVATEQYGQCVCSTWGEDHNQNFGSETQA

SEQ ID NO: 186214 - protein, 37 aa, Artificial Sequence
  Description of Artificial Sequence: Synthetic polypeptide
CEEEIRTTNPVATEQYGQCVCSWEEHNAEHFNSDNQA

SEQ ID NO: 186215 - protein, 36 aa, Artificial Sequence
  Description of Artificial Sequence: Synthetic polypeptide
DEDEIRTTNPVAYECWGSVAWTDDGQDQRGEQQEES

SEQ ID NO: 186216 - protein, 36 aa, Artificial Sequence
  Description of Artificial Sequence: Synthetic polypeptide
CEEEIRTTNPVATEQYGQCVCSWEEHNEENFISDQE

SEQ ID NO: 186217 - protein, 38 aa, Artificial Sequence
  Description of Artificial Sequence: Synthetic polypeptide
DENEIRTTNPVATEQYGTVVTVWLPEDEQTENLQIDEI

SEQ ID NO: 186218 - protein, 35 aa, Artificial Sequence
  Description of Artificial Sequence: Synthetic polypeptide
DEDEIRTTNPVAYEEWGSVCVQNDNDQPEKNMGDT

SEQ ID NO: 186219 - protein, 35 aa, Artificial Sequence
  Description of Artificial Sequence: Synthetic polypeptide
DEDEIRTTNPVAYEEWGSVCVQNDNDQPEKNNTDN

SEQ ID NO: 186220 - protein, 38 aa, Artificial Sequence
  Description of Artificial Sequence: Synthetic polypeptide
DEAEIRTTNPVATEQYGSSVSCSGILCEELMNINEEAF

SEQ ID NO: 186221 - protein, 35 aa, Artificial Sequence
  Description of Artificial Sequence: Synthetic polypeptide
DEVSIATTNPVAYDPWGMVPSCTAEASQRTGENRE

SEQ ID NO: 186222 - protein, 38 aa, Artificial Sequence
  Description of Artificial Sequence: Synthetic polypeptide
DEAEIRTTNPVATEQYGSSVSCSGHLCEELMNLNEEVF

SEQ ID NO: 186223 - protein, 36 aa, Artificial Sequence
  Description of Artificial Sequence: Synthetic polypeptide
DEDEIRTTNPVAYEQWGEVCSTINQGNHGEAGGGEP

SEQ ID NO: 186224 - protein, 36 aa, Artificial Sequence
  Description of Artificial Sequence: Synthetic polypeptide
DEDEIRTTNPVAYEQWGEVCSTPNQGNHGPAGGGEY

SEQ ID NO: 186225 - protein, 36 aa, Artificial Sequence
  Description of Artificial Sequence: Synthetic polypeptide
DENEIRTTNPVATEQYGSWTMDKVDNESFRDETQIS

SEQ ID NO: 186226 - protein, 37 aa, Artificial Sequence
  Description of Artificial Sequence: Synthetic polypeptide
DENEIRTTNPVATEQYGSWTMDKGDTNESFRESTQIS

SEQ ID NO: 186227 - protein, 36 aa, Artificial Sequence
  Description of Artificial Sequence: Synthetic polypeptide
DENEIRTTNPVATEQYGSWTMDKGDNEHFNGETQIS

SEQ ID NO: 186228 - protein, 37 aa, Artificial Sequence
  Description of Artificial Sequence: Synthetic polypeptide
DENEIRTTNPVATEQYGSVYTTWYPMIQTESSEEHGQ

SEQ ID NO: 186229 - protein, 37 aa, Artificial Sequence
  Description of Artificial Sequence: Synthetic polypeptide
DENEIRTTNPVATEQYGSVYTTWNPMITSESSEEHTQ

SEQ ID NO: 186230 - protein, 37 aa, Artificial Sequence
  Description of Artificial Sequence: Synthetic polypeptide
DENEIRTTNPVATEQYGSVYTTWAPIIQTESSEEHTQ

SEQ ID NO: 186231 - protein, 37 aa, Artificial Sequence
  Description of Artificial Sequence: Synthetic polypeptide
DENEIRTTNPVATEQYGSVYTAWNPMIFTESSEEHTQ

SEQ ID NO: 186232 - protein, 37 aa, Artificial Sequence
  Description of Artificial Sequence: Synthetic polypeptide
CEEEIRTTNPVATEQYGQCVCSWPEHNQENFISENQS

SEQ ID NO: 186233 - protein, 38 aa, Artificial Sequence
  Description of Artificial Sequence: Synthetic polypeptide
DENEIRTTNPVATEQYGSVYSESPNESAMASFDENQMF

SEQ ID NO: 186234 - protein, 36 aa, Artificial Sequence
  Description of Artificial Sequence: Synthetic polypeptide
DEDEIRTTNPVAYEPWGSVYMGENDAQGERRQGGME

SEQ ID NO: 186235 - protein, 37 aa, Artificial Sequence
  Description of Artificial Sequence: Synthetic polypeptide
DEAEIRTTNPVATEQYGSIPWTPPLEDNQDHQSEPVP

SEQ ID NO: 186236 - protein, 34 aa, Artificial Sequence
  Description of Artificial Sequence: Synthetic polypeptide
DEVSIATTNPVAYDPWGMVPSCTAEHSQQGENVR

SEQ ID NO: 186237 - protein, 35 aa, Artificial Sequence
  Description of Artificial Sequence: Synthetic polypeptide
DEVTVIQTTNPVAYEQWGCVPACAVNPSQRGGQER

SEQ ID NO: 186238 - protein, 37 aa, Artificial Sequence
  Description of Artificial Sequence: Synthetic polypeptide
DEAEIRTTNPVATEQYGSLIWNWTAPINDLEINMDQE

SEQ ID NO: 186239 - protein, 37 aa, Artificial Sequence
  Description of Artificial Sequence: Synthetic polypeptide
DEAEIRTTNPVATEQYGSLIWMYTAPINDLEINDYQE

SEQ ID NO: 186240 - protein, 37 aa, Artificial Sequence
  Description of Artificial Sequence: Synthetic polypeptide
DEAEIRTTNPVATEQYGSLIWEYTAPINDLEINKDQE

SEQ ID NO: 186241 - protein, 37 aa, Artificial Sequence
  Description of Artificial Sequence: Synthetic polypeptide
DEAEIRTTNPVATEQYGSLIWAYTAPINDLHINMDQE

SEQ ID NO: 186242 - protein, 38 aa, Artificial Sequence
  Description of Artificial Sequence: Synthetic polypeptide
DEAEIRTTNPVATEQYGSLHWSYMQMINDLEINMDNQE

SEQ ID NO: 186243 - protein, 38 aa, Artificial Sequence
  Description of Artificial Sequence: Synthetic polypeptide
DEYEIRGTNPVATEAYGSVTSNGANGQADQEGDQNDTP

SEQ ID NO: 186244 - protein, 38 aa, Artificial Sequence
  Description of Artificial Sequence: Synthetic polypeptide
CEEEIRTTNPVATEQYGSVVNLTTPEGPEMGQGENEEG

SEQ ID NO: 186245 - protein, 37 aa, Artificial Sequence
  Description of Artificial Sequence: Synthetic polypeptide
DEAEIRTTNPVATEQYGSIVIWENEKDENESDENFAY

SEQ ID NO: 186246 - protein, 39 aa, Artificial Sequence
  Description of Artificial Sequence: Synthetic polypeptide
DEAEIRTTNPVATEQYGSIVIWAEENELDENDSGENENY

SEQ ID NO: 186247 - protein, 36 aa, Artificial Sequence
  Description of Artificial Sequence: Synthetic polypeptide
CEEEIRTTNPVATEQYGVCVHPSPVFMPNPVDMFEG

SEQ ID NO: 186248 - protein, 37 aa, Artificial Sequence
  Description of Artificial Sequence: Synthetic polypeptide
DEYEIRTTNPVATEQYGSCMPIPMLWPENRSISQQTS

SEQ ID NO: 186249 - protein, 36 aa, Artificial Sequence
  Description of Artificial Sequence: Synthetic polypeptide
CEEEIRTTNPVATEQYGVCVHPSPVNMPNIVDMFEL

SEQ ID NO: 186250 - protein, 37 aa, Artificial Sequence
  Description of Artificial Sequence: Synthetic polypeptide
DEYEIRTTNPVATEQYGSNFWVAEDHETQPETGEDTF

SEQ ID NO: 186251 - protein, 37 aa, Artificial Sequence
  Description of Artificial Sequence: Synthetic polypeptide
CEEEIRTTNPVATEQYGVVSILIAGGDEDQSEDGDGD

SEQ ID NO: 186252 - protein, 38 aa, Artificial Sequence
  Description of Artificial Sequence: Synthetic polypeptide
CEEEIRTTNPVATEQYGVVSILIAGGDNDTQDEGGDGD

SEQ ID NO: 186253 - protein, 38 aa, Artificial Sequence
  Description of Artificial Sequence: Synthetic polypeptide
CEEEIRTTNPVATEQYGVVSILIATGDEDQSEQGDPGD

SEQ ID NO: 186254 - protein, 37 aa, Artificial Sequence
  Description of Artificial Sequence: Synthetic polypeptide
DEAEIRTTNPVATEQYGSIPWTPPLENNQKHQSEPPP

SEQ ID NO: 186255 - protein, 39 aa, Artificial Sequence
  Description of Artificial Sequence: Synthetic polypeptide
CEEEIRTTNPVATEQYGVVSILIATGDNDNQGEGGDIGD

SEQ ID NO: 186256 - protein, 37 aa, Artificial Sequence
  Description of Artificial Sequence: Synthetic polypeptide
DEAEIRTTNPVATEQYGSIPWTPPLEENTDHVQSEPM

SEQ ID NO: 186257 - protein, 38 aa, Artificial Sequence
  Description of Artificial Sequence: Synthetic polypeptide
CEEEIRTTNPVATEQYGVVSILITTGDEDQSEQGGDGD

SEQ ID NO: 186258 - protein, 37 aa, Artificial Sequence
  Description of Artificial Sequence: Synthetic polypeptide
DEAEIRTTNPVATEQYGSIPWTPPLEENQHEQSEVHQ

SEQ ID NO: 186259 - protein, 37 aa, Artificial Sequence
  Description of Artificial Sequence: Synthetic polypeptide
DEAEIRTTNPVATEQYGSIPWTPPLEENQEHQSELPP

SEQ ID NO: 186260 - protein, 37 aa, Artificial Sequence
  Description of Artificial Sequence: Synthetic polypeptide
DEAEIRTTNPVATEQYGSIPWTPPLEENQDHQSEMPM

SEQ ID NO: 186261 - protein, 37 aa, Artificial Sequence
  Description of Artificial Sequence: Synthetic polypeptide
DEAEIRTTNPVATEQYGSLIWSYAAMINDLEINMDQE

SEQ ID NO: 186262 - protein, 37 aa, Artificial Sequence
  Description of Artificial Sequence: Synthetic polypeptide
DEAEIRTTNPVATEQYGSLIWSYMQSINDLEINDDQE

SEQ ID NO: 186263 - protein, 37 aa, Artificial Sequence
  Description of Artificial Sequence: Synthetic polypeptide
DEAEIRTTNPVATEQYGSLIWSYNYPINDLHINMDQE

SEQ ID NO: 186264 - protein, 37 aa, Artificial Sequence
  Description of Artificial Sequence: Synthetic polypeptide
DEAEIRTTNPVATEQYGSLIWSYPALINCLEINMDQE

SEQ ID NO: 186265 - protein, 38 aa, Artificial Sequence
  Description of Artificial Sequence: Synthetic polypeptide
CEEEIRTTNPVATEQYGSVNEPTYGQMQLQAQDPPELF

SEQ ID NO: 186266 - protein, 38 aa, Artificial Sequence
  Description of Artificial Sequence: Synthetic polypeptide
CEEEIRTTNPVATEQYGSVPPVAQMVKVEAGVEPEQRD

SEQ ID NO: 186267 - protein, 34 aa, Artificial Sequence
  Description of Artificial Sequence: Synthetic polypeptide
DEWEIRTTNPVAHECWGSFGPCINEPEAREFENG

SEQ ID NO: 186268 - protein, 38 aa, Artificial Sequence
  Description of Artificial Sequence: Synthetic polypeptide
CEEEIRTTNPVATEQYGSVQCKESAEHQPDFLLPFENG

SEQ ID NO: 186269 - protein, 39 aa, Artificial Sequence
  Description of Artificial Sequence: Synthetic polypeptide
DEAEIRTTNPVATEQYGSNIVTSEVNDEEVNPEPEINRV

SEQ ID NO: 186270 - protein, 36 aa, Artificial Sequence
  Description of Artificial Sequence: Synthetic polypeptide
DEWEIRTTNPVATEQWGKVPSEQIAHSMNAAEGDAV

SEQ ID NO: 186271 - protein, 37 aa, Artificial Sequence
  Description of Artificial Sequence: Synthetic polypeptide
DEWEIRTTNPVAYEAYGSTVPCFGNSGWNEPVGNNGK

SEQ ID NO: 186272 - protein, 37 aa, Artificial Sequence
  Description of Artificial Sequence: Synthetic polypeptide
DEAEIRTTNPVATEQYGSLIWSYWAPINDLEINDIQE

SEQ ID NO: 186273 - protein, 38 aa, Artificial Sequence
  Description of Artificial Sequence: Synthetic polypeptide
DEAEIRTTNPVATEQYGSLIWSYVYPINTLEINMDGQE

SEQ ID NO: 186274 - protein, 37 aa, Artificial Sequence
  Description of Artificial Sequence: Synthetic polypeptide
DEAEIRTTNPVATEQYGSLIWSYVWPINDLEINMDQE

SEQ ID NO: 186275 - protein, 37 aa, Artificial Sequence
  Description of Artificial Sequence: Synthetic polypeptide
DEYEIATTNPVATEFYGSVSATGDQGDEDQETGEDGD

SEQ ID NO: 186276 - protein, 33 aa, Artificial Sequence
  Description of Artificial Sequence: Synthetic polypeptide
DEVSIATTNPVAYDPWGMVPWCTAEHSQHGENR

SEQ ID NO: 186277 - protein, 38 aa, Artificial Sequence
  Description of Artificial Sequence: Synthetic polypeptide
DEAEIRTTNPVATEQYGSLIWSYTYPINDLEINMDTQE

SEQ ID NO: 186278 - protein, 36 aa, Artificial Sequence
  Description of Artificial Sequence: Synthetic polypeptide
DEYEIATTNPVAYEEWGSVATGGNTGNANGNDQQRN

SEQ ID NO: 186279 - protein, 36 aa, Artificial Sequence
  Description of Artificial Sequence: Synthetic polypeptide
DEYEIATTNPVAYEEWGSVATTGGNTGNVGNDQQRE

SEQ ID NO: 186280 - protein, 37 aa, Artificial Sequence
  Description of Artificial Sequence: Synthetic polypeptide
DEYEICTTNPVATEFYGSVSATGDQGQEDQPGGEDGD

SEQ ID NO: 186281 - protein, 37 aa, Artificial Sequence
  Description of Artificial Sequence: Synthetic polypeptide
DEYEICTTNPVATEFYGSVSITGDQDDEDQEGGEDGD

SEQ ID NO: 186282 - protein, 37 aa, Artificial Sequence
  Description of Artificial Sequence: Synthetic polypeptide
DEYEICTTNPVATESYGSVSATGDQGDEDQEGGEDGD

SEQ ID NO: 186283 - protein, 38 aa, Artificial Sequence
  Description of Artificial Sequence: Synthetic polypeptide
DEAEIRTTNPVATEQYGSLIWSYTAPGNDLEINMDYQE

SEQ ID NO: 186284 - protein, 37 aa, Artificial Sequence
  Description of Artificial Sequence: Synthetic polypeptide
DEYEIGTTNPVATEFYGSVSATGDQGQEDLEGGEDED

SEQ ID NO: 186285 - protein, 37 aa, Artificial Sequence
  Description of Artificial Sequence: Synthetic polypeptide
DEYEIGTTNPVATEFYGSVSSTGDQGQEDQEGGEDGA

SEQ ID NO: 186286 - protein, 38 aa, Artificial Sequence
  Description of Artificial Sequence: Synthetic polypeptide
DEYEIGTTNPVATEFYGSVSTATGDQGIEDQEGNEDGD

SEQ ID NO: 186287 - protein, 37 aa, Artificial Sequence
  Description of Artificial Sequence: Synthetic polypeptide
DEYEIGTTNPVATEFYGSVTATGDQGIENQERGEDGD

SEQ ID NO: 186288 - protein, 37 aa, Artificial Sequence
  Description of Artificial Sequence: Synthetic polypeptide
DEYEIGTTNPVATEGYGSVSATGDQGQEDQEGGEEGD

SEQ ID NO: 186289 - protein, 35 aa, Artificial Sequence
  Description of Artificial Sequence: Synthetic polypeptide
DEYEIATTNPVAYEEWGSVATGGNTGNAGNDQQKM

SEQ ID NO: 186290 - protein, 37 aa, Artificial Sequence
  Description of Artificial Sequence: Synthetic polypeptide
CEEEISTTNPVATEQYGQCVCSWGEHNQEGFGSDNQE

SEQ ID NO: 186291 - protein, 36 aa, Artificial Sequence
  Description of Artificial Sequence: Synthetic polypeptide
DQAEISTTNPVATEQYGSVSWASWNEEAFFGDLPLQ

SEQ ID NO: 186292 - protein, 37 aa, Artificial Sequence
  Description of Artificial Sequence: Synthetic polypeptide
DENEIRTTNPVATEQYGQVVVMNGFNGEGGFDENTDQ

SEQ ID NO: 186293 - protein, 37 aa, Artificial Sequence
  Description of Artificial Sequence: Synthetic polypeptide
DENEIRTTNPVATEQYGACCMVHDNDVEQLEPGEDTS

SEQ ID NO: 186294 - protein, 37 aa, Artificial Sequence
  Description of Artificial Sequence: Synthetic polypeptide
DEEAISTTNPVATEQYGCVCSNWGEHNQENFGSDNQA

SEQ ID NO: 186295 - protein, 34 aa, Artificial Sequence
  Description of Artificial Sequence: Synthetic polypeptide
AENEIACTNPVATEQYGCSCSWGEHNAYFGSEQS

SEQ ID NO: 186296 - protein, 34 aa, Artificial Sequence
  Description of Artificial Sequence: Synthetic polypeptide
AENEIACTNPVATEQYGCSCSWEPHNQYFGSQQS

SEQ ID NO: 186297 - protein, 36 aa, Artificial Sequence
  Description of Artificial Sequence: Synthetic polypeptide
DEEAISTTNPVATEQYGCVCSNWGEHNQSFNSDTQA

SEQ ID NO: 186298 - protein, 38 aa, Artificial Sequence
  Description of Artificial Sequence: Synthetic polypeptide
DSEEIRTTNPVATEQYGAALLTSTTDAETQEGNFETGA

SEQ ID NO: 186299 - protein, 37 aa, Artificial Sequence
  Description of Artificial Sequence: Synthetic polypeptide
DEEAISTTNPVATEQYGCVCSNWGEHNTENFNSDNQS

SEQ ID NO: 186300 - protein, 38 aa, Artificial Sequence
  Description of Artificial Sequence: Synthetic polypeptide
DEEEIRTTNPVATEQYGSVTRAHALNDQQSMIVFEQEE

SEQ ID NO: 186301 - protein, 36 aa, Artificial Sequence
  Description of Artificial Sequence: Synthetic polypeptide
DSEEIRTTNPVATEQYGKVVCHCANAPSHPTVTHNA

SEQ ID NO: 186302 - protein, 35 aa, Artificial Sequence
  Description of Artificial Sequence: Synthetic polypeptide
AENEIACTNPVATEQYGCSCSWELNQENFGSETQS

SEQ ID NO: 186303 - protein, 34 aa, Artificial Sequence
  Description of Artificial Sequence: Synthetic polypeptide
AENEIACTNPVATEQYGCSCSWELNAEYFNSDQS

SEQ ID NO: 186304 - protein, 37 aa, Artificial Sequence
  Description of Artificial Sequence: Synthetic polypeptide
DSEEIRTTNPVATEQYGSAWWSFYVEMENLPTDEEQI

SEQ ID NO: 186305 - protein, 37 aa, Artificial Sequence
  Description of Artificial Sequence: Synthetic polypeptide
DSEEIRTTNPVATEQYGSNAPFQYAEELENFEGSNQH

SEQ ID NO: 186306 - protein, 39 aa, Artificial Sequence
  Description of Artificial Sequence: Synthetic polypeptide
DSEEIRTTNPVATEQYGSNIVTWSVNNEEQNAEPEIQRV

SEQ ID NO: 186307 - protein, 38 aa, Artificial Sequence
  Description of Artificial Sequence: Synthetic polypeptide
DSEEIRTTNPVATEQYGSQWWSWTVEMENNLPTDESQI

SEQ ID NO: 186308 - protein, 33 aa, Artificial Sequence
  Description of Artificial Sequence: Synthetic polypeptide
AENEIACTNPVATEQYGCSCSWEDNQYFSSDQS

SEQ ID NO: 186309 - protein, 34 aa, Artificial Sequence
  Description of Artificial Sequence: Synthetic polypeptide
AENEIACTNPVATEQYGCSCSWEDHNAHFGSDQA

SEQ ID NO: 186310 - protein, 36 aa, Artificial Sequence
  Description of Artificial Sequence: Synthetic polypeptide
DEEAISTTNPVATEQYGCVCSWGEDHNTNFNSDTQA

SEQ ID NO: 186311 - protein, 36 aa, Artificial Sequence
  Description of Artificial Sequence: Synthetic polypeptide
DEEAISTTNPVATEQYGCVCSWGEHNAENFNSDTQP

SEQ ID NO: 186312 - protein, 36 aa, Artificial Sequence
  Description of Artificial Sequence: Synthetic polypeptide
DENEIRTTNPVATEQWGVVDNEEGEEMNDGQGDGEQ

SEQ ID NO: 186313 - protein, 35 aa, Artificial Sequence
  Description of Artificial Sequence: Synthetic polypeptide
DEEAISTTNPVATEQYGCVCSWGEHNQENFISDQA

SEQ ID NO: 186314 - protein, 37 aa, Artificial Sequence
  Description of Artificial Sequence: Synthetic polypeptide
DEAEIRTTNPVATEQYGCVVTLTEDVQGVPEEENDQY

SEQ ID NO: 186315 - protein, 36 aa, Artificial Sequence
  Description of Artificial Sequence: Synthetic polypeptide
DEAEIRTTNPVATEQYGCVTYLEDVNNVSEEKNDQY

SEQ ID NO: 186316 - protein, 36 aa, Artificial Sequence
  Description of Artificial Sequence: Synthetic polypeptide
DENEIRTTNPVATEQYGACCWVADVDVEILEPGEDN

SEQ ID NO: 186317 - protein, 37 aa, Artificial Sequence
  Description of Artificial Sequence: Synthetic polypeptide
DEEAISTTNPVATEQYGCVCSNWGEHNAENFGSDNQA

SEQ ID NO: 186318 - protein, 34 aa, Artificial Sequence
  Description of Artificial Sequence: Synthetic polypeptide
AENEIACTNPVATEQYGCSCSWNHNQEHFISDQA

SEQ ID NO: 186319 - protein, 35 aa, Artificial Sequence
  Description of Artificial Sequence: Synthetic polypeptide
AENEIACTNPVATEQYGCSCSWNHNQENFGSQTQS

SEQ ID NO: 186320 - protein, 35 aa, Artificial Sequence
  Description of Artificial Sequence: Synthetic polypeptide
DSEEIRPTNPVAYEQYGKVVHCANAPAHPRVTHNA

SEQ ID NO: 186321 - protein, 36 aa, Artificial Sequence
  Description of Artificial Sequence: Synthetic polypeptide
DENEIRTTNPVATEQYGCCWVAQVDVEQGEPGEDGY

SEQ ID NO: 186322 - protein, 36 aa, Artificial Sequence
  Description of Artificial Sequence: Synthetic polypeptide
DENEIRTTNPVATEQYGCCWVADVDVEQLEPQEDLV

SEQ ID NO: 186323 - protein, 37 aa, Artificial Sequence
  Description of Artificial Sequence: Synthetic polypeptide
DENEIRTTNPVATEQYGCCWMVADNDVEQLEPGEDTN

SEQ ID NO: 186324 - protein, 36 aa, Artificial Sequence
  Description of Artificial Sequence: Synthetic polypeptide
DENEIRTTNPVATEQYGCCTVADVGVEQLEPGEDLN

SEQ ID NO: 186325 - protein, 36 aa, Artificial Sequence
  Description of Artificial Sequence: Synthetic polypeptide
DENEIRTTNPVATEQYGCCTVADVDVEYLEPGEDTM

SEQ ID NO: 186326 - protein, 36 aa, Artificial Sequence
  Description of Artificial Sequence: Synthetic polypeptide
DENEIRTTNPVATEQYGCCTVADVDVEQLEPGEETT

SEQ ID NO: 186327 - protein, 36 aa, Artificial Sequence
  Description of Artificial Sequence: Synthetic polypeptide
DENEIRTTNPVATEQYGCCTVADVDVEQLEPGEDDS

SEQ ID NO: 186328 - protein, 38 aa, Artificial Sequence
  Description of Artificial Sequence: Synthetic polypeptide
DENEIRTTNPVATEQYGCCTSESPNELAMASFDENQFE

SEQ ID NO: 186329 - protein, 36 aa, Artificial Sequence
  Description of Artificial Sequence: Synthetic polypeptide
DEEAIRTTNPVAYEHYGSVYACTAADSPNKGTSPRM

SEQ ID NO: 186330 - protein, 37 aa, Artificial Sequence
  Description of Artificial Sequence: Synthetic polypeptide
DEEAIRTTNPVAYEQYGQCVCSTGEDHNQNFNSDNQG

SEQ ID NO: 186331 - protein, 36 aa, Artificial Sequence
  Description of Artificial Sequence: Synthetic polypeptide
DEAEIRTTNPVATEQYGCVTLVEDVPNNPEEKNDEY

SEQ ID NO: 186332 - protein, 36 aa, Artificial Sequence
  Description of Artificial Sequence: Synthetic polypeptide
DENEIRTTNPVATEQYGCCMVADVDVEQLEPGEDQL

SEQ ID NO: 186333 - protein, 36 aa, Artificial Sequence
  Description of Artificial Sequence: Synthetic polypeptide
DENEIRTTNPVATEQYGAVVDIMNMEPVNEEGGQGD

SEQ ID NO: 186334 - protein, 35 aa, Artificial Sequence
  Description of Artificial Sequence: Synthetic polypeptide
AENEIACTNPVATEQYGCYCSWGNLNQENFGSDQS

SEQ ID NO: 186335 - protein, 35 aa, Artificial Sequence
  Description of Artificial Sequence: Synthetic polypeptide
AENEIACTNPVATEQYGCYCSWELNQENFGSDNQS

SEQ ID NO: 186336 - protein, 35 aa, Artificial Sequence
  Description of Artificial Sequence: Synthetic polypeptide
DEEAISTTNPVATEQWGCVCGWNEDNQEHFGSEQS

SEQ ID NO: 186337 - protein, 37 aa, Artificial Sequence
  Description of Artificial Sequence: Synthetic polypeptide
DEEAISTTNPVATEQYGCVCPNWGEHNQENFGSDNQS

SEQ ID NO: 186338 - protein, 35 aa, Artificial Sequence
  Description of Artificial Sequence: Synthetic polypeptide
DEEAISTTNPVATEQYGCVCSDWGEHAENFGSDQA

SEQ ID NO: 186339 - protein, 35 aa, Artificial Sequence
  Description of Artificial Sequence: Synthetic polypeptide
AENEIACTNPVATEQYGCSCSWVNHNQNFGSDTQA

SEQ ID NO: 186340 - protein, 36 aa, Artificial Sequence
  Description of Artificial Sequence: Synthetic polypeptide
DEEAISTTNPVATEQYGCVCSNWEEHQENFGSDFQS

SEQ ID NO: 186341 - protein, 36 aa, Artificial Sequence
  Description of Artificial Sequence: Synthetic polypeptide
DENEIRTTNPVATEQYGACCWVADVWVEQLEGLEDL

SEQ ID NO: 186342 - protein, 35 aa, Artificial Sequence
  Description of Artificial Sequence: Synthetic polypeptide
DSEEIRTTNPVATENYGKVVHCANAPSHPIVTHNA

SEQ ID NO: 186343 - protein, 36 aa, Artificial Sequence
  Description of Artificial Sequence: Synthetic polypeptide
DENEIRTTNPVATEQYGACCWVADVDVEVLEGGMDL

SEQ ID NO: 186344 - protein, 34 aa, Artificial Sequence
  Description of Artificial Sequence: Synthetic polypeptide
AENEIACTNPVATEQYGCYCSWNPNQEYFGSDQS

SEQ ID NO: 186345 - protein, 35 aa, Artificial Sequence
  Description of Artificial Sequence: Synthetic polypeptide
DSEEIRPTNPVATEVYGKVVHCANAPSHPRVTDNA

SEQ ID NO: 186346 - protein, 36 aa, Artificial Sequence
  Description of Artificial Sequence: Synthetic polypeptide
DEAEIRTTNPVATEQYGCVTLPEDVQSVPEEKNDQY

SEQ ID NO: 186347 - protein, 36 aa, Artificial Sequence
  Description of Artificial Sequence: Synthetic polypeptide
DEAEIRTTNPVATEQYGCVTLPEDVPNNPEEKNDQK

SEQ ID NO: 186348 - protein, 36 aa, Artificial Sequence
  Description of Artificial Sequence: Synthetic polypeptide
DENEIRTTNPVATEQWGQCVCSSGEDNANASNSDAS

SEQ ID NO: 186349 - protein, 34 aa, Artificial Sequence
  Description of Artificial Sequence: Synthetic polypeptide
DEECIATTNPVAYEGWGSVATENNNGGDTQGDTQ

SEQ ID NO: 186350 - protein, 34 aa, Artificial Sequence
  Description of Artificial Sequence: Synthetic polypeptide
DEECIATTNPVAYEGWGSVATGPNGGDHTQGDSD

SEQ ID NO: 186351 - protein, 34 aa, Artificial Sequence
  Description of Artificial Sequence: Synthetic polypeptide
DEECIATTNPVAYEGWGSVATTDNNGGDTQGDSD

SEQ ID NO: 186352 - protein, 35 aa, Artificial Sequence
  Description of Artificial Sequence: Synthetic polypeptide
DEECIATTNPVAYEGWGSVATTENNQGEDTQGDSD

SEQ ID NO: 186353 - protein, 34 aa, Artificial Sequence
  Description of Artificial Sequence: Synthetic polypeptide
DEECIATTNPVAYEGWGSVATTGLGGNDTQGDGP

SEQ ID NO: 186354 - protein, 35 aa, Artificial Sequence
  Description of Artificial Sequence: Synthetic polypeptide
DSEEISTTNPVAYDQWGSTVVSTLPPSMRGGGMGT

SEQ ID NO: 186355 - protein, 34 aa, Artificial Sequence
  Description of Artificial Sequence: Synthetic polypeptide
DEECIATTNPVAYEGWGSVATTLPNGGDTQGDAN

SEQ ID NO: 186356 - protein, 35 aa, Artificial Sequence
  Description of Artificial Sequence: Synthetic polypeptide
DSEEISTTNPVAYTQWGSTVPSYQPPSMRGGNMAT

SEQ ID NO: 186357 - protein, 35 aa, Artificial Sequence
  Description of Artificial Sequence: Synthetic polypeptide
DEECIATTNPVAYEGWGSVATTNLLGENDTQGDGH

SEQ ID NO: 186358 - protein, 34 aa, Artificial Sequence
  Description of Artificial Sequence: Synthetic polypeptide
DEECIATTNPVAYEGWGSVATTNMNGGDTQGDAI

SEQ ID NO: 186359 - protein, 35 aa, Artificial Sequence
  Description of Artificial Sequence: Synthetic polypeptide
DEECIATTNPVAYEGWGSVATTNNGGNDRTQGDGT

SEQ ID NO: 186360 - protein, 34 aa, Artificial Sequence
  Description of Artificial Sequence: Synthetic polypeptide
DEECIATTNPVAYEGWGSVATTNNGGNDTQGDQH

SEQ ID NO: 186361 - protein, 36 aa, Artificial Sequence
  Description of Artificial Sequence: Synthetic polypeptide
DEECIATTNPVAYEGWGSVATTNNLGGNDQTQGDGT

SEQ ID NO: 186362 - protein, 35 aa, Artificial Sequence
  Description of Artificial Sequence: Synthetic polypeptide
DSGEICTTNPVAYERYGKVVCSTVMLSQNTGMTQI

SEQ ID NO: 186363 - protein, 35 aa, Artificial Sequence
  Description of Artificial Sequence: Synthetic polypeptide
DEECIATTNPVAYEGWGSVATTNNLGGNDTQGDQS

SEQ ID NO: 186364 - protein, 34 aa, Artificial Sequence
  Description of Artificial Sequence: Synthetic polypeptide
DEECIATTNPVAYEGWGSVATTNPGGNDTQGDGQ

SEQ ID NO: 186365 - protein, 35 aa, Artificial Sequence
  Description of Artificial Sequence: Synthetic polypeptide
DEECIATTNPVAYEGWGSVATTNPNGGQDTQGDSD

SEQ ID NO: 186366 - protein, 34 aa, Artificial Sequence
  Description of Artificial Sequence: Synthetic polypeptide
DEECIATTNPVAYEGWGSVATTNPVGGDTQGDGH

SEQ ID NO: 186367 - protein, 34 aa, Artificial Sequence
  Description of Artificial Sequence: Synthetic polypeptide
DEECIATTNPVAYEGWGSVATTNQGGGDTQGDSA

SEQ ID NO: 186368 - protein, 35 aa, Artificial Sequence
  Description of Artificial Sequence: Synthetic polypeptide
DEECIATTNPVAYEGWGSVATTNQNGGNDTQGDAD

SEQ ID NO: 186369 - protein, 34 aa, Artificial Sequence
  Description of Artificial Sequence: Synthetic polypeptide
DEECIATTNPVAYEGWGSVATTPLGENDTQGDGA

SEQ ID NO: 186370 - protein, 34 aa, Artificial Sequence
  Description of Artificial Sequence: Synthetic polypeptide
DEECIATTNPVAYEGWGSVATTPLGGNDTIGGGA

SEQ ID NO: 186371 - protein, 33 aa, Artificial Sequence
  Description of Artificial Sequence: Synthetic polypeptide
DEECIATTNPVAYEGWGSVACDNNGGDTQGDAD

SEQ ID NO: 186372 - protein, 34 aa, Artificial Sequence
  Description of Artificial Sequence: Synthetic polypeptide
DEECIATTNPVAYEGWGEVATTNLGGNDTQGDEH

SEQ ID NO: 186373 - protein, 35 aa, Artificial Sequence
  Description of Artificial Sequence: Synthetic polypeptide
DSEEIRTTNPVGYETWGCVRHNNDQQQDGRGGDAR

SEQ ID NO: 186374 - protein, 35 aa, Artificial Sequence
  Description of Artificial Sequence: Synthetic polypeptide
DSEEIRTTNPVGYESWGCVRHNNDHQQDRRGEDRE

SEQ ID NO: 186375 - protein, 36 aa, Artificial Sequence
  Description of Artificial Sequence: Synthetic polypeptide
DEAEIRTTNPVATEQYGCVTLPEDVNNNPEENNDQY

SEQ ID NO: 186376 - protein, 36 aa, Artificial Sequence
  Description of Artificial Sequence: Synthetic polypeptide
DEAEIRTTNPVATEQYGCVTLPEDVENNPEEKNIQY

SEQ ID NO: 186377 - protein, 35 aa, Artificial Sequence
  Description of Artificial Sequence: Synthetic polypeptide
DEAEIRTTNPVATEQYGCVTLEDVPNVPEEPHSQY

SEQ ID NO: 186378 - protein, 36 aa, Artificial Sequence
  Description of Artificial Sequence: Synthetic polypeptide
DEAEIRTTNPVATEQYGCVTLDEDVNNVPEEKNDQY

SEQ ID NO: 186379 - protein, 35 aa, Artificial Sequence
  Description of Artificial Sequence: Synthetic polypeptide
AENEIACTNPVATEQYGCSCSNWEHNQHFGSDNQA

SEQ ID NO: 186380 - protein, 36 aa, Artificial Sequence
  Description of Artificial Sequence: Synthetic polypeptide
DEEAISTTNPVATEQYGQCVCSSGEHNQESFGSDQA

SEQ ID NO: 186381 - protein, 35 aa, Artificial Sequence
  Description of Artificial Sequence: Synthetic polypeptide
DSEEIRTTNPVGTEQWGCVCSNWEHNQENFGSQQS

SEQ ID NO: 186382 - protein, 36 aa, Artificial Sequence
  Description of Artificial Sequence: Synthetic polypeptide
DEEAISTTNPVATEQYGQCVCSWGEHNQENFGSDQP

SEQ ID NO: 186383 - protein, 36 aa, Artificial Sequence
  Description of Artificial Sequence: Synthetic polypeptide
DSEEIRTTNPVGTEQWGCVCSTTGEHNQENFGSVQA

SEQ ID NO: 186384 - protein, 35 aa, Artificial Sequence
  Description of Artificial Sequence: Synthetic polypeptide
DEEAISTTNPVAYEQYGCVCSNWGEHQNFNSDTQA

SEQ ID NO: 186385 - protein, 35 aa, Artificial Sequence
  Description of Artificial Sequence: Synthetic polypeptide
DEECEIATTNPVAYEGWGSVATTPLGGNDTQGDGD

SEQ ID NO: 186386 - protein, 36 aa, Artificial Sequence
  Description of Artificial Sequence: Synthetic polypeptide
DEAEIRTTNPVATEQYGCVTLPEDVPNNSEEWNDQY

SEQ ID NO: 186387 - protein, 37 aa, Artificial Sequence
  Description of Artificial Sequence: Synthetic polypeptide
DEECEIATTNPVAYEQWGSVSWGNNGLEPNGDEGGGN

SEQ ID NO: 186388 - protein, 36 aa, Artificial Sequence
  Description of Artificial Sequence: Synthetic polypeptide
DEAEIRTTNPVATEQYGCVMLPEDVPNVPEEKLNQY

SEQ ID NO: 186389 - protein, 35 aa, Artificial Sequence
  Description of Artificial Sequence: Synthetic polypeptide
DEAEIRTTNPVATEQYGCVLDAMAEVESRQQEDTI

SEQ ID NO: 186390 - protein, 36 aa, Artificial Sequence
  Description of Artificial Sequence: Synthetic polypeptide
DEECIATTNPCATECYGVVCYKTNDEAQRQGGGEDH

SEQ ID NO: 186391 - protein, 36 aa, Artificial Sequence
  Description of Artificial Sequence: Synthetic polypeptide
DEECIATTNPCATECYGVVCYKTNDETQRQGGGMDQ

SEQ ID NO: 186392 - protein, 36 aa, Artificial Sequence
  Description of Artificial Sequence: Synthetic polypeptide
DEECIATTNPCSTECYGVVCYKTNDETQRQGGGDTR

SEQ ID NO: 186393 - protein, 35 aa, Artificial Sequence
  Description of Artificial Sequence: Synthetic polypeptide
DEECIATTNPVATEGYGCVCGWGEDLQEYFGSDQS

SEQ ID NO: 186394 - protein, 37 aa, Artificial Sequence
  Description of Artificial Sequence: Synthetic polypeptide
DEAEIRTTNPVATEQYGCVCSWGEDHNQENFNSDTQS

SEQ ID NO: 186395 - protein, 34 aa, Artificial Sequence
  Description of Artificial Sequence: Synthetic polypeptide
DSEEIRTTNPVGYEQWGCVRHEDKQQDRKGGSTT

SEQ ID NO: 186396 - protein, 34 aa, Artificial Sequence
  Description of Artificial Sequence: Synthetic polypeptide
DSEEIRTTNPVGYEQWGCVRHEDKQQDRRGGEDP

SEQ ID NO: 186397 - protein, 35 aa, Artificial Sequence
  Description of Artificial Sequence: Synthetic polypeptide
DSEEIRTTNPVGYEQWGCVRHIQDHQQDRRGKDDR

SEQ ID NO: 186398 - protein, 35 aa, Artificial Sequence
  Description of Artificial Sequence: Synthetic polypeptide
DSEEIRTTNPVGYEQWGCVRHNNDHQQDRRGGDMG

SEQ ID NO: 186399 - protein, 35 aa, Artificial Sequence
  Description of Artificial Sequence: Synthetic polypeptide
DEECEIATTNPVAYERWGVVYITGNQGNEQEGDDS

SEQ ID NO: 186400 - protein, 35 aa, Artificial Sequence
  Description of Artificial Sequence: Synthetic polypeptide
DQECISTTNPVAYEHYGQTTVAVTNPLSTRGGEAG

SEQ ID NO: 186401 - protein, 35 aa, Artificial Sequence
  Description of Artificial Sequence: Synthetic polypeptide
DSEEIRPTNPVATEQWGKTVHCANAPAHERVTHNA

SEQ ID NO: 186402 - protein, 37 aa, Artificial Sequence
  Description of Artificial Sequence: Synthetic polypeptide
DENEIRTTNPVATEQYGCSCLYCSDEIWPNESNEDRD

SEQ ID NO: 186403 - protein, 37 aa, Artificial Sequence
  Description of Artificial Sequence: Synthetic polypeptide
DEAEIRTTNPVATEQYGGVTWSPVNWDENPNTDEVGN

SEQ ID NO: 186404 - protein, 38 aa, Artificial Sequence
  Description of Artificial Sequence: Synthetic polypeptide
DEAEIRTTNPVATEQYGGVTWSPVLWLENPNQSGEVGN

SEQ ID NO: 186405 - protein, 39 aa, Artificial Sequence
  Description of Artificial Sequence: Synthetic polypeptide
DEAEIRTTNPVATEQYGESYVSCSGIMLEELNNGNEEVF

SEQ ID NO: 186406 - protein, 37 aa, Artificial Sequence
  Description of Artificial Sequence: Synthetic polypeptide
DEEAICTVNPVATEAYGVVSTNPNQQQGNQQGNNNQE

SEQ ID NO: 186407 - protein, 37 aa, Artificial Sequence
  Description of Artificial Sequence: Synthetic polypeptide
DEEAICTVNPVATEAYGVVSTVNNQQQGNQQGNNNQQ

SEQ ID NO: 186408 - protein, 36 aa, Artificial Sequence
  Description of Artificial Sequence: Synthetic polypeptide
DQEEISCTNPVAYEQWGHKTVVCTNALSGRPGPNDV

SEQ ID NO: 186409 - protein, 35 aa, Artificial Sequence
  Description of Artificial Sequence: Synthetic polypeptide
DEAEIRTTNPVATEQYGDIWNNYHEFSNPSEEYQI

SEQ ID NO: 186410 - protein, 35 aa, Artificial Sequence
  Description of Artificial Sequence: Synthetic polypeptide
CEEEISTTNPVATEQYGCAVCGWGEHNQNFNSDQS

SEQ ID NO: 186411 - protein, 37 aa, Artificial Sequence
  Description of Artificial Sequence: Synthetic polypeptide
DQEEISTTNPVATEQYGCVYYTTWSAMTNEKGNEDFQ

SEQ ID NO: 186412 - protein, 38 aa, Artificial Sequence
  Description of Artificial Sequence: Synthetic polypeptide
DEEEIRTTNPVATEQYGSVTPIPPVLEAEVMPGDVHSV

SEQ ID NO: 186413 - protein, 37 aa, Artificial Sequence
  Description of Artificial Sequence: Synthetic polypeptide
DEEEIRTTNPVATEQYGSVTPLPPVLEAVMPEEVHSV

SEQ ID NO: 186414 - protein, 35 aa, Artificial Sequence
  Description of Artificial Sequence: Synthetic polypeptide
DQQEIATTNPVATEQWGSVSAVGDLEADTPGGEDF

SEQ ID NO: 186415 - protein, 38 aa, Artificial Sequence
  Description of Artificial Sequence: Synthetic polypeptide
DEEEIRTTNPVATEQYGSVTPQPPVLEVAVMPGDVHSV

SEQ ID NO: 186416 - protein, 38 aa, Artificial Sequence
  Description of Artificial Sequence: Synthetic polypeptide
DENEIRTTNPVATEQYGDVNGQDTNMGDNIVEGGNEQT

SEQ ID NO: 186417 - protein, 38 aa, Artificial Sequence
  Description of Artificial Sequence: Synthetic polypeptide
DENEIRTTNPVATEQYGDVIMSSDNGDEQNEGGGEQGT

SEQ ID NO: 186418 - protein, 38 aa, Artificial Sequence
  Description of Artificial Sequence: Synthetic polypeptide
DENEIRTTNPVATEQYGDVIMSSDNGDEQGEGAGEEGT

SEQ ID NO: 186419 - protein, 38 aa, Artificial Sequence
  Description of Artificial Sequence: Synthetic polypeptide
DENEIRTTNPVATEQYGDVIMSSDNGDEQGEEGGEGTT

SEQ ID NO: 186420 - protein, 36 aa, Artificial Sequence
  Description of Artificial Sequence: Synthetic polypeptide
DEAEIRTTNPVATEQYGCWYNEVNHTSVQDSVEEQN

SEQ ID NO: 186421 - protein, 36 aa, Artificial Sequence
  Description of Artificial Sequence: Synthetic polypeptide
DEAEIRTTNPVATEQYGCWYNAVPNHLTQDSAEEQN

SEQ ID NO: 186422 - protein, 36 aa, Artificial Sequence
  Description of Artificial Sequence: Synthetic polypeptide
DEAEIRTTNPVATEQYGCWYNAVPEILVQDSAEEQN

SEQ ID NO: 186423 - protein, 38 aa, Artificial Sequence
  Description of Artificial Sequence: Synthetic polypeptide
DENEIRTTNPVATEQYGCVYSTSPNEPAMASFDENQFE

SEQ ID NO: 186424 - protein, 37 aa, Artificial Sequence
  Description of Artificial Sequence: Synthetic polypeptide
DENEIRTTNPVATEQYGCVYDTDAENGSDGTPESQVE

SEQ ID NO: 186425 - protein, 36 aa, Artificial Sequence
  Description of Artificial Sequence: Synthetic polypeptide
DENEIRTTNPVATEQYGCVVTDAENGSVETEESQPE

SEQ ID NO: 186426 - protein, 38 aa, Artificial Sequence
  Description of Artificial Sequence: Synthetic polypeptide
DEAEIRTTNPVATEQYGGVTWSPVNWLENPNTSFEVGN

SEQ ID NO: 186427 - protein, 38 aa, Artificial Sequence
  Description of Artificial Sequence: Synthetic polypeptide
DEAEIRTTNPVATEQYGHSWNNVREEERSDTSTQESMF

SEQ ID NO: 186428 - protein, 35 aa, Artificial Sequence
  Description of Artificial Sequence: Synthetic polypeptide
DEAEIRTTNPVATEQYGHVNNVPEPEDMAHGIEHM

SEQ ID NO: 186429 - protein, 38 aa, Artificial Sequence
  Description of Artificial Sequence: Synthetic polypeptide
DEEEIRTTNPVATEQYGSVTLAHATTDQQSMIVFEQSE

SEQ ID NO: 186430 - protein, 36 aa, Artificial Sequence
  Description of Artificial Sequence: Synthetic polypeptide
DENEIRTTNPVATEQYGQVDTDRENGSDETEESQVE

SEQ ID NO: 186431 - protein, 40 aa, Artificial Sequence
  Description of Artificial Sequence: Synthetic polypeptide
DENEIRTTNPVATEQYGQASCPCVASVNLLQEVVVQEDRN

SEQ ID NO: 186432 - protein, 36 aa, Artificial Sequence
  Description of Artificial Sequence: Synthetic polypeptide
DQEEIGTTNPVATEQYGCVYTTWSAMTNEKNNEEFQ

SEQ ID NO: 186433 - protein, 36 aa, Artificial Sequence
  Description of Artificial Sequence: Synthetic polypeptide
DEDELSTTNPVATEQYGSVFVWINQEQQRKQQQDSH

SEQ ID NO: 186434 - protein, 35 aa, Artificial Sequence
  Description of Artificial Sequence: Synthetic polypeptide
DEDENATTNPVAYERWGSVSGGNADDSRNNGNGNE

SEQ ID NO: 186435 - protein, 38 aa, Artificial Sequence
  Description of Artificial Sequence: Synthetic polypeptide
DQEEIRTTNPVATCQYGCVCSNTGEGDNAENFGSDNQS

SEQ ID NO: 186436 - protein, 38 aa, Artificial Sequence
  Description of Artificial Sequence: Synthetic polypeptide
DEAEIRTTNPVATEQYGLTVSYSGIMLEELMNGNEEVF

SEQ ID NO: 186437 - protein, 37 aa, Artificial Sequence
  Description of Artificial Sequence: Synthetic polypeptide
DQEEIRTTNPVATCQYGCVCSTGEGDNQENFFSDNQS

SEQ ID NO: 186438 - protein, 37 aa, Artificial Sequence
  Description of Artificial Sequence: Synthetic polypeptide
DQEEIRTTNPVATCQYGCVCSTGEGHNQENFISDNQA

SEQ ID NO: 186439 - protein, 38 aa, Artificial Sequence
  Description of Artificial Sequence: Synthetic polypeptide
DENEIRTTNPVATEQYGMTVTTVWLPHDEGENLQIDEI

SEQ ID NO: 186440 - protein, 33 aa, Artificial Sequence
  Description of Artificial Sequence: Synthetic polypeptide
DEEAAATTNPVAYEPWGTCATDGGDHQRGSNMS

SEQ ID NO: 186441 - protein, 39 aa, Artificial Sequence
  Description of Artificial Sequence: Synthetic polypeptide
DREGVEIRTTNPVATEQYGQQLVPAMNELSQNNTVTNNR

SEQ ID NO: 186442 - protein, 37 aa, Artificial Sequence
  Description of Artificial Sequence: Synthetic polypeptide
DEEAEIATTNPVAYECWGSVATGNGPLNDDRQQNGTD

SEQ ID NO: 186443 - protein, 37 aa, Artificial Sequence
  Description of Artificial Sequence: Synthetic polypeptide
DQEEIRTTNPVATEQYGYVYQGSSEFEEEPVGEMNQG

SEQ ID NO: 186444 - protein, 36 aa, Artificial Sequence
  Description of Artificial Sequence: Synthetic polypeptide
DEEAEIATTNPVAYERWGVVYTTNGNQGEEVGNGDA

SEQ ID NO: 186445 - protein, 36 aa, Artificial Sequence
  Description of Artificial Sequence: Synthetic polypeptide
DEAEIRTTNPVATEQYGHYYCNVSEENRSDTSDEMF

SEQ ID NO: 186446 - protein, 36 aa, Artificial Sequence
  Description of Artificial Sequence: Synthetic polypeptide
DENEIRTTNPVATEQYGDVVVMNGFNGEGGFDESTD

SEQ ID NO: 186447 - protein, 37 aa, Artificial Sequence
  Description of Artificial Sequence: Synthetic polypeptide
DENEIRTTNPVATEQYGDVVVDDFNFGQGEGDDEAET

SEQ ID NO: 186448 - protein, 35 aa, Artificial Sequence
  Description of Artificial Sequence: Synthetic polypeptide
DEEAEIRTTNPVAYESWGVVSGGNAGNADNGGGTD

SEQ ID NO: 186449 - protein, 34 aa, Artificial Sequence
  Description of Artificial Sequence: Synthetic polypeptide
DEEAIATTNPVAYEEWGQCCTTDGGDHQRGSNTT

SEQ ID NO: 186450 - protein, 34 aa, Artificial Sequence
  Description of Artificial Sequence: Synthetic polypeptide
DEEAIATTNPVAYEQWGAYWSLDNDLRKPKVDRG

SEQ ID NO: 186451 - protein, 35 aa, Artificial Sequence
  Description of Artificial Sequence: Synthetic polypeptide
DEEAIATTNPVAYERWGQATTNGGDHQGRGDNKHI

SEQ ID NO: 186452 - protein, 34 aa, Artificial Sequence
  Description of Artificial Sequence: Synthetic polypeptide
DEEAIATTNPVAYERWGQATTNGGDHQNGDNKHE

SEQ ID NO: 186453 - protein, 37 aa, Artificial Sequence
  Description of Artificial Sequence: Synthetic polypeptide
DEAEIRTTNPVATEQYGHVNNVPEPLDQAEIGIEQHQ

SEQ ID NO: 186454 - protein, 37 aa, Artificial Sequence
  Description of Artificial Sequence: Synthetic polypeptide
DENEIRTTNPVATEQYGHTVTTVWLPDEQESLQIDEI

SEQ ID NO: 186455 - protein, 36 aa, Artificial Sequence
  Description of Artificial Sequence: Synthetic polypeptide
DENEIRTTNPVATEQYGCLCWVADVDVEVLEPGEDL

SEQ ID NO: 186456 - protein, 37 aa, Artificial Sequence
  Description of Artificial Sequence: Synthetic polypeptide
DENEIRTTNPVATEQYGCVTDTDAYNGSLGTEESQVE

SEQ ID NO: 186457 - protein, 35 aa, Artificial Sequence
  Description of Artificial Sequence: Synthetic polypeptide
DEEAIRTTNPVATEQWGCVCGWGEHNQHFNSDTQA

SEQ ID NO: 186458 - protein, 37 aa, Artificial Sequence
  Description of Artificial Sequence: Synthetic polypeptide
DENEIRTTNPVATEQYGCVDTDAENGSDETMNMSQVE

SEQ ID NO: 186459 - protein, 36 aa, Artificial Sequence
  Description of Artificial Sequence: Synthetic polypeptide
DENEIRTTNPVATEQYGCVDTDAENGSAETEESQME

SEQ ID NO: 186460 - protein, 36 aa, Artificial Sequence
  Description of Artificial Sequence: Synthetic polypeptide
DENEIRTTNPVATEQYGCVDTDAENGMVETEDPQVE

SEQ ID NO: 186461 - protein, 37 aa, Artificial Sequence
  Description of Artificial Sequence: Synthetic polypeptide
DEEAIRTTNPVATEQYGQCVCSNWGEHNQENFGSDQS

SEQ ID NO: 186462 - protein, 36 aa, Artificial Sequence
  Description of Artificial Sequence: Synthetic polypeptide
DENEIRTTNPVATEQYGCVDTDAANGSVHTEESQVE

SEQ ID NO: 186463 - protein, 38 aa, Artificial Sequence
  Description of Artificial Sequence: Synthetic polypeptide
DEEAIRTTNPVATEQYGQCVCSTWGEHNQENFNSDTQA

SEQ ID NO: 186464 - protein, 37 aa, Artificial Sequence
  Description of Artificial Sequence: Synthetic polypeptide
DEEAIRTTNPVATEQYGQCVCSWEEHNIENFNSDTQA

SEQ ID NO: 186465 - protein, 37 aa, Artificial Sequence
  Description of Artificial Sequence: Synthetic polypeptide
DENEIRTTNPVATEQYGCVDTDAANGSEETQEESQVE

SEQ ID NO: 186466 - protein, 36 aa, Artificial Sequence
  Description of Artificial Sequence: Synthetic polypeptide
DENEIRTTNPVATEQYGCVDTDAANGSDETEESEIE

SEQ ID NO: 186467 - protein, 36 aa, Artificial Sequence
  Description of Artificial Sequence: Synthetic polypeptide
DENEIRTTNPVATEQYGCVDNDAENGSLGTEESQVS

SEQ ID NO: 186468 - protein, 37 aa, Artificial Sequence
  Description of Artificial Sequence: Synthetic polypeptide
CEEEISTTNPVATEQYGCVCSNTEDDNQENFNSDTQA

SEQ ID NO: 186469 - protein, 36 aa, Artificial Sequence
  Description of Artificial Sequence: Synthetic polypeptide
DEAEIRTTNPVATEQYGCWYNAVNALNVQDSVEEQN

SEQ ID NO: 186470 - protein, 36 aa, Artificial Sequence
  Description of Artificial Sequence: Synthetic polypeptide
DEAEIRTTNPVATEQYGCWYNAVKHSSVLDSAEEQN

SEQ ID NO: 186471 - protein, 37 aa, Artificial Sequence
  Description of Artificial Sequence: Synthetic polypeptide
DENEIRTTNPVATEQYGCVCSNWGEHNQESFNSDNQS

SEQ ID NO: 186472 - protein, 37 aa, Artificial Sequence
  Description of Artificial Sequence: Synthetic polypeptide
DSEEIGTTNPVATEAYGSTVCIGQPEPSTNPGGNNVK

SEQ ID NO: 186473 - protein, 37 aa, Artificial Sequence
  Description of Artificial Sequence: Synthetic polypeptide
DSEEIGTTNPVATEAYGSTVCILQHESSTNPGGNQVK

SEQ ID NO: 186474 - protein, 37 aa, Artificial Sequence
  Description of Artificial Sequence: Synthetic polypeptide
DSEEIGTTNPVATEAYGSTVCPGQHEPSTNMGGNQVK

SEQ ID NO: 186475 - protein, 37 aa, Artificial Sequence
  Description of Artificial Sequence: Synthetic polypeptide
DSEEIGTTNPVATEAYGSTVCWDQPEPSTNPGGNQDK

SEQ ID NO: 186476 - protein, 36 aa, Artificial Sequence
  Description of Artificial Sequence: Synthetic polypeptide
DSEEIGTTNPVATEQYGKVVHCANAPSHPRVTHNAH

SEQ ID NO: 186477 - protein, 37 aa, Artificial Sequence
  Description of Artificial Sequence: Synthetic polypeptide
DSEEINTTNPVATEAYGSTVCICQPEYSTNPGGNQVK

SEQ ID NO: 186478 - protein, 38 aa, Artificial Sequence
  Description of Artificial Sequence: Synthetic polypeptide
DENEIRTTNPVATEQYGCVCSESPNELAMASFDENQFG

SEQ ID NO: 186479 - protein, 37 aa, Artificial Sequence
  Description of Artificial Sequence: Synthetic polypeptide
DENEIRTTNPVATEQYGCVCQNSGEHNAENFNSENQS

SEQ ID NO: 186480 - protein, 38 aa, Artificial Sequence
  Description of Artificial Sequence: Synthetic polypeptide
DENEIRTTNPVATEQYGCSCSTYCSDEIWINESNEDRD

SEQ ID NO: 186481 - protein, 37 aa, Artificial Sequence
  Description of Artificial Sequence: Synthetic polypeptide
DEEAIRTTNPVATEQYGQCVCSNWGEAHNQNFNSEQS

SEQ ID NO: 186482 - protein, 38 aa, Artificial Sequence
  Description of Artificial Sequence: Synthetic polypeptide
DEEAIRTTNPVATEQYGQCVCSNWEEHNQENGNSDTQS

SEQ ID NO: 186483 - protein, 36 aa, Artificial Sequence
  Description of Artificial Sequence: Synthetic polypeptide
DEEAIRTTNPVATEQYGQCVCSNWEEHANFGSDFQS

SEQ ID NO: 186484 - protein, 36 aa, Artificial Sequence
  Description of Artificial Sequence: Synthetic polypeptide
DEEAIRTTNPVATEQYGCYSYHIIDHQVGGMQEHEQ

SEQ ID NO: 186485 - protein, 37 aa, Artificial Sequence
  Description of Artificial Sequence: Synthetic polypeptide
CEEEISTTNPVATEQYGCVCSMWGEHNAENFGSDNQS

SEQ ID NO: 186486 - protein, 36 aa, Artificial Sequence
  Description of Artificial Sequence: Synthetic polypeptide
DEAEIRTTNPVATEQYGCWYNAVPDHLVQDSLEEQN

SEQ ID NO: 186487 - protein, 36 aa, Artificial Sequence
  Description of Artificial Sequence: Synthetic polypeptide
DEAEIRTTNPVATEQYGCWYNAVNHLSVQDSLEEMN

SEQ ID NO: 186488 - protein, 35 aa, Artificial Sequence
  Description of Artificial Sequence: Synthetic polypeptide
CEEEISTTNPVATEQYGCVCSNSGEHAENFGSDQA

SEQ ID NO: 186489 - protein, 35 aa, Artificial Sequence
  Description of Artificial Sequence: Synthetic polypeptide
DEEAIRTTNPVATEQYGCAIWIIDHHVGGMQEGEQ

SEQ ID NO: 186490 - protein, 36 aa, Artificial Sequence
  Description of Artificial Sequence: Synthetic polypeptide
DEEAIRTTNPVATEQYGCASYHIIDHHVGGMQEGGQ

SEQ ID NO: 186491 - protein, 36 aa, Artificial Sequence
  Description of Artificial Sequence: Synthetic polypeptide
DENEIRTTNPVATEQYGCVRTDENGSVETDEESQVE

SEQ ID NO: 186492 - protein, 37 aa, Artificial Sequence
  Description of Artificial Sequence: Synthetic polypeptide
DEEAIRTTNPVATEQYGCVCSNWEEDHNQENFNSQQE

SEQ ID NO: 186493 - protein, 36 aa, Artificial Sequence
  Description of Artificial Sequence: Synthetic polypeptide
DEEAIRTTNPVATEQYGCVCSNWEEHAENFNSDFQS

SEQ ID NO: 186494 - protein, 37 aa, Artificial Sequence
  Description of Artificial Sequence: Synthetic polypeptide
DEEAIRTTNPVATEQYGCVCSNWEEHNQENFGSDFQP

SEQ ID NO: 186495 - protein, 36 aa, Artificial Sequence
  Description of Artificial Sequence: Synthetic polypeptide
DENEIRTTNPVATEQYGCVISPDYDEWIDEIEGSQK

SEQ ID NO: 186496 - protein, 36 aa, Artificial Sequence
  Description of Artificial Sequence: Synthetic polypeptide
CEEEISTTNPVATEQYGCVCPNWGEHNEEGFNSDQA

SEQ ID NO: 186497 - protein, 36 aa, Artificial Sequence
  Description of Artificial Sequence: Synthetic polypeptide
DENEIRTTNPVATEQYGCVIICPQLMIEDSESSQRE

SEQ ID NO: 186498 - protein, 36 aa, Artificial Sequence
  Description of Artificial Sequence: Synthetic polypeptide
DENEIRTTNPVATEQYGCVDVDENGSVETTEGSQVE

SEQ ID NO: 186499 - protein, 37 aa, Artificial Sequence
  Description of Artificial Sequence: Synthetic polypeptide
DEEAIRTTNPVATEQYGCVCSWEEDHNIENFNSDFQS

SEQ ID NO: 186500 - protein, 37 aa, Artificial Sequence
  Description of Artificial Sequence: Synthetic polypeptide
DENEIRTTNPVATEQYGCVDTLAENGSVETLEESQVE

SEQ ID NO: 186501 - protein, 33 aa, Artificial Sequence
  Description of Artificial Sequence: Synthetic polypeptide
DSEDIATTNPVATAQWGGCVATADNHGPDSNGN

SEQ ID NO: 186502 - protein, 36 aa, Artificial Sequence
  Description of Artificial Sequence: Synthetic polypeptide
DENEIRTTNPVATEQYGCVDTEAENGSDATEESQVE

SEQ ID NO: 186503 - protein, 36 aa, Artificial Sequence
  Description of Artificial Sequence: Synthetic polypeptide
DENEIRTTNPVATEQYGCVDTDKENGSDETEESEVE

SEQ ID NO: 186504 - protein, 32 aa, Artificial Sequence
  Description of Artificial Sequence: Synthetic polypeptide
DSEDIATTNPVATEQWGCVAGEGHQTPAVIGL

SEQ ID NO: 186505 - protein, 32 aa, Artificial Sequence
  Description of Artificial Sequence: Synthetic polypeptide
DSEDIATTNPVATEQWGGCCAGEGHQPAVGLN

SEQ ID NO: 186506 - protein, 36 aa, Artificial Sequence
  Description of Artificial Sequence: Synthetic polypeptide
DENEIRTTNPVATEQYGCVDTDAENVSDETEETQVE

SEQ ID NO: 186507 - protein, 36 aa, Artificial Sequence
  Description of Artificial Sequence: Synthetic polypeptide
DENEIRTTNPVATEQYGCVDTDAENGSVEHEESQDE

SEQ ID NO: 186508 - protein, 37 aa, Artificial Sequence
  Description of Artificial Sequence: Synthetic polypeptide
DENEIRTTNPVATEQYGCVDTDAENGSLGTMEESQVE

SEQ ID NO: 186509 - protein, 36 aa, Artificial Sequence
  Description of Artificial Sequence: Synthetic polypeptide
DENEIRTTNPVATEQYGCVDYDAENGSDGTEFSQVE

SEQ ID NO: 186510 - protein, 39 aa, Artificial Sequence
  Description of Artificial Sequence: Synthetic polypeptide
DENEIRTTNPVATEQYGVVSVVDNTNMNGQNDDGGGEGT

SEQ ID NO: 186511 - protein, 38 aa, Artificial Sequence
  Description of Artificial Sequence: Synthetic polypeptide
FEEEIRTTNPVATEGYGSVVMNFDDNNDQTGGEGNEEE

SEQ ID NO: 186512 - protein, 38 aa, Artificial Sequence
  Description of Artificial Sequence: Synthetic polypeptide
FEEEIRTTNPVATEIYGSVYGTAIDNGEEDQGDQTGDG

SEQ ID NO: 186513 - protein, 38 aa, Artificial Sequence
  Description of Artificial Sequence: Synthetic polypeptide
MTEEIRTTNPVATEQYGSVCVKSVDGWTDEHPQECNID

SEQ ID NO: 186514 - protein, 36 aa, Artificial Sequence
  Description of Artificial Sequence: Synthetic polypeptide
DEEEIACTNPVATEQWGSVSCAGENPQPADSMISDA

SEQ ID NO: 186515 - protein, 36 aa, Artificial Sequence
  Description of Artificial Sequence: Synthetic polypeptide
DEEEIACTNPVATEQWGSVSGEGGPGGINHDDNLAG

SEQ ID NO: 186516 - protein, 36 aa, Artificial Sequence
  Description of Artificial Sequence: Synthetic polypeptide
DEEEIACTNPVATEQWGSVSGEGGPLGINHDDFMAH

SEQ ID NO: 186517 - protein, 36 aa, Artificial Sequence
  Description of Artificial Sequence: Synthetic polypeptide
DEEEIACTNPVATEQWGSVSGEGGPLGINHDDMSAE

SEQ ID NO: 186518 - protein, 36 aa, Artificial Sequence
  Description of Artificial Sequence: Synthetic polypeptide
DEEEIACTNPVATEQWGSVSGEGGPLGINHDDNSDI

SEQ ID NO: 186519 - protein, 36 aa, Artificial Sequence
  Description of Artificial Sequence: Synthetic polypeptide
CEGTIRTTNPVATDAYGSVMGSMMLNLDGIGGFNDN

SEQ ID NO: 186520 - protein, 37 aa, Artificial Sequence
  Description of Artificial Sequence: Synthetic polypeptide
DEEEIACTNPVATEQWGSVSGEGGPLGINHQDDNMAA

SEQ ID NO: 186521 - protein, 36 aa, Artificial Sequence
  Description of Artificial Sequence: Synthetic polypeptide
DEEEIACTNPVATEQWGSVSGEGGPPGINHDDNVAN

SEQ ID NO: 186522 - protein, 36 aa, Artificial Sequence
  Description of Artificial Sequence: Synthetic polypeptide
DEEEIACTNPVATEQWGSVSGQGPGPQETPDGQTHN

SEQ ID NO: 186523 - protein, 36 aa, Artificial Sequence
  Description of Artificial Sequence: Synthetic polypeptide
NDEEIRTTNPVATEQYGVVCSMWEEHNQENFGSDQS

SEQ ID NO: 186524 - protein, 36 aa, Artificial Sequence
  Description of Artificial Sequence: Synthetic polypeptide
DENEIATTNPVATEQYGSVCVADGPLGDPEMENMLN

SEQ ID NO: 186525 - protein, 37 aa, Artificial Sequence
  Description of Artificial Sequence: Synthetic polypeptide
DENEIATTNPVATEQYGSVCSPMPNQNNEAMIGDGDN

SEQ ID NO: 186526 - protein, 36 aa, Artificial Sequence
  Description of Artificial Sequence: Synthetic polypeptide
NDEEISTTNPVATEQYGCVCSNWGELNQNFGSDTQS

SEQ ID NO: 186527 - protein, 37 aa, Artificial Sequence
  Description of Artificial Sequence: Synthetic polypeptide
DENEIATTNPVATEQYGSVCSADNPPGNAHQGDIEAM

SEQ ID NO: 186528 - protein, 36 aa, Artificial Sequence
  Description of Artificial Sequence: Synthetic polypeptide
NEAEIATTNPCATEQYGCVAWTDNGEQDGQGGNNDA

SEQ ID NO: 186529 - protein, 33 aa, Artificial Sequence
  Description of Artificial Sequence: Synthetic polypeptide
NEAEIATTNPCAYEHWGSVCYNNDDQVHGQNDH

SEQ ID NO: 186530 - protein, 37 aa, Artificial Sequence
  Description of Artificial Sequence: Synthetic polypeptide
DEEEIACTNPVATEQYGCACASTNPQENTADPMEGVM

SEQ ID NO: 186531 - protein, 35 aa, Artificial Sequence
  Description of Artificial Sequence: Synthetic polypeptide
NEAEIATTNPVATESWGSVCFTNEDHQDQMGMGEM

SEQ ID NO: 186532 - protein, 33 aa, Artificial Sequence
  Description of Artificial Sequence: Synthetic polypeptide
NEAEIATTNPVAYEQWGAVYCTEEQDGGQDQLL

SEQ ID NO: 186533 - protein, 33 aa, Artificial Sequence
  Description of Artificial Sequence: Synthetic polypeptide
NEAEIATTNPVAYEQWGCVPTDGNDTNHGGMPQ

SEQ ID NO: 186534 - protein, 31 aa, Artificial Sequence
  Description of Artificial Sequence: Synthetic polypeptide
NEAEIATTNPVAYEQWGEAYYVERQPEEEGR

SEQ ID NO: 186535 - protein, 36 aa, Artificial Sequence
  Description of Artificial Sequence: Synthetic polypeptide
NEAEIATTNPVAYEQWGSVCLQNNNGLDNVQEGGAR

SEQ ID NO: 186536 - protein, 38 aa, Artificial Sequence
  Description of Artificial Sequence: Synthetic polypeptide
MTEEIRTTNPVATEQYGSVCPKSVDGWTDEHPNEENGN

SEQ ID NO: 186537 - protein, 37 aa, Artificial Sequence
  Description of Artificial Sequence: Synthetic polypeptide
DENEIATTNPVATEQYGSVCAQVPHGPLDSMIGNDEH

SEQ ID NO: 186538 - protein, 35 aa, Artificial Sequence
  Description of Artificial Sequence: Synthetic polypeptide
MSGEIRTTNPVATEQYGCTSWMEIVTDERFEDNRE

SEQ ID NO: 186539 - protein, 35 aa, Artificial Sequence
  Description of Artificial Sequence: Synthetic polypeptide
MQGEIRTTNPVATEQYGCTATEEIVTDEQFEDNRE

SEQ ID NO: 186540 - protein, 37 aa, Artificial Sequence
  Description of Artificial Sequence: Synthetic polypeptide
CEGEIATTNPVATEQYGSVCAGMTHGGAEAPIGDNRG

SEQ ID NO: 186541 - protein, 37 aa, Artificial Sequence
  Description of Artificial Sequence: Synthetic polypeptide
MESEIRTTNPVATEQYGAPKMTVQSMADENLNGNESQ

SEQ ID NO: 186542 - protein, 37 aa, Artificial Sequence
  Description of Artificial Sequence: Synthetic polypeptide
MESEIRTTNPVATEQYGAVCSETNENLMEIEEIMAEP

SEQ ID NO: 186543 - protein, 34 aa, Artificial Sequence
  Description of Artificial Sequence: Synthetic polypeptide
DEEEIACTNPVATEQWGCVAGTNSHAEADMDIEN

SEQ ID NO: 186544 - protein, 36 aa, Artificial Sequence
  Description of Artificial Sequence: Synthetic polypeptide
MESEIRTTNPVATEQYGCCVATGVPNNDIHGGGLMD

SEQ ID NO: 186545 - protein, 37 aa, Artificial Sequence
  Description of Artificial Sequence: Synthetic polypeptide
CEGEIATTNPVATEQYGSVSPTGEAGINPDDGMEKVH

SEQ ID NO: 186546 - protein, 36 aa, Artificial Sequence
  Description of Artificial Sequence: Synthetic polypeptide
MESEIRTTNPVATEQYGQVAPNTDAEPQPILQEEPQ

SEQ ID NO: 186547 - protein, 37 aa, Artificial Sequence
  Description of Artificial Sequence: Synthetic polypeptide
MESEIRTTNPVATEQYGSSYMPVDNEVNQEIGSNQAE

SEQ ID NO: 186548 - protein, 37 aa, Artificial Sequence
  Description of Artificial Sequence: Synthetic polypeptide
MESEIRTTNPVATEQYGSVRVVTYALPETNEISPQTV

SEQ ID NO: 186549 - protein, 37 aa, Artificial Sequence
  Description of Artificial Sequence: Synthetic polypeptide
DEEEIACTNPVATEQWGCVVAMTNDLTNPDDGMGDRH

SEQ ID NO: 186550 - protein, 35 aa, Artificial Sequence
  Description of Artificial Sequence: Synthetic polypeptide
DEEEIACTNPVATEQWGCWNAATGNPLPAPMENHN

SEQ ID NO: 186551 - protein, 35 aa, Artificial Sequence
  Description of Artificial Sequence: Synthetic polypeptide
DEEEIACTNPVATEQWGCWNATIEPNQAPMEGNND

SEQ ID NO: 186552 - protein, 36 aa, Artificial Sequence
  Description of Artificial Sequence: Synthetic polypeptide
DEEEIACTNPVATEQWGCWNAVTIEPLQAPMEEGNN

SEQ ID NO: 186553 - protein, 35 aa, Artificial Sequence
  Description of Artificial Sequence: Synthetic polypeptide
DEEEIACTNPVATEQWGHSASLAGMGQAEDPLENQ

SEQ ID NO: 186554 - protein, 36 aa, Artificial Sequence
  Description of Artificial Sequence: Synthetic polypeptide
MESEIRTTNPVATEQYGSVSWCGVAEIPFSHQVAET

SEQ ID NO: 186555 - protein, 36 aa, Artificial Sequence
  Description of Artificial Sequence: Synthetic polypeptide
CEGEIATTNPVAYEQYGSCSTGPALGQNHQDGMEGN

SEQ ID NO: 186556 - protein, 37 aa, Artificial Sequence
  Description of Artificial Sequence: Synthetic polypeptide
MESEIRTTNPVATESYGSVVSDGMEGITNGEGDQIGD

SEQ ID NO: 186557 - protein, 36 aa, Artificial Sequence
  Description of Artificial Sequence: Synthetic polypeptide
CEGEIATTNPVAYEQYGSVAAITNGEEAPDNQEGRM

SEQ ID NO: 186558 - protein, 36 aa, Artificial Sequence
  Description of Artificial Sequence: Synthetic polypeptide
CEGEIRATNPVATDQYGVVTMQDGDNGQRFNDRGQA

SEQ ID NO: 186559 - protein, 38 aa, Artificial Sequence
  Description of Artificial Sequence: Synthetic polypeptide
DEEEIACTNPVATEQWGHVSNANTGALPENQGGGINQM

SEQ ID NO: 186560 - protein, 35 aa, Artificial Sequence
  Description of Artificial Sequence: Synthetic polypeptide
METEIRTTNPVAFEEYGSVIDGNNNGQERNQTEGD

SEQ ID NO: 186561 - protein, 35 aa, Artificial Sequence
  Description of Artificial Sequence: Synthetic polypeptide
METEIRTTNPVATESYGSVVDLQAGGEEEGGQGEI

SEQ ID NO: 186562 - protein, 34 aa, Artificial Sequence
  Description of Artificial Sequence: Synthetic polypeptide
MEYEIATTNPVATEQYGAVAGPEVGQGEGEGEEN

SEQ ID NO: 186563 - protein, 35 aa, Artificial Sequence
  Description of Artificial Sequence: Synthetic polypeptide
MSGEIRTTNPVATEQYGCTSTEEIVTDEEFEDNRE

SEQ ID NO: 186564 - protein, 36 aa, Artificial Sequence
  Description of Artificial Sequence: Synthetic polypeptide
DEAEIRCTNPVATEQYGCVCSWGEHNIEHFGSDTQS

SEQ ID NO: 186565 - protein, 35 aa, Artificial Sequence
  Description of Artificial Sequence: Synthetic polypeptide
NEAEIATTNPVAYEQWGVVAWTEAGDLDRQGMNEL

SEQ ID NO: 186566 - protein, 37 aa, Artificial Sequence
  Description of Artificial Sequence: Synthetic polypeptide
NEAEICCTNPVAYEQYGHVVQSTCLNEQVDRGGNNVE

SEQ ID NO: 186567 - protein, 38 aa, Artificial Sequence
  Description of Artificial Sequence: Synthetic polypeptide
DEAEIRATNPVATEQYGSVCYSDWNNLQDELQSDTQQS

SEQ ID NO: 186568 - protein, 34 aa, Artificial Sequence
  Description of Artificial Sequence: Synthetic polypeptide
NEDEIRTTNPVAYEHWGCFSWINDLVDRQGQQHQ

SEQ ID NO: 186569 - protein, 37 aa, Artificial Sequence
  Description of Artificial Sequence: Synthetic polypeptide
NEEAEICTTNPVAYECWGSVATGNGPLNDDRGQNGTD

SEQ ID NO: 186570 - protein, 36 aa, Artificial Sequence
  Description of Artificial Sequence: Synthetic polypeptide
DENEIATTNPVATEQYGSACAATMTGQNEMGPEGDA

SEQ ID NO: 186571 - protein, 36 aa, Artificial Sequence
  Description of Artificial Sequence: Synthetic polypeptide
DEEEIACTNPVATEQYGSACAAANPGAEAEMGNGNF

SEQ ID NO: 186572 - protein, 36 aa, Artificial Sequence
  Description of Artificial Sequence: Synthetic polypeptide
NEECIATTNPCATECYGVVCYKTNDEAQRQGGDMDR

SEQ ID NO: 186573 - protein, 36 aa, Artificial Sequence
  Description of Artificial Sequence: Synthetic polypeptide
DEEEIACTNPVATEQYGSACAAAPHLAEAPMGETNN

SEQ ID NO: 186574 - protein, 36 aa, Artificial Sequence
  Description of Artificial Sequence: Synthetic polypeptide
NEECIRTTNPVAYEQWGYYWSDQNDDLQRQTDRRGD

SEQ ID NO: 186575 - protein, 38 aa, Artificial Sequence
  Description of Artificial Sequence: Synthetic polypeptide
DEAEIRATNPVATEMYGSVCSEMAIELEQTTGNNEEEG

SEQ ID NO: 186576 - protein, 35 aa, Artificial Sequence
  Description of Artificial Sequence: Synthetic polypeptide
NEEEIACTNPVATEQWGGCPSAATHLQPDSQGQEM

SEQ ID NO: 186577 - protein, 36 aa, Artificial Sequence
  Description of Artificial Sequence: Synthetic polypeptide
DEEEIACTNPVATEQYGSACAANPAEADAEIGNDDQ

SEQ ID NO: 186578 - protein, 35 aa, Artificial Sequence
  Description of Artificial Sequence: Synthetic polypeptide
DEEEIACTNPVATEQYGSACAANPAEGQHQDDFMW

SEQ ID NO: 186579 - protein, 36 aa, Artificial Sequence
  Description of Artificial Sequence: Synthetic polypeptide
DEEEIACTNPVATEQYGSACAANPDTEGAHGDNDAP

SEQ ID NO: 186580 - protein, 38 aa, Artificial Sequence
  Description of Artificial Sequence: Synthetic polypeptide
DENEIATTNPVATEQYGCVCAMNNGELTNPDDGMENRM

SEQ ID NO: 186581 - protein, 37 aa, Artificial Sequence
  Description of Artificial Sequence: Synthetic polypeptide
DENEIATTNPVATEQYGCVAGTPGQSTGPDDQMEGMD

SEQ ID NO: 186582 - protein, 36 aa, Artificial Sequence
  Description of Artificial Sequence: Synthetic polypeptide
DENEIATTNPVATEQYGCVAGNNGLTGADAGEEGHW

SEQ ID NO: 186583 - protein, 36 aa, Artificial Sequence
  Description of Artificial Sequence: Synthetic polypeptide
DEEEIACTNPVATEQYGSACAAPHLEAEAPMGEMNN

SEQ ID NO: 186584 - protein, 36 aa, Artificial Sequence
  Description of Artificial Sequence: Synthetic polypeptide
DENEIATTNPVATEQYGCVAATSGLPPAEAEPGTHH

SEQ ID NO: 186585 - protein, 37 aa, Artificial Sequence
  Description of Artificial Sequence: Synthetic polypeptide
DEEEIACTNPVATEQYGSACAATNGEEAPDEQMEGAH

SEQ ID NO: 186586 - protein, 37 aa, Artificial Sequence
  Description of Artificial Sequence: Synthetic polypeptide
DEEEIACTNPVATEQYGSACAATNGEEAPGEQMESNM

SEQ ID NO: 186587 - protein, 34 aa, Artificial Sequence
  Description of Artificial Sequence: Synthetic polypeptide
NEEEIATTNPEATDAYGQVCCCDQDQKREGDNHS

SEQ ID NO: 186588 - protein, 35 aa, Artificial Sequence
  Description of Artificial Sequence: Synthetic polypeptide
DEAEIGTTNPVATEQYGCLFTATDDMVEFEGNSKQ

SEQ ID NO: 186589 - protein, 34 aa, Artificial Sequence
  Description of Artificial Sequence: Synthetic polypeptide
DEAEIGTTNPVATEQYGCLFTAPDDPVEFEGDKQ

SEQ ID NO: 186590 - protein, 35 aa, Artificial Sequence
  Description of Artificial Sequence: Synthetic polypeptide
DENEIATTNPVATEQYGSCAAGAPGFDRESENGVE

SEQ ID NO: 186591 - protein, 38 aa, Artificial Sequence
  Description of Artificial Sequence: Synthetic polypeptide
DEAEIRATNPVATEQYGSVCYSDWNNLQDETQSDTQIN

SEQ ID NO: 186592 - protein, 36 aa, Artificial Sequence
  Description of Artificial Sequence: Synthetic polypeptide
DENEIATTNPVATEQYGSTACAANDGLPLGSGEGIH

SEQ ID NO: 186593 - protein, 33 aa, Artificial Sequence
  Description of Artificial Sequence: Synthetic polypeptide
NEDEIRCTNPTAYECWGSVYYENDDRHRGDDIR

SEQ ID NO: 186594 - protein, 34 aa, Artificial Sequence
  Description of Artificial Sequence: Synthetic polypeptide
NEAEICTTNPVAYEQWGSCVPTDGPNDTNHGGTD

SEQ ID NO: 186595 - protein, 33 aa, Artificial Sequence
  Description of Artificial Sequence: Synthetic polypeptide
NEAEIQCTNPVAYEPYGCVVQPAHEQDRGGNNV

SEQ ID NO: 186596 - protein, 36 aa, Artificial Sequence
  Description of Artificial Sequence: Synthetic polypeptide
NEAEIQCTNPVAYEQYGIHVVQSCQNEQDDRGGNNV

SEQ ID NO: 186597 - protein, 36 aa, Artificial Sequence
  Description of Artificial Sequence: Synthetic polypeptide
NEAEIRTTNPVATEAWGSVCSTWEQGNDTNGGMTTM

SEQ ID NO: 186598 - protein, 37 aa, Artificial Sequence
  Description of Artificial Sequence: Synthetic polypeptide
DENEIATTNPVATEQYGSVCAMNNGNLEPPDDQMNGA

SEQ ID NO: 186599 - protein, 35 aa, Artificial Sequence
  Description of Artificial Sequence: Synthetic polypeptide
NEAEIRTTNPVATEQYGCVCGWGEHNQEYFGSDQS

SEQ ID NO: 186600 - protein, 38 aa, Artificial Sequence
  Description of Artificial Sequence: Synthetic polypeptide
NEAEIRTTNPVATEQYGSVCSETPWAFNISEGSEEPQP

SEQ ID NO: 186601 - protein, 37 aa, Artificial Sequence
  Description of Artificial Sequence: Synthetic polypeptide
DENEIATTNPVATEQYGSVCAANNGVLEPPDDQAEGA

SEQ ID NO: 186602 - protein, 36 aa, Artificial Sequence
  Description of Artificial Sequence: Synthetic polypeptide
DENEIATTNPVATEQYGSVCAANNGDENGMDISIDF

SEQ ID NO: 186603 - protein, 37 aa, Artificial Sequence
  Description of Artificial Sequence: Synthetic polypeptide
DENEIATTNPVATEQYGSVCAANNGDENGMDIQNANS

SEQ ID NO: 186604 - protein, 37 aa, Artificial Sequence
  Description of Artificial Sequence: Synthetic polypeptide
DENEIATTNPVATEQYGSVCAANNGDENGMDINNHND

SEQ ID NO: 186605 - protein, 36 aa, Artificial Sequence
  Description of Artificial Sequence: Synthetic polypeptide
MESEIRTTNPVATEFYGVVVDGGGNQTNDDDGGNQG

SEQ ID NO: 186606 - protein, 37 aa, Artificial Sequence
  Description of Artificial Sequence: Synthetic polypeptide
DENEIATTNPVATEQYGSVCAANNGDENGMDIDNSNP

SEQ ID NO: 186607 - protein, 36 aa, Artificial Sequence
  Description of Artificial Sequence: Synthetic polypeptide
DENEIATTNPVATEQYGSVCAANMGEEAPDDGMEAH

SEQ ID NO: 186608 - protein, 36 aa, Artificial Sequence
  Description of Artificial Sequence: Synthetic polypeptide
DENEIATTNPVATEQYGSVCAANMGEEAPDAQMEGG

SEQ ID NO: 186609 - protein, 36 aa, Artificial Sequence
  Description of Artificial Sequence: Synthetic polypeptide
DENEIATTNPVATEQYGSVCAAMAHDEAGMPPDLNH

SEQ ID NO: 186610 - protein, 35 aa, Artificial Sequence
  Description of Artificial Sequence: Synthetic polypeptide
DEAEIRATNPVAYEQWGSVCYTTDNNDHGHGTQVD

SEQ ID NO: 186611 - protein, 36 aa, Artificial Sequence
  Description of Artificial Sequence: Synthetic polypeptide
CEMEIATTNPVATEQYGCVCSTWEHNEEHFGSETQA

SEQ ID NO: 186612 - protein, 35 aa, Artificial Sequence
  Description of Artificial Sequence: Synthetic polypeptide
DEAEIRATNPVAYEQWGSVCYTTDNNDHGHGQTDH

SEQ ID NO: 186613 - protein, 35 aa, Artificial Sequence
  Description of Artificial Sequence: Synthetic polypeptide
DEAEIRATNPVAYEQWGSVCYTTDNNDHGHGGTQM

SEQ ID NO: 186614 - protein, 35 aa, Artificial Sequence
  Description of Artificial Sequence: Synthetic polypeptide
DEAEIRATNPVAYEQWGSVCYTTDNNDHGHGESQH

SEQ ID NO: 186615 - protein, 34 aa, Artificial Sequence
  Description of Artificial Sequence: Synthetic polypeptide
DEAEIRATNPVAYECWGSVCYTTDNNDHGHGTVH

SEQ ID NO: 186616 - protein, 35 aa, Artificial Sequence
  Description of Artificial Sequence: Synthetic polypeptide
NEDEIASTNPVATEQYGSVYCNWNDQHHQGHPDGS

SEQ ID NO: 186617 - protein, 30 aa, Artificial Sequence
  Description of Artificial Sequence: Synthetic polypeptide
NEDEIATTNPVAYEQWGEAYYVWEQHEAQG

SEQ ID NO: 186618 - protein, 36 aa, Artificial Sequence
  Description of Artificial Sequence: Synthetic polypeptide
DENEIATTNPVATEQYGSVCAANNGDENGMDIDEAN

SEQ ID NO: 186619 - protein, 37 aa, Artificial Sequence
  Description of Artificial Sequence: Synthetic polypeptide
MESEIRTTNPVATDQYGSVVNDTNGQNFEEGQGGGGG

SEQ ID NO: 186620 - protein, 35 aa, Artificial Sequence
  Description of Artificial Sequence: Synthetic polypeptide
MESEIRTTNPVATDIYGVVVQDNNGLGQRFDEEMQ

SEQ ID NO: 186621 - protein, 36 aa, Artificial Sequence
  Description of Artificial Sequence: Synthetic polypeptide
MESEIRTTNPVATCQYGCCVATGVPNNDSRGQQDMD

SEQ ID NO: 186622 - protein, 38 aa, Artificial Sequence
  Description of Artificial Sequence: Synthetic polypeptide
MEGEIRTTNPVATEQYGSVSSPPEAEGPNMRFEGNSVE

SEQ ID NO: 186623 - protein, 38 aa, Artificial Sequence
  Description of Artificial Sequence: Synthetic polypeptide
MEGEIRTTNPVATEQYGSVSSPPPAEGPNMRFEQNSVC

SEQ ID NO: 186624 - protein, 38 aa, Artificial Sequence
  Description of Artificial Sequence: Synthetic polypeptide
MEGEIRTTNPVATEQYGSVSSPSPAVGPNMRFGENPVH

SEQ ID NO: 186625 - protein, 38 aa, Artificial Sequence
  Description of Artificial Sequence: Synthetic polypeptide
MEGEIRTTNPVATEQYGSVSSPTPAEGPNMIFEMNSVM

SEQ ID NO: 186626 - protein, 38 aa, Artificial Sequence
  Description of Artificial Sequence: Synthetic polypeptide
MEGEIRTTNPVATEQYGSVSSPTPAEGPNMRFEMNSQS

SEQ ID NO: 186627 - protein, 36 aa, Artificial Sequence
  Description of Artificial Sequence: Synthetic polypeptide
DENEIATTNPVAYEQYGSACAAVATGVNTAGGDTMA

SEQ ID NO: 186628 - protein, 37 aa, Artificial Sequence
  Description of Artificial Sequence: Synthetic polypeptide
DENEIATTNPVAYEQYGSACAATNPQEAGDSGMGNSM

SEQ ID NO: 186629 - protein, 34 aa, Artificial Sequence
  Description of Artificial Sequence: Synthetic polypeptide
DENEIATTNPVAYEQWGTSACAAANGLQSEVDDS

SEQ ID NO: 186630 - protein, 37 aa, Artificial Sequence
  Description of Artificial Sequence: Synthetic polypeptide
MEGEIRTTNPVATEQYGSVWETTDNGVNTTFEDNYCD

SEQ ID NO: 186631 - protein, 37 aa, Artificial Sequence
  Description of Artificial Sequence: Synthetic polypeptide
MEGEIRTTNPVATEQYGSVWNNTNHDLDLIFESTQQG

SEQ ID NO: 186632 - protein, 37 aa, Artificial Sequence
  Description of Artificial Sequence: Synthetic polypeptide
MEGEIRTTNPVATEQYGSVWNQTPDLDIAEPNEDEMG

SEQ ID NO: 186633 - protein, 37 aa, Artificial Sequence
  Description of Artificial Sequence: Synthetic polypeptide
MEGEIRTTNPVATEQYGSVWNQTYPDLDIEPNEDECG

SEQ ID NO: 186634 - protein, 37 aa, Artificial Sequence
  Description of Artificial Sequence: Synthetic polypeptide
MEGEIRTTNPVATEQYGSVWNVTPYLDIVEPGEDEGA

SEQ ID NO: 186635 - protein, 38 aa, Artificial Sequence
  Description of Artificial Sequence: Synthetic polypeptide
MEGEIRTTNPVATEQYGSVWSPAPAEGPNMYFEGNSVE

SEQ ID NO: 186636 - protein, 35 aa, Artificial Sequence
  Description of Artificial Sequence: Synthetic polypeptide
DEEEIACTNPVATEQWGAVCAAQNPVNTAGNPEGD

SEQ ID NO: 186637 - protein, 37 aa, Artificial Sequence
  Description of Artificial Sequence: Synthetic polypeptide
MEGEIRTTNPVATEQYGSWSMTTPAGPNERFESNSVA

SEQ ID NO: 186638 - protein, 37 aa, Artificial Sequence
  Description of Artificial Sequence: Synthetic polypeptide
MEGEIRTTNPVATEQYGTVSSTWPAGPNERFEMSDVA

SEQ ID NO: 186639 - protein, 38 aa, Artificial Sequence
  Description of Artificial Sequence: Synthetic polypeptide
MEGEIRTTNPVATEWYGCSVSVAGNDLTTERGVQADEV

SEQ ID NO: 186640 - protein, 36 aa, Artificial Sequence
  Description of Artificial Sequence: Synthetic polypeptide
MEGTIRTTNPVATEQYGSVMGEMDNAFIGIGGENGG

SEQ ID NO: 186641 - protein, 37 aa, Artificial Sequence
  Description of Artificial Sequence: Synthetic polypeptide
MEGTIRTTNPVATEQYGSVMGSMDNAFIGIGIENGGD

SEQ ID NO: 186642 - protein, 36 aa, Artificial Sequence
  Description of Artificial Sequence: Synthetic polypeptide
MEHEIATVNPAATEQYGSVIITNGLGGGQEDGEGTV

SEQ ID NO: 186643 - protein, 36 aa, Artificial Sequence
  Description of Artificial Sequence: Synthetic polypeptide
MEHEIATVNPAATEQYGSVIITNGLGGGQEGGEEEQ

SEQ ID NO: 186644 - protein, 33 aa, Artificial Sequence
  Description of Artificial Sequence: Synthetic polypeptide
DENEIATTNPVAYEQWGGVYDIEIEMNQREDQG

SEQ ID NO: 186645 - protein, 38 aa, Artificial Sequence
  Description of Artificial Sequence: Synthetic polypeptide
MEGEIRTTNPVATEQYGSVSSPAPQEWPNMRFEGMSVE

SEQ ID NO: 186646 - protein, 38 aa, Artificial Sequence
  Description of Artificial Sequence: Synthetic polypeptide
MEGEIRTTNPVATEQYGSVSSPAPAEGPTMGFEGNSVE

SEQ ID NO: 186647 - protein, 38 aa, Artificial Sequence
  Description of Artificial Sequence: Synthetic polypeptide
MEGEIRTTNPVATEQYGSVSSPAPAEGPNMVFEGNSSS

SEQ ID NO: 186648 - protein, 38 aa, Artificial Sequence
  Description of Artificial Sequence: Synthetic polypeptide
MEGEIRTTNPVATEQYGSVSSPAPAEGPNMRFEGISVN

SEQ ID NO: 186649 - protein, 35 aa, Artificial Sequence
  Description of Artificial Sequence: Synthetic polypeptide
DEAEIRTTNGVAYCQYGCVCSTEEHNQEYFGSDQS

SEQ ID NO: 186650 - protein, 36 aa, Artificial Sequence
  Description of Artificial Sequence: Synthetic polypeptide
MEGEIRTTNPVATEQYGSVCNQTPDWDIEPNEDEMG

SEQ ID NO: 186651 - protein, 38 aa, Artificial Sequence
  Description of Artificial Sequence: Synthetic polypeptide
MEGEIRTTNPVATEQYGSVCSPAPCEGPNMRFEGNSVE

SEQ ID NO: 186652 - protein, 38 aa, Artificial Sequence
  Description of Artificial Sequence: Synthetic polypeptide
MEGEIRTTNPVATEQYGSVCSPWPAEGPNMVFEGNSDC

SEQ ID NO: 186653 - protein, 37 aa, Artificial Sequence
  Description of Artificial Sequence: Synthetic polypeptide
MEGEIRTTNPVATEQYGSVFEDTPAGPNERFESNDDA

SEQ ID NO: 186654 - protein, 37 aa, Artificial Sequence
  Description of Artificial Sequence: Synthetic polypeptide
MEGEIRTTNPVATEQYGSVITDTTINPNTTRSQIEHN

SEQ ID NO: 186655 - protein, 38 aa, Artificial Sequence
  Description of Artificial Sequence: Synthetic polypeptide
MEGEIRTTNPVATEQYGSVMSPAPAEGPNMRFEGNSVA

SEQ ID NO: 186656 - protein, 38 aa, Artificial Sequence
  Description of Artificial Sequence: Synthetic polypeptide
MEGEIRTTNPVATEQYGSVNETTPAAGPNERFEMNDVA

SEQ ID NO: 186657 - protein, 36 aa, Artificial Sequence
  Description of Artificial Sequence: Synthetic polypeptide
MEGEIRTTNPVATEQYGSVNVQWDDVESDGGESNQS

SEQ ID NO: 186658 - protein, 38 aa, Artificial Sequence
  Description of Artificial Sequence: Synthetic polypeptide
MEGEIRTTNPVATEQYGSVPSPAPAEGPNMVFEGNSDV

SEQ ID NO: 186659 - protein, 37 aa, Artificial Sequence
  Description of Artificial Sequence: Synthetic polypeptide
DEEEIACTNPVATAQWGSVSVSGNPLENTRGVIEEMN

SEQ ID NO: 186660 - protein, 35 aa, Artificial Sequence
  Description of Artificial Sequence: Synthetic polypeptide
DENEIATTNPVAYEQWGGTVYSIEIENMMQRTDHN

SEQ ID NO: 186661 - protein, 38 aa, Artificial Sequence
  Description of Artificial Sequence: Synthetic polypeptide
MEGEIRTTNPVATEQYGSVSEDTPAEGPNERFESNDQA

SEQ ID NO: 186662 - protein, 37 aa, Artificial Sequence
  Description of Artificial Sequence: Synthetic polypeptide
DENEIATTNPVAYEQYGSTVCASNDGPTEHQDGTEMK

SEQ ID NO: 186663 - protein, 38 aa, Artificial Sequence
  Description of Artificial Sequence: Synthetic polypeptide
MEGEIRTTNPVATEQYGSVSGPAPAEGPNMNFEGNSVC

SEQ ID NO: 186664 - protein, 36 aa, Artificial Sequence
  Description of Artificial Sequence: Synthetic polypeptide
DENEIATTNPVAYEQYGSTAATNTDPADGPGMNLHN

SEQ ID NO: 186665 - protein, 36 aa, Artificial Sequence
  Description of Artificial Sequence: Synthetic polypeptide
DENEIATTNPVAYEQYGSACSANPQGQEHQDGTAMK

SEQ ID NO: 186666 - protein, 38 aa, Artificial Sequence
  Description of Artificial Sequence: Synthetic polypeptide
MEGEIRTTNPVATEQYGSVSSAAPAEGPNMRFESNSVC

SEQ ID NO: 186667 - protein, 38 aa, Artificial Sequence
  Description of Artificial Sequence: Synthetic polypeptide
MEGEIRTTNPVATEQYGSVSSIAPHEGPNMRFEGNSVE

SEQ ID NO: 186668 - protein, 38 aa, Artificial Sequence
  Description of Artificial Sequence: Synthetic polypeptide
MEGEIRTTNPVATEQYGSVSSPADAEGPNMRFEGNSVH

SEQ ID NO: 186669 - protein, 38 aa, Artificial Sequence
  Description of Artificial Sequence: Synthetic polypeptide
MEGEIRTTNPVATEQYGSVSSPAMAEGPNVRFEGNSVE

SEQ ID NO: 186670 - protein, 38 aa, Artificial Sequence
  Description of Artificial Sequence: Synthetic polypeptide
MEGEIRTTNPVATEQYGSVSSPAPAEGNNMEFEGNSVC

SEQ ID NO: 186671 - protein, 38 aa, Artificial Sequence
  Description of Artificial Sequence: Synthetic polypeptide
MEGEIRTTNPVATEQYGSVSSPAPAEGPNARFEGQSVE

SEQ ID NO: 186672 - protein, 38 aa, Artificial Sequence
  Description of Artificial Sequence: Synthetic polypeptide
MEGEIRTTNPVATEQYGSVSSPAPAEGPNMAFEGNSDP

SEQ ID NO: 186673 - protein, 38 aa, Artificial Sequence
  Description of Artificial Sequence: Synthetic polypeptide
MEGEIRTTNPVATEQYGSVSEPAPAEGPNMVFEGNSDF

SEQ ID NO: 186674 - protein, 34 aa, Artificial Sequence
  Description of Artificial Sequence: Synthetic polypeptide
DEAEIGTTNPVATEQYGCLFTAIDGPVEFEGFKQ

SEQ ID NO: 186675 - protein, 34 aa, Artificial Sequence
  Description of Artificial Sequence: Synthetic polypeptide
DENEIATTNPVAYEQWGGTVYHIENIEMNQREDH

SEQ ID NO: 186676 - protein, 37 aa, Artificial Sequence
  Description of Artificial Sequence: Synthetic polypeptide
MEMEIGTTNPVATEQYGSVTTATGGQLQEEMGEFGES

SEQ ID NO: 186677 - protein, 37 aa, Artificial Sequence
  Description of Artificial Sequence: Synthetic polypeptide
MENEIRTTNPVATEQYGSVSPVFNESEMTTFPGQPEK

SEQ ID NO: 186678 - protein, 38 aa, Artificial Sequence
  Description of Artificial Sequence: Synthetic polypeptide
MENEIRTTNPVATEQYGSVSSPAPAEGPNMVFEGNSDD

SEQ ID NO: 186679 - protein, 34 aa, Artificial Sequence
  Description of Artificial Sequence: Synthetic polypeptide
DENEIATTNPVAYAQWGCNVAGNGLQAAPDGSGN

SEQ ID NO: 186680 - protein, 32 aa, Artificial Sequence
  Description of Artificial Sequence: Synthetic polypeptide
DENEIATTNPVAYAPWGNVATGAGENPRNGEN

SEQ ID NO: 186681 - protein, 36 aa, Artificial Sequence
  Description of Artificial Sequence: Synthetic polypeptide
MENEIRTTNPVATEQYGSVSWCGVAEIPFAHQVQET

SEQ ID NO: 186682 - protein, 36 aa, Artificial Sequence
  Description of Artificial Sequence: Synthetic polypeptide
MENEIRTTNPVATEQYGSVSWCGVAEIPFIHQEIET

SEQ ID NO: 186683 - protein, 36 aa, Artificial Sequence
  Description of Artificial Sequence: Synthetic polypeptide
MENEIRTTNPVATEQYGSVSWCGVAEIPFSVQEQEC

SEQ ID NO: 186684 - protein, 36 aa, Artificial Sequence
  Description of Artificial Sequence: Synthetic polypeptide
MENEIRTTNPVATEQYGSVSWCGVAEIPQSHQEVET

SEQ ID NO: 186685 - protein, 36 aa, Artificial Sequence
  Description of Artificial Sequence: Synthetic polypeptide
MENEIRTTNPVATEQYGSVSWCGVGEIPFSHQEVDT

SEQ ID NO: 186686 - protein, 36 aa, Artificial Sequence
  Description of Artificial Sequence: Synthetic polypeptide
MENEIRTTNPVATEQYGSVSWCGVSEIPFSHQVSET

SEQ ID NO: 186687 - protein, 37 aa, Artificial Sequence
  Description of Artificial Sequence: Synthetic polypeptide
MENEIRTTNPVATEQYGSVSWCNGVAEEPFSHQVVET

SEQ ID NO: 186688 - protein, 36 aa, Artificial Sequence
  Description of Artificial Sequence: Synthetic polypeptide
MENEIRTTNPVATEQYGSVSWGGVAEIPFSHQVVEM

SEQ ID NO: 186689 - protein, 36 aa, Artificial Sequence
  Description of Artificial Sequence: Synthetic polypeptide
MENEIRTTNPVATEQYGSVSWSGVAEIPFSHQEVAT

SEQ ID NO: 186690 - protein, 36 aa, Artificial Sequence
  Description of Artificial Sequence: Synthetic polypeptide
MENEIRTTNPVATEQYGVVSNDQQGDGQGGEDTGDE

SEQ ID NO: 186691 - protein, 36 aa, Artificial Sequence
  Description of Artificial Sequence: Synthetic polypeptide
MENEIRTTNPVATEWYGEVMVMSSAAELEPRTQNDG

SEQ ID NO: 186692 - protein, 35 aa, Artificial Sequence
  Description of Artificial Sequence: Synthetic polypeptide
MENEIRTTNPVSTEPYGQMITSDMSDGGVQQNGNH

SEQ ID NO: 186693 - protein, 34 aa, Artificial Sequence
  Description of Artificial Sequence: Synthetic polypeptide
DEEEIACTNPVATEQWGCTAGTENPTAGILMEAH

SEQ ID NO: 186694 - protein, 35 aa, Artificial Sequence
  Description of Artificial Sequence: Synthetic polypeptide
MEQEIRTTNPVATEQYGSVAVMAASHEGFGDEVIE

SEQ ID NO: 186695 - protein, 38 aa, Artificial Sequence
  Description of Artificial Sequence: Synthetic polypeptide
MEQEIRTTNPVATEQYGSVITDTTINPPTTRSQNEVHN

SEQ ID NO: 186696 - protein, 34 aa, Artificial Sequence
  Description of Artificial Sequence: Synthetic polypeptide
DEEEIACTNPVATEQWGCVAATGGEADTPDDTRW

SEQ ID NO: 186697 - protein, 34 aa, Artificial Sequence
  Description of Artificial Sequence: Synthetic polypeptide
DEAEIRTTNGVAYCQYGCVCSNWEHNQENGSDQA

SEQ ID NO: 186698 - protein, 37 aa, Artificial Sequence
  Description of Artificial Sequence: Synthetic polypeptide
MESEIRTTNPVATCQYGCCCATGVPNLDSRGGNQFED

SEQ ID NO: 186699 - protein, 36 aa, Artificial Sequence
  Description of Artificial Sequence: Synthetic polypeptide
MESEIRTTNPVATCQYGCCVATGVPNLDSDGGQFGD

SEQ ID NO: 186700 - protein, 37 aa, Artificial Sequence
  Description of Artificial Sequence: Synthetic polypeptide
MENEIRTTNPVATEQYGSVNVDVSLNHDTGIPYLIDS

SEQ ID NO: 186701 - protein, 36 aa, Artificial Sequence
  Description of Artificial Sequence: Synthetic polypeptide
DEEEIACTNPVATEQWGAVVCSQNPVQETAGFPTES

SEQ ID NO: 186702 - protein, 35 aa, Artificial Sequence
  Description of Artificial Sequence: Synthetic polypeptide
MENEIRTTNPVATEQYGSCYLPLCDSDIIDLNNMQ

SEQ ID NO: 186703 - protein, 36 aa, Artificial Sequence
  Description of Artificial Sequence: Synthetic polypeptide
MENEIRTTNPVATEQYGSCYFPLVSDSDIIDLNNMT

SEQ ID NO: 186704 - protein, 35 aa, Artificial Sequence
  Description of Artificial Sequence: Synthetic polypeptide
MENCIRCTNPVATEQYGSVWSPTGNDETESDQELD

SEQ ID NO: 186705 - protein, 34 aa, Artificial Sequence
  Description of Artificial Sequence: Synthetic polypeptide
DENEIATTNPVAYEQWGCNTAGNGLQAAPDGSKN

SEQ ID NO: 186706 - protein, 34 aa, Artificial Sequence
  Description of Artificial Sequence: Synthetic polypeptide
DENEIATTNPVAYEQWGATYYSTEIEANQREMDY

SEQ ID NO: 186707 - protein, 35 aa, Artificial Sequence
  Description of Artificial Sequence: Synthetic polypeptide
DEEEIACTNPVATEQWGAVCAQNPVNNTAGNPLGT

SEQ ID NO: 186708 - protein, 34 aa, Artificial Sequence
  Description of Artificial Sequence: Synthetic polypeptide
DEEEIACTNPVATEQWGAVCAQNPVNTAGDPTGY

SEQ ID NO: 186709 - protein, 35 aa, Artificial Sequence
  Description of Artificial Sequence: Synthetic polypeptide
DEEEIACTNPVATEQWGAVCAQNPVNTAGNPEGAY

SEQ ID NO: 186710 - protein, 33 aa, Artificial Sequence
  Description of Artificial Sequence: Synthetic polypeptide
MENEIATTNPVATEGYGCVCSWGEHQHFISELA

SEQ ID NO: 186711 - protein, 35 aa, Artificial Sequence
  Description of Artificial Sequence: Synthetic polypeptide
DEEEIACTNPVATEQWGAVCSQNPVPETAGDPTGT

SEQ ID NO: 186712 - protein, 37 aa, Artificial Sequence
  Description of Artificial Sequence: Synthetic polypeptide
MENEICTTNPVATEQYGSVNNQNPENGLGQQEGEGED

SEQ ID NO: 186713 - protein, 36 aa, Artificial Sequence
  Description of Artificial Sequence: Synthetic polypeptide
MENEIRGTNPVATEQYGSVNVTLGEGEGQEEQGVGQ

SEQ ID NO: 186714 - protein, 36 aa, Artificial Sequence
  Description of Artificial Sequence: Synthetic polypeptide
MENEIRTTNPVATEFYGSVVGDGNNEQNVGEEGEMQ

SEQ ID NO: 186715 - protein, 34 aa, Artificial Sequence
  Description of Artificial Sequence: Synthetic polypeptide
DENEIATTNPVAYEQWGCVAGNGLQAAPDDSFSN

SEQ ID NO: 186716 - protein, 34 aa, Artificial Sequence
  Description of Artificial Sequence: Synthetic polypeptide
DENEIATTNPVAYEQWGATVYSIEIQMNQREMTH

SEQ ID NO: 186717 - protein, 36 aa, Artificial Sequence
  Description of Artificial Sequence: Synthetic polypeptide
MENEIRTTNPVATEQYGACCWSQDVSEDEEGDANMK

SEQ ID NO: 186718 - protein, 36 aa, Artificial Sequence
  Description of Artificial Sequence: Synthetic polypeptide
MENEIRTTNPVATEQYGACCWSQDVSELDEEGSAEK

SEQ ID NO: 186719 - protein, 36 aa, Artificial Sequence
  Description of Artificial Sequence: Synthetic polypeptide
MENEIRTTNPVATEQYGACCWSQDVSELDEIGSAMM

SEQ ID NO: 186720 - protein, 35 aa, Artificial Sequence
  Description of Artificial Sequence: Synthetic polypeptide
MENEIRTTNPVATEQYGCCWSQDVSEDEIGSDTEK

SEQ ID NO: 186721 - protein, 37 aa, Artificial Sequence
  Description of Artificial Sequence: Synthetic polypeptide
MENEIRTTNPVATEQYGCVAVTGNEMIMLEYDQESHI

SEQ ID NO: 186722 - protein, 36 aa, Artificial Sequence
  Description of Artificial Sequence: Synthetic polypeptide
MENEIRTTNPVATEQYGSCSYFPLNDDIIDLNNIQQ

SEQ ID NO: 186723 - protein, 35 aa, Artificial Sequence
  Description of Artificial Sequence: Synthetic polypeptide
MENEIRTTNPVATEQYGSCVWVPSDIVETAMPVSQ

SEQ ID NO: 186724 - protein, 36 aa, Artificial Sequence
  Description of Artificial Sequence: Synthetic polypeptide
MENEIRTTNPVATEQYGSCWCTMNAIFNQEDMSIEQ

SEQ ID NO: 186725 - protein, 35 aa, Artificial Sequence
  Description of Artificial Sequence: Synthetic polypeptide
MENEIRTTNPVATEQYGSCYFPLLDSDIIDLNEMQ

SEQ ID NO: 186726 - protein, 35 aa, Artificial Sequence
  Description of Artificial Sequence: Synthetic polypeptide
MENEIRTTNPVATEQYGSCYFPLNDDIIDLNFNQQ

SEQ ID NO: 186727 - protein, 35 aa, Artificial Sequence
  Description of Artificial Sequence: Synthetic polypeptide
MENEIRTTNPVATEQYGSCYFPLNDDIIDNNNLQY

SEQ ID NO: 186728 - protein, 35 aa, Artificial Sequence
  Description of Artificial Sequence: Synthetic polypeptide
MENEIRTTNPVATEQYGACCTSEDVSEDEIHSAMK

SEQ ID NO: 186729 - protein, 35 aa, Artificial Sequence
  Description of Artificial Sequence: Synthetic polypeptide
DEAEIGTTNPVATEQYGCLCTATDGPVEFEGPNKQ

SEQ ID NO: 186730 - protein, 34 aa, Artificial Sequence
  Description of Artificial Sequence: Synthetic polypeptide
NEEEIATTNPVATEQWGCVAGAGPAPDNQMGGED

SEQ ID NO: 186731 - protein, 36 aa, Artificial Sequence
  Description of Artificial Sequence: Synthetic polypeptide
NEEEIATTNPVATEQWGGCCTAAAGNLDDGMGNNHE

SEQ ID NO: 186732 - protein, 38 aa, Artificial Sequence
  Description of Artificial Sequence: Synthetic polypeptide
DEEEIRTTNPVATEQYGSYCYSPTEVTGLPAMHEVVQL

SEQ ID NO: 186733 - protein, 35 aa, Artificial Sequence
  Description of Artificial Sequence: Synthetic polypeptide
NEGEIRTTNPVATEQYGSVMYAAYHEDEFIMSSQR

SEQ ID NO: 186734 - protein, 37 aa, Artificial Sequence
  Description of Artificial Sequence: Synthetic polypeptide
DEEEIRTTNPVATEQYGSYIERVAPAGEIQQALLDPT

SEQ ID NO: 186735 - protein, 38 aa, Artificial Sequence
  Description of Artificial Sequence: Synthetic polypeptide
DEEEIRTTNPVATEQYGSYIHSDAEWIWQNVLMPEQGE

SEQ ID NO: 186736 - protein, 37 aa, Artificial Sequence
  Description of Artificial Sequence: Synthetic polypeptide
NEGEIRTTNPVATEQYGSVTWSPVVWLENPNTEEGGN

SEQ ID NO: 186737 - protein, 38 aa, Artificial Sequence
  Description of Artificial Sequence: Synthetic polypeptide
DEEEIRTTNPVATEQYGSVPPVAQMVKVEHGVEPEQMD

SEQ ID NO: 186738 - protein, 35 aa, Artificial Sequence
  Description of Artificial Sequence: Synthetic polypeptide
NEGEIRTTNPVATGHYGSVPDVPENLNTEGTFDMC

SEQ ID NO: 186739 - protein, 32 aa, Artificial Sequence
  Description of Artificial Sequence: Synthetic polypeptide
NEMEIACTNPCSYEQYGCVCSWNPQSFGSEQS

SEQ ID NO: 186740 - protein, 37 aa, Artificial Sequence
  Description of Artificial Sequence: Synthetic polypeptide
DEEEIRTTNPVATEQYGSYNCCCSELPIQMEEQEDLI

SEQ ID NO: 186741 - protein, 35 aa, Artificial Sequence
  Description of Artificial Sequence: Synthetic polypeptide
NEMEIRTTNPVATEQYGCVCQWMEHNQENFGSDQS

SEQ ID NO: 186742 - protein, 37 aa, Artificial Sequence
  Description of Artificial Sequence: Synthetic polypeptide
DEEEIRTTNPVATEQYGSYNMEANPDDTGGSGQEEIG

SEQ ID NO: 186743 - protein, 37 aa, Artificial Sequence
  Description of Artificial Sequence: Synthetic polypeptide
DEEEIRTTNPVATEQYGSYNWEAGPDDLGGSGQEEDG

SEQ ID NO: 186744 - protein, 36 aa, Artificial Sequence
  Description of Artificial Sequence: Synthetic polypeptide
NEMEIRTTNPVATEQYGSCSSTCINPNYPEHSEEFT

SEQ ID NO: 186745 - protein, 36 aa, Artificial Sequence
  Description of Artificial Sequence: Synthetic polypeptide
CENEIRTTNPVATEQYGAISLEFEETEIVREMQLRN

SEQ ID NO: 186746 - protein, 37 aa, Artificial Sequence
  Description of Artificial Sequence: Synthetic polypeptide
NEMEIRTTNPVATEQYGSVCPTIQSGQETLQEDQIED

SEQ ID NO: 186747 - protein, 37 aa, Artificial Sequence
  Description of Artificial Sequence: Synthetic polypeptide
NEMEIRTTNPVATEQYGSVSFTIASGQETLPEDQIED

SEQ ID NO: 186748 - protein, 37 aa, Artificial Sequence
  Description of Artificial Sequence: Synthetic polypeptide
NEMEIRTTNPVATEQYGSVSPTIQSGQEPLPEDQIED

SEQ ID NO: 186749 - protein, 37 aa, Artificial Sequence
  Description of Artificial Sequence: Synthetic polypeptide
NEMEIRTTNPVATEQYGSVSSVPLHDNIMEWSEENNM

SEQ ID NO: 186750 - protein, 35 aa, Artificial Sequence
  Description of Artificial Sequence: Synthetic polypeptide
CENEIRTTNPVATEQYGAISLSFEETEIRDMQLVG

SEQ ID NO: 186751 - protein, 38 aa, Artificial Sequence
  Description of Artificial Sequence: Synthetic polypeptide
DEEEIRTTNPVATEQYGSYQEAHMVTVEVATNVEQNAH

SEQ ID NO: 186752 - protein, 33 aa, Artificial Sequence
  Description of Artificial Sequence: Synthetic polypeptide
NENAEIATTNPVAYEAWGSVYCSDNDDEKDDGR

SEQ ID NO: 186753 - protein, 33 aa, Artificial Sequence
  Description of Artificial Sequence: Synthetic polypeptide
NENAEIATTNPVAYEAWGSVYCSDNDDEKQEGT

SEQ ID NO: 186754 - protein, 33 aa, Artificial Sequence
  Description of Artificial Sequence: Synthetic polypeptide
NENAEIATTNPVAYEAWGSVYCSDPDDERQGMV

SEQ ID NO: 186755 - protein, 38 aa, Artificial Sequence
  Description of Artificial Sequence: Synthetic polypeptide
NEESSEIRTTNPVATEAWGSVCSTWEQGNDTNGGMTTR

SEQ ID NO: 186756 - protein, 36 aa, Artificial Sequence
  Description of Artificial Sequence: Synthetic polypeptide
NEEEISTTNPVATEQYGQCVCSSGEHNDEFFGSDQS

SEQ ID NO: 186757 - protein, 36 aa, Artificial Sequence
  Description of Artificial Sequence: Synthetic polypeptide
NEEEISTTNPVATEQYGCVCSWGEHNDENFNSDTQS

SEQ ID NO: 186758 - protein, 37 aa, Artificial Sequence
  Description of Artificial Sequence: Synthetic polypeptide
NEEEISTTNPVATEQYGCSCSTSGEDNAENFQSDTQA

SEQ ID NO: 186759 - protein, 33 aa, Artificial Sequence
  Description of Artificial Sequence: Synthetic polypeptide
DENEIATTNPIATECYGATVWAEDWQEHKGEYL

SEQ ID NO: 186760 - protein, 38 aa, Artificial Sequence
  Description of Artificial Sequence: Synthetic polypeptide
DEEEIRTTNPVATEQYGSYAEPTELNMEWWREEVESTA

SEQ ID NO: 186761 - protein, 30 aa, Artificial Sequence
  Description of Artificial Sequence: Synthetic polypeptide
DENEIATTNPIATECWGDVANADWAHEEYL

SEQ ID NO: 186762 - protein, 30 aa, Artificial Sequence
  Description of Artificial Sequence: Synthetic polypeptide
DENEIATTNPIATECWGAVANADWAHEEYL

SEQ ID NO: 186763 - protein, 37 aa, Artificial Sequence
  Description of Artificial Sequence: Synthetic polypeptide
NEEEIRTTNPVATEQYGSYSSPHMVTVEVAANVQDQY

SEQ ID NO: 186764 - protein, 32 aa, Artificial Sequence
  Description of Artificial Sequence: Synthetic polypeptide
DENEIATTNPCTYEPYGTISMEWDQQQQNGNH

SEQ ID NO: 186765 - protein, 34 aa, Artificial Sequence
  Description of Artificial Sequence: Synthetic polypeptide
NEEEIRTTNPVAYEKWGSVCWIELQGEQVDHTDN

SEQ ID NO: 186766 - protein, 33 aa, Artificial Sequence
  Description of Artificial Sequence: Synthetic polypeptide
NEEEIRTTNPVAYEKWGSVCWPEQQQQHEHSGI

SEQ ID NO: 186767 - protein, 37 aa, Artificial Sequence
  Description of Artificial Sequence: Synthetic polypeptide
NEEEIRTTNPVAYEQWGCSYNVNMDDRDQREGHRPRS

SEQ ID NO: 186768 - protein, 37 aa, Artificial Sequence
  Description of Artificial Sequence: Synthetic polypeptide
NEEEIRTTNPVAYEQWGCSYNVPMDDTDQREGDRDRS

SEQ ID NO: 186769 - protein, 37 aa, Artificial Sequence
  Description of Artificial Sequence: Synthetic polypeptide
NEEEIRTTNPVAYEQWGCSYNVPMDDTDQREGHDPRP

SEQ ID NO: 186770 - protein, 38 aa, Artificial Sequence
  Description of Artificial Sequence: Synthetic polypeptide
DEEEIRTTNPVATEQYGSYSSPHMVTVEVAANMMQQVP

SEQ ID NO: 186771 - protein, 37 aa, Artificial Sequence
  Description of Artificial Sequence: Synthetic polypeptide
NEEEIRTTNPVAYEQWGCSYNVPMDDTDQREGHRPGD

SEQ ID NO: 186772 - protein, 36 aa, Artificial Sequence
  Description of Artificial Sequence: Synthetic polypeptide
NEEEIRTTNPVAYEQWGCSYNVPMEDTKQIPGKRPV

SEQ ID NO: 186773 - protein, 32 aa, Artificial Sequence
  Description of Artificial Sequence: Synthetic polypeptide
CENEIATTNPVGYEPYGKVSIIGHLSQHETES

SEQ ID NO: 186774 - protein, 39 aa, Artificial Sequence
  Description of Artificial Sequence: Synthetic polypeptide
DEEEIRTTNPVATEQYGSYAISPTATPLHEVSPMQLERN

SEQ ID NO: 186775 - protein, 39 aa, Artificial Sequence
  Description of Artificial Sequence: Synthetic polypeptide
DEEEIRTTNPVATEQYGSYAISPTATPLHEVSPSQDEQN

SEQ ID NO: 186776 - protein, 37 aa, Artificial Sequence
  Description of Artificial Sequence: Synthetic polypeptide
DEEEIRTTNPVATEQYGSYANNEDNPDDEGSGQEEIG

SEQ ID NO: 186777 - protein, 36 aa, Artificial Sequence
  Description of Artificial Sequence: Synthetic polypeptide
CENEIKTTNPVATETYGMVSNFNSLIQQEVGDTVPA

SEQ ID NO: 186778 - protein, 37 aa, Artificial Sequence
  Description of Artificial Sequence: Synthetic polypeptide
DEEEIRTTNPVATEQYGSYAYPTPAFEWQGQIVVEDV

SEQ ID NO: 186779 - protein, 37 aa, Artificial Sequence
  Description of Artificial Sequence: Synthetic polypeptide
DEEEIRTTNPVATEQYGSYCYEPEEVLILAAQVEVVG

SEQ ID NO: 186780 - protein, 38 aa, Artificial Sequence
  Description of Artificial Sequence: Synthetic polypeptide
DEEEIRTTNPVATEQYGSYCYSPLEVDLIAFAQVEVVQ

SEQ ID NO: 186781 - protein, 38 aa, Artificial Sequence
  Description of Artificial Sequence: Synthetic polypeptide
DEEEIRTTNPVATEQYGSYCYSPLEVLILDAQVEVVGT

SEQ ID NO: 186782 - protein, 38 aa, Artificial Sequence
  Description of Artificial Sequence: Synthetic polypeptide
DEEEIRTTNPVATEQYGSYCYSPLVVTEIFRQIQPDVL

SEQ ID NO: 186783 - protein, 37 aa, Artificial Sequence
  Description of Artificial Sequence: Synthetic polypeptide
NEEEIRTTNPVAYEQWGCSYNVPMDDTDQREGHRQIS

SEQ ID NO: 186784 - protein, 31 aa, Artificial Sequence
  Description of Artificial Sequence: Synthetic polypeptide
DENEIATTNPIATECYGATWSNACWAEPEPL

SEQ ID NO: 186785 - protein, 38 aa, Artificial Sequence
  Description of Artificial Sequence: Synthetic polypeptide
NENEIRTTNPAATEFYGVVAITNDLENGQQRFIEGGNT

SEQ ID NO: 186786 - protein, 33 aa, Artificial Sequence
  Description of Artificial Sequence: Synthetic polypeptide
CEPVIACTNPVATEQWGCVAGTNPATMMGEQNW

SEQ ID NO: 186787 - protein, 36 aa, Artificial Sequence
  Description of Artificial Sequence: Synthetic polypeptide
DEEEIACTNPVATEQYGSVCAAIDGLEANDDLGAQA

SEQ ID NO: 186788 - protein, 37 aa, Artificial Sequence
  Description of Artificial Sequence: Synthetic polypeptide
DEEEIRTTNPVATEQYGSYTYLCPNSENVSSVAMWED

SEQ ID NO: 186789 - protein, 34 aa, Artificial Sequence
  Description of Artificial Sequence: Synthetic polypeptide
NEREIRTTNPVAYEAWGCVTQWTGGLSPTEGSRN

SEQ ID NO: 186790 - protein, 35 aa, Artificial Sequence
  Description of Artificial Sequence: Synthetic polypeptide
NESCIRTTNPVATEQYGCVFWPNNNVSIRIDDQNL

SEQ ID NO: 186791 - protein, 38 aa, Artificial Sequence
  Description of Artificial Sequence: Synthetic polypeptide
DEEEIRTTNPVATEQYGSYVCVSTTVEMEEVIEEMDEA

SEQ ID NO: 186792 - protein, 36 aa, Artificial Sequence
  Description of Artificial Sequence: Synthetic polypeptide
DENEAEIRTTNPVAYECWGVCSTTNLGGIDTQGDSD

SEQ ID NO: 186793 - protein, 38 aa, Artificial Sequence
  Description of Artificial Sequence: Synthetic polypeptide
DEEEIRTTNPVATEQYGSYVISPRVDDAIQMSPVEQFP

SEQ ID NO: 186794 - protein, 36 aa, Artificial Sequence
  Description of Artificial Sequence: Synthetic polypeptide
CESEIATTNPCATEQYGTVCSDTGEEPSENMTGGND

SEQ ID NO: 186795 - protein, 38 aa, Artificial Sequence
  Description of Artificial Sequence: Synthetic polypeptide
DEEEIRTTNPVATEQYGSVPMNNNTQTAQMVPVAQVDG

SEQ ID NO: 186796 - protein, 36 aa, Artificial Sequence
  Description of Artificial Sequence: Synthetic polypeptide
NESEIRTTNPVATEQYGSVPYQTDEEDSTPSIEECP

SEQ ID NO: 186797 - protein, 36 aa, Artificial Sequence
  Description of Artificial Sequence: Synthetic polypeptide
DEEEIACTNPVATEQYGSVCAAPDGHLENDDLGAQA

SEQ ID NO: 186798 - protein, 38 aa, Artificial Sequence
  Description of Artificial Sequence: Synthetic polypeptide
DEEEIRTTNPVATEQYGSVPIFNNISDAVMEVAVNENS

SEQ ID NO: 186799 - protein, 38 aa, Artificial Sequence
  Description of Artificial Sequence: Synthetic polypeptide
DEEEIRTTNPVATEQYGSVPGLWPGTTHEETVSQEQRM

SEQ ID NO: 186800 - protein, 36 aa, Artificial Sequence
  Description of Artificial Sequence: Synthetic polypeptide
DEEEIACTNPVATEQYGSVCAATEHIEADDLAEDAM

SEQ ID NO: 186801 - protein, 37 aa, Artificial Sequence
  Description of Artificial Sequence: Synthetic polypeptide
DEEEIACTNPVATEQYGSVCAATEHLEATRDLAEDAM

SEQ ID NO: 186802 - protein, 38 aa, Artificial Sequence
  Description of Artificial Sequence: Synthetic polypeptide
DEEEIACTNPVATEQYGSVCAATEPGLEAGMPPGEARN

SEQ ID NO: 186803 - protein, 37 aa, Artificial Sequence
  Description of Artificial Sequence: Synthetic polypeptide
DEEEIACTNPVATEQYGSVCAATEVLEAGTDGAEDAH

SEQ ID NO: 186804 - protein, 37 aa, Artificial Sequence
  Description of Artificial Sequence: Synthetic polypeptide
DEEEIACTNPVATEQYGSVCAATEVLEAMGEQDEEAM

SEQ ID NO: 186805 - protein, 32 aa, Artificial Sequence
  Description of Artificial Sequence: Synthetic polypeptide
NETEIATTNPVAYEAWGVCATNANGDTGNGND

SEQ ID NO: 186806 - protein, 34 aa, Artificial Sequence
  Description of Artificial Sequence: Synthetic polypeptide
NETEIATTNPVAYEQWGCTYSDQRDNQQGEGGNN

SEQ ID NO: 186807 - protein, 30 aa, Artificial Sequence
  Description of Artificial Sequence: Synthetic polypeptide
NETEIATTNPVAYEQWGEAYYVEQPEKEGE

SEQ ID NO: 186808 - protein, 36 aa, Artificial Sequence
  Description of Artificial Sequence: Synthetic polypeptide
DEEEIACTNPVATEQYGSVCAATHPLEADDLMEDAM

SEQ ID NO: 186809 - protein, 35 aa, Artificial Sequence
  Description of Artificial Sequence: Synthetic polypeptide
NETEIRTTNPCAYEQWGSVWGDNLNDQQGQGGGKD

SEQ ID NO: 186810 - protein, 37 aa, Artificial Sequence
  Description of Artificial Sequence: Synthetic polypeptide
DEEEIRTTNPVATEQYGSYTSLLPALENVSSVAMWED

SEQ ID NO: 186811 - protein, 36 aa, Artificial Sequence
  Description of Artificial Sequence: Synthetic polypeptide
CESEIATTNPCATEQYGTVCSATGEEWSTNTNGGND

SEQ ID NO: 186812 - protein, 38 aa, Artificial Sequence
  Description of Artificial Sequence: Synthetic polypeptide
DEEEIRTTNPVATEQYGSYTSLCPNLENVSSVAVMWET

SEQ ID NO: 186813 - protein, 38 aa, Artificial Sequence
  Description of Artificial Sequence: Synthetic polypeptide
DEEEIRTTNPVATEQYGSVPPELGDILHEERILLTDVF

SEQ ID NO: 186814 - protein, 35 aa, Artificial Sequence
  Description of Artificial Sequence: Synthetic polypeptide
CEQEIRATNPVATEIYGVVTMQDGDNGQRFNDNGQ

SEQ ID NO: 186815 - protein, 36 aa, Artificial Sequence
  Description of Artificial Sequence: Synthetic polypeptide
NENEIRTTNPVATEQYGSVPYQTDEEDQTPSIEEQP

SEQ ID NO: 186816 - protein, 38 aa, Artificial Sequence
  Description of Artificial Sequence: Synthetic polypeptide
CEQEIRTTNPVATEQYGSVVMSVNDNNTGGGQQGQVGD

SEQ ID NO: 186817 - protein, 33 aa, Artificial Sequence
  Description of Artificial Sequence: Synthetic polypeptide
NENSIRTTNPVSTEPYGCTISMEDIQQQQNGNH

SEQ ID NO: 186818 - protein, 35 aa, Artificial Sequence
  Description of Artificial Sequence: Synthetic polypeptide
NENVEIATTNPVAYEPWGSVYCTNLGDDAGGNGDT

SEQ ID NO: 186819 - protein, 36 aa, Artificial Sequence
  Description of Artificial Sequence: Synthetic polypeptide
NEPEIATTNPVATEQYGGCSVMANVEVLINGQSTDT

SEQ ID NO: 186820 - protein, 35 aa, Artificial Sequence
  Description of Artificial Sequence: Synthetic polypeptide
NEPEIATTNPVATEQYGSVLMADQEVLINGQSTDV

SEQ ID NO: 186821 - protein, 37 aa, Artificial Sequence
  Description of Artificial Sequence: Synthetic polypeptide
DEEEIRTTNPVATEQYGSVPPPMIHEQAEEFVVEETP

SEQ ID NO: 186822 - protein, 37 aa, Artificial Sequence
  Description of Artificial Sequence: Synthetic polypeptide
NEQEIATTNPVATEAYGSTVCSCTALVSEDHEGGENG

SEQ ID NO: 186823 - protein, 37 aa, Artificial Sequence
  Description of Artificial Sequence: Synthetic polypeptide
NEQEIATTNPVATEQYGSTVSCTATVSEDHEGGDNGP

SEQ ID NO: 186824 - protein, 38 aa, Artificial Sequence
  Description of Artificial Sequence: Synthetic polypeptide
CEQEIRTTNPVATEQYGVVSILIATGDEDQSEGNDGGD

SEQ ID NO: 186825 - protein, 33 aa, Artificial Sequence
  Description of Artificial Sequence: Synthetic polypeptide
CEPVIACTNPVATEQWGCVAGTGPADMMGENRW

SEQ ID NO: 186826 - protein, 37 aa, Artificial Sequence
  Description of Artificial Sequence: Synthetic polypeptide
NEQEIRTTNPVATEQYGCSCVNTETVTLEIGEGDQQV

SEQ ID NO: 186827 - protein, 36 aa, Artificial Sequence
  Description of Artificial Sequence: Synthetic polypeptide
NEREIRTTNPVATEQYGCVCQNWGEHNQEIFGSDQS

SEQ ID NO: 186828 - protein, 35 aa, Artificial Sequence
  Description of Artificial Sequence: Synthetic polypeptide
NEREIRTTNPVATEQYGCVCQWEHNQESFGSDTQS

SEQ ID NO: 186829 - protein, 36 aa, Artificial Sequence
  Description of Artificial Sequence: Synthetic polypeptide
CESEIATTNPCATEQYGKVCSATGEEWSENSNGGND

SEQ ID NO: 186830 - protein, 36 aa, Artificial Sequence
  Description of Artificial Sequence: Synthetic polypeptide
CESEIATTNPCATEQYGKVCSATGSEWSENMNSGND

SEQ ID NO: 186831 - protein, 36 aa, Artificial Sequence
  Description of Artificial Sequence: Synthetic polypeptide
CESEIATTNPCATEQYGQVCSCTGEEVSENMNGGNP

SEQ ID NO: 186832 - protein, 32 aa, Artificial Sequence
  Description of Artificial Sequence: Synthetic polypeptide
DENEIACTNPVATECWGATTANAEDWAPGPYR

SEQ ID NO: 186833 - protein, 33 aa, Artificial Sequence
  Description of Artificial Sequence: Synthetic polypeptide
DENEIACTNPIATECWGATWSNAENLAEPKGPR

SEQ ID NO: 186834 - protein, 37 aa, Artificial Sequence
  Description of Artificial Sequence: Synthetic polypeptide
DEEEIRTTNPVATEQYGSYTSAPAIGIQQLSVEEFCL

SEQ ID NO: 186835 - protein, 37 aa, Artificial Sequence
  Description of Artificial Sequence: Synthetic polypeptide
DEEEIRTTNPVATEQYGSYTSLCPCLENVSSVAMQED

SEQ ID NO: 186836 - protein, 38 aa, Artificial Sequence
  Description of Artificial Sequence: Synthetic polypeptide
DEEEIRTTNPVATEQYGSYTSLCPNLEAVSKVAMMMEE

SEQ ID NO: 186837 - protein, 38 aa, Artificial Sequence
  Description of Artificial Sequence: Synthetic polypeptide
DEEEIRTTNPVATEQYGSVPPENTGWLLEEVDLELDPF

SEQ ID NO: 186838 - protein, 36 aa, Artificial Sequence
  Description of Artificial Sequence: Synthetic polypeptide
DEEEIRTTNPVATEQYGSYTIAPIGIQQLSVEELCS

SEQ ID NO: 186839 - protein, 37 aa, Artificial Sequence
  Description of Artificial Sequence: Synthetic polypeptide
MEGEIRTTNPVATEQYGSSWSPTPAEGPNMRFEMNSV

SEQ ID NO: 186840 - protein, 31 aa, Artificial Sequence
  Description of Artificial Sequence: Synthetic polypeptide
DENEIATTNPIATECYGDTAADLAEHKEEYL

SEQ ID NO: 186841 - protein, 33 aa, Artificial Sequence
  Description of Artificial Sequence: Synthetic polypeptide
CENEIATTNPVAYEPYGQKVQSYMHLSQHETES

SEQ ID NO: 186842 - protein, 31 aa, Artificial Sequence
  Description of Artificial Sequence: Synthetic polypeptide
NEEEIATTNPVAYEQWGEAYYVEQQPEAEGH

SEQ ID NO: 186843 - protein, 31 aa, Artificial Sequence
  Description of Artificial Sequence: Synthetic polypeptide
NEEEIATTNPVAYEQWGEAYYVEQQPEEHGE

SEQ ID NO: 186844 - protein, 35 aa, Artificial Sequence
  Description of Artificial Sequence: Synthetic polypeptide
DENEIATTNPVATEQWGCVVAADGSLAPDQENGHM

SEQ ID NO: 186845 - protein, 36 aa, Artificial Sequence
  Description of Artificial Sequence: Synthetic polypeptide
NEEEIATTNPVAYEQYGSVAGTNGVLPENMDIEDTN

SEQ ID NO: 186846 - protein, 35 aa, Artificial Sequence
  Description of Artificial Sequence: Synthetic polypeptide
DENEIATTNPVATEQWGCVAGSGHPANPNPMGAQP

SEQ ID NO: 186847 - protein, 35 aa, Artificial Sequence
  Description of Artificial Sequence: Synthetic polypeptide
DENEIATTNPVATEQWGCVAGENGVEMNGAEEDNA

SEQ ID NO: 186848 - protein, 36 aa, Artificial Sequence
  Description of Artificial Sequence: Synthetic polypeptide
NEEEIATTNPVAYEQYGSVATTGPLSENADIEEGFM

SEQ ID NO: 186849 - protein, 34 aa, Artificial Sequence
  Description of Artificial Sequence: Synthetic polypeptide
DENEIATTNPVATEQWGCVAGEGVEMNADEGGAD

SEQ ID NO: 186850 - protein, 34 aa, Artificial Sequence
  Description of Artificial Sequence: Synthetic polypeptide
DENEIATTNPVATEQWGCVAGEGGEANAASDNID

SEQ ID NO: 186851 - protein, 37 aa, Artificial Sequence
  Description of Artificial Sequence: Synthetic polypeptide
NEEEIGTTNPVATEQYGSTPVVPSTGKDEVILAEMGF

SEQ ID NO: 186852 - protein, 34 aa, Artificial Sequence
  Description of Artificial Sequence: Synthetic polypeptide
DENEIATTNPVATEQWGCVAGEGEANAASLDNLD

SEQ ID NO: 186853 - protein, 34 aa, Artificial Sequence
  Description of Artificial Sequence: Synthetic polypeptide
DENEIATTNPVATEQWGCVAGEGEANAASEDNAE

SEQ ID NO: 186854 - protein, 35 aa, Artificial Sequence
  Description of Artificial Sequence: Synthetic polypeptide
DENEIATTNPVATEQWGCVAANSGLPPAEAEPNHH

SEQ ID NO: 186855 - protein, 37 aa, Artificial Sequence
  Description of Artificial Sequence: Synthetic polypeptide
NEEEIRTTNPVATEFYGTVVLSDLINMDQSTGEGGQG

SEQ ID NO: 186856 - protein, 35 aa, Artificial Sequence
  Description of Artificial Sequence: Synthetic polypeptide
NEEEIRTTNPVATEFYGVVNQTDGEFEGQGQQEGA

SEQ ID NO: 186857 - protein, 36 aa, Artificial Sequence
  Description of Artificial Sequence: Synthetic polypeptide
NEEEIRTTNPVATEGYGMVNGQGTGQGDGGDEQNGE

SEQ ID NO: 186858 - protein, 35 aa, Artificial Sequence
  Description of Artificial Sequence: Synthetic polypeptide
DENEIATTNPVATEQWGCTAATENLTAGIQMEKAH

SEQ ID NO: 186859 - protein, 36 aa, Artificial Sequence
  Description of Artificial Sequence: Synthetic polypeptide
DEEEIACTNPVATEQYGSACAPNPHTAEAGIGNAED

SEQ ID NO: 186860 - protein, 37 aa, Artificial Sequence
  Description of Artificial Sequence: Synthetic polypeptide
DEEEIACTNPVATEQYGSACATNPDEEAGAHQDGEAP

SEQ ID NO: 186861 - protein, 36 aa, Artificial Sequence
  Description of Artificial Sequence: Synthetic polypeptide
DEEEIACTNPVATEQYGSACATNPEEGQEHQDDSAG

SEQ ID NO: 186862 - protein, 37 aa, Artificial Sequence
  Description of Artificial Sequence: Synthetic polypeptide
NEEEIRTTNPVATEQYGCSCPPTWALSVETTIEQFDN

SEQ ID NO: 186863 - protein, 37 aa, Artificial Sequence
  Description of Artificial Sequence: Synthetic polypeptide
NEEEIRTTNPVATEQYGCSCSMWGEHNTEYFQSDTQS

SEQ ID NO: 186864 - protein, 38 aa, Artificial Sequence
  Description of Artificial Sequence: Synthetic polypeptide
NEEEIRTTNPVATEQYGCSCSNWGEDDNTENFQSDTQA

SEQ ID NO: 186865 - protein, 31 aa, Artificial Sequence
  Description of Artificial Sequence: Synthetic polypeptide
NEEEIATTNPVAYEQWGEACYVWEQHDAEDG

SEQ ID NO: 186866 - protein, 33 aa, Artificial Sequence
  Description of Artificial Sequence: Synthetic polypeptide
NEEEIATTNPVAYEKWGSVCWIELGGQVDHHSN

SEQ ID NO: 186867 - protein, 38 aa, Artificial Sequence
  Description of Artificial Sequence: Synthetic polypeptide
DEEEIRTTNPVATEQYGSVQICQQLDTPEENSHPNMDL

SEQ ID NO: 186868 - protein, 32 aa, Artificial Sequence
  Description of Artificial Sequence: Synthetic polypeptide
CENEIATTNPVAYEPFGKVSCMGHLSQHETEL

SEQ ID NO: 186869 - protein, 34 aa, Artificial Sequence
  Description of Artificial Sequence: Synthetic polypeptide
NEEEIATTNPVATEQWGGCCTAAAGNLDNMPQSH

SEQ ID NO: 186870 - protein, 35 aa, Artificial Sequence
  Description of Artificial Sequence: Synthetic polypeptide
NEEEIATTNPVATEQWGGCCTAAAGNPDNMDPGHR

SEQ ID NO: 186871 - protein, 38 aa, Artificial Sequence
  Description of Artificial Sequence: Synthetic polypeptide
DEEEIACTNPVATEQYGSACAATNGIEEAPGDQMEGNH

SEQ ID NO: 186872 - protein, 37 aa, Artificial Sequence
  Description of Artificial Sequence: Synthetic polypeptide
NEEEIATTNPVATEQWGSVSMSGDTPTNNDDLMDNQM

SEQ ID NO: 186873 - protein, 37 aa, Artificial Sequence
  Description of Artificial Sequence: Synthetic polypeptide
NEEEIATTNPVATEQWGSVSMSGDTPTNNDDLMGAQH

SEQ ID NO: 186874 - protein, 38 aa, Artificial Sequence
  Description of Artificial Sequence: Synthetic polypeptide
DENEIATTNPVATEQYGCTTAANAGGLPQANMHGMNRQ

SEQ ID NO: 186875 - protein, 36 aa, Artificial Sequence
  Description of Artificial Sequence: Synthetic polypeptide
DENEIATTNPVATEQYGCSSAANTHAPEAGGNLEGN

SEQ ID NO: 186876 - protein, 36 aa, Artificial Sequence
  Description of Artificial Sequence: Synthetic polypeptide
NEEEIATTNPVATEQYGCVAANNGGEATDSQSGEAM

SEQ ID NO: 186877 - protein, 38 aa, Artificial Sequence
  Description of Artificial Sequence: Synthetic polypeptide
AEEEIRTTNPVATEQYGSYVQPAAVPSDIQMIEPGNIL

SEQ ID NO: 186878 - protein, 35 aa, Artificial Sequence
  Description of Artificial Sequence: Synthetic polypeptide
DENEIATTNPVATEQYGCNVAANHSGDNGMDPLGG

SEQ ID NO: 186879 - protein, 38 aa, Artificial Sequence
  Description of Artificial Sequence: Synthetic polypeptide
DEEEIACTNPVATEQYGSACAATNGPLEAPGEQMEGRH

SEQ ID NO: 186880 - protein, 37 aa, Artificial Sequence
  Description of Artificial Sequence: Synthetic polypeptide
DEEEIACTNPVATEQYGSACATNPELGQLHQDDSMAG

SEQ ID NO: 186881 - protein, 37 aa, Artificial Sequence
  Description of Artificial Sequence: Synthetic polypeptide
DEEEIACTNPVATEQYGSACAATNGQEAPGEQMEGTH

SEQ ID NO: 186882 - protein, 37 aa, Artificial Sequence
  Description of Artificial Sequence: Synthetic polypeptide
NEEEIATTNPVATEQYGSACSAANPAEADAEIGNNTQ

SEQ ID NO: 186883 - protein, 38 aa, Artificial Sequence
  Description of Artificial Sequence: Synthetic polypeptide
NEEEIATTNPVATEQYGSACSTANPAEGQDHQDDINAE

SEQ ID NO: 186884 - protein, 37 aa, Artificial Sequence
  Description of Artificial Sequence: Synthetic polypeptide
AEEEIRTTNPVATEQYGSYSSPITAEPNSPVAHPPVW

SEQ ID NO: 186885 - protein, 37 aa, Artificial Sequence
  Description of Artificial Sequence: Synthetic polypeptide
AEEEIRTTNPVATEQYGSYSEPSTAEPNSPVNHPPVC

SEQ ID NO: 186886 - protein, 37 aa, Artificial Sequence
  Description of Artificial Sequence: Synthetic polypeptide
DEEEIACTNPVATEQYGSACAATNPEEAPGEQMEDNH

SEQ ID NO: 186887 - protein, 36 aa, Artificial Sequence
  Description of Artificial Sequence: Synthetic polypeptide
NEEEIATTNPVATEQYGSICAGMGGVEDNEMNENDN

SEQ ID NO: 186888 - protein, 37 aa, Artificial Sequence
  Description of Artificial Sequence: Synthetic polypeptide
DEEEIACTNPVATEQYGSACAAVATGVNTAGGDTAHW

SEQ ID NO: 186889 - protein, 37 aa, Artificial Sequence
  Description of Artificial Sequence: Synthetic polypeptide
DEEEIACTNPVATEQYGSACAGANPHLAEAPMGEANN

SEQ ID NO: 186890 - protein, 32 aa, Artificial Sequence
  Description of Artificial Sequence: Synthetic polypeptide
CENEIATTNPVAYDPYGKVSIIGALSQQETEG

SEQ ID NO: 186891 - protein, 34 aa, Artificial Sequence
  Description of Artificial Sequence: Synthetic polypeptide
DENEIATTNPVATEQWGNVAGSGNPANPDPPAQP

SEQ ID NO: 186892 - protein, 34 aa, Artificial Sequence
  Description of Artificial Sequence: Synthetic polypeptide
DENEIATTNPVATEQWGNVAGEGWPANPNPGAQP

SEQ ID NO: 186893 - protein, 38 aa, Artificial Sequence
  Description of Artificial Sequence: Synthetic polypeptide
DEEEIACTNPVATEQYGSACAATNGVSEAPGEQMEGNH

SEQ ID NO: 186894 - protein, 38 aa, Artificial Sequence
  Description of Artificial Sequence: Synthetic polypeptide
DEEEIRTTNPVATEQYGSYAEPTELNMEFSRDEVESTA

SEQ ID NO: 186895 - protein, 33 aa, Artificial Sequence
  Description of Artificial Sequence: Synthetic polypeptide
CENEIATTNPVAYEPYGCKTVSCMHLSQHETEL

SEQ ID NO: 186896 - protein, 37 aa, Artificial Sequence
  Description of Artificial Sequence: Synthetic polypeptide
NEEEIRTTNPVATEQYGCVCSSGEDHNDEFFNSDTQS

SEQ ID NO: 186897 - protein, 36 aa, Artificial Sequence
  Description of Artificial Sequence: Synthetic polypeptide
DEEEIACTNPVATEQYGSACSANPNLNDSPDESADE

SEQ ID NO: 186898 - protein, 37 aa, Artificial Sequence
  Description of Artificial Sequence: Synthetic polypeptide
NEEEIRTTNPVATEQYGSTSCPPTALSVETTIEIFDN

SEQ ID NO: 186899 - protein, 33 aa, Artificial Sequence
  Description of Artificial Sequence: Synthetic polypeptide
CENEIATTNPVAYEPYGKVSIMGGLSQHETEGI

SEQ ID NO: 186900 - protein, 37 aa, Artificial Sequence
  Description of Artificial Sequence: Synthetic polypeptide
DEEEIACTNPVATEQYGSACSPAPDTLQEDAGEPKMH

SEQ ID NO: 186901 - protein, 36 aa, Artificial Sequence
  Description of Artificial Sequence: Synthetic polypeptide
NEEEIRTTNPVATEQYGSVEGWNTGMDIEMEFESQA

SEQ ID NO: 186902 - protein, 37 aa, Artificial Sequence
  Description of Artificial Sequence: Synthetic polypeptide
DEEEIACTNPVATEQYGSCAAAPGNHPMEGMEIGNRD

SEQ ID NO: 186903 - protein, 37 aa, Artificial Sequence
  Description of Artificial Sequence: Synthetic polypeptide
DEEEIACTNPVATEQYGSCAAATGNGPMAGMEIGNNN

SEQ ID NO: 186904 - protein, 36 aa, Artificial Sequence
  Description of Artificial Sequence: Synthetic polypeptide
DEEEIACTNPVATEQYGSCAAGFPLFDNQEPEEGAE

SEQ ID NO: 186905 - protein, 36 aa, Artificial Sequence
  Description of Artificial Sequence: Synthetic polypeptide
DEEEIACTNPVATEQYGSCAAGNPLFDGPEGEGGEE

SEQ ID NO: 186906 - protein, 36 aa, Artificial Sequence
  Description of Artificial Sequence: Synthetic polypeptide
DEEEIACTNPVATEQYGSCAAGNPPFDGPEHENGVD

SEQ ID NO: 186907 - protein, 37 aa, Artificial Sequence
  Description of Artificial Sequence: Synthetic polypeptide
DEEEIACTNPVATEQYGSCAAMGNGGTNTADGMNNMN

SEQ ID NO: 186908 - protein, 36 aa, Artificial Sequence
  Description of Artificial Sequence: Synthetic polypeptide
DEEEIACTNPVATEQYGSCAAMGNGGTNTADINEDN

SEQ ID NO: 186909 - protein, 37 aa, Artificial Sequence
  Description of Artificial Sequence: Synthetic polypeptide
DEEEIACTNPVATEQYGSCAAMGNGTTNTADGMGNDN

SEQ ID NO: 186910 - protein, 37 aa, Artificial Sequence
  Description of Artificial Sequence: Synthetic polypeptide
DEEEIACTNPVATEQYGSCAATGNGLTNPDDGMGDFN

SEQ ID NO: 186911 - protein, 37 aa, Artificial Sequence
  Description of Artificial Sequence: Synthetic polypeptide
DEEEIACTNPVATEQYGSCAATGNPGDTTAGNDNAEQ

SEQ ID NO: 186912 - protein, 31 aa, Artificial Sequence
  Description of Artificial Sequence: Synthetic polypeptide
DENEIATTNPVATECWGATTAAECWQEHEPL

SEQ ID NO: 186913 - protein, 38 aa, Artificial Sequence
  Description of Artificial Sequence: Synthetic polypeptide
DEEEIACTNPVATEQYGSCPAGTGNVPTQPDDEMGNDD

SEQ ID NO: 186914 - protein, 32 aa, Artificial Sequence
  Description of Artificial Sequence: Synthetic polypeptide
CENEIATTNPVAYEPYGKVSNHQSQHEVTEML

SEQ ID NO: 186915 - protein, 37 aa, Artificial Sequence
  Description of Artificial Sequence: Synthetic polypeptide
DEEEIACTNPVATEQYGSIACATNPLENTADPTEGVM

SEQ ID NO: 186916 - protein, 32 aa, Artificial Sequence
  Description of Artificial Sequence: Synthetic polypeptide
CENEIATTNPVAYEPYGKVSPIGHDSQHETEG

SEQ ID NO: 186917 - protein, 37 aa, Artificial Sequence
  Description of Artificial Sequence: Synthetic polypeptide
DEEEIACTNPVATEQYGSTACAANPGLPLGSEGNQHN

SEQ ID NO: 186918 - protein, 34 aa, Artificial Sequence
  Description of Artificial Sequence: Synthetic polypeptide
DENEIATTNPVATASWGGCNVANNNLQADANTHH

SEQ ID NO: 186919 - protein, 37 aa, Artificial Sequence
  Description of Artificial Sequence: Synthetic polypeptide
DEEEIACTNPVATEQYGSVACSPVDNNHNPDAMGEGN

SEQ ID NO: 186920 - protein, 37 aa, Artificial Sequence
  Description of Artificial Sequence: Synthetic polypeptide
NEEEIRTTNPVATEQYGSSCPPTQWLSVETTIEQFDN

SEQ ID NO: 186921 - protein, 36 aa, Artificial Sequence
  Description of Artificial Sequence: Synthetic polypeptide
DEEEIACTNPVATEQYGSACSANPAEGQDHQDDQAN

SEQ ID NO: 186922 - protein, 38 aa, Artificial Sequence
  Description of Artificial Sequence: Synthetic polypeptide
DEEEIRTTNPVATEQYGSVPYVGIEAEQIENTEEDNDM

SEQ ID NO: 186923 - protein, 36 aa, Artificial Sequence
  Description of Artificial Sequence: Synthetic polypeptide
DEAEICTTNPVATEMWGVVSHTNNNIDDRQNMGGHE

SEQ ID NO: 186924 - protein, 33 aa, Artificial Sequence
  Description of Artificial Sequence: Synthetic polypeptide
CENEIATTNPVAYEPYGKTVSIMHALSQHETEL

SEQ ID NO: 186925 - protein, 35 aa, Artificial Sequence
  Description of Artificial Sequence: Synthetic polypeptide
DENEIATTNPVATEPWGSVAGSGNPANPNPMGAQP

SEQ ID NO: 186926 - protein, 36 aa, Artificial Sequence
  Description of Artificial Sequence: Synthetic polypeptide
NEEEIRTTNPVATEQYGCVHDYYVCQEKDGVVDSDS

SEQ ID NO: 186927 - protein, 33 aa, Artificial Sequence
  Description of Artificial Sequence: Synthetic polypeptide
DEAEICTTNPVAYEQWGCVCPNNDEWDTGDTEQ

SEQ ID NO: 186928 - protein, 36 aa, Artificial Sequence
  Description of Artificial Sequence: Synthetic polypeptide
DEEEIACTNPVATEQYGSACATNPQENTADPMESKA

SEQ ID NO: 186929 - protein, 33 aa, Artificial Sequence
  Description of Artificial Sequence: Synthetic polypeptide
CENEIATTNPVAYEPYGKVGSIIGHLSGQETEG

SEQ ID NO: 186930 - protein, 37 aa, Artificial Sequence
  Description of Artificial Sequence: Synthetic polypeptide
NEEEIRTTNPVATEQYGMVSVEGMGDGGEGQEFENGE

SEQ ID NO: 186931 - protein, 36 aa, Artificial Sequence
  Description of Artificial Sequence: Synthetic polypeptide
NEEEIRTTNPVATEQYGMVSVEGMGDGGEGQEQEGV

SEQ ID NO: 186932 - protein, 38 aa, Artificial Sequence
  Description of Artificial Sequence: Synthetic polypeptide
NEEEIRTTNPVATEQYGMVSVEGMGDGGQGNEQDETGN

SEQ ID NO: 186933 - protein, 38 aa, Artificial Sequence
  Description of Artificial Sequence: Synthetic polypeptide
NEEEIRTTNPVATEQYGMVSVETGMGVGGQGQEQDEGN

SEQ ID NO: 186934 - protein, 37 aa, Artificial Sequence
  Description of Artificial Sequence: Synthetic polypeptide
NEEEIRTTNPVATEQYGNTVPHSIVWSGISDQELVLQ

SEQ ID NO: 186935 - protein, 33 aa, Artificial Sequence
  Description of Artificial Sequence: Synthetic polypeptide
CENEIATTNPVAYEPYGKIVSIIGYLSQHETEG

SEQ ID NO: 186936 - protein, 37 aa, Artificial Sequence
  Description of Artificial Sequence: Synthetic polypeptide
NEEEIRTTNPVATEQYGQCSCSSGEDNQENFQSDTQA

SEQ ID NO: 186937 - protein, 36 aa, Artificial Sequence
  Description of Artificial Sequence: Synthetic polypeptide
NEEEIRTTNPVATEQYGQCVCSSGEHDEFFGSDTQA

SEQ ID NO: 186938 - protein, 36 aa, Artificial Sequence
  Description of Artificial Sequence: Synthetic polypeptide
DEEEIACTNPVATEQYGSACGTGDTPQPDDLMGDQH

SEQ ID NO: 186939 - protein, 34 aa, Artificial Sequence
  Description of Artificial Sequence: Synthetic polypeptide
DEAEICTTNPVAYEEWGCVCPNNNDQMDTGDNEP

SEQ ID NO: 186940 - protein, 32 aa, Artificial Sequence
  Description of Artificial Sequence: Synthetic polypeptide
CENEIATTNPVAYEPYGKVNIIGHLSQAETEG

SEQ ID NO: 186941 - protein, 39 aa, Artificial Sequence
  Description of Artificial Sequence: Synthetic polypeptide
DEAEICTTNPVATEQYGSVSGNGTTNDGEGQNEEQDEDQ

SEQ ID NO: 186942 - protein, 37 aa, Artificial Sequence
  Description of Artificial Sequence: Synthetic polypeptide
DEAEICTTNPVATEQYGSVNNPGWNSLEFGEFEQQVP

SEQ ID NO: 186943 - protein, 38 aa, Artificial Sequence
  Description of Artificial Sequence: Synthetic polypeptide
NEEEIRTTNPVATEQYGSFVIESLDNQEVAEPELTPRF

SEQ ID NO: 186944 - protein, 32 aa, Artificial Sequence
  Description of Artificial Sequence: Synthetic polypeptide
CENEIATTNPVAYEPYGKVQAIGHLSQHETEG

SEQ ID NO: 186945 - protein, 33 aa, Artificial Sequence
  Description of Artificial Sequence: Synthetic polypeptide
CENEIATTNPVAYEPYGKVSIEGHLSQHETELQ

SEQ ID NO: 186946 - protein, 33 aa, Artificial Sequence
  Description of Artificial Sequence: Synthetic polypeptide
CENEIATTNPVAYEPYGKVSIIGHALSQHETEG

SEQ ID NO: 186947 - protein, 36 aa, Artificial Sequence
  Description of Artificial Sequence: Synthetic polypeptide
DEAEICTTNPVATEMWGVVSHTNNNIDDRQNQNGDH

SEQ ID NO: 186948 - protein, 37 aa, Artificial Sequence
  Description of Artificial Sequence: Synthetic polypeptide
NEEEIRTTNPVATEQYGQCSCSWGEHNIEYFQSDTQS

SEQ ID NO: 186949 - protein, 37 aa, Artificial Sequence
  Description of Artificial Sequence: Synthetic polypeptide
MEGEIRTTNPVATEQYGSSNYVSMNHGQDEVSSEFDS

SEQ ID NO: 186950 - protein, 36 aa, Artificial Sequence
  Description of Artificial Sequence: Synthetic polypeptide
MEGEIRTTNPVATEQYGSNSTPWKGIENNMDNEDFD

SEQ ID NO: 186951 - protein, 37 aa, Artificial Sequence
  Description of Artificial Sequence: Synthetic polypeptide
MEGEIRTTNPVATEQYGSNSTPAKGIENQNMDNNDTD

SEQ ID NO: 186952 - protein, 34 aa, Artificial Sequence
  Description of Artificial Sequence: Synthetic polypeptide
DENEIRTTNPIATECYGAIWANMEDWAQPNGPYI

SEQ ID NO: 186953 - protein, 37 aa, Artificial Sequence
  Description of Artificial Sequence: Synthetic polypeptide
FEEEIRTTNPVAYEQYGESMQSPSVTLEQFAVGEPVD

SEQ ID NO: 186954 - protein, 38 aa, Artificial Sequence
  Description of Artificial Sequence: Synthetic polypeptide
FEEEIRTTNPVAYEQYGESMTSPSVTLEQEMRVGEPVD

SEQ ID NO: 186955 - protein, 32 aa, Artificial Sequence
  Description of Artificial Sequence: Synthetic polypeptide
DENEIRTTNPIATECWGDTVANEDEANAAGDA

SEQ ID NO: 186956 - protein, 35 aa, Artificial Sequence
  Description of Artificial Sequence: Synthetic polypeptide
FEEEISTTNPSAQYFYGTSVPMAMFLDQNVAGNQR

SEQ ID NO: 186957 - protein, 34 aa, Artificial Sequence
  Description of Artificial Sequence: Synthetic polypeptide
DENEIRTTNPIATECWGATVWSNADLAEPKGPYI

SEQ ID NO: 186958 - protein, 33 aa, Artificial Sequence
  Description of Artificial Sequence: Synthetic polypeptide
DENEIRTTNPIATECWGATVWSEDEANPAEPYI

SEQ ID NO: 186959 - protein, 33 aa, Artificial Sequence
  Description of Artificial Sequence: Synthetic polypeptide
DENEIRTTNPIATECWGATVWANADWMNPKGDI

SEQ ID NO: 186960 - protein, 33 aa, Artificial Sequence
  Description of Artificial Sequence: Synthetic polypeptide
DENEIRTTNPIATECWGATVWANADWMNPKGDA

SEQ ID NO: 186961 - protein, 32 aa, Artificial Sequence
  Description of Artificial Sequence: Synthetic polypeptide
DENEIRTTNPIATECWGATVANADWMNPKGDA

SEQ ID NO: 186962 - protein, 32 aa, Artificial Sequence
  Description of Artificial Sequence: Synthetic polypeptide
DENEIRTTNPIATECWGATVANADWMNPKEDA

SEQ ID NO: 186963 - protein, 36 aa, Artificial Sequence
  Description of Artificial Sequence: Synthetic polypeptide
FEGEIATTNPVATEQYGSSFSAPYDTLEPHEGEDTR

SEQ ID NO: 186964 - protein, 33 aa, Artificial Sequence
  Description of Artificial Sequence: Synthetic polypeptide
DENEIRTTNPIATECWGATTWANADWAEPKGPR

SEQ ID NO: 186965 - protein, 36 aa, Artificial Sequence
  Description of Artificial Sequence: Synthetic polypeptide
FEQEIRTTNPVATEQYGVVDDNDDDEEEGGEGNIQG

SEQ ID NO: 186966 - protein, 33 aa, Artificial Sequence
  Description of Artificial Sequence: Synthetic polypeptide
DENEIRTTNPCSYEPYGTTSSMEWDQQQQNGNH

SEQ ID NO: 186967 - protein, 36 aa, Artificial Sequence
  Description of Artificial Sequence: Synthetic polypeptide
FQPEIRTTNPVATEQYGSVSWAKWNEEASNEDLPLQ

SEQ ID NO: 186968 - protein, 33 aa, Artificial Sequence
  Description of Artificial Sequence: Synthetic polypeptide
DENEIRTTNPCSYEPYGTIYSMEWIQQQQNGNH

SEQ ID NO: 186969 - protein, 33 aa, Artificial Sequence
  Description of Artificial Sequence: Synthetic polypeptide
DENEIRTTNPCIYEPYGTTSAMEWDQMQQNGNH

SEQ ID NO: 186970 - protein, 37 aa, Artificial Sequence
  Description of Artificial Sequence: Synthetic polypeptide
DENEIRTTNPCATEQYGVVATTNANANDTGTEEGSNI

SEQ ID NO: 186971 - protein, 38 aa, Artificial Sequence
  Description of Artificial Sequence: Synthetic polypeptide
DENEIRTTNPAATEQYGQVVTNTQDNGENGEGQGEGEQ

SEQ ID NO: 186972 - protein, 34 aa, Artificial Sequence
  Description of Artificial Sequence: Synthetic polypeptide
CEEVIACTNPVATEQWGSVSMNNSNAAGDPGESW

SEQ ID NO: 186973 - protein, 32 aa, Artificial Sequence
  Description of Artificial Sequence: Synthetic polypeptide
DENEIRSTNPVSTEPYGTIAMEDIQQQQNGDI

SEQ ID NO: 186974 - protein, 32 aa, Artificial Sequence
  Description of Artificial Sequence: Synthetic polypeptide
DENEIRSTNPVSTEPYGTIAMEDIQQQHNGDI

SEQ ID NO: 186975 - protein, 34 aa, Artificial Sequence
  Description of Artificial Sequence: Synthetic polypeptide
DENEIRTTNPIATECYGAIWANMEDWQQPNGPYI

SEQ ID NO: 186976 - protein, 33 aa, Artificial Sequence
  Description of Artificial Sequence: Synthetic polypeptide
DENEIRTTNPIATECYGATTSNAEDIAEPKGPI

SEQ ID NO: 186977 - protein, 33 aa, Artificial Sequence
  Description of Artificial Sequence: Synthetic polypeptide
DENEIRTTNPIATECYGATVANAEDWAEHGPYI

SEQ ID NO: 186978 - protein, 39 aa, Artificial Sequence
  Description of Artificial Sequence: Synthetic polypeptide
FEEEIRTTNPVATEQYGVVYTQGTDQLIDQNNEGGNQGT

SEQ ID NO: 186979 - protein, 40 aa, Artificial Sequence
  Description of Artificial Sequence: Synthetic polypeptide
FEEEIRTTNPVATEQYGSVVYGQGTDQLIDQEGEGGNQGT

SEQ ID NO: 186980 - protein, 37 aa, Artificial Sequence
  Description of Artificial Sequence: Synthetic polypeptide
AEEEIRTTNPVAYEQYGQCVCSNTGEHNQNFNSDNQG

SEQ ID NO: 186981 - protein, 33 aa, Artificial Sequence
  Description of Artificial Sequence: Synthetic polypeptide
DENEIRTTNPIATEQWGATTANAIWANAKGDYI

SEQ ID NO: 186982 - protein, 33 aa, Artificial Sequence
  Description of Artificial Sequence: Synthetic polypeptide
DENEIRTTNPIATEQWGATTANAIEANAKEDYI

SEQ ID NO: 186983 - protein, 33 aa, Artificial Sequence
  Description of Artificial Sequence: Synthetic polypeptide
DENEIRTTNPIATEQWGATTANADWANAKGDYI

SEQ ID NO: 186984 - protein, 37 aa, Artificial Sequence
  Description of Artificial Sequence: Synthetic polypeptide
FEEEIRTTNPVATEQYGSYSSPHMVTVEVAANHQDQQ

SEQ ID NO: 186985 - protein, 37 aa, Artificial Sequence
  Description of Artificial Sequence: Synthetic polypeptide
FEEEIRTTNPVATEQYGSYSSPITAEVNSRVVHPPVC

SEQ ID NO: 186986 - protein, 36 aa, Artificial Sequence
  Description of Artificial Sequence: Synthetic polypeptide
AEEEIRTTNPVAYEQYGCVCSMWGEHNQENFNSDQS

SEQ ID NO: 186987 - protein, 33 aa, Artificial Sequence
  Description of Artificial Sequence: Synthetic polypeptide
DENEIRTTNPIATEPYGATTSNAEDIAEPKGPI

SEQ ID NO: 186988 - protein, 37 aa, Artificial Sequence
  Description of Artificial Sequence: Synthetic polypeptide
FEEEIRTTNPVATEQYGTYSNPITAEMNSRVGEPPVC

SEQ ID NO: 186989 - protein, 38 aa, Artificial Sequence
  Description of Artificial Sequence: Synthetic polypeptide
FEEEIRTTNPVATEQYGVIVNDTTVNNDQGEEFDQGAE

SEQ ID NO: 186990 - protein, 33 aa, Artificial Sequence
  Description of Artificial Sequence: Synthetic polypeptide
HEDEIRCTNPTAYECWGSVYYENDDRHRGDINN

SEQ ID NO: 186991 - protein, 37 aa, Artificial Sequence
  Description of Artificial Sequence: Synthetic polypeptide
FEEEIRTTNPVATEQYGVIVNVELQDGQEQGGQGEGQ

SEQ ID NO: 186992 - protein, 33 aa, Artificial Sequence
  Description of Artificial Sequence: Synthetic polypeptide
DENEIRTTNPIATEPWGATISAEDWQQQNGPYI

SEQ ID NO: 186993 - protein, 33 aa, Artificial Sequence
  Description of Artificial Sequence: Synthetic polypeptide
DENEIRTTNPIATEPWGATISAEDWQQQKGPYI

SEQ ID NO: 186994 - protein, 33 aa, Artificial Sequence
  Description of Artificial Sequence: Synthetic polypeptide
DENEIRTTNPIATEPWGATISAEDWQEQKGPYI

SEQ ID NO: 186995 - protein, 33 aa, Artificial Sequence
  Description of Artificial Sequence: Synthetic polypeptide
DENEIRTTNPIATEPWGATISAEDWAEQKGPYI

SEQ ID NO: 186996 - protein, 39 aa, Artificial Sequence
  Description of Artificial Sequence: Synthetic polypeptide
FEEEIRTTNPVATEQYGVVQTQGDDQLIDQEGEGGNQGT

SEQ ID NO: 186997 - protein, 35 aa, Artificial Sequence
  Description of Artificial Sequence: Synthetic polypeptide
DEECISTTNPVATEQYGQCVCSWGEHNANFNSDQS

SEQ ID NO: 186998 - protein, 36 aa, Artificial Sequence
  Description of Artificial Sequence: Synthetic polypeptide
DEECISTTNPVATEQYGQCVCSWGEHNQNFNSDTQA

SEQ ID NO: 186999 - protein, 35 aa, Artificial Sequence
  Description of Artificial Sequence: Synthetic polypeptide
DEECISTTNPVATEQYSACVCSWEHNQNFGSDTQS

SEQ ID NO: 187000 - protein, 32 aa, Artificial Sequence
  Description of Artificial Sequence: Synthetic polypeptide
DENEIRTTNPIATECYGATWSEDWAEHKEPYL

SEQ ID NO: 187001 - protein, 32 aa, Artificial Sequence
  Description of Artificial Sequence: Synthetic polypeptide
DENEIRTTNPIATECYGATWSEDWAEHKEPYI

SEQ ID NO: 187002 - protein, 34 aa, Artificial Sequence
  Description of Artificial Sequence: Synthetic polypeptide
DENEIRTTNPIATECYGATWANMEDWAQPNGPYI

SEQ ID NO: 187003 - protein, 33 aa, Artificial Sequence
  Description of Artificial Sequence: Synthetic polypeptide
DENEIRTTNPIATEPYGATISNMEDIAEPKGPH

SEQ ID NO: 187004 - protein, 37 aa, Artificial Sequence
  Description of Artificial Sequence: Synthetic polypeptide
FEEEIRTTNPVATEQYGSVVYDGMFTQEGEQEEDDGV

SEQ ID NO: 187005 - protein, 34 aa, Artificial Sequence
  Description of Artificial Sequence: Synthetic polypeptide
HEEEIATTNPPAMCGYTTVWQDTPHLGERGNGRG

SEQ ID NO: 187006 - protein, 37 aa, Artificial Sequence
  Description of Artificial Sequence: Synthetic polypeptide
DENEIRSTNPVATEQYGSVVTTDGMENQTGEDEQGIN

SEQ ID NO: 187007 - protein, 39 aa, Artificial Sequence
  Description of Artificial Sequence: Synthetic polypeptide
AEEEIRTTNPVATEQYGVVVVTVTTNNTEQGTEGGNTTT

SEQ ID NO: 187008 - protein, 39 aa, Artificial Sequence
  Description of Artificial Sequence: Synthetic polypeptide
AEEEIRTTNPVATEQYGVVVVTVTTNNLGGTEQGTNVNQ

SEQ ID NO: 187009 - protein, 39 aa, Artificial Sequence
  Description of Artificial Sequence: Synthetic polypeptide
AEEEIRTTNPVATEQYGVVVVTVTTNNLEQGTEGGSTTN

SEQ ID NO: 187010 - protein, 37 aa, Artificial Sequence
  Description of Artificial Sequence: Synthetic polypeptide
DEEEIRTTNPVATEQYGSVVYDGMFGAEGEQEEDDGV

SEQ ID NO: 187011 - protein, 37 aa, Artificial Sequence
  Description of Artificial Sequence: Synthetic polypeptide
IEEEIRTTNPVATEQYGVYSSPITAEPNMGVGHPQVE

SEQ ID NO: 187012 - protein, 39 aa, Artificial Sequence
  Description of Artificial Sequence: Synthetic polypeptide
AEEEIRTTNPVATEQYGVVVVTVTNNQLGNTEQGTNMEE

SEQ ID NO: 187013 - protein, 38 aa, Artificial Sequence
  Description of Artificial Sequence: Synthetic polypeptide
DENEIRGTNPVATEQYGSVIYSDGQQTGQGEIGNEETQ

SEQ ID NO: 187014 - protein, 38 aa, Artificial Sequence
  Description of Artificial Sequence: Synthetic polypeptide
DENEIRGTNPVATEQYGSVIVQVNQGLERGEGGGQDQE

SEQ ID NO: 187015 - protein, 34 aa, Artificial Sequence
  Description of Artificial Sequence: Synthetic polypeptide
IENEIRTTNPVATEQWGALPWSSEVQMNIPETDA

SEQ ID NO: 187016 - protein, 37 aa, Artificial Sequence
  Description of Artificial Sequence: Synthetic polypeptide
DENEIRGTNPVATEQYGDVMQNVGQQNVEMGGNGQGN

SEQ ID NO: 187017 - protein, 37 aa, Artificial Sequence
  Description of Artificial Sequence: Synthetic polypeptide
IEQEICTTNPVATEQYGSVYNTVENLHEQHIYSLQDE

SEQ ID NO: 187018 - protein, 34 aa, Artificial Sequence
  Description of Artificial Sequence: Synthetic polypeptide
IEQEIRTTNPVATECWGSFGCINEPEAREFENNG

SEQ ID NO: 187019 - protein, 36 aa, Artificial Sequence
  Description of Artificial Sequence: Synthetic polypeptide
DENEIRGTNPVATEFYGSVYNVQQDQEGGQEENGDD

SEQ ID NO: 187020 - protein, 36 aa, Artificial Sequence
  Description of Artificial Sequence: Synthetic polypeptide
IESEIRTTNPVATEAYGKVVPSCTLSHSTKGGNGTS

SEQ ID NO: 187021 - protein, 38 aa, Artificial Sequence
  Description of Artificial Sequence: Synthetic polypeptide
INEEIRTTNPVATEQYGSVHEPADNLAEETYGNGHFET

SEQ ID NO: 187022 - protein, 36 aa, Artificial Sequence
  Description of Artificial Sequence: Synthetic polypeptide
DEECISTTNPVAYEQYGQCVCSWGEHTENFNSDNQA

SEQ ID NO: 187023 - protein, 35 aa, Artificial Sequence
  Description of Artificial Sequence: Synthetic polypeptide
INSEIRTTNPVATEQYGSCSSTHPNTTSYPEVDQE

SEQ ID NO: 187024 - protein, 36 aa, Artificial Sequence
  Description of Artificial Sequence: Synthetic polypeptide
ITREIRTTNPVATEQYGSVNSVNNESDNHETMEDNV

SEQ ID NO: 187025 - protein, 36 aa, Artificial Sequence
  Description of Artificial Sequence: Synthetic polypeptide
KCEEIATTNPVATEQYGISTHCTGNEASTSSTNNRH

SEQ ID NO: 187026 - protein, 34 aa, Artificial Sequence
  Description of Artificial Sequence: Synthetic polypeptide
KEAEIATTNPVAYCAWGQTVPSCNLSQWGTNNQD

SEQ ID NO: 187027 - protein, 35 aa, Artificial Sequence
  Description of Artificial Sequence: Synthetic polypeptide
KEAEIATTNPVAYCAYGQTVPSCNLSQDAGTNNQD

SEQ ID NO: 187028 - protein, 35 aa, Artificial Sequence
  Description of Artificial Sequence: Synthetic polypeptide
KEAEIATTNPVAYCAYGQTVPSCNLSQKPGTNNDD

SEQ ID NO: 187029 - protein, 36 aa, Artificial Sequence
  Description of Artificial Sequence: Synthetic polypeptide
KEAEIATTNPVAYCAYGQTVPSCTNLSQLKGTNNQD

SEQ ID NO: 187030 - protein, 39 aa, Artificial Sequence
  Description of Artificial Sequence: Synthetic polypeptide
AEEEIRTTNPVATEQYGVVVVTVTTNQLGGTEQGSTDNQ

SEQ ID NO: 187031 - protein, 39 aa, Artificial Sequence
  Description of Artificial Sequence: Synthetic polypeptide
AEEEIRTTNPVATEQYGVVVVTVTTNQLGGTEQGVNNNQ

SEQ ID NO: 187032 - protein, 38 aa, Artificial Sequence
  Description of Artificial Sequence: Synthetic polypeptide
AEEEIRTTNPVATEQYGVVVVVNTVNNDESGTVNNNTQ

SEQ ID NO: 187033 - protein, 38 aa, Artificial Sequence
  Description of Artificial Sequence: Synthetic polypeptide
DENEIRGTNPVATEQYGSVNYSGGQITGQGEIGNEETQ

SEQ ID NO: 187034 - protein, 38 aa, Artificial Sequence
  Description of Artificial Sequence: Synthetic polypeptide
DENEIRSTNPVATEQYGSVNTTDGFNNQTGEDEQGIET

SEQ ID NO: 187035 - protein, 36 aa, Artificial Sequence
  Description of Artificial Sequence: Synthetic polypeptide
DENEIRSTNPVATEAYGSVMSNQGQNIFQEEMDEGF

SEQ ID NO: 187036 - protein, 35 aa, Artificial Sequence
  Description of Artificial Sequence: Synthetic polypeptide
DEECISTTNPVAYEHYGQTTVAVGNPLATRGGMAG

SEQ ID NO: 187037 - protein, 35 aa, Artificial Sequence
  Description of Artificial Sequence: Synthetic polypeptide
DEECISTTNPVAYEHYGQTTVAVTMELSTRGGEAG

SEQ ID NO: 187038 - protein, 35 aa, Artificial Sequence
  Description of Artificial Sequence: Synthetic polypeptide
DEECISTTNPVAYEHYGQTTVAVTNELATPAGEAG

SEQ ID NO: 187039 - protein, 36 aa, Artificial Sequence
  Description of Artificial Sequence: Synthetic polypeptide
DEECISTTNPVAYEHYGQTTVAVTNELATRGGEVMG

SEQ ID NO: 187040 - protein, 37 aa, Artificial Sequence
  Description of Artificial Sequence: Synthetic polypeptide
DEECISTTNPVAYEHYRGQTTVAYVTNELATRGGERG

SEQ ID NO: 187041 - protein, 33 aa, Artificial Sequence
  Description of Artificial Sequence: Synthetic polypeptide
DEECISTTNPVAYEQWGTYVYNQDSDDDRGEKD

SEQ ID NO: 187042 - protein, 36 aa, Artificial Sequence
  Description of Artificial Sequence: Synthetic polypeptide
HEEEIRTTNPVAYEAYGSTVPCCFGNSGWNEPVGMG

SEQ ID NO: 187043 - protein, 36 aa, Artificial Sequence
  Description of Artificial Sequence: Synthetic polypeptide
DEECISTTNPVAYEQYAEEVTTTGNGNPNDQGGGSR

SEQ ID NO: 187044 - protein, 36 aa, Artificial Sequence
  Description of Artificial Sequence: Synthetic polypeptide
HEGEIRCTNPVATEQYGSVCPPDYDSHNVGDDNNYQ

SEQ ID NO: 187045 - protein, 38 aa, Artificial Sequence
  Description of Artificial Sequence: Synthetic polypeptide
DENEIRSTNPVATEQYGSVVTTDGMNEQTGEDEQGIET

SEQ ID NO: 187046 - protein, 35 aa, Artificial Sequence
  Description of Artificial Sequence: Synthetic polypeptide
HEGEIRTTNPVATEQYGSVFCDDHQDEFDFSEMQV

SEQ ID NO: 187047 - protein, 40 aa, Artificial Sequence
  Description of Artificial Sequence: Synthetic polypeptide
DEEEIRTTNPVATEQYGSVVVTVVTVGTQAGNTEAGSTVY

SEQ ID NO: 187048 - protein, 39 aa, Artificial Sequence
  Description of Artificial Sequence: Synthetic polypeptide
AEEEIRTTNPVATEQYGVVVVVSVTTNNNQEQGEETETD

SEQ ID NO: 187049 - protein, 35 aa, Artificial Sequence
  Description of Artificial Sequence: Synthetic polypeptide
DEECISTTNPVAYEQYGCVCSWGEHNIYFGSDTQS

SEQ ID NO: 187050 - protein, 35 aa, Artificial Sequence
  Description of Artificial Sequence: Synthetic polypeptide
DEECISTTNPVAYEQYGCVCSWGEHNQEYFGSQQA

SEQ ID NO: 187051 - protein, 35 aa, Artificial Sequence
  Description of Artificial Sequence: Synthetic polypeptide
DEECISTTNPVAYEQYGCVCSWGEHNQEYFNSDQS

SEQ ID NO: 187052 - protein, 37 aa, Artificial Sequence
  Description of Artificial Sequence: Synthetic polypeptide
HSEEIRTTNPVATEQYGSVGILTVNTEEHRVLASPVS

SEQ ID NO: 187053 - protein, 36 aa, Artificial Sequence
  Description of Artificial Sequence: Synthetic polypeptide
IDSEIRTTNPVATEQYGSVCTPDAGDLTLMGDGLQG

SEQ ID NO: 187054 - protein, 36 aa, Artificial Sequence
  Description of Artificial Sequence: Synthetic polypeptide
IDSEIRTTNPVATEQYGSVCTPTAGDLTNQGDMLQG

SEQ ID NO: 187055 - protein, 37 aa, Artificial Sequence
  Description of Artificial Sequence: Synthetic polypeptide
DENEIRGTNPVATEQYGSVVVPNDNIMEGGGGNDDGN

SEQ ID NO: 187056 - protein, 38 aa, Artificial Sequence
  Description of Artificial Sequence: Synthetic polypeptide
DENEIRGTNPVATEQYGSVVTTDGMNNQTGEDEQGMET

SEQ ID NO: 187057 - protein, 38 aa, Artificial Sequence
  Description of Artificial Sequence: Synthetic polypeptide
DENEIRGTNPVATEQYGSVSVQVNQGLEMIEGGGQDDE

SEQ ID NO: 187058 - protein, 36 aa, Artificial Sequence
  Description of Artificial Sequence: Synthetic polypeptide
HEGEIRTTNPVATEQYGSVFCDDSNQDEFDFSNFQV

SEQ ID NO: 187059 - protein, 34 aa, Artificial Sequence
  Description of Artificial Sequence: Synthetic polypeptide
KEAEIATTNPVAYCAYGQTVPSTNLSMKSTNNQD

SEQ ID NO: 187060 - protein, 37 aa, Artificial Sequence
  Description of Artificial Sequence: Synthetic polypeptide
FEEEIRTTNPVATEQYGSVVYDGMFGQEGEEEEDDQG

SEQ ID NO: 187061 - protein, 33 aa, Artificial Sequence
  Description of Artificial Sequence: Synthetic polypeptide
DENEIRTTNPIATEQWGATTWANAIWANPKGPI

SEQ ID NO: 187062 - protein, 38 aa, Artificial Sequence
  Description of Artificial Sequence: Synthetic polypeptide
FEEEIRTTNPVATEQYGSVIEPEMYESTEPDLGIVEME

SEQ ID NO: 187063 - protein, 38 aa, Artificial Sequence
  Description of Artificial Sequence: Synthetic polypeptide
FEEEIRTTNPVATEQYGSVIEPRMYHSTVPDFGIVEME

SEQ ID NO: 187064 - protein, 38 aa, Artificial Sequence
  Description of Artificial Sequence: Synthetic polypeptide
FEEEIRTTNPVATEQYGSVIEPVMYESTVPLEGIVEME

SEQ ID NO: 187065 - protein, 37 aa, Artificial Sequence
  Description of Artificial Sequence: Synthetic polypeptide
FEEEIRTTNPVATEQYGSVIGGQGDDDGQDEGGETVS

SEQ ID NO: 187066 - protein, 36 aa, Artificial Sequence
  Description of Artificial Sequence: Synthetic polypeptide
DEECISTTNPVATEQYGCVCSNSGEHNQNFGSETQA

SEQ ID NO: 187067 - protein, 37 aa, Artificial Sequence
  Description of Artificial Sequence: Synthetic polypeptide
DEECISTTNPVATEQYGCVCSNTGEDNQENFNSEFQG

SEQ ID NO: 187068 - protein, 33 aa, Artificial Sequence
  Description of Artificial Sequence: Synthetic polypeptide
DENEIRTTNPVATECWGDVANEEDWANAKEDYI

SEQ ID NO: 187069 - protein, 37 aa, Artificial Sequence
  Description of Artificial Sequence: Synthetic polypeptide
DEECISTTNPVATEQYGCVCSNTGEHNQEAFNSDNQS

SEQ ID NO: 187070 - protein, 37 aa, Artificial Sequence
  Description of Artificial Sequence: Synthetic polypeptide
FEEEIRTTNPVATEQYGSVLMPLDALEEEQPDTWVGD

SEQ ID NO: 187071 - protein, 37 aa, Artificial Sequence
  Description of Artificial Sequence: Synthetic polypeptide
FEEEIRTTNPVATEQYGSVMDPTGGDGEEEEGEGGEG

SEQ ID NO: 187072 - protein, 38 aa, Artificial Sequence
  Description of Artificial Sequence: Synthetic polypeptide
FEEEIRTTNPVATEQYGSVMGNIGEQEGQTDTEEGGQQ

SEQ ID NO: 187073 - protein, 38 aa, Artificial Sequence
  Description of Artificial Sequence: Synthetic polypeptide
FEEEIRTTNPVATEQYGSVMGSMSEEGEPEDNGGNGQQ

SEQ ID NO: 187074 - protein, 32 aa, Artificial Sequence
  Description of Artificial Sequence: Synthetic polypeptide
DENEIRTTNPVATECWGATWAEEIEAEPAGPI

SEQ ID NO: 187075 - protein, 32 aa, Artificial Sequence
  Description of Artificial Sequence: Synthetic polypeptide
DENEIRTTNPVATECWGATWAEEIEAEAAGPI

SEQ ID NO: 187076 - protein, 32 aa, Artificial Sequence
  Description of Artificial Sequence: Synthetic polypeptide
DENEIRTTNPVATECWGATWAAEIEAEPAGPI

SEQ ID NO: 187077 - protein, 32 aa, Artificial Sequence
  Description of Artificial Sequence: Synthetic polypeptide
DENEIRTTNPVATECWGATTSEDWAEPAEPYA

SEQ ID NO: 187078 - protein, 32 aa, Artificial Sequence
  Description of Artificial Sequence: Synthetic polypeptide
DENEIRTTNPVATECWGATTSEDEAEPAEPYA

SEQ ID NO: 187079 - protein, 33 aa, Artificial Sequence
  Description of Artificial Sequence: Synthetic polypeptide
DENEIRTTNPVATECWGATTANAEDWQEPEPYL

SEQ ID NO: 187080 - protein, 33 aa, Artificial Sequence
  Description of Artificial Sequence: Synthetic polypeptide
DENEIRTTNPVATECWGATTANAECWQEPEPYL

SEQ ID NO: 187081 - protein, 38 aa, Artificial Sequence
  Description of Artificial Sequence: Synthetic polypeptide
FEEEIRTTNPVATEQYGSVNMQNMNQDDQQEEDDENGD

SEQ ID NO: 187082 - protein, 38 aa, Artificial Sequence
  Description of Artificial Sequence: Synthetic polypeptide
DENEIRTTNPVATEAYGVVVDQVTMNTIGQGGQGGQNG

SEQ ID NO: 187083 - protein, 36 aa, Artificial Sequence
  Description of Artificial Sequence: Synthetic polypeptide
CEEGIRQTNTVATEGWGYSVNEITENYDLPRGFSVR

SEQ ID NO: 187084 - protein, 37 aa, Artificial Sequence
  Description of Artificial Sequence: Synthetic polypeptide
AEEEISTTNPVATEQYGCVTSTWGADNAEYFNSDPQS

SEQ ID NO: 187085 - protein, 36 aa, Artificial Sequence
  Description of Artificial Sequence: Synthetic polypeptide
DEECISTTNPVATEQYGCVCSDWGEHNQENFNSDQS

SEQ ID NO: 187086 - protein, 37 aa, Artificial Sequence
  Description of Artificial Sequence: Synthetic polypeptide
FEEEIRTTNPVATEQYGSVGRLYNTSDIGQTQTIPES

SEQ ID NO: 187087 - protein, 38 aa, Artificial Sequence
  Description of Artificial Sequence: Synthetic polypeptide
FEEEIRTTNPVATEQYGSVGQNNVDTQGQLGEDGQGQL

SEQ ID NO: 187088 - protein, 37 aa, Artificial Sequence
  Description of Artificial Sequence: Synthetic polypeptide
DEECISTTNPVATEQYGCQVCSTGEDHQENFNSDTQQ

SEQ ID NO: 187089 - protein, 36 aa, Artificial Sequence
  Description of Artificial Sequence: Synthetic polypeptide
CEEEISTTNPVAYEQYGCVCSNTEHNQENFGSQTQS

SEQ ID NO: 187090 - protein, 37 aa, Artificial Sequence
  Description of Artificial Sequence: Synthetic polypeptide
FEEEIRTTNPVATEQYGAVIVDDLDDEGNTDDQGNNL

SEQ ID NO: 187091 - protein, 35 aa, Artificial Sequence
  Description of Artificial Sequence: Synthetic polypeptide
DENEIRTTNPVATECYGATTWANAEDWQEQKGPYI

SEQ ID NO: 187092 - protein, 34 aa, Artificial Sequence
  Description of Artificial Sequence: Synthetic polypeptide
DEECISTTNPVATEGYGQCVCNWEADQYFGSDQS

SEQ ID NO: 187093 - protein, 35 aa, Artificial Sequence
  Description of Artificial Sequence: Synthetic polypeptide
DEECISTTNPVATEGYGQCVCNWEAHNQYFGSNQS

SEQ ID NO: 187094 - protein, 35 aa, Artificial Sequence
  Description of Artificial Sequence: Synthetic polypeptide
DENEIRTTNPVATECYGATTWANAEDWQEPKGPYI

SEQ ID NO: 187095 - protein, 37 aa, Artificial Sequence
  Description of Artificial Sequence: Synthetic polypeptide
FEEEIRTTNPVATEQYGAVVTTTDGNGNDLEEEFEQI

SEQ ID NO: 187096 - protein, 36 aa, Artificial Sequence
  Description of Artificial Sequence: Synthetic polypeptide
FEEEIRTTNPVATEQYGAVYDDDNQENMVNDGEGDN

SEQ ID NO: 187097 - protein, 37 aa, Artificial Sequence
  Description of Artificial Sequence: Synthetic polypeptide
FEEEIRTTNPVATEQYGDVGNNVDTPGILGEDGQGQL

SEQ ID NO: 187098 - protein, 36 aa, Artificial Sequence
  Description of Artificial Sequence: Synthetic polypeptide
DEAEIRTTNPVATEAWGCVCSWMEENQENFGSDNQS

SEQ ID NO: 187099 - protein, 38 aa, Artificial Sequence
  Description of Artificial Sequence: Synthetic polypeptide
DEAEIRTTNPVATDQYGSYVSCSGILCEELGNGNEEVF

SEQ ID NO: 187100 - protein, 36 aa, Artificial Sequence
  Description of Artificial Sequence: Synthetic polypeptide
AEEEISTTNPVATEQYGCVCSWMEHNAENFNSQFQA

SEQ ID NO: 187101 - protein, 38 aa, Artificial Sequence
  Description of Artificial Sequence: Synthetic polypeptide
FEEEIRTTNPVATEQYGDVVTDLNNDDDQVNEFTQGGD

SEQ ID NO: 187102 - protein, 36 aa, Artificial Sequence
  Description of Artificial Sequence: Synthetic polypeptide
FEEEIRTTNPVATEQYGMVSVEGMGDGGQGQEAEGG

SEQ ID NO: 187103 - protein, 37 aa, Artificial Sequence
  Description of Artificial Sequence: Synthetic polypeptide
FEEEIRTTNPVATEQYGQIVYPSMPVELGMLNGVEGG

SEQ ID NO: 187104 - protein, 37 aa, Artificial Sequence
  Description of Artificial Sequence: Synthetic polypeptide
FEEEIRTTNPVATEQYGSACSPTNPAFYEVIIEPQDN

SEQ ID NO: 187105 - protein, 38 aa, Artificial Sequence
  Description of Artificial Sequence: Synthetic polypeptide
FEEEIRTTNPVATEQYGSACTPTVNESEQQSGPQAGGD

SEQ ID NO: 187106 - protein, 36 aa, Artificial Sequence
  Description of Artificial Sequence: Synthetic polypeptide
FEEEIRTTNPVATEQYGSCSPSIPAQTEVIIEPQDN

SEQ ID NO: 187107 - protein, 36 aa, Artificial Sequence
  Description of Artificial Sequence: Synthetic polypeptide
FEEEIRTTNPVATEQYGSIARMDPVMDAETLEILQE

SEQ ID NO: 187108 - protein, 37 aa, Artificial Sequence
  Description of Artificial Sequence: Synthetic polypeptide
FEEEIRTTNPVATEQYGSIARMDPVSGAEETLEILQE

SEQ ID NO: 187109 - protein, 36 aa, Artificial Sequence
  Description of Artificial Sequence: Synthetic polypeptide
FEEEIRTTNPVATEQYGSIARMDPVSIAETMEILQE

SEQ ID NO: 187110 - protein, 37 aa, Artificial Sequence
  Description of Artificial Sequence: Synthetic polypeptide
FEEEIRTTNPVATEQYGSIARMDPVSLEAETLEFLTE

SEQ ID NO: 187111 - protein, 37 aa, Artificial Sequence
  Description of Artificial Sequence: Synthetic polypeptide
FEEEIRTTNPVATEQYGSTPQPPCNWMAPENAHELRV

SEQ ID NO: 187112 - protein, 36 aa, Artificial Sequence
  Description of Artificial Sequence: Synthetic polypeptide
FEEEIRTTNPVATEQYGSTPQPPKNWAPLNGAELFV

SEQ ID NO: 187113 - protein, 36 aa, Artificial Sequence
  Description of Artificial Sequence: Synthetic polypeptide
CEEEISTTNPVAYEQYGQCVCSWGEHEQNFGSDNQS

SEQ ID NO: 187114 - protein, 37 aa, Artificial Sequence
  Description of Artificial Sequence: Synthetic polypeptide
FEEEIRTTNPVATEQYGSVVVMGMSNMDDEEGQTTGG

SEQ ID NO: 187115 - protein, 36 aa, Artificial Sequence
  Description of Artificial Sequence: Synthetic polypeptide
AEEEISTTNPVATEQYGCVCSWGEHNQESFISENQS

SEQ ID NO: 187116 - protein, 36 aa, Artificial Sequence
  Description of Artificial Sequence: Synthetic polypeptide
AEEEISTTNPVATEQYGCVCSWGEHNQENFISDNQS

SEQ ID NO: 187117 - protein, 37 aa, Artificial Sequence
  Description of Artificial Sequence: Synthetic polypeptide
AEEEISTTNPVATEQYGCVCSMTGEHNQENFGSDTQA

SEQ ID NO: 187118 - protein, 37 aa, Artificial Sequence
  Description of Artificial Sequence: Synthetic polypeptide
AEEEISTTNPVATEQYGCVCSMSEETNEENFNSDNQA

SEQ ID NO: 187119 - protein, 36 aa, Artificial Sequence
  Description of Artificial Sequence: Synthetic polypeptide
AEEEISTTNPVATEQYGCVCSDWGEHEQENFGSDQS

SEQ ID NO: 187120 - protein, 37 aa, Artificial Sequence
  Description of Artificial Sequence: Synthetic polypeptide
AEEEIRTTNPVAYEQYGQCVCSWGEDLNQENFGSEQA

SEQ ID NO: 187121 - protein, 34 aa, Artificial Sequence
  Description of Artificial Sequence: Synthetic polypeptide
DENEIRTTNPISTEPYGTTTSNMEDIQAQPKGNH

SEQ ID NO: 187122 - protein, 36 aa, Artificial Sequence
  Description of Artificial Sequence: Synthetic polypeptide
FEEEIRTTNPVATEQYGSVSVVVDAAIMEEVSMVED

SEQ ID NO: 187123 - protein, 33 aa, Artificial Sequence
  Description of Artificial Sequence: Synthetic polypeptide
DENEIRTTNPISTEPYGATISNMEDIAEPKGNH

SEQ ID NO: 187124 - protein, 33 aa, Artificial Sequence
  Description of Artificial Sequence: Synthetic polypeptide
DENEIRTTNPISTEPYGAIWANMEDWQQPNGPI

SEQ ID NO: 187125 - protein, 32 aa, Artificial Sequence
  Description of Artificial Sequence: Synthetic polypeptide
DENEIRTTNPISTEPYGAIWAMEDWQQPNGPI

SEQ ID NO: 187126 - protein, 32 aa, Artificial Sequence
  Description of Artificial Sequence: Synthetic polypeptide
DENEIRTTNPISTEPYGAIWAMEDIQQPNGPI

SEQ ID NO: 187127 - protein, 33 aa, Artificial Sequence
  Description of Artificial Sequence: Synthetic polypeptide
DENEIRTTNPISTEPWGATWSMEDIQAEPKGNH

SEQ ID NO: 187128 - protein, 33 aa, Artificial Sequence
  Description of Artificial Sequence: Synthetic polypeptide
DENEIRTTNPISTECYGAIANMEDIQQQPNGNH

SEQ ID NO: 187129 - protein, 33 aa, Artificial Sequence
  Description of Artificial Sequence: Synthetic polypeptide
CEEVIACTNPVATEQWGCVAGTNPAAMMGEGDG

SEQ ID NO: 187130 - protein, 37 aa, Artificial Sequence
  Description of Artificial Sequence: Synthetic polypeptide
FEEEIRTTNPVATEQYGSVVLDGMFGQEGEQEEDDGE

SEQ ID NO: 187131 - protein, 38 aa, Artificial Sequence
  Description of Artificial Sequence: Synthetic polypeptide
FEEEIRTTNPVATEQYGSVVLQMTEGGEQNIEEGQDEE

SEQ ID NO: 187132 - protein, 34 aa, Artificial Sequence
  Description of Artificial Sequence: Synthetic polypeptide
DENEIRTTNPIATEQWGDTVWANEEDWMEAKGPA

SEQ ID NO: 187133 - protein, 34 aa, Artificial Sequence
  Description of Artificial Sequence: Synthetic polypeptide
DENEIRTTNPIATEQWGDTVWANEEDWMEAAGPA

SEQ ID NO: 187134 - protein, 34 aa, Artificial Sequence
  Description of Artificial Sequence: Synthetic polypeptide
DENEIRTTNPIATEQWGDTVWANEEDWAEAKGPI

SEQ ID NO: 187135 - protein, 33 aa, Artificial Sequence
  Description of Artificial Sequence: Synthetic polypeptide
DENEIRTTNPIATEQWGATWSNEEDWANPKEDA

SEQ ID NO: 187136 - protein, 33 aa, Artificial Sequence
  Description of Artificial Sequence: Synthetic polypeptide
DENEIRTTNPIATEQWGATWSNEEDEANPKEDA

SEQ ID NO: 187137 - protein, 33 aa, Artificial Sequence
  Description of Artificial Sequence: Synthetic polypeptide
DENEIRTTNPIATEQWGATWSNAEDWAEPKGDA

SEQ ID NO: 187138 - protein, 32 aa, Artificial Sequence
  Description of Artificial Sequence: Synthetic polypeptide
DENEIRTTNPIATEQWGATWSEEDEANPKEDA

SEQ ID NO: 187139 - protein, 38 aa, Artificial Sequence
  Description of Artificial Sequence: Synthetic polypeptide
FEEEIRTTNPVATEQYGSVVVAGVNDNNGNQGEFNEDD

SEQ ID NO: 187140 - protein, 37 aa, Artificial Sequence
  Description of Artificial Sequence: Synthetic polypeptide
AEEEISTTNPVATEQYGCVCSMWEETNEENFNSQTQS

SEQ ID NO: 187141 - protein, 37 aa, Artificial Sequence
  Description of Artificial Sequence: Synthetic polypeptide
AEEEISTTNPVATEQYGCVCSNTGEHNAENFGSEFQG

SEQ ID NO: 187142 - protein, 36 aa, Artificial Sequence
  Description of Artificial Sequence: Synthetic polypeptide
AEEEISTTNPVATEQYGCVCSNWGEDNQENFNSDQS

SEQ ID NO: 187143 - protein, 36 aa, Artificial Sequence
  Description of Artificial Sequence: Synthetic polypeptide
AEEEISTTNPVATEQYGCVCSNWGEHFQENFGSDQV

SEQ ID NO: 187144 - protein, 39 aa, Artificial Sequence
  Description of Artificial Sequence: Synthetic polypeptide
DEEEIRTTNPVATEQYGSVVTVVVSNNNNTEQGSVQQDD

SEQ ID NO: 187145 - protein, 35 aa, Artificial Sequence
  Description of Artificial Sequence: Synthetic polypeptide
DENEIRTTNPVATEAWGKVPSEQIAHSMNAAEGDF

SEQ ID NO: 187146 - protein, 37 aa, Artificial Sequence
  Description of Artificial Sequence: Synthetic polypeptide
DEECISTTNPVATEQYGCVCSNWGEHNQENFGSDNQS

SEQ ID NO: 187147 - protein, 36 aa, Artificial Sequence
  Description of Artificial Sequence: Synthetic polypeptide
AEEEISTTNPVATEQYGCVCSWGEHNAEHFNSENQS

SEQ ID NO: 187148 - protein, 36 aa, Artificial Sequence
  Description of Artificial Sequence: Synthetic polypeptide
DEECISTTNPVATEQYGCVCSNWGEHNQENFGSDQS

SEQ ID NO: 187149 - protein, 36 aa, Artificial Sequence
  Description of Artificial Sequence: Synthetic polypeptide
DEECISTTNPVATEQYGCVCSNWGEHNQENFGSEQD

SEQ ID NO: 187150 - protein, 37 aa, Artificial Sequence
  Description of Artificial Sequence: Synthetic polypeptide
DENEIRTTNPVATDQYGVVVDNSIGQNQGQTDNNEDQ

SEQ ID NO: 187151 - protein, 35 aa, Artificial Sequence
  Description of Artificial Sequence: Synthetic polypeptide
DEECISTTNPVATEQYGCVCSSGEHNQENFISDQS

SEQ ID NO: 187152 - protein, 33 aa, Artificial Sequence
  Description of Artificial Sequence: Synthetic polypeptide
CEEVIACTNPVATEQWGCVAGNNLATMNLNENG

SEQ ID NO: 187153 - protein, 36 aa, Artificial Sequence
  Description of Artificial Sequence: Synthetic polypeptide
AEEEISTTNPVATEQYGCVCSWEEHNQENFGSDTQS

SEQ ID NO: 187154 - protein, 36 aa, Artificial Sequence
  Description of Artificial Sequence: Synthetic polypeptide
AEEEISTTNPVATEQYGCVCSVWGEHNQEGFGSDQM

SEQ ID NO: 187155 - protein, 37 aa, Artificial Sequence
  Description of Artificial Sequence: Synthetic polypeptide
DEECISTTNPVATEQYGCVCSNWGEHNQEGFNSETQT

SEQ ID NO: 187156 - protein, 33 aa, Artificial Sequence
  Description of Artificial Sequence: Synthetic polypeptide
CEEVIACTNPVATEQWGCVAGTGPAAMHMGERE

SEQ ID NO: 187157 - protein, 36 aa, Artificial Sequence
  Description of Artificial Sequence: Synthetic polypeptide
DEECISTTNPVATEQYGCVCSWGEHDAENFNSDNQS

SEQ ID NO: 187158 - protein, 36 aa, Artificial Sequence
  Description of Artificial Sequence: Synthetic polypeptide
DEECISTTNPVATEQYGCVCSWGEHNQENFNSDNQA

SEQ ID NO: 187159 - protein, 36 aa, Artificial Sequence
  Description of Artificial Sequence: Synthetic polypeptide
DEECISTTNPVATEQYGCVCSWGEHNQESFNSENQY

SEQ ID NO: 187160 - protein, 36 aa, Artificial Sequence
  Description of Artificial Sequence: Synthetic polypeptide
DEECISTTNPVATEQYGCVCSWMEDNAEFFNSDNQS

SEQ ID NO: 187161 - protein, 37 aa, Artificial Sequence
  Description of Artificial Sequence: Synthetic polypeptide
FEEEIRTTNPVATEQYGSVSMVVVDEAHMEEGSMVED

SEQ ID NO: 187162 - protein, 36 aa, Artificial Sequence
  Description of Artificial Sequence: Synthetic polypeptide
AEEEISTTNPVATEQYGCVCSSGEHNQENFGSDTQS

SEQ ID NO: 187163 - protein, 37 aa, Artificial Sequence
  Description of Artificial Sequence: Synthetic polypeptide
AEEEISTTNPVATEQYGCVCSNWGETNQENFNSENQA

SEQ ID NO: 187164 - protein, 37 aa, Artificial Sequence
  Description of Artificial Sequence: Synthetic polypeptide
AEEEISTTNPVATEQYGCVCSNWGEPNQENFGSENQS

SEQ ID NO: 187165 - protein, 34 aa, Artificial Sequence
  Description of Artificial Sequence: Synthetic polypeptide
CEEVIACTNPVATEQWGCVAGTNLATMNLNEENN

SEQ ID NO: 187166 - protein, 36 aa, Artificial Sequence
  Description of Artificial Sequence: Synthetic polypeptide
AEEEISTTNPVATEQYGCVCSNWGEHNTENFGSEQS

SEQ ID NO: 187167 - protein, 37 aa, Artificial Sequence
  Description of Artificial Sequence: Synthetic polypeptide
DEECISTTNPVATEQYGQCVCSMWGEHNQNFGSDNQA

SEQ ID NO: 187168 - protein, 35 aa, Artificial Sequence
  Description of Artificial Sequence: Synthetic polypeptide
DEECISTTNPVATEQYGCVCSWGEDNQEFFISDQS

SEQ ID NO: 187169 - protein, 37 aa, Artificial Sequence
  Description of Artificial Sequence: Synthetic polypeptide
FEEEIRTTNPVATEGYGSVVMNFDDNNDQTGGGMEDV

SEQ ID NO: 187170 - protein, 35 aa, Artificial Sequence
  Description of Artificial Sequence: Synthetic polypeptide
KEAEIATTNPVAYCAYGQTVPSTNSSQTKGTNNQD

SEQ ID NO: 187171 - protein, 33 aa, Artificial Sequence
  Description of Artificial Sequence: Synthetic polypeptide
KEDEIRCTNPTAYECWGSVYYENDDRHRGDTGR

SEQ ID NO: 187172 - protein, 36 aa, Artificial Sequence
  Description of Artificial Sequence: Synthetic polypeptide
DENEICTTNPVATEQYGSTFTWTYWPQEQFQSNQIM

SEQ ID NO: 187173 - protein, 36 aa, Artificial Sequence
  Description of Artificial Sequence: Synthetic polypeptide
DEECVRTTNPIAYEQWGCTVVSCDNLSQQTGGNYTL

SEQ ID NO: 187174 - protein, 36 aa, Artificial Sequence
  Description of Artificial Sequence: Synthetic polypeptide
DENEICTTNPVATEQYGSHFTWTYWPDTQIQDNQIM

SEQ ID NO: 187175 - protein, 37 aa, Artificial Sequence
  Description of Artificial Sequence: Synthetic polypeptide
DENEICTTNPVATEQYGSGFTSWTYWPQTQPQDNQIM

SEQ ID NO: 187176 - protein, 36 aa, Artificial Sequence
  Description of Artificial Sequence: Synthetic polypeptide
CEGEIACTNPVATEQYGSVCSVNPDQQEHQDGTEMK

SEQ ID NO: 187177 - protein, 36 aa, Artificial Sequence
  Description of Artificial Sequence: Synthetic polypeptide
DEECVRTTNPIAYEQYGCEVVSCCNISQQTGGNYPD

SEQ ID NO: 187178 - protein, 37 aa, Artificial Sequence
  Description of Artificial Sequence: Synthetic polypeptide
DEECVRTTNPIAYEQYGCEVVSCDNEPSQQTGGNYRD

SEQ ID NO: 187179 - protein, 36 aa, Artificial Sequence
  Description of Artificial Sequence: Synthetic polypeptide
DEAEIRTTNPCATEEYGVVAMGNNMDRQDGDRGTDH

SEQ ID NO: 187180 - protein, 33 aa, Artificial Sequence
  Description of Artificial Sequence: Synthetic polypeptide
DENEIATTNPVSTEPYGVCYYEDGQQQQNGNQH

SEQ ID NO: 187181 - protein, 32 aa, Artificial Sequence
  Description of Artificial Sequence: Synthetic polypeptide
DENEIATTNPVSTEPYGVCYCEDGQQQQSGHE

SEQ ID NO: 187182 - protein, 33 aa, Artificial Sequence
  Description of Artificial Sequence: Synthetic polypeptide
DENEIATTNPVSTEPYGVCYCEDGQQQQSGGNH

SEQ ID NO: 187183 - protein, 33 aa, Artificial Sequence
  Description of Artificial Sequence: Synthetic polypeptide
DENEIATTNPVSTEPYGVCYCEDGQQQQPGNSE

SEQ ID NO: 187184 - protein, 34 aa, Artificial Sequence
  Description of Artificial Sequence: Synthetic polypeptide
DENEIATTNPVSTEPYGVCYCEDGQQQQNGVNRH

SEQ ID NO: 187185 - protein, 33 aa, Artificial Sequence
  Description of Artificial Sequence: Synthetic polypeptide
DENEIATTNPVSTEPYGVCYCEDGQQQQNGNTT

SEQ ID NO: 187186 - protein, 33 aa, Artificial Sequence
  Description of Artificial Sequence: Synthetic polypeptide
DENEIATTNPVSTEPYGVCYCEDGQQQQNGNHA

SEQ ID NO: 187187 - protein, 33 aa, Artificial Sequence
  Description of Artificial Sequence: Synthetic polypeptide
DENEIATTNPVSTEPYGVCYCEDGQQQQNGDNP

SEQ ID NO: 187188 - protein, 38 aa, Artificial Sequence
  Description of Artificial Sequence: Synthetic polypeptide
MEEEIRTTNPVATEQYGSVTEWTMMLNVAFMQMNEDGG

SEQ ID NO: 187189 - protein, 37 aa, Artificial Sequence
  Description of Artificial Sequence: Synthetic polypeptide
MEEEIRTTNPVATEQYGSVVMGFPIEMDNNDDDGQST

SEQ ID NO: 187190 - protein, 38 aa, Artificial Sequence
  Description of Artificial Sequence: Synthetic polypeptide
MEEEIRTTNPVATEQYGSVVNPEQPIGPEMGQGENEEG

SEQ ID NO: 187191 - protein, 38 aa, Artificial Sequence
  Description of Artificial Sequence: Synthetic polypeptide
MEEEIRTTNPVATESYGSVMGLNGGNTEDEFQGGNGDT

SEQ ID NO: 187192 - protein, 38 aa, Artificial Sequence
  Description of Artificial Sequence: Synthetic polypeptide
MEEEIRTTNPVATESYGSVMGLNIGNNEDEFQDGNGDT

SEQ ID NO: 187193 - protein, 38 aa, Artificial Sequence
  Description of Artificial Sequence: Synthetic polypeptide
MEEEIRTTNPVATESYGSVMGLNVGNLEDEFQGGQGDS

SEQ ID NO: 187194 - protein, 38 aa, Artificial Sequence
  Description of Artificial Sequence: Synthetic polypeptide
MEEEIRTTNPVATESYGSVMGLNVGNLEDEMQNGQGDT

SEQ ID NO: 187195 - protein, 36 aa, Artificial Sequence
  Description of Artificial Sequence: Synthetic polypeptide
DENEICTTNPVATEQYGSVFTWTYGPQTQFQDEQIM

SEQ ID NO: 187196 - protein, 36 aa, Artificial Sequence
  Description of Artificial Sequence: Synthetic polypeptide
DEECVRTTNPIAYEPYGCEVVSCDGLSQQTGGNYRD

SEQ ID NO: 187197 - protein, 36 aa, Artificial Sequence
  Description of Artificial Sequence: Synthetic polypeptide
DENEICTTNPVATEQYGSYFTWTYDPQTQFNSNQIM

SEQ ID NO: 187198 - protein, 33 aa, Artificial Sequence
  Description of Artificial Sequence: Synthetic polypeptide
DENEICTTNPVAYEQWGMVYSIEIEMNQAEDDA

SEQ ID NO: 187199 - protein, 36 aa, Artificial Sequence
  Description of Artificial Sequence: Synthetic polypeptide
MEEEIRTTNPVATEQYGAIIHGTTLEDHNDEQVDEQ

SEQ ID NO: 187200 - protein, 36 aa, Artificial Sequence
  Description of Artificial Sequence: Synthetic polypeptide
MEEEIRTTNPVATEQYGAVYNGDNDDEMDEGGGGIQ

SEQ ID NO: 187201 - protein, 36 aa, Artificial Sequence
  Description of Artificial Sequence: Synthetic polypeptide
MEEEIRTTNPVATEQYGCIIHGTHLEDHNDEYGDEQ

SEQ ID NO: 187202 - protein, 33 aa, Artificial Sequence
  Description of Artificial Sequence: Synthetic polypeptide
DEECNATTNPVAYEGWGSVATTNNGGDTQGDSS

SEQ ID NO: 187203 - protein, 37 aa, Artificial Sequence
  Description of Artificial Sequence: Synthetic polypeptide
DEECTCTTNPVAVEQYGVVSTTVNNNQNDEQGTNVND

SEQ ID NO: 187204 - protein, 36 aa, Artificial Sequence
  Description of Artificial Sequence: Synthetic polypeptide
DEECTCTTNPVAVEQYGVVSTVNNNNADEQGTNVDE

SEQ ID NO: 187205 - protein, 36 aa, Artificial Sequence
  Description of Artificial Sequence: Synthetic polypeptide
DEECTCTTNPVAVEQYGVVSTVNNNNNDEQGTNNND

SEQ ID NO: 187206 - protein, 36 aa, Artificial Sequence
  Description of Artificial Sequence: Synthetic polypeptide
MEEEIRTTNPVATEQYGDVYGIVDNGGEEGGGEQIS

SEQ ID NO: 187207 - protein, 36 aa, Artificial Sequence
  Description of Artificial Sequence: Synthetic polypeptide
MEEEIRTTNPVATEQYGDVYGVDNAGGEEGGGEQQD

SEQ ID NO: 187208 - protein, 38 aa, Artificial Sequence
  Description of Artificial Sequence: Synthetic polypeptide
MEEEIRTTNPVATEQYGESVIGSLEVMTAQVGELAEEV

SEQ ID NO: 187209 - protein, 38 aa, Artificial Sequence
  Description of Artificial Sequence: Synthetic polypeptide
MEEEIRTTNPVATEQYGIVYSAPITAEPNSRVNLPPVC

SEQ ID NO: 187210 - protein, 38 aa, Artificial Sequence
  Description of Artificial Sequence: Synthetic polypeptide
MEEEIRTTNPVATESYGSVMGLNVGNLEDEQQGEQGDT

SEQ ID NO: 187211 - protein, 33 aa, Artificial Sequence
  Description of Artificial Sequence: Synthetic polypeptide
DENEIDTTNPCSTEPYGTISMEDQIQQQQNGNH

SEQ ID NO: 187212 - protein, 36 aa, Artificial Sequence
  Description of Artificial Sequence: Synthetic polypeptide
DEECTCTTNPVAVEQYGVVSTVQNNNNSEQGSTVND

SEQ ID NO: 187213 - protein, 36 aa, Artificial Sequence
  Description of Artificial Sequence: Synthetic polypeptide
DEECTCTTNPVAVEQYGVVSTVVNNNADEQGTNVND

SEQ ID NO: 187214 - protein, 35 aa, Artificial Sequence
  Description of Artificial Sequence: Synthetic polypeptide
CEEVIACTNPVATEQYGSVCATNPPEAPANQTEGT

SEQ ID NO: 187215 - protein, 35 aa, Artificial Sequence
  Description of Artificial Sequence: Synthetic polypeptide
CEEVIACTNPVATEQYGSVPANMNNSNAAGNPGEA

SEQ ID NO: 187216 - protein, 38 aa, Artificial Sequence
  Description of Artificial Sequence: Synthetic polypeptide
MEEEIRTTNPVATEQYGQCVCSNWEEHNQENFGSENQA

SEQ ID NO: 187217 - protein, 39 aa, Artificial Sequence
  Description of Artificial Sequence: Synthetic polypeptide
MEEEIRTTNPVATEQYGQVSVMDDTNEMTGDEGGDTENQ

SEQ ID NO: 187218 - protein, 32 aa, Artificial Sequence
  Description of Artificial Sequence: Synthetic polypeptide
DENEICTTNPVAYEQWGTVWSKEIEMNKAEDA

SEQ ID NO: 187219 - protein, 36 aa, Artificial Sequence
  Description of Artificial Sequence: Synthetic polypeptide
DEECTCTTNPVAVEQYGVVSTVVNNNNDEQGSVTND

SEQ ID NO: 187220 - protein, 37 aa, Artificial Sequence
  Description of Artificial Sequence: Synthetic polypeptide
DEECVFRTTNPIAYERYGCEVVSCDNLSQQTVGNYRE

SEQ ID NO: 187221 - protein, 37 aa, Artificial Sequence
  Description of Artificial Sequence: Synthetic polypeptide
MEEEIRTTNPVATEQYGSIIHGTPLEDHNDEYGDEQH

SEQ ID NO: 187222 - protein, 38 aa, Artificial Sequence
  Description of Artificial Sequence: Synthetic polypeptide
MEEEIRTTNPVATEQYGSIIHGTTLEDHNDEYGDENQM

SEQ ID NO: 187223 - protein, 36 aa, Artificial Sequence
  Description of Artificial Sequence: Synthetic polypeptide
DEAEIRTTNPCATEQYGQCVCSWGEDNAENFGSDQS

SEQ ID NO: 187224 - protein, 38 aa, Artificial Sequence
  Description of Artificial Sequence: Synthetic polypeptide
MEEEIRTTNPVATEGYGVVVVNANGNLIQQEGGGDNGD

SEQ ID NO: 187225 - protein, 35 aa, Artificial Sequence
  Description of Artificial Sequence: Synthetic polypeptide
DEEEIACTNPVATAQWGCVAGTANSHQEADIGIHD

SEQ ID NO: 187226 - protein, 33 aa, Artificial Sequence
  Description of Artificial Sequence: Synthetic polypeptide
DENEIATTNPVSTEPWGCIAPEDIQRQQQGNTH

SEQ ID NO: 187227 - protein, 38 aa, Artificial Sequence
  Description of Artificial Sequence: Synthetic polypeptide
MEGEIRTTNPVATEQYGCVHSLEVLEQNNIGVNNQFFD

SEQ ID NO: 187228 - protein, 36 aa, Artificial Sequence
  Description of Artificial Sequence: Synthetic polypeptide
MEGEIRTTNPVATEQYGCVVGSPMDNLSDDFVSETQ

SEQ ID NO: 187229 - protein, 34 aa, Artificial Sequence
  Description of Artificial Sequence: Synthetic polypeptide
MEGEIRTTNPVATEQYGMCTSLEWANEPTTDDQG

SEQ ID NO: 187230 - protein, 36 aa, Artificial Sequence
  Description of Artificial Sequence: Synthetic polypeptide
MEGEIRTTNPVATEQYGSACTSPASVTINEHFNSDD

SEQ ID NO: 187231 - protein, 37 aa, Artificial Sequence
  Description of Artificial Sequence: Synthetic polypeptide
MEGEIRTTNPVATEQYGSCCTSPASTTWNEHFSSNDE

SEQ ID NO: 187232 - protein, 36 aa, Artificial Sequence
  Description of Artificial Sequence: Synthetic polypeptide
MEGEIRTTNPVATEQYGSCFSCMDHIWQGENGEEHN

SEQ ID NO: 187233 - protein, 36 aa, Artificial Sequence
  Description of Artificial Sequence: Synthetic polypeptide
DENEIATTNPVAYEQYGSVCAAANNLPLDSKEGTEN

SEQ ID NO: 187234 - protein, 36 aa, Artificial Sequence
  Description of Artificial Sequence: Synthetic polypeptide
DENEIATTNPVAYEQYGSVATTGHGPLDSMENNNMF

SEQ ID NO: 187235 - protein, 36 aa, Artificial Sequence
  Description of Artificial Sequence: Synthetic polypeptide
DENEIATTNPVAYEQYGSVATTGHGPLDSMENNDFQ

SEQ ID NO: 187236 - protein, 35 aa, Artificial Sequence
  Description of Artificial Sequence: Synthetic polypeptide
MEGEIRTTNPVATEQYGSCTFEAMMQQETSNEEEN

SEQ ID NO: 187237 - protein, 36 aa, Artificial Sequence
  Description of Artificial Sequence: Synthetic polypeptide
MEGEIRTTNPVATEQYGSCTSPASTTIDEMFSSNDP

SEQ ID NO: 187238 - protein, 37 aa, Artificial Sequence
  Description of Artificial Sequence: Synthetic polypeptide
MEGEIRTTNPVATEQYGSCTSPASTTISNEHFSSNDF

SEQ ID NO: 187239 - protein, 36 aa, Artificial Sequence
  Description of Artificial Sequence: Synthetic polypeptide
MEGEIRTTNPVATEQYGSCTSPASTTIVNEHFSSFD

SEQ ID NO: 187240 - protein, 36 aa, Artificial Sequence
  Description of Artificial Sequence: Synthetic polypeptide
MEGEIRTTNPVATEQYGSCTSPASVTIDEHFSSNMD

SEQ ID NO: 187241 - protein, 36 aa, Artificial Sequence
  Description of Artificial Sequence: Synthetic polypeptide
MEGEIRTTNPVATEQYGSCTYPASTTIYDEHFSSND

SEQ ID NO: 187242 - protein, 36 aa, Artificial Sequence
  Description of Artificial Sequence: Synthetic polypeptide
MEGEIRTTNPVATEQYGSCVYFPLNDSDIIDLNNMQ

SEQ ID NO: 187243 - protein, 37 aa, Artificial Sequence
  Description of Artificial Sequence: Synthetic polypeptide
MEGEIRTTNPVATEQYGSIVMTWPDHTGQDSGQYPSG

SEQ ID NO: 187244 - protein, 38 aa, Artificial Sequence
  Description of Artificial Sequence: Synthetic polypeptide
MEGEIRTTNPVATEQYGSIVNMWPNEVLGQDSGQETTQ

SEQ ID NO: 187245 - protein, 37 aa, Artificial Sequence
  Description of Artificial Sequence: Synthetic polypeptide
MEGEIRTTNPVATEQYGSLWTNCYDNLGEELFMGSQI

SEQ ID NO: 187246 - protein, 39 aa, Artificial Sequence
  Description of Artificial Sequence: Synthetic polypeptide
MEGEIRTTNPVATEQYGSNIVTWSVNDEEQNNEPEINRV

SEQ ID NO: 187247 - protein, 36 aa, Artificial Sequence
  Description of Artificial Sequence: Synthetic polypeptide
MEGEIRTTNPVATEQYGSNPTPAKGIENNWDNNDHD

SEQ ID NO: 187248 - protein, 36 aa, Artificial Sequence
  Description of Artificial Sequence: Synthetic polypeptide
MEGEIRTTNPVATEQYGSNSTPAKGIENNADNTDFD

SEQ ID NO: 187249 - protein, 37 aa, Artificial Sequence
  Description of Artificial Sequence: Synthetic polypeptide
MEGEIRTTNPVATEQYGSNSTPAKGIENPNMDSNDFD

SEQ ID NO: 187250 - protein, 38 aa, Artificial Sequence
  Description of Artificial Sequence: Synthetic polypeptide
MEGEIRTTNPVATEQYGCVHSLEVLEQNNIGSNNFFHD

SEQ ID NO: 187251 - protein, 37 aa, Artificial Sequence
  Description of Artificial Sequence: Synthetic polypeptide
MEGEIRTTNPVATEQYGCVCSEGLIMLQTEGTFEDFP

SEQ ID NO: 187252 - protein, 35 aa, Artificial Sequence
  Description of Artificial Sequence: Synthetic polypeptide
MEGEIRTTNPVATEQYGCSWAGNEDEEQESFELQI

SEQ ID NO: 187253 - protein, 36 aa, Artificial Sequence
  Description of Artificial Sequence: Synthetic polypeptide
MEGEIRTTNPVATEQYGCQWYNWLEMEMQMVIDERA

SEQ ID NO: 187254 - protein, 34 aa, Artificial Sequence
  Description of Artificial Sequence: Synthetic polypeptide
DEEEIACTNPVATAQWGCVAGTNSHQEAMIDIDE

SEQ ID NO: 187255 - protein, 36 aa, Artificial Sequence
  Description of Artificial Sequence: Synthetic polypeptide
MEEEISTTNPSATYTYGGTSVPMAMFLDQLAPGMNR

SEQ ID NO: 187256 - protein, 37 aa, Artificial Sequence
  Description of Artificial Sequence: Synthetic polypeptide
MEEEISTTNPVATEQYGCVCSTWGEHNQEGFGSDTQM

SEQ ID NO: 187257 - protein, 36 aa, Artificial Sequence
  Description of Artificial Sequence: Synthetic polypeptide
MEEEISTTNPVATEQYGCVCSVWGEDHNAGFGSDQM

SEQ ID NO: 187258 - protein, 36 aa, Artificial Sequence
  Description of Artificial Sequence: Synthetic polypeptide
MEEEISTTNPVATEQYGCVCSVWGEHNAEGFNSDQM

SEQ ID NO: 187259 - protein, 35 aa, Artificial Sequence
  Description of Artificial Sequence: Synthetic polypeptide
DEAEIRTTNGVAYCQYGCVCSWGNHQENFNSDTQA

SEQ ID NO: 187260 - protein, 32 aa, Artificial Sequence
  Description of Artificial Sequence: Synthetic polypeptide
DENEIATTNPVSTAPWGTISMEWGQMQQNGNH

SEQ ID NO: 187261 - protein, 34 aa, Artificial Sequence
  Description of Artificial Sequence: Synthetic polypeptide
DEAEIRTTNGVAYCQYGCVCSWGEHNTNFGSDQA

SEQ ID NO: 187262 - protein, 34 aa, Artificial Sequence
  Description of Artificial Sequence: Synthetic polypeptide
DEAEIRTTNGVAYCQYGCVCSWGADQENFGSDQA

SEQ ID NO: 187263 - protein, 36 aa, Artificial Sequence
  Description of Artificial Sequence: Synthetic polypeptide
MEEEISTTNPVATEQYGQCVCSVWEHNQEGFGSDQM

SEQ ID NO: 187264 - protein, 31 aa, Artificial Sequence
  Description of Artificial Sequence: Synthetic polypeptide
DENEIATTNPVAYERWGTVSKEIEMNTAEDA

SEQ ID NO: 187265 - protein, 38 aa, Artificial Sequence
  Description of Artificial Sequence: Synthetic polypeptide
MEEEIRTVNPVATEAYGSVVGGLQRGMGQRNINGQGEQ

SEQ ID NO: 187266 - protein, 35 aa, Artificial Sequence
  Description of Artificial Sequence: Synthetic polypeptide
DEAEIRTTNGVAYCQYGCVCSWEDHNQNFGSDNQS

SEQ ID NO: 187267 - protein, 35 aa, Artificial Sequence
  Description of Artificial Sequence: Synthetic polypeptide
DEAEIRTTNGVAYCQYGCVCSTTEHQEYFGSDTQS

SEQ ID NO: 187268 - protein, 36 aa, Artificial Sequence
  Description of Artificial Sequence: Synthetic polypeptide
DENEIATTNPVAYEQYGSVCSVDHLPADSMDGAEAW

SEQ ID NO: 187269 - protein, 37 aa, Artificial Sequence
  Description of Artificial Sequence: Synthetic polypeptide
MEGAIRTTNPVATEQYGSVFMDTIGANSLEEIQSDEV

SEQ ID NO: 187270 - protein, 36 aa, Artificial Sequence
  Description of Artificial Sequence: Synthetic polypeptide
MEGEIATTNPVATEQYGSSFSATDTLEPHEYFEDTR

SEQ ID NO: 187271 - protein, 35 aa, Artificial Sequence
  Description of Artificial Sequence: Synthetic polypeptide
MEGEIRCTNPVATEQYGSVVEDYGLEFLSNSQEET

SEQ ID NO: 187272 - protein, 36 aa, Artificial Sequence
  Description of Artificial Sequence: Synthetic polypeptide
MEGEIRTTNPVATEQWGSVWNNTNKDSDLIFESTQE

SEQ ID NO: 187273 - protein, 37 aa, Artificial Sequence
  Description of Artificial Sequence: Synthetic polypeptide
MEGEIRTTNPVATEQYGAVCSETAENLMEIEEHMIEP

SEQ ID NO: 187274 - protein, 37 aa, Artificial Sequence
  Description of Artificial Sequence: Synthetic polypeptide
MEGEIRTTNPVATEQYGCCCSLEVLNQNNIGNNGHQD

SEQ ID NO: 187275 - protein, 37 aa, Artificial Sequence
  Description of Artificial Sequence: Synthetic polypeptide
MEGEIRTTNPVATEQYGCCSCTPDHIWQEREGQEEHN

SEQ ID NO: 187276 - protein, 38 aa, Artificial Sequence
  Description of Artificial Sequence: Synthetic polypeptide
MEGEIRTTNPVATEQYGCCVHSLEVLEQNNIGNNFFFD

SEQ ID NO: 187277 - protein, 35 aa, Artificial Sequence
  Description of Artificial Sequence: Synthetic polypeptide
MEGEIRTTNPVATEQYGCFFDPWENAEQEWEENQP

SEQ ID NO: 187278 - protein, 36 aa, Artificial Sequence
  Description of Artificial Sequence: Synthetic polypeptide
DEAEIRTTNGVAYCQYGCVCSTWEHNQENFGSDNQA

SEQ ID NO: 187279 - protein, 34 aa, Artificial Sequence
  Description of Artificial Sequence: Synthetic polypeptide
KEAEIATTNPVAYYAYGQTVPSCNTSQKGTNNQD

SEQ ID NO: 187280 - protein, 36 aa, Artificial Sequence
  Description of Artificial Sequence: Synthetic polypeptide
MEEEIRTTNPVATEGYGVVVDDQNENMVGGGNEEEG

SEQ ID NO: 187281 - protein, 37 aa, Artificial Sequence
  Description of Artificial Sequence: Synthetic polypeptide
MEEEIRTTNPVATEGYGTIVSDLFTGDPEGQGDDEGN

SEQ ID NO: 187282 - protein, 36 aa, Artificial Sequence
  Description of Artificial Sequence: Synthetic polypeptide
LESEIATTNPCATEQYGTVCSCTGGEWSENANGGND

SEQ ID NO: 187283 - protein, 36 aa, Artificial Sequence
  Description of Artificial Sequence: Synthetic polypeptide
LESEIRTTNPVATEQYGCVHDEYVLQEKDGVVDSMS

SEQ ID NO: 187284 - protein, 36 aa, Artificial Sequence
  Description of Artificial Sequence: Synthetic polypeptide
DEECLRTTNPCAYEQYGCVCSNTGELNQEYFGSDQS

SEQ ID NO: 187285 - protein, 33 aa, Artificial Sequence
  Description of Artificial Sequence: Synthetic polypeptide
DENEIRCTNPVATEQWGATANAEDLAEPKGGYI

SEQ ID NO: 187286 - protein, 35 aa, Artificial Sequence
  Description of Artificial Sequence: Synthetic polypeptide
DEAEIRTTNPCAYEQWGSVCGDNNNDMQGQGGGKD

SEQ ID NO: 187287 - protein, 35 aa, Artificial Sequence
  Description of Artificial Sequence: Synthetic polypeptide
LNSEIRTTNPVATEQYGSVSVDVEDEVEGQMEDIQ

SEQ ID NO: 187288 - protein, 36 aa, Artificial Sequence
  Description of Artificial Sequence: Synthetic polypeptide
LSDEIRTTNPVATEQYGSVFIVSAEDEREGQMEDPQ

SEQ ID NO: 187289 - protein, 35 aa, Artificial Sequence
  Description of Artificial Sequence: Synthetic polypeptide
MANEIRTTNPVATEQYGSVWVDEASNIPQLEDDSP

SEQ ID NO: 187290 - protein, 36 aa, Artificial Sequence
  Description of Artificial Sequence: Synthetic polypeptide
MDGEIRTTNPVATEQYGSCTHPASVTINEHFSSNDN

SEQ ID NO: 187291 - protein, 36 aa, Artificial Sequence
  Description of Artificial Sequence: Synthetic polypeptide
MDGEIRTTNPVATEQYGSCTNMASVTINEHFSSNSD

SEQ ID NO: 187292 - protein, 35 aa, Artificial Sequence
  Description of Artificial Sequence: Synthetic polypeptide
MDPEIRCTNPVATEQYGSAAWVLDMNSEEGGNENI

SEQ ID NO: 187293 - protein, 35 aa, Artificial Sequence
  Description of Artificial Sequence: Synthetic polypeptide
MEAEIATTNPVAYCAYGQTVPSCNGLSQKGTNNQD

SEQ ID NO: 187294 - protein, 36 aa, Artificial Sequence
  Description of Artificial Sequence: Synthetic polypeptide
MEAEIRTTNPVATEGYGSVCDVTPPIDGLFDSIEER

SEQ ID NO: 187295 - protein, 34 aa, Artificial Sequence
  Description of Artificial Sequence: Synthetic polypeptide
MEDEIRCTNPTAYECWGSVYYENDDRHRGDDNRR

SEQ ID NO: 187296 - protein, 37 aa, Artificial Sequence
  Description of Artificial Sequence: Synthetic polypeptide
MEDEIRCTNPVATEQYGSVSWEAVISTEIQPMEDFND

SEQ ID NO: 187297 - protein, 36 aa, Artificial Sequence
  Description of Artificial Sequence: Synthetic polypeptide
MEDEIRTTNPVATEGYGSVYDDDIMNFGQVEEEGGQ

SEQ ID NO: 187298 - protein, 36 aa, Artificial Sequence
  Description of Artificial Sequence: Synthetic polypeptide
MEDEIRTTNPVATEGYGSVYDDDIMNLGVEEEEGGF

SEQ ID NO: 187299 - protein, 37 aa, Artificial Sequence
  Description of Artificial Sequence: Synthetic polypeptide
MEDEIRTTNPVATEGYGSVYDLDIMNLGQGEEEEGGQ

SEQ ID NO: 187300 - protein, 36 aa, Artificial Sequence
  Description of Artificial Sequence: Synthetic polypeptide
MEDEIRTTNPVATEQYGSVSWCGDAEIPFSHQEVET

SEQ ID NO: 187301 - protein, 37 aa, Artificial Sequence
  Description of Artificial Sequence: Synthetic polypeptide
MEDEIRTTNPVATESYGSVTDNDTQNNGQEDGQGQET

SEQ ID NO: 187302 - protein, 37 aa, Artificial Sequence
  Description of Artificial Sequence: Synthetic polypeptide
MEEEIACTNPVATEQWYCMGVWSPIENALNRSISNAR

SEQ ID NO: 187303 - protein, 34 aa, Artificial Sequence
  Description of Artificial Sequence: Synthetic polypeptide
DENEIRCTNPIATEQWGATWANAEDLAEPKGPYR

SEQ ID NO: 187304 - protein, 36 aa, Artificial Sequence
  Description of Artificial Sequence: Synthetic polypeptide
MEEEIATTNPVAHEQWYIMGVWYPTNVLNRSISNAS

SEQ ID NO: 187305 - protein, 37 aa, Artificial Sequence
  Description of Artificial Sequence: Synthetic polypeptide
LEPEISTTNPVATEQYGESCVSFENEQMQGVVQTCEE

SEQ ID NO: 187306 - protein, 35 aa, Artificial Sequence
  Description of Artificial Sequence: Synthetic polypeptide
DENEIRCTNPVATEQYGCCWVAQVDVEQGEGGEDL

SEQ ID NO: 187307 - protein, 39 aa, Artificial Sequence
  Description of Artificial Sequence: Synthetic polypeptide
AEEEIRTTNPVATEQYGVVVTTVTTNNLEQGTEGGVTTE

SEQ ID NO: 187308 - protein, 38 aa, Artificial Sequence
  Description of Artificial Sequence: Synthetic polypeptide
LEEEISTTNPVATEQYGESSCVSAFNEQMQGVVQTCEE

SEQ ID NO: 187309 - protein, 34 aa, Artificial Sequence
  Description of Artificial Sequence: Synthetic polypeptide
KEDEIRCTNPTAYECWGSVYYENDDRHRGGDNTR

SEQ ID NO: 187310 - protein, 36 aa, Artificial Sequence
  Description of Artificial Sequence: Synthetic polypeptide
DENEIRGTNPVATDAYGSVANMTEGLQEGEGGQGDQ

SEQ ID NO: 187311 - protein, 34 aa, Artificial Sequence
  Description of Artificial Sequence: Synthetic polypeptide
DEECISTVNPVATEGYGCVCSSGEHNENFGSDQS

SEQ ID NO: 187312 - protein, 35 aa, Artificial Sequence
  Description of Artificial Sequence: Synthetic polypeptide
DEECISTVNPVATEGYGCVCSWEDLNEENFGSNQS

SEQ ID NO: 187313 - protein, 38 aa, Artificial Sequence
  Description of Artificial Sequence: Synthetic polypeptide
DEEEIRTTNPVATEQYGSVVYDGMFGQEGEQEEDQGGT

SEQ ID NO: 187314 - protein, 34 aa, Artificial Sequence
  Description of Artificial Sequence: Synthetic polypeptide
DEECISTVNPVATEGYGCVCSWEGHNENFGSDQS

SEQ ID NO: 187315 - protein, 39 aa, Artificial Sequence
  Description of Artificial Sequence: Synthetic polypeptide
DEEEIRTTNPVATEQYGSVVYDGMFGQLGDQEEDNDQGN

SEQ ID NO: 187316 - protein, 34 aa, Artificial Sequence
  Description of Artificial Sequence: Synthetic polypeptide
DEECISTVNPVATEGYGCVCSWEHNEEYFNSDQS

SEQ ID NO: 187317 - protein, 34 aa, Artificial Sequence
  Description of Artificial Sequence: Synthetic polypeptide
DEECISTVNPVATEGYGCVCSWEHNENFISDNQS

SEQ ID NO: 187318 - protein, 33 aa, Artificial Sequence
  Description of Artificial Sequence: Synthetic polypeptide
KETEIRCTNPTAYECWGSVYYENDDRHRGDDER

SEQ ID NO: 187319 - protein, 38 aa, Artificial Sequence
  Description of Artificial Sequence: Synthetic polypeptide
LEAEIRATNPVATEQYGSVCYSDWMNLQDERQSDTQQK

SEQ ID NO: 187320 - protein, 35 aa, Artificial Sequence
  Description of Artificial Sequence: Synthetic polypeptide
DEECLRTTNPCAYEQYGCVCSWEHNQENFGSNNQA

SEQ ID NO: 187321 - protein, 36 aa, Artificial Sequence
  Description of Artificial Sequence: Synthetic polypeptide
LEAEIRTTNPVATEQYGSIPWTPPLEENQHDSEDPQ

SEQ ID NO: 187322 - protein, 36 aa, Artificial Sequence
  Description of Artificial Sequence: Synthetic polypeptide
LEAEIRTTNPVATEQYGSIPWTPPLEENQSHQSEPQ

SEQ ID NO: 187323 - protein, 36 aa, Artificial Sequence
  Description of Artificial Sequence: Synthetic polypeptide
LEAEIRTTNPVATEQYGSVSFDWDSGGATIDGTQQM

SEQ ID NO: 187324 - protein, 38 aa, Artificial Sequence
  Description of Artificial Sequence: Synthetic polypeptide
DEEEIRTTNPVATEQYGSVVYDGMFGQSGEQEEDQDDG

SEQ ID NO: 187325 - protein, 36 aa, Artificial Sequence
  Description of Artificial Sequence: Synthetic polypeptide
LEDEIRTTNPVATEQYGSVSVSAEDEPPEGQMEDLQ

SEQ ID NO: 187326 - protein, 34 aa, Artificial Sequence
  Description of Artificial Sequence: Synthetic polypeptide
CEEVIACTNPVATEQYGCVAMNNNQTAGGPEGSK

SEQ ID NO: 187327 - protein, 35 aa, Artificial Sequence
  Description of Artificial Sequence: Synthetic polypeptide
CEEVIACTNPVATEQYGCVANMNNNQTAGGPNGSD

SEQ ID NO: 187328 - protein, 34 aa, Artificial Sequence
  Description of Artificial Sequence: Synthetic polypeptide
DEECISTVNPVATEGYGCVCSWGELENFGSDTQS

SEQ ID NO: 187329 - protein, 34 aa, Artificial Sequence
  Description of Artificial Sequence: Synthetic polypeptide
DEECISTVNPVATEGYGCVCSWMEHNENFGSEQS

SEQ ID NO: 187330 - protein, 36 aa, Artificial Sequence
  Description of Artificial Sequence: Synthetic polypeptide
LEEEIRTTNPVATEQYGCVHDYYVVQEKDGFLDSDS

SEQ ID NO: 187331 - protein, 36 aa, Artificial Sequence
  Description of Artificial Sequence: Synthetic polypeptide
LEEEIRTTNPVATEQYGCVYDYYVAQEKDGVVDSDS

SEQ ID NO: 187332 - protein, 38 aa, Artificial Sequence
  Description of Artificial Sequence: Synthetic polypeptide
DEEEIRTTNPVATEQYGSVVYVGMFGQEGEQEEDGDGI

SEQ ID NO: 187333 - protein, 36 aa, Artificial Sequence
  Description of Artificial Sequence: Synthetic polypeptide
LEAEIRTTNPVATEQYGSIPWTPPLEENQHQSEEPV

SEQ ID NO: 187334 - protein, 37 aa, Artificial Sequence
  Description of Artificial Sequence: Synthetic polypeptide
MEEEIRTTNPVATEGYGTIVSDLGTGDPEGQGGDEGI

SEQ ID NO: 187335 - protein, 33 aa, Artificial Sequence
  Description of Artificial Sequence: Synthetic polypeptide
DEECLRTTNPCAYEQYGCVCSWEHNQNFSSDQS

SEQ ID NO: 187336 - protein, 37 aa, Artificial Sequence
  Description of Artificial Sequence: Synthetic polypeptide
DENEIRATNPVATEQYGTVTTVWLPDEQKENMQIDEC

SEQ ID NO: 187337 - protein, 36 aa, Artificial Sequence
  Description of Artificial Sequence: Synthetic polypeptide
MEEEIRSTNPVATEFYGSVYDQQNFNIGEGDGGNED

SEQ ID NO: 187338 - protein, 35 aa, Artificial Sequence
  Description of Artificial Sequence: Synthetic polypeptide
MEEEIRSTNPVATEFYGSVYDQQNFNIGGGIGGED

SEQ ID NO: 187339 - protein, 36 aa, Artificial Sequence
  Description of Artificial Sequence: Synthetic polypeptide
MEEEIRSTNPVATEFYGSVYDQTNFNFGMEDDGGGD

SEQ ID NO: 187340 - protein, 37 aa, Artificial Sequence
  Description of Artificial Sequence: Synthetic polypeptide
MEEEIRSTNPVATEQYGSVNMNDNQGLQGEEFDEVED

SEQ ID NO: 187341 - protein, 38 aa, Artificial Sequence
  Description of Artificial Sequence: Synthetic polypeptide
MEEEIRSTNPVATEQYGVVSILIATGDNDQQEGGDIGD

SEQ ID NO: 187342 - protein, 35 aa, Artificial Sequence
  Description of Artificial Sequence: Synthetic polypeptide
MEEEIRSTNPVATESYGSVVSDGFGGEGQGEEQGE

SEQ ID NO: 187343 - protein, 37 aa, Artificial Sequence
  Description of Artificial Sequence: Synthetic polypeptide
MEEEIRSTNPVATESYGSVYDQTNFNVGMEGDGGNED

SEQ ID NO: 187344 - protein, 37 aa, Artificial Sequence
  Description of Artificial Sequence: Synthetic polypeptide
MEEEIRTTNPVAFEQYGDVVTGGQTDDGEQQRGGGGG

SEQ ID NO: 187345 - protein, 36 aa, Artificial Sequence
  Description of Artificial Sequence: Synthetic polypeptide
MEEEIRTTNPVATEFYGSVVMEPGFGGGEGDEGNNI

SEQ ID NO: 187346 - protein, 36 aa, Artificial Sequence
  Description of Artificial Sequence: Synthetic polypeptide
MEEEIRTTNPVATEFYGSVYDDIIDGGQEDDTGEVQ

SEQ ID NO: 187347 - protein, 36 aa, Artificial Sequence
  Description of Artificial Sequence: Synthetic polypeptide
MEEEIRTTNPVATEFYGSVYDDIIDGGQEEYTGEQQ

SEQ ID NO: 187348 - protein, 38 aa, Artificial Sequence
  Description of Artificial Sequence: Synthetic polypeptide
MEEEIRTTNPVATEFYGVVGVDGGGNATNDDDEGNQGR

SEQ ID NO: 187349 - protein, 37 aa, Artificial Sequence
  Description of Artificial Sequence: Synthetic polypeptide
MEEEIRTTNPVATEFYGVVVDGGGNATNDDGEGGNQG

SEQ ID NO: 187350 - protein, 36 aa, Artificial Sequence
  Description of Artificial Sequence: Synthetic polypeptide
MEEEIRTTNPVATEFYGVVVDGGGNATNDDTGGSQG

SEQ ID NO: 187351 - protein, 37 aa, Artificial Sequence
  Description of Artificial Sequence: Synthetic polypeptide
MEEEIRTTNPVATEFYGVVVDVGGNATNDDEGGNQGI

SEQ ID NO: 187352 - protein, 37 aa, Artificial Sequence
  Description of Artificial Sequence: Synthetic polypeptide
MEEEIRTTNPVATEFYGVVVSDTTNAFGEDNIGQGGF

SEQ ID NO: 187353 - protein, 33 aa, Artificial Sequence
  Description of Artificial Sequence: Synthetic polypeptide
DENEIHTTNPVSTEPWGTISMEDIQQQQNGNHP

SEQ ID NO: 187354 - protein, 38 aa, Artificial Sequence
  Description of Artificial Sequence: Synthetic polypeptide
MEEEIRTTNPVATEGYGMVDNGSGMGNLQENNGGQQGQ

SEQ ID NO: 187355 - protein, 37 aa, Artificial Sequence
  Description of Artificial Sequence: Synthetic polypeptide
MEEEIRTTNPVATEGYGSVVNDNIIQGGQGQEEDEQN

SEQ ID NO: 187356 - protein, 37 aa, Artificial Sequence
  Description of Artificial Sequence: Synthetic polypeptide
MEEEIRTTNPVATEGYGSVVYDNIIQGGQEGEEDEQE

SEQ ID NO: 187357 - protein, 37 aa, Artificial Sequence
  Description of Artificial Sequence: Synthetic polypeptide
MEEEIRTTNPVATEGYGSVVYDNIIQGGQGGEEDEQS

SEQ ID NO: 187358 - protein, 37 aa, Artificial Sequence
  Description of Artificial Sequence: Synthetic polypeptide
MEEEIRTTNPVATEGYGSVVYDNIIQGQQGGEEDEQA

SEQ ID NO: 187359 - protein, 36 aa, Artificial Sequence
  Description of Artificial Sequence: Synthetic polypeptide
MEEEIRTTNPVATEGYGSVYDDIIDGGQTDETGEIE

SEQ ID NO: 187360 - protein, 35 aa, Artificial Sequence
  Description of Artificial Sequence: Synthetic polypeptide
MEEEIRSTNPVATEFYGSVYDQQNFNGEGTGGGED

SEQ ID NO: 187361 - protein, 35 aa, Artificial Sequence
  Description of Artificial Sequence: Synthetic polypeptide
MEEEIRSTNPVATEFYGSVYDQQNFNGEEGDGGEN

SEQ ID NO: 187362 - protein, 36 aa, Artificial Sequence
  Description of Artificial Sequence: Synthetic polypeptide
MEEEIRSTNPVATEFYGSVYDQNTNFNFGEGDGGED

SEQ ID NO: 187363 - protein, 36 aa, Artificial Sequence
  Description of Artificial Sequence: Synthetic polypeptide
MEEEIRSTNPVATEFYGSVYDQFNFNTGQEGDGGED

SEQ ID NO: 187364 - protein, 37 aa, Artificial Sequence
  Description of Artificial Sequence: Synthetic polypeptide
DENEIRATNPVATEQYGTVTTVWLPDEQFENCQIDEE

SEQ ID NO: 187365 - protein, 37 aa, Artificial Sequence
  Description of Artificial Sequence: Synthetic polypeptide
DENEIRATNPVATEQYGTVTTVMLPTDEQENLQIDEI

SEQ ID NO: 187366 - protein, 35 aa, Artificial Sequence
  Description of Artificial Sequence: Synthetic polypeptide
MEEEIATTNPVATEQYGVVMAGPIEGEGGQGENEG

SEQ ID NO: 187367 - protein, 38 aa, Artificial Sequence
  Description of Artificial Sequence: Synthetic polypeptide
MEEEIATTNPVATWQWYAMGVWSPTRNALNGRSISNAR

SEQ ID NO: 187368 - protein, 37 aa, Artificial Sequence
  Description of Artificial Sequence: Synthetic polypeptide
DENEIRATNPVATEQYGSVGDTGDGNFGDATGGGDGG

SEQ ID NO: 187369 - protein, 34 aa, Artificial Sequence
  Description of Artificial Sequence: Synthetic polypeptide
DEECLRTTNPEAYEQYGCVCSWGEDNQNFGSEQS

SEQ ID NO: 187370 - protein, 36 aa, Artificial Sequence
  Description of Artificial Sequence: Synthetic polypeptide
DENEIRATNPVATEQYGSCMPIMLWPENRSQSQQTS

SEQ ID NO: 187371 - protein, 34 aa, Artificial Sequence
  Description of Artificial Sequence: Synthetic polypeptide
MEEEIGTTNPEATCQYVGPWADEYDLQPHGGNNM

SEQ ID NO: 187372 - protein, 37 aa, Artificial Sequence
  Description of Artificial Sequence: Synthetic polypeptide
DENEIRATNPVATEQYGMVSVEGMGLGGQGQEGEDGM

SEQ ID NO: 187373 - protein, 36 aa, Artificial Sequence
  Description of Artificial Sequence: Synthetic polypeptide
DENEIRATNPVATEFYGSVVPGGMNQDIGGNGNEQG

SEQ ID NO: 187374 - protein, 38 aa, Artificial Sequence
  Description of Artificial Sequence: Synthetic polypeptide
MEEEIKTTNPVATEQYGSFVINPLTQNMELEQAVVKTA

SEQ ID NO: 187375 - protein, 37 aa, Artificial Sequence
  Description of Artificial Sequence: Synthetic polypeptide
MEEEIATTNPVATEQYGCVCSVWEEHNQEGFNSDNQA

SEQ ID NO: 187376 - protein, 34 aa, Artificial Sequence
  Description of Artificial Sequence: Synthetic polypeptide
MEEEIRCTNPAATEQYGDVAVVSEGGMGGEGGET

SEQ ID NO: 187377 - protein, 37 aa, Artificial Sequence
  Description of Artificial Sequence: Synthetic polypeptide
MEEEIRCTNPVATEFYGVVSNGVNGQSGQEGGQNDTF

SEQ ID NO: 187378 - protein, 38 aa, Artificial Sequence
  Description of Artificial Sequence: Synthetic polypeptide
MEEEIRCTNPVATEQYGSVISNGVNGQSGQEGGQEDTF

SEQ ID NO: 187379 - protein, 37 aa, Artificial Sequence
  Description of Artificial Sequence: Synthetic polypeptide
DENEIKTTNPVATEFYGSVVDFELQDETNDGQGGEGD

SEQ ID NO: 187380 - protein, 37 aa, Artificial Sequence
  Description of Artificial Sequence: Synthetic polypeptide
MEEEIRGTNPVATECYGSVSANDNGNEEGQGEEVGDD

SEQ ID NO: 187381 - protein, 36 aa, Artificial Sequence
  Description of Artificial Sequence: Synthetic polypeptide
MEEEIRGTNPVATEQWGCVVANVGGQLIIGGGNDGQ

SEQ ID NO: 187382 - protein, 37 aa, Artificial Sequence
  Description of Artificial Sequence: Synthetic polypeptide
MEEEIRGTNPVATEQWGVTSVVVNTLGIERGGGQDGD

SEQ ID NO: 187383 - protein, 37 aa, Artificial Sequence
  Description of Artificial Sequence: Synthetic polypeptide
MEEEIRGTNPVATEQYGSFGSAEGETGGGNDDNENDV

SEQ ID NO: 187384 - protein, 37 aa, Artificial Sequence
  Description of Artificial Sequence: Synthetic polypeptide
MEEEIRGTNPVATEQYGSVIFGNNNEGGNQTTEGEDG

SEQ ID NO: 187385 - protein, 37 aa, Artificial Sequence
  Description of Artificial Sequence: Synthetic polypeptide
DENEIKTTNPAATEQYGSVSVLEDINGEEEEGGNQGN

SEQ ID NO: 187386 - protein, 38 aa, Artificial Sequence
  Description of Artificial Sequence: Synthetic polypeptide
MEEEIRGTNPVATEQYGSVVSAIMVGGDDNQGGETGNN

SEQ ID NO: 187387 - protein, 37 aa, Artificial Sequence
  Description of Artificial Sequence: Synthetic polypeptide
MEEEIRGTNPVATEQYGSVVVNNMPNAGQEGGQTGGQ

SEQ ID NO: 187388 - protein, 37 aa, Artificial Sequence
  Description of Artificial Sequence: Synthetic polypeptide
DENEIKTTNPVATESYGSVVSDGMQGLTLGDGDQNGD

SEQ ID NO: 187389 - protein, 38 aa, Artificial Sequence
  Description of Artificial Sequence: Synthetic polypeptide
DEEEIRTTNPVATEQYGSVPAVWQMVKVEPGVEPEQFD

SEQ ID NO: 187390 - protein, 37 aa, Artificial Sequence
  Description of Artificial Sequence: Synthetic polypeptide
DENEIRTTNPVATEQYGVVVAMNGFNGEGGFEENTFD

SEQ ID NO: 187391 - protein, 36 aa, Artificial Sequence
  Description of Artificial Sequence: Synthetic polypeptide
DEDEIRTTNPVAYDQYGSVVQCIGNQSQWTGTKYGV

SEQ ID NO: 187392 - protein, 34 aa, Artificial Sequence
  Description of Artificial Sequence: Synthetic polypeptide
DEAEIRTTNPVAYECWGVVCYTTIDQDGGQGGDN

SEQ ID NO: 187393 - protein, 35 aa, Artificial Sequence
  Description of Artificial Sequence: Synthetic polypeptide
DEAEIRTTNPVAYECWGSVYYGNGMEQNNGGGQAN

SEQ ID NO: 187394 - protein, 34 aa, Artificial Sequence
  Description of Artificial Sequence: Synthetic polypeptide
DEAEIRTTNPVAYECWGSVYYGDVGEQQNEQSPN

SEQ ID NO: 187395 - protein, 36 aa, Artificial Sequence
  Description of Artificial Sequence: Synthetic polypeptide
DEDEIATTNPVATEQYGCVVAANMGLANANPSNMTV

SEQ ID NO: 187396 - protein, 35 aa, Artificial Sequence
  Description of Artificial Sequence: Synthetic polypeptide
DEAEIRTTNPVAYECWGSVCYTNIDNNDHGMEGDN

SEQ ID NO: 187397 - protein, 37 aa, Artificial Sequence
  Description of Artificial Sequence: Synthetic polypeptide
DEDEIATTNPVATEQYGSACAATNGQEVPDDGMGDDH

SEQ ID NO: 187398 - protein, 36 aa, Artificial Sequence
  Description of Artificial Sequence: Synthetic polypeptide
DEAEIRTTNPVAYECWGSVCYTNIDMNDHRGQDGDN

SEQ ID NO: 187399 - protein, 37 aa, Artificial Sequence
  Description of Artificial Sequence: Synthetic polypeptide
DEDEIATTNPVATEQYGSACAATNPQEAGDSGMGEHM

SEQ ID NO: 187400 - protein, 37 aa, Artificial Sequence
  Description of Artificial Sequence: Synthetic polypeptide
DEDEIATTNPVATEQYGSACSAANNPATAHGGDNEAM

SEQ ID NO: 187401 - protein, 37 aa, Artificial Sequence
  Description of Artificial Sequence: Synthetic polypeptide
DEDEIATTNPVATEQYGSACSANPAEGGEHQDGMEMW

SEQ ID NO: 187402 - protein, 35 aa, Artificial Sequence
  Description of Artificial Sequence: Synthetic polypeptide
DEAEIRTTNPVAYEAWGVVYMSPNPGEQPEDGGQQ

SEQ ID NO: 187403 - protein, 36 aa, Artificial Sequence
  Description of Artificial Sequence: Synthetic polypeptide
DEAEIRTTNPVATQCWGSVSRCINEPQVRDDETLGE

SEQ ID NO: 187404 - protein, 32 aa, Artificial Sequence
  Description of Artificial Sequence: Synthetic polypeptide
CEDEIATTNPVAYEQWGITHTNWIDLDGEDSD

SEQ ID NO: 187405 - protein, 37 aa, Artificial Sequence
  Description of Artificial Sequence: Synthetic polypeptide
DEAEIRTTNPVATESYGSVTWSPVVWLENPNTWEVHN

SEQ ID NO: 187406 - protein, 37 aa, Artificial Sequence
  Description of Artificial Sequence: Synthetic polypeptide
DEAEIRTTNPVATEQYWSVCPDPVYNLHEDEIGGIVE

SEQ ID NO: 187407 - protein, 35 aa, Artificial Sequence
  Description of Artificial Sequence: Synthetic polypeptide
DEDEIATTNPVATEQYGSVCAAVAHGEADMPPGEN

SEQ ID NO: 187408 - protein, 37 aa, Artificial Sequence
  Description of Artificial Sequence: Synthetic polypeptide
DEDEIATTNPVATEQYGSVCAGMTHGGAEAPIGDGNK

SEQ ID NO: 187409 - protein, 36 aa, Artificial Sequence
  Description of Artificial Sequence: Synthetic polypeptide
DEAEIRTTNPVATEQYGYAANSLVPDFDDNTEDERG

SEQ ID NO: 187410 - protein, 36 aa, Artificial Sequence
  Description of Artificial Sequence: Synthetic polypeptide
DEAEIRTTNPVATEQYGWVNGTAPDFDYSIGQEIID

SEQ ID NO: 187411 - protein, 39 aa, Artificial Sequence
  Description of Artificial Sequence: Synthetic polypeptide
DEAEIRTTNPVATEQYGWSYVSCSGIMCEELMNGNEEFF

SEQ ID NO: 187412 - protein, 35 aa, Artificial Sequence
  Description of Artificial Sequence: Synthetic polypeptide
DEAEIRTTNPVATEQYGWIWNNWHEFSNPSIETQI

SEQ ID NO: 187413 - protein, 36 aa, Artificial Sequence
  Description of Artificial Sequence: Synthetic polypeptide
DEAEIRTTNPVATEQYGWIPWTPPLEENTQHQSEHV

SEQ ID NO: 187414 - protein, 36 aa, Artificial Sequence
  Description of Artificial Sequence: Synthetic polypeptide
DEAEIRTTNPVATEQYGWIPWTPPLEENNQHQFEHQ

SEQ ID NO: 187415 - protein, 35 aa, Artificial Sequence
  Description of Artificial Sequence: Synthetic polypeptide
DEAEIRTTNPVAYEEWGCVCPNGNDMQRDTGDEEL

SEQ ID NO: 187416 - protein, 36 aa, Artificial Sequence
  Description of Artificial Sequence: Synthetic polypeptide
DEAEIRTTNPVATEQYGVVYNAVNHLSVLDSAEEQN

SEQ ID NO: 187417 - protein, 34 aa, Artificial Sequence
  Description of Artificial Sequence: Synthetic polypeptide
DEAEIRTTNPVAYEEWGCVCPNNNDQMDTGDPEM

SEQ ID NO: 187418 - protein, 35 aa, Artificial Sequence
  Description of Artificial Sequence: Synthetic polypeptide
DEDEIATTNPVATEQYGCVAANGDPATMPMGDPHN

SEQ ID NO: 187419 - protein, 36 aa, Artificial Sequence
  Description of Artificial Sequence: Synthetic polypeptide
DEDEIATTNPVATEQWGCTFAGNEHLEATADGDNRM

SEQ ID NO: 187420 - protein, 35 aa, Artificial Sequence
  Description of Artificial Sequence: Synthetic polypeptide
DEAEIRTTNPVAYEPWGSVYCGEGQHQNTGGNAPE

SEQ ID NO: 187421 - protein, 35 aa, Artificial Sequence
  Description of Artificial Sequence: Synthetic polypeptide
DEDEIATTNPVATEQWGCVAANNGVPAGAGPEGNN

SEQ ID NO: 187422 - protein, 34 aa, Artificial Sequence
  Description of Artificial Sequence: Synthetic polypeptide
DEDEIATTNPVATEQWGCVAGTGPPNSMNPQDHQ

SEQ ID NO: 187423 - protein, 35 aa, Artificial Sequence
  Description of Artificial Sequence: Synthetic polypeptide
DEDEIATTNPVATEQWGCVAMGNGENPSNQTEGRN

SEQ ID NO: 187424 - protein, 36 aa, Artificial Sequence
  Description of Artificial Sequence: Synthetic polypeptide
DEDEIATTNPVATEQWGCVTAAPANGLQPADAPNNN

SEQ ID NO: 187425 - protein, 33 aa, Artificial Sequence
  Description of Artificial Sequence: Synthetic polypeptide
DEDEIATTNPVATEQWGGCCAGPGHQAEGPMDT

SEQ ID NO: 187426 - protein, 34 aa, Artificial Sequence
  Description of Artificial Sequence: Synthetic polypeptide
DEDEIATTNPVATEQWGGCCAGTGHQAEDQPMGN

SEQ ID NO: 187427 - protein, 34 aa, Artificial Sequence
  Description of Artificial Sequence: Synthetic polypeptide
DEDEIATTNPVATEQWGGCCAGTGHQQAEGPQFN

SEQ ID NO: 187428 - protein, 34 aa, Artificial Sequence
  Description of Artificial Sequence: Synthetic polypeptide
DEDEIATTNPVATEQWGGCCNAGTGHQAEDPMRS

SEQ ID NO: 187429 - protein, 35 aa, Artificial Sequence
  Description of Artificial Sequence: Synthetic polypeptide
DEDEIATTNPVATEQWGGCTAGNEHLEATRDGDQM

SEQ ID NO: 187430 - protein, 35 aa, Artificial Sequence
  Description of Artificial Sequence: Synthetic polypeptide
DEDEIATTNPVATEQWGSVAIPNPEEAPDNGMGDP

SEQ ID NO: 187431 - protein, 35 aa, Artificial Sequence
  Description of Artificial Sequence: Synthetic polypeptide
DEDEIATTNPVATEQWGSVTSAANNPDATTPPDEM

SEQ ID NO: 187432 - protein, 33 aa, Artificial Sequence
  Description of Artificial Sequence: Synthetic polypeptide
DEDEIATTNPVATEQWGTNCAAAAHGMRSNDSW

SEQ ID NO: 187433 - protein, 34 aa, Artificial Sequence
  Description of Artificial Sequence: Synthetic polypeptide
DEDEIATTNPVATEQWGTNCAANDGEEEIDEGND

SEQ ID NO: 187434 - protein, 34 aa, Artificial Sequence
  Description of Artificial Sequence: Synthetic polypeptide
DEDEIATTNPVATEQWGTNCAANDGEPVEDEGND

SEQ ID NO: 187435 - protein, 34 aa, Artificial Sequence
  Description of Artificial Sequence: Synthetic polypeptide
DEDEIATTNPVATEQWGTNCAATDGGVEDESGND

SEQ ID NO: 187436 - protein, 34 aa, Artificial Sequence
  Description of Artificial Sequence: Synthetic polypeptide
DEDEIATTNPVATEQWGTNCAATDGNPVEFEIND

SEQ ID NO: 187437 - protein, 34 aa, Artificial Sequence
  Description of Artificial Sequence: Synthetic polypeptide
DEDEIATTNPVATEQWGTNCSAAAAHMNRSNDSW

SEQ ID NO: 187438 - protein, 35 aa, Artificial Sequence
  Description of Artificial Sequence: Synthetic polypeptide
DEDEIATTNPVATEQWGTVCAANDGYPVEDEGNDM

SEQ ID NO: 187439 - protein, 35 aa, Artificial Sequence
  Description of Artificial Sequence: Synthetic polypeptide
DEAEIRTTNPVAYEEWGNVCYTNEDHNDHQQDGDN

SEQ ID NO: 187440 - protein, 34 aa, Artificial Sequence
  Description of Artificial Sequence: Synthetic polypeptide
DEAEIRTTNPVAYEEWGCVCPNNNDQMQTGGEEP

SEQ ID NO: 187441 - protein, 34 aa, Artificial Sequence
  Description of Artificial Sequence: Synthetic polypeptide
DEDEIATTNPVATEQYGCVAAKPGEMDSMDNNNM

SEQ ID NO: 187442 - protein, 34 aa, Artificial Sequence
  Description of Artificial Sequence: Synthetic polypeptide
DEAEIRTTNPVAYEEWGCVCPNNNDQMDTGMEGP

SEQ ID NO: 187443 - protein, 37 aa, Artificial Sequence
  Description of Artificial Sequence: Synthetic polypeptide
DEDEIATTNPVATEQYGSVCAMNNGEPTGGDLENGGM

SEQ ID NO: 187444 - protein, 37 aa, Artificial Sequence
  Description of Artificial Sequence: Synthetic polypeptide
DEDEIATTNPVATEQYGSVCAMNNGGTEATGDVNNVA

SEQ ID NO: 187445 - protein, 37 aa, Artificial Sequence
  Description of Artificial Sequence: Synthetic polypeptide
DEDEIATTNPVATEQYGSVCAMNNGNGEPGRDVPDTA

SEQ ID NO: 187446 - protein, 37 aa, Artificial Sequence
  Description of Artificial Sequence: Synthetic polypeptide
DEQEIATTNPVATEQYGSVCAANNGDENGMDINNGHY

SEQ ID NO: 187447 - protein, 37 aa, Artificial Sequence
  Description of Artificial Sequence: Synthetic polypeptide
DEQEIATTNPVATEQYGSVCAANNGDENGMDINMQNY

SEQ ID NO: 187448 - protein, 34 aa, Artificial Sequence
  Description of Artificial Sequence: Synthetic polypeptide
DEDEIATTNPVAYEPYGETAAMANDQQVSNDTPR

SEQ ID NO: 187449 - protein, 34 aa, Artificial Sequence
  Description of Artificial Sequence: Synthetic polypeptide
DEDEIATTNPVAYEPYGETAAMANDQVSNDGTAR

SEQ ID NO: 187450 - protein, 34 aa, Artificial Sequence
  Description of Artificial Sequence: Synthetic polypeptide
DEDEIATTNPVAYEPYGEVCAAMAWDQVSNDTVR

SEQ ID NO: 187451 - protein, 37 aa, Artificial Sequence
  Description of Artificial Sequence: Synthetic polypeptide
CEDEIATTNPVATEQYGSACAATNGQEAGDSPMGNGM

SEQ ID NO: 187452 - protein, 33 aa, Artificial Sequence
  Description of Artificial Sequence: Synthetic polypeptide
DEDEIATTNPVAYEPYGTTAAMANDQVSNDTVN

SEQ ID NO: 187453 - protein, 35 aa, Artificial Sequence
  Description of Artificial Sequence: Synthetic polypeptide
DEDEIATTNPVAYEQWGCVAANNGLTGAPDGANPH

SEQ ID NO: 187454 - protein, 35 aa, Artificial Sequence
  Description of Artificial Sequence: Synthetic polypeptide
CEEEIATVNPVATAQWGGCVAGNNGLQQRANDQEN

SEQ ID NO: 187455 - protein, 33 aa, Artificial Sequence
  Description of Artificial Sequence: Synthetic polypeptide
DEDEIATTNPVAYEQWGCVAGTAGELDNNAPVN

SEQ ID NO: 187456 - protein, 37 aa, Artificial Sequence
  Description of Artificial Sequence: Synthetic polypeptide
CEDEIATTNPVATEQWGSVSMSGDTPTNNDDLDGNEM

SEQ ID NO: 187457 - protein, 37 aa, Artificial Sequence
  Description of Artificial Sequence: Synthetic polypeptide
CEDEIATTNPVATEQWGSVSMSGDTPTGNDDLMGNQH

SEQ ID NO: 187458 - protein, 33 aa, Artificial Sequence
  Description of Artificial Sequence: Synthetic polypeptide
DEDEIATTNPVAYEQWGMTATGGLQGDHDDSSG

SEQ ID NO: 187459 - protein, 34 aa, Artificial Sequence
  Description of Artificial Sequence: Synthetic polypeptide
CEDEIATTNPVATEQWGCTAGNEHLEATRDIDRM

SEQ ID NO: 187460 - protein, 36 aa, Artificial Sequence
  Description of Artificial Sequence: Synthetic polypeptide
CEDEIATTNPVATEMWGSVAHGAGLTNPGNQTEGNN

SEQ ID NO: 187461 - protein, 35 aa, Artificial Sequence
  Description of Artificial Sequence: Synthetic polypeptide
CEDEIATTNPVATEMWGAVATAQMTNPGNQTEGNN

SEQ ID NO: 187462 - protein, 35 aa, Artificial Sequence
  Description of Artificial Sequence: Synthetic polypeptide
DEDEIATTNPVAYEQWGSCSINGAPGEDERGGDHH

SEQ ID NO: 187463 - protein, 35 aa, Artificial Sequence
  Description of Artificial Sequence: Synthetic polypeptide
DEDEIATTNPVAYEQWGSVAATAHGAAAPPGSVNA

SEQ ID NO: 187464 - protein, 38 aa, Artificial Sequence
  Description of Artificial Sequence: Synthetic polypeptide
DESEIRTTNPVATEFYGSVYDNVDNGENQNEGNGNDDI

SEQ ID NO: 187465 - protein, 36 aa, Artificial Sequence
  Description of Artificial Sequence: Synthetic polypeptide
DESEIRTTNPVATEGWGCVCSTWGEENQEYFGSDQG

SEQ ID NO: 187466 - protein, 35 aa, Artificial Sequence
  Description of Artificial Sequence: Synthetic polypeptide
DESEIRTTNPVATEGWGCVCSWGEENQEYFISNQG

SEQ ID NO: 187467 - protein, 36 aa, Artificial Sequence
  Description of Artificial Sequence: Synthetic polypeptide
DESEIRTTNPVATEGWGCVCSWGEHNAEYFGSNTQS

SEQ ID NO: 187468 - protein, 36 aa, Artificial Sequence
  Description of Artificial Sequence: Synthetic polypeptide
DESEIRTTNPVATEGWGCVCSWGEHNQEYSGSDNQA

SEQ ID NO: 187469 - protein, 37 aa, Artificial Sequence
  Description of Artificial Sequence: Synthetic polypeptide
DEQEIATTNPVATEQYGSVCAANNGDENGMDINNMNM

SEQ ID NO: 187470 - protein, 33 aa, Artificial Sequence
  Description of Artificial Sequence: Synthetic polypeptide
DEDEIATTNPVAYEPYGETAAMANDDQVSNDTS

SEQ ID NO: 187471 - protein, 36 aa, Artificial Sequence
  Description of Artificial Sequence: Synthetic polypeptide
DEQEIATTNPVATEQYGSVCAGMTHGGAEAPIGTHH

SEQ ID NO: 187472 - protein, 38 aa, Artificial Sequence
  Description of Artificial Sequence: Synthetic polypeptide
DEQEIATTNPVATEQYGSVCAMNNGEDTNPDDQMEHRM

SEQ ID NO: 187473 - protein, 37 aa, Artificial Sequence
  Description of Artificial Sequence: Synthetic polypeptide
DEDEIATTNPVATEQYGSVCAMNNGNLEPGMDVPDEA

SEQ ID NO: 187474 - protein, 37 aa, Artificial Sequence
  Description of Artificial Sequence: Synthetic polypeptide
DEDEIATTNPVATEQYGSVCAMNNNDLPPADGSGDDP

SEQ ID NO: 187475 - protein, 36 aa, Artificial Sequence
  Description of Artificial Sequence: Synthetic polypeptide
DEAEIRTTNPVATEQYGVVCSNWEEHNQENFPSDQS

SEQ ID NO: 187476 - protein, 38 aa, Artificial Sequence
  Description of Artificial Sequence: Synthetic polypeptide
DEDEIATTNPVATEQYGSVCAMTNNQNPQDDTTGGGLP

SEQ ID NO: 187477 - protein, 38 aa, Artificial Sequence
  Description of Artificial Sequence: Synthetic polypeptide
DEAEIRTTNPVATEQYGSYVYVMGPPLDFDTQIENSIV

SEQ ID NO: 187478 - protein, 38 aa, Artificial Sequence
  Description of Artificial Sequence: Synthetic polypeptide
DEDEIATTNPVATEQYGSVCPMGNNSGPQEHQDGNENN

SEQ ID NO: 187479 - protein, 38 aa, Artificial Sequence
  Description of Artificial Sequence: Synthetic polypeptide
DEDEIATTNPVATEQYGSVCSAANPPAPEAHGGDNEAM

SEQ ID NO: 187480 - protein, 38 aa, Artificial Sequence
  Description of Artificial Sequence: Synthetic polypeptide
DEDEIATTNPVATEQYGSVCSADNPPGGNAHPGDLDVM

SEQ ID NO: 187481 - protein, 37 aa, Artificial Sequence
  Description of Artificial Sequence: Synthetic polypeptide
DEDEIATTNPVATEQYGSVCSPAGNHMTEADDPNEHT

SEQ ID NO: 187482 - protein, 37 aa, Artificial Sequence
  Description of Artificial Sequence: Synthetic polypeptide
DEDEIATTNPVATEQYGSVPAITNHHETSGAEMGDDT

SEQ ID NO: 187483 - protein, 38 aa, Artificial Sequence
  Description of Artificial Sequence: Synthetic polypeptide
DEAEIRTTNPVATEQYGSYVSCSGIMWEELMNINENVF

SEQ ID NO: 187484 - protein, 35 aa, Artificial Sequence
  Description of Artificial Sequence: Synthetic polypeptide
DEDEIATTNPVATEQWGAVTSANNGAEPAGDPLGT

SEQ ID NO: 187485 - protein, 37 aa, Artificial Sequence
  Description of Artificial Sequence: Synthetic polypeptide
CEEEIATTNPVAYEQYGSVSGTGEAGINPRDGMEKVH

SEQ ID NO: 187486 - protein, 38 aa, Artificial Sequence
  Description of Artificial Sequence: Synthetic polypeptide
DEAEIRTTNPVATEQYGSYTSYSGIMLEELMNGNEEVI

SEQ ID NO: 187487 - protein, 38 aa, Artificial Sequence
  Description of Artificial Sequence: Synthetic polypeptide
DEAEIRTTNPVATEQYGSYMSYSGIMLEELANGNEEVW

SEQ ID NO: 187488 - protein, 39 aa, Artificial Sequence
  Description of Artificial Sequence: Synthetic polypeptide
DEAEIRTTNPVATEQYGSVYVSCSGIMCEELMNGNEEVF

SEQ ID NO: 187489 - protein, 38 aa, Artificial Sequence
  Description of Artificial Sequence: Synthetic polypeptide
DEAEIRTTNPVATEQYGSVYSESPNEGAMASFDENQFE

SEQ ID NO: 187490 - protein, 34 aa, Artificial Sequence
  Description of Artificial Sequence: Synthetic polypeptide
DEDEIATTNPVAYECWGSVAWNNEQQMNQGGSDS

SEQ ID NO: 187491 - protein, 34 aa, Artificial Sequence
  Description of Artificial Sequence: Synthetic polypeptide
DEDEIATTNPVAYECWGSVSGGEPGNAGEHDGQD

SEQ ID NO: 187492 - protein, 36 aa, Artificial Sequence
  Description of Artificial Sequence: Synthetic polypeptide
DEDEIATTNPVAYECWGVVSKTNNPLDDRQNGGGDM

SEQ ID NO: 187493 - protein, 37 aa, Artificial Sequence
  Description of Artificial Sequence: Synthetic polypeptide
DEQEIATTNPVATEQYGSVCSPMPNQNNEAMIGDLAN

SEQ ID NO: 187494 - protein, 37 aa, Artificial Sequence
  Description of Artificial Sequence: Synthetic polypeptide
DEQEIATTNPVATEQYGSVCAMNPNNLEPDSDQPNDA

SEQ ID NO: 187495 - protein, 36 aa, Artificial Sequence
  Description of Artificial Sequence: Synthetic polypeptide
CEDEIATTNPVATEQYGSACSADNPLPAEAPIGEHK

SEQ ID NO: 187496 - protein, 37 aa, Artificial Sequence
  Description of Artificial Sequence: Synthetic polypeptide
CEDEIATTNPVATEQYGSACAATNPQEAGDSMMGNSM

SEQ ID NO: 187497 - protein, 36 aa, Artificial Sequence
  Description of Artificial Sequence: Synthetic polypeptide
DEDEIATTNPVATEQYGTVCAANDGPAENDDGNNDD

SEQ ID NO: 187498 - protein, 35 aa, Artificial Sequence
  Description of Artificial Sequence: Synthetic polypeptide
DEDEIATTNPVATEQWGAVTSANNGAEHAGDPTDN

SEQ ID NO: 187499 - protein, 35 aa, Artificial Sequence
  Description of Artificial Sequence: Synthetic polypeptide
DEDEIATTNPVATEQWGAVCSQNPGVETAGEPTGT

SEQ ID NO: 187500 - protein, 35 aa, Artificial Sequence
  Description of Artificial Sequence: Synthetic polypeptide
DEDEIATTNPVATEQWGAVCAQNPPVETAGNPTAS

SEQ ID NO: 187501 - protein, 35 aa, Artificial Sequence
  Description of Artificial Sequence: Synthetic polypeptide
DESEIRTTNPVATECWGSTVACIDWPQDPKGEPYG

SEQ ID NO: 187502 - protein, 36 aa, Artificial Sequence
  Description of Artificial Sequence: Synthetic polypeptide
DEAEIRTTNPVAYEQYSSLPNPNVDMMNYQSGQDEW

SEQ ID NO: 187503 - protein, 37 aa, Artificial Sequence
  Description of Artificial Sequence: Synthetic polypeptide
DEDCIRTTNPVATEAWGSQVATEGNMESDYNEGNNRN

SEQ ID NO: 187504 - protein, 36 aa, Artificial Sequence
  Description of Artificial Sequence: Synthetic polypeptide
DEDCIRTTNPVATECWGSVATTGSMESIYNGGNNRN

SEQ ID NO: 187505 - protein, 37 aa, Artificial Sequence
  Description of Artificial Sequence: Synthetic polypeptide
DEDCIRTTNPVATEPWGSQVATTGNMESIYNGGGNRN

SEQ ID NO: 187506 - protein, 38 aa, Artificial Sequence
  Description of Artificial Sequence: Synthetic polypeptide
DEDCIRTTNPVATEQWGSQVATNGGMESDYNNEGNNRN

SEQ ID NO: 187507 - protein, 38 aa, Artificial Sequence
  Description of Artificial Sequence: Synthetic polypeptide
DEDCIRTTNPVATEQWGSQVPATTGNMESVYNGGNNRN

SEQ ID NO: 187508 - protein, 36 aa, Artificial Sequence
  Description of Artificial Sequence: Synthetic polypeptide
DEAEIRTTNPVAYEQYGQCVCSWEDHNAENFGSEQA

SEQ ID NO: 187509 - protein, 36 aa, Artificial Sequence
  Description of Artificial Sequence: Synthetic polypeptide
DEDCIRTTNPVATEQYGCVTMTSQPNNIQGTQQDEQ

SEQ ID NO: 187510 - protein, 37 aa, Artificial Sequence
  Description of Artificial Sequence: Synthetic polypeptide
DEDCIRTTNPVATESWGSVAATTGNMESIYNGGNNRN

SEQ ID NO: 187511 - protein, 36 aa, Artificial Sequence
  Description of Artificial Sequence: Synthetic polypeptide
DEDEAEIATTNPVAYEPWGSVSWNIDQNEQKGDAQP

SEQ ID NO: 187512 - protein, 34 aa, Artificial Sequence
  Description of Artificial Sequence: Synthetic polypeptide
CEEEIATTNPVAYEQYGSACAAANGLDSEHVDDD

SEQ ID NO: 187513 - protein, 37 aa, Artificial Sequence
  Description of Artificial Sequence: Synthetic polypeptide
CEEEIATTNPVAYEQYGSACSAANPGPLDSMIGNDNE

SEQ ID NO: 187514 - protein, 34 aa, Artificial Sequence
  Description of Artificial Sequence: Synthetic polypeptide
DEAEIRTTNPVAYEQYGQCICSWEHNENFPSDQA

SEQ ID NO: 187515 - protein, 37 aa, Artificial Sequence
  Description of Artificial Sequence: Synthetic polypeptide
DEAEIRTTNPVAYEQYGCVTSTWGAHNAEHFGSDPQS

SEQ ID NO: 187516 - protein, 35 aa, Artificial Sequence
  Description of Artificial Sequence: Synthetic polypeptide
DEDEIACTNPVATEQWGCVANMTNLNPDDSMGDMA

SEQ ID NO: 187517 - protein, 34 aa, Artificial Sequence
  Description of Artificial Sequence: Synthetic polypeptide
DEAEIRTTNPVAYEQYGCVCQWAHNIENFMSDQS

SEQ ID NO: 187518 - protein, 35 aa, Artificial Sequence
  Description of Artificial Sequence: Synthetic polypeptide
DEAEIRTTNPVAYEQYGCICSWNDHNENFPSDTQS

SEQ ID NO: 187519 - protein, 35 aa, Artificial Sequence
  Description of Artificial Sequence: Synthetic polypeptide
DEAEIRTTNPVAYEQYGCICSWGEHNENFNSDNQA

SEQ ID NO: 187520 - protein, 35 aa, Artificial Sequence
  Description of Artificial Sequence: Synthetic polypeptide
DEDEIACTNPVATEQWGGCVAGTGLAAAGDDNGML

SEQ ID NO: 187521 - protein, 35 aa, Artificial Sequence
  Description of Artificial Sequence: Synthetic polypeptide
DEAEIRTTNPVAYEQYGCICSWEHNEENFNSDTQS

SEQ ID NO: 187522 - protein, 35 aa, Artificial Sequence
  Description of Artificial Sequence: Synthetic polypeptide
DEAEIRTTNPVAYEQWGVVYNNPNPGEQPEDGGQH

SEQ ID NO: 187523 - protein, 35 aa, Artificial Sequence
  Description of Artificial Sequence: Synthetic polypeptide
DEAEIRTTNPVAYEQWGVVYNNPNHGEQPENGGQE

SEQ ID NO: 187524 - protein, 33 aa, Artificial Sequence
  Description of Artificial Sequence: Synthetic polypeptide
DEAEIRTTNPVAYERWGCVCPNNDEMDTGDMEQ

SEQ ID NO: 187525 - protein, 34 aa, Artificial Sequence
  Description of Artificial Sequence: Synthetic polypeptide
DEAEIRTTNPVAYQQYGCVCIWINDDERDQHDQH

SEQ ID NO: 187526 - protein, 35 aa, Artificial Sequence
  Description of Artificial Sequence: Synthetic polypeptide
DEAEIRTTNPVAYQQYGCVCIWINDDEREQHDGQY

SEQ ID NO: 187527 - protein, 33 aa, Artificial Sequence
  Description of Artificial Sequence: Synthetic polypeptide
DEAEIRTTNPVSTEAWGCIAPEDPQQQQNGNTH

SEQ ID NO: 187528 - protein, 33 aa, Artificial Sequence
  Description of Artificial Sequence: Synthetic polypeptide
DEQEIATTNPVAYECWGVVSGGNGNEAGGEGMH

SEQ ID NO: 187529 - protein, 34 aa, Artificial Sequence
  Description of Artificial Sequence: Synthetic polypeptide
DEQEIATTNPVAYECWGSVYNTPQQGEDAGGDEM

SEQ ID NO: 187530 - protein, 35 aa, Artificial Sequence
  Description of Artificial Sequence: Synthetic polypeptide
DEQEIATTNPVAYECWGSVATGNMLGDAQGMQDKE

SEQ ID NO: 187531 - protein, 35 aa, Artificial Sequence
  Description of Artificial Sequence: Synthetic polypeptide
DEQEIATTNPVAYECWGCVYSGDFATNEGTGNNMN

SEQ ID NO: 187532 - protein, 35 aa, Artificial Sequence
  Description of Artificial Sequence: Synthetic polypeptide
DEAEISTTNPVATEGYGCVCSWGEHEQENFNSDQS

SEQ ID NO: 187533 - protein, 34 aa, Artificial Sequence
  Description of Artificial Sequence: Synthetic polypeptide
DECNIYTTNPVATEAYGITVIGSEQLMYPGEILQ

SEQ ID NO: 187534 - protein, 37 aa, Artificial Sequence
  Description of Artificial Sequence: Synthetic polypeptide
DECPIRMTNPVAYEAYGSTVPSCTEELSQMTDEDNRD

SEQ ID NO: 187535 - protein, 37 aa, Artificial Sequence
  Description of Artificial Sequence: Synthetic polypeptide
DECTICTTNPVATEAYGVVSTVTNQQQQNGNNNNVDQ

SEQ ID NO: 187536 - protein, 38 aa, Artificial Sequence
  Description of Artificial Sequence: Synthetic polypeptide
DECTICTTNPVATEQYGSVTVVVTTNNQQAGIGTNQDE

SEQ ID NO: 187537 - protein, 37 aa, Artificial Sequence
  Description of Artificial Sequence: Synthetic polypeptide
DEQEIATTNPVATEQYGSVVNATGDDGEDQEGEGDGG

SEQ ID NO: 187538 - protein, 38 aa, Artificial Sequence
  Description of Artificial Sequence: Synthetic polypeptide
DECTICTTNPVATEQYGVVSTVTNNNNQQAGNGTNVDE

SEQ ID NO: 187539 - protein, 35 aa, Artificial Sequence
  Description of Artificial Sequence: Synthetic polypeptide
DEAEIRTTNPVAYEQWGVVYMNPNHGEQPNNGGQK

SEQ ID NO: 187540 - protein, 38 aa, Artificial Sequence
  Description of Artificial Sequence: Synthetic polypeptide
DECTICTTNPVATEQYGVVSTVTNNNQQQNGNGTNNDE

SEQ ID NO: 187541 - protein, 35 aa, Artificial Sequence
  Description of Artificial Sequence: Synthetic polypeptide
DEAEIRTTNPVSTEPWGTVISCMEDISQQQNGNNH

SEQ ID NO: 187542 - protein, 37 aa, Artificial Sequence
  Description of Artificial Sequence: Synthetic polypeptide
DECTICTTNPVATEQYGVVTVVTVTTNNQQGNGTNVD

SEQ ID NO: 187543 - protein, 34 aa, Artificial Sequence
  Description of Artificial Sequence: Synthetic polypeptide
DEAEIRTTNPVSTEPWGCIAPNDQQQQQNRNGHY

SEQ ID NO: 187544 - protein, 38 aa, Artificial Sequence
  Description of Artificial Sequence: Synthetic polypeptide
DECTICTTNPVATEQYGVVTVVVTTNNLQAGIGTNTEE

SEQ ID NO: 187545 - protein, 34 aa, Artificial Sequence
  Description of Artificial Sequence: Synthetic polypeptide
DEAEIRTTNPVSTEPWGCIAPNDQQQQQNRNDMG

SEQ ID NO: 187546 - protein, 34 aa, Artificial Sequence
  Description of Artificial Sequence: Synthetic polypeptide
DEAEIRTTNPVSTEPWGCIAPNDQQQQQNRETAG

SEQ ID NO: 187547 - protein, 34 aa, Artificial Sequence
  Description of Artificial Sequence: Synthetic polypeptide
DEAEIRTTNPVSTEPWGCIAPNDQQQQENRNTDG

SEQ ID NO: 187548 - protein, 34 aa, Artificial Sequence
  Description of Artificial Sequence: Synthetic polypeptide
DEAEIRTTNPVSTEPWGCIAPEDQQQQQNRGNEK

SEQ ID NO: 187549 - protein, 34 aa, Artificial Sequence
  Description of Artificial Sequence: Synthetic polypeptide
DEAEIRTTNPVSTEPWGCIAPEDQQQQQERGTNS

SEQ ID NO: 187550 - protein, 33 aa, Artificial Sequence
  Description of Artificial Sequence: Synthetic polypeptide
DEAEIRTTNPVSTEPWGCIAPEDQQGQQQREEH

SEQ ID NO: 187551 - protein, 33 aa, Artificial Sequence
  Description of Artificial Sequence: Synthetic polypeptide
DEAEIRTTNPVSTEPWGCIAPEDQQGQQNNNTH

SEQ ID NO: 187552 - protein, 38 aa, Artificial Sequence
  Description of Artificial Sequence: Synthetic polypeptide
DECTICTTNPVATEQYGVVSTVTSNQQQQNGNGTNVDE

SEQ ID NO: 187553 - protein, 36 aa, Artificial Sequence
  Description of Artificial Sequence: Synthetic polypeptide
DESEIRTTNPVATEGWGCVCSWGEPNQEYFGSNTQA

SEQ ID NO: 187554 - protein, 36 aa, Artificial Sequence
  Description of Artificial Sequence: Synthetic polypeptide
DEDEIACTNPVATEQYGSACAANPELGQEHQDDNAH

SEQ ID NO: 187555 - protein, 36 aa, Artificial Sequence
  Description of Artificial Sequence: Synthetic polypeptide
CEEEIATTNPVAYEQYGSCATGPAEGPNHQMGMQMW

SEQ ID NO: 187556 - protein, 35 aa, Artificial Sequence
  Description of Artificial Sequence: Synthetic polypeptide
DEDEIATTNPVATASWGCVAAANGEVQDRGGENDG

SEQ ID NO: 187557 - protein, 34 aa, Artificial Sequence
  Description of Artificial Sequence: Synthetic polypeptide
DEDEIATTNPVATASWGCVAAANGHVQDAGGENG

SEQ ID NO: 187558 - protein, 35 aa, Artificial Sequence
  Description of Artificial Sequence: Synthetic polypeptide
DEDEIATTNPVATASWGCVAAANNAEPQDRGDENG

SEQ ID NO: 187559 - protein, 38 aa, Artificial Sequence
  Description of Artificial Sequence: Synthetic polypeptide
DEAEIRTTNPVAYEQWGMVSIPGAGNAGPDQNKGDNGR

SEQ ID NO: 187560 - protein, 39 aa, Artificial Sequence
  Description of Artificial Sequence: Synthetic polypeptide
DEAEIRTTNPVAYEQWGMVSIPGAGNAGDDQRKGQNMDR

SEQ ID NO: 187561 - protein, 34 aa, Artificial Sequence
  Description of Artificial Sequence: Synthetic polypeptide
DEDEIATTNPVATASWGCVAAANNEPFDRGEENG

SEQ ID NO: 187562 - protein, 34 aa, Artificial Sequence
  Description of Artificial Sequence: Synthetic polypeptide
DEDEIATTNPVATASWGCVAAANNEPLDDGGENG

SEQ ID NO: 187563 - protein, 38 aa, Artificial Sequence
  Description of Artificial Sequence: Synthetic polypeptide
DEAEIRTTNPVAYEQWGMVSIPGAGNAGDDQRKGDNAP

SEQ ID NO: 187564 - protein, 34 aa, Artificial Sequence
  Description of Artificial Sequence: Synthetic polypeptide
DEDEIATTNPVATASWGCVAAANNEPLDNGTENN

SEQ ID NO: 187565 - protein, 34 aa, Artificial Sequence
  Description of Artificial Sequence: Synthetic polypeptide
DEDEIATTNPVATASWGCVAAANNEPLDNTGENQ

SEQ ID NO: 187566 - protein, 35 aa, Artificial Sequence
  Description of Artificial Sequence: Synthetic polypeptide
DEDEIATTNPVATASWGCVAAANNEPLQNGGENGH

SEQ ID NO: 187567 - protein, 35 aa, Artificial Sequence
  Description of Artificial Sequence: Synthetic polypeptide
DEDEIATTNPVATASWGCVAAANNEPQDRGGENHP

SEQ ID NO: 187568 - protein, 39 aa, Artificial Sequence
  Description of Artificial Sequence: Synthetic polypeptide
DEAEIRTTNPVAYEQWGMVSIAGAGNAGDDQRKGDNDRR

SEQ ID NO: 187569 - protein, 35 aa, Artificial Sequence
  Description of Artificial Sequence: Synthetic polypeptide
DEDEIATTNPVATASWGCVAAANNEVQARGGENTH

SEQ ID NO: 187570 - protein, 35 aa, Artificial Sequence
  Description of Artificial Sequence: Synthetic polypeptide
DEDEIATTNPVATASWGCVAAANNEVQDRGGENVH

SEQ ID NO: 187571 - protein, 35 aa, Artificial Sequence
  Description of Artificial Sequence: Synthetic polypeptide
DEDEIATTNPVATASWGCVAAANNEVQDRGLENGV

SEQ ID NO: 187572 - protein, 35 aa, Artificial Sequence
  Description of Artificial Sequence: Synthetic polypeptide
DEDEIATTNPVATASWGCVAAANNEVQDRMGENTG

SEQ ID NO: 187573 - protein, 35 aa, Artificial Sequence
  Description of Artificial Sequence: Synthetic polypeptide
DEDEIATTNPVATASWGCVSAANNEPTDRGGENTG

SEQ ID NO: 187574 - protein, 36 aa, Artificial Sequence
  Description of Artificial Sequence: Synthetic polypeptide
DEDEIATTNPVATASWGSVSVANNTPQDHGGENAGN

SEQ ID NO: 187575 - protein, 36 aa, Artificial Sequence
  Description of Artificial Sequence: Synthetic polypeptide
DEDEIATTNPVATECYGCVCQTLIDTQDQQGQGNDN

SEQ ID NO: 187576 - protein, 34 aa, Artificial Sequence
  Description of Artificial Sequence: Synthetic polypeptide
DEAEIRTTNPVAYEQWGCVCINNDPEMDTGDTEQ

SEQ ID NO: 187577 - protein, 35 aa, Artificial Sequence
  Description of Artificial Sequence: Synthetic polypeptide
DEDEIATTNPVATEQWGATVCAANDGPVEPDEGND

SEQ ID NO: 187578 - protein, 35 aa, Artificial Sequence
  Description of Artificial Sequence: Synthetic polypeptide
DEDEIATTNPVATEQWGAVAGSGAPANPNPMGAQP

SEQ ID NO: 187579 - protein, 33 aa, Artificial Sequence
  Description of Artificial Sequence: Synthetic polypeptide
DEDEIATTNPVATASWGCTAGNNNLQEDAGGGH

SEQ ID NO: 187580 - protein, 39 aa, Artificial Sequence
  Description of Artificial Sequence: Synthetic polypeptide
DEAEIRTTNPVAYEQWGMVSIPGAGNAGPDQRKGDNPQR

SEQ ID NO: 187581 - protein, 34 aa, Artificial Sequence
  Description of Artificial Sequence: Synthetic polypeptide
DEDEIATTNPVATASWGCNVAGNNNLQDAGMGHH

SEQ ID NO: 187582 - protein, 34 aa, Artificial Sequence
  Description of Artificial Sequence: Synthetic polypeptide
DEDEIATTNPVATASWGCNVAGNNNLQDAGGEHN

SEQ ID NO: 187583 - protein, 36 aa, Artificial Sequence
  Description of Artificial Sequence: Synthetic polypeptide
CEEEIATTNPVAYEQYGSCATGPALGQNHQDGMQGN

SEQ ID NO: 187584 - protein, 37 aa, Artificial Sequence
  Description of Artificial Sequence: Synthetic polypeptide
DEDEIACTNPVATEQYGSVCAATENLEAGTLGAEDAH

SEQ ID NO: 187585 - protein, 37 aa, Artificial Sequence
  Description of Artificial Sequence: Synthetic polypeptide
DEDEIACTNPVATEQYGSVCAATMHGENTADGMGDRH

SEQ ID NO: 187586 - protein, 36 aa, Artificial Sequence
  Description of Artificial Sequence: Synthetic polypeptide
DEDEIACTNPVATEQYGSVCAATMHGEVTADGDDRG

SEQ ID NO: 187587 - protein, 37 aa, Artificial Sequence
  Description of Artificial Sequence: Synthetic polypeptide
DEDEIACTNPVATEQYGSVCAGMTHGGAEAPIGDNRK

SEQ ID NO: 187588 - protein, 37 aa, Artificial Sequence
  Description of Artificial Sequence: Synthetic polypeptide
DEDEIACTNPVATEQYGSVCAMANPAEDQDDPLGNHK

SEQ ID NO: 187589 - protein, 36 aa, Artificial Sequence
  Description of Artificial Sequence: Synthetic polypeptide
DEDEIACTNPVATEQYGSVCAMNNNDLPADGSGGQP

SEQ ID NO: 187590 - protein, 36 aa, Artificial Sequence
  Description of Artificial Sequence: Synthetic polypeptide
DEAEIRTTNPVAYEQWGVVAWNNLDQGEQHQGGQDQ

SEQ ID NO: 187591 - protein, 37 aa, Artificial Sequence
  Description of Artificial Sequence: Synthetic polypeptide
DEDEIACTNPVATEQYGSVSAIWNAVGTNQGNPMEPV

SEQ ID NO: 187592 - protein, 36 aa, Artificial Sequence
  Description of Artificial Sequence: Synthetic polypeptide
DEDEIACTNPVATEQYGSVSAIWPAGTNGGNPMEPV

SEQ ID NO: 187593 - protein, 37 aa, Artificial Sequence
  Description of Artificial Sequence: Synthetic polypeptide
DEDEIACTNPVATEQYGSVSASTPAITNIGNGMEPVH

SEQ ID NO: 187594 - protein, 36 aa, Artificial Sequence
  Description of Artificial Sequence: Synthetic polypeptide
DEDEIACTNPVATEQYGSACAPANTHQEAEDGNENQ

SEQ ID NO: 187595 - protein, 37 aa, Artificial Sequence
  Description of Artificial Sequence: Synthetic polypeptide
DEDEIACTNPVATEQYGSVSSTGEAGINPRDGMEKVE

SEQ ID NO: 187596 - protein, 37 aa, Artificial Sequence
  Description of Artificial Sequence: Synthetic polypeptide
CEEEIATTNPVAYEQYGSTVCSNNPQPQEHQDGTEMK

SEQ ID NO: 187597 - protein, 37 aa, Artificial Sequence
  Description of Artificial Sequence: Synthetic polypeptide
DEAEIRTTNPVAYEQWGSVSGGMPANGGNMRNGMGDV

SEQ ID NO: 187598 - protein, 36 aa, Artificial Sequence
  Description of Artificial Sequence: Synthetic polypeptide
DEDEIACTNPVAYEQYGSVAACPNGLAAGTNGDSVG

SEQ ID NO: 187599 - protein, 35 aa, Artificial Sequence
  Description of Artificial Sequence: Synthetic polypeptide
DEDEIACTNPVAYEQYGSVAACPPGLATGTNGSVG

SEQ ID NO: 187600 - protein, 36 aa, Artificial Sequence
  Description of Artificial Sequence: Synthetic polypeptide
DEDEIACTNPVAYEQYGSVCSANPNAFAHQGDGQDH

SEQ ID NO: 187601 - protein, 37 aa, Artificial Sequence
  Description of Artificial Sequence: Synthetic polypeptide
DEAEIRTTNPVAYEQWGSVSGGEPANGPNMRNGGGKG

SEQ ID NO: 187602 - protein, 36 aa, Artificial Sequence
  Description of Artificial Sequence: Synthetic polypeptide
DEAEIRTTNPVAYEQWGSVCVNENDQQQQDGQDTVQ

SEQ ID NO: 187603 - protein, 35 aa, Artificial Sequence
  Description of Artificial Sequence: Synthetic polypeptide
DEDEIATTNPVATAQWGGCCATGALQTQMGNNDLN

SEQ ID NO: 187604 - protein, 37 aa, Artificial Sequence
  Description of Artificial Sequence: Synthetic polypeptide
DEAEIRTTNPVAYEQWGSVAGAPNGNHQNTGDGNDEE

SEQ ID NO: 187605 - protein, 33 aa, Artificial Sequence
  Description of Artificial Sequence: Synthetic polypeptide
DEDEIATTNPVATASWGCIATTAEQDTPDGNNN

SEQ ID NO: 187606 - protein, 34 aa, Artificial Sequence
  Description of Artificial Sequence: Synthetic polypeptide
DEDEIATTNPVATASWGCNVAGNNGLQDDAGGHN

SEQ ID NO: 187607 - protein, 34 aa, Artificial Sequence
  Description of Artificial Sequence: Synthetic polypeptide
DEDEIACTNPVAYEQWGCVASGALPENHQDDNAE

SEQ ID NO: 187608 - protein, 35 aa, Artificial Sequence
  Description of Artificial Sequence: Synthetic polypeptide
DESEIRTTNPVATEGWGCVCSWGNENIEYFGSDQG

SEQ ID NO: 187609 - protein, 36 aa, Artificial Sequence
  Description of Artificial Sequence: Synthetic polypeptide
DEQEIATTNPVATEQYGSTCAMNNGGTEAGDVNNVA

SEQ ID NO: 187610 - protein, 35 aa, Artificial Sequence
  Description of Artificial Sequence: Synthetic polypeptide
DESEIRTTNPVATEGWGCVCSWMAENQEHFGSEQS

SEQ ID NO: 187611 - protein, 35 aa, Artificial Sequence
  Description of Artificial Sequence: Synthetic polypeptide
DEQEIATTNPVATEQWGCVAANNGLEATMNPDDNH

SEQ ID NO: 187612 - protein, 35 aa, Artificial Sequence
  Description of Artificial Sequence: Synthetic polypeptide
CAEEIATTNPVAYEQYGSVCSVSVLPAGAIDISDM

SEQ ID NO: 187613 - protein, 35 aa, Artificial Sequence
  Description of Artificial Sequence: Synthetic polypeptide
DEDEIATTNPVAYERWGSVTGGNPGNAQGEHDGSR

SEQ ID NO: 187614 - protein, 36 aa, Artificial Sequence
  Description of Artificial Sequence: Synthetic polypeptide
CAEEIATTNPVAYEQYGSVCANNNGEEAPDNQEGNH

SEQ ID NO: 187615 - protein, 35 aa, Artificial Sequence
  Description of Artificial Sequence: Synthetic polypeptide
DEDEIATTNPVAYERWGTVSGGNPGNAQGEHDGQR

SEQ ID NO: 187616 - protein, 34 aa, Artificial Sequence
  Description of Artificial Sequence: Synthetic polypeptide
CAEEIATTNPVAYEQYGSTAGNNGLPQSDDQAEN

SEQ ID NO: 187617 - protein, 34 aa, Artificial Sequence
  Description of Artificial Sequence: Synthetic polypeptide
DEDEIATTNPVAYERWGVCATNNLDPGDHPNNME

SEQ ID NO: 187618 - protein, 37 aa, Artificial Sequence
  Description of Artificial Sequence: Synthetic polypeptide
CAEEIATTNPVATEQYGSVCAANNGLEADGPLGEMNH

SEQ ID NO: 187619 - protein, 35 aa, Artificial Sequence
  Description of Artificial Sequence: Synthetic polypeptide
DEDEIATVNPVATAQWGGCVAGNGLQSRANAQTEQ

SEQ ID NO: 187620 - protein, 34 aa, Artificial Sequence
  Description of Artificial Sequence: Synthetic polypeptide
DEQEIATTNPVATEQWGCTAGNENLEATPDGDQM

SEQ ID NO: 187621 - protein, 36 aa, Artificial Sequence
  Description of Artificial Sequence: Synthetic polypeptide
CAEEIATTNPVATEQYGSACSADNPLPAEAPIGDPQ

SEQ ID NO: 187622 - protein, 35 aa, Artificial Sequence
  Description of Artificial Sequence: Synthetic polypeptide
CAEEIATTNPVATEQYGCVSPGEGGHGQESEEENK

SEQ ID NO: 187623 - protein, 36 aa, Artificial Sequence
  Description of Artificial Sequence: Synthetic polypeptide
CAEEIATTNPVATEQWGSVSNGDGPGGPDDQTGGRM

SEQ ID NO: 187624 - protein, 37 aa, Artificial Sequence
  Description of Artificial Sequence: Synthetic polypeptide
CAEEIATTNPVATEQWGSVSGNNGVPTPDGALTEGNN

SEQ ID NO: 187625 - protein, 36 aa, Artificial Sequence
  Description of Artificial Sequence: Synthetic polypeptide
DEQEIATTNPVATEPYGSACSVNPAEGQNHQDDTMW

SEQ ID NO: 187626 - protein, 35 aa, Artificial Sequence
  Description of Artificial Sequence: Synthetic polypeptide
DEDEIRATNPVAYECWGSVCYTTDNLNDHGHGTQH

SEQ ID NO: 187627 - protein, 35 aa, Artificial Sequence
  Description of Artificial Sequence: Synthetic polypeptide
DESEIRTTNPVAYEAWGICVSCANSSSDREGGMVC

SEQ ID NO: 187628 - protein, 36 aa, Artificial Sequence
  Description of Artificial Sequence: Synthetic polypeptide
DESEIRTTNPVAYEAWGISVSACANSSSDREGGMMG

SEQ ID NO: 187629 - protein, 36 aa, Artificial Sequence
  Description of Artificial Sequence: Synthetic polypeptide
DESEIRTTNPVAYEAWGISVSCANESASDREGGMDG

SEQ ID NO: 187630 - protein, 35 aa, Artificial Sequence
  Description of Artificial Sequence: Synthetic polypeptide
DESEIRTTNPVAYEAWGISVSCANSSMDIEGGMVG

SEQ ID NO: 187631 - protein, 36 aa, Artificial Sequence
  Description of Artificial Sequence: Synthetic polypeptide
DESEIRTTNPVAYEAWGISVSCANWSSSDRPGGMGC

SEQ ID NO: 187632 - protein, 35 aa, Artificial Sequence
  Description of Artificial Sequence: Synthetic polypeptide
DEQEIATTNPVATECWGSVCYNNDDNNDEGGQNDA

SEQ ID NO: 187633 - protein, 33 aa, Artificial Sequence
  Description of Artificial Sequence: Synthetic polypeptide
DEQEIATTNPVATECWGAVWAATDWAEPKGPDI

SEQ ID NO: 187634 - protein, 34 aa, Artificial Sequence
  Description of Artificial Sequence: Synthetic polypeptide
DEDEIATTNPVAYERWGSVSGQNPGNAGEHDGQE

SEQ ID NO: 187635 - protein, 34 aa, Artificial Sequence
  Description of Artificial Sequence: Synthetic polypeptide
CAEEIATTNPVGTEQWGGCTVAGNGLAMNPGDRV

SEQ ID NO: 187636 - protein, 34 aa, Artificial Sequence
  Description of Artificial Sequence: Synthetic polypeptide
CAEEIATTNPVGTEQWGGCVAGNGLAMNPGDARW

SEQ ID NO: 187637 - protein, 33 aa, Artificial Sequence
  Description of Artificial Sequence: Synthetic polypeptide
CAEEIATTNPVGTEQWGGCVAGNGLAMNPGDHE

SEQ ID NO: 187638 - protein, 37 aa, Artificial Sequence
  Description of Artificial Sequence: Synthetic polypeptide
DESEIRTTNPVATEQYGSVYTTWVPMIQTESSEEHTQ

SEQ ID NO: 187639 - protein, 37 aa, Artificial Sequence
  Description of Artificial Sequence: Synthetic polypeptide
DESEIRTTNPVATEQYGVIVDFGMGGGDTGTDNGNTD

SEQ ID NO: 187640 - protein, 36 aa, Artificial Sequence
  Description of Artificial Sequence: Synthetic polypeptide
DEDEIATTNPVAYEQYGSVSANPPAPQAHMIDLTAM

SEQ ID NO: 187641 - protein, 37 aa, Artificial Sequence
  Description of Artificial Sequence: Synthetic polypeptide
DESEIRTTNPVATEQYGVVLWPVDPWLESPEGFENKN

SEQ ID NO: 187642 - protein, 36 aa, Artificial Sequence
  Description of Artificial Sequence: Synthetic polypeptide
CDAEIRTTNPVATEQYGCVCSNTGEHNQENFGSDQS

SEQ ID NO: 187643 - protein, 37 aa, Artificial Sequence
  Description of Artificial Sequence: Synthetic polypeptide
DEQEIATTNPVATEQWGSVSAAGDPMGEDHQGGEDNP

SEQ ID NO: 187644 - protein, 36 aa, Artificial Sequence
  Description of Artificial Sequence: Synthetic polypeptide
DEDEIATTNPVAYEQYGSVVAPPQGGLPTVENPNEK

SEQ ID NO: 187645 - protein, 36 aa, Artificial Sequence
  Description of Artificial Sequence: Synthetic polypeptide
DEQEIATTNPVATEQWGKVSAVGDLEADTPWGEDNH

SEQ ID NO: 187646 - protein, 37 aa, Artificial Sequence
  Description of Artificial Sequence: Synthetic polypeptide
DEQEIATTNPVATEQWGHSVSATGDPMEDHQGDEDNH

SEQ ID NO: 187647 - protein, 38 aa, Artificial Sequence
  Description of Artificial Sequence: Synthetic polypeptide
DESEIRTTNPVATESYGSVVSDGMQGLTLGEGDQEGDG

SEQ ID NO: 187648 - protein, 37 aa, Artificial Sequence
  Description of Artificial Sequence: Synthetic polypeptide
DESEIRTTNPVATESYGSVVSDGMQGLTLGGGDQTGD

SEQ ID NO: 187649 - protein, 35 aa, Artificial Sequence
  Description of Artificial Sequence: Synthetic polypeptide
DEQEIATTNPVATASWGSVSAVGDLEADTPQEDNN

SEQ ID NO: 187650 - protein, 35 aa, Artificial Sequence
  Description of Artificial Sequence: Synthetic polypeptide
DEQEIATTNPVATEQWGHCTAATAGLEAPDNQNRD

SEQ ID NO: 187651 - protein, 34 aa, Artificial Sequence
  Description of Artificial Sequence: Synthetic polypeptide
CAEEIATTNPVGTEQWGGCVAGTGLPATMNPDSR

SEQ ID NO: 187652 - protein, 33 aa, Artificial Sequence
  Description of Artificial Sequence: Synthetic polypeptide
CAEEIATTNPVGTEQWGGCVAGTGLATMNPDNI

SEQ ID NO: 187653 - protein, 34 aa, Artificial Sequence
  Description of Artificial Sequence: Synthetic polypeptide
DEDEIATTNPVAYERWGSVSGGNPGNAGEHDGDT

SEQ ID NO: 187654 - protein, 35 aa, Artificial Sequence
  Description of Artificial Sequence: Synthetic polypeptide
DEDEIATTNPVAYERWGSVSGGNPGNAGEHDGSNI

SEQ ID NO: 187655 - protein, 34 aa, Artificial Sequence
  Description of Artificial Sequence: Synthetic polypeptide
DEDEIATTNPVAYERWGSVSGGNPGNAGEHKGTD

SEQ ID NO: 187656 - protein, 34 aa, Artificial Sequence
  Description of Artificial Sequence: Synthetic polypeptide
DEDEIATTNPVAYERWGSVSGGNPGNAGEKDGQM

SEQ ID NO: 187657 - protein, 35 aa, Artificial Sequence
  Description of Artificial Sequence: Synthetic polypeptide
DEDEIATTNPVAYERWGSVSGGNPGNARGEDDGQG

SEQ ID NO: 187658 - protein, 34 aa, Artificial Sequence
  Description of Artificial Sequence: Synthetic polypeptide
DEDEIATTNPVAYERWGSVSGLNPGNAGEHDGKG

SEQ ID NO: 187659 - protein, 34 aa, Artificial Sequence
  Description of Artificial Sequence: Synthetic polypeptide
DEDEIATTNPVAYERWGSVSGLNPGNAGETDGQD

SEQ ID NO: 187660 - protein, 33 aa, Artificial Sequence
  Description of Artificial Sequence: Synthetic polypeptide
CAEEIATTNPVGTEQWGGCVAGTGHATMNPDRD

SEQ ID NO: 187661 - protein, 35 aa, Artificial Sequence
  Description of Artificial Sequence: Synthetic polypeptide
DEQEIATTNPVATEQWGCVAGSGNPANPAPMGAQP

SEQ ID NO: 187662 - protein, 34 aa, Artificial Sequence
  Description of Artificial Sequence: Synthetic polypeptide
DEQEIATTNPVATEQWGGCCAGTGHQAEGQPMYN

SEQ ID NO: 187663 - protein, 37 aa, Artificial Sequence
  Description of Artificial Sequence: Synthetic polypeptide
CDEEIRTTNPVATEQYGCVCSNTGEHNQENFGSDTQA

SEQ ID NO: 187664 - protein, 34 aa, Artificial Sequence
  Description of Artificial Sequence: Synthetic polypeptide
DEQEIATTNPVATASWGCVAAANNEPLDNGEENG

SEQ ID NO: 187665 - protein, 36 aa, Artificial Sequence
  Description of Artificial Sequence: Synthetic polypeptide
DEQEIATTNPVATAQWGSVSATGDLEADTPPMENNN

SEQ ID NO: 187666 - protein, 36 aa, Artificial Sequence
  Description of Artificial Sequence: Synthetic polypeptide
DEDEIRGTNPVATEFWGNVSAANGEGQRGQGEQQGV

SEQ ID NO: 187667 - protein, 35 aa, Artificial Sequence
  Description of Artificial Sequence: Synthetic polypeptide
DEDEIRGTNPVATEFWGNVSAANGQGQDGQGEQGD

SEQ ID NO: 187668 - protein, 35 aa, Artificial Sequence
  Description of Artificial Sequence: Synthetic polypeptide
DEDEIRGTNPVATEFWGNVSIANGEGQDGQGEIGD

SEQ ID NO: 187669 - protein, 36 aa, Artificial Sequence
  Description of Artificial Sequence: Synthetic polypeptide
DEDEIRGTNPVATEFWGSVSAINGEGQDGQGEQTGD

SEQ ID NO: 187670 - protein, 37 aa, Artificial Sequence
  Description of Artificial Sequence: Synthetic polypeptide
DESEIRTTNPVAYEQWGTVCPTDNHGLLNGQKGQDQN

SEQ ID NO: 187671 - protein, 37 aa, Artificial Sequence
  Description of Artificial Sequence: Synthetic polypeptide
DESEIRTTNPVAYEQWGTVCPTDNHGNNNGQKGNDQK

SEQ ID NO: 187672 - protein, 37 aa, Artificial Sequence
  Description of Artificial Sequence: Synthetic polypeptide
DESEIRTTNPVAYEQWGTVCPTDNLGEVNGQKGADHK

SEQ ID NO: 187673 - protein, 36 aa, Artificial Sequence
  Description of Artificial Sequence: Synthetic polypeptide
DEDEIRGTNPVATEFWGVVSAANGEGQRGQGETPGD

SEQ ID NO: 187674 - protein, 36 aa, Artificial Sequence
  Description of Artificial Sequence: Synthetic polypeptide
DEDEIRGTNPVATEFWGVVSAANGEGQRGQTEQGGT

SEQ ID NO: 187675 - protein, 37 aa, Artificial Sequence
  Description of Artificial Sequence: Synthetic polypeptide
DEDEIRGTNPVATEFWGVVVSAANGEGQRGQGEQRGV

SEQ ID NO: 187676 - protein, 36 aa, Artificial Sequence
  Description of Artificial Sequence: Synthetic polypeptide
DEDEIRGTNPVATEFWGVVVSAVNGEGQRGQGEQGV

SEQ ID NO: 187677 - protein, 35 aa, Artificial Sequence
  Description of Artificial Sequence: Synthetic polypeptide
DEDEIRGTNPVATEFWGWISVGNGEGQRGQGEQGN

SEQ ID NO: 187678 - protein, 35 aa, Artificial Sequence
  Description of Artificial Sequence: Synthetic polypeptide
DEDEIRGTNPVATEFWGWVSAAGGEGQRGQGEDGD

SEQ ID NO: 187679 - protein, 35 aa, Artificial Sequence
  Description of Artificial Sequence: Synthetic polypeptide
DEDEIRGTNPVATEFWGWVSAANGEGQNGQGEAGD

SEQ ID NO: 187680 - protein, 36 aa, Artificial Sequence
  Description of Artificial Sequence: Synthetic polypeptide
DEDEIRGTNPVATEFWGWVSAAQTGEGQRGQGEQGD

SEQ ID NO: 187681 - protein, 36 aa, Artificial Sequence
  Description of Artificial Sequence: Synthetic polypeptide
DEDEIRGTNPVATEFWGWVSAATAEGQRGQGEQGGD

SEQ ID NO: 187682 - protein, 36 aa, Artificial Sequence
  Description of Artificial Sequence: Synthetic polypeptide
DEDEIRGTNPVATEFWGWVSASANGEGQRGQGEQGD

SEQ ID NO: 187683 - protein, 34 aa, Artificial Sequence
  Description of Artificial Sequence: Synthetic polypeptide
AEVEIATTNPVAYEQWGSCSATNDNNDHQTESDV

SEQ ID NO: 187684 - protein, 32 aa, Artificial Sequence
  Description of Artificial Sequence: Synthetic polypeptide
AEVEIATTNPVAYEQWGCTWNNHNMEDGGNKQ

SEQ ID NO: 187685 - protein, 31 aa, Artificial Sequence
  Description of Artificial Sequence: Synthetic polypeptide
AEVEIATTNPVAYEQWGCTWNNHNMEDDNNQ

SEQ ID NO: 187686 - protein, 35 aa, Artificial Sequence
  Description of Artificial Sequence: Synthetic polypeptide
DEQEIATTNPAVATLQYWGSKSITDDLEDHEDEDL

SEQ ID NO: 187687 - protein, 35 aa, Artificial Sequence
  Description of Artificial Sequence: Synthetic polypeptide
DEQEIATTNPAVATLQYWGSKSATDGLEDHEDEDG

SEQ ID NO: 187688 - protein, 34 aa, Artificial Sequence
  Description of Artificial Sequence: Synthetic polypeptide
AETEIRTTNPVATECWGATAWANAEDWQERGPYI

SEQ ID NO: 187689 - protein, 35 aa, Artificial Sequence
  Description of Artificial Sequence: Synthetic polypeptide
DEDEIRGTNPVATEFWGNVSAANGEGQNGQGEGGV

SEQ ID NO: 187690 - protein, 35 aa, Artificial Sequence
  Description of Artificial Sequence: Synthetic polypeptide
DEDEIRGTNPVATEFWGNVSAANGEGQDGQDEAGD

SEQ ID NO: 187691 - protein, 35 aa, Artificial Sequence
  Description of Artificial Sequence: Synthetic polypeptide
DEDEIRGTNPVATEFWGNVSAANGEGQDGDGEQGG

SEQ ID NO: 187692 - protein, 35 aa, Artificial Sequence
  Description of Artificial Sequence: Synthetic polypeptide
DEDEIRGTNPVATEFWGNVSAANGEGEDGQGEQGN

SEQ ID NO: 187693 - protein, 35 aa, Artificial Sequence
  Description of Artificial Sequence: Synthetic polypeptide
DEQEIATTNPVATAQWGSVSAPGTPGTDHQGDEDN

SEQ ID NO: 187694 - protein, 35 aa, Artificial Sequence
  Description of Artificial Sequence: Synthetic polypeptide
DEQEIATTNPVATAQWGSVSAAGDPGEDHQGDENN

SEQ ID NO: 187695 - protein, 35 aa, Artificial Sequence
  Description of Artificial Sequence: Synthetic polypeptide
DEQEIATTNPVATAQWGSVAATGDLEADTPQGEDN

SEQ ID NO: 187696 - protein, 38 aa, Artificial Sequence
  Description of Artificial Sequence: Synthetic polypeptide
CEEEIRSTNPVATEQYGVVSILIATGDNDQDEGGEDGD

SEQ ID NO: 187697 - protein, 35 aa, Artificial Sequence
  Description of Artificial Sequence: Synthetic polypeptide
DESEIRTTNPVAYEEWGCVFGGNGEERNNMGNGNQ

SEQ ID NO: 187698 - protein, 35 aa, Artificial Sequence
  Description of Artificial Sequence: Synthetic polypeptide
DEQEIATTNPIATEQWGSTTWSNTEDLADPEGPDL

SEQ ID NO: 187699 - protein, 34 aa, Artificial Sequence
  Description of Artificial Sequence: Synthetic polypeptide
DESEIRTTNPVAYEGWGCVCSWMEENQEHFGSDQ

SEQ ID NO: 187700 - protein, 37 aa, Artificial Sequence
  Description of Artificial Sequence: Synthetic polypeptide
DEDEIRGTNPVATDQYGVVNDNLIGQNQGGQEDNDTN

SEQ ID NO: 187701 - protein, 36 aa, Artificial Sequence
  Description of Artificial Sequence: Synthetic polypeptide
DEDEIRGTNPVATDQYGVVNDNSIGQNGGEEDTDND

SEQ ID NO: 187702 - protein, 33 aa, Artificial Sequence
  Description of Artificial Sequence: Synthetic polypeptide
DEQEIATTNPIATEQWGATTSAADLAEPKGPYI

SEQ ID NO: 187703 - protein, 33 aa, Artificial Sequence
  Description of Artificial Sequence: Synthetic polypeptide
DEQEIATTNPIATEQWGATTSAADLAEHKGPYI

SEQ ID NO: 187704 - protein, 36 aa, Artificial Sequence
  Description of Artificial Sequence: Synthetic polypeptide
DEQEIATTNPVATAQWGSVSATGDPGEDHQGDIDNN

SEQ ID NO: 187705 - protein, 34 aa, Artificial Sequence
  Description of Artificial Sequence: Synthetic polypeptide
DEQEIATTNPIATECYGSVWSNAEDWAEPEGPYI

SEQ ID NO: 187706 - protein, 36 aa, Artificial Sequence
  Description of Artificial Sequence: Synthetic polypeptide
DEDEIRGTNPVATEFWGAVSNAANGQGQRGQGEQGD

SEQ ID NO: 187707 - protein, 35 aa, Artificial Sequence
  Description of Artificial Sequence: Synthetic polypeptide
DEDEIRGTNPVATEFWGCVSVANGEGQDGQGEQGD

SEQ ID NO: 187708 - protein, 36 aa, Artificial Sequence
  Description of Artificial Sequence: Synthetic polypeptide
DEDEIRGTNPVATEFWGDVSVAANGEGQRGQGEQGD

SEQ ID NO: 187709 - protein, 35 aa, Artificial Sequence
  Description of Artificial Sequence: Synthetic polypeptide
DEDEIRGTNPVATEFWGFVSAMNGEGQGGQGEDGV

SEQ ID NO: 187710 - protein, 36 aa, Artificial Sequence
  Description of Artificial Sequence: Synthetic polypeptide
DEDEIRGTNPVATEFWGFVSNANNGEGQRGQGEQGD

SEQ ID NO: 187711 - protein, 33 aa, Artificial Sequence
  Description of Artificial Sequence: Synthetic polypeptide
DEQEIATTNPIATECYGATSAAEDLEEPKGEDL

SEQ ID NO: 187712 - protein, 36 aa, Artificial Sequence
  Description of Artificial Sequence: Synthetic polypeptide
DEDEIRGTNPVATEFWGIVSAANGEGQRGQQEGDAD

SEQ ID NO: 187713 - protein, 34 aa, Artificial Sequence
  Description of Artificial Sequence: Synthetic polypeptide
DEQEIATTNPEATDCYGQVCCCDQDQKREGGDSR

SEQ ID NO: 187714 - protein, 35 aa, Artificial Sequence
  Description of Artificial Sequence: Synthetic polypeptide
DESEIRTTNPVAYEQWGSVCYNNDQDQDPHHEDSE

SEQ ID NO: 187715 - protein, 38 aa, Artificial Sequence
  Description of Artificial Sequence: Synthetic polypeptide
DESEIRTTNPVAYEQWGSVSGGLPANGGNMRNGMGDVN

SEQ ID NO: 187716 - protein, 38 aa, Artificial Sequence
  Description of Artificial Sequence: Synthetic polypeptide
CEEEIRTTNCVATEQYGVVSILGPTGDNDQGEGGDIGD

SEQ ID NO: 187717 - protein, 37 aa, Artificial Sequence
  Description of Artificial Sequence: Synthetic polypeptide
DEDEIRGTNPVATDQYGVVNDNSIGQNGGQEGNDMDI

SEQ ID NO: 187718 - protein, 35 aa, Artificial Sequence
  Description of Artificial Sequence: Synthetic polypeptide
DECEIRTTNPVAYECWGTVYWINENQDRQMMNNGD

SEQ ID NO: 187719 - protein, 36 aa, Artificial Sequence
  Description of Artificial Sequence: Synthetic polypeptide
DEDEIATTNPVAYEQYGSVCTDTPGPNDSGDGEGHN

SEQ ID NO: 187720 - protein, 37 aa, Artificial Sequence
  Description of Artificial Sequence: Synthetic polypeptide
DESEIRTTNPVATEQYGSVVDLMVNEGQEEEVQTEGD

SEQ ID NO: 187721 - protein, 38 aa, Artificial Sequence
  Description of Artificial Sequence: Synthetic polypeptide
DEQEIATTNPVATEQYGSACAATNPMQEAGDSLMGNGM

SEQ ID NO: 187722 - protein, 35 aa, Artificial Sequence
  Description of Artificial Sequence: Synthetic polypeptide
CEDEIACTNPVATEQYGSVCAAGPLGFATMGDENG

SEQ ID NO: 187723 - protein, 37 aa, Artificial Sequence
  Description of Artificial Sequence: Synthetic polypeptide
DEQEIATTNPVATEQYGSACAATNPEEAGDSGMGNHM

SEQ ID NO: 187724 - protein, 38 aa, Artificial Sequence
  Description of Artificial Sequence: Synthetic polypeptide
DEQEIATTNPVATEQYGSACAATNPAEEAGRHGDNATP

SEQ ID NO: 187725 - protein, 36 aa, Artificial Sequence
  Description of Artificial Sequence: Synthetic polypeptide
DEDEIATTNPVAYEQYGSACAATNPQEADSGMGHSM

SEQ ID NO: 187726 - protein, 35 aa, Artificial Sequence
  Description of Artificial Sequence: Synthetic polypeptide
DEDEIATTNPVAYEQYGSACSAADGQPAGTPSESF

SEQ ID NO: 187727 - protein, 36 aa, Artificial Sequence
  Description of Artificial Sequence: Synthetic polypeptide
DEDEIATTNPVAYEQYGSTVCAGVNGDEATAGLNEH

SEQ ID NO: 187728 - protein, 36 aa, Artificial Sequence
  Description of Artificial Sequence: Synthetic polypeptide
DEQEIATTNPVATEQYGCVVAANNGLEATMNPESNH

SEQ ID NO: 187729 - protein, 36 aa, Artificial Sequence
  Description of Artificial Sequence: Synthetic polypeptide
DEDEIATTNPVAYEQYGSVAACPNGLATETNGSDVG

SEQ ID NO: 187730 - protein, 36 aa, Artificial Sequence
  Description of Artificial Sequence: Synthetic polypeptide
DEDEIATTNPVAYEQYGSVAACPNPLATETNGGSHG

SEQ ID NO: 187731 - protein, 36 aa, Artificial Sequence
  Description of Artificial Sequence: Synthetic polypeptide
DEDEIATTNPVAYEQYGSVAACPNPLATETNGSVEG

SEQ ID NO: 187732 - protein, 36 aa, Artificial Sequence
  Description of Artificial Sequence: Synthetic polypeptide
DEDEIATTNPVAYEQYGSVAACPPNPLATETNGSVG

SEQ ID NO: 187733 - protein, 35 aa, Artificial Sequence
  Description of Artificial Sequence: Synthetic polypeptide
CEDEIACTNPVATEQYGSACAANDLQNHADENGHH

SEQ ID NO: 187734 - protein, 36 aa, Artificial Sequence
  Description of Artificial Sequence: Synthetic polypeptide
DEDEIATTNPVAYEQYGSVAACPQGLATGTNIGSVE

SEQ ID NO: 187735 - protein, 37 aa, Artificial Sequence
  Description of Artificial Sequence: Synthetic polypeptide
DEDEIATTNPVAYEQYGSVAAIANNDLDQATGGSEEY

SEQ ID NO: 187736 - protein, 35 aa, Artificial Sequence
  Description of Artificial Sequence: Synthetic polypeptide
CEEEIKTTNPCAYEQWGSVYCTDDHQHRQKGGHSN

SEQ ID NO: 187737 - protein, 38 aa, Artificial Sequence
  Description of Artificial Sequence: Synthetic polypeptide
DESEIRTTNPVATEQYGAVIFGSGDDGGQEGTEGNIAE

SEQ ID NO: 187738 - protein, 35 aa, Artificial Sequence
  Description of Artificial Sequence: Synthetic polypeptide
DEDEIATTNPVAYEQYGSVAGGGGVTTAENPNEKT

SEQ ID NO: 187739 - protein, 36 aa, Artificial Sequence
  Description of Artificial Sequence: Synthetic polypeptide
DEQEIATTNPVATEQYGCVAAWHVDENGTPPDNNRN

SEQ ID NO: 187740 - protein, 36 aa, Artificial Sequence
  Description of Artificial Sequence: Synthetic polypeptide
DEQEIATTNPVATEQYGCVAATTNSNATPSIDENDD

SEQ ID NO: 187741 - protein, 36 aa, Artificial Sequence
  Description of Artificial Sequence: Synthetic polypeptide
DEQEIATTNPVATEQYGCVAATPHPEEAGMMDENAV

SEQ ID NO: 187742 - protein, 33 aa, Artificial Sequence
  Description of Artificial Sequence: Synthetic polypeptide
CEDEIACTNPVATEQYGCVAGTGLAANPYPQDV

SEQ ID NO: 187743 - protein, 35 aa, Artificial Sequence
  Description of Artificial Sequence: Synthetic polypeptide
DEQEIATTNPVATEQYGCVAANVGDATMPMGDPHW

SEQ ID NO: 187744 - protein, 35 aa, Artificial Sequence
  Description of Artificial Sequence: Synthetic polypeptide
DEDEIATTNPVAYEQWGTVVVGNWNEGDRQGMNES

SEQ ID NO: 187745 - protein, 35 aa, Artificial Sequence
  Description of Artificial Sequence: Synthetic polypeptide
DEDEIATTNPVAYEQWGTVCAATAGQMPDSGPNDN

SEQ ID NO: 187746 - protein, 35 aa, Artificial Sequence
  Description of Artificial Sequence: Synthetic polypeptide
DEDEIATTNPVAYEQWGTVCAATAGGLPDSGPNGV

SEQ ID NO: 187747 - protein, 35 aa, Artificial Sequence
  Description of Artificial Sequence: Synthetic polypeptide
DEDEIATTNPVAYEQWGTVCAATAGELPDSNPNQR

SEQ ID NO: 187748 - protein, 35 aa, Artificial Sequence
  Description of Artificial Sequence: Synthetic polypeptide
DESEIRTTNPVATEGWGCVCSWMEDNQDNFGSDQM

SEQ ID NO: 187749 - protein, 36 aa, Artificial Sequence
  Description of Artificial Sequence: Synthetic polypeptide
DESEIRTTNPVATEGWGCVCSWMEENQEGFGSNTQS

SEQ ID NO: 187750 - protein, 36 aa, Artificial Sequence
  Description of Artificial Sequence: Synthetic polypeptide
DESEIRTTNPVATEGWGCVCSWMEENQEYFGSNNQF

SEQ ID NO: 187751 - protein, 35 aa, Artificial Sequence
  Description of Artificial Sequence: Synthetic polypeptide
DESEIRTTNPVATEGWGCVCSWMEENQEYFNSNQA

SEQ ID NO: 187752 - protein, 35 aa, Artificial Sequence
  Description of Artificial Sequence: Synthetic polypeptide
DESEIRTTNPVATEGWGCVCSWMEHNQDSFGSDQS

SEQ ID NO: 187753 - protein, 35 aa, Artificial Sequence
  Description of Artificial Sequence: Synthetic polypeptide
DESEIRTTNPVATEGWGCVCSWMNENAENFGSDQG

SEQ ID NO: 187754 - protein, 39 aa, Artificial Sequence
  Description of Artificial Sequence: Synthetic polypeptide
DEAEIRTTNPVATEQYGSVVVSGSSIMLEELFNGNEEVF

SEQ ID NO: 187755 - protein, 37 aa, Artificial Sequence
  Description of Artificial Sequence: Synthetic polypeptide
DESEIRTTNPVATEGWGQCVCSWMNENQEYFGSENQS

SEQ ID NO: 187756 - protein, 33 aa, Artificial Sequence
  Description of Artificial Sequence: Synthetic polypeptide
CEDEIACTNPVAYEQWGEYYVIENDQRTPGESI

SEQ ID NO: 187757 - protein, 36 aa, Artificial Sequence
  Description of Artificial Sequence: Synthetic polypeptide
DEDEIATTNPVAYEQWGSVSGQGPPQQATPDGSNNH

SEQ ID NO: 187758 - protein, 35 aa, Artificial Sequence
  Description of Artificial Sequence: Synthetic polypeptide
DEDEIATTNPVAYEQWGSVSGQGPPQQDTPDGSSN

SEQ ID NO: 187759 - protein, 39 aa, Artificial Sequence
  Description of Artificial Sequence: Synthetic polypeptide
DESEIRTTNPVATEQYGDVTVGDQTGGLGQNDEDGNEDD

SEQ ID NO: 187760 - protein, 35 aa, Artificial Sequence
  Description of Artificial Sequence: Synthetic polypeptide
DEDEIATTNPVAYEQWGSVSQGPAPQDDTPDGSEH

SEQ ID NO: 187761 - protein, 38 aa, Artificial Sequence
  Description of Artificial Sequence: Synthetic polypeptide
DEAEIRTTNPVATEQYGSVTWSPVVWLEAPNTWEEVGN

SEQ ID NO: 187762 - protein, 36 aa, Artificial Sequence
  Description of Artificial Sequence: Synthetic polypeptide
DESEIRTTNPVATEGYGDVVDGTDQEGQGQQGEDGQ

SEQ ID NO: 187763 - protein, 38 aa, Artificial Sequence
  Description of Artificial Sequence: Synthetic polypeptide
DEAEIRTTNPVATEQYGSVTWSPVVHLENPNTWTEVGN

SEQ ID NO: 187764 - protein, 35 aa, Artificial Sequence
  Description of Artificial Sequence: Synthetic polypeptide
DEDEIATTNPVAYEQWGSVVCNAAMPIEDREDDRE

SEQ ID NO: 187765 - protein, 37 aa, Artificial Sequence
  Description of Artificial Sequence: Synthetic polypeptide
DESEIRTTNPVATEGYGSVNNVAGFGLGETEQDNGDT

SEQ ID NO: 187766 - protein, 36 aa, Artificial Sequence
  Description of Artificial Sequence: Synthetic polypeptide
CEDEIACTNPVATEQYGSVCAATMHGENTADGDDRL

SEQ ID NO: 187767 - protein, 34 aa, Artificial Sequence
  Description of Artificial Sequence: Synthetic polypeptide
DEDEIATTNPVAYEQWGTICAATAGQMPDSGPNH

SEQ ID NO: 187768 - protein, 35 aa, Artificial Sequence
  Description of Artificial Sequence: Synthetic polypeptide
DEDEIATTNPVAYEQWGTSVAATAHGAAAPPGSNN

SEQ ID NO: 187769 - protein, 36 aa, Artificial Sequence
  Description of Artificial Sequence: Synthetic polypeptide
DEDEIATTNPVAYEQWGTTVCAATAGELPDSGPNDR

SEQ ID NO: 187770 - protein, 34 aa, Artificial Sequence
  Description of Artificial Sequence: Synthetic polypeptide
DEDEIATTNPVAYEQWGTVCAAQAGGLPDSGPNH

SEQ ID NO: 187771 - protein, 35 aa, Artificial Sequence
  Description of Artificial Sequence: Synthetic polypeptide
DEDEIATTNPVAYEQWGTVCAATAGELPDSGNNDH

SEQ ID NO: 187772 - protein, 35 aa, Artificial Sequence
  Description of Artificial Sequence: Synthetic polypeptide
DEDEIATTNPVAYEQWGSVSQGPPQDDTPDGSAEN

SEQ ID NO: 187773 - protein, 37 aa, Artificial Sequence
  Description of Artificial Sequence: Synthetic polypeptide
DESEIRTTNPVATEQYGSVVDLMVNTGIQEEDETEGQ

SEQ ID NO: 187774 - protein, 36 aa, Artificial Sequence
  Description of Artificial Sequence: Synthetic polypeptide
DEQEIATTNPVATEQYGCVAANPSGLPPAEAEPNHH

SEQ ID NO: 187775 - protein, 35 aa, Artificial Sequence
  Description of Artificial Sequence: Synthetic polypeptide
DEQEIATTNPVATEQYGCVAANNGDIANAMINNEE

SEQ ID NO: 187776 - protein, 36 aa, Artificial Sequence
  Description of Artificial Sequence: Synthetic polypeptide
CEEEIRATNPVATDQYGVVTMQDGDNGQRFIDQGQN

SEQ ID NO: 187777 - protein, 35 aa, Artificial Sequence
  Description of Artificial Sequence: Synthetic polypeptide
CEAEISTTNPVATEQYGCVCSSEDHNTNFNSDTQS

SEQ ID NO: 187778 - protein, 38 aa, Artificial Sequence
  Description of Artificial Sequence: Synthetic polypeptide
DEDEIATTNPVAYEQYGSVCAMTNNQLPQDDTTGGGLV

SEQ ID NO: 187779 - protein, 37 aa, Artificial Sequence
  Description of Artificial Sequence: Synthetic polypeptide
DEDEIATTNPVAYEQYGSVCAMTNNQNQDDTTGGGLA

SEQ ID NO: 187780 - protein, 36 aa, Artificial Sequence
  Description of Artificial Sequence: Synthetic polypeptide
CEEEIRATNPVATDQYGVVTMQDGDNGQRFNNDGQN

SEQ ID NO: 187781 - protein, 36 aa, Artificial Sequence
  Description of Artificial Sequence: Synthetic polypeptide
DEQEIATTNPVATEQWGSVSAVGDLEADTPQGEDLH

SEQ ID NO: 187782 - protein, 37 aa, Artificial Sequence
  Description of Artificial Sequence: Synthetic polypeptide
DEQEIATTNPVATEQWGSVSATGDYMGEDHQGEEDNH

SEQ ID NO: 187783 - protein, 37 aa, Artificial Sequence
  Description of Artificial Sequence: Synthetic polypeptide
DEDEIATTNPVAYEQYGSVCSANPALAQAHQQDLTAM

SEQ ID NO: 187784 - protein, 37 aa, Artificial Sequence
  Description of Artificial Sequence: Synthetic polypeptide
DEDEIATTNPVAYEQYGSVCSANPALGQEHMIDLTAM

SEQ ID NO: 187785 - protein, 36 aa, Artificial Sequence
  Description of Artificial Sequence: Synthetic polypeptide
DEDEIATTNPVAYEQYGSVCSANPALPGAHMDLTAM

SEQ ID NO: 187786 - protein, 36 aa, Artificial Sequence
  Description of Artificial Sequence: Synthetic polypeptide
DEQEIATTNPVATEQWGSVSATGDPGPEAHQGDEDN

SEQ ID NO: 187787 - protein, 36 aa, Artificial Sequence
  Description of Artificial Sequence: Synthetic polypeptide
DEDEIATTNPVAYEQYGSVCSANPALPNAHEDLTAD

SEQ ID NO: 187788 - protein, 37 aa, Artificial Sequence
  Description of Artificial Sequence: Synthetic polypeptide
DEQEIATTNPVATEQWGSVSATGDPGGIDHQGDEDNH

SEQ ID NO: 187789 - protein, 36 aa, Artificial Sequence
  Description of Artificial Sequence: Synthetic polypeptide
DEQEIATTNPVATEQWGSVSATGDPEEADTEGGEDA

SEQ ID NO: 187790 - protein, 37 aa, Artificial Sequence
  Description of Artificial Sequence: Synthetic polypeptide
CEAEIACTNPVATEQYGSVCNPTPNPQNEAGIGNADD

SEQ ID NO: 187791 - protein, 35 aa, Artificial Sequence
  Description of Artificial Sequence: Synthetic polypeptide
CDEEISTTNPVATEQYGCVCSWGEHNAENFGSDQS

SEQ ID NO: 187792 - protein, 36 aa, Artificial Sequence
  Description of Artificial Sequence: Synthetic polypeptide
CDEEISTTNPVATEQYGCVCSWGEDNQEGFNSDNQS

SEQ ID NO: 187793 - protein, 35 aa, Artificial Sequence
  Description of Artificial Sequence: Synthetic polypeptide
CDEEISTTNPVATEQYGCVCSNWEHNQGFNSDNQM

SEQ ID NO: 187794 - protein, 36 aa, Artificial Sequence
  Description of Artificial Sequence: Synthetic polypeptide
DEDEIATTNPVAYEQYGSVCSVAPALAQAHQDLTAM

SEQ ID NO: 187795 - protein, 36 aa, Artificial Sequence
  Description of Artificial Sequence: Synthetic polypeptide
DEDEIATTNPVAYEQYGSVCSVDHGPQDSMDGTEMW

SEQ ID NO: 187796 - protein, 37 aa, Artificial Sequence
  Description of Artificial Sequence: Synthetic polypeptide
DESEIRTTNPVATEQYGSVTPYQTDEEQITPSIEEVP

SEQ ID NO: 187797 - protein, 35 aa, Artificial Sequence
  Description of Artificial Sequence: Synthetic polypeptide
DEDEIATTNPVAYEQYGSVCTANPAWIPADPMEEW

SEQ ID NO: 187798 - protein, 37 aa, Artificial Sequence
  Description of Artificial Sequence: Synthetic polypeptide
DESEIRTTNPVATEQYGSVVDLMVDNGQQEEDQTEGQ

SEQ ID NO: 187799 - protein, 35 aa, Artificial Sequence
  Description of Artificial Sequence: Synthetic polypeptide
CEAEISTTNPVATEQYGCVCSSEEDHQNFNSDTQS

SEQ ID NO: 187800 - protein, 36 aa, Artificial Sequence
  Description of Artificial Sequence: Synthetic polypeptide
CEAEISTTNPVATEQYGCVCSTEDHNQEYFNSENQS

SEQ ID NO: 187801 - protein, 36 aa, Artificial Sequence
  Description of Artificial Sequence: Synthetic polypeptide
CEAEISTTNPVATEQYGCVCSTGPDHNQNFNSDTQS

SEQ ID NO: 187802 - protein, 36 aa, Artificial Sequence
  Description of Artificial Sequence: Synthetic polypeptide
DEDEIATTNPVAYEQYGSVCAANPPMQPDNQTEGTM

SEQ ID NO: 187803 - protein, 37 aa, Artificial Sequence
  Description of Artificial Sequence: Synthetic polypeptide
DESEIRTTNPVATEQYGEVVPSCTLSHSTKAGGPGTS

SEQ ID NO: 187804 - protein, 32 aa, Artificial Sequence
  Description of Artificial Sequence: Synthetic polypeptide
CEDEIACTNPVATEQYGCAPGEGHGNDSDGED

SEQ ID NO: 187805 - protein, 35 aa, Artificial Sequence
  Description of Artificial Sequence: Synthetic polypeptide
DEQEIATTNPVATEQYGCVAANGDGATMPSGDPHW

SEQ ID NO: 187806 - protein, 35 aa, Artificial Sequence
  Description of Artificial Sequence: Synthetic polypeptide
DEQEIATTNPVATEQYGCVAANGDEATMPMGDLHG

SEQ ID NO: 187807 - protein, 37 aa, Artificial Sequence
  Description of Artificial Sequence: Synthetic polypeptide
DESEIRTTNPVATEQYGQCVCSNWEHNQENFNSDNQG

SEQ ID NO: 187808 - protein, 37 aa, Artificial Sequence
  Description of Artificial Sequence: Synthetic polypeptide
DESEIRTTNPVATEQYGSCPMPIMLWPENRSISQQTD

SEQ ID NO: 187809 - protein, 37 aa, Artificial Sequence
  Description of Artificial Sequence: Synthetic polypeptide
DESEIRTTNPVATEQYGSIIECVEWPMEQEEYNQQDG

SEQ ID NO: 187810 - protein, 34 aa, Artificial Sequence
  Description of Artificial Sequence: Synthetic polypeptide
CEDEIACTNPVATEQWGCVAGTNISHQEADMLIR

SEQ ID NO: 187811 - protein, 34 aa, Artificial Sequence
  Description of Artificial Sequence: Synthetic polypeptide
DEQEIATTNPVATEQYGCVAANGDATMPMEDAHW

SEQ ID NO: 187812 - protein, 32 aa, Artificial Sequence
  Description of Artificial Sequence: Synthetic polypeptide
CEDEIACTNPVATEQWGCVAGTGDEAMNMEVD

SEQ ID NO: 187813 - protein, 32 aa, Artificial Sequence
  Description of Artificial Sequence: Synthetic polypeptide
CEDEIACTNPVATEQWGCVAGTGDEAMMNEID

SEQ ID NO: 187814 - protein, 35 aa, Artificial Sequence
  Description of Artificial Sequence: Synthetic polypeptide
DEQEIATTNPVATEQYGCVAANNGSEATMNPEDVH

SEQ ID NO: 187815 - protein, 31 aa, Artificial Sequence
  Description of Artificial Sequence: Synthetic polypeptide
CEDEIACTNPVATEQWGCVAGTGDATMMEMD

SEQ ID NO: 187816 - protein, 31 aa, Artificial Sequence
  Description of Artificial Sequence: Synthetic polypeptide
CEDEIACTNPVATEQWGCVAGTGDAMNMEIE

SEQ ID NO: 187817 - protein, 37 aa, Artificial Sequence
  Description of Artificial Sequence: Synthetic polypeptide
DEQEIATTNPVATEQYGCVAAATGHLPADSGNGEADP

SEQ ID NO: 187818 - protein, 35 aa, Artificial Sequence
  Description of Artificial Sequence: Synthetic polypeptide
DEQEIATTNPVATEQYGCSAANHLEATMPGGEPHN

SEQ ID NO: 187819 - protein, 37 aa, Artificial Sequence
  Description of Artificial Sequence: Synthetic polypeptide
DESEIRTTNPVATEQYGSVIECYWPMEQEEYNQQDGA

SEQ ID NO: 187820 - protein, 38 aa, Artificial Sequence
  Description of Artificial Sequence: Synthetic polypeptide
DESEIRTTNPVATEQYGSVIEVTLWPMEQEEYNQQDGI

SEQ ID NO: 187821 - protein, 38 aa, Artificial Sequence
  Description of Artificial Sequence: Synthetic polypeptide
DESEIRTTNPVATEQYGSVMWVTYDVSPTERPQFVQYQ

SEQ ID NO: 187822 - protein, 36 aa, Artificial Sequence
  Description of Artificial Sequence: Synthetic polypeptide
DESEIRTTNPVATEQYGSVMYQTDEEDITPSIEEMP

SEQ ID NO: 187823 - protein, 36 aa, Artificial Sequence
  Description of Artificial Sequence: Synthetic polypeptide
DEDEIATTNPVAYEQYGSVCAADNGDEDGMDINNNN

SEQ ID NO: 187824 - protein, 36 aa, Artificial Sequence
  Description of Artificial Sequence: Synthetic polypeptide
DESEIRTTNPVATEQYGSVPYQTDEEDITPSPEEDP

SEQ ID NO: 187825 - protein, 34 aa, Artificial Sequence
  Description of Artificial Sequence: Synthetic polypeptide
DEQEIATTNPVATEQWGTVCAATDGPEETEIQND

SEQ ID NO: 187826 - protein, 34 aa, Artificial Sequence
  Description of Artificial Sequence: Synthetic polypeptide
DEQEIATTNPVATEQWGTICAATDGPEEGTEIND

SEQ ID NO: 187827 - protein, 32 aa, Artificial Sequence
  Description of Artificial Sequence: Synthetic polypeptide
CEDEIACTNPVATEQWGCVAGTGDAMPMEPRE

SEQ ID NO: 187828 - protein, 37 aa, Artificial Sequence
  Description of Artificial Sequence: Synthetic polypeptide
DEQEIATTNPVAYEGWGSVCSGTDNNQDREDGGQEEN

SEQ ID NO: 187829 - protein, 35 aa, Artificial Sequence
  Description of Artificial Sequence: Synthetic polypeptide
DEQEIATTNPVAYEGWGSVCVGTDNQDRGDGGQML

SEQ ID NO: 187830 - protein, 35 aa, Artificial Sequence
  Description of Artificial Sequence: Synthetic polypeptide
DEQEIATTNPVAYEHWGSICSPTDNNEHQDDRDDP

SEQ ID NO: 187831 - protein, 38 aa, Artificial Sequence
  Description of Artificial Sequence: Synthetic polypeptide
CEEEIACTNPVATEQYGSVCAMNGKHGPLDQGEGNMED

SEQ ID NO: 187832 - protein, 38 aa, Artificial Sequence
  Description of Artificial Sequence: Synthetic polypeptide
CEEEIACTNPVATEQYGSVCAMNGKHGPLDQGGGNPPD

SEQ ID NO: 187833 - protein, 38 aa, Artificial Sequence
  Description of Artificial Sequence: Synthetic polypeptide
CEEEIACTNPVATEQYGSVCAMTNPELTNPDDQDEHNM

SEQ ID NO: 187834 - protein, 36 aa, Artificial Sequence
  Description of Artificial Sequence: Synthetic polypeptide
CEEEIACTNPVATEQYGSVCAMTPHGIADSIGENND

SEQ ID NO: 187835 - protein, 34 aa, Artificial Sequence
  Description of Artificial Sequence: Synthetic polypeptide
DECEIATTNPVAYEAWGCVAGWNGEERNNMQGNA

SEQ ID NO: 187836 - protein, 35 aa, Artificial Sequence
  Description of Artificial Sequence: Synthetic polypeptide
CEEEIACTNPVATEQYGSVCATDIHPDNNNSEEAM

SEQ ID NO: 187837 - protein, 35 aa, Artificial Sequence
  Description of Artificial Sequence: Synthetic polypeptide
DECEIATTNPVAYECWGSVCPTTDNQDQQNDNGPQ

SEQ ID NO: 187838 - protein, 36 aa, Artificial Sequence
  Description of Artificial Sequence: Synthetic polypeptide
CEEEIACTNPVATEQYGSVCATDNNPAEEAAEGGEE

SEQ ID NO: 187839 - protein, 36 aa, Artificial Sequence
  Description of Artificial Sequence: Synthetic polypeptide
DECEIATTNPVAYECWGSVVSTGSLAQGEQDRNDSE

SEQ ID NO: 187840 - protein, 35 aa, Artificial Sequence
  Description of Artificial Sequence: Synthetic polypeptide
DECEIATTNPVAYEEWGSVATNGGNTGNAGNDNQI

SEQ ID NO: 187841 - protein, 37 aa, Artificial Sequence
  Description of Artificial Sequence: Synthetic polypeptide
CEEEIACTNPVATEQYGSVCATDNNPAEEAGAEGGNW

SEQ ID NO: 187842 - protein, 36 aa, Artificial Sequence
  Description of Artificial Sequence: Synthetic polypeptide
DECEIATTNPVAYEGWGSVATNGGNTGNAEGNDNQR

SEQ ID NO: 187843 - protein, 35 aa, Artificial Sequence
  Description of Artificial Sequence: Synthetic polypeptide
CEEEIACTNPVATEQYGSVCWVPGEATEDGNGADM

SEQ ID NO: 187844 - protein, 37 aa, Artificial Sequence
  Description of Artificial Sequence: Synthetic polypeptide
CEEEIACTNPVATEQYGSVSGTGEPGINPDDGMEKVH

SEQ ID NO: 187845 - protein, 37 aa, Artificial Sequence
  Description of Artificial Sequence: Synthetic polypeptide
CEEEIACTNPVATEQYGSVSPTGEPGINPRDGMEKVY

SEQ ID NO: 187846 - protein, 36 aa, Artificial Sequence
  Description of Artificial Sequence: Synthetic polypeptide
CEEEIACTNPVATEQYGSVVAGTGPTAPGEQMEGAH

SEQ ID NO: 187847 - protein, 35 aa, Artificial Sequence
  Description of Artificial Sequence: Synthetic polypeptide
DECEIATTNPVAYEHWGEVATGGNTGNAGNDNQRE

SEQ ID NO: 187848 - protein, 35 aa, Artificial Sequence
  Description of Artificial Sequence: Synthetic polypeptide
DECEIATTNPVAYEHWGSVCPTDNQDQNHNDNMPQ

SEQ ID NO: 187849 - protein, 33 aa, Artificial Sequence
  Description of Artificial Sequence: Synthetic polypeptide
DECEIATTNPVAYEHWGSVCYNNDDQDHQDQDA

SEQ ID NO: 187850 - protein, 37 aa, Artificial Sequence
  Description of Artificial Sequence: Synthetic polypeptide
CEEEIACTNPVATEQYGVSTACAANDPQETEGGNDNQ

SEQ ID NO: 187851 - protein, 35 aa, Artificial Sequence
  Description of Artificial Sequence: Synthetic polypeptide
DESEIATTNPVATEEYGTVCAATGGEPSEFEGGND

SEQ ID NO: 187852 - protein, 34 aa, Artificial Sequence
  Description of Artificial Sequence: Synthetic polypeptide
CEEEIACTNPVAYEQYGCVAGTGLDNIGGEMPMN

SEQ ID NO: 187853 - protein, 35 aa, Artificial Sequence
  Description of Artificial Sequence: Synthetic polypeptide
CEEEIACTNPVAYEQYGSACSADLNQNHQDENNMW

SEQ ID NO: 187854 - protein, 34 aa, Artificial Sequence
  Description of Artificial Sequence: Synthetic polypeptide
CEEEIACTNPVATEQYGSVCAFDIHPDNNNSEAD

SEQ ID NO: 187855 - protein, 34 aa, Artificial Sequence
  Description of Artificial Sequence: Synthetic polypeptide
DECEIATTNPVATETWGAVCTIEGQQGQDQEEIN

SEQ ID NO: 187856 - protein, 34 aa, Artificial Sequence
  Description of Artificial Sequence: Synthetic polypeptide
DECEIATTNPVATETWGAVCTIEGHQGQDQENVV

SEQ ID NO: 187857 - protein, 34 aa, Artificial Sequence
  Description of Artificial Sequence: Synthetic polypeptide
CEEEIACTNPVATEQYGSVCAATHEEAMMDETAG

SEQ ID NO: 187858 - protein, 36 aa, Artificial Sequence
  Description of Artificial Sequence: Synthetic polypeptide
DEAEISTVNPVATEQYGCVCSTGNHNAENFISDNQA

SEQ ID NO: 187859 - protein, 37 aa, Artificial Sequence
  Description of Artificial Sequence: Synthetic polypeptide
DEAEISTVNPVATEQYGCVCSTGEAHNAENFGSDNQA

SEQ ID NO: 187860 - protein, 36 aa, Artificial Sequence
  Description of Artificial Sequence: Synthetic polypeptide
DEAEISTVNPVATEQYGCVCSSGEHNAENFQSDNQA

SEQ ID NO: 187861 - protein, 38 aa, Artificial Sequence
  Description of Artificial Sequence: Synthetic polypeptide
DEQEIRTTNPVATEQYGSVVMSVYDNNTGGGQTDQVGD

SEQ ID NO: 187862 - protein, 39 aa, Artificial Sequence
  Description of Artificial Sequence: Synthetic polypeptide
DEQEIRTTNPVATEQYGSVVMSVNDNNTEGGGQTGQVGD

SEQ ID NO: 187863 - protein, 37 aa, Artificial Sequence
  Description of Artificial Sequence: Synthetic polypeptide
DEAEISTVNPVATEQYGCVCSMTGELNAENFGSDNQA

SEQ ID NO: 187864 - protein, 36 aa, Artificial Sequence
  Description of Artificial Sequence: Synthetic polypeptide
DESEIATTNPCATEQYGTVCAACGGEVSENMNGGND

SEQ ID NO: 187865 - protein, 36 aa, Artificial Sequence
  Description of Artificial Sequence: Synthetic polypeptide
DESEIATTNPCATEQYGTVCAATGGEDSENYNGGND

SEQ ID NO: 187866 - protein, 36 aa, Artificial Sequence
  Description of Artificial Sequence: Synthetic polypeptide
DESEIATTNPCATEQYGTVCAATGGEWSENFNEGND

SEQ ID NO: 187867 - protein, 36 aa, Artificial Sequence
  Description of Artificial Sequence: Synthetic polypeptide
DESEIATTNPCATEQYGTVCSATGGEWSENTNGGSD

SEQ ID NO: 187868 - protein, 37 aa, Artificial Sequence
  Description of Artificial Sequence: Synthetic polypeptide
DESEIATTNPCATEQYGTVCSATGVEPSENSNGGNDP

SEQ ID NO: 187869 - protein, 35 aa, Artificial Sequence
  Description of Artificial Sequence: Synthetic polypeptide
CEEEIACTNPVAYEQYGSCSAGPALGQNHMGMQDA

SEQ ID NO: 187870 - protein, 36 aa, Artificial Sequence
  Description of Artificial Sequence: Synthetic polypeptide
CEEEIACTNPVATEQYGNCAAATGNPQIDPMEEGNN

SEQ ID NO: 187871 - protein, 35 aa, Artificial Sequence
  Description of Artificial Sequence: Synthetic polypeptide
DESEIATTNPCAYEEWGSVATPNGNQQLEGDHQRE

SEQ ID NO: 187872 - protein, 37 aa, Artificial Sequence
  Description of Artificial Sequence: Synthetic polypeptide
DESEIATTNPIATEAYGSTVASCTNMVSADAGGNMHF

SEQ ID NO: 187873 - protein, 31 aa, Artificial Sequence
  Description of Artificial Sequence: Synthetic polypeptide
DESEIATTNPIGTECWGVMWASEDWQEHGPI

SEQ ID NO: 187874 - protein, 31 aa, Artificial Sequence
  Description of Artificial Sequence: Synthetic polypeptide
DESEIATTNPIGTEGYGVMWAATLAPKGDYI

SEQ ID NO: 187875 - protein, 32 aa, Artificial Sequence
  Description of Artificial Sequence: Synthetic polypeptide
DESEIATTNPISTEGWGNVAAAETIQSRVGPI

SEQ ID NO: 187876 - protein, 36 aa, Artificial Sequence
  Description of Artificial Sequence: Synthetic polypeptide
DESEIATTNPVATAQWGSVAGANDPGAPTNQMEGNP

SEQ ID NO: 187877 - protein, 37 aa, Artificial Sequence
  Description of Artificial Sequence: Synthetic polypeptide
CEEEIACTNPVATEQYGCVTAIANNLPQEAPGENAHK

SEQ ID NO: 187878 - protein, 37 aa, Artificial Sequence
  Description of Artificial Sequence: Synthetic polypeptide
DESEIATTNPVATEAWGSVAWTEPINDQDLQNMNQEK

SEQ ID NO: 187879 - protein, 33 aa, Artificial Sequence
  Description of Artificial Sequence: Synthetic polypeptide
DESEIATTNPVATECWGATTANADLAEPKGPYI

SEQ ID NO: 187880 - protein, 36 aa, Artificial Sequence
  Description of Artificial Sequence: Synthetic polypeptide
CEEEIACTNPVATEQYGSVCAAGPLGFATMGDNEAD

SEQ ID NO: 187881 - protein, 36 aa, Artificial Sequence
  Description of Artificial Sequence: Synthetic polypeptide
CEEEIACTNPVATEQYGSVCAATEVLEAMGEQEEAD

SEQ ID NO: 187882 - protein, 35 aa, Artificial Sequence
  Description of Artificial Sequence: Synthetic polypeptide
DESEIATTNPCAYECWGSVATPNGNQQLEDDGQSR

SEQ ID NO: 187883 - protein, 37 aa, Artificial Sequence
  Description of Artificial Sequence: Synthetic polypeptide
DEAEISTVNPVATEQYGCVCSTWGEHNAENFGSENQA

SEQ ID NO: 187884 - protein, 34 aa, Artificial Sequence
  Description of Artificial Sequence: Synthetic polypeptide
DECEIATTNPVAYEQWGSVVCNAAMPMEDAEDTR

SEQ ID NO: 187885 - protein, 36 aa, Artificial Sequence
  Description of Artificial Sequence: Synthetic polypeptide
DESEIATTNPVATEQYGCFTAANANGLQPADPPNNN

SEQ ID NO: 187886 - protein, 37 aa, Artificial Sequence
  Description of Artificial Sequence: Synthetic polypeptide
DESEIATTNPVATEQYGTVCSATGGEPSESFEGGNQD

SEQ ID NO: 187887 - protein, 38 aa, Artificial Sequence
  Description of Artificial Sequence: Synthetic polypeptide
DECEICTTNPVATEAYGTVATVTNLQRATNEEGATTDV

SEQ ID NO: 187888 - protein, 36 aa, Artificial Sequence
  Description of Artificial Sequence: Synthetic polypeptide
DESEIATTNPVATESYGTVCSATGGEVSEFEGGNDI

SEQ ID NO: 187889 - protein, 37 aa, Artificial Sequence
  Description of Artificial Sequence: Synthetic polypeptide
DEQEIRTTNPVATEQYGSVNIWVTSLPNEPPDSTEEN

SEQ ID NO: 187890 - protein, 34 aa, Artificial Sequence
  Description of Artificial Sequence: Synthetic polypeptide
CEEEIACTNPVATEQWGCVAGTENEEAGPGDEDA

SEQ ID NO: 187891 - protein, 35 aa, Artificial Sequence
  Description of Artificial Sequence: Synthetic polypeptide
CEEEIACTNPVATEQWGCVAGPGLVQTAENAGMND

SEQ ID NO: 187892 - protein, 37 aa, Artificial Sequence
  Description of Artificial Sequence: Synthetic polypeptide
DEQEIRTTNPVATEQYGSVNIVVTSDLNEPEDSTEEN

SEQ ID NO: 187893 - protein, 36 aa, Artificial Sequence
  Description of Artificial Sequence: Synthetic polypeptide
DEQEIRTTNPVATEQYGSVNIPVTSQMEPEDVTEEN

SEQ ID NO: 187894 - protein, 34 aa, Artificial Sequence
  Description of Artificial Sequence: Synthetic polypeptide
DESEIATTNPVAYECWGSVYSAPQQGEDHGQDET

SEQ ID NO: 187895 - protein, 35 aa, Artificial Sequence
  Description of Artificial Sequence: Synthetic polypeptide
DESEIATTNPVAYEEWGVVATGGNTGNAGNDNQRN

SEQ ID NO: 187896 - protein, 38 aa, Artificial Sequence
  Description of Artificial Sequence: Synthetic polypeptide
DEQEIRTTNPVATEQYGSVNIPVTSGLCNEQEDVTESN

SEQ ID NO: 187897 - protein, 35 aa, Artificial Sequence
  Description of Artificial Sequence: Synthetic polypeptide
DESEIATTNPVAYEQWGSVCYNNDNDQFGHGEDIE

SEQ ID NO: 187898 - protein, 35 aa, Artificial Sequence
  Description of Artificial Sequence: Synthetic polypeptide
DESEIATTNPVAYEQWGSVCYNNDQDQGHGEDIFE

SEQ ID NO: 187899 - protein, 35 aa, Artificial Sequence
  Description of Artificial Sequence: Synthetic polypeptide
CEEEIATTNPVATAQWGSVSATGPPGENHDIMQAN

SEQ ID NO: 187900 - protein, 36 aa, Artificial Sequence
  Description of Artificial Sequence: Synthetic polypeptide
DESEIATTNPVAYEQWGSVSGGNQNESHGLEGDGTS

SEQ ID NO: 187901 - protein, 34 aa, Artificial Sequence
  Description of Artificial Sequence: Synthetic polypeptide
CEEEIACTNPVATEQWGCVAGAGLVQTAENHGMN

SEQ ID NO: 187902 - protein, 34 aa, Artificial Sequence
  Description of Artificial Sequence: Synthetic polypeptide
CEEEIACTNPVATEQWGCVAGAGLAQTAEAAGEN

SEQ ID NO: 187903 - protein, 37 aa, Artificial Sequence
  Description of Artificial Sequence: Synthetic polypeptide
CEEEIATTNPVATAQWGSVSMSGDTPTNNDDLLGNGM

SEQ ID NO: 187904 - protein, 37 aa, Artificial Sequence
  Description of Artificial Sequence: Synthetic polypeptide
DESEIATTNPVAYEQWGTVCPTDNHGLPNGQKGNDQK

SEQ ID NO: 187905 - protein, 34 aa, Artificial Sequence
  Description of Artificial Sequence: Synthetic polypeptide
CEEEIACTNPVATEQWGCTVAGTNSHQEADMLIH

SEQ ID NO: 187906 - protein, 37 aa, Artificial Sequence
  Description of Artificial Sequence: Synthetic polypeptide
DEQEIRTTNPVATEQYGSTIPWTPPLEENHHSQIEMQ

SEQ ID NO: 187907 - protein, 37 aa, Artificial Sequence
  Description of Artificial Sequence: Synthetic polypeptide
DEAEISTTNPVATEQYGQCVCSWGEHNQENFGSDNQA

SEQ ID NO: 187908 - protein, 34 aa, Artificial Sequence
  Description of Artificial Sequence: Synthetic polypeptide
DESEIATTNPVAYESWGSVCPGEEDQHPDTNHKR

SEQ ID NO: 187909 - protein, 37 aa, Artificial Sequence
  Description of Artificial Sequence: Synthetic polypeptide
DESEIATTNPVATEQYGTVCNATGGEPSENFEGGNDN

SEQ ID NO: 187910 - protein, 37 aa, Artificial Sequence
  Description of Artificial Sequence: Synthetic polypeptide
DESEIATTNPVATEQYGTTVLSAIGGEPSENFEGGND

SEQ ID NO: 187911 - protein, 35 aa, Artificial Sequence
  Description of Artificial Sequence: Synthetic polypeptide
CEEEIACTNPVATEQWGCVAGTGLVTTAENAGMNW

SEQ ID NO: 187912 - protein, 34 aa, Artificial Sequence
  Description of Artificial Sequence: Synthetic polypeptide
CEEEIACTNPVATEQWGCVAGTISHQEADMLINN

SEQ ID NO: 187913 - protein, 37 aa, Artificial Sequence
  Description of Artificial Sequence: Synthetic polypeptide
DECEIATTNPVAYEQYGTVCSYTDGLPEEEHDGNNHS

SEQ ID NO: 187914 - protein, 36 aa, Artificial Sequence
  Description of Artificial Sequence: Synthetic polypeptide
DESEIATTNPVATEQYGCVAADHNDNNQTAGGGEGD

SEQ ID NO: 187915 - protein, 36 aa, Artificial Sequence
  Description of Artificial Sequence: Synthetic polypeptide
DECEIATTNPVAYEQYGTVCSYTDGLPEEHEGDGDK

SEQ ID NO: 187916 - protein, 37 aa, Artificial Sequence
  Description of Artificial Sequence: Synthetic polypeptide
DESEIATTNPVATEQYGCVTAANANGLQPADPPIVNN

SEQ ID NO: 187917 - protein, 37 aa, Artificial Sequence
  Description of Artificial Sequence: Synthetic polypeptide
DESEIATTNPVATEQYGCVTAAQANGLQPADPPNPNN

SEQ ID NO: 187918 - protein, 34 aa, Artificial Sequence
  Description of Artificial Sequence: Synthetic polypeptide
DEAEISTTNPVAYEQYGCICSTEDNENFPSQTQA

SEQ ID NO: 187919 - protein, 34 aa, Artificial Sequence
  Description of Artificial Sequence: Synthetic polypeptide
CEEEIACTNPVATEQYGCAPPEHGQDSMEGENKM

SEQ ID NO: 187920 - protein, 35 aa, Artificial Sequence
  Description of Artificial Sequence: Synthetic polypeptide
DEAEISTTNPVAYEQWGSVCGDLNDDMNGQGNLSN

SEQ ID NO: 187921 - protein, 32 aa, Artificial Sequence
  Description of Artificial Sequence: Synthetic polypeptide
CEEEIACTNPVATEQYGCAPGEHGTDSEGEDN

SEQ ID NO: 187922 - protein, 37 aa, Artificial Sequence
  Description of Artificial Sequence: Synthetic polypeptide
DESEIATTNPVATEQYGQTVCSATGGEPSEFEGGNGD

SEQ ID NO: 187923 - protein, 36 aa, Artificial Sequence
  Description of Artificial Sequence: Synthetic polypeptide
DESEIATTNPVATEQYGSACSATMPGAEAAPEDGHN

SEQ ID NO: 187924 - protein, 36 aa, Artificial Sequence
  Description of Artificial Sequence: Synthetic polypeptide
DESEIATTNPVATEQWGTVCSATGGEVSEFEGGNMD

SEQ ID NO: 187925 - protein, 33 aa, Artificial Sequence
  Description of Artificial Sequence: Synthetic polypeptide
CEEEIACTNPVATEQYGCAAPMHGQDSGEGEDD

SEQ ID NO: 187926 - protein, 36 aa, Artificial Sequence
  Description of Artificial Sequence: Synthetic polypeptide
DESEIATTNPVATEQYGSVCAADNGDEATRNAMIVH

SEQ ID NO: 187927 - protein, 37 aa, Artificial Sequence
  Description of Artificial Sequence: Synthetic polypeptide
DESEIATTNPVATEQYGSVCAADNGLEAAMAAMIDRH

SEQ ID NO: 187928 - protein, 36 aa, Artificial Sequence
  Description of Artificial Sequence: Synthetic polypeptide
DECEIATTNPVAYERWGSVCSGTDNQDRRDGGQEEQ

SEQ ID NO: 187929 - protein, 36 aa, Artificial Sequence
  Description of Artificial Sequence: Synthetic polypeptide
DESEIATTNPVATEQYGSVCAAMAHDEAGMPPDNAN

SEQ ID NO: 187930 - protein, 36 aa, Artificial Sequence
  Description of Artificial Sequence: Synthetic polypeptide
DESEIATTNPVATEQYGSVCAAMAHDEAGMPPENNN

SEQ ID NO: 187931 - protein, 37 aa, Artificial Sequence
  Description of Artificial Sequence: Synthetic polypeptide
DESEIATTNPVATEQYGSVCAAMNHDEAGMPPDNDNN

SEQ ID NO: 187932 - protein, 32 aa, Artificial Sequence
  Description of Artificial Sequence: Synthetic polypeptide
DECEIATTNPVSTEPYGVCYCEDGQQQQNGDH

SEQ ID NO: 187933 - protein, 35 aa, Artificial Sequence
  Description of Artificial Sequence: Synthetic polypeptide
DECEICTTNPLATECWGSCAPTDNQQQQHRGDGQD

SEQ ID NO: 187934 - protein, 35 aa, Artificial Sequence
  Description of Artificial Sequence: Synthetic polypeptide
CEEEIACTNPVATEQWGHSASLAGMGQAQDPGENH

SEQ ID NO: 187935 - protein, 34 aa, Artificial Sequence
  Description of Artificial Sequence: Synthetic polypeptide
CEEEIACTNPVATEQWGGCNAITHLQPDDQGGAM

SEQ ID NO: 187936 - protein, 35 aa, Artificial Sequence
  Description of Artificial Sequence: Synthetic polypeptide
CEEEIACTNPVATEQWGCVAGTNGEENGMQEEDRR

SEQ ID NO: 187937 - protein, 36 aa, Artificial Sequence
  Description of Artificial Sequence: Synthetic polypeptide
CEEEIACTNPVATEQWGTCSAGTGLVQTAENPGMNM

SEQ ID NO: 187938 - protein, 37 aa, Artificial Sequence
  Description of Artificial Sequence: Synthetic polypeptide
DEAEISTTNPVATEQYGQCVCSWGEHEQENFGSDNQS

SEQ ID NO: 187939 - protein, 36 aa, Artificial Sequence
  Description of Artificial Sequence: Synthetic polypeptide
DEAEISTVNPVATEQYGCVCSTWGEHNANFNSDNQA

SEQ ID NO: 187940 - protein, 38 aa, Artificial Sequence
  Description of Artificial Sequence: Synthetic polypeptide
DEQEIRTTNPVATEQYGTVVMSNNDNFTGGGQTGQTGD

SEQ ID NO: 187941 - protein, 36 aa, Artificial Sequence
  Description of Artificial Sequence: Synthetic polypeptide
DESAIRTTNPVATEQYGEVVPSCTLSHSTKGGVGTS

SEQ ID NO: 187942 - protein, 36 aa, Artificial Sequence
  Description of Artificial Sequence: Synthetic polypeptide
CEEEIACTNPVATEQYGSACATNPQEADAHLDGMTW

SEQ ID NO: 187943 - protein, 37 aa, Artificial Sequence
  Description of Artificial Sequence: Synthetic polypeptide
CEEEIACTNPVATEQYGSACATNPELGQLHQDDGDAG

SEQ ID NO: 187944 - protein, 37 aa, Artificial Sequence
  Description of Artificial Sequence: Synthetic polypeptide
CEEEIACTNPVATEQYGSACATNPEDGQLHQDDENAH

SEQ ID NO: 187945 - protein, 35 aa, Artificial Sequence
  Description of Artificial Sequence: Synthetic polypeptide
DEAVGATTNPVAYEQWGTVCSTNDRRDQNGQNGSV

SEQ ID NO: 187946 - protein, 35 aa, Artificial Sequence
  Description of Artificial Sequence: Synthetic polypeptide
DESCIATTNPTATEAYGSTNASCTNMVSAYVGNHF

SEQ ID NO: 187947 - protein, 35 aa, Artificial Sequence
  Description of Artificial Sequence: Synthetic polypeptide
DESCIATTNPTATEAYGSTVATCTNMVSAHGGNHF

SEQ ID NO: 187948 - protein, 37 aa, Artificial Sequence
  Description of Artificial Sequence: Synthetic polypeptide
DESCIATTNPVATEAYGSTVASCTANMISEYMGTNHN

SEQ ID NO: 187949 - protein, 37 aa, Artificial Sequence
  Description of Artificial Sequence: Synthetic polypeptide
CEEEIACTNPVATEQYGSACAGTNGEEAPGEQMEGNH

SEQ ID NO: 187950 - protein, 35 aa, Artificial Sequence
  Description of Artificial Sequence: Synthetic polypeptide
CEEEIACTNPVATEQYGSACAGINHGQTEMGDAEE

SEQ ID NO: 187951 - protein, 35 aa, Artificial Sequence
  Description of Artificial Sequence: Synthetic polypeptide
DEAVGATTNPVAYEQWGTVCSTNDRHDQNRQGQSP

SEQ ID NO: 187952 - protein, 35 aa, Artificial Sequence
  Description of Artificial Sequence: Synthetic polypeptide
DEAVGATTNPVAYEQWGTVCSTNDIHDQNGQNGSQ

SEQ ID NO: 187953 - protein, 35 aa, Artificial Sequence
  Description of Artificial Sequence: Synthetic polypeptide
DEAVGATTNPVAYEQWGTVCSMNDLHDQNGRNGSQ

SEQ ID NO: 187954 - protein, 35 aa, Artificial Sequence
  Description of Artificial Sequence: Synthetic polypeptide
DEAVEIATTNPVAYECWGSVYIAENDPQQDGGNMP

SEQ ID NO: 187955 - protein, 36 aa, Artificial Sequence
  Description of Artificial Sequence: Synthetic polypeptide
DESCIRTTNPVATEQYGCVFWAPNNNRSIRIDDQNL

SEQ ID NO: 187956 - protein, 36 aa, Artificial Sequence
  Description of Artificial Sequence: Synthetic polypeptide
DESCIRTTNPVATEQYGCVFWPKSNNRSISIDDQNL

SEQ ID NO: 187957 - protein, 36 aa, Artificial Sequence
  Description of Artificial Sequence: Synthetic polypeptide
DESCIRTTNPVATEQYGCVFWPWNNNWSIRIDDQNL

SEQ ID NO: 187958 - protein, 35 aa, Artificial Sequence
  Description of Artificial Sequence: Synthetic polypeptide
DESCIRTTNPVATEQYGSCYNANNHSMEGGQTDMV

SEQ ID NO: 187959 - protein, 36 aa, Artificial Sequence
  Description of Artificial Sequence: Synthetic polypeptide
DESCIRTTNPVATEQYGSHWMTNNITQPEESQDDDG

SEQ ID NO: 187960 - protein, 34 aa, Artificial Sequence
  Description of Artificial Sequence: Synthetic polypeptide
DEAVEATTNPVAYEQWGCVYSVNNDRGEQGGNSM

SEQ ID NO: 187961 - protein, 36 aa, Artificial Sequence
  Description of Artificial Sequence: Synthetic polypeptide
DEQTEIATTNPVAYEQWGSVCFTVEMNDRQPDGHKA

SEQ ID NO: 187962 - protein, 36 aa, Artificial Sequence
  Description of Artificial Sequence: Synthetic polypeptide
DESCIRTTNPVATEQYGTVWMTVNITQPEEQQDDDQ

SEQ ID NO: 187963 - protein, 35 aa, Artificial Sequence
  Description of Artificial Sequence: Synthetic polypeptide
CEEEIACTNPVATEQYGSACAANPQQEHQMGTEMK

SEQ ID NO: 187964 - protein, 37 aa, Artificial Sequence
  Description of Artificial Sequence: Synthetic polypeptide
CEEEIACTNPVATEQYGSCAAGGNGGTNPDDQTGDRV

SEQ ID NO: 187965 - protein, 35 aa, Artificial Sequence
  Description of Artificial Sequence: Synthetic polypeptide
DEAVGATTNPVAYEQWGVACSTNDLHDQNGQNGSQ

SEQ ID NO: 187966 - protein, 36 aa, Artificial Sequence
  Description of Artificial Sequence: Synthetic polypeptide
DESAEIATTNPVAYEQWGSVSGGNGNESGLEGDGTS

SEQ ID NO: 187967 - protein, 36 aa, Artificial Sequence
  Description of Artificial Sequence: Synthetic polypeptide
DESAEIATTNPVAYEQWGSSVIDNEHERAGNGDGQS

SEQ ID NO: 187968 - protein, 36 aa, Artificial Sequence
  Description of Artificial Sequence: Synthetic polypeptide
DEREIRTTNPCAYEGYGSCPSCTMNELSGTGGDQVL

SEQ ID NO: 187969 - protein, 36 aa, Artificial Sequence
  Description of Artificial Sequence: Synthetic polypeptide
DEAVIGTTNPVATEQWGCVCSTEDLNQEYFGSDTQA

SEQ ID NO: 187970 - protein, 36 aa, Artificial Sequence
  Description of Artificial Sequence: Synthetic polypeptide
CEEEIACTNPVATEQYGSACSPNPEQNEHQDGTESK

SEQ ID NO: 187971 - protein, 36 aa, Artificial Sequence
  Description of Artificial Sequence: Synthetic polypeptide
CEEEIACTNPVATEQYGSACSPADNHQEAEDPMENQ

SEQ ID NO: 187972 - protein, 35 aa, Artificial Sequence
  Description of Artificial Sequence: Synthetic polypeptide
DEAVIGTTNPVATEQWGCVCSTGEDDNQYFNSDQS

SEQ ID NO: 187973 - protein, 37 aa, Artificial Sequence
  Description of Artificial Sequence: Synthetic polypeptide
CEEEIACTNPVATEQYGSACSATNPHEAEAPGGNMHW

SEQ ID NO: 187974 - protein, 37 aa, Artificial Sequence
  Description of Artificial Sequence: Synthetic polypeptide
CEEEIACTNPVATEQYGSACSAQNPLPAEAPIGDNHN

SEQ ID NO: 187975 - protein, 36 aa, Artificial Sequence
  Description of Artificial Sequence: Synthetic polypeptide
CEEEIACTNPVATEQYGSACSANPQGQEHQDGTEMK

SEQ ID NO: 187976 - protein, 37 aa, Artificial Sequence
  Description of Artificial Sequence: Synthetic polypeptide
CEEEIACTNPVATEQYGSACSANPPAPLTAGNPNDDQ

SEQ ID NO: 187977 - protein, 36 aa, Artificial Sequence
  Description of Artificial Sequence: Synthetic polypeptide
CEEEIACTNPVATEQYGSACSANPNLQDSPDEEADE

SEQ ID NO: 187978 - protein, 36 aa, Artificial Sequence
  Description of Artificial Sequence: Synthetic polypeptide
CEEEIACTNPVATEQYGSACSANPGQTEHQDGTEMK

SEQ ID NO: 187979 - protein, 36 aa, Artificial Sequence
  Description of Artificial Sequence: Synthetic polypeptide
CEEEIACTNPVATEQYGSACAANPQPQEHQDGTVHR

SEQ ID NO: 187980 - protein, 36 aa, Artificial Sequence
  Description of Artificial Sequence: Synthetic polypeptide
CEEEIACTNPVATEQYGSACSANDIGQNHADEQGTP

SEQ ID NO: 187981 - protein, 36 aa, Artificial Sequence
  Description of Artificial Sequence: Synthetic polypeptide
CEEEIACTNPVATEQYGSACSADNPLPAEAPIGDHL

SEQ ID NO: 187982 - protein, 34 aa, Artificial Sequence
  Description of Artificial Sequence: Synthetic polypeptide
DEAVIGTTNPVATEQWGCVCSWGEDHQYFGSDQA

SEQ ID NO: 187983 - protein, 36 aa, Artificial Sequence
  Description of Artificial Sequence: Synthetic polypeptide
CEEEIACTNPVATEQYGSACSAAPHDQDAGNDENGH

SEQ ID NO: 187984 - protein, 36 aa, Artificial Sequence
  Description of Artificial Sequence: Synthetic polypeptide
CEEEIACTNPVATEQYGSACSAANPQQEHQDGTEHK

SEQ ID NO: 187985 - protein, 36 aa, Artificial Sequence
  Description of Artificial Sequence: Synthetic polypeptide
CEEEIACTNPVATEQYGSACSAANPLPAEAGIGDHQ

SEQ ID NO: 187986 - protein, 36 aa, Artificial Sequence
  Description of Artificial Sequence: Synthetic polypeptide
CEEEIACTNPVATEQYGSACSAANPLEAEAPIGEHQ

SEQ ID NO: 187987 - protein, 36 aa, Artificial Sequence
  Description of Artificial Sequence: Synthetic polypeptide
CEEEIACTNPVATEQYGSACSAANPLAEAEMGPGMY

SEQ ID NO: 187988 - protein, 36 aa, Artificial Sequence
  Description of Artificial Sequence: Synthetic polypeptide
DEREISTTNPVATEQYGCVCSNWEEHNQENFGSDQA

SEQ ID NO: 187989 - protein, 35 aa, Artificial Sequence
  Description of Artificial Sequence: Synthetic polypeptide
DEREISTTNPVATEQYGQCVCSWGEHNQNFISEQS

SEQ ID NO: 187990 - protein, 36 aa, Artificial Sequence
  Description of Artificial Sequence: Synthetic polypeptide
DERNEIATTNPVAYEQWGSVSGPNGNANGNEGDTTT

SEQ ID NO: 187991 - protein, 35 aa, Artificial Sequence
  Description of Artificial Sequence: Synthetic polypeptide
DERVEIATTNPVAYEKWGEVATGGNTGNAGNDNQR

SEQ ID NO: 187992 - protein, 36 aa, Artificial Sequence
  Description of Artificial Sequence: Synthetic polypeptide
CEEEIACTNPVATEQYGSACSAGDLGQNHADENGHH

SEQ ID NO: 187993 - protein, 36 aa, Artificial Sequence
  Description of Artificial Sequence: Synthetic polypeptide
DEAEISTVNPVATEQYGCVCSWEDHNAENFGSQNQA

SEQ ID NO: 187994 - protein, 36 aa, Artificial Sequence
  Description of Artificial Sequence: Synthetic polypeptide
CEEEIACTNPVATEQYGSACAANPQPQEHQDGNQHH

SEQ ID NO: 187995 - protein, 35 aa, Artificial Sequence
  Description of Artificial Sequence: Synthetic polypeptide
DEQSEIATTNPVAYEQWGSVVCNAAMPREDREDTA

SEQ ID NO: 187996 - protein, 34 aa, Artificial Sequence
  Description of Artificial Sequence: Synthetic polypeptide
DECEIATTNPCATEHWGSVCYNNDDQDHGDQDHA

SEQ ID NO: 187997 - protein, 34 aa, Artificial Sequence
  Description of Artificial Sequence: Synthetic polypeptide
DECEIATTNPCATEHWGSVCYNNDDQDHQDNDHE

SEQ ID NO: 187998 - protein, 34 aa, Artificial Sequence
  Description of Artificial Sequence: Synthetic polypeptide
DEASIATTNPTAYEQWGSYYIFDNDLKRSNGGVR

SEQ ID NO: 187999 - protein, 37 aa, Artificial Sequence
  Description of Artificial Sequence: Synthetic polypeptide
CEEEIACTNPVATEQYGSCAATGNHHPLDSAEGNPND

SEQ ID NO: 188000 - protein, 37 aa, Artificial Sequence
  Description of Artificial Sequence: Synthetic polypeptide
DEANEIATTNPVAYEQYGSVAITPHEEANGDGMGDRH

SEQ ID NO: 188001 - protein, 37 aa, Artificial Sequence
  Description of Artificial Sequence: Synthetic polypeptide
DEQEITTTNPVATEFYGSVSATGDQGDEDQETGEDGQ

SEQ ID NO: 188002 - protein, 36 aa, Artificial Sequence
  Description of Artificial Sequence: Synthetic polypeptide
DEAIIRTTNPVATDCWGSVSRCINEPQVRDDENLGE

SEQ ID NO: 188003 - protein, 37 aa, Artificial Sequence
  Description of Artificial Sequence: Synthetic polypeptide
DEAGEIATTNPVAYEQYGTVATSNGGDQQNGGQRGEA

SEQ ID NO: 188004 - protein, 36 aa, Artificial Sequence
  Description of Artificial Sequence: Synthetic polypeptide
DEAGEIATTNPVAYEQWGSVSGGNGNESGNEGDNTS

SEQ ID NO: 188005 - protein, 35 aa, Artificial Sequence
  Description of Artificial Sequence: Synthetic polypeptide
DEAGEIATTNPVAYEQWGSVSGGNGNESGEGGGTS

SEQ ID NO: 188006 - protein, 35 aa, Artificial Sequence
  Description of Artificial Sequence: Synthetic polypeptide
DEAGEIATTNPVAYEQWGSVSGGNGNESGEGDGST

SEQ ID NO: 188007 - protein, 38 aa, Artificial Sequence
  Description of Artificial Sequence: Synthetic polypeptide
DEQEIRTTNPVGTEQYGSVVMSVNDNNTGGGQTGQSGD

SEQ ID NO: 188008 - protein, 36 aa, Artificial Sequence
  Description of Artificial Sequence: Synthetic polypeptide
CEEEIACTNPVATEQYGSCPATGAIGAPGAQMENRM

SEQ ID NO: 188009 - protein, 35 aa, Artificial Sequence
  Description of Artificial Sequence: Synthetic polypeptide
CEEEIACTNPVATEQYGSCVAAGNPDNADPQGVHN

SEQ ID NO: 188010 - protein, 38 aa, Artificial Sequence
  Description of Artificial Sequence: Synthetic polypeptide
DEQEIRTTNPVAYEQYGESMVSPSVTLEQKEEVGEPVD

SEQ ID NO: 188011 - protein, 36 aa, Artificial Sequence
  Description of Artificial Sequence: Synthetic polypeptide
DEAEIYTTNPVATECWGSVSRCINEPQVHDDENLGE

SEQ ID NO: 188012 - protein, 32 aa, Artificial Sequence
  Description of Artificial Sequence: Synthetic polypeptide
DESEIASTNPVSTEGWGNVAAAETIQSRVGPI

SEQ ID NO: 188013 - protein, 36 aa, Artificial Sequence
  Description of Artificial Sequence: Synthetic polypeptide
DEQEIRTTNPVATESYGMVSVEGMGMGGQGQEGEQT

SEQ ID NO: 188014 - protein, 38 aa, Artificial Sequence
  Description of Artificial Sequence: Synthetic polypeptide
CEEEIACTNPVATEQYGSVACSAENPLPAEAPIGDNHM

SEQ ID NO: 188015 - protein, 36 aa, Artificial Sequence
  Description of Artificial Sequence: Synthetic polypeptide
DEAEISTVNPVATEQYGCVCSWGEDHNANFGSNNQA

SEQ ID NO: 188016 - protein, 38 aa, Artificial Sequence
  Description of Artificial Sequence: Synthetic polypeptide
DEQEIRTTNPVATEQYGVVMTNNDNNTEGPEQTGQTGD

SEQ ID NO: 188017 - protein, 38 aa, Artificial Sequence
  Description of Artificial Sequence: Synthetic polypeptide
DEQEIRTTNPVATEQYGVVMSNNDNDTGGPGQTGQQGD

SEQ ID NO: 188018 - protein, 37 aa, Artificial Sequence
  Description of Artificial Sequence: Synthetic polypeptide
DEQEIRTTNPVATEQYGVVMENNDNVTGGGQTGQTGD

SEQ ID NO: 188019 - protein, 35 aa, Artificial Sequence
  Description of Artificial Sequence: Synthetic polypeptide
CEEEIACTNPVATEQYGSACAANDLATAAIGESDM

SEQ ID NO: 188020 - protein, 35 aa, Artificial Sequence
  Description of Artificial Sequence: Synthetic polypeptide
DEAVISTTNPVATEQYGCFHNKTNQPQTFIINNAP

SEQ ID NO: 188021 - protein, 34 aa, Artificial Sequence
  Description of Artificial Sequence: Synthetic polypeptide
DEASIATTNPTAYEQWGSYYSIDHDGKRSNGGNR

SEQ ID NO: 188022 - protein, 34 aa, Artificial Sequence
  Description of Artificial Sequence: Synthetic polypeptide
DEASIATTNPTAYEQWGSYYSNDNDGKRSNQGNW

SEQ ID NO: 188023 - protein, 36 aa, Artificial Sequence
  Description of Artificial Sequence: Synthetic polypeptide
CEEEIACTNPVATEQYGSACAANPQPQEHQDGNAGQ

SEQ ID NO: 188024 - protein, 36 aa, Artificial Sequence
  Description of Artificial Sequence: Synthetic polypeptide
DESCISTTNPVATEQYGSVWMTNNITQPEESQDDDE

SEQ ID NO: 188025 - protein, 36 aa, Artificial Sequence
  Description of Artificial Sequence: Synthetic polypeptide
CEEEIACTNPVATEQYGSACAANPQGQEHQDGNVHQ

SEQ ID NO: 188026 - protein, 34 aa, Artificial Sequence
  Description of Artificial Sequence: Synthetic polypeptide
DEAVEATTNPVAYEQWGCVYSVNNDAGEQGGNKE

SEQ ID NO: 188027 - protein, 35 aa, Artificial Sequence
  Description of Artificial Sequence: Synthetic polypeptide
DEAVEATTNPVAYEQWGCVYSTNNDQTGEQGGNEM

SEQ ID NO: 188028 - protein, 35 aa, Artificial Sequence
  Description of Artificial Sequence: Synthetic polypeptide
DEAVEATTNPVAYEQWGCVYSTNNDLGEQGGDEEM

SEQ ID NO: 188029 - protein, 35 aa, Artificial Sequence
  Description of Artificial Sequence: Synthetic polypeptide
DEAVEATTNPVAYEQWGCVYSNNNDLNGEQGGNEM

SEQ ID NO: 188030 - protein, 34 aa, Artificial Sequence
  Description of Artificial Sequence: Synthetic polypeptide
DEAVEATTNPVAYEQWGCVYSMNNDLGEQGGQEM

SEQ ID NO: 188031 - protein, 34 aa, Artificial Sequence
  Description of Artificial Sequence: Synthetic polypeptide
DEAVEATTNPVAYEQWGCVYSENNDAGEQGGNIM

SEQ ID NO: 188032 - protein, 34 aa, Artificial Sequence
  Description of Artificial Sequence: Synthetic polypeptide
DEATIATTNPVAYERWGSTYSMNNGINDHGQNER

SEQ ID NO: 188033 - protein, 36 aa, Artificial Sequence
  Description of Artificial Sequence: Synthetic polypeptide
DEATEIATTNPVAYERWGSVSGGNADDSRNNGQGNK

SEQ ID NO: 188034 - protein, 35 aa, Artificial Sequence
  Description of Artificial Sequence: Synthetic polypeptide
DEAVEATTNPVAYEQWGCVYSVNNDLGEQGGGNET

SEQ ID NO: 188035 - protein, 36 aa, Artificial Sequence
  Description of Artificial Sequence: Synthetic polypeptide
DEATEIATTNPVAYERWGSVSGGNADDSRNNGNDNP

SEQ ID NO: 188036 - protein, 37 aa, Artificial Sequence
  Description of Artificial Sequence: Synthetic polypeptide
DESEIAATNPVATEPYGSVCIWVQNDQRDDRRNGNHS

SEQ ID NO: 188037 - protein, 37 aa, Artificial Sequence
  Description of Artificial Sequence: Synthetic polypeptide
DESEIAATNPVATEPYGSVCIWVQNDQRDEERGGNTS

SEQ ID NO: 188038 - protein, 37 aa, Artificial Sequence
  Description of Artificial Sequence: Synthetic polypeptide
DESEIAATNPVATEPYGSVCIWVQNDQRDPRQGGNTS

SEQ ID NO: 188039 - protein, 37 aa, Artificial Sequence
  Description of Artificial Sequence: Synthetic polypeptide
DESEIAATNPVATEPYGSVCIWVQNDQRDQRQNGNNS

SEQ ID NO: 188040 - protein, 36 aa, Artificial Sequence
  Description of Artificial Sequence: Synthetic polypeptide
DEATEIATTNPVAYECWGVVCSTDNGNQVQDGDGRR

SEQ ID NO: 188041 - protein, 35 aa, Artificial Sequence
  Description of Artificial Sequence: Synthetic polypeptide
CEEEIACTNPVATEQYGSACAANNIETEAPGGNMH

SEQ ID NO: 188042 - protein, 34 aa, Artificial Sequence
  Description of Artificial Sequence: Synthetic polypeptide
DESEIACTNPVAYEQWGCVAGNGLQAAPDGSAMN

SEQ ID NO: 188043 - protein, 36 aa, Artificial Sequence
  Description of Artificial Sequence: Synthetic polypeptide
DEATEIATTNPVAYECWGVVCSTDNGHQEQDGDGKR

SEQ ID NO: 188044 - protein, 35 aa, Artificial Sequence
  Description of Artificial Sequence: Synthetic polypeptide
DEATEIATTNPVAYECWGSVYHPNNDTQNGGRNEA

SEQ ID NO: 188045 - protein, 35 aa, Artificial Sequence
  Description of Artificial Sequence: Synthetic polypeptide
CEEEIACTNPVATEQYGSACAANNIETEAPGENTP

SEQ ID NO: 188046 - protein, 35 aa, Artificial Sequence
  Description of Artificial Sequence: Synthetic polypeptide
DEQENATTNPVAYEQWGSVCGDQRNDLQNGGGQQE

SEQ ID NO: 188047 - protein, 37 aa, Artificial Sequence
  Description of Artificial Sequence: Synthetic polypeptide
DESEIAATNPVATEPYGSVCIWVQNDQDDQRRNGNTP

SEQ ID NO: 188048 - protein, 32 aa, Artificial Sequence
  Description of Artificial Sequence: Synthetic polypeptide
AETEIRTTNPIATEQWGATWSNEDWAPKGPYI

SEQ ID NO: 188049 - protein, 37 aa, Artificial Sequence
  Description of Artificial Sequence: Synthetic polypeptide
DEQEIRTTNPVATEQYGSCNEMVLNNNQQQEMQESQI

SEQ ID NO: 188050 - protein, 37 aa, Artificial Sequence
  Description of Artificial Sequence: Synthetic polypeptide
DEQEIRTTNPVATEQYGSAVNIPVTTLNEPEDVTEEN

SEQ ID NO: 188051 - protein, 36 aa, Artificial Sequence
  Description of Artificial Sequence: Synthetic polypeptide
DEQEIATTNPVAYEQYGSVATTGHGPLDSMENNDVD

SEQ ID NO: 188052 - protein, 37 aa, Artificial Sequence
  Description of Artificial Sequence: Synthetic polypeptide
DECEICTTNPVATTQYGVVATTNANLQQGTESGSTDY

SEQ ID NO: 188053 - protein, 36 aa, Artificial Sequence
  Description of Artificial Sequence: Synthetic polypeptide
DECEICTTNPVATTQYGVVATTNANQQGTESGSTDG

SEQ ID NO: 188054 - protein, 37 aa, Artificial Sequence
  Description of Artificial Sequence: Synthetic polypeptide
DECEICTTNPVATTQYGVVATTNAQLQQGTEAGSTDA

SEQ ID NO: 188055 - protein, 36 aa, Artificial Sequence
  Description of Artificial Sequence: Synthetic polypeptide
CEEEIATTNPVATEQYGSVCAAGPLGFAMMGDEEGN

SEQ ID NO: 188056 - protein, 36 aa, Artificial Sequence
  Description of Artificial Sequence: Synthetic polypeptide
DECEICTTNPVATTQYGVVATTQQLQQGTEAGTTDS

SEQ ID NO: 188057 - protein, 35 aa, Artificial Sequence
  Description of Artificial Sequence: Synthetic polypeptide
DEAEISTTNPVATEQYGCVCSMWGEHAENFGSDQS

SEQ ID NO: 188058 - protein, 34 aa, Artificial Sequence
  Description of Artificial Sequence: Synthetic polypeptide
DESEIRTTNPIATECWGATAAENEPADRKGENYG

SEQ ID NO: 188059 - protein, 33 aa, Artificial Sequence
  Description of Artificial Sequence: Synthetic polypeptide
DESEIRTTNPIATECWGATANCINWADPEGNYG

SEQ ID NO: 188060 - protein, 33 aa, Artificial Sequence
  Description of Artificial Sequence: Synthetic polypeptide
DESEIRTTNPIATECWGATSNAINEAEPEGPYI

SEQ ID NO: 188061 - protein, 33 aa, Artificial Sequence
  Description of Artificial Sequence: Synthetic polypeptide
DESEIRTTNPIATECWGATSNAINWAEPEGPYI

SEQ ID NO: 188062 - protein, 34 aa, Artificial Sequence
  Description of Artificial Sequence: Synthetic polypeptide
DESEIRTTNPIATECWGATTAAENWPQDPEGNYI

SEQ ID NO: 188063 - protein, 35 aa, Artificial Sequence
  Description of Artificial Sequence: Synthetic polypeptide
DESEIRTTNPIATECWGATVANAINWQEPKGENYI

SEQ ID NO: 188064 - protein, 35 aa, Artificial Sequence
  Description of Artificial Sequence: Synthetic polypeptide
DESEIRTTNPIATECWGATVWANAIDWQEPKGNYI

SEQ ID NO: 188065 - protein, 35 aa, Artificial Sequence
  Description of Artificial Sequence: Synthetic polypeptide
DESEIRTTNPIATECWGATVWANAINWQEPKGNYI

SEQ ID NO: 188066 - protein, 34 aa, Artificial Sequence
  Description of Artificial Sequence: Synthetic polypeptide
DESEIRTTNPIATECWGATWACENWPQEREGPYI

SEQ ID NO: 188067 - protein, 33 aa, Artificial Sequence
  Description of Artificial Sequence: Synthetic polypeptide
DESEIRTTNPIATECWGATWACENWQEPEGPYI

SEQ ID NO: 188068 - protein, 36 aa, Artificial Sequence
  Description of Artificial Sequence: Synthetic polypeptide
CEEEIATTNPVATEQYGSVCAANMGEEAPDDGMEDA

SEQ ID NO: 188069 - protein, 36 aa, Artificial Sequence
  Description of Artificial Sequence: Synthetic polypeptide
CEEEIATTNPVATEQYGSVCAGMTHGGAEAPIGDSN

SEQ ID NO: 188070 - protein, 36 aa, Artificial Sequence
  Description of Artificial Sequence: Synthetic polypeptide
DEAEISTTNPVATEQYGCVCSMWEEHNQENFGSDQE

SEQ ID NO: 188071 - protein, 35 aa, Artificial Sequence
  Description of Artificial Sequence: Synthetic polypeptide
DEQEIATTNPVAYEQYGSTVCAANNEQDATLTKDQ

SEQ ID NO: 188072 - protein, 35 aa, Artificial Sequence
  Description of Artificial Sequence: Synthetic polypeptide
DESEIRTTNPIATECWGSVWANAEDWPAERKGPYG

SEQ ID NO: 188073 - protein, 32 aa, Artificial Sequence
  Description of Artificial Sequence: Synthetic polypeptide
DESEIRTTNPIATEGWGATWAAEDLAEHGPYI

SEQ ID NO: 188074 - protein, 37 aa, Artificial Sequence
  Description of Artificial Sequence: Synthetic polypeptide
DEQEIATTNPVAYEQYGSVCAAANVLMQEATEHANDS

SEQ ID NO: 188075 - protein, 34 aa, Artificial Sequence
  Description of Artificial Sequence: Synthetic polypeptide
DESEIRTTNPCAYEQWGVVCYNNLIDDDGIGGHG

SEQ ID NO: 188076 - protein, 38 aa, Artificial Sequence
  Description of Artificial Sequence: Synthetic polypeptide
DECEICTTNPVATEQYGVVSTVVNQAGNTNQQGTDEEE

SEQ ID NO: 188077 - protein, 38 aa, Artificial Sequence
  Description of Artificial Sequence: Synthetic polypeptide
DECEICTTNPVATEQYGVVSTVVNQAGNNEQQGTDEEA

SEQ ID NO: 188078 - protein, 36 aa, Artificial Sequence
  Description of Artificial Sequence: Synthetic polypeptide
DEAEISTTNPVATEQYGCVCSNWGEHQENFGSDTQA

SEQ ID NO: 188079 - protein, 37 aa, Artificial Sequence
  Description of Artificial Sequence: Synthetic polypeptide
DEAEISTTNPVATEQYGCVCSNWGEHNTENFGSENQS

SEQ ID NO: 188080 - protein, 32 aa, Artificial Sequence
  Description of Artificial Sequence: Synthetic polypeptide
DESEIRSTNPVGTEGYGVTWANATWAEHGDYI

SEQ ID NO: 188081 - protein, 37 aa, Artificial Sequence
  Description of Artificial Sequence: Synthetic polypeptide
DEAEISTTNPVATEQYGCVCSNWGEHNQENFGSDNQS

SEQ ID NO: 188082 - protein, 37 aa, Artificial Sequence
  Description of Artificial Sequence: Synthetic polypeptide
DEAEISTTNPVATEQYGCVCSNWGEHNQEGFNSDNQA

SEQ ID NO: 188083 - protein, 36 aa, Artificial Sequence
  Description of Artificial Sequence: Synthetic polypeptide
CEEEIATTNPVATEQYGSACAANPELGQLHQDDQHQ

SEQ ID NO: 188084 - protein, 37 aa, Artificial Sequence
  Description of Artificial Sequence: Synthetic polypeptide
DEAEISTTNPVATEQYGCVCSNWGEDNTENFNSENQA

SEQ ID NO: 188085 - protein, 36 aa, Artificial Sequence
  Description of Artificial Sequence: Synthetic polypeptide
CEEEIATTNPVATEQYGSACSADNPLPAEAPIEDHQ

SEQ ID NO: 188086 - protein, 37 aa, Artificial Sequence
  Description of Artificial Sequence: Synthetic polypeptide
CEEEIATTNPVATEQYGSACSADNPLPAEAPIGDLHK

SEQ ID NO: 188087 - protein, 38 aa, Artificial Sequence
  Description of Artificial Sequence: Synthetic polypeptide
CEEEIATTNPVATEQYGSTACAATNPEEAPDDQDGTNP

SEQ ID NO: 188088 - protein, 36 aa, Artificial Sequence
  Description of Artificial Sequence: Synthetic polypeptide
DEQEIATTNPVAYERWGSVCSTTDNHDRQGGMQEEE

SEQ ID NO: 188089 - protein, 37 aa, Artificial Sequence
  Description of Artificial Sequence: Synthetic polypeptide
DEQEIATTNPVAYEQWGVVVHTDQVLDDQDRTGEGRG

SEQ ID NO: 188090 - protein, 35 aa, Artificial Sequence
  Description of Artificial Sequence: Synthetic polypeptide
DEQEIATTNPVAYERWGSVCSTIDNINGDGGQEQQ

SEQ ID NO: 188091 - protein, 37 aa, Artificial Sequence
  Description of Artificial Sequence: Synthetic polypeptide
DESEIRTTNCVATDAYGAVSNVTRGNQGQLEGGNGDT

SEQ ID NO: 188092 - protein, 35 aa, Artificial Sequence
  Description of Artificial Sequence: Synthetic polypeptide
DESEIRTTNCVATDAYGSVNMFGFQGQLEGGNGDT

SEQ ID NO: 188093 - protein, 37 aa, Artificial Sequence
  Description of Artificial Sequence: Synthetic polypeptide
DESEIRTTNCVATEQYGVVSVDDNDQGQGDQGQGEGV

SEQ ID NO: 188094 - protein, 38 aa, Artificial Sequence
  Description of Artificial Sequence: Synthetic polypeptide
DESEIRTTNCVATEQYGVVSVVDDNMNGQEDQGIGENT

SEQ ID NO: 188095 - protein, 37 aa, Artificial Sequence
  Description of Artificial Sequence: Synthetic polypeptide
DEQEIATTNPVAYEQYGTVCSYTDGLPENDEGQDGDS

SEQ ID NO: 188096 - protein, 37 aa, Artificial Sequence
  Description of Artificial Sequence: Synthetic polypeptide
DEQEIATTNPVAYEQYGSVVAAVAGELQDGLGLNDSF

SEQ ID NO: 188097 - protein, 36 aa, Artificial Sequence
  Description of Artificial Sequence: Synthetic polypeptide
DEQEIATTNPVAYEQYGSVVAAAAGELQDSLDLNDM

SEQ ID NO: 188098 - protein, 38 aa, Artificial Sequence
  Description of Artificial Sequence: Synthetic polypeptide
CEEEIATTNPVATEQYGSVACSADNPALPAEAPIGDHK

SEQ ID NO: 188099 - protein, 36 aa, Artificial Sequence
  Description of Artificial Sequence: Synthetic polypeptide
DEAEISTTNPVATEQYGCVCSNWEEHNAENFNSDQS

SEQ ID NO: 188100 - protein, 37 aa, Artificial Sequence
  Description of Artificial Sequence: Synthetic polypeptide
DEQEIATTNPVAYEQYGSVSPTGEAGINPRDGMEKVH

SEQ ID NO: 188101 - protein, 38 aa, Artificial Sequence
  Description of Artificial Sequence: Synthetic polypeptide
DECEICTTNPVATEQYGVVSTVVATNQQAGTEAGTEDN

SEQ ID NO: 188102 - protein, 35 aa, Artificial Sequence
  Description of Artificial Sequence: Synthetic polypeptide
DEQEIATTNPVAYERWGSTCVNGDNMDHNRDGNDL

SEQ ID NO: 188103 - protein, 38 aa, Artificial Sequence
  Description of Artificial Sequence: Synthetic polypeptide
DECEICTTNPVATEQYGVVSTVNQQNNTEQGTTEELGQ

SEQ ID NO: 188104 - protein, 33 aa, Artificial Sequence
  Description of Artificial Sequence: Synthetic polypeptide
DEQEIATTNPVAYEQWGTVCAATDGPEEFEIND

SEQ ID NO: 188105 - protein, 35 aa, Artificial Sequence
  Description of Artificial Sequence: Synthetic polypeptide
DEQEIATTNPVAYEQWGSVVCNAAMPREDREDTHS

SEQ ID NO: 188106 - protein, 37 aa, Artificial Sequence
  Description of Artificial Sequence: Synthetic polypeptide
CEDEIRTTNPVATEFYGSVDNGFNVGQEIGGQGGNGN

SEQ ID NO: 188107 - protein, 36 aa, Artificial Sequence
  Description of Artificial Sequence: Synthetic polypeptide
CEDEIRTTNPVATEFYGQVVDTIMNGEGQDNDGGGI

SEQ ID NO: 188108 - protein, 34 aa, Artificial Sequence
  Description of Artificial Sequence: Synthetic polypeptide
CEDEIATTNPVAYEQYGSVFAGNNGDADTNPDFE

SEQ ID NO: 188109 - protein, 36 aa, Artificial Sequence
  Description of Artificial Sequence: Synthetic polypeptide
DESEIRTTNPVATEAWGCVCSNWMNENQENFGSDQS

SEQ ID NO: 188110 - protein, 37 aa, Artificial Sequence
  Description of Artificial Sequence: Synthetic polypeptide
DEQEIATTNPVAYEQWGMVSIPGAGNAGDQRKGDNPN

SEQ ID NO: 188111 - protein, 35 aa, Artificial Sequence
  Description of Artificial Sequence: Synthetic polypeptide
DEQEIATTNPVAYEQWGITCSATDNNDHQQGDDDY

SEQ ID NO: 188112 - protein, 36 aa, Artificial Sequence
  Description of Artificial Sequence: Synthetic polypeptide
DESEIRTTNPVATEAWGQCVCSWMEENQENFGSNQS

SEQ ID NO: 188113 - protein, 34 aa, Artificial Sequence
  Description of Artificial Sequence: Synthetic polypeptide
DEQEIATTNPVAYEQWGHCNVAANTNLATPADPW

SEQ ID NO: 188114 - protein, 34 aa, Artificial Sequence
  Description of Artificial Sequence: Synthetic polypeptide
DEQEIATTNPVAYEQWGHCNVAANTGLATPANPH

SEQ ID NO: 188115 - protein, 38 aa, Artificial Sequence
  Description of Artificial Sequence: Synthetic polypeptide
DECEICTVNPVATEQYGVVSSTTQNLQQGTEQGSTTDD

SEQ ID NO: 188116 - protein, 37 aa, Artificial Sequence
  Description of Artificial Sequence: Synthetic polypeptide
DECEICTVNPVATEQYGVVSTQQQLQQGTEQGSTVVD

SEQ ID NO: 188117 - protein, 37 aa, Artificial Sequence
  Description of Artificial Sequence: Synthetic polypeptide
DECEICTVNPVATEQYGVVSTTQQLQQGTEQGTVVTE

SEQ ID NO: 188118 - protein, 37 aa, Artificial Sequence
  Description of Artificial Sequence: Synthetic polypeptide
DECEIGTTNPVATEFYGSVSVTGDQGQEDQEGTEDGD

SEQ ID NO: 188119 - protein, 35 aa, Artificial Sequence
  Description of Artificial Sequence: Synthetic polypeptide
DECEIGTTNPVAYEEWGCVATTGGNTGNAGNDDQR

SEQ ID NO: 188120 - protein, 37 aa, Artificial Sequence
  Description of Artificial Sequence: Synthetic polypeptide
DESEIRTTNPVATEAYGQVVVVDNFDQSGNQGQEFED

SEQ ID NO: 188121 - protein, 36 aa, Artificial Sequence
  Description of Artificial Sequence: Synthetic polypeptide
DEQEIATTNPVAYEQWGEVCSTPNQGNHPEAGDGRN

SEQ ID NO: 188122 - protein, 34 aa, Artificial Sequence
  Description of Artificial Sequence: Synthetic polypeptide
DEQEIATTNPVAYEQWGCNVAANNGLADTPGDPY

SEQ ID NO: 188123 - protein, 34 aa, Artificial Sequence
  Description of Artificial Sequence: Synthetic polypeptide
DESEIRTTNPVATECWGATTANAIDWQEPEGPYI

SEQ ID NO: 188124 - protein, 34 aa, Artificial Sequence
  Description of Artificial Sequence: Synthetic polypeptide
DESEIRTTNPVATECWGATTANCIDWQEPEGPYI

SEQ ID NO: 188125 - protein, 34 aa, Artificial Sequence
  Description of Artificial Sequence: Synthetic polypeptide
DESEIRTTNPVATECWGATVANAIDWPAEREGPI

SEQ ID NO: 188126 - protein, 35 aa, Artificial Sequence
  Description of Artificial Sequence: Synthetic polypeptide
DEQEIATTNPVAYEPWGSVTGLNENDQQGNMGNTQ

SEQ ID NO: 188127 - protein, 35 aa, Artificial Sequence
  Description of Artificial Sequence: Synthetic polypeptide
DESEIRTTNPVATECWGATWANAIDWQEPKGENYG

SEQ ID NO: 188128 - protein, 36 aa, Artificial Sequence
  Description of Artificial Sequence: Synthetic polypeptide
DESEIRTTNPVATECWGATWANCIDWPQERKGENYG

SEQ ID NO: 188129 - protein, 37 aa, Artificial Sequence
  Description of Artificial Sequence: Synthetic polypeptide
CEDEIRTTNPVATEFYGSVNGFNNGQEINGQGGNEGQ

SEQ ID NO: 188130 - protein, 37 aa, Artificial Sequence
  Description of Artificial Sequence: Synthetic polypeptide
DEQEIATTNPVAYEQWGSCSATEDRNLNDHQGDEDDR

SEQ ID NO: 188131 - protein, 36 aa, Artificial Sequence
  Description of Artificial Sequence: Synthetic polypeptide
DEQEIATTNPVAYEQWGSCSATEDRNNDHQRDEDSH

SEQ ID NO: 188132 - protein, 35 aa, Artificial Sequence
  Description of Artificial Sequence: Synthetic polypeptide
DEQEIATTNPVAYEQWGSCSPTDNHNEHQDDSDDP

SEQ ID NO: 188133 - protein, 35 aa, Artificial Sequence
  Description of Artificial Sequence: Synthetic polypeptide
DEQEIATTNPVAYEQWGSVVCNAAMPREDREDMAM

SEQ ID NO: 188134 - protein, 34 aa, Artificial Sequence
  Description of Artificial Sequence: Synthetic polypeptide
DEQEIATTNPVAYEQWGSVVCNAAMPREDIEDTQ

SEQ ID NO: 188135 - protein, 34 aa, Artificial Sequence
  Description of Artificial Sequence: Synthetic polypeptide
DEQEIATTNPVAYEQWGSVVCNAAMPREDAEDPG

SEQ ID NO: 188136 - protein, 35 aa, Artificial Sequence
  Description of Artificial Sequence: Synthetic polypeptide
DEQEIATTNPVAYEQWGSVVCNAAMPREDAEDHRR

SEQ ID NO: 188137 - protein, 34 aa, Artificial Sequence
  Description of Artificial Sequence: Synthetic polypeptide
DEQEIATTNPVAYEQWGSVVCNAAMPMEDREEDA

SEQ ID NO: 188138 - protein, 36 aa, Artificial Sequence
  Description of Artificial Sequence: Synthetic polypeptide
DEQEIATTNPVAYEQWGSVTGGNENDQQQNDMGNQP

SEQ ID NO: 188139 - protein, 36 aa, Artificial Sequence
  Description of Artificial Sequence: Synthetic polypeptide
DEQEIATTNPVAYEQWGSVTGGNENDQQGNMGNNPA

SEQ ID NO: 188140 - protein, 36 aa, Artificial Sequence
  Description of Artificial Sequence: Synthetic polypeptide
DEQEIATTNPVAYEQWGSVTGGNENDQQGNMGNGGE

SEQ ID NO: 188141 - protein, 37 aa, Artificial Sequence
  Description of Artificial Sequence: Synthetic polypeptide
CEEEIATTNPVATEQYGSVCAMTVHPTAPDAQMENNV

SEQ ID NO: 188142 - protein, 36 aa, Artificial Sequence
  Description of Artificial Sequence: Synthetic polypeptide
DEAEISTTNPVATEQYGCAVCSWEEHNQENFNSEQA

SEQ ID NO: 188143 - protein, 38 aa, Artificial Sequence
  Description of Artificial Sequence: Synthetic polypeptide
DECEICTTNPVAVEQYGSVSTVNNNPNSEQGSTNNVED

SEQ ID NO: 188144 - protein, 35 aa, Artificial Sequence
  Description of Artificial Sequence: Synthetic polypeptide
DEQEIATTNPVAYEQWGSVYGTGAPGEQEQGGGDH

SEQ ID NO: 188145 - protein, 38 aa, Artificial Sequence
  Description of Artificial Sequence: Synthetic polypeptide
DECEICTTNPVAVEQYGSVSTVPVNENSEQGSTTNVED

SEQ ID NO: 188146 - protein, 38 aa, Artificial Sequence
  Description of Artificial Sequence: Synthetic polypeptide
DECEICTTNPVAVEQYGSVSTVTTNNNAEQGSTNNTED

SEQ ID NO: 188147 - protein, 36 aa, Artificial Sequence
  Description of Artificial Sequence: Synthetic polypeptide
DEQEIATTNPVAYEQWGSVCPNDSNGDDQGGNNLIP

SEQ ID NO: 188148 - protein, 36 aa, Artificial Sequence
  Description of Artificial Sequence: Synthetic polypeptide
DEQEIATTNPVAYEQWGSTCSTTDNNNDHQGDDGGY

SEQ ID NO: 188149 - protein, 35 aa, Artificial Sequence
  Description of Artificial Sequence: Synthetic polypeptide
DEQEIATTNPVAYEQWGSTCSPTDNNDHQGDDLDE

SEQ ID NO: 188150 - protein, 35 aa, Artificial Sequence
  Description of Artificial Sequence: Synthetic polypeptide
DESEIRTTNPVATCHYGCVCSNWEDNQEYFNSDQS

SEQ ID NO: 188151 - protein, 35 aa, Artificial Sequence
  Description of Artificial Sequence: Synthetic polypeptide
DESEIRTTNPVATCHYGCVCSNWNHNQENFTSDQA

SEQ ID NO: 188152 - protein, 35 aa, Artificial Sequence
  Description of Artificial Sequence: Synthetic polypeptide
DESEIRTTNPVATCHYGCVCSTEEHNQENFTSDQA

SEQ ID NO: 188153 - protein, 35 aa, Artificial Sequence
  Description of Artificial Sequence: Synthetic polypeptide
DESEIRTTNPVATCHYGCVCSWGEDNQEYFNSDQA

SEQ ID NO: 188154 - protein, 38 aa, Artificial Sequence
  Description of Artificial Sequence: Synthetic polypeptide
CEDEIRTTNPVATEQYGVVSILIATGDNDQDEFGGDGD

SEQ ID NO: 188155 - protein, 38 aa, Artificial Sequence
  Description of Artificial Sequence: Synthetic polypeptide
CEDEIRTTNPVATEQYGSVVNMGFNFNIDLEGGGENIN

SEQ ID NO: 188156 - protein, 36 aa, Artificial Sequence
  Description of Artificial Sequence: Synthetic polypeptide
CEDEIRTTNPVATEQYGSVNGVNNMDNNGGGDQEGT

SEQ ID NO: 188157 - protein, 38 aa, Artificial Sequence
  Description of Artificial Sequence: Synthetic polypeptide
DECEICTTNPVAVEQYGSVSTVTNNNNTEQGSTNNVED

SEQ ID NO: 188158 - protein, 36 aa, Artificial Sequence
  Description of Artificial Sequence: Synthetic polypeptide
DEQEIRTTNPVATEQYGSCFYDPPMLEEERPEQSQQ

SEQ ID NO: 188159 - protein, 36 aa, Artificial Sequence
  Description of Artificial Sequence: Synthetic polypeptide
DEAEISTTNPVATEQYGCVCSNWGPHNIENFNSEQS

SEQ ID NO: 188160 - protein, 34 aa, Artificial Sequence
  Description of Artificial Sequence: Synthetic polypeptide
CEDWIATTNPVATAQWGCVAAANHLQEAPGGNNQ

SEQ ID NO: 188161 - protein, 35 aa, Artificial Sequence
  Description of Artificial Sequence: Synthetic polypeptide
DEQEIRTTNPVATECWGSFGPCINEPEARIFENMG

SEQ ID NO: 188162 - protein, 34 aa, Artificial Sequence
  Description of Artificial Sequence: Synthetic polypeptide
DEQEIRTTNPVATECWGSFGPCIGEPEARETENG

SEQ ID NO: 188163 - protein, 34 aa, Artificial Sequence
  Description of Artificial Sequence: Synthetic polypeptide
DEQEIRTTNPVATECWGSFGPAINEPEAYETENG

SEQ ID NO: 188164 - protein, 35 aa, Artificial Sequence
  Description of Artificial Sequence: Synthetic polypeptide
DEQEIRTTNPVATECWGMSFGPCMNEPEARETENG

SEQ ID NO: 188165 - protein, 37 aa, Artificial Sequence
  Description of Artificial Sequence: Synthetic polypeptide
DEQEIRTTNPVATEAYGVVMSNNDNDTGGGQIGQVGD

SEQ ID NO: 188166 - protein, 37 aa, Artificial Sequence
  Description of Artificial Sequence: Synthetic polypeptide
DEQEIRTTNPVATDQYGVVMSNNDNDTGGGQTGQVGD

SEQ ID NO: 188167 - protein, 36 aa, Artificial Sequence
  Description of Artificial Sequence: Synthetic polypeptide
DESEIGTTNPVATEQYGAVCSAWDGPVEKFEGNSQE

SEQ ID NO: 188168 - protein, 37 aa, Artificial Sequence
  Description of Artificial Sequence: Synthetic polypeptide
DECEICTTNPVATEQYGTVATVELQQSATEEGTVTDD

SEQ ID NO: 188169 - protein, 37 aa, Artificial Sequence
  Description of Artificial Sequence: Synthetic polypeptide
DECEICTTNPVATEQYGTVATVLNQQSATEEGIVTDD

SEQ ID NO: 188170 - protein, 37 aa, Artificial Sequence
  Description of Artificial Sequence: Synthetic polypeptide
DECEICTTNPVATEQYGTVATVNQQQSATEEGVVTDD

SEQ ID NO: 188171 - protein, 36 aa, Artificial Sequence
  Description of Artificial Sequence: Synthetic polypeptide
CEEEIATTNPVATEQWGSVSGEGGPDGINHDDNEAE

SEQ ID NO: 188172 - protein, 36 aa, Artificial Sequence
  Description of Artificial Sequence: Synthetic polypeptide
CEEEIATTNPVATEQWGSVSGEGGPLGINHDDNSSE

SEQ ID NO: 188173 - protein, 36 aa, Artificial Sequence
  Description of Artificial Sequence: Synthetic polypeptide
CEEEIATTNPVATEQWGSVSGEGGPLGINHDDTNAK

SEQ ID NO: 188174 - protein, 37 aa, Artificial Sequence
  Description of Artificial Sequence: Synthetic polypeptide
DECEICTTNPVATEQYGTVATVVNQQSATEEGTTTDD

SEQ ID NO: 188175 - protein, 38 aa, Artificial Sequence
  Description of Artificial Sequence: Synthetic polypeptide
DECEICTTNPVATEQYGTVATVVNQQSATNEEGENNDT

SEQ ID NO: 188176 - protein, 38 aa, Artificial Sequence
  Description of Artificial Sequence: Synthetic polypeptide
DECEICTTNPVATEQYGTVATVVNQQSATNEEGTNQDD

SEQ ID NO: 188177 - protein, 37 aa, Artificial Sequence
  Description of Artificial Sequence: Synthetic polypeptide
DESEIKTTNPVATEFYGSVVDFEENDETNDGQNGEGD

SEQ ID NO: 188178 - protein, 35 aa, Artificial Sequence
  Description of Artificial Sequence: Synthetic polypeptide
DEQEIRTTNPIATEQWGATTWSNTEDLADPEGPDL

SEQ ID NO: 188179 - protein, 34 aa, Artificial Sequence
  Description of Artificial Sequence: Synthetic polypeptide
DEQEIRTTNPIATECYGATWSATEDWADHEGPYL

SEQ ID NO: 188180 - protein, 34 aa, Artificial Sequence
  Description of Artificial Sequence: Synthetic polypeptide
DEQEIRTTNPIATECYGATWSATEDWADHEGPDL

SEQ ID NO: 188181 - protein, 34 aa, Artificial Sequence
  Description of Artificial Sequence: Synthetic polypeptide
DEQEIRTTNPIATECYGATWSATEDWADHEGEDL

SEQ ID NO: 188182 - protein, 37 aa, Artificial Sequence
  Description of Artificial Sequence: Synthetic polypeptide
DESEIKTTNPVATEQYGSVVSDGMQGLTDGEGQTDDE

SEQ ID NO: 188183 - protein, 34 aa, Artificial Sequence
  Description of Artificial Sequence: Synthetic polypeptide
DEQEIRTTNPIATECWGAVWANTEDLEEPKGEYI

SEQ ID NO: 188184 - protein, 36 aa, Artificial Sequence
  Description of Artificial Sequence: Synthetic polypeptide
CEECISTTNPVATEQYGCVCSNTGEDNQENFNSDQA

SEQ ID NO: 188185 - protein, 35 aa, Artificial Sequence
  Description of Artificial Sequence: Synthetic polypeptide
CEEEIATTNPVATEQWGGCVAGNGELAQNNSADHE

SEQ ID NO: 188186 - protein, 38 aa, Artificial Sequence
  Description of Artificial Sequence: Synthetic polypeptide
DESEICTTNPVATEQYGSVVSDGMQGLTDGQEGDQTGD

SEQ ID NO: 188187 - protein, 38 aa, Artificial Sequence
  Description of Artificial Sequence: Synthetic polypeptide
DESEICTTNPVATEQYGSVVSDGMQGLTDGNEGNQNGD

SEQ ID NO: 188188 - protein, 34 aa, Artificial Sequence
  Description of Artificial Sequence: Synthetic polypeptide
CEEEIATTNPVATASWGTSQSLATALGQHDDTSN

SEQ ID NO: 188189 - protein, 38 aa, Artificial Sequence
  Description of Artificial Sequence: Synthetic polypeptide
DEAEISTTNPVATEQYGQCVCSTWGEHNAENFGSENQS

SEQ ID NO: 188190 - protein, 36 aa, Artificial Sequence
  Description of Artificial Sequence: Synthetic polypeptide
DESEIATTNPVGTEGYGVMSATTPTLPQMHNGMNPV

SEQ ID NO: 188191 - protein, 38 aa, Artificial Sequence
  Description of Artificial Sequence: Synthetic polypeptide
DEAEISTTNPVATEQYGQCVCSNWNEHEQEGFGSDNQS

SEQ ID NO: 188192 - protein, 37 aa, Artificial Sequence
  Description of Artificial Sequence: Synthetic polypeptide
CEEEIATTNPVATEQWGCVAGTVGQDGATGNNDTLRD

SEQ ID NO: 188193 - protein, 36 aa, Artificial Sequence
  Description of Artificial Sequence: Synthetic polypeptide
CEEEIATTNPVATEQWGGCCTAAAGNDLDDGMHNHW

SEQ ID NO: 188194 - protein, 35 aa, Artificial Sequence
  Description of Artificial Sequence: Synthetic polypeptide
CEEEIATTNPVATEQWGGCCTAAAGNGLDDTMHNH

SEQ ID NO: 188195 - protein, 35 aa, Artificial Sequence
  Description of Artificial Sequence: Synthetic polypeptide
DESEIATTNPVSTEPYGSVVCIENGDQDGQGGHTM

SEQ ID NO: 188196 - protein, 37 aa, Artificial Sequence
  Description of Artificial Sequence: Synthetic polypeptide
DESEICATNPVATEPYGSVCIWVQNDQRDQRPGGNTS

SEQ ID NO: 188197 - protein, 34 aa, Artificial Sequence
  Description of Artificial Sequence: Synthetic polypeptide
DEQEIRTTNPVATENWGSFGPCINEPEAKETENG

SEQ ID NO: 188198 - protein, 34 aa, Artificial Sequence
  Description of Artificial Sequence: Synthetic polypeptide
DEQEIRTTNPVATEMWGSFGPCIKEPEAREFENG

SEQ ID NO: 188199 - protein, 38 aa, Artificial Sequence
  Description of Artificial Sequence: Synthetic polypeptide
DESEIKTTNPVATESYGSVVSDGMEGLTNGEGDQIGDV

SEQ ID NO: 188200 - protein, 38 aa, Artificial Sequence
  Description of Artificial Sequence: Synthetic polypeptide
DESEICTTNPAATEQYGSVVSDGMQGLTDGQEGDDNGD

SEQ ID NO: 188201 - protein, 37 aa, Artificial Sequence
  Description of Artificial Sequence: Synthetic polypeptide
DEQEIRTTNPVATEGYGSVMGQFQIGGQQNGNGGGQE

SEQ ID NO: 188202 - protein, 34 aa, Artificial Sequence
  Description of Artificial Sequence: Synthetic polypeptide
CEEEIACTNPVATEQWGCNAGTGLVQTAENAGEN

SEQ ID NO: 188203 - protein, 37 aa, Artificial Sequence
  Description of Artificial Sequence: Synthetic polypeptide
DEQEIRTTNPVATEFYGVVYTNGGQDQQTDEVGQGGI

SEQ ID NO: 188204 - protein, 38 aa, Artificial Sequence
  Description of Artificial Sequence: Synthetic polypeptide
DEQEIRTTNPVATEFYGSVVYTNGDQDQQIDEGGQGGI

SEQ ID NO: 188205 - protein, 37 aa, Artificial Sequence
  Description of Artificial Sequence: Synthetic polypeptide
DEQEIRTTNPVATEFYGAVISNQGNGQGTNEFGDEED

SEQ ID NO: 188206 - protein, 35 aa, Artificial Sequence
  Description of Artificial Sequence: Synthetic polypeptide
CEEEIATTNPVATEQWGGCVAGNGELADNNSDEHE

SEQ ID NO: 188207 - protein, 36 aa, Artificial Sequence
  Description of Artificial Sequence: Synthetic polypeptide
CEEEIATTNPVATEQWGGCVAGNGELADNNSGMENE

SEQ ID NO: 188208 - protein, 36 aa, Artificial Sequence
  Description of Artificial Sequence: Synthetic polypeptide
CEEEIATTNPVATEQWGGCVAGNGELADPNSGNEHE

SEQ ID NO: 188209 - protein, 35 aa, Artificial Sequence
  Description of Artificial Sequence: Synthetic polypeptide
DEQEIRTTNPVATECYGSTTWANAEDWAEPKGPYI

SEQ ID NO: 188210 - protein, 35 aa, Artificial Sequence
  Description of Artificial Sequence: Synthetic polypeptide
DEQEIRTTNPVATECYGSTTWANAEDWAEPKGPDI

SEQ ID NO: 188211 - protein, 38 aa, Artificial Sequence
  Description of Artificial Sequence: Synthetic polypeptide
DESEICTTNPVATEQYGSVSGNNSNGGEGQNEDQDEDQ

SEQ ID NO: 188212 - protein, 35 aa, Artificial Sequence
  Description of Artificial Sequence: Synthetic polypeptide
CEEEIATTNPVATEQWGGCTAGNGELADNNSGNHK

SEQ ID NO: 188213 - protein, 39 aa, Artificial Sequence
  Description of Artificial Sequence: Synthetic polypeptide
DECEICTTNPVATEQYGVVSTVNQNNNNLQQGTTEQGQD

SEQ ID NO: 188214 - protein, 34 aa, Artificial Sequence
  Description of Artificial Sequence: Synthetic polypeptide
DEQEIRTTNPIATECWGAVWANTEDLAEPKGEYI

SEQ ID NO: 188215 - protein, 34 aa, Artificial Sequence
  Description of Artificial Sequence: Synthetic polypeptide
DEQEIRTTNPIATECWGAVWANAEDLAEPKGEYI

SEQ ID NO: 188216 - protein, 39 aa, Artificial Sequence
  Description of Artificial Sequence: Synthetic polypeptide
DECEICTTNPVATEQYGVVSTTNQNGNLNQQGTTEQGQD

SEQ ID NO: 188217 - protein, 36 aa, Artificial Sequence
  Description of Artificial Sequence: Synthetic polypeptide
DEQEICTTNPVAYECWGSVASGNGPLQDDRQQEDTD

SEQ ID NO: 188218 - protein, 38 aa, Artificial Sequence
  Description of Artificial Sequence: Synthetic polypeptide
DECEICTTNPVATEQYGVVSTTNQQNTEQGSTEEEEDE

SEQ ID NO: 188219 - protein, 31 aa, Artificial Sequence
  Description of Artificial Sequence: Synthetic polypeptide
DESEIRSTNPIATECWGATMWANSDWAPGPI

SEQ ID NO: 188220 - protein, 31 aa, Artificial Sequence
  Description of Artificial Sequence: Synthetic polypeptide
DESEIRSTNPIATECWGATTWANSDWAPGPI

SEQ ID NO: 188221 - protein, 31 aa, Artificial Sequence
  Description of Artificial Sequence: Synthetic polypeptide
DESEIRSTNPIATEGWGATMWANSDWAPGDI

SEQ ID NO: 188222 - protein, 31 aa, Artificial Sequence
  Description of Artificial Sequence: Synthetic polypeptide
DESEIRSTNPIATEGWGATMWANSDWAPGPI

SEQ ID NO: 188223 - protein, 36 aa, Artificial Sequence
  Description of Artificial Sequence: Synthetic polypeptide
DEAEISTTNPVATEQYGCVCSWGEHNQENFNSDPQS

SEQ ID NO: 188224 - protein, 36 aa, Artificial Sequence
  Description of Artificial Sequence: Synthetic polypeptide
DEAEISTTNPVATEQYGCVCSWGEHNAEYFGSDFQS

SEQ ID NO: 188225 - protein, 36 aa, Artificial Sequence
  Description of Artificial Sequence: Synthetic polypeptide
DEAEISTTNPVATEQYGCVCSWGEHNAENFNSDNQA

SEQ ID NO: 188226 - protein, 37 aa, Artificial Sequence
  Description of Artificial Sequence: Synthetic polypeptide
DEAEISTTNPVATEQYGCVCSWGEDHNQENFGSENQS

SEQ ID NO: 188227 - protein, 35 aa, Artificial Sequence
  Description of Artificial Sequence: Synthetic polypeptide
DEAEISTTNPVATEQYGCVCSWGEDHNAYFNSDQS

SEQ ID NO: 188228 - protein, 37 aa, Artificial Sequence
  Description of Artificial Sequence: Synthetic polypeptide
DEAEISTTNPVATEQYGCVCSWGEDHFQENFGSENQS

SEQ ID NO: 188229 - protein, 37 aa, Artificial Sequence
  Description of Artificial Sequence: Synthetic polypeptide
DEAEISTTNPVATEQYGCVCSTWGEHNQENFNSDTQS

SEQ ID NO: 188230 - protein, 37 aa, Artificial Sequence
  Description of Artificial Sequence: Synthetic polypeptide
DEAEISTTNPVATEQYGCVCSTWGEDHNAEYFGSDQS

SEQ ID NO: 188231 - protein, 36 aa, Artificial Sequence
  Description of Artificial Sequence: Synthetic polypeptide
CEEAIRTTNPVATEQYGCVCSNWGEHNAENFNSDQA

SEQ ID NO: 188232 - protein, 39 aa, Artificial Sequence
  Description of Artificial Sequence: Synthetic polypeptide
DECEICTTNPVATEQYGVVSTVNNNGNLLQQGTTEQGSD

SEQ ID NO: 188233 - protein, 35 aa, Artificial Sequence
  Description of Artificial Sequence: Synthetic polypeptide
DESEIRSTNPVAYECYGSTVQVLSELSQNEEVNTE

SEQ ID NO: 188234 - protein, 35 aa, Artificial Sequence
  Description of Artificial Sequence: Synthetic polypeptide
DESEIRSTNPVAYECYGSTVQVYTSLSDNEEVNTE

SEQ ID NO: 188235 - protein, 35 aa, Artificial Sequence
  Description of Artificial Sequence: Synthetic polypeptide
DESEIRSTNPVAYEHYGSTVQVTSLSDNEEVNTEY

SEQ ID NO: 188236 - protein, 36 aa, Artificial Sequence
  Description of Artificial Sequence: Synthetic polypeptide
DESEIRSTNPVAYEPYGSTVQFTLSLSQDIEVNTEL

SEQ ID NO: 188237 - protein, 35 aa, Artificial Sequence
  Description of Artificial Sequence: Synthetic polypeptide
DESEIRSTNPVAYEPYGSTVQVTPLSSNDEVNTEP

SEQ ID NO: 188238 - protein, 38 aa, Artificial Sequence
  Description of Artificial Sequence: Synthetic polypeptide
DECEICTTNPVATEQYGVVSTVNQAGNNQQGTTEQGQD

SEQ ID NO: 188239 - protein, 37 aa, Artificial Sequence
  Description of Artificial Sequence: Synthetic polypeptide
DEQEICTTNPVAYECWGSVATTGNGPLQDDRQQNGTY

SEQ ID NO: 188240 - protein, 35 aa, Artificial Sequence
  Description of Artificial Sequence: Synthetic polypeptide
DEAEISTTNPVATEQYGCVCSWGEHQENFISDTQA

SEQ ID NO: 188241 - protein, 36 aa, Artificial Sequence
  Description of Artificial Sequence: Synthetic polypeptide
DEQEICTTNPVAYEQWGSVTGENGNQSQGNGMGNQE

SEQ ID NO: 188242 - protein, 38 aa, Artificial Sequence
  Description of Artificial Sequence: Synthetic polypeptide
DECEICTTNPVATEQYGVVATVTNGQSATTEEGNNNDD

SEQ ID NO: 188243 - protein, 38 aa, Artificial Sequence
  Description of Artificial Sequence: Synthetic polypeptide
DECEICTTNPVATEQYGTVSTVNQNGNAEQGTTEEGSQ

SEQ ID NO: 188244 - protein, 38 aa, Artificial Sequence
  Description of Artificial Sequence: Synthetic polypeptide
DECEICTTNPVATEQYGTVSTVNQNGNNQQGTTEEGSD

SEQ ID NO: 188245 - protein, 38 aa, Artificial Sequence
  Description of Artificial Sequence: Synthetic polypeptide
DECEICTTNPVATEQYGTVSTVNQNGNQQQGTTEQGSQ

SEQ ID NO: 188246 - protein, 38 aa, Artificial Sequence
  Description of Artificial Sequence: Synthetic polypeptide
DEQEIRTTNPAATEQYGQVVTNTQDNGENGEGQGEVEG

SEQ ID NO: 188247 - protein, 37 aa, Artificial Sequence
  Description of Artificial Sequence: Synthetic polypeptide
DEQEIRTTNPAATEQYGQVVITQDNGEGQGQGEGDTG

SEQ ID NO: 188248 - protein, 36 aa, Artificial Sequence
  Description of Artificial Sequence: Synthetic polypeptide
DEQEIRSTNPVAYESYGQSVCCEGNHSHTRNGGTRL

SEQ ID NO: 188249 - protein, 35 aa, Artificial Sequence
  Description of Artificial Sequence: Synthetic polypeptide
DESEINTTNPVAYEAWGISVSCANSSSDREGGDVC

SEQ ID NO: 188250 - protein, 37 aa, Artificial Sequence
  Description of Artificial Sequence: Synthetic polypeptide
DESEIQTTNPCATEQYGTVVCSATGGEPSENFNGGND

SEQ ID NO: 188251 - protein, 36 aa, Artificial Sequence
  Description of Artificial Sequence: Synthetic polypeptide
CEECIRTTNPVAYEQWGWVACTNNGLQDDHQDGEMM

SEQ ID NO: 188252 - protein, 37 aa, Artificial Sequence
  Description of Artificial Sequence: Synthetic polypeptide
DESEIRATNPVATEPYGSVCIWVQNDQRDERRGSETS

SEQ ID NO: 188253 - protein, 34 aa, Artificial Sequence
  Description of Artificial Sequence: Synthetic polypeptide
CEEEIATTNPVATEQWGTNCSAAAHGMRASNDAW

SEQ ID NO: 188254 - protein, 34 aa, Artificial Sequence
  Description of Artificial Sequence: Synthetic polypeptide
DEQEIRTTNPIATECWGAVWANAEDLAEPKGPYI

SEQ ID NO: 188255 - protein, 37 aa, Artificial Sequence
  Description of Artificial Sequence: Synthetic polypeptide
DEAEISTTNPVATEQYGQCVCSNTGEHNQENFGSDQS

SEQ ID NO: 188256 - protein, 37 aa, Artificial Sequence
  Description of Artificial Sequence: Synthetic polypeptide
DEQEIRATNPVATEQYGVVMSNNDNQTGGGQTGQVGD

SEQ ID NO: 188257 - protein, 38 aa, Artificial Sequence
  Description of Artificial Sequence: Synthetic polypeptide
DESEIRGTNCVATECYGSVSNMNLVGDDQDQEDDDGNP

SEQ ID NO: 188258 - protein, 37 aa, Artificial Sequence
  Description of Artificial Sequence: Synthetic polypeptide
DESEIRGTNPVATEQYGAVITGEGNNMNDGGNDQFQD

SEQ ID NO: 188259 - protein, 37 aa, Artificial Sequence
  Description of Artificial Sequence: Synthetic polypeptide
DESEIRGTNPVATEQYGSVGDDVNNSGMEEGNEQGDN

SEQ ID NO: 188260 - protein, 38 aa, Artificial Sequence
  Description of Artificial Sequence: Synthetic polypeptide
DESEIRGTNPVATEQYGSVGDDVNNSGQMGEGNEQGDG

SEQ ID NO: 188261 - protein, 37 aa, Artificial Sequence
  Description of Artificial Sequence: Synthetic polypeptide
DESEIRGTNPVATEQYGSVVDGPNQQIGEGGDEDQQI

SEQ ID NO: 188262 - protein, 36 aa, Artificial Sequence
  Description of Artificial Sequence: Synthetic polypeptide
DESEIRGTNPVATEQYGVVGDDVNNSGMEEGNEGGD

SEQ ID NO: 188263 - protein, 38 aa, Artificial Sequence
  Description of Artificial Sequence: Synthetic polypeptide
DECEICTTNPVATEQYGVVATVQLQQSATNEEGNNNDD

SEQ ID NO: 188264 - protein, 37 aa, Artificial Sequence
  Description of Artificial Sequence: Synthetic polypeptide
DEQEIGTTNPVATEFYGSVSNTEDTGDEDQEGGDDGN

SEQ ID NO: 188265 - protein, 37 aa, Artificial Sequence
  Description of Artificial Sequence: Synthetic polypeptide
DEAEISTTNPVATEQYGCVTSTWPADNAEYFNSDPQS

SEQ ID NO: 188266 - protein, 38 aa, Artificial Sequence
  Description of Artificial Sequence: Synthetic polypeptide
DECEICTTNPVATEQYGVVATVTLQQSATNEEGVENDD

SEQ ID NO: 188267 - protein, 36 aa, Artificial Sequence
  Description of Artificial Sequence: Synthetic polypeptide
CEEEIATTNPVATEQYGCVAANGELTITNPEEEHNH

SEQ ID NO: 188268 - protein, 35 aa, Artificial Sequence
  Description of Artificial Sequence: Synthetic polypeptide
DEDEIRTTNPVAYEAWGEVCSNDNDDQPGQQGTEP

SEQ ID NO: 188269 - protein, 35 aa, Artificial Sequence
  Description of Artificial Sequence: Synthetic polypeptide
DEDEIRGTNPVATEGWGSVSAGMEGQDGEGEQTTV

SEQ ID NO: 188270 - protein, 35 aa, Artificial Sequence
  Description of Artificial Sequence: Synthetic polypeptide
DEDEIRGTNPVATEGWGSVSAGMEGQNGEGEQFII

SEQ ID NO: 188271 - protein, 36 aa, Artificial Sequence
  Description of Artificial Sequence: Synthetic polypeptide
DETEIRTTNPVATEQYGCVDTDAENGSVETEEPQGE

SEQ ID NO: 188272 - protein, 30 aa, Artificial Sequence
  Description of Artificial Sequence: Synthetic polypeptide
AEQEIATTNPVAYECWGVAYECLQHHEHEM

SEQ ID NO: 188273 - protein, 38 aa, Artificial Sequence
  Description of Artificial Sequence: Synthetic polypeptide
DETEIRTTNPVATEQYGDVVTTDGMNDNQTGEDEQGES

SEQ ID NO: 188274 - protein, 35 aa, Artificial Sequence
  Description of Artificial Sequence: Synthetic polypeptide
AEQEIATTNPVATEQYGSVCAAGPLGFATMGDEQG

SEQ ID NO: 188275 - protein, 37 aa, Artificial Sequence
  Description of Artificial Sequence: Synthetic polypeptide
DETEIRTTNPVATEQYGSIICEPCLPQYVQLGIQPQD

SEQ ID NO: 188276 - protein, 37 aa, Artificial Sequence
  Description of Artificial Sequence: Synthetic polypeptide
DETEIRTTNPVATEQYGSIIEEVLPQYEQQLQIQPQD

SEQ ID NO: 188277 - protein, 34 aa, Artificial Sequence
  Description of Artificial Sequence: Synthetic polypeptide
AEQEIATTNPVATEQYGCVAANGDATMGMGDPHN

SEQ ID NO: 188278 - protein, 38 aa, Artificial Sequence
  Description of Artificial Sequence: Synthetic polypeptide
DETEIRTTNPVATEQYGSVCTTGGDNNDEGEEGEGGET

SEQ ID NO: 188279 - protein, 37 aa, Artificial Sequence
  Description of Artificial Sequence: Synthetic polypeptide
DETEIRTTNPVATEQYGSVGDPGDGNEEGETGEGGET

SEQ ID NO: 188280 - protein, 39 aa, Artificial Sequence
  Description of Artificial Sequence: Synthetic polypeptide
DETEIRTTNPVATEQYGSVLGSGQEDQIEQDGEGEGNGE

SEQ ID NO: 188281 - protein, 38 aa, Artificial Sequence
  Description of Artificial Sequence: Synthetic polypeptide
DETEIRTTNPVATEQYGSVQGSGQDDEEDDGEGQNNGD

SEQ ID NO: 188282 - protein, 34 aa, Artificial Sequence
  Description of Artificial Sequence: Synthetic polypeptide
AEPEIRTTNPVATEQWGDCVSVIEQMIAVEPDAE

SEQ ID NO: 188283 - protein, 34 aa, Artificial Sequence
  Description of Artificial Sequence: Synthetic polypeptide
AEPEIRTTNPVATEEYGCCWYNIGVSLEGMNIQE

SEQ ID NO: 188284 - protein, 35 aa, Artificial Sequence
  Description of Artificial Sequence: Synthetic polypeptide
AEPEIRTTNPVATEEYGCCWYNIGVSETRGMNIQE

SEQ ID NO: 188285 - protein, 36 aa, Artificial Sequence
  Description of Artificial Sequence: Synthetic polypeptide
DEDEIRTTNPVATEPWGSVCLIEDNGDRDGGGGDDI

SEQ ID NO: 188286 - protein, 37 aa, Artificial Sequence
  Description of Artificial Sequence: Synthetic polypeptide
DEDEIRTTNPVATEPWGSVCLIEDNGDRDRDGGNDDP

SEQ ID NO: 188287 - protein, 37 aa, Artificial Sequence
  Description of Artificial Sequence: Synthetic polypeptide
DEDEIRTTNPVATEPWGSVCLIEDNGDRDRNGDNDDI

SEQ ID NO: 188288 - protein, 38 aa, Artificial Sequence
  Description of Artificial Sequence: Synthetic polypeptide
DETEIRTTNPVATEQYGSVVCTGGDNDEEGEEGEGGAT

SEQ ID NO: 188289 - protein, 38 aa, Artificial Sequence
  Description of Artificial Sequence: Synthetic polypeptide
DETEIRTTNPVATEQYGSVVPTGGDFNEEGEEGEGGET

SEQ ID NO: 188290 - protein, 36 aa, Artificial Sequence
  Description of Artificial Sequence: Synthetic polypeptide
DEDEIRTTNPVATEPWGSVCLIEDNGDRDRNGGDGI

SEQ ID NO: 188291 - protein, 39 aa, Artificial Sequence
  Description of Artificial Sequence: Synthetic polypeptide
DETEIRTTNPVATEQYGSVVTTDGMNDNQTGEDEQGAED

SEQ ID NO: 188292 - protein, 38 aa, Artificial Sequence
  Description of Artificial Sequence: Synthetic polypeptide
DETEIRTTNPVATEQYGSVVTTFGDNDEEGEEGEGGIT

SEQ ID NO: 188293 - protein, 38 aa, Artificial Sequence
  Description of Artificial Sequence: Synthetic polypeptide
DETEIRTTNPVATEQYGSVVTTGGDINNEGEEGEGGET

SEQ ID NO: 188294 - protein, 35 aa, Artificial Sequence
  Description of Artificial Sequence: Synthetic polypeptide
DETEIRTTNPVATEQYGATTWANAEDWEEPEGPYI

SEQ ID NO: 188295 - protein, 38 aa, Artificial Sequence
  Description of Artificial Sequence: Synthetic polypeptide
DETEIRTTNPVATEQYGSVVTTGGDNDEEDEDGEGGET

SEQ ID NO: 188296 - protein, 35 aa, Artificial Sequence
  Description of Artificial Sequence: Synthetic polypeptide
DETEIRTTNPVATEQYGATTWANAEDWEEPEGEDI

SEQ ID NO: 188297 - protein, 35 aa, Artificial Sequence
  Description of Artificial Sequence: Synthetic polypeptide
DETEIRTTNPVATEQYGATTCSNADGWEEPKGPYI

SEQ ID NO: 188298 - protein, 38 aa, Artificial Sequence
  Description of Artificial Sequence: Synthetic polypeptide
DETEIRTTNPVATEGYGSVVTTGGDNDEEQEEGEGGET

SEQ ID NO: 188299 - protein, 36 aa, Artificial Sequence
  Description of Artificial Sequence: Synthetic polypeptide
AEQEIRTTNPVATEQYGSCVISMMQDESFMEYNNEQ

SEQ ID NO: 188300 - protein, 32 aa, Artificial Sequence
  Description of Artificial Sequence: Synthetic polypeptide
DETEIRTTNPVATEQWGATANAEDWAEHKEPI

SEQ ID NO: 188301 - protein, 34 aa, Artificial Sequence
  Description of Artificial Sequence: Synthetic polypeptide
DETEIRTTNPVATEQWGATTANAEDWAEHKGPYI

SEQ ID NO: 188302 - protein, 34 aa, Artificial Sequence
  Description of Artificial Sequence: Synthetic polypeptide
DETEIRTTNPVATEQWGATTSNAEDEAEAKGPYI

SEQ ID NO: 188303 - protein, 34 aa, Artificial Sequence
  Description of Artificial Sequence: Synthetic polypeptide
DETEIRTTNPVATEQWGATTSNAEDEAEPKGPYI

SEQ ID NO: 188304 - protein, 37 aa, Artificial Sequence
  Description of Artificial Sequence: Synthetic polypeptide
DETEIRTTNPVATEQWGATVSANTEAGPAERNGMPPI

SEQ ID NO: 188305 - protein, 37 aa, Artificial Sequence
  Description of Artificial Sequence: Synthetic polypeptide
DETEIRTTNPVATEQWGATVSANTEAGPAERNGMPPV

SEQ ID NO: 188306 - protein, 34 aa, Artificial Sequence
  Description of Artificial Sequence: Synthetic polypeptide
DETEIRTTNPVATEQWGATWAATEDWAEPEGPDL

SEQ ID NO: 188307 - protein, 34 aa, Artificial Sequence
  Description of Artificial Sequence: Synthetic polypeptide
DETEIRTTNPVATEQWGATWANAEDWAEPEGPDL

SEQ ID NO: 188308 - protein, 34 aa, Artificial Sequence
  Description of Artificial Sequence: Synthetic polypeptide
DETEIRTTNPVATEQWGATWANAEDWAEPKGPDL

SEQ ID NO: 188309 - protein, 34 aa, Artificial Sequence
  Description of Artificial Sequence: Synthetic polypeptide
DETEIRTTNPVATEQWGDTTWSNEIEMNPAGPYA

SEQ ID NO: 188310 - protein, 35 aa, Artificial Sequence
  Description of Artificial Sequence: Synthetic polypeptide
DETEIRTTNPVATEQWGSTTWANAEDWAEPEGPYI

SEQ ID NO: 188311 - protein, 35 aa, Artificial Sequence
  Description of Artificial Sequence: Synthetic polypeptide
DETEIRTTNPVATEQWGSTTWANAPDWAEPKGPYV

SEQ ID NO: 188312 - protein, 35 aa, Artificial Sequence
  Description of Artificial Sequence: Synthetic polypeptide
DETEIRTTNPVATEQWGSTTWANAPDWNEPKGPYV

SEQ ID NO: 188313 - protein, 35 aa, Artificial Sequence
  Description of Artificial Sequence: Synthetic polypeptide
DETEIRTTNPVATEQWGSTTWANAPDWNEPNGPYV

SEQ ID NO: 188314 - protein, 36 aa, Artificial Sequence
  Description of Artificial Sequence: Synthetic polypeptide
DETEIRTTNPVATEQWGSTTWANTEAGPAERNGPYV

SEQ ID NO: 188315 - protein, 36 aa, Artificial Sequence
  Description of Artificial Sequence: Synthetic polypeptide
DETEIRTTNPVATEQWGSTTWATAPDGNMPNGMPPV

SEQ ID NO: 188316 - protein, 36 aa, Artificial Sequence
  Description of Artificial Sequence: Synthetic polypeptide
DETEIRTTNPVATEQWGSTTWATAPDGNMPNGMPYV

SEQ ID NO: 188317 - protein, 36 aa, Artificial Sequence
  Description of Artificial Sequence: Synthetic polypeptide
DETEIRTTNPVATEQWGSTTWATAPDWNEPNGMPYV

SEQ ID NO: 188318 - protein, 34 aa, Artificial Sequence
  Description of Artificial Sequence: Synthetic polypeptide
DETEIRTTNPVATEQWGSTWAAAEDWADPEGEDI

SEQ ID NO: 188319 - protein, 34 aa, Artificial Sequence
  Description of Artificial Sequence: Synthetic polypeptide
DETEIRTTNPVATEQWGSTWAAAEDWAEPEGEDI

SEQ ID NO: 188320 - protein, 34 aa, Artificial Sequence
  Description of Artificial Sequence: Synthetic polypeptide
DETEIRTTNPVATEQWGSTWAAAEDWAEPEGEYI

SEQ ID NO: 188321 - protein, 35 aa, Artificial Sequence
  Description of Artificial Sequence: Synthetic polypeptide
DETEIRTTNPVATEQYGATTWANAEDWAEHKGEYI

SEQ ID NO: 188322 - protein, 38 aa, Artificial Sequence
  Description of Artificial Sequence: Synthetic polypeptide
DETEIRTTNPVATEQYGSVVTTGGDNQEEGEEDEGGET

SEQ ID NO: 188323 - protein, 38 aa, Artificial Sequence
  Description of Artificial Sequence: Synthetic polypeptide
DETEIRTTNPVATEQYGSVVTTGGDNVEEEEEGEGGET

SEQ ID NO: 188324 - protein, 38 aa, Artificial Sequence
  Description of Artificial Sequence: Synthetic polypeptide
DETEIRTTNPVATEQYGSVVTTLNDNDEEGEEGEGGET

SEQ ID NO: 188325 - protein, 34 aa, Artificial Sequence
  Description of Artificial Sequence: Synthetic polypeptide
DETEIRTTNPVSTEPYGAIWANMEDIQAQQNGPI

SEQ ID NO: 188326 - protein, 34 aa, Artificial Sequence
  Description of Artificial Sequence: Synthetic polypeptide
DETEIRTTNPVSTEPYGATTWANAEDIAQPKGPI

SEQ ID NO: 188327 - protein, 37 aa, Artificial Sequence
  Description of Artificial Sequence: Synthetic polypeptide
DEDEIRTTNPVATEQWGTVVTTLQQSATNVATEDGSQ

SEQ ID NO: 188328 - protein, 37 aa, Artificial Sequence
  Description of Artificial Sequence: Synthetic polypeptide
DEDEIRTTNPVATEQWGTVVTTQQQSATNVATEDGSG

SEQ ID NO: 188329 - protein, 37 aa, Artificial Sequence
  Description of Artificial Sequence: Synthetic polypeptide
DETEISTTNPVATEQYGSVYTTGDSNEEGETGEGGET

SEQ ID NO: 188330 - protein, 32 aa, Artificial Sequence
  Description of Artificial Sequence: Synthetic polypeptide
DETEIVTTNPIATECWGTVWSAADDWAPEGPI

SEQ ID NO: 188331 - protein, 34 aa, Artificial Sequence
  Description of Artificial Sequence: Synthetic polypeptide
DETEIVTTNPIATEQWGAVCANADDWVAPEGNYI

SEQ ID NO: 188332 - protein, 34 aa, Artificial Sequence
  Description of Artificial Sequence: Synthetic polypeptide
DETEIVTTNPIATEQWGTTVCSATDGPVEFKGPI

SEQ ID NO: 188333 - protein, 34 aa, Artificial Sequence
  Description of Artificial Sequence: Synthetic polypeptide
DETEIVTTNPIATEQYGTVCAAADDWVAPEGNYI

SEQ ID NO: 188334 - protein, 33 aa, Artificial Sequence
  Description of Artificial Sequence: Synthetic polypeptide
DETEIVTTNPVATECWGATCSNTDDPEFKGPYD

SEQ ID NO: 188335 - protein, 35 aa, Artificial Sequence
  Description of Artificial Sequence: Synthetic polypeptide
DETEIVTTNPVATEQYGAVCAATDGPVEEFKGPYD

SEQ ID NO: 188336 - protein, 37 aa, Artificial Sequence
  Description of Artificial Sequence: Synthetic polypeptide
DEDEIRTTNPVATEQWGTVVVTEQQSATNVATEDGQE

SEQ ID NO: 188337 - protein, 34 aa, Artificial Sequence
  Description of Artificial Sequence: Synthetic polypeptide
DETEIVTTNPVATEQYGTTCANADGWAEFEGPYD

SEQ ID NO: 188338 - protein, 35 aa, Artificial Sequence
  Description of Artificial Sequence: Synthetic polypeptide
DETEIVTTNPVATEQYGTTVCSAADGPEEPKGPYI

SEQ ID NO: 188339 - protein, 37 aa, Artificial Sequence
  Description of Artificial Sequence: Synthetic polypeptide
DEDEIRTTNPVATEQWGTVVVTEQQSATNVATEDGSD

SEQ ID NO: 188340 - protein, 37 aa, Artificial Sequence
  Description of Artificial Sequence: Synthetic polypeptide
DETESEIRTTNPVAYEPWGVCSTGDNRQDERQDNGAS

SEQ ID NO: 188341 - protein, 37 aa, Artificial Sequence
  Description of Artificial Sequence: Synthetic polypeptide
DEDEIRTTNPVATEQWGTVVVTEQQSATNVATEDGSQ

SEQ ID NO: 188342 - protein, 37 aa, Artificial Sequence
  Description of Artificial Sequence: Synthetic polypeptide
DEDEIRTTNPVATEQWGTVVVTQQQSATNVATEDGAD

SEQ ID NO: 188343 - protein, 37 aa, Artificial Sequence
  Description of Artificial Sequence: Synthetic polypeptide
DEDEIRTTNPVATEQWGVTVTTAQQQGTNVATEDGAE

SEQ ID NO: 188344 - protein, 38 aa, Artificial Sequence
  Description of Artificial Sequence: Synthetic polypeptide
DEDEIRTTNPVATEQWGVTVVSTELQSATNVATEDGSF

SEQ ID NO: 188345 - protein, 37 aa, Artificial Sequence
  Description of Artificial Sequence: Synthetic polypeptide
DEDEIRTTNPVATEQWGVTVVSTEQQSATNVATEDGA

SEQ ID NO: 188346 - protein, 37 aa, Artificial Sequence
  Description of Artificial Sequence: Synthetic polypeptide
DEDEIRTTNPVATEQWGVTVVTAQQSATNVATEDGSE

SEQ ID NO: 188347 - protein, 37 aa, Artificial Sequence
  Description of Artificial Sequence: Synthetic polypeptide
DEDEIRTTNPVATEQWGVTVVTNQQQATNVATEDGSM

SEQ ID NO: 188348 - protein, 34 aa, Artificial Sequence
  Description of Artificial Sequence: Synthetic polypeptide
DETEIRTTNPVSTECWGATTANAEDWAERKGPYR

SEQ ID NO: 188349 - protein, 36 aa, Artificial Sequence
  Description of Artificial Sequence: Synthetic polypeptide
DEDEIRTTNPVATEQWGTVVTEQQGATNVATEDGSM

SEQ ID NO: 188350 - protein, 33 aa, Artificial Sequence
  Description of Artificial Sequence: Synthetic polypeptide
DETEIRTTNPVGTECWGATTWANAETLAPKGDI

SEQ ID NO: 188351 - protein, 33 aa, Artificial Sequence
  Description of Artificial Sequence: Synthetic polypeptide
DETEIRTTNPVGTECWGATTWANAEDLAPKGDI

SEQ ID NO: 188352 - protein, 37 aa, Artificial Sequence
  Description of Artificial Sequence: Synthetic polypeptide
DETEIRTTNPVATEQYGVVVGPGDNNEEGELGEGGET

SEQ ID NO: 188353 - protein, 39 aa, Artificial Sequence
  Description of Artificial Sequence: Synthetic polypeptide
DETEIRTTNPVATEQYGVVVGSGQTDQEEQDGEGEGNGV

SEQ ID NO: 188354 - protein, 38 aa, Artificial Sequence
  Description of Artificial Sequence: Synthetic polypeptide
DETEIRTTNPVATESYGSVNDNSNMTQNNMTEGEFGQE

SEQ ID NO: 188355 - protein, 38 aa, Artificial Sequence
  Description of Artificial Sequence: Synthetic polypeptide
DETEIRTTNPVATESYGSVQDNNNMDQNNMGENEFGQE

SEQ ID NO: 188356 - protein, 36 aa, Artificial Sequence
  Description of Artificial Sequence: Synthetic polypeptide
DETEIRTTNPVATESYGSVVVDGFGQENDQEEDAQG

SEQ ID NO: 188357 - protein, 34 aa, Artificial Sequence
  Description of Artificial Sequence: Synthetic polypeptide
DETEIRTTNPVAYEAWGVVTGGNANEDLNGGDSN

SEQ ID NO: 188358 - protein, 36 aa, Artificial Sequence
  Description of Artificial Sequence: Synthetic polypeptide
DETEIRTTNPVAYECWGCVCAGGGNMGNQRGGGDER

SEQ ID NO: 188359 - protein, 35 aa, Artificial Sequence
  Description of Artificial Sequence: Synthetic polypeptide
DETEIRTTNPVAYECWGCVYQINENQDRQMMNNGS

SEQ ID NO: 188360 - protein, 35 aa, Artificial Sequence
  Description of Artificial Sequence: Synthetic polypeptide
DETEIRTTNPVAYECWGSVYMGIGNDQGNQGGDAQ

SEQ ID NO: 188361 - protein, 35 aa, Artificial Sequence
  Description of Artificial Sequence: Synthetic polypeptide
DETEIRTTNPVAYEEWGCVYHTDGMQRNNQGMDGM

SEQ ID NO: 188362 - protein, 35 aa, Artificial Sequence
  Description of Artificial Sequence: Synthetic polypeptide
DETEIRTTNPVAYEKWGEVASGEGNQGNHGNGNPN

SEQ ID NO: 188363 - protein, 36 aa, Artificial Sequence
  Description of Artificial Sequence: Synthetic polypeptide
DETEIRTTNPVATEFYGVVVDGQLINMDGNEEGDQG

SEQ ID NO: 188364 - protein, 35 aa, Artificial Sequence
  Description of Artificial Sequence: Synthetic polypeptide
DETEIRTTNPVAYEKWGEVASGEGQGNHGNGNSNN

SEQ ID NO: 188365 - protein, 34 aa, Artificial Sequence
  Description of Artificial Sequence: Synthetic polypeptide
DETEIRTTNPVAYEKWGEVAYGENQGNHGNGNSN

SEQ ID NO: 188366 - protein, 35 aa, Artificial Sequence
  Description of Artificial Sequence: Synthetic polypeptide
DETEIRTTNPVAYEQWGMIRHTDNDHRDRKDQDSR

SEQ ID NO: 188367 - protein, 35 aa, Artificial Sequence
  Description of Artificial Sequence: Synthetic polypeptide
DETEIRTTNPVAYEQWGSVACGPNPIDDENGGDSH

SEQ ID NO: 188368 - protein, 36 aa, Artificial Sequence
  Description of Artificial Sequence: Synthetic polypeptide
AENEIRTTNPVATEQYGSVFYPVADMDNNGFENNMV

SEQ ID NO: 188369 - protein, 37 aa, Artificial Sequence
  Description of Artificial Sequence: Synthetic polypeptide
AENEIRTTNPVATEQYGSTWETVPNHNTEVQGKDGQQ

SEQ ID NO: 188370 - protein, 36 aa, Artificial Sequence
  Description of Artificial Sequence: Synthetic polypeptide
DEDEIRTTNPVATEQWGTVVATEQQGTNVATEDGAN

SEQ ID NO: 188371 - protein, 37 aa, Artificial Sequence
  Description of Artificial Sequence: Synthetic polypeptide
DEDEIRTTNPVATEQWGTVVSTAQQSATNVATEDGSA

SEQ ID NO: 188372 - protein, 37 aa, Artificial Sequence
  Description of Artificial Sequence: Synthetic polypeptide
DEDEIRTTNPVATEQWGTVVSTEQQGATNVATEDGSF

SEQ ID NO: 188373 - protein, 37 aa, Artificial Sequence
  Description of Artificial Sequence: Synthetic polypeptide
DEDEIRTTNPVATEQWGTVVSTEQQSATNVATEDGTD

SEQ ID NO: 188374 - protein, 37 aa, Artificial Sequence
  Description of Artificial Sequence: Synthetic polypeptide
DEDEIRTTNPVATEQWGTVVSTEQQSATNVATEMGSF

SEQ ID NO: 188375 - protein, 37 aa, Artificial Sequence
  Description of Artificial Sequence: Synthetic polypeptide
DEDEIRTTNPVATEQWGTVVSTQQQSATNVATEDGQA

SEQ ID NO: 188376 - protein, 35 aa, Artificial Sequence
  Description of Artificial Sequence: Synthetic polypeptide
DETEIRTTNPVAYEKWGEVASGEPNQGNHGNGNSH

SEQ ID NO: 188377 - protein, 36 aa, Artificial Sequence
  Description of Artificial Sequence: Synthetic polypeptide
DETEIRTTNPVATEFYGSVTAPGGDEGGGQTGEQQE

SEQ ID NO: 188378 - protein, 35 aa, Artificial Sequence
  Description of Artificial Sequence: Synthetic polypeptide
AEREIRTTNPVATEQYGCVCGWGEDNQEYFGSDQS

SEQ ID NO: 188379 - protein, 35 aa, Artificial Sequence
  Description of Artificial Sequence: Synthetic polypeptide
AEREIRTTNPVATEQYGCVCGWGEHNQYFGSDTQS

SEQ ID NO: 188380 - protein, 33 aa, Artificial Sequence
  Description of Artificial Sequence: Synthetic polypeptide
DETEIRTTNPIATEGWGATTWANATLAEPGPYI

SEQ ID NO: 188381 - protein, 35 aa, Artificial Sequence
  Description of Artificial Sequence: Synthetic polypeptide
DETEIRTTNPIATEPYGATIWSNMEDWQEPKGNYI

SEQ ID NO: 188382 - protein, 34 aa, Artificial Sequence
  Description of Artificial Sequence: Synthetic polypeptide
DETEIRTTNPIATEPYGATTWAMEDWAQQKGNYI

SEQ ID NO: 188383 - protein, 35 aa, Artificial Sequence
  Description of Artificial Sequence: Synthetic polypeptide
DETEIRTTNPIATEPYGATTWSNMEDWQEPKGNYI

SEQ ID NO: 188384 - protein, 34 aa, Artificial Sequence
  Description of Artificial Sequence: Synthetic polypeptide
DETEIRTTNPIATEPYGTTTWAAEDIQQQQKGNH

SEQ ID NO: 188385 - protein, 35 aa, Artificial Sequence
  Description of Artificial Sequence: Synthetic polypeptide
DETEIRTTNPIATEPYGTTTWANAEDIQQQQKGNH

SEQ ID NO: 188386 - protein, 32 aa, Artificial Sequence
  Description of Artificial Sequence: Synthetic polypeptide
DETEIRTTNPIATEQWGATAWPAEVWAHKGPK

SEQ ID NO: 188387 - protein, 35 aa, Artificial Sequence
  Description of Artificial Sequence: Synthetic polypeptide
DETEIRTTNPIATEQWGATSANAPDGPNMPNGPYV

SEQ ID NO: 188388 - protein, 33 aa, Artificial Sequence
  Description of Artificial Sequence: Synthetic polypeptide
DETEIRTTNPIATEQWGATTANADWAEPKGDYI

SEQ ID NO: 188389 - protein, 33 aa, Artificial Sequence
  Description of Artificial Sequence: Synthetic polypeptide
DETEIRTTNPIATEQWGATTANADWANAKGDYI

SEQ ID NO: 188390 - protein, 36 aa, Artificial Sequence
  Description of Artificial Sequence: Synthetic polypeptide
DETEIRTTNPIATEQWGATTSATTPDWPNEPKGNPI

SEQ ID NO: 188391 - protein, 36 aa, Artificial Sequence
  Description of Artificial Sequence: Synthetic polypeptide
DETEIRTTNPIATEQWGATTSATTPDWPNEPKGNPV

SEQ ID NO: 188392 - protein, 36 aa, Artificial Sequence
  Description of Artificial Sequence: Synthetic polypeptide
DETEIRTTNPIATEQWGATTSATTPDWPNEPNGNPV

SEQ ID NO: 188393 - protein, 36 aa, Artificial Sequence
  Description of Artificial Sequence: Synthetic polypeptide
DETEIRTTNPIATEQWGATTSATTPDWPNERNGNPV

SEQ ID NO: 188394 - protein, 35 aa, Artificial Sequence
  Description of Artificial Sequence: Synthetic polypeptide
DETEIRTTNPIATEQWGATTWANAEDLQEPKGTYI

SEQ ID NO: 188395 - protein, 33 aa, Artificial Sequence
  Description of Artificial Sequence: Synthetic polypeptide
DETEIRTTNPIATEQWGATTWPNAEVWAEHGEI

SEQ ID NO: 188396 - protein, 35 aa, Artificial Sequence
  Description of Artificial Sequence: Synthetic polypeptide
DETEIRTTNPIATEQWGATVCSATDGPVAEFKGPI

SEQ ID NO: 188397 - protein, 35 aa, Artificial Sequence
  Description of Artificial Sequence: Synthetic polypeptide
DETEIRTTNPIATEQWGATVCSATDGPVEEFKGPI

SEQ ID NO: 188398 - protein, 34 aa, Artificial Sequence
  Description of Artificial Sequence: Synthetic polypeptide
DETEIRTTNPIATEQWGAVCANADDWAEPKGPYI

SEQ ID NO: 188399 - protein, 33 aa, Artificial Sequence
  Description of Artificial Sequence: Synthetic polypeptide
DETEIRTTNPIATEQWGDTWSNAIWAEAKGDYA

SEQ ID NO: 188400 - protein, 33 aa, Artificial Sequence
  Description of Artificial Sequence: Synthetic polypeptide
DETEIRTTNPIATEQWGETAWANEEDWAEPGGI

SEQ ID NO: 188401 - protein, 33 aa, Artificial Sequence
  Description of Artificial Sequence: Synthetic polypeptide
DETEIRTTNPIATEQWGETAWANEENWAEPGGI

SEQ ID NO: 188402 - protein, 36 aa, Artificial Sequence
  Description of Artificial Sequence: Synthetic polypeptide
DETEIRTTNPIATEQWGSTTSANAEDWPAMRKGPPV

SEQ ID NO: 188403 - protein, 35 aa, Artificial Sequence
  Description of Artificial Sequence: Synthetic polypeptide
DETEIRTTNPIATECYGSTVWANAEDWADPEGPYI

SEQ ID NO: 188404 - protein, 35 aa, Artificial Sequence
  Description of Artificial Sequence: Synthetic polypeptide
DETEIRTTNPIATECYGSTVWANAEDWADPEGEYI

SEQ ID NO: 188405 - protein, 32 aa, Artificial Sequence
  Description of Artificial Sequence: Synthetic polypeptide
DETEIRTTNPIATECYGETAWPEEVWAHGEYI

SEQ ID NO: 188406 - protein, 32 aa, Artificial Sequence
  Description of Artificial Sequence: Synthetic polypeptide
DETEIRTTNPIATECYGATWSEDWAEHKEPYI

SEQ ID NO: 188407 - protein, 31 aa, Artificial Sequence
  Description of Artificial Sequence: Synthetic polypeptide
DETEIRTTNPIATECWGETAAEVWAEPGEYI

SEQ ID NO: 188408 - protein, 33 aa, Artificial Sequence
  Description of Artificial Sequence: Synthetic polypeptide
DETEIRTTNPIATECWGETTANAEDWQPKGPYK

SEQ ID NO: 188409 - protein, 33 aa, Artificial Sequence
  Description of Artificial Sequence: Synthetic polypeptide
DETEIRTTNPIATECWGITTWANAEDWQEPGPI

SEQ ID NO: 188410 - protein, 35 aa, Artificial Sequence
  Description of Artificial Sequence: Synthetic polypeptide
DETEIRTTNPIATECWGITVWANAENLAEPKGPYR

SEQ ID NO: 188411 - protein, 35 aa, Artificial Sequence
  Description of Artificial Sequence: Synthetic polypeptide
DETEIRTTNPIATECWGITVWANAENLAESKGPYR

SEQ ID NO: 188412 - protein, 35 aa, Artificial Sequence
  Description of Artificial Sequence: Synthetic polypeptide
DETEIRTTNPIATECWGSTTSANTPDWAMRKGPYI

SEQ ID NO: 188413 - protein, 33 aa, Artificial Sequence
  Description of Artificial Sequence: Synthetic polypeptide
DETEIRTTNPIATECWGSTTWANAEDWAEPGPI

SEQ ID NO: 188414 - protein, 33 aa, Artificial Sequence
  Description of Artificial Sequence: Synthetic polypeptide
DETEIRTTNPIATECWGSTTWSNADWAEPKGPI

SEQ ID NO: 188415 - protein, 33 aa, Artificial Sequence
  Description of Artificial Sequence: Synthetic polypeptide
DETEIRTTNPIATECWGSTTWSNEDWAEPKGPI

SEQ ID NO: 188416 - protein, 35 aa, Artificial Sequence
  Description of Artificial Sequence: Synthetic polypeptide
DETEIRTTNPIATECWGSTVWANAENWMEPKGPYR

SEQ ID NO: 188417 - protein, 34 aa, Artificial Sequence
  Description of Artificial Sequence: Synthetic polypeptide
DETEIRTTNPIATECWGSTWSNTEDWAEPKGPYI

SEQ ID NO: 188418 - protein, 33 aa, Artificial Sequence
  Description of Artificial Sequence: Synthetic polypeptide
DETEIRTTNPIATEQWGSTWAAADWAEHEGEYI

SEQ ID NO: 188419 - protein, 35 aa, Artificial Sequence
  Description of Artificial Sequence: Synthetic polypeptide
DETEIRTTNPIATECWGSVWANAEDWPAERKGPYG

SEQ ID NO: 188420 - protein, 34 aa, Artificial Sequence
  Description of Artificial Sequence: Synthetic polypeptide
DETEIRTTNPIATECWGSVWATTEAGAEPKGPYV

SEQ ID NO: 188421 - protein, 33 aa, Artificial Sequence
  Description of Artificial Sequence: Synthetic polypeptide
DETEIRTTNPIATECWGTVCAAADDWAPKGNYD

SEQ ID NO: 188422 - protein, 33 aa, Artificial Sequence
  Description of Artificial Sequence: Synthetic polypeptide
DETEIRTTNPIATECWGTVCAAADGWAPKGNYD

SEQ ID NO: 188423 - protein, 33 aa, Artificial Sequence
  Description of Artificial Sequence: Synthetic polypeptide
DETEIRTTNPIATECWGTVCANADDWAPKGPYD

SEQ ID NO: 188424 - protein, 33 aa, Artificial Sequence
  Description of Artificial Sequence: Synthetic polypeptide
DETEIRTTNPIATECWGTVCANADDWAPKGPYI

SEQ ID NO: 188425 - protein, 33 aa, Artificial Sequence
  Description of Artificial Sequence: Synthetic polypeptide
DETEIRTTNPIATECWGTVWANADDWAPKGPYI

SEQ ID NO: 188426 - protein, 31 aa, Artificial Sequence
  Description of Artificial Sequence: Synthetic polypeptide
DETEIRTTNPIATECYGATANEDWAEHKEPI

SEQ ID NO: 188427 - protein, 35 aa, Artificial Sequence
  Description of Artificial Sequence: Synthetic polypeptide
DETEIRTTNPIATECYGATTWANAEDLAERKGPYI

SEQ ID NO: 188428 - protein, 33 aa, Artificial Sequence
  Description of Artificial Sequence: Synthetic polypeptide
DETEIRTTNPIATECYGATWANAEDWAEHKGPI

SEQ ID NO: 188429 - protein, 33 aa, Artificial Sequence
  Description of Artificial Sequence: Synthetic polypeptide
DETEIRTTNPIATECYGATWANAEDWAESGPYQ

SEQ ID NO: 188430 - protein, 34 aa, Artificial Sequence
  Description of Artificial Sequence: Synthetic polypeptide
DETEIRTTNPIATECYGATWANEEDWAEPKGPYR

SEQ ID NO: 188431 - protein, 35 aa, Artificial Sequence
  Description of Artificial Sequence: Synthetic polypeptide
DETEIRTTNPIATECWGSVWANAEDWPAERKGPYI

SEQ ID NO: 188432 - protein, 36 aa, Artificial Sequence
  Description of Artificial Sequence: Synthetic polypeptide
DETNEIATTNPVAYEQWGSVSGDNMNGDDRQDGSEE

SEQ ID NO: 188433 - protein, 33 aa, Artificial Sequence
  Description of Artificial Sequence: Synthetic polypeptide
DETEIRTTNPIATEQWGSTWAAADWAEHEGEYL

SEQ ID NO: 188434 - protein, 33 aa, Artificial Sequence
  Description of Artificial Sequence: Synthetic polypeptide
DETEIRTTNPISTECWGATVWAANLAEPKGTYI

SEQ ID NO: 188435 - protein, 33 aa, Artificial Sequence
  Description of Artificial Sequence: Synthetic polypeptide
DETEIRTTNPVATECWGATTWANAEGWAFKGPI

SEQ ID NO: 188436 - protein, 33 aa, Artificial Sequence
  Description of Artificial Sequence: Synthetic polypeptide
DETEIRTTNPVATECWGATTWSNADWAPKGGYI

SEQ ID NO: 188437 - protein, 36 aa, Artificial Sequence
  Description of Artificial Sequence: Synthetic polypeptide
DETEIRTTNPVATECWGATVSANAEAGAEPNGMPPI

SEQ ID NO: 188438 - protein, 35 aa, Artificial Sequence
  Description of Artificial Sequence: Synthetic polypeptide
DETEIRTTNPVATECWGATVSANAEDWAEPKGPYI

SEQ ID NO: 188439 - protein, 36 aa, Artificial Sequence
  Description of Artificial Sequence: Synthetic polypeptide
DETEIRTTNPVATECWGATVSANTEAGAERNGMPPI

SEQ ID NO: 188440 - protein, 35 aa, Artificial Sequence
  Description of Artificial Sequence: Synthetic polypeptide
DETEIRTTNPVATECWGATVWANAEDEAERKGPYI

SEQ ID NO: 188441 - protein, 35 aa, Artificial Sequence
  Description of Artificial Sequence: Synthetic polypeptide
DETEIRTTNPVATECWGATVWANAEDWAERKGPYI

SEQ ID NO: 188442 - protein, 35 aa, Artificial Sequence
  Description of Artificial Sequence: Synthetic polypeptide
DETEIRTTNPVATECWGATVWSNAEDWPQEPEGPI

SEQ ID NO: 188443 - protein, 33 aa, Artificial Sequence
  Description of Artificial Sequence: Synthetic polypeptide
DETEIRTTNPVATECWGATWANADWAEPKGPDI

SEQ ID NO: 188444 - protein, 34 aa, Artificial Sequence
  Description of Artificial Sequence: Synthetic polypeptide
DETEIRTTNPVATECWGATWANAEDLADHKGPDI

SEQ ID NO: 188445 - protein, 34 aa, Artificial Sequence
  Description of Artificial Sequence: Synthetic polypeptide
DETEIRTTNPVATECWGATWANAINEPAERKGPI

SEQ ID NO: 188446 - protein, 32 aa, Artificial Sequence
  Description of Artificial Sequence: Synthetic polypeptide
DETEIRTTNPVATECWGATWSNADEAEAAEPA

SEQ ID NO: 188447 - protein, 32 aa, Artificial Sequence
  Description of Artificial Sequence: Synthetic polypeptide
DETEIRTTNPVATECWGATWSNADWAEAAEPA

SEQ ID NO: 188448 - protein, 32 aa, Artificial Sequence
  Description of Artificial Sequence: Synthetic polypeptide
DETEIRTTNPVATECWGATWSNADWAEAKEPA

SEQ ID NO: 188449 - protein, 33 aa, Artificial Sequence
  Description of Artificial Sequence: Synthetic polypeptide
DETEIRTTNPVATECWGDTWSNEEDWANAKEDA

SEQ ID NO: 188450 - protein, 33 aa, Artificial Sequence
  Description of Artificial Sequence: Synthetic polypeptide
DETEIRTTNPVATECWGDTWSNEEDWANAKEPA

SEQ ID NO: 188451 - protein, 35 aa, Artificial Sequence
  Description of Artificial Sequence: Synthetic polypeptide
DETEIRTTNPVATECWGSTTWANAEDWNMRKGPYI

SEQ ID NO: 188452 - protein, 36 aa, Artificial Sequence
  Description of Artificial Sequence: Synthetic polypeptide
DETEIRTTNPVATECWGSTTWSTAEDWPNEPNGPYI

SEQ ID NO: 188453 - protein, 34 aa, Artificial Sequence
  Description of Artificial Sequence: Synthetic polypeptide
DETEIRTTNPVATECWGTTTWANAEDWAQPNGPI

SEQ ID NO: 188454 - protein, 34 aa, Artificial Sequence
  Description of Artificial Sequence: Synthetic polypeptide
DETEIRTTNPVATECYGATTWANAEDWAEHKGPI

SEQ ID NO: 188455 - protein, 34 aa, Artificial Sequence
  Description of Artificial Sequence: Synthetic polypeptide
DETEIRTTNPVATECYGATVANDEDWAEPKGPYI

SEQ ID NO: 188456 - protein, 35 aa, Artificial Sequence
  Description of Artificial Sequence: Synthetic polypeptide
DETEIRTTNPVATECYGATVWANDEDWAEPKGPYI

SEQ ID NO: 188457 - protein, 35 aa, Artificial Sequence
  Description of Artificial Sequence: Synthetic polypeptide
DETEIRTTNPVATECYGSTTWANAEDWAEPKGPYI

SEQ ID NO: 188458 - protein, 33 aa, Artificial Sequence
  Description of Artificial Sequence: Synthetic polypeptide
DETEIRTTNPVATECWGATTWANAEDWAPGPYI

SEQ ID NO: 188459 - protein, 34 aa, Artificial Sequence
  Description of Artificial Sequence: Synthetic polypeptide
DETEIRTTNPVATECWGATTWANAECLAEPGPYI

SEQ ID NO: 188460 - protein, 34 aa, Artificial Sequence
  Description of Artificial Sequence: Synthetic polypeptide
DETEIRTTNPVATECWGATTWANADWQEPKGPYI

SEQ ID NO: 188461 - protein, 33 aa, Artificial Sequence
  Description of Artificial Sequence: Synthetic polypeptide
DETEIRTTNPVATECWGATTWAAECLAEPGPYI

SEQ ID NO: 188462 - protein, 32 aa, Artificial Sequence
  Description of Artificial Sequence: Synthetic polypeptide
DETEIRTTNPISTECWGATWANCEDLAPKGTI

SEQ ID NO: 188463 - protein, 33 aa, Artificial Sequence
  Description of Artificial Sequence: Synthetic polypeptide
DETEIRTTNPISTEPWGTTIWSMEDWQEQKGNH

SEQ ID NO: 188464 - protein, 34 aa, Artificial Sequence
  Description of Artificial Sequence: Synthetic polypeptide
DETEIRTTNPISTEPYGATWSNMEDIQAEQNGNH

SEQ ID NO: 188465 - protein, 35 aa, Artificial Sequence
  Description of Artificial Sequence: Synthetic polypeptide
AESEEIATTNPVAYEQWGSCSTGGNAGEHQGKTDE

SEQ ID NO: 188466 - protein, 35 aa, Artificial Sequence
  Description of Artificial Sequence: Synthetic polypeptide
AESEEIATTNPVAYEQWGHVSTGGNAGEHQGPTDE

SEQ ID NO: 188467 - protein, 36 aa, Artificial Sequence
  Description of Artificial Sequence: Synthetic polypeptide
AESDEIATTNPVAYEQWGSVSTGGNAGEHQPGTDES

SEQ ID NO: 188468 - protein, 36 aa, Artificial Sequence
  Description of Artificial Sequence: Synthetic polypeptide
AESDEIATTNPVAYEQWGSVSTGGNAGEHQGGTDEK

SEQ ID NO: 188469 - protein, 35 aa, Artificial Sequence
  Description of Artificial Sequence: Synthetic polypeptide
AESDEIATTNPVAYEQWGSVCYNNDVNENRGNNNS

SEQ ID NO: 188470 - protein, 35 aa, Artificial Sequence
  Description of Artificial Sequence: Synthetic polypeptide
AESDEIATTNPVAYEQWGSVCLQNDVNEPRGQNDS

SEQ ID NO: 188471 - protein, 32 aa, Artificial Sequence
  Description of Artificial Sequence: Synthetic polypeptide
AESCIACTNPVAYEGYGEASCENGSQRVGGSV

SEQ ID NO: 188472 - protein, 36 aa, Artificial Sequence
  Description of Artificial Sequence: Synthetic polypeptide
DETEIRTTNPVATEAYGSVFGQFEDDEGGNIQENID

SEQ ID NO: 188473 - protein, 34 aa, Artificial Sequence
  Description of Artificial Sequence: Synthetic polypeptide
DETEIRTTNPIATEQYGTTCANAEDWAEFKGPYD

SEQ ID NO: 188474 - protein, 35 aa, Artificial Sequence
  Description of Artificial Sequence: Synthetic polypeptide
AESAEIATTNPVAYEQWGSVSTGGNAGEHQGTDEG

SEQ ID NO: 188475 - protein, 32 aa, Artificial Sequence
  Description of Artificial Sequence: Synthetic polypeptide
DETEIRTTNPVATECWGATAAEIWMEPAGPYA

SEQ ID NO: 188476 - protein, 32 aa, Artificial Sequence
  Description of Artificial Sequence: Synthetic polypeptide
DETEIRTTNPVATECWGATAAEIWMEPKGPYA

SEQ ID NO: 188477 - protein, 33 aa, Artificial Sequence
  Description of Artificial Sequence: Synthetic polypeptide
DETEIRTTNPVATECWGATACIDWPADREGEPG

SEQ ID NO: 188478 - protein, 31 aa, Artificial Sequence
  Description of Artificial Sequence: Synthetic polypeptide
DETEIRTTNPVATECWGATANAIEMEAAEDI

SEQ ID NO: 188479 - protein, 32 aa, Artificial Sequence
  Description of Artificial Sequence: Synthetic polypeptide
DETEIRTTNPVATECWGATANAIEMEAAGDYI

SEQ ID NO: 188480 - protein, 32 aa, Artificial Sequence
  Description of Artificial Sequence: Synthetic polypeptide
DETEIRTTNPVATECWGATANAIEMEPAGDYI

SEQ ID NO: 188481 - protein, 31 aa, Artificial Sequence
  Description of Artificial Sequence: Synthetic polypeptide
DETEIRTTNPVATECWGATANEIEMEAAEDA

SEQ ID NO: 188482 - protein, 34 aa, Artificial Sequence
  Description of Artificial Sequence: Synthetic polypeptide
DETEIRTTNPVATECWGATSANTEDWAEPKGPYV

SEQ ID NO: 188483 - protein, 34 aa, Artificial Sequence
  Description of Artificial Sequence: Synthetic polypeptide
DETEIRTTNPVATECWGATTANAEDWAERKGPYI

SEQ ID NO: 188484 - protein, 33 aa, Artificial Sequence
  Description of Artificial Sequence: Synthetic polypeptide
DETEIRTTNPVATECWGATTANAEIWMNPAEPI

SEQ ID NO: 188485 - protein, 33 aa, Artificial Sequence
  Description of Artificial Sequence: Synthetic polypeptide
DETEIRTTNPVATECWGATTANEEIEMNPAEPI

SEQ ID NO: 188486 - protein, 33 aa, Artificial Sequence
  Description of Artificial Sequence: Synthetic polypeptide
DETEIRTTNPVATECWGAIWSNAEDWAEPKGPI

SEQ ID NO: 188487 - protein, 36 aa, Artificial Sequence
  Description of Artificial Sequence: Synthetic polypeptide
DETNEIATTNPVAYERWGSVSGGNADDSRNNGNGEM

SEQ ID NO: 188488 - protein, 36 aa, Artificial Sequence
  Description of Artificial Sequence: Synthetic polypeptide
DETNEIATTNPVAYERWGSVSGGNADDSRNNGTGNP

SEQ ID NO: 188489 - protein, 35 aa, Artificial Sequence
  Description of Artificial Sequence: Synthetic polypeptide
DETNEIATTNPVAYERWGTVPTGNLEGNDAGGNEP

SEQ ID NO: 188490 - protein, 39 aa, Artificial Sequence
  Description of Artificial Sequence: Synthetic polypeptide
DEDEIRTTNPVATEQYGVVSTVTNPNNNQQGIGTTQEED

SEQ ID NO: 188491 - protein, 40 aa, Artificial Sequence
  Description of Artificial Sequence: Synthetic polypeptide
DEDEIRTTNPVATEQYGVVSTVTNQNNNQQGIGTNQQDED

SEQ ID NO: 188492 - protein, 37 aa, Artificial Sequence
  Description of Artificial Sequence: Synthetic polypeptide
DEAEIRTTNPVATEQYGSTISWCPPLEENQHEQIEMQ

SEQ ID NO: 188493 - protein, 39 aa, Artificial Sequence
  Description of Artificial Sequence: Synthetic polypeptide
DEDEIRTTNPVATEQYGVVSTVTNQNNNQQGIGTTEDED

SEQ ID NO: 188494 - protein, 40 aa, Artificial Sequence
  Description of Artificial Sequence: Synthetic polypeptide
DEDEIRTTNPVATEQYGVVSTVTTGNGNQQGIGTTNQDED

SEQ ID NO: 188495 - protein, 37 aa, Artificial Sequence
  Description of Artificial Sequence: Synthetic polypeptide
DEAEIRTTNPVATEQYGSTIPWTPYWEENDHSQIEMQ

SEQ ID NO: 188496 - protein, 37 aa, Artificial Sequence
  Description of Artificial Sequence: Synthetic polypeptide
DEAEIRTTNPVATEQYGSTIPWTPVWEDNIHSQIEMQ

SEQ ID NO: 188497 - protein, 37 aa, Artificial Sequence
  Description of Artificial Sequence: Synthetic polypeptide
DEVEICTTNPVATEGYGSVVNFDDPTVGDQTGEGGNI

SEQ ID NO: 188498 - protein, 37 aa, Artificial Sequence
  Description of Artificial Sequence: Synthetic polypeptide
DEAEIRTTNPVATEQYGSTIPWTPVLEENQHSQIEMI

SEQ ID NO: 188499 - protein, 37 aa, Artificial Sequence
  Description of Artificial Sequence: Synthetic polypeptide
DEAEIRTTNPVATEQYGSTIPWTPTLEENQHFQIETQ

SEQ ID NO: 188500 - protein, 38 aa, Artificial Sequence
  Description of Artificial Sequence: Synthetic polypeptide
DEAEIRTTNPVATEQYGSTIPWTPPWLENQHSQIEGLQ

SEQ ID NO: 188501 - protein, 35 aa, Artificial Sequence
  Description of Artificial Sequence: Synthetic polypeptide
DEVEICTTNPVATEQYGQVVDQFGGGNDDQNEQDT

SEQ ID NO: 188502 - protein, 38 aa, Artificial Sequence
  Description of Artificial Sequence: Synthetic polypeptide
DEDEIRTTNPVATEQYGVVSTVVATQQGEEEEEETTDE

SEQ ID NO: 188503 - protein, 38 aa, Artificial Sequence
  Description of Artificial Sequence: Synthetic polypeptide
DEDEIRTTNPVATEQYGVVSTVVATQQLEEEEEETNDT

SEQ ID NO: 188504 - protein, 37 aa, Artificial Sequence
  Description of Artificial Sequence: Synthetic polypeptide
DEDEIRTTNPVATEQYGVVSTVVATQQNEEEEEEEEQ

SEQ ID NO: 188505 - protein, 37 aa, Artificial Sequence
  Description of Artificial Sequence: Synthetic polypeptide
DEDEIRTTNPVATEQYGVVSTVVATQQNEEEEEETED

SEQ ID NO: 188506 - protein, 39 aa, Artificial Sequence
  Description of Artificial Sequence: Synthetic polypeptide
DEDEIRTTNPVATEQYGVVSTVVNGNNNQQGIGTTQDEQ

SEQ ID NO: 188507 - protein, 40 aa, Artificial Sequence
  Description of Artificial Sequence: Synthetic polypeptide
DEDEIRTTNPVATEQYGVVSTVVNNNNNEQGIGTTNQEED

SEQ ID NO: 188508 - protein, 39 aa, Artificial Sequence
  Description of Artificial Sequence: Synthetic polypeptide
DEDEIRTTNPVATEQYGVVSTVVNNNNQQLIGTTDEEED

SEQ ID NO: 188509 - protein, 36 aa, Artificial Sequence
  Description of Artificial Sequence: Synthetic polypeptide
DEVEIHTTNPVATEQYGTVVVSATDGDDEEGEGGDI

SEQ ID NO: 188510 - protein, 38 aa, Artificial Sequence
  Description of Artificial Sequence: Synthetic polypeptide
DEDEIRTTNPVATEQYGVVSTVVNNQQNEEEAEEETDQ

SEQ ID NO: 188511 - protein, 37 aa, Artificial Sequence
  Description of Artificial Sequence: Synthetic polypeptide
DEVEIKTTNPVATEQYGSVVDFDNGEGFDEQTGEIAL

SEQ ID NO: 188512 - protein, 36 aa, Artificial Sequence
  Description of Artificial Sequence: Synthetic polypeptide
DEVEIKTTNPVATEQYGTVVDVGNMDTDGGGGQNGE

SEQ ID NO: 188513 - protein, 40 aa, Artificial Sequence
  Description of Artificial Sequence: Synthetic polypeptide
DEDEIRTTNPVATEQYGVVSTVTNPNNLQQGIGTTSQDED

SEQ ID NO: 188514 - protein, 37 aa, Artificial Sequence
  Description of Artificial Sequence: Synthetic polypeptide
DEAEIRTTNPVATEQYGSTIYWTPPWEENQHDQIEMQ

SEQ ID NO: 188515 - protein, 34 aa, Artificial Sequence
  Description of Artificial Sequence: Synthetic polypeptide
DEVEIATTNPVAYESWGCVSGWNGEERNNMQGDA

SEQ ID NO: 188516 - protein, 34 aa, Artificial Sequence
  Description of Artificial Sequence: Synthetic polypeptide
DEVEIATTNPVAYERWGVCATNNLDPGDHPNHAE

SEQ ID NO: 188517 - protein, 37 aa, Artificial Sequence
  Description of Artificial Sequence: Synthetic polypeptide
DEVEIATTNPVAYEQYGTVCSYTDGLPEEEHDGDNHS

SEQ ID NO: 188518 - protein, 36 aa, Artificial Sequence
  Description of Artificial Sequence: Synthetic polypeptide
DEVEIATTNPVAYEQYGTVCSYTDGLPEGHEGMGKS

SEQ ID NO: 188519 - protein, 39 aa, Artificial Sequence
  Description of Artificial Sequence: Synthetic polypeptide
DEDEIRTTNPVATEQYGVVSTVNNQNNNQQGIGTTQDTD

SEQ ID NO: 188520 - protein, 40 aa, Artificial Sequence
  Description of Artificial Sequence: Synthetic polypeptide
DEDEIRTTNPVATEQYGVVSTVNNQQGNQQGIGTTTQDED

SEQ ID NO: 188521 - protein, 40 aa, Artificial Sequence
  Description of Artificial Sequence: Synthetic polypeptide
DEDEIRTTNPVATEQYGVVSTVNPNNNNQQGIGTTNQQED

SEQ ID NO: 188522 - protein, 40 aa, Artificial Sequence
  Description of Artificial Sequence: Synthetic polypeptide
DEDEIRTTNPVATEQYGVVSTVNPPNNNQQGIGTTNQDEE

SEQ ID NO: 188523 - protein, 40 aa, Artificial Sequence
  Description of Artificial Sequence: Synthetic polypeptide
DEDEIRTTNPVATEQYGVVSTVNPQNGNQQGIGTTNQDED

SEQ ID NO: 188524 - protein, 36 aa, Artificial Sequence
  Description of Artificial Sequence: Synthetic polypeptide
AENEIAQTNPVATEQYGSVSATTGGQVELDNGEEDD

SEQ ID NO: 188525 - protein, 40 aa, Artificial Sequence
  Description of Artificial Sequence: Synthetic polypeptide
DEDEIRTTNPVATEQYGVVSTVNPQNNNLQGIGTTTEEED

SEQ ID NO: 188526 - protein, 40 aa, Artificial Sequence
  Description of Artificial Sequence: Synthetic polypeptide
DEDEIRTTNPVATEQYGVVSTVNQGNNDEQGIGTTNQDED

SEQ ID NO: 188527 - protein, 39 aa, Artificial Sequence
  Description of Artificial Sequence: Synthetic polypeptide
DEDEIRTTNPVATEQYGVVSTVNQNGNQQGIGTTDQGED

SEQ ID NO: 188528 - protein, 36 aa, Artificial Sequence
  Description of Artificial Sequence: Synthetic polypeptide
DEVEIKTTNPVATESYGAVVVDDNNEQIGGQNGQTL

SEQ ID NO: 188529 - protein, 39 aa, Artificial Sequence
  Description of Artificial Sequence: Synthetic polypeptide
DEDEIRTTNPVATEQYGVVSTVNQNNNNQGIGTTGQDED

SEQ ID NO: 188530 - protein, 40 aa, Artificial Sequence
  Description of Artificial Sequence: Synthetic polypeptide
DEDEIRTTNPVATEQYGVVSTVNQQNNNQQGIGTNTQDED

SEQ ID NO: 188531 - protein, 40 aa, Artificial Sequence
  Description of Artificial Sequence: Synthetic polypeptide
DEDEIRTTNPVATEQYGVVSTVNTGNNNQQGIGTNNEDED

SEQ ID NO: 188532 - protein, 40 aa, Artificial Sequence
  Description of Artificial Sequence: Synthetic polypeptide
DEDEIRTTNPVATEQYGVVSTVNTGNNNQQGIGTTNQTEQ

SEQ ID NO: 188533 - protein, 40 aa, Artificial Sequence
  Description of Artificial Sequence: Synthetic polypeptide
DEDEIRTTNPVATEQYGVVSTVNTQNNNQQGIGTTDQNED

SEQ ID NO: 188534 - protein, 39 aa, Artificial Sequence
  Description of Artificial Sequence: Synthetic polypeptide
DEDEIRTTNPVATEQYGVVSTVQTGNNNQQGIGTTQDED

SEQ ID NO: 188535 - protein, 33 aa, Artificial Sequence
  Description of Artificial Sequence: Synthetic polypeptide
DEVEIATTNPVAYERWGCTYTTEQINGNDNDGE

SEQ ID NO: 188536 - protein, 34 aa, Artificial Sequence
  Description of Artificial Sequence: Synthetic polypeptide
DEVEIATTNPVAYERWGCTYTTMQMNPGNDNDKR

SEQ ID NO: 188537 - protein, 40 aa, Artificial Sequence
  Description of Artificial Sequence: Synthetic polypeptide
DEDEIRTTNPVATEQYGVVSTVTAGNNNQQGIGTTNQEED

SEQ ID NO: 188538 - protein, 40 aa, Artificial Sequence
  Description of Artificial Sequence: Synthetic polypeptide
DEDEIRTTNPVATEQYGVVSTVTGGNNNQQGIGTNNQDED

SEQ ID NO: 188539 - protein, 39 aa, Artificial Sequence
  Description of Artificial Sequence: Synthetic polypeptide
DEDEIRTTNPVATEQYGVVSTVTIGNNNNQGIGTTQDED

SEQ ID NO: 188540 - protein, 40 aa, Artificial Sequence
  Description of Artificial Sequence: Synthetic polypeptide
DEDEIRTTNPVATEQYGVVSTVTIGNNNQQGIGTTNQDEM

SEQ ID NO: 188541 - protein, 40 aa, Artificial Sequence
  Description of Artificial Sequence: Synthetic polypeptide
DEDEIRTTNPVATEQYGVVSTVNQNNNNQQGIGTTNQDTD

SEQ ID NO: 188542 - protein, 40 aa, Artificial Sequence
  Description of Artificial Sequence: Synthetic polypeptide
DEDEIRTTNPVATEQYGVVSTVNNQNNLQQGIGTTDQDED

SEQ ID NO: 188543 - protein, 37 aa, Artificial Sequence
  Description of Artificial Sequence: Synthetic polypeptide
DEVEIRATNPVATEQYGSVVQDGFEGQGQGQNEGVEG

SEQ ID NO: 188544 - protein, 34 aa, Artificial Sequence
  Description of Artificial Sequence: Synthetic polypeptide
DENEIRTTNPVAYEQWGGVYTIEIEKMNQNEKDA

SEQ ID NO: 188545 - protein, 37 aa, Artificial Sequence
  Description of Artificial Sequence: Synthetic polypeptide
DEAEIRTTNPVATEQYGSTIPWTPPLEENIHWQIEMQ

SEQ ID NO: 188546 - protein, 37 aa, Artificial Sequence
  Description of Artificial Sequence: Synthetic polypeptide
DEAEIRTTNPVATEQYGSTIPWTPPLEENGHSQIESQ

SEQ ID NO: 188547 - protein, 36 aa, Artificial Sequence
  Description of Artificial Sequence: Synthetic polypeptide
DEVEIRTTNPVATEQYGMVSVEGMGDGGQGQEMEET

SEQ ID NO: 188548 - protein, 37 aa, Artificial Sequence
  Description of Artificial Sequence: Synthetic polypeptide
DEAEIRTTNPVATEQYGSTIPWTPPLEENAHFQTEMQ

SEQ ID NO: 188549 - protein, 37 aa, Artificial Sequence
  Description of Artificial Sequence: Synthetic polypeptide
DEVEIRTTNPVATEQYGSTIPWVPPLHENQHEQIEMQ

SEQ ID NO: 188550 - protein, 37 aa, Artificial Sequence
  Description of Artificial Sequence: Synthetic polypeptide
DEAEIRTTNPVATEQYGSTIPWTPPLEANQHEQSEMA

SEQ ID NO: 188551 - protein, 37 aa, Artificial Sequence
  Description of Artificial Sequence: Synthetic polypeptide
DENEIRTTNPVATEVYGSVVVNADGEGQEEEEGQEED

SEQ ID NO: 188552 - protein, 38 aa, Artificial Sequence
  Description of Artificial Sequence: Synthetic polypeptide
DENEIRTTNPVATEVYGSVSVNTDGPEGQTEEQGQEED

SEQ ID NO: 188553 - protein, 38 aa, Artificial Sequence
  Description of Artificial Sequence: Synthetic polypeptide
DEVEIRTTNPVATEQYGSVFDNNNMNQNEMTENEFGGE

SEQ ID NO: 188554 - protein, 38 aa, Artificial Sequence
  Description of Artificial Sequence: Synthetic polypeptide
DEVEIRTTNPVATEQYGSVGDNNEMGQNEMTENEAGQE

SEQ ID NO: 188555 - protein, 38 aa, Artificial Sequence
  Description of Artificial Sequence: Synthetic polypeptide
DEVEIRTTNPVATEQYGSVGDNNEMGQNTMTENEFGQQ

SEQ ID NO: 188556 - protein, 37 aa, Artificial Sequence
  Description of Artificial Sequence: Synthetic polypeptide
DEAEIRTTNPVATEQYGSTIPWTLPLEENQHEQSEMQ

SEQ ID NO: 188557 - protein, 36 aa, Artificial Sequence
  Description of Artificial Sequence: Synthetic polypeptide
DENEIRTTNPVATETYGSVFVDDVSLEEDIGSTQEQ

SEQ ID NO: 188558 - protein, 37 aa, Artificial Sequence
  Description of Artificial Sequence: Synthetic polypeptide
DENEIRTTNPVATESYGSVVSDGMQGLTLGEGDQIGD

SEQ ID NO: 188559 - protein, 35 aa, Artificial Sequence
  Description of Artificial Sequence: Synthetic polypeptide
DEDEIRTTNPVATTQYGVVATTQAGTTEQGSVTDE

SEQ ID NO: 188560 - protein, 36 aa, Artificial Sequence
  Description of Artificial Sequence: Synthetic polypeptide
DENEIRTTNPVATESYGSVMGNDFTGDTTGGGGGED

SEQ ID NO: 188561 - protein, 35 aa, Artificial Sequence
  Description of Artificial Sequence: Synthetic polypeptide
DENEIRTTNPVATESWGKVPSEQIAHSMNAAEGHA

SEQ ID NO: 188562 - protein, 38 aa, Artificial Sequence
  Description of Artificial Sequence: Synthetic polypeptide
DEVEIRTTNPVATEQYGSVQDNNNMNQNEMTVGEFGQE

SEQ ID NO: 188563 - protein, 37 aa, Artificial Sequence
  Description of Artificial Sequence: Synthetic polypeptide
DENEIRTTNPVATEQYGVVVMNGFNGEGGQDENTDDG

SEQ ID NO: 188564 - protein, 37 aa, Artificial Sequence
  Description of Artificial Sequence: Synthetic polypeptide
DENEIRTTNPVATEQYGVVVMNGFNAGEGGQLENTDG

SEQ ID NO: 188565 - protein, 38 aa, Artificial Sequence
  Description of Artificial Sequence: Synthetic polypeptide
DENEIRTTNPVATEQYGVVVMDTEGGDQEGNGEGEDLV

SEQ ID NO: 188566 - protein, 36 aa, Artificial Sequence
  Description of Artificial Sequence: Synthetic polypeptide
DEDEIRTTNPVAYDQWGSVQQCFGNQSQWTGTKNGV

SEQ ID NO: 188567 - protein, 38 aa, Artificial Sequence
  Description of Artificial Sequence: Synthetic polypeptide
DEDEIRTTNPVAYDQYGCSVQQCTGNQSQNWTGTKNLV

SEQ ID NO: 188568 - protein, 37 aa, Artificial Sequence
  Description of Artificial Sequence: Synthetic polypeptide
DEAEIRTTNPVATEQYGSTIPWTPPLEENQHFDQEMQ

SEQ ID NO: 188569 - protein, 37 aa, Artificial Sequence
  Description of Artificial Sequence: Synthetic polypeptide
CEEEIRTTNPVATEQYGQCVCSNWGEHQEYFGSDTQQ

SEQ ID NO: 188570 - protein, 37 aa, Artificial Sequence
  Description of Artificial Sequence: Synthetic polypeptide
DEAEIRTTNPVATEQYGSTIPWTPPLEENQHFQEEFQ

SEQ ID NO: 188571 - protein, 38 aa, Artificial Sequence
  Description of Artificial Sequence: Synthetic polypeptide
DEAEIRTTNPVATEQYGSTIPWTPPLEENQRHEQEEMQ

SEQ ID NO: 188572 - protein, 38 aa, Artificial Sequence
  Description of Artificial Sequence: Synthetic polypeptide
DEVEIRSTNPVATEQYGSVITMGNAGTNDEGEGGGNQG

SEQ ID NO: 188573 - protein, 38 aa, Artificial Sequence
  Description of Artificial Sequence: Synthetic polypeptide
DEVEIRSTNPVATEQYGSVITMNNAGTNDEGEGGNQGA

SEQ ID NO: 188574 - protein, 36 aa, Artificial Sequence
  Description of Artificial Sequence: Synthetic polypeptide
DEVEIRSTNPVATEQYGSVTVNGNMDIMGQGEDEGG

SEQ ID NO: 188575 - protein, 38 aa, Artificial Sequence
  Description of Artificial Sequence: Synthetic polypeptide
DEVEIRSTNPVATEQYGSVVITDGMNNQTGEDEQGIET

SEQ ID NO: 188576 - protein, 40 aa, Artificial Sequence
  Description of Artificial Sequence: Synthetic polypeptide
DEDEIRTTNPVATEQYGVVSTVVNQNNNQQGIGTNLQGED

SEQ ID NO: 188577 - protein, 40 aa, Artificial Sequence
  Description of Artificial Sequence: Synthetic polypeptide
DEDEIRTTNPVATEQYGVVSTVVNQNNNQQGIGTTNQDED

SEQ ID NO: 188578 - protein, 37 aa, Artificial Sequence
  Description of Artificial Sequence: Synthetic polypeptide
DEVEIRTTNPVATDQYGVVNDNSIGQNQGQGDENEDQ

SEQ ID NO: 188579 - protein, 39 aa, Artificial Sequence
  Description of Artificial Sequence: Synthetic polypeptide
DEDEIRTTNPVATEQYGVVSTVVTNNNNEQGIGTTQDED

SEQ ID NO: 188580 - protein, 37 aa, Artificial Sequence
  Description of Artificial Sequence: Synthetic polypeptide
DEVEIRTTNPVATECYGSVNSNVDNNGEEMTEGEGQG

SEQ ID NO: 188581 - protein, 38 aa, Artificial Sequence
  Description of Artificial Sequence: Synthetic polypeptide
DEDEIRTTNPVATEQYGVVSTVVVNQQNEEEEEEEDTE

SEQ ID NO: 188582 - protein, 39 aa, Artificial Sequence
  Description of Artificial Sequence: Synthetic polypeptide
DEDEIRTTNPVATEQYGVVSTVVVTDNQLAGSTNQNATE

SEQ ID NO: 188583 - protein, 36 aa, Artificial Sequence
  Description of Artificial Sequence: Synthetic polypeptide
DEVEIRGTNPVATEFWGVVVSAANGEGQRGQGEQGD

SEQ ID NO: 188584 - protein, 37 aa, Artificial Sequence
  Description of Artificial Sequence: Synthetic polypeptide
DEAEIRTTNPVATEQYGSTIPWTPPLWENQHFQIEWQ

SEQ ID NO: 188585 - protein, 37 aa, Artificial Sequence
  Description of Artificial Sequence: Synthetic polypeptide
DEDEIRTTNPVATEQYGVVSTVVVTQQNEEEEEEEDG

SEQ ID NO: 188586 - protein, 37 aa, Artificial Sequence
  Description of Artificial Sequence: Synthetic polypeptide
DEVEIRTTNPVATEGYGSVVDFDNGEGQDEQTGESVL

SEQ ID NO: 188587 - protein, 37 aa, Artificial Sequence
  Description of Artificial Sequence: Synthetic polypeptide
DEVEIRTTNPVATEGYGSVVDFDQGEGQDEQTGEIAR

SEQ ID NO: 188588 - protein, 38 aa, Artificial Sequence
  Description of Artificial Sequence: Synthetic polypeptide
CEEEIRTTNPVATEQYGMVGVDEDNTGGQEGQGENEGS

SEQ ID NO: 188589 - protein, 34 aa, Artificial Sequence
  Description of Artificial Sequence: Synthetic polypeptide
AENEIACTNPVAYEQYGCSCSWEHNQYFGSQNQA

SEQ ID NO: 188590 - protein, 37 aa, Artificial Sequence
  Description of Artificial Sequence: Synthetic polypeptide
CEEEIRTTNPVATEQYGQCVCPNWGEHNEGFNSDTQA

SEQ ID NO: 188591 - protein, 38 aa, Artificial Sequence
  Description of Artificial Sequence: Synthetic polypeptide
CEEEIRTTNPVATEQYGQCVCQNWGEHNQENFGSDNQA

SEQ ID NO: 188592 - protein, 38 aa, Artificial Sequence
  Description of Artificial Sequence: Synthetic polypeptide
DEVEIRTTNPVATEQYGAVSVNSVGNSGEFTNTEGQGP

SEQ ID NO: 188593 - protein, 38 aa, Artificial Sequence
  Description of Artificial Sequence: Synthetic polypeptide
DEDEIRTTNPVATESYGSVSADNFGQNNGQEDGQGQET

SEQ ID NO: 188594 - protein, 38 aa, Artificial Sequence
  Description of Artificial Sequence: Synthetic polypeptide
DEDEIRTTNPVATESYGSVTDNFTQNANGQEDGEGQET

SEQ ID NO: 188595 - protein, 37 aa, Artificial Sequence
  Description of Artificial Sequence: Synthetic polypeptide
CEEEIRTTNPVATEQYGQCVCSNWGEHNAENFNSDQD

SEQ ID NO: 188596 - protein, 36 aa, Artificial Sequence
  Description of Artificial Sequence: Synthetic polypeptide
DEVEIRTTNPVATEFYGQVVVGDGEGQSEVGGGNGD

SEQ ID NO: 188597 - protein, 32 aa, Artificial Sequence
  Description of Artificial Sequence: Synthetic polypeptide
DETEIRTTNPIATECWGAVWSADWMEPKEDYA

SEQ ID NO: 188598 - protein, 40 aa, Artificial Sequence
  Description of Artificial Sequence: Synthetic polypeptide
DEDEIRTTNPVATEQYGVVSTVNNQNGNQQGIGTNLQDED

SEQ ID NO: 188599 - protein, 40 aa, Artificial Sequence
  Description of Artificial Sequence: Synthetic polypeptide
DEDEIRTTNPVATEQYGVVSTVNNNQNNQQGIGTTNQDED

SEQ ID NO: 188600 - protein, 33 aa, Artificial Sequence
  Description of Artificial Sequence: Synthetic polypeptide
DEVEIATTNPVATEQWGTNCAANDGPVEDENND

SEQ ID NO: 188601 - protein, 35 aa, Artificial Sequence
  Description of Artificial Sequence: Synthetic polypeptide
DEVEIATTNPVATEQWGTVCAANDGPVEDEGGNDQ

SEQ ID NO: 188602 - protein, 35 aa, Artificial Sequence
  Description of Artificial Sequence: Synthetic polypeptide
DEVEIATTNPVATEQYGCVAANNGGEATDSQGEAM

SEQ ID NO: 188603 - protein, 38 aa, Artificial Sequence
  Description of Artificial Sequence: Synthetic polypeptide
DEVEIATTNPVATEQYGSVCADHNHPLENGMPMENVHA

SEQ ID NO: 188604 - protein, 38 aa, Artificial Sequence
  Description of Artificial Sequence: Synthetic polypeptide
DEVEIATTNPVATEQYGSVDQDTNEGQNLPDTNGGDQN

SEQ ID NO: 188605 - protein, 35 aa, Artificial Sequence
  Description of Artificial Sequence: Synthetic polypeptide
DENEIRTTNPVSTEPYGCISMEDAMQQPQSGQNHP

SEQ ID NO: 188606 - protein, 34 aa, Artificial Sequence
  Description of Artificial Sequence: Synthetic polypeptide
DENEIRTTNPVSTEPYGAIWANMEDIQAQQNGPI

SEQ ID NO: 188607 - protein, 40 aa, Artificial Sequence
  Description of Artificial Sequence: Synthetic polypeptide
DEDEIRTTNPVATEQYGSVSTVTNQNNNQQGIGTTSQDED

SEQ ID NO: 188608 - protein, 33 aa, Artificial Sequence
  Description of Artificial Sequence: Synthetic polypeptide
DENEIRTTNPVSTEPYGAIWAMEDIQAQQNGPI

SEQ ID NO: 188609 - protein, 40 aa, Artificial Sequence
  Description of Artificial Sequence: Synthetic polypeptide
DEDEIRTTNPVATEQYGSVSTVVNGNNNQQGIGTTLQDED

SEQ ID NO: 188610 - protein, 36 aa, Artificial Sequence
  Description of Artificial Sequence: Synthetic polypeptide
AENEIATTNPVATEHYGVLVACTYEHSQRPGTMPQR

SEQ ID NO: 188611 - protein, 40 aa, Artificial Sequence
  Description of Artificial Sequence: Synthetic polypeptide
DEDEIRTTNPVATEQYGVVSTSNNGNNNQQGIGTTNQEED

SEQ ID NO: 188612 - protein, 34 aa, Artificial Sequence
  Description of Artificial Sequence: Synthetic polypeptide
AENEIATTNPVATEGYGCVCSWVELQEHFISELA

SEQ ID NO: 188613 - protein, 33 aa, Artificial Sequence
  Description of Artificial Sequence: Synthetic polypeptide
AENEIATTNPVATEGYGCVCSWEHNQHSISELA

SEQ ID NO: 188614 - protein, 40 aa, Artificial Sequence
  Description of Artificial Sequence: Synthetic polypeptide
DEDEIRTTNPVATEQYGVVSTSNNGNQLLQGIGTTQQGEQ

SEQ ID NO: 188615 - protein, 34 aa, Artificial Sequence
  Description of Artificial Sequence: Synthetic polypeptide
DENEIRTTNPVSTEPWGTISCMEDHSQQQNGNNH

SEQ ID NO: 188616 - protein, 33 aa, Artificial Sequence
  Description of Artificial Sequence: Synthetic polypeptide
AENEIATTNPVATEGYGCVCSWAHNQHFESELS

SEQ ID NO: 188617 - protein, 35 aa, Artificial Sequence
  Description of Artificial Sequence: Synthetic polypeptide
AENEIATTNPVATEGYGCVCSTWELNQEHFISELA

SEQ ID NO: 188618 - protein, 34 aa, Artificial Sequence
  Description of Artificial Sequence: Synthetic polypeptide
DENEIRTTNPVSTEPWGATISMEDWQQQQNGNYI

SEQ ID NO: 188619 - protein, 32 aa, Artificial Sequence
  Description of Artificial Sequence: Synthetic polypeptide
DENEIRTTNPVSTEPWGAIAMEDIQQQNGPYH

SEQ ID NO: 188620 - protein, 35 aa, Artificial Sequence
  Description of Artificial Sequence: Synthetic polypeptide
DENEIRTTNPVSTEGYGTITSWEEHNQEQFGSDQA

SEQ ID NO: 188621 - protein, 34 aa, Artificial Sequence
  Description of Artificial Sequence: Synthetic polypeptide
DENEIRTTNPVSTEGYGTISWEDIQQEQFNSNQS

SEQ ID NO: 188622 - protein, 34 aa, Artificial Sequence
  Description of Artificial Sequence: Synthetic polypeptide
DENEIRTTNPVSTEGYGTISWEDINQENFGSDQS

SEQ ID NO: 188623 - protein, 36 aa, Artificial Sequence
  Description of Artificial Sequence: Synthetic polypeptide
DEVEIATTNPVATEQWGGCVAGTGELAQINNSQNNH

SEQ ID NO: 188624 - protein, 36 aa, Artificial Sequence
  Description of Artificial Sequence: Synthetic polypeptide
DEVEIATTNPVATEQWGCVAITEHLEAPDNQDENNH

SEQ ID NO: 188625 - protein, 36 aa, Artificial Sequence
  Description of Artificial Sequence: Synthetic polypeptide
DEVEIATTNPVATEQWGCVAALPNGLTNQGNPTPDH

SEQ ID NO: 188626 - protein, 32 aa, Artificial Sequence
  Description of Artificial Sequence: Synthetic polypeptide
AENEIATTNPVATTQWGMVRCWDQHQQEQNDP

SEQ ID NO: 188627 - protein, 35 aa, Artificial Sequence
  Description of Artificial Sequence: Synthetic polypeptide
DETQIQTTNPVAYEQWGCVAACTNNTSQRPPGQYP

SEQ ID NO: 188628 - protein, 37 aa, Artificial Sequence
  Description of Artificial Sequence: Synthetic polypeptide
DEDEIRTTNPVATEQWGVVVSTQQQSATNVATEDGSE

SEQ ID NO: 188629 - protein, 36 aa, Artificial Sequence
  Description of Artificial Sequence: Synthetic polypeptide
DEDEIRTTNPVATEQYGCVDTDAENGSDETEESQVE

SEQ ID NO: 188630 - protein, 36 aa, Artificial Sequence
  Description of Artificial Sequence: Synthetic polypeptide
DETSICTTNPCATEQWGVVSTVNNNNNQQQGTNTDE

SEQ ID NO: 188631 - protein, 35 aa, Artificial Sequence
  Description of Artificial Sequence: Synthetic polypeptide
DETSICTTNPCATEQWGVVSTVVNNTNQQGTTDGD

SEQ ID NO: 188632 - protein, 35 aa, Artificial Sequence
  Description of Artificial Sequence: Synthetic polypeptide
DENEIRTTNPVSTEPYGTISCIEDEISQQQNGNNH

SEQ ID NO: 188633 - protein, 36 aa, Artificial Sequence
  Description of Artificial Sequence: Synthetic polypeptide
DETSISTTNPCATEQWGVVSTVNNNNNQQQGTNTDE

SEQ ID NO: 188634 - protein, 37 aa, Artificial Sequence
  Description of Artificial Sequence: Synthetic polypeptide
DETTEISTTNPVAYECWGSVATGNGPLQDDRQQEGTD

SEQ ID NO: 188635 - protein, 34 aa, Artificial Sequence
  Description of Artificial Sequence: Synthetic polypeptide
DENEIRTTNPVSTEPYGTINSCEDIQQNQNGKTH

SEQ ID NO: 188636 - protein, 33 aa, Artificial Sequence
  Description of Artificial Sequence: Synthetic polypeptide
DENEIRTTNPVSTEPYGTINMEDMQQPQSGEHN

SEQ ID NO: 188637 - protein, 36 aa, Artificial Sequence
  Description of Artificial Sequence: Synthetic polypeptide
DETVEATTNPVAYEQWGCVYSTVNNDLKGEQGGNEH

SEQ ID NO: 188638 - protein, 35 aa, Artificial Sequence
  Description of Artificial Sequence: Synthetic polypeptide
DENEIRTTNPVSTEGYGTISWEDDQQEQFGSNTQS

SEQ ID NO: 188639 - protein, 35 aa, Artificial Sequence
  Description of Artificial Sequence: Synthetic polypeptide
DETVEATTNPVAYEQWGCVYSTVNNDQGEQGGNEM

SEQ ID NO: 188640 - protein, 34 aa, Artificial Sequence
  Description of Artificial Sequence: Synthetic polypeptide
DETVIQTTNPVAYEQWGCVAACTVNPSNRPGVEP

SEQ ID NO: 188641 - protein, 35 aa, Artificial Sequence
  Description of Artificial Sequence: Synthetic polypeptide
DETVIQTTNPVAYEQWGVVAACTVNPSQRGGTEPP

SEQ ID NO: 188642 - protein, 35 aa, Artificial Sequence
  Description of Artificial Sequence: Synthetic polypeptide
DETVISTTNPVAYEQWGCTAACTVNEPSQRGGTER

SEQ ID NO: 188643 - protein, 33 aa, Artificial Sequence
  Description of Artificial Sequence: Synthetic polypeptide
DENEIRTTNPVSTEPYGTIGEMEDIQQQQNGTH

SEQ ID NO: 188644 - protein, 35 aa, Artificial Sequence
  Description of Artificial Sequence: Synthetic polypeptide
DENEIRTTNPVSTEPYGTICSWEAHNQEQFGSDQA

SEQ ID NO: 188645 - protein, 35 aa, Artificial Sequence
  Description of Artificial Sequence: Synthetic polypeptide
DEVEIATTNPVATDQYGVVSTGDEGGGGQGEEQTA

SEQ ID NO: 188646 - protein, 35 aa, Artificial Sequence
  Description of Artificial Sequence: Synthetic polypeptide
DEVEIATTNPVATDQYGVVSTTGDEGGGGQGEETF

SEQ ID NO: 188647 - protein, 34 aa, Artificial Sequence
  Description of Artificial Sequence: Synthetic polypeptide
DENEIRTTNPVSTEPYGRTISVEDEQQPQSLQHN

SEQ ID NO: 188648 - protein, 32 aa, Artificial Sequence
  Description of Artificial Sequence: Synthetic polypeptide
AENEIATTNPVSTEPYGVCYCEDGQQQQNGNE

SEQ ID NO: 188649 - protein, 32 aa, Artificial Sequence
  Description of Artificial Sequence: Synthetic polypeptide
AENEIATTNPVAYEQWGGVYSIEIEMNQHEDQ

SEQ ID NO: 188650 - protein, 36 aa, Artificial Sequence
  Description of Artificial Sequence: Synthetic polypeptide
DEAEIRTTNPVATEQYGSVCIYMHDPTPEIGMEDEL

SEQ ID NO: 188651 - protein, 34 aa, Artificial Sequence
  Description of Artificial Sequence: Synthetic polypeptide
DETVIQTTNPVAYEQWGCVAACTVNPSAEGGQER

SEQ ID NO: 188652 - protein, 40 aa, Artificial Sequence
  Description of Artificial Sequence: Synthetic polypeptide
DEDEIRTTNPVATEQYGVVSTVNNPNNDQQGIGTTNQDED

SEQ ID NO: 188653 - protein, 33 aa, Artificial Sequence
  Description of Artificial Sequence: Synthetic polypeptide
DEVEIATTNPVAYECWGCVSGGNGNENGGEGMW

SEQ ID NO: 188654 - protein, 35 aa, Artificial Sequence
  Description of Artificial Sequence: Synthetic polypeptide
DEVEIATTNPVAYECWGSVYIAENDHQQDGGMNNP

SEQ ID NO: 188655 - protein, 40 aa, Artificial Sequence
  Description of Artificial Sequence: Synthetic polypeptide
DEDEIRTTNPVATEQYGVVSTVNDGNNNQQGIGTTNPTED

SEQ ID NO: 188656 - protein, 40 aa, Artificial Sequence
  Description of Artificial Sequence: Synthetic polypeptide
DEDEIRTTNPVATEQYGVVSTVNDGNNNQQGIGTTNQNTD

SEQ ID NO: 188657 - protein, 40 aa, Artificial Sequence
  Description of Artificial Sequence: Synthetic polypeptide
DEDEIRTTNPVATEQYGVVSTVNDQNNNLQGIGTTTEDEE

SEQ ID NO: 188658 - protein, 35 aa, Artificial Sequence
  Description of Artificial Sequence: Synthetic polypeptide
DENEIRTTNPVSTECYGTTTSNMEDIQQQQNGNYH

SEQ ID NO: 188659 - protein, 35 aa, Artificial Sequence
  Description of Artificial Sequence: Synthetic polypeptide
DENEIRTTNPVSTECYGTTTSNMEDIQQEQNGNYH

SEQ ID NO: 188660 - protein, 39 aa, Artificial Sequence
  Description of Artificial Sequence: Synthetic polypeptide
DEDEIRTTNPVATEQYGVVSTVNGNNNNNQGIGTTQDED

SEQ ID NO: 188661 - protein, 39 aa, Artificial Sequence
  Description of Artificial Sequence: Synthetic polypeptide
DEDEIRTTNPVATEQYGVVSTVNGNNNNQGIGTTDQGED

SEQ ID NO: 188662 - protein, 40 aa, Artificial Sequence
  Description of Artificial Sequence: Synthetic polypeptide
DEDEIRTTNPVATEQYGVVSTVNIGNNNEQGIGTNNQDED

SEQ ID NO: 188663 - protein, 32 aa, Artificial Sequence
  Description of Artificial Sequence: Synthetic polypeptide
DENEIRTTNPVSTECWGAIAMEDIQQQNGPYH

SEQ ID NO: 188664 - protein, 32 aa, Artificial Sequence
  Description of Artificial Sequence: Synthetic polypeptide
DENEIRTTNPVSTECWGAIAMEDIAQQNGPYH

SEQ ID NO: 188665 - protein, 36 aa, Artificial Sequence
  Description of Artificial Sequence: Synthetic polypeptide
DENEIRTTNPVSTEAYGTVISCMEDAISQTSNGGNH

SEQ ID NO: 188666 - protein, 40 aa, Artificial Sequence
  Description of Artificial Sequence: Synthetic polypeptide
DEDEIRTTNPVATEQYGVVSTVNLGNNNQQGIGTTEQGED

SEQ ID NO: 188667 - protein, 34 aa, Artificial Sequence
  Description of Artificial Sequence: Synthetic polypeptide
AENEIATTNPVATEAYGCVCSWELNQHFISETLA

SEQ ID NO: 188668 - protein, 40 aa, Artificial Sequence
  Description of Artificial Sequence: Synthetic polypeptide
DEDEIRTTNPVATEQYGVVSTVNNDNNNLQGIGTTDEDED

SEQ ID NO: 188669 - protein, 36 aa, Artificial Sequence
  Description of Artificial Sequence: Synthetic polypeptide
DEVEIATTNPVAYEQYGSVATPAHITQGTPGDEAAP

SEQ ID NO: 188670 - protein, 39 aa, Artificial Sequence
  Description of Artificial Sequence: Synthetic polypeptide
DEDEIRTTNPVATEQYGVVSTVNNGNNNEQGIGTTQDED

SEQ ID NO: 188671 - protein, 40 aa, Artificial Sequence
  Description of Artificial Sequence: Synthetic polypeptide
DEDEIRTTNPVATEQYGVVSTVNNLNNNQQGIGTTSQDED

SEQ ID NO: 188672 - protein, 36 aa, Artificial Sequence
  Description of Artificial Sequence: Synthetic polypeptide
DENEIRTTNPVSTEAYGCICSWEEINQEQFGSNTQS

SEQ ID NO: 188673 - protein, 35 aa, Artificial Sequence
  Description of Artificial Sequence: Synthetic polypeptide
DENEIRTTNPVSTEAYGCICSWEEINQEQFGSDQG

SEQ ID NO: 188674 - protein, 39 aa, Artificial Sequence
  Description of Artificial Sequence: Synthetic polypeptide
DEDEIRTTNPVATEQYGVVSTVNNNDQQGTEQYGTVTDD

SEQ ID NO: 188675 - protein, 35 aa, Artificial Sequence
  Description of Artificial Sequence: Synthetic polypeptide
DENEIRTTNPVSTEAYGCICSWEEHNAEQFGSDQS

SEQ ID NO: 188676 - protein, 39 aa, Artificial Sequence
  Description of Artificial Sequence: Synthetic polypeptide
DEDEIRTTNPVATEQYGVVSTVNNNNDQQGIGTTDQDED

SEQ ID NO: 188677 - protein, 39 aa, Artificial Sequence
  Description of Artificial Sequence: Synthetic polypeptide
DEDEIRTTNPVATEQYGVVSTVNNNNQNGTEQGTTTDDD

SEQ ID NO: 188678 - protein, 40 aa, Artificial Sequence
  Description of Artificial Sequence: Synthetic polypeptide
DEDEIRTTNPVATEQYGVVSTVNDGGNNQQGIGTNNQDED

SEQ ID NO: 188679 - protein, 40 aa, Artificial Sequence
  Description of Artificial Sequence: Synthetic polypeptide
DEDEIRTTNPVATEQYGVVSTVNAQNNNQQGIGTTNQTED

SEQ ID NO: 188680 - protein, 40 aa, Artificial Sequence
  Description of Artificial Sequence: Synthetic polypeptide
DEDEIRTTNPVATEQYGVVSTVNANNNNQQGIGTTNEDED

SEQ ID NO: 188681 - protein, 40 aa, Artificial Sequence
  Description of Artificial Sequence: Synthetic polypeptide
DEDEIRTTNPVATEQYGVVSTVNAGNNNQQGIGTNQQGED

SEQ ID NO: 188682 - protein, 35 aa, Artificial Sequence
  Description of Artificial Sequence: Synthetic polypeptide
DEVEIATTNPVAYECWGSVYIAENDPQQDGGNNPV

SEQ ID NO: 188683 - protein, 35 aa, Artificial Sequence
  Description of Artificial Sequence: Synthetic polypeptide
DEVEIATTNPVAYECWGSVYIAENDQMQQDGGNNP

SEQ ID NO: 188684 - protein, 35 aa, Artificial Sequence
  Description of Artificial Sequence: Synthetic polypeptide
DEVEIATTNPVAYECWGSVYIAENDQQQDGGNGPI

SEQ ID NO: 188685 - protein, 35 aa, Artificial Sequence
  Description of Artificial Sequence: Synthetic polypeptide
DEVEIATTNPVAYECWGSVYIAENDQQQDGGNNAT

SEQ ID NO: 188686 - protein, 35 aa, Artificial Sequence
  Description of Artificial Sequence: Synthetic polypeptide
DEVEIATTNPVAYECWGSVYIAENDTQQDGGKNGP

SEQ ID NO: 188687 - protein, 33 aa, Artificial Sequence
  Description of Artificial Sequence: Synthetic polypeptide
DEVEIATTNPVAYECWGVVSGGNGNEAGGEGIE

SEQ ID NO: 188688 - protein, 40 aa, Artificial Sequence
  Description of Artificial Sequence: Synthetic polypeptide
DEDEIRTTNPVATEQYGVVSTTNNGNNQQQGIGTTNQDED

SEQ ID NO: 188689 - protein, 35 aa, Artificial Sequence
  Description of Artificial Sequence: Synthetic polypeptide
DENEIRTTNPVSTEGYGTISAQEDGIQQDQGGGNG

SEQ ID NO: 188690 - protein, 40 aa, Artificial Sequence
  Description of Artificial Sequence: Synthetic polypeptide
DEDEIRTTNPVATEQYGVVSTTNNQNNNQQGIGTNPQDED

SEQ ID NO: 188691 - protein, 35 aa, Artificial Sequence
  Description of Artificial Sequence: Synthetic polypeptide
DENEIRTTNPVSTEGYGTICSWEPINQEQFNSNQS

SEQ ID NO: 188692 - protein, 35 aa, Artificial Sequence
  Description of Artificial Sequence: Synthetic polypeptide
DENEIRTTNPVSTEGYGTICSWEEHNQEQFGSQQS

SEQ ID NO: 188693 - protein, 34 aa, Artificial Sequence
  Description of Artificial Sequence: Synthetic polypeptide
DEVEIATTNPVAYECWGSVYIADNDKQQDGGMGP

SEQ ID NO: 188694 - protein, 34 aa, Artificial Sequence
  Description of Artificial Sequence: Synthetic polypeptide
DENEIRTTNPVSTEGYGTICSWEDINQENFGDQA

SEQ ID NO: 188695 - protein, 32 aa, Artificial Sequence
  Description of Artificial Sequence: Synthetic polypeptide
DEVEIATTNPVAYEQWGCVYNMMDMDMNGGHS

SEQ ID NO: 188696 - protein, 35 aa, Artificial Sequence
  Description of Artificial Sequence: Synthetic polypeptide
DEVEIATTNPVAYEQWGEAVCSDRNDMTNGGGDER

SEQ ID NO: 188697 - protein, 36 aa, Artificial Sequence
  Description of Artificial Sequence: Synthetic polypeptide
DEVEIATTNPVAYEQWGSVACMNNDPDDQAGMNHES

SEQ ID NO: 188698 - protein, 35 aa, Artificial Sequence
  Description of Artificial Sequence: Synthetic polypeptide
DENEIRTTNPVSTEGYGCICSWEPINQEQFGSDQQ

SEQ ID NO: 188699 - protein, 35 aa, Artificial Sequence
  Description of Artificial Sequence: Synthetic polypeptide
DENEIRTTNPVSTEGYGCICSWEEPNQEQFGSDQF

SEQ ID NO: 188700 - protein, 35 aa, Artificial Sequence
  Description of Artificial Sequence: Synthetic polypeptide
DEVEIATTNPVAYEQWGSVCQTFEDRTTRDGGGQM

SEQ ID NO: 188701 - protein, 35 aa, Artificial Sequence
  Description of Artificial Sequence: Synthetic polypeptide
DEVEIATTNPVAYEQWGSVCQTFEDRTTRDGGSDG

SEQ ID NO: 188702 - protein, 35 aa, Artificial Sequence
  Description of Artificial Sequence: Synthetic polypeptide
DEVEIATTNPVAYEQWGSVCQTFEDRTTRDGGSDI

SEQ ID NO: 188703 - protein, 36 aa, Artificial Sequence
  Description of Artificial Sequence: Synthetic polypeptide
DENEIRTTNPVSTEGYGCICSTWEETNQEQFGSDQS

SEQ ID NO: 188704 - protein, 36 aa, Artificial Sequence
  Description of Artificial Sequence: Synthetic polypeptide
DEVEIATTNPVAYEQWGSVSGGEPAGGNMRNGMNNV

SEQ ID NO: 188705 - protein, 40 aa, Artificial Sequence
  Description of Artificial Sequence: Synthetic polypeptide
DEDEIRTTNPVATEQYGVVSTVLAGNNNQQGIGTTNQDTD

SEQ ID NO: 188706 - protein, 35 aa, Artificial Sequence
  Description of Artificial Sequence: Synthetic polypeptide
DEVEIATTNPVAYEQWGCVSGDINMQPNQDQHGGW

SEQ ID NO: 188707 - protein, 33 aa, Artificial Sequence
  Description of Artificial Sequence: Synthetic polypeptide
DETEIRTTNPIATECWGAVWANAENWAPKGPYI

SEQ ID NO: 188708 - protein, 34 aa, Artificial Sequence
  Description of Artificial Sequence: Synthetic polypeptide
DETEIRTTNPIATECWGAVWANAENLAESKGPYI

SEQ ID NO: 188709 - protein, 34 aa, Artificial Sequence
  Description of Artificial Sequence: Synthetic polypeptide
DETEIRTTNPIATECWGAVWANAENLAEPKGPYI

SEQ ID NO: 188710 - protein, 38 aa, Artificial Sequence
  Description of Artificial Sequence: Synthetic polypeptide
DEAEIRTTNPVATEQYGSVNNLQEISWIEGGFMEEFSQ

SEQ ID NO: 188711 - protein, 36 aa, Artificial Sequence
  Description of Artificial Sequence: Synthetic polypeptide
DEAEIRTTNPVATEQYGSVNNIEPVVEGGIGEIQSC

SEQ ID NO: 188712 - protein, 37 aa, Artificial Sequence
  Description of Artificial Sequence: Synthetic polypeptide
DEDEIRTTNPVATEGYGMVSNNDEFDLEFEDDGDDGN

SEQ ID NO: 188713 - protein, 36 aa, Artificial Sequence
  Description of Artificial Sequence: Synthetic polypeptide
DEDEIRTTNPVATEGYGSVNNDEFDEDDEDEGNQGN

SEQ ID NO: 188714 - protein, 37 aa, Artificial Sequence
  Description of Artificial Sequence: Synthetic polypeptide
DEDEIRTTNPVATEGYGSVNNDEFDENGDTDGGNQGN

SEQ ID NO: 188715 - protein, 37 aa, Artificial Sequence
  Description of Artificial Sequence: Synthetic polypeptide
DEDEIRTTNPVATEGYGSVNNDEFQDEEDEEGGNQGN

SEQ ID NO: 188716 - protein, 37 aa, Artificial Sequence
  Description of Artificial Sequence: Synthetic polypeptide
DEDEIRTTNPVATEGYGSVVNNFEFDEGDEDGGNQGN

SEQ ID NO: 188717 - protein, 37 aa, Artificial Sequence
  Description of Artificial Sequence: Synthetic polypeptide
CEEEIRTTNPVATEQYGCVCSWGEDHFAENFNSDNQD

SEQ ID NO: 188718 - protein, 35 aa, Artificial Sequence
  Description of Artificial Sequence: Synthetic polypeptide
DESVIRTTNPVAYEQWGACYYGEKNMDQRDGQNEV

SEQ ID NO: 188719 - protein, 34 aa, Artificial Sequence
  Description of Artificial Sequence: Synthetic polypeptide
DENEIVTTNPVATEQWGTVCSAEDIEVENAEEDA

SEQ ID NO: 188720 - protein, 38 aa, Artificial Sequence
  Description of Artificial Sequence: Synthetic polypeptide
DETAEIATTNPVATEQYGSVCATNHQLPQNPMVEMAEE

SEQ ID NO: 188721 - protein, 35 aa, Artificial Sequence
  Description of Artificial Sequence: Synthetic polypeptide
DETAEIATTNPVAYECWGSVYHINNDMQGPGGNEI

SEQ ID NO: 188722 - protein, 35 aa, Artificial Sequence
  Description of Artificial Sequence: Synthetic polypeptide
DETAEIATTNPVAYEQYGSVANPGNGDPAAEMENP

SEQ ID NO: 188723 - protein, 35 aa, Artificial Sequence
  Description of Artificial Sequence: Synthetic polypeptide
DETAEIATTNPVAYEQYGSVATPHGDGSPMGQLDE

SEQ ID NO: 188724 - protein, 33 aa, Artificial Sequence
  Description of Artificial Sequence: Synthetic polypeptide
DENEISTTNPVSTEPYGTISSMEDIQHQQNVNH

SEQ ID NO: 188725 - protein, 34 aa, Artificial Sequence
  Description of Artificial Sequence: Synthetic polypeptide
DETCIRTTNPCATEQFGCVCSWEDNQESFGSDQS

SEQ ID NO: 188726 - protein, 35 aa, Artificial Sequence
  Description of Artificial Sequence: Synthetic polypeptide
DETCIRTTNPLATEQWGCVCSNWEHNQSFGSDNQA

SEQ ID NO: 188727 - protein, 33 aa, Artificial Sequence
  Description of Artificial Sequence: Synthetic polypeptide
DETDEIATTNPVAYEAWGVCATNSNGDTGNGSD

SEQ ID NO: 188728 - protein, 35 aa, Artificial Sequence
  Description of Artificial Sequence: Synthetic polypeptide
DETDEIATTNPVAYEGWGSVYITDGDQTRNGDQEQ

SEQ ID NO: 188729 - protein, 34 aa, Artificial Sequence
  Description of Artificial Sequence: Synthetic polypeptide
DENEISTTNPVAYEQWGIVSKEIEPMNQAEGDAE

SEQ ID NO: 188730 - protein, 34 aa, Artificial Sequence
  Description of Artificial Sequence: Synthetic polypeptide
DETDEICTTNPVAYESWGVVATTGGNTGADGDMR

SEQ ID NO: 188731 - protein, 33 aa, Artificial Sequence
  Description of Artificial Sequence: Synthetic polypeptide
DETEIACTNPIATECYGETWSNAEDLQEPGPYI

SEQ ID NO: 188732 - protein, 34 aa, Artificial Sequence
  Description of Artificial Sequence: Synthetic polypeptide
DETEIACTNPVATAQWGCVAAGNLFTPNPMGERH

SEQ ID NO: 188733 - protein, 36 aa, Artificial Sequence
  Description of Artificial Sequence: Synthetic polypeptide
AESNEEIATTNPVAYEQWGSVSTGGNAGEHQGTDEL

SEQ ID NO: 188734 - protein, 35 aa, Artificial Sequence
  Description of Artificial Sequence: Synthetic polypeptide
AESNEIATTNPVAYEQWGWVSTGGNAGNEQHGDDS

SEQ ID NO: 188735 - protein, 36 aa, Artificial Sequence
  Description of Artificial Sequence: Synthetic polypeptide
DESVEIATTNPVAYECWGSVSGGNGNTQRDAEGDMD

SEQ ID NO: 188736 - protein, 36 aa, Artificial Sequence
  Description of Artificial Sequence: Synthetic polypeptide
DESTIQTTNPVATEQYGDIVVGIMNNDQGGGDNDQG

SEQ ID NO: 188737 - protein, 31 aa, Artificial Sequence
  Description of Artificial Sequence: Synthetic polypeptide
DENEVRSTNPVSTEQWGNVAAEIEMSAAEDR

SEQ ID NO: 188738 - protein, 36 aa, Artificial Sequence
  Description of Artificial Sequence: Synthetic polypeptide
DESNEIATTNPVAYEQWGCVYSVNGNDQEGERNDQG

SEQ ID NO: 188739 - protein, 36 aa, Artificial Sequence
  Description of Artificial Sequence: Synthetic polypeptide
DESNEIATTNPVAYERWGSVSGGNADDSRNNGDGNS

SEQ ID NO: 188740 - protein, 36 aa, Artificial Sequence
  Description of Artificial Sequence: Synthetic polypeptide
DESPIATTNPVAYTEAYGCASVLLNETSQRGGDAQA

SEQ ID NO: 188741 - protein, 36 aa, Artificial Sequence
  Description of Artificial Sequence: Synthetic polypeptide
DESPIATTNPVAYTEAYGCVSVLLAETSQREGGDEA

SEQ ID NO: 188742 - protein, 35 aa, Artificial Sequence
  Description of Artificial Sequence: Synthetic polypeptide
DESPIATTNPVAYTEAYGCVSVLLGETSERGGDQA

SEQ ID NO: 188743 - protein, 36 aa, Artificial Sequence
  Description of Artificial Sequence: Synthetic polypeptide
DESPIATTNPVAYTEAYGCVSVLLNETSQREIGDQS

SEQ ID NO: 188744 - protein, 36 aa, Artificial Sequence
  Description of Artificial Sequence: Synthetic polypeptide
DESPIATTNPVAYTEAYGCVSVVLSETSQREGGDQA

SEQ ID NO: 188745 - protein, 36 aa, Artificial Sequence
  Description of Artificial Sequence: Synthetic polypeptide
DESPIATTNPVAYTEAYGQVSVLLNETSQRALGDQA

SEQ ID NO: 188746 - protein, 36 aa, Artificial Sequence
  Description of Artificial Sequence: Synthetic polypeptide
DESPIATTNPVAYTEAYGVVSVLLNETSQREHGDQA

SEQ ID NO: 188747 - protein, 36 aa, Artificial Sequence
  Description of Artificial Sequence: Synthetic polypeptide
DESPIATTNPVAYTEAYRGQVSVLLNETSQRQGDQA

SEQ ID NO: 188748 - protein, 35 aa, Artificial Sequence
  Description of Artificial Sequence: Synthetic polypeptide
DETEIACTNPVATAQWGCVAGTNGQLDNRMGGTLI

SEQ ID NO: 188749 - protein, 36 aa, Artificial Sequence
  Description of Artificial Sequence: Synthetic polypeptide
DESPIGTTNPVAYTEAYGQVSVLLFETSQRGGDTQA

SEQ ID NO: 188750 - protein, 39 aa, Artificial Sequence
  Description of Artificial Sequence: Synthetic polypeptide
DEDEIRTTNPVATEAYGVVSVTVVNNQQSAEQGTTNVTD

SEQ ID NO: 188751 - protein, 38 aa, Artificial Sequence
  Description of Artificial Sequence: Synthetic polypeptide
DEDEIRTTNPVATEAYGVVSVVVVTNQNLLAGTEEGQD

SEQ ID NO: 188752 - protein, 33 aa, Artificial Sequence
  Description of Artificial Sequence: Synthetic polypeptide
DESSIATTNPVAYECWGSVYNWMNDVAREGDDM

SEQ ID NO: 188753 - protein, 34 aa, Artificial Sequence
  Description of Artificial Sequence: Synthetic polypeptide
DESSIATTNPVAYECWGSVYNWMTNDKAREGHHM

SEQ ID NO: 188754 - protein, 34 aa, Artificial Sequence
  Description of Artificial Sequence: Synthetic polypeptide
DENELRTTNPVSTEPYGTISMEDIQQQQNGWNVH

SEQ ID NO: 188755 - protein, 36 aa, Artificial Sequence
  Description of Artificial Sequence: Synthetic polypeptide
DESTICTTNPVATEFYGDVSVDINGLEQGEGDDEDD

SEQ ID NO: 188756 - protein, 35 aa, Artificial Sequence
  Description of Artificial Sequence: Synthetic polypeptide
DESTICTTNPVATEFYGQYSNDINGLEQGEGDIED

SEQ ID NO: 188757 - protein, 36 aa, Artificial Sequence
  Description of Artificial Sequence: Synthetic polypeptide
DESTICTTNPVATEFYGQYSVDINGLEQGEGDDEDQ

SEQ ID NO: 188758 - protein, 36 aa, Artificial Sequence
  Description of Artificial Sequence: Synthetic polypeptide
DESTICTTNPVATEFYGQYSVDINGLEQGEGDTETD

SEQ ID NO: 188759 - protein, 35 aa, Artificial Sequence
  Description of Artificial Sequence: Synthetic polypeptide
DESTICTTNPVATEFYGQYSVDINGMEQGEGDTED

SEQ ID NO: 188760 - protein, 36 aa, Artificial Sequence
  Description of Artificial Sequence: Synthetic polypeptide
DESTICTTNPVATEFYGQYSVINDINGLEGGGNDED

SEQ ID NO: 188761 - protein, 39 aa, Artificial Sequence
  Description of Artificial Sequence: Synthetic polypeptide
DEDEIRTTNPVATEAYGVVSVTVTNQQQSAEQGTTNTTD

SEQ ID NO: 188762 - protein, 39 aa, Artificial Sequence
  Description of Artificial Sequence: Synthetic polypeptide
DEDEIRTTNPVATEAYGVVSTTVTQLQQSAEQGSTNVTD

SEQ ID NO: 188763 - protein, 36 aa, Artificial Sequence
  Description of Artificial Sequence: Synthetic polypeptide
DETEIACTNPVATAQWGSVSVSGNPLENTGGVNEEM

SEQ ID NO: 188764 - protein, 35 aa, Artificial Sequence
  Description of Artificial Sequence: Synthetic polypeptide
DETEIACTNPVATAQWGSVSVVGNPLENTGGVEEE

SEQ ID NO: 188765 - protein, 35 aa, Artificial Sequence
  Description of Artificial Sequence: Synthetic polypeptide
DETEIACTNPVATEQYGSCAQGPQLNPDAQMGGDD

SEQ ID NO: 188766 - protein, 35 aa, Artificial Sequence
  Description of Artificial Sequence: Synthetic polypeptide
DETEIACTNPVATEQYGSCNATNGVIDAMDDMNNN

SEQ ID NO: 188767 - protein, 35 aa, Artificial Sequence
  Description of Artificial Sequence: Synthetic polypeptide
DETEIACTNPVATEQYGSCPATHPEAQANQTEGTP

SEQ ID NO: 188768 - protein, 35 aa, Artificial Sequence
  Description of Artificial Sequence: Synthetic polypeptide
DETEIACTNPVATEQYGSCSAGDIGNNHADDMNTN

SEQ ID NO: 188769 - protein, 36 aa, Artificial Sequence
  Description of Artificial Sequence: Synthetic polypeptide
DETEIACTNPVATEQYGSCSAGDTIGNNHADEANNQ

SEQ ID NO: 188770 - protein, 35 aa, Artificial Sequence
  Description of Artificial Sequence: Synthetic polypeptide
DETEIACTNPVATEQYGSCSAGPPGANGALMGAQD

SEQ ID NO: 188771 - protein, 36 aa, Artificial Sequence
  Description of Artificial Sequence: Synthetic polypeptide
DETEIACTNPVATEQYGSTACAANPGLPLGSEGNEH

SEQ ID NO: 188772 - protein, 36 aa, Artificial Sequence
  Description of Artificial Sequence: Synthetic polypeptide
DENEISTTNPVATEQYGCVCSWEETEQENFNSETQN

SEQ ID NO: 188773 - protein, 37 aa, Artificial Sequence
  Description of Artificial Sequence: Synthetic polypeptide
DENEISTTNPVATEQYGCVCSTGEGHNQENFNSDTQS

SEQ ID NO: 188774 - protein, 32 aa, Artificial Sequence
  Description of Artificial Sequence: Synthetic polypeptide
AESEIASTNPVGYEAYGCVMASGALSQHVGDI

SEQ ID NO: 188775 - protein, 35 aa, Artificial Sequence
  Description of Artificial Sequence: Synthetic polypeptide
DETEIACTNPVATEQYGSVCAADNGDEAGMDPGMN

SEQ ID NO: 188776 - protein, 36 aa, Artificial Sequence
  Description of Artificial Sequence: Synthetic polypeptide
DETEIACTNPVATEQYGSVCAADNGDEQGMDINNNM

SEQ ID NO: 188777 - protein, 36 aa, Artificial Sequence
  Description of Artificial Sequence: Synthetic polypeptide
DETEIACTNPVATEQYGSVCAANNGDENGMDINENE

SEQ ID NO: 188778 - protein, 35 aa, Artificial Sequence
  Description of Artificial Sequence: Synthetic polypeptide
DETEIACTNPVATEQYGSVCAAPDGPENDDLGAQA

SEQ ID NO: 188779 - protein, 36 aa, Artificial Sequence
  Description of Artificial Sequence: Synthetic polypeptide
DETEIACTNPVATEQYGSVCAGMTHDPTDSEENARQ

SEQ ID NO: 188780 - protein, 34 aa, Artificial Sequence
  Description of Artificial Sequence: Synthetic polypeptide
DENEISTTNPVATEQWGCVTSWEENTEAFISDAS

SEQ ID NO: 188781 - protein, 36 aa, Artificial Sequence
  Description of Artificial Sequence: Synthetic polypeptide
DETEIACTNPVATEQYGSVCAMANPAEDQDDPLGDH

SEQ ID NO: 188782 - protein, 38 aa, Artificial Sequence
  Description of Artificial Sequence: Synthetic polypeptide
DETEIACTNPVATEQYGSVCAMTNPQLTNPDDQMEHNM

SEQ ID NO: 188783 - protein, 37 aa, Artificial Sequence
  Description of Artificial Sequence: Synthetic polypeptide
DETEIACTNPVATEQYGSVCSTGDPQGFDHQMDGSLH

SEQ ID NO: 188784 - protein, 36 aa, Artificial Sequence
  Description of Artificial Sequence: Synthetic polypeptide
DETEIACTNPVATEQYGSVCSVGDIGQPDDLMENQD

SEQ ID NO: 188785 - protein, 37 aa, Artificial Sequence
  Description of Artificial Sequence: Synthetic polypeptide
DETEIACTNPVATEQYGSVSSTGEPGINPDDGMEKVE

SEQ ID NO: 188786 - protein, 34 aa, Artificial Sequence
  Description of Artificial Sequence: Synthetic polypeptide
DETEIACTNPVAYEQYGSVANNGVTTAENPNEKT

SEQ ID NO: 188787 - protein, 32 aa, Artificial Sequence
  Description of Artificial Sequence: Synthetic polypeptide
DETEIAPTNPCASECYGAVWAAENWQEPGPYI

SEQ ID NO: 188788 - protein, 35 aa, Artificial Sequence
  Description of Artificial Sequence: Synthetic polypeptide
DETEIACTNPVATEQYGSCAATHGPLDSMGGDDHM

SEQ ID NO: 188789 - protein, 34 aa, Artificial Sequence
  Description of Artificial Sequence: Synthetic polypeptide
DETEIACTNPVATEQYGSCAAGHGPLDSMIGTED

SEQ ID NO: 188790 - protein, 37 aa, Artificial Sequence
  Description of Artificial Sequence: Synthetic polypeptide
DETEIACTNPVATEQYGSACSPVGNDQNDSGNDQALH

SEQ ID NO: 188791 - protein, 37 aa, Artificial Sequence
  Description of Artificial Sequence: Synthetic polypeptide
DETEIACTNPVATEQYGSACSATNPGVNAAGDDNGAD

SEQ ID NO: 188792 - protein, 34 aa, Artificial Sequence
  Description of Artificial Sequence: Synthetic polypeptide
DETEIACTNPVATEQWGCNVAGNGLDNNDGDTEM

SEQ ID NO: 188793 - protein, 34 aa, Artificial Sequence
  Description of Artificial Sequence: Synthetic polypeptide
DETEIACTNPVATEQWGCVAGTENHEAGPGEEDA

SEQ ID NO: 188794 - protein, 35 aa, Artificial Sequence
  Description of Artificial Sequence: Synthetic polypeptide
DETEIACTNPVATEQWGCVAMTNLTNPDDGMGDMH

SEQ ID NO: 188795 - protein, 35 aa, Artificial Sequence
  Description of Artificial Sequence: Synthetic polypeptide
DETEIACTNPVATEQWGNVSAGPPGANGAGMGNQD

SEQ ID NO: 188796 - protein, 35 aa, Artificial Sequence
  Description of Artificial Sequence: Synthetic polypeptide
DETEIACTNPVATEQWGSVAATGDEEAGTEGGENA

SEQ ID NO: 188797 - protein, 37 aa, Artificial Sequence
  Description of Artificial Sequence: Synthetic polypeptide
DETEIACTNPVATEQWGSVAITNADPEQNGDQMNSDA

SEQ ID NO: 188798 - protein, 34 aa, Artificial Sequence
  Description of Artificial Sequence: Synthetic polypeptide
DETEIACTNPVATEQWGSVAMNHSITTAADDSLA

SEQ ID NO: 188799 - protein, 35 aa, Artificial Sequence
  Description of Artificial Sequence: Synthetic polypeptide
DETEIACTNPVATEQWGSVSAGPAPGANGAGMGQP

SEQ ID NO: 188800 - protein, 36 aa, Artificial Sequence
  Description of Artificial Sequence: Synthetic polypeptide
DETEIACTNPVATEQWGSVSATGDEEAGMEGGENAW

SEQ ID NO: 188801 - protein, 35 aa, Artificial Sequence
  Description of Artificial Sequence: Synthetic polypeptide
DETEIACTNPVATEQWGSVSATGDEEAGTPGDEDA

SEQ ID NO: 188802 - protein, 35 aa, Artificial Sequence
  Description of Artificial Sequence: Synthetic polypeptide
DETEIACTNPVATEQWGSVSATGGEEADTEGGEDA

SEQ ID NO: 188803 - protein, 36 aa, Artificial Sequence
  Description of Artificial Sequence: Synthetic polypeptide
DETEIACTNPVATAQWGSVSVSGNPLENTRGVEEQE

SEQ ID NO: 188804 - protein, 35 aa, Artificial Sequence
  Description of Artificial Sequence: Synthetic polypeptide
DETEIACTNPVATEQWGSVSEGNHGPNDSNGEAAD

SEQ ID NO: 188805 - protein, 36 aa, Artificial Sequence
  Description of Artificial Sequence: Synthetic polypeptide
DETEIACTNPVATEQWGSVSGPAIAPPQAAGNPIEQ

SEQ ID NO: 188806 - protein, 35 aa, Artificial Sequence
  Description of Artificial Sequence: Synthetic polypeptide
DETEIACTNPVATEQWGSVVANAGNGEYGAEGGMR

SEQ ID NO: 188807 - protein, 36 aa, Artificial Sequence
  Description of Artificial Sequence: Synthetic polypeptide
DENEISTTNPVATEQYGQCVCSWGEEDQENFNSDQS

SEQ ID NO: 188808 - protein, 36 aa, Artificial Sequence
  Description of Artificial Sequence: Synthetic polypeptide
DENEISTTNPVATEQYGQCVCSSGEHNQNFISDNQG

SEQ ID NO: 188809 - protein, 36 aa, Artificial Sequence
  Description of Artificial Sequence: Synthetic polypeptide
DENEISTTNPVATEQYGQCVCSSGEDAENFNSDNQA

SEQ ID NO: 188810 - protein, 36 aa, Artificial Sequence
  Description of Artificial Sequence: Synthetic polypeptide
DETEIACTNPVATEQYGSACAAANPQQEHQDGNEHQ

SEQ ID NO: 188811 - protein, 35 aa, Artificial Sequence
  Description of Artificial Sequence: Synthetic polypeptide
DETEIACTNPVATEQYGSACAANPAQEHQDGDAMW

SEQ ID NO: 188812 - protein, 35 aa, Artificial Sequence
  Description of Artificial Sequence: Synthetic polypeptide
DETEIACTNPVATEQYGSACAANPQQEHQDGDDHQ

SEQ ID NO: 188813 - protein, 35 aa, Artificial Sequence
  Description of Artificial Sequence: Synthetic polypeptide
DETEIACTNPVATEQYGSACAAPHLAEAPMGEANW

SEQ ID NO: 188814 - protein, 34 aa, Artificial Sequence
  Description of Artificial Sequence: Synthetic polypeptide
DETEIACTNPVATEQYGSACAGMNHGTEAMNMVF

SEQ ID NO: 188815 - protein, 36 aa, Artificial Sequence
  Description of Artificial Sequence: Synthetic polypeptide
DETEIACTNPVATEQYGSACAPANPLNDADGDENNH

SEQ ID NO: 188816 - protein, 35 aa, Artificial Sequence
  Description of Artificial Sequence: Synthetic polypeptide
DETEIACTNPVATEQWGSVSGEGPNPEANNSNNAW

SEQ ID NO: 188817 - protein, 32 aa, Artificial Sequence
  Description of Artificial Sequence: Synthetic polypeptide
DETEIASTNPIATECWGATMANSTLQHKGPYI

SEQ ID NO: 188818 - protein, 39 aa, Artificial Sequence
  Description of Artificial Sequence: Synthetic polypeptide
DEDEIRTTNPVATEAYGVVSTTVTNQQQSAEQGTTNVAE

SEQ ID NO: 188819 - protein, 38 aa, Artificial Sequence
  Description of Artificial Sequence: Synthetic polypeptide
DEDEIRTTNPVATEAYGVVSTNTNQQQSAEQGSTDTTD

SEQ ID NO: 188820 - protein, 36 aa, Artificial Sequence
  Description of Artificial Sequence: Synthetic polypeptide
DEQAEIATTNPVAYEQWGSTCSCTINNDHQSDDGDY

SEQ ID NO: 188821 - protein, 35 aa, Artificial Sequence
  Description of Artificial Sequence: Synthetic polypeptide
DEPEISTTNPVATEQYGTVVSAVDGDDEEGEGGED

SEQ ID NO: 188822 - protein, 37 aa, Artificial Sequence
  Description of Artificial Sequence: Synthetic polypeptide
DEPEISTTNPVATEQYGTVVSATDGDDEEGEGGNTDN

SEQ ID NO: 188823 - protein, 37 aa, Artificial Sequence
  Description of Artificial Sequence: Synthetic polypeptide
DEPEISTTNPVATEQYGTVVSATDGDDEEAGEGGNGD

SEQ ID NO: 188824 - protein, 37 aa, Artificial Sequence
  Description of Artificial Sequence: Synthetic polypeptide
DEPEISTTNPVATEQYGSVGHNNMEQEFQITNVPGIY

SEQ ID NO: 188825 - protein, 37 aa, Artificial Sequence
  Description of Artificial Sequence: Synthetic polypeptide
CEEEIRTTNPVATEFYGAITVMDGNGEGQNEGGNAEF

SEQ ID NO: 188826 - protein, 37 aa, Artificial Sequence
  Description of Artificial Sequence: Synthetic polypeptide
CEEEIRTTNPVATEFYGAITVMTGNGEGQNEGGEAEA

SEQ ID NO: 188827 - protein, 35 aa, Artificial Sequence
  Description of Artificial Sequence: Synthetic polypeptide
DEDEIRTTNPCAYECWGCVATPNGNQQLEGDHGRR

SEQ ID NO: 188828 - protein, 35 aa, Artificial Sequence
  Description of Artificial Sequence: Synthetic polypeptide
DEDEIRTTNPCAYEEWGSVATPNGNQQLEGDHGLD

SEQ ID NO: 188829 - protein, 37 aa, Artificial Sequence
  Description of Artificial Sequence: Synthetic polypeptide
DEPEIRTTNPVATEQYGTVVIETVNIEVPINHEAYVP

SEQ ID NO: 188830 - protein, 36 aa, Artificial Sequence
  Description of Artificial Sequence: Synthetic polypeptide
DESEIRTTNPVTTEHWGSVYCWMPNDQDDQRQNGQS

SEQ ID NO: 188831 - protein, 35 aa, Artificial Sequence
  Description of Artificial Sequence: Synthetic polypeptide
DEDEIRTTNPCAYEQWGSVCGDNNNDQQGQQGGDD

SEQ ID NO: 188832 - protein, 36 aa, Artificial Sequence
  Description of Artificial Sequence: Synthetic polypeptide
CEEEIRTTNPVATEFYGQVNDLGNDLENAEEGEGGG

SEQ ID NO: 188833 - protein, 37 aa, Artificial Sequence
  Description of Artificial Sequence: Synthetic polypeptide
CEEEIRTTNPVATEGYGCVCSMWGEHNQEGFNSDNQS

SEQ ID NO: 188834 - protein, 37 aa, Artificial Sequence
  Description of Artificial Sequence: Synthetic polypeptide
CEEEIRTTNPVATEGYGSVVITFTGDENQDGEGQGQT

SEQ ID NO: 188835 - protein, 38 aa, Artificial Sequence
  Description of Artificial Sequence: Synthetic polypeptide
CEEEIRTTNPVATEQYGAVNTTITDGNGNDLEGENEQV

SEQ ID NO: 188836 - protein, 37 aa, Artificial Sequence
  Description of Artificial Sequence: Synthetic polypeptide
DEDEIRTTNPVATASWGSVSATTPAQGTNQGNGMEPV

SEQ ID NO: 188837 - protein, 35 aa, Artificial Sequence
  Description of Artificial Sequence: Synthetic polypeptide
DESEISTTNPVATEGWGCVCSWMNENQEYFGSDQM

SEQ ID NO: 188838 - protein, 36 aa, Artificial Sequence
  Description of Artificial Sequence: Synthetic polypeptide
DESEISTTNPVATEQYGCVCSNWGEHNQNFNSDTQG

SEQ ID NO: 188839 - protein, 36 aa, Artificial Sequence
  Description of Artificial Sequence: Synthetic polypeptide
DEDEIRTTNPVATDAYGSVMSDTIEGGQEDDDQFDN

SEQ ID NO: 188840 - protein, 34 aa, Artificial Sequence
  Description of Artificial Sequence: Synthetic polypeptide
AETEIATTNPCAYEQWGSVCGDNNNDQQGQMGND

SEQ ID NO: 188841 - protein, 38 aa, Artificial Sequence
  Description of Artificial Sequence: Synthetic polypeptide
DESEISTTNPVATEQYGVVVSNMNLVGDDQDQEDDDGN

SEQ ID NO: 188842 - protein, 34 aa, Artificial Sequence
  Description of Artificial Sequence: Synthetic polypeptide
DESEISTTNPVAYEQWGMTCVTDNDDQRQAPQGH

SEQ ID NO: 188843 - protein, 35 aa, Artificial Sequence
  Description of Artificial Sequence: Synthetic polypeptide
DESEIRTTNPVSTEPYGTIPSMEDAISQQQNGGNH

SEQ ID NO: 188844 - protein, 35 aa, Artificial Sequence
  Description of Artificial Sequence: Synthetic polypeptide
DESEIRTTNPVSTEPYGTIPSCMGDISQQQNGNNH

SEQ ID NO: 188845 - protein, 35 aa, Artificial Sequence
  Description of Artificial Sequence: Synthetic polypeptide
DESEIRTTNPVSTEPWGCIAPTDFQQQQQQRGTNS

SEQ ID NO: 188846 - protein, 34 aa, Artificial Sequence
  Description of Artificial Sequence: Synthetic polypeptide
DESEIRTTNPVSTEPWGCIAPNDQQQQQQQGTNM

SEQ ID NO: 188847 - protein, 36 aa, Artificial Sequence
  Description of Artificial Sequence: Synthetic polypeptide
DEDEIRGTNPVATESYGSVSVQFDDMIEGDEQEGAT

SEQ ID NO: 188848 - protein, 35 aa, Artificial Sequence
  Description of Artificial Sequence: Synthetic polypeptide
DEQEIATTNPAVATLQYGGSVSAHDLIEDHEDEDL

SEQ ID NO: 188849 - protein, 35 aa, Artificial Sequence
  Description of Artificial Sequence: Synthetic polypeptide
DESEIRTTNPVAYQQYGCVCIWINDDEREQTDGQH

SEQ ID NO: 188850 - protein, 35 aa, Artificial Sequence
  Description of Artificial Sequence: Synthetic polypeptide
DESEIRTTNPVAYQQYGCVCIWINDDERSQHDGEH

SEQ ID NO: 188851 - protein, 34 aa, Artificial Sequence
  Description of Artificial Sequence: Synthetic polypeptide
DESEIRTTNPVAYQQYGCVCIWINDDPERQHDGM

SEQ ID NO: 188852 - protein, 34 aa, Artificial Sequence
  Description of Artificial Sequence: Synthetic polypeptide
DESEIRTTNPVAYQQYGCVCIWINDDPGEQHDAT

SEQ ID NO: 188853 - protein, 35 aa, Artificial Sequence
  Description of Artificial Sequence: Synthetic polypeptide
DEQEIATTNPAVATLQYGGRVSATDLEDHEDLEDL

SEQ ID NO: 188854 - protein, 37 aa, Artificial Sequence
  Description of Artificial Sequence: Synthetic polypeptide
DEDEIRSTNPVGTEQYGSVVTGDNTGDQVGEGGQEPE

SEQ ID NO: 188855 - protein, 38 aa, Artificial Sequence
  Description of Artificial Sequence: Synthetic polypeptide
CEEEIRTTNCVATEQYGVVSILIPTGDNDQGEAGDIGG

SEQ ID NO: 188856 - protein, 38 aa, Artificial Sequence
  Description of Artificial Sequence: Synthetic polypeptide
CEEEIRTTNCVATEQYGVVSNLIATGDNDQGEGGDIGV

SEQ ID NO: 188857 - protein, 39 aa, Artificial Sequence
  Description of Artificial Sequence: Synthetic polypeptide
AETEICTTNPVATEAYGSVSTVSTEEIGTNLQIGTNEEM

SEQ ID NO: 188858 - protein, 34 aa, Artificial Sequence
  Description of Artificial Sequence: Synthetic polypeptide
DESEISTTNPVAYEQWGMTCVTDNNDDQRQAQEH

SEQ ID NO: 188859 - protein, 36 aa, Artificial Sequence
  Description of Artificial Sequence: Synthetic polypeptide
CEEEIRTTNPTAVEQYGSVWTNVKHSSETPMGSDPN

SEQ ID NO: 188860 - protein, 35 aa, Artificial Sequence
  Description of Artificial Sequence: Synthetic polypeptide
DEQEIACTNPVATEQWGSVSAVGDLEADTPGGEDL

SEQ ID NO: 188861 - protein, 34 aa, Artificial Sequence
  Description of Artificial Sequence: Synthetic polypeptide
DEQDEIATTNPVAYEGWGSVATLDNGGDTQGDGH

SEQ ID NO: 188862 - protein, 38 aa, Artificial Sequence
  Description of Artificial Sequence: Synthetic polypeptide
AETEICTTNPVATEAYGSVSTNSTEQIGTNNQQGNEDM

SEQ ID NO: 188863 - protein, 38 aa, Artificial Sequence
  Description of Artificial Sequence: Synthetic polypeptide
AETEICTTNPVATEAYGSVSTNSTEQIGNNQTGNNEDM

SEQ ID NO: 188864 - protein, 33 aa, Artificial Sequence
  Description of Artificial Sequence: Synthetic polypeptide
DESEIRTTNPVSTEPWGCIAPEDGQQQQQRGTA

SEQ ID NO: 188865 - protein, 33 aa, Artificial Sequence
  Description of Artificial Sequence: Synthetic polypeptide
DESEIRTTNPVSTEPWGCIAPEDNQQQQQHGGK

SEQ ID NO: 188866 - protein, 35 aa, Artificial Sequence
  Description of Artificial Sequence: Synthetic polypeptide
DESEIRTTNPVSTEPWGCIAPEDNQQQQQQRGSNS

SEQ ID NO: 188867 - protein, 33 aa, Artificial Sequence
  Description of Artificial Sequence: Synthetic polypeptide
DESEIRTTNPVSTEPWGCIAPEDQQQHTQRGTD

SEQ ID NO: 188868 - protein, 33 aa, Artificial Sequence
  Description of Artificial Sequence: Synthetic polypeptide
DESEIRTTNPVSTEPWGCIAPEDQQQQHQRGTG

SEQ ID NO: 188869 - protein, 34 aa, Artificial Sequence
  Description of Artificial Sequence: Synthetic polypeptide
DESEIRTTNPVSTEPWGCIAPEDQQQQTQRGTNN

SEQ ID NO: 188870 - protein, 34 aa, Artificial Sequence
  Description of Artificial Sequence: Synthetic polypeptide
DESEIRTTNPVSTEPWGCIAPGDQQQQQQRGTND

SEQ ID NO: 188871 - protein, 38 aa, Artificial Sequence
  Description of Artificial Sequence: Synthetic polypeptide
CEEEIRTTNPVATDQYGSVVINPVNVVGINNGGQEGNG

SEQ ID NO: 188872 - protein, 39 aa, Artificial Sequence
  Description of Artificial Sequence: Synthetic polypeptide
DEDEIRTTNPVATEAYGVVSTTVTNQQQSAEQGTTNQDD

SEQ ID NO: 188873 - protein, 36 aa, Artificial Sequence
  Description of Artificial Sequence: Synthetic polypeptide
CEEEIRTTNPVATEQYGCVCSNSEDHNQENFISDQA

SEQ ID NO: 188874 - protein, 38 aa, Artificial Sequence
  Description of Artificial Sequence: Synthetic polypeptide
CEEEIRTTNPVATEQYGCVCSNTPEDHNQENFGSETQS

SEQ ID NO: 188875 - protein, 36 aa, Artificial Sequence
  Description of Artificial Sequence: Synthetic polypeptide
DEPEIATTNPVATDQYGVVDNTTDGEQGGQGENETN

SEQ ID NO: 188876 - protein, 35 aa, Artificial Sequence
  Description of Artificial Sequence: Synthetic polypeptide
DEPEIATTNPAATDQYGVVSTTDGETGGQGEGETI

SEQ ID NO: 188877 - protein, 33 aa, Artificial Sequence
  Description of Artificial Sequence: Synthetic polypeptide
DESEVASTNPVSTEGYGNVAANNIPQSRVGEQG

SEQ ID NO: 188878 - protein, 33 aa, Artificial Sequence
  Description of Artificial Sequence: Synthetic polypeptide
DESEVASTNPVSTEGYGNVAANTIPQSRVGEQG

SEQ ID NO: 188879 - protein, 34 aa, Artificial Sequence
  Description of Artificial Sequence: Synthetic polypeptide
DENVIRGTNPVATWHYGSVSTMNQEVVETVEEDF

SEQ ID NO: 188880 - protein, 33 aa, Artificial Sequence
  Description of Artificial Sequence: Synthetic polypeptide
DENTIRTTNPVSTEPYGTCIPEAIEIQQNGVNH

SEQ ID NO: 188881 - protein, 37 aa, Artificial Sequence
  Description of Artificial Sequence: Synthetic polypeptide
DENSIRTTNPVATEQYGSCPMPNMLWPENRSISQQTS

SEQ ID NO: 188882 - protein, 36 aa, Artificial Sequence
  Description of Artificial Sequence: Synthetic polypeptide
DEDEIRTTNPVATEAWGTVVVTVTNNEQGTNVEQGS

SEQ ID NO: 188883 - protein, 36 aa, Artificial Sequence
  Description of Artificial Sequence: Synthetic polypeptide
DENSEIATTNPVAYERWGSVSGGNADDSRNNGMGNE

SEQ ID NO: 188884 - protein, 36 aa, Artificial Sequence
  Description of Artificial Sequence: Synthetic polypeptide
DENSEIATTNPVAYERWGSVSGGNADDNRNNGGGNE

SEQ ID NO: 188885 - protein, 36 aa, Artificial Sequence
  Description of Artificial Sequence: Synthetic polypeptide
DENSEIATTNPVAYECWGSVSGGNADDSRNNGNGNM

SEQ ID NO: 188886 - protein, 35 aa, Artificial Sequence
  Description of Artificial Sequence: Synthetic polypeptide
DENSEIATTNPVAYEAWGVCSTMNDEHHGQGGNQT

SEQ ID NO: 188887 - protein, 36 aa, Artificial Sequence
  Description of Artificial Sequence: Synthetic polypeptide
DEDEIRTTNPVATEAWGVVTVTVTNNEQGTNVEQGT

SEQ ID NO: 188888 - protein, 36 aa, Artificial Sequence
  Description of Artificial Sequence: Synthetic polypeptide
DEDEIRTTNPVATEAWGVVTVTVVNVEQGTNNEQGT

SEQ ID NO: 188889 - protein, 33 aa, Artificial Sequence
  Description of Artificial Sequence: Synthetic polypeptide
DENPIRTTNPVSTEPYGTISMEDIQQQQNDSNH

SEQ ID NO: 188890 - protein, 33 aa, Artificial Sequence
  Description of Artificial Sequence: Synthetic polypeptide
DESEVATTNPVSTEGYGTIAANETIQQSRVGQH

SEQ ID NO: 188891 - protein, 36 aa, Artificial Sequence
  Description of Artificial Sequence: Synthetic polypeptide
DEDEIRTTNPVATEAWGVVVTTVVNNEQGTNVEQGS

SEQ ID NO: 188892 - protein, 36 aa, Artificial Sequence
  Description of Artificial Sequence: Synthetic polypeptide
DEDEIRTTNPVATEAWGVVVTVVNANEQGTNVEQGS

SEQ ID NO: 188893 - protein, 36 aa, Artificial Sequence
  Description of Artificial Sequence: Synthetic polypeptide
DEDEIRTTNPVATEAWGVVVTVVNNEQGTNNEQYGE

SEQ ID NO: 188894 - protein, 36 aa, Artificial Sequence
  Description of Artificial Sequence: Synthetic polypeptide
DEDEIRTTNPVATEAWGVVVTVVNPNEQGTNNEQGT

SEQ ID NO: 188895 - protein, 36 aa, Artificial Sequence
  Description of Artificial Sequence: Synthetic polypeptide
DEDEIRTTNPVATEAWGVVVTVVNTEQGTNNEQMGT

SEQ ID NO: 188896 - protein, 36 aa, Artificial Sequence
  Description of Artificial Sequence: Synthetic polypeptide
DEDEIRTTNPVATEAWGVVVVTVVNNEQGTNVEQGT

SEQ ID NO: 188897 - protein, 36 aa, Artificial Sequence
  Description of Artificial Sequence: Synthetic polypeptide
DENNEIATTNPVAYERWGSVSGGNADDSRNNGNGNP

SEQ ID NO: 188898 - protein, 33 aa, Artificial Sequence
  Description of Artificial Sequence: Synthetic polypeptide
DESEVASTNPVSTEGYGNVAAMEDIQQSRVGQR

SEQ ID NO: 188899 - protein, 32 aa, Artificial Sequence
  Description of Artificial Sequence: Synthetic polypeptide
DESEVASTNPVSTEGYGNVAAAETIQSRVGPI

SEQ ID NO: 188900 - protein, 35 aa, Artificial Sequence
  Description of Artificial Sequence: Synthetic polypeptide
DEPEIATTNPVATDQYGVVSTGDEGGGGQGEETTD

SEQ ID NO: 188901 - protein, 37 aa, Artificial Sequence
  Description of Artificial Sequence: Synthetic polypeptide
DEDEIRTTNPVATEAWGSVSTVVNNTEQGTTDEQEEE

SEQ ID NO: 188902 - protein, 37 aa, Artificial Sequence
  Description of Artificial Sequence: Synthetic polypeptide
CEEEIRTTNPVATEQYGCVCSNWEEHNAENFNSDTQD

SEQ ID NO: 188903 - protein, 37 aa, Artificial Sequence
  Description of Artificial Sequence: Synthetic polypeptide
DESEIVTTNPVATEQYGSVGNNVDTPGQLGPGGQTGD

SEQ ID NO: 188904 - protein, 38 aa, Artificial Sequence
  Description of Artificial Sequence: Synthetic polypeptide
DESEIVTTNPVATEQYGSVVDIDTNEGQNLDSNGGDQN

SEQ ID NO: 188905 - protein, 36 aa, Artificial Sequence
  Description of Artificial Sequence: Synthetic polypeptide
CEEEIRTTNPVATEQYGCVCSNWEEHNQENFISDQA

SEQ ID NO: 188906 - protein, 37 aa, Artificial Sequence
  Description of Artificial Sequence: Synthetic polypeptide
DEPEIRTTNPVATEQYGSIPWTPPLEENQDHQSEEPP

SEQ ID NO: 188907 - protein, 38 aa, Artificial Sequence
  Description of Artificial Sequence: Synthetic polypeptide
CEEEIRTTNPVATEQYGCVCSNWGEDHNQENFGSDNQE

SEQ ID NO: 188908 - protein, 37 aa, Artificial Sequence
  Description of Artificial Sequence: Synthetic polypeptide
CEEEIRTTNPVATEQYGCVCSNWGEDHNQENFGSDQF

SEQ ID NO: 188909 - protein, 37 aa, Artificial Sequence
  Description of Artificial Sequence: Synthetic polypeptide
CEEEIRTTNPVATEQYGCVCSNWGEHNAENFNSDTQS

SEQ ID NO: 188910 - protein, 37 aa, Artificial Sequence
  Description of Artificial Sequence: Synthetic polypeptide
CEEEIRTTNPVATEQYGCVCSNWGEHNQENFNSDTQA

SEQ ID NO: 188911 - protein, 37 aa, Artificial Sequence
  Description of Artificial Sequence: Synthetic polypeptide
CEEEIRTTNPVATEQYGCVCSNWGEHNQEYFNSDNQE

SEQ ID NO: 188912 - protein, 36 aa, Artificial Sequence
  Description of Artificial Sequence: Synthetic polypeptide
CEEEIRTTNPVATEQYGCVCSNWGEHNQNFISETQA

SEQ ID NO: 188913 - protein, 37 aa, Artificial Sequence
  Description of Artificial Sequence: Synthetic polypeptide
CEEEIRTTNPVATEQYGCVCSNTGEHNEENFISDTQF

SEQ ID NO: 188914 - protein, 38 aa, Artificial Sequence
  Description of Artificial Sequence: Synthetic polypeptide
CEEEIRTTNPVATEQYGCVCSNWPEDHNQENFGSENQA

SEQ ID NO: 188915 - protein, 37 aa, Artificial Sequence
  Description of Artificial Sequence: Synthetic polypeptide
DESEIVTTNPVATEQYGTVVVSATDGDDEEGEGNNQD

SEQ ID NO: 188916 - protein, 33 aa, Artificial Sequence
  Description of Artificial Sequence: Synthetic polypeptide
DESELSTTNPVAYEQWGMTCVTDNDDQRQAQMH

SEQ ID NO: 188917 - protein, 36 aa, Artificial Sequence
  Description of Artificial Sequence: Synthetic polypeptide
DESEMATTNPVAYEQYGTVCSATGGEPSENFNGGND

SEQ ID NO: 188918 - protein, 35 aa, Artificial Sequence
  Description of Artificial Sequence: Synthetic polypeptide
DEPEIRTTNPVATEQWGACVSVAIEQMIAVETDAE

SEQ ID NO: 188919 - protein, 36 aa, Artificial Sequence
  Description of Artificial Sequence: Synthetic polypeptide
CEEEIRTTNPVATEQYGCVCSSGEHNEENFISDTQA

SEQ ID NO: 188920 - protein, 34 aa, Artificial Sequence
  Description of Artificial Sequence: Synthetic polypeptide
DEPEIRATNPVATEQWGACVSVIEQMIAVEDVAE

SEQ ID NO: 188921 - protein, 34 aa, Artificial Sequence
  Description of Artificial Sequence: Synthetic polypeptide
DEPEIQTTNPVAYESYGEVCCIGNHSHTRGGTEL

SEQ ID NO: 188922 - protein, 35 aa, Artificial Sequence
  Description of Artificial Sequence: Synthetic polypeptide
DEPEIATTNPVAYERWGSVSGGNPGNAQGEHDGRD

SEQ ID NO: 188923 - protein, 34 aa, Artificial Sequence
  Description of Artificial Sequence: Synthetic polypeptide
DESEVASTNPVATEGYGNVAATPAIPQMRNGQPV

SEQ ID NO: 188924 - protein, 34 aa, Artificial Sequence
  Description of Artificial Sequence: Synthetic polypeptide
DESEVASTNPVATEGYGNVAATPAIPQMRVGQPV

SEQ ID NO: 188925 - protein, 36 aa, Artificial Sequence
  Description of Artificial Sequence: Synthetic polypeptide
DEPEIATTNPVATEQYGTVVSAVDGDDEEGEGGNDD

SEQ ID NO: 188926 - protein, 36 aa, Artificial Sequence
  Description of Artificial Sequence: Synthetic polypeptide
CEEEIRTTNPVATEQYGCVCSSGEDHDIEHFNSDQT

SEQ ID NO: 188927 - protein, 35 aa, Artificial Sequence
  Description of Artificial Sequence: Synthetic polypeptide
DEDEIRGTNPVATEGWGSVSAGMEGQDGEGFQEGI

SEQ ID NO: 188928 - protein, 32 aa, Artificial Sequence
  Description of Artificial Sequence: Synthetic polypeptide
DETEIASTNPIATECWGATMANSTLQPKGPYI

SEQ ID NO: 188929 - protein, 34 aa, Artificial Sequence
  Description of Artificial Sequence: Synthetic polypeptide
DETEIATTNPCAYEQWGSVCGDNNNDDQGQMGDD

SEQ ID NO: 188930 - protein, 33 aa, Artificial Sequence
  Description of Artificial Sequence: Synthetic polypeptide
AESEIACTNPVAYEGYGEASCENLSQTEVGGSD

SEQ ID NO: 188931 - protein, 33 aa, Artificial Sequence
  Description of Artificial Sequence: Synthetic polypeptide
DETEIATTNPVSTEPYGVCYCEDGQQQQNGNEH

SEQ ID NO: 188932 - protein, 36 aa, Artificial Sequence
  Description of Artificial Sequence: Synthetic polypeptide
DETEICTTNPCAYEEWGSVAVTWNDHQGDRQGHNAQ

SEQ ID NO: 188933 - protein, 38 aa, Artificial Sequence
  Description of Artificial Sequence: Synthetic polypeptide
DETEICTTNPVATEAYGSVSGNTTNDGEGQNEEQDEDQ

SEQ ID NO: 188934 - protein, 32 aa, Artificial Sequence
  Description of Artificial Sequence: Synthetic polypeptide
AESEIACTNPVAYEGYGEASCENLSFTVGGDQ

SEQ ID NO: 188935 - protein, 36 aa, Artificial Sequence
  Description of Artificial Sequence: Synthetic polypeptide
DETEICTTNPVATEMWGVVSHTNNNIDDRQNGDGGH

SEQ ID NO: 188936 - protein, 36 aa, Artificial Sequence
  Description of Artificial Sequence: Synthetic polypeptide
DETEICTTNPVATEMWGVVSHTNNNIDDRQNQGGDS

SEQ ID NO: 188937 - protein, 32 aa, Artificial Sequence
  Description of Artificial Sequence: Synthetic polypeptide
AESEIACTNPVAYEGYGEAACENLSQTVGGDL

SEQ ID NO: 188938 - protein, 36 aa, Artificial Sequence
  Description of Artificial Sequence: Synthetic polypeptide
DETEICTTNPVAYECWGSVATGNGPPQDDRQQSGTH

SEQ ID NO: 188939 - protein, 36 aa, Artificial Sequence
  Description of Artificial Sequence: Synthetic polypeptide
DETEICTTNPVAYECWGSVATGNGPTQNDRQQNGSD

SEQ ID NO: 188940 - protein, 34 aa, Artificial Sequence
  Description of Artificial Sequence: Synthetic polypeptide
DETEICTTNPVAYECWGSVYMMPGDLQDHVGQQG

SEQ ID NO: 188941 - protein, 35 aa, Artificial Sequence
  Description of Artificial Sequence: Synthetic polypeptide
DETEICTTNPVAYEQWGMISHTDNHPERRGHDSDK

SEQ ID NO: 188942 - protein, 33 aa, Artificial Sequence
  Description of Artificial Sequence: Synthetic polypeptide
DENEIRTTNPVSTEPYGTITMEDPQQPQSGEEH

SEQ ID NO: 188943 - protein, 35 aa, Artificial Sequence
  Description of Artificial Sequence: Synthetic polypeptide
DETEICTTNPVAYEQWGVVVHTDNHNQQQGQGPDV

SEQ ID NO: 188944 - protein, 35 aa, Artificial Sequence
  Description of Artificial Sequence: Synthetic polypeptide
DENEIRTTNPVSTEPYGTISWEDINQENFGSNTQS

SEQ ID NO: 188945 - protein, 37 aa, Artificial Sequence
  Description of Artificial Sequence: Synthetic polypeptide
DETEIGTTNPVATEFYGSVSNTGDQGQEDQEGGEDGD

SEQ ID NO: 188946 - protein, 38 aa, Artificial Sequence
  Description of Artificial Sequence: Synthetic polypeptide
DETEIKTTNPVATEQYGVVSVGQAEQGSGINGGQEGGT

SEQ ID NO: 188947 - protein, 37 aa, Artificial Sequence
  Description of Artificial Sequence: Synthetic polypeptide
DETEIKTTNPVATEQYGVVSVGQAEQNGQGGGQETIT

SEQ ID NO: 188948 - protein, 36 aa, Artificial Sequence
  Description of Artificial Sequence: Synthetic polypeptide
DETEINTTNPVAYEEYGETVVSINELSQESNGGLQM

SEQ ID NO: 188949 - protein, 36 aa, Artificial Sequence
  Description of Artificial Sequence: Synthetic polypeptide
DETEINTTNPVAYEQYGETVVSINEESQESNGGLQI

SEQ ID NO: 188950 - protein, 33 aa, Artificial Sequence
  Description of Artificial Sequence: Synthetic polypeptide
DETEIRCTNPIATECWGATVWANADWAEPKGNI

SEQ ID NO: 188951 - protein, 34 aa, Artificial Sequence
  Description of Artificial Sequence: Synthetic polypeptide
DETEIRCTNPIATEQWGATWANEEDWQERKGPYI

SEQ ID NO: 188952 - protein, 34 aa, Artificial Sequence
  Description of Artificial Sequence: Synthetic polypeptide
DETEIRCTNPIATEQYGETTWANEEDLAEPKGPI

SEQ ID NO: 188953 - protein, 34 aa, Artificial Sequence
  Description of Artificial Sequence: Synthetic polypeptide
DETEIATTNPVAYERWGVVPTGPMLGEDQRNTEQ

SEQ ID NO: 188954 - protein, 34 aa, Artificial Sequence
  Description of Artificial Sequence: Synthetic polypeptide
DENEIRTTNPVSTEPYGTQIPEAIEIQQNGVNHH

SEQ ID NO: 188955 - protein, 35 aa, Artificial Sequence
  Description of Artificial Sequence: Synthetic polypeptide
DETEIATTNPVAYERWGSVSGMNPGNAGEHDGQRQ

SEQ ID NO: 188956 - protein, 34 aa, Artificial Sequence
  Description of Artificial Sequence: Synthetic polypeptide
AESEIACTNPVAYEGYGEIASCENALSQRVGGSC

SEQ ID NO: 188957 - protein, 34 aa, Artificial Sequence
  Description of Artificial Sequence: Synthetic polypeptide
DETEIATTNPVAYEQWGCNVAANNMLINSDDNGN

SEQ ID NO: 188958 - protein, 35 aa, Artificial Sequence
  Description of Artificial Sequence: Synthetic polypeptide
DETEIATTNPVAYEQWGCVYSSNNDERNERGEGAV

SEQ ID NO: 188959 - protein, 36 aa, Artificial Sequence
  Description of Artificial Sequence: Synthetic polypeptide
DETEIATTNPVAYEQWGEVCSTPNQGNHGEQGQGRN

SEQ ID NO: 188960 - protein, 35 aa, Artificial Sequence
  Description of Artificial Sequence: Synthetic polypeptide
DETEIATTNPVAYEQWGHCNVAATNGLPAPAPGGF

SEQ ID NO: 188961 - protein, 35 aa, Artificial Sequence
  Description of Artificial Sequence: Synthetic polypeptide
DETEIATTNPVAYEQWGHSACAAANGLQSDGVDDS

SEQ ID NO: 188962 - protein, 35 aa, Artificial Sequence
  Description of Artificial Sequence: Synthetic polypeptide
DETEIATTNPVAYEQWGSVAITNQDENNGGMEADD

SEQ ID NO: 188963 - protein, 36 aa, Artificial Sequence
  Description of Artificial Sequence: Synthetic polypeptide
DETEIATTNPVAYEQWGSVSGGPNEGNQGEQMNGDD

SEQ ID NO: 188964 - protein, 35 aa, Artificial Sequence
  Description of Artificial Sequence: Synthetic polypeptide
DETEIATTNPVAYEQWGSVSGQGPPQDETPDGSEH

SEQ ID NO: 188965 - protein, 35 aa, Artificial Sequence
  Description of Artificial Sequence: Synthetic polypeptide
DETEIATTNPVAYEQWGSVSQGPPQEDTPDGDAEN

SEQ ID NO: 188966 - protein, 36 aa, Artificial Sequence
  Description of Artificial Sequence: Synthetic polypeptide
DENEIRTTNPVSTEPYGTVISCQEDAISQTQTGGNH

SEQ ID NO: 188967 - protein, 36 aa, Artificial Sequence
  Description of Artificial Sequence: Synthetic polypeptide
DENEIRTTNPVSTEPYGTVISCMEVAISQTQNGGNH

SEQ ID NO: 188968 - protein, 36 aa, Artificial Sequence
  Description of Artificial Sequence: Synthetic polypeptide
DETEIRGTNPVATDQYGVVNDNSIGQEGGQEDNDTL

SEQ ID NO: 188969 - protein, 36 aa, Artificial Sequence
  Description of Artificial Sequence: Synthetic polypeptide
DENEIRTTNPVSTEPYGTVISCMEDAISQTENGGNM

SEQ ID NO: 188970 - protein, 36 aa, Artificial Sequence
  Description of Artificial Sequence: Synthetic polypeptide
DENEIRTTNPVSTEPYGTVIPSCMEDISQQQNGGNH

SEQ ID NO: 188971 - protein, 31 aa, Artificial Sequence
  Description of Artificial Sequence: Synthetic polypeptide
AESEIACTNPVAYEGYGVAACEWLSQTVGGD

SEQ ID NO: 188972 - protein, 34 aa, Artificial Sequence
  Description of Artificial Sequence: Synthetic polypeptide
DENEIRTTNPVSTEPYGTTSMEDWDQQNQNIENH

SEQ ID NO: 188973 - protein, 35 aa, Artificial Sequence
  Description of Artificial Sequence: Synthetic polypeptide
DETEIATTNPVAYEQWGSVVCNAAMPREDAEDMRD

SEQ ID NO: 188974 - protein, 35 aa, Artificial Sequence
  Description of Artificial Sequence: Synthetic polypeptide
DETEIATTNPVAYEQWGSVVCNAAMPREDREGGDH

SEQ ID NO: 188975 - protein, 34 aa, Artificial Sequence
  Description of Artificial Sequence: Synthetic polypeptide
DETEIATTNPVAYEQYGSACAAANGLDSAEVDDD

SEQ ID NO: 188976 - protein, 36 aa, Artificial Sequence
  Description of Artificial Sequence: Synthetic polypeptide
DETEIATTNPVAYEQYGSVAAAGPLDNDTPGGNLHK

SEQ ID NO: 188977 - protein, 36 aa, Artificial Sequence
  Description of Artificial Sequence: Synthetic polypeptide
DETEIATTNPVAYEQYGSVATTGHGPLDSMENNNFD

SEQ ID NO: 188978 - protein, 35 aa, Artificial Sequence
  Description of Artificial Sequence: Synthetic polypeptide
DENEIRTTNPVSTEPYGTTISMEDISQQQNGGNNQ

SEQ ID NO: 188979 - protein, 33 aa, Artificial Sequence
  Description of Artificial Sequence: Synthetic polypeptide
DENEIRTTNPVSTEPYGTTIAMEDWQQQQNGPH

SEQ ID NO: 188980 - protein, 33 aa, Artificial Sequence
  Description of Artificial Sequence: Synthetic polypeptide
DENEIRTTNPVSTEPYGTTIAMEDWQQQQKGPH

SEQ ID NO: 188981 - protein, 36 aa, Artificial Sequence
  Description of Artificial Sequence: Synthetic polypeptide
DENEIRTTNPVSTEPYGTVISCLEDAISHQQEGGNH

SEQ ID NO: 188982 - protein, 35 aa, Artificial Sequence
  Description of Artificial Sequence: Synthetic polypeptide
DETEIATTNPVAYEPWGSVYPNDDQDQDTGRNDKS

SEQ ID NO: 188983 - protein, 33 aa, Artificial Sequence
  Description of Artificial Sequence: Synthetic polypeptide
DETEIRSTNPIATECWGATVANAENLAPKGPYI

SEQ ID NO: 188984 - protein, 36 aa, Artificial Sequence
  Description of Artificial Sequence: Synthetic polypeptide
AESEEIATTNPVAYEQWGWVSTGGNAGETQNGGDAS

SEQ ID NO: 188985 - protein, 33 aa, Artificial Sequence
  Description of Artificial Sequence: Synthetic polypeptide
DETEIRTTNPIATECWGATTWANAEDWQPGPYI

SEQ ID NO: 188986 - protein, 33 aa, Artificial Sequence
  Description of Artificial Sequence: Synthetic polypeptide
DETEIRTTNPIATECWGATTWANDEDLAPGPYI

SEQ ID NO: 188987 - protein, 33 aa, Artificial Sequence
  Description of Artificial Sequence: Synthetic polypeptide
DETEIRTTNPIATECWGATTWSEEDWQEPKGPL

SEQ ID NO: 188988 - protein, 33 aa, Artificial Sequence
  Description of Artificial Sequence: Synthetic polypeptide
DETEIRTTNPIATECWGATTWSNAEDWQPGPYI

SEQ ID NO: 188989 - protein, 33 aa, Artificial Sequence
  Description of Artificial Sequence: Synthetic polypeptide
DETEIRTTNPIATECWGATTWSNAEGPAFKGND

SEQ ID NO: 188990 - protein, 33 aa, Artificial Sequence
  Description of Artificial Sequence: Synthetic polypeptide
DETEIRTTNPIATECWGATTWSNAEGWAPKGND

SEQ ID NO: 188991 - protein, 35 aa, Artificial Sequence
  Description of Artificial Sequence: Synthetic polypeptide
DETEIRTTNPIATECWGATTWSNCIDEPQERKGNI

SEQ ID NO: 188992 - protein, 34 aa, Artificial Sequence
  Description of Artificial Sequence: Synthetic polypeptide
DETEIRTTNPIATECWGATVAAIDEAEREGENYG

SEQ ID NO: 188993 - protein, 34 aa, Artificial Sequence
  Description of Artificial Sequence: Synthetic polypeptide
DETEIRTTNPIATECWGATVWANAEDWQEPEGPI

SEQ ID NO: 188994 - protein, 34 aa, Artificial Sequence
  Description of Artificial Sequence: Synthetic polypeptide
DETEIRTTNPIATECWGATVWANAEDWQEPKGPI

SEQ ID NO: 188995 - protein, 34 aa, Artificial Sequence
  Description of Artificial Sequence: Synthetic polypeptide
DETEIRTTNPIATECWGATVWSNADLAEPKGPYI

SEQ ID NO: 188996 - protein, 32 aa, Artificial Sequence
  Description of Artificial Sequence: Synthetic polypeptide
DETEIRTTNPIATECWGATWAAEDCQPKGPYI

SEQ ID NO: 188997 - protein, 32 aa, Artificial Sequence
  Description of Artificial Sequence: Synthetic polypeptide
DETEIRTTNPIATECWGATWAAEDWQHKGPYI

SEQ ID NO: 188998 - protein, 33 aa, Artificial Sequence
  Description of Artificial Sequence: Synthetic polypeptide
DETEIRTTNPIATECWGATWANAEDLAEPKGPI

SEQ ID NO: 188999 - protein, 33 aa, Artificial Sequence
  Description of Artificial Sequence: Synthetic polypeptide
DETEIRTTNPIATECWGATWANAEDWARKGPYI

SEQ ID NO: 189000 - protein, 33 aa, Artificial Sequence
  Description of Artificial Sequence: Synthetic polypeptide
DETEIRTTNPIATECWGATWANENWMERKGPYI

SEQ ID NO: 189001 - protein, 35 aa, Artificial Sequence
  Description of Artificial Sequence: Synthetic polypeptide
DETEIRTTNPIATECWGATWSNAIDWPQERKGNYG

SEQ ID NO: 189002 - protein, 34 aa, Artificial Sequence
  Description of Artificial Sequence: Synthetic polypeptide
DETEIRTTNPIATECWGATWSNAIDWQEPKGNYG

SEQ ID NO: 189003 - protein, 32 aa, Artificial Sequence
  Description of Artificial Sequence: Synthetic polypeptide
DETEIRTTNPIATECWGAVWAADWANPKGPYI

SEQ ID NO: 189004 - protein, 34 aa, Artificial Sequence
  Description of Artificial Sequence: Synthetic polypeptide
DETEIRTTNPIATECWGAVWACENEPQDPKGPYG

SEQ ID NO: 189005 - protein, 34 aa, Artificial Sequence
  Description of Artificial Sequence: Synthetic polypeptide
DETEIRTTNPIATECWGAVWACENEPQEPKGPYG

SEQ ID NO: 189006 - protein, 33 aa, Artificial Sequence
  Description of Artificial Sequence: Synthetic polypeptide
DETEIRTTNPIATECWGAVWANADDWAPKGPYI

SEQ ID NO: 189007 - protein, 33 aa, Artificial Sequence
  Description of Artificial Sequence: Synthetic polypeptide
DETEIRTTNPIATECWGAVWANADWANPKGPYI

SEQ ID NO: 189008 - protein, 33 aa, Artificial Sequence
  Description of Artificial Sequence: Synthetic polypeptide
DETEIRTTNPIATECWGATTWANAEDWQEPGPI

SEQ ID NO: 189009 - protein, 33 aa, Artificial Sequence
  Description of Artificial Sequence: Synthetic polypeptide
DETEIRTTNPIATECWGATTWANAEDWAPKGTR

SEQ ID NO: 189010 - protein, 31 aa, Artificial Sequence
  Description of Artificial Sequence: Synthetic polypeptide
DETEIRTTNPIATECWGATTWAAEDWAPGPI

SEQ ID NO: 189011 - protein, 34 aa, Artificial Sequence
  Description of Artificial Sequence: Synthetic polypeptide
DETEIRTTNPIATECWGATTANAEDLQEPKGPYI

SEQ ID NO: 189012 - protein, 35 aa, Artificial Sequence
  Description of Artificial Sequence: Synthetic polypeptide
DETEIRTTNPCAYEQWGSVCGDINNDQQGQGGGKE

SEQ ID NO: 189013 - protein, 36 aa, Artificial Sequence
  Description of Artificial Sequence: Synthetic polypeptide
DETEIRTTNPCAYEQWGSVCGDNHNDNQRGQGMGDD

SEQ ID NO: 189014 - protein, 35 aa, Artificial Sequence
  Description of Artificial Sequence: Synthetic polypeptide
DETEIRTTNPCAYEQWGSVCGDNMNDQQGQGGGTD

SEQ ID NO: 189015 - protein, 35 aa, Artificial Sequence
  Description of Artificial Sequence: Synthetic polypeptide
DETEIRTTNPCAYEQWGSVCGDNNHDQSGQGGGKD

SEQ ID NO: 189016 - protein, 35 aa, Artificial Sequence
  Description of Artificial Sequence: Synthetic polypeptide
DETEIRTTNPCAYEQWGSVCGDNNNDGQQGQGGKD

SEQ ID NO: 189017 - protein, 35 aa, Artificial Sequence
  Description of Artificial Sequence: Synthetic polypeptide
DETEIRTTNPCAYEQWGSVCGDNNNDMQGQTGGDD

SEQ ID NO: 189018 - protein, 35 aa, Artificial Sequence
  Description of Artificial Sequence: Synthetic polypeptide
DETEIRTTNPCAYEQWGSVCGDNNNDQAGQGGGDD

SEQ ID NO: 189019 - protein, 35 aa, Artificial Sequence
  Description of Artificial Sequence: Synthetic polypeptide
DETEIRTTNPCAYEQWGSVCGDNNNDQNGQGGKKD

SEQ ID NO: 189020 - protein, 35 aa, Artificial Sequence
  Description of Artificial Sequence: Synthetic polypeptide
DETEIRTTNPCAYEQWGSVCGDNNNDQQGQGGSSD

SEQ ID NO: 189021 - protein, 35 aa, Artificial Sequence
  Description of Artificial Sequence: Synthetic polypeptide
DETEIRTTNPCAYEQWGSVCGDNNNDQQGTQGGKD

SEQ ID NO: 189022 - protein, 35 aa, Artificial Sequence
  Description of Artificial Sequence: Synthetic polypeptide
DETEIRTTNPCAYEQWGSVCGDNNNDQQQGQMGDD

SEQ ID NO: 189023 - protein, 38 aa, Artificial Sequence
  Description of Artificial Sequence: Synthetic polypeptide
DETEIRSTNPVATEQYGSVNYDGPGNLDTGEMNETEDI

SEQ ID NO: 189024 - protein, 35 aa, Artificial Sequence
  Description of Artificial Sequence: Synthetic polypeptide
DETEIRTTNPCAYEQWGSVCGDNNNDQQQQNGGKD

SEQ ID NO: 189025 - protein, 35 aa, Artificial Sequence
  Description of Artificial Sequence: Synthetic polypeptide
DETEIRTTNPCAYEQWGSVCGDRNNDQQGQGGGGD

SEQ ID NO: 189026 - protein, 33 aa, Artificial Sequence
  Description of Artificial Sequence: Synthetic polypeptide
DETEIRTTNPCAYEQWGVVCYNIEKDDQDNHDS

SEQ ID NO: 189027 - protein, 33 aa, Artificial Sequence
  Description of Artificial Sequence: Synthetic polypeptide
DETEIRTTNPCAYEQWGVVCYNIEKEDQDHIVS

SEQ ID NO: 189028 - protein, 33 aa, Artificial Sequence
  Description of Artificial Sequence: Synthetic polypeptide
DETEIRTTNPCAYEQWGVVCYNIEKSDQDEIDP

SEQ ID NO: 189029 - protein, 33 aa, Artificial Sequence
  Description of Artificial Sequence: Synthetic polypeptide
DETEIRTTNPIATECWGATAAENEADRKGEPYG

SEQ ID NO: 189030 - protein, 32 aa, Artificial Sequence
  Description of Artificial Sequence: Synthetic polypeptide
DETEIRTTNPIATECWGATAMEDIQEQKGPYH

SEQ ID NO: 189031 - protein, 32 aa, Artificial Sequence
  Description of Artificial Sequence: Synthetic polypeptide
DETEIRTTNPIATECWGATANANWAEPKGPYI

SEQ ID NO: 189032 - protein, 33 aa, Artificial Sequence
  Description of Artificial Sequence: Synthetic polypeptide
DETEIRTTNPIATECWGATCSNTDDPEFKGPYD

SEQ ID NO: 189033 - protein, 32 aa, Artificial Sequence
  Description of Artificial Sequence: Synthetic polypeptide
DETEIRTTNPIATECWGATTANADWAPKGGYI

SEQ ID NO: 189034 - protein, 32 aa, Artificial Sequence
  Description of Artificial Sequence: Synthetic polypeptide
DETEIRTTNPIATECWGATTANADWAPKGPYI

SEQ ID NO: 189035 - protein, 33 aa, Artificial Sequence
  Description of Artificial Sequence: Synthetic polypeptide
DETEIRTTNPIATECWGATTANADWMEPKGNYI

SEQ ID NO: 189036 - protein, 35 aa, Artificial Sequence
  Description of Artificial Sequence: Synthetic polypeptide
DETEIRTTNPCAYEQWGSVCGDNNNDVQGQGGGKK

SEQ ID NO: 189037 - protein, 35 aa, Artificial Sequence
  Description of Artificial Sequence: Synthetic polypeptide
DETEIATTNPCAYEHWGSVATPNGNQQLEGDHGGR

SEQ ID NO: 189038 - protein, 34 aa, Artificial Sequence
  Description of Artificial Sequence: Synthetic polypeptide
DETEIATTNPVAYEPQWGQVVAQNGLVQTADITG

SEQ ID NO: 189039 - protein, 33 aa, Artificial Sequence
  Description of Artificial Sequence: Synthetic polypeptide
DETEIATTNPVAYEAWGVCATNPNGDDTGNDSE

SEQ ID NO: 189040 - protein, 34 aa, Artificial Sequence
  Description of Artificial Sequence: Synthetic polypeptide
DETEIATTNPVATECWGATVWSNTDWEEHKGPDL

SEQ ID NO: 189041 - protein, 34 aa, Artificial Sequence
  Description of Artificial Sequence: Synthetic polypeptide
DETEIATTNPVATECYGATTANAEDLAEHEGEYI

SEQ ID NO: 189042 - protein, 34 aa, Artificial Sequence
  Description of Artificial Sequence: Synthetic polypeptide
DETEIATTNPVATECYGATTANAEDLAEHEGPYI

SEQ ID NO: 189043 - protein, 34 aa, Artificial Sequence
  Description of Artificial Sequence: Synthetic polypeptide
DETEIATTNPVATECYGATTANAEDLEEHEGEYI

SEQ ID NO: 189044 - protein, 34 aa, Artificial Sequence
  Description of Artificial Sequence: Synthetic polypeptide
DETEIATTNPVATECYGATTANAEDLEEHEGEYL

SEQ ID NO: 189045 - protein, 34 aa, Artificial Sequence
  Description of Artificial Sequence: Synthetic polypeptide
DETEIATTNPVATECYGATTSNAEDLEDHEGEYL

SEQ ID NO: 189046 - protein, 36 aa, Artificial Sequence
  Description of Artificial Sequence: Synthetic polypeptide
DETEIATTNPVATECYGTVAATPNDGDERNGQGGGA

SEQ ID NO: 189047 - protein, 37 aa, Artificial Sequence
  Description of Artificial Sequence: Synthetic polypeptide
DEAEIRTTNPVATEQYGSVIEPEVYVLPPNLGVELIE

SEQ ID NO: 189048 - protein, 31 aa, Artificial Sequence
  Description of Artificial Sequence: Synthetic polypeptide
DETEIATTNPVATEQWGAAANAEDCAEHEEK

SEQ ID NO: 189049 - protein, 31 aa, Artificial Sequence
  Description of Artificial Sequence: Synthetic polypeptide
DETEIATTNPVATEQWGATANAEDCAEHEEK

SEQ ID NO: 189050 - protein, 31 aa, Artificial Sequence
  Description of Artificial Sequence: Synthetic polypeptide
DETEIATTNPVATEQWGATANAEDWAEHEEK

SEQ ID NO: 189051 - protein, 31 aa, Artificial Sequence
  Description of Artificial Sequence: Synthetic polypeptide
DETEIATTNPVATEQWGATPEEDWAEHKEPK

SEQ ID NO: 189052 - protein, 35 aa, Artificial Sequence
  Description of Artificial Sequence: Synthetic polypeptide
DETEIATTNPVATEQWGCVAGEGGPANPMQMGAQP

SEQ ID NO: 189053 - protein, 35 aa, Artificial Sequence
  Description of Artificial Sequence: Synthetic polypeptide
DETEIATTNPVATEQWGCVAGEGPGIANAGQGNAD

SEQ ID NO: 189054 - protein, 34 aa, Artificial Sequence
  Description of Artificial Sequence: Synthetic polypeptide
DETEIATTNPVATEQWGCVAGEGVEMNAAEDNMW

SEQ ID NO: 189055 - protein, 36 aa, Artificial Sequence
  Description of Artificial Sequence: Synthetic polypeptide
DETEIATTNPVATEQWGHCNVAATANGLPAAPGGFG

SEQ ID NO: 189056 - protein, 36 aa, Artificial Sequence
  Description of Artificial Sequence: Synthetic polypeptide
DETEIATTNPVATEQWGHCNVAATNGLPAAPGDGFP

SEQ ID NO: 189057 - protein, 38 aa, Artificial Sequence
  Description of Artificial Sequence: Synthetic polypeptide
DENEIRTVNPVATEFYGAVSTGDDDGEGQLEGQGGNGT

SEQ ID NO: 189058 - protein, 35 aa, Artificial Sequence
  Description of Artificial Sequence: Synthetic polypeptide
DENEIRTTNPVSYEPYGTVISVEDMISQQQNGGNH

SEQ ID NO: 189059 - protein, 35 aa, Artificial Sequence
  Description of Artificial Sequence: Synthetic polypeptide
DENEIRTTNPVSYEPYGTVISCMEDISQQQNGNNH

SEQ ID NO: 189060 - protein, 35 aa, Artificial Sequence
  Description of Artificial Sequence: Synthetic polypeptide
DENEIRTTNPVSYEPYGTVIPSMEDAISQQQTGNH

SEQ ID NO: 189061 - protein, 34 aa, Artificial Sequence
  Description of Artificial Sequence: Synthetic polypeptide
DENEIRTTNPVSYEPYGTTIPSMEDHSQQQNGNH

SEQ ID NO: 189062 - protein, 36 aa, Artificial Sequence
  Description of Artificial Sequence: Synthetic polypeptide
DETEIATTNPVATEQWGSVSATGDEEADTEGGEDAW

SEQ ID NO: 189063 - protein, 34 aa, Artificial Sequence
  Description of Artificial Sequence: Synthetic polypeptide
DETEIATTNPVATECWGATVWSATDWEEHKGPDL

SEQ ID NO: 189064 - protein, 36 aa, Artificial Sequence
  Description of Artificial Sequence: Synthetic polypeptide
DETEIATTNPVATASWGSVSAAGDMGTDHQGGEDNP

SEQ ID NO: 189065 - protein, 35 aa, Artificial Sequence
  Description of Artificial Sequence: Synthetic polypeptide
DETEIATTNPVATASWGCVSAANNEPLDNGGENGM

SEQ ID NO: 189066 - protein, 33 aa, Artificial Sequence
  Description of Artificial Sequence: Synthetic polypeptide
DETEIATTNPVATASWGCIATTAEQDTDGNENN

SEQ ID NO: 189067 - protein, 34 aa, Artificial Sequence
  Description of Artificial Sequence: Synthetic polypeptide
DETEIATTNPCAYEQWGSVCGDNNNDQQDQGGDD

SEQ ID NO: 189068 - protein, 33 aa, Artificial Sequence
  Description of Artificial Sequence: Synthetic polypeptide
DETEIATTNPIASECWGAVSNCEDLAESKGPYR

SEQ ID NO: 189069 - protein, 32 aa, Artificial Sequence
  Description of Artificial Sequence: Synthetic polypeptide
DETEIATTNPIATECWGATANAEDLQEPGDYI

SEQ ID NO: 189070 - protein, 33 aa, Artificial Sequence
  Description of Artificial Sequence: Synthetic polypeptide
DETEIATTNPIATECWGATTWSNADLQEPGPYI

SEQ ID NO: 189071 - protein, 31 aa, Artificial Sequence
  Description of Artificial Sequence: Synthetic polypeptide
DETEIATTNPIATECWGATVANADWAHGPYL

SEQ ID NO: 189072 - protein, 31 aa, Artificial Sequence
  Description of Artificial Sequence: Synthetic polypeptide
DETEIATTNPIATECWGATWSNACWQPEPYI

SEQ ID NO: 189073 - protein, 36 aa, Artificial Sequence
  Description of Artificial Sequence: Synthetic polypeptide
DENEISTTNPVATEGYGCVCSWGEHNQENFGSDNQA

SEQ ID NO: 189074 - protein, 32 aa, Artificial Sequence
  Description of Artificial Sequence: Synthetic polypeptide
DETEIATTNPIATECWGVMWANAEDWQEHGPI

SEQ ID NO: 189075 - protein, 32 aa, Artificial Sequence
  Description of Artificial Sequence: Synthetic polypeptide
DETEIATTNPIATECWGVMWANAEDWQEPGPI

SEQ ID NO: 189076 - protein, 31 aa, Artificial Sequence
  Description of Artificial Sequence: Synthetic polypeptide
DETEIATTNPIATECYGATAADLAEHKEPYL

SEQ ID NO: 189077 - protein, 32 aa, Artificial Sequence
  Description of Artificial Sequence: Synthetic polypeptide
DETEIATTNPIATECYGATTWSNACWAEPGPL

SEQ ID NO: 189078 - protein, 34 aa, Artificial Sequence
  Description of Artificial Sequence: Synthetic polypeptide
DENEIRTTNPVSYEPYGTISMEDEHSQQQNGGNH

SEQ ID NO: 189079 - protein, 33 aa, Artificial Sequence
  Description of Artificial Sequence: Synthetic polypeptide
DETEIATTNPIATECYGATWANEEDLAEPKGPI

SEQ ID NO: 189080 - protein, 31 aa, Artificial Sequence
  Description of Artificial Sequence: Synthetic polypeptide
DETEIATTNPIATECYGDTAADLAEHKEEYL

SEQ ID NO: 189081 - protein, 34 aa, Artificial Sequence
  Description of Artificial Sequence: Synthetic polypeptide
DETEIATTNPIATEQWGATWSNEENWQEPKGPYI

SEQ ID NO: 189082 - protein, 34 aa, Artificial Sequence
  Description of Artificial Sequence: Synthetic polypeptide
DETEIATTNPIATEQYGATTWANAEDWQEPKGPI

SEQ ID NO: 189083 - protein, 34 aa, Artificial Sequence
  Description of Artificial Sequence: Synthetic polypeptide
DETEIATTNPIATEQYGSTVANAEDWADHEGEYL

SEQ ID NO: 189084 - protein, 31 aa, Artificial Sequence
  Description of Artificial Sequence: Synthetic polypeptide
DETEIATTNPIGTECWGVMWASEDWQEHGPI

SEQ ID NO: 189085 - protein, 36 aa, Artificial Sequence
  Description of Artificial Sequence: Synthetic polypeptide
DETEIATTNPVATAQWGSTVAANDPGAPTNQMEGNP

SEQ ID NO: 189086 - protein, 36 aa, Artificial Sequence
  Description of Artificial Sequence: Synthetic polypeptide
DETEIATTNPVATAQWGSVSAAGDMGEDHQGGEDNV

SEQ ID NO: 189087 - protein, 36 aa, Artificial Sequence
  Description of Artificial Sequence: Synthetic polypeptide
DETEIATTNPVATAQWGSVSADGAGGQAEMGNGSFE

SEQ ID NO: 189088 - protein, 36 aa, Artificial Sequence
  Description of Artificial Sequence: Synthetic polypeptide
DETEIATTNPVATAQWGSVSANGDMGEDHQGEEDNP

SEQ ID NO: 189089 - protein, 36 aa, Artificial Sequence
  Description of Artificial Sequence: Synthetic polypeptide
DETEIATTNPVATAQWGSVSATGTPGEDHQGDEDNN

SEQ ID NO: 189090 - protein, 36 aa, Artificial Sequence
  Description of Artificial Sequence: Synthetic polypeptide
DETEIATTNPVATAQWGSVSPAGEMGEDHQGGEDNP

SEQ ID NO: 189091 - protein, 31 aa, Artificial Sequence
  Description of Artificial Sequence: Synthetic polypeptide
DETEIATTNPIATECYGATWSNACWAEPEPL

SEQ ID NO: 189092 - protein, 34 aa, Artificial Sequence
  Description of Artificial Sequence: Synthetic polypeptide
DETEIATTNPVAYECWGTVYQINENQDRQMMNNG

SEQ ID NO: 189093 - protein, 34 aa, Artificial Sequence
  Description of Artificial Sequence: Synthetic polypeptide
DENEIRTTNPVSYEPYGTISCMEDEISQQSNGNH

SEQ ID NO: 189094 - protein, 37 aa, Artificial Sequence
  Description of Artificial Sequence: Synthetic polypeptide
DETEIATTNPVATEQWGSVSGEGGPGENTRDNMNPVS

SEQ ID NO: 189095 - protein, 36 aa, Artificial Sequence
  Description of Artificial Sequence: Synthetic polypeptide
DETEIATTNPVATEQYGSVCAANMGEEAPDSNMEAH

SEQ ID NO: 189096 - protein, 36 aa, Artificial Sequence
  Description of Artificial Sequence: Synthetic polypeptide
DETEIATTNPVATEQYGSVCAANNGDENGMDIGEDI

SEQ ID NO: 189097 - protein, 36 aa, Artificial Sequence
  Description of Artificial Sequence: Synthetic polypeptide
DETEIATTNPVATEQYGSVCAANNGDENGMDIIDKP

SEQ ID NO: 189098 - protein, 36 aa, Artificial Sequence
  Description of Artificial Sequence: Synthetic polypeptide
DETEIATTNPVATEQYGSVCAANNGDENGMDIMIEF

SEQ ID NO: 189099 - protein, 37 aa, Artificial Sequence
  Description of Artificial Sequence: Synthetic polypeptide
DETEIATTNPVATEQYGSVCAANNGDENGMDINEDTM

SEQ ID NO: 189100 - protein, 37 aa, Artificial Sequence
  Description of Artificial Sequence: Synthetic polypeptide
DETEIATTNPVATEQYGSVCAANNGDENGMDINSDNW

SEQ ID NO: 189101 - protein, 37 aa, Artificial Sequence
  Description of Artificial Sequence: Synthetic polypeptide
DETEIATTNPVATEQYGSVCAANNGDENGMDMAEDNW

SEQ ID NO: 189102 - protein, 37 aa, Artificial Sequence
  Description of Artificial Sequence: Synthetic polypeptide
DETEIATTNPVATEQYGSVCAANNGDEQGMDINNKNN

SEQ ID NO: 189103 - protein, 37 aa, Artificial Sequence
  Description of Artificial Sequence: Synthetic polypeptide
DETEIATTNPVATEQYGSVCAANNGMLEPPDDQANGA

SEQ ID NO: 189104 - protein, 35 aa, Artificial Sequence
  Description of Artificial Sequence: Synthetic polypeptide
DENEIRTTNPVSTEVYGTVQTGHPMDIEIQQNDNH

SEQ ID NO: 189105 - protein, 36 aa, Artificial Sequence
  Description of Artificial Sequence: Synthetic polypeptide
DETEIATTNPVATEQYGSVCAGMTHGGAEAPIGDHN

SEQ ID NO: 189106 - protein, 36 aa, Artificial Sequence
  Description of Artificial Sequence: Synthetic polypeptide
DETEIATTNPVATEQYGSVCAGNNGLADNPIDEMAM

SEQ ID NO: 189107 - protein, 37 aa, Artificial Sequence
  Description of Artificial Sequence: Synthetic polypeptide
DETEIATTNPVATEQYGSVCAMNNGGTEAGDVNNVAP

SEQ ID NO: 189108 - protein, 37 aa, Artificial Sequence
  Description of Artificial Sequence: Synthetic polypeptide
DETEIATTNPVATEQYGSVCAMTNNEPTGGDALEEGA

SEQ ID NO: 189109 - protein, 37 aa, Artificial Sequence
  Description of Artificial Sequence: Synthetic polypeptide
DETEIATTNPVATEQYGSVCAMTVGGEAPDAQMENNH

SEQ ID NO: 189110 - protein, 37 aa, Artificial Sequence
  Description of Artificial Sequence: Synthetic polypeptide
DETEIATTNPVATEQYGSVCSGMTHGGAEAPIEDNHN

SEQ ID NO: 189111 - protein, 31 aa, Artificial Sequence
  Description of Artificial Sequence: Synthetic polypeptide
AESEIASTNPVGTEGWGVCAPTDLQHKGDTS

SEQ ID NO: 189112 - protein, 31 aa, Artificial Sequence
  Description of Artificial Sequence: Synthetic polypeptide
AESEIASTNPVGTEGWGVCAPTDLQHGGDTE

SEQ ID NO: 189113 - protein, 31 aa, Artificial Sequence
  Description of Artificial Sequence: Synthetic polypeptide
AESEIASTNPVGTEGWGVCAPTDLQHAGGDI

SEQ ID NO: 189114 - protein, 38 aa, Artificial Sequence
  Description of Artificial Sequence: Synthetic polypeptide
DEAEIRTTNPVATEQYGSVEYTTWNPMIQTESSEEHTQ

SEQ ID NO: 189115 - protein, 34 aa, Artificial Sequence
  Description of Artificial Sequence: Synthetic polypeptide
DETEIATTNPVAYAQWGSVSQGPPQQATPDGSEN

SEQ ID NO: 189116 - protein, 33 aa, Artificial Sequence
  Description of Artificial Sequence: Synthetic polypeptide
DETEIATTNPVAYEAWGVCATNAGNGDTGNGSE

SEQ ID NO: 189117 - protein, 32 aa, Artificial Sequence
  Description of Artificial Sequence: Synthetic polypeptide
DETEIATTNPVAYEAWGVCATNANGDTDGGSD

SEQ ID NO: 189118 - protein, 36 aa, Artificial Sequence
  Description of Artificial Sequence: Synthetic polypeptide
DETEIATTNPVATEQYGSVCAANMGEEAPDQGMEHQ

SEQ ID NO: 189119 - protein, 37 aa, Artificial Sequence
  Description of Artificial Sequence: Synthetic polypeptide
DETEIATTNPVATEQYGSVCAANMGEEAPDNQMEGAY

SEQ ID NO: 189120 - protein, 38 aa, Artificial Sequence
  Description of Artificial Sequence: Synthetic polypeptide
DETEIATTNPVATEQYGSVCAAMNPAEEAGDSGSGNRD

SEQ ID NO: 189121 - protein, 37 aa, Artificial Sequence
  Description of Artificial Sequence: Synthetic polypeptide
DETEIATTNPVATEQYGSVCAADNGVDEDGMDINHNA

SEQ ID NO: 189122 - protein, 34 aa, Artificial Sequence
  Description of Artificial Sequence: Synthetic polypeptide
DENEIRTTNPVSYEPWGKISCSEYISDQQNGGNF

SEQ ID NO: 189123 - protein, 34 aa, Artificial Sequence
  Description of Artificial Sequence: Synthetic polypeptide
DENEIRTTNPVSYEPWGKISCMLDISMQQNGGNH

SEQ ID NO: 189124 - protein, 34 aa, Artificial Sequence
  Description of Artificial Sequence: Synthetic polypeptide
DENEIRTTNPVSYEPWGKISCMEDVSQAQNGGNF

SEQ ID NO: 189125 - protein, 34 aa, Artificial Sequence
  Description of Artificial Sequence: Synthetic polypeptide
DETEIATTNPVATEQWGTNCSAAAHGMRNSNDAM

SEQ ID NO: 189126 - protein, 35 aa, Artificial Sequence
  Description of Artificial Sequence: Synthetic polypeptide
DETEIATTNPVATEQWGTNCSATAHGMNRGSGDMW

SEQ ID NO: 189127 - protein, 34 aa, Artificial Sequence
  Description of Artificial Sequence: Synthetic polypeptide
DETEIATTNPVATEQYGATTANAEDWADHKGPYI

SEQ ID NO: 189128 - protein, 34 aa, Artificial Sequence
  Description of Artificial Sequence: Synthetic polypeptide
DETEIATTNPVATEQYGATTANAEDWADHKGPYL

SEQ ID NO: 189129 - protein, 34 aa, Artificial Sequence
  Description of Artificial Sequence: Synthetic polypeptide
DETEIATTNPVATEQYGATTANAEDWAEHKGPYI

SEQ ID NO: 189130 - protein, 34 aa, Artificial Sequence
  Description of Artificial Sequence: Synthetic polypeptide
DETEIATTNPVATEQYGATVAAAEDWADHKGPYL

SEQ ID NO: 189131 - protein, 34 aa, Artificial Sequence
  Description of Artificial Sequence: Synthetic polypeptide
DETEIATTNPVATEQYGATVANAEDWADHKGPYL

SEQ ID NO: 189132 - protein, 35 aa, Artificial Sequence
  Description of Artificial Sequence: Synthetic polypeptide
DETEIATTNPVATEQYGCVAANGDGATMPMGDGHG

SEQ ID NO: 189133 - protein, 37 aa, Artificial Sequence
  Description of Artificial Sequence: Synthetic polypeptide
DETEIATTNPVATEQWGSVSAVAHAGGQDHQDGNNNH

SEQ ID NO: 189134 - protein, 30 aa, Artificial Sequence
  Description of Artificial Sequence: Synthetic polypeptide
AESEIASTNPVGTEGWGVCAPTDWQHGDTI

SEQ ID NO: 189135 - protein, 36 aa, Artificial Sequence
  Description of Artificial Sequence: Synthetic polypeptide
DETEIATTNPVATEQYGSACAANHGPLDSMGGDFPH

SEQ ID NO: 189136 - protein, 36 aa, Artificial Sequence
  Description of Artificial Sequence: Synthetic polypeptide
DETEIATTNPVATEQYGSACAANPQGQEHQDGTQMK

SEQ ID NO: 189137 - protein, 36 aa, Artificial Sequence
  Description of Artificial Sequence: Synthetic polypeptide
DETEIATTNPVATEQYGSACAATNGEANDTGMGTMM

SEQ ID NO: 189138 - protein, 37 aa, Artificial Sequence
  Description of Artificial Sequence: Synthetic polypeptide
DETEIATTNPVATEQYGSACAATNPQEAGDSGMGHEM

SEQ ID NO: 189139 - protein, 37 aa, Artificial Sequence
  Description of Artificial Sequence: Synthetic polypeptide
DETEIATTNPVATEQYGSACATNPELGQEHQDDQTAH

SEQ ID NO: 189140 - protein, 37 aa, Artificial Sequence
  Description of Artificial Sequence: Synthetic polypeptide
DETEIATTNPVATEQYGSACATNPELGQLHQDDSLDG

SEQ ID NO: 189141 - protein, 37 aa, Artificial Sequence
  Description of Artificial Sequence: Synthetic polypeptide
DETEIATTNPVATEQYGSACSAANPAEADAEIGNHTA

SEQ ID NO: 189142 - protein, 37 aa, Artificial Sequence
  Description of Artificial Sequence: Synthetic polypeptide
DETEIATTNPVATEQYGSCAAGGAGGTNPDDGMGDRN

SEQ ID NO: 189143 - protein, 34 aa, Artificial Sequence
  Description of Artificial Sequence: Synthetic polypeptide
DENEIRTTNPVSTSPYGTISMEDIQGQQNGRNHV

SEQ ID NO: 189144 - protein, 31 aa, Artificial Sequence
  Description of Artificial Sequence: Synthetic polypeptide
AESEIASTNPVGTEGWGVCAPTDLQHQGDTS

SEQ ID NO: 189145 - protein, 37 aa, Artificial Sequence
  Description of Artificial Sequence: Synthetic polypeptide
DETEIATTNPVATEQYGSVCAADNGDEDGMDINNNND

SEQ ID NO: 189146 - protein, 30 aa, Artificial Sequence
  Description of Artificial Sequence: Synthetic polypeptide
AESEIASTNPVGTEGWGVCAPTDRDQMGDA

SEQ ID NO: 189147 - protein, 37 aa, Artificial Sequence
  Description of Artificial Sequence: Synthetic polypeptide
DEEEIACTNPVATEQYGSVCAGMTHDPTDSGEENASQ

SEQ ID NO: 189148 - protein, 34 aa, Artificial Sequence
  Description of Artificial Sequence: Synthetic polypeptide
DETEIRTTNPIATECYGATWANEEDWAEPKGGYR

SEQ ID NO: 189149 - protein, 35 aa, Artificial Sequence
  Description of Artificial Sequence: Synthetic polypeptide
DEMEISTTNPVATEQYGCVCQTGADNIENFMSDQA

SEQ ID NO: 189150 - protein, 36 aa, Artificial Sequence
  Description of Artificial Sequence: Synthetic polypeptide
QAEEIATTNPVATEQYGSVCAWTPAGNQDPMEEGMM

SEQ ID NO: 189151 - protein, 37 aa, Artificial Sequence
  Description of Artificial Sequence: Synthetic polypeptide
QAEEIATTNPVATEQYGSVCAPTHNGPLDSMIGQDEE

SEQ ID NO: 189152 - protein, 36 aa, Artificial Sequence
  Description of Artificial Sequence: Synthetic polypeptide
QAEEIATTNPVATEQYGSVCAPTHGPLDSMIENDEE

SEQ ID NO: 189153 - protein, 37 aa, Artificial Sequence
  Description of Artificial Sequence: Synthetic polypeptide
QAEEIATTNPVATEQYGSVCAMTNNDLTPADGSGGDP

SEQ ID NO: 189154 - protein, 37 aa, Artificial Sequence
  Description of Artificial Sequence: Synthetic polypeptide
QAEEIATTNPVATEQYGSVCAMNNGLEADGPGGEMNW

SEQ ID NO: 189155 - protein, 37 aa, Artificial Sequence
  Description of Artificial Sequence: Synthetic polypeptide
QAEEIATTNPVATEQYGSVCAMNNGGLEAPGDVNGVA

SEQ ID NO: 189156 - protein, 37 aa, Artificial Sequence
  Description of Artificial Sequence: Synthetic polypeptide
QAEEIATTNPVATEQYGSVCSANPALGIDHPDDTNMM

SEQ ID NO: 189157 - protein, 36 aa, Artificial Sequence
  Description of Artificial Sequence: Synthetic polypeptide
DEMEIATTNPVAYEQYGCVCSTTELNEEHFGSETLA

SEQ ID NO: 189158 - protein, 36 aa, Artificial Sequence
  Description of Artificial Sequence: Synthetic polypeptide
QEEEIATTNPVATEQYGVVMGGPGEGEGGQTGENED

SEQ ID NO: 189159 - protein, 37 aa, Artificial Sequence
  Description of Artificial Sequence: Synthetic polypeptide
QAEEIATTNPVATEQYGSVCAANNGLPADAPAGNMHA

SEQ ID NO: 189160 - protein, 37 aa, Artificial Sequence
  Description of Artificial Sequence: Synthetic polypeptide
QAEEIATTNPVATEQYGSVCAANNGLEADMPGMNDNH

SEQ ID NO: 189161 - protein, 37 aa, Artificial Sequence
  Description of Artificial Sequence: Synthetic polypeptide
QAEEIATTNPVATEQYGSVCAANNGLEADAPGGEENH

SEQ ID NO: 189162 - protein, 37 aa, Artificial Sequence
  Description of Artificial Sequence: Synthetic polypeptide
DEMEIATTNPVAYEQYGTVCSYTDGLNEEHRINGQDS

SEQ ID NO: 189163 - protein, 36 aa, Artificial Sequence
  Description of Artificial Sequence: Synthetic polypeptide
DEMEIATTNPVAYEQYGTVCSYTDGLNEEHRPDQDS

SEQ ID NO: 189164 - protein, 35 aa, Artificial Sequence
  Description of Artificial Sequence: Synthetic polypeptide
QAEEIATTNPVATEQYGSVCAAPHLDNDHPMGEFH

SEQ ID NO: 189165 - protein, 37 aa, Artificial Sequence
  Description of Artificial Sequence: Synthetic polypeptide
DEMEIATTNPVAYEQYGTVCSYTDGLNEKHRPRGQDS

SEQ ID NO: 189166 - protein, 37 aa, Artificial Sequence
  Description of Artificial Sequence: Synthetic polypeptide
QAEEIATTNPVATEQYGSVCSANPALGIDHPDGTAAE

SEQ ID NO: 189167 - protein, 37 aa, Artificial Sequence
  Description of Artificial Sequence: Synthetic polypeptide
QAEEIATTNPVATEQYGSVCSTNPALPIDHPDDTVAM

SEQ ID NO: 189168 - protein, 37 aa, Artificial Sequence
  Description of Artificial Sequence: Synthetic polypeptide
DEEEIATTNPVATEQYGSACAANNGEEAGMEMDGMNH

SEQ ID NO: 189169 - protein, 37 aa, Artificial Sequence
  Description of Artificial Sequence: Synthetic polypeptide
DEEEIATTNPVATEQYGSACAANNGEEAGMEMDNHNP

SEQ ID NO: 189170 - protein, 37 aa, Artificial Sequence
  Description of Artificial Sequence: Synthetic polypeptide
DEMEIRTTNPVATEQYGSIPWTPPLEENGDHQSEPPP

SEQ ID NO: 189171 - protein, 34 aa, Artificial Sequence
  Description of Artificial Sequence: Synthetic polypeptide
QAEEIATTNPVAYEQWGSTTAGNNLTTAEGGNDN

SEQ ID NO: 189172 - protein, 34 aa, Artificial Sequence
  Description of Artificial Sequence: Synthetic polypeptide
QEEEIATTNPVATEQYGVVAGFGEGEGGQGEEDN

SEQ ID NO: 189173 - protein, 34 aa, Artificial Sequence
  Description of Artificial Sequence: Synthetic polypeptide
QEEEIATTNPVATEQYGVVAGLEGEGGQGIEEDD

SEQ ID NO: 189174 - protein, 37 aa, Artificial Sequence
  Description of Artificial Sequence: Synthetic polypeptide
QAEEIATTNPVATEQYGSVCSPMHQNQQNPMVENAEE

SEQ ID NO: 189175 - protein, 36 aa, Artificial Sequence
  Description of Artificial Sequence: Synthetic polypeptide
DEMEIATTNPVAYEGWGSVCSGTDMQDRNGGDQQGQ

SEQ ID NO: 189176 - protein, 36 aa, Artificial Sequence
  Description of Artificial Sequence: Synthetic polypeptide
QEEEIATTNPVATEQYGVVAGPGEGEGGQEGNENED

SEQ ID NO: 189177 - protein, 35 aa, Artificial Sequence
  Description of Artificial Sequence: Synthetic polypeptide
QEEEIATTNPVATEQYGVVAGPGEGEGGQGNEFDD

SEQ ID NO: 189178 - protein, 34 aa, Artificial Sequence
  Description of Artificial Sequence: Synthetic polypeptide
QAEEIATTNPVAYEQWGCVATTGHGQDSNGNFHH

SEQ ID NO: 189179 - protein, 35 aa, Artificial Sequence
  Description of Artificial Sequence: Synthetic polypeptide
QEEEIATTNPVATEQYGVVDQGPGEGEGGQGENED

SEQ ID NO: 189180 - protein, 36 aa, Artificial Sequence
  Description of Artificial Sequence: Synthetic polypeptide
QAEEIATTNPVAYEQPYGSVANTNPDQTANPMNENN

SEQ ID NO: 189181 - protein, 37 aa, Artificial Sequence
  Description of Artificial Sequence: Synthetic polypeptide
QAEEIATTNPVATEQYGSVCSVNPALDITHQDDTAAE

SEQ ID NO: 189182 - protein, 34 aa, Artificial Sequence
  Description of Artificial Sequence: Synthetic polypeptide
QEEEIATTNPVATEQYGVVAGLEGGEGGQGEEDT

SEQ ID NO: 189183 - protein, 36 aa, Artificial Sequence
  Description of Artificial Sequence: Synthetic polypeptide
QEEEIATTNPVATEQYGVVMGGPGQGEGGQGENEDN

SEQ ID NO: 189184 - protein, 36 aa, Artificial Sequence
  Description of Artificial Sequence: Synthetic polypeptide
QEEEIATTNPVATEQYGVVMNGPGEQGEGGQGENED

SEQ ID NO: 189185 - protein, 37 aa, Artificial Sequence
  Description of Artificial Sequence: Synthetic polypeptide
DEEEIATTNPVATEQYGSACAANPELGQLHQDDSMAN

SEQ ID NO: 189186 - protein, 34 aa, Artificial Sequence
  Description of Artificial Sequence: Synthetic polypeptide
QAEEIATTNPVATEQYGCVAPGEGGGNESEEENQ

SEQ ID NO: 189187 - protein, 34 aa, Artificial Sequence
  Description of Artificial Sequence: Synthetic polypeptide
QAEEIATTNPVATEQYGCVAPGEGGGNESAEEED

SEQ ID NO: 189188 - protein, 32 aa, Artificial Sequence
  Description of Artificial Sequence: Synthetic polypeptide
QAEEIATTNPVATEQYGCVAPEGHGTDSEEEK

SEQ ID NO: 189189 - protein, 35 aa, Artificial Sequence
  Description of Artificial Sequence: Synthetic polypeptide
QEEEIATTNPVAYEPYRGQSVPINEGSTSSPGAPR

SEQ ID NO: 189190 - protein, 31 aa, Artificial Sequence
  Description of Artificial Sequence: Synthetic polypeptide
QEEEIATTNPVAYEQWGEAYMVEQGHEEQGD

SEQ ID NO: 189191 - protein, 36 aa, Artificial Sequence
  Description of Artificial Sequence: Synthetic polypeptide
QEEEIATTNPVAYEQWGHCSSAPTTNGLAEAGNEHT

SEQ ID NO: 189192 - protein, 34 aa, Artificial Sequence
  Description of Artificial Sequence: Synthetic polypeptide
QAEEIATTNPVATEQYGCVAPGEGGGNESEEQMK

SEQ ID NO: 189193 - protein, 33 aa, Artificial Sequence
  Description of Artificial Sequence: Synthetic polypeptide
QEEEIATTNPVAYEQYGEACCEVECSQHTEGEL

SEQ ID NO: 189194 - protein, 33 aa, Artificial Sequence
  Description of Artificial Sequence: Synthetic polypeptide
QEEEIATTNPVAYEQYGEANCEPECSQHAEGEL

SEQ ID NO: 189195 - protein, 33 aa, Artificial Sequence
  Description of Artificial Sequence: Synthetic polypeptide
QEEEIATTNPVAYEQYGEAPCEVEESQHAEGGM

SEQ ID NO: 189196 - protein, 33 aa, Artificial Sequence
  Description of Artificial Sequence: Synthetic polypeptide
QEEEIATTNPVAYEQYGEAPCEVEHSQHALGEM

SEQ ID NO: 189197 - protein, 33 aa, Artificial Sequence
  Description of Artificial Sequence: Synthetic polypeptide
QEEEIATTNPVAYEQYGEAPCEVEQSQHPEGEK

SEQ ID NO: 189198 - protein, 34 aa, Artificial Sequence
  Description of Artificial Sequence: Synthetic polypeptide
QEEEIATTNPVAYEQYGEAPCEVESSQHAEGEQQ

SEQ ID NO: 189199 - protein, 34 aa, Artificial Sequence
  Description of Artificial Sequence: Synthetic polypeptide
QAEEIATTNPVATEQYGCVANPGEGGGNESEEEH

SEQ ID NO: 189200 - protein, 36 aa, Artificial Sequence
  Description of Artificial Sequence: Synthetic polypeptide
DEMEIRTTNPVATEQYGCVWGIWYPMMQQEGGQETN

SEQ ID NO: 189201 - protein, 38 aa, Artificial Sequence
  Description of Artificial Sequence: Synthetic polypeptide
DEMEIRTTNPVATEQYGQACVPSIVPNYDNRIDEENEE

SEQ ID NO: 189202 - protein, 36 aa, Artificial Sequence
  Description of Artificial Sequence: Synthetic polypeptide
DEMEIATTNPVAYEQYGTVCSYTDGLPENHDGDGDS

SEQ ID NO: 189203 - protein, 37 aa, Artificial Sequence
  Description of Artificial Sequence: Synthetic polypeptide
DEMEIATTNPVAYEQYGTVCSYTDGLPENEEGQDGQS

SEQ ID NO: 189204 - protein, 36 aa, Artificial Sequence
  Description of Artificial Sequence: Synthetic polypeptide
DEMEIATTNPVAYEQYGTVCSYTDGLPEGDEGDGQS

SEQ ID NO: 189205 - protein, 37 aa, Artificial Sequence
  Description of Artificial Sequence: Synthetic polypeptide
DEEEIATTNPVATEQYGSVCAAMAHDEAGMPPDNSAH

SEQ ID NO: 189206 - protein, 34 aa, Artificial Sequence
  Description of Artificial Sequence: Synthetic polypeptide
QAEEIATTNPVATEQYGCYPPEGHGQDSEGENKM

SEQ ID NO: 189207 - protein, 37 aa, Artificial Sequence
  Description of Artificial Sequence: Synthetic polypeptide
DEMEIRTTNPVATEQYGSCPMPIMLWPENRSISQQAS

SEQ ID NO: 189208 - protein, 36 aa, Artificial Sequence
  Description of Artificial Sequence: Synthetic polypeptide
QAEEIATTNPVATEQYGCVSPGEGGHGQESEGENKD

SEQ ID NO: 189209 - protein, 38 aa, Artificial Sequence
  Description of Artificial Sequence: Synthetic polypeptide
DEMEIRTTNPVATEQYGSANFWVEEDHETQPFTGEDRF

SEQ ID NO: 189210 - protein, 39 aa, Artificial Sequence
  Description of Artificial Sequence: Synthetic polypeptide
DEMEIRTTNPVATEQYGQSIVNSVMLEVEGDRFDGSIME

SEQ ID NO: 189211 - protein, 35 aa, Artificial Sequence
  Description of Artificial Sequence: Synthetic polypeptide
QAEEIATTNPVATEQYGCVSPGEGGHGNEAEEANK

SEQ ID NO: 189212 - protein, 37 aa, Artificial Sequence
  Description of Artificial Sequence: Synthetic polypeptide
DEMEIRTTNPVATEQYGQCVCSNWEHNAENFNSDTQA

SEQ ID NO: 189213 - protein, 38 aa, Artificial Sequence
  Description of Artificial Sequence: Synthetic polypeptide
DEEEIATTNPVATEQYGSVCAALANVGGEEHQDDNLAG

SEQ ID NO: 189214 - protein, 33 aa, Artificial Sequence
  Description of Artificial Sequence: Synthetic polypeptide
QAEEIATTNPVATEQYGCVAPGEGPGTESEEEK

SEQ ID NO: 189215 - protein, 36 aa, Artificial Sequence
  Description of Artificial Sequence: Synthetic polypeptide
DEMEIRTTNPVATEQYGQCICSWGETNANFISDTQS

SEQ ID NO: 189216 - protein, 37 aa, Artificial Sequence
  Description of Artificial Sequence: Synthetic polypeptide
DEMEIRTTNPVATEQYGQCICSWEDTNQENFGSDTQS

SEQ ID NO: 189217 - protein, 34 aa, Artificial Sequence
  Description of Artificial Sequence: Synthetic polypeptide
QAEEIATTNPVATEQYGCVAPGEGGGQNSAEEPK

SEQ ID NO: 189218 - protein, 34 aa, Artificial Sequence
  Description of Artificial Sequence: Synthetic polypeptide
QAEEIATTNPVATEQYGCVAPGEGGGQESEHENK

SEQ ID NO: 189219 - protein, 36 aa, Artificial Sequence
  Description of Artificial Sequence: Synthetic polypeptide
DEMEIRTTNPVATEQYGSISSSASTEQAETDDEIKV

SEQ ID NO: 189220 - protein, 34 aa, Artificial Sequence
  Description of Artificial Sequence: Synthetic polypeptide
QEEEIATTNPVAYEQYGEAWCLVECSQHAEGENL

SEQ ID NO: 189221 - protein, 37 aa, Artificial Sequence
  Description of Artificial Sequence: Synthetic polypeptide
DEEEIATTNPVATEQYGSACAAANPAEGADAEMNNHV

SEQ ID NO: 189222 - protein, 37 aa, Artificial Sequence
  Description of Artificial Sequence: Synthetic polypeptide
DEEEIATTNPVATEQYGSACAAANPAEADREGMGDLV

SEQ ID NO: 189223 - protein, 36 aa, Artificial Sequence
  Description of Artificial Sequence: Synthetic polypeptide
DEMEIATTNPVATEQYGCVCSTWGEPNEEFFSSDQS

SEQ ID NO: 189224 - protein, 37 aa, Artificial Sequence
  Description of Artificial Sequence: Synthetic polypeptide
DEMEIATTNPVATEQYGCVCSTWMEHNEEHFGSDTQA

SEQ ID NO: 189225 - protein, 36 aa, Artificial Sequence
  Description of Artificial Sequence: Synthetic polypeptide
QAHEIATTNPVAYEQYGSVCSTMSNNIEAGGENGEN

SEQ ID NO: 189226 - protein, 34 aa, Artificial Sequence
  Description of Artificial Sequence: Synthetic polypeptide
DAAEIATTNPVATEQYGSVANPHVLPADMVDDQV

SEQ ID NO: 189227 - protein, 36 aa, Artificial Sequence
  Description of Artificial Sequence: Synthetic polypeptide
DAAEIATTNPVATEQYGSVCAATAHDPQDSMINDGN

SEQ ID NO: 189228 - protein, 38 aa, Artificial Sequence
  Description of Artificial Sequence: Synthetic polypeptide
DEEEIRTTNPVATEQYGSVNNASDVWDFDSLIGHDMSD

SEQ ID NO: 189229 - protein, 36 aa, Artificial Sequence
  Description of Artificial Sequence: Synthetic polypeptide
DAAEIATTNPVATEQYGCVAATANDPQDSMIQNHGN

SEQ ID NO: 189230 - protein, 35 aa, Artificial Sequence
  Description of Artificial Sequence: Synthetic polypeptide
DAAEIATTNPVATEQYGSVCAMANHADSKAPADNN

SEQ ID NO: 189231 - protein, 37 aa, Artificial Sequence
  Description of Artificial Sequence: Synthetic polypeptide
DAAEIATTNPVATEQYGSVCAMNNGELIQDSPDENGN

SEQ ID NO: 189232 - protein, 36 aa, Artificial Sequence
  Description of Artificial Sequence: Synthetic polypeptide
DAAEIATTNPVATEQYGSVCAMNNGGTEAGDVNNAP

SEQ ID NO: 189233 - protein, 35 aa, Artificial Sequence
  Description of Artificial Sequence: Synthetic polypeptide
QAHEIATTNPVATEQYGCVAATAGLPQDSMINNEN

SEQ ID NO: 189234 - protein, 33 aa, Artificial Sequence
  Description of Artificial Sequence: Synthetic polypeptide
DEAEIATTNPVAYESWGEVAWTDNQQDQQQMDS

SEQ ID NO: 189235 - protein, 36 aa, Artificial Sequence
  Description of Artificial Sequence: Synthetic polypeptide
DAAEIATTNPVATEQYGSVCAMNNGVLEDGGVPAEQ

SEQ ID NO: 189236 - protein, 37 aa, Artificial Sequence
  Description of Artificial Sequence: Synthetic polypeptide
DEEEIRTTNPVATEQYGVVPANNEIMATPETQQFLFT

SEQ ID NO: 189237 - protein, 37 aa, Artificial Sequence
  Description of Artificial Sequence: Synthetic polypeptide
DAAEIATTNPVATEQYGSVCAMKNGELEVGTVGDNMS

SEQ ID NO: 189238 - protein, 36 aa, Artificial Sequence
  Description of Artificial Sequence: Synthetic polypeptide
DAAEIATTNPVATEQYGSVCAMTNNVGEDGGVPAEM

SEQ ID NO: 189239 - protein, 37 aa, Artificial Sequence
  Description of Artificial Sequence: Synthetic polypeptide
DEEEIRTTNPVATEQYGVVCVHPSPVNMPNAVDMFEE

SEQ ID NO: 189240 - protein, 36 aa, Artificial Sequence
  Description of Artificial Sequence: Synthetic polypeptide
DAAEIATTNPVATEQWGSVSAGAHAGNAPMDNGNMN

SEQ ID NO: 189241 - protein, 36 aa, Artificial Sequence
  Description of Artificial Sequence: Synthetic polypeptide
DEEEIACTNPVATEQYGSVCAGNNGLAAMPLDEMAM

SEQ ID NO: 189242 - protein, 38 aa, Artificial Sequence
  Description of Artificial Sequence: Synthetic polypeptide
DEEEIRTTNPVATEQYGTAITPTTNYENTTSVGEENAS

SEQ ID NO: 189243 - protein, 37 aa, Artificial Sequence
  Description of Artificial Sequence: Synthetic polypeptide
DEMEIATTNPVATEQYGCVCSTWGELNTEHFGSETQA

SEQ ID NO: 189244 - protein, 34 aa, Artificial Sequence
  Description of Artificial Sequence: Synthetic polypeptide
DEAEIATTNPVAYERWGVCATNNLDPGDHPNKDE

SEQ ID NO: 189245 - protein, 34 aa, Artificial Sequence
  Description of Artificial Sequence: Synthetic polypeptide
DEAEIATTNPVAYECWGSVYTTPQQGEDAGQDET

SEQ ID NO: 189246 - protein, 33 aa, Artificial Sequence
  Description of Artificial Sequence: Synthetic polypeptide
QEEEIATTNPVATEQYGEIAPEEVAQHEVEEKQ

SEQ ID NO: 189247 - protein, 36 aa, Artificial Sequence
  Description of Artificial Sequence: Synthetic polypeptide
QAVEIATTNPVATEQWGSVSGTGNPPPDANGSNDSW

SEQ ID NO: 189248 - protein, 37 aa, Artificial Sequence
  Description of Artificial Sequence: Synthetic polypeptide
CTGEIRTTNPVATEQYGSVVDQTQNNFTGEEGNGGGI

SEQ ID NO: 189249 - protein, 36 aa, Artificial Sequence
  Description of Artificial Sequence: Synthetic polypeptide
CESNEIATTNPVAYECWGSVATGQINGDIQGGGNQR

SEQ ID NO: 189250 - protein, 35 aa, Artificial Sequence
  Description of Artificial Sequence: Synthetic polypeptide
QEEEIATTNPVATEQYGETAACEVCSQHPEGENKS

SEQ ID NO: 189251 - protein, 35 aa, Artificial Sequence
  Description of Artificial Sequence: Synthetic polypeptide
QEEEIATTNPVATEQYGETAPCEVVSQHPEGENKV

SEQ ID NO: 189252 - protein, 35 aa, Artificial Sequence
  Description of Artificial Sequence: Synthetic polypeptide
QEEEIATTNPVATEQYGETIPCEVCSQHPEGENKN

SEQ ID NO: 189253 - protein, 33 aa, Artificial Sequence
  Description of Artificial Sequence: Synthetic polypeptide
DAAEIATTNPVATEQWGCVAANPDATMPPGEAH

SEQ ID NO: 189254 - protein, 36 aa, Artificial Sequence
  Description of Artificial Sequence: Synthetic polypeptide
QAVEIATTNPVATEQYGSVCAPDGTGNEAGIGNADN

SEQ ID NO: 189255 - protein, 32 aa, Artificial Sequence
  Description of Artificial Sequence: Synthetic polypeptide
DEAEIATTNPVAYECWGCVSGGPIGDVQGQEQ

SEQ ID NO: 189256 - protein, 37 aa, Artificial Sequence
  Description of Artificial Sequence: Synthetic polypeptide
DEEEIRTTNPVATEQYGVVQVAIEMEQIENTEEANDM

SEQ ID NO: 189257 - protein, 37 aa, Artificial Sequence
  Description of Artificial Sequence: Synthetic polypeptide
DAAEIATTNPVATEQYGSVCSPVDNNHNIDAMGEGNG

SEQ ID NO: 189258 - protein, 37 aa, Artificial Sequence
  Description of Artificial Sequence: Synthetic polypeptide
DEEEIATTNPVATEQYGSVCAANMGEEAPDSQMEHAA

SEQ ID NO: 189259 - protein, 37 aa, Artificial Sequence
  Description of Artificial Sequence: Synthetic polypeptide
DEAEIATTNPVATEQYGSVCADHNHPEENGMPMENNH

SEQ ID NO: 189260 - protein, 37 aa, Artificial Sequence
  Description of Artificial Sequence: Synthetic polypeptide
DEMEIRTTNPVATEQYGSVCNWHCMMMEHGIESNLQI

SEQ ID NO: 189261 - protein, 35 aa, Artificial Sequence
  Description of Artificial Sequence: Synthetic polypeptide
QAEEIATTNPVAYEQYGSACSAANNLTDSKGGDHK

SEQ ID NO: 189262 - protein, 38 aa, Artificial Sequence
  Description of Artificial Sequence: Synthetic polypeptide
DEEEIATTNPVATEQYGQCVCSNTGEHNQENFNSDNQF

SEQ ID NO: 189263 - protein, 36 aa, Artificial Sequence
  Description of Artificial Sequence: Synthetic polypeptide
DEMEIATTNPVAYEGWGSVCSGTDMQDRADGGGQEQ

SEQ ID NO: 189264 - protein, 35 aa, Artificial Sequence
  Description of Artificial Sequence: Synthetic polypeptide
QAEEIATTNPVAYEQYGSACAAANNLQDQGGGDHY

SEQ ID NO: 189265 - protein, 37 aa, Artificial Sequence
  Description of Artificial Sequence: Synthetic polypeptide
DEMEIRTTNPVATEQYGSVCTATVPSHEENDEINMMD

SEQ ID NO: 189266 - protein, 37 aa, Artificial Sequence
  Description of Artificial Sequence: Synthetic polypeptide
DEEEIATTNPVATEQYGQCVCSWGEHNQENFNSDNQS

SEQ ID NO: 189267 - protein, 37 aa, Artificial Sequence
  Description of Artificial Sequence: Synthetic polypeptide
DAAEIRTTNPVATEQYGSVNNLEETESDERSGSDQAE

SEQ ID NO: 189268 - protein, 36 aa, Artificial Sequence
  Description of Artificial Sequence: Synthetic polypeptide
DEAEIATTNPVATEQYGSVCAANMGEEAPDSGMELH

SEQ ID NO: 189269 - protein, 36 aa, Artificial Sequence
  Description of Artificial Sequence: Synthetic polypeptide
DEAEIATTNPVATEQYGSVCAANMGEEAPDAQMEGH

SEQ ID NO: 189270 - protein, 38 aa, Artificial Sequence
  Description of Artificial Sequence: Synthetic polypeptide
DEMEIRTTNPVATEQYGSNFWVVEDHETQPETGAEDRF

SEQ ID NO: 189271 - protein, 37 aa, Artificial Sequence
  Description of Artificial Sequence: Synthetic polypeptide
DEMEIRTTNPVATEQYGSMCCVFANTENEPTNTQDEG

SEQ ID NO: 189272 - protein, 37 aa, Artificial Sequence
  Description of Artificial Sequence: Synthetic polypeptide
DEMEIRTTNPVATEQYGSMCCVFANPEPETMNTQDEG

SEQ ID NO: 189273 - protein, 36 aa, Artificial Sequence
  Description of Artificial Sequence: Synthetic polypeptide
DEMEIRTTNPVATEQYGSTCELDGLVEVEWDMNDFE

SEQ ID NO: 189274 - protein, 37 aa, Artificial Sequence
  Description of Artificial Sequence: Synthetic polypeptide
DEAEIATTNPVATEQYGSVCAMNNGHNQTAPGPMESG

SEQ ID NO: 189275 - protein, 37 aa, Artificial Sequence
  Description of Artificial Sequence: Synthetic polypeptide
DEAEIATTNPVATEQYGSVCAMNNGILEPPDDQANGA

SEQ ID NO: 189276 - protein, 37 aa, Artificial Sequence
  Description of Artificial Sequence: Synthetic polypeptide
DEAEIATTNPVATEQYGSVCAMNNGVLNPTAGPMESP

SEQ ID NO: 189277 - protein, 36 aa, Artificial Sequence
  Description of Artificial Sequence: Synthetic polypeptide
QAEEIATTNPVAYEQYGSVCAMNNGLGPADGGDNDA

SEQ ID NO: 189278 - protein, 35 aa, Artificial Sequence
  Description of Artificial Sequence: Synthetic polypeptide
QAEEIATTNPVAYEQYGSVCAHNSVEGAAIDNSDM

SEQ ID NO: 189279 - protein, 38 aa, Artificial Sequence
  Description of Artificial Sequence: Synthetic polypeptide
DEEEIATTNPVATEQYGSVCAAMNPAEEAGDSGSENTD

SEQ ID NO: 189280 - protein, 37 aa, Artificial Sequence
  Description of Artificial Sequence: Synthetic polypeptide
QAEEIATTNPVAYEQYGSVCAANNGLEADAPGMNMRH

SEQ ID NO: 189281 - protein, 37 aa, Artificial Sequence
  Description of Artificial Sequence: Synthetic polypeptide
DEAEIATTNPVATEQYGSVCSPMPNQNNEAMIGDGAL

SEQ ID NO: 189282 - protein, 39 aa, Artificial Sequence
  Description of Artificial Sequence: Synthetic polypeptide
QEEEIRTTNPVATEQYGSVNNSTTPEPGPEMGQGENEEG

SEQ ID NO: 189283 - protein, 38 aa, Artificial Sequence
  Description of Artificial Sequence: Synthetic polypeptide
QEEEIRTTNPVATEQYGSVNNLTVPEGPEMGQGENEEG

SEQ ID NO: 189284 - protein, 37 aa, Artificial Sequence
  Description of Artificial Sequence: Synthetic polypeptide
DEMEIATTNPVAYECWGSVCSGTDNHDRPDGGIQGER

SEQ ID NO: 189285 - protein, 36 aa, Artificial Sequence
  Description of Artificial Sequence: Synthetic polypeptide
DEMEIATTNPVAYECWGSVCSTTDNHDRQGGGQHEQ

SEQ ID NO: 189286 - protein, 34 aa, Artificial Sequence
  Description of Artificial Sequence: Synthetic polypeptide
DAAEIATTNPVAYEQWGSVAGEGPGNNNAGNSDD

SEQ ID NO: 189287 - protein, 35 aa, Artificial Sequence
  Description of Artificial Sequence: Synthetic polypeptide
DEMEIATTNPVAYEEWGSVATGGNTGNAGTDQQRE

SEQ ID NO: 189288 - protein, 37 aa, Artificial Sequence
  Description of Artificial Sequence: Synthetic polypeptide
DEAEIATTNPVATEQYGSVCAMNNNDLPADGSDGGDP

SEQ ID NO: 189289 - protein, 38 aa, Artificial Sequence
  Description of Artificial Sequence: Synthetic polypeptide
DEEEIRTTNPVATEQYGSVIFPSFSYLGELEIVEVQVL

SEQ ID NO: 189290 - protein, 38 aa, Artificial Sequence
  Description of Artificial Sequence: Synthetic polypeptide
DEAEIATTNPVATEQYGSVCAMNNGVLPEGADGGNPQQ

SEQ ID NO: 189291 - protein, 34 aa, Artificial Sequence
  Description of Artificial Sequence: Synthetic polypeptide
DEMEIATTNPVAYEEWGVVATGGNTGNAGNDNQQ

SEQ ID NO: 189292 - protein, 37 aa, Artificial Sequence
  Description of Artificial Sequence: Synthetic polypeptide
DEMEIRTTNPVATEQYGSISSVSESSTEQAETDDEGK

SEQ ID NO: 189293 - protein, 35 aa, Artificial Sequence
  Description of Artificial Sequence: Synthetic polypeptide
QAEEIATTNPVATEQYGCVAANNGPAEDPGENQHN

SEQ ID NO: 189294 - protein, 35 aa, Artificial Sequence
  Description of Artificial Sequence: Synthetic polypeptide
QAEEIATTNPVATEQYGCVAANNGDTQDDSDGTVH

SEQ ID NO: 189295 - protein, 33 aa, Artificial Sequence
  Description of Artificial Sequence: Synthetic polypeptide
QEEEIATTNPVAYEQYGEIWCEHECSQHAEGEM

SEQ ID NO: 189296 - protein, 37 aa, Artificial Sequence
  Description of Artificial Sequence: Synthetic polypeptide
DEEEIACTNPVAYEQYGSVAAITNNEEAPGAQMGGDP

SEQ ID NO: 189297 - protein, 37 aa, Artificial Sequence
  Description of Artificial Sequence: Synthetic polypeptide
DEEEIACTNPVAYEQYGSVAAITNNEEAPANQAEGRP

SEQ ID NO: 189298 - protein, 37 aa, Artificial Sequence
  Description of Artificial Sequence: Synthetic polypeptide
DEEEIACTNPVAYEQYGSVAAITNGPEAPGAQMEGRA

SEQ ID NO: 189299 - protein, 38 aa, Artificial Sequence
  Description of Artificial Sequence: Synthetic polypeptide
DEEEIACTNPVAYEQYGSTVCAVTEAGGAQARGSENAM

SEQ ID NO: 189300 - protein, 36 aa, Artificial Sequence
  Description of Artificial Sequence: Synthetic polypeptide
DEEEIACTNPVAYEQYGSTACAANDGEPLGSEGNNT

SEQ ID NO: 189301 - protein, 36 aa, Artificial Sequence
  Description of Artificial Sequence: Synthetic polypeptide
DEMEICTTNPVATEQYGCACVCPATDGTVEFEGNDQ

SEQ ID NO: 189302 - protein, 36 aa, Artificial Sequence
  Description of Artificial Sequence: Synthetic polypeptide
DEEEIACTNPVAYEQYGSVANTNNLEAEAPPDEMAM

SEQ ID NO: 189303 - protein, 34 aa, Artificial Sequence
  Description of Artificial Sequence: Synthetic polypeptide
DEEEIACTNPVAYEQYGSACAAANGLDSEEVDDD

SEQ ID NO: 189304 - protein, 34 aa, Artificial Sequence
  Description of Artificial Sequence: Synthetic polypeptide
DEEEIACTNPVAYEQWGVVAACENLTQAALIDID

SEQ ID NO: 189305 - protein, 37 aa, Artificial Sequence
  Description of Artificial Sequence: Synthetic polypeptide
DENAEICTTNPVAYECWGSVATGNGPLNDNRGQNGTD

SEQ ID NO: 189306 - protein, 36 aa, Artificial Sequence
  Description of Artificial Sequence: Synthetic polypeptide
DENAEICTTNPVAYEQWGSVCSGEGNQTTNGTNGMN

SEQ ID NO: 189307 - protein, 35 aa, Artificial Sequence
  Description of Artificial Sequence: Synthetic polypeptide
DENAIATTNPVATECWGMHCWTMNEQQRGQDNNSD

SEQ ID NO: 189308 - protein, 34 aa, Artificial Sequence
  Description of Artificial Sequence: Synthetic polypeptide
DEEEIACTNPVAYEQWGHSASLANMGTAEDPNEN

SEQ ID NO: 189309 - protein, 36 aa, Artificial Sequence
  Description of Artificial Sequence: Synthetic polypeptide
QEEEICTTNPVCYEPYGCVSCDPNAFSQNRQGGNND

SEQ ID NO: 189310 - protein, 36 aa, Artificial Sequence
  Description of Artificial Sequence: Synthetic polypeptide
DENAEIATTNPVAYEQWGSVSWGENAGNMGGGVNDN

SEQ ID NO: 189311 - protein, 36 aa, Artificial Sequence
  Description of Artificial Sequence: Synthetic polypeptide
DEMEIRTTNPVATEGYGCVCFWGEHNTENFISDNQS

SEQ ID NO: 189312 - protein, 35 aa, Artificial Sequence
  Description of Artificial Sequence: Synthetic polypeptide
DAEEIATTNPVATEQYGSTCAMIEHLEATGDGDQN

SEQ ID NO: 189313 - protein, 35 aa, Artificial Sequence
  Description of Artificial Sequence: Synthetic polypeptide
QEEEICTTNPVATEQYGVVAGPGEGEGGQGGEEQT

SEQ ID NO: 189314 - protein, 30 aa, Artificial Sequence
  Description of Artificial Sequence: Synthetic polypeptide
QEGEIACTNPVGTAGWGGVSASGTGQDGDI

SEQ ID NO: 189315 - protein, 38 aa, Artificial Sequence
  Description of Artificial Sequence: Synthetic polypeptide
DEMEIRTTNPVATEQYGCACVPTIVPNYDNRIDVENEE

SEQ ID NO: 189316 - protein, 38 aa, Artificial Sequence
  Description of Artificial Sequence: Synthetic polypeptide
DEMEIRTTNPVATEQYGAVSCEPTTVEQEGDEVSQQEQ

SEQ ID NO: 189317 - protein, 36 aa, Artificial Sequence
  Description of Artificial Sequence: Synthetic polypeptide
DEEEIACTNPVAYEQYGSVCSAAPHLNEAPGGEAHH

SEQ ID NO: 189318 - protein, 40 aa, Artificial Sequence
  Description of Artificial Sequence: Synthetic polypeptide
DEMEIRTTNPVATEQYGASSVWEPTTVNEQEGDEVNLQEQ

SEQ ID NO: 189319 - protein, 37 aa, Artificial Sequence
  Description of Artificial Sequence: Synthetic polypeptide
DAEEIATTNPVATEQYGSACAANPQLGLNHADENGHQ

SEQ ID NO: 189320 - protein, 35 aa, Artificial Sequence
  Description of Artificial Sequence: Synthetic polypeptide
DAEEIATTNPVATEQYGSCAAGQAPAPDAGTPGNN

SEQ ID NO: 189321 - protein, 36 aa, Artificial Sequence
  Description of Artificial Sequence: Synthetic polypeptide
DEEEIATTNPVATEQYGSCAAAMGHGPADSGEGNQT

SEQ ID NO: 189322 - protein, 39 aa, Artificial Sequence
  Description of Artificial Sequence: Synthetic polypeptide
DEEEIATTNPVATEQYGSGCTIESNIQIGMVPVIEAVRE

SEQ ID NO: 189323 - protein, 38 aa, Artificial Sequence
  Description of Artificial Sequence: Synthetic polypeptide
DEEEIATTNPVATEQYGSTACAANDGLPLGSGEGNNHK

SEQ ID NO: 189324 - protein, 38 aa, Artificial Sequence
  Description of Artificial Sequence: Synthetic polypeptide
DEEEIATTNPVATEQYGSTACAAVPAEGQNHQDGMQMA

SEQ ID NO: 189325 - protein, 36 aa, Artificial Sequence
  Description of Artificial Sequence: Synthetic polypeptide
DEMEIRTTNPVATEQWGCVCSSGEDNANASNSDTAS

SEQ ID NO: 189326 - protein, 35 aa, Artificial Sequence
  Description of Artificial Sequence: Synthetic polypeptide
DEMEIRTTNPVATEQWGACVSVIEQMIAVEADDAT

SEQ ID NO: 189327 - protein, 37 aa, Artificial Sequence
  Description of Artificial Sequence: Synthetic polypeptide
DAEEIATTNPVATEQYGSACAATNPDEEGAHGDNDQP

SEQ ID NO: 189328 - protein, 37 aa, Artificial Sequence
  Description of Artificial Sequence: Synthetic polypeptide
DEEEIATTNPVATEQYGSCAANMGHGPLDSGEGQQPD

SEQ ID NO: 189329 - protein, 31 aa, Artificial Sequence
  Description of Artificial Sequence: Synthetic polypeptide
QEGEIACTNPVGTAGWGGVSASMLQHGDESG

SEQ ID NO: 189330 - protein, 34 aa, Artificial Sequence
  Description of Artificial Sequence: Synthetic polypeptide
DEEEIACTNPVAYEQWGCVAGTGLDNQGTEMLHW

SEQ ID NO: 189331 - protein, 36 aa, Artificial Sequence
  Description of Artificial Sequence: Synthetic polypeptide
DENAICTTNPVATEQYGSVFTWTYNPQTQFMDVQIM

SEQ ID NO: 189332 - protein, 33 aa, Artificial Sequence
  Description of Artificial Sequence: Synthetic polypeptide
DEMEIRTTNPVATECWGATCAAADGPVAPEGND

SEQ ID NO: 189333 - protein, 33 aa, Artificial Sequence
  Description of Artificial Sequence: Synthetic polypeptide
DEMEIRTTNPVATECWGATCAAADDPVAPEGND

SEQ ID NO: 189334 - protein, 37 aa, Artificial Sequence
  Description of Artificial Sequence: Synthetic polypeptide
DEMEICTTNPVATEQYGCACVCSATDGTVEFEGNNDL

SEQ ID NO: 189335 - protein, 36 aa, Artificial Sequence
  Description of Artificial Sequence: Synthetic polypeptide
DENAINTTNPVATEYYCSVGSDSNKPLVEQLGEVTM

SEQ ID NO: 189336 - protein, 35 aa, Artificial Sequence
  Description of Artificial Sequence: Synthetic polypeptide
DEMEIRTTNPVATEAWGCVCSWMEENQENFGSQQS

SEQ ID NO: 189337 - protein, 35 aa, Artificial Sequence
  Description of Artificial Sequence: Synthetic polypeptide
DEMEIRTTNPVATDQYGSVPPMFWLENSSESQQEF

SEQ ID NO: 189338 - protein, 33 aa, Artificial Sequence
  Description of Artificial Sequence: Synthetic polypeptide
DEMEIRTTNPVATECWGTTCAAADGPVAFEGND

SEQ ID NO: 189339 - protein, 35 aa, Artificial Sequence
  Description of Artificial Sequence: Synthetic polypeptide
DAEEIATTNPVATEQYGSVCAAGPEQDDPASIAEN

SEQ ID NO: 189340 - protein, 37 aa, Artificial Sequence
  Description of Artificial Sequence: Synthetic polypeptide
QEEEIRGTNPVATEQWGDCVVANGGQTLIRGGGNDGD

SEQ ID NO: 189341 - protein, 38 aa, Artificial Sequence
  Description of Artificial Sequence: Synthetic polypeptide
QEEEIRGTNPVATEQYGSVNIQGNLNLEGGGQTEGEDG

SEQ ID NO: 189342 - protein, 30 aa, Artificial Sequence
  Description of Artificial Sequence: Synthetic polypeptide
NGAEIATTNPVAYEQWGCCGTWDQGMQSGI

SEQ ID NO: 189343 - protein, 38 aa, Artificial Sequence
  Description of Artificial Sequence: Synthetic polypeptide
QEEEIRGTNPVATEQYGSVSIPGVQNDEGGGQTEGEDG

SEQ ID NO: 189344 - protein, 38 aa, Artificial Sequence
  Description of Artificial Sequence: Synthetic polypeptide
QEEEIRGTNPVATEQYGSVVIPGNLNEGGGQDTEGEDE

SEQ ID NO: 189345 - protein, 36 aa, Artificial Sequence
  Description of Artificial Sequence: Synthetic polypeptide
DENAIRATNPVATEQYGSVAVTPWDSNSAETQNEPQ

SEQ ID NO: 189346 - protein, 38 aa, Artificial Sequence
  Description of Artificial Sequence: Synthetic polypeptide
QEEEIRCTNPVATEQYGSVVIPGNLNGEFGGQTEGEDG

SEQ ID NO: 189347 - protein, 34 aa, Artificial Sequence
  Description of Artificial Sequence: Synthetic polypeptide
DEMEIRTTNPVATECWGTTTCSNTDDPAPKGPYI

SEQ ID NO: 189348 - protein, 37 aa, Artificial Sequence
  Description of Artificial Sequence: Synthetic polypeptide
DENAICTTNPVATEQYGSVFTWTYNPSQTQFQDNQIT

SEQ ID NO: 189349 - protein, 34 aa, Artificial Sequence
  Description of Artificial Sequence: Synthetic polypeptide
DEMEIRTTNPVATECWGTTTWSNTDDPAPKGPYI

SEQ ID NO: 189350 - protein, 30 aa, Artificial Sequence
  Description of Artificial Sequence: Synthetic polypeptide
QEEEIGTVNPVAYEWYGEAPEEVCQHEECK

SEQ ID NO: 189351 - protein, 36 aa, Artificial Sequence
  Description of Artificial Sequence: Synthetic polypeptide
QEEEIHTTNPVATEQYGVVMAGNGEGEGGQGENEFT

SEQ ID NO: 189352 - protein, 35 aa, Artificial Sequence
  Description of Artificial Sequence: Synthetic polypeptide
NNEEIRTTNPVATEQYGSVCFPDVVEDRIDDFMDE

SEQ ID NO: 189353 - protein, 35 aa, Artificial Sequence
  Description of Artificial Sequence: Synthetic polypeptide
NNEEIRTTNPVATEQYGSVCFPDVLEDPITDFVDE

SEQ ID NO: 189354 - protein, 35 aa, Artificial Sequence
  Description of Artificial Sequence: Synthetic polypeptide
NNEEIRTTNPVATEQYGSVCFPDVLEDDITDFHDQ

SEQ ID NO: 189355 - protein, 36 aa, Artificial Sequence
  Description of Artificial Sequence: Synthetic polypeptide
DEMEIRTTNPVATEGWGCVCSWGNENQEYFNSDNQA

SEQ ID NO: 189356 - protein, 35 aa, Artificial Sequence
  Description of Artificial Sequence: Synthetic polypeptide
DEMEIRTTNPVATEGWGCVCSWGEHNQEYFGSQTQ

SEQ ID NO: 189357 - protein, 36 aa, Artificial Sequence
  Description of Artificial Sequence: Synthetic polypeptide
QEEEIKTTNPVATEQYGMVSVEGMGGGQGQEGEEGT

SEQ ID NO: 189358 - protein, 37 aa, Artificial Sequence
  Description of Artificial Sequence: Synthetic polypeptide
QEEEIKTTNPVATEQYGSVVVAGVNDNNGQGEFNEID

SEQ ID NO: 189359 - protein, 35 aa, Artificial Sequence
  Description of Artificial Sequence: Synthetic polypeptide
QEEEIKTTNPVATEQYGTVMLGPIEGEGGQGENED

SEQ ID NO: 189360 - protein, 35 aa, Artificial Sequence
  Description of Artificial Sequence: Synthetic polypeptide
NNEEIRTTNPVATEQYGSVCFPDVLEDDETDFQDF

SEQ ID NO: 189361 - protein, 35 aa, Artificial Sequence
  Description of Artificial Sequence: Synthetic polypeptide
QEEEIKTTNPVATEQYGVVMAGFGEGEGGQGENED

SEQ ID NO: 189362 - protein, 35 aa, Artificial Sequence
  Description of Artificial Sequence: Synthetic polypeptide
DEMEIRTTNPVATEGWGCVCSWGEDNQEYFGSQQS

SEQ ID NO: 189363 - protein, 36 aa, Artificial Sequence
  Description of Artificial Sequence: Synthetic polypeptide
DAEEIATTNPVATEQYGSTCAMIEHLEATGDGDSRD

SEQ ID NO: 189364 - protein, 38 aa, Artificial Sequence
  Description of Artificial Sequence: Synthetic polypeptide
DEEEIATTNPVATEQYGSVAGMPGSGGPHGGNHQGPVD

SEQ ID NO: 189365 - protein, 36 aa, Artificial Sequence
  Description of Artificial Sequence: Synthetic polypeptide
DEMEIRTTNPVATEQYGCCCVLANPENEMWTQDPEQ

SEQ ID NO: 189366 - protein, 37 aa, Artificial Sequence
  Description of Artificial Sequence: Synthetic polypeptide
DEMEIRTTNPVATEQYGCICSNWGEHNQEYFGSDNQS

SEQ ID NO: 189367 - protein, 34 aa, Artificial Sequence
  Description of Artificial Sequence: Synthetic polypeptide
DEMTIVTTNPVATEYYGTVCSATDGVPVEFEVND

SEQ ID NO: 189368 - protein, 36 aa, Artificial Sequence
  Description of Artificial Sequence: Synthetic polypeptide
DEMEIRTTNPVATEQYGCICSTGETNAENFISDTQA

SEQ ID NO: 189369 - protein, 36 aa, Artificial Sequence
  Description of Artificial Sequence: Synthetic polypeptide
QAEEIATTNPVATEQWGSVSQGEPGENTGDIMGQNH

SEQ ID NO: 189370 - protein, 37 aa, Artificial Sequence
  Description of Artificial Sequence: Synthetic polypeptide
QAEEIATTNPVATEQWGSVSGTGNPPPDANGSENGSW

SEQ ID NO: 189371 - protein, 36 aa, Artificial Sequence
  Description of Artificial Sequence: Synthetic polypeptide
QAEEIATTNPVATEQWGHCNVAATNGLPAAPGNGDF

SEQ ID NO: 189372 - protein, 36 aa, Artificial Sequence
  Description of Artificial Sequence: Synthetic polypeptide
DEMEIATTNPVAYERWGSVCVGTDNHDRDDGGQEER

SEQ ID NO: 189373 - protein, 35 aa, Artificial Sequence
  Description of Artificial Sequence: Synthetic polypeptide
QAEEIATTNPVATEQWGGCVTAAAGLQNQMGGERK

SEQ ID NO: 189374 - protein, 35 aa, Artificial Sequence
  Description of Artificial Sequence: Synthetic polypeptide
DEMEIATTNPVAYERWGVVCSNTDNHDRQDEGEEQ

SEQ ID NO: 189375 - protein, 34 aa, Artificial Sequence
  Description of Artificial Sequence: Synthetic polypeptide
QAEEIATTNPVATEQYGCAPAMTHGTDSEGENKD

SEQ ID NO: 189376 - protein, 34 aa, Artificial Sequence
  Description of Artificial Sequence: Synthetic polypeptide
DEMEIVTTNPVAYEAWGTVCSYTDGPSEFTGGND

SEQ ID NO: 189377 - protein, 35 aa, Artificial Sequence
  Description of Artificial Sequence: Synthetic polypeptide
DEMEIATTNPVAYERWGVVCSTTDNHDRQGGQEEA

SEQ ID NO: 189378 - protein, 30 aa, Artificial Sequence
  Description of Artificial Sequence: Synthetic polypeptide
QEGEIACTNPCSYEQWGITYCELQGSGDTR

SEQ ID NO: 189379 - protein, 35 aa, Artificial Sequence
  Description of Artificial Sequence: Synthetic polypeptide
DEMEIATTNPVAYESWGSVCSGNDNHDRDGGQEEQ

SEQ ID NO: 189380 - protein, 36 aa, Artificial Sequence
  Description of Artificial Sequence: Synthetic polypeptide
DAEEIATTNPVATEQYGSVCAPDGPENNDDLDGAQA

SEQ ID NO: 189381 - protein, 36 aa, Artificial Sequence
  Description of Artificial Sequence: Synthetic polypeptide
QAEEIATTNPVATECYGSVCSANHGPLDSGEGQAQD

SEQ ID NO: 189382 - protein, 32 aa, Artificial Sequence
  Description of Artificial Sequence: Synthetic polypeptide
QEGEIACTNPCSYEQWGIVAKNLEQSQGDTDR

SEQ ID NO: 189383 - protein, 35 aa, Artificial Sequence
  Description of Artificial Sequence: Synthetic polypeptide
QAEEIATTNPVATEQWGCVAGATGALQNPGDIEDL

SEQ ID NO: 189384 - protein, 36 aa, Artificial Sequence
  Description of Artificial Sequence: Synthetic polypeptide
DEMEIATTNPVAYERWGSVCSTTDNNHDRDGGQEEQ

SEQ ID NO: 189385 - protein, 38 aa, Artificial Sequence
  Description of Artificial Sequence: Synthetic polypeptide
QEEEIRTTNPVATEQYGQVSVMDDTNMTGDEAGGEEGT

SEQ ID NO: 189386 - protein, 38 aa, Artificial Sequence
  Description of Artificial Sequence: Synthetic polypeptide
QEEEIRTTNPVATEQYGQVSVMDDTNMTGDEDGEEEGQ

SEQ ID NO: 189387 - protein, 34 aa, Artificial Sequence
  Description of Artificial Sequence: Synthetic polypeptide
QEEEIATTNPVAYEQYGEIWCEHECSQYAEGENL

SEQ ID NO: 189388 - protein, 34 aa, Artificial Sequence
  Description of Artificial Sequence: Synthetic polypeptide
QEEEIATTNPVAYEQYGEVAFCEHEFSQHAEGEW

SEQ ID NO: 189389 - protein, 33 aa, Artificial Sequence
  Description of Artificial Sequence: Synthetic polypeptide
DAEEIATTNPVATASWGCIATTAENDTPDGNEN

SEQ ID NO: 189390 - protein, 33 aa, Artificial Sequence
  Description of Artificial Sequence: Synthetic polypeptide
QEEEIATTNPVAYEQYGQAWCEVEASQHAEGEK

SEQ ID NO: 189391 - protein, 37 aa, Artificial Sequence
  Description of Artificial Sequence: Synthetic polypeptide
DEEEIATTNPVATEQYGSACAANPQLGQLHQDDQSAG

SEQ ID NO: 189392 - protein, 35 aa, Artificial Sequence
  Description of Artificial Sequence: Synthetic polypeptide
QEEEIATTNPVAYEQYGSVCADGAQANTGGVMQMD

SEQ ID NO: 189393 - protein, 37 aa, Artificial Sequence
  Description of Artificial Sequence: Synthetic polypeptide
QEEEIATTNPVAYEQYGSVVAAVAGELQDSLGLNDSF

SEQ ID NO: 189394 - protein, 31 aa, Artificial Sequence
  Description of Artificial Sequence: Synthetic polypeptide
QEEEIATTNPVAYERWGEAYMVENQHDEGAG

SEQ ID NO: 189395 - protein, 31 aa, Artificial Sequence
  Description of Artificial Sequence: Synthetic polypeptide
QEEEIATTNPVAYERWGEAYMVEQHDEGQPG

SEQ ID NO: 189396 - protein, 34 aa, Artificial Sequence
  Description of Artificial Sequence: Synthetic polypeptide
QAEEIATTNPVATEQYGCVAAGEGGGNESEEGKD

SEQ ID NO: 189397 - protein, 38 aa, Artificial Sequence
  Description of Artificial Sequence: Synthetic polypeptide
QEEEIRTTNPVATEQYGSIGEPVMFGDPDRGQAPNDVP

SEQ ID NO: 189398 - protein, 38 aa, Artificial Sequence
  Description of Artificial Sequence: Synthetic polypeptide
DEEEIRTTNPVATEQYGSVEYLINNMNVQEQMQEITDS

SEQ ID NO: 189399 - protein, 34 aa, Artificial Sequence
  Description of Artificial Sequence: Synthetic polypeptide
QAEEIATTNPVATEQYGCVAAGEGGEGNESEEEN

SEQ ID NO: 189400 - protein, 36 aa, Artificial Sequence
  Description of Artificial Sequence: Synthetic polypeptide
DEMEIATTNPVAYERWGSVCSGTDNHDRMDGGQEEQ

SEQ ID NO: 189401 - protein, 36 aa, Artificial Sequence
  Description of Artificial Sequence: Synthetic polypeptide
DEMEIATTNPVAYERWGSVCSTTDNHDRDGGGQEAG

SEQ ID NO: 189402 - protein, 38 aa, Artificial Sequence
  Description of Artificial Sequence: Synthetic polypeptide
DEEEIRTTNPVATEQYGSVGYPLMNGEEQMIMDAEMEL

SEQ ID NO: 189403 - protein, 37 aa, Artificial Sequence
  Description of Artificial Sequence: Synthetic polypeptide
DEMEIATTNPVATEQYGCVCSTWGEHNEEHFSSENLS

SEQ ID NO: 189404 - protein, 38 aa, Artificial Sequence
  Description of Artificial Sequence: Synthetic polypeptide
DEEEIATTNPVATEQYGSACAATAGVGGENHQDDNLAQ

SEQ ID NO: 189405 - protein, 33 aa, Artificial Sequence
  Description of Artificial Sequence: Synthetic polypeptide
QAEEIATTNPVATASWGCNVAGAGLQTAGEDNH

SEQ ID NO: 189406 - protein, 36 aa, Artificial Sequence
  Description of Artificial Sequence: Synthetic polypeptide
DEMEIRTTNPVATEQYGCVICEQQMEESSIESSQRE

SEQ ID NO: 189407 - protein, 35 aa, Artificial Sequence
  Description of Artificial Sequence: Synthetic polypeptide
DEMEIRTTNPVATEQYGCVICEQLIKEDSESSQGE

SEQ ID NO: 189408 - protein, 38 aa, Artificial Sequence
  Description of Artificial Sequence: Synthetic polypeptide
DEEEIATTNPVATEQYGSACSAANPAEIADAEIGNNTA

SEQ ID NO: 189409 - protein, 36 aa, Artificial Sequence
  Description of Artificial Sequence: Synthetic polypeptide
DEMEIRTTNPVATEQYGCVCSNWEDHNANFNSDTQA

SEQ ID NO: 189410 - protein, 38 aa, Artificial Sequence
  Description of Artificial Sequence: Synthetic polypeptide
DEMNEIATTNPVAYEQYGTVCSYTDGLVEGDQRGRGES

SEQ ID NO: 189411 - protein, 36 aa, Artificial Sequence
  Description of Artificial Sequence: Synthetic polypeptide
DEMEIRTTNPVATEQYGCSMCVAAMPENEMWTQDEQ

SEQ ID NO: 189412 - protein, 32 aa, Artificial Sequence
  Description of Artificial Sequence: Synthetic polypeptide
DEEEIASVNPIATECYGAVSNDEDWAEPGPYQ

SEQ ID NO: 189413 - protein, 32 aa, Artificial Sequence
  Description of Artificial Sequence: Synthetic polypeptide
DEEEIASTNPIATECWGAVSNDEDWAEPGPYQ

SEQ ID NO: 189414 - protein, 35 aa, Artificial Sequence
  Description of Artificial Sequence: Synthetic polypeptide
NNNEIVTTNPVATEQYGVCVWDTQVLNQDGGPEMM

SEQ ID NO: 189415 - protein, 36 aa, Artificial Sequence
  Description of Artificial Sequence: Synthetic polypeptide
NNNEIVTTNPVATEQYGVCVWCTQNLNQDGGPEPME

SEQ ID NO: 189416 - protein, 36 aa, Artificial Sequence
  Description of Artificial Sequence: Synthetic polypeptide
DEMEIRTTNPVATEQYGCMCVFANMENEMWTQDPEQ

SEQ ID NO: 189417 - protein, 36 aa, Artificial Sequence
  Description of Artificial Sequence: Synthetic polypeptide
DEMEIRTTNPVATEQYGCMCVFAKPENEMWTQDTEQ

SEQ ID NO: 189418 - protein, 36 aa, Artificial Sequence
  Description of Artificial Sequence: Synthetic polypeptide
DEMEIRTTNPVATEQYGCIVPVYHEREHGFSETPQN

SEQ ID NO: 189419 - protein, 37 aa, Artificial Sequence
  Description of Artificial Sequence: Synthetic polypeptide
DEEEIATTNPVATEQYGSACSANPAEGQDHQDDSADE

SEQ ID NO: 189420 - protein, 33 aa, Artificial Sequence
  Description of Artificial Sequence: Synthetic polypeptide
NQAEIQCTNPVAYEQYGKTVQPAHEQDRGGNNV

SEQ ID NO: 189421 - protein, 30 aa, Artificial Sequence
  Description of Artificial Sequence: Synthetic polypeptide
QEGEIACTNPVATEQYGEAPREVCEPHAEK

SEQ ID NO: 189422 - protein, 36 aa, Artificial Sequence
  Description of Artificial Sequence: Synthetic polypeptide
DEMEIRTTNPVATEQYGCVICPVLMIEDSLESSQRE

SEQ ID NO: 189423 - protein, 36 aa, Artificial Sequence
  Description of Artificial Sequence: Synthetic polypeptide
DEMEICTTNPVATEQYGAVCTATDGHPVEPFEGNEQ

SEQ ID NO: 189424 - protein, 33 aa, Artificial Sequence
  Description of Artificial Sequence: Synthetic polypeptide
DAEEIATTNPVATEQWGGCCTAATAHGTSGGEH

SEQ ID NO: 189425 - protein, 36 aa, Artificial Sequence
  Description of Artificial Sequence: Synthetic polypeptide
DAEEIATTNPVATEQWGHCNVAATNGLPAEAPGGVF

SEQ ID NO: 189426 - protein, 36 aa, Artificial Sequence
  Description of Artificial Sequence: Synthetic polypeptide
DAEEIATTNPVATEQWGSVAITPHPGNEAGDGAGML

SEQ ID NO: 189427 - protein, 37 aa, Artificial Sequence
  Description of Artificial Sequence: Synthetic polypeptide
QEEEIRTTNPVATEQYGMTVLIGDEGGGQGEDGGTNV

SEQ ID NO: 189428 - protein, 36 aa, Artificial Sequence
  Description of Artificial Sequence: Synthetic polypeptide
DAEEIATTNPVATEQWGSVSAGPAPGANGAGMGASD

SEQ ID NO: 189429 - protein, 37 aa, Artificial Sequence
  Description of Artificial Sequence: Synthetic polypeptide
DEEEIATTNPVATEQYGSACAATNPDEEGAHGDEDAP

SEQ ID NO: 189430 - protein, 37 aa, Artificial Sequence
  Description of Artificial Sequence: Synthetic polypeptide
QEEEIRTTNPVATEQYGMITVNMGMEDTNEEGGGGQD

SEQ ID NO: 189431 - protein, 36 aa, Artificial Sequence
  Description of Artificial Sequence: Synthetic polypeptide
DEMEIVTTNPVAYEQYGCVCSNTGEPNEFFGSDTDA

SEQ ID NO: 189432 - protein, 34 aa, Artificial Sequence
  Description of Artificial Sequence: Synthetic polypeptide
QAEEIATTNPVATAQWGCVSGSGNPDNADGNGAN

SEQ ID NO: 189433 - protein, 36 aa, Artificial Sequence
  Description of Artificial Sequence: Synthetic polypeptide
DEMEIRTTNPVATEQYGCVIVCPQLMYEDSESSQRE

SEQ ID NO: 189434 - protein, 36 aa, Artificial Sequence
  Description of Artificial Sequence: Synthetic polypeptide
DEMEIRTTNPVATEQYGCVITCECLISEDSESSQYE

SEQ ID NO: 189435 - protein, 36 aa, Artificial Sequence
  Description of Artificial Sequence: Synthetic polypeptide
DEMEIRTTNPVATEQYGCVIPCEQLMAEDSESSQRE

SEQ ID NO: 189436 - protein, 37 aa, Artificial Sequence
  Description of Artificial Sequence: Synthetic polypeptide
DEEEIATTNPVATEQYGSACAVPPAEGQNHQDDMEMN

SEQ ID NO: 189437 - protein, 35 aa, Artificial Sequence
  Description of Artificial Sequence: Synthetic polypeptide
DEMEICTTNPMATETYGSVPIWPDPQHASGENFMG

SEQ ID NO: 189438 - protein, 34 aa, Artificial Sequence
  Description of Artificial Sequence: Synthetic polypeptide
DEMEICTTNPMATETYGSVPVPDPEHASGENFMG

SEQ ID NO: 189439 - protein, 33 aa, Artificial Sequence
  Description of Artificial Sequence: Synthetic polypeptide
QEGEIACTNPCSYEQYGVTVRCCNMLSQSGGTR

SEQ ID NO: 189440 - protein, 36 aa, Artificial Sequence
  Description of Artificial Sequence: Synthetic polypeptide
DENAIRATNPVATEQYGSVAVTVWDSNSAEYTQNVQ

SEQ ID NO: 189441 - protein, 38 aa, Artificial Sequence
  Description of Artificial Sequence: Synthetic polypeptide
DEMEIATTNPVATEQYGCVCSTWGEDLNEEHFGSENLS

SEQ ID NO: 189442 - protein, 37 aa, Artificial Sequence
  Description of Artificial Sequence: Synthetic polypeptide
DEMEIATTNPVATEQYGCVCSTWEGLNEEHFGSETQA

SEQ ID NO: 189443 - protein, 37 aa, Artificial Sequence
  Description of Artificial Sequence: Synthetic polypeptide
QEDEIATTNPVATEQYGMISFSAPDTDNEPHENEDTR

SEQ ID NO: 189444 - protein, 35 aa, Artificial Sequence
  Description of Artificial Sequence: Synthetic polypeptide
DEMEISTTNPVAYEQYGCICSWGETNANFGSDTQS

SEQ ID NO: 189445 - protein, 36 aa, Artificial Sequence
  Description of Artificial Sequence: Synthetic polypeptide
DEEEIATTNPVATEQWGGCFTAGTGQLDNQMGGELH

SEQ ID NO: 189446 - protein, 36 aa, Artificial Sequence
  Description of Artificial Sequence: Synthetic polypeptide
DEEEIATTNPVATEQWGGCNVAGTGQDDNQMEGELH

SEQ ID NO: 189447 - protein, 37 aa, Artificial Sequence
  Description of Artificial Sequence: Synthetic polypeptide
DEEEIATTNPVATEQWGGCVAGNGELAQDNASQNDHT

SEQ ID NO: 189448 - protein, 37 aa, Artificial Sequence
  Description of Artificial Sequence: Synthetic polypeptide
QEEGIRTTNPVATEAYGSVSVNNNGGEETGGQSNQGN

SEQ ID NO: 189449 - protein, 32 aa, Artificial Sequence
  Description of Artificial Sequence: Synthetic polypeptide
DEEEIATTNPVATEQWGETAWAAVCAEHKEEI

SEQ ID NO: 189450 - protein, 37 aa, Artificial Sequence
  Description of Artificial Sequence: Synthetic polypeptide
DEEEIRTTNPVATEQYGTVIGEVMNTIQINTMEQMQL

SEQ ID NO: 189451 - protein, 37 aa, Artificial Sequence
  Description of Artificial Sequence: Synthetic polypeptide
DEEEIATTNPVATEQWGGCVAGTGELAQPNNEQNEHA

SEQ ID NO: 189452 - protein, 36 aa, Artificial Sequence
  Description of Artificial Sequence: Synthetic polypeptide
DEEEIATTNPVATEQWGGNTTTAATNHVLAGMEMNN

SEQ ID NO: 189453 - protein, 36 aa, Artificial Sequence
  Description of Artificial Sequence: Synthetic polypeptide
QEEEIVTTNPVATEQYGVVMTGPIEMGEGGQGENED

SEQ ID NO: 189454 - protein, 36 aa, Artificial Sequence
  Description of Artificial Sequence: Synthetic polypeptide
QEEEIVTTNPVATEQYGVVMNGQIEGEGGQGENEDD

SEQ ID NO: 189455 - protein, 35 aa, Artificial Sequence
  Description of Artificial Sequence: Synthetic polypeptide
CETEIACTNPVATEQYGSACAANPQQEHQDGNLHQ

SEQ ID NO: 189456 - protein, 36 aa, Artificial Sequence
  Description of Artificial Sequence: Synthetic polypeptide
QECEICTTNPVATEAYGVVSTVTQQLEQQGTEETEE

SEQ ID NO: 189457 - protein, 37 aa, Artificial Sequence
  Description of Artificial Sequence: Synthetic polypeptide
DEEEIATTNPVATEQYGSVCAATMHPLEANIDPMEAH

SEQ ID NO: 189458 - protein, 36 aa, Artificial Sequence
  Description of Artificial Sequence: Synthetic polypeptide
QEEEIVTTNPVATEQYGVVMLGPHENGEGGQGENGD

SEQ ID NO: 189459 - protein, 34 aa, Artificial Sequence
  Description of Artificial Sequence: Synthetic polypeptide
QEDEIATTNPVATEQYGVVAGPGEGEGGQGENED

SEQ ID NO: 189460 - protein, 35 aa, Artificial Sequence
  Description of Artificial Sequence: Synthetic polypeptide
DEMCISTTNPVATEQYGCICSWGETNQENFGSDQS

SEQ ID NO: 189461 - protein, 34 aa, Artificial Sequence
  Description of Artificial Sequence: Synthetic polypeptide
DEMEIVTTNPIATEQWGTTVWAATEGPEEPEGND

SEQ ID NO: 189462 - protein, 35 aa, Artificial Sequence
  Description of Artificial Sequence: Synthetic polypeptide
DEMEIVTTNPIATEQWGTTVCSATEGPVEEPEGND

SEQ ID NO: 189463 - protein, 34 aa, Artificial Sequence
  Description of Artificial Sequence: Synthetic polypeptide
DEAEIATTNPVAYEQWGSVMGGNMNESGEGDGTQ

SEQ ID NO: 189464 - protein, 36 aa, Artificial Sequence
  Description of Artificial Sequence: Synthetic polypeptide
DEEEIATTNPVATEQWGCVAGEGGPGENTADGPDNS

SEQ ID NO: 189465 - protein, 35 aa, Artificial Sequence
  Description of Artificial Sequence: Synthetic polypeptide
DEAEIATTNPVAYEQWGSVAWNDQGEQHGGQQDQA

SEQ ID NO: 189466 - protein, 36 aa, Artificial Sequence
  Description of Artificial Sequence: Synthetic polypeptide
DEEEIRTTNPVATEQYGTVTCIEMGEEVPEGEVPAN

SEQ ID NO: 189467 - protein, 34 aa, Artificial Sequence
  Description of Artificial Sequence: Synthetic polypeptide
DEMCISTTNPVATEQYGCVCEWGEPNQYFGSQQS

SEQ ID NO: 189468 - protein, 37 aa, Artificial Sequence
  Description of Artificial Sequence: Synthetic polypeptide
DEEEIRTTNPVATEQYGTVTCISPGVEEVPEGEVPEI

SEQ ID NO: 189469 - protein, 39 aa, Artificial Sequence
  Description of Artificial Sequence: Synthetic polypeptide
DEEEIRTTNPVATEQYGTVTECSTESAEQQDRQMVILFT

SEQ ID NO: 189470 - protein, 36 aa, Artificial Sequence
  Description of Artificial Sequence: Synthetic polypeptide
QEDEIATTNPVAYEQYGSVCTDGALTGTRGVPMQMD

SEQ ID NO: 189471 - protein, 31 aa, Artificial Sequence
  Description of Artificial Sequence: Synthetic polypeptide
QEDEIATTNPVAYEQYGEAACEVEHSQHEEK

SEQ ID NO: 189472 - protein, 35 aa, Artificial Sequence
  Description of Artificial Sequence: Synthetic polypeptide
CETEIACTNPVATEQYGSACAANPQQEHQDGNADE

SEQ ID NO: 189473 - protein, 36 aa, Artificial Sequence
  Description of Artificial Sequence: Synthetic polypeptide
DEMEITTTNPVATEQYGTVCSATSGPVEFQHEKIDV

SEQ ID NO: 189474 - protein, 34 aa, Artificial Sequence
  Description of Artificial Sequence: Synthetic polypeptide
DEMEITTTNPVATEQYGTVCQATSGPVEFEHEED

SEQ ID NO: 189475 - protein, 36 aa, Artificial Sequence
  Description of Artificial Sequence: Synthetic polypeptide
DEEEIRTTNPVATEQYGTVTCVEMGEEVPAAEVPEI

SEQ ID NO: 189476 - protein, 35 aa, Artificial Sequence
  Description of Artificial Sequence: Synthetic polypeptide
DEMEISTTNPVATEQYGTVCSNWGEPNEFFISDQA

SEQ ID NO: 189477 - protein, 36 aa, Artificial Sequence
  Description of Artificial Sequence: Synthetic polypeptide
DEMEISTTNPVATEQYGTVCSNWDEPNEEFFGSDQA

SEQ ID NO: 189478 - protein, 36 aa, Artificial Sequence
  Description of Artificial Sequence: Synthetic polypeptide
QECEICTTNPVATEAYGVVSTVQQQNNQQGTEEQED

SEQ ID NO: 189479 - protein, 37 aa, Artificial Sequence
  Description of Artificial Sequence: Synthetic polypeptide
DEEEIATTNPVATEQYGSVCAGMTHGGAEAPIGEAEN

SEQ ID NO: 189480 - protein, 39 aa, Artificial Sequence
  Description of Artificial Sequence: Synthetic polypeptide
DEEEIRTTNPVATEQYGTTVNTDLVNYEEQIIIVETQNS

SEQ ID NO: 189481 - protein, 39 aa, Artificial Sequence
  Description of Artificial Sequence: Synthetic polypeptide
DEEEIRTTNPVATEQYGTTVNTDLVDAEEQIIIVPTQNS

SEQ ID NO: 189482 - protein, 34 aa, Artificial Sequence
  Description of Artificial Sequence: Synthetic polypeptide
DEMEIACTNPVATEQWGTVCAATDGPEAAEGGND

SEQ ID NO: 189483 - protein, 39 aa, Artificial Sequence
  Description of Artificial Sequence: Synthetic polypeptide
DEEEIRTTNPVATEQYGTTVNTCLVNYEEQIIITPTQNS

SEQ ID NO: 189484 - protein, 38 aa, Artificial Sequence
  Description of Artificial Sequence: Synthetic polypeptide
DEEEIRTTNPVATEQYGTTTTYQNDHQAEMREVFQQKL

SEQ ID NO: 189485 - protein, 39 aa, Artificial Sequence
  Description of Artificial Sequence: Synthetic polypeptide
DEEEIRTTNPVATEQYGTTVNTDLVNYEEQSIIVPTQNP

SEQ ID NO: 189486 - protein, 37 aa, Artificial Sequence
  Description of Artificial Sequence: Synthetic polypeptide
DEMEIACTNPVATEQYGCVCSTWGELNEEHFGSENQS

SEQ ID NO: 189487 - protein, 32 aa, Artificial Sequence
  Description of Artificial Sequence: Synthetic polypeptide
QECEICATNPCTTEIYGVVATSNATNQNGTDT

SEQ ID NO: 189488 - protein, 33 aa, Artificial Sequence
  Description of Artificial Sequence: Synthetic polypeptide
QECEICATNPCTTEIYGVVATQSGTNNQNQGDD

SEQ ID NO: 189489 - protein, 35 aa, Artificial Sequence
  Description of Artificial Sequence: Synthetic polypeptide
DEMEIATTNPVATCQYGCVCSNSGAHNQNFGSDQS

SEQ ID NO: 189490 - protein, 34 aa, Artificial Sequence
  Description of Artificial Sequence: Synthetic polypeptide
QECEICATNPCTTEIYGVVATQSGTNNQNGNDDT

SEQ ID NO: 189491 - protein, 35 aa, Artificial Sequence
  Description of Artificial Sequence: Synthetic polypeptide
DEMEIATTNPVATCQYGCVCSNWGADNQNFNSDQS

SEQ ID NO: 189492 - protein, 36 aa, Artificial Sequence
  Description of Artificial Sequence: Synthetic polypeptide
QEEEIRTTNPVCYEPYGVVVYCDPNHSENRQSGGND

SEQ ID NO: 189493 - protein, 32 aa, Artificial Sequence
  Description of Artificial Sequence: Synthetic polypeptide
QECEICATNPCTTEIYGVVATVNNTNQNGDTT

SEQ ID NO: 189494 - protein, 39 aa, Artificial Sequence
  Description of Artificial Sequence: Synthetic polypeptide
DEEEIRTTNPVATEQYGTVATTNQQQSTATEEGSTVTED

SEQ ID NO: 189495 - protein, 39 aa, Artificial Sequence
  Description of Artificial Sequence: Synthetic polypeptide
DEEEIRTTNPVATEQYGTVATVVTGNNNNQQGTEEGSTD

SEQ ID NO: 189496 - protein, 36 aa, Artificial Sequence
  Description of Artificial Sequence: Synthetic polypeptide
DEMEIVTTNPVATEQYGTVCSATDVTPVEVFELEND

SEQ ID NO: 189497 - protein, 37 aa, Artificial Sequence
  Description of Artificial Sequence: Synthetic polypeptide
DEMEISTTNPVATEQYGTVCSNTGEPNAEFFGSDTQA

SEQ ID NO: 189498 - protein, 37 aa, Artificial Sequence
  Description of Artificial Sequence: Synthetic polypeptide
DEEEIRTTNPVATEQYGSVEHVVGVKEAIRPMMEMGQ

SEQ ID NO: 189499 - protein, 37 aa, Artificial Sequence
  Description of Artificial Sequence: Synthetic polypeptide
QECEICTTNPVATEAYGVVSTVQQQLLQQGTNEEGED

SEQ ID NO: 189500 - protein, 37 aa, Artificial Sequence
  Description of Artificial Sequence: Synthetic polypeptide
DEEEIATTNPVATEQYGSVCAATMHGEANIDGMEAAH

SEQ ID NO: 189501 - protein, 37 aa, Artificial Sequence
  Description of Artificial Sequence: Synthetic polypeptide
QECEICTTNPVATEAYGVVSTVNTQLNQQGTEDEQET

SEQ ID NO: 189502 - protein, 37 aa, Artificial Sequence
  Description of Artificial Sequence: Synthetic polypeptide
QECEICTTNPVATEAYGVVSTVNQQLLQQGTEGGQED

SEQ ID NO: 189503 - protein, 37 aa, Artificial Sequence
  Description of Artificial Sequence: Synthetic polypeptide
QECEICTTNPVATEAYGVVSTVNQQLLQQGTEEETED

SEQ ID NO: 189504 - protein, 36 aa, Artificial Sequence
  Description of Artificial Sequence: Synthetic polypeptide
DEMEISTTNPVATEQYGQCVCSWGEHQENFNSDNQA

SEQ ID NO: 189505 - protein, 37 aa, Artificial Sequence
  Description of Artificial Sequence: Synthetic polypeptide
QECEICTTNPVATEAYGVVSTVNQQLEQQGTEDEEED

SEQ ID NO: 189506 - protein, 37 aa, Artificial Sequence
  Description of Artificial Sequence: Synthetic polypeptide
QECEICTTNPVATEAYGVVSTVNQQLEQIGTEDETEE

SEQ ID NO: 189507 - protein, 36 aa, Artificial Sequence
  Description of Artificial Sequence: Synthetic polypeptide
QECEICTTNPVATEAYGVVSTVNQQGTQQGTEEQEE

SEQ ID NO: 189508 - protein, 35 aa, Artificial Sequence
  Description of Artificial Sequence: Synthetic polypeptide
QEEEISTTNPVATEQYGVVMAGPGEGEGGQDENED

SEQ ID NO: 189509 - protein, 37 aa, Artificial Sequence
  Description of Artificial Sequence: Synthetic polypeptide
QECEICTTNPVATEAYGVVSTNQQQLLQQGTEEEQED

SEQ ID NO: 189510 - protein, 36 aa, Artificial Sequence
  Description of Artificial Sequence: Synthetic polypeptide
QECEICTTNPVATEAYGVVSTNNQQNQQQGTEEGTE

SEQ ID NO: 189511 - protein, 36 aa, Artificial Sequence
  Description of Artificial Sequence: Synthetic polypeptide
QECEICTTNPVATEAYGVVSTEQQQGNQQGTEEATE

SEQ ID NO: 189512 - protein, 35 aa, Artificial Sequence
  Description of Artificial Sequence: Synthetic polypeptide
DEMEIVTTNPIATEQWGTTVWSATEGPVEEPEGND

SEQ ID NO: 189513 - protein, 33 aa, Artificial Sequence
  Description of Artificial Sequence: Synthetic polypeptide
QECEICATNPCTTEIYGVVATQSGTNNQNGDIN

SEQ ID NO: 189514 - protein, 33 aa, Artificial Sequence
  Description of Artificial Sequence: Synthetic polypeptide
DEMEIVTTNPIATEQWGTVCAAADGPAFEGNYD

SEQ ID NO: 189515 - protein, 33 aa, Artificial Sequence
  Description of Artificial Sequence: Synthetic polypeptide
DEMEIVTTNPIATEQWGTVCAAADGPAPKGNYD

SEQ ID NO: 189516 - protein, 35 aa, Artificial Sequence
  Description of Artificial Sequence: Synthetic polypeptide
DEMEIVTTNPVATEQYGTTCANADGPVEEFEGNYD

SEQ ID NO: 189517 - protein, 36 aa, Artificial Sequence
  Description of Artificial Sequence: Synthetic polypeptide
DEMCIRTTNPVATEQYGCVCSWGEHNAENFGSDTQA

SEQ ID NO: 189518 - protein, 30 aa, Artificial Sequence
  Description of Artificial Sequence: Synthetic polypeptide
QEEEIATTNPIATECWGATWAADWAHKGEK

SEQ ID NO: 189519 - protein, 30 aa, Artificial Sequence
  Description of Artificial Sequence: Synthetic polypeptide
QEEEIATTNPIATECWGETPAVCQEPEEYK

SEQ ID NO: 189520 - protein, 33 aa, Artificial Sequence
  Description of Artificial Sequence: Synthetic polypeptide
QEEEIATTNPIATEQWGATWANEEDWQEPGPYK

SEQ ID NO: 189521 - protein, 32 aa, Artificial Sequence
  Description of Artificial Sequence: Synthetic polypeptide
QEEEIATTNPIATEQWGEAANAEVCQEHGEYK

SEQ ID NO: 189522 - protein, 35 aa, Artificial Sequence
  Description of Artificial Sequence: Synthetic polypeptide
DEMEIVTTNPVATEQYGTTCANTDGPVEEFEGNYD

SEQ ID NO: 189523 - protein, 31 aa, Artificial Sequence
  Description of Artificial Sequence: Synthetic polypeptide
QEEEIATTNPIATEQWGEAANAEVCQHEEYK

SEQ ID NO: 189524 - protein, 33 aa, Artificial Sequence
  Description of Artificial Sequence: Synthetic polypeptide
QEEEIATTNPVATAQWGSVAATGAGGTAPQDAF

SEQ ID NO: 189525 - protein, 35 aa, Artificial Sequence
  Description of Artificial Sequence: Synthetic polypeptide
DEAEIATTNPVAYEQWGSVYCDDGNGRQQGGGSTN

SEQ ID NO: 189526 - protein, 33 aa, Artificial Sequence
  Description of Artificial Sequence: Synthetic polypeptide
QEEEIATTNPVATASWGCIATTAEQDTQDGNEN

SEQ ID NO: 189527 - protein, 34 aa, Artificial Sequence
  Description of Artificial Sequence: Synthetic polypeptide
QEEEIATTNPVATDQYGVVVAGLEGEGGQGEEID

SEQ ID NO: 189528 - protein, 31 aa, Artificial Sequence
  Description of Artificial Sequence: Synthetic polypeptide
QEEEIATTNPVATECWGATAAEEDCQEPEPI

SEQ ID NO: 189529 - protein, 38 aa, Artificial Sequence
  Description of Artificial Sequence: Synthetic polypeptide
DEEEIRTTNPVATEQYGSVMGSMDEEGEPEDNGGGEQQ

SEQ ID NO: 189530 - protein, 37 aa, Artificial Sequence
  Description of Artificial Sequence: Synthetic polypeptide
QEEEIATTNPVATAQWGSFVANANGLPQAAPGENMNW

SEQ ID NO: 189531 - protein, 35 aa, Artificial Sequence
  Description of Artificial Sequence: Synthetic polypeptide
DEAEIATTNPVAYEQWGSVVCNTPDDDHRENHEDL

SEQ ID NO: 189532 - protein, 35 aa, Artificial Sequence
  Description of Artificial Sequence: Synthetic polypeptide
DEMEIVTTNPVATEQYGTTVCSAADGPEEPKGPYI

SEQ ID NO: 189533 - protein, 38 aa, Artificial Sequence
  Description of Artificial Sequence: Synthetic polypeptide
DEEEIRTTNPVATEQYGSVMQEVMLQLDDITQQVDEDT

SEQ ID NO: 189534 - protein, 30 aa, Artificial Sequence
  Description of Artificial Sequence: Synthetic polypeptide
QEEAIATVNPVATEWYGEAPEEPAQHEECK

SEQ ID NO: 189535 - protein, 31 aa, Artificial Sequence
  Description of Artificial Sequence: Synthetic polypeptide
DEEEIATTNPVATECWGETAEDCAEHKEEYI

SEQ ID NO: 189536 - protein, 33 aa, Artificial Sequence
  Description of Artificial Sequence: Synthetic polypeptide
QEEEIACTNPVATEQYGCAPGIGHGQDSEGEKM

SEQ ID NO: 189537 - protein, 34 aa, Artificial Sequence
  Description of Artificial Sequence: Synthetic polypeptide
QEEEIACTNPVATEQYGCAPPEGHGQDSEGENKM

SEQ ID NO: 189538 - protein, 34 aa, Artificial Sequence
  Description of Artificial Sequence: Synthetic polypeptide
QEEEIACTNPVATEQYGCVAPPEHGTDSEGENKM

SEQ ID NO: 189539 - protein, 37 aa, Artificial Sequence
  Description of Artificial Sequence: Synthetic polypeptide
DEEEIATTNPVATECYGSVCAAVANALADTPPEEANN

SEQ ID NO: 189540 - protein, 35 aa, Artificial Sequence
  Description of Artificial Sequence: Synthetic polypeptide
DEMEIVTTNPVATEQYGTTVCSAADGPVEEPEGPD

SEQ ID NO: 189541 - protein, 38 aa, Artificial Sequence
  Description of Artificial Sequence: Synthetic polypeptide
DEEEIRTTNPVATEQYGSVNGAAIPEYHDSRSNENEEV

SEQ ID NO: 189542 - protein, 38 aa, Artificial Sequence
  Description of Artificial Sequence: Synthetic polypeptide
DEEEIRTTNPVATEQYGSVNGAAINEYHDSRSEEEFQV

SEQ ID NO: 189543 - protein, 38 aa, Artificial Sequence
  Description of Artificial Sequence: Synthetic polypeptide
DEEEIRTTNPVATEQYGSVNGAAINEYHDSMSEENFDV

SEQ ID NO: 189544 - protein, 38 aa, Artificial Sequence
  Description of Artificial Sequence: Synthetic polypeptide
QEDEIRTTNPVATEQYGSVNSTVMAGGPEMGQGEGEEG

SEQ ID NO: 189545 - protein, 37 aa, Artificial Sequence
  Description of Artificial Sequence: Synthetic polypeptide
DEAEIATTNPVAYEQYGSACSAANPGPLDSMIGNDNH

SEQ ID NO: 189546 - protein, 35 aa, Artificial Sequence
  Description of Artificial Sequence: Synthetic polypeptide
DEEEIATTNPVATEHYGISTACTSEHDTSSTNNKM

SEQ ID NO: 189547 - protein, 35 aa, Artificial Sequence
  Description of Artificial Sequence: Synthetic polypeptide
DEAEIATTNPVAYEQWGVVAPTDNQDDQDQGGGSE

SEQ ID NO: 189548 - protein, 37 aa, Artificial Sequence
  Description of Artificial Sequence: Synthetic polypeptide
QEDEIRTTNPVAYEQYGTICSCTQNSLSQTSTEENPP

SEQ ID NO: 189549 - protein, 33 aa, Artificial Sequence
  Description of Artificial Sequence: Synthetic polypeptide
QEEEIATTNPVATECYGEVPCIVEPQDHEEEEK

SEQ ID NO: 189550 - protein, 35 aa, Artificial Sequence
  Description of Artificial Sequence: Synthetic polypeptide
QEEEIATTNPVATECYGSVCAANGEEANDSGGEHM

SEQ ID NO: 189551 - protein, 36 aa, Artificial Sequence
  Description of Artificial Sequence: Synthetic polypeptide
DEMEIVTTNPVATEQYGQCVCSNWGEPNEFFGSQDA

SEQ ID NO: 189552 - protein, 34 aa, Artificial Sequence
  Description of Artificial Sequence: Synthetic polypeptide
DEMEIVTTNPVATECYGTTTCSATDDPEFKGPYI

SEQ ID NO: 189553 - protein, 34 aa, Artificial Sequence
  Description of Artificial Sequence: Synthetic polypeptide
DEMEIVTTNPVATECYGTTTCSATDDPAFKGPYI

SEQ ID NO: 189554 - protein, 34 aa, Artificial Sequence
  Description of Artificial Sequence: Synthetic polypeptide
DEMEIVTTNPVATECYGTTCANTEGPVEEFKGND

SEQ ID NO: 189555 - protein, 34 aa, Artificial Sequence
  Description of Artificial Sequence: Synthetic polypeptide
DEMEIVTTNPVATECYGTTCAATEGPVEEFKGND

SEQ ID NO: 189556 - protein, 34 aa, Artificial Sequence
  Description of Artificial Sequence: Synthetic polypeptide
DEMEIVTTNPVATECYGAVWANADGWVEEFKGPD

SEQ ID NO: 189557 - protein, 34 aa, Artificial Sequence
  Description of Artificial Sequence: Synthetic polypeptide
DEMEIVTTNPVATECYGAVWANADDWVEEFKGPD

SEQ ID NO: 189558 - protein, 35 aa, Artificial Sequence
  Description of Artificial Sequence: Synthetic polypeptide
DEMEIVTTNPVATECYGTTTCSATDDPVEFKGNYI

SEQ ID NO: 189559 - protein, 35 aa, Artificial Sequence
  Description of Artificial Sequence: Synthetic polypeptide
DEMCIGTTNPVATEQWGCVCSWGEDLNQYFGSDQA

SEQ ID NO: 189560 - protein, 34 aa, Artificial Sequence
  Description of Artificial Sequence: Synthetic polypeptide
DEMEIVTTNPVATECWGAVCSNTDGPVEFEGPYD

SEQ ID NO: 189561 - protein, 36 aa, Artificial Sequence
  Description of Artificial Sequence: Synthetic polypeptide
DEEEIATTNPVATEQWGANRTTAATNHPAGMDMNNN

SEQ ID NO: 189562 - protein, 36 aa, Artificial Sequence
  Description of Artificial Sequence: Synthetic polypeptide
DEEEIATTNPVATEQWGCNVAGAGGPANQAGGNPVD

SEQ ID NO: 189563 - protein, 37 aa, Artificial Sequence
  Description of Artificial Sequence: Synthetic polypeptide
DEEEIATTNPVATEQWGCNVAGNNGGLPEENNHGTNH

SEQ ID NO: 189564 - protein, 34 aa, Artificial Sequence
  Description of Artificial Sequence: Synthetic polypeptide
CETEIACTNPVATEQWGCVAGTNSHQEADMLIRE

SEQ ID NO: 189565 - protein, 33 aa, Artificial Sequence
  Description of Artificial Sequence: Synthetic polypeptide
DEMEIVTTNPIATEQWGTVCAAADGWAPKGNYD

SEQ ID NO: 189566 - protein, 34 aa, Artificial Sequence
  Description of Artificial Sequence: Synthetic polypeptide
DEMCIGTTNPVATEQWGCVCSWEDHNQYFGSDQS

SEQ ID NO: 189567 - protein, 34 aa, Artificial Sequence
  Description of Artificial Sequence: Synthetic polypeptide
DEMEIVTTNPVATECYGTTTCSNTDDPAFKGPYI

SEQ ID NO: 189568 - protein, 37 aa, Artificial Sequence
  Description of Artificial Sequence: Synthetic polypeptide
DEMEIVTTNPVATEGYGCVCSNTGEPNEEFFGSENQS

SEQ ID NO: 189569 - protein, 34 aa, Artificial Sequence
  Description of Artificial Sequence: Synthetic polypeptide
QEEEIATTNPVATEQYGCYCPWGEDNQHFNSEQN

SEQ ID NO: 189570 - protein, 37 aa, Artificial Sequence
  Description of Artificial Sequence: Synthetic polypeptide
DEMEIVTTNPVATEQYGQCVCSNTGEPNEFFGSDTDS

SEQ ID NO: 189571 - protein, 35 aa, Artificial Sequence
  Description of Artificial Sequence: Synthetic polypeptide
DEAEIATTNPVAYEQWGSVSGQGPPQQETPDGSDN

SEQ ID NO: 189572 - protein, 35 aa, Artificial Sequence
  Description of Artificial Sequence: Synthetic polypeptide
DEMEIVTTNPVATEQYGCVCSNWGEPNEFFISDDS

SEQ ID NO: 189573 - protein, 37 aa, Artificial Sequence
  Description of Artificial Sequence: Synthetic polypeptide
QEDEIRGTNCVATEQYGSVMTGANQNLVGEGDGNDGD

SEQ ID NO: 189574 - protein, 33 aa, Artificial Sequence
  Description of Artificial Sequence: Synthetic polypeptide
QEDEIRCTNPTAYECWGSVWGENDDMHRGDDER

SEQ ID NO: 189575 - protein, 34 aa, Artificial Sequence
  Description of Artificial Sequence: Synthetic polypeptide
QEEEIATTNPVATEPYGETAPCEVASQHPEGENK

SEQ ID NO: 189576 - protein, 36 aa, Artificial Sequence
  Description of Artificial Sequence: Synthetic polypeptide
QEDEICTTNPVAYEQYGTICSCTLNSLSQTSTEENP

SEQ ID NO: 189577 - protein, 37 aa, Artificial Sequence
  Description of Artificial Sequence: Synthetic polypeptide
DEMEIVTTNPVATEQYGCVCSNTGEPNAEFFNSNTQS

SEQ ID NO: 189578 - protein, 37 aa, Artificial Sequence
  Description of Artificial Sequence: Synthetic polypeptide
DEMEIVTTNPVATEQYGCVCSNTGEDPNEFFGSDTQG

SEQ ID NO: 189579 - protein, 38 aa, Artificial Sequence
  Description of Artificial Sequence: Synthetic polypeptide
DEMEIVTTNPVATEQYGCVCSNTGEDPNAEFFGSDNQS

SEQ ID NO: 189580 - protein, 34 aa, Artificial Sequence
  Description of Artificial Sequence: Synthetic polypeptide
DEMEIVTTNPVATEQYGCLCTATDGPVEFEGEKQ

SEQ ID NO: 189581 - protein, 34 aa, Artificial Sequence
  Description of Artificial Sequence: Synthetic polypeptide
DEMEIVTTNPVATEQYGAVWAAADGWVEEFKGPD

SEQ ID NO: 189582 - protein, 36 aa, Artificial Sequence
  Description of Artificial Sequence: Synthetic polypeptide
QEEEIATTNPVATEQWGGCCTAAAGNLDDGMGNNHD

SEQ ID NO: 189583 - protein, 35 aa, Artificial Sequence
  Description of Artificial Sequence: Synthetic polypeptide
DEMEIVTTNPVATEQYGAVCFAWDGPVEFEGNFES

SEQ ID NO: 189584 - protein, 34 aa, Artificial Sequence
  Description of Artificial Sequence: Synthetic polypeptide
QEEEIATTNPVATEQYGCYCPWEDNQEHFNSEQG

SEQ ID NO: 189585 - protein, 33 aa, Artificial Sequence
  Description of Artificial Sequence: Synthetic polypeptide
DEMEIVTTNPIATEQWGTVCAAADGPAFKGNYD

SEQ ID NO: 189586 - protein, 36 aa, Artificial Sequence
  Description of Artificial Sequence: Synthetic polypeptide
DEMEISTTNPVATEQYGQCVCSNSGEPNEFFGSDQA

SEQ ID NO: 189587 - protein, 36 aa, Artificial Sequence
  Description of Artificial Sequence: Synthetic polypeptide
QEEEIRTTNPVCYEPYGVVVSCDPFHSQNVQGGGND

SEQ ID NO: 189588 - protein, 32 aa, Artificial Sequence
  Description of Artificial Sequence: Synthetic polypeptide
QECEICATNPCTTEIYGVVATNVATNNQNGDT

SEQ ID NO: 189589 - protein, 34 aa, Artificial Sequence
  Description of Artificial Sequence: Synthetic polypeptide
QEAEIATTNPVAYCAYGQEVPSCVLSQKGTNNQD

SEQ ID NO: 189590 - protein, 39 aa, Artificial Sequence
  Description of Artificial Sequence: Synthetic polypeptide
DEEEIRTTNPVATEQYGVIVSDNTENQVVNGFEGQGEGG

SEQ ID NO: 189591 - protein, 31 aa, Artificial Sequence
  Description of Artificial Sequence: Synthetic polypeptide
QEAEIASTNPVGTEGWGVCAPTDLQHQGDEI

SEQ ID NO: 189592 - protein, 36 aa, Artificial Sequence
  Description of Artificial Sequence: Synthetic polypeptide
DEMEIATTNPVATEQYGCVCSNSALNEEHFGSEDLA

SEQ ID NO: 189593 - protein, 30 aa, Artificial Sequence
  Description of Artificial Sequence: Synthetic polypeptide
QEAEIAPTNPCSYEQWGIAFCNDQSGDTDR

SEQ ID NO: 189594 - protein, 37 aa, Artificial Sequence
  Description of Artificial Sequence: Synthetic polypeptide
DAEEIATTNPVATEQYGSVCSMANPAPEATMGDLAAM

SEQ ID NO: 189595 - protein, 38 aa, Artificial Sequence
  Description of Artificial Sequence: Synthetic polypeptide
QEEEIRTTNPVATEQYGVVSVMDDTNMTGPEFGEEEGQ

SEQ ID NO: 189596 - protein, 33 aa, Artificial Sequence
  Description of Artificial Sequence: Synthetic polypeptide
QEAEIACTNPVAYEQWGEYYSIENDQDRGPGES

SEQ ID NO: 189597 - protein, 37 aa, Artificial Sequence
  Description of Artificial Sequence: Synthetic polypeptide
DEMEIATTNPVATEQYGCVCSNSMELNEEHFGSENLA

SEQ ID NO: 189598 - protein, 36 aa, Artificial Sequence
  Description of Artificial Sequence: Synthetic polypeptide
DEAEIATTNPVAYEPQWGQSVSVTGDIGQAHMIAER

SEQ ID NO: 189599 - protein, 37 aa, Artificial Sequence
  Description of Artificial Sequence: Synthetic polypeptide
DEMAIRTTNPVATEQYGCFCSTGEGHNIENFGSDNQS

SEQ ID NO: 189600 - protein, 37 aa, Artificial Sequence
  Description of Artificial Sequence: Synthetic polypeptide
DEMEIATTNPVATEQYGCVCSNTEEHNEDHFGSEDQA

SEQ ID NO: 189601 - protein, 38 aa, Artificial Sequence
  Description of Artificial Sequence: Synthetic polypeptide
QEEEIRTTNPVATEQYGSVVNTQTPIGPEMGQEENEEG

SEQ ID NO: 189602 - protein, 38 aa, Artificial Sequence
  Description of Artificial Sequence: Synthetic polypeptide
QEEEIRTTNPVATEQYGSVVNPTTPEGPEMGQGENEET

SEQ ID NO: 189603 - protein, 30 aa, Artificial Sequence
  Description of Artificial Sequence: Synthetic polypeptide
QEGEIAATNPCSYEQWGCGYCNDQSQGDTR

SEQ ID NO: 189604 - protein, 35 aa, Artificial Sequence
  Description of Artificial Sequence: Synthetic polypeptide
DEAEIATTNPVAYEKWGTVCSNDNHDQPGQQGNEH

SEQ ID NO: 189605 - protein, 37 aa, Artificial Sequence
  Description of Artificial Sequence: Synthetic polypeptide
DEEEIRTTNPVATEQYGVCVYPSPVHMPNQVDMFLEG

SEQ ID NO: 189606 - protein, 36 aa, Artificial Sequence
  Description of Artificial Sequence: Synthetic polypeptide
DEEEIATTNPVATAQWGGCCAGTGNGLEATANGNEF

SEQ ID NO: 189607 - protein, 34 aa, Artificial Sequence
  Description of Artificial Sequence: Synthetic polypeptide
DEEEIATTNPVATASWGCIATSGAEQDTDGNENN

SEQ ID NO: 189608 - protein, 33 aa, Artificial Sequence
  Description of Artificial Sequence: Synthetic polypeptide
DEEEIATTNPVATASWGCIATAAEEDTPDGNEN

SEQ ID NO: 189609 - protein, 37 aa, Artificial Sequence
  Description of Artificial Sequence: Synthetic polypeptide
DEEEIRTTNPVATEQYGVCVHPSPVNMSNAVDMIFYE

SEQ ID NO: 189610 - protein, 37 aa, Artificial Sequence
  Description of Artificial Sequence: Synthetic polypeptide
DEMEIRTTNPVATEQYGSVTPWVPVGAEERYSSNMDD

SEQ ID NO: 189611 - protein, 31 aa, Artificial Sequence
  Description of Artificial Sequence: Synthetic polypeptide
QECEIAPTNPCSYEQWGIVWCNDKQSGDTDR

SEQ ID NO: 189612 - protein, 36 aa, Artificial Sequence
  Description of Artificial Sequence: Synthetic polypeptide
DEEEIATTNPVATAQWGSVSATGAGGTAPQDIAQHK

SEQ ID NO: 189613 - protein, 38 aa, Artificial Sequence
  Description of Artificial Sequence: Synthetic polypeptide
QEEEIRTTNPVATEQYGVVVNPTTLEGPEMGQGENEEG

SEQ ID NO: 189614 - protein, 38 aa, Artificial Sequence
  Description of Artificial Sequence: Synthetic polypeptide
DEEEIATTNPVATEQWGYSNVASSSDEEQHLRVFQGFV

SEQ ID NO: 189615 - protein, 38 aa, Artificial Sequence
  Description of Artificial Sequence: Synthetic polypeptide
DEMEIRTTNPVATEQYGSVTFWVAEDHETQPETGEDRF

SEQ ID NO: 189616 - protein, 37 aa, Artificial Sequence
  Description of Artificial Sequence: Synthetic polypeptide
DEEEIATTNPVATEQYGCNVAGNNGGLPDENNHTMEQ

SEQ ID NO: 189617 - protein, 37 aa, Artificial Sequence
  Description of Artificial Sequence: Synthetic polypeptide
DEMEIRTTNPVATEQYGSVTATVPSHTEEMDEIDMMD

SEQ ID NO: 189618 - protein, 37 aa, Artificial Sequence
  Description of Artificial Sequence: Synthetic polypeptide
DEEEIATTNPVATEQYGCSSAANTHGPEAGGNMEGNN

SEQ ID NO: 189619 - protein, 37 aa, Artificial Sequence
  Description of Artificial Sequence: Synthetic polypeptide
DEEEIATTNPVATEQYGCSSAANTHGPEAPGNQMETN

SEQ ID NO: 189620 - protein, 36 aa, Artificial Sequence
  Description of Artificial Sequence: Synthetic polypeptide
DEMEIRTTNPVATEQYGSVTATVPSHEEFDEIDMMT

SEQ ID NO: 189621 - protein, 36 aa, Artificial Sequence
  Description of Artificial Sequence: Synthetic polypeptide
QEAEIRTTNPVAYEPYRGQSVQSINEGSTSMPGAPR

SEQ ID NO: 189622 - protein, 39 aa, Artificial Sequence
  Description of Artificial Sequence: Synthetic polypeptide
QEEEIRTTNPVATEQYGSVVNPTTLELGPEMGQGENETG

SEQ ID NO: 189623 - protein, 38 aa, Artificial Sequence
  Description of Artificial Sequence: Synthetic polypeptide
QEEEIRTTNPVATEQYGSVVNPQTLEGPEMVQGNNEEG

SEQ ID NO: 189624 - protein, 37 aa, Artificial Sequence
  Description of Artificial Sequence: Synthetic polypeptide
DEMEIATTNPVATEQYGCVCSNTMEHNAEHFGSEDLS

SEQ ID NO: 189625 - protein, 36 aa, Artificial Sequence
  Description of Artificial Sequence: Synthetic polypeptide
DEMEIATTNPVATEQYGCVCSNWEHNAEHFNSEDQA

SEQ ID NO: 189626 - protein, 38 aa, Artificial Sequence
  Description of Artificial Sequence: Synthetic polypeptide
DEEEIRTTNPVATEQYGTECFYPSVNHDEQEQNEAQMQ

SEQ ID NO: 189627 - protein, 39 aa, Artificial Sequence
  Description of Artificial Sequence: Synthetic polypeptide
DEEEIRTTNPVATEQYGTECFYPSVNHCEVEQGNEAQRQ

SEQ ID NO: 189628 - protein, 36 aa, Artificial Sequence
  Description of Artificial Sequence: Synthetic polypeptide
DEMEIATTNPVATEQYGCVCSNWEHNEEHFGSDDQA

SEQ ID NO: 189629 - protein, 39 aa, Artificial Sequence
  Description of Artificial Sequence: Synthetic polypeptide
QEEEIRTTNPVATEQYGSVVDPTTLEDGPEMGQGENEEG

SEQ ID NO: 189630 - protein, 36 aa, Artificial Sequence
  Description of Artificial Sequence: Synthetic polypeptide
DEMEIATTNPVATEQYGCVCSNWEHNEEHFNSETLI

SEQ ID NO: 189631 - protein, 37 aa, Artificial Sequence
  Description of Artificial Sequence: Synthetic polypeptide
DEEEIRTTNPVATEQYGTFVTCISIGEEVPEGEVPEI

SEQ ID NO: 189632 - protein, 29 aa, Artificial Sequence
  Description of Artificial Sequence: Synthetic peptide
QDSEIASTNPVSTEGYGEVAEVCQSHEQK

SEQ ID NO: 189633 - protein, 38 aa, Artificial Sequence
  Description of Artificial Sequence: Synthetic polypeptide
DEEEIRTTNPVATEQYGTCVCSNWGEHNEENFNSDNQS

SEQ ID NO: 189634 - protein, 37 aa, Artificial Sequence
  Description of Artificial Sequence: Synthetic polypeptide
DEMEIATTNPVATEQYGCVCSNWGEHNAENFGSENQS

SEQ ID NO: 189635 - protein, 36 aa, Artificial Sequence
  Description of Artificial Sequence: Synthetic polypeptide
DEMEIATTNPVATEQYGCVCSNWGEPNTEFFGSDQS

SEQ ID NO: 189636 - protein, 37 aa, Artificial Sequence
  Description of Artificial Sequence: Synthetic polypeptide
DEMEIATTNPVATEQYGCVCSTTEDHNEEHFGSEDQA

SEQ ID NO: 189637 - protein, 35 aa, Artificial Sequence
  Description of Artificial Sequence: Synthetic polypeptide
DEAEIATTNPVAYERWGAVCTWDNPNQGLEQGGGS

SEQ ID NO: 189638 - protein, 34 aa, Artificial Sequence
  Description of Artificial Sequence: Synthetic polypeptide
DEAEIATTNPVAYERWGAVCTWDNPNQHEQGDGS

SEQ ID NO: 189639 - protein, 36 aa, Artificial Sequence
  Description of Artificial Sequence: Synthetic polypeptide
DEMEIATTNPVATEQYGCVCSNWGEHNAEHFGSETA

SEQ ID NO: 189640 - protein, 36 aa, Artificial Sequence
  Description of Artificial Sequence: Synthetic polypeptide
DEMEIATTNPVATEQYGCVCSNWEHNAEHFGSETLF

SEQ ID NO: 189641 - protein, 35 aa, Artificial Sequence
  Description of Artificial Sequence: Synthetic polypeptide
DEMAIRTTNPVATEQYGCFCSSEEHNIENFGSDQA

SEQ ID NO: 189642 - protein, 37 aa, Artificial Sequence
  Description of Artificial Sequence: Synthetic polypeptide
DEEEIATTNPVATEQYGCVCSNWGEHNAENFNSENQS

SEQ ID NO: 189643 - protein, 39 aa, Artificial Sequence
  Description of Artificial Sequence: Synthetic polypeptide
QEEEIRTTNPVATEQYGSVVNGTTPENGPEMGQGENEEG

SEQ ID NO: 189644 - protein, 37 aa, Artificial Sequence
  Description of Artificial Sequence: Synthetic polypeptide
DEEEIRTTNPVATEQYGVTIVYPSPVHMPNVDMYFEG

SEQ ID NO: 189645 - protein, 38 aa, Artificial Sequence
  Description of Artificial Sequence: Synthetic polypeptide
DEEEIRTTNPVATEQYGVTTYQLQVGHPVHDAGAAVEV

SEQ ID NO: 189646 - protein, 39 aa, Artificial Sequence
  Description of Artificial Sequence: Synthetic polypeptide
DEEEIRTTNPVATEQYGVTVGTQLVNYEEQIIIVPTQNS

SEQ ID NO: 189647 - protein, 38 aa, Artificial Sequence
  Description of Artificial Sequence: Synthetic polypeptide
DEEEIATTNPVATEQYGCVCAMNNGELTNPDDQMEHNM

SEQ ID NO: 189648 - protein, 37 aa, Artificial Sequence
  Description of Artificial Sequence: Synthetic polypeptide
DEEEIATTNPVATEQYGCVCAMNNGNLEPPADIANDA

SEQ ID NO: 189649 - protein, 38 aa, Artificial Sequence
  Description of Artificial Sequence: Synthetic polypeptide
DEEEIRTTNPVATEQYGVTYVLVESPVEMWEEGNVPDS

SEQ ID NO: 189650 - protein, 37 aa, Artificial Sequence
  Description of Artificial Sequence: Synthetic polypeptide
DEEEIATTNPVATEQYGCVCSDSGEHNQENFSSDNQS

SEQ ID NO: 189651 - protein, 37 aa, Artificial Sequence
  Description of Artificial Sequence: Synthetic polypeptide
DEEEIRTTNPVATEQYGTQAIDNTNMIEQHQVATMKE

SEQ ID NO: 189652 - protein, 30 aa, Artificial Sequence
  Description of Artificial Sequence: Synthetic polypeptide
QDSEIATTNPVSTEGYGNAANVCQSHVGEK

SEQ ID NO: 189653 - protein, 37 aa, Artificial Sequence
  Description of Artificial Sequence: Synthetic polypeptide
QEEEIRTTNPVATEQYGSVVMGFPIEMDVNDDDGGST

SEQ ID NO: 189654 - protein, 38 aa, Artificial Sequence
  Description of Artificial Sequence: Synthetic polypeptide
QEEEIRTTNPVATEQYGSVVIPNTPEGPEMGQGENEEG

SEQ ID NO: 189655 - protein, 30 aa, Artificial Sequence
  Description of Artificial Sequence: Synthetic polypeptide
QDSEIATTNPVSTEGYGNAANTCQSHVGEK

SEQ ID NO: 189656 - protein, 39 aa, Artificial Sequence
  Description of Artificial Sequence: Synthetic polypeptide
DEEEIRTTNPVATEQYGVVATTNNQQQSATEEGGTTTDQ

SEQ ID NO: 189657 - protein, 37 aa, Artificial Sequence
  Description of Artificial Sequence: Synthetic polypeptide
DEMEIATTNPVATEQYGCVCSNWEAHNEEHFGSENQS

SEQ ID NO: 189658 - protein, 34 aa, Artificial Sequence
  Description of Artificial Sequence: Synthetic polypeptide
DEEEIATTNPVATASWGCIATTAEQDTPDGNENH

SEQ ID NO: 189659 - protein, 36 aa, Artificial Sequence
  Description of Artificial Sequence: Synthetic polypeptide
DEAEIATTNPVAYEQYGSVATTGHGPLDSMENNAMS

SEQ ID NO: 189660 - protein, 37 aa, Artificial Sequence
  Description of Artificial Sequence: Synthetic polypeptide
DEEEIRTTNPVATEQYGVCVHPSPVNMSNAVDMFSEY

SEQ ID NO: 189661 - protein, 35 aa, Artificial Sequence
  Description of Artificial Sequence: Synthetic polypeptide
DEEEIATTNPVATEQWGTNCSAAADHGMNNSNDSW

SEQ ID NO: 189662 - protein, 35 aa, Artificial Sequence
  Description of Artificial Sequence: Synthetic polypeptide
DEMAISTTNPVATEQYGCFCSTEHNIENFGSDTQS

SEQ ID NO: 189663 - protein, 33 aa, Artificial Sequence
  Description of Artificial Sequence: Synthetic polypeptide
QECEICATNPCTTEIYGVVATNNTNNQNLGNDT

SEQ ID NO: 189664 - protein, 37 aa, Artificial Sequence
  Description of Artificial Sequence: Synthetic polypeptide
DEMEISTTNPVATEQYGCVCSNWEEHNAENFGSQNQS

SEQ ID NO: 189665 - protein, 36 aa, Artificial Sequence
  Description of Artificial Sequence: Synthetic polypeptide
DEMEISTTNPVATEQYGCVCSNWEDNAENFNSDTQA

SEQ ID NO: 189666 - protein, 36 aa, Artificial Sequence
  Description of Artificial Sequence: Synthetic polypeptide
DEMEISTTNPVATEQYGCVCSNTGEPNEFFNSDTQA

SEQ ID NO: 189667 - protein, 37 aa, Artificial Sequence
  Description of Artificial Sequence: Synthetic polypeptide
DEMEISTTNPVATEQYGCVCSNTGEPNEEFFGSDTQF

SEQ ID NO: 189668 - protein, 37 aa, Artificial Sequence
  Description of Artificial Sequence: Synthetic polypeptide
DEMEISTTNPVATEQYGCVCSNWGEHNTENFNSDNQS

SEQ ID NO: 189669 - protein, 37 aa, Artificial Sequence
  Description of Artificial Sequence: Synthetic polypeptide
DEMEISTTNPVATEQYGCVCSNTGEPNAEFFQSDTQS

SEQ ID NO: 189670 - protein, 36 aa, Artificial Sequence
  Description of Artificial Sequence: Synthetic polypeptide
DEMEISTTNPVATEQYGCVCSNSGEPNENFGSDTQA

SEQ ID NO: 189671 - protein, 35 aa, Artificial Sequence
  Description of Artificial Sequence: Synthetic polypeptide
DEMEISTTNPVATEQYGCVCQTAHNIENFMSDTQS

SEQ ID NO: 189672 - protein, 37 aa, Artificial Sequence
  Description of Artificial Sequence: Synthetic polypeptide
DEEEIATTNPVATEQWGSVAKAGTPLPLDSAEENMSE

SEQ ID NO: 189673 - protein, 37 aa, Artificial Sequence
  Description of Artificial Sequence: Synthetic polypeptide
DEMEISTTNPVATCQYGCVCSTWGEHNEENFGSDNQS

SEQ ID NO: 189674 - protein, 32 aa, Artificial Sequence
  Description of Artificial Sequence: Synthetic polypeptide
QECEICATNPCTTEIYGVVATNNTNNQNGDTT

SEQ ID NO: 189675 - protein, 32 aa, Artificial Sequence
  Description of Artificial Sequence: Synthetic polypeptide
QECEICATNPCTTEIYGVVATNNTNNQNGDET

SEQ ID NO: 189676 - protein, 37 aa, Artificial Sequence
  Description of Artificial Sequence: Synthetic polypeptide
DEMEISTTNPVATEQYGCVCSNTGEHNAENFNSEFQG

SEQ ID NO: 189677 - protein, 35 aa, Artificial Sequence
  Description of Artificial Sequence: Synthetic polypeptide
DEMEISTTNPVATEQYGCVCSNWGEPNAFFNSDQA

SEQ ID NO: 189678 - protein, 36 aa, Artificial Sequence
  Description of Artificial Sequence: Synthetic polypeptide
DEMEISTTNPVATEQYGCVCSNWGEPNAYFGSDTQA

SEQ ID NO: 189679 - protein, 36 aa, Artificial Sequence
  Description of Artificial Sequence: Synthetic polypeptide
DEMEIATTNPVATCQYGQCVCSTGAHNAENFGSDQS

SEQ ID NO: 189680 - protein, 32 aa, Artificial Sequence
  Description of Artificial Sequence: Synthetic polypeptide
QECEICATNPCTTEIYGVVATNTNNNQNGDTD

SEQ ID NO: 189681 - protein, 36 aa, Artificial Sequence
  Description of Artificial Sequence: Synthetic polypeptide
QEEEIRTTNPVCYEPYGVVVFCDPNHSQNRAGGGND

SEQ ID NO: 189682 - protein, 32 aa, Artificial Sequence
  Description of Artificial Sequence: Synthetic polypeptide
QECEICATNPCTTEIYGVVATNNTTNQNQGDT

SEQ ID NO: 189683 - protein, 36 aa, Artificial Sequence
  Description of Artificial Sequence: Synthetic polypeptide
QEEEIRTTNPVCYEPYGTVVSCDPNHSNNRQGGGND

SEQ ID NO: 189684 - protein, 32 aa, Artificial Sequence
  Description of Artificial Sequence: Synthetic polypeptide
QECEICATNPCTTEIYGVVATNNTTNQNGDTE

SEQ ID NO: 189685 - protein, 32 aa, Artificial Sequence
  Description of Artificial Sequence: Synthetic polypeptide
QECEICATNPCTTEIYGVVATNNTNQQGTDDT

SEQ ID NO: 189686 - protein, 36 aa, Artificial Sequence
  Description of Artificial Sequence: Synthetic polypeptide
DEEEIATTNPVATEQWGHSVCPAEGPHGENTSDIDH

SEQ ID NO: 189687 - protein, 32 aa, Artificial Sequence
  Description of Artificial Sequence: Synthetic polypeptide
QECEICATNPCTTEIYGVVATNNTNQNQGDTE

SEQ ID NO: 189688 - protein, 32 aa, Artificial Sequence
  Description of Artificial Sequence: Synthetic polypeptide
QECEICATNPCTTEIYGVVATNNTNQNIGTDT

SEQ ID NO: 189689 - protein, 32 aa, Artificial Sequence
  Description of Artificial Sequence: Synthetic polypeptide
QECEICATNPCTTEIYGVVATNNTNQNGTDDT

SEQ ID NO: 189690 - protein, 36 aa, Artificial Sequence
  Description of Artificial Sequence: Synthetic polypeptide
DEMEISTTNPVATEQYGCVCSWMEDHNAEYFNSDQS

SEQ ID NO: 189691 - protein, 36 aa, Artificial Sequence
  Description of Artificial Sequence: Synthetic polypeptide
QEEEIRTTNPVAYEQYGTICACNVNSLSDNYTEENP

SEQ ID NO: 189692 - protein, 36 aa, Artificial Sequence
  Description of Artificial Sequence: Synthetic polypeptide
DEMEISTTNPVATEQYGCVCSWGEHNQENFNSDNQS

SEQ ID NO: 189693 - protein, 36 aa, Artificial Sequence
  Description of Artificial Sequence: Synthetic polypeptide
DEMEISTTNPVATEQYGCVCSSGEHNQENFNSDNQA

SEQ ID NO: 189694 - protein, 36 aa, Artificial Sequence
  Description of Artificial Sequence: Synthetic polypeptide
DEMEIATTNPVATCQYGQCVCSSGADNQNFGSDNQS

SEQ ID NO: 189695 - protein, 32 aa, Artificial Sequence
  Description of Artificial Sequence: Synthetic polypeptide
QECEICATNPCTTEIYGVVATNNATNQNGTDT

SEQ ID NO: 189696 - protein, 37 aa, Artificial Sequence
  Description of Artificial Sequence: Synthetic polypeptide
DEMEIATTNPVATEQYGCVCSTWGAHNEEHFNSETQA

SEQ ID NO: 189697 - protein, 36 aa, Artificial Sequence
  Description of Artificial Sequence: Synthetic polypeptide
DEMEISTTNPVATCQYGCVCNTGEHNQENFGSDNQS

SEQ ID NO: 189698 - protein, 39 aa, Artificial Sequence
  Description of Artificial Sequence: Synthetic polypeptide
DEMEIRTTNPVAYEQYGESMVQGPSVTLEQKERVGEPVD

SEQ ID NO: 189699 - protein, 37 aa, Artificial Sequence
  Description of Artificial Sequence: Synthetic polypeptide
DEMEIRTTNPVATEQYGSYCYATPDEDWNIMGGGEES

SEQ ID NO: 189700 - protein, 33 aa, Artificial Sequence
  Description of Artificial Sequence: Synthetic polypeptide
DEAEIATTNPVAYEQWGCAYAGNGNLGEHHGGE

SEQ ID NO: 189701 - protein, 37 aa, Artificial Sequence
  Description of Artificial Sequence: Synthetic polypeptide
DEEEIRTTNPVATEQYGTYGAINEYTLQIQMQELTEE

SEQ ID NO: 189702 - protein, 37 aa, Artificial Sequence
  Description of Artificial Sequence: Synthetic polypeptide
DEEEIRTTNPVATEQYGTYPSPMAVGLEAPELGVEGH

SEQ ID NO: 189703 - protein, 36 aa, Artificial Sequence
  Description of Artificial Sequence: Synthetic polypeptide
DEEEIRTTNPVATEQYGTYTVIEMGEEVPEGEVPEI

SEQ ID NO: 189704 - protein, 32 aa, Artificial Sequence
  Description of Artificial Sequence: Synthetic polypeptide
QECEICATNPCTTEIYGVVATNNANNQNGEDT

SEQ ID NO: 189705 - protein, 37 aa, Artificial Sequence
  Description of Artificial Sequence: Synthetic polypeptide
DEMEIRTTNPVATEQYGSYCYTTVPDEWNMEGGGEEE

SEQ ID NO: 189706 - protein, 36 aa, Artificial Sequence
  Description of Artificial Sequence: Synthetic polypeptide
DEEEIRTTNPVATEQYGVCVHPCPVNMPNVDMMFEL

SEQ ID NO: 189707 - protein, 37 aa, Artificial Sequence
  Description of Artificial Sequence: Synthetic polypeptide
DEEEIRTTNPVATEQYGVCVHPNPVSMPNFVDMFVEG

SEQ ID NO: 189708 - protein, 37 aa, Artificial Sequence
  Description of Artificial Sequence: Synthetic polypeptide
DEEEIRTTNPVATEQYGVCVHPSCVHMPNFVDMVFEG

SEQ ID NO: 189709 - protein, 37 aa, Artificial Sequence
  Description of Artificial Sequence: Synthetic polypeptide
DEEEIRTTNPVATEQYGVCVHPSPVHMPNFVDMFEDG

SEQ ID NO: 189710 - protein, 37 aa, Artificial Sequence
  Description of Artificial Sequence: Synthetic polypeptide
DEEEIATTNPVATEQWGSVSYANDTPGDEHGGIAEAE

SEQ ID NO: 189711 - protein, 38 aa, Artificial Sequence
  Description of Artificial Sequence: Synthetic polypeptide
DEEEIRTTNPVATEQYGVCVHPSPVHMPNPVDMQFIEG

SEQ ID NO: 189712 - protein, 37 aa, Artificial Sequence
  Description of Artificial Sequence: Synthetic polypeptide
DEEEIRTTNPVATEQYGVCVHPSPVHMPNVDMFFEEG

SEQ ID NO: 189713 - protein, 37 aa, Artificial Sequence
  Description of Artificial Sequence: Synthetic polypeptide
DEEEIRTTNPVATEQYGVCVHPNPVKMPNFVDMVFEG

SEQ ID NO: 189714 - protein, 37 aa, Artificial Sequence
  Description of Artificial Sequence: Synthetic polypeptide
DEAEIATTNPVAYEQWGCSCSPIPDNDQHRERNGNGS

SEQ ID NO: 189715 - protein, 34 aa, Artificial Sequence
  Description of Artificial Sequence: Synthetic polypeptide
DEAEIATTNPVAYEQWGCVAGEGPGQNAMGNSDN

SEQ ID NO: 189716 - protein, 39 aa, Artificial Sequence
  Description of Artificial Sequence: Synthetic polypeptide
DEMEIRTTNPVATEQYGTSNCSPTVNANMENIIQETNQM

SEQ ID NO: 189717 - protein, 36 aa, Artificial Sequence
  Description of Artificial Sequence: Synthetic polypeptide
DEMEIRTTNPVAYEQYGCVCQTGAHNIENFMSDNQS

SEQ ID NO: 189718 - protein, 35 aa, Artificial Sequence
  Description of Artificial Sequence: Synthetic polypeptide
DEMEIATTNPVATEGYGCVCSNWEHNEEHFGSETL

SEQ ID NO: 189719 - protein, 35 aa, Artificial Sequence
  Description of Artificial Sequence: Synthetic polypeptide
DEMEIRTTNPVAYCQYGCVCSWEHNEENFGSDTQS

SEQ ID NO: 189720 - protein, 37 aa, Artificial Sequence
  Description of Artificial Sequence: Synthetic polypeptide
CETEIATTNPVATEQYGSACSADNPLPAEAPIGDNHQ

SEQ ID NO: 189721 - protein, 38 aa, Artificial Sequence
  Description of Artificial Sequence: Synthetic polypeptide
DEEEIATTNPVATEQYGSVCAATANVGGEEHQDDSLAK

SEQ ID NO: 189722 - protein, 36 aa, Artificial Sequence
  Description of Artificial Sequence: Synthetic polypeptide
DEMEIATTNPVATEGYGCVCSTTEHNEEHFGSEDQA

SEQ ID NO: 189723 - protein, 39 aa, Artificial Sequence
  Description of Artificial Sequence: Synthetic polypeptide
DEEEIRTTNPVATEQYGTVTTNGNSNVIGTTSISTTGNT

SEQ ID NO: 189724 - protein, 39 aa, Artificial Sequence
  Description of Artificial Sequence: Synthetic polypeptide
DEEEIRTTNPVATEQYGTVTTSGNSDEIGTTSISTTGNT

SEQ ID NO: 189725 - protein, 35 aa, Artificial Sequence
  Description of Artificial Sequence: Synthetic polypeptide
CSEEIATTNPVGTEQWGGMCVNITTNITQGGGMER

SEQ ID NO: 189726 - protein, 39 aa, Artificial Sequence
  Description of Artificial Sequence: Synthetic polypeptide
DEEEIRTTNPVATEQYGTVVTVVVVQNGGTEQGTNQGTD

SEQ ID NO: 189727 - protein, 36 aa, Artificial Sequence
  Description of Artificial Sequence: Synthetic polypeptide
DEAEIATTNPVAYEQWGEVCSTPNQGNHGEAGDHRN

SEQ ID NO: 189728 - protein, 36 aa, Artificial Sequence
  Description of Artificial Sequence: Synthetic polypeptide
DEMEIRTTNPVATEQYGTTTWSATEGPVEEFKGPYI

SEQ ID NO: 189729 - protein, 36 aa, Artificial Sequence
  Description of Artificial Sequence: Synthetic polypeptide
DEMEIRTTNPVATEQYGTTTCSATEGPVEEFKGPYI

SEQ ID NO: 189730 - protein, 36 aa, Artificial Sequence
  Description of Artificial Sequence: Synthetic polypeptide
DEMEIRTTNPVATEQYGTTTCSATDGPVEEFKGPYI

SEQ ID NO: 189731 - protein, 36 aa, Artificial Sequence
  Description of Artificial Sequence: Synthetic polypeptide
DEMEIRTTNPVATEQYGTTTCSATDGPVEEFEGPYI

SEQ ID NO: 189732 - protein, 36 aa, Artificial Sequence
  Description of Artificial Sequence: Synthetic polypeptide
CETEIACTNPVATEQYGSVCATNPPMQPDNQTEGTM

SEQ ID NO: 189733 - protein, 38 aa, Artificial Sequence
  Description of Artificial Sequence: Synthetic polypeptide
QEEEIRGTNPVATEQYGSVVIPGNLNGEQGGQTEGEDT

SEQ ID NO: 189734 - protein, 35 aa, Artificial Sequence
  Description of Artificial Sequence: Synthetic polypeptide
QEECIRTTNPVATEPYGKISQTHEFSSNFVGNQFG

SEQ ID NO: 189735 - protein, 38 aa, Artificial Sequence
  Description of Artificial Sequence: Synthetic polypeptide
DAEEIATTNPVATEQYGSVCAMNNGELEPPDDQANGTA

SEQ ID NO: 189736 - protein, 36 aa, Artificial Sequence
  Description of Artificial Sequence: Synthetic polypeptide
QEEEIRTTNPVATECYGSVNNDNTFETGGGQTEQTI

SEQ ID NO: 189737 - protein, 37 aa, Artificial Sequence
  Description of Artificial Sequence: Synthetic polypeptide
DAEEIATTNPVATEQYGSVCAMNNGGTEATGDVNNTA

SEQ ID NO: 189738 - protein, 36 aa, Artificial Sequence
  Description of Artificial Sequence: Synthetic polypeptide
QEEEIRSTNPVATEFYGSVNTDNMIETDGGGQEQGQ

SEQ ID NO: 189739 - protein, 37 aa, Artificial Sequence
  Description of Artificial Sequence: Synthetic polypeptide
QEEEIRGTNPVATEQYGSVVSAIMVGGDIQGNETGDI

SEQ ID NO: 189740 - protein, 32 aa, Artificial Sequence
  Description of Artificial Sequence: Synthetic polypeptide
NEVEIATTNPVAYEQWGCVYNMDMQMNGGHAS

SEQ ID NO: 189741 - protein, 35 aa, Artificial Sequence
  Description of Artificial Sequence: Synthetic polypeptide
DENCIATVNPVATECYGSVVCIDHQEDQHRQGNEE

SEQ ID NO: 189742 - protein, 37 aa, Artificial Sequence
  Description of Artificial Sequence: Synthetic polypeptide
DAEEIATTNPVATEQYGSVCAMNNNDLNPADGSGDDP

SEQ ID NO: 189743 - protein, 34 aa, Artificial Sequence
  Description of Artificial Sequence: Synthetic polypeptide
DEMEIGTTNPVATEQYGCLCTATDGPVEFDTNEQ

SEQ ID NO: 189744 - protein, 36 aa, Artificial Sequence
  Description of Artificial Sequence: Synthetic polypeptide
QEEEIRTTNPVATEPYGKTIHQTHEFSSNRVGNQFH

SEQ ID NO: 189745 - protein, 38 aa, Artificial Sequence
  Description of Artificial Sequence: Synthetic polypeptide
DEEEIACTNPVATEQYGSVSGTGEAGGINPDDGMEKVH

SEQ ID NO: 189746 - protein, 36 aa, Artificial Sequence
  Description of Artificial Sequence: Synthetic polypeptide
QEEEIRTTNPVATECYGSVNNDNNFEEGGGQTEQGF

SEQ ID NO: 189747 - protein, 35 aa, Artificial Sequence
  Description of Artificial Sequence: Synthetic polypeptide
DENCIATVNPVATECYGTVVCIDHQDQHDRQGNER

SEQ ID NO: 189748 - protein, 36 aa, Artificial Sequence
  Description of Artificial Sequence: Synthetic polypeptide
DENCAEIATTNPVAYERWGSVWTGGNLQDPSGGGTS

SEQ ID NO: 189749 - protein, 33 aa, Artificial Sequence
  Description of Artificial Sequence: Synthetic polypeptide
DEMEIRTTNPIATECWGTVWANADGWEEPKGPI

SEQ ID NO: 189750 - protein, 37 aa, Artificial Sequence
  Description of Artificial Sequence: Synthetic polypeptide
DAEEIATTNPVATEQYGSVCAMANHADDSKAPDNPRN

SEQ ID NO: 189751 - protein, 36 aa, Artificial Sequence
  Description of Artificial Sequence: Synthetic polypeptide
DEEEIACTNPVATEQYGSVCAVNAGLIADPPAEDAH

SEQ ID NO: 189752 - protein, 37 aa, Artificial Sequence
  Description of Artificial Sequence: Synthetic polypeptide
DAEEIATTNPVATEQYGSVCAANMGEEAPDNQANGHI

SEQ ID NO: 189753 - protein, 38 aa, Artificial Sequence
  Description of Artificial Sequence: Synthetic polypeptide
DAEEIATTNPVATEQYGSVCAMNNGNLEPGADIGNDAE

SEQ ID NO: 189754 - protein, 37 aa, Artificial Sequence
  Description of Artificial Sequence: Synthetic polypeptide
DAEEIATTNPVATEQYGSVCAANMGEEAPDDQAEGEV

SEQ ID NO: 189755 - protein, 38 aa, Artificial Sequence
  Description of Artificial Sequence: Synthetic polypeptide
QEEEIRTTNPVATEFYGSVVNSTVPEGPEMGQGENEEG

SEQ ID NO: 189756 - protein, 38 aa, Artificial Sequence
  Description of Artificial Sequence: Synthetic polypeptide
QEEEIRTTNPVATECYGSVVNPTTLEGFEMGQGENEDG

SEQ ID NO: 189757 - protein, 36 aa, Artificial Sequence
  Description of Artificial Sequence: Synthetic polypeptide
QEEEIRTTNPVATECYGSVNNDNTFEEEGGGQTEIG

SEQ ID NO: 189758 - protein, 37 aa, Artificial Sequence
  Description of Artificial Sequence: Synthetic polypeptide
DAEEIATTNPVATEQYGSVCAMTNNEPTGGDPLEEGA

SEQ ID NO: 189759 - protein, 30 aa, Artificial Sequence
  Description of Artificial Sequence: Synthetic polypeptide
QEGEIACTNPVGTAGWGVSASGLQHGDDIM

SEQ ID NO: 189760 - protein, 38 aa, Artificial Sequence
  Description of Artificial Sequence: Synthetic polypeptide
DAEEIATTNPVATEQYGSVCAMNNGNLEPGAEQPNDAV

SEQ ID NO: 189761 - protein, 36 aa, Artificial Sequence
  Description of Artificial Sequence: Synthetic polypeptide
DEMEIRTTNPVATCQYGCVCQNWEHNQENFGSDTQS

SEQ ID NO: 189762 - protein, 37 aa, Artificial Sequence
  Description of Artificial Sequence: Synthetic polypeptide
QEEEIRTTNPVATECYGSVNTDNMFETGGGGQTEQGQ

SEQ ID NO: 189763 - protein, 37 aa, Artificial Sequence
  Description of Artificial Sequence: Synthetic polypeptide
QEEEIRTTNPVATECYGSVVNTDNMIETGGGQTEQGM

SEQ ID NO: 189764 - protein, 35 aa, Artificial Sequence
  Description of Artificial Sequence: Synthetic polypeptide
DEMEIRTTNPVATCQYGCVCNWEEHNQENFGSDQA

SEQ ID NO: 189765 - protein, 30 aa, Artificial Sequence
  Description of Artificial Sequence: Synthetic polypeptide
NEVEIATTNPVAYEQWGEAYYVEQGHDAEG

SEQ ID NO: 189766 - protein, 36 aa, Artificial Sequence
  Description of Artificial Sequence: Synthetic polypeptide
QEEEIRTTNPVATECYGSVVNNGNMVETGGGQTTTG

SEQ ID NO: 189767 - protein, 38 aa, Artificial Sequence
  Description of Artificial Sequence: Synthetic polypeptide
QEEEIRTTNPVATECYGSVVNPTLLEGPEMGQGENEEQ

SEQ ID NO: 189768 - protein, 37 aa, Artificial Sequence
  Description of Artificial Sequence: Synthetic polypeptide
DAEEIATTNPVATEQYGSVCALAGGLEPTRDGMGAGV

SEQ ID NO: 189769 - protein, 37 aa, Artificial Sequence
  Description of Artificial Sequence: Synthetic polypeptide
DAEEIATTNPVATEQYGSVCAMNNGGTEAGDVNNAAM

SEQ ID NO: 189770 - protein, 30 aa, Artificial Sequence
  Description of Artificial Sequence: Synthetic polypeptide
QEGEIACTNPVGTAGWGVSASMLQQHGDIQ

SEQ ID NO: 189771 - protein, 38 aa, Artificial Sequence
  Description of Artificial Sequence: Synthetic polypeptide
QEEEIRGTNPVATEQYGSVVITGNLNLEGGGQTEIEDT

SEQ ID NO: 189772 - protein, 36 aa, Artificial Sequence
  Description of Artificial Sequence: Synthetic polypeptide
DEMEIRTTNPVATCQYGCVCSWGEDLNENFGSDTQA

SEQ ID NO: 189773 - protein, 36 aa, Artificial Sequence
  Description of Artificial Sequence: Synthetic polypeptide
QEEEIRTTNPVATECYGSVVNNDNTFEEGGGQTETG

SEQ ID NO: 189774 - protein, 35 aa, Artificial Sequence
  Description of Artificial Sequence: Synthetic polypeptide
DENCIATVNPVATECYGSVVCIDHQQQERQGDNEN

SEQ ID NO: 189775 - protein, 38 aa, Artificial Sequence
  Description of Artificial Sequence: Synthetic polypeptide
DAEEIATTNPVATEQYGSVCAMNNGELTNIDDGMENNH

SEQ ID NO: 189776 - protein, 36 aa, Artificial Sequence
  Description of Artificial Sequence: Synthetic polypeptide
QEEEIRTTNPVATEQYGAVVNGFGQGGQDDDQTVGF

SEQ ID NO: 189777 - protein, 33 aa, Artificial Sequence
  Description of Artificial Sequence: Synthetic polypeptide
DEMEIRTTNPIATECYGATWAAAEDWEPKGNYD

SEQ ID NO: 189778 - protein, 34 aa, Artificial Sequence
  Description of Artificial Sequence: Synthetic polypeptide
DENCIATVNPVATECYGSVVCIDHQDQHRQGGEN

SEQ ID NO: 189779 - protein, 38 aa, Artificial Sequence
  Description of Artificial Sequence: Synthetic polypeptide
DEEEIATTNPVATEQYGSVCAMNNGEPTNPDDQGEDAM

SEQ ID NO: 189780 - protein, 36 aa, Artificial Sequence
  Description of Artificial Sequence: Synthetic polypeptide
QEEEIRTTNPVATECYGSVNNDNMFETGGGQTEDGT

SEQ ID NO: 189781 - protein, 37 aa, Artificial Sequence
  Description of Artificial Sequence: Synthetic polypeptide
DEMEICTTNPVATEQYGCACVCSAWDGTVEFEGGNDI

SEQ ID NO: 189782 - protein, 37 aa, Artificial Sequence
  Description of Artificial Sequence: Synthetic polypeptide
DAEEIATTNPVATEQYGSVCAANMGEEQPDDQANGAM

SEQ ID NO: 189783 - protein, 36 aa, Artificial Sequence
  Description of Artificial Sequence: Synthetic polypeptide
DAEEIATTNPVATEQYGSVCAMANHADDSKAPANHN

SEQ ID NO: 189784 - protein, 37 aa, Artificial Sequence
  Description of Artificial Sequence: Synthetic polypeptide
DEEEIACTNPVATEQYGSVCAMNNGMLEAPDDQANGA

SEQ ID NO: 189785 - protein, 39 aa, Artificial Sequence
  Description of Artificial Sequence: Synthetic polypeptide
QEEEIRGTNPVATEQYGSVVITGNLNLTGGGQDTEGEDG

SEQ ID NO: 189786 - protein, 36 aa, Artificial Sequence
  Description of Artificial Sequence: Synthetic polypeptide
QEEEIRSTNPVATEQYGMITVNMGMEDTNEEGGGGI

SEQ ID NO: 189787 - protein, 37 aa, Artificial Sequence
  Description of Artificial Sequence: Synthetic polypeptide
QEEEIRGTNPVATEQYGSVVNGNMPNAGEEGGQTGGQ

SEQ ID NO: 189788 - protein, 36 aa, Artificial Sequence
  Description of Artificial Sequence: Synthetic polypeptide
QEEEIRTTNPVATECYGSVNNDNMDETGGGQTEQGA

SEQ ID NO: 189789 - protein, 38 aa, Artificial Sequence
  Description of Artificial Sequence: Synthetic polypeptide
QEEEIRTTNPVATDQYGSVVNGPVNVVGINNGGQEGNG

SEQ ID NO: 189790 - protein, 36 aa, Artificial Sequence
  Description of Artificial Sequence: Synthetic polypeptide
QEEEIRTTNPVATEGYGSVVTGTDDDEFDEGGQGGI

SEQ ID NO: 189791 - protein, 38 aa, Artificial Sequence
  Description of Artificial Sequence: Synthetic polypeptide
QEEEIRTTNPVATEGYGMVNMQDTMNEQGEEITGNQGG

SEQ ID NO: 189792 - protein, 37 aa, Artificial Sequence
  Description of Artificial Sequence: Synthetic polypeptide
QEEEIRTTNPVATECYGSVNNDNMFEQGGGGQTEQGG

SEQ ID NO: 189793 - protein, 38 aa, Artificial Sequence
  Description of Artificial Sequence: Synthetic polypeptide
DEEEIACTNPVATEQYGSVCAMTNGELTNPDDLMEHRM

SEQ ID NO: 189794 - protein, 31 aa, Artificial Sequence
  Description of Artificial Sequence: Synthetic polypeptide
DENCIATTNPVAYEQWGTVSKEIEMNMKEDA

SEQ ID NO: 189795 - protein, 37 aa, Artificial Sequence
  Description of Artificial Sequence: Synthetic polypeptide
QEEEIRTTNCVATEQYGSVNGNFEDDEGGNDQENGIY

SEQ ID NO: 189796 - protein, 35 aa, Artificial Sequence
  Description of Artificial Sequence: Synthetic polypeptide
QEEEIRTTNPCAYEGYGSCACTMNELSGTGGDQVL

SEQ ID NO: 189797 - protein, 36 aa, Artificial Sequence
  Description of Artificial Sequence: Synthetic polypeptide
DAEEIATTNPVATEQYGSVCAPAGPNDNDASEGAEE

SEQ ID NO: 189798 - protein, 38 aa, Artificial Sequence
  Description of Artificial Sequence: Synthetic polypeptide
DEEEIACTNPVATEQYGSVCAMWNGEPTNPDDQMEHRM

SEQ ID NO: 189799 - protein, 36 aa, Artificial Sequence
  Description of Artificial Sequence: Synthetic polypeptide
QEEEIRTTNPVATECYGSVNNDNTFEEGGGGQQEQG

SEQ ID NO: 189800 - protein, 33 aa, Artificial Sequence
  Description of Artificial Sequence: Synthetic polypeptide
DEMEIRTTNPIATECWGTVCAAADGWAPKGNYD

SEQ ID NO: 189801 - protein, 35 aa, Artificial Sequence
  Description of Artificial Sequence: Synthetic polypeptide
DENCIATVNPVATECYGSVVCIDNDHERQGDNSEV

SEQ ID NO: 189802 - protein, 39 aa, Artificial Sequence
  Description of Artificial Sequence: Synthetic polypeptide
QEEEIRTTNPVATEGYGMVNNSGMGNNLQNNNGGFNNQV

SEQ ID NO: 189803 - protein, 38 aa, Artificial Sequence
  Description of Artificial Sequence: Synthetic polypeptide
DEEEIATTNPVATEQYGSVCAMNNGEPTNADDQGEHTM

SEQ ID NO: 189804 - protein, 36 aa, Artificial Sequence
  Description of Artificial Sequence: Synthetic polypeptide
QEEEIRTTNPVATEGYGMVNGQGTNQGEGGIEQFGD

SEQ ID NO: 189805 - protein, 38 aa, Artificial Sequence
  Description of Artificial Sequence: Synthetic polypeptide
DEEEIACTNPVATEQYGSVCAMNNGILTNPDDGMENNN

SEQ ID NO: 189806 - protein, 37 aa, Artificial Sequence
  Description of Artificial Sequence: Synthetic polypeptide
DEEEIACTNPVATEQYGSVCSPMNHDINTAGEEGQMD

SEQ ID NO: 189807 - protein, 37 aa, Artificial Sequence
  Description of Artificial Sequence: Synthetic polypeptide
QEEEIRTTNPVATEFYGVVNVGTMTNGLGEEFVENIV

SEQ ID NO: 189808 - protein, 34 aa, Artificial Sequence
  Description of Artificial Sequence: Synthetic polypeptide
DEMEIRTTNPIATECWGAVCSNTDGWVAFEGPYD

SEQ ID NO: 189809 - protein, 34 aa, Artificial Sequence
  Description of Artificial Sequence: Synthetic polypeptide
DEMEIRTTNPIATECWGAVCSNTDGPVAFEGPYD

SEQ ID NO: 189810 - protein, 38 aa, Artificial Sequence
  Description of Artificial Sequence: Synthetic polypeptide
DEEEIACTNPVATEQYGSVCAMNNGELTNPDDGAENNM

SEQ ID NO: 189811 - protein, 37 aa, Artificial Sequence
  Description of Artificial Sequence: Synthetic polypeptide
QEEEIRTTNPVATECYGSVNTFNMFETGGGGDTEQGE

SEQ ID NO: 189812 - protein, 36 aa, Artificial Sequence
  Description of Artificial Sequence: Synthetic polypeptide
QEEEIRTTNPVATEFYGVVVDQPNDQQNEEFGQAFQ

SEQ ID NO: 189813 - protein, 38 aa, Artificial Sequence
  Description of Artificial Sequence: Synthetic polypeptide
QEEEIRTTNPVATEGYGMVNMQDTMNNQEEITGGNQGQ

SEQ ID NO: 189814 - protein, 37 aa, Artificial Sequence
  Description of Artificial Sequence: Synthetic polypeptide
DAEEIATTNPVATEQYGSVCAANMGEEAPDNQAGGSD

SEQ ID NO: 189815 - protein, 37 aa, Artificial Sequence
  Description of Artificial Sequence: Synthetic polypeptide
DAEEIATTNPVATEQYGSVCAANMGEEQPDDGDGEPM

SEQ ID NO: 189816 - protein, 36 aa, Artificial Sequence
  Description of Artificial Sequence: Synthetic polypeptide
DEEEIACTNPVATEQYGSVPANTGHAGEYGAEGGSN

SEQ ID NO: 189817 - protein, 35 aa, Artificial Sequence
  Description of Artificial Sequence: Synthetic polypeptide
DENCIATVNPVATECYGSVVCIDNDHERRGHNGTE

SEQ ID NO: 189818 - protein, 37 aa, Artificial Sequence
  Description of Artificial Sequence: Synthetic polypeptide
QEEEIRTTNPVATEGYGMVNMNMTMDEQEEITGNQGG

SEQ ID NO: 189819 - protein, 33 aa, Artificial Sequence
  Description of Artificial Sequence: Synthetic polypeptide
DEMEIRTTNPIATECWGAVCSNAEGWAFEGPYD

SEQ ID NO: 189820 - protein, 34 aa, Artificial Sequence
  Description of Artificial Sequence: Synthetic polypeptide
DEMEIGTTNPVATEQYGCLCTACDGPVEFEGGEQ

SEQ ID NO: 189821 - protein, 37 aa, Artificial Sequence
  Description of Artificial Sequence: Synthetic polypeptide
QEEEIRTTNPVATEGYGSVMGFNAEMNNQEGDAGDSE

SEQ ID NO: 189822 - protein, 29 aa, Artificial Sequence
  Description of Artificial Sequence: Synthetic peptide
QEGEIACTNPVGTAGWGVSASGLQHDDDI

SEQ ID NO: 189823 - protein, 35 aa, Artificial Sequence
  Description of Artificial Sequence: Synthetic polypeptide
DENCIATVNPVATECYGSVVCIDHQDKERQGGNEN

SEQ ID NO: 189824 - protein, 30 aa, Artificial Sequence
  Description of Artificial Sequence: Synthetic polypeptide
QEGEIACTNPVGTAGWGGVSASTLGQHIDD

SEQ ID NO: 189825 - protein, 35 aa, Artificial Sequence
  Description of Artificial Sequence: Synthetic polypeptide
DEMEIGTTNPVATEQYGCLCTATDGPVEFYGNEKQ

SEQ ID NO: 189826 - protein, 36 aa, Artificial Sequence
  Description of Artificial Sequence: Synthetic polypeptide
QEEEIRTTNPVATECYGSVVNNGNMFETGGGQTEQG

SEQ ID NO: 189827 - protein, 36 aa, Artificial Sequence
  Description of Artificial Sequence: Synthetic polypeptide
DEMEIRTTNPVATCQYGCVCQSGEHNQENFGSDTQS

SEQ ID NO: 189828 - protein, 36 aa, Artificial Sequence
  Description of Artificial Sequence: Synthetic polypeptide
DEMEIGTTNPVATEQYGCVCSNWGEPNAFSGSDTQA

SEQ ID NO: 189829 - protein, 37 aa, Artificial Sequence
  Description of Artificial Sequence: Synthetic polypeptide
DEMEIRTTNPVATCQYGCVCSNWGNHNEENFGSDNQS

SEQ ID NO: 189830 - protein, 35 aa, Artificial Sequence
  Description of Artificial Sequence: Synthetic polypeptide
DEMEIRTTNPIATEQWGTVWANAEGWVAEPEGNYI

SEQ ID NO: 189831 - protein, 36 aa, Artificial Sequence
  Description of Artificial Sequence: Synthetic polypeptide
DEMEIRTTNPVATCQYGCVCNWGEHNIENFGSDNQS

SEQ ID NO: 189832 - protein, 36 aa, Artificial Sequence
  Description of Artificial Sequence: Synthetic polypeptide
QEEEIRTTNPVATEFYGAVDVGVFNGQGTGGDDDDT

SEQ ID NO: 189833 - protein, 36 aa, Artificial Sequence
  Description of Artificial Sequence: Synthetic polypeptide
DEEEIACTNPVATEQYGSVCAIEHLDAGDPLDEMAW

SEQ ID NO: 189834 - protein, 36 aa, Artificial Sequence
  Description of Artificial Sequence: Synthetic polypeptide
DEMEIGTTNPVATEQYGCLCTATDGEPVELFEGNKQ

SEQ ID NO: 189835 - protein, 38 aa, Artificial Sequence
  Description of Artificial Sequence: Synthetic polypeptide
DEEEIACTNPVATEQYGSVCAMTNPELTNPDDQAEHAM

SEQ ID NO: 189836 - protein, 37 aa, Artificial Sequence
  Description of Artificial Sequence: Synthetic polypeptide
DAEEIATTNPVATEQYGSVCAANNGPPAGAPAENAGM

SEQ ID NO: 189837 - protein, 36 aa, Artificial Sequence
  Description of Artificial Sequence: Synthetic polypeptide
DEMEIRTTNPVATCQYGCVCNTGEDHNQNFGSDTQS

SEQ ID NO: 189838 - protein, 36 aa, Artificial Sequence
  Description of Artificial Sequence: Synthetic polypeptide
QEEEIRTTNPVATEFYGAVDVGVFNGQGGGFDDDDV

SEQ ID NO: 189839 - protein, 36 aa, Artificial Sequence
  Description of Artificial Sequence: Synthetic polypeptide
NEVEDEIATTNPVAYEQWGSVCPNDHFQDGRGGDSG

SEQ ID NO: 189840 - protein, 35 aa, Artificial Sequence
  Description of Artificial Sequence: Synthetic polypeptide
DEMEIRTTNPIATEQWGTVWSNAEGWVAEPEGNYI

SEQ ID NO: 189841 - protein, 38 aa, Artificial Sequence
  Description of Artificial Sequence: Synthetic polypeptide
DEAEIRTTNPVATEQYGQCVCSNWGEHNEESFNSDTQS

SEQ ID NO: 189842 - protein, 38 aa, Artificial Sequence
  Description of Artificial Sequence: Synthetic polypeptide
SEEEIRTTNPVATEQYGCVCGNWGADHNQENFNSDNQA

SEQ ID NO: 189843 - protein, 37 aa, Artificial Sequence
  Description of Artificial Sequence: Synthetic polypeptide
QEEEIRTTNPVATECYGSVVNNGNMFETGGGQTEQGV

SEQ ID NO: 189844 - protein, 38 aa, Artificial Sequence
  Description of Artificial Sequence: Synthetic polypeptide
DEAEIRTTNPVATEQYGQCVCSNWGEHNIENFNSDTQS

SEQ ID NO: 189845 - protein, 37 aa, Artificial Sequence
  Description of Artificial Sequence: Synthetic polypeptide
CEDEIACTNPVATEQYGSCAAPGPHTPLDSGEGNDRF

SEQ ID NO: 189846 - protein, 38 aa, Artificial Sequence
  Description of Artificial Sequence: Synthetic polypeptide
CETEIACTNPVATEQYGSACSPTPDGNPLEAGEGMNQD

SEQ ID NO: 189847 - protein, 37 aa, Artificial Sequence
  Description of Artificial Sequence: Synthetic polypeptide
DEMEISTTNPVATEQYGCVCSWEEDHNQENFNSDNQA

SEQ ID NO: 189848 - protein, 34 aa, Artificial Sequence
  Description of Artificial Sequence: Synthetic polypeptide
QEGEIAPTNPCSYEQYGQVTVSCCNMNSQSGGTR

SEQ ID NO: 189849 - protein, 37 aa, Artificial Sequence
  Description of Artificial Sequence: Synthetic polypeptide
DEMEISTTNPVATEQYGCVCSNWGEPNAENFISDNQA

SEQ ID NO: 189850 - protein, 37 aa, Artificial Sequence
  Description of Artificial Sequence: Synthetic polypeptide
DEEEISTTNPVAYEQYGCVCSWGEDHNQENFGSDTQS

SEQ ID NO: 189851 - protein, 38 aa, Artificial Sequence
  Description of Artificial Sequence: Synthetic polypeptide
SEEEIRTTNPVATEQYGCSCSNWGEGHNAEYFQSDTQA

SEQ ID NO: 189852 - protein, 38 aa, Artificial Sequence
  Description of Artificial Sequence: Synthetic polypeptide
DEEEISTTNPVAYEQYGCVCSTWGEDHNAENFNSDTQS

SEQ ID NO: 189853 - protein, 37 aa, Artificial Sequence
  Description of Artificial Sequence: Synthetic polypeptide
DECEICTTNPVATTQYGVVATTQQQLQQGTEQGTVDD

SEQ ID NO: 189854 - protein, 36 aa, Artificial Sequence
  Description of Artificial Sequence: Synthetic polypeptide
CEEEISCTNPVATEQYGCVCSNWGEHNQNFNSDTQA

SEQ ID NO: 189855 - protein, 34 aa, Artificial Sequence
  Description of Artificial Sequence: Synthetic polypeptide
DESEIRTTNPIATECWGATAAENEPADRKGEPYG

SEQ ID NO: 189856 - protein, 37 aa, Artificial Sequence
  Description of Artificial Sequence: Synthetic polypeptide
DEAEISTTNPVATEQYGCVCSMWGEHNQENFNSDTQS

SEQ ID NO: 189857 - protein, 37 aa, Artificial Sequence
  Description of Artificial Sequence: Synthetic polypeptide
DEEEIRTTNPVATEQYGCTCSMWEEHNQEYIISETQS

SEQ ID NO: 189858 - protein, 38 aa, Artificial Sequence
  Description of Artificial Sequence: Synthetic polypeptide
DEAEIRTTNPVATEQYGQCVCSNWGEHNAEYFNSDTQA

SEQ ID NO: 189859 - protein, 37 aa, Artificial Sequence
  Description of Artificial Sequence: Synthetic polypeptide
QEEEIRTTNPVAYEPYRGQSVVSINEGSTSPPGAPDN

SEQ ID NO: 189860 - protein, 38 aa, Artificial Sequence
  Description of Artificial Sequence: Synthetic polypeptide
DEEEISTTNPVAYEQYGCVCSTWEEDHNAENFPSENQL

SEQ ID NO: 189861 - protein, 37 aa, Artificial Sequence
  Description of Artificial Sequence: Synthetic polypeptide
DEAEISTTNPVATEQYGCVCSMWGEHNAEYFNSENQS

SEQ ID NO: 189862 - protein, 38 aa, Artificial Sequence
  Description of Artificial Sequence: Synthetic polypeptide
DEAEIRTTNPVATEQYGQCVCSNWGEHNAENFNSDTQS

SEQ ID NO: 189863 - protein, 37 aa, Artificial Sequence
  Description of Artificial Sequence: Synthetic polypeptide
DEMEISTTNPVATEQYGCVCSNWGEPNEEFFGSDTDA

SEQ ID NO: 189864 - protein, 38 aa, Artificial Sequence
  Description of Artificial Sequence: Synthetic polypeptide
DEEEISTTNPVAYEQYGCVCSTWEEDHNQENFNSDTQA

SEQ ID NO: 189865 - protein, 36 aa, Artificial Sequence
  Description of Artificial Sequence: Synthetic polypeptide
CEEEISCTNPVATEQYGCVCSWGEHNQENFNSDNQA

SEQ ID NO: 189866 - protein, 38 aa, Artificial Sequence
  Description of Artificial Sequence: Synthetic polypeptide
DEAEIRTTNPVATEQYGQCVCSNWGEHNAENFNSEPQS

SEQ ID NO: 189867 - protein, 38 aa, Artificial Sequence
  Description of Artificial Sequence: Synthetic polypeptide
DEAEIRTTNPVATEQYGQCVCSNWGEHNIENFNSDTQG

SEQ ID NO: 189868 - protein, 39 aa, Artificial Sequence
  Description of Artificial Sequence: Synthetic polypeptide
DEEEIRTTNPVATEAYGTVTTYGESDEIGTTSISTTGNT

SEQ ID NO: 189869 - protein, 38 aa, Artificial Sequence
  Description of Artificial Sequence: Synthetic polypeptide
SEEEIRTTNPVATEGYGMVVNGQGTNQDEPGGNEQFDG

SEQ ID NO: 189870 - protein, 37 aa, Artificial Sequence
  Description of Artificial Sequence: Synthetic polypeptide
DEMEISTTNPVATEQYGCVCSWGEDHNQENFNSDNQS

SEQ ID NO: 189871 - protein, 38 aa, Artificial Sequence
  Description of Artificial Sequence: Synthetic polypeptide
DEQEIATTNPVATEQYGSACSAANPAEVADAEIGNGTA

SEQ ID NO: 189872 - protein, 32 aa, Artificial Sequence
  Description of Artificial Sequence: Synthetic polypeptide
DDSEVASTNPVSTEGYGCVATWAIQEYFGSQQ

SEQ ID NO: 189873 - protein, 38 aa, Artificial Sequence
  Description of Artificial Sequence: Synthetic polypeptide
DENEIRTTNPVATEQYGSLQQPVMYMLEVSSQDNVITT

SEQ ID NO: 189874 - protein, 37 aa, Artificial Sequence
  Description of Artificial Sequence: Synthetic polypeptide
SEEEIRTTNPVATEGYGMVNGQGTIQGEVGGNEQFGD

SEQ ID NO: 189875 - protein, 36 aa, Artificial Sequence
  Description of Artificial Sequence: Synthetic polypeptide
SEEEIRTTNPVATEGYGMVNGQGTGQGGGGDEEFGE

SEQ ID NO: 189876 - protein, 38 aa, Artificial Sequence
  Description of Artificial Sequence: Synthetic polypeptide
DENEIRTTNPVATEQYGSLLQPVMYMLEVSSQDVVIPY

SEQ ID NO: 189877 - protein, 37 aa, Artificial Sequence
  Description of Artificial Sequence: Synthetic polypeptide
SEEEIRTTNPVATEGYGMVNGQGTFNQGNGGGEEGGE

SEQ ID NO: 189878 - protein, 37 aa, Artificial Sequence
  Description of Artificial Sequence: Synthetic polypeptide
SEEEIRTTNPVATEGYGMVNGQGTEGQGEGGQEQFGE

SEQ ID NO: 189879 - protein, 37 aa, Artificial Sequence
  Description of Artificial Sequence: Synthetic polypeptide
DENEIRTTNPVATEQYGSLLQNVMYMQEVSSDVVIPN

SEQ ID NO: 189880 - protein, 37 aa, Artificial Sequence
  Description of Artificial Sequence: Synthetic polypeptide
SEEEIRTTNPVATEGYGMVNGQGTAQDENGGNEQFQD

SEQ ID NO: 189881 - protein, 36 aa, Artificial Sequence
  Description of Artificial Sequence: Synthetic polypeptide
SEEEIRTTNPVATEGYGMVNGQGINQDEGGGEQFGD

SEQ ID NO: 189882 - protein, 37 aa, Artificial Sequence
  Description of Artificial Sequence: Synthetic polypeptide
SEEEIRTTNPVATEGYGMVNGQGGNQQGEGQDEQFGE

SEQ ID NO: 189883 - protein, 36 aa, Artificial Sequence
  Description of Artificial Sequence: Synthetic polypeptide
QEEEIRTTNPVATECYGVVNNGNMFETGGGQTETGS

SEQ ID NO: 189884 - protein, 38 aa, Artificial Sequence
  Description of Artificial Sequence: Synthetic polypeptide
SEEEIRTTNPVATEGYGMVDNGQGTNQDEPGGNEQFGD

SEQ ID NO: 189885 - protein, 38 aa, Artificial Sequence
  Description of Artificial Sequence: Synthetic polypeptide
SEEEIRTTNPVATEGYGMVDNGQGTNMQEGGGGEQFFD

SEQ ID NO: 189886 - protein, 38 aa, Artificial Sequence
  Description of Artificial Sequence: Synthetic polypeptide
SEEEIRTTNPVATEGYGMVDNGQGTNDQENGGGEQAGD

SEQ ID NO: 189887 - protein, 38 aa, Artificial Sequence
  Description of Artificial Sequence: Synthetic polypeptide
SEEEIRTTNPVATEGYGMVDNGQGTNDQEGGGQEQIGD

SEQ ID NO: 189888 - protein, 39 aa, Artificial Sequence
  Description of Artificial Sequence: Synthetic polypeptide
SEEEIRTTNPVATEGYGMVDNGQGTNDDQEGLNGEQFGD

SEQ ID NO: 189889 - protein, 39 aa, Artificial Sequence
  Description of Artificial Sequence: Synthetic polypeptide
SEEEIRTTNPVATEGYGMVDNGQGTNDDQEGGGGNQGGD

SEQ ID NO: 189890 - protein, 38 aa, Artificial Sequence
  Description of Artificial Sequence: Synthetic polypeptide
SEEEIRTTNPVATEGYGMVDNGQGTDLQEGGGGEQFGD

SEQ ID NO: 189891 - protein, 38 aa, Artificial Sequence
  Description of Artificial Sequence: Synthetic polypeptide
DEEEISTTNPVAYEQYGQCVCSMWEEHNAENFGSDNQA

SEQ ID NO: 189892 - protein, 36 aa, Artificial Sequence
  Description of Artificial Sequence: Synthetic polypeptide
SEEEIRTTNPVATEGYGCVCSNWMEHNANFNSDTQS

SEQ ID NO: 189893 - protein, 37 aa, Artificial Sequence
  Description of Artificial Sequence: Synthetic polypeptide
SEEEIRTTNPVATEGYGCVCSNWGEHNDENFNSDTQS

SEQ ID NO: 189894 - protein, 37 aa, Artificial Sequence
  Description of Artificial Sequence: Synthetic polypeptide
DEAEIRTTNPVATEQYGQCVCGNWGEHNIENFGSDQA

SEQ ID NO: 189895 - protein, 37 aa, Artificial Sequence
  Description of Artificial Sequence: Synthetic polypeptide
DAEEIATTNPVATEQYGSVCPWPTPGPDDSGDGMGMN

SEQ ID NO: 189896 - protein, 37 aa, Artificial Sequence
  Description of Artificial Sequence: Synthetic polypeptide
DENEIRTTNPVATEQYGSILQPLMYMLEVSSMDVNTY

SEQ ID NO: 189897 - protein, 37 aa, Artificial Sequence
  Description of Artificial Sequence: Synthetic polypeptide
DENEIRTTNPVATEQYGSHGPYQPDEENQTPSMEERW

SEQ ID NO: 189898 - protein, 37 aa, Artificial Sequence
  Description of Artificial Sequence: Synthetic polypeptide
SEEEIRTTNPVATEGYGMVNGQGTNQGEFGQDEQFGE

SEQ ID NO: 189899 - protein, 38 aa, Artificial Sequence
  Description of Artificial Sequence: Synthetic polypeptide
DENEIRTTNPVATEQYGSLQQPVMYMLEVSSQDVVIEQ

SEQ ID NO: 189900 - protein, 38 aa, Artificial Sequence
  Description of Artificial Sequence: Synthetic polypeptide
DNSEIRTTNPVATEQYGQCLSWHSEQDLDEPQEPLNGD

SEQ ID NO: 189901 - protein, 38 aa, Artificial Sequence
  Description of Artificial Sequence: Synthetic polypeptide
DNSEIRTTNPVATEQYGCLSWHSEYVVLDENQIALNGD

SEQ ID NO: 189902 - protein, 37 aa, Artificial Sequence
  Description of Artificial Sequence: Synthetic polypeptide
VEEEIRTTNPVATEFYGAVVTTTDGNGNDLEDEDEQI

SEQ ID NO: 189903 - protein, 36 aa, Artificial Sequence
  Description of Artificial Sequence: Synthetic polypeptide
DEEEISTTNPVAYEQYGCVCSWGEHNEENFISETQP

SEQ ID NO: 189904 - protein, 37 aa, Artificial Sequence
  Description of Artificial Sequence: Synthetic polypeptide
DAEEIATTNPVATEQYGSVCGPVDNNHNIDAMGEGMG

SEQ ID NO: 189905 - protein, 36 aa, Artificial Sequence
  Description of Artificial Sequence: Synthetic polypeptide
DEDEIRTTNPVAYEQYGCVAISNNDTATAHIDDQAM

SEQ ID NO: 189906 - protein, 38 aa, Artificial Sequence
  Description of Artificial Sequence: Synthetic polypeptide
DEAEIRTTNPVATEQYGQCVCSNSGEHNQENFNSDNQL

SEQ ID NO: 189907 - protein, 38 aa, Artificial Sequence
  Description of Artificial Sequence: Synthetic polypeptide
DEAEIRTTNPVATEQYGQCVCSNSGEHNAENFNSDTQS

SEQ ID NO: 189908 - protein, 38 aa, Artificial Sequence
  Description of Artificial Sequence: Synthetic polypeptide
DEAEIRTTNPVATEQYGQCVCSMWGEHNQENFNSDTQA

SEQ ID NO: 189909 - protein, 37 aa, Artificial Sequence
  Description of Artificial Sequence: Synthetic polypeptide
DEEEISTTNPVAYEQYGCVCSWMEDHNQENFNSETQS

SEQ ID NO: 189910 - protein, 37 aa, Artificial Sequence
  Description of Artificial Sequence: Synthetic polypeptide
DEMEISTTNPVATEQYGQCICSNWGETNQENFGSDQS

SEQ ID NO: 189911 - protein, 36 aa, Artificial Sequence
  Description of Artificial Sequence: Synthetic polypeptide
DEAEIRTTNPVATEQYGQCVCQWMAHIENFMSDTQA

SEQ ID NO: 189912 - protein, 38 aa, Artificial Sequence
  Description of Artificial Sequence: Synthetic polypeptide
DENEIRTTNPVATEQYGSSCAVTWPINPEDSNFVHEGG

SEQ ID NO: 189913 - protein, 36 aa, Artificial Sequence
  Description of Artificial Sequence: Synthetic polypeptide
DNNEIRTTNPVATEQYGSCCMYEIVTHTYPETQIVG

SEQ ID NO: 189914 - protein, 38 aa, Artificial Sequence
  Description of Artificial Sequence: Synthetic polypeptide
DENEIRTTNPVATEQYGSSCAVTWPINIEDQDFVHEGG

SEQ ID NO: 189915 - protein, 37 aa, Artificial Sequence
  Description of Artificial Sequence: Synthetic polypeptide
DENEIRTTNPVATEQYGSVCPYQDDEEDFTPSIEERP

SEQ ID NO: 189916 - protein, 37 aa, Artificial Sequence
  Description of Artificial Sequence: Synthetic polypeptide
DENEIRTTNPVATEQYGSSCAVTWPINEDDTFVHEGG

SEQ ID NO: 189917 - protein, 37 aa, Artificial Sequence
  Description of Artificial Sequence: Synthetic polypeptide
DEEEIRTTNPCATEQYGSACAAANHADATAHLDEMAD

SEQ ID NO: 189918 - protein, 38 aa, Artificial Sequence
  Description of Artificial Sequence: Synthetic polypeptide
DENEIRTTNPVATEQYGSQLQPVMYMLEVSSQDVVDTY

SEQ ID NO: 189919 - protein, 38 aa, Artificial Sequence
  Description of Artificial Sequence: Synthetic polypeptide
DNEEIRTTNPVATEQWGYAVTSAVPLELVAIVGSTERG

SEQ ID NO: 189920 - protein, 37 aa, Artificial Sequence
  Description of Artificial Sequence: Synthetic polypeptide
SEEEIRTTNPVATEGYGMVVNGQGTFQGEQGNEQFGD

SEQ ID NO: 189921 - protein, 37 aa, Artificial Sequence
  Description of Artificial Sequence: Synthetic polypeptide
SEEEIRTTNPVATEGYGMVVNGQGTFQGEGGNTQFGS

SEQ ID NO: 189922 - protein, 36 aa, Artificial Sequence
  Description of Artificial Sequence: Synthetic polypeptide
DENEIRTTNPVATEQYGSNPYQTDEEDIPPSEEEVP

SEQ ID NO: 189923 - protein, 37 aa, Artificial Sequence
  Description of Artificial Sequence: Synthetic polypeptide
SEEEIRTTNPVATEGYGMVNTGQGTNQGEGQDEQFGE

SEQ ID NO: 189924 - protein, 39 aa, Artificial Sequence
  Description of Artificial Sequence: Synthetic polypeptide
SEEEIRTTNPVATEGYGMVNNVGMGNVLQENNGGQDNPT

SEQ ID NO: 189925 - protein, 36 aa, Artificial Sequence
  Description of Artificial Sequence: Synthetic polypeptide
CEDEIACTNPVATEQYGSVCAAGPLGFAVMGDNSGM

SEQ ID NO: 189926 - protein, 37 aa, Artificial Sequence
  Description of Artificial Sequence: Synthetic polypeptide
SEEEIRTTNPVATEGYGMVNNMQGTFQGEGGNEQFGE

SEQ ID NO: 189927 - protein, 38 aa, Artificial Sequence
  Description of Artificial Sequence: Synthetic polypeptide
SEEEIRTTNPVATEGYGMVNNGQGTNQGEIGGNEQFGD

SEQ ID NO: 189928 - protein, 38 aa, Artificial Sequence
  Description of Artificial Sequence: Synthetic polypeptide
DENEIRTTNPVATEQYGSLQYPVMYMSEVSSQDVVITY

SEQ ID NO: 189929 - protein, 37 aa, Artificial Sequence
  Description of Artificial Sequence: Synthetic polypeptide
SEEEIRTTNPVATEGYGMVNGQGTTDQGEGGQEQFGD

SEQ ID NO: 189930 - protein, 37 aa, Artificial Sequence
  Description of Artificial Sequence: Synthetic polypeptide
DENEIRTTNPVATEQYGSSCAVQWPINIEDTFVHEGG

SEQ ID NO: 189931 - protein, 38 aa, Artificial Sequence
  Description of Artificial Sequence: Synthetic polypeptide
DEAEIRTTNPVATEQYGQCVCSNWGEHNQEHFNSENQA

SEQ ID NO: 189932 - protein, 37 aa, Artificial Sequence
  Description of Artificial Sequence: Synthetic polypeptide
DEEEISTTNPVAYEQYGCVCSNWGEHNQENFNSEFQA

SEQ ID NO: 189933 - protein, 38 aa, Artificial Sequence
  Description of Artificial Sequence: Synthetic polypeptide
DEAEIRTTNPVATEQYGQCVCSNWGEHNQENFGSETQG

SEQ ID NO: 189934 - protein, 37 aa, Artificial Sequence
  Description of Artificial Sequence: Synthetic polypeptide
DEEEISTTNPVAYEQYGCVCSDWGEHEQENFNSDTQS

SEQ ID NO: 189935 - protein, 37 aa, Artificial Sequence
  Description of Artificial Sequence: Synthetic polypeptide
DEMEIRTTNPVATCQYGCVCNNTGEHNQENFGSDTQS

SEQ ID NO: 189936 - protein, 38 aa, Artificial Sequence
  Description of Artificial Sequence: Synthetic polypeptide
DEEEIATTNPVAYEQYGSCATANGNGLTMNEGGEHADQ

SEQ ID NO: 189937 - protein, 37 aa, Artificial Sequence
  Description of Artificial Sequence: Synthetic polypeptide
DEAEIRTTNPVATEQYGSIPRYPPLEENQDHQSEEMP

SEQ ID NO: 189938 - protein, 37 aa, Artificial Sequence
  Description of Artificial Sequence: Synthetic polypeptide
DEEEISTTNPVAYEQYGCVCSMWGEHNQENFGSDTQA

SEQ ID NO: 189939 - protein, 37 aa, Artificial Sequence
  Description of Artificial Sequence: Synthetic polypeptide
DEEEISTTNPVAYEQYGCVCSNSGEHNAENFGSDTQS

SEQ ID NO: 189940 - protein, 37 aa, Artificial Sequence
  Description of Artificial Sequence: Synthetic polypeptide
DEEEISTTNPVAYEQYGCVCSNSGEHNAENFNSDPQS

SEQ ID NO: 189941 - protein, 37 aa, Artificial Sequence
  Description of Artificial Sequence: Synthetic polypeptide
DEEEIATTNPVATEQWGSVAKAGFPLPLDSMIENMGE

SEQ ID NO: 189942 - protein, 37 aa, Artificial Sequence
  Description of Artificial Sequence: Synthetic polypeptide
DEEEISTTNPVAYEQYGCVCSNSGPHNQEFFNSDTQA

SEQ ID NO: 189943 - protein, 38 aa, Artificial Sequence
  Description of Artificial Sequence: Synthetic polypeptide
DEAEIRTTNPVATEQYGSHISWDIFTLDETGGEMEMDN

SEQ ID NO: 189944 - protein, 39 aa, Artificial Sequence
  Description of Artificial Sequence: Synthetic polypeptide
SEEEIRTTNPVATEQYGSNIVTWSVNDEEINNEPEINEV

SEQ ID NO: 189945 - protein, 37 aa, Artificial Sequence
  Description of Artificial Sequence: Synthetic polypeptide
DEAEIRTTNPVATEQYGSHACPPDEHDEQPEVENDTG

SEQ ID NO: 189946 - protein, 34 aa, Artificial Sequence
  Description of Artificial Sequence: Synthetic polypeptide
DEHEISTTNPVAYECWGTVYWINENQDRDMMTDG

SEQ ID NO: 189947 - protein, 37 aa, Artificial Sequence
  Description of Artificial Sequence: Synthetic polypeptide
DEMEISTTNPVATEQYGCSCSNWGEPNAEFFGSDTQA

SEQ ID NO: 189948 - protein, 33 aa, Artificial Sequence
  Description of Artificial Sequence: Synthetic polypeptide
DESEIRTTNPIATECWGATSNAIDWAEPEGPYI

SEQ ID NO: 189949 - protein, 36 aa, Artificial Sequence
  Description of Artificial Sequence: Synthetic polypeptide
CEEEIRTTNPVAYEPYGISSSNTVNPWHPDVIKDTA

SEQ ID NO: 189950 - protein, 36 aa, Artificial Sequence
  Description of Artificial Sequence: Synthetic polypeptide
DEYPIATTNPVAYTEAYGCVQVLGNETSQREGGDQA

SEQ ID NO: 189951 - protein, 37 aa, Artificial Sequence
  Description of Artificial Sequence: Synthetic polypeptide
CEEEIRTTNPVAYEQYGQCVCSNWGEHNIENFGSDQS

SEQ ID NO: 189952 - protein, 38 aa, Artificial Sequence
  Description of Artificial Sequence: Synthetic polypeptide
SEEEIRTTNPVATEQYGQCVCGNWGADHNQNFGSDTQS

SEQ ID NO: 189953 - protein, 37 aa, Artificial Sequence
  Description of Artificial Sequence: Synthetic polypeptide
CEEEIRTTNPVAYEQYGQCVCSNWGEHNANFNSDNQS

SEQ ID NO: 189954 - protein, 38 aa, Artificial Sequence
  Description of Artificial Sequence: Synthetic polypeptide
SEEEIRTTNPVATEQYGQCVCSNSGEHNAENFNSDTQS

SEQ ID NO: 189955 - protein, 38 aa, Artificial Sequence
  Description of Artificial Sequence: Synthetic polypeptide
SEEEIRTTNPVATEQYGQCVCSNWGEHNAENFNSDNQA

SEQ ID NO: 189956 - protein, 38 aa, Artificial Sequence
  Description of Artificial Sequence: Synthetic polypeptide
SEEEIRTTNPVATEQYGQCVCSNWGEHNIENFNSDNQS

SEQ ID NO: 189957 - protein, 37 aa, Artificial Sequence
  Description of Artificial Sequence: Synthetic polypeptide
AEDEICATNPVATEQYGVVATVNGNNQQAGNGNGEDD

SEQ ID NO: 189958 - protein, 37 aa, Artificial Sequence
  Description of Artificial Sequence: Synthetic polypeptide
SEEEIRTTNPVATEQYGQCVCSWGEDDAENFNSDTQS

SEQ ID NO: 189959 - protein, 37 aa, Artificial Sequence
  Description of Artificial Sequence: Synthetic polypeptide
DEEEISTTNPVAYEQYGCVCSNWGAHNQENFNSDFQS

SEQ ID NO: 189960 - protein, 37 aa, Artificial Sequence
  Description of Artificial Sequence: Synthetic polypeptide
DEAEIRTTNPVATEQYGSFYNWETEQKDESSMTENVH

SEQ ID NO: 189961 - protein, 36 aa, Artificial Sequence
  Description of Artificial Sequence: Synthetic polypeptide
DEMEISTTNPVATEQYGCVCQWGAHNIENFQSDTQS

SEQ ID NO: 189962 - protein, 37 aa, Artificial Sequence
  Description of Artificial Sequence: Synthetic polypeptide
DEMEIRTTNPVATCQYGCVCGWGEDHNQEYFGSDNQA

SEQ ID NO: 189963 - protein, 37 aa, Artificial Sequence
  Description of Artificial Sequence: Synthetic polypeptide
DEEEISTTNPVAYEQYGCVCSNWEEHNAENFNSDNQS

SEQ ID NO: 189964 - protein, 38 aa, Artificial Sequence
  Description of Artificial Sequence: Synthetic polypeptide
DEEEISTTNPVAYEQYGCVCSNWEEDTNAENFNSDTQS

SEQ ID NO: 189965 - protein, 38 aa, Artificial Sequence
  Description of Artificial Sequence: Synthetic polypeptide
CEEEIRTTNPVAYEQYGQCVCSNWEEHNAENFGSDNQE

SEQ ID NO: 189966 - protein, 38 aa, Artificial Sequence
  Description of Artificial Sequence: Synthetic polypeptide
SEEEIRTTNPVATEQYGMVSVENGMGDGGQGQEAEIGE

SEQ ID NO: 189967 - protein, 37 aa, Artificial Sequence
  Description of Artificial Sequence: Synthetic polypeptide
DEEEIATTNPVAYEQYGSACSVAPHLNNEAPNGEAPN

SEQ ID NO: 189968 - protein, 35 aa, Artificial Sequence
  Description of Artificial Sequence: Synthetic polypeptide
DEEEISTTNPVAYEQYGCVCGWGEHNAYFDSDTQS

SEQ ID NO: 189969 - protein, 37 aa, Artificial Sequence
  Description of Artificial Sequence: Synthetic polypeptide
DEYEIGTTNPVATEFYGSVTATGDQGVEDDEGGEDGD

SEQ ID NO: 189970 - protein, 37 aa, Artificial Sequence
  Description of Artificial Sequence: Synthetic polypeptide
DEYEIGTTNPVATEFYGSVTTTGDQGIETQEGGEDGD

SEQ ID NO: 189971 - protein, 38 aa, Artificial Sequence
  Description of Artificial Sequence: Synthetic polypeptide
DEAEIRTTNPVATEQYGSLIWSYPAPEINDLEINMDQE

SEQ ID NO: 189972 - protein, 38 aa, Artificial Sequence
  Description of Artificial Sequence: Synthetic polypeptide
AEDEICATNPVATEQYGVVATVVNNNNLLQLNGNGEDD

SEQ ID NO: 189973 - protein, 38 aa, Artificial Sequence
  Description of Artificial Sequence: Synthetic polypeptide
AEDEICATNPVATEQYGVVATVVNNNLNQQLNGNGEDD

SEQ ID NO: 189974 - protein, 37 aa, Artificial Sequence
  Description of Artificial Sequence: Synthetic polypeptide
DEEEIATTNPVAYEQYGSACSPAGPHLNEAPGGEAEE

SEQ ID NO: 189975 - protein, 38 aa, Artificial Sequence
  Description of Artificial Sequence: Synthetic polypeptide
DEAEIRTTNPVATEQYGSLIWGYTAMINDLEINMDQQE

SEQ ID NO: 189976 - protein, 33 aa, Artificial Sequence
  Description of Artificial Sequence: Synthetic polypeptide
DESEIRTTNPIATECWGATTWANADWAEPGPYI

SEQ ID NO: 189977 - protein, 37 aa, Artificial Sequence
  Description of Artificial Sequence: Synthetic polypeptide
DEAEIRTTNPVATEQYGSLIWFYPAPINDTEINMDQE

SEQ ID NO: 189978 - protein, 34 aa, Artificial Sequence
  Description of Artificial Sequence: Synthetic polypeptide
DESEIRTTNPIATECWGATTANCIDWAEPKGNYG

SEQ ID NO: 189979 - protein, 38 aa, Artificial Sequence
  Description of Artificial Sequence: Synthetic polypeptide
DEEEIRTTNPCATEQYGSVPSVWSGGEVAIFPINEPQN

SEQ ID NO: 189980 - protein, 34 aa, Artificial Sequence
  Description of Artificial Sequence: Synthetic polypeptide
DESEIRTTNPIATECWGATTANCIDWADPKGNYG

SEQ ID NO: 189981 - protein, 34 aa, Artificial Sequence
  Description of Artificial Sequence: Synthetic polypeptide
DESEIRTTNPIATECWGATTANCIDWADPEGNYG

SEQ ID NO: 189982 - protein, 38 aa, Artificial Sequence
  Description of Artificial Sequence: Synthetic polypeptide
DEEEIATTNPVAYEQYGSACSVANPHLNNEAPMGEAEN

SEQ ID NO: 189983 - protein, 38 aa, Artificial Sequence
  Description of Artificial Sequence: Synthetic polypeptide
CEEEIRTTNPVATEQYGSVYMDLDPNLEAVSEVAMWED

SEQ ID NO: 189984 - protein, 34 aa, Artificial Sequence
  Description of Artificial Sequence: Synthetic polypeptide
DESEIRTTNPIATECWGATTANAIDWAEPKGNYG

SEQ ID NO: 189985 - protein, 34 aa, Artificial Sequence
  Description of Artificial Sequence: Synthetic polypeptide
DESEIRTTNPIATECWGATTANAEDWAEPKGNYG

SEQ ID NO: 189986 - protein, 36 aa, Artificial Sequence
  Description of Artificial Sequence: Synthetic polypeptide
DEEEISTTNPVAYEQYGCVCGNWMEHNQYFDSDTQS

SEQ ID NO: 189987 - protein, 37 aa, Artificial Sequence
  Description of Artificial Sequence: Synthetic polypeptide
DEEEIATTNPVAYEQYGSACSVAPHLNNEAPIGEAMK

SEQ ID NO: 189988 - protein, 37 aa, Artificial Sequence
  Description of Artificial Sequence: Synthetic polypeptide
DEEEISTTNPVAYEQYGCSCSMWEEHNQEYIGSDTQS

SEQ ID NO: 189989 - protein, 37 aa, Artificial Sequence
  Description of Artificial Sequence: Synthetic polypeptide
DEEEISTTNPVAYEQYGCQVCSNWGEHNQNFNSDNQE

SEQ ID NO: 189990 - protein, 38 aa, Artificial Sequence
  Description of Artificial Sequence: Synthetic polypeptide
DEAEIRTTNPVATEQYGSIPWTPPLEENQDHSQSEAPP

SEQ ID NO: 189991 - protein, 38 aa, Artificial Sequence
  Description of Artificial Sequence: Synthetic polypeptide
DEEEISTTNPVAYEQWGSVSGGPPGNGGNMRNMEGQSD

SEQ ID NO: 189992 - protein, 37 aa, Artificial Sequence
  Description of Artificial Sequence: Synthetic polypeptide
DEEEISTTNPVAYEQYGCVCPNWGEHEQENFISDNQN

SEQ ID NO: 189993 - protein, 38 aa, Artificial Sequence
  Description of Artificial Sequence: Synthetic polypeptide
CEEEIRTTNPVATEQYGVVSILIGTGDEDEEDEGGDGF

SEQ ID NO: 189994 - protein, 38 aa, Artificial Sequence
  Description of Artificial Sequence: Synthetic polypeptide
CEEEIRTTNPVATEQYGVVSILIADGDEDGQGEGGDGF

SEQ ID NO: 189995 - protein, 37 aa, Artificial Sequence
  Description of Artificial Sequence: Synthetic polypeptide
DEEEIATTNPVAYEQYGSACSVAPHENNEAPIGEAVN

SEQ ID NO: 189996 - protein, 39 aa, Artificial Sequence
  Description of Artificial Sequence: Synthetic polypeptide
CEEEIRTTNPVATEQYGVTVQSKESAEHQPDRLLEFENG

SEQ ID NO: 189997 - protein, 38 aa, Artificial Sequence
  Description of Artificial Sequence: Synthetic polypeptide
QEEEIRTTNPVATESYGSVYNPTTPIGPEMGQGENEET

SEQ ID NO: 189998 - protein, 37 aa, Artificial Sequence
  Description of Artificial Sequence: Synthetic polypeptide
AEDEICATNPVATEQYGVVATVNNNQLQQLNGIGTDQ

SEQ ID NO: 189999 - protein, 37 aa, Artificial Sequence
  Description of Artificial Sequence: Synthetic polypeptide
CEEEIRTTNPVATEQYGTTAYLTPLCDEQQALVVLEV

SEQ ID NO: 190000 - protein, 34 aa, Artificial Sequence
  Description of Artificial Sequence: Synthetic polypeptide
DESEIRTTNPIATECWGATTAAENWPADPEGNYI

SEQ ID NO: 190001 - protein, 38 aa, Artificial Sequence
  Description of Artificial Sequence: Synthetic polypeptide
SEEEIRTTNPVATEQYGCVCSDWGEDDNQENFNSDTQA

SEQ ID NO: 190002 - protein, 37 aa, Artificial Sequence
  Description of Artificial Sequence: Synthetic polypeptide
SEEEIRTTNPVATEQYGMVSVEMGMGDGGQGQEAEGT

SEQ ID NO: 190003 - protein, 37 aa, Artificial Sequence
  Description of Artificial Sequence: Synthetic polypeptide
SEEEIRTTNPVATEQYGMVSVEGMGDGGQGEEMETGE

SEQ ID NO: 190004 - protein, 37 aa, Artificial Sequence
  Description of Artificial Sequence: Synthetic polypeptide
DEEEISTTNPVAYEQYGCVCSNWGEHNQENFGSDTQA

SEQ ID NO: 190005 - protein, 40 aa, Artificial Sequence
  Description of Artificial Sequence: Synthetic polypeptide
DEEEIRTTNPVATEQYGDSYAISPLATPLDVVSPMQPEPN

SEQ ID NO: 190006 - protein, 37 aa, Artificial Sequence
  Description of Artificial Sequence: Synthetic polypeptide
DEEEISTTNPVAYEQYGCVCSNWGEHNQENFGSDTQS

SEQ ID NO: 190007 - protein, 37 aa, Artificial Sequence
  Description of Artificial Sequence: Synthetic polypeptide
DEEEISTTNPVAYEQYGCVCSNWGEHNQENFISDNQA

SEQ ID NO: 190008 - protein, 37 aa, Artificial Sequence
  Description of Artificial Sequence: Synthetic polypeptide
DEEEISTTNPVAYEQYGCVCSNWGEHNQENFNSDNQA

SEQ ID NO: 190009 - protein, 39 aa, Artificial Sequence
  Description of Artificial Sequence: Synthetic polypeptide
DEEEIATTNPVAYEQYGSTVCAVTEAGGAQASGNDEMAN

SEQ ID NO: 190010 - protein, 38 aa, Artificial Sequence
  Description of Artificial Sequence: Synthetic polypeptide
DEEEIATTNPVAYEQYGSTVCAVTEAGGAQASGSEGAM

SEQ ID NO: 190011 - protein, 39 aa, Artificial Sequence
  Description of Artificial Sequence: Synthetic polypeptide
DEEEIATTNPVAYEQYGSTVCAVTEAGGAQATGGDNSDM

SEQ ID NO: 190012 - protein, 37 aa, Artificial Sequence
  Description of Artificial Sequence: Synthetic polypeptide
DEEEISTTNPVAYEQYGCVCSNWGEHNQENFNSDNQS

SEQ ID NO: 190013 - protein, 38 aa, Artificial Sequence
  Description of Artificial Sequence: Synthetic polypeptide
DENEIRTTNPVATEQYGSVGYLAIEEEQQENTEEDPDM

SEQ ID NO: 190014 - protein, 37 aa, Artificial Sequence
  Description of Artificial Sequence: Synthetic polypeptide
DEEEISTTNPVAYEQYGCVCSNWGEHNQENFNSDTQS

SEQ ID NO: 190015 - protein, 39 aa, Artificial Sequence
  Description of Artificial Sequence: Synthetic polypeptide
DEEEIATTNPVAYEQYGSTVCAVTEAGGATARGGDNSGM

SEQ ID NO: 190016 - protein, 37 aa, Artificial Sequence
  Description of Artificial Sequence: Synthetic polypeptide
DEEEISTTNPVAYEQYGCVCSNWGEHNQESFNSDNQA

SEQ ID NO: 190017 - protein, 38 aa, Artificial Sequence
  Description of Artificial Sequence: Synthetic polypeptide
DEEEIATTNPVAYEQYGSTVCAVTEAGGATASGGDNMM

SEQ ID NO: 190018 - protein, 37 aa, Artificial Sequence
  Description of Artificial Sequence: Synthetic polypeptide
DEEEISTTNPVAYEQYGCVCSNWGEHNTENFGSETQA

SEQ ID NO: 190019 - protein, 38 aa, Artificial Sequence
  Description of Artificial Sequence: Synthetic polypeptide
DEAEIRTTNPVATEQYGQSCHINLGTLWDEDISQNDDM

SEQ ID NO: 190020 - protein, 37 aa, Artificial Sequence
  Description of Artificial Sequence: Synthetic polypeptide
DEAEIRTTNPVATEQYGQQSWCELMLNEMLEETQQHP

SEQ ID NO: 190021 - protein, 38 aa, Artificial Sequence
  Description of Artificial Sequence: Synthetic polypeptide
SEEEIRTTNPVATEQYGCVCSMWGEDHNQENFNSDNQS

SEQ ID NO: 190022 - protein, 38 aa, Artificial Sequence
  Description of Artificial Sequence: Synthetic polypeptide
SEEEIRTTNPVATEQYGCVCSNWGEDHEQENFGSETQA

SEQ ID NO: 190023 - protein, 38 aa, Artificial Sequence
  Description of Artificial Sequence: Synthetic polypeptide
SEEEIRTTNPVATEQYGCVCSNWGEDHNAENFNSDTQS

SEQ ID NO: 190024 - protein, 37 aa, Artificial Sequence
  Description of Artificial Sequence: Synthetic polypeptide
DEEEISTTNPVAYEQYGCVCSSGEDHNQENFNSDTQS

SEQ ID NO: 190025 - protein, 38 aa, Artificial Sequence
  Description of Artificial Sequence: Synthetic polypeptide
DEAEIRTTNPVATEQYGQCVCSWGEDDNAENFNSQTQA

SEQ ID NO: 190026 - protein, 37 aa, Artificial Sequence
  Description of Artificial Sequence: Synthetic polypeptide
DEMEISTTNPVATEQYGCVCSNWGEPNAEHFNSDTQA

SEQ ID NO: 190027 - protein, 37 aa, Artificial Sequence
  Description of Artificial Sequence: Synthetic polypeptide
DEEEISTTNPVAYEQYGCVCSNWGEHNQEFFGSDTQA

SEQ ID NO: 190028 - protein, 37 aa, Artificial Sequence
  Description of Artificial Sequence: Synthetic polypeptide
DEAEIRTTNPVATEQYGQCVCSWGEDHNQNFPSDTQS

SEQ ID NO: 190029 - protein, 36 aa, Artificial Sequence
  Description of Artificial Sequence: Synthetic polypeptide
DEMEISTTNPVATEQYGCVCSNWGEPNAEFFISDQS

SEQ ID NO: 190030 - protein, 33 aa, Artificial Sequence
  Description of Artificial Sequence: Synthetic polypeptide
DESEIRTTNPIATECWGATANCIDWADPEGNYG

SEQ ID NO: 190031 - protein, 38 aa, Artificial Sequence
  Description of Artificial Sequence: Synthetic polypeptide
DEDEIATTNPVAYEQYGSACAATNPAEEAGRHGDNDTP

SEQ ID NO: 190032 - protein, 37 aa, Artificial Sequence
  Description of Artificial Sequence: Synthetic polypeptide
DMGEIRTTNPVATEQYGSCSVTAQVEHCDEELFEEHN

SEQ ID NO: 190033 - protein, 37 aa, Artificial Sequence
  Description of Artificial Sequence: Synthetic polypeptide
DMGEIRTTNPVATEQYGSCSNTAVEHCDEEVLFEEHV

SEQ ID NO: 190034 - protein, 37 aa, Artificial Sequence
  Description of Artificial Sequence: Synthetic polypeptide
DEMEISTTNPVATEQYGCVCSNWGEHNQENFNSENQS

SEQ ID NO: 190035 - protein, 37 aa, Artificial Sequence
  Description of Artificial Sequence: Synthetic polypeptide
DEEEIATTNPVATEQWGSTTAGNGGLPAEAENQNSDD

SEQ ID NO: 190036 - protein, 37 aa, Artificial Sequence
  Description of Artificial Sequence: Synthetic polypeptide
SEEEIRTTNPVATEQYGMVSVEGMGDGGQGQEQEEGT

SEQ ID NO: 190037 - protein, 38 aa, Artificial Sequence
  Description of Artificial Sequence: Synthetic polypeptide
DEEEIRTTNPVATEQYGDFACYPTYGTSVVIHGQENDE

SEQ ID NO: 190038 - protein, 37 aa, Artificial Sequence
  Description of Artificial Sequence: Synthetic polypeptide
DEEEISTTNPVAYEQYGCVCSNWGEHNAENFNSDTQD

SEQ ID NO: 190039 - protein, 38 aa, Artificial Sequence
  Description of Artificial Sequence: Synthetic polypeptide
CEEEIRTTNPVAYEQYGQCVCSNWGEHNQEGFGSDNQA

SEQ ID NO: 190040 - protein, 37 aa, Artificial Sequence
  Description of Artificial Sequence: Synthetic polypeptide
CEEEIRTTNPVAYEQYGQCVCSTGEHEQENFISDTQS

SEQ ID NO: 190041 - protein, 34 aa, Artificial Sequence
  Description of Artificial Sequence: Synthetic polypeptide
DESEIRTTNPIATECWGATSNAIDEAERKGEPYI

SEQ ID NO: 190042 - protein, 38 aa, Artificial Sequence
  Description of Artificial Sequence: Synthetic polypeptide
SEEEIRTTNPVATEQYGHIGNNVPLEQTDNHSGIEHPE

SEQ ID NO: 190043 - protein, 32 aa, Artificial Sequence
  Description of Artificial Sequence: Synthetic polypeptide
DDSEVASTNPVSTEGYGCVAMWTIQEGSGSQR

SEQ ID NO: 190044 - protein, 38 aa, Artificial Sequence
  Description of Artificial Sequence: Synthetic polypeptide
DEAEIRTTNPVATEQYGSCPMPIAMLWPENRSISGQTS

SEQ ID NO: 190045 - protein, 38 aa, Artificial Sequence
  Description of Artificial Sequence: Synthetic polypeptide
SEEEIRTTNPVATEQYGECVYFTVVRTPLEDGDESIEE

SEQ ID NO: 190046 - protein, 38 aa, Artificial Sequence
  Description of Artificial Sequence: Synthetic polypeptide
QEEEIRTTNPVATECYGSVVNMTTPEGPEMGQGENEEG

SEQ ID NO: 190047 - protein, 37 aa, Artificial Sequence
  Description of Artificial Sequence: Synthetic polypeptide
SEEEIRTTNPVATEQYGDYSVGNMDEMIGEEEGEGDE

SEQ ID NO: 190048 - protein, 37 aa, Artificial Sequence
  Description of Artificial Sequence: Synthetic polypeptide
VEEEIRTTNCVATEQYGAVVTTTDGNGNDLEDEEEQS

SEQ ID NO: 190049 - protein, 38 aa, Artificial Sequence
  Description of Artificial Sequence: Synthetic polypeptide
SEEEIRTTNPVATEQYGDVGQNNVDTPGQQGEDGQGQL

SEQ ID NO: 190050 - protein, 35 aa, Artificial Sequence
  Description of Artificial Sequence: Synthetic polypeptide
CEDEIACTNPVATEQYGSCAAAVGNGNEAEGHPMH

SEQ ID NO: 190051 - protein, 36 aa, Artificial Sequence
  Description of Artificial Sequence: Synthetic polypeptide
DEDEIATTNPVAYEQYGSTVAGNGGVTTAENPNEKV

SEQ ID NO: 190052 - protein, 38 aa, Artificial Sequence
  Description of Artificial Sequence: Synthetic polypeptide
DEEEISTTNPVAYEQYGCVCSNWGEDHNIENFGSENQA

SEQ ID NO: 190053 - protein, 38 aa, Artificial Sequence
  Description of Artificial Sequence: Synthetic polypeptide
DENEIRTTNPVATEQYGSVPYDWLASGEGKEGGFESIF

SEQ ID NO: 190054 - protein, 37 aa, Artificial Sequence
  Description of Artificial Sequence: Synthetic polypeptide
QEEEIRTTNPVAYEPYGTIHACTVNSLSDNRTENYPF

SEQ ID NO: 190055 - protein, 38 aa, Artificial Sequence
  Description of Artificial Sequence: Synthetic polypeptide
DEEEISTTNPVAYEQYGCVCSNWGEDHNQENFGSDNQA

SEQ ID NO: 190056 - protein, 37 aa, Artificial Sequence
  Description of Artificial Sequence: Synthetic polypeptide
DEEEISTTNPVAYEQYGCVCSNWGEHNAENFNSDTQA

SEQ ID NO: 190057 - protein, 37 aa, Artificial Sequence
  Description of Artificial Sequence: Synthetic polypeptide
DEEEISTTNPVAYEQYGCVCSNWGEHNAEGFNSDTQS

SEQ ID NO: 190058 - protein, 37 aa, Artificial Sequence
  Description of Artificial Sequence: Synthetic polypeptide
DEEEISTTNPVAYEQYGCVCSNWGEHNAEGFNSDNQA

SEQ ID NO: 190059 - protein, 37 aa, Artificial Sequence
  Description of Artificial Sequence: Synthetic polypeptide
DEEEISTTNPVAYEQYGCVCSNWGEHDQENFGSDTQS

SEQ ID NO: 190060 - protein, 38 aa, Artificial Sequence
  Description of Artificial Sequence: Synthetic polypeptide
DEAEIRTTNPVATEQYGQVVCSNWGEHNQENFPSDNQS

SEQ ID NO: 190061 - protein, 38 aa, Artificial Sequence
  Description of Artificial Sequence: Synthetic polypeptide
DEEEISTTNPVAYEQYGCVCSNWGEDTNAENFNSDNQA

SEQ ID NO: 190062 - protein, 37 aa, Artificial Sequence
  Description of Artificial Sequence: Synthetic polypeptide
DEEEISTTNPVAYEQYGCVCSNWGEHNAESFNSDNQA

SEQ ID NO: 190063 - protein, 38 aa, Artificial Sequence
  Description of Artificial Sequence: Synthetic polypeptide
DEEEISTTNPVAYEQYGCVCSNWGEDPNTENFNSDNQN

SEQ ID NO: 190064 - protein, 39 aa, Artificial Sequence
  Description of Artificial Sequence: Synthetic polypeptide
DEEEIATTNPVAYEQYGSTVCAVTEAGGAQARGSEHAMW

SEQ ID NO: 190065 - protein, 37 aa, Artificial Sequence
  Description of Artificial Sequence: Synthetic polypeptide
DEDEIATTNPVAYEQYGSACSAGNHLNNEAGDGAGDD

SEQ ID NO: 190066 - protein, 39 aa, Artificial Sequence
  Description of Artificial Sequence: Synthetic polypeptide
DEEEIATTNPVAYEQYGSTVCAVGEAGGPQARGGDNSAM

SEQ ID NO: 190067 - protein, 37 aa, Artificial Sequence
  Description of Artificial Sequence: Synthetic polypeptide
VEEEIRTTNPVATDQYGMITVNMGMEDINEEGGNGGD

SEQ ID NO: 190068 - protein, 38 aa, Artificial Sequence
  Description of Artificial Sequence: Synthetic polypeptide
SEEEIRTTNPVATEQYGCVTSTWGADHNAENFISDPVA

SEQ ID NO: 190069 - protein, 38 aa, Artificial Sequence
  Description of Artificial Sequence: Synthetic polypeptide
DEEEIATTNPVAYEQYGSTACAVNPAEGQNHQDGMQMM

SEQ ID NO: 190070 - protein, 37 aa, Artificial Sequence
  Description of Artificial Sequence: Synthetic polypeptide
DEEEISTTNPVAYEQYGCVCSNWGEDNAEYFNSDTQA

SEQ ID NO: 190071 - protein, 38 aa, Artificial Sequence
  Description of Artificial Sequence: Synthetic polypeptide
DENEIRTTNPVATEQYGSGWADSYVPLNNIDDGTQEDD

SEQ ID NO: 190072 - protein, 37 aa, Artificial Sequence
  Description of Artificial Sequence: Synthetic polypeptide
DEEEIRTTNPCATEQYGCVCQTWGEHNQENFISDTAS

SEQ ID NO: 190073 - protein, 35 aa, Artificial Sequence
  Description of Artificial Sequence: Synthetic polypeptide
DQAEICTTNPVAYEQYGQCTAACIVELVHGGANRT

SEQ ID NO: 190074 - protein, 31 aa, Artificial Sequence
  Description of Artificial Sequence: Synthetic polypeptide
DSADIACTNPVATAQWGGCVAADHGRDSNGN

SEQ ID NO: 190075 - protein, 37 aa, Artificial Sequence
  Description of Artificial Sequence: Synthetic polypeptide
DENEIRTTNPVATEQYGCVTDTDAENGSDVTEESQVE

SEQ ID NO: 190076 - protein, 34 aa, Artificial Sequence
  Description of Artificial Sequence: Synthetic polypeptide
SEEEIRCTNPTAYEQWGSTVYGENKDIHRDLDQS

SEQ ID NO: 190077 - protein, 34 aa, Artificial Sequence
  Description of Artificial Sequence: Synthetic polypeptide
DEMEIACTNPVATEQWGTNCAATDGNPVEAEIND

SEQ ID NO: 190078 - protein, 36 aa, Artificial Sequence
  Description of Artificial Sequence: Synthetic polypeptide
CEEEISTTNPVATEQYGCVCPWGEDHNAENFNSDQA

SEQ ID NO: 190079 - protein, 38 aa, Artificial Sequence
  Description of Artificial Sequence: Synthetic polypeptide
QEEEIRTTNPVATEFYGSVPNPTTPEGPEMGQGENEEG

SEQ ID NO: 190080 - protein, 36 aa, Artificial Sequence
  Description of Artificial Sequence: Synthetic polypeptide
DEEAIRTTNPVATEQWGCVCGWEEHNQEHFGSDTQA

SEQ ID NO: 190081 - protein, 37 aa, Artificial Sequence
  Description of Artificial Sequence: Synthetic polypeptide
DEEAIRTTNPVATEQWGCVCGWGEDDNQEHFGSDNQS

SEQ ID NO: 190082 - protein, 37 aa, Artificial Sequence
  Description of Artificial Sequence: Synthetic polypeptide
CEEEIATTNPVATEQYGSACAANPELGQLHQDDQMAG

SEQ ID NO: 190083 - protein, 37 aa, Artificial Sequence
  Description of Artificial Sequence: Synthetic polypeptide
DEAEISTTNPVATEQYGCVCSNWGEDHNQNFGSETQA

SEQ ID NO: 190084 - protein, 37 aa, Artificial Sequence
  Description of Artificial Sequence: Synthetic polypeptide
DEAEIRTTNPVATEQYGCWYNAVNHLSVQDSVKEEQN

SEQ ID NO: 190085 - protein, 37 aa, Artificial Sequence
  Description of Artificial Sequence: Synthetic polypeptide
DEAEIRTTNPVATEQYGCWYNAVNHLSVLDSAGEEIN

SEQ ID NO: 190086 - protein, 38 aa, Artificial Sequence
  Description of Artificial Sequence: Synthetic polypeptide
DEAEISTTNPVATEQYGCVCSNWGEDHNTENFNSDNQQ

SEQ ID NO: 190087 - protein, 39 aa, Artificial Sequence
  Description of Artificial Sequence: Synthetic polypeptide
DEEAIRTTNPVATEQYGASQVIYLWINENTGGNESSISE

SEQ ID NO: 190088 - protein, 37 aa, Artificial Sequence
  Description of Artificial Sequence: Synthetic polypeptide
DEAEISTTNPVATEQYGCVCSNWGEDHNQENFNSEAE

SEQ ID NO: 190089 - protein, 37 aa, Artificial Sequence
  Description of Artificial Sequence: Synthetic polypeptide
DEEAIRTTNPVATEQYGCAAQMYIIDTQVGGMQEGEQ

SEQ ID NO: 190090 - protein, 33 aa, Artificial Sequence
  Description of Artificial Sequence: Synthetic polypeptide
DDSEVASTNPVSTEGYGCVCFNNEIQERFGSQQ

SEQ ID NO: 190091 - protein, 36 aa, Artificial Sequence
  Description of Artificial Sequence: Synthetic polypeptide
DEDEIATTNPVAYEQWGTFACAATAGELPDSGPNDR

SEQ ID NO: 190092 - protein, 37 aa, Artificial Sequence
  Description of Artificial Sequence: Synthetic polypeptide
DEAEISTTNPVATEQYGCVCSNWGEHNAEFFNSDPQS

SEQ ID NO: 190093 - protein, 35 aa, Artificial Sequence
  Description of Artificial Sequence: Synthetic polypeptide
DEDEIATTNPVAYEQWGSVYCGEIDQDQQGHQGTD

SEQ ID NO: 190094 - protein, 37 aa, Artificial Sequence
  Description of Artificial Sequence: Synthetic polypeptide
CEEEISTTNPVATEQYGCVCSNSGEHNQEHFNSDNQI

SEQ ID NO: 190095 - protein, 38 aa, Artificial Sequence
  Description of Artificial Sequence: Synthetic polypeptide
DEEAIRTTNPVATEQYGCVCSMWGEDHNAENFNSDNQA

SEQ ID NO: 190096 - protein, 37 aa, Artificial Sequence
  Description of Artificial Sequence: Synthetic polypeptide
DEAEISTTNPVATEQYGCVCSNWGEHNAENFNSDFQS

SEQ ID NO: 190097 - protein, 37 aa, Artificial Sequence
  Description of Artificial Sequence: Synthetic polypeptide
DEAEISTTNPVATEQYGCVCSNWGEHNAENFNSDNQS

SEQ ID NO: 190098 - protein, 37 aa, Artificial Sequence
  Description of Artificial Sequence: Synthetic polypeptide
DEAEISTTNPVATEQYGCVCSNWGEHNAENFNSDTQA

SEQ ID NO: 190099 - protein, 36 aa, Artificial Sequence
  Description of Artificial Sequence: Synthetic polypeptide
DEEEIRTTNPCATEGYGQCCCSWGELNAENFGSDQA

SEQ ID NO: 190100 - protein, 36 aa, Artificial Sequence
  Description of Artificial Sequence: Synthetic polypeptide
CEEEISTTNPVATEQYGCVCSNSGEHNQENFFSDQA

SEQ ID NO: 190101 - protein, 36 aa, Artificial Sequence
  Description of Artificial Sequence: Synthetic polypeptide
DEAEIRTTNPVATEQYGCWYNAVNHGSVQDSAEEQN

SEQ ID NO: 190102 - protein, 37 aa, Artificial Sequence
  Description of Artificial Sequence: Synthetic polypeptide
DEAEISTTNPVATEQYGCVCSNWGEHNQENFNSDTQA

SEQ ID NO: 190103 - protein, 36 aa, Artificial Sequence
  Description of Artificial Sequence: Synthetic polypeptide
DEAEIRTTNPVATEQYGCWYNAVNEESVLDSAEEQN

SEQ ID NO: 190104 - protein, 38 aa, Artificial Sequence
  Description of Artificial Sequence: Synthetic polypeptide
DEEEIRTTNPVAYEQYGQCVCSNWGEHNQEHFNSDNQS

SEQ ID NO: 190105 - protein, 37 aa, Artificial Sequence
  Description of Artificial Sequence: Synthetic polypeptide
DEAEISTTNPVATEQYGCVCSNWGEHNQENFNSQTQA

SEQ ID NO: 190106 - protein, 38 aa, Artificial Sequence
  Description of Artificial Sequence: Synthetic polypeptide
DEAEISTTNPVATEQYGCVCSNWGEDHNQENFGSDNQA

SEQ ID NO: 190107 - protein, 37 aa, Artificial Sequence
  Description of Artificial Sequence: Synthetic polypeptide
DEAEIRTTNPVATEQYGCWYNAVPNHSNVQDSAEEQN

SEQ ID NO: 190108 - protein, 37 aa, Artificial Sequence
  Description of Artificial Sequence: Synthetic polypeptide
DEAEISTTNPVATEQYGCVCSNWGEDHEQENFGSDQS

SEQ ID NO: 190109 - protein, 37 aa, Artificial Sequence
  Description of Artificial Sequence: Synthetic polypeptide
DEAEIRTTNPVATEQYGHYWNNVQEEESSDTSGQETF

SEQ ID NO: 190110 - protein, 37 aa, Artificial Sequence
  Description of Artificial Sequence: Synthetic polypeptide
DEAEIRTTNPVATEQYGHYWNNVIEEEASDTSGQEMF

SEQ ID NO: 190111 - protein, 37 aa, Artificial Sequence
  Description of Artificial Sequence: Synthetic polypeptide
DEAEIRTTNPVATEQYGHYWNNVDEEENSDTSGQECF

SEQ ID NO: 190112 - protein, 37 aa, Artificial Sequence
  Description of Artificial Sequence: Synthetic polypeptide
DEAEIRTTNPVATEQYGHYWCNVREEERSDTSGQEQF

SEQ ID NO: 190113 - protein, 38 aa, Artificial Sequence
  Description of Artificial Sequence: Synthetic polypeptide
DEAEIRTTNPVATEQYGHSWNNVREEERSDETSYQEMF

SEQ ID NO: 190114 - protein, 38 aa, Artificial Sequence
  Description of Artificial Sequence: Synthetic polypeptide
DEAEIRTTNPVATEQYGGVTWSPVVWLENPNTWGEVGK

SEQ ID NO: 190115 - protein, 38 aa, Artificial Sequence
  Description of Artificial Sequence: Synthetic polypeptide
DEAEIRTTNPVATEQYGGVTWSPVHWLENPNTWGEVLN

SEQ ID NO: 190116 - protein, 37 aa, Artificial Sequence
  Description of Artificial Sequence: Synthetic polypeptide
CEEEISTTNPVATEQYGCAVCGNWGEHNQENFGSDQS

SEQ ID NO: 190117 - protein, 32 aa, Artificial Sequence
  Description of Artificial Sequence: Synthetic polypeptide
DDSEVASTNPVSTEGYGCVCATWPIQEHFGQQ

SEQ ID NO: 190118 - protein, 36 aa, Artificial Sequence
  Description of Artificial Sequence: Synthetic polypeptide
DEDEIATTNPVAYEQWGTNCAATAGELPDSGPNPRP

SEQ ID NO: 190119 - protein, 31 aa, Artificial Sequence
  Description of Artificial Sequence: Synthetic polypeptide
QENEIATTNPIATECYGDTAADLAEHKEEYL

SEQ ID NO: 190120 - protein, 36 aa, Artificial Sequence
  Description of Artificial Sequence: Synthetic polypeptide
DEAEIRTTNPVATEQYGDIWNNWMEHFSNPSEETQI

SEQ ID NO: 190121 - protein, 37 aa, Artificial Sequence
  Description of Artificial Sequence: Synthetic polypeptide
DEAEIRTTNPVATEQYGDIWNNTHEYFGSNPSEETQI

SEQ ID NO: 190122 - protein, 38 aa, Artificial Sequence
  Description of Artificial Sequence: Synthetic polypeptide
DEEAIRTTNPVATEGYGCVTSTWGADDNAEHFNSDPQS

SEQ ID NO: 190123 - protein, 36 aa, Artificial Sequence
  Description of Artificial Sequence: Synthetic polypeptide
DDQEIATTNPVATEQYGSVTATPDALEDHITIEDLY

SEQ ID NO: 190124 - protein, 35 aa, Artificial Sequence
  Description of Artificial Sequence: Synthetic polypeptide
DEDEIATTNPVAYEQWGTNCAATAGELPDSGPNKM

SEQ ID NO: 190125 - protein, 38 aa, Artificial Sequence
  Description of Artificial Sequence: Synthetic polypeptide
DAEEIATTNPVATEQYGSVCAMANHADDSKAPGDHNHN

SEQ ID NO: 190126 - protein, 38 aa, Artificial Sequence
  Description of Artificial Sequence: Synthetic polypeptide
DEEEIRTTNPVAYEQYGQCVCSNWGEHNAEFFNSDTQS

SEQ ID NO: 190127 - protein, 38 aa, Artificial Sequence
  Description of Artificial Sequence: Synthetic polypeptide
CEEEIATTNPVATEQYGSICAMNNGELTNPDDQMENHM

SEQ ID NO: 190128 - protein, 38 aa, Artificial Sequence
  Description of Artificial Sequence: Synthetic polypeptide
DEEEIRTTNPVAYEQYGQCVCSNWGEHNIEFFNSDTQS

SEQ ID NO: 190129 - protein, 33 aa, Artificial Sequence
  Description of Artificial Sequence: Synthetic polypeptide
DDSEVASTNPVSTEGYGCVCETWTIQERFGQQN

SEQ ID NO: 190130 - protein, 38 aa, Artificial Sequence
  Description of Artificial Sequence: Synthetic polypeptide
DEEEIRTTNPVATEQYGEVRRADEVMETQVETMEENMT

SEQ ID NO: 190131 - protein, 37 aa, Artificial Sequence
  Description of Artificial Sequence: Synthetic polypeptide
DEEEIRTTNPCATEPYGNTCAAGTGNLPATAPLGEMA

SEQ ID NO: 190132 - protein, 36 aa, Artificial Sequence
  Description of Artificial Sequence: Synthetic polypeptide
DEEEIRTTNPVAYEPFGISHVYMWKVLEADTIIENA

SEQ ID NO: 190133 - protein, 36 aa, Artificial Sequence
  Description of Artificial Sequence: Synthetic polypeptide
DEAEIRTTNPVATEQYGDIWNNNCHEFSNPSEETHI

SEQ ID NO: 190134 - protein, 36 aa, Artificial Sequence
  Description of Artificial Sequence: Synthetic polypeptide
DEAEIRTTNPVATEQYGDIWNNETHEFSQPSEETQI

SEQ ID NO: 190135 - protein, 39 aa, Artificial Sequence
  Description of Artificial Sequence: Synthetic polypeptide
DENEIRTTNPVATEQYGDMNVDGQDGNNLTHEEDGGNNG

SEQ ID NO: 190136 - protein, 37 aa, Artificial Sequence
  Description of Artificial Sequence: Synthetic polypeptide
DEAEIRTTNPVATEQYGCWYNQVPNHLVVQDSAEEQN

SEQ ID NO: 190137 - protein, 36 aa, Artificial Sequence
  Description of Artificial Sequence: Synthetic polypeptide
DEEEIRTTNPCATEPYGNCAATGHLPATAPGGEMWN

SEQ ID NO: 190138 - protein, 35 aa, Artificial Sequence
  Description of Artificial Sequence: Synthetic polypeptide
DQQEIATTNPVATEQYGCVAANGDGATMPMGDPHG

SEQ ID NO: 190139 - protein, 38 aa, Artificial Sequence
  Description of Artificial Sequence: Synthetic polypeptide
DEAEIRTTNPVATEQYGHYWNNVREEERSDTSGQENMM

SEQ ID NO: 190140 - protein, 36 aa, Artificial Sequence
  Description of Artificial Sequence: Synthetic polypeptide
DEAEISTTNPVATEQYGCVCSNWGEHNQEYFPSDQS

SEQ ID NO: 190141 - protein, 38 aa, Artificial Sequence
  Description of Artificial Sequence: Synthetic polypeptide
DEHNEIATTNPVAYEQWGEVCSTPNQGNHGEQEGDGNN

SEQ ID NO: 190142 - protein, 37 aa, Artificial Sequence
  Description of Artificial Sequence: Synthetic polypeptide
DEMEISTTNPVATEQYGQCVCSNWGEHNAEYFNSDQS

SEQ ID NO: 190143 - protein, 38 aa, Artificial Sequence
  Description of Artificial Sequence: Synthetic polypeptide
DEEAIRTTNPVATEQYGQCVCSNWGEHNAENFNSDTQS

SEQ ID NO: 190144 - protein, 38 aa, Artificial Sequence
  Description of Artificial Sequence: Synthetic polypeptide
DEEAIRTTNPVATEQYGQCVCSNWGEHNQENFISDNQA

SEQ ID NO: 190145 - protein, 38 aa, Artificial Sequence
  Description of Artificial Sequence: Synthetic polypeptide
DEEAIRTTNPVATEQYGQCVCSNWGEHNTESFNSDTQS

SEQ ID NO: 190146 - protein, 36 aa, Artificial Sequence
  Description of Artificial Sequence: Synthetic polypeptide
DEMEISTTNPVATEQYGQCVCSNWGEHNENFNSDQA

SEQ ID NO: 190147 - protein, 37 aa, Artificial Sequence
  Description of Artificial Sequence: Synthetic polypeptide
DENEIRTTNPVATEQYGCVDFDAENGSVETLEEPQVE

SEQ ID NO: 190148 - protein, 37 aa, Artificial Sequence
  Description of Artificial Sequence: Synthetic polypeptide
DENEIRTTNPVATEQYGCVDDTLSVKEYQISSSAEDV

SEQ ID NO: 190149 - protein, 34 aa, Artificial Sequence
  Description of Artificial Sequence: Synthetic polypeptide
DSEEIATTNPVGYEQWGCVRHEDHQQDRRGTVDG

SEQ ID NO: 190150 - protein, 38 aa, Artificial Sequence
  Description of Artificial Sequence: Synthetic polypeptide
DEEEIRTTNPVAYEQYGQCVCSNWGEHNQENFGSDTQT

SEQ ID NO: 190151 - protein, 38 aa, Artificial Sequence
  Description of Artificial Sequence: Synthetic polypeptide
DEEEIRTTNPVAYEQYGQCVCSNWGEHNQENFGSETQL

SEQ ID NO: 190152 - protein, 34 aa, Artificial Sequence
  Description of Artificial Sequence: Synthetic polypeptide
DSEEIATTNPVGYEQWGCVRHEDKQNDRRGGTDG

SEQ ID NO: 190153 - protein, 34 aa, Artificial Sequence
  Description of Artificial Sequence: Synthetic polypeptide
DSEEIATTNPVGYEQWGCVRHEDKQQDRREGVTG

SEQ ID NO: 190154 - protein, 34 aa, Artificial Sequence
  Description of Artificial Sequence: Synthetic polypeptide
DSEEIATTNPVGYEQWGCVRHEDKQQDRRGGKGG

SEQ ID NO: 190155 - protein, 37 aa, Artificial Sequence
  Description of Artificial Sequence: Synthetic polypeptide
DEAEISTTNPVATEQYGCVCSWGEDHEQENFNSDNQS

SEQ ID NO: 190156 - protein, 38 aa, Artificial Sequence
  Description of Artificial Sequence: Synthetic polypeptide
DEEAIRTTNPVATEQYGQCVCSNWGEHNAEHFNSENQS

SEQ ID NO: 190157 - protein, 36 aa, Artificial Sequence
  Description of Artificial Sequence: Synthetic polypeptide
DEAEISTTNPVATEQYGCVCSWGEDHNAEYFISDQA

SEQ ID NO: 190158 - protein, 38 aa, Artificial Sequence
  Description of Artificial Sequence: Synthetic polypeptide
DEEEIRTTNPVAYEQYGQCVCSNWGEHNQENFISDNQA

SEQ ID NO: 190159 - protein, 38 aa, Artificial Sequence
  Description of Artificial Sequence: Synthetic polypeptide
DENEIRTTNPVATEQYGCVCSNWGEDHNQENFNSDTQS

SEQ ID NO: 190160 - protein, 36 aa, Artificial Sequence
  Description of Artificial Sequence: Synthetic polypeptide
DEEEIRTTNPCATEEYGCVCGWEEDHNAENFGSDAA

SEQ ID NO: 190161 - protein, 38 aa, Artificial Sequence
  Description of Artificial Sequence: Synthetic polypeptide
DENEIRTTNPVATEQYGCVCSNWGEDHNAENFNSDNQL

SEQ ID NO: 190162 - protein, 36 aa, Artificial Sequence
  Description of Artificial Sequence: Synthetic polypeptide
CETEIACTNPVATEQYGSACSADNPLPAEAPIGIHQ

SEQ ID NO: 190163 - protein, 39 aa, Artificial Sequence
  Description of Artificial Sequence: Synthetic polypeptide
QEEEIRTTNPVATEFYGVVVNVGTTTNGLGEEFGENIDL

SEQ ID NO: 190164 - protein, 38 aa, Artificial Sequence
  Description of Artificial Sequence: Synthetic polypeptide
DEDEIATTNPVAYEQWGSVSGGNPGNGGNMRREMEPMR

SEQ ID NO: 190165 - protein, 37 aa, Artificial Sequence
  Description of Artificial Sequence: Synthetic polypeptide
DEAEISTTNPVATEQYGCVCSWGEDHNQESFNSDNQS

SEQ ID NO: 190166 - protein, 36 aa, Artificial Sequence
  Description of Artificial Sequence: Synthetic polypeptide
DEIAEIATTNPVATEPWGVVCFTNEDHQDLGGTQSN

SEQ ID NO: 190167 - protein, 38 aa, Artificial Sequence
  Description of Artificial Sequence: Synthetic polypeptide
DEEEIRTTNPVAYEQYGQCVCSNWGEHNQENFNSDTQS

SEQ ID NO: 190168 - protein, 37 aa, Artificial Sequence
  Description of Artificial Sequence: Synthetic polypeptide
DSEEIGTTNPVATEAYGSVVCSDQPEPSTNPGGPQVK

SEQ ID NO: 190169 - protein, 37 aa, Artificial Sequence
  Description of Artificial Sequence: Synthetic polypeptide
DSEEIGTTNPVAWEAYGSTVCSDQPEPSTNPGGNMVK

SEQ ID NO: 190170 - protein, 36 aa, Artificial Sequence
  Description of Artificial Sequence: Synthetic polypeptide
DEAEIRTTNPVATEQYGCWYNAVGHLSVLDSPEAQN

SEQ ID NO: 190171 - protein, 40 aa, Artificial Sequence
  Description of Artificial Sequence: Synthetic polypeptide
DEEEIRTTNPVATEQYGHCWNVNPNLPDWDIEPSNYDSRT

SEQ ID NO: 190172 - protein, 35 aa, Artificial Sequence
  Description of Artificial Sequence: Synthetic polypeptide
DEEEIRTTNPCATEEYGCVCGWGEHAENFNSDTAA

SEQ ID NO: 190173 - protein, 37 aa, Artificial Sequence
  Description of Artificial Sequence: Synthetic polypeptide
DEEEIRTTNPCATEGYGCCCSTWGEDHNAENFGSDQA

SEQ ID NO: 190174 - protein, 36 aa, Artificial Sequence
  Description of Artificial Sequence: Synthetic polypeptide
DSEEIASTNPVATERWGQKVSCTNNPPMSPGGGERY

SEQ ID NO: 190175 - protein, 36 aa, Artificial Sequence
  Description of Artificial Sequence: Synthetic polypeptide
DSEEIASTNPVATERWGQKVSCTNNPNDFPGGGYRY

SEQ ID NO: 190176 - protein, 38 aa, Artificial Sequence
  Description of Artificial Sequence: Synthetic polypeptide
DEAEISTTNPVATEQYGCVCSNWGELHNQENFNSETQA

SEQ ID NO: 190177 - protein, 37 aa, Artificial Sequence
  Description of Artificial Sequence: Synthetic polypeptide
DEAEISTTNPVATEQYGCVCSNWGNHNAEYFNSDTQA

SEQ ID NO: 190178 - protein, 37 aa, Artificial Sequence
  Description of Artificial Sequence: Synthetic polypeptide
DEDEIATTNPVAYEQWGSVWVINNDLMRDQNGSGDHD

SEQ ID NO: 190179 - protein, 32 aa, Artificial Sequence
  Description of Artificial Sequence: Synthetic polypeptide
DESEIRSTNPVGTEGWGVTWANATWAEHGDYI

SEQ ID NO: 190180 - protein, 38 aa, Artificial Sequence
  Description of Artificial Sequence: Synthetic polypeptide
DEEAIRTTNPVATEQYGCVCSNWGEDHNAENFGSDTQS

SEQ ID NO: 190181 - protein, 36 aa, Artificial Sequence
  Description of Artificial Sequence: Synthetic polypeptide
DEAEISTTNPVATEQYGCVCSSGEHNQENFPSDTQS

SEQ ID NO: 190182 - protein, 37 aa, Artificial Sequence
  Description of Artificial Sequence: Synthetic polypeptide
DEEAIRTTNPVATEQYGCVCSNWGEHEAENFISETQS

SEQ ID NO: 190183 - protein, 39 aa, Artificial Sequence
  Description of Artificial Sequence: Synthetic polypeptide
DESEIRTTNPVATEGYGVVDVGVGTGNVGNQEGEGNDTT

SEQ ID NO: 190184 - protein, 38 aa, Artificial Sequence
  Description of Artificial Sequence: Synthetic polypeptide
DEEAIRTTNPVATEQYGCVCSNWMEDHNAENFGSQTQS

SEQ ID NO: 190185 - protein, 39 aa, Artificial Sequence
  Description of Artificial Sequence: Synthetic polypeptide
DECEICTTNPVATEQYGVVSTVNQNGNQGQQGTTEQGSD

SEQ ID NO: 190186 - protein, 36 aa, Artificial Sequence
  Description of Artificial Sequence: Synthetic polypeptide
QEEEISTTNPVATEQYGVVTAGPGEGEGGQGGEEDT

SEQ ID NO: 190187 - protein, 39 aa, Artificial Sequence
  Description of Artificial Sequence: Synthetic polypeptide
DEEEIRTTNPVATEQYGEYAISPTATPLHEVSPMQDLRN

SEQ ID NO: 190188 - protein, 37 aa, Artificial Sequence
  Description of Artificial Sequence: Synthetic polypeptide
DENEIRTTNPVATEQYGCVDVDAENGSDETQEEEQVE

SEQ ID NO: 190189 - protein, 36 aa, Artificial Sequence
  Description of Artificial Sequence: Synthetic polypeptide
DSECISTTNPVAYEHYGQTTVAVTNELATNRGGEAG

SEQ ID NO: 190190 - protein, 36 aa, Artificial Sequence
  Description of Artificial Sequence: Synthetic polypeptide
DSEEIASTNPVATERWGQKVSCTNNPPHFPGGGQRY

SEQ ID NO: 190191 - protein, 34 aa, Artificial Sequence
  Description of Artificial Sequence: Synthetic polypeptide
DSECISTTNPVAYNQWGCTVPSQPPSMRGGNMGT

SEQ ID NO: 190192 - protein, 34 aa, Artificial Sequence
  Description of Artificial Sequence: Synthetic polypeptide
DSEDIATTNPVATEQWGGCVAGEGHQNPAVGPLD

SEQ ID NO: 190193 - protein, 37 aa, Artificial Sequence
  Description of Artificial Sequence: Synthetic polypeptide
QEEEIRTTNPVATEFYGTVMNDQVNVGLGEEGEGEEY

SEQ ID NO: 190194 - protein, 37 aa, Artificial Sequence
  Description of Artificial Sequence: Synthetic polypeptide
DENEIRTTNPVATEQYGCVDTDCENGSVETHEESQCE

SEQ ID NO: 190195 - protein, 35 aa, Artificial Sequence
  Description of Artificial Sequence: Synthetic polypeptide
CEDWIATTNPVATAQWGCVANANNLPQEAPGGNES

SEQ ID NO: 190196 - protein, 39 aa, Artificial Sequence
  Description of Artificial Sequence: Synthetic polypeptide
DEEEIRTTNPVATEQYGFSARGPEINEEILARQQPIVQT

SEQ ID NO: 190197 - protein, 38 aa, Artificial Sequence
  Description of Artificial Sequence: Synthetic polypeptide
DEEAIRTTNPVATEQYGQCVCSMWEEHNQENFGSDFQG

SEQ ID NO: 190198 - protein, 37 aa, Artificial Sequence
  Description of Artificial Sequence: Synthetic polypeptide
DEEEIRTTNPVAYEGYGCVCFNWGEHNTENFSSDNQS

SEQ ID NO: 190199 - protein, 38 aa, Artificial Sequence
  Description of Artificial Sequence: Synthetic polypeptide
DEEAIRTTNPVATEQYGQCVCSMWGEHNAENFNSENQA

SEQ ID NO: 190200 - protein, 38 aa, Artificial Sequence
  Description of Artificial Sequence: Synthetic polypeptide
DEEAIRTTNPVATEQYGQCVCSNWEEHNIENFNSDFQS

SEQ ID NO: 190201 - protein, 35 aa, Artificial Sequence
  Description of Artificial Sequence: Synthetic polypeptide
DEACISTTNPVATEQYGCVCEWGEPNAEYFGSDQA

SEQ ID NO: 190202 - protein, 38 aa, Artificial Sequence
  Description of Artificial Sequence: Synthetic polypeptide
DEEEIRTTNPVATEQYGGIYNWEANPDDLGGSGQEEIG

SEQ ID NO: 190203 - protein, 35 aa, Artificial Sequence
  Description of Artificial Sequence: Synthetic polypeptide
DEEEIRTTNPCATEEYGCVCQWEEHNANFNSDTAA

SEQ ID NO: 190204 - protein, 36 aa, Artificial Sequence
  Description of Artificial Sequence: Synthetic polypeptide
DSEEIASTNPVATEQWGQKCSCTNNLPMFPGGGYDY

SEQ ID NO: 190205 - protein, 37 aa, Artificial Sequence
  Description of Artificial Sequence: Synthetic polypeptide
DSEEIASTNPVATEQWGQKVSCTNNLPATFPGGGYDY

SEQ ID NO: 190206 - protein, 35 aa, Artificial Sequence
  Description of Artificial Sequence: Synthetic polypeptide
CEDWIATTNPVATAQWGCVAIANNLQEAPGGGMNP

SEQ ID NO: 190207 - protein, 40 aa, Artificial Sequence
  Description of Artificial Sequence: Synthetic polypeptide
DECEICTTNPVATEQYGVVSTVVVTTTQLQQGNNNQEEDT

SEQ ID NO: 190208 - protein, 37 aa, Artificial Sequence
  Description of Artificial Sequence: Synthetic polypeptide
DEAEIRTTNPVATEQYGHYWNNVREEERSDTSVQEMF

SEQ ID NO: 190209 - protein, 37 aa, Artificial Sequence
  Description of Artificial Sequence: Synthetic polypeptide
DEEEIRTTNPVATECWGSTTWSNAPDWPNEPNGMPYI

SEQ ID NO: 190210 - protein, 36 aa, Artificial Sequence
  Description of Artificial Sequence: Synthetic polypeptide
SEEEIRTTNPTATECWGCVCTIDSNNHNGQQGGDHE

SEQ ID NO: 190211 - protein, 37 aa, Artificial Sequence
  Description of Artificial Sequence: Synthetic polypeptide
DEEEIRTTNPCATEQYGCVCGNWGEHNQENFISDTQS

SEQ ID NO: 190212 - protein, 38 aa, Artificial Sequence
  Description of Artificial Sequence: Synthetic polypeptide
DEEEISTTNPVAYEQYGQCVCSNWGEDNQENFGSENQS

SEQ ID NO: 190213 - protein, 37 aa, Artificial Sequence
  Description of Artificial Sequence: Synthetic polypeptide
DDAEISTTNPVATEQYGCVCSMSGEHNQENFGSDNQA

SEQ ID NO: 190214 - protein, 38 aa, Artificial Sequence
  Description of Artificial Sequence: Synthetic polypeptide
DQAEIRTTNPVATEQYGSVPIGTREMPNNWEEEHINDG

SEQ ID NO: 190215 - protein, 37 aa, Artificial Sequence
  Description of Artificial Sequence: Synthetic polypeptide
DENEIRTTNPVATEQYGSCCMYTIVNTHTIPETQIVE

SEQ ID NO: 190216 - protein, 37 aa, Artificial Sequence
  Description of Artificial Sequence: Synthetic polypeptide
DENEIRTTNPVATEQYGSCCMYEIVTGHTIPETQIVE

SEQ ID NO: 190217 - protein, 38 aa, Artificial Sequence
  Description of Artificial Sequence: Synthetic polypeptide
DEEEISTTNPVAYEQYGQCVCSNWGEHNIENFGSDNQM

SEQ ID NO: 190218 - protein, 37 aa, Artificial Sequence
  Description of Artificial Sequence: Synthetic polypeptide
DENEIRTTNPVATEQYGSCCMYEIVNTHTTPETQIDG

SEQ ID NO: 190219 - protein, 37 aa, Artificial Sequence
  Description of Artificial Sequence: Synthetic polypeptide
DENEIRTTNPVATEQYGSCCMYEDVYTHTTPYTQIDG

SEQ ID NO: 190220 - protein, 38 aa, Artificial Sequence
  Description of Artificial Sequence: Synthetic polypeptide
DEEEISTTNPVAYEQYGQCVCSNWGEHNIESFGSDNQS

SEQ ID NO: 190221 - protein, 37 aa, Artificial Sequence
  Description of Artificial Sequence: Synthetic polypeptide
DENEIRTTNPVATEQYGSCCMYAIVTDHTIPETQILG

SEQ ID NO: 190222 - protein, 38 aa, Artificial Sequence
  Description of Artificial Sequence: Synthetic polypeptide
DEEEISTTNPVAYEQYGQCVCSNWGEHNQEGFNSQTQA

SEQ ID NO: 190223 - protein, 39 aa, Artificial Sequence
  Description of Artificial Sequence: Synthetic polypeptide
DEAEIRTTNPVATEQYGQCAVCSNWEEHNTENFFSENQS

SEQ ID NO: 190224 - protein, 36 aa, Artificial Sequence
  Description of Artificial Sequence: Synthetic polypeptide
DEDEIRTTNPVAYESWGTVCSNDNHDQPGQQGMTEH

SEQ ID NO: 190225 - protein, 37 aa, Artificial Sequence
  Description of Artificial Sequence: Synthetic polypeptide
DEEEISTTNPVAYEQYGQCVCSNWGEHNQENSGSDQL

SEQ ID NO: 190226 - protein, 38 aa, Artificial Sequence
  Description of Artificial Sequence: Synthetic polypeptide
DEEEISTTNPVAYEQYGQCVCSNWMEDDNQYFGSDNQS

SEQ ID NO: 190227 - protein, 37 aa, Artificial Sequence
  Description of Artificial Sequence: Synthetic polypeptide
DENEIRTTNPVATEQYGSAVMYQTDEEDIPPSIEEVL

SEQ ID NO: 190228 - protein, 37 aa, Artificial Sequence
  Description of Artificial Sequence: Synthetic polypeptide
DEAEISTTNPVATEQYGCVCSNSGEHNAENFGSETQA

SEQ ID NO: 190229 - protein, 33 aa, Artificial Sequence
  Description of Artificial Sequence: Synthetic polypeptide
DDSEVASTNPVSTEGYGCVCANSEDQERFGSQQ

SEQ ID NO: 190230 - protein, 35 aa, Artificial Sequence
  Description of Artificial Sequence: Synthetic polypeptide
DQAEISTTNPVATEQYGCCCSNWEHNQEHFGSQQA

SEQ ID NO: 190231 - protein, 37 aa, Artificial Sequence
  Description of Artificial Sequence: Synthetic polypeptide
CEEEISTTNPVATEGYGCVCSNWGEHNAENFGSENQS

SEQ ID NO: 190232 - protein, 37 aa, Artificial Sequence
  Description of Artificial Sequence: Synthetic polypeptide
DEAEISTTNPVATEQYGCVCSNSGEHNAENFNSDTQA

SEQ ID NO: 190233 - protein, 37 aa, Artificial Sequence
  Description of Artificial Sequence: Synthetic polypeptide
DEEEISTTNPVAYEQYGQCVCSWGEDHNANFNSDNQG

SEQ ID NO: 190234 - protein, 37 aa, Artificial Sequence
  Description of Artificial Sequence: Synthetic polypeptide
DEEEISTTNPVAYEQYGQCVCSWGEDHNQENFGSDQA

SEQ ID NO: 190235 - protein, 38 aa, Artificial Sequence
  Description of Artificial Sequence: Synthetic polypeptide
DEEEIRTTNPVAYEQYGQCVCSNWGEHNAEFFNSDNQP

SEQ ID NO: 190236 - protein, 37 aa, Artificial Sequence
  Description of Artificial Sequence: Synthetic polypeptide
DEMEIRTTNPVATCQYGCVCGNSGEHNAENFGSDTQS

SEQ ID NO: 190237 - protein, 37 aa, Artificial Sequence
  Description of Artificial Sequence: Synthetic polypeptide
QEEEIRTTNPVCYEPYGVVVYCDPNHSQNRDGGGNDW

SEQ ID NO: 190238 - protein, 35 aa, Artificial Sequence
  Description of Artificial Sequence: Synthetic polypeptide
QEEEIRTTNPVATEFYGAVVNGFGQGQDTDQTTGF

SEQ ID NO: 190239 - protein, 37 aa, Artificial Sequence
  Description of Artificial Sequence: Synthetic polypeptide
DEAEISTTNPVATEQYGCVCSNWEEHNQEHFNSDNQA

SEQ ID NO: 190240 - protein, 34 aa, Artificial Sequence
  Description of Artificial Sequence: Synthetic polypeptide
DQAEIRTTNPVSYEPWGKISCMVDISQQQTGGNF

SEQ ID NO: 190241 - protein, 38 aa, Artificial Sequence
  Description of Artificial Sequence: Synthetic polypeptide
DEEEISTTNPVAYEQYGQCVCSWGEDLNQENFGSETQA

SEQ ID NO: 190242 - protein, 36 aa, Artificial Sequence
  Description of Artificial Sequence: Synthetic polypeptide
DENEIRTTNPVATEQYGSCMPIMLWPEEMSISQQTS

SEQ ID NO: 190243 - protein, 37 aa, Artificial Sequence
  Description of Artificial Sequence: Synthetic polypeptide
DENEIRTTNPVATEQYGSCPMPFMLWPENDSISQQTS

SEQ ID NO: 190244 - protein, 37 aa, Artificial Sequence
  Description of Artificial Sequence: Synthetic polypeptide
DEEEISTTNPVAYEQYGQCVCSNSGEDHNQYFGSQQA

SEQ ID NO: 190245 - protein, 36 aa, Artificial Sequence
  Description of Artificial Sequence: Synthetic polypeptide
SEEEIRTTNPVATEGYGCVCGWGAHNQENFNSDNQS

SEQ ID NO: 190246 - protein, 36 aa, Artificial Sequence
  Description of Artificial Sequence: Synthetic polypeptide
DQAEIKTTNPVAYEQYGQCTASCIEELHHTGTANRT

SEQ ID NO: 190247 - protein, 38 aa, Artificial Sequence
  Description of Artificial Sequence: Synthetic polypeptide
DEEEIRTTNPCATEQYGQCVCSNWGEDNAEYFNSDNQA

SEQ ID NO: 190248 - protein, 38 aa, Artificial Sequence
  Description of Artificial Sequence: Synthetic polypeptide
DEEEISTTNPVAYEQYGQCVCSNSGEHNQENFGSDNQA

SEQ ID NO: 190249 - protein, 37 aa, Artificial Sequence
  Description of Artificial Sequence: Synthetic polypeptide
DEEEISTTNPVAYEQYGQCVCSNSGEHQENFGSDTQA

SEQ ID NO: 190250 - protein, 36 aa, Artificial Sequence
  Description of Artificial Sequence: Synthetic polypeptide
DEEEIRTTNPCATEQYGQCVCGWGEHNQNFISDTAS

SEQ ID NO: 190251 - protein, 36 aa, Artificial Sequence
  Description of Artificial Sequence: Synthetic polypeptide
DQAEIKTTNPVAYEQYGQCTASCIMELVQTGTPNVW

SEQ ID NO: 190252 - protein, 37 aa, Artificial Sequence
  Description of Artificial Sequence: Synthetic polypeptide
DQAEIRTTNPVATEQYGCCCSNTGEDHNQEHFGSDQS

SEQ ID NO: 190253 - protein, 37 aa, Artificial Sequence
  Description of Artificial Sequence: Synthetic polypeptide
DQAEIRTTNPVATEQYGCCCSNTGEHNAEHFGSETQA

SEQ ID NO: 190254 - protein, 36 aa, Artificial Sequence
  Description of Artificial Sequence: Synthetic polypeptide
DQAEIRTTNPVATEQYGCCCSNWEDHNQHFGSETQA

SEQ ID NO: 190255 - protein, 36 aa, Artificial Sequence
  Description of Artificial Sequence: Synthetic polypeptide
SEEEIRTTNPVATEGYGCTGSIMNDIGDIGGDDGEG

SEQ ID NO: 190256 - protein, 36 aa, Artificial Sequence
  Description of Artificial Sequence: Synthetic polypeptide
DQAEIRTTNPVATEQYGCCCSWGEHNQENFGSDTQA

SEQ ID NO: 190257 - protein, 37 aa, Artificial Sequence
  Description of Artificial Sequence: Synthetic polypeptide
DEAEIRTTNPVATEQYGQCTCSWGEDDNQENFGSDQS

SEQ ID NO: 190258 - protein, 32 aa, Artificial Sequence
  Description of Artificial Sequence: Synthetic polypeptide
DDSEVASTNPVSTEGYGCVCADWEIQEYFGQR

SEQ ID NO: 190259 - protein, 38 aa, Artificial Sequence
  Description of Artificial Sequence: Synthetic polypeptide
SEEEIRTTNPVATEGYGAVDNLQGTNDQEGGGGEQFGD

SEQ ID NO: 190260 - protein, 36 aa, Artificial Sequence
  Description of Artificial Sequence: Synthetic polypeptide
DEDEIATTNPVAYEQWGTVCAATAGELPDSMGPNDA

SEQ ID NO: 190261 - protein, 36 aa, Artificial Sequence
  Description of Artificial Sequence: Synthetic polypeptide
DEDEIATTNPVAYEQWGTVCAATAGELPDSGPNGKP

SEQ ID NO: 190262 - protein, 36 aa, Artificial Sequence
  Description of Artificial Sequence: Synthetic polypeptide
SEEEIRTTNPVATEFWGSVFVNENDNHEHQGHDQGD

SEQ ID NO: 190263 - protein, 37 aa, Artificial Sequence
  Description of Artificial Sequence: Synthetic polypeptide
DEEEISTTNPVAYEQYGQCVCSNWGEDDNIYFGSDQA

SEQ ID NO: 190264 - protein, 35 aa, Artificial Sequence
  Description of Artificial Sequence: Synthetic polypeptide
DEDEIRTTNPVAYERWGTVCPNDQHDQPGQGGDEH

SEQ ID NO: 190265 - protein, 36 aa, Artificial Sequence
  Description of Artificial Sequence: Synthetic polypeptide
DEEEIRTTNPCATEQYGCVCQWGEDHNANFNSDTAS

SEQ ID NO: 190266 - protein, 37 aa, Artificial Sequence
  Description of Artificial Sequence: Synthetic polypeptide
DEYEIGTTNPVATEFYGSVTATGDQGIEDGEEGIDGD

SEQ ID NO: 190267 - protein, 37 aa, Artificial Sequence
  Description of Artificial Sequence: Synthetic polypeptide
SEEEIRTTNPVATECWGCVCTIDSNNHNGQQGGDHDM

SEQ ID NO: 190268 - protein, 37 aa, Artificial Sequence
  Description of Artificial Sequence: Synthetic polypeptide
DEEEIRTTNPCATEQYGCVCPNWEEHNAEYFGSDTQS

SEQ ID NO: 190269 - protein, 37 aa, Artificial Sequence
  Description of Artificial Sequence: Synthetic polypeptide
DEEEIRTTNPCATEQYGCVCGWGEDHNQENFNSDTQS

SEQ ID NO: 190270 - protein, 38 aa, Artificial Sequence
  Description of Artificial Sequence: Synthetic polypeptide
DEAEIRTTNPVATEQYGQCAVCSWEEHNQENFNSETQA

SEQ ID NO: 190271 - protein, 38 aa, Artificial Sequence
  Description of Artificial Sequence: Synthetic polypeptide
DEEEIRTTNPCATEQYGCVCGTWGEDDNQENFNSDTAS

SEQ ID NO: 190272 - protein, 37 aa, Artificial Sequence
  Description of Artificial Sequence: Synthetic polypeptide
DENEIRTTNPVATEQYGSCPMPIMLWPETRSISHQTS

SEQ ID NO: 190273 - protein, 37 aa, Artificial Sequence
  Description of Artificial Sequence: Synthetic polypeptide
DENEIRTTNPVATEQYGSCPMPIMLAPENMSISQQTS

SEQ ID NO: 190274 - protein, 35 aa, Artificial Sequence
  Description of Artificial Sequence: Synthetic polypeptide
DEDEIATTNPVAYEQWGTVCAATAGELPDSTPNDQ

SEQ ID NO: 190275 - protein, 37 aa, Artificial Sequence
  Description of Artificial Sequence: Synthetic polypeptide
QEEEIRTTNPVTTEHWGSVYCWISNDQDDQRQGGGEI

SEQ ID NO: 190276 - protein, 36 aa, Artificial Sequence
  Description of Artificial Sequence: Synthetic polypeptide
DEDEISTTNPVAYEQWGEVCSTPNQGNHGEAGGGEN

SEQ ID NO: 190277 - protein, 37 aa, Artificial Sequence
  Description of Artificial Sequence: Synthetic polypeptide
DEEEISTTNPVAYEQYGQCVCSWGEHNAENFNSDNQS

SEQ ID NO: 190278 - protein, 32 aa, Artificial Sequence
  Description of Artificial Sequence: Synthetic polypeptide
DDSEIASTNPISTECWGNTTAANTWQSRVGPR

SEQ ID NO: 190279 - protein, 38 aa, Artificial Sequence
  Description of Artificial Sequence: Synthetic polypeptide
DENEIRTTNPVATEQYGMVSVEMGMGGGQGQEGAEDGM

SEQ ID NO: 190280 - protein, 38 aa, Artificial Sequence
  Description of Artificial Sequence: Synthetic polypeptide
DENEIRTTNPVATEQYGMVGVIMDNQLIEEGGGEDEMG

SEQ ID NO: 190281 - protein, 36 aa, Artificial Sequence
  Description of Artificial Sequence: Synthetic polypeptide
DEDVIATTNPVATAQWGGCFVAIANNSLQEAPGGNH

SEQ ID NO: 190282 - protein, 36 aa, Artificial Sequence
  Description of Artificial Sequence: Synthetic polypeptide
SEEEIRPTNPCATEQYGCVCATTQGGLVLCEAGDLD

SEQ ID NO: 190283 - protein, 38 aa, Artificial Sequence
  Description of Artificial Sequence: Synthetic polypeptide
DESEIRTTNCVATEQYGAVGNAAGDDNDGEQGGENGAQ

SEQ ID NO: 190284 - protein, 38 aa, Artificial Sequence
  Description of Artificial Sequence: Synthetic polypeptide
DENEIRTTNPVATEQYGMSCPMDIMLWPENRSISQQTS

SEQ ID NO: 190285 - protein, 37 aa, Artificial Sequence
  Description of Artificial Sequence: Synthetic polypeptide
AEDEICATNPVATEQYGVVATVNANNNQQQLGIGNDD

SEQ ID NO: 190286 - protein, 38 aa, Artificial Sequence
  Description of Artificial Sequence: Synthetic polypeptide
DENEIRTTNPVATEQYGMICVSDDDDEGDDEEGEGNQQ

SEQ ID NO: 190287 - protein, 39 aa, Artificial Sequence
  Description of Artificial Sequence: Synthetic polypeptide
DEEEIRTTNPVATEQYGEAHEHAPGVSNENVRTTNNGQE

SEQ ID NO: 190288 - protein, 40 aa, Artificial Sequence
  Description of Artificial Sequence: Synthetic polypeptide
DEEEIRTTNPVATEQYGEAHEHAPGVSNENVVRTTLNGSE

SEQ ID NO: 190289 - protein, 38 aa, Artificial Sequence
  Description of Artificial Sequence: Synthetic polypeptide
DENEIRTTNPVATEQYGMCVWDTDAENGSDGTEESQVE

SEQ ID NO: 190290 - protein, 36 aa, Artificial Sequence
  Description of Artificial Sequence: Synthetic polypeptide
CEEEISTTNPVATEGYGCVCSWGEHNAENFNSETQT

SEQ ID NO: 190291 - protein, 34 aa, Artificial Sequence
  Description of Artificial Sequence: Synthetic polypeptide
DDSEVASTNPVSTEGYGCVCATWGTIQERFGSQR

SEQ ID NO: 190292 - protein, 38 aa, Artificial Sequence
  Description of Artificial Sequence: Synthetic polypeptide
SEEEIRSTNPAATEFYGQVVNNDLDQIMDGRGETREQE

SEQ ID NO: 190293 - protein, 38 aa, Artificial Sequence
  Description of Artificial Sequence: Synthetic polypeptide
DEEEIRTTNPVATEQYGECKISNSSVEVHEWLVENDVG

SEQ ID NO: 190294 - protein, 37 aa, Artificial Sequence
  Description of Artificial Sequence: Synthetic polypeptide
DEEEIRTTNPVATEQYGEIYEEMAILEHEVQGVFLEQ

SEQ ID NO: 190295 - protein, 37 aa, Artificial Sequence
  Description of Artificial Sequence: Synthetic polypeptide
DEEEIRTTNPVATEQYGEIYEENVAINEEVNPPFLLA

SEQ ID NO: 190296 - protein, 37 aa, Artificial Sequence
  Description of Artificial Sequence: Synthetic polypeptide
DEEEIRTTNPVATEQYGENACRFPAQEEASTQEVNDM

SEQ ID NO: 190297 - protein, 36 aa, Artificial Sequence
  Description of Artificial Sequence: Synthetic polypeptide
DESEIRTTNCVATDAYGVVNVTRGGQGQLEGGNGDT

SEQ ID NO: 190298 - protein, 37 aa, Artificial Sequence
  Description of Artificial Sequence: Synthetic polypeptide
DDSCIRTTNPVATEQYGCSVCSWWPNVIIDNSMQNVT

SEQ ID NO: 190299 - protein, 38 aa, Artificial Sequence
  Description of Artificial Sequence: Synthetic polypeptide
DESEIRTTNCVATDAYGSVSNVTRGVNQGQLEGGVGDT

SEQ ID NO: 190300 - protein, 39 aa, Artificial Sequence
  Description of Artificial Sequence: Synthetic polypeptide
DEEEIRTTNPVATEQYGESEHCCSSNTGIEAIHNTQSLT

SEQ ID NO: 190301 - protein, 38 aa, Artificial Sequence
  Description of Artificial Sequence: Synthetic polypeptide
DENEIRTTNPVATEQYGDVVIMTQGGPEGMLINDVGIE

SEQ ID NO: 190302 - protein, 34 aa, Artificial Sequence
  Description of Artificial Sequence: Synthetic polypeptide
DEEAIATTNPVAYEEWGYCHTTDGGDHQRGMDEA

SEQ ID NO: 190303 - protein, 38 aa, Artificial Sequence
  Description of Artificial Sequence: Synthetic polypeptide
DEAEIRTTNPVATEQYGHYWVNVDEEERSDTSGQEQMF

SEQ ID NO: 190304 - protein, 37 aa, Artificial Sequence
  Description of Artificial Sequence: Synthetic polypeptide
DEAEIRTTNPVATEQYGHYWNNVSEERSDQTSTEEMN

SEQ ID NO: 190305 - protein, 37 aa, Artificial Sequence
  Description of Artificial Sequence: Synthetic polypeptide
DEAEIRTTNPVATEQYGHYWNNVSEEERSDTSIEKGF

SEQ ID NO: 190306 - protein, 35 aa, Artificial Sequence
  Description of Artificial Sequence: Synthetic polypeptide
DEDEIATTNPVAYEQWGTNCAATAGELPDSGSNDK

SEQ ID NO: 190307 - protein, 37 aa, Artificial Sequence
  Description of Artificial Sequence: Synthetic polypeptide
DESEIRTTNCVATDAYGSVNQTRGQNQGQLEGGQGDT

SEQ ID NO: 190308 - protein, 36 aa, Artificial Sequence
  Description of Artificial Sequence: Synthetic polypeptide
DDSCIRTTNPVATEQYGCVCSWWPNTIIDNSEQNET

SEQ ID NO: 190309 - protein, 37 aa, Artificial Sequence
  Description of Artificial Sequence: Synthetic polypeptide
DEEEISTTNPVAYEQYGQCVCSWGEHNAEGFNSDNQG

SEQ ID NO: 190310 - protein, 38 aa, Artificial Sequence
  Description of Artificial Sequence: Synthetic polypeptide
DESEIRTTNCVATEQYGDVAANMDTGINGEFGDARGQA

SEQ ID NO: 190311 - protein, 37 aa, Artificial Sequence
  Description of Artificial Sequence: Synthetic polypeptide
DEEEISTVNPVATEQYGCVCSWGEDHNTEYFNSQTQS

SEQ ID NO: 190312 - protein, 37 aa, Artificial Sequence
  Description of Artificial Sequence: Synthetic polypeptide
DEEEISTTNPVAYEQYGQCVCSWGEHNAENFNSDTQP

SEQ ID NO: 190313 - protein, 36 aa, Artificial Sequence
  Description of Artificial Sequence: Synthetic polypeptide
DEDEIATTNPVAYEQWGTTFACAATAGELPDSGSNR

SEQ ID NO: 190314 - protein, 37 aa, Artificial Sequence
  Description of Artificial Sequence: Synthetic polypeptide
DEEEISTTNPVAYEQYGQCVCSWGEHNAENFNSDTQS

SEQ ID NO: 190315 - protein, 37 aa, Artificial Sequence
  Description of Artificial Sequence: Synthetic polypeptide
DEEEISTTNPVAYEQYGQCVCSWGEHNAENFNSETQA

SEQ ID NO: 190316 - protein, 37 aa, Artificial Sequence
  Description of Artificial Sequence: Synthetic polypeptide
DEEEISTTNPVAYEQYGQCVCSWGEHNQENFGSDTQS

SEQ ID NO: 190317 - protein, 37 aa, Artificial Sequence
  Description of Artificial Sequence: Synthetic polypeptide
DEEEISTTNPVAYEQYGQCVCSWGEHNQENFNSQNQA

SEQ ID NO: 190318 - protein, 33 aa, Artificial Sequence
  Description of Artificial Sequence: Synthetic polypeptide
DDSEVASTNPVSTEGYGCVCATWEHQERFGQQA

SEQ ID NO: 190319 - protein, 38 aa, Artificial Sequence
  Description of Artificial Sequence: Synthetic polypeptide
QEEEIRTTNPVGTEQYGSVVNVTMPEGPEMGQGENEEG

SEQ ID NO: 190320 - protein, 36 aa, Artificial Sequence
  Description of Artificial Sequence: Synthetic polypeptide
DDAEISTTNPVATEQYGCVCSWGEDHNQESFNSDQS

SEQ ID NO: 190321 - protein, 37 aa, Artificial Sequence
  Description of Artificial Sequence: Synthetic polypeptide
DEEEISTTNPVAYEQYGQCVCSWGPHNAENFNSETQS

SEQ ID NO: 190322 - protein, 35 aa, Artificial Sequence
  Description of Artificial Sequence: Synthetic polypeptide
DEDEISTTNPVAYERWGSVSGGNPGNAGEHKGQDN

SEQ ID NO: 190323 - protein, 34 aa, Artificial Sequence
  Description of Artificial Sequence: Synthetic polypeptide
SEEEIRTTNPIATECWGSTTWANEEDWAPKGPYI

SEQ ID NO: 190324 - protein, 37 aa, Artificial Sequence
  Description of Artificial Sequence: Synthetic polypeptide
DEEEISTTNPVAYEQYGQCVCSWMEDDNQYFNSDNQA

SEQ ID NO: 190325 - protein, 37 aa, Artificial Sequence
  Description of Artificial Sequence: Synthetic polypeptide
DEEEISTTNPVAYEQYGQCVCSWMEDHNQENFGSQQN

SEQ ID NO: 190326 - protein, 37 aa, Artificial Sequence
  Description of Artificial Sequence: Synthetic polypeptide
DEEEISTVNPVATEQYGCVCSWGEDPNAENFNSQNQS

SEQ ID NO: 190327 - protein, 37 aa, Artificial Sequence
  Description of Artificial Sequence: Synthetic polypeptide
DEDEIVTTNPVATEGYGSVVMGTPEMDINEDNEGGEF

SEQ ID NO: 190328 - protein, 34 aa, Artificial Sequence
  Description of Artificial Sequence: Synthetic polypeptide
SEEEIRTTNPCATEEYGCVCGWGEHAENFGSDAA

SEQ ID NO: 190329 - protein, 37 aa, Artificial Sequence
  Description of Artificial Sequence: Synthetic polypeptide
DEMEISTTNPVATEQYGQCVCSNWEHNQENFNSDNQS

SEQ ID NO: 190330 - protein, 37 aa, Artificial Sequence
  Description of Artificial Sequence: Synthetic polypeptide
SEEEIRTTNPCATECYGCVCTIDSNNHNGQQGGDHET

SEQ ID NO: 190331 - protein, 38 aa, Artificial Sequence
  Description of Artificial Sequence: Synthetic polypeptide
DENEIRTTNPVATEQYGQCVCSNWGEHNIEFFNSDTQS

SEQ ID NO: 190332 - protein, 37 aa, Artificial Sequence
  Description of Artificial Sequence: Synthetic polypeptide
DEQEIATTNPVAYEQYGSVVAPPNGGLPTVENPNEKA

SEQ ID NO: 190333 - protein, 37 aa, Artificial Sequence
  Description of Artificial Sequence: Synthetic polypeptide
DEAEISTTNPVATEQYGCVCSNWEEHNQENFGSETQA

SEQ ID NO: 190334 - protein, 36 aa, Artificial Sequence
  Description of Artificial Sequence: Synthetic polypeptide
DQEEIRCTNPVAYEQWGHKTVVCANAFSGRPGGNDV

SEQ ID NO: 190335 - protein, 33 aa, Artificial Sequence
  Description of Artificial Sequence: Synthetic polypeptide
DEDENSTTNPVAYESWGCVYYGDQPDHNREGAE

SEQ ID NO: 190336 - protein, 37 aa, Artificial Sequence
  Description of Artificial Sequence: Synthetic polypeptide
DEEEISTTNPVGTEQYGCVCSNWGEDDNAENFNSQQA

SEQ ID NO: 190337 - protein, 36 aa, Artificial Sequence
  Description of Artificial Sequence: Synthetic polypeptide
DEEEISTTNPVGTEQYGCVCSSGEDHNANFNSDTQA

SEQ ID NO: 190338 - protein, 38 aa, Artificial Sequence
  Description of Artificial Sequence: Synthetic polypeptide
DEEEISTTNPVSTEQYGCVCGNWGEDLNQEGFGSQTQA

SEQ ID NO: 190339 - protein, 36 aa, Artificial Sequence
  Description of Artificial Sequence: Synthetic polypeptide
DEEEISTTNPVSTEQYGCVCGWEEDNQEGFGSQTQS

SEQ ID NO: 190340 - protein, 36 aa, Artificial Sequence
  Description of Artificial Sequence: Synthetic polypeptide
DEEEISTTNPVSTEQYGCVCQNWGEHNAEGFISQQS

SEQ ID NO: 190341 - protein, 35 aa, Artificial Sequence
  Description of Artificial Sequence: Synthetic polypeptide
DEDSEATTNPVAYEQWGTVATQNGGQQNGGQRGEE

SEQ ID NO: 190342 - protein, 36 aa, Artificial Sequence
  Description of Artificial Sequence: Synthetic polypeptide
DDAEISTTNPVATEQYGCVCSWGEDNAEYFNSDTQS

SEQ ID NO: 190343 - protein, 38 aa, Artificial Sequence
  Description of Artificial Sequence: Synthetic polypeptide
AEDEICATNPVATEQYGVVATVVNNQLLQQGNGNQEDD

SEQ ID NO: 190344 - protein, 34 aa, Artificial Sequence
  Description of Artificial Sequence: Synthetic polypeptide
DESEIRTTNPIATECWGATVWAAADWQSPKGPYI

SEQ ID NO: 190345 - protein, 37 aa, Artificial Sequence
  Description of Artificial Sequence: Synthetic polypeptide
DEEEIRTTNPVGTEHWGSVYCWIPNDQDDQQEGGDSI

SEQ ID NO: 190346 - protein, 38 aa, Artificial Sequence
  Description of Artificial Sequence: Synthetic polypeptide
DEVEIATTNPVATEQYGSVGDDNDEEGGQNDDGTDGFG

SEQ ID NO: 190347 - protein, 34 aa, Artificial Sequence
  Description of Artificial Sequence: Synthetic polypeptide
DEAEIATTNPVAYEPYGETAAMAGDQVSNDNTPR

SEQ ID NO: 190348 - protein, 35 aa, Artificial Sequence
  Description of Artificial Sequence: Synthetic polypeptide
DENEIRTTNPVSTEPYGCICSWEEDNQEYFGSDQS

SEQ ID NO: 190349 - protein, 35 aa, Artificial Sequence
  Description of Artificial Sequence: Synthetic polypeptide
DENEIRTTNPVSTEPYGCICSWEDINQESFGSDQG

SEQ ID NO: 190350 - protein, 35 aa, Artificial Sequence
  Description of Artificial Sequence: Synthetic polypeptide
AENEIATTNPVATEQYGCVAANGDEATMPMGDPHN

SEQ ID NO: 190351 - protein, 34 aa, Artificial Sequence
  Description of Artificial Sequence: Synthetic polypeptide
DENEIRTTNPVSTEPWGTISNMEDIQQQQNGPYH

SEQ ID NO: 190352 - protein, 36 aa, Artificial Sequence
  Description of Artificial Sequence: Synthetic polypeptide
DEACIRTTNPVATEQYGCVCEWGEPNQEYFGSDTQA

SEQ ID NO: 190353 - protein, 35 aa, Artificial Sequence
  Description of Artificial Sequence: Synthetic polypeptide
CEDEIACTNPVATEQWGCVAGTAGQLQNEMGGTLI

SEQ ID NO: 190354 - protein, 35 aa, Artificial Sequence
  Description of Artificial Sequence: Synthetic polypeptide
AENEIATTNPVATEGYGQCVCSWEHNQHFSSENLA

SEQ ID NO: 190355 - protein, 39 aa, Artificial Sequence
  Description of Artificial Sequence: Synthetic polypeptide
DEEEISTTNPVATEQYGQCVCSTWEEDHNQENFPSQNQL

SEQ ID NO: 190356 - protein, 37 aa, Artificial Sequence
  Description of Artificial Sequence: Synthetic polypeptide
DEMEIATTNPVATEQYGCVCQNWGEDNAEHFGSENQA

SEQ ID NO: 190357 - protein, 35 aa, Artificial Sequence
  Description of Artificial Sequence: Synthetic polypeptide
AENEIATTNPVATEGYGICVCSWELNQEHFISEQA

SEQ ID NO: 190358 - protein, 39 aa, Artificial Sequence
  Description of Artificial Sequence: Synthetic polypeptide
DEEEISTTNPVATEQYGQCVCSTWGEDHNAEFFNSDNQS

SEQ ID NO: 190359 - protein, 37 aa, Artificial Sequence
  Description of Artificial Sequence: Synthetic polypeptide
DEMEIATTNPVATEQYGCVCGTWGEHNEEHFGSETQA

SEQ ID NO: 190360 - protein, 38 aa, Artificial Sequence
  Description of Artificial Sequence: Synthetic polypeptide
DEVEIATTNPVATEQYGSVCSADNPPGDNAHQGDEEAM

SEQ ID NO: 190361 - protein, 38 aa, Artificial Sequence
  Description of Artificial Sequence: Synthetic polypeptide
DEVEIATTNPVATEQYGVSACSAANPAEADAEIGNNTA

SEQ ID NO: 190362 - protein, 39 aa, Artificial Sequence
  Description of Artificial Sequence: Synthetic polypeptide
DEEEISTTNPVATEQYGQCVCSTWGEDHNAEHFNSDTQL

SEQ ID NO: 190363 - protein, 39 aa, Artificial Sequence
  Description of Artificial Sequence: Synthetic polypeptide
DEEEISTTNPVATEQYGQCVCSTWGEDHNAEHFNSENQA

SEQ ID NO: 190364 - protein, 38 aa, Artificial Sequence
  Description of Artificial Sequence: Synthetic polypeptide
VEEEIACTNPVATEQYGSVCAATANVGGEEHQDDNLAQ

SEQ ID NO: 190365 - protein, 37 aa, Artificial Sequence
  Description of Artificial Sequence: Synthetic polypeptide
SEEEIRTTNPVAYEQYGCVCSWEEDHNAENFNSDFQA

SEQ ID NO: 190366 - protein, 37 aa, Artificial Sequence
  Description of Artificial Sequence: Synthetic polypeptide
SEEEIRTTNPVAYEQYGCVCSNWGEDNQENFGSDTQS

SEQ ID NO: 190367 - protein, 37 aa, Artificial Sequence
  Description of Artificial Sequence: Synthetic polypeptide
DEQEIATTNPVAYEQWGSVTGGNENDQQGNQMGNQPE

SEQ ID NO: 190368 - protein, 38 aa, Artificial Sequence
  Description of Artificial Sequence: Synthetic polypeptide
DEEEIRTTNPVATEQYGVQCVNVLDKLAPDRMDMELEQ

SEQ ID NO: 190369 - protein, 39 aa, Artificial Sequence
  Description of Artificial Sequence: Synthetic polypeptide
DEEEISTTNPVATEQYGQCVCSTWGEDHNAENFGSDTQP

SEQ ID NO: 190370 - protein, 39 aa, Artificial Sequence
  Description of Artificial Sequence: Synthetic polypeptide
DEEEISTTNPVATEQYGQCVCSTWGEDHNAENFGSDTQS

SEQ ID NO: 190371 - protein, 39 aa, Artificial Sequence
  Description of Artificial Sequence: Synthetic polypeptide
DEEEISTTNPVATEQYGQCVCSTWGEDHNAEYFNSENQA

SEQ ID NO: 190372 - protein, 39 aa, Artificial Sequence
  Description of Artificial Sequence: Synthetic polypeptide
DEEEISTTNPVATEQYGQCVCSTWGEDHNAEYFNSETQS

SEQ ID NO: 190373 - protein, 39 aa, Artificial Sequence
  Description of Artificial Sequence: Synthetic polypeptide
DEEEISTTNPVATEQYGQCVCSTWGEDHNQENFGSDFQF

SEQ ID NO: 190374 - protein, 35 aa, Artificial Sequence
  Description of Artificial Sequence: Synthetic polypeptide
AENEIATTNPVATEGYGCVCSWGELHNQHFISEQA

SEQ ID NO: 190375 - protein, 39 aa, Artificial Sequence
  Description of Artificial Sequence: Synthetic polypeptide
DEEEISTTNPVATEQYGQCVCSTWGEDHNQEYFNSDTQS

SEQ ID NO: 190376 - protein, 39 aa, Artificial Sequence
  Description of Artificial Sequence: Synthetic polypeptide
DEEEISTTNPVATEQYGQCVCSTWGEDHNAEHFNSDNQA

SEQ ID NO: 190377 - protein, 35 aa, Artificial Sequence
  Description of Artificial Sequence: Synthetic polypeptide
DENEIRTTNPVSTEPWGTISCMEDISQQQNVGNNH

SEQ ID NO: 190378 - protein, 38 aa, Artificial Sequence
  Description of Artificial Sequence: Synthetic polypeptide
DEEEIRTVNPVATEQYGQCVCSNWEEDNQENFNSQNQA

SEQ ID NO: 190379 - protein, 38 aa, Artificial Sequence
  Description of Artificial Sequence: Synthetic polypeptide
DEEEIRTVNPVATEQYGQCVCSNWGEDHNQYFNSQTQS

SEQ ID NO: 190380 - protein, 38 aa, Artificial Sequence
  Description of Artificial Sequence: Synthetic polypeptide
DEEEIRTTNPVATEQWGYANVAAMFGEDQHQRPGQGQT

SEQ ID NO: 190381 - protein, 37 aa, Artificial Sequence
  Description of Artificial Sequence: Synthetic polypeptide
SEEEISTTNPVATEQYGCVCSNSGEDNAENFNSDTQA

SEQ ID NO: 190382 - protein, 36 aa, Artificial Sequence
  Description of Artificial Sequence: Synthetic polypeptide
DEVEIATTNPVATECYGCVCQTLIDEKDQHGQGDDN

SEQ ID NO: 190383 - protein, 39 aa, Artificial Sequence
  Description of Artificial Sequence: Synthetic polypeptide
DEEEIRTTNPVATEQWGYANVAAMFDELQHERPGQGLEV

SEQ ID NO: 190384 - protein, 36 aa, Artificial Sequence
  Description of Artificial Sequence: Synthetic polypeptide
DEQEIATTNPVATEQYGCACAANNGEEAGMEMDNNH

SEQ ID NO: 190385 - protein, 38 aa, Artificial Sequence
  Description of Artificial Sequence: Synthetic polypeptide
SEEEISTTNPVATEQYGCVCGNWGADHNQENFGSDNQS

SEQ ID NO: 190386 - protein, 36 aa, Artificial Sequence
  Description of Artificial Sequence: Synthetic polypeptide
DEQEIATTNPVATEQYGCNVAANGDGATMPMGDGHN

SEQ ID NO: 190387 - protein, 37 aa, Artificial Sequence
  Description of Artificial Sequence: Synthetic polypeptide
DEEEIRTTNPVGTEQYGCVCSNSGEDHNINFNSDTQA

SEQ ID NO: 190388 - protein, 36 aa, Artificial Sequence
  Description of Artificial Sequence: Synthetic polypeptide
SEEEISTTNPVATEGYGCVCSWGEHNAENFNSDTQA

SEQ ID NO: 190389 - protein, 37 aa, Artificial Sequence
  Description of Artificial Sequence: Synthetic polypeptide
SEEEISTTNPVATEGYGCVCSNTGELNAENFGSDTQS

SEQ ID NO: 190390 - protein, 36 aa, Artificial Sequence
  Description of Artificial Sequence: Synthetic polypeptide
SEEEISTTNPVATEGYGCVCSNSEEHNQNFNSENQA

SEQ ID NO: 190391 - protein, 38 aa, Artificial Sequence
  Description of Artificial Sequence: Synthetic polypeptide
DECEICTTNPVAVEQYGVVSTVTVNANSEQGSTVNVED

SEQ ID NO: 190392 - protein, 37 aa, Artificial Sequence
  Description of Artificial Sequence: Synthetic polypeptide
SEEEISTTNPCATEQYGCVCSNWGEHNAEYFGSDNQS

SEQ ID NO: 190393 - protein, 35 aa, Artificial Sequence
  Description of Artificial Sequence: Synthetic polypeptide
SEEEISTTNPCATEQYGCVCPWEHNQENFNSDTQA

SEQ ID NO: 190394 - protein, 36 aa, Artificial Sequence
  Description of Artificial Sequence: Synthetic polypeptide
DEVEIATTNPVATEQYGSVCAGVHAGAGAGIGPEQW

SEQ ID NO: 190395 - protein, 37 aa, Artificial Sequence
  Description of Artificial Sequence: Synthetic polypeptide
DEMEIATTNPVATEQYGCVCSNSEDLNEEHFGSETQA

SEQ ID NO: 190396 - protein, 37 aa, Artificial Sequence
  Description of Artificial Sequence: Synthetic polypeptide
DEVEIATTNPVATEQWGCNVAGNNGGLPEENNHGGNV

SEQ ID NO: 190397 - protein, 37 aa, Artificial Sequence
  Description of Artificial Sequence: Synthetic polypeptide
DEEEIRTTNPVGTEQWGSVTGTAVEHGGEEGGDIDAM

SEQ ID NO: 190398 - protein, 37 aa, Artificial Sequence
  Description of Artificial Sequence: Synthetic polypeptide
DEHEIRTTNPVGTEHWGSVYCWIPNDQDDQMQGGDNI

SEQ ID NO: 190399 - protein, 35 aa, Artificial Sequence
  Description of Artificial Sequence: Synthetic polypeptide
SEEEISCTNPCATEQYGCVCSWGEHNAEYFNSDQS

SEQ ID NO: 190400 - protein, 35 aa, Artificial Sequence
  Description of Artificial Sequence: Synthetic polypeptide
SEEEISCTNPCATEQYGCVCSWGEDNAHFGSDTQA

SEQ ID NO: 190401 - protein, 35 aa, Artificial Sequence
  Description of Artificial Sequence: Synthetic polypeptide
SEEEISCTNPCATEQYGCVCSWEEDNAENFGSDQS

SEQ ID NO: 190402 - protein, 35 aa, Artificial Sequence
  Description of Artificial Sequence: Synthetic polypeptide
SEEEISCTNPCATEQYGCVCSNWMEDNANFGSDQS

SEQ ID NO: 190403 - protein, 34 aa, Artificial Sequence
  Description of Artificial Sequence: Synthetic polypeptide
DEVEIATTNPVATEQWGTNCAATDGPVEFEINDM

SEQ ID NO: 190404 - protein, 36 aa, Artificial Sequence
  Description of Artificial Sequence: Synthetic polypeptide
DEVEIATTNPVATEQYGCSAANSGLPPAEAEPNHHH

SEQ ID NO: 190405 - protein, 37 aa, Artificial Sequence
  Description of Artificial Sequence: Synthetic polypeptide
DEVEIATTNPVATEQYGSACAANPELGQEHQDDEMAH

SEQ ID NO: 190406 - protein, 37 aa, Artificial Sequence
  Description of Artificial Sequence: Synthetic polypeptide
DEAEIRTTNPVATEQYGSYNWEALPDDLGGSGQEEIG

SEQ ID NO: 190407 - protein, 37 aa, Artificial Sequence
  Description of Artificial Sequence: Synthetic polypeptide
AENEIATTNPVATEQYGQLVVACTYEHSQRPGTMPQV

SEQ ID NO: 190408 - protein, 36 aa, Artificial Sequence
  Description of Artificial Sequence: Synthetic polypeptide
AENEIATTNPVATEQYGQLVACTYEHSQQPGTMPQW

SEQ ID NO: 190409 - protein, 36 aa, Artificial Sequence
  Description of Artificial Sequence: Synthetic polypeptide
AENEIATTNPVATEQYGQLVACIAEHSQRPGTMPQW

SEQ ID NO: 190410 - protein, 36 aa, Artificial Sequence
  Description of Artificial Sequence: Synthetic polypeptide
AENEIATTNPVATESYGQLVACTYEHSQRPGTSPQW

SEQ ID NO: 190411 - protein, 39 aa, Artificial Sequence
  Description of Artificial Sequence: Synthetic polypeptide
DEEEISTTNPVATEQYGQCVCSTWGEDTNAENFNSDTQS

SEQ ID NO: 190412 - protein, 37 aa, Artificial Sequence
  Description of Artificial Sequence: Synthetic polypeptide
DEEEIRTTNPVATEQYGVIYGEPSFEMGITQTVETTG

SEQ ID NO: 190413 - protein, 36 aa, Artificial Sequence
  Description of Artificial Sequence: Synthetic polypeptide
AENEIATTNPVATEGYGCVCSWEELNQEHFISENQA

SEQ ID NO: 190414 - protein, 38 aa, Artificial Sequence
  Description of Artificial Sequence: Synthetic polypeptide
DEEEISTTNPVATEQYGQCVCSWGEDDNQENFNSDNQS

SEQ ID NO: 190415 - protein, 38 aa, Artificial Sequence
  Description of Artificial Sequence: Synthetic polypeptide
DEEEISTTNPVATEQYGQCVCSWGEDHNAENFFSENQS

SEQ ID NO: 190416 - protein, 38 aa, Artificial Sequence
  Description of Artificial Sequence: Synthetic polypeptide
DEEEISTTNPVATEQYGQCVCSWGEDHNAENFGSDTQA

SEQ ID NO: 190417 - protein, 38 aa, Artificial Sequence
  Description of Artificial Sequence: Synthetic polypeptide
DEEEISTTNPVATEQYGQCVCSWGEDHNAENFNSDTQA

SEQ ID NO: 190418 - protein, 38 aa, Artificial Sequence
  Description of Artificial Sequence: Synthetic polypeptide
DEEEISTTNPVATEQYGQCVCSWGEDHNAENFNSDTQS

SEQ ID NO: 190419 - protein, 33 aa, Artificial Sequence
  Description of Artificial Sequence: Synthetic polypeptide
CEDEIACTNPVATEQWGCVAGTGLALAMDDFML

SEQ ID NO: 190420 - protein, 38 aa, Artificial Sequence
  Description of Artificial Sequence: Synthetic polypeptide
DEEEISTTNPVATEQYGQCVCSWGEDHNAENFNSETQS

SEQ ID NO: 190421 - protein, 38 aa, Artificial Sequence
  Description of Artificial Sequence: Synthetic polypeptide
DEEEISTTNPVATEQYGQCVCSWGEDHNAEYFNSETQS

SEQ ID NO: 190422 - protein, 38 aa, Artificial Sequence
  Description of Artificial Sequence: Synthetic polypeptide
DEEEISTTNPVATEQYGQCVCSWGEDHNIEYFNSEFQS

SEQ ID NO: 190423 - protein, 38 aa, Artificial Sequence
  Description of Artificial Sequence: Synthetic polypeptide
DEEEISTTNPVATEQYGQCVCSWGEDHNQEFFGSDTQA

SEQ ID NO: 190424 - protein, 38 aa, Artificial Sequence
  Description of Artificial Sequence: Synthetic polypeptide
DEEEISTTNPVATEQYGQCVCSWGEDHNQEFFGSDTQQ

SEQ ID NO: 190425 - protein, 38 aa, Artificial Sequence
  Description of Artificial Sequence: Synthetic polypeptide
DEEEISTTNPVATEQYGQCVCSWGEDHNQENFGSDTQA

SEQ ID NO: 190426 - protein, 38 aa, Artificial Sequence
  Description of Artificial Sequence: Synthetic polypeptide
DEEEISTTNPVATEQYGQCVCSWGEDHNQENFGSDTQS

SEQ ID NO: 190427 - protein, 37 aa, Artificial Sequence
  Description of Artificial Sequence: Synthetic polypeptide
DEEEIRTTNPVATEQYGVCVHPVPVHMPNFVDMFLEG

SEQ ID NO: 190428 - protein, 38 aa, Artificial Sequence
  Description of Artificial Sequence: Synthetic polypeptide
DEEEISTTNPVATEQYGQCVCSWGEDDNIENFNSDNQS

SEQ ID NO: 190429 - protein, 35 aa, Artificial Sequence
  Description of Artificial Sequence: Synthetic polypeptide
DENEIRTTNPVSTEGYGCICSWEEPNAENFGSDQA

SEQ ID NO: 190430 - protein, 37 aa, Artificial Sequence
  Description of Artificial Sequence: Synthetic polypeptide
DENEIRTTNPVSTEGYGCICSWEEGHNQEQFGSDNQA

SEQ ID NO: 190431 - protein, 36 aa, Artificial Sequence
  Description of Artificial Sequence: Synthetic polypeptide
DEAEISTTNPVATEQYGCTCSWGEHNQENFNSDNQS

SEQ ID NO: 190432 - protein, 37 aa, Artificial Sequence
  Description of Artificial Sequence: Synthetic polypeptide
VEEEIATTNPVATEQWGGCCTAAAGNLDDGMPGDNHA

SEQ ID NO: 190433 - protein, 38 aa, Artificial Sequence
  Description of Artificial Sequence: Synthetic polypeptide
DEEEIATTNPVATEQWGVTVAGTPGGLPQGNMEAENNW

SEQ ID NO: 190434 - protein, 38 aa, Artificial Sequence
  Description of Artificial Sequence: Synthetic polypeptide
DEEEISTTNPVATEQYGQCVCSWGEDPNAENFNSDNQL

SEQ ID NO: 190435 - protein, 35 aa, Artificial Sequence
  Description of Artificial Sequence: Synthetic polypeptide
DENEIRTTNPVSTEGYGCICSWEDHNQENFGSQQS

SEQ ID NO: 190436 - protein, 34 aa, Artificial Sequence
  Description of Artificial Sequence: Synthetic polypeptide
DEQEIATTNPVAYEQWGVTCVVWDNGNGDGGGAH

SEQ ID NO: 190437 - protein, 38 aa, Artificial Sequence
  Description of Artificial Sequence: Synthetic polypeptide
DEEEISTTNPVATEQYGQCVCSWGEGHNQENFGSETQS

SEQ ID NO: 190438 - protein, 37 aa, Artificial Sequence
  Description of Artificial Sequence: Synthetic polypeptide
DENEIRTTNPVSTEGYGCICSTWEEHNAEHFGSDNQS

SEQ ID NO: 190439 - protein, 37 aa, Artificial Sequence
  Description of Artificial Sequence: Synthetic polypeptide
DENEIRTTNPVSTEGYGCICSTWEEDNQEYFGSDNQA

SEQ ID NO: 190440 - protein, 36 aa, Artificial Sequence
  Description of Artificial Sequence: Synthetic polypeptide
DESEIRTTNPVATEQYGSHPYQTDEEDITPSIEEFP

SEQ ID NO: 190441 - protein, 37 aa, Artificial Sequence
  Description of Artificial Sequence: Synthetic polypeptide
DENEIRTTNPVSTEGYGCICSNWEAHNQEQFGSDNQA

SEQ ID NO: 190442 - protein, 37 aa, Artificial Sequence
  Description of Artificial Sequence: Synthetic polypeptide
DEAEISTTNPVATEQYGCVCGNSGEHNEENFGSETQS

SEQ ID NO: 190443 - protein, 36 aa, Artificial Sequence
  Description of Artificial Sequence: Synthetic polypeptide
DESEIRTTNPVATEQYGSCPYQTDEEDITISIEEWP

SEQ ID NO: 190444 - protein, 35 aa, Artificial Sequence
  Description of Artificial Sequence: Synthetic polypeptide
DENEIRTTNPVSTEGYGCICSWEEHNQEQFNSDTQ

SEQ ID NO: 190445 - protein, 38 aa, Artificial Sequence
  Description of Artificial Sequence: Synthetic polypeptide
DEEEISTTNPVATEQYGQCVCSWGEDDNAENFNSDNQS

SEQ ID NO: 190446 - protein, 37 aa, Artificial Sequence
  Description of Artificial Sequence: Synthetic polypeptide
DEVEIATTNPVAYEQWGMVSIPGAGNAGDQRKGDVAK

SEQ ID NO: 190447 - protein, 32 aa, Artificial Sequence
  Description of Artificial Sequence: Synthetic polypeptide
CEDEIACTNPVATEQWGCVAGTGDEAMSMEDS

SEQ ID NO: 190448 - protein, 34 aa, Artificial Sequence
  Description of Artificial Sequence: Synthetic polypeptide
AENEIATTNPVATEGYGCVCSWEDHQEHFISELA

SEQ ID NO: 190449 - protein, 33 aa, Artificial Sequence
  Description of Artificial Sequence: Synthetic polypeptide
AENEIATTNPVATEGYGCVCSWEDAEHFISELA

SEQ ID NO: 190450 - protein, 35 aa, Artificial Sequence
  Description of Artificial Sequence: Synthetic polypeptide
DENEIRTTNPVSTEPWGTISCMEDEISQQQNGGNH

SEQ ID NO: 190451 - protein, 36 aa, Artificial Sequence
  Description of Artificial Sequence: Synthetic polypeptide
CTGEIRTTNPVATEAYGSVNDQAINNGQEEEQGGGI

SEQ ID NO: 190452 - protein, 39 aa, Artificial Sequence
  Description of Artificial Sequence: Synthetic polypeptide
DEEEISTTNPVATEQYGQCVCSTWGELHNAENFNSDTQS

SEQ ID NO: 190453 - protein, 36 aa, Artificial Sequence
  Description of Artificial Sequence: Synthetic polypeptide
VEEEIACTNPVAYEQYGSACSVAPHLNEAPAGEARN

SEQ ID NO: 190454 - protein, 38 aa, Artificial Sequence
  Description of Artificial Sequence: Synthetic polypeptide
DEEEISTTNPVATEQYGQCVCSVWGEDHNQNFNSDTQS

SEQ ID NO: 190455 - protein, 37 aa, Artificial Sequence
  Description of Artificial Sequence: Synthetic polypeptide
DEEEISTTNPVATEQYGQCVCSWEEAHNQNFISEFQS

SEQ ID NO: 190456 - protein, 38 aa, Artificial Sequence
  Description of Artificial Sequence: Synthetic polypeptide
DEEEISTTNPVATEQYGQCVCSWEEDDNAENFNSDTQS

SEQ ID NO: 190457 - protein, 38 aa, Artificial Sequence
  Description of Artificial Sequence: Synthetic polypeptide
DEEEISTTNPVATEQYGQCVCSWEEDHNAENFNSDTQA

SEQ ID NO: 190458 - protein, 38 aa, Artificial Sequence
  Description of Artificial Sequence: Synthetic polypeptide
DEEEISTTNPVATEQYGQCVCSWEEDHNAENFNSDTQG

SEQ ID NO: 190459 - protein, 38 aa, Artificial Sequence
  Description of Artificial Sequence: Synthetic polypeptide
DEEEISTTNPVATEQYGQCVCSWEEDHNQEFFGSDTQA

SEQ ID NO: 190460 - protein, 39 aa, Artificial Sequence
  Description of Artificial Sequence: Synthetic polypeptide
DEEEIRTTNPVATEAYGVVSTVVTNQAGTEAGSVTTEVE

SEQ ID NO: 190461 - protein, 36 aa, Artificial Sequence
  Description of Artificial Sequence: Synthetic polypeptide
CTGEIRTTNPVATEAYGSVNDQAINAGPEEGQGGGI

SEQ ID NO: 190462 - protein, 39 aa, Artificial Sequence
  Description of Artificial Sequence: Synthetic polypeptide
DEEEIRTTNPVATEAYGVVSTVVTNQAGTEAGTVTDEEE

SEQ ID NO: 190463 - protein, 34 aa, Artificial Sequence
  Description of Artificial Sequence: Synthetic polypeptide
DEEEIATTNPVAYEQWGTACAAANGLDSEHVDDS

SEQ ID NO: 190464 - protein, 34 aa, Artificial Sequence
  Description of Artificial Sequence: Synthetic polypeptide
DEVEIATTNPVAYEAWGVVWPGPNNENDGQMGEM

SEQ ID NO: 190465 - protein, 37 aa, Artificial Sequence
  Description of Artificial Sequence: Synthetic polypeptide
VEEEIATTNPVATEQWGCNVAGNNGGLPDENNHGTNP

SEQ ID NO: 190466 - protein, 38 aa, Artificial Sequence
  Description of Artificial Sequence: Synthetic polypeptide
DEEEISTTNPVATEQYGQCVCSWEELHNEENFISDNQS

SEQ ID NO: 190467 - protein, 32 aa, Artificial Sequence
  Description of Artificial Sequence: Synthetic polypeptide
DDSEVASTNPVSTEGWGNVWAANTIQSPVGPR

SEQ ID NO: 190468 - protein, 32 aa, Artificial Sequence
  Description of Artificial Sequence: Synthetic polypeptide
CEDEIACTNPVATEQWGCVAGTGDEAMMDKDD

SEQ ID NO: 190469 - protein, 36 aa, Artificial Sequence
  Description of Artificial Sequence: Synthetic polypeptide
DEAEISTTNPVATEQYGCTCSNWGEHNQEHFGSDQS

SEQ ID NO: 190470 - protein, 36 aa, Artificial Sequence
  Description of Artificial Sequence: Synthetic polypeptide
DEQEIATTNPVAYEQWGSVVCNAAMPRNEDREDGRE

SEQ ID NO: 190471 - protein, 38 aa, Artificial Sequence
  Description of Artificial Sequence: Synthetic polypeptide
SEEEISTTNPVATEQYGCVCSNWGEDHNQENFGSDNQP

SEQ ID NO: 190472 - protein, 38 aa, Artificial Sequence
  Description of Artificial Sequence: Synthetic polypeptide
DEEEIRTTNPVAYEQYGQCVCSNWGADHNQENFGSEQA

SEQ ID NO: 190473 - protein, 36 aa, Artificial Sequence
  Description of Artificial Sequence: Synthetic polypeptide
DESEIRTTNPTAYEAWGISVSCANESSSDREGGMVC

SEQ ID NO: 190474 - protein, 36 aa, Artificial Sequence
  Description of Artificial Sequence: Synthetic polypeptide
DEEEIATTNPVAYEQWGTSACAAANGDAMQAGDQHQ

SEQ ID NO: 190475 - protein, 36 aa, Artificial Sequence
  Description of Artificial Sequence: Synthetic polypeptide
SEEEIRTTNPVAYEQWGHNNVYYWEEQQNREGGHGD

SEQ ID NO: 190476 - protein, 38 aa, Artificial Sequence
  Description of Artificial Sequence: Synthetic polypeptide
QEEEIRTTNPVATEQYGVVSVMDDFNMTGPEDGDEEGG

SEQ ID NO: 190477 - protein, 36 aa, Artificial Sequence
  Description of Artificial Sequence: Synthetic polypeptide
CTGEIRTTNPVATEAYGSVDQAIDNGQPEEGQGGGI

SEQ ID NO: 190478 - protein, 40 aa, Artificial Sequence
  Description of Artificial Sequence: Synthetic polypeptide
DEDEIRTTNPVATEQYGVVSTTNAQNNNQQGIGTTDQGED

SEQ ID NO: 190479 - protein, 33 aa, Artificial Sequence
  Description of Artificial Sequence: Synthetic polypeptide
CEDEIACTNPVATEQWGCVAGTGDATMPMEQRD

SEQ ID NO: 190480 - protein, 37 aa, Artificial Sequence
  Description of Artificial Sequence: Synthetic polypeptide
SEEEISTTNPVATEQYGCVCSNWGEDNQENFNSENQA

SEQ ID NO: 190481 - protein, 37 aa, Artificial Sequence
  Description of Artificial Sequence: Synthetic polypeptide
SEEEISTTNPVATEQYGCVCSNWGEHNAEGFNSENQS

SEQ ID NO: 190482 - protein, 37 aa, Artificial Sequence
  Description of Artificial Sequence: Synthetic polypeptide
SEEEISTTNPVATEQYGCVCSNWGEHNAEHFNSDTQA

SEQ ID NO: 190483 - protein, 39 aa, Artificial Sequence
  Description of Artificial Sequence: Synthetic polypeptide
DEEEIRTTNPVATEAYGVVSTSIGTTEQGSTNDEQGDED

SEQ ID NO: 190484 - protein, 38 aa, Artificial Sequence
  Description of Artificial Sequence: Synthetic polypeptide
DEDEIRTTNPVATEQWGVTVVSTLQQSATNVATEDGSQ

SEQ ID NO: 190485 - protein, 38 aa, Artificial Sequence
  Description of Artificial Sequence: Synthetic polypeptide
DEDEIRTTNPVATEQWGVTVVSTQQQSATNVATEDGSQ

SEQ ID NO: 190486 - protein, 38 aa, Artificial Sequence
  Description of Artificial Sequence: Synthetic polypeptide
DEEEIATTNPVATEQYGCVCSNWGEDHNQENFNSDTQA

SEQ ID NO: 190487 - protein, 33 aa, Artificial Sequence
  Description of Artificial Sequence: Synthetic polypeptide
DEMEIRTTNPIATECWGATCSNAEGWAFEGPYD

SEQ ID NO: 190488 - protein, 38 aa, Artificial Sequence
  Description of Artificial Sequence: Synthetic polypeptide
DEDEIRTTNPVATEQWGVTVVVTEQQSATNVATEDGSM

SEQ ID NO: 190489 - protein, 36 aa, Artificial Sequence
  Description of Artificial Sequence: Synthetic polypeptide
SEEEVSTTNPVATEQYGQCVCSWGEHDQNIGSDTQS

SEQ ID NO: 190490 - protein, 31 aa, Artificial Sequence
  Description of Artificial Sequence: Synthetic polypeptide
QEGEIAPTNPCSYEQWGIAFCNDIQSDGDTR

SEQ ID NO: 190491 - protein, 37 aa, Artificial Sequence
  Description of Artificial Sequence: Synthetic polypeptide
SEEEVSTTNPVATEQYGCVCSTWGEHNAENINSDTQA

SEQ ID NO: 190492 - protein, 33 aa, Artificial Sequence
  Description of Artificial Sequence: Synthetic polypeptide
DDSEVASTNPVSTEGWGNVAANDIQSRMGDQGR

SEQ ID NO: 190493 - protein, 37 aa, Artificial Sequence
  Description of Artificial Sequence: Synthetic polypeptide
DEQEIATTNPVATEQWGVVAVTWDHTQQDDQRGADES

SEQ ID NO: 190494 - protein, 35 aa, Artificial Sequence
  Description of Artificial Sequence: Synthetic polypeptide
DETNEIATTNPVAYEQWGCVYNTNPDGNENGGHEE

SEQ ID NO: 190495 - protein, 36 aa, Artificial Sequence
  Description of Artificial Sequence: Synthetic polypeptide
DETNEIATTNPVAYEQWGCVYSSNNDEMNEQGEGHV

SEQ ID NO: 190496 - protein, 36 aa, Artificial Sequence
  Description of Artificial Sequence: Synthetic polypeptide
DETNEIATTNPVAYEQWGCVYSSNNDEMNERGEGAD

SEQ ID NO: 190497 - protein, 38 aa, Artificial Sequence
  Description of Artificial Sequence: Synthetic polypeptide
DEDEIRTTNPVATEQWGTVVVTTEQQSATNVATEDGSE

SEQ ID NO: 190498 - protein, 37 aa, Artificial Sequence
  Description of Artificial Sequence: Synthetic polypeptide
CEDEIRTTNPVATEFYGSVVNGFNNGQEIGGQSGMGN

SEQ ID NO: 190499 - protein, 38 aa, Artificial Sequence
  Description of Artificial Sequence: Synthetic polypeptide
DEEEIATTNPVATEQYGCVCSNWGEDHNEEGFNSENQA

SEQ ID NO: 190500 - protein, 33 aa, Artificial Sequence
  Description of Artificial Sequence: Synthetic polypeptide
VEDQIACTNPVATEQWGCVAGTAGELINMMNAD

SEQ ID NO: 190501 - protein, 37 aa, Artificial Sequence
  Description of Artificial Sequence: Synthetic polypeptide
SEEEVRTTNPVATEQYGCVCSTWGEHDAENFGSDTQA

SEQ ID NO: 190502 - protein, 39 aa, Artificial Sequence
  Description of Artificial Sequence: Synthetic polypeptide
DEEEISTTNPVATEQYGQCVCSNWMEDHNQEFFGSDNQA

SEQ ID NO: 190503 - protein, 37 aa, Artificial Sequence
  Description of Artificial Sequence: Synthetic polypeptide
SEEEVRTTNPVATEQYGCVCSNWGEHNIENINSDTQS

SEQ ID NO: 190504 - protein, 37 aa, Artificial Sequence
  Description of Artificial Sequence: Synthetic polypeptide
SEEEVRTTNPVATEQYGCVCSNTGEHDQENIISDTQA

SEQ ID NO: 190505 - protein, 35 aa, Artificial Sequence
  Description of Artificial Sequence: Synthetic polypeptide
DETPIQTTNPVAYEQWGCVAACTNNPSHRPPGQYP

SEQ ID NO: 190506 - protein, 38 aa, Artificial Sequence
  Description of Artificial Sequence: Synthetic polypeptide
DEEEISTTNPVATEQYGQCVCSNWMEDNAENFNSENQA

SEQ ID NO: 190507 - protein, 38 aa, Artificial Sequence
  Description of Artificial Sequence: Synthetic polypeptide
DEEEISTTNPVATEQYGQCVCSNWMEHNAEFFNSDTQS

SEQ ID NO: 190508 - protein, 38 aa, Artificial Sequence
  Description of Artificial Sequence: Synthetic polypeptide
DEEEISTTNPVATEQYGQCVCSNWMEHNAENFNSDTQA

SEQ ID NO: 190509 - protein, 38 aa, Artificial Sequence
  Description of Artificial Sequence: Synthetic polypeptide
DEEEIRTTNPVAYEQYGQCVCSNWEEHNAENFISDNQS

SEQ ID NO: 190510 - protein, 38 aa, Artificial Sequence
  Description of Artificial Sequence: Synthetic polypeptide
DEEEISTTNPVATEQYGQCVCSNWMEHNQENFNSDTQQ

SEQ ID NO: 190511 - protein, 38 aa, Artificial Sequence
  Description of Artificial Sequence: Synthetic polypeptide
DEEEISTTNPVATEQYGQCVCSNWMEPNAENFNSDNQS

SEQ ID NO: 190512 - protein, 38 aa, Artificial Sequence
  Description of Artificial Sequence: Synthetic polypeptide
DEEEISTTNPVATEQYGQCVCSNWMEPNEENFNSDTQA

SEQ ID NO: 190513 - protein, 39 aa, Artificial Sequence
  Description of Artificial Sequence: Synthetic polypeptide
DEEEISTTNPVATEQYGQCVCSNWGYDTNQENFNSDTQS

SEQ ID NO: 190514 - protein, 38 aa, Artificial Sequence
  Description of Artificial Sequence: Synthetic polypeptide
DEEEISTTNPVATEQYGQCVCSNWGEPNQENFGSDTQA

SEQ ID NO: 190515 - protein, 38 aa, Artificial Sequence
  Description of Artificial Sequence: Synthetic polypeptide
DEEEISTTNPVATEQYGQCVCSNWGEPNQEFFNSQTQS

SEQ ID NO: 190516 - protein, 38 aa, Artificial Sequence
  Description of Artificial Sequence: Synthetic polypeptide
DEEEISTTNPVATEQYGQCVCSNWGEPNIENFNSDNQA

SEQ ID NO: 190517 - protein, 38 aa, Artificial Sequence
  Description of Artificial Sequence: Synthetic polypeptide
DEEEISTTNPVATEQYGQCVCSNWGEHNEENFGSDPQA

SEQ ID NO: 190518 - protein, 38 aa, Artificial Sequence
  Description of Artificial Sequence: Synthetic polypeptide
DEEEISTTNPVATEQYGQCVCSNWGEHNIEFFNSDFQS

SEQ ID NO: 190519 - protein, 38 aa, Artificial Sequence
  Description of Artificial Sequence: Synthetic polypeptide
DEEEISTTNPVATEQYGQCVCSNWGEHNIENFGSDTQP

SEQ ID NO: 190520 - protein, 38 aa, Artificial Sequence
  Description of Artificial Sequence: Synthetic polypeptide
DEEEISTTNPVATEQYGQCVCSNWGEHNQEFFGSDTQE

SEQ ID NO: 190521 - protein, 35 aa, Artificial Sequence
  Description of Artificial Sequence: Synthetic polypeptide
SEEVIACTNPVATAQWGSVASGHGPLGAPGGNGHQ

SEQ ID NO: 190522 - protein, 38 aa, Artificial Sequence
  Description of Artificial Sequence: Synthetic polypeptide
DEEEISTTNPVATEQYGQCVCSNWGEHNQEHFGSETQF

SEQ ID NO: 190523 - protein, 38 aa, Artificial Sequence
  Description of Artificial Sequence: Synthetic polypeptide
DEEEISTTNPVATEQYGQCVCSNWGEHNQENFFSENQA

SEQ ID NO: 190524 - protein, 38 aa, Artificial Sequence
  Description of Artificial Sequence: Synthetic polypeptide
DEEEISTTNPVATEQYGQCVCSNWGEHNQENFGSDFQS

SEQ ID NO: 190525 - protein, 38 aa, Artificial Sequence
  Description of Artificial Sequence: Synthetic polypeptide
DEEEISTTNPVATEQYGQCVCSNWGEHNQENFGSDTQA

SEQ ID NO: 190526 - protein, 38 aa, Artificial Sequence
  Description of Artificial Sequence: Synthetic polypeptide
DEEEISTTNPVATEQYGQCVCSNWGEHNQENFISDNQS

SEQ ID NO: 190527 - protein, 36 aa, Artificial Sequence
  Description of Artificial Sequence: Synthetic polypeptide
SEESIRTTNPVAYEPYYQGVNSNTLDLLQPRSIEKH

SEQ ID NO: 190528 - protein, 38 aa, Artificial Sequence
  Description of Artificial Sequence: Synthetic polypeptide
DEEEISTTNPVATEQYGQCVCSNWGEHNQENFNSDNQS

SEQ ID NO: 190529 - protein, 38 aa, Artificial Sequence
  Description of Artificial Sequence: Synthetic polypeptide
DEEEISTTNPVATEQYGQCVCSNWGEHNQENFNSDTQA

SEQ ID NO: 190530 - protein, 38 aa, Artificial Sequence
  Description of Artificial Sequence: Synthetic polypeptide
DEEEISTTNPVATEQYGQCVCSNWGEHNQESFGSQTQS

SEQ ID NO: 190531 - protein, 37 aa, Artificial Sequence
  Description of Artificial Sequence: Synthetic polypeptide
DEMEIATTNPVATEQYGCVCSNWEEHNEEHFGSEFLS

SEQ ID NO: 190532 - protein, 37 aa, Artificial Sequence
  Description of Artificial Sequence: Synthetic polypeptide
CEDEIATTNPVAYEQYGSVPAIANNIEPAQQGGQDRP

SEQ ID NO: 190533 - protein, 38 aa, Artificial Sequence
  Description of Artificial Sequence: Synthetic polypeptide
DEEEISTTNPVATEQYGQCVCSNWGEHNQEYFGSDTQS

SEQ ID NO: 190534 - protein, 38 aa, Artificial Sequence
  Description of Artificial Sequence: Synthetic polypeptide
DEEEISTTNPVATEQYGQCVCSNWGEPNAENFNSDTQA

SEQ ID NO: 190535 - protein, 38 aa, Artificial Sequence
  Description of Artificial Sequence: Synthetic polypeptide
DEEEISTTNPVATEQYGQCVCSNWGEPNAENFGSETQS

SEQ ID NO: 190536 - protein, 38 aa, Artificial Sequence
  Description of Artificial Sequence: Synthetic polypeptide
DEEEISTTNPVATEQYGQCVCSNWGEPNAEFFNSDFQA

SEQ ID NO: 190537 - protein, 38 aa, Artificial Sequence
  Description of Artificial Sequence: Synthetic polypeptide
DEEEISTTNPVATEQYGQCVCSNWGEPHNANFNSDNQN

SEQ ID NO: 190538 - protein, 38 aa, Artificial Sequence
  Description of Artificial Sequence: Synthetic polypeptide
DEEEISTTNPVATEQYGQCVCSNWGENNIENFNSETQA

SEQ ID NO: 190539 - protein, 37 aa, Artificial Sequence
  Description of Artificial Sequence: Synthetic polypeptide
DESEIRTTNPVATDQYGSVVDLMVETGQEEEDQTEGD

SEQ ID NO: 190540 - protein, 38 aa, Artificial Sequence
  Description of Artificial Sequence: Synthetic polypeptide
DEEEISTTNPVATEQYGQCVCSNWMPHEAENFNSDNQA

SEQ ID NO: 190541 - protein, 38 aa, Artificial Sequence
  Description of Artificial Sequence: Synthetic polypeptide
DEEEISTTNPVATEQYGQCVCSNWGEHNTESFISDNQA

SEQ ID NO: 190542 - protein, 38 aa, Artificial Sequence
  Description of Artificial Sequence: Synthetic polypeptide
DEEEISTTNPVATEQYGQCVCSNWGEHNQEYFNSDTQM

SEQ ID NO: 190543 - protein, 38 aa, Artificial Sequence
  Description of Artificial Sequence: Synthetic polypeptide
DEEEISTTNPVATEQYGQCVCSNWGEHNQEYFNSDNQS

SEQ ID NO: 190544 - protein, 38 aa, Artificial Sequence
  Description of Artificial Sequence: Synthetic polypeptide
DEEEISTTNPVATEQYGQCVCSNWGEHNQEYFNSDNQA

SEQ ID NO: 190545 - protein, 38 aa, Artificial Sequence
  Description of Artificial Sequence: Synthetic polypeptide
DEEEISTTNPVATEQYGQCVCSNWGEHNQEYFISENQS

SEQ ID NO: 190546 - protein, 38 aa, Artificial Sequence
  Description of Artificial Sequence: Synthetic polypeptide
DEEEISTTNPVATEQYGQCVCSNWGEHNQEYFGSETQA

SEQ ID NO: 190547 - protein, 35 aa, Artificial Sequence
  Description of Artificial Sequence: Synthetic polypeptide
SEESAEIATTNPVAYECWGSVATGDDRQGTGQDEQ

SEQ ID NO: 190548 - protein, 38 aa, Artificial Sequence
  Description of Artificial Sequence: Synthetic polypeptide
DEEEISTTNPVATEQYGQCVCSNWGEHNTEHFNSDTQM

SEQ ID NO: 190549 - protein, 34 aa, Artificial Sequence
  Description of Artificial Sequence: Synthetic polypeptide
CEDEIACTNPVATEQWGCVAGTNSHQEADMLIED

SEQ ID NO: 190550 - protein, 38 aa, Artificial Sequence
  Description of Artificial Sequence: Synthetic polypeptide
DEDEIRTTNPVATEQWGVVNVSTLQQSATNVATEDGSQ

SEQ ID NO: 190551 - protein, 36 aa, Artificial Sequence
  Description of Artificial Sequence: Synthetic polypeptide
AEECISTTNPVATEQYGCVCSWGEDNQEFFGSDTQS

SEQ ID NO: 190552 - protein, 38 aa, Artificial Sequence
  Description of Artificial Sequence: Synthetic polypeptide
DEMEIRTTNPVATCQYGCVCNTWGEDHNQENFGSDNQS

SEQ ID NO: 190553 - protein, 37 aa, Artificial Sequence
  Description of Artificial Sequence: Synthetic polypeptide
CEDEIRTTNPVATESYGSVVNNDEFDEEDEDGGNQGN

SEQ ID NO: 190554 - protein, 37 aa, Artificial Sequence
  Description of Artificial Sequence: Synthetic polypeptide
CEDEIRTTNPVATEVYGSVTDNFTQEVGQEDGQGQET

SEQ ID NO: 190555 - protein, 35 aa, Artificial Sequence
  Description of Artificial Sequence: Synthetic polypeptide
SEEEISTTNPVAYEGYGCVCSNWEHNANFGSDTQA

SEQ ID NO: 190556 - protein, 39 aa, Artificial Sequence
  Description of Artificial Sequence: Synthetic polypeptide
DEEEIRTTNPVATEQWGYANVRAAMFNEAQHQRPMQGEV

SEQ ID NO: 190557 - protein, 39 aa, Artificial Sequence
  Description of Artificial Sequence: Synthetic polypeptide
DEEEIRTTNPVATEAYGVVSTTIGTTEQGSTNQEQNDED

SEQ ID NO: 190558 - protein, 36 aa, Artificial Sequence
  Description of Artificial Sequence: Synthetic polypeptide
SEEEISTTNPVATESWGAVFWNENDDHEKQRMGQSQ

SEQ ID NO: 190559 - protein, 37 aa, Artificial Sequence
  Description of Artificial Sequence: Synthetic polypeptide
SEEEISTTNPVATEQYGQCVCSWGEHNTENFNSDTQS

SEQ ID NO: 190560 - protein, 36 aa, Artificial Sequence
  Description of Artificial Sequence: Synthetic polypeptide
SEEEISTTNPVATEQYGQCVCSWGEHNAHFNSDFQA

SEQ ID NO: 190561 - protein, 37 aa, Artificial Sequence
  Description of Artificial Sequence: Synthetic polypeptide
DAEEIATTNPVATEQYGSVCAMANHADDSKAPDSLNN

SEQ ID NO: 190562 - protein, 38 aa, Artificial Sequence
  Description of Artificial Sequence: Synthetic polypeptide
SEEEISTTNPVATEQYGQCVCSWGEDHNQEGFNSDTQA

SEQ ID NO: 190563 - protein, 38 aa, Artificial Sequence
  Description of Artificial Sequence: Synthetic polypeptide
SEEEISTTNPVATEQYGQCVCSTWGEHNAENFNSDTQS

SEQ ID NO: 190564 - protein, 37 aa, Artificial Sequence
  Description of Artificial Sequence: Synthetic polypeptide
SEEEISTTNPVATEQYGQCVCSNWGEHNTENFGSDQA

SEQ ID NO: 190565 - protein, 37 aa, Artificial Sequence
  Description of Artificial Sequence: Synthetic polypeptide
SEEEISTTNPVATEQYGQCVCSNWGEHNQENFGSEQA

SEQ ID NO: 190566 - protein, 36 aa, Artificial Sequence
  Description of Artificial Sequence: Synthetic polypeptide
DEQEIATTNPVAYEQWGSTCSCTDNGNDHQGDDDGY

SEQ ID NO: 190567 - protein, 34 aa, Artificial Sequence
  Description of Artificial Sequence: Synthetic polypeptide
DECEICTTNPVAYEKWGSVCGDQGEGDRQGDGGA

SEQ ID NO: 190568 - protein, 36 aa, Artificial Sequence
  Description of Artificial Sequence: Synthetic polypeptide
DEVEIACTNPVATEQWGCTAGNGGDTLAAGEEMNRD

SEQ ID NO: 190569 - protein, 37 aa, Artificial Sequence
  Description of Artificial Sequence: Synthetic polypeptide
SEEEISTTNPVATEQYGCVCSWGEDHNAEHFNSDFQA

SEQ ID NO: 190570 - protein, 33 aa, Artificial Sequence
  Description of Artificial Sequence: Synthetic polypeptide
DEVEIATTNPCVYEQWGCVYGNPPGNAGETQDR

SEQ ID NO: 190571 - protein, 38 aa, Artificial Sequence
  Description of Artificial Sequence: Synthetic polypeptide
DEEEIRTTNPVATEQYGVTCVKPSPVHMPNTVDMYFEG

SEQ ID NO: 190572 - protein, 37 aa, Artificial Sequence
  Description of Artificial Sequence: Synthetic polypeptide
SEEEISTTNPVATEQYGCVCSNWGEHNTENFNSDTQS

SEQ ID NO: 190573 - protein, 37 aa, Artificial Sequence
  Description of Artificial Sequence: Synthetic polypeptide
SEEEISTTNPVATEQYGCVCSNWGEHNTENFNSDTQA

SEQ ID NO: 190574 - protein, 37 aa, Artificial Sequence
  Description of Artificial Sequence: Synthetic polypeptide
SEEEISTTNPVATEQYGCVCSNWGEHNQENFNSEFQG

SEQ ID NO: 190575 - protein, 35 aa, Artificial Sequence
  Description of Artificial Sequence: Synthetic polypeptide
DENEIRTTNPVSTEPYGTICSWEEINQEYFGSDQA

SEQ ID NO: 190576 - protein, 37 aa, Artificial Sequence
  Description of Artificial Sequence: Synthetic polypeptide
SEEEISTTNPVATEQYGCVCSNWGEHNQENFNSDTQE

SEQ ID NO: 190577 - protein, 36 aa, Artificial Sequence
  Description of Artificial Sequence: Synthetic polypeptide
SEEEISTTNPVATEQYGCVCSNWGEHNQENFFSEQS

SEQ ID NO: 190578 - protein, 37 aa, Artificial Sequence
  Description of Artificial Sequence: Synthetic polypeptide
SEEEISTTNPVATEQYGCVCSNWGEHNQEHFNSDNQA

SEQ ID NO: 190579 - protein, 37 aa, Artificial Sequence
  Description of Artificial Sequence: Synthetic polypeptide
SEEEISTTNPVATEQYGCVCSNWGEHNEENFGSETQS

SEQ ID NO: 190580 - protein, 37 aa, Artificial Sequence
  Description of Artificial Sequence: Synthetic polypeptide
SEEEISTTNPVATEQYGCVCSNWGEHNAENFNSDTQS

SEQ ID NO: 190581 - protein, 37 aa, Artificial Sequence
  Description of Artificial Sequence: Synthetic polypeptide
SEEEISTTNPVATEQYGCVCSNWGEHNAENFNSDNQY

SEQ ID NO: 190582 - protein, 37 aa, Artificial Sequence
  Description of Artificial Sequence: Synthetic polypeptide
DEVCIATTNPVATEGYGMIVPFTQNEGSQDSTGGNEM

SEQ ID NO: 190583 - protein, 35 aa, Artificial Sequence
  Description of Artificial Sequence: Synthetic polypeptide
DEQEIATTNPVAYEQWGSTCSCSDNNDHQEDDDDY

SEQ ID NO: 190584 - protein, 36 aa, Artificial Sequence
  Description of Artificial Sequence: Synthetic polypeptide
DESEIRTTNPVATCGYGCVCSTWGEHNQEYFTSDQS

SEQ ID NO: 190585 - protein, 35 aa, Artificial Sequence
  Description of Artificial Sequence: Synthetic polypeptide
DEQEIATTNPVAYEQWGSTCSASDNNDHQIDDSDY

SEQ ID NO: 190586 - protein, 38 aa, Artificial Sequence
  Description of Artificial Sequence: Synthetic polypeptide
DEDEIRTTNPVATEQWGVVVVSTAQQSATNVATEDGSM

SEQ ID NO: 190587 - protein, 36 aa, Artificial Sequence
  Description of Artificial Sequence: Synthetic polypeptide
SEEELRTTNPVATEQYGCVCSNWGEHDAEYIGSDQS

SEQ ID NO: 190588 - protein, 38 aa, Artificial Sequence
  Description of Artificial Sequence: Synthetic polypeptide
DEDEIRTTNPVATEQYGDVIMSSDNGDETGEGAGEGGT

SEQ ID NO: 190589 - protein, 38 aa, Artificial Sequence
  Description of Artificial Sequence: Synthetic polypeptide
DEDEIRTTNPVATEQYGDVVVNGFGQGGQTTDQTTGFD

SEQ ID NO: 190590 - protein, 37 aa, Artificial Sequence
  Description of Artificial Sequence: Synthetic polypeptide
DESEIRTTNPVATEQYGSVPYQTDEEYITPSSIEEWP

SEQ ID NO: 190591 - protein, 36 aa, Artificial Sequence
  Description of Artificial Sequence: Synthetic polypeptide
AEECISTTNPVATEQYGCVCSWGEENAENFGSDTQS

SEQ ID NO: 190592 - protein, 32 aa, Artificial Sequence
  Description of Artificial Sequence: Synthetic polypeptide
DDSEVASTNPVSTEGYGMVAAYTIQESKHGVR

SEQ ID NO: 190593 - protein, 36 aa, Artificial Sequence
  Description of Artificial Sequence: Synthetic polypeptide
DETSISTTNPCATEQWGVVSTVNNNNNDEQGTNTDE

SEQ ID NO: 190594 - protein, 36 aa, Artificial Sequence
  Description of Artificial Sequence: Synthetic polypeptide
DETSISTTNPCATEQWGVVSTVNNNNNQLQGTTTDE

SEQ ID NO: 190595 - protein, 35 aa, Artificial Sequence
  Description of Artificial Sequence: Synthetic polypeptide
AEECISTTNPVATEQYGCVCSWMEHNQEHFISDQS

SEQ ID NO: 190596 - protein, 35 aa, Artificial Sequence
  Description of Artificial Sequence: Synthetic polypeptide
DETTEISTTNPVAYEKWGEVASGENQGNHGNGNMN

SEQ ID NO: 190597 - protein, 36 aa, Artificial Sequence
  Description of Artificial Sequence: Synthetic polypeptide
DENEIRTTNPVSTEPYGTIPSCMEDISQQQNGGNNT

SEQ ID NO: 190598 - protein, 36 aa, Artificial Sequence
  Description of Artificial Sequence: Synthetic polypeptide
DEAEIATTNPVAYEKWGCSYSIGPNLNGEETGENDH

SEQ ID NO: 190599 - protein, 37 aa, Artificial Sequence
  Description of Artificial Sequence: Synthetic polypeptide
DEHEIRTTNPVAYEPWGSVYCSEHQDDQNQRLNEGTI

SEQ ID NO: 190600 - protein, 39 aa, Artificial Sequence
  Description of Artificial Sequence: Synthetic polypeptide
QEEEIRTTNPVATEQYGSVVNDLTLEEGPEMGQGENEEG

SEQ ID NO: 190601 - protein, 38 aa, Artificial Sequence
  Description of Artificial Sequence: Synthetic polypeptide
DEHEIRTTNPVAYEPWGSVYCSETQDDQNQRDRNEGII

SEQ ID NO: 190602 - protein, 35 aa, Artificial Sequence
  Description of Artificial Sequence: Synthetic polypeptide
DETVEIATTNPVAYEQWGCVYNGNLDGNENGGDED

SEQ ID NO: 190603 - protein, 38 aa, Artificial Sequence
  Description of Artificial Sequence: Synthetic polypeptide
QEEEIRTTNPVATEQYGSVVNPTTPIGPEMGQGEMEEG

SEQ ID NO: 190604 - protein, 37 aa, Artificial Sequence
  Description of Artificial Sequence: Synthetic polypeptide
DAEEIATTNPVAYEQYGSVCAANMGEEAPDDQANGHD

SEQ ID NO: 190605 - protein, 37 aa, Artificial Sequence
  Description of Artificial Sequence: Synthetic polypeptide
DEDEIATTNPVAYEQYGSVCAAANGEDTDSLGLNDSL

SEQ ID NO: 190606 - protein, 35 aa, Artificial Sequence
  Description of Artificial Sequence: Synthetic polypeptide
DETVIQTTNPVAYETWGCVAACTNNPSQRPPGAYP

SEQ ID NO: 190607 - protein, 36 aa, Artificial Sequence
  Description of Artificial Sequence: Synthetic polypeptide
DEQEIATTNPVAYEQWGSPCAQATPGNPAGGPNQDD

SEQ ID NO: 190608 - protein, 37 aa, Artificial Sequence
  Description of Artificial Sequence: Synthetic polypeptide
DEDEIATTNPVAYEQYGSVCAAANNPANAHGGDNEAM

SEQ ID NO: 190609 - protein, 38 aa, Artificial Sequence
  Description of Artificial Sequence: Synthetic polypeptide
DEEEISTTNPVATEQYGQCVCSNWNEHEIEGFGSDTQA

SEQ ID NO: 190610 - protein, 36 aa, Artificial Sequence
  Description of Artificial Sequence: Synthetic polypeptide
VEEEIACTNPVATEQWGNVVASGSEHGNNHQDGESG

SEQ ID NO: 190611 - protein, 39 aa, Artificial Sequence
  Description of Artificial Sequence: Synthetic polypeptide
QEEEIRTTNPVATEQYGSVVNPLMLETGPEMGQGENEEG

SEQ ID NO: 190612 - protein, 38 aa, Artificial Sequence
  Description of Artificial Sequence: Synthetic polypeptide
QEEEIRTTNPVATEQYGSVVNPFTLEGPEMGQGEFEEG

SEQ ID NO: 190613 - protein, 35 aa, Artificial Sequence
  Description of Artificial Sequence: Synthetic polypeptide
DETVIQTTNPVAYEQWGCVAHCTVNPSARPPGQEP

SEQ ID NO: 190614 - protein, 36 aa, Artificial Sequence
  Description of Artificial Sequence: Synthetic polypeptide
CEDEIRTTNPVATEQYGMVSVEGMGDGGQGQEQEGE

SEQ ID NO: 190615 - protein, 35 aa, Artificial Sequence
  Description of Artificial Sequence: Synthetic polypeptide
DETVIQTTNPVAYEQWGCVAACTNNHSQNPPGQYP

SEQ ID NO: 190616 - protein, 35 aa, Artificial Sequence
  Description of Artificial Sequence: Synthetic polypeptide
DETVIQTTNPMAYEQWGCVAACTNNISQRPPGQYP

SEQ ID NO: 190617 - protein, 38 aa, Artificial Sequence
  Description of Artificial Sequence: Synthetic polypeptide
CEDEIRTTNPVATEQYGVVSILIATGDEDTQDEGGDGD

SEQ ID NO: 190618 - protein, 37 aa, Artificial Sequence
  Description of Artificial Sequence: Synthetic polypeptide
DEEEIRTTNPVGTEHWGSCYCWIPNDQDDQRQGGDSI

SEQ ID NO: 190619 - protein, 36 aa, Artificial Sequence
  Description of Artificial Sequence: Synthetic polypeptide
DENEIRTTNPVSTECYGTTTWSNMEDIQQEQNGNYH

SEQ ID NO: 190620 - protein, 34 aa, Artificial Sequence
  Description of Artificial Sequence: Synthetic polypeptide
CEDEIACTNPVATEQWGCVAGTNSHQEADMLIHV

SEQ ID NO: 190621 - protein, 38 aa, Artificial Sequence
  Description of Artificial Sequence: Synthetic polypeptide
DEAEIRTTNPVATEQYGSTIPWTPPLEENQVHSAIEMQ

SEQ ID NO: 190622 - protein, 38 aa, Artificial Sequence
  Description of Artificial Sequence: Synthetic polypeptide
DEAEIRTTNPVATEQYGSTIPWTPPLEENQHFQIEFMM

SEQ ID NO: 190623 - protein, 37 aa, Artificial Sequence
  Description of Artificial Sequence: Synthetic polypeptide
DENEIRTTNPVATYQYGSCCMYEIVSTHTIPETQIVG

SEQ ID NO: 190624 - protein, 38 aa, Artificial Sequence
  Description of Artificial Sequence: Synthetic polypeptide
CEEEIRTTNPVATEQYGQCVCSNWGEHNQENFISDNQF

SEQ ID NO: 190625 - protein, 37 aa, Artificial Sequence
  Description of Artificial Sequence: Synthetic polypeptide
DEAEIRTTNPVATEQYGSTIPWTPPLEENPHSPIEQQ

SEQ ID NO: 190626 - protein, 37 aa, Artificial Sequence
  Description of Artificial Sequence: Synthetic polypeptide
CEEEIRTTNPVATEQYGQCVCSSGEHDIEHFNSDTQS

SEQ ID NO: 190627 - protein, 38 aa, Artificial Sequence
  Description of Artificial Sequence: Synthetic polypeptide
DEAEIRTTNPVATEQYGSTIPWTPPLEENFTHFQIEMQ

SEQ ID NO: 190628 - protein, 38 aa, Artificial Sequence
  Description of Artificial Sequence: Synthetic polypeptide
DEAEIRTTNPVATEQYGSTIPWTPPLEENDHEQIEDMQ

SEQ ID NO: 190629 - protein, 36 aa, Artificial Sequence
  Description of Artificial Sequence: Synthetic polypeptide
DEEEIRTTNPCAYEQYGSACAAVANGAEPPMIDNGG

SEQ ID NO: 190630 - protein, 38 aa, Artificial Sequence
  Description of Artificial Sequence: Synthetic polypeptide
DEEEIRTTNPVAYEQYGQCVCSNWGEDNQENFNSDNQS

SEQ ID NO: 190631 - protein, 38 aa, Artificial Sequence
  Description of Artificial Sequence: Synthetic polypeptide
DEAEIRTTNPVATEQYGSTIPWTPPLEENDCHFQIEFQ

SEQ ID NO: 190632 - protein, 37 aa, Artificial Sequence
  Description of Artificial Sequence: Synthetic polypeptide
DEACIRTTNPVATEQYGQCVCETGEPNQEYFGSDTQS

SEQ ID NO: 190633 - protein, 37 aa, Artificial Sequence
  Description of Artificial Sequence: Synthetic polypeptide
DEEEIRTTNPVAYEQFGQCVCSWGYDHNAHFGSDTQS

SEQ ID NO: 190634 - protein, 39 aa, Artificial Sequence
  Description of Artificial Sequence: Synthetic polypeptide
DEVEIRTTNPVATEQYGSVAGDDNDEEGGQNDDETDGLT

SEQ ID NO: 190635 - protein, 38 aa, Artificial Sequence
  Description of Artificial Sequence: Synthetic polypeptide
CEEEIRTTNPVATEQYGQCVCSNWGEHDQENFNSDTQF

SEQ ID NO: 190636 - protein, 38 aa, Artificial Sequence
  Description of Artificial Sequence: Synthetic polypeptide
DEAEIRTTNPVATEQYGSTIPWTPPLEANQHSQIEWMQ

SEQ ID NO: 190637 - protein, 33 aa, Artificial Sequence
  Description of Artificial Sequence: Synthetic polypeptide
DDSEIASTNPVSTEGYGNVWANNEDIQSPKGQI

SEQ ID NO: 190638 - protein, 32 aa, Artificial Sequence
  Description of Artificial Sequence: Synthetic polypeptide
CETEIATTNPCAYEPYGKVNIIGHLSQHETEG

SEQ ID NO: 190639 - protein, 33 aa, Artificial Sequence
  Description of Artificial Sequence: Synthetic polypeptide
DDSEIASTNPVSTEGYGNVWAANEDIQSPKGQI

SEQ ID NO: 190640 - protein, 38 aa, Artificial Sequence
  Description of Artificial Sequence: Synthetic polypeptide
DEAEIRTTNPVATEQYGSTIPWTLPLEENQHFQIEDFQ

SEQ ID NO: 190641 - protein, 37 aa, Artificial Sequence
  Description of Artificial Sequence: Synthetic polypeptide
DEAEIRTTNPVATEQYGSTIPWPPPLEENQHHQIEFQ

SEQ ID NO: 190642 - protein, 36 aa, Artificial Sequence
  Description of Artificial Sequence: Synthetic polypeptide
DDAEIRTTNPVATEQYGCVGPDFENGMDTTNKVQEE

SEQ ID NO: 190643 - protein, 32 aa, Artificial Sequence
  Description of Artificial Sequence: Synthetic polypeptide
DDSEVASTNPVSTEGYGAVIAANTIVSGPGQR

SEQ ID NO: 190644 - protein, 37 aa, Artificial Sequence
  Description of Artificial Sequence: Synthetic polypeptide
DEAEIRTTNPVATEQYGSTIPWDPPLEENQHEQIEME

SEQ ID NO: 190645 - protein, 37 aa, Artificial Sequence
  Description of Artificial Sequence: Synthetic polypeptide
DENEIRTTNPVATEQYGVVVMNGFNGEGGQLEMTDDV

SEQ ID NO: 190646 - protein, 38 aa, Artificial Sequence
  Description of Artificial Sequence: Synthetic polypeptide
DDAEIRTTNPVATEQYGCVTSTWGADDNAEYFNSDPQS

SEQ ID NO: 190647 - protein, 38 aa, Artificial Sequence
  Description of Artificial Sequence: Synthetic polypeptide
DEDEIATTNPVAYEQYGSVAACPYNGLATGTNGDSTVG

SEQ ID NO: 190648 - protein, 39 aa, Artificial Sequence
  Description of Artificial Sequence: Synthetic polypeptide
DENEIRTTNPVATEQYGVVSVGINNNMDGQNDEGGGEGT

SEQ ID NO: 190649 - protein, 37 aa, Artificial Sequence
  Description of Artificial Sequence: Synthetic polypeptide
DEAEIRTTNPVATEQYGSTIHWTPPWEENQTSIIEMQ

SEQ ID NO: 190650 - protein, 37 aa, Artificial Sequence
  Description of Artificial Sequence: Synthetic polypeptide
DDAEIRTTNPVATEQYGQCVCSWGEDHNISFGSDTQA

SEQ ID NO: 190651 - protein, 37 aa, Artificial Sequence
  Description of Artificial Sequence: Synthetic polypeptide
DDAEIRTTNPVATEQYGCVCSWGEDHNQESFLSDTQS

SEQ ID NO: 190652 - protein, 38 aa, Artificial Sequence
  Description of Artificial Sequence: Synthetic polypeptide
DEEEIRTTNPVATEQWGTCVCSNWMYDNAENFGSETQS

SEQ ID NO: 190653 - protein, 38 aa, Artificial Sequence
  Description of Artificial Sequence: Synthetic polypeptide
CEEEIRTTNPVATEQYGQCVCSNWGEDNEEHFNSDNQS

SEQ ID NO: 190654 - protein, 38 aa, Artificial Sequence
  Description of Artificial Sequence: Synthetic polypeptide
CEEEIRTTNPVATEQYGQCVCSNWGEDHNQYFNSETQS

SEQ ID NO: 190655 - protein, 36 aa, Artificial Sequence
  Description of Artificial Sequence: Synthetic polypeptide
DENEIRTTNPVAYEIYGCVWSPWVLSEQEFSIEKTN

SEQ ID NO: 190656 - protein, 35 aa, Artificial Sequence
  Description of Artificial Sequence: Synthetic polypeptide
DENEIRTTNPVAYEIYGCVVPWVLPEQEFSIEKTN

SEQ ID NO: 190657 - protein, 37 aa, Artificial Sequence
  Description of Artificial Sequence: Synthetic polypeptide
DENEIRTTNPVAYEGYGCVCSNWGEHNQENFGSDNQA

SEQ ID NO: 190658 - protein, 36 aa, Artificial Sequence
  Description of Artificial Sequence: Synthetic polypeptide
DEEEIRTTNPEATEQYGQCVCPWGEDNAENFISDQS

SEQ ID NO: 190659 - protein, 32 aa, Artificial Sequence
  Description of Artificial Sequence: Synthetic polypeptide
DDSEVASTNPVSTEGYGAVAANTIVNGVGQPR

SEQ ID NO: 190660 - protein, 38 aa, Artificial Sequence
  Description of Artificial Sequence: Synthetic polypeptide
DEAEIRTTNPVATEQYGSTIPWTPPLTENQTHEQIEMQ

SEQ ID NO: 190661 - protein, 38 aa, Artificial Sequence
  Description of Artificial Sequence: Synthetic polypeptide
DDAEIRTTNPVATEQYGCVCSTTGEDHNQESFGSDTQS

SEQ ID NO: 190662 - protein, 37 aa, Artificial Sequence
  Description of Artificial Sequence: Synthetic polypeptide
DEVEIRTTNPVATEFYGTVVLDLINMDQSTGEGGGQG

SEQ ID NO: 190663 - protein, 38 aa, Artificial Sequence
  Description of Artificial Sequence: Synthetic polypeptide
DEAEIRTTNPVATEQYGSTIPWTPPLMENQHFQIEYFQ

SEQ ID NO: 190664 - protein, 38 aa, Artificial Sequence
  Description of Artificial Sequence: Synthetic polypeptide
DEAEIRTTNPVATEQYGSTIPWTPPLHENQEHWQIEMQ

SEQ ID NO: 190665 - protein, 38 aa, Artificial Sequence
  Description of Artificial Sequence: Synthetic polypeptide
DEAEIRTTNPVATEQYGSTIPWTPPLHECQHEQIEMMQ

SEQ ID NO: 190666 - protein, 34 aa, Artificial Sequence
  Description of Artificial Sequence: Synthetic polypeptide
AENEIACTNPVAYEQYGCSCSWEHNQEYFGSDQS

SEQ ID NO: 190667 - protein, 35 aa, Artificial Sequence
  Description of Artificial Sequence: Synthetic polypeptide
AENEIACTNPVAYEQYGCSCSNWGELNQYFGSDQS

SEQ ID NO: 190668 - protein, 38 aa, Artificial Sequence
  Description of Artificial Sequence: Synthetic polypeptide
CEEEIRTTNPVATEQYGQCVCGTWEEHNQENFNSETQS

SEQ ID NO: 190669 - protein, 34 aa, Artificial Sequence
  Description of Artificial Sequence: Synthetic polypeptide
DDSEIATTNPVATECWGATTWANADWAERKGPYR

SEQ ID NO: 190670 - protein, 36 aa, Artificial Sequence
  Description of Artificial Sequence: Synthetic polypeptide
DEQEIATTNPVATEQYGCVAGNHSGDPATMHNGEEV

SEQ ID NO: 190671 - protein, 37 aa, Artificial Sequence
  Description of Artificial Sequence: Synthetic polypeptide
CEEEIRTTNPVATEQYGQCVCPWGEHNQENFNSDTQA

SEQ ID NO: 190672 - protein, 39 aa, Artificial Sequence
  Description of Artificial Sequence: Synthetic polypeptide
DESEIRTTNPVATEQYGAVIFGTSGDDGGQEGGNGEING

SEQ ID NO: 190673 - protein, 38 aa, Artificial Sequence
  Description of Artificial Sequence: Synthetic polypeptide
CEEEIRTTNPVATEQYGQCVCSMSGEHNAEYFNSDTQS

SEQ ID NO: 190674 - protein, 37 aa, Artificial Sequence
  Description of Artificial Sequence: Synthetic polypeptide
DEDEIRTTNPVATESYGMVSVEQGMGGGQGQEGEEST

SEQ ID NO: 190675 - protein, 38 aa, Artificial Sequence
  Description of Artificial Sequence: Synthetic polypeptide
CEEEIRTTNPVATEQYGQCVCSMWGEDNEENFNSDTQE

SEQ ID NO: 190676 - protein, 38 aa, Artificial Sequence
  Description of Artificial Sequence: Synthetic polypeptide
DESEIRTTNPVATEQYGAVIFGSGDDGGQEGGQTIIMG

SEQ ID NO: 190677 - protein, 36 aa, Artificial Sequence
  Description of Artificial Sequence: Synthetic polypeptide
DEEEIRTTNPCSYEQWGSCYTIDQHRQNGGGKTGDD

SEQ ID NO: 190678 - protein, 39 aa, Artificial Sequence
  Description of Artificial Sequence: Synthetic polypeptide
DEDEIRTTNPVATESYGSVTDNFTQNMNGQEDQGQGQGT

SEQ ID NO: 190679 - protein, 38 aa, Artificial Sequence
  Description of Artificial Sequence: Synthetic polypeptide
DEAEIRTTNPVATEQYGSTIPWTPPLEEQQHHFQIEMQ

SEQ ID NO: 190680 - protein, 38 aa, Artificial Sequence
  Description of Artificial Sequence: Synthetic polypeptide
CEEEIRTTNPVATEQYGQCVCSNTGEHNQENFSSDTQA

SEQ ID NO: 190681 - protein, 38 aa, Artificial Sequence
  Description of Artificial Sequence: Synthetic polypeptide
CEEEIRTTNPVATEQYGQCVCSNWEEDPTEGFGSDNQS

SEQ ID NO: 190682 - protein, 38 aa, Artificial Sequence
  Description of Artificial Sequence: Synthetic polypeptide
CEEEIRTTNPVATEQYGQCVCSNWEEHNQENFSSDNQE

SEQ ID NO: 190683 - protein, 39 aa, Artificial Sequence
  Description of Artificial Sequence: Synthetic polypeptide
CEEEIRTTNPVATEQYGQCVCSNWGEDHNAEGFGSDNQE

SEQ ID NO: 190684 - protein, 38 aa, Artificial Sequence
  Description of Artificial Sequence: Synthetic polypeptide
CEEEIATTNPVATEQYGSVCAMNNGEPTNPDDEMENNM

SEQ ID NO: 190685 - protein, 37 aa, Artificial Sequence
  Description of Artificial Sequence: Synthetic polypeptide
CEEEIRTTNPVATEQYGQCVCPWEDHNEENFNSDTQA

SEQ ID NO: 190686 - protein, 38 aa, Artificial Sequence
  Description of Artificial Sequence: Synthetic polypeptide
CEEEIRTTNPVATEQYGQCVCSWGEDHEQEYFNSDTQA

SEQ ID NO: 190687 - protein, 38 aa, Artificial Sequence
  Description of Artificial Sequence: Synthetic polypeptide
DENEIRTTNPVATEQYGVSCMCAGVDLLQEVVVQEDRN

SEQ ID NO: 190688 - protein, 36 aa, Artificial Sequence
  Description of Artificial Sequence: Synthetic polypeptide
DEMEIRTTNPVAYEQWGCVTSWGEENTENFISDTAS

SEQ ID NO: 190689 - protein, 38 aa, Artificial Sequence
  Description of Artificial Sequence: Synthetic polypeptide
QEEEIRTTNPVATESYGSVVNPTPPIGPEMGQGENEEG

SEQ ID NO: 190690 - protein, 40 aa, Artificial Sequence
  Description of Artificial Sequence: Synthetic polypeptide
DEEEIRTTNPCATEQYGVVVVTVVNNTQQGTTEQGTSTNF

SEQ ID NO: 190691 - protein, 40 aa, Artificial Sequence
  Description of Artificial Sequence: Synthetic polypeptide
DEEEIRTTNPCATEQYGVVVVTVVNNDQQGTTEQGSTTND

SEQ ID NO: 190692 - protein, 38 aa, Artificial Sequence
  Description of Artificial Sequence: Synthetic polypeptide
DEEEIRTTNPCATEQYGVVSVVVSNQAGTEQGSTDQQE

SEQ ID NO: 190693 - protein, 37 aa, Artificial Sequence
  Description of Artificial Sequence: Synthetic polypeptide
DEVEISTTNPVATEQYGVIVDDLTQIMDGGDNGGLQD

SEQ ID NO: 190694 - protein, 37 aa, Artificial Sequence
  Description of Artificial Sequence: Synthetic polypeptide
DEVEISTTNPVATEQYGVIVDDLTQIMDGGDQGGEDI

SEQ ID NO: 190695 - protein, 37 aa, Artificial Sequence
  Description of Artificial Sequence: Synthetic polypeptide
DEDEIATTNPVAYEQWGSVSGGEPGNGGNMRNPMEMM

SEQ ID NO: 190696 - protein, 38 aa, Artificial Sequence
  Description of Artificial Sequence: Synthetic polypeptide
QEEEIRTTNPVATESYGSVVNVTLPEGPEMGQGENEEG

SEQ ID NO: 190697 - protein, 38 aa, Artificial Sequence
  Description of Artificial Sequence: Synthetic polypeptide
DEEEIRTTNPVATEAYGVVTVVVVTVTNQQGTTAEEEE

SEQ ID NO: 190698 - protein, 37 aa, Artificial Sequence
  Description of Artificial Sequence: Synthetic polypeptide
DEVEISTTNPVATEQYGVIVDDLTQIMSGGDNGGEDD

SEQ ID NO: 190699 - protein, 38 aa, Artificial Sequence
  Description of Artificial Sequence: Synthetic polypeptide
DEVEISTTNPVATEQYGVIVYDDLTQIMDGGDNGGEGD

SEQ ID NO: 190700 - protein, 37 aa, Artificial Sequence
  Description of Artificial Sequence: Synthetic polypeptide
DEVEISTTNPVATEQYGVVSVDEGDDEDQEEGEDDES

SEQ ID NO: 190701 - protein, 35 aa, Artificial Sequence
  Description of Artificial Sequence: Synthetic polypeptide
DESEIRTTNPIATECWGATTWANAIDWQEPKGNYI

SEQ ID NO: 190702 - protein, 36 aa, Artificial Sequence
  Description of Artificial Sequence: Synthetic polypeptide
DEEEISTTNPVAYEGYGCSCSWGEENAEYFNSDTQA

SEQ ID NO: 190703 - protein, 38 aa, Artificial Sequence
  Description of Artificial Sequence: Synthetic polypeptide
QEEEIRTTNPVATESYGSVVMPTDPEGPEMGQGENEEG

SEQ ID NO: 190704 - protein, 37 aa, Artificial Sequence
  Description of Artificial Sequence: Synthetic polypeptide
CEDEIACTNPVATEQYGSACATNPELGQNHADENGHN

SEQ ID NO: 190705 - protein, 36 aa, Artificial Sequence
  Description of Artificial Sequence: Synthetic polypeptide
DEMEISTTNPVATCQYGCVCQWGEHNQEYFGSDNQA

SEQ ID NO: 190706 - protein, 36 aa, Artificial Sequence
  Description of Artificial Sequence: Synthetic polypeptide
DEMEISTTNPVATCQYGCVCSNWEHNEENFGSDTQS

SEQ ID NO: 190707 - protein, 37 aa, Artificial Sequence
  Description of Artificial Sequence: Synthetic polypeptide
CEDEIACTNPVATEQYGSACSPAANFHQEAEDGNENP

SEQ ID NO: 190708 - protein, 36 aa, Artificial Sequence
  Description of Artificial Sequence: Synthetic polypeptide
DEVTVIQTTNPVAYEAWGCVAACTVNPSQRGGQERG

SEQ ID NO: 190709 - protein, 37 aa, Artificial Sequence
  Description of Artificial Sequence: Synthetic polypeptide
DEMEISTTNPVATCQYGCVCSNWMEDNEENFGSDNQS

SEQ ID NO: 190710 - protein, 32 aa, Artificial Sequence
  Description of Artificial Sequence: Synthetic polypeptide
DDSEVASTNPVSTEGYGCVADWTIQEHFGSQR

SEQ ID NO: 190711 - protein, 39 aa, Artificial Sequence
  Description of Artificial Sequence: Synthetic polypeptide
DEAEIRTTNPVATEQYGSLYVSCSGILCEELMNDNEEVF

SEQ ID NO: 190712 - protein, 36 aa, Artificial Sequence
  Description of Artificial Sequence: Synthetic polypeptide
DEEEISTTNPVAYEGYGCVCSWGEHNAENFNSENQS

SEQ ID NO: 190713 - protein, 34 aa, Artificial Sequence
  Description of Artificial Sequence: Synthetic polypeptide
DEYEIATTNPVAYECWGCVSGGNGNEAGGGEGMW

SEQ ID NO: 190714 - protein, 36 aa, Artificial Sequence
  Description of Artificial Sequence: Synthetic polypeptide
DEEEISTTNPVAYEGYGCVCSWGEHNQENFNSDNQA

SEQ ID NO: 190715 - protein, 37 aa, Artificial Sequence
  Description of Artificial Sequence: Synthetic polypeptide
DEYEIGTTNPVATEAYGSVTATGDQGIEDQEEGEDGD

SEQ ID NO: 190716 - protein, 37 aa, Artificial Sequence
  Description of Artificial Sequence: Synthetic polypeptide
DEYEIGTTNPVATEFYGSVSASGDQGDEDQEGGEDGD

SEQ ID NO: 190717 - protein, 36 aa, Artificial Sequence
  Description of Artificial Sequence: Synthetic polypeptide
DEEEIRTTNPVATECWGATVWANAEDWPAEPKGPPI

SEQ ID NO: 190718 - protein, 36 aa, Artificial Sequence
  Description of Artificial Sequence: Synthetic polypeptide
DEEEIRTTNPVATECWGATVWSNAEDWPAEPKGPPI

SEQ ID NO: 190719 - protein, 37 aa, Artificial Sequence
  Description of Artificial Sequence: Synthetic polypeptide
CEDEIACTNPVATEQYGSACSAANPAEADAQIGENTA

SEQ ID NO: 190720 - protein, 39 aa, Artificial Sequence
  Description of Artificial Sequence: Synthetic polypeptide
DEEEIRTTNPVATEAYGVVTTVSNSDEIGTTSISTTGNT

SEQ ID NO: 190721 - protein, 39 aa, Artificial Sequence
  Description of Artificial Sequence: Synthetic polypeptide
QEEEIRTTNPVATESYGSVDTGMTGNFEGDEDGNEDGQE

SEQ ID NO: 190722 - protein, 39 aa, Artificial Sequence
  Description of Artificial Sequence: Synthetic polypeptide
DEEEIRTTNPVATEAYGVVTTVIGTTEQGSTNDEQSTED

SEQ ID NO: 190723 - protein, 35 aa, Artificial Sequence
  Description of Artificial Sequence: Synthetic polypeptide
DEDEIRTTNPVAYECWGSVYMGEGNEMGNQKDDAG

SEQ ID NO: 190724 - protein, 36 aa, Artificial Sequence
  Description of Artificial Sequence: Synthetic polypeptide
DEDEIRTTNPVAYECWGSVYMGEGNEQGNQKDDAET

SEQ ID NO: 190725 - protein, 36 aa, Artificial Sequence
  Description of Artificial Sequence: Synthetic polypeptide
AENEIACTNPVATEQYGQCSCSWGNHNQEHFGSDQA

SEQ ID NO: 190726 - protein, 35 aa, Artificial Sequence
  Description of Artificial Sequence: Synthetic polypeptide
AENEIACTNPVATEQYGQCSCSWGEHNQYFGSDQA

SEQ ID NO: 190727 - protein, 35 aa, Artificial Sequence
  Description of Artificial Sequence: Synthetic polypeptide
AENEIACTNPVATEQYGQCSCSWEDNQYFGSDTQA

SEQ ID NO: 190728 - protein, 36 aa, Artificial Sequence
  Description of Artificial Sequence: Synthetic polypeptide
AENEIACTNPVATEQYGQCSCSWEDNQEYFGSDNQS

SEQ ID NO: 190729 - protein, 36 aa, Artificial Sequence
  Description of Artificial Sequence: Synthetic polypeptide
DDAEIRTTNPVATEQYGQCVCSWGEDHNQSFISDQA

SEQ ID NO: 190730 - protein, 40 aa, Artificial Sequence
  Description of Artificial Sequence: Synthetic polypeptide
DEEEIRTTNPVATEAYGVVSVTVTTNQAGTEAGTVNDEND

SEQ ID NO: 190731 - protein, 35 aa, Artificial Sequence
  Description of Artificial Sequence: Synthetic polypeptide
AENEIACTNPVATEQYGICSCSWEHNQNFGSDTQA

SEQ ID NO: 190732 - protein, 40 aa, Artificial Sequence
  Description of Artificial Sequence: Synthetic polypeptide
DEEEIRTTNPVATEAYGVVSVTVTTQQAGTEAGTVNQEDE

SEQ ID NO: 190733 - protein, 37 aa, Artificial Sequence
  Description of Artificial Sequence: Synthetic polypeptide
DEMEIRTTNPVAYEQYGCVCQNWGEHNQEYFNSDTQS

SEQ ID NO: 190734 - protein, 37 aa, Artificial Sequence
  Description of Artificial Sequence: Synthetic polypeptide
DEDEIATTNPVAYEQYGSVAACPYEGLAAGTNGDSVG

SEQ ID NO: 190735 - protein, 38 aa, Artificial Sequence
  Description of Artificial Sequence: Synthetic polypeptide
DEAEIRTTNPVATEQYGSSCVHSMDVIKEMQDDQEEKN

SEQ ID NO: 190736 - protein, 37 aa, Artificial Sequence
  Description of Artificial Sequence: Synthetic polypeptide
DEAEIRTTNPVATEQYGSSCPVAIVAGAEIQVFQEMP

SEQ ID NO: 190737 - protein, 37 aa, Artificial Sequence
  Description of Artificial Sequence: Synthetic polypeptide
DEAEIRTTNPVATEQYGSSCPLAIVNGAETQVFVEMP

SEQ ID NO: 190738 - protein, 38 aa, Artificial Sequence
  Description of Artificial Sequence: Synthetic polypeptide
DEAEIRTTNPVATEQYGSSCPLAIVAGDAETQVFQEMN

SEQ ID NO: 190739 - protein, 34 aa, Artificial Sequence
  Description of Artificial Sequence: Synthetic polypeptide
DESEIRTTNPIATECWGNTTWANATWAEPVGQYR

SEQ ID NO: 190740 - protein, 38 aa, Artificial Sequence
  Description of Artificial Sequence: Synthetic polypeptide
DEEEIRTTNPVGTEIYGSVYGTAIDNGEEDQGDQTEDG

SEQ ID NO: 190741 - protein, 34 aa, Artificial Sequence
  Description of Artificial Sequence: Synthetic polypeptide
DESEIRTTNPIATECWGATWANCENWQEPEGPYI

SEQ ID NO: 190742 - protein, 40 aa, Artificial Sequence
  Description of Artificial Sequence: Synthetic polypeptide
DEEEIRTTNPVATEAYGVVSVVVTTNNATGEQGTEQGSED

SEQ ID NO: 190743 - protein, 38 aa, Artificial Sequence
  Description of Artificial Sequence: Synthetic polypeptide
DEVEIRTTNPVATEQYGSVVNPIENVNFDDEGGQDQEE

SEQ ID NO: 190744 - protein, 39 aa, Artificial Sequence
  Description of Artificial Sequence: Synthetic polypeptide
DEVEIRTTNPVATEQYGSVVFDNNEMGQNEMTENEFTQE

SEQ ID NO: 190745 - protein, 37 aa, Artificial Sequence
  Description of Artificial Sequence: Synthetic polypeptide
DEEEIRTTNPVGTEQWGNSAGTANEPGGEHGGDIEAM

SEQ ID NO: 190746 - protein, 37 aa, Artificial Sequence
  Description of Artificial Sequence: Synthetic polypeptide
DEEEIRTTNPVAYEQWGHNNVYYWEEQQHERPTGHED

SEQ ID NO: 190747 - protein, 37 aa, Artificial Sequence
  Description of Artificial Sequence: Synthetic polypeptide
DEACIRTTNPVAYEQYGCVCENWGEPNQEYFGSDNQS

SEQ ID NO: 190748 - protein, 38 aa, Artificial Sequence
  Description of Artificial Sequence: Synthetic polypeptide
DEEEIATTNPVAYEQYGSACAAVATAGVNTAGGDTAAW

SEQ ID NO: 190749 - protein, 36 aa, Artificial Sequence
  Description of Artificial Sequence: Synthetic polypeptide
DDAEIRTTNPVATEQYGSVGPLFENGMDTTVKPQEE

SEQ ID NO: 190750 - protein, 31 aa, Artificial Sequence
  Description of Artificial Sequence: Synthetic polypeptide
DDSEIASTNPVSTEGYGEVAAEVCQSHVEQK

SEQ ID NO: 190751 - protein, 37 aa, Artificial Sequence
  Description of Artificial Sequence: Synthetic polypeptide
CETEIACTNPVATEQYGSACSPVGNDQNDSGNDQMVH

SEQ ID NO: 190752 - protein, 36 aa, Artificial Sequence
  Description of Artificial Sequence: Synthetic polypeptide
CEDEIACTNPVATEQYGSACAANPAQGEHQDGNAHQ

SEQ ID NO: 190753 - protein, 37 aa, Artificial Sequence
  Description of Artificial Sequence: Synthetic polypeptide
DEDEIRTTNPVAYEQWGMVSGGEPANGPNMRNGGGKD

SEQ ID NO: 190754 - protein, 36 aa, Artificial Sequence
  Description of Artificial Sequence: Synthetic polypeptide
DEACIRTTNPVAYEQWGQVACTNNGLQDDHQDTEKL

SEQ ID NO: 190755 - protein, 37 aa, Artificial Sequence
  Description of Artificial Sequence: Synthetic polypeptide
DEEEIRTTNPVAYEQWGHNTVYPWEGQQHQRPNGAES

SEQ ID NO: 190756 - protein, 40 aa, Artificial Sequence
  Description of Artificial Sequence: Synthetic polypeptide
DEDEIRTTNPVATEQYGVVSTVVSNNNNQQGIGTTDEDED

SEQ ID NO: 190757 - protein, 37 aa, Artificial Sequence
  Description of Artificial Sequence: Synthetic polypeptide
DEEEIRTTNPVAYEQWGHNTVYYWEHQQHGNPMGNES

SEQ ID NO: 190758 - protein, 36 aa, Artificial Sequence
  Description of Artificial Sequence: Synthetic polypeptide
DEQEIATTNPVATEQYGCVAANGGDGATMPMGDTHW

SEQ ID NO: 190759 - protein, 40 aa, Artificial Sequence
  Description of Artificial Sequence: Synthetic polypeptide
DEDEIRTTNPVATEQYGVVSTVNNQNNNQQGIGTTTQEED

SEQ ID NO: 190760 - protein, 36 aa, Artificial Sequence
  Description of Artificial Sequence: Synthetic polypeptide
CEDEIACTNPVATEQWGGCSATNPLENGMPGENTNY

SEQ ID NO: 190761 - protein, 40 aa, Artificial Sequence
  Description of Artificial Sequence: Synthetic polypeptide
DEDEIRTTNPVATEQYGVVSTVNPNNNNQQGIGTTDEDEE

SEQ ID NO: 190762 - protein, 37 aa, Artificial Sequence
  Description of Artificial Sequence: Synthetic polypeptide
DEEEIRTTNPVAYEQYGQCVCSNWGEDHQENFMSDQY

SEQ ID NO: 190763 - protein, 34 aa, Artificial Sequence
  Description of Artificial Sequence: Synthetic polypeptide
DEEEIRTTNPIATECWGETTWANADWAEHKGPYI

SEQ ID NO: 190764 - protein, 38 aa, Artificial Sequence
  Description of Artificial Sequence: Synthetic polypeptide
DEEEIRTTNPVATEQYGVCVHPNPVHMPNFVDMAFAEG

SEQ ID NO: 190765 - protein, 36 aa, Artificial Sequence
  Description of Artificial Sequence: Synthetic polypeptide
CEDEIACTNPVATEQWGGCVAATNNLENGMGDNTNQ

SEQ ID NO: 190766 - protein, 37 aa, Artificial Sequence
  Description of Artificial Sequence: Synthetic polypeptide
DEEEIRTTNPVATEQYGVCVHPCPVHMPNFVDMTFEG

SEQ ID NO: 190767 - protein, 40 aa, Artificial Sequence
  Description of Artificial Sequence: Synthetic polypeptide
DEDEIRTTNPVATEQYGVVSTVNPQNNNQQGIGTTDQGTD

SEQ ID NO: 190768 - protein, 36 aa, Artificial Sequence
  Description of Artificial Sequence: Synthetic polypeptide
CEDEIACTNPVATEQWGGCVATNNLENGMMGEFTNM

SEQ ID NO: 190769 - protein, 36 aa, Artificial Sequence
  Description of Artificial Sequence: Synthetic polypeptide
DEEEIRTTNPIATECWGATWATTPDGPAERKGMNPV

SEQ ID NO: 190770 - protein, 34 aa, Artificial Sequence
  Description of Artificial Sequence: Synthetic polypeptide
DEEEIRTTNPIATECWGATWANAEDWAEPKGPYI

SEQ ID NO: 190771 - protein, 40 aa, Artificial Sequence
  Description of Artificial Sequence: Synthetic polypeptide
DEDEIRTTNPVATEQYGVVSTVNQNNNNQQGIGTTDQGED

SEQ ID NO: 190772 - protein, 37 aa, Artificial Sequence
  Description of Artificial Sequence: Synthetic polypeptide
DEMEIATTNPVATEGYGCVCSTWGEHNEEHFISENQS

SEQ ID NO: 190773 - protein, 32 aa, Artificial Sequence
  Description of Artificial Sequence: Synthetic polypeptide
DDSEVASTNPVSTEGWGNVWAANTIQSPVGQR

SEQ ID NO: 190774 - protein, 35 aa, Artificial Sequence
  Description of Artificial Sequence: Synthetic polypeptide
DEEEIRTTNPIATECWGATVWANAEDWAEPKGPYI

SEQ ID NO: 190775 - protein, 40 aa, Artificial Sequence
  Description of Artificial Sequence: Synthetic polypeptide
DEDEIRTTNPVATEQYGVVSTVNTGGNNQQGIGTTTQDED

SEQ ID NO: 190776 - protein, 35 aa, Artificial Sequence
  Description of Artificial Sequence: Synthetic polypeptide
DEEEIRTTNPIATECWGATTWSNAPDWNEPNGPYI

SEQ ID NO: 190777 - protein, 35 aa, Artificial Sequence
  Description of Artificial Sequence: Synthetic polypeptide
DEEEIRTTNPIATECWGATTWSNAPDWNEPKGPYI

SEQ ID NO: 190778 - protein, 37 aa, Artificial Sequence
  Description of Artificial Sequence: Synthetic polypeptide
DEEEIRTTNPVATEQYGTYTFISMGEEVPELGEVPEI

SEQ ID NO: 190779 - protein, 38 aa, Artificial Sequence
  Description of Artificial Sequence: Synthetic polypeptide
DEEEISTTNPVATEQYGQCVCSWGELHNAENFNSDTQL

SEQ ID NO: 190780 - protein, 40 aa, Artificial Sequence
  Description of Artificial Sequence: Synthetic polypeptide
DEDEIRTTNPVATEQYGVVSTVNVNNNNQQGIGTTDQDEG

SEQ ID NO: 190781 - protein, 32 aa, Artificial Sequence
  Description of Artificial Sequence: Synthetic polypeptide
DDSEVASTNPVSTEGWGNVWANNTIQSPVGPR

SEQ ID NO: 190782 - protein, 38 aa, Artificial Sequence
  Description of Artificial Sequence: Synthetic polypeptide
DEEEIRTTNPVATEQYGTYGANALNEMVQVDVMEQADE

SEQ ID NO: 190783 - protein, 37 aa, Artificial Sequence
  Description of Artificial Sequence: Synthetic polypeptide
VEEEIATTNPVATEQYGSVCAANMGEEAPDDLMEDAA

SEQ ID NO: 190784 - protein, 40 aa, Artificial Sequence
  Description of Artificial Sequence: Synthetic polypeptide
DEDEIRTTNPVATEQYGVVSTVTANNNNQQGIGTTDQDED

SEQ ID NO: 190785 - protein, 35 aa, Artificial Sequence
  Description of Artificial Sequence: Synthetic polypeptide
QEGEIAPTNPCSYEQYGVTVSCCNMLSQSTQGTDR

SEQ ID NO: 190786 - protein, 38 aa, Artificial Sequence
  Description of Artificial Sequence: Synthetic polypeptide
VEEEIATTNPVATEQYGSVCAMNNGELTNPDDEMENNH

SEQ ID NO: 190787 - protein, 40 aa, Artificial Sequence
  Description of Artificial Sequence: Synthetic polypeptide
DEDEIRTTNPVATEQYGVVSTVTNGNNNQQGIGTTTQDED

SEQ ID NO: 190788 - protein, 40 aa, Artificial Sequence
  Description of Artificial Sequence: Synthetic polypeptide
DEDEIRTTNPVATEQYGVVSTVNSNNNNQQGIGTTTQDED

SEQ ID NO: 190789 - protein, 38 aa, Artificial Sequence
  Description of Artificial Sequence: Synthetic polypeptide
DEEEIRTTNPVATEQYGCVRVLGIADMTMEEPEQEMTP

SEQ ID NO: 190790 - protein, 38 aa, Artificial Sequence
  Description of Artificial Sequence: Synthetic polypeptide
DEEEIRTVNPVATEQYGCVCSNWMEDHNAENFNSDTQS

SEQ ID NO: 190791 - protein, 37 aa, Artificial Sequence
  Description of Artificial Sequence: Synthetic polypeptide
DEVEIATTNPVAYEQYGTVCSYTDGLNDEKMEGGIDS

SEQ ID NO: 190792 - protein, 40 aa, Artificial Sequence
  Description of Artificial Sequence: Synthetic polypeptide
DEDEIRTTNPVATEQYGVVSTVNDQNNNQQGIGTTDEDED

SEQ ID NO: 190793 - protein, 35 aa, Artificial Sequence
  Description of Artificial Sequence: Synthetic polypeptide
CEDEIACTNPVATEQWGCVANMTHLNPDDGMGDRA

SEQ ID NO: 190794 - protein, 39 aa, Artificial Sequence
  Description of Artificial Sequence: Synthetic polypeptide
DEEEIRTTNPVAYEQYGQCVCSNWGEDHNQENFGSDNQD

SEQ ID NO: 190795 - protein, 38 aa, Artificial Sequence
  Description of Artificial Sequence: Synthetic polypeptide
DEAEIRTTNPVATEQYGSYFNSLGWVSLEFGEFEQQVP

SEQ ID NO: 190796 - protein, 35 aa, Artificial Sequence
  Description of Artificial Sequence: Synthetic polypeptide
DENEIRTTNPVSTECYGTTTWSNAEDIQEQNGPYI

SEQ ID NO: 190797 - protein, 40 aa, Artificial Sequence
  Description of Artificial Sequence: Synthetic polypeptide
DEDEIRTTNPVATEQYGVVSTVNDQQNNQQGIGTTDQGED

SEQ ID NO: 190798 - protein, 35 aa, Artificial Sequence
  Description of Artificial Sequence: Synthetic polypeptide
DENEIRTTNPVSTECYGTTTWANAEDIQEQNGPYI

SEQ ID NO: 190799 - protein, 36 aa, Artificial Sequence
  Description of Artificial Sequence: Synthetic polypeptide
DENEIRTTNPVSTECYGTTQTSRPEAIEIQQSGNGV

SEQ ID NO: 190800 - protein, 40 aa, Artificial Sequence
  Description of Artificial Sequence: Synthetic polypeptide
DEDEIRTTNPVATEQYGVVSTVNGGNNNQQGIGTTQQGEQ

SEQ ID NO: 190801 - protein, 37 aa, Artificial Sequence
  Description of Artificial Sequence: Synthetic polypeptide
QEEEIRTTNPVATECYGSVNNDNTFEEGGGGQTEQGE

SEQ ID NO: 190802 - protein, 37 aa, Artificial Sequence
  Description of Artificial Sequence: Synthetic polypeptide
DEAEISTTNPVATEQYGCVCGNWGEHNAEYFGSDNQA

SEQ ID NO: 190803 - protein, 40 aa, Artificial Sequence
  Description of Artificial Sequence: Synthetic polypeptide
DEDEIRTTNPVATEQYGVVSTVNGNQNNQQGIGTTDEDED

SEQ ID NO: 190804 - protein, 37 aa, Artificial Sequence
  Description of Artificial Sequence: Synthetic polypeptide
DEAEISTTNPVATEQYGCVCGNWGEHNQENFNSQNQA

SEQ ID NO: 190805 - protein, 33 aa, Artificial Sequence
  Description of Artificial Sequence: Synthetic polypeptide
DENEIRTTNPVSTECWGAIANMEDIAQQNGPYH

SEQ ID NO: 190806 - protein, 37 aa, Artificial Sequence
  Description of Artificial Sequence: Synthetic polypeptide
DEVEIATTNPVAYEQWGVVVHTDQVLDQENREGEGTP

SEQ ID NO: 190807 - protein, 37 aa, Artificial Sequence
  Description of Artificial Sequence: Synthetic polypeptide
DEVEIATTNPVAYEQWGVVVHTDQVNDQENRAGEGTG

SEQ ID NO: 190808 - protein, 32 aa, Artificial Sequence
  Description of Artificial Sequence: Synthetic polypeptide
DESEIRTTNPIGTEGWGATWAAEDLAEHGPYI

SEQ ID NO: 190809 - protein, 40 aa, Artificial Sequence
  Description of Artificial Sequence: Synthetic polypeptide
DEDEIRTTNPVATEQYGVVSTVNNQNNNQQGIGTDEQDED

SEQ ID NO: 190810 - protein, 39 aa, Artificial Sequence
  Description of Artificial Sequence: Synthetic polypeptide
DEEEIRTTNPVAYEQYGQCVCSNWGEDHNTENFISDNQS

SEQ ID NO: 190811 - protein, 37 aa, Artificial Sequence
  Description of Artificial Sequence: Synthetic polypeptide
VEEEIATTNPVATEQYGSICAGMGGVEDNEMNEENNN

SEQ ID NO: 190812 - protein, 36 aa, Artificial Sequence
  Description of Artificial Sequence: Synthetic polypeptide
DEAEISTTNPVATEQYGCVCGWGEHNEENFISENQA

SEQ ID NO: 190813 - protein, 40 aa, Artificial Sequence
  Description of Artificial Sequence: Synthetic polypeptide
DEDEIRTTNPVATEQYGVVSTVNNNNNNQQGIGTTDEEED

SEQ ID NO: 190814 - protein, 35 aa, Artificial Sequence
  Description of Artificial Sequence: Synthetic polypeptide
DEEEIRTTNPIATEQWGATTWANAEDGAEPKGPYI

SEQ ID NO: 190815 - protein, 37 aa, Artificial Sequence
  Description of Artificial Sequence: Synthetic polypeptide
DEAEIRTTNPVATEQYGSTVPYQTDEEDIPPSIEEVP

SEQ ID NO: 190816 - protein, 35 aa, Artificial Sequence
  Description of Artificial Sequence: Synthetic polypeptide
QEGEIAPTNPCSYEQYGVTVSCCNMLSQTVGGEER

SEQ ID NO: 190817 - protein, 35 aa, Artificial Sequence
  Description of Artificial Sequence: Synthetic polypeptide
DENEIRTTNPVSTEAYGCICSWEDHNQEYFGSDQS

SEQ ID NO: 190818 - protein, 37 aa, Artificial Sequence
  Description of Artificial Sequence: Synthetic polypeptide
DEDEIATTNPVATESYGSVTDNFGQNNGLEDGQGQET

SEQ ID NO: 190819 - protein, 32 aa, Artificial Sequence
  Description of Artificial Sequence: Synthetic polypeptide
AENEIASTNPVGYEAYGVVMACSGLSQHVGDI

SEQ ID NO: 190820 - protein, 40 aa, Artificial Sequence
  Description of Artificial Sequence: Synthetic polypeptide
DEDEIRTTNPVATEQYGVVSTVNNGNNNQQGIGTTLQDET

SEQ ID NO: 190821 - protein, 40 aa, Artificial Sequence
  Description of Artificial Sequence: Synthetic polypeptide
DEDEIRTTNPVATEQYGVVSTVNNGNNNQQGIGTTGEDED

SEQ ID NO: 190822 - protein, 35 aa, Artificial Sequence
  Description of Artificial Sequence: Synthetic polypeptide
DENEIRTTNPVSTEAYGTICSWEDINQEHFGSQQS

SEQ ID NO: 190823 - protein, 35 aa, Artificial Sequence
  Description of Artificial Sequence: Synthetic polypeptide
DEEEIRTTNPIATEQWGATTWANAEDGAMPKGPYI

SEQ ID NO: 190824 - protein, 40 aa, Artificial Sequence
  Description of Artificial Sequence: Synthetic polypeptide
DEDEIRTTNPVATEQYGVVSTVNDGNNNQQGIGTTQQGQD

SEQ ID NO: 190825 - protein, 36 aa, Artificial Sequence
  Description of Artificial Sequence: Synthetic polypeptide
SEEEIRTTNPVATESWGAVFWNEQDDHEKQRMDQSY

SEQ ID NO: 190826 - protein, 40 aa, Artificial Sequence
  Description of Artificial Sequence: Synthetic polypeptide
DEDEIRTTNPVATEQYGVVSTVTNNNNNQQGIGTTDEDEQ

SEQ ID NO: 190827 - protein, 36 aa, Artificial Sequence
  Description of Artificial Sequence: Synthetic polypeptide
DDAEIRTTNPVATEQYGCVCSSGEDHNQESFISDQS

SEQ ID NO: 190828 - protein, 40 aa, Artificial Sequence
  Description of Artificial Sequence: Synthetic polypeptide
DEDEIRTTNPVATEQYGVVSTVVNGNGNQQGIGTTAQDED

SEQ ID NO: 190829 - protein, 40 aa, Artificial Sequence
  Description of Artificial Sequence: Synthetic polypeptide
DEDEIRTTNPVATEQYGVVSTVVNGNNNQQGIGTTDQSED

SEQ ID NO: 190830 - protein, 40 aa, Artificial Sequence
  Description of Artificial Sequence: Synthetic polypeptide
DEDEIRTTNPVATEQYGVVSTVVNGNNNQQGIGTTGQDTD

SEQ ID NO: 190831 - protein, 39 aa, Artificial Sequence
  Description of Artificial Sequence: Synthetic polypeptide
DEVEICTTNPVATEQYGSVVLDGMQGQTDGQEGDQNGDM

SEQ ID NO: 190832 - protein, 37 aa, Artificial Sequence
  Description of Artificial Sequence: Synthetic polypeptide
DEVEICTTNPVATEQYGVIVDDLTQIMDGNDDGGEDD

SEQ ID NO: 190833 - protein, 34 aa, Artificial Sequence
  Description of Artificial Sequence: Synthetic polypeptide
DEEEIRTTNPIATECWGATTWAEEDWAERKGPYI

SEQ ID NO: 190834 - protein, 36 aa, Artificial Sequence
  Description of Artificial Sequence: Synthetic polypeptide
DEMEIRTTNPVATEQYGTTTWAATEGPVEEFKGPYI

SEQ ID NO: 190835 - protein, 40 aa, Artificial Sequence
  Description of Artificial Sequence: Synthetic polypeptide
DEDEIRTTNPVATEQYGVVSTVVNNNNDEQGIGTTTQDED

SEQ ID NO: 190836 - protein, 40 aa, Artificial Sequence
  Description of Artificial Sequence: Synthetic polypeptide
DEDEIRTTNPVATEQYGVVSTVVNNNNNEQGIGTTDTDED

SEQ ID NO: 190837 - protein, 36 aa, Artificial Sequence
  Description of Artificial Sequence: Synthetic polypeptide
DEMEIRTTNPVATEQYGTTTWAATEGWVEEFKGPYI

SEQ ID NO: 190838 - protein, 40 aa, Artificial Sequence
  Description of Artificial Sequence: Synthetic polypeptide
DEDEIRTTNPVATEQYGVVSTVVNNNNNEQGIGTTVQDTD

SEQ ID NO: 190839 - protein, 34 aa, Artificial Sequence
  Description of Artificial Sequence: Synthetic polypeptide
DEEEIRTTNPIATECWGATTWAAEDWAERKGPYI

SEQ ID NO: 190840 - protein, 40 aa, Artificial Sequence
  Description of Artificial Sequence: Synthetic polypeptide
DEDEIRTTNPVATEQYGVVSTVVNNNNNQQGIGTTTQDEE

SEQ ID NO: 190841 - protein, 34 aa, Artificial Sequence
  Description of Artificial Sequence: Synthetic polypeptide
DEEEIRTTNPIATECWGATTWANADWAEHKGPYI

SEQ ID NO: 190842 - protein, 37 aa, Artificial Sequence
  Description of Artificial Sequence: Synthetic polypeptide
VEEEIATTNPVAYEQWGSVSGGPPGNGGNMRNMMGMS

SEQ ID NO: 190843 - protein, 35 aa, Artificial Sequence
  Description of Artificial Sequence: Synthetic polypeptide
VEEEIATTNPVAYEQWGTVCAATGQMPDSGPNDSM

SEQ ID NO: 190844 - protein, 35 aa, Artificial Sequence
  Description of Artificial Sequence: Synthetic polypeptide
DEEEIRTTNPIATECWGATTSANAPDWAMPNGPPI

SEQ ID NO: 190845 - protein, 39 aa, Artificial Sequence
  Description of Artificial Sequence: Synthetic polypeptide
DEEEIRTTNPVATEQYGTVYLWFVTNPEEIGEPGQGVET

SEQ ID NO: 190846 - protein, 34 aa, Artificial Sequence
  Description of Artificial Sequence: Synthetic polypeptide
DEEEIRTTNPIATECWGATTANAEDWAEPKGPYI

SEQ ID NO: 190847 - protein, 38 aa, Artificial Sequence
  Description of Artificial Sequence: Synthetic polypeptide
DEVEIKTTNPVATEQYGVVSGGQAEQGSGQNGGQEGGT

SEQ ID NO: 190848 - protein, 38 aa, Artificial Sequence
  Description of Artificial Sequence: Synthetic polypeptide
DEAEIRTTNPVATEQYGSTIPWTPPWEENQHDQIEQLQ

SEQ ID NO: 190849 - protein, 39 aa, Artificial Sequence
  Description of Artificial Sequence: Synthetic polypeptide
DESEIRTTNPVATEQYGCSISTSMSAPTEQAETDDEGKN

SEQ ID NO: 190850 - protein, 36 aa, Artificial Sequence
  Description of Artificial Sequence: Synthetic polypeptide
DEVEIKTTNPVATESYGTVVSATDGDDEEGEGGIGQ

SEQ ID NO: 190851 - protein, 37 aa, Artificial Sequence
  Description of Artificial Sequence: Synthetic polypeptide
DEVEIRATNPVATEQYGMVSAEGMGDGGQGQENEFGT

SEQ ID NO: 190852 - protein, 36 aa, Artificial Sequence
  Description of Artificial Sequence: Synthetic polypeptide
DEAEIATTNPVAYEQWGGCVAGNNGLTAAPDGSIRN

SEQ ID NO: 190853 - protein, 36 aa, Artificial Sequence
  Description of Artificial Sequence: Synthetic polypeptide
DEQEIATTNPVATEQYGCVAGNHSGDPAAMAMGEEE

SEQ ID NO: 190854 - protein, 38 aa, Artificial Sequence
  Description of Artificial Sequence: Synthetic polypeptide
DEMEIRTTNPVATEQYGWCNTSNETTMLEHFYGEDTQI

SEQ ID NO: 190855 - protein, 38 aa, Artificial Sequence
  Description of Artificial Sequence: Synthetic polypeptide
DEEEISTTNPVATEQYGQVVCSNWGEHNAEGFNSDNQA

SEQ ID NO: 190856 - protein, 36 aa, Artificial Sequence
  Description of Artificial Sequence: Synthetic polypeptide
DEMEIRTTNPVATEWYGCMCVPANPENEMWTQDPEQ

SEQ ID NO: 190857 - protein, 38 aa, Artificial Sequence
  Description of Artificial Sequence: Synthetic polypeptide
DEEEIRTTNPVATEQYGTVYPSPMAAWRLEAPELVEGH

SEQ ID NO: 190858 - protein, 37 aa, Artificial Sequence
  Description of Artificial Sequence: Synthetic polypeptide
DDAEIRTTNPVATEQYGCVCSNWGEDHNIESFGSDQS

SEQ ID NO: 190859 - protein, 38 aa, Artificial Sequence
  Description of Artificial Sequence: Synthetic polypeptide
DESEIRTTNPVATEQYGCVCSNSGEDHNQENFNSDTQG

SEQ ID NO: 190860 - protein, 38 aa, Artificial Sequence
  Description of Artificial Sequence: Synthetic polypeptide
DEAEIRTTNPVATEQYGSTIPWTPPWEENQHQQIEMMQ

SEQ ID NO: 190861 - protein, 36 aa, Artificial Sequence
  Description of Artificial Sequence: Synthetic polypeptide
SEEEIRTTNPVATESWGAVFWNENDDHERQGGDQGM

SEQ ID NO: 190862 - protein, 36 aa, Artificial Sequence
  Description of Artificial Sequence: Synthetic polypeptide
DEQEIATTNPVATEQYGCVAANPGDGATMPMGDPHN

SEQ ID NO: 190863 - protein, 40 aa, Artificial Sequence
  Description of Artificial Sequence: Synthetic polypeptide
DEDEIRTTNPVATEQYGVVSTVTNPNNNQQGIGTTDQDEN

SEQ ID NO: 190864 - protein, 37 aa, Artificial Sequence
  Description of Artificial Sequence: Synthetic polypeptide
DDAEIRTTNPVATEQYGCSCSNWGEHNAENFGSDTQS

SEQ ID NO: 190865 - protein, 40 aa, Artificial Sequence
  Description of Artificial Sequence: Synthetic polypeptide
DEDEIRTTNPVATEQYGVVSTVTNQNNNQAGIGTTLQDED

SEQ ID NO: 190866 - protein, 36 aa, Artificial Sequence
  Description of Artificial Sequence: Synthetic polypeptide
SEEEIRTTNPVATESWGAVFVNENDDHERQGGDQED

SEQ ID NO: 190867 - protein, 39 aa, Artificial Sequence
  Description of Artificial Sequence: Synthetic polypeptide
SEEEIRTTNPVATEQYWSNIVTWSPHDEEQNNEPEINRD

SEQ ID NO: 190868 - protein, 37 aa, Artificial Sequence
  Description of Artificial Sequence: Synthetic polypeptide
DDAEIRTTNPVATEQYGCVCSDWGEDHNQESFGSDQA

SEQ ID NO: 190869 - protein, 40 aa, Artificial Sequence
  Description of Artificial Sequence: Synthetic polypeptide
DEDEIRTTNPVATEQYGVVSTVTNQNNNQQGIGTTDQQED

SEQ ID NO: 190870 - protein, 35 aa, Artificial Sequence
  Description of Artificial Sequence: Synthetic polypeptide
QEGEIAPTNPCSYEQYGVTVSCCNMLSQGVGGHPR

SEQ ID NO: 190871 - protein, 40 aa, Artificial Sequence
  Description of Artificial Sequence: Synthetic polypeptide
DEDEIRTTNPVATEQYGVVSTVTNQNNNQQGIGTTGQDEE

SEQ ID NO: 190872 - protein, 40 aa, Artificial Sequence
  Description of Artificial Sequence: Synthetic polypeptide
DEDEIRTTNPVATEQYGVVSTVTQGNNNQQGIGTTDEDED

SEQ ID NO: 190873 - protein, 40 aa, Artificial Sequence
  Description of Artificial Sequence: Synthetic polypeptide
DEDEIRTTNPVATEQYGVVSTVTQGNNNQQGIGTTQQGED

SEQ ID NO: 190874 - protein, 35 aa, Artificial Sequence
  Description of Artificial Sequence: Synthetic polypeptide
DEEEIRTTNPIATECWGATTWANTPAGAEPNGPPV

SEQ ID NO: 190875 - protein, 38 aa, Artificial Sequence
  Description of Artificial Sequence: Synthetic polypeptide
SEEEIRTTNPVATEQYGVVGGQDDTNDDEEDEGGQGET

SEQ ID NO: 190876 - protein, 35 aa, Artificial Sequence
  Description of Artificial Sequence: Synthetic polypeptide
QEGEIAPTNPCSYEQYGVTVSCCNMLSQESFGGTR

SEQ ID NO: 190877 - protein, 38 aa, Artificial Sequence
  Description of Artificial Sequence: Synthetic polypeptide
CEEEIRTTNPVATEQYGDVGQNNVDIEGQLGEDGQGEL

SEQ ID NO: 190878 - protein, 38 aa, Artificial Sequence
  Description of Artificial Sequence: Synthetic polypeptide
DEAEIRTTNPVATEQYGSTIPWTPPWEENQIHSQIEEQ

SEQ ID NO: 190879 - protein, 38 aa, Artificial Sequence
  Description of Artificial Sequence: Synthetic polypeptide
DEAEIRTTNPVATEQYGSTIPWTPPWEENSKHSQIEMQ

SEQ ID NO: 190880 - protein, 37 aa, Artificial Sequence
  Description of Artificial Sequence: Synthetic polypeptide
DEVEICTTNPVATEQYGSVNDLQTNMNGEMVEDEFGI

SEQ ID NO: 190881 - protein, 36 aa, Artificial Sequence
  Description of Artificial Sequence: Synthetic polypeptide
DEVEICTTNPVATEQYGQYGVDQNGGGNDDQNEQDG

SEQ ID NO: 190882 - protein, 37 aa, Artificial Sequence
  Description of Artificial Sequence: Synthetic polypeptide
SEEEIRTTNPVATEQYGSYMDLRPNLEAVSEVAMLED

SEQ ID NO: 190883 - protein, 34 aa, Artificial Sequence
  Description of Artificial Sequence: Synthetic polypeptide
DEEEIRTTNPIATECWGATTWANAEDWAEPKGPI

SEQ ID NO: 190884 - protein, 36 aa, Artificial Sequence
  Description of Artificial Sequence: Synthetic polypeptide
SEEEIRTTNPVATESWGAVFWNENDQHEDQGGDQSM

SEQ ID NO: 190885 - protein, 40 aa, Artificial Sequence
  Description of Artificial Sequence: Synthetic polypeptide
DEDEIRTTNPVATEQYGVVSTVTVNNNNQQGIGTTDEQED

SEQ ID NO: 190886 - protein, 36 aa, Artificial Sequence
  Description of Artificial Sequence: Synthetic polypeptide
DESEIRTTNPVATEQYGCVPYQTDEEDITPSIEEWP

SEQ ID NO: 190887 - protein, 35 aa, Artificial Sequence
  Description of Artificial Sequence: Synthetic polypeptide
DENEIRTTNPVAYMQWGAAPTWEGDQQMQGRNGDK

SEQ ID NO: 190888 - protein, 39 aa, Artificial Sequence
  Description of Artificial Sequence: Synthetic polypeptide
SEEEIRTTNPVATEQYGTVYISYPLIHMHQMEVIQDENQ

SEQ ID NO: 190889 - protein, 34 aa, Artificial Sequence
  Description of Artificial Sequence: Synthetic polypeptide
QEGEIAPTNPCSYEQYGVTVSCCNMLSNSSGGTR

SEQ ID NO: 190890 - protein, 38 aa, Artificial Sequence
  Description of Artificial Sequence: Synthetic polypeptide
DEAEIRTTNPVATEQYGSTIPWTPWLEENQHFQIEDMQ

SEQ ID NO: 190891 - protein, 38 aa, Artificial Sequence
  Description of Artificial Sequence: Synthetic polypeptide
CEEEIRTTNPVATEQYGDVGQNNVDTVGQLGEDGQGQL

SEQ ID NO: 190892 - protein, 35 aa, Artificial Sequence
  Description of Artificial Sequence: Synthetic polypeptide
DEEEIRTTNPIATECWGATTWANAEDWQEPKGPYI

SEQ ID NO: 190893 - protein, 36 aa, Artificial Sequence
  Description of Artificial Sequence: Synthetic polypeptide
DEAEIRTTNPVATEQYGCWYNAVDHISVQDSVEEQN

SEQ ID NO: 190894 - protein, 37 aa, Artificial Sequence
  Description of Artificial Sequence: Synthetic polypeptide
QEEEIVTTNPVATEQYGVVMLGPIEQGEGGQLGENED

SEQ ID NO: 190895 - protein, 37 aa, Artificial Sequence
  Description of Artificial Sequence: Synthetic polypeptide
DEDEIATTNPVAYEQWGSVSGGEPGNGGNMRNMTEMS

SEQ ID NO: 190896 - protein, 36 aa, Artificial Sequence
  Description of Artificial Sequence: Synthetic polypeptide
DEEEIATTNPVAYERWGVCATLNNLDPGDHPNGSNE

SEQ ID NO: 190897 - protein, 37 aa, Artificial Sequence
  Description of Artificial Sequence: Synthetic polypeptide
EDETICTTNPVATESYGVVSTVDQTGNNNQTGTNNTE

SEQ ID NO: 190898 - protein, 37 aa, Artificial Sequence
  Description of Artificial Sequence: Synthetic polypeptide
EDETICTTNPVATESYGVVSTVDQTGNNQTGTTNDTE

SEQ ID NO: 190899 - protein, 37 aa, Artificial Sequence
  Description of Artificial Sequence: Synthetic polypeptide
EDETICTTNPVATESYGVVSTVNDETGNNQTGTNNTE

SEQ ID NO: 190900 - protein, 37 aa, Artificial Sequence
  Description of Artificial Sequence: Synthetic polypeptide
EDETICTTNPVATESYGVVSTVNDQTGNNQQTGTNTE

SEQ ID NO: 190901 - protein, 37 aa, Artificial Sequence
  Description of Artificial Sequence: Synthetic polypeptide
EDETICTTNPVATESYGVVSTVNDQTGNNQTGTNNVQ

SEQ ID NO: 190902 - protein, 37 aa, Artificial Sequence
  Description of Artificial Sequence: Synthetic polypeptide
EDETICTTNPVATESYGVVSTVNDQTGNNQTGTNSTD

SEQ ID NO: 190903 - protein, 36 aa, Artificial Sequence
  Description of Artificial Sequence: Synthetic polypeptide
QEEEIATTNPVATEQWGCVAANGEDTATGTGSNSHD

SEQ ID NO: 190904 - protein, 38 aa, Artificial Sequence
  Description of Artificial Sequence: Synthetic polypeptide
EDETICTTNPVATESYGVVSTVVDQTGNNLQTGTTNVE

SEQ ID NO: 190905 - protein, 37 aa, Artificial Sequence
  Description of Artificial Sequence: Synthetic polypeptide
EDETICTTNPVATESYGVVSTVVDTGNNNNQTGTNVD

SEQ ID NO: 190906 - protein, 37 aa, Artificial Sequence
  Description of Artificial Sequence: Synthetic polypeptide
EDETICTTNPVATESYGVVSTVVDTGNNNQTGTTNVQ

SEQ ID NO: 190907 - protein, 37 aa, Artificial Sequence
  Description of Artificial Sequence: Synthetic polypeptide
EDETICTTNPVATESYGVVSTVVDTGNNQTGTNNATD

SEQ ID NO: 190908 - protein, 37 aa, Artificial Sequence
  Description of Artificial Sequence: Synthetic polypeptide
EDETICTTNPVATESYGVVSTVVDTGNNQTGTTNVTE

SEQ ID NO: 190909 - protein, 37 aa, Artificial Sequence
  Description of Artificial Sequence: Synthetic polypeptide
EDETICTTNPVATESYGVVSTVVNDQTGNNQTGTNVE

SEQ ID NO: 190910 - protein, 36 aa, Artificial Sequence
  Description of Artificial Sequence: Synthetic polypeptide
DEEEIATTNPVAYERWGVCATGNNLDPGDHPNGNAE

SEQ ID NO: 190911 - protein, 37 aa, Artificial Sequence
  Description of Artificial Sequence: Synthetic polypeptide
EDETICTTNPVATESYGVVSTVVNDTGNNNQTGTNVQ

SEQ ID NO: 190912 - protein, 38 aa, Artificial Sequence
  Description of Artificial Sequence: Synthetic polypeptide
EDETICTTNPVATESYGVVSTVVSDTGNNNQTGTTNVD

SEQ ID NO: 190913 - protein, 37 aa, Artificial Sequence
  Description of Artificial Sequence: Synthetic polypeptide
EDETICTTNPVATESYGVVSTVVTDTGNNNQTGTNTD

SEQ ID NO: 190914 - protein, 37 aa, Artificial Sequence
  Description of Artificial Sequence: Synthetic polypeptide
EDETICTTNPVATESYGVVSTVVTDTGNNQTGTNNTE

SEQ ID NO: 190915 - protein, 35 aa, Artificial Sequence
  Description of Artificial Sequence: Synthetic polypeptide
EEAAEIATTNPVAYEQWGSVACPNNDQGIQQDNGE

SEQ ID NO: 190916 - protein, 33 aa, Artificial Sequence
  Description of Artificial Sequence: Synthetic polypeptide
AECEIACTNPVAYEQWGEYYQIENDQRTPGESM

SEQ ID NO: 190917 - protein, 35 aa, Artificial Sequence
  Description of Artificial Sequence: Synthetic polypeptide
DEEEIATTNPVAYESWGCVCTIDSNDRNDQDEKEE

SEQ ID NO: 190918 - protein, 31 aa, Artificial Sequence
  Description of Artificial Sequence: Synthetic polypeptide
EEAEIATTNPVAYECWGEVYYVEDIHQHEEV

SEQ ID NO: 190919 - protein, 38 aa, Artificial Sequence
  Description of Artificial Sequence: Synthetic polypeptide
SEEEIATTNPVATEQYGSVCAMNNGEPTNPDDQGEHHM

SEQ ID NO: 190920 - protein, 38 aa, Artificial Sequence
  Description of Artificial Sequence: Synthetic polypeptide
SEEEIATTNPVATEQYGSVCAMNNGEPTGGDPLENGGM

SEQ ID NO: 190921 - protein, 38 aa, Artificial Sequence
  Description of Artificial Sequence: Synthetic polypeptide
SEEEIATTNPVATEQYGSVCAMNNGELTNPDDGMEGTM

SEQ ID NO: 190922 - protein, 37 aa, Artificial Sequence
  Description of Artificial Sequence: Synthetic polypeptide
DEMEIVTTNPVATEQYGCVCSNSGEDPNEENFGSDQS

SEQ ID NO: 190923 - protein, 34 aa, Artificial Sequence
  Description of Artificial Sequence: Synthetic polypeptide
DDSEVASTNPVSTEGYGCVCQTWEIQERFGSQNQ

SEQ ID NO: 190924 - protein, 36 aa, Artificial Sequence
  Description of Artificial Sequence: Synthetic polypeptide
CEDEIATTNPVATEQWGNVAIPNHEEATGNQDGENP

SEQ ID NO: 190925 - protein, 36 aa, Artificial Sequence
  Description of Artificial Sequence: Synthetic polypeptide
CEEEIACTNPVATEQWGGCTVATNNLENGMPGEFTN

SEQ ID NO: 190926 - protein, 37 aa, Artificial Sequence
  Description of Artificial Sequence: Synthetic polypeptide
EDETICTTNPVATESYGVVSTVVNDTGNNQTGTTNVA

SEQ ID NO: 190927 - protein, 36 aa, Artificial Sequence
  Description of Artificial Sequence: Synthetic polypeptide
CEEEIACTNPVATEQWGGCVAITNALENGMAGEETN

SEQ ID NO: 190928 - protein, 36 aa, Artificial Sequence
  Description of Artificial Sequence: Synthetic polypeptide
EDETICTTNPVATEQWGVVSTTNNEQGSEEGTVVED

SEQ ID NO: 190929 - protein, 37 aa, Artificial Sequence
  Description of Artificial Sequence: Synthetic polypeptide
EDETICTTNPVATEQWGTVSTVVNNQNGTEQGTNVTD

SEQ ID NO: 190930 - protein, 37 aa, Artificial Sequence
  Description of Artificial Sequence: Synthetic polypeptide
DDEEISTTNPVATEQYGCVCSMWEEHNAENFNSDNQS

SEQ ID NO: 190931 - protein, 36 aa, Artificial Sequence
  Description of Artificial Sequence: Synthetic polypeptide
EAAEIATTNPVATESYGSVCYNNEGQQQDQQGMNDP

SEQ ID NO: 190932 - protein, 36 aa, Artificial Sequence
  Description of Artificial Sequence: Synthetic polypeptide
QEEEIATTNPVATEQWGGCNVAGTGQDDNQMGGEHH

SEQ ID NO: 190933 - protein, 38 aa, Artificial Sequence
  Description of Artificial Sequence: Synthetic polypeptide
DECEICTTNPVATEAYGVVSVTQLQAGTEQGSTTTQEE

SEQ ID NO: 190934 - protein, 38 aa, Artificial Sequence
  Description of Artificial Sequence: Synthetic polypeptide
DECEICTTNPVATEAYGVVSTTQLQNATEQGSTTDQDE

SEQ ID NO: 190935 - protein, 37 aa, Artificial Sequence
  Description of Artificial Sequence: Synthetic polypeptide
EAESCEIATTNPVAYEQWGSVCSTWDGNDQNQHGGKT

SEQ ID NO: 190936 - protein, 36 aa, Artificial Sequence
  Description of Artificial Sequence: Synthetic polypeptide
SEEEICTTNPVATEFYGATSMTGGGEGQGEGEGAEM

SEQ ID NO: 190937 - protein, 34 aa, Artificial Sequence
  Description of Artificial Sequence: Synthetic polypeptide
EATEIATTNPVAYEQWGSVYTWPGEESQNQQEGM

SEQ ID NO: 190938 - protein, 32 aa, Artificial Sequence
  Description of Artificial Sequence: Synthetic polypeptide
EATEIATTNPVAYERWGVVSWNNSGNAGEDGA

SEQ ID NO: 190939 - protein, 37 aa, Artificial Sequence
  Description of Artificial Sequence: Synthetic polypeptide
DEECIRTTNPVATEQYGCVCSWGEDDNQEFFISETQS

SEQ ID NO: 190940 - protein, 35 aa, Artificial Sequence
  Description of Artificial Sequence: Synthetic polypeptide
DEDEIATTNPVAYEQWGSVAATAHGAAAPPGSLAE

SEQ ID NO: 190941 - protein, 37 aa, Artificial Sequence
  Description of Artificial Sequence: Synthetic polypeptide
DDEEISTTNPVATEQYGCVCSDWGEHNQENFNSDTQA

SEQ ID NO: 190942 - protein, 37 aa, Artificial Sequence
  Description of Artificial Sequence: Synthetic polypeptide
DDEEISTTNPVATEQYGCVCSDWGEHNAENFNSDNQS

SEQ ID NO: 190943 - protein, 36 aa, Artificial Sequence
  Description of Artificial Sequence: Synthetic polypeptide
DDEEISTTNPVATEQYGCVCGWGEHNQENFNSETQP

SEQ ID NO: 190944 - protein, 37 aa, Artificial Sequence
  Description of Artificial Sequence: Synthetic polypeptide
EDETICTTNPVATEQWGTVSTVVNNQQGSEQGTNVED

SEQ ID NO: 190945 - protein, 38 aa, Artificial Sequence
  Description of Artificial Sequence: Synthetic polypeptide
DDEEISTTNPVATEQYGCAVCSNWGEHNTEGFGSDNQS

SEQ ID NO: 190946 - protein, 34 aa, Artificial Sequence
  Description of Artificial Sequence: Synthetic polypeptide
AECEIATTNPVAYEEWGVVATGGNTGNAGTDNQD

SEQ ID NO: 190947 - protein, 36 aa, Artificial Sequence
  Description of Artificial Sequence: Synthetic polypeptide
SEEEIATVNPVATAQWGGCTVAGNGLQSRANASGEQ

SEQ ID NO: 190948 - protein, 35 aa, Artificial Sequence
  Description of Artificial Sequence: Synthetic polypeptide
AECEIATTNPVAYEEWGVVATGGNTGNAGNDNQRW

SEQ ID NO: 190949 - protein, 37 aa, Artificial Sequence
  Description of Artificial Sequence: Synthetic polypeptide
EDETICTTNPVATEQWGTVSTNQNNEQGSEQGTNVED

SEQ ID NO: 190950 - protein, 37 aa, Artificial Sequence
  Description of Artificial Sequence: Synthetic polypeptide
EDETICTTNPVATEQWGTVSTTNNNLNGSEQGTNVTD

SEQ ID NO: 190951 - protein, 37 aa, Artificial Sequence
  Description of Artificial Sequence: Synthetic polypeptide
EDETICTTNPVATEQWGTVSTTNNNQQGSEEGTNVED

SEQ ID NO: 190952 - protein, 37 aa, Artificial Sequence
  Description of Artificial Sequence: Synthetic polypeptide
EDETICTTNPVATEQWGTVSTTVNNEQGSEEGTNVEE

SEQ ID NO: 190953 - protein, 37 aa, Artificial Sequence
  Description of Artificial Sequence: Synthetic polypeptide
EDETICTTNPVATEQWGTVSTTVNNLNGSEQGTNTED

SEQ ID NO: 190954 - protein, 36 aa, Artificial Sequence
  Description of Artificial Sequence: Synthetic polypeptide
SEEEIATTNPVAYEQWGGCVAGNNGLQAAPDGSIEN

SEQ ID NO: 190955 - protein, 38 aa, Artificial Sequence
  Description of Artificial Sequence: Synthetic polypeptide
DEEEIRTTNPVATEQYGQCVCSWGEDHNQENFFSETQA

SEQ ID NO: 190956 - protein, 39 aa, Artificial Sequence
  Description of Artificial Sequence: Synthetic polypeptide
YEEEIRTTNPVATEFYGSVDTVMTGNNGGDEDQNDDGQE

SEQ ID NO: 190957 - protein, 37 aa, Artificial Sequence
  Description of Artificial Sequence: Synthetic polypeptide
EDETICTTNPVATEQWGTVSTVNNNLNGSEQGTNVEQ

SEQ ID NO: 190958 - protein, 36 aa, Artificial Sequence
  Description of Artificial Sequence: Synthetic polypeptide
CEDEIACTNPVAYEQYGSVCSAPNAGEEHQGDNQDA

SEQ ID NO: 190959 - protein, 34 aa, Artificial Sequence
  Description of Artificial Sequence: Synthetic polypeptide
DEDEIATTNPVAYEQWGSIAATAHGAAAPPGSHH

SEQ ID NO: 190960 - protein, 35 aa, Artificial Sequence
  Description of Artificial Sequence: Synthetic polypeptide
AECEIATTNPVAYEEWGVVATGGNTGNAQGIDNQR

SEQ ID NO: 190961 - protein, 35 aa, Artificial Sequence
  Description of Artificial Sequence: Synthetic polypeptide
EEAEIRTTNPVAYECWGCVFGGNGEERNNMGNGNQ

SEQ ID NO: 190962 - protein, 35 aa, Artificial Sequence
  Description of Artificial Sequence: Synthetic polypeptide
EEAEIRTTNPVAYEQWGHYTIPPNEGDQQQNGDER

SEQ ID NO: 190963 - protein, 35 aa, Artificial Sequence
  Description of Artificial Sequence: Synthetic polypeptide
EEAEIRTTNPVAYEQWGHYTIQNNEGDQQQEGDTR

SEQ ID NO: 190964 - protein, 37 aa, Artificial Sequence
  Description of Artificial Sequence: Synthetic polypeptide
DEETICTTNPVATEAYGVVATVVNNDQQLGTEEQEED

SEQ ID NO: 190965 - protein, 37 aa, Artificial Sequence
  Description of Artificial Sequence: Synthetic polypeptide
SEEEIATTNPVATEQYGSTACAMNPEEAPDDQANDNP

SEQ ID NO: 190966 - protein, 37 aa, Artificial Sequence
  Description of Artificial Sequence: Synthetic polypeptide
SEEEIATTNPVATEQYGSTACAAANNEVPDDGMNANV

SEQ ID NO: 190967 - protein, 37 aa, Artificial Sequence
  Description of Artificial Sequence: Synthetic polypeptide
CEEEIACTNPVATEQWGNVVASGDGTPNDAPAGNAYN

SEQ ID NO: 190968 - protein, 37 aa, Artificial Sequence
  Description of Artificial Sequence: Synthetic polypeptide
SEEEIATTNPVATEQYGSACAANNGEEAGMEMDNGNH

SEQ ID NO: 190969 - protein, 36 aa, Artificial Sequence
  Description of Artificial Sequence: Synthetic polypeptide
SEEEIATTNPVATEQYGSACAAGPLGFATMGDEEGN

SEQ ID NO: 190970 - protein, 38 aa, Artificial Sequence
  Description of Artificial Sequence: Synthetic polypeptide
SEEEIATTNPVATEQYGSACAAANPHQIAEAEMGNGNF

SEQ ID NO: 190971 - protein, 34 aa, Artificial Sequence
  Description of Artificial Sequence: Synthetic polypeptide
SEEEIATTNPVATEQYGQCFCPWEDNQHFSSEQS

SEQ ID NO: 190972 - protein, 38 aa, Artificial Sequence
  Description of Artificial Sequence: Synthetic polypeptide
DEECIRTTNPVATEQYGQCVCSNWGEHNQENFNSDTQS

SEQ ID NO: 190973 - protein, 35 aa, Artificial Sequence
  Description of Artificial Sequence: Synthetic polypeptide
EEEEIATTNPVAYECWGSVYHPINDHQQATKGKES

SEQ ID NO: 190974 - protein, 38 aa, Artificial Sequence
  Description of Artificial Sequence: Synthetic polypeptide
DEECIRTTNPVATEQYGQCVCSNWGEHNQENFNSQTQS

SEQ ID NO: 190975 - protein, 38 aa, Artificial Sequence
  Description of Artificial Sequence: Synthetic polypeptide
DEECIRTTNPVATEQYGQCVCSNWGEHNQESFNSDNQS

SEQ ID NO: 190976 - protein, 39 aa, Artificial Sequence
  Description of Artificial Sequence: Synthetic polypeptide
DEEEIRTTNPVATLQYGTVAARSFPLANIIETSGAQNLE

SEQ ID NO: 190977 - protein, 39 aa, Artificial Sequence
  Description of Artificial Sequence: Synthetic polypeptide
DEEEIRTTNPVATLQYGTVAARSFELSNLVETSNAQQVE

SEQ ID NO: 190978 - protein, 37 aa, Artificial Sequence
  Description of Artificial Sequence: Synthetic polypeptide
CEEEIACTNPVATEQWGHVVANTGNGEYGAEGMGNRT

SEQ ID NO: 190979 - protein, 38 aa, Artificial Sequence
  Description of Artificial Sequence: Synthetic polypeptide
DEECIRTTNPVATEQYGQCVCSNWGEHNTENFNSDTQA

SEQ ID NO: 190980 - protein, 39 aa, Artificial Sequence
  Description of Artificial Sequence: Synthetic polypeptide
DEEEIRTTNPVATLQYGTVAARSFELANIIETSQAQNPP

SEQ ID NO: 190981 - protein, 36 aa, Artificial Sequence
  Description of Artificial Sequence: Synthetic polypeptide
DEMEIVTTNPVATEQYGCVCSNWGEPNEEFFTSDQS

SEQ ID NO: 190982 - protein, 39 aa, Artificial Sequence
  Description of Artificial Sequence: Synthetic polypeptide
DEEEIRTTNPVATLQYGTVAARSFELANIIETSGAQNQS

SEQ ID NO: 190983 - protein, 38 aa, Artificial Sequence
  Description of Artificial Sequence: Synthetic polypeptide
DEECIRTTNPVATEQYGQCVCSWGEDHNQENFNSDPQS

SEQ ID NO: 190984 - protein, 39 aa, Artificial Sequence
  Description of Artificial Sequence: Synthetic polypeptide
DEECIRTTNPVATEQYGQCVTSTWGADDNAEYFISDNQS

SEQ ID NO: 190985 - protein, 36 aa, Artificial Sequence
  Description of Artificial Sequence: Synthetic polypeptide
SEEEIATTNPVATEQYGCSCPTWEEDNQHFISETQS

SEQ ID NO: 190986 - protein, 32 aa, Artificial Sequence
  Description of Artificial Sequence: Synthetic polypeptide
AEHEIASTNPVGYEAYGVVMAYSGQSQEVGDQ

SEQ ID NO: 190987 - protein, 37 aa, Artificial Sequence
  Description of Artificial Sequence: Synthetic polypeptide
SEEEIATTNPVATEQYGCNVAGNNGGLPAENNHTENQ

SEQ ID NO: 190988 - protein, 32 aa, Artificial Sequence
  Description of Artificial Sequence: Synthetic polypeptide
AEHEIASTNPVGYEAYGVVMAYEGLSQHVGDS

SEQ ID NO: 190989 - protein, 35 aa, Artificial Sequence
  Description of Artificial Sequence: Synthetic polypeptide
EEEEIRCTNPTAYEQWGSTVYGENDDHQGGKGKTW

SEQ ID NO: 190990 - protein, 35 aa, Artificial Sequence
  Description of Artificial Sequence: Synthetic polypeptide
EEEEIRCTNPTAYEQWGSTVYGENDDHQGKDGKDH

SEQ ID NO: 190991 - protein, 35 aa, Artificial Sequence
  Description of Artificial Sequence: Synthetic polypeptide
SEEEIATTNPVATEQWGTNVCAAGALTEHQDDEMQ

SEQ ID NO: 190992 - protein, 39 aa, Artificial Sequence
  Description of Artificial Sequence: Synthetic polypeptide
DEEEIRTTNPVAYEQYGQCVCSTWMEDHNQENFGSDTQA

SEQ ID NO: 190993 - protein, 35 aa, Artificial Sequence
  Description of Artificial Sequence: Synthetic polypeptide
EEEEIRCTNPTAYEQWGSTVYGENNDDHRGGDPKA

SEQ ID NO: 190994 - protein, 39 aa, Artificial Sequence
  Description of Artificial Sequence: Synthetic polypeptide
DEEEIRTTNPVATLQYGTVAARSFELANSIETSQAQNKL

SEQ ID NO: 190995 - protein, 38 aa, Artificial Sequence
  Description of Artificial Sequence: Synthetic polypeptide
EEEEIATTNPVATEQYGSQTSTWTVGQELENAPVLCDQ

SEQ ID NO: 190996 - protein, 38 aa, Artificial Sequence
  Description of Artificial Sequence: Synthetic polypeptide
DEECIRTTNPVATEQYGQCVCSNWGEHNAENFNSDTQP

SEQ ID NO: 190997 - protein, 38 aa, Artificial Sequence
  Description of Artificial Sequence: Synthetic polypeptide
DEECIRTTNPVATEQYGQCVCSNWGEHNAENFNSDNQS

SEQ ID NO: 190998 - protein, 38 aa, Artificial Sequence
  Description of Artificial Sequence: Synthetic polypeptide
DEECIRTTNPVATEQYGQCAVCSNWGEHNQENFNSDQS

SEQ ID NO: 190999 - protein, 38 aa, Artificial Sequence
  Description of Artificial Sequence: Synthetic polypeptide
DEECIRTTNPVATEQYGQCVCSNSGEDNAENFNSDNQS

SEQ ID NO: 191000 - protein, 37 aa, Artificial Sequence
  Description of Artificial Sequence: Synthetic polypeptide
CEDEIATTNPVATEQWGSVAIPNHDEEATGDQDGSNP

SEQ ID NO: 191001 - protein, 38 aa, Artificial Sequence
  Description of Artificial Sequence: Synthetic polypeptide
DEESIRTTNPVAYEPYFYQVVNSNTRNDLLQPRSIEKH

SEQ ID NO: 191002 - protein, 34 aa, Artificial Sequence
  Description of Artificial Sequence: Synthetic polypeptide
CEEEIACTNPVATEQWGHSASLAGMGQAEDPMED

SEQ ID NO: 191003 - protein, 36 aa, Artificial Sequence
  Description of Artificial Sequence: Synthetic polypeptide
EEAENSTTNPVAYEQWGSYTISPNEGDQDRKGEGRP

SEQ ID NO: 191004 - protein, 38 aa, Artificial Sequence
  Description of Artificial Sequence: Synthetic polypeptide
DEESIRTTNPVAYEPYYQGVNSNTRNDLLQPENSIEKH

SEQ ID NO: 191005 - protein, 37 aa, Artificial Sequence
  Description of Artificial Sequence: Synthetic polypeptide
DEMEIVTTNPVATEQYGCVCSNTGEPNEESFISDTQS

SEQ ID NO: 191006 - protein, 38 aa, Artificial Sequence
  Description of Artificial Sequence: Synthetic polypeptide
DEESIRTTNPVAYEPYYQGVNSNTRNDLLQPRLIEKHN

SEQ ID NO: 191007 - protein, 34 aa, Artificial Sequence
  Description of Artificial Sequence: Synthetic polypeptide
DEDEIATTNPVAYEAWGVVWPGPNNENDGQKGDD

SEQ ID NO: 191008 - protein, 37 aa, Artificial Sequence
  Description of Artificial Sequence: Synthetic polypeptide
DEESIRTTNPVAYEPYYQSLVNSNENDLLQPDSIEKH

SEQ ID NO: 191009 - protein, 38 aa, Artificial Sequence
  Description of Artificial Sequence: Synthetic polypeptide
DEESIRTTNPVAYEPYYQVVNSNTRNDDLQPRSIEKHA

SEQ ID NO: 191010 - protein, 38 aa, Artificial Sequence
  Description of Artificial Sequence: Synthetic polypeptide
DEECIRTTNPVATEQYGQCVCSNSGEHNAEFFNSDFQS

SEQ ID NO: 191011 - protein, 38 aa, Artificial Sequence
  Description of Artificial Sequence: Synthetic polypeptide
CEDEIATTNPVATEQWGSVPAITNHGEEATGNQDGVNP

SEQ ID NO: 191012 - protein, 38 aa, Artificial Sequence
  Description of Artificial Sequence: Synthetic polypeptide
DEECIRTTNPVATEQYGQCVCSNWEEHNQESFNSDTQS

SEQ ID NO: 191013 - protein, 34 aa, Artificial Sequence
  Description of Artificial Sequence: Synthetic polypeptide
EECEIATTNPVAYEQWGSVACNVNDQGIQQDLGE

SEQ ID NO: 191014 - protein, 38 aa, Artificial Sequence
  Description of Artificial Sequence: Synthetic polypeptide
DEECIRTTNPVATEQYGQCVCSNWEPHNQENFNSDFQS

SEQ ID NO: 191015 - protein, 36 aa, Artificial Sequence
  Description of Artificial Sequence: Synthetic polypeptide
DDEEISTTNPVATEGYGCVCSMWGEHNQNFNSDTQA

SEQ ID NO: 191016 - protein, 37 aa, Artificial Sequence
  Description of Artificial Sequence: Synthetic polypeptide
DENEIRTTNPVATEQWGCVTSNWGAENAEYFNSDNQA

SEQ ID NO: 191017 - protein, 36 aa, Artificial Sequence
  Description of Artificial Sequence: Synthetic polypeptide
DEAEIACTNPVATEQYGSVCAAMAHDEAGMPPDNPH

SEQ ID NO: 191018 - protein, 36 aa, Artificial Sequence
  Description of Artificial Sequence: Synthetic polypeptide
DEAEIACTNPVATEQYGSVCAAIEGLEAGTLAEDAH

SEQ ID NO: 191019 - protein, 35 aa, Artificial Sequence
  Description of Artificial Sequence: Synthetic polypeptide
AEANEIATTNPVAYERWGCVPTNPLEGNDAGGNEE

SEQ ID NO: 191020 - protein, 35 aa, Artificial Sequence
  Description of Artificial Sequence: Synthetic polypeptide
DEDEIATTNPVAYECWGSVSGGNPGNAGEDDGQDQ

SEQ ID NO: 191021 - protein, 36 aa, Artificial Sequence
  Description of Artificial Sequence: Synthetic polypeptide
DEEEIATTNPVAYEQYGVSTVCAMIEGLGPPTQPST

SEQ ID NO: 191022 - protein, 38 aa, Artificial Sequence
  Description of Artificial Sequence: Synthetic polypeptide
DEEEIRTTNPVATEFYGVVTMQGIGNDDNQTGEFTEEG

SEQ ID NO: 191023 - protein, 38 aa, Artificial Sequence
  Description of Artificial Sequence: Synthetic polypeptide
AEATEIATTNPVAYEQWGSVCSTLNWNDQDANGDNNKG

SEQ ID NO: 191024 - protein, 38 aa, Artificial Sequence
  Description of Artificial Sequence: Synthetic polypeptide
DEEEIRTTNPVATEFYGVVNVQGINNMFNQTGEFTEEG

SEQ ID NO: 191025 - protein, 38 aa, Artificial Sequence
  Description of Artificial Sequence: Synthetic polypeptide
DEEEIRTTNPVATEFYGVVNMQGPNTEDNQTGEFTEEG

SEQ ID NO: 191026 - protein, 38 aa, Artificial Sequence
  Description of Artificial Sequence: Synthetic polypeptide
DEEEIRTTNPVATEFYGVVNMQGPNNMDNQTGEFTGEN

SEQ ID NO: 191027 - protein, 38 aa, Artificial Sequence
  Description of Artificial Sequence: Synthetic polypeptide
DEEEIRTTNPVATEFYGVVNMQGPNNMDNQTGEDTEEI

SEQ ID NO: 191028 - protein, 38 aa, Artificial Sequence
  Description of Artificial Sequence: Synthetic polypeptide
DEEEIRTTNPVATEFYGVVNMQGINNEDTQTGEFTEEG

SEQ ID NO: 191029 - protein, 30 aa, Artificial Sequence
  Description of Artificial Sequence: Synthetic polypeptide
DDSEVASTNPVSTEGYGNVANTIQSHVEEL

SEQ ID NO: 191030 - protein, 38 aa, Artificial Sequence
  Description of Artificial Sequence: Synthetic polypeptide
DECEICTTNPVATEAYGVVSVTQLQNATEQGSTTQEED

SEQ ID NO: 191031 - protein, 37 aa, Artificial Sequence
  Description of Artificial Sequence: Synthetic polypeptide
DTTTICTTNPVATEQYGSVSTVTNTNNGEQGTVEVGT

SEQ ID NO: 191032 - protein, 37 aa, Artificial Sequence
  Description of Artificial Sequence: Synthetic polypeptide
DDEEISTTNPVATEQYGCVCSMWGEHNAENFGSDTQS

SEQ ID NO: 191033 - protein, 35 aa, Artificial Sequence
  Description of Artificial Sequence: Synthetic polypeptide
DEESIATTNPVATASWGCNVAGTAAELGPDDSGNM

SEQ ID NO: 191034 - protein, 37 aa, Artificial Sequence
  Description of Artificial Sequence: Synthetic polypeptide
DESEIRTTNPVATEGWGCVCSMWGEENQEYFGSNTQS

SEQ ID NO: 191035 - protein, 38 aa, Artificial Sequence
  Description of Artificial Sequence: Synthetic polypeptide
DEECIRTTNPVATEQYGCSCSNSGEPHNAENFNSDNQA

SEQ ID NO: 191036 - protein, 37 aa, Artificial Sequence
  Description of Artificial Sequence: Synthetic polypeptide
DDEEISTTNPVATEQYGCVCSNWGEHNQEYFNSDTQA

SEQ ID NO: 191037 - protein, 37 aa, Artificial Sequence
  Description of Artificial Sequence: Synthetic polypeptide
DDEEISTTNPVATEQYGCVCSNWGEHNQENFGSDTQG

SEQ ID NO: 191038 - protein, 37 aa, Artificial Sequence
  Description of Artificial Sequence: Synthetic polypeptide
DDEEISTTNPVATEQYGCVCSNWGEHNQEHFNSQNQS

SEQ ID NO: 191039 - protein, 37 aa, Artificial Sequence
  Description of Artificial Sequence: Synthetic polypeptide
DDEEISTTNPVATEQYGCVCSNWGEHNQEHFNSETQA

SEQ ID NO: 191040 - protein, 36 aa, Artificial Sequence
  Description of Artificial Sequence: Synthetic polypeptide
DESEIRTTNPVATEGWGCVCSDWMEENQEHFGSDQA

SEQ ID NO: 191041 - protein, 37 aa, Artificial Sequence
  Description of Artificial Sequence: Synthetic polypeptide
DEECIRTTNPVATEQYGCVCGNWGEHNDENFNSDTQS

SEQ ID NO: 191042 - protein, 37 aa, Artificial Sequence
  Description of Artificial Sequence: Synthetic polypeptide
DDEEISTTNPVATEQYGCVCSNWGEHNIENFNSQTQA

SEQ ID NO: 191043 - protein, 37 aa, Artificial Sequence
  Description of Artificial Sequence: Synthetic polypeptide
DEECIRTTNPVATEQYGCVCQNWGEDNAEFFNSQNQS

SEQ ID NO: 191044 - protein, 37 aa, Artificial Sequence
  Description of Artificial Sequence: Synthetic polypeptide
DEECIRTTNPVATEQYGCVCQNWGEHNAENFGSDTQS

SEQ ID NO: 191045 - protein, 38 aa, Artificial Sequence
  Description of Artificial Sequence: Synthetic polypeptide
DESEIRTTNPVATEFYGVVNTQGPNNMDNQTGEFTEEG

SEQ ID NO: 191046 - protein, 34 aa, Artificial Sequence
  Description of Artificial Sequence: Synthetic polypeptide
DEMEIVTTNPVATECWGTTTCSNTDDPAFKGPYI

SEQ ID NO: 191047 - protein, 39 aa, Artificial Sequence
  Description of Artificial Sequence: Synthetic polypeptide
DESEIATTNPVAYEQWGVVSVLNPTGNGDVQDRKGGDAR

SEQ ID NO: 191048 - protein, 38 aa, Artificial Sequence
  Description of Artificial Sequence: Synthetic polypeptide
DEECIRTTNPVATEQYGCVCSMWGEDHNIENFNSDNQS

SEQ ID NO: 191049 - protein, 37 aa, Artificial Sequence
  Description of Artificial Sequence: Synthetic polypeptide
DEECIRTTNPVATEQYGCVCSNSGEDNQENFISDTQA

SEQ ID NO: 191050 - protein, 37 aa, Artificial Sequence
  Description of Artificial Sequence: Synthetic polypeptide
DDEEISTTNPVATEQYGCVCSNWGEHNAENFNSDTQG

SEQ ID NO: 191051 - protein, 34 aa, Artificial Sequence
  Description of Artificial Sequence: Synthetic polypeptide
DEMEIVTTNPVATECWGTTTCSNTDDPAPKGPYI

SEQ ID NO: 191052 - protein, 37 aa, Artificial Sequence
  Description of Artificial Sequence: Synthetic polypeptide
DDEEISTTNPVATEQYGCVCSNWGEHNAENFNSDTQA

SEQ ID NO: 191053 - protein, 36 aa, Artificial Sequence
  Description of Artificial Sequence: Synthetic polypeptide
DEDEIATTNPVAYEQWGSVCTDTPLPNDSGDGAGQN

SEQ ID NO: 191054 - protein, 37 aa, Artificial Sequence
  Description of Artificial Sequence: Synthetic polypeptide
AEMEIATTNPVATEQYGCVCSNTMELNEEHFGSEDQA

SEQ ID NO: 191055 - protein, 37 aa, Artificial Sequence
  Description of Artificial Sequence: Synthetic polypeptide
DDEEISTTNPVATEQYGCVCSNWGEHNAENFISDNQA

SEQ ID NO: 191056 - protein, 37 aa, Artificial Sequence
  Description of Artificial Sequence: Synthetic polypeptide
DDEEISTTNPVATEQYGCVCSNWGEHNAENFGSETQS

SEQ ID NO: 191057 - protein, 37 aa, Artificial Sequence
  Description of Artificial Sequence: Synthetic polypeptide
DEECIRTTNPVATEQYGCVCSNSGEHNDENFISDTQS

SEQ ID NO: 191058 - protein, 37 aa, Artificial Sequence
  Description of Artificial Sequence: Synthetic polypeptide
DDEEISTTNPVATEQYGCVCSNWGEHNAEHFNSDTQA

SEQ ID NO: 191059 - protein, 38 aa, Artificial Sequence
  Description of Artificial Sequence: Synthetic polypeptide
DDEEISTTNPVATEQYGCVCSNWGEDTNQENFNSDTQA

SEQ ID NO: 191060 - protein, 37 aa, Artificial Sequence
  Description of Artificial Sequence: Synthetic polypeptide
DDEEISTTNPVATEQYGCVCSNWGEDNQENFNSDNQS

SEQ ID NO: 191061 - protein, 38 aa, Artificial Sequence
  Description of Artificial Sequence: Synthetic polypeptide
DDEEISTTNPVATEQYGCVCSNWGEDHNQENFGSENQS

SEQ ID NO: 191062 - protein, 36 aa, Artificial Sequence
  Description of Artificial Sequence: Synthetic polypeptide
DAEEIATTNPVAYEQWGHCNVAATMNGLDAGAPPGF

SEQ ID NO: 191063 - protein, 37 aa, Artificial Sequence
  Description of Artificial Sequence: Synthetic polypeptide
DDEEISTTNPVATEQYGCVCSNWGEHNAESFISENQP

SEQ ID NO: 191064 - protein, 37 aa, Artificial Sequence
  Description of Artificial Sequence: Synthetic polypeptide
DEEEIATTNPVATEQFGQCVCSWMYHNAENFGSETQS

SEQ ID NO: 191065 - protein, 38 aa, Artificial Sequence
  Description of Artificial Sequence: Synthetic polypeptide
DEECIRTTNPVATEQWGQCVCQNWNEHNQEGFISDNQS

SEQ ID NO: 191066 - protein, 35 aa, Artificial Sequence
  Description of Artificial Sequence: Synthetic polypeptide
CEEEIACTNPVATEQWGCVAGAGEVQTAENAGMNS

SEQ ID NO: 191067 - protein, 38 aa, Artificial Sequence
  Description of Artificial Sequence: Synthetic polypeptide
DEECIRTTNPVATEQWGCVCQNWNEDHNQEGFNSDNQS

SEQ ID NO: 191068 - protein, 37 aa, Artificial Sequence
  Description of Artificial Sequence: Synthetic polypeptide
DEAEIRTTNPVATEQWGSTIPWTPPLEENPHSQIEVQ

SEQ ID NO: 191069 - protein, 36 aa, Artificial Sequence
  Description of Artificial Sequence: Synthetic polypeptide
DEAEIRTTNPVATEQWGMYWCTTESVIEEFEVDNME

SEQ ID NO: 191070 - protein, 36 aa, Artificial Sequence
  Description of Artificial Sequence: Synthetic polypeptide
SEEEIRCTNPCATEEYGCVCSWGEHNAENFGSDNQS

SEQ ID NO: 191071 - protein, 37 aa, Artificial Sequence
  Description of Artificial Sequence: Synthetic polypeptide
DEECIRTTNPVATEQWGCVCQWGEDHNQEGFISDNQS

SEQ ID NO: 191072 - protein, 36 aa, Artificial Sequence
  Description of Artificial Sequence: Synthetic polypeptide
DESEIRTTNPVATEGWGCVCSWGEENQEYFNSQTQG

SEQ ID NO: 191073 - protein, 36 aa, Artificial Sequence
  Description of Artificial Sequence: Synthetic polypeptide
DESEIRTTNPVATEGWGCVCSWGEENQEYFGSETQN

SEQ ID NO: 191074 - protein, 38 aa, Artificial Sequence
  Description of Artificial Sequence: Synthetic polypeptide
DEEEIATTNPVAYEQYGSVPANANHADTQHAADDQTNQ

SEQ ID NO: 191075 - protein, 37 aa, Artificial Sequence
  Description of Artificial Sequence: Synthetic polypeptide
DEECIRTTNPVATEQWGCVCQWNEDHNAEGFGSENQS

SEQ ID NO: 191076 - protein, 37 aa, Artificial Sequence
  Description of Artificial Sequence: Synthetic polypeptide
DEQEIRTTNPVATEQYGSTIPWTPPWEENNHSPIEMQ

SEQ ID NO: 191077 - protein, 36 aa, Artificial Sequence
  Description of Artificial Sequence: Synthetic polypeptide
CEEEIATTNPVATAQWGSVVSATGPPGENHDEMTWN

SEQ ID NO: 191078 - protein, 39 aa, Artificial Sequence
  Description of Artificial Sequence: Synthetic polypeptide
DEEEIATTNPVATEQWGCNVTAGNNGGLPQENNHGGENQ

SEQ ID NO: 191079 - protein, 38 aa, Artificial Sequence
  Description of Artificial Sequence: Synthetic polypeptide
DEEEIATTNPVATEQWGCNVAGNNGGLPENNNHGIDNE

SEQ ID NO: 191080 - protein, 37 aa, Artificial Sequence
  Description of Artificial Sequence: Synthetic polypeptide
DESEIRTTNPVATEGWGCVCSTWGEDENQEYFGSQQS

SEQ ID NO: 191081 - protein, 38 aa, Artificial Sequence
  Description of Artificial Sequence: Synthetic polypeptide
DTEEIRTTNPVATEQYGVVVTVVTTNNTAEEQGTEEED

SEQ ID NO: 191082 - protein, 38 aa, Artificial Sequence
  Description of Artificial Sequence: Synthetic polypeptide
DEEEIATTNPVATEQWGCNVAGNNGGLPEENNHGIVNS

SEQ ID NO: 191083 - protein, 37 aa, Artificial Sequence
  Description of Artificial Sequence: Synthetic polypeptide
DDEEISTTNPVATEQYGCVCSNWPEDPNTENFNSEQS

SEQ ID NO: 191084 - protein, 36 aa, Artificial Sequence
  Description of Artificial Sequence: Synthetic polypeptide
DEESIACTNPVAYEQYGSVATPAHITQGTPGDEAAP

SEQ ID NO: 191085 - protein, 38 aa, Artificial Sequence
  Description of Artificial Sequence: Synthetic polypeptide
DEECIRTTNPVATEQWGQCVCQNWGEDNQEGFNSDTQS

SEQ ID NO: 191086 - protein, 39 aa, Artificial Sequence
  Description of Artificial Sequence: Synthetic polypeptide
DEEEIRGTNPVATEQYGVVVMGPDQNDQELPAEGQTGGQ

SEQ ID NO: 191087 - protein, 38 aa, Artificial Sequence
  Description of Artificial Sequence: Synthetic polypeptide
DEEEIRTTNPVAYEQYGQCVCSNWMPDHNQNFGSQTQA

SEQ ID NO: 191088 - protein, 37 aa, Artificial Sequence
  Description of Artificial Sequence: Synthetic polypeptide
DESEIRTTNPVATEGWGCVCSNWMEDNQEYFGSNTQA

SEQ ID NO: 191089 - protein, 37 aa, Artificial Sequence
  Description of Artificial Sequence: Synthetic polypeptide
DDEEISTTNPVATEQYGCVCSNWGPHNAENFNSDNQS

SEQ ID NO: 191090 - protein, 38 aa, Artificial Sequence
  Description of Artificial Sequence: Synthetic polypeptide
DDEEISTTNPVATEQYGCVCSNWGEDHNQENFGSDNQM

SEQ ID NO: 191091 - protein, 37 aa, Artificial Sequence
  Description of Artificial Sequence: Synthetic polypeptide
DEAEIACTNPVATEQYGSACSAANPAEADAEIGNNTA

SEQ ID NO: 191092 - protein, 38 aa, Artificial Sequence
  Description of Artificial Sequence: Synthetic polypeptide
DDEEISTTNPVATEQYGCVCSNWMEDHNEENFGSDNQV

SEQ ID NO: 191093 - protein, 38 aa, Artificial Sequence
  Description of Artificial Sequence: Synthetic polypeptide
DEEEIATTNPVATEQWGCNVAGNNGGLPEENNHGGQNQ

SEQ ID NO: 191094 - protein, 37 aa, Artificial Sequence
  Description of Artificial Sequence: Synthetic polypeptide
DEAEIACTNPVATEQYGSACAATNPHEAEAENGNMTG

SEQ ID NO: 191095 - protein, 38 aa, Artificial Sequence
  Description of Artificial Sequence: Synthetic polypeptide
DEAEIACTNPVATEQYGSACAATNPAEEAGRHGDNEAE

SEQ ID NO: 191096 - protein, 36 aa, Artificial Sequence
  Description of Artificial Sequence: Synthetic polypeptide
DEAEIACTNPVATEQYGSACAANPDTEGRHGDEDAP

SEQ ID NO: 191097 - protein, 36 aa, Artificial Sequence
  Description of Artificial Sequence: Synthetic polypeptide
DEAEIACTNPVATEQYGSACAAHHQMLGMDIGNDNH

SEQ ID NO: 191098 - protein, 37 aa, Artificial Sequence
  Description of Artificial Sequence: Synthetic polypeptide
DEAEIACTNPVATEQYGSACPATNPHEEAEAPGGNDN

SEQ ID NO: 191099 - protein, 33 aa, Artificial Sequence
  Description of Artificial Sequence: Synthetic polypeptide
AEHEIASTNPVGYEAYGVVHAYSSLSQHVGDNI

SEQ ID NO: 191100 - protein, 37 aa, Artificial Sequence
  Description of Artificial Sequence: Synthetic polypeptide
DEDEIATTNPVAYEQWGSVCSPANPALQEHWIDLTAM

SEQ ID NO: 191101 - protein, 35 aa, Artificial Sequence
  Description of Artificial Sequence: Synthetic polypeptide
CEEEIACTNPVATEQWGCVAGAGPAQTAENAGMNW

SEQ ID NO: 191102 - protein, 37 aa, Artificial Sequence
  Description of Artificial Sequence: Synthetic polypeptide
DDEEISTTNPVATEQYGCVCSNWEEHNQEYFNSDNQA

SEQ ID NO: 191103 - protein, 37 aa, Artificial Sequence
  Description of Artificial Sequence: Synthetic polypeptide
DDEEISTTNPVATEQYGCVCSNWEEHNQEGFISETQA

SEQ ID NO: 191104 - protein, 34 aa, Artificial Sequence
  Description of Artificial Sequence: Synthetic polypeptide
DTNEIATTNPVATEQWGCVAGEGVEMNAAEDNKW

SEQ ID NO: 191105 - protein, 37 aa, Artificial Sequence
  Description of Artificial Sequence: Synthetic polypeptide
DDEEISTTNPVATEQYGCVCSNWEEHNQEGFGSETQA

SEQ ID NO: 191106 - protein, 34 aa, Artificial Sequence
  Description of Artificial Sequence: Synthetic polypeptide
DTNEIATTNPVATEQWGCVAGEGVEMNAAEMDNA

SEQ ID NO: 191107 - protein, 36 aa, Artificial Sequence
  Description of Artificial Sequence: Synthetic polypeptide
DTNEICTTNPVATEQYGSAFTWTYWPITQFQDNQIM

SEQ ID NO: 191108 - protein, 36 aa, Artificial Sequence
  Description of Artificial Sequence: Synthetic polypeptide
DDEEISTTNPVATEQYGCVCSNWEEHNQEFFISDQG

SEQ ID NO: 191109 - protein, 36 aa, Artificial Sequence
  Description of Artificial Sequence: Synthetic polypeptide
DDEEISTTNPVATEQYGCVCSNWEEHNAHFNSETQA

SEQ ID NO: 191110 - protein, 37 aa, Artificial Sequence
  Description of Artificial Sequence: Synthetic polypeptide
DDEEISTTNPVATEQYGCVCSNWEEDHNQEHFGSEQA

SEQ ID NO: 191111 - protein, 33 aa, Artificial Sequence
  Description of Artificial Sequence: Synthetic polypeptide
AEMEIACTNPCSYEQYGCVCSWEDNQSFGSENQ

SEQ ID NO: 191112 - protein, 36 aa, Artificial Sequence
  Description of Artificial Sequence: Synthetic polypeptide
DTSEIRTTNPVAYEAWGISVSCANSSSDREGGMPDG

SEQ ID NO: 191113 - protein, 37 aa, Artificial Sequence
  Description of Artificial Sequence: Synthetic polypeptide
DDEEISTTNPVATEQYGCVCSNSGEDNQENFGSEFQG

SEQ ID NO: 191114 - protein, 34 aa, Artificial Sequence
  Description of Artificial Sequence: Synthetic polypeptide
DTSEVACTNPVSTEGYGNVCYNTDQQSRVGDQDR

SEQ ID NO: 191115 - protein, 33 aa, Artificial Sequence
  Description of Artificial Sequence: Synthetic polypeptide
DTTAEIATTNPVAYEPWGHVVAATANDTAAANN

SEQ ID NO: 191116 - protein, 37 aa, Artificial Sequence
  Description of Artificial Sequence: Synthetic polypeptide
DEEEIATTNPVAYEQYGVSTVCAMIEGLGPPDGGSAM

SEQ ID NO: 191117 - protein, 36 aa, Artificial Sequence
  Description of Artificial Sequence: Synthetic polypeptide
DESEIATTNPVAYEQWGGCVAGNNGLQAAPDGSMHN

SEQ ID NO: 191118 - protein, 35 aa, Artificial Sequence
  Description of Artificial Sequence: Synthetic polypeptide
DESEIATTNPVAYEQWGEVCYNNDQDQLGHKEDQE

SEQ ID NO: 191119 - protein, 36 aa, Artificial Sequence
  Description of Artificial Sequence: Synthetic polypeptide
DESEIATTNPVAYEQWGEAVCSDRNDMPNGGTGQER

SEQ ID NO: 191120 - protein, 35 aa, Artificial Sequence
  Description of Artificial Sequence: Synthetic polypeptide
DESEIATTNPVAYEQWGATYYSIEIERMNQREPDH

SEQ ID NO: 191121 - protein, 39 aa, Artificial Sequence
  Description of Artificial Sequence: Synthetic polypeptide
DEEEIRTTNPVATWQYGNSFVDPVFSEHQITSEQIETTE

SEQ ID NO: 191122 - protein, 32 aa, Artificial Sequence
  Description of Artificial Sequence: Synthetic polypeptide
DDSEVASTNPVSTEGYGNVACYTDIESRVGQQ

SEQ ID NO: 191123 - protein, 37 aa, Artificial Sequence
  Description of Artificial Sequence: Synthetic polypeptide
DESEIATTNPVAYECWGSTVYVTPQQGERDAGQDGRN

SEQ ID NO: 191124 - protein, 35 aa, Artificial Sequence
  Description of Artificial Sequence: Synthetic polypeptide
DESEIATTNPVAYEAWGCTYTTPGNQQNDNNRDEK

SEQ ID NO: 191125 - protein, 35 aa, Artificial Sequence
  Description of Artificial Sequence: Synthetic polypeptide
CEEEIACTNPVATEQWGCVAGAGPLVQTAMNAGMN

SEQ ID NO: 191126 - protein, 34 aa, Artificial Sequence
  Description of Artificial Sequence: Synthetic polypeptide
CEEEIACTNPVATEQWGCVAGKGLVPTAENDGMN

SEQ ID NO: 191127 - protein, 34 aa, Artificial Sequence
  Description of Artificial Sequence: Synthetic polypeptide
CEEEIACTNPVATEQWGCVAGNGDADAPMNETEA

SEQ ID NO: 191128 - protein, 35 aa, Artificial Sequence
  Description of Artificial Sequence: Synthetic polypeptide
DAEEIATTNPVAYEQWGCNTAGNNGLTTAPDGNAS

SEQ ID NO: 191129 - protein, 38 aa, Artificial Sequence
  Description of Artificial Sequence: Synthetic polypeptide
DDEEISTTNPVATEQYGCVCSNSGEDHNAENFGSDNQS

SEQ ID NO: 191130 - protein, 38 aa, Artificial Sequence
  Description of Artificial Sequence: Synthetic polypeptide
DDEEISTTNPVATEQYGCVCSMWGNDHNQENFNSDTQA

SEQ ID NO: 191131 - protein, 35 aa, Artificial Sequence
  Description of Artificial Sequence: Synthetic polypeptide
CEEEIACTNPVATEQWGCVAGTEGLEAGPGEEDAQ

SEQ ID NO: 191132 - protein, 37 aa, Artificial Sequence
  Description of Artificial Sequence: Synthetic polypeptide
DESEIATTNPVAYEQWGEVVHSLGDNQIEQRNGGGGH

SEQ ID NO: 191133 - protein, 39 aa, Artificial Sequence
  Description of Artificial Sequence: Synthetic polypeptide
DEEEIRGTNPVATEQYGSVVGNMNMPNAGQEGGQTGGQI

SEQ ID NO: 191134 - protein, 34 aa, Artificial Sequence
  Description of Artificial Sequence: Synthetic polypeptide
AEMEIACTNPCSYEQYGCVCSWGNLQSFGSETQS

SEQ ID NO: 191135 - protein, 39 aa, Artificial Sequence
  Description of Artificial Sequence: Synthetic polypeptide
DEEEIRGTNPVATEQYGSVVLLIGENELDTADDVGGGEN

SEQ ID NO: 191136 - protein, 36 aa, Artificial Sequence
  Description of Artificial Sequence: Synthetic polypeptide
DESEIATTNPVAYEQWGSVCYNNWNDQDQGHGEDQE

SEQ ID NO: 191137 - protein, 36 aa, Artificial Sequence
  Description of Artificial Sequence: Synthetic polypeptide
DESEIATTNPVAYEQWGSVCYNINDQDQEGHGEDIE

SEQ ID NO: 191138 - protein, 37 aa, Artificial Sequence
  Description of Artificial Sequence: Synthetic polypeptide
DEAEIACTNPVATEQYGSCAAAPGTHPMQGMEIGNND

SEQ ID NO: 191139 - protein, 36 aa, Artificial Sequence
  Description of Artificial Sequence: Synthetic polypeptide
DESEIATTNPVAYEQWGSVCYNIEDQDQLGHKEDQE

SEQ ID NO: 191140 - protein, 38 aa, Artificial Sequence
  Description of Artificial Sequence: Synthetic polypeptide
DEECIRTTNPVATEQYGCVCSNWEEDHNQENFNSDNQS

SEQ ID NO: 191141 - protein, 37 aa, Artificial Sequence
  Description of Artificial Sequence: Synthetic polypeptide
DEDEIATTNPVAYEQWGSVCSANPAQPQEHGIDLTAM

SEQ ID NO: 191142 - protein, 38 aa, Artificial Sequence
  Description of Artificial Sequence: Synthetic polypeptide
DDEEISTTNPVATEQYGCVCSNWGEDDNQENFGSENQS

SEQ ID NO: 191143 - protein, 37 aa, Artificial Sequence
  Description of Artificial Sequence: Synthetic polypeptide
DEECIRTTNPVATEQYGCVCSNWGEDDNAENFISDQS

SEQ ID NO: 191144 - protein, 38 aa, Artificial Sequence
  Description of Artificial Sequence: Synthetic polypeptide
DEECIRTTNPVATEQYGCVCSNWGEDDNAEYFNSQNQS

SEQ ID NO: 191145 - protein, 36 aa, Artificial Sequence
  Description of Artificial Sequence: Synthetic polypeptide
DEDEIATTNPVAYEQWGSVCSANPALGEHMIDLAAM

SEQ ID NO: 191146 - protein, 38 aa, Artificial Sequence
  Description of Artificial Sequence: Synthetic polypeptide
DEECIRTTNPVATEQYGCVCSNWGEDHNQENFNSDTQA

SEQ ID NO: 191147 - protein, 38 aa, Artificial Sequence
  Description of Artificial Sequence: Synthetic polypeptide
DEECIRTTNPVATEQYGCVCSNWGEDHNQENFNSDTQS

SEQ ID NO: 191148 - protein, 38 aa, Artificial Sequence
  Description of Artificial Sequence: Synthetic polypeptide
DEEEIRTTNPVAYEQYGQCVCSSGEDHNQENFISDNQS

SEQ ID NO: 191149 - protein, 38 aa, Artificial Sequence
  Description of Artificial Sequence: Synthetic polypeptide
DEECIRTTNPVATEQYGCVCSNWGEGDNAENFNSDTQA

SEQ ID NO: 191150 - protein, 36 aa, Artificial Sequence
  Description of Artificial Sequence: Synthetic polypeptide
DEDEIATTNPVAYEQWGSVCQDTPLPNDSGDGMGYN

SEQ ID NO: 191151 - protein, 38 aa, Artificial Sequence
  Description of Artificial Sequence: Synthetic polypeptide
DEEEIRTTNPVAYEQYGQCVCSSGEDHNQEYFNSETQA

SEQ ID NO: 191152 - protein, 35 aa, Artificial Sequence
  Description of Artificial Sequence: Synthetic polypeptide
DEESIATTNPVAYECWGSVYNWMNDVKGHEGHHMR

SEQ ID NO: 191153 - protein, 32 aa, Artificial Sequence
  Description of Artificial Sequence: Synthetic polypeptide
AEMEIACTNPCSYEQYGCVCSWMEDQSFGSEQ

SEQ ID NO: 191154 - protein, 35 aa, Artificial Sequence
  Description of Artificial Sequence: Synthetic polypeptide
DTGEIATTNPVATEQYGCVAANHSGDPAMHPGDEG

SEQ ID NO: 191155 - protein, 38 aa, Artificial Sequence
  Description of Artificial Sequence: Synthetic polypeptide
DEEEIATTNPVAYEQYGVSTACAANDGEPLGSEGEHHH

SEQ ID NO: 191156 - protein, 32 aa, Artificial Sequence
  Description of Artificial Sequence: Synthetic polypeptide
AEMEIACTNPCSYEQYGCVCSWNHNASFGSEQ

SEQ ID NO: 191157 - protein, 39 aa, Artificial Sequence
  Description of Artificial Sequence: Synthetic polypeptide
DEEEIRGTNPVATEQYGSYVQLVELGILVAQTRVDSQLE

SEQ ID NO: 191158 - protein, 37 aa, Artificial Sequence
  Description of Artificial Sequence: Synthetic polypeptide
DEAEIATTNPVAYEQWGSVSGGEIGNGGNMRRKEEMM

SEQ ID NO: 191159 - protein, 38 aa, Artificial Sequence
  Description of Artificial Sequence: Synthetic polypeptide
DDEEISTTNPVATEQYGCVCSNWGEDHNAENFGSENQS

SEQ ID NO: 191160 - protein, 38 aa, Artificial Sequence
  Description of Artificial Sequence: Synthetic polypeptide
DEEEIRGTNPVATEQYGSYVQLVELGTVAQTYVDIQLE

SEQ ID NO: 191161 - protein, 38 aa, Artificial Sequence
  Description of Artificial Sequence: Synthetic polypeptide
DEEEIRGTNPVATEQYGVAYGGNGGENSGGTNGDGGDG

SEQ ID NO: 191162 - protein, 34 aa, Artificial Sequence
  Description of Artificial Sequence: Synthetic polypeptide
DTEEISATNPVAYEQWGCSYNEIDNQDQDNGTTS

SEQ ID NO: 191163 - protein, 32 aa, Artificial Sequence
  Description of Artificial Sequence: Synthetic polypeptide
AEMEIACTNPCSYEQYGCVTSWEHQSFGSQQS

SEQ ID NO: 191164 - protein, 35 aa, Artificial Sequence
  Description of Artificial Sequence: Synthetic polypeptide
DEMEIRTTNPIATEQWGTTWANAEGWVAEPEGNYI

SEQ ID NO: 191165 - protein, 35 aa, Artificial Sequence
  Description of Artificial Sequence: Synthetic polypeptide
DEDEIATTNPVAYEQWGSVAATAHGAGAPPGSVHN

SEQ ID NO: 191166 - protein, 36 aa, Artificial Sequence
  Description of Artificial Sequence: Synthetic polypeptide
DEDEIATTNPVAYEQWGSVCAANPALAQAHQDLTAM

SEQ ID NO: 191167 - protein, 36 aa, Artificial Sequence
  Description of Artificial Sequence: Synthetic polypeptide
QEEEIATTNPVATEQYGCYCPNWGEDNQHFNSENQS

SEQ ID NO: 191168 - protein, 39 aa, Artificial Sequence
  Description of Artificial Sequence: Synthetic polypeptide
EEEEIRTTNPVATEAYGVVNPDTNFLNRNEGIPGEMEGD

SEQ ID NO: 191169 - protein, 38 aa, Artificial Sequence
  Description of Artificial Sequence: Synthetic polypeptide
DEMEIVTTNPVATEQYGQCVCSNTGEPNEEFFGSDPQS

SEQ ID NO: 191170 - protein, 36 aa, Artificial Sequence
  Description of Artificial Sequence: Synthetic polypeptide
DEDEIATTNPVAYEQWGHCNVAATGNGLPAAPGGQF

SEQ ID NO: 191171 - protein, 35 aa, Artificial Sequence
  Description of Artificial Sequence: Synthetic polypeptide
DDSEVASTNPVSTEGYGNVCYNTIDQSRHGDQNRS

SEQ ID NO: 191172 - protein, 35 aa, Artificial Sequence
  Description of Artificial Sequence: Synthetic polypeptide
DEAEIATTNPIATEQWGSIVPTWWDQHEHDQHTEP

SEQ ID NO: 191173 - protein, 38 aa, Artificial Sequence
  Description of Artificial Sequence: Synthetic polypeptide
DEEEIRTTNPVATEWYGQHWITYNYDPGQDLEINDYQE

SEQ ID NO: 191174 - protein, 38 aa, Artificial Sequence
  Description of Artificial Sequence: Synthetic polypeptide
DEEEIRTTNPVATEWYGQAWSWYNTDPGQDLEINDMQE

SEQ ID NO: 191175 - protein, 38 aa, Artificial Sequence
  Description of Artificial Sequence: Synthetic polypeptide
DEEEIRTTNPVATEWYGQAWITYNGDSGMDLEINDYQE

SEQ ID NO: 191176 - protein, 36 aa, Artificial Sequence
  Description of Artificial Sequence: Synthetic polypeptide
DEEEIRTTNPVATEQYGSANWPEIPEDDADEKDILF

SEQ ID NO: 191177 - protein, 38 aa, Artificial Sequence
  Description of Artificial Sequence: Synthetic polypeptide
DEEEIRTTNPVATEWYGQAWITYNFDPGQDLEINDFQE

SEQ ID NO: 191178 - protein, 37 aa, Artificial Sequence
  Description of Artificial Sequence: Synthetic polypeptide
DEEEIRTTNPVATEQYGSAPPPPLWLEEVPMDPLEFG

SEQ ID NO: 191179 - protein, 37 aa, Artificial Sequence
  Description of Artificial Sequence: Synthetic polypeptide
DEEEIRTTNPVATEQYGSAQEGWNTGMDIPSTFESQT

SEQ ID NO: 191180 - protein, 34 aa, Artificial Sequence
  Description of Artificial Sequence: Synthetic polypeptide
DDSEVASTNPVSTEGYGNVCYNTIDQSRHGQNGK

SEQ ID NO: 191181 - protein, 39 aa, Artificial Sequence
  Description of Artificial Sequence: Synthetic polypeptide
DDEEIRTTNPVATEQYGSVYGVGQEGDLEVGNGGQEEFA

SEQ ID NO: 191182 - protein, 38 aa, Artificial Sequence
  Description of Artificial Sequence: Synthetic polypeptide
DEEEIRTTNPVATEGYGCVCENWGEDDNTEYFGSDNQS

SEQ ID NO: 191183 - protein, 34 aa, Artificial Sequence
  Description of Artificial Sequence: Synthetic polypeptide
DDSEVASTNPVSTEGYGNVCYNTIDQSRHGQQSR

SEQ ID NO: 191184 - protein, 37 aa, Artificial Sequence
  Description of Artificial Sequence: Synthetic polypeptide
DEEEIRTTNPVATEGYGCVCFNWGEHNAENFGSDTQS

SEQ ID NO: 191185 - protein, 38 aa, Artificial Sequence
  Description of Artificial Sequence: Synthetic polypeptide
DEECIRTTNPVAYEQYGQCVCSNTGEDNQEYFGSDTQS

SEQ ID NO: 191186 - protein, 34 aa, Artificial Sequence
  Description of Artificial Sequence: Synthetic polypeptide
DDSEVASTNPVSTEGYGNVCYNTIDQSRVGQNKE

SEQ ID NO: 191187 - protein, 37 aa, Artificial Sequence
  Description of Artificial Sequence: Synthetic polypeptide
CEEEISTTNPVATEQYGCVCSNWGEPNQENFNSQTQS

SEQ ID NO: 191188 - protein, 39 aa, Artificial Sequence
  Description of Artificial Sequence: Synthetic polypeptide
DDEEIRTTNPVATEQYGSVYGQGQIGDLEVGNGGIEETA

SEQ ID NO: 191189 - protein, 38 aa, Artificial Sequence
  Description of Artificial Sequence: Synthetic polypeptide
DEECIRTTNPVAYEQYGQCVCSTGEDHNQEYFGSETQA

SEQ ID NO: 191190 - protein, 37 aa, Artificial Sequence
  Description of Artificial Sequence: Synthetic polypeptide
CEEEISTTNPVATEQYGCVCSSGEDHDIEHFGSDNQS

SEQ ID NO: 191191 - protein, 36 aa, Artificial Sequence
  Description of Artificial Sequence: Synthetic polypeptide
CEEEIACTNPVATEQYGCSAAMVGNLDNIDPNEMTH

SEQ ID NO: 191192 - protein, 37 aa, Artificial Sequence
  Description of Artificial Sequence: Synthetic polypeptide
DEAEISTTNPVAYEQYGCVCSWGEDHNAEYFGSDNQA

SEQ ID NO: 191193 - protein, 36 aa, Artificial Sequence
  Description of Artificial Sequence: Synthetic polypeptide
DEAEIRTTNPVATEGWGQCVCSWMEENQEHFGSDQA

SEQ ID NO: 191194 - protein, 36 aa, Artificial Sequence
  Description of Artificial Sequence: Synthetic polypeptide
SEECIRTTNPVAYEQYGCVCSNWGEHNQYFNSDTQS

SEQ ID NO: 191195 - protein, 36 aa, Artificial Sequence
  Description of Artificial Sequence: Synthetic polypeptide
QEEEIACTNPVAYEQYGSCSAGPALGQNHPMGMQMN

SEQ ID NO: 191196 - protein, 38 aa, Artificial Sequence
  Description of Artificial Sequence: Synthetic polypeptide
CEEEISTTNPVATEQYGCVCSTWGEDHNIENFGSDFQA

SEQ ID NO: 191197 - protein, 37 aa, Artificial Sequence
  Description of Artificial Sequence: Synthetic polypeptide
SEECIRTTNPVATEQYGCVCSNWGEHNAENFNSDTQA

SEQ ID NO: 191198 - protein, 37 aa, Artificial Sequence
  Description of Artificial Sequence: Synthetic polypeptide
SEECIRTTNPVATEQYGCVCSNWEEHNAEYFLSDNQS

SEQ ID NO: 191199 - protein, 35 aa, Artificial Sequence
  Description of Artificial Sequence: Synthetic polypeptide
SEECIRTTNPVATEGYGCVCSNWEHAENFGSDTQS

SEQ ID NO: 191200 - protein, 38 aa, Artificial Sequence
  Description of Artificial Sequence: Synthetic polypeptide
DDEEIRTTNPVATEQYGSVYGQGQGDLEVGEGGEEETA

SEQ ID NO: 191201 - protein, 37 aa, Artificial Sequence
  Description of Artificial Sequence: Synthetic polypeptide
DEMCIRTTNPVATEQYGCVCENTGEPNQEYFGSQTQS

SEQ ID NO: 191202 - protein, 35 aa, Artificial Sequence
  Description of Artificial Sequence: Synthetic polypeptide
DEAEIATTNPIATEQWGHIVPTWWDQHQHDQNMAG

SEQ ID NO: 191203 - protein, 37 aa, Artificial Sequence
  Description of Artificial Sequence: Synthetic polypeptide
CEEEISTTNPVATEQYGCVCSNWGEHNQENFGSETQA

SEQ ID NO: 191204 - protein, 36 aa, Artificial Sequence
  Description of Artificial Sequence: Synthetic polypeptide
CEEEISTTNPVATEQYGCVCSNWGEHAEYFGSDTQS

SEQ ID NO: 191205 - protein, 37 aa, Artificial Sequence
  Description of Artificial Sequence: Synthetic polypeptide
DDEEIRTTNPVAYEQYGCVCSWGEDHNEENFNSDTQA

SEQ ID NO: 191206 - protein, 38 aa, Artificial Sequence
  Description of Artificial Sequence: Synthetic polypeptide
EEEEIRTTNPVATEQYGSYYMMPTFPQAEVIVHVNEPG

SEQ ID NO: 191207 - protein, 37 aa, Artificial Sequence
  Description of Artificial Sequence: Synthetic polypeptide
DEDEIATTNPVAYEQWGCNVAGNNGGLPQENNHGTNP

SEQ ID NO: 191208 - protein, 39 aa, Artificial Sequence
  Description of Artificial Sequence: Synthetic polypeptide
DEEEIRTTNPVATEQYGSAETRHELNVVETASAFPEQNL

SEQ ID NO: 191209 - protein, 36 aa, Artificial Sequence
  Description of Artificial Sequence: Synthetic polypeptide
DEDEIATTNPVAYEQWGCNVAANNGLQAAPDGAHPH

SEQ ID NO: 191210 - protein, 36 aa, Artificial Sequence
  Description of Artificial Sequence: Synthetic polypeptide
DEMEIVTTNPVATEQYGTTVCSAADGPVEEPEGPYD

SEQ ID NO: 191211 - protein, 36 aa, Artificial Sequence
  Description of Artificial Sequence: Synthetic polypeptide
DEMEIVTTNPVATEQYGTTVCSAADGPVEEPKGPYD

SEQ ID NO: 191212 - protein, 34 aa, Artificial Sequence
  Description of Artificial Sequence: Synthetic polypeptide
DDSEVASTNPVSTEGYGNVCYNTIDQDRHGQQRH

SEQ ID NO: 191213 - protein, 33 aa, Artificial Sequence
  Description of Artificial Sequence: Synthetic polypeptide
DEAEIATTNPCSYEQWGCVYGNPPNGNAGETAT

SEQ ID NO: 191214 - protein, 37 aa, Artificial Sequence
  Description of Artificial Sequence: Synthetic polypeptide
DEAEIRTTNPVATEIYGCVCSNWGEHNAENFNSDTQA

SEQ ID NO: 191215 - protein, 33 aa, Artificial Sequence
  Description of Artificial Sequence: Synthetic polypeptide
DDSEVASTNPVSTEGYGCVQTWTIQERIGSQQS

SEQ ID NO: 191216 - protein, 33 aa, Artificial Sequence
  Description of Artificial Sequence: Synthetic polypeptide
DEDEIATTNPVAYEPYVETAAMANDQVSNDGTS

SEQ ID NO: 191217 - protein, 34 aa, Artificial Sequence
  Description of Artificial Sequence: Synthetic polypeptide
DDSEVASTNPVSTEGYGNVCYNTIDQMRHGQQER

SEQ ID NO: 191218 - protein, 34 aa, Artificial Sequence
  Description of Artificial Sequence: Synthetic polypeptide
DDSEVASTNPVSTEGYGNVCYNTIDQSRDGQQRE

SEQ ID NO: 191219 - protein, 38 aa, Artificial Sequence
  Description of Artificial Sequence: Synthetic polypeptide
DEEEIRTTNPVATEQYGSAMQLECVFEVKTPQMMELEE

SEQ ID NO: 191220 - protein, 38 aa, Artificial Sequence
  Description of Artificial Sequence: Synthetic polypeptide
DEEEIRTTNPVATEQYGSAMQLEMVFEVQTPQPMEHEE

SEQ ID NO: 191221 - protein, 38 aa, Artificial Sequence
  Description of Artificial Sequence: Synthetic polypeptide
DEEEIRTTNPVATEQYGSAMQLEPVFEVQTPQPMEMES

SEQ ID NO: 191222 - protein, 37 aa, Artificial Sequence
  Description of Artificial Sequence: Synthetic polypeptide
DEDEIATTNPVAYEPYGSVVAMANGEDQDSLGLNDSL

SEQ ID NO: 191223 - protein, 37 aa, Artificial Sequence
  Description of Artificial Sequence: Synthetic polypeptide
CEEEISTTNPVATEQYGCVCSNWGEDNAENFNSETQN

SEQ ID NO: 191224 - protein, 37 aa, Artificial Sequence
  Description of Artificial Sequence: Synthetic polypeptide
CEEEISTTNPVATEQYGCVCSNWGEDHNQYFNSDTQA

SEQ ID NO: 191225 - protein, 37 aa, Artificial Sequence
  Description of Artificial Sequence: Synthetic polypeptide
CEEEISTTNPVATEQYGCVCSNWGEDHNQNFGSQTQS

SEQ ID NO: 191226 - protein, 34 aa, Artificial Sequence
  Description of Artificial Sequence: Synthetic polypeptide
DEAEISTTNPVAYEQYGCICSWEHNEENFPSDQA

SEQ ID NO: 191227 - protein, 35 aa, Artificial Sequence
  Description of Artificial Sequence: Synthetic polypeptide
DEAEIATTNPIATEQWGHIVPTWWDQHEHDQNTPK

SEQ ID NO: 191228 - protein, 35 aa, Artificial Sequence
  Description of Artificial Sequence: Synthetic polypeptide
SEECIRCTNPCATEQYGCVCSWGEHNANFGSDTQA

SEQ ID NO: 191229 - protein, 35 aa, Artificial Sequence
  Description of Artificial Sequence: Synthetic polypeptide
DEAEIATTNPIATEQWGHIVPTWWDQHEHDHNTVD

SEQ ID NO: 191230 - protein, 35 aa, Artificial Sequence
  Description of Artificial Sequence: Synthetic polypeptide
SEEEIACTNPVATAQWGCSNATTGNPLPAPMENHN

SEQ ID NO: 191231 - protein, 35 aa, Artificial Sequence
  Description of Artificial Sequence: Synthetic polypeptide
SEEEIACTNPVATAQWGGCTVAGTMLQHADDNLPE

SEQ ID NO: 191232 - protein, 35 aa, Artificial Sequence
  Description of Artificial Sequence: Synthetic polypeptide
SEEEIACTNPVATAQWGGCVAGTGMLGIEGDDNPH

SEQ ID NO: 191233 - protein, 35 aa, Artificial Sequence
  Description of Artificial Sequence: Synthetic polypeptide
SEEEIACTNPVATAQWGGCVAGTGMLGQHMDDNPH

SEQ ID NO: 191234 - protein, 38 aa, Artificial Sequence
  Description of Artificial Sequence: Synthetic polypeptide
CEEEISTTNPVATEQYGCVCSNWGEDDNQENFGSDNQS

SEQ ID NO: 191235 - protein, 38 aa, Artificial Sequence
  Description of Artificial Sequence: Synthetic polypeptide
DEEEIRTTNPVATEQYGSAMQLERVEEVQTPQMMEMEE

SEQ ID NO: 191236 - protein, 39 aa, Artificial Sequence
  Description of Artificial Sequence: Synthetic polypeptide
DDEEIRTTNPVATEQYGVVVGSGQVDQEEQDGEGEGNGV

SEQ ID NO: 191237 - protein, 37 aa, Artificial Sequence
  Description of Artificial Sequence: Synthetic polypeptide
AEEEISTTNPVAYEQWGSVSGGPPGNGGNMRNMQGTS

SEQ ID NO: 191238 - protein, 38 aa, Artificial Sequence
  Description of Artificial Sequence: Synthetic polypeptide
DDEEIRTTNPVATEQYGSVYGQGQGDDELGIGGQEEGF

SEQ ID NO: 191239 - protein, 38 aa, Artificial Sequence
  Description of Artificial Sequence: Synthetic polypeptide
DDEEIRTTNPVATEQYGSVYGQGQGDDEFQIGGQTEEA

SEQ ID NO: 191240 - protein, 37 aa, Artificial Sequence
  Description of Artificial Sequence: Synthetic polypeptide
DEQEIATTNPVATEQYGSVCAAMAHDEATMPPDNDNN

SEQ ID NO: 191241 - protein, 36 aa, Artificial Sequence
  Description of Artificial Sequence: Synthetic polypeptide
DEAEIATTNPVATCQYGCVCSWEAHNQEYFNSDTQS

SEQ ID NO: 191242 - protein, 36 aa, Artificial Sequence
  Description of Artificial Sequence: Synthetic polypeptide
DEAEIATTNPVATCQYGCVCSWGAHNAENFGSDTQA

SEQ ID NO: 191243 - protein, 38 aa, Artificial Sequence
  Description of Artificial Sequence: Synthetic polypeptide
EENEIRGTNPVATEQYGSVIISSFENVDVPRVGPVFDD

SEQ ID NO: 191244 - protein, 36 aa, Artificial Sequence
  Description of Artificial Sequence: Synthetic polypeptide
EENEIRTTNPVATDQYGSVHNIMVQEVHVQANSNDG

SEQ ID NO: 191245 - protein, 34 aa, Artificial Sequence
  Description of Artificial Sequence: Synthetic polypeptide
DEDEIATTNPVAYEPYGNETAAMANDQVSNDNTN

SEQ ID NO: 191246 - protein, 34 aa, Artificial Sequence
  Description of Artificial Sequence: Synthetic polypeptide
DEDEIATTNPVAYEPYGETAAMANDQVSNDTVSK

SEQ ID NO: 191247 - protein, 34 aa, Artificial Sequence
  Description of Artificial Sequence: Synthetic polypeptide
DEDEIATTNPVAYEPYGETAAMANDQVSNDNTPH

SEQ ID NO: 191248 - protein, 37 aa, Artificial Sequence
  Description of Artificial Sequence: Synthetic polypeptide
EENEIRTTNPVATEQYGSCYTTWNPMIQTESSEEHTQ

SEQ ID NO: 191249 - protein, 35 aa, Artificial Sequence
  Description of Artificial Sequence: Synthetic polypeptide
SEDEIRTTNPVAYEQWGCVAGTGAPGEEQGQGGDH

SEQ ID NO: 191250 - protein, 35 aa, Artificial Sequence
  Description of Artificial Sequence: Synthetic polypeptide
EENEITTTNPVATDQYGSVNIMQNQEVHMQANSDN

SEQ ID NO: 191251 - protein, 35 aa, Artificial Sequence
  Description of Artificial Sequence: Synthetic polypeptide
EENEITTTNPVATDQYGSVNIMQSQEVHPTANSDN

SEQ ID NO: 191252 - protein, 34 aa, Artificial Sequence
  Description of Artificial Sequence: Synthetic polypeptide
SEDEIRTTNPVAYECWGCSYPNPQPDNGDMQDAR

SEQ ID NO: 191253 - protein, 36 aa, Artificial Sequence
  Description of Artificial Sequence: Synthetic polypeptide
SEDEIRTTNPVATESWGAVFWNWNDDHERQGMDNSQ

SEQ ID NO: 191254 - protein, 37 aa, Artificial Sequence
  Description of Artificial Sequence: Synthetic polypeptide
SEEAIRTTNPVATEAYGSGPPWTYSLVTISGSNESQD

SEQ ID NO: 191255 - protein, 33 aa, Artificial Sequence
  Description of Artificial Sequence: Synthetic polypeptide
DEMEIRTTNPIATECWGTTWANADGWEEPKGPI

SEQ ID NO: 191256 - protein, 34 aa, Artificial Sequence
  Description of Artificial Sequence: Synthetic polypeptide
EESAEIATTNPVAYECWGSVYCTEIQVNDGQDSP

SEQ ID NO: 191257 - protein, 35 aa, Artificial Sequence
  Description of Artificial Sequence: Synthetic polypeptide
EESAEIATTNPVAYEQWGSTVTIINGGDLRQGDEN

SEQ ID NO: 191258 - protein, 32 aa, Artificial Sequence
  Description of Artificial Sequence: Synthetic polypeptide
DEEEIATTNPVATECWGETAEEDCAEHKEEYI

SEQ ID NO: 191259 - protein, 34 aa, Artificial Sequence
  Description of Artificial Sequence: Synthetic polypeptide
SEDEIRCTNPTAYEQWGSTVYGENKDIHRDGDKP

SEQ ID NO: 191260 - protein, 31 aa, Artificial Sequence
  Description of Artificial Sequence: Synthetic polypeptide
EESEIASTNPVGTEAWGVCAPTDRDQHGQDI

SEQ ID NO: 191261 - protein, 33 aa, Artificial Sequence
  Description of Artificial Sequence: Synthetic polypeptide
SEDEIRCTNPTAYECWGSVYGENDDMHRNGDVQ

SEQ ID NO: 191262 - protein, 32 aa, Artificial Sequence
  Description of Artificial Sequence: Synthetic polypeptide
EESEIASTNPVGTEGWGVCAPTDLQDHQGDTQ

SEQ ID NO: 191263 - protein, 36 aa, Artificial Sequence
  Description of Artificial Sequence: Synthetic polypeptide
DEAEIATTNPVATECYGCVCQTLDDEQDQHGQGDSN

SEQ ID NO: 191264 - protein, 34 aa, Artificial Sequence
  Description of Artificial Sequence: Synthetic polypeptide
QEEEIACTNPVATEQWGCVAGTGLEATIDLEDQA

SEQ ID NO: 191265 - protein, 31 aa, Artificial Sequence
  Description of Artificial Sequence: Synthetic polypeptide
EESEIATTNPVAYECWGTVYYVEDIHQHEEI

SEQ ID NO: 191266 - protein, 36 aa, Artificial Sequence
  Description of Artificial Sequence: Synthetic polypeptide
EESEIRTTNPVATEQYGCVSWFDVPEMEIGIPSQFY

SEQ ID NO: 191267 - protein, 35 aa, Artificial Sequence
  Description of Artificial Sequence: Synthetic polypeptide
DEDEIATTNPVAYEPWGSVAATAHGAAAPPGSLNN

SEQ ID NO: 191268 - protein, 37 aa, Artificial Sequence
  Description of Artificial Sequence: Synthetic polypeptide
DEECISCTNPVATEQYGCVCSWGEDDNQENFGSDNQS

SEQ ID NO: 191269 - protein, 36 aa, Artificial Sequence
  Description of Artificial Sequence: Synthetic polypeptide
AEAEISTTNPVATEQYGCVCSNWEHNAEYFNSDTQS

SEQ ID NO: 191270 - protein, 38 aa, Artificial Sequence
  Description of Artificial Sequence: Synthetic polypeptide
EEPEIRTTNPVATEQYGSVNGPVTYEWEQEINGQPVGI

SEQ ID NO: 191271 - protein, 37 aa, Artificial Sequence
  Description of Artificial Sequence: Synthetic polypeptide
SEEAIRTTNPVATEAYGSHIPPWTYLVTYSGSNESQD

SEQ ID NO: 191272 - protein, 37 aa, Artificial Sequence
  Description of Artificial Sequence: Synthetic polypeptide
SEEAIRTTNPVATEAYGSIPNWTYDLVTISGSNESQD

SEQ ID NO: 191273 - protein, 37 aa, Artificial Sequence
  Description of Artificial Sequence: Synthetic polypeptide
SEEAIRTTNPVATEAYGSIPPWNYMLVTISGSNESQD

SEQ ID NO: 191274 - protein, 38 aa, Artificial Sequence
  Description of Artificial Sequence: Synthetic polypeptide
DDEEIRTTNPVATEQYGSVYGQGQGDDEFLIGGQEETG

SEQ ID NO: 191275 - protein, 38 aa, Artificial Sequence
  Description of Artificial Sequence: Synthetic polypeptide
DDEEIRTTNPVATEQYGSVYGQGQGDDEFGTGGQEEDV

SEQ ID NO: 191276 - protein, 38 aa, Artificial Sequence
  Description of Artificial Sequence: Synthetic polypeptide
DDEEIRTTNPVATEQYGSVYGQGQGDDEFGTGGQEDTA

SEQ ID NO: 191277 - protein, 35 aa, Artificial Sequence
  Description of Artificial Sequence: Synthetic polypeptide
EEIAEIATTNPVATEPWGVVCFTNEDQADLGGTTS

SEQ ID NO: 191278 - protein, 37 aa, Artificial Sequence
  Description of Artificial Sequence: Synthetic polypeptide
DEECIRTVNPVATEQYGQCVCSWEEHNAENFNSQTQS

SEQ ID NO: 191279 - protein, 37 aa, Artificial Sequence
  Description of Artificial Sequence: Synthetic polypeptide
CEEEISTTNPVATEQYGCVCSWGEDDNAENFNSDNQS

SEQ ID NO: 191280 - protein, 38 aa, Artificial Sequence
  Description of Artificial Sequence: Synthetic polypeptide
DEEEIRCTNPVATEQYGQCVCSNWMEHNDEHFGSDTQA

SEQ ID NO: 191281 - protein, 38 aa, Artificial Sequence
  Description of Artificial Sequence: Synthetic polypeptide
DEEEIRCTNPVATEQYGQCVCSNWGEHNAENFNSDNQS

SEQ ID NO: 191282 - protein, 39 aa, Artificial Sequence
  Description of Artificial Sequence: Synthetic polypeptide
DEEEIRCTNPVATEQYGQCVCSNWGEDHNQEGFGSENQS

SEQ ID NO: 191283 - protein, 38 aa, Artificial Sequence
  Description of Artificial Sequence: Synthetic polypeptide
DDEEIRTTNPVATEQYGSVYGQGQGDDEFGIGGQELTT

SEQ ID NO: 191284 - protein, 38 aa, Artificial Sequence
  Description of Artificial Sequence: Synthetic polypeptide
DDEEIRTTNPVATEQYGSVYGQGQGDDEFGIGGQEAQA

SEQ ID NO: 191285 - protein, 38 aa, Artificial Sequence
  Description of Artificial Sequence: Synthetic polypeptide
DEEEIRCTNPVATEQYGQCVCSMTGEDFAEGFGSDTQS

SEQ ID NO: 191286 - protein, 38 aa, Artificial Sequence
  Description of Artificial Sequence: Synthetic polypeptide
DDEEIRTTNPVATEQYGSVYGQGQGDDEFGIGGDEEGA

SEQ ID NO: 191287 - protein, 38 aa, Artificial Sequence
  Description of Artificial Sequence: Synthetic polypeptide
DDEEIRTTNPVATEQYGSVYGQGQGDDEFGIGDQEETA

SEQ ID NO: 191288 - protein, 38 aa, Artificial Sequence
  Description of Artificial Sequence: Synthetic polypeptide
DDEEIRTTNPVATEQYGSVYGQGQGDDEFGIDGQEGTA

SEQ ID NO: 191289 - protein, 38 aa, Artificial Sequence
  Description of Artificial Sequence: Synthetic polypeptide
DDEEIRTTNPVATEQYGSVYGQGMGDDEFGNIGDEETA

SEQ ID NO: 191290 - protein, 38 aa, Artificial Sequence
  Description of Artificial Sequence: Synthetic polypeptide
DDEEIRTTNPVATEQYGSVYGQGMGDDEFGNGGQLETA

SEQ ID NO: 191291 - protein, 36 aa, Artificial Sequence
  Description of Artificial Sequence: Synthetic polypeptide
SEEAIRTTNPVATEAYGSISPWWYMVTISGSNESQD

SEQ ID NO: 191292 - protein, 38 aa, Artificial Sequence
  Description of Artificial Sequence: Synthetic polypeptide
DEEEIRTTNPVATEQYGSVNGAAIMEYHDSESEENFEV

SEQ ID NO: 191293 - protein, 38 aa, Artificial Sequence
  Description of Artificial Sequence: Synthetic polypeptide
DEEEIATTNPVATEGYGCVTSTWGADHNAENFGSDTQA

SEQ ID NO: 191294 - protein, 37 aa, Artificial Sequence
  Description of Artificial Sequence: Synthetic polypeptide
CEEEISTTNPVATEQYGCVCSWGEGHNQENFNSDTQD

SEQ ID NO: 191295 - protein, 39 aa, Artificial Sequence
  Description of Artificial Sequence: Synthetic polypeptide
DDEEIRTTNPVATEQYGSVYGQGLDGDDEFGNGGQEEDA

SEQ ID NO: 191296 - protein, 38 aa, Artificial Sequence
  Description of Artificial Sequence: Synthetic polypeptide
DDEEIRTTNPVATEQYGSVYGQGLGDDEFGDGGQIEQA

SEQ ID NO: 191297 - protein, 38 aa, Artificial Sequence
  Description of Artificial Sequence: Synthetic polypeptide
DDEEIRTTNPVATEQYGSVYGQGQGDDEFTQGGQEETA

SEQ ID NO: 191298 - protein, 38 aa, Artificial Sequence
  Description of Artificial Sequence: Synthetic polypeptide
DDEEIRTTNPVATEQYGSVYGQGLGDDEFGEMGQEEQA

SEQ ID NO: 191299 - protein, 37 aa, Artificial Sequence
  Description of Artificial Sequence: Synthetic polypeptide
CEEEISTTNPVATEQYGCVCSWGEDHNAENFNSDTQA

SEQ ID NO: 191300 - protein, 37 aa, Artificial Sequence
  Description of Artificial Sequence: Synthetic polypeptide
CEEEISTTNPVATEQYGCVCSWGEDHNAENFFSDNQA

SEQ ID NO: 191301 - protein, 37 aa, Artificial Sequence
  Description of Artificial Sequence: Synthetic polypeptide
DEQEIATTNPVATEQYGSVCAMTVHGTADDPLHENAH

SEQ ID NO: 191302 - protein, 37 aa, Artificial Sequence
  Description of Artificial Sequence: Synthetic polypeptide
CEEEISTTNPVATEQYGCVCSWGEDDNQENFNSDTQD

SEQ ID NO: 191303 - protein, 38 aa, Artificial Sequence
  Description of Artificial Sequence: Synthetic polypeptide
DEEEIRCTNPVATEQYGQCVCSMSGEDFAEGFNSDTQA

SEQ ID NO: 191304 - protein, 39 aa, Artificial Sequence
  Description of Artificial Sequence: Synthetic polypeptide
DDEEIRTTNPVATEQYGSVYGQGLNGDDEFGNGGDEEQA

SEQ ID NO: 191305 - protein, 37 aa, Artificial Sequence
  Description of Artificial Sequence: Synthetic polypeptide
CEEEISTTNPVATEQYGCVCSWGEDHNAEYFNSDNQS

SEQ ID NO: 191306 - protein, 35 aa, Artificial Sequence
  Description of Artificial Sequence: Synthetic polypeptide
SEEEIRCTNPCATEQYGCVCGWGEDNAENFGSDQS

SEQ ID NO: 191307 - protein, 34 aa, Artificial Sequence
  Description of Artificial Sequence: Synthetic polypeptide
SEEEIACTNPVATEQWGAVCAQNPVETAGEPTGT

SEQ ID NO: 191308 - protein, 34 aa, Artificial Sequence
  Description of Artificial Sequence: Synthetic polypeptide
SEEEIACTNPVATEQWGCVAGTGHADAEIGEHAD

SEQ ID NO: 191309 - protein, 33 aa, Artificial Sequence
  Description of Artificial Sequence: Synthetic polypeptide
DDSEVASTNPVSTEGYGCVGTWEIQEYFGSQNQ

SEQ ID NO: 191310 - protein, 38 aa, Artificial Sequence
  Description of Artificial Sequence: Synthetic polypeptide
EEEEIRTTNPVATEQYGSVCVFTTVEEMEEVLEEMDSP

SEQ ID NO: 191311 - protein, 32 aa, Artificial Sequence
  Description of Artificial Sequence: Synthetic polypeptide
DDSEVASTNPVSTEGYGCVGTWTDQEYFGSQQ

SEQ ID NO: 191312 - protein, 36 aa, Artificial Sequence
  Description of Artificial Sequence: Synthetic polypeptide
DENEIRTTNPVATEQWGCVCSSGPDENANNFISDAA

SEQ ID NO: 191313 - protein, 37 aa, Artificial Sequence
  Description of Artificial Sequence: Synthetic polypeptide
DESEIRTTNPVATECYGSVQDDQGGDDDQQDEGDLQS

SEQ ID NO: 191314 - protein, 36 aa, Artificial Sequence
  Description of Artificial Sequence: Synthetic polypeptide
DENEIRTTNPVATEQWGCVCSSGEENANAFMSDTAS

SEQ ID NO: 191315 - protein, 36 aa, Artificial Sequence
  Description of Artificial Sequence: Synthetic polypeptide
DDEEISTTNPVATCQYGCVCSWGEHNAENFGSQTQA

SEQ ID NO: 191316 - protein, 38 aa, Artificial Sequence
  Description of Artificial Sequence: Synthetic polypeptide
DEEEIRGTNPVATEQYGSCVQPPIMWTLEEQQSMDSGL

SEQ ID NO: 191317 - protein, 36 aa, Artificial Sequence
  Description of Artificial Sequence: Synthetic polypeptide
DDEEISTTNPVATCQYGCVCSWGEDPNANFNSDNQA

SEQ ID NO: 191318 - protein, 37 aa, Artificial Sequence
  Description of Artificial Sequence: Synthetic polypeptide
DDECIRTTNPVAYEQYGCVCSNWGEHNQEYFGSDNQS

SEQ ID NO: 191319 - protein, 36 aa, Artificial Sequence
  Description of Artificial Sequence: Synthetic polypeptide
DEAEIACTNPVATEQYGSVVAITHPEAGAPLAEDAM

SEQ ID NO: 191320 - protein, 37 aa, Artificial Sequence
  Description of Artificial Sequence: Synthetic polypeptide
DENEIRTTNPVATEQWGCVCSSGEDENANYSISDNAS

SEQ ID NO: 191321 - protein, 36 aa, Artificial Sequence
  Description of Artificial Sequence: Synthetic polypeptide
DENEIRTTNPVATEQWGCVCSSGEDDNANASISDAA

SEQ ID NO: 191322 - protein, 38 aa, Artificial Sequence
  Description of Artificial Sequence: Synthetic polypeptide
EEEEIRTTNPVATEQYGSVNVLGIADMTMEEPEQEITP

SEQ ID NO: 191323 - protein, 35 aa, Artificial Sequence
  Description of Artificial Sequence: Synthetic polypeptide
DEDEIATTNPVAYEKWGSVATTGGNTGADGKDTSI

SEQ ID NO: 191324 - protein, 36 aa, Artificial Sequence
  Description of Artificial Sequence: Synthetic polypeptide
CEEEIACTNPVATEQWGSVSGEGGPLGINHDDNTAY

SEQ ID NO: 191325 - protein, 32 aa, Artificial Sequence
  Description of Artificial Sequence: Synthetic polypeptide
QEEEIATTNPIATEQWGEAANAEVCQEHEEYK

SEQ ID NO: 191326 - protein, 36 aa, Artificial Sequence
  Description of Artificial Sequence: Synthetic polypeptide
DENEIRTTNPVATEQWGCVCSSEDDNANASISDTAS

SEQ ID NO: 191327 - protein, 35 aa, Artificial Sequence
  Description of Artificial Sequence: Synthetic polypeptide
DEEEICATNPVAYEQWGMVCPGWINDHQHGQGGDK

SEQ ID NO: 191328 - protein, 35 aa, Artificial Sequence
  Description of Artificial Sequence: Synthetic polypeptide
AEEVIATTNPVATQEYGCIVCCCNELSTLPGGNNV

SEQ ID NO: 191329 - protein, 32 aa, Artificial Sequence
  Description of Artificial Sequence: Synthetic polypeptide
QEEEIATTNPIATEQWGEAANAEVCAEHGEYK

SEQ ID NO: 191330 - protein, 34 aa, Artificial Sequence
  Description of Artificial Sequence: Synthetic polypeptide
DDECISTTNPVATCQYGCVCSNWGEPANFGSDQA

SEQ ID NO: 191331 - protein, 37 aa, Artificial Sequence
  Description of Artificial Sequence: Synthetic polypeptide
DENEIRTTNPVATEQWGCVCSNSGEDNAEASNSDTQS

SEQ ID NO: 191332 - protein, 34 aa, Artificial Sequence
  Description of Artificial Sequence: Synthetic polypeptide
DDECISTTNPVATCQYGCVCSWGEPNANFNSDQA

SEQ ID NO: 191333 - protein, 36 aa, Artificial Sequence
  Description of Artificial Sequence: Synthetic polypeptide
DENEIRTTNPVATEQWGCVCSNSEPENANAFSSDAS

SEQ ID NO: 191334 - protein, 35 aa, Artificial Sequence
  Description of Artificial Sequence: Synthetic polypeptide
CEEEIATVNPVATAQWGGCVAGNGLQSNANAQGKN

SEQ ID NO: 191335 - protein, 34 aa, Artificial Sequence
  Description of Artificial Sequence: Synthetic polypeptide
SEEEIASVNPVCTEQYGCVCSWGEHNQSFNSQQA

SEQ ID NO: 191336 - protein, 34 aa, Artificial Sequence
  Description of Artificial Sequence: Synthetic polypeptide
SEEEIASVNPVCTEQYGCVCSWEDHNQSFGSQQA

SEQ ID NO: 191337 - protein, 34 aa, Artificial Sequence
  Description of Artificial Sequence: Synthetic polypeptide
SEEEIASVNPVCTEQYGCVCSNWEHNASFGSDQA

SEQ ID NO: 191338 - protein, 40 aa, Artificial Sequence
  Description of Artificial Sequence: Synthetic polypeptide
DEEEIRGTNPVATEQYGAVVVMGPNTNDQELLAEGQTGGQ

SEQ ID NO: 191339 - protein, 36 aa, Artificial Sequence
  Description of Artificial Sequence: Synthetic polypeptide
DENEIRTTNPVATEQWGCVCSSEEENANNSSSDTAA

SEQ ID NO: 191340 - protein, 36 aa, Artificial Sequence
  Description of Artificial Sequence: Synthetic polypeptide
DEEEIATVNPVATAQWGGCVAGNVGLQSNANAQGEN

SEQ ID NO: 191341 - protein, 34 aa, Artificial Sequence
  Description of Artificial Sequence: Synthetic polypeptide
SEEEIATTNPVATAAWGCVAGTPQGLEATANGEF

SEQ ID NO: 191342 - protein, 37 aa, Artificial Sequence
  Description of Artificial Sequence: Synthetic polypeptide
DEECIRTTNPVATEQYYAQCVCSWGEHNANFGSDTQA

SEQ ID NO: 191343 - protein, 39 aa, Artificial Sequence
  Description of Artificial Sequence: Synthetic polypeptide
EEEEIRTTNPVATEAYGVVSTVVVIGTTQQGNNQNDTDT

SEQ ID NO: 191344 - protein, 33 aa, Artificial Sequence
  Description of Artificial Sequence: Synthetic polypeptide
AEHEIASTNPVGYEAYGVVHAYSGALSQHVGDI

SEQ ID NO: 191345 - protein, 37 aa, Artificial Sequence
  Description of Artificial Sequence: Synthetic polypeptide
DDECIRTTNPVATEQYGQCVCSWGEHNQENFNSDNLS

SEQ ID NO: 191346 - protein, 34 aa, Artificial Sequence
  Description of Artificial Sequence: Synthetic polypeptide
AEHEIASTNPVGYEAYGVVAAYSPGNLSQHVGDI

SEQ ID NO: 191347 - protein, 38 aa, Artificial Sequence
  Description of Artificial Sequence: Synthetic polypeptide
EEEEIRTTNPVATEQYGAVVTTTTDGNGNDLNEEFEQI

SEQ ID NO: 191348 - protein, 35 aa, Artificial Sequence
  Description of Artificial Sequence: Synthetic polypeptide
DEEEIATTNPVGTAQWGSVATPAGSAGTPIDLDAM

SEQ ID NO: 191349 - protein, 37 aa, Artificial Sequence
  Description of Artificial Sequence: Synthetic polypeptide
DEMEIVTTNPVATEQYGQCVCSNWGEPNEEFSGSDQA

SEQ ID NO: 191350 - protein, 37 aa, Artificial Sequence
  Description of Artificial Sequence: Synthetic polypeptide
DESEIATTNPVATEQYGSVCAANMGEEAPDNGMEGAH

SEQ ID NO: 191351 - protein, 37 aa, Artificial Sequence
  Description of Artificial Sequence: Synthetic polypeptide
DEETICTTNPVATEFYGVVVNEQDNTGEQDEEGGNIQ

SEQ ID NO: 191352 - protein, 39 aa, Artificial Sequence
  Description of Artificial Sequence: Synthetic polypeptide
DEEEIRTTNPVATEQYGQCVTSTWGADDNAEYFSSDTQS

SEQ ID NO: 191353 - protein, 37 aa, Artificial Sequence
  Description of Artificial Sequence: Synthetic polypeptide
EEEEIRTTNPVATEQYGSACSVWGMAIEERQETVVEI

SEQ ID NO: 191354 - protein, 36 aa, Artificial Sequence
  Description of Artificial Sequence: Synthetic polypeptide
AEGSDEIATTNPVAYEQWGSVSTGGNAGEHQGKTDE

SEQ ID NO: 191355 - protein, 37 aa, Artificial Sequence
  Description of Artificial Sequence: Synthetic polypeptide
DEMEIVTTNPVATEQYGQTVCSNWGEPNEEFFGSEQS

SEQ ID NO: 191356 - protein, 36 aa, Artificial Sequence
  Description of Artificial Sequence: Synthetic polypeptide
QEEEIRTTNPVATEPYGKISQTEHEFSSNKVGEQFH

SEQ ID NO: 191357 - protein, 37 aa, Artificial Sequence
  Description of Artificial Sequence: Synthetic polypeptide
SEEEIATTNPVATEQWGCNVAGNNGGLPAENNHGTNQ

SEQ ID NO: 191358 - protein, 35 aa, Artificial Sequence
  Description of Artificial Sequence: Synthetic polypeptide
DEDEIATTNPVAYEEWGSVCVQNDNDQPEKNNQDT

SEQ ID NO: 191359 - protein, 38 aa, Artificial Sequence
  Description of Artificial Sequence: Synthetic polypeptide
DEECIRTTNPVATEQYSACVCSNWGEHNAESFGSDNQS

SEQ ID NO: 191360 - protein, 37 aa, Artificial Sequence
  Description of Artificial Sequence: Synthetic polypeptide
SEEEIATTNPVATAQWGSFVANANGLPQAAPGEIMHW

SEQ ID NO: 191361 - protein, 35 aa, Artificial Sequence
  Description of Artificial Sequence: Synthetic polypeptide
DDEEISTTNPVATCQYGQCVCSWGEPNANFISDQA

SEQ ID NO: 191362 - protein, 39 aa, Artificial Sequence
  Description of Artificial Sequence: Synthetic polypeptide
DEEEIRTTNPVATEQYGQSAWVNGNVMISGDSEQDSIVA

SEQ ID NO: 191363 - protein, 37 aa, Artificial Sequence
  Description of Artificial Sequence: Synthetic polypeptide
DEECIRTTNPVATEQYYACVCSWGEDNQENFNSDNQA

SEQ ID NO: 191364 - protein, 37 aa, Artificial Sequence
  Description of Artificial Sequence: Synthetic polypeptide
QEEEIATTNPVATASWGSVSATGNPNDENQGGTIPEN

SEQ ID NO: 191365 - protein, 39 aa, Artificial Sequence
  Description of Artificial Sequence: Synthetic polypeptide
DEEEIRTTNPVAYEQYGQCVCSTSGEDHNAENFNSDTQS

SEQ ID NO: 191366 - protein, 34 aa, Artificial Sequence
  Description of Artificial Sequence: Synthetic polypeptide
DEDEIATTNPVAYEQWGCTAGNGHTNHQAEDKHH

SEQ ID NO: 191367 - protein, 31 aa, Artificial Sequence
  Description of Artificial Sequence: Synthetic polypeptide
QEEEIATTNPVATECWGATAAEEDCAEPEPI

SEQ ID NO: 191368 - protein, 39 aa, Artificial Sequence
  Description of Artificial Sequence: Synthetic polypeptide
DEEEIRTTNPVATLQYGTVAACSFELANIIETSGAQNHE

SEQ ID NO: 191369 - protein, 33 aa, Artificial Sequence
  Description of Artificial Sequence: Synthetic polypeptide
DDSEVASTNPVSTEGYGCVGNWTIQERSGSQRS

SEQ ID NO: 191370 - protein, 32 aa, Artificial Sequence
  Description of Artificial Sequence: Synthetic polypeptide
QEEEIATTNPVATECWGATAAEEDWAEPKGPI

SEQ ID NO: 191371 - protein, 35 aa, Artificial Sequence
  Description of Artificial Sequence: Synthetic polypeptide
DEMEIRTTNPIATECYGTVCANADGPVEEPEGPYD

SEQ ID NO: 191372 - protein, 33 aa, Artificial Sequence
  Description of Artificial Sequence: Synthetic polypeptide
DDSEVASTNPVSTEGYGCVGNSTIQERFGSQTQ

SEQ ID NO: 191373 - protein, 39 aa, Artificial Sequence
  Description of Artificial Sequence: Synthetic polypeptide
AEGEICTTNPVATEAYGSVYTVNTEEIGTNLQIGTNEEM

SEQ ID NO: 191374 - protein, 37 aa, Artificial Sequence
  Description of Artificial Sequence: Synthetic polypeptide
DEECIRTTNPVATEQYSACVCSWGEDHNQNFGSDTQS

SEQ ID NO: 191375 - protein, 35 aa, Artificial Sequence
  Description of Artificial Sequence: Synthetic polypeptide
SEEEIACTNPVATEQWGCVAATTNDEAGAPMGEHE

SEQ ID NO: 191376 - protein, 35 aa, Artificial Sequence
  Description of Artificial Sequence: Synthetic polypeptide
DDEEISTTNPVATCQYGCVCSNWGEPAHFGSDTQS

SEQ ID NO: 191377 - protein, 33 aa, Artificial Sequence
  Description of Artificial Sequence: Synthetic polypeptide
SEEEIACVNPVCYEQYGVVCSWEDQESFGSDQA

SEQ ID NO: 191378 - protein, 35 aa, Artificial Sequence
  Description of Artificial Sequence: Synthetic polypeptide
DAEEIATTNPVAYEQWGCNTAGNNGLTTAEDGNDD

SEQ ID NO: 191379 - protein, 38 aa, Artificial Sequence
  Description of Artificial Sequence: Synthetic polypeptide
DEEEIRTTNPVATEQYGQVQVHPSPVEMPNMVVMQFEL

SEQ ID NO: 191380 - protein, 37 aa, Artificial Sequence
  Description of Artificial Sequence: Synthetic polypeptide
DEEEIRCTNPVAYEQYGQCVCSNWGEDDNQNFGSDQS

SEQ ID NO: 191381 - protein, 38 aa, Artificial Sequence
  Description of Artificial Sequence: Synthetic polypeptide
DEEEIRCTNPVAYEQYGCVTSTWGADDNAEHFNSDPQS

SEQ ID NO: 191382 - protein, 37 aa, Artificial Sequence
  Description of Artificial Sequence: Synthetic polypeptide
DEEEIRCTNPVAYEQYGCVCSNWGEDNTEYFNSDTQA

SEQ ID NO: 191383 - protein, 38 aa, Artificial Sequence
  Description of Artificial Sequence: Synthetic polypeptide
DDEEIRTTNPVGTEQYGCVCSNWGEDTNAENFGSQTQS

SEQ ID NO: 191384 - protein, 37 aa, Artificial Sequence
  Description of Artificial Sequence: Synthetic polypeptide
CEEEISTTNPVATEQYGCVCSNWEDDNQENFNSDTQS

SEQ ID NO: 191385 - protein, 33 aa, Artificial Sequence
  Description of Artificial Sequence: Synthetic polypeptide
DDSEVASTNPVSTEGYGNVCSANTIVESFVGQR

SEQ ID NO: 191386 - protein, 37 aa, Artificial Sequence
  Description of Artificial Sequence: Synthetic polypeptide
CEEEISTTNPVATEQYGCVCSNWEEHNAENFNSDTQD

SEQ ID NO: 191387 - protein, 36 aa, Artificial Sequence
  Description of Artificial Sequence: Synthetic polypeptide
SEEEIACTNPVATEQYGSTACAANNEEAPDDQGQNP

SEQ ID NO: 191388 - protein, 37 aa, Artificial Sequence
  Description of Artificial Sequence: Synthetic polypeptide
SEEEIACTNPVATEQYGSCAAATGHTGPAGQGEGNNQ

SEQ ID NO: 191389 - protein, 36 aa, Artificial Sequence
  Description of Artificial Sequence: Synthetic polypeptide
DEAEISTTNPVAYEQWGSVVCNPTPDDDHRSNHEDH

SEQ ID NO: 191390 - protein, 37 aa, Artificial Sequence
  Description of Artificial Sequence: Synthetic polypeptide
CEDEIATTNPVATEQWGSVSMSGDTPTNNDDLMGSQM

SEQ ID NO: 191391 - protein, 37 aa, Artificial Sequence
  Description of Artificial Sequence: Synthetic polypeptide
SEEEIACTNPVATEQYGSACAASNGEEAPGEQMEGNH

SEQ ID NO: 191392 - protein, 38 aa, Artificial Sequence
  Description of Artificial Sequence: Synthetic polypeptide
DEEEIRTTNPVATEQYGQVCVVPSPVHMPNFVDMMFEG

SEQ ID NO: 191393 - protein, 34 aa, Artificial Sequence
  Description of Artificial Sequence: Synthetic polypeptide
DDSEVASTNPVSTEGYGNVCYNTDIQSRVGGQER

SEQ ID NO: 191394 - protein, 35 aa, Artificial Sequence
  Description of Artificial Sequence: Synthetic polypeptide
DDEEIRTTNPVGTEQWGCVCSWGEHNQENFSSVQA

SEQ ID NO: 191395 - protein, 36 aa, Artificial Sequence
  Description of Artificial Sequence: Synthetic polypeptide
DDEEIRTTNPVGTEQWGCVCSWEEHNAENFGSVTQS

SEQ ID NO: 191396 - protein, 37 aa, Artificial Sequence
  Description of Artificial Sequence: Synthetic polypeptide
DEECIRTTNPVAYEQYGCVCGNWGEHNQEYFGSDTQS

SEQ ID NO: 191397 - protein, 37 aa, Artificial Sequence
  Description of Artificial Sequence: Synthetic polypeptide
DEECIRTTNPVAYEQYGCVCSDWGEHNQENFSSDNQS

SEQ ID NO: 191398 - protein, 36 aa, Artificial Sequence
  Description of Artificial Sequence: Synthetic polypeptide
DDEEIRTTNPVGTEQWGCVCSSGEHNQENFGSVTQA

SEQ ID NO: 191399 - protein, 36 aa, Artificial Sequence
  Description of Artificial Sequence: Synthetic polypeptide
DDEEIRTTNPVGTEQWGCVCSNWGEHNQENFGSDQS

SEQ ID NO: 191400 - protein, 36 aa, Artificial Sequence
  Description of Artificial Sequence: Synthetic polypeptide
DDEEIRTTNPVAYEQYGQSATVANDAASVRTVEPDI

SEQ ID NO: 191401 - protein, 38 aa, Artificial Sequence
  Description of Artificial Sequence: Synthetic polypeptide
DDEEIRTTNPVAYEQYGQCVCSWGEDHNQEYFGSENQA

SEQ ID NO: 191402 - protein, 34 aa, Artificial Sequence
  Description of Artificial Sequence: Synthetic polypeptide
CEDEIATTNPVATEQWGTNCAANDGGVEDQGNDM

SEQ ID NO: 191403 - protein, 36 aa, Artificial Sequence
  Description of Artificial Sequence: Synthetic polypeptide
SEEEIACTNPVATEQWGNVAGTGPALGQNHMINQAE

SEQ ID NO: 191404 - protein, 35 aa, Artificial Sequence
  Description of Artificial Sequence: Synthetic polypeptide
SEEEIACTNPVATEQWGHSASLAGMGQSAQDPGEN

SEQ ID NO: 191405 - protein, 36 aa, Artificial Sequence
  Description of Artificial Sequence: Synthetic polypeptide
DEDEIATTNPVAYEQWGCNVAIANNLQEHGGDIEAD

SEQ ID NO: 191406 - protein, 35 aa, Artificial Sequence
  Description of Artificial Sequence: Synthetic polypeptide
SEEEIACTNPVATEQWGCVAGTNGGADAEIGEEAH

SEQ ID NO: 191407 - protein, 37 aa, Artificial Sequence
  Description of Artificial Sequence: Synthetic polypeptide
DDEEIRTTNPVAYEQYGQCVCSNWGEDDNANFGSDQS

SEQ ID NO: 191408 - protein, 36 aa, Artificial Sequence
  Description of Artificial Sequence: Synthetic polypeptide
DDEEIRTTNPVGTEQWGCVCSWMEDNAENFNSDTQS

SEQ ID NO: 191409 - protein, 38 aa, Artificial Sequence
  Description of Artificial Sequence: Synthetic polypeptide
DEEEIRTTNPVATEQYGQTQFPTMGNEEHPEPGSVAEI

SEQ ID NO: 191410 - protein, 36 aa, Artificial Sequence
  Description of Artificial Sequence: Synthetic polypeptide
DEAEIASTNPVAYEQWGSVVCGNAQLDHVDQERDDQ

SEQ ID NO: 191411 - protein, 34 aa, Artificial Sequence
  Description of Artificial Sequence: Synthetic polypeptide
DEECIRTTNPVAYEQWGTYVYNQDSDDDHGEKDN

SEQ ID NO: 191412 - protein, 38 aa, Artificial Sequence
  Description of Artificial Sequence: Synthetic polypeptide
DEAEIRTTNPVATEQWGAYWCGWTASVTEENYEAGGME

SEQ ID NO: 191413 - protein, 35 aa, Artificial Sequence
  Description of Artificial Sequence: Synthetic polypeptide
DDEEISTTNPVATCGYGCVCSTGEPAENFGSDTQA

SEQ ID NO: 191414 - protein, 38 aa, Artificial Sequence
  Description of Artificial Sequence: Synthetic polypeptide
DEEEIRGTNPVATEQWGMFNVVNNEMNALQHGPGGGQE

SEQ ID NO: 191415 - protein, 34 aa, Artificial Sequence
  Description of Artificial Sequence: Synthetic polypeptide
SEEEIACTNPVAYEQWGCVAAANNLQEAHHVDDP

SEQ ID NO: 191416 - protein, 36 aa, Artificial Sequence
  Description of Artificial Sequence: Synthetic polypeptide
DEAEIRTTNPVATEQWGAANSLVPDFDAPNTEDERG

SEQ ID NO: 191417 - protein, 36 aa, Artificial Sequence
  Description of Artificial Sequence: Synthetic polypeptide
DDEEISTTNPCATEHYGCVCSWGNHNQENFNSDNQS

SEQ ID NO: 191418 - protein, 37 aa, Artificial Sequence
  Description of Artificial Sequence: Synthetic polypeptide
AEENEIATTNPVAYEQWGCVYSGINENDQNGERDSQK

SEQ ID NO: 191419 - protein, 35 aa, Artificial Sequence
  Description of Artificial Sequence: Synthetic polypeptide
DDEEISTTNPCATEHYGCVCSWGEDNQNFNSQTQS

SEQ ID NO: 191420 - protein, 35 aa, Artificial Sequence
  Description of Artificial Sequence: Synthetic polypeptide
DDEEISTTNPCATEHYGCVCSWGEDNQENFNSNQA

SEQ ID NO: 191421 - protein, 37 aa, Artificial Sequence
  Description of Artificial Sequence: Synthetic polypeptide
DEAEIRTTNPVATEQLEGSTCFLNENEDSSNLEDKME

SEQ ID NO: 191422 - protein, 38 aa, Artificial Sequence
  Description of Artificial Sequence: Synthetic polypeptide
DEEEIRGTNPVATEQWGFVNVDNNENFLQHEGEGQGGT

SEQ ID NO: 191423 - protein, 37 aa, Artificial Sequence
  Description of Artificial Sequence: Synthetic polypeptide
AEEEVSTTNPVATEQYGCVCSTWEEHDQEYIGSDTQS

SEQ ID NO: 191424 - protein, 38 aa, Artificial Sequence
  Description of Artificial Sequence: Synthetic polypeptide
DEEEIRGTNPVATEQWGDVNVDDLENALQHEGEGQGGT

SEQ ID NO: 191425 - protein, 36 aa, Artificial Sequence
  Description of Artificial Sequence: Synthetic polypeptide
DEEEIRGTNPVATEGYGVVNMGQPNMTDEGGEGDDQ

SEQ ID NO: 191426 - protein, 39 aa, Artificial Sequence
  Description of Artificial Sequence: Synthetic polypeptide
YEEEIRTTNPVATEQYGMCSVEGGMGDGGQGQENQERGT

SEQ ID NO: 191427 - protein, 31 aa, Artificial Sequence
  Description of Artificial Sequence: Synthetic polypeptide
QEEEIATTNPIATECWGATWAADWAEPKGEI

SEQ ID NO: 191428 - protein, 39 aa, Artificial Sequence
  Description of Artificial Sequence: Synthetic polypeptide
DEEEIRGTNPVATEGYGVVDVGVGTGNVGQETGEGNDSE

SEQ ID NO: 191429 - protein, 38 aa, Artificial Sequence
  Description of Artificial Sequence: Synthetic polypeptide
DEEEIRGTNPVATECYGSVYDQGENFNVGENGDGGEED

SEQ ID NO: 191430 - protein, 38 aa, Artificial Sequence
  Description of Artificial Sequence: Synthetic polypeptide
DEEEIRGTNPVATEFYGMVGSGNMNNNIQDIEFDNNNE

SEQ ID NO: 191431 - protein, 37 aa, Artificial Sequence
  Description of Artificial Sequence: Synthetic polypeptide
DEEEIRGTNPVATEFYGQIVNDGQNSGINENDGDEDG

SEQ ID NO: 191432 - protein, 34 aa, Artificial Sequence
  Description of Artificial Sequence: Synthetic polypeptide
CEEEIACTNPVATEQYGCAPGEGHHGINDSDGED

SEQ ID NO: 191433 - protein, 37 aa, Artificial Sequence
  Description of Artificial Sequence: Synthetic polypeptide
AEEEISTTNPVAYEQYGQCVCSNWGEHNISFGSENQS

SEQ ID NO: 191434 - protein, 39 aa, Artificial Sequence
  Description of Artificial Sequence: Synthetic polypeptide
DEEEIRGTNPVATEFYGTVVMGFNTNDQELLATGQTGEQ

SEQ ID NO: 191435 - protein, 38 aa, Artificial Sequence
  Description of Artificial Sequence: Synthetic polypeptide
DEEEIRGTNPVATEQWGQVVVDDNENFLQLEGEGQGDI

SEQ ID NO: 191436 - protein, 38 aa, Artificial Sequence
  Description of Artificial Sequence: Synthetic polypeptide
DEEEIRGTNPVATEGYGSVDIMDDPGDNQDEGQGEGLD

SEQ ID NO: 191437 - protein, 38 aa, Artificial Sequence
  Description of Artificial Sequence: Synthetic polypeptide
DEEEIRGTNPVATEGYGTVVMDNNQTDQFLANGQTGEI

SEQ ID NO: 191438 - protein, 39 aa, Artificial Sequence
  Description of Artificial Sequence: Synthetic polypeptide
DEEEIRGTNPVATEGYGVVDAGDQTGNVGQEEGEGNDTE

SEQ ID NO: 191439 - protein, 39 aa, Artificial Sequence
  Description of Artificial Sequence: Synthetic polypeptide
DEEEIRGTNPVATEGYGVVDVGVGTGNVGQEEGDGNNTN

SEQ ID NO: 191440 - protein, 39 aa, Artificial Sequence
  Description of Artificial Sequence: Synthetic polypeptide
DEEEIRGTNPVATEGYGVVDVGVGTGNVGQEEGEGNGTE

SEQ ID NO: 191441 - protein, 37 aa, Artificial Sequence
  Description of Artificial Sequence: Synthetic polypeptide
DEEEIRTTNPVATEGYGCSCSNWGEDHNQNFDSDTQS

SEQ ID NO: 191442 - protein, 36 aa, Artificial Sequence
  Description of Artificial Sequence: Synthetic polypeptide
AEEELSTTNPVATEQYGCVCSWGEHNAEYIGSDTQS

SEQ ID NO: 191443 - protein, 38 aa, Artificial Sequence
  Description of Artificial Sequence: Synthetic polypeptide
DEEEIRGTNPVATEGYGSVVNMDLMDQNTADPGSGQGE

SEQ ID NO: 191444 - protein, 38 aa, Artificial Sequence
  Description of Artificial Sequence: Synthetic polypeptide
DEEEIRTTNPVAYEQYGQCVCSNWMEDDNQENFNSDQM

SEQ ID NO: 191445 - protein, 36 aa, Artificial Sequence
  Description of Artificial Sequence: Synthetic polypeptide
SEEEIRCTNPCATEQYGCVCSMWGELNAHFGSDTQA

SEQ ID NO: 191446 - protein, 35 aa, Artificial Sequence
  Description of Artificial Sequence: Synthetic polypeptide
SEEEIRCTNPCATEQYGCVCSNWEDNANFISDTQS

SEQ ID NO: 191447 - protein, 37 aa, Artificial Sequence
  Description of Artificial Sequence: Synthetic polypeptide
DENEIRTTNPVATEQWGSVVDDEEGEEMNAGEGDGAN

SEQ ID NO: 191448 - protein, 37 aa, Artificial Sequence
  Description of Artificial Sequence: Synthetic polypeptide
DEEEIRTTNPVATEEYGQCVCSNWGEHAEFFNSDNQL

SEQ ID NO: 191449 - protein, 36 aa, Artificial Sequence
  Description of Artificial Sequence: Synthetic polypeptide
DEAEAEIATTNPCAYEQWGSVVITPNFENEGHGGDV

SEQ ID NO: 191450 - protein, 33 aa, Artificial Sequence
  Description of Artificial Sequence: Synthetic polypeptide
AEDEIATTNPVAYEQWGCVTGDQNDHGQQDSPV

SEQ ID NO: 191451 - protein, 37 aa, Artificial Sequence
  Description of Artificial Sequence: Synthetic polypeptide
DEEPIATTNPVAYEQWGTTCSTTNDLHDQNEGGSHSN

SEQ ID NO: 191452 - protein, 35 aa, Artificial Sequence
  Description of Artificial Sequence: Synthetic polypeptide
DEECCATTNPIAYEQWGIVYKTWNEQDHDGRGETM

SEQ ID NO: 191453 - protein, 38 aa, Artificial Sequence
  Description of Artificial Sequence: Synthetic polypeptide
DEEEIRTTNPVATEQYGNCCQNVDSYAIGQSPEPVSEM

SEQ ID NO: 191454 - protein, 36 aa, Artificial Sequence
  Description of Artificial Sequence: Synthetic polypeptide
DEAEIRTTNPVATEQYGCVMLVEDVPNVPEEKSDQY

SEQ ID NO: 191455 - protein, 36 aa, Artificial Sequence
  Description of Artificial Sequence: Synthetic polypeptide
DEEEIATTNPVATEQWGGCNVAGAGANDNSMGGELH

SEQ ID NO: 191456 - protein, 36 aa, Artificial Sequence
  Description of Artificial Sequence: Synthetic polypeptide
DEQEIRTTNPVATECWGVSFGPCINEPEARETENEG

SEQ ID NO: 191457 - protein, 36 aa, Artificial Sequence
  Description of Artificial Sequence: Synthetic polypeptide
DEECIATTNPVATEGYGCVCNNWEDDNQEYFNSDQS

SEQ ID NO: 191458 - protein, 35 aa, Artificial Sequence
  Description of Artificial Sequence: Synthetic polypeptide
DEECIATTNPVATEGYGCVCNWEDHNAEYFNSDQS

SEQ ID NO: 191459 - protein, 38 aa, Artificial Sequence
  Description of Artificial Sequence: Synthetic polypeptide
DEEEIRSTNPVATEQYGMVSVEGMGDGGQGQENSEFGQ

SEQ ID NO: 191460 - protein, 38 aa, Artificial Sequence
  Description of Artificial Sequence: Synthetic polypeptide
DEEEIRSTNPVATEQYGMVSVEGMGDGGQGQEDQERGQ

SEQ ID NO: 191461 - protein, 37 aa, Artificial Sequence
  Description of Artificial Sequence: Synthetic polypeptide
CEECISTTNPVATEQYGCVCSTWGEHNTEHFNSDNQA

SEQ ID NO: 191462 - protein, 36 aa, Artificial Sequence
  Description of Artificial Sequence: Synthetic polypeptide
DSEEIRTTNPVGYEAWGCVRHNQDKQNDRRGGDTRN

SEQ ID NO: 191463 - protein, 39 aa, Artificial Sequence
  Description of Artificial Sequence: Synthetic polypeptide
DESEICTTNPVATEQYGSVVLDGMQGLTDGQEGDQNGDE

SEQ ID NO: 191464 - protein, 37 aa, Artificial Sequence
  Description of Artificial Sequence: Synthetic polypeptide
DENEIRTTNPVATEQWGQCVTSSMEDNAEAFNSDTAA

SEQ ID NO: 191465 - protein, 35 aa, Artificial Sequence
  Description of Artificial Sequence: Synthetic polypeptide
DEECIATTNPVAYEGWGEVATTNLGGNDPTQGDGT

SEQ ID NO: 191466 - protein, 39 aa, Artificial Sequence
  Description of Artificial Sequence: Synthetic polypeptide
YEEEICTTNPVATEAYGVVVPDTNFLNRNEGIDGEDNGQ

SEQ ID NO: 191467 - protein, 35 aa, Artificial Sequence
  Description of Artificial Sequence: Synthetic polypeptide
DSEEIRTTNPVGYETWGCVRHNNDKQMDRRGGDDP

SEQ ID NO: 191468 - protein, 37 aa, Artificial Sequence
  Description of Artificial Sequence: Synthetic polypeptide
DEAEAEIRTTNPVAYEPWGVCSTGDNDRPGERQDNAQ

SEQ ID NO: 191469 - protein, 37 aa, Artificial Sequence
  Description of Artificial Sequence: Synthetic polypeptide
DDCEIRTTNPVATEQYGSVGPDFENGMDTTRNKPQEE

SEQ ID NO: 191470 - protein, 35 aa, Artificial Sequence
  Description of Artificial Sequence: Synthetic polypeptide
DSEEIRTTNPVGYETWGCVRHNNDQQQDRRQGDAG

SEQ ID NO: 191471 - protein, 37 aa, Artificial Sequence
  Description of Artificial Sequence: Synthetic polypeptide
DEEPIRTTNPVATEPYGISVCFMQNAWSTDTGGMPEN

SEQ ID NO: 191472 - protein, 35 aa, Artificial Sequence
  Description of Artificial Sequence: Synthetic polypeptide
DSEEIRTTNPVGYETWGCVRHNNDQQQQHRGGDAN

SEQ ID NO: 191473 - protein, 34 aa, Artificial Sequence
  Description of Artificial Sequence: Synthetic polypeptide
DEECIATTNPVAYEGWGEVATTNNGGNDTQGDGA

SEQ ID NO: 191474 - protein, 36 aa, Artificial Sequence
  Description of Artificial Sequence: Synthetic polypeptide
DENEIRTTNPVATEQWGQCVCSSGPENANAFSSDAS

SEQ ID NO: 191475 - protein, 36 aa, Artificial Sequence
  Description of Artificial Sequence: Synthetic polypeptide
DENEIRTTNPVATEQWGQCVCSSGEENAEASESDAS

SEQ ID NO: 191476 - protein, 36 aa, Artificial Sequence
  Description of Artificial Sequence: Synthetic polypeptide
DDEEISTVNPVATEQYGCVCSWGEDNAENFNSQTQS

SEQ ID NO: 191477 - protein, 36 aa, Artificial Sequence
  Description of Artificial Sequence: Synthetic polypeptide
DEQEIRTTNPVATECWGVSFMPCINEPEARIFENGE

SEQ ID NO: 191478 - protein, 37 aa, Artificial Sequence
  Description of Artificial Sequence: Synthetic polypeptide
DEEAISTTNPVAYEQYGCVCSNWGEHNQEGFNSDTQA

SEQ ID NO: 191479 - protein, 38 aa, Artificial Sequence
  Description of Artificial Sequence: Synthetic polypeptide
DENEIRTTNPVATEQWGSVVDNGEEGEEMNAGEDDGTN

SEQ ID NO: 191480 - protein, 38 aa, Artificial Sequence
  Description of Artificial Sequence: Synthetic polypeptide
DENEIRTTNPVATEQWGSVVDNGEEGEEMNAGEGDGGA

SEQ ID NO: 191481 - protein, 38 aa, Artificial Sequence
  Description of Artificial Sequence: Synthetic polypeptide
DEENICTTNPVATEAYGVVVVTVTNNLQQLQQGTDEED

SEQ ID NO: 191482 - protein, 36 aa, Artificial Sequence
  Description of Artificial Sequence: Synthetic polypeptide
DEAEIRTTNPVATEQYGCVTLPEDVHNNPEEKKDQY

SEQ ID NO: 191483 - protein, 36 aa, Artificial Sequence
  Description of Artificial Sequence: Synthetic polypeptide
AENEIACTNPVATEQYGCSCSNWGNHNQNFGSQTQA

SEQ ID NO: 191484 - protein, 38 aa, Artificial Sequence
  Description of Artificial Sequence: Synthetic polypeptide
DECEICTTNPVATEQYGTVATVTLQQSATNEEGTTQDD

SEQ ID NO: 191485 - protein, 35 aa, Artificial Sequence
  Description of Artificial Sequence: Synthetic polypeptide
AENEIACTNPVATEQYGCSCSNWGEHNQYFGSQQA

SEQ ID NO: 191486 - protein, 36 aa, Artificial Sequence
  Description of Artificial Sequence: Synthetic polypeptide
DESEIRTTNPVATEGWGQCVCSWGEENIEYFGSQQS

SEQ ID NO: 191487 - protein, 41 aa, Artificial Sequence
  Description of Artificial Sequence: Synthetic polypeptide
DEENICTTNPVATEQYGVVSVVVVTTTQNNLQQGTNEEQQE

SEQ ID NO: 191488 - protein, 36 aa, Artificial Sequence
  Description of Artificial Sequence: Synthetic polypeptide
QEEGIETTNPVATEAYGSVAGGTRGGEEGGQGNEGF

SEQ ID NO: 191489 - protein, 35 aa, Artificial Sequence
  Description of Artificial Sequence: Synthetic polypeptide
DEEEIRTTNPVSYEAYPGIWSTFVHETEATEQQTK

SEQ ID NO: 191490 - protein, 38 aa, Artificial Sequence
  Description of Artificial Sequence: Synthetic polypeptide
DESEIGTTNPVATEQYGASVCSAWDGPVEKFEGNNPEQ

SEQ ID NO: 191491 - protein, 37 aa, Artificial Sequence
  Description of Artificial Sequence: Synthetic polypeptide
DECEICTTNPVATEQYGTVATVAQQQSATNEEGVTDD

SEQ ID NO: 191492 - protein, 37 aa, Artificial Sequence
  Description of Artificial Sequence: Synthetic polypeptide
CEEEIATTNPVATEQWGGCVAGNVGELADLNNSGNHE

SEQ ID NO: 191493 - protein, 38 aa, Artificial Sequence
  Description of Artificial Sequence: Synthetic polypeptide
DEQEIRTTNPVATDQYGSVNTTDGMTNQTGEDEQGQET

SEQ ID NO: 191494 - protein, 34 aa, Artificial Sequence
  Description of Artificial Sequence: Synthetic polypeptide
DEQEIRTTNPVATECWGKFGPCINEPEAREFEDG

SEQ ID NO: 191495 - protein, 36 aa, Artificial Sequence
  Description of Artificial Sequence: Synthetic polypeptide
AENEIACTNPVATEQYGCSCSNWEHNQEYFGSQNQA

SEQ ID NO: 191496 - protein, 35 aa, Artificial Sequence
  Description of Artificial Sequence: Synthetic polypeptide
AENEIACTNPVATEQYGCSCSNWEHNANFGSDTQA

SEQ ID NO: 191497 - protein, 35 aa, Artificial Sequence
  Description of Artificial Sequence: Synthetic polypeptide
AENEIACTNPVATEQYGCSCSNWEHNAEHFGSDQA

SEQ ID NO: 191498 - protein, 38 aa, Artificial Sequence
  Description of Artificial Sequence: Synthetic polypeptide
DEEEIRTTNPVATEQYGMVSVEGMGDGGQGQEAQEVGM

SEQ ID NO: 191499 - protein, 38 aa, Artificial Sequence
  Description of Artificial Sequence: Synthetic polypeptide
DENEIRTTNPVATEQWGSVVDNGEEGEEMNAGEGTGEQ

SEQ ID NO: 191500 - protein, 38 aa, Artificial Sequence
  Description of Artificial Sequence: Synthetic polypeptide
DENEIRTTNPVATEQWGSVVDNGEEGEEMNVGEGDGEP

SEQ ID NO: 191501 - protein, 34 aa, Artificial Sequence
  Description of Artificial Sequence: Synthetic polypeptide
AEDEIATTNPVAYERWGSVSGGNPGNAGEHDGQV

SEQ ID NO: 191502 - protein, 36 aa, Artificial Sequence
  Description of Artificial Sequence: Synthetic polypeptide
DSEEIRTTNPVGTEQWGCVCSWGEHNQENFISDNQA

SEQ ID NO: 191503 - protein, 36 aa, Artificial Sequence
  Description of Artificial Sequence: Synthetic polypeptide
DSEEIRTTNPVGTEQWGCVCSWEEHNQENFGSDTQS

SEQ ID NO: 191504 - protein, 38 aa, Artificial Sequence
  Description of Artificial Sequence: Synthetic polypeptide
YEEEICTTNPVATEQYGSVMGNFNENNGQQGQEVEEQE

SEQ ID NO: 191505 - protein, 36 aa, Artificial Sequence
  Description of Artificial Sequence: Synthetic polypeptide
DEQEIRTTNPVATECWGSFGPCINYEPEAREFENGG

SEQ ID NO: 191506 - protein, 36 aa, Artificial Sequence
  Description of Artificial Sequence: Synthetic polypeptide
DSEEIRTTNPVGTEQWGCVCSNWEHNQENFNSVNQS

SEQ ID NO: 191507 - protein, 38 aa, Artificial Sequence
  Description of Artificial Sequence: Synthetic polypeptide
DEEAISTTNPVATEQYGQCVCSTWGEHNAENFNSQTQS

SEQ ID NO: 191508 - protein, 34 aa, Artificial Sequence
  Description of Artificial Sequence: Synthetic polypeptide
DEACSATTNPIAYEQWGEVCSTWEGLQHDKNGTE

SEQ ID NO: 191509 - protein, 33 aa, Artificial Sequence
  Description of Artificial Sequence: Synthetic polypeptide
DEACSATTNPIAYEQWGEVCSTWEGIQHNQNND

SEQ ID NO: 191510 - protein, 37 aa, Artificial Sequence
  Description of Artificial Sequence: Synthetic polypeptide
DEEAISTTNPVATEQYGQCVCSNWGEHNAENFNSDQS

SEQ ID NO: 191511 - protein, 39 aa, Artificial Sequence
  Description of Artificial Sequence: Synthetic polypeptide
DEEEIRTTNPVATEEYGQCVCSMWGEDHNIENFGSENQS

SEQ ID NO: 191512 - protein, 33 aa, Artificial Sequence
  Description of Artificial Sequence: Synthetic polypeptide
DEACSATTNPIAYEQWGEVCSTWEGQQHDQNNW

SEQ ID NO: 191513 - protein, 38 aa, Artificial Sequence
  Description of Artificial Sequence: Synthetic polypeptide
DEENICTTNPVATEAYGVVVVTVTNANQQLQQGTDEED

SEQ ID NO: 191514 - protein, 39 aa, Artificial Sequence
  Description of Artificial Sequence: Synthetic polypeptide
DEEEIRSTNPVATEGYGVVDVGVGTGNVGNQEGEGNDTS

SEQ ID NO: 191515 - protein, 36 aa, Artificial Sequence
  Description of Artificial Sequence: Synthetic polypeptide
DEAEEATTNPVAYEPWGVVVHTDQGLQDDRMGGGTR

SEQ ID NO: 191516 - protein, 34 aa, Artificial Sequence
  Description of Artificial Sequence: Synthetic polypeptide
DEECIATTNPVAYEQWGAYWSLDNDLRKAKADSG

SEQ ID NO: 191517 - protein, 34 aa, Artificial Sequence
  Description of Artificial Sequence: Synthetic polypeptide
DEECIATTNPVAYEQWGAYWSLDNDLRKAKVDTS

SEQ ID NO: 191518 - protein, 36 aa, Artificial Sequence
  Description of Artificial Sequence: Synthetic polypeptide
DEEQIATTNPVATASWGCVAGTNHGPLASGNGQMTN

SEQ ID NO: 191519 - protein, 35 aa, Artificial Sequence
  Description of Artificial Sequence: Synthetic polypeptide
DEECIATTNPVAYEQWGAYWSLDNDLRKTKVTDRG

SEQ ID NO: 191520 - protein, 36 aa, Artificial Sequence
  Description of Artificial Sequence: Synthetic polypeptide
DEECIATTNPVAYEQWGAYWSTLDNDLRKAKVDDRG

SEQ ID NO: 191521 - protein, 36 aa, Artificial Sequence
  Description of Artificial Sequence: Synthetic polypeptide
DENEIRTTNPVATEQWGNCVSNEAVEEMNIMEFDEA

SEQ ID NO: 191522 - protein, 36 aa, Artificial Sequence
  Description of Artificial Sequence: Synthetic polypeptide
DENEIRTTNPVATEQWGNCVSEAVWEMNIAEFDEAD

SEQ ID NO: 191523 - protein, 36 aa, Artificial Sequence
  Description of Artificial Sequence: Synthetic polypeptide
DEMEISTTNPVAYEQYGCVCSNWGEPNEEFFGSQQA

SEQ ID NO: 191524 - protein, 38 aa, Artificial Sequence
  Description of Artificial Sequence: Synthetic polypeptide
DEEEIRTTNPVATEFYGMTTTVMQTGFNGGDEGGETQF

SEQ ID NO: 191525 - protein, 39 aa, Artificial Sequence
  Description of Artificial Sequence: Synthetic polypeptide
DEEEIRTTNPVATEQYGQCVCGNSGEDDNAENFNSDTQS

SEQ ID NO: 191526 - protein, 39 aa, Artificial Sequence
  Description of Artificial Sequence: Synthetic polypeptide
DEEEIRTTNPVATEQYGQCVCGNSGEDHNAENFNSDNQA

SEQ ID NO: 191527 - protein, 37 aa, Artificial Sequence
  Description of Artificial Sequence: Synthetic polypeptide
DSNEIGTTNPVATEAYGSTVCSDQPEGSTNPGGNQVK

SEQ ID NO: 191528 - protein, 37 aa, Artificial Sequence
  Description of Artificial Sequence: Synthetic polypeptide
DSNEIRATNPVATEQYGTTVTTVWLPDEQENLQIDEI

SEQ ID NO: 191529 - protein, 36 aa, Artificial Sequence
  Description of Artificial Sequence: Synthetic polypeptide
DSNEIRATNPVATEQYGTVTTVWLPDEQENIQIDEH

SEQ ID NO: 191530 - protein, 38 aa, Artificial Sequence
  Description of Artificial Sequence: Synthetic polypeptide
DEEEIRTTNPVATEQYGQCTCSNWGEHNQENFISDNQS

SEQ ID NO: 191531 - protein, 38 aa, Artificial Sequence
  Description of Artificial Sequence: Synthetic polypeptide
DEEEIRTTNPVATEQYGQCVCGNWGEDHNAENFNSDQL

SEQ ID NO: 191532 - protein, 39 aa, Artificial Sequence
  Description of Artificial Sequence: Synthetic polypeptide
DEEEIRTTNPVATEQYGQCVCGNWGEDHNQENFISDNQS

SEQ ID NO: 191533 - protein, 39 aa, Artificial Sequence
  Description of Artificial Sequence: Synthetic polypeptide
DEEEIRTTNPVATEQYGQCVCGNWGEDHNQENFNSDTQA

SEQ ID NO: 191534 - protein, 39 aa, Artificial Sequence
  Description of Artificial Sequence: Synthetic polypeptide
DEEEIRTTNPVATEQYGQCVCGNWGEDHNQENFNSQTQA

SEQ ID NO: 191535 - protein, 38 aa, Artificial Sequence
  Description of Artificial Sequence: Synthetic polypeptide
DEEEIRTTNPVATEQYGQCVCGNWGEHNAENFNSDNQA

SEQ ID NO: 191536 - protein, 38 aa, Artificial Sequence
  Description of Artificial Sequence: Synthetic polypeptide
DEEEIRTTNPVATEQYGQCVCGNWGEHNAENFNSETQS

SEQ ID NO: 191537 - protein, 37 aa, Artificial Sequence
  Description of Artificial Sequence: Synthetic polypeptide
DSNEIRTTNPVATEQYGQSVCSVTWPIYEDMFVEEAQ

SEQ ID NO: 191538 - protein, 37 aa, Artificial Sequence
  Description of Artificial Sequence: Synthetic polypeptide
DSNEIRTTNPVATEQYGSLSCSVKNENNPMTDNSDQY

SEQ ID NO: 191539 - protein, 36 aa, Artificial Sequence
  Description of Artificial Sequence: Synthetic polypeptide
DSNEIRTTNPVATEQYGSVCMVTWPIYEDMFDEEGQ

SEQ ID NO: 191540 - protein, 38 aa, Artificial Sequence
  Description of Artificial Sequence: Synthetic polypeptide
DEEEIRTTNPVATEQYGQCVCQNWEEHNEENFNSDTQA

SEQ ID NO: 191541 - protein, 39 aa, Artificial Sequence
  Description of Artificial Sequence: Synthetic polypeptide
DEEEIRTTNPVATEQYGQCVCQNWGEDTNEENFNSDNQA

SEQ ID NO: 191542 - protein, 38 aa, Artificial Sequence
  Description of Artificial Sequence: Synthetic polypeptide
DEEEIRTTNPVATEQYGQCVCQNWGEHNAENFNSDNQS

SEQ ID NO: 191543 - protein, 37 aa, Artificial Sequence
  Description of Artificial Sequence: Synthetic polypeptide
DEMEISTTNPVAYEQYGCVCSTWGEPNAEFFGSDTQS

SEQ ID NO: 191544 - protein, 37 aa, Artificial Sequence
  Description of Artificial Sequence: Synthetic polypeptide
DEEEIRTTNPVATEFYGMVSVEGMGDGGQGQEAFEGV

SEQ ID NO: 191545 - protein, 37 aa, Artificial Sequence
  Description of Artificial Sequence: Synthetic polypeptide
DSNEIRTTNPVATEQYGSVCSVTWPISHEDMFVEEAQ

SEQ ID NO: 191546 - protein, 38 aa, Artificial Sequence
  Description of Artificial Sequence: Synthetic polypeptide
DEEEIRTTNPVATEQYGQCVCGNWGEDHNIENFISDQA

SEQ ID NO: 191547 - protein, 34 aa, Artificial Sequence
  Description of Artificial Sequence: Synthetic polypeptide
DEECIATTNPVAYEQWGAYWSLDNDLRHAKVDDG

SEQ ID NO: 191548 - protein, 35 aa, Artificial Sequence
  Description of Artificial Sequence: Synthetic polypeptide
DEECIATTNPVAYEQWGAYWSLDNDLRAAKVDHRG

SEQ ID NO: 191549 - protein, 35 aa, Artificial Sequence
  Description of Artificial Sequence: Synthetic polypeptide
DEECIATTNPVAYEKWGCVANLPDNHNGQKGNNGS

SEQ ID NO: 191550 - protein, 35 aa, Artificial Sequence
  Description of Artificial Sequence: Synthetic polypeptide
CEECISTTNPVAYEQYAEEVTTGNGNPNDQGGKKA

SEQ ID NO: 191551 - protein, 34 aa, Artificial Sequence
  Description of Artificial Sequence: Synthetic polypeptide
DSEEISSTNPVAYTQWGSTVPAQPPSMRSGNMGT

SEQ ID NO: 191552 - protein, 35 aa, Artificial Sequence
  Description of Artificial Sequence: Synthetic polypeptide
DSEEISTTNPCAYTQWGSTVPSQPGSMNRGGNMDV

SEQ ID NO: 191553 - protein, 35 aa, Artificial Sequence
  Description of Artificial Sequence: Synthetic polypeptide
DEECIATTNPVAYEGWGSVATTLGENNGDTQGDGH

SEQ ID NO: 191554 - protein, 35 aa, Artificial Sequence
  Description of Artificial Sequence: Synthetic polypeptide
DEECIATTNPVAYEGWGSVATTLPMNGGDTQGDGH

SEQ ID NO: 191555 - protein, 39 aa, Artificial Sequence
  Description of Artificial Sequence: Synthetic polypeptide
DEEEIRTTNPVATEQYGQCAVCSNSGEHNAENFISENQA

SEQ ID NO: 191556 - protein, 39 aa, Artificial Sequence
  Description of Artificial Sequence: Synthetic polypeptide
DEEEIRTTNPVATEQYGQCAVCSNWEEHNQENFNSQTQS

SEQ ID NO: 191557 - protein, 39 aa, Artificial Sequence
  Description of Artificial Sequence: Synthetic polypeptide
DEEEIRTTNPVATEQYGQCAVCSNWGEDHNAENFNSDQS

SEQ ID NO: 191558 - protein, 34 aa, Artificial Sequence
  Description of Artificial Sequence: Synthetic polypeptide
DSEEISTTNPVAYTAWGATVPSQPPSMRGGNMDT

SEQ ID NO: 191559 - protein, 39 aa, Artificial Sequence
  Description of Artificial Sequence: Synthetic polypeptide
DEEEIRTTNPVATEQYGQCAVCSWGEDHDQENFGSETQL

SEQ ID NO: 191560 - protein, 35 aa, Artificial Sequence
  Description of Artificial Sequence: Synthetic polypeptide
DSEEISTTNPVAYTQWGSTVPQCQPPSMRGGNMGT

SEQ ID NO: 191561 - protein, 38 aa, Artificial Sequence
  Description of Artificial Sequence: Synthetic polypeptide
DEEEIRTTNPVATEQYGQCFCSMWEEDNAEYFGSDTQA

SEQ ID NO: 191562 - protein, 37 aa, Artificial Sequence
  Description of Artificial Sequence: Synthetic polypeptide
DEMEISTTNPVAYEQWGSVSGGPPGNGGNMRNMNGMS

SEQ ID NO: 191563 - protein, 34 aa, Artificial Sequence
  Description of Artificial Sequence: Synthetic polypeptide
AEECLRTTNPCAYEQYGCVCSWGEHNQNFGSDQS

SEQ ID NO: 191564 - protein, 40 aa, Artificial Sequence
  Description of Artificial Sequence: Synthetic polypeptide
DEEEIRTTNPVATEQYGQCQVCSMTGEDHNQENFNSDTQQ

SEQ ID NO: 191565 - protein, 35 aa, Artificial Sequence
  Description of Artificial Sequence: Synthetic polypeptide
DEEQIACTNPVATAQWGSVASGHGPLGAPLGTAAS

SEQ ID NO: 191566 - protein, 35 aa, Artificial Sequence
  Description of Artificial Sequence: Synthetic polypeptide
DEEQIACTNPVATAQWGSVASGHGPLGAPPGSAAF

SEQ ID NO: 191567 - protein, 35 aa, Artificial Sequence
  Description of Artificial Sequence: Synthetic polypeptide
CEEEIACTNPVATAQWGCVAMTGLTNPDDKMGNQM

SEQ ID NO: 191568 - protein, 39 aa, Artificial Sequence
  Description of Artificial Sequence: Synthetic polypeptide
QEEEIRTTNPVATEGYGMVNMQDTMNMQTEEITGDNQGG

SEQ ID NO: 191569 - protein, 35 aa, Artificial Sequence
  Description of Artificial Sequence: Synthetic polypeptide
DSGEIRTTNPVATEQYGSLMPWSWLSSEIMFDSQQ

SEQ ID NO: 191570 - protein, 36 aa, Artificial Sequence
  Description of Artificial Sequence: Synthetic polypeptide
DEMEISTTNPVAYEQYGCVCSMWGEHQENFGSETQS

SEQ ID NO: 191571 - protein, 37 aa, Artificial Sequence
  Description of Artificial Sequence: Synthetic polypeptide
DEMEISTTNPVAYEQYGCVCSMTEEHNQESFNSDNQS

SEQ ID NO: 191572 - protein, 35 aa, Artificial Sequence
  Description of Artificial Sequence: Synthetic polypeptide
DDCEIRTTNPVATEQYGVVVWTEDMMEETPFEVGQ

SEQ ID NO: 191573 - protein, 37 aa, Artificial Sequence
  Description of Artificial Sequence: Synthetic polypeptide
DEEEIRSTNPVATEGYGVIVSDLFTGDGEGQGEDEGI

SEQ ID NO: 191574 - protein, 39 aa, Artificial Sequence
  Description of Artificial Sequence: Synthetic polypeptide
DEEEIRTTNPVATEAYGVVSTTVAQNQNTATEQGTEEEE

SEQ ID NO: 191575 - protein, 35 aa, Artificial Sequence
  Description of Artificial Sequence: Synthetic polypeptide
DSGEICTTNPVAYERYGSVVCSTVMGSQLTPMTQI

SEQ ID NO: 191576 - protein, 35 aa, Artificial Sequence
  Description of Artificial Sequence: Synthetic polypeptide
DSGEICTTNPVAYERYGNVMCSTVMGSQNTGMTQI

SEQ ID NO: 191577 - protein, 35 aa, Artificial Sequence
  Description of Artificial Sequence: Synthetic polypeptide
DSGEICTTNPVAYERYGMVVCSTVMGSQNTGMTQS

SEQ ID NO: 191578 - protein, 38 aa, Artificial Sequence
  Description of Artificial Sequence: Synthetic polypeptide
DEEEIRTTNPVATEQYGQCSCSNWGEPDNIENFISDQS

SEQ ID NO: 191579 - protein, 38 aa, Artificial Sequence
  Description of Artificial Sequence: Synthetic polypeptide
DEEEIRTTNPVATEQYGQCSCSNWGEDHNANFDSDTQS

SEQ ID NO: 191580 - protein, 38 aa, Artificial Sequence
  Description of Artificial Sequence: Synthetic polypeptide
DEEEIRTTNPVATEQYGQCSCSNWGEDDNQENFDSDQS

SEQ ID NO: 191581 - protein, 37 aa, Artificial Sequence
  Description of Artificial Sequence: Synthetic polypeptide
DSGEIGTTNPVATEAYGSTVCSDQPEPSTNPGGNQVP

SEQ ID NO: 191582 - protein, 36 aa, Artificial Sequence
  Description of Artificial Sequence: Synthetic polypeptide
CEEEIACTNPVATEPYGSACSANPDTQEHQDGTEMK

SEQ ID NO: 191583 - protein, 38 aa, Artificial Sequence
  Description of Artificial Sequence: Synthetic polypeptide
DESEIKTTNPVATDQYGSVVSDGMQGLTDFDGDINGEE

SEQ ID NO: 191584 - protein, 38 aa, Artificial Sequence
  Description of Artificial Sequence: Synthetic polypeptide
DESEIKTTNPVATDQYGSVVSDGMQGLTDGQDGDIVGE

SEQ ID NO: 191585 - protein, 36 aa, Artificial Sequence
  Description of Artificial Sequence: Synthetic polypeptide
DEIAEIATTNPVATEPWGVVCFTNEDWTDLGGTNSQ

SEQ ID NO: 191586 - protein, 35 aa, Artificial Sequence
  Description of Artificial Sequence: Synthetic polypeptide
CEECIACTNPVATEQYGSVANMNNSNAAGGPGEDP

SEQ ID NO: 191587 - protein, 38 aa, Artificial Sequence
  Description of Artificial Sequence: Synthetic polypeptide
DEEEIRTTNPVAYEQYGQCVCSNWGEHNQENFPSENQP

SEQ ID NO: 191588 - protein, 37 aa, Artificial Sequence
  Description of Artificial Sequence: Synthetic polypeptide
DEDEIATTNPVAYEQWGSVSGGEPGNGGNMREKQESD

SEQ ID NO: 191589 - protein, 35 aa, Artificial Sequence
  Description of Artificial Sequence: Synthetic polypeptide
DEIAEIATTNPVATEPWGVVCFTNEDWTDLGTDGS

SEQ ID NO: 191590 - protein, 37 aa, Artificial Sequence
  Description of Artificial Sequence: Synthetic polypeptide
DESEIRGTNPVATEQYGVVGDLVNNSGMGEGNEDGDN

SEQ ID NO: 191591 - protein, 36 aa, Artificial Sequence
  Description of Artificial Sequence: Synthetic polypeptide
DENEIRTTNPVATEQYGAVPYATDEEDIPPSIEEVP

SEQ ID NO: 191592 - protein, 38 aa, Artificial Sequence
  Description of Artificial Sequence: Synthetic polypeptide
DEEGEQQTTSNLPCVADNEQAGTLSPWVNCSQRGCNVR

SEQ ID NO: 191593 - protein, 36 aa, Artificial Sequence
  Description of Artificial Sequence: Synthetic polypeptide
DESEIRGTNPVATEQYGVVGDLVNNSGMEGEEDGDT

SEQ ID NO: 191594 - protein, 38 aa, Artificial Sequence
  Description of Artificial Sequence: Synthetic polypeptide
DESEIRGTNPVATEQYGVVGDLVNNSEGQMEGNEDGDQ

SEQ ID NO: 191595 - protein, 37 aa, Artificial Sequence
  Description of Artificial Sequence: Synthetic polypeptide
DEEEIRTTNPVCTEHYGQCVCSWPEDNQENFGSETQS

SEQ ID NO: 191596 - protein, 37 aa, Artificial Sequence
  Description of Artificial Sequence: Synthetic polypeptide
DEEEIRTTNPVCTEHYGQCVCSWGEHNQENFGSDTLS

SEQ ID NO: 191597 - protein, 35 aa, Artificial Sequence
  Description of Artificial Sequence: Synthetic polypeptide
DEIAEIATTNPVATEPWGVVCFTNEDWTEEGGDTS

SEQ ID NO: 191598 - protein, 38 aa, Artificial Sequence
  Description of Artificial Sequence: Synthetic polypeptide
DEEEIRTTNPVATEQWGQCVCSSGEDHNQENFNSDNQA

SEQ ID NO: 191599 - protein, 38 aa, Artificial Sequence
  Description of Artificial Sequence: Synthetic polypeptide
DEAEISTTNPVATEQYGCVTSTWGEDDNAEYFNSDPQS

SEQ ID NO: 191600 - protein, 38 aa, Artificial Sequence
  Description of Artificial Sequence: Synthetic polypeptide
DEEEIRTTNPVATEQWGQCVCSNWGEHNQENFNSDTQS

SEQ ID NO: 191601 - protein, 37 aa, Artificial Sequence
  Description of Artificial Sequence: Synthetic polypeptide
DEDEIATTNPVAYEQWGSVSGGEPGNGGNIRRKEEMM

SEQ ID NO: 191602 - protein, 37 aa, Artificial Sequence
  Description of Artificial Sequence: Synthetic polypeptide
DESEIRGTNPVATEQYGAVGDLVNNSGEMGEGNEQGQ

SEQ ID NO: 191603 - protein, 32 aa, Artificial Sequence
  Description of Artificial Sequence: Synthetic polypeptide
DDSEVGSTNPVSTEGYGAVAANTIVSGVGQRI

SEQ ID NO: 191604 - protein, 38 aa, Artificial Sequence
  Description of Artificial Sequence: Synthetic polypeptide
DEEEIRTTNPVATEQYGLVCCAHGARVTEEHELMEVVF

SEQ ID NO: 191605 - protein, 38 aa, Artificial Sequence
  Description of Artificial Sequence: Synthetic polypeptide
DESEIRGTNPVATEQYGAIIVSGEGNNMNDGGNDQDQL

SEQ ID NO: 191606 - protein, 36 aa, Artificial Sequence
  Description of Artificial Sequence: Synthetic polypeptide
DEEAISTTNPVATEQYGCVCGWGEHNAENFNSENQG

SEQ ID NO: 191607 - protein, 37 aa, Artificial Sequence
  Description of Artificial Sequence: Synthetic polypeptide
DEEEIRTTNPVCTEHYGCVCSWGEPHNQENFGSDTQS

SEQ ID NO: 191608 - protein, 37 aa, Artificial Sequence
  Description of Artificial Sequence: Synthetic polypeptide
DESEIRGTNPVATEQYGAIINVGEGNNMNDGGNDQQN

SEQ ID NO: 191609 - protein, 37 aa, Artificial Sequence
  Description of Artificial Sequence: Synthetic polypeptide
DESEIRGTNPVATEGYGSVGGMGVNDNLEEGGETDTD

SEQ ID NO: 191610 - protein, 38 aa, Artificial Sequence
  Description of Artificial Sequence: Synthetic polypeptide
DESEIRGTNPVATEFYGSVVNITNTGMTLVNEMDNEDQ

SEQ ID NO: 191611 - protein, 37 aa, Artificial Sequence
  Description of Artificial Sequence: Synthetic polypeptide
DEEEIRTTNPVATEQYGMIQFPTMGEEEPEPGSVAEI

SEQ ID NO: 191612 - protein, 38 aa, Artificial Sequence
  Description of Artificial Sequence: Synthetic polypeptide
DENEIRTTNPVATEQYGASCMCVAGVLPQEVVVQEDVV

SEQ ID NO: 191613 - protein, 38 aa, Artificial Sequence
  Description of Artificial Sequence: Synthetic polypeptide
DEEEIRTTNPVATEQYGMMGYDDSGNMNDIMDEGGTGT

SEQ ID NO: 191614 - protein, 38 aa, Artificial Sequence
  Description of Artificial Sequence: Synthetic polypeptide
DEEEIRTTNPVATEQYGMMGYDGSGNMDDIFDEGGIGT

SEQ ID NO: 191615 - protein, 39 aa, Artificial Sequence
  Description of Artificial Sequence: Synthetic polypeptide
DEEEIRTTNPVATEQWGQCQVCSYTGEAHNAEYFGSDFA

SEQ ID NO: 191616 - protein, 37 aa, Artificial Sequence
  Description of Artificial Sequence: Synthetic polypeptide
DEDEIATTNPVAYEQWGSVSGGEPGNGGNMRNMMDMT

SEQ ID NO: 191617 - protein, 36 aa, Artificial Sequence
  Description of Artificial Sequence: Synthetic polypeptide
DEIAEIATTNPVATEPWGVVCFTNEDWTDLGGDPSR

SEQ ID NO: 191618 - protein, 34 aa, Artificial Sequence
  Description of Artificial Sequence: Synthetic polypeptide
AENEIACTNPVATEQYGCYCSWMEDNQNFGSDQS

SEQ ID NO: 191619 - protein, 39 aa, Artificial Sequence
  Description of Artificial Sequence: Synthetic polypeptide
DEEEIRTTNPVATEQYGHISNNAPWEQTDQDHSGIEHPE

SEQ ID NO: 191620 - protein, 39 aa, Artificial Sequence
  Description of Artificial Sequence: Synthetic polypeptide
DEEEIRTTNPVATEQYGHIVNNVPIEQTDNAHSGIEMPP

SEQ ID NO: 191621 - protein, 38 aa, Artificial Sequence
  Description of Artificial Sequence: Synthetic polypeptide
DEEEIRTTNPVATEQYGHIVNNVPIEQTDNHSNIEEPE

SEQ ID NO: 191622 - protein, 39 aa, Artificial Sequence
  Description of Artificial Sequence: Synthetic polypeptide
DEEEIRTTNPVATEQYGHIVNNVPLEQIDYQHSGIDHPE

SEQ ID NO: 191623 - protein, 38 aa, Artificial Sequence
  Description of Artificial Sequence: Synthetic polypeptide
DEEEIRTTNPVATEQYGHIVNNVPVEQTDNHSGIQHPE

SEQ ID NO: 191624 - protein, 39 aa, Artificial Sequence
  Description of Artificial Sequence: Synthetic polypeptide
DEEEIRTTNPVATEQYGHIVNNVPWEQTDQLHSGIEHPE

SEQ ID NO: 191625 - protein, 37 aa, Artificial Sequence
  Description of Artificial Sequence: Synthetic polypeptide
DEDEIATTNPVAYEQWGSVSGGEPGNGGNMRNMREEM

SEQ ID NO: 191626 - protein, 37 aa, Artificial Sequence
  Description of Artificial Sequence: Synthetic polypeptide
DEMEISTTNPVATEQYGTVCSNWGEPNEEFFGSQTQS

SEQ ID NO: 191627 - protein, 37 aa, Artificial Sequence
  Description of Artificial Sequence: Synthetic polypeptide
DENEIRTTNPVATEQYGCICTVADVDVEQLEPGEDTA

SEQ ID NO: 191628 - protein, 37 aa, Artificial Sequence
  Description of Artificial Sequence: Synthetic polypeptide
DEEEIRTTNPCATEEYGCVCGNSGEHNIENFGSDTAA

SEQ ID NO: 191629 - protein, 37 aa, Artificial Sequence
  Description of Artificial Sequence: Synthetic polypeptide
DEEAIRTTNPVATEQYGVASCWVWVLEEDTPNDNQED

SEQ ID NO: 191630 - protein, 37 aa, Artificial Sequence
  Description of Artificial Sequence: Synthetic polypeptide
DEEAIRTTNPVATEQYGVVSCWVEVEEEDTPNDNQED

SEQ ID NO: 191631 - protein, 36 aa, Artificial Sequence
  Description of Artificial Sequence: Synthetic polypeptide
DENEIRTTNPVATEQYGCCTVADVDVEQLEPVEDTI

SEQ ID NO: 191632 - protein, 37 aa, Artificial Sequence
  Description of Artificial Sequence: Synthetic polypeptide
DEMEISTTNPVATEQYGTVCSNWGEPNEEHFGSDTQA

SEQ ID NO: 191633 - protein, 36 aa, Artificial Sequence
  Description of Artificial Sequence: Synthetic polypeptide
DEMEISTTNPVATEQYGTVCSNWGEPNEFFSSDTQS

SEQ ID NO: 191634 - protein, 34 aa, Artificial Sequence
  Description of Artificial Sequence: Synthetic polypeptide
DEEAIRTTNPVSTEAAGIVSTFYHETETFEQQTK

SEQ ID NO: 191635 - protein, 37 aa, Artificial Sequence
  Description of Artificial Sequence: Synthetic polypeptide
DEEAIRTTNPVSTEQYGCVCGNWGEHNQEGFGSQTQA

SEQ ID NO: 191636 - protein, 35 aa, Artificial Sequence
  Description of Artificial Sequence: Synthetic polypeptide
AENEIACTNPVATEQYGCYCSWNDNQENFGSDTQS

SEQ ID NO: 191637 - protein, 36 aa, Artificial Sequence
  Description of Artificial Sequence: Synthetic polypeptide
QEEEIVTTNPVATEQYGVVMNGPIEGQGGQGEQEDD

SEQ ID NO: 191638 - protein, 38 aa, Artificial Sequence
  Description of Artificial Sequence: Synthetic polypeptide
DENEIRTTNPVATEQYGAVVVAMNGFNGEGGFNENTTD

SEQ ID NO: 191639 - protein, 38 aa, Artificial Sequence
  Description of Artificial Sequence: Synthetic polypeptide
DEAEISTTNPVATEQYGCVTSTWGADDNAEHFGSDPQS

SEQ ID NO: 191640 - protein, 37 aa, Artificial Sequence
  Description of Artificial Sequence: Synthetic polypeptide
QEEEIVTTNPVATEQYGVVMNGPIEGEGGQGGENPDD

SEQ ID NO: 191641 - protein, 35 aa, Artificial Sequence
  Description of Artificial Sequence: Synthetic polypeptide
DEHEIRTTNPVAYMQWGAAPTWEGDQQMQGNNPDK

SEQ ID NO: 191642 - protein, 39 aa, Artificial Sequence
  Description of Artificial Sequence: Synthetic polypeptide
DEEEIRTTNPVATEQWGICQVCSYTEEDDNAEHFGSDQA

SEQ ID NO: 191643 - protein, 39 aa, Artificial Sequence
  Description of Artificial Sequence: Synthetic polypeptide
DENEIRTTNPVATEQYGAVYTQGTDQIIDQEGEGGNQGT

SEQ ID NO: 191644 - protein, 39 aa, Artificial Sequence
  Description of Artificial Sequence: Synthetic polypeptide
DEEEIRTTNPVATEQYGICVTSNWGADDNAEYFNSDPQS

SEQ ID NO: 191645 - protein, 38 aa, Artificial Sequence
  Description of Artificial Sequence: Synthetic polypeptide
VEEEIRTTNPVATEQYGIAVQSPNMNITEVPINNDVIS

SEQ ID NO: 191646 - protein, 39 aa, Artificial Sequence
  Description of Artificial Sequence: Synthetic polypeptide
DENEIRTTNPVATEQYGAYSCMCAGVNLLQEVVVQEDRN

SEQ ID NO: 191647 - protein, 36 aa, Artificial Sequence
  Description of Artificial Sequence: Synthetic polypeptide
DEIAEIATTNPVATEPWGVVCFTNEDHQDVGGTTST

SEQ ID NO: 191648 - protein, 37 aa, Artificial Sequence
  Description of Artificial Sequence: Synthetic polypeptide
DENEIRTTNPVATEQYGCCFWVAQVDVEQLEPGEDLM

SEQ ID NO: 191649 - protein, 37 aa, Artificial Sequence
  Description of Artificial Sequence: Synthetic polypeptide
DENEIRTTNPVATEQYGCCITVADVDVEQLEPGEDTG

SEQ ID NO: 191650 - protein, 39 aa, Artificial Sequence
  Description of Artificial Sequence: Synthetic polypeptide
DEEEIRTTNPVATEQYGIDNYVLEKTHHPQEKQQNEEQY

SEQ ID NO: 191651 - protein, 37 aa, Artificial Sequence
  Description of Artificial Sequence: Synthetic polypeptide
DEAEIRTTNPVATEQYGCVTPLPEDVPNIPEEKNDQY

SEQ ID NO: 191652 - protein, 38 aa, Artificial Sequence
  Description of Artificial Sequence: Synthetic polypeptide
DEEEIRTTNPVATEQYGMMVQFPYMGEEQPEPGSVAEI

SEQ ID NO: 191653 - protein, 37 aa, Artificial Sequence
  Description of Artificial Sequence: Synthetic polypeptide
DENEIRTTNPVATEQYGAMTNGFNQENMGEGIQLEDN

SEQ ID NO: 191654 - protein, 34 aa, Artificial Sequence
  Description of Artificial Sequence: Synthetic polypeptide
DEQEIRQTNPVATECWGSFGPCINEPEAREFETG

SEQ ID NO: 191655 - protein, 38 aa, Artificial Sequence
  Description of Artificial Sequence: Synthetic polypeptide
DEEEIRTTNPVATEEYGCVCSNWGEDHNAENFNSENQS

SEQ ID NO: 191656 - protein, 39 aa, Artificial Sequence
  Description of Artificial Sequence: Synthetic polypeptide
DDGEIRTTNPVATEQYGCTIFSGAVMTDDGQHDGFDENI

SEQ ID NO: 191657 - protein, 35 aa, Artificial Sequence
  Description of Artificial Sequence: Synthetic polypeptide
DEQEIRTCNPVATECWGSCFGPCINEPEAREFENG

SEQ ID NO: 191658 - protein, 37 aa, Artificial Sequence
  Description of Artificial Sequence: Synthetic polypeptide
DEQEIRTTNCVATEQYGMVSVEGMGDGGQGQENQEGE

SEQ ID NO: 191659 - protein, 37 aa, Artificial Sequence
  Description of Artificial Sequence: Synthetic polypeptide
DEEAISTTNPVATEQYGCVCSNWGPHNQENFNSDTQS

SEQ ID NO: 191660 - protein, 39 aa, Artificial Sequence
  Description of Artificial Sequence: Synthetic polypeptide
DECEICTTNPVATEQYGTVSTVNQNGNTTQQGTTEEGSQ

SEQ ID NO: 191661 - protein, 36 aa, Artificial Sequence
  Description of Artificial Sequence: Synthetic polypeptide
DENEIRTTNPVATEQWGVVVDNEEGEEMNAGEGDGA

SEQ ID NO: 191662 - protein, 32 aa, Artificial Sequence
  Description of Artificial Sequence: Synthetic polypeptide
QENEIATTNPVATECYGATVANAECWAEHEPL

SEQ ID NO: 191663 - protein, 32 aa, Artificial Sequence
  Description of Artificial Sequence: Synthetic polypeptide
QENEIATTNPVATECYGATVANAEDWAEHEPL

SEQ ID NO: 191664 - protein, 34 aa, Artificial Sequence
  Description of Artificial Sequence: Synthetic polypeptide
AENEIACTNPVATEQYGCSCSWEHNQHFSSDTQA

SEQ ID NO: 191665 - protein, 34 aa, Artificial Sequence
  Description of Artificial Sequence: Synthetic polypeptide
AENEIACTNPVATEQYGCSCSWEHNQEYFISQQA

SEQ ID NO: 191666 - protein, 38 aa, Artificial Sequence
  Description of Artificial Sequence: Synthetic polypeptide
VEEEIRTTNPVATEQYGSAVQLPWMNITEVPINNDVIS

SEQ ID NO: 191667 - protein, 38 aa, Artificial Sequence
  Description of Artificial Sequence: Synthetic polypeptide
DEENICTTNPVATEAYGVVATVNGNNNQQLQQGTDEED

SEQ ID NO: 191668 - protein, 38 aa, Artificial Sequence
  Description of Artificial Sequence: Synthetic polypeptide
DEQEIRPTNPVATECYGSVVMSVNDNNTGGGQTGQVGD

SEQ ID NO: 191669 - protein, 38 aa, Artificial Sequence
  Description of Artificial Sequence: Synthetic polypeptide
DEENICTTNPVATEAYGVVATVNGTALQQLQQGTDEED

SEQ ID NO: 191670 - protein, 39 aa, Artificial Sequence
  Description of Artificial Sequence: Synthetic polypeptide
DSEEIRTTNPVATEQYGSNIVTWSVNDEEQNNEPEITEM

SEQ ID NO: 191671 - protein, 36 aa, Artificial Sequence
  Description of Artificial Sequence: Synthetic polypeptide
DEENICTTNPVATEAYGVVATVVNDQQSTTEEAEED

SEQ ID NO: 191672 - protein, 35 aa, Artificial Sequence
  Description of Artificial Sequence: Synthetic polypeptide
DEQEIRTTNPIATECWGATTWSNTEDLADPEGPDL

SEQ ID NO: 191673 - protein, 38 aa, Artificial Sequence
  Description of Artificial Sequence: Synthetic polypeptide
DEHEIRTTNPVATEQYGFVNSATEVPNEVNFETHDEMW

SEQ ID NO: 191674 - protein, 37 aa, Artificial Sequence
  Description of Artificial Sequence: Synthetic polypeptide
DEEEIRTTNPVATEQYGMVQFPTMGEEDPEPHSVLEI

SEQ ID NO: 191675 - protein, 35 aa, Artificial Sequence
  Description of Artificial Sequence: Synthetic polypeptide
AENEIACTNPVATEQYGCSCSWEEHNAEYFGSDQS

SEQ ID NO: 191676 - protein, 37 aa, Artificial Sequence
  Description of Artificial Sequence: Synthetic polypeptide
DEEAISTTNPVATEQYGCVCSWGEDHNQENFNSDTQP

SEQ ID NO: 191677 - protein, 39 aa, Artificial Sequence
  Description of Artificial Sequence: Synthetic polypeptide
VEEEIRTTNPVATEQYGSAVQSPWMNMITEVPINNPVIS

SEQ ID NO: 191678 - protein, 36 aa, Artificial Sequence
  Description of Artificial Sequence: Synthetic polypeptide
AENEIACTNPVATEQYGCSCSTWGEDNQEYFNSDQS

SEQ ID NO: 191679 - protein, 36 aa, Artificial Sequence
  Description of Artificial Sequence: Synthetic polypeptide
DENEIRTTNPVATEQWGVVDNEEGEEMNGGEGDGEN

SEQ ID NO: 191680 - protein, 36 aa, Artificial Sequence
  Description of Artificial Sequence: Synthetic polypeptide
DENEIRTTNPVATEQWGVVDNEEGEEMNAGEGDGGF

SEQ ID NO: 191681 - protein, 36 aa, Artificial Sequence
  Description of Artificial Sequence: Synthetic polypeptide
DENEIRTTNPVATEQWGVVDNEEGEEMNAGEGDDDQ

SEQ ID NO: 191682 - protein, 38 aa, Artificial Sequence
  Description of Artificial Sequence: Synthetic polypeptide
DEEEIATTNPVAYEQYGSVCAMNNGEPTNPDDQGEHMM

SEQ ID NO: 191683 - protein, 38 aa, Artificial Sequence
  Description of Artificial Sequence: Synthetic polypeptide
DECEICTTNPVATEQYGTVATVTNQQSATNEEGTVTDD

SEQ ID NO: 191684 - protein, 38 aa, Artificial Sequence
  Description of Artificial Sequence: Synthetic polypeptide
DEEEIATTNPVAYEQYGSVCAATAGVGGEEHQDDNLAG

SEQ ID NO: 191685 - protein, 38 aa, Artificial Sequence
  Description of Artificial Sequence: Synthetic polypeptide
DEQEIRGTNPVATEFYGDVMTSNGGQGDGQGDTEQDRN

SEQ ID NO: 191686 - protein, 38 aa, Artificial Sequence
  Description of Artificial Sequence: Synthetic polypeptide
DEQEIRGTNPVATECYGSVYDQTGNNFNGENGDGGEED

SEQ ID NO: 191687 - protein, 37 aa, Artificial Sequence
  Description of Artificial Sequence: Synthetic polypeptide
DEMEIRTTNPVATCGYGCVCSTWGEHNEENFNSDTQS

SEQ ID NO: 191688 - protein, 37 aa, Artificial Sequence
  Description of Artificial Sequence: Synthetic polypeptide
DEEAISTTNPVATEQYGCVCSMWMEHNQENFNSDTQA

SEQ ID NO: 191689 - protein, 39 aa, Artificial Sequence
  Description of Artificial Sequence: Synthetic polypeptide
DEEEIRTTNPVATEQWGICQVCSTWGEDHNAYFGSDTQA

SEQ ID NO: 191690 - protein, 37 aa, Artificial Sequence
  Description of Artificial Sequence: Synthetic polypeptide
DESEIRGTNPVATDQYGVVNDNSIGQNGGQEDNDTDP

SEQ ID NO: 191691 - protein, 37 aa, Artificial Sequence
  Description of Artificial Sequence: Synthetic polypeptide
DENEIRTTNPVATEQYGACVDTDAENGPVETEESQVE

SEQ ID NO: 191692 - protein, 37 aa, Artificial Sequence
  Description of Artificial Sequence: Synthetic polypeptide
DENEIRTTNPVATEQYGACTWVADVDVEQLEGGEDHL

SEQ ID NO: 191693 - protein, 37 aa, Artificial Sequence
  Description of Artificial Sequence: Synthetic polypeptide
DENEIRTTNPVATEQYGACCWVAVVDVEQLEPGEDIL

SEQ ID NO: 191694 - protein, 37 aa, Artificial Sequence
  Description of Artificial Sequence: Synthetic polypeptide
DENEIRTTNPVATEQYGACCWVALVDVEQLEGGEDHS

SEQ ID NO: 191695 - protein, 38 aa, Artificial Sequence
  Description of Artificial Sequence: Synthetic polypeptide
DEEEIRTTNPVATEQWGICQVCSNWGEDHNAYFGSDQS

SEQ ID NO: 191696 - protein, 39 aa, Artificial Sequence
  Description of Artificial Sequence: Synthetic polypeptide
DEEEIRTTNPVATEQWGICQVCSNWEEDDNANFGSDNQA

SEQ ID NO: 191697 - protein, 37 aa, Artificial Sequence
  Description of Artificial Sequence: Synthetic polypeptide
DENEIRTTNPVATEQYGACCWVADVDVEQLYGGEQHL

SEQ ID NO: 191698 - protein, 37 aa, Artificial Sequence
  Description of Artificial Sequence: Synthetic polypeptide
DENEIRTTNPVATEQYGACCWVADVDVEQLFGGEDHI

SEQ ID NO: 191699 - protein, 36 aa, Artificial Sequence
  Description of Artificial Sequence: Synthetic polypeptide
DENEIRTTNPVATEQYGACCWVADVDVEQLEPQEDE

SEQ ID NO: 191700 - protein, 37 aa, Artificial Sequence
  Description of Artificial Sequence: Synthetic polypeptide
DENEIRTTNPVATEQYGACCWVADVDVEQLEPNEDLN

SEQ ID NO: 191701 - protein, 37 aa, Artificial Sequence
  Description of Artificial Sequence: Synthetic polypeptide
DENEIRTTNPVATEQYGACCWVADVDVEQLEPGEDSI

SEQ ID NO: 191702 - protein, 37 aa, Artificial Sequence
  Description of Artificial Sequence: Synthetic polypeptide
DEEAISTTNPVATEQYGCVCSNWGEHNAENFNSDTQA

SEQ ID NO: 191703 - protein, 37 aa, Artificial Sequence
  Description of Artificial Sequence: Synthetic polypeptide
DEEAISTTNPVATEQYGCVCSNWGEHNAENFNSDTQS

SEQ ID NO: 191704 - protein, 37 aa, Artificial Sequence
  Description of Artificial Sequence: Synthetic polypeptide
DENEIRTTNPVATEQYGACCWVADVDVEQLEGIEDHG

SEQ ID NO: 191705 - protein, 35 aa, Artificial Sequence
  Description of Artificial Sequence: Synthetic polypeptide
DESEIRATNPVAYECWGSVCYTTDNNDHGHPGTQH

SEQ ID NO: 191706 - protein, 38 aa, Artificial Sequence
  Description of Artificial Sequence: Synthetic polypeptide
DEEEIRTCNPVATEAYGAVVVGGQERGLQIGDNGQGEI

SEQ ID NO: 191707 - protein, 37 aa, Artificial Sequence
  Description of Artificial Sequence: Synthetic polypeptide
DESEIRCTNPVAYEQWGTVCPTDNHGLVNTQKGQDQG

SEQ ID NO: 191708 - protein, 35 aa, Artificial Sequence
  Description of Artificial Sequence: Synthetic polypeptide
AENEIACTNPVATEQYGCSCSWGEHNQEYFNSEQA

SEQ ID NO: 191709 - protein, 35 aa, Artificial Sequence
  Description of Artificial Sequence: Synthetic polypeptide
AENEIACTNPVATEQYGCSCSWGEHNQHFNSDNQA

SEQ ID NO: 191710 - protein, 35 aa, Artificial Sequence
  Description of Artificial Sequence: Synthetic polypeptide
AENEIACTNPVATEQYGCSCSWGEPNQYFNSDTQS

SEQ ID NO: 191711 - protein, 38 aa, Artificial Sequence
  Description of Artificial Sequence: Synthetic polypeptide
DEEEIRTTNPVATEQWGICQVCSYTEDHNAHFNSDTQA

SEQ ID NO: 191712 - protein, 37 aa, Artificial Sequence
  Description of Artificial Sequence: Synthetic polypeptide
DEEAISTTNPVATEQYGCVCSNWGEHNQENFGSETQA

SEQ ID NO: 191713 - protein, 37 aa, Artificial Sequence
  Description of Artificial Sequence: Synthetic polypeptide
DENEIRTTNPVATEQYGACCWVADQDVEQLEGGETHL

SEQ ID NO: 191714 - protein, 37 aa, Artificial Sequence
  Description of Artificial Sequence: Synthetic polypeptide
DENEIRTTNPVATEQYGACCWVADVDVEQLEEGEDEL

SEQ ID NO: 191715 - protein, 36 aa, Artificial Sequence
  Description of Artificial Sequence: Synthetic polypeptide
DEEEIRTTNCVATEGYGCVGDGNMDNPEGEGTEEQE

SEQ ID NO: 191716 - protein, 38 aa, Artificial Sequence
  Description of Artificial Sequence: Synthetic polypeptide
DEEEIRTTNCVATEQYGMVSVEGMGDGGQGQENQESGI

SEQ ID NO: 191717 - protein, 38 aa, Artificial Sequence
  Description of Artificial Sequence: Synthetic polypeptide
DEQEIKTTNPVATEQYGVVMSNNDNNTEGPGQTGQGGD

SEQ ID NO: 191718 - protein, 37 aa, Artificial Sequence
  Description of Artificial Sequence: Synthetic polypeptide
DEEEIRTTNPVCTEHYGCVCSNWGEHNQEYFGSDTQA

SEQ ID NO: 191719 - protein, 37 aa, Artificial Sequence
  Description of Artificial Sequence: Synthetic polypeptide
DDMEIATTNPVATEQYGCVCSTWGEDNEEHFGSETQA

SEQ ID NO: 191720 - protein, 37 aa, Artificial Sequence
  Description of Artificial Sequence: Synthetic polypeptide
DEACISTTNPVATEQYGCVCSNWGEHNQENFGSENQA

SEQ ID NO: 191721 - protein, 37 aa, Artificial Sequence
  Description of Artificial Sequence: Synthetic polypeptide
DSNEIRTTNPVATEQYGSVCSVTWPIYEDMKFMEEAQ

SEQ ID NO: 191722 - protein, 37 aa, Artificial Sequence
  Description of Artificial Sequence: Synthetic polypeptide
DSNEIRTTNPVATEQYGSVCSVTWPIYEEDMEVHEGQ

SEQ ID NO: 191723 - protein, 36 aa, Artificial Sequence
  Description of Artificial Sequence: Synthetic polypeptide
CEEEIATTNPVATEQWGANRTTAATEHLAGMNGNNH

SEQ ID NO: 191724 - protein, 39 aa, Artificial Sequence
  Description of Artificial Sequence: Synthetic polypeptide
DEEEIRTTNPVATEQYGQCVCSNWGEEHNAENFNSETQS

SEQ ID NO: 191725 - protein, 39 aa, Artificial Sequence
  Description of Artificial Sequence: Synthetic polypeptide
DEEEIRTTNPVATEQYGQCVCSNWGEGHNQEFFNSDFQS

SEQ ID NO: 191726 - protein, 33 aa, Artificial Sequence
  Description of Artificial Sequence: Synthetic polypeptide
AEDEIACTNPVAYEQWGEYYSIENDVRTQGESM

SEQ ID NO: 191727 - protein, 38 aa, Artificial Sequence
  Description of Artificial Sequence: Synthetic polypeptide
QEEEIRTTNPVATEGYGMVNMQMTMTEQVEEITGNQGG

SEQ ID NO: 191728 - protein, 36 aa, Artificial Sequence
  Description of Artificial Sequence: Synthetic polypeptide
DEAEIRTTNPVATEQYGCTCSWGEHNAENFPSDTQS

SEQ ID NO: 191729 - protein, 36 aa, Artificial Sequence
  Description of Artificial Sequence: Synthetic polypeptide
DEAEIRTTNPVATEQYGCTCSWGEDHNQENFISDQS

SEQ ID NO: 191730 - protein, 38 aa, Artificial Sequence
  Description of Artificial Sequence: Synthetic polypeptide
DEEEIRTTNPVATEQYGQCVCSNWGEHEAENFGSDTQA

SEQ ID NO: 191731 - protein, 38 aa, Artificial Sequence
  Description of Artificial Sequence: Synthetic polypeptide
DEEEIRTTNPVATEQYGQCVCSNWGEHEAEYFNSDNQS

SEQ ID NO: 191732 - protein, 37 aa, Artificial Sequence
  Description of Artificial Sequence: Synthetic polypeptide
DDECIRTTNPVATEGYGCVTSTWGAHNAENFNSDPQA

SEQ ID NO: 191733 - protein, 38 aa, Artificial Sequence
  Description of Artificial Sequence: Synthetic polypeptide
DEEEIRTTNPVAYEQYGQCVCSNWGEPNQENFNSDNQS

SEQ ID NO: 191734 - protein, 37 aa, Artificial Sequence
  Description of Artificial Sequence: Synthetic polypeptide
DEECIRTTNPVATEEYGCVCGNWGEHNQEYFGSDTQS

SEQ ID NO: 191735 - protein, 37 aa, Artificial Sequence
  Description of Artificial Sequence: Synthetic polypeptide
DEECIRTTNPVATEGWGCVCQNWGEHNQEGFNSDNQS

SEQ ID NO: 191736 - protein, 37 aa, Artificial Sequence
  Description of Artificial Sequence: Synthetic polypeptide
DEEEIRTTNPVATEQYGTVTCIEEGYEEVPEGEVPEI

SEQ ID NO: 191737 - protein, 39 aa, Artificial Sequence
  Description of Artificial Sequence: Synthetic polypeptide
DEEEIRTTNPVATEQYGQCVCSNWGEEHNAENFNSDNQS

SEQ ID NO: 191738 - protein, 37 aa, Artificial Sequence
  Description of Artificial Sequence: Synthetic polypeptide
DEECIRTTNPVATEGYGCVCGTWGEHNQEYFNSDTQS

SEQ ID NO: 191739 - protein, 37 aa, Artificial Sequence
  Description of Artificial Sequence: Synthetic polypeptide
DEAEISTTNPVATEQYGQCVCSNWGNHNAEYFGSDQS

SEQ ID NO: 191740 - protein, 36 aa, Artificial Sequence
  Description of Artificial Sequence: Synthetic polypeptide
DEESIACTNPVATEQWGCVAATTNSNATPDGDENDD

SEQ ID NO: 191741 - protein, 34 aa, Artificial Sequence
  Description of Artificial Sequence: Synthetic polypeptide
AEDEIACTNPVAYEQWGEYYSIENDTQRGPGESQ

SEQ ID NO: 191742 - protein, 33 aa, Artificial Sequence
  Description of Artificial Sequence: Synthetic polypeptide
AEDEIACTNPVAYEQWGEYYSIENDTQNGPGEH

SEQ ID NO: 191743 - protein, 36 aa, Artificial Sequence
  Description of Artificial Sequence: Synthetic polypeptide
CEEEIATTNPVATEMWGGCVAGNGELADTNNHGNHE

SEQ ID NO: 191744 - protein, 38 aa, Artificial Sequence
  Description of Artificial Sequence: Synthetic polypeptide
DEAEISTTNPVATEQYGQCVCSNWMEHNEEGFGSENQA

SEQ ID NO: 191745 - protein, 38 aa, Artificial Sequence
  Description of Artificial Sequence: Synthetic polypeptide
DEEEIRTTNPVATEQYGQCVCSNWGEHNQEFFISDTQS

SEQ ID NO: 191746 - protein, 33 aa, Artificial Sequence
  Description of Artificial Sequence: Synthetic polypeptide
AEDEIACTNPVAYEQWGEYYSIENDQRTPQESE

SEQ ID NO: 191747 - protein, 38 aa, Artificial Sequence
  Description of Artificial Sequence: Synthetic polypeptide
DEAEISTTNPVATEQYGQCVCSTWGEHNAENFNSDNQL

SEQ ID NO: 191748 - protein, 38 aa, Artificial Sequence
  Description of Artificial Sequence: Synthetic polypeptide
DEAEISTTNPVATEQYGQCVCSTWGEHNQENFNSDTQA

SEQ ID NO: 191749 - protein, 37 aa, Artificial Sequence
  Description of Artificial Sequence: Synthetic polypeptide
DEAEISTTNPVATEQYGQCVCSWEDHNAEYFGSDTQS

SEQ ID NO: 191750 - protein, 38 aa, Artificial Sequence
  Description of Artificial Sequence: Synthetic polypeptide
DEQEIRTTNPVATEQYGDVVVNGFGQGGQDTDQTEGFD

SEQ ID NO: 191751 - protein, 37 aa, Artificial Sequence
  Description of Artificial Sequence: Synthetic polypeptide
DEECIRTTNPVATEGYGCVCSNWGEHNAENFGSQTQS

SEQ ID NO: 191752 - protein, 34 aa, Artificial Sequence
  Description of Artificial Sequence: Synthetic polypeptide
AEDEIACTNPVAYEQWGEYYSIENDQQRTPGMSM

SEQ ID NO: 191753 - protein, 36 aa, Artificial Sequence
  Description of Artificial Sequence: Synthetic polypeptide
DEECIRTTNPVATEGYGCVCQMWEHNQENFGSDTQA

SEQ ID NO: 191754 - protein, 35 aa, Artificial Sequence
  Description of Artificial Sequence: Synthetic polypeptide
CEEEIATTNPVATEQWGCVAANGEDTATGGSESHD

SEQ ID NO: 191755 - protein, 39 aa, Artificial Sequence
  Description of Artificial Sequence: Synthetic polypeptide
DEEEIRTTNPVATEQYGQCVCSNWGEDPNQENFNSDPQS

SEQ ID NO: 191756 - protein, 39 aa, Artificial Sequence
  Description of Artificial Sequence: Synthetic polypeptide
DEEEIRTTNPVATEQYGQCVCSNWGEDPNQEFFNSETQS

SEQ ID NO: 191757 - protein, 39 aa, Artificial Sequence
  Description of Artificial Sequence: Synthetic polypeptide
DEEEIRTTNPVATEQYGQCVCSNWGEDHNAENFISENQS

SEQ ID NO: 191758 - protein, 39 aa, Artificial Sequence
  Description of Artificial Sequence: Synthetic polypeptide
DEEEIRTTNPVATEQYGQCVCSNWGEDHNAENFNSDNQG

SEQ ID NO: 191759 - protein, 39 aa, Artificial Sequence
  Description of Artificial Sequence: Synthetic polypeptide
DEEEIRTTNPVATEQYGQCVCSNWGEDHNAENFNSDNQS

SEQ ID NO: 191760 - protein, 39 aa, Artificial Sequence
  Description of Artificial Sequence: Synthetic polypeptide
DEEEIRTTNPVATEQYGQCVCSNWGEDHNAENFNSDTQS

SEQ ID NO: 191761 - protein, 39 aa, Artificial Sequence
  Description of Artificial Sequence: Synthetic polypeptide
DEEEIRTTNPVATEQYGQCVCSNWGEDHNAENFNSENQS

SEQ ID NO: 191762 - protein, 39 aa, Artificial Sequence
  Description of Artificial Sequence: Synthetic polypeptide
DEEEIRTTNPVATEQYGQCVCSNWGEDHNAENFNSQTQD

SEQ ID NO: 191763 - protein, 38 aa, Artificial Sequence
  Description of Artificial Sequence: Synthetic polypeptide
DEEEIRTTNPVATEQYGQCVCSNWGEDHNEENFMSDQS

SEQ ID NO: 191764 - protein, 39 aa, Artificial Sequence
  Description of Artificial Sequence: Synthetic polypeptide
DEEEIRTTNPVATEQYGQCVCSNWGEDHNEENFNSDTQA

SEQ ID NO: 191765 - protein, 39 aa, Artificial Sequence
  Description of Artificial Sequence: Synthetic polypeptide
DEEEIRTTNPVATEQYGQCVCSNWGEDHNIEGFISENQS

SEQ ID NO: 191766 - protein, 39 aa, Artificial Sequence
  Description of Artificial Sequence: Synthetic polypeptide
DEEEIRTTNPVATEQYGQCVCSNWGEDHNIENFISDNQA

SEQ ID NO: 191767 - protein, 39 aa, Artificial Sequence
  Description of Artificial Sequence: Synthetic polypeptide
DEEEIRTTNPVATEQYGQCVCSNWGEDHNIEYFNSETQS

SEQ ID NO: 191768 - protein, 39 aa, Artificial Sequence
  Description of Artificial Sequence: Synthetic polypeptide
DEEEIRTTNPVATEQYGQCVCSNWGEDHNQEFFGSDTQA

SEQ ID NO: 191769 - protein, 39 aa, Artificial Sequence
  Description of Artificial Sequence: Synthetic polypeptide
DEEEIRTTNPVATEQYGQCVCSNWGEDHNQEHFNSDNQS

SEQ ID NO: 191770 - protein, 39 aa, Artificial Sequence
  Description of Artificial Sequence: Synthetic polypeptide
DEEEIRTTNPVATEQYGQCVCSNWGEDHNQEHFNSDTQS

SEQ ID NO: 191771 - protein, 39 aa, Artificial Sequence
  Description of Artificial Sequence: Synthetic polypeptide
DEEEIRTTNPVATEQYGQCVCSNWGEDHNQEHFNSETQS

SEQ ID NO: 191772 - protein, 39 aa, Artificial Sequence
  Description of Artificial Sequence: Synthetic polypeptide
DEEEIRTTNPVATEQYGQCVCSNWGEDHNQENFGSDTQS

SEQ ID NO: 191773 - protein, 39 aa, Artificial Sequence
  Description of Artificial Sequence: Synthetic polypeptide
DEEEIRTTNPVATEQYGQCVCSNWGEDHNQENFISENQA

SEQ ID NO: 191774 - protein, 38 aa, Artificial Sequence
  Description of Artificial Sequence: Synthetic polypeptide
DEEEIRTTNPVATEQYGQCVCSNWGEDNQENFSSDTQA

SEQ ID NO: 191775 - protein, 37 aa, Artificial Sequence
  Description of Artificial Sequence: Synthetic polypeptide
DEAEISTTNPVATEQYGQCVCSNWGEHNQNFNSDNQA

SEQ ID NO: 191776 - protein, 38 aa, Artificial Sequence
  Description of Artificial Sequence: Synthetic polypeptide
DEAEISTTNPVATEQYGQCVCSNWGEHNQENFGSENQA

SEQ ID NO: 191777 - protein, 34 aa, Artificial Sequence
  Description of Artificial Sequence: Synthetic polypeptide
AENCIACTNPVATEQYGCSCSNWEHNQYFGSDQS

SEQ ID NO: 191778 - protein, 36 aa, Artificial Sequence
  Description of Artificial Sequence: Synthetic polypeptide
DESEIRTTNPVATEGWGCVCSWMEDENQENFGSDQM

SEQ ID NO: 191779 - protein, 35 aa, Artificial Sequence
  Description of Artificial Sequence: Synthetic polypeptide
DEAEIACTNPVATEQWGGCVAGTNGSHQEADMLIN

SEQ ID NO: 191780 - protein, 33 aa, Artificial Sequence
  Description of Artificial Sequence: Synthetic polypeptide
AEDEIACTNPVAYEQWGEYYSIENDQDEGPGET

SEQ ID NO: 191781 - protein, 35 aa, Artificial Sequence
  Description of Artificial Sequence: Synthetic polypeptide
DEHEIRTTNPVAYEQWGHNNVYYWEEQQHHPGGHG

SEQ ID NO: 191782 - protein, 39 aa, Artificial Sequence
  Description of Artificial Sequence: Synthetic polypeptide
DEEEIRTTNPVATEQYGQCVCSNWGEDHNQEYFNSENQF

SEQ ID NO: 191783 - protein, 39 aa, Artificial Sequence
  Description of Artificial Sequence: Synthetic polypeptide
DEEEIRTTNPVATEQYGQCVCSNWGEDHNQEYFNSDNQS

SEQ ID NO: 191784 - protein, 39 aa, Artificial Sequence
  Description of Artificial Sequence: Synthetic polypeptide
DEEEIRTTNPVATEQYGQCVCSNWGEDHNQEYFNSDNQA

SEQ ID NO: 191785 - protein, 39 aa, Artificial Sequence
  Description of Artificial Sequence: Synthetic polypeptide
DEEEIRTTNPVATEQYGQCVCSNWGEDHNQENFNSQNQA

SEQ ID NO: 191786 - protein, 39 aa, Artificial Sequence
  Description of Artificial Sequence: Synthetic polypeptide
DEEEIRTTNPVATEQYGQCVCSNWGEDHNQENFNSETQS

SEQ ID NO: 191787 - protein, 39 aa, Artificial Sequence
  Description of Artificial Sequence: Synthetic polypeptide
DEEEIRTTNPVATEQYGQCVCSNWGEDHNQENFNSDTQS

SEQ ID NO: 191788 - protein, 38 aa, Artificial Sequence
  Description of Artificial Sequence: Synthetic polypeptide
DEAEISTTNPVATEQYGQCVCSNWGEHNQEGFNSDNQL

SEQ ID NO: 191789 - protein, 39 aa, Artificial Sequence
  Description of Artificial Sequence: Synthetic polypeptide
DEEEIRTTNPVATEQYGQCVCSNWGEDHNAEHFNSETQA

SEQ ID NO: 191790 - protein, 34 aa, Artificial Sequence
  Description of Artificial Sequence: Synthetic polypeptide
AEDEIACTNPVAYEQWGEYYSIEINDQQRGPGES

SEQ ID NO: 191791 - protein, 37 aa, Artificial Sequence
  Description of Artificial Sequence: Synthetic polypeptide
DEAEISTTNPVATEQYGQCVCSWGEDNQENFPSDNQS

SEQ ID NO: 191792 - protein, 36 aa, Artificial Sequence
  Description of Artificial Sequence: Synthetic polypeptide
DEESIACTNPVATEQYGSACAANPHPAEAPMGNGHN

SEQ ID NO: 191793 - protein, 37 aa, Artificial Sequence
  Description of Artificial Sequence: Synthetic polypeptide
DEESIACTNPVATEQYGSACATNPAEEAGAHQDQGAP

SEQ ID NO: 191794 - protein, 36 aa, Artificial Sequence
  Description of Artificial Sequence: Synthetic polypeptide
DEESIACTNPVATEQYGSACAVNPHPAEAPMGEGNE

SEQ ID NO: 191795 - protein, 35 aa, Artificial Sequence
  Description of Artificial Sequence: Synthetic polypeptide
DESEIATTNPVAYERWGVCATNNQDPGDHPNNSAE

SEQ ID NO: 191796 - protein, 38 aa, Artificial Sequence
  Description of Artificial Sequence: Synthetic polypeptide
DEESIACTNPVATEQYGSCASAVGNVITNPDDEMGNEM

SEQ ID NO: 191797 - protein, 37 aa, Artificial Sequence
  Description of Artificial Sequence: Synthetic polypeptide
DEQEIRTTNPVATEQYGSHCIWPWEHDEQPEVENDQG

SEQ ID NO: 191798 - protein, 36 aa, Artificial Sequence
  Description of Artificial Sequence: Synthetic polypeptide
DESEIRTTNPVATEGWGCVCSWGNHNAEYFGSDTQG

SEQ ID NO: 191799 - protein, 36 aa, Artificial Sequence
  Description of Artificial Sequence: Synthetic polypeptide
DEECIRTTNPVATEIYGCVCGWEEHNQENFISDNQA

SEQ ID NO: 191800 - protein, 36 aa, Artificial Sequence
  Description of Artificial Sequence: Synthetic polypeptide
DEAEIRTTNPVATEQYGCFYNAVPNHEVQDSAEEQN

SEQ ID NO: 191801 - protein, 37 aa, Artificial Sequence
  Description of Artificial Sequence: Synthetic polypeptide
DEQEIRTTNPVATEQYGSHIIHVWEHDEQPEVEADQG

SEQ ID NO: 191802 - protein, 37 aa, Artificial Sequence
  Description of Artificial Sequence: Synthetic polypeptide
DEESIACTNPVATEQYGSVCAATNNSENPDDGAGDLT

SEQ ID NO: 191803 - protein, 38 aa, Artificial Sequence
  Description of Artificial Sequence: Synthetic polypeptide
DEEEIRTTNPVAYEQYGQCVCSNWGEPNQENFNSENQS

SEQ ID NO: 191804 - protein, 39 aa, Artificial Sequence
  Description of Artificial Sequence: Synthetic polypeptide
DEQEIRTTNPVATEQYGSNIVTWTPVDEEQNNEPEIMRV

SEQ ID NO: 191805 - protein, 34 aa, Artificial Sequence
  Description of Artificial Sequence: Synthetic polypeptide
DEMEIVTTNPIATECWGAVCSNTDGPVEFEGPYD

SEQ ID NO: 191806 - protein, 38 aa, Artificial Sequence
  Description of Artificial Sequence: Synthetic polypeptide
SEEEIRCTNPCATEQYGQCVCSTWGEDNAENFGSDNQS

SEQ ID NO: 191807 - protein, 38 aa, Artificial Sequence
  Description of Artificial Sequence: Synthetic polypeptide
DEAEIRTTNPVATEQYGASTIPWTPPLHENQEEQIEMQ

SEQ ID NO: 191808 - protein, 35 aa, Artificial Sequence
  Description of Artificial Sequence: Synthetic polypeptide
SEEEIRCTNPCATEQYGCVCSWGEHNAENFISQQS

SEQ ID NO: 191809 - protein, 35 aa, Artificial Sequence
  Description of Artificial Sequence: Synthetic polypeptide
DEMEIVTTNPIATEQWGATVWANAEGPAEPEGNYI

SEQ ID NO: 191810 - protein, 38 aa, Artificial Sequence
  Description of Artificial Sequence: Synthetic polypeptide
AEMEIRTTNPVATEQYGQCICSNWGETNQENFGSDNQS

SEQ ID NO: 191811 - protein, 37 aa, Artificial Sequence
  Description of Artificial Sequence: Synthetic polypeptide
AEMEIRTTNPVATEQYGCVCSNWGEDHNAEYFNSDQS

SEQ ID NO: 191812 - protein, 38 aa, Artificial Sequence
  Description of Artificial Sequence: Synthetic polypeptide
DAEEIATTNPVATEQYGSVCAMANHADDSKAPGDSFNE

SEQ ID NO: 191813 - protein, 36 aa, Artificial Sequence
  Description of Artificial Sequence: Synthetic polypeptide
DEAEIRTTNPVATEQYGAANSGLHPDFDPNTEDEGG

SEQ ID NO: 191814 - protein, 37 aa, Artificial Sequence
  Description of Artificial Sequence: Synthetic polypeptide
SEEEIRCTNPCATEQYGCVCSTWGEHNAENFISDNQS

SEQ ID NO: 191815 - protein, 36 aa, Artificial Sequence
  Description of Artificial Sequence: Synthetic polypeptide
SEEEIRCTNPCATEQYGCVCSTWGEDNAENFSSDQS

SEQ ID NO: 191816 - protein, 37 aa, Artificial Sequence
  Description of Artificial Sequence: Synthetic polypeptide
SEEEIRCTNPCATEQYGCVCSTWGEDHNANFGSDTQS

SEQ ID NO: 191817 - protein, 37 aa, Artificial Sequence
  Description of Artificial Sequence: Synthetic polypeptide
SEEEIRCTNPCATEQYGCVCSTWGEDHNAEYFGSDQS

SEQ ID NO: 191818 - protein, 34 aa, Artificial Sequence
  Description of Artificial Sequence: Synthetic polypeptide
DEMEIVTTNPIATEQWGTTVWAAAEGPEEPEGND

SEQ ID NO: 191819 - protein, 36 aa, Artificial Sequence
  Description of Artificial Sequence: Synthetic polypeptide
DEAEIRTTNPVATEQYGAAANSLHPDFDPNTEDEDG

SEQ ID NO: 191820 - protein, 35 aa, Artificial Sequence
  Description of Artificial Sequence: Synthetic polypeptide
AEDEIACTNPVAYEQWGEAWSIENDLRQERGGETL

SEQ ID NO: 191821 - protein, 39 aa, Artificial Sequence
  Description of Artificial Sequence: Synthetic polypeptide
DEEEIRTTNPVATEQYGSVVGLGQEDQEEQDGEGEGDGE

SEQ ID NO: 191822 - protein, 36 aa, Artificial Sequence
  Description of Artificial Sequence: Synthetic polypeptide
SEEEIRCTNPCATEQYGCVCSWGEHNAEYFGSDFQS

SEQ ID NO: 191823 - protein, 38 aa, Artificial Sequence
  Description of Artificial Sequence: Synthetic polypeptide
DTEEIRTTNPVATEQYGSLCWPETDILIQAEEPQEDEQ

SEQ ID NO: 191824 - protein, 38 aa, Artificial Sequence
  Description of Artificial Sequence: Synthetic polypeptide
DTEEIRTTNPVATEQYGSLCWPETDIELIQEYPQEDEQ

SEQ ID NO: 191825 - protein, 37 aa, Artificial Sequence
  Description of Artificial Sequence: Synthetic polypeptide
DTEEIRTTNPVATEQYGSGCWPETDKPIQEYPQEDEQ

SEQ ID NO: 191826 - protein, 38 aa, Artificial Sequence
  Description of Artificial Sequence: Synthetic polypeptide
DEEEIATTNPVATEQYGSVCAAVANVGGEEHQDDTLAQ

SEQ ID NO: 191827 - protein, 37 aa, Artificial Sequence
  Description of Artificial Sequence: Synthetic polypeptide
DEEEIATTNPVATEQYGSVCADGAPGGFMHQGDEMAD

SEQ ID NO: 191828 - protein, 39 aa, Artificial Sequence
  Description of Artificial Sequence: Synthetic polypeptide
YEEEIRCTNPVATEIYGSVNNSTTPENGPEMGQGENEEG

SEQ ID NO: 191829 - protein, 36 aa, Artificial Sequence
  Description of Artificial Sequence: Synthetic polypeptide
CEEEIATTNPVATASWGSVSATGAGGTAPQDIADNN

SEQ ID NO: 191830 - protein, 36 aa, Artificial Sequence
  Description of Artificial Sequence: Synthetic polypeptide
YEEEIRGTNCVATEFYGSVVYDGFTQGGNEDTDDQE

SEQ ID NO: 191831 - protein, 38 aa, Artificial Sequence
  Description of Artificial Sequence: Synthetic polypeptide
DEECIRTTNPVATEGYGQCVCSNWGEHNTENFNSDNQS

SEQ ID NO: 191832 - protein, 35 aa, Artificial Sequence
  Description of Artificial Sequence: Synthetic polypeptide
SEEEIRCTNPCAYEQYGCVCSWEHNAENFGSDTQS

SEQ ID NO: 191833 - protein, 36 aa, Artificial Sequence
  Description of Artificial Sequence: Synthetic polypeptide
SEEEIRCTNPCAYEQYGCVCSTWGEHNAENFGSDQS

SEQ ID NO: 191834 - protein, 35 aa, Artificial Sequence
  Description of Artificial Sequence: Synthetic polypeptide
SEEEIRCTNPCAYEQYGCVCSNWEDNAENFGSDQS

SEQ ID NO: 191835 - protein, 36 aa, Artificial Sequence
  Description of Artificial Sequence: Synthetic polypeptide
DEEEIATTNPVATEQWGCVAKAGPPPLDSDINNMSE

SEQ ID NO: 191836 - protein, 39 aa, Artificial Sequence
  Description of Artificial Sequence: Synthetic polypeptide
YEEEIRGTNPVATEQYGVVVVGPDTNDQELLAEGQTGGQ

SEQ ID NO: 191837 - protein, 38 aa, Artificial Sequence
  Description of Artificial Sequence: Synthetic polypeptide
YEEEIRGTNPVATESYGSVVVDQMQLGQQRTEIQGADI

SEQ ID NO: 191838 - protein, 36 aa, Artificial Sequence
  Description of Artificial Sequence: Synthetic polypeptide
DEAEIACTNPVATEQYGCNVAAGANQPTEAEGGNEE

SEQ ID NO: 191839 - protein, 36 aa, Artificial Sequence
  Description of Artificial Sequence: Synthetic polypeptide
AEMEISTTNPVATEQYGCVCSNWGEPNEEFFGSDQS

SEQ ID NO: 191840 - protein, 37 aa, Artificial Sequence
  Description of Artificial Sequence: Synthetic polypeptide
AEMEISTTNPVATEQYGCVCSNWGEPNAEFFGSDNQA

SEQ ID NO: 191841 - protein, 39 aa, Artificial Sequence
  Description of Artificial Sequence: Synthetic polypeptide
DEEEIRTTNPVATEQYGQCVCSNWMEDHNAENFGSDTQS

SEQ ID NO: 191842 - protein, 37 aa, Artificial Sequence
  Description of Artificial Sequence: Synthetic polypeptide
DEAEISTTNPVATEQYGQCVCSWGEHNAENFNSDTQA

SEQ ID NO: 191843 - protein, 37 aa, Artificial Sequence
  Description of Artificial Sequence: Synthetic polypeptide
DTEEIRTTNPVATEQYGSGCWPETDISIQEYPQEDEV

SEQ ID NO: 191844 - protein, 38 aa, Artificial Sequence
  Description of Artificial Sequence: Synthetic polypeptide
DTEEIRTTNPVATEQYGSGCWPETDILNQAEYPQEDEQ

SEQ ID NO: 191845 - protein, 36 aa, Artificial Sequence
  Description of Artificial Sequence: Synthetic polypeptide
DEEEIATTNPVATEQWGCVAGEGGPGENTADGPMDI

SEQ ID NO: 191846 - protein, 36 aa, Artificial Sequence
  Description of Artificial Sequence: Synthetic polypeptide
DEAEIATTNPVAYEQWGSVCDDTPLPNDSGDGEGHN

SEQ ID NO: 191847 - protein, 37 aa, Artificial Sequence
  Description of Artificial Sequence: Synthetic polypeptide
DDECIRTTNPVATEQYGCVCSNWGEHNAENFNSENQL

SEQ ID NO: 191848 - protein, 37 aa, Artificial Sequence
  Description of Artificial Sequence: Synthetic polypeptide
DTEEIRTTNPVATEQYGSGCWPEADILIPEYPQEDEQ

SEQ ID NO: 191849 - protein, 38 aa, Artificial Sequence
  Description of Artificial Sequence: Synthetic polypeptide
DEECIRTTNPVATEGYGCVTSTWGEDHNAENFNSDPQA

SEQ ID NO: 191850 - protein, 38 aa, Artificial Sequence
  Description of Artificial Sequence: Synthetic polypeptide
DTEEIRTTNPVATEQYGSGCWPCTDIILIQEYPQEDEQ

SEQ ID NO: 191851 - protein, 35 aa, Artificial Sequence
  Description of Artificial Sequence: Synthetic polypeptide
DESEIATTNPVAYESWGVVSGGLNAGNADNGGKTD

SEQ ID NO: 191852 - protein, 36 aa, Artificial Sequence
  Description of Artificial Sequence: Synthetic polypeptide
DEECIRTTNPVATEIYGCVCGNWGEHNAEYFNSDQS

SEQ ID NO: 191853 - protein, 37 aa, Artificial Sequence
  Description of Artificial Sequence: Synthetic polypeptide
YEEEIRSTNPVATEQYGAVMGNFNENNGQQGQEGEQE

SEQ ID NO: 191854 - protein, 36 aa, Artificial Sequence
  Description of Artificial Sequence: Synthetic polypeptide
DEESIACTNPVATEQYGSACAANPAEADAEIGNDTM

SEQ ID NO: 191855 - protein, 37 aa, Artificial Sequence
  Description of Artificial Sequence: Synthetic polypeptide
DEAEISTTNPVATEQYGQCVCSWGEHNQEHFNSDTQS

SEQ ID NO: 191856 - protein, 33 aa, Artificial Sequence
  Description of Artificial Sequence: Synthetic polypeptide
DDSEVASTNPVSTEGYGNVAANVTWVQGDVGQR

SEQ ID NO: 191857 - protein, 37 aa, Artificial Sequence
  Description of Artificial Sequence: Synthetic polypeptide
DDECIRTTNPVATEQYGCVCSNWEEHNQEYFNSDTQA

SEQ ID NO: 191858 - protein, 37 aa, Artificial Sequence
  Description of Artificial Sequence: Synthetic polypeptide
DSNEIRTTNPVATEQYGSVCSVTWPIYEDMMFVEEAT

SEQ ID NO: 191859 - protein, 39 aa, Artificial Sequence
  Description of Artificial Sequence: Synthetic polypeptide
DEEEIRTTNPVATEQYGQCVCSNWGEDHNAEHFNSDNQA

SEQ ID NO: 191860 - protein, 39 aa, Artificial Sequence
  Description of Artificial Sequence: Synthetic polypeptide
DEEEIRTTNPVATEQYGQCVCSNWGEDHNAEFFNSDTQA

SEQ ID NO: 191861 - protein, 39 aa, Artificial Sequence
  Description of Artificial Sequence: Synthetic polypeptide
DEEEIRTTNPVATEQYGQCVCSMWGEPHNQENFISENQS

SEQ ID NO: 191862 - protein, 39 aa, Artificial Sequence
  Description of Artificial Sequence: Synthetic polypeptide
DEEEIRTTNPVATEQYGQCVCSMWMEDHNQENFGSETQS

SEQ ID NO: 191863 - protein, 33 aa, Artificial Sequence
  Description of Artificial Sequence: Synthetic polypeptide
DSSEVASTNPVSYEAYGNVACNTEISQSRTGQR

SEQ ID NO: 191864 - protein, 38 aa, Artificial Sequence
  Description of Artificial Sequence: Synthetic polypeptide
DEEEIRTTNPVATEQYGQCVCSNSEDHNQENFMSDTQS

SEQ ID NO: 191865 - protein, 34 aa, Artificial Sequence
  Description of Artificial Sequence: Synthetic polypeptide
DSSEVASTNPVSYEAYGNVACNTIQSRTGGQNRL

SEQ ID NO: 191866 - protein, 34 aa, Artificial Sequence
  Description of Artificial Sequence: Synthetic polypeptide
DSSEVASTNPVSYEAYGNVACNTISQSRTGLQNR

SEQ ID NO: 191867 - protein, 33 aa, Artificial Sequence
  Description of Artificial Sequence: Synthetic polypeptide
DSSEVASTNPVSYEAYGNVPACNTISQSRVGQR

SEQ ID NO: 191868 - protein, 35 aa, Artificial Sequence
  Description of Artificial Sequence: Synthetic polypeptide
DESEIRTTNPVATEGWGCVCSWMEENQESFISDQS

SEQ ID NO: 191869 - protein, 39 aa, Artificial Sequence
  Description of Artificial Sequence: Synthetic polypeptide
DEEEIRTTNPVATEQYGQCVCSNSGEAHNAENFNSDNQS

SEQ ID NO: 191870 - protein, 39 aa, Artificial Sequence
  Description of Artificial Sequence: Synthetic polypeptide
DEEEIRTTNPVATEQYGQCVCSNSGEDHNAENFGSETQS

SEQ ID NO: 191871 - protein, 39 aa, Artificial Sequence
  Description of Artificial Sequence: Synthetic polypeptide
DEEEIRTTNPVATEQYGQCVCSNSGEDHNAENFISENQS

SEQ ID NO: 191872 - protein, 39 aa, Artificial Sequence
  Description of Artificial Sequence: Synthetic polypeptide
DEEEIRTTNPVATEQYGQCVCSNSGEDHNAENFNSDPQA

SEQ ID NO: 191873 - protein, 39 aa, Artificial Sequence
  Description of Artificial Sequence: Synthetic polypeptide
DEEEIRTTNPVATEQYGQCVCSNSGEDHNAENFNSDTQL

SEQ ID NO: 191874 - protein, 39 aa, Artificial Sequence
  Description of Artificial Sequence: Synthetic polypeptide
DEEEIRTTNPVATEQYGQCVCSNSGEDHNIENFGSDPQS

SEQ ID NO: 191875 - protein, 33 aa, Artificial Sequence
  Description of Artificial Sequence: Synthetic polypeptide
DSSEVASTNPVSYEAYGNVACETIDSRTGGQNR

SEQ ID NO: 191876 - protein, 39 aa, Artificial Sequence
  Description of Artificial Sequence: Synthetic polypeptide
DEEEIRTTNPVATEQYGQCVCSNSGEDHNQEFFGSDTQA

SEQ ID NO: 191877 - protein, 32 aa, Artificial Sequence
  Description of Artificial Sequence: Synthetic polypeptide
DSSEVASTNPVSYEGYGKVAAITIQSRVGGQR

SEQ ID NO: 191878 - protein, 39 aa, Artificial Sequence
  Description of Artificial Sequence: Synthetic polypeptide
DEEEIRTTNPVATEQYGQCVCSNSGEDHNQENFQSDTQA

SEQ ID NO: 191879 - protein, 38 aa, Artificial Sequence
  Description of Artificial Sequence: Synthetic polypeptide
DEEEIRTTNPVATEQYGQCVCSNSGEDHNQNFISETQN

SEQ ID NO: 191880 - protein, 39 aa, Artificial Sequence
  Description of Artificial Sequence: Synthetic polypeptide
DEEEIRTTNPVATEQYGQCVCSNSGEEHNIENFNSDTQS

SEQ ID NO: 191881 - protein, 39 aa, Artificial Sequence
  Description of Artificial Sequence: Synthetic polypeptide
DEEEIRTTNPVATEQYGQCVCSNSGEGHNQENFNSDTQP

SEQ ID NO: 191882 - protein, 34 aa, Artificial Sequence
  Description of Artificial Sequence: Synthetic polypeptide
DSSEVASTNPVSYEGYGNTVACNTISQSRTGQNR

SEQ ID NO: 191883 - protein, 34 aa, Artificial Sequence
  Description of Artificial Sequence: Synthetic polypeptide
DSSEVASTNPVSYEGYGNVAACTISQSRTGGSNR

SEQ ID NO: 191884 - protein, 34 aa, Artificial Sequence
  Description of Artificial Sequence: Synthetic polypeptide
DSSEVASTNPVSYEGYGNVAANTISQSRTVGQNR

SEQ ID NO: 191885 - protein, 33 aa, Artificial Sequence
  Description of Artificial Sequence: Synthetic polypeptide
DSSEVASTNPVSYEGYGNVACNTISQSRPVGQR

SEQ ID NO: 191886 - protein, 38 aa, Artificial Sequence
  Description of Artificial Sequence: Synthetic polypeptide
DDEEISTTNPVATEQYGQCVCSNWGEDNQENFGSDNQP

SEQ ID NO: 191887 - protein, 34 aa, Artificial Sequence
  Description of Artificial Sequence: Synthetic polypeptide
DSSEVASTNPVSYEGYGNVPACNTIQVRTGGQNR

SEQ ID NO: 191888 - protein, 38 aa, Artificial Sequence
  Description of Artificial Sequence: Synthetic polypeptide
DDEEISTTNPVATEQYGQCVCSNWGEDNAENFGSENQA

SEQ ID NO: 191889 - protein, 33 aa, Artificial Sequence
  Description of Artificial Sequence: Synthetic polypeptide
DSSEVASTNPVSYEGYGNVPACNTISQNRTGQR

SEQ ID NO: 191890 - protein, 39 aa, Artificial Sequence
  Description of Artificial Sequence: Synthetic polypeptide
DEEEIRTTNPVATEQYGQCVCSNSMEDHNAENFMSDNQS

SEQ ID NO: 191891 - protein, 39 aa, Artificial Sequence
  Description of Artificial Sequence: Synthetic polypeptide
DEEEIRTTNPVATEQYGQCVCSNSGEDHNQEFFNSDTQD

SEQ ID NO: 191892 - protein, 38 aa, Artificial Sequence
  Description of Artificial Sequence: Synthetic polypeptide
DEEEIRTTNPVATEQYGQCVCSMWGEHEAEYFNSETQS

SEQ ID NO: 191893 - protein, 34 aa, Artificial Sequence
  Description of Artificial Sequence: Synthetic polypeptide
DSSEVASTNPVSTEPYGTTVACNTISQSRTGGQR

SEQ ID NO: 191894 - protein, 34 aa, Artificial Sequence
  Description of Artificial Sequence: Synthetic polypeptide
DSSEVASTNPVSTEPYGQVACLTEISQSRTGGQR

SEQ ID NO: 191895 - protein, 37 aa, Artificial Sequence
  Description of Artificial Sequence: Synthetic polypeptide
DSNEIRTTNPVATEQYGSVCSVTWPIYIEDMFVEEGS

SEQ ID NO: 191896 - protein, 36 aa, Artificial Sequence
  Description of Artificial Sequence: Synthetic polypeptide
DSNEIRTTNPVATEQYGSVCTVTWPIYEDMFVEEKQ

SEQ ID NO: 191897 - protein, 39 aa, Artificial Sequence
  Description of Artificial Sequence: Synthetic polypeptide
DEEEIRTTNPVATEQYGQCVCSDWGEDHNQENFISENQA

SEQ ID NO: 191898 - protein, 36 aa, Artificial Sequence
  Description of Artificial Sequence: Synthetic polypeptide
CEEEIATTNPVATEQWGGCVAGNGELADNNSMNEGE

SEQ ID NO: 191899 - protein, 36 aa, Artificial Sequence
  Description of Artificial Sequence: Synthetic polypeptide
DEECIATTNPVAYEQWGQVACTNNGLQDDHHDTEKL

SEQ ID NO: 191900 - protein, 36 aa, Artificial Sequence
  Description of Artificial Sequence: Synthetic polypeptide
DAEEIATTNPVAYEQYGSACSVAPHLNEAPGGEAHH

SEQ ID NO: 191901 - protein, 35 aa, Artificial Sequence
  Description of Artificial Sequence: Synthetic polypeptide
DSQEIRTTNPVATECWGSFIGPCINEPEAREFENG

SEQ ID NO: 191902 - protein, 36 aa, Artificial Sequence
  Description of Artificial Sequence: Synthetic polypeptide
CEEEIATTNPVATEQWGGCVAGNGELADNNSDNNIE

SEQ ID NO: 191903 - protein, 35 aa, Artificial Sequence
  Description of Artificial Sequence: Synthetic polypeptide
DEMCISTTNPVATEQYGCVCSWGEHNAYFNSDTQS

SEQ ID NO: 191904 - protein, 37 aa, Artificial Sequence
  Description of Artificial Sequence: Synthetic polypeptide
DSSEIATTNPCATEQYGTVCSATGVEPSENFNGGNDF

SEQ ID NO: 191905 - protein, 37 aa, Artificial Sequence
  Description of Artificial Sequence: Synthetic polypeptide
DDEEISTTNPVATEQYGQCVCSWGEHNAENFNSDNQL

SEQ ID NO: 191906 - protein, 37 aa, Artificial Sequence
  Description of Artificial Sequence: Synthetic polypeptide
DDEEISTTNPVATEQYGQCVCSWGEHNAEGFNSDNQS

SEQ ID NO: 191907 - protein, 38 aa, Artificial Sequence
  Description of Artificial Sequence: Synthetic polypeptide
DDEEISTTNPVATEQYGQCVCSWGEDHNQENFGSDNQI

SEQ ID NO: 191908 - protein, 38 aa, Artificial Sequence
  Description of Artificial Sequence: Synthetic polypeptide
DDEEISTTNPVATEQYGQCVCSWGEDHNAEGFGSENQS

SEQ ID NO: 191909 - protein, 33 aa, Artificial Sequence
  Description of Artificial Sequence: Synthetic polypeptide
DSSELASTNPVSYEAYGNVACNTISQSRVGGQR

SEQ ID NO: 191910 - protein, 37 aa, Artificial Sequence
  Description of Artificial Sequence: Synthetic polypeptide
DDEEISTTNPVATEQYGQCVCSWEEHNAEHFISENQA

SEQ ID NO: 191911 - protein, 33 aa, Artificial Sequence
  Description of Artificial Sequence: Synthetic polypeptide
AEDEIACTNPVAYERWGEYYSIEGNDQRGPGES

SEQ ID NO: 191912 - protein, 39 aa, Artificial Sequence
  Description of Artificial Sequence: Synthetic polypeptide
DEEEIRTTNPVATEQYGQCVCSMWGEDHNAENFNSENQA

SEQ ID NO: 191913 - protein, 39 aa, Artificial Sequence
  Description of Artificial Sequence: Synthetic polypeptide
DEEEIRTTNPVATEQYGQCVCSMWGEDHNAEGFNSDTQS

SEQ ID NO: 191914 - protein, 34 aa, Artificial Sequence
  Description of Artificial Sequence: Synthetic polypeptide
DSSEVASTNPVSTEPYGNTVACNTISQSRVVGQR

SEQ ID NO: 191915 - protein, 33 aa, Artificial Sequence
  Description of Artificial Sequence: Synthetic polypeptide
DSSEVASTNPVSTEGYGNTVACNTISQSRTVQR

SEQ ID NO: 191916 - protein, 39 aa, Artificial Sequence
  Description of Artificial Sequence: Synthetic polypeptide
DEEEIRTTNPVATEQYGQCVCSMWEEDHNQENFGSETQA

SEQ ID NO: 191917 - protein, 34 aa, Artificial Sequence
  Description of Artificial Sequence: Synthetic polypeptide
DSSEVASTNPVSTEGYGNTVACNTHSQSRTGGQR

SEQ ID NO: 191918 - protein, 38 aa, Artificial Sequence
  Description of Artificial Sequence: Synthetic polypeptide
VEEEIRTTNPVATEQYGSVCQVLFEEHEGTTQGPPMME

SEQ ID NO: 191919 - protein, 34 aa, Artificial Sequence
  Description of Artificial Sequence: Synthetic polypeptide
DSSEVASTNPVSTEGYGNTVACITEISQSRTGQR

SEQ ID NO: 191920 - protein, 33 aa, Artificial Sequence
  Description of Artificial Sequence: Synthetic polypeptide
DSSEVASTNPVSTEAYGNVACNTISQSTTGGQR

SEQ ID NO: 191921 - protein, 34 aa, Artificial Sequence
  Description of Artificial Sequence: Synthetic polypeptide
DSSEVASTNPVSTEAYGNVACFTEISQSRTGGQR

SEQ ID NO: 191922 - protein, 40 aa, Artificial Sequence
  Description of Artificial Sequence: Synthetic polypeptide
DEEEIRTTNPVATEFYGQVMEQSTETNDQVGQGDGGQDQE

SEQ ID NO: 191923 - protein, 33 aa, Artificial Sequence
  Description of Artificial Sequence: Synthetic polypeptide
DSSEVAPTNPVSYEAYGNVACNTISQSRTGGQR

SEQ ID NO: 191924 - protein, 34 aa, Artificial Sequence
  Description of Artificial Sequence: Synthetic polypeptide
DSSEVACTNPVSTEGYGNVCYNTIDQSRHGMGGR

SEQ ID NO: 191925 - protein, 34 aa, Artificial Sequence
  Description of Artificial Sequence: Synthetic polypeptide
DSSEVACTNPVSTEGYGNVCYNTDIQSRQGDQDR

SEQ ID NO: 191926 - protein, 34 aa, Artificial Sequence
  Description of Artificial Sequence: Synthetic polypeptide
DSSEVASTNPVSTEGYGKVACNTEISQSRTGGQR

SEQ ID NO: 191927 - protein, 39 aa, Artificial Sequence
  Description of Artificial Sequence: Synthetic polypeptide
DEEEIRTTNPVATEQYGQCVCSNWGEDHNAEGFNSDTQA

SEQ ID NO: 191928 - protein, 39 aa, Artificial Sequence
  Description of Artificial Sequence: Synthetic polypeptide
DEEEIRTTNPVATEQYGQCVCSNTEEDHNQENFPSDTQP

SEQ ID NO: 191929 - protein, 39 aa, Artificial Sequence
  Description of Artificial Sequence: Synthetic polypeptide
DEEEIRTTNPVATEQYGQCVCSNTGEDHEQENFISETQN

SEQ ID NO: 191930 - protein, 38 aa, Artificial Sequence
  Description of Artificial Sequence: Synthetic polypeptide
DEAEIRTTNPVATEQYGCVCSNWGEDHNAENFNSDNQS

SEQ ID NO: 191931 - protein, 38 aa, Artificial Sequence
  Description of Artificial Sequence: Synthetic polypeptide
DEAEIRTTNPVATEQYGCVCSNWGEDDNQENFNSDTQA

SEQ ID NO: 191932 - protein, 35 aa, Artificial Sequence
  Description of Artificial Sequence: Synthetic polypeptide
SEEEIRCTNPIATEQYGCVCSNWGEHNAYFNSDQS

SEQ ID NO: 191933 - protein, 35 aa, Artificial Sequence
  Description of Artificial Sequence: Synthetic polypeptide
SEEEIRCTNPIATEQYGCVCSNWGEHANFGSDTQA

SEQ ID NO: 191934 - protein, 36 aa, Artificial Sequence
  Description of Artificial Sequence: Synthetic polypeptide
SEEEIRCTNPIATEQYGCVCSNWGEDNAENFNSDQS

SEQ ID NO: 191935 - protein, 38 aa, Artificial Sequence
  Description of Artificial Sequence: Synthetic polypeptide
DEAEIRTTNPVATEQYGCVCSNWEEDHNAENFNSDNQA

SEQ ID NO: 191936 - protein, 33 aa, Artificial Sequence
  Description of Artificial Sequence: Synthetic polypeptide
DEESIACTNPVATASWGCVAGTGENGPDDQNPD

SEQ ID NO: 191937 - protein, 37 aa, Artificial Sequence
  Description of Artificial Sequence: Synthetic polypeptide
DEECIRCTNPVATEQYGQCVCSNWGEDNANFNSDNQS

SEQ ID NO: 191938 - protein, 38 aa, Artificial Sequence
  Description of Artificial Sequence: Synthetic polypeptide
DEECIRCTNPVATEQYGQCVCSWGEDDNIENFGSDNQS

SEQ ID NO: 191939 - protein, 38 aa, Artificial Sequence
  Description of Artificial Sequence: Synthetic polypeptide
DEAEIRTTNPVATEQYGCVCSNSGEDHNAENFNSETQA

SEQ ID NO: 191940 - protein, 38 aa, Artificial Sequence
  Description of Artificial Sequence: Synthetic polypeptide
DEAEIRTTNPVATEQYGCVCSNSGEDHNAENFNSDNQS

SEQ ID NO: 191941 - protein, 34 aa, Artificial Sequence
  Description of Artificial Sequence: Synthetic polypeptide
AEDEIACTNPVAYEQWGYAQIEGNDRQRDGSGER

SEQ ID NO: 191942 - protein, 37 aa, Artificial Sequence
  Description of Artificial Sequence: Synthetic polypeptide
DDECIRCTNPVATEQYGCSCSNWGEHNQENFGSDNQA

SEQ ID NO: 191943 - protein, 33 aa, Artificial Sequence
  Description of Artificial Sequence: Synthetic polypeptide
DDSEVASTNPVSTEGYGCVCGASTIQERFGSQQ

SEQ ID NO: 191944 - protein, 38 aa, Artificial Sequence
  Description of Artificial Sequence: Synthetic polypeptide
DEECIRCTNPVATEQYGCVCSNWGEGHNQEYFGSDNQS

SEQ ID NO: 191945 - protein, 36 aa, Artificial Sequence
  Description of Artificial Sequence: Synthetic polypeptide
DESEIRTTNPVATEGWGCVCSWMEENQEHFNSDNQA

SEQ ID NO: 191946 - protein, 36 aa, Artificial Sequence
  Description of Artificial Sequence: Synthetic polypeptide
CETEIACTNPVATEQYGSACAANPQGGEHQDGNAAQ

SEQ ID NO: 191947 - protein, 35 aa, Artificial Sequence
  Description of Artificial Sequence: Synthetic polypeptide
CETEIACTNPVATEQYGSACAANPQGEHQDGEAHQ

SEQ ID NO: 191948 - protein, 36 aa, Artificial Sequence
  Description of Artificial Sequence: Synthetic polypeptide
AENEEIASTNPVAYEQWGWVSTGGNAGEHQDHGDPS

SEQ ID NO: 191949 - protein, 39 aa, Artificial Sequence
  Description of Artificial Sequence: Synthetic polypeptide
DEEEIRTTNPVATEQYGQCVCSNWGEDDEQENFNSETQA

SEQ ID NO: 191950 - protein, 39 aa, Artificial Sequence
  Description of Artificial Sequence: Synthetic polypeptide
DEEEIRTTNPVATEQYGQCVCSNWGEDDNAENFNSDNQS

SEQ ID NO: 191951 - protein, 39 aa, Artificial Sequence
  Description of Artificial Sequence: Synthetic polypeptide
DEEEIRTTNPVATEQYGQCVCSNWGEDDNEENFNSDTQA

SEQ ID NO: 191952 - protein, 39 aa, Artificial Sequence
  Description of Artificial Sequence: Synthetic polypeptide
DEEEIRTTNPVATEQYGQCVCSNWGEDDNQENFNSDTQS

SEQ ID NO: 191953 - protein, 39 aa, Artificial Sequence
  Description of Artificial Sequence: Synthetic polypeptide
DEEEIRTTNPVATEQYGQCVCSNWGEDDNQEYFNSDTQS

SEQ ID NO: 191954 - protein, 36 aa, Artificial Sequence
  Description of Artificial Sequence: Synthetic polypeptide
DESEIRTTNPVATEGWGCVCSWMEENIENFISDNQA

SEQ ID NO: 191955 - protein, 38 aa, Artificial Sequence
  Description of Artificial Sequence: Synthetic polypeptide
DEEEIRTTNPVATEQYGQCVCSNWGEDHEINFGSETQN

SEQ ID NO: 191956 - protein, 39 aa, Artificial Sequence
  Description of Artificial Sequence: Synthetic polypeptide
DEEEIRTTNPVATEQYGQCVCSNWGEDHEQEGFISDTQA

SEQ ID NO: 191957 - protein, 39 aa, Artificial Sequence
  Description of Artificial Sequence: Synthetic polypeptide
DEEEIRTTNPVATEQYGQCVCSNWGEDHEQENFNSQTQS

SEQ ID NO: 191958 - protein, 39 aa, Artificial Sequence
  Description of Artificial Sequence: Synthetic polypeptide
DEEEIRTTNPVATEQYGQCVCSNWGEDHNAEFFGSETQS

SEQ ID NO: 191959 - protein, 39 aa, Artificial Sequence
  Description of Artificial Sequence: Synthetic polypeptide
DEEEIRTTNPVATEQYGQCVCSNWGEDHNAEFFNSDNQA

SEQ ID NO: 191960 - protein, 38 aa, Artificial Sequence
  Description of Artificial Sequence: Synthetic polypeptide
DEEEIRTTNPVAYEQYGQCVCSNWGEHNTESFNSDNQA

SEQ ID NO: 191961 - protein, 37 aa, Artificial Sequence
  Description of Artificial Sequence: Synthetic polypeptide
DEECIRCTNPVATEQYGCVCSNWGEDNQENFGSDTAS

SEQ ID NO: 191962 - protein, 37 aa, Artificial Sequence
  Description of Artificial Sequence: Synthetic polypeptide
DEECIRCTNPVATEQWGCVCQNWGEHNQEGFGSDNQS

SEQ ID NO: 191963 - protein, 33 aa, Artificial Sequence
  Description of Artificial Sequence: Synthetic polypeptide
DEESIACTNPVATASWGCVAGTGELAIDNSNMV

SEQ ID NO: 191964 - protein, 38 aa, Artificial Sequence
  Description of Artificial Sequence: Synthetic polypeptide
YEEEIKTTNPAATEQYGSVSVGQDEQNSGQNGGQEGIT

SEQ ID NO: 191965 - protein, 37 aa, Artificial Sequence
  Description of Artificial Sequence: Synthetic polypeptide
SEEEIRCTNPIATEQYGQCVCSWGEHNAENFGSNTQS

SEQ ID NO: 191966 - protein, 37 aa, Artificial Sequence
  Description of Artificial Sequence: Synthetic polypeptide
CEEEIATTNPVATEQWGGCTCTAAAGNHLDDGMHNHF

SEQ ID NO: 191967 - protein, 39 aa, Artificial Sequence
  Description of Artificial Sequence: Synthetic polypeptide
DEEEIRTTNPVATEQYGQCVCSNTGEDHNQENFISDTQA

SEQ ID NO: 191968 - protein, 37 aa, Artificial Sequence
  Description of Artificial Sequence: Synthetic polypeptide
DDEEISTTNPVATEQYGQCVCGSGEHNAENFNSDTQS

SEQ ID NO: 191969 - protein, 37 aa, Artificial Sequence
  Description of Artificial Sequence: Synthetic polypeptide
DDEEISTTNPVATEQYGQCVCGNSGEHNQNFGSDTQS

SEQ ID NO: 191970 - protein, 32 aa, Artificial Sequence
  Description of Artificial Sequence: Synthetic polypeptide
DSTDIATTNPVATEQWGGCVAGEGHAPAPGHL

SEQ ID NO: 191971 - protein, 33 aa, Artificial Sequence
  Description of Artificial Sequence: Synthetic polypeptide
DSTDIATTNPVATEQWGGCVAGEGHQPAPMGLE

SEQ ID NO: 191972 - protein, 37 aa, Artificial Sequence
  Description of Artificial Sequence: Synthetic polypeptide
DSWEIGTTNPVATEAYGSTVCSDQPEPSTNPGGNQGK

SEQ ID NO: 191973 - protein, 37 aa, Artificial Sequence
  Description of Artificial Sequence: Synthetic polypeptide
DDEEISTTNPVATEQYGCVCSWGEDHNAENFNSDTQV

SEQ ID NO: 191974 - protein, 37 aa, Artificial Sequence
  Description of Artificial Sequence: Synthetic polypeptide
DDEEISTTNPVATEQYGCVCSWGEDHNAENFNSDPQS

SEQ ID NO: 191975 - protein, 35 aa, Artificial Sequence
  Description of Artificial Sequence: Synthetic polypeptide
AENEIACTNPVATEGYGCSCSWGEHNAHFGSDNQA

SEQ ID NO: 191976 - protein, 38 aa, Artificial Sequence
  Description of Artificial Sequence: Synthetic polypeptide
DDEEISTTNPVATEQYGCVCSTWGEDHNTENFNSDTQS

SEQ ID NO: 191977 - protein, 36 aa, Artificial Sequence
  Description of Artificial Sequence: Synthetic polypeptide
DENEIRTTNPVATEQWGICVCSSGEHNANASISDAA

SEQ ID NO: 191978 - protein, 36 aa, Artificial Sequence
  Description of Artificial Sequence: Synthetic polypeptide
DTAEIRTTNPVATEQYGCWYNAVEHLSVQDSLEEQN

SEQ ID NO: 191979 - protein, 38 aa, Artificial Sequence
  Description of Artificial Sequence: Synthetic polypeptide
DTAEIRTTNPVATEQYGSAIPRTPPLEENQDHQSEERP

SEQ ID NO: 191980 - protein, 39 aa, Artificial Sequence
  Description of Artificial Sequence: Synthetic polypeptide
DEEEIRTTNPVATEQYGQCVCSNWEEDHNAEFFNSDTQL

SEQ ID NO: 191981 - protein, 32 aa, Artificial Sequence
  Description of Artificial Sequence: Synthetic polypeptide
DEESIACTNPVATASWGCVAGPAGELADNSNM

SEQ ID NO: 191982 - protein, 38 aa, Artificial Sequence
  Description of Artificial Sequence: Synthetic polypeptide
DEEEIRTTNPVATEQYGQCVCSNWEEHNIENFISDTQS

SEQ ID NO: 191983 - protein, 35 aa, Artificial Sequence
  Description of Artificial Sequence: Synthetic polypeptide
SEEEIRCTNPIATEQYGCVCSWGEDAENFGSDTQS

SEQ ID NO: 191984 - protein, 34 aa, Artificial Sequence
  Description of Artificial Sequence: Synthetic polypeptide
AENEIACTNPVATEAYGCSCSWEHNQNFGSQTQS

SEQ ID NO: 191985 - protein, 36 aa, Artificial Sequence
  Description of Artificial Sequence: Synthetic polypeptide
DENEIRTTNPVATEQWGDVVDNEEGEEMNAGEDGAE

SEQ ID NO: 191986 - protein, 36 aa, Artificial Sequence
  Description of Artificial Sequence: Synthetic polypeptide
DENEIRTTNPVATEQWGDVVNEEGEEMNAGEGDGDG

SEQ ID NO: 191987 - protein, 38 aa, Artificial Sequence
  Description of Artificial Sequence: Synthetic polypeptide
DEQEIRTTNPVATEGYGVVVMSVNDNNTGGGQTGQVGD

SEQ ID NO: 191988 - protein, 34 aa, Artificial Sequence
  Description of Artificial Sequence: Synthetic polypeptide
DEESIACTNPVATAQWGAVASGHGPLGAPLGSAE

SEQ ID NO: 191989 - protein, 35 aa, Artificial Sequence
  Description of Artificial Sequence: Synthetic polypeptide
DTEEIAATNPVAYEQWGCSYQNIDNDRQNGRQDRK

SEQ ID NO: 191990 - protein, 36 aa, Artificial Sequence
  Description of Artificial Sequence: Synthetic polypeptide
DENEIRTTNPVATEQWGEVDNEEGEEMGDGNGDGEQ

SEQ ID NO: 191991 - protein, 39 aa, Artificial Sequence
  Description of Artificial Sequence: Synthetic polypeptide
DEEEIRTTNPVATEQYGQCVCSNWEEDHNQENFGSDTQS

SEQ ID NO: 191992 - protein, 38 aa, Artificial Sequence
  Description of Artificial Sequence: Synthetic polypeptide
DEEEIRTTNPVATEQYGQCVCSNWEEDHNINFNSDPQA

SEQ ID NO: 191993 - protein, 39 aa, Artificial Sequence
  Description of Artificial Sequence: Synthetic polypeptide
DEEEIRTTNPVATEQYGQCVCSNWEEDHNAENFNSDTQA

SEQ ID NO: 191994 - protein, 39 aa, Artificial Sequence
  Description of Artificial Sequence: Synthetic polypeptide
DEEEIRTTNPVATEQYGQCVCSNWEEDHNAEFFNSDTQP

SEQ ID NO: 191995 - protein, 35 aa, Artificial Sequence
  Description of Artificial Sequence: Synthetic polypeptide
DTEEIAATNPVAYEQWGCSYQNIDQDRQMGRQDRA

SEQ ID NO: 191996 - protein, 37 aa, Artificial Sequence
  Description of Artificial Sequence: Synthetic polypeptide
DEEEISTTNPVATEQYGQCVCSNWGEHNASFNSETQI

SEQ ID NO: 191997 - protein, 37 aa, Artificial Sequence
  Description of Artificial Sequence: Synthetic polypeptide
SEGEIATTNPVATEQYGSVCSPMPNQNNEAMIGDGHN

SEQ ID NO: 191998 - protein, 38 aa, Artificial Sequence
  Description of Artificial Sequence: Synthetic polypeptide
DEEEISTTNPVATEQYGQCVCSNWGEHNAEYFNSDTQA

SEQ ID NO: 191999 - protein, 32 aa, Artificial Sequence
  Description of Artificial Sequence: Synthetic polypeptide
DETEIAPTNPCATECWGATWAAEDLQPKGPYI

SEQ ID NO: 192000 - protein, 33 aa, Artificial Sequence
  Description of Artificial Sequence: Synthetic polypeptide
DETEIAPTNPIATECYGAVWAAENWAEPKGPYI

SEQ ID NO: 192001 - protein, 38 aa, Artificial Sequence
  Description of Artificial Sequence: Synthetic polypeptide
DEEEISTTNPVATEQYGCVCGNWGELHNAENFNSETQS

SEQ ID NO: 192002 - protein, 32 aa, Artificial Sequence
  Description of Artificial Sequence: Synthetic polypeptide
DETEIASTNPIATECWGATMANSTLAPKGPYI

SEQ ID NO: 192003 - protein, 32 aa, Artificial Sequence
  Description of Artificial Sequence: Synthetic polypeptide
DETEIASTNPIATECWGATTANSDLAPKGPYI

SEQ ID NO: 192004 - protein, 39 aa, Artificial Sequence
  Description of Artificial Sequence: Synthetic polypeptide
DEEEIRTTNPVAYEQYGICVCSTWGADDNAEYFNSDPQS

SEQ ID NO: 192005 - protein, 32 aa, Artificial Sequence
  Description of Artificial Sequence: Synthetic polypeptide
DETEIASTNPIATECWGATTANSTLAPKGPYI

SEQ ID NO: 192006 - protein, 32 aa, Artificial Sequence
  Description of Artificial Sequence: Synthetic polypeptide
DETEIASTNPICTECYGVVWSADWAESKGPYI

SEQ ID NO: 192007 - protein, 33 aa, Artificial Sequence
  Description of Artificial Sequence: Synthetic polypeptide
DDSEVACTNPVSTEGYGNVCYNTDIQSRVDQHR

SEQ ID NO: 192008 - protein, 37 aa, Artificial Sequence
  Description of Artificial Sequence: Synthetic polypeptide
DEEEISTTNPVATEQYGCVCGWGEDHNQENFNSDTQS

SEQ ID NO: 192009 - protein, 37 aa, Artificial Sequence
  Description of Artificial Sequence: Synthetic polypeptide
DEEEISTTNPVATEQYGCVCGWGEDHNQENSNSETQS

SEQ ID NO: 192010 - protein, 34 aa, Artificial Sequence
  Description of Artificial Sequence: Synthetic polypeptide
DEDEIATTNPVATASWGCVAAANTEDTDNGGENH

SEQ ID NO: 192011 - protein, 36 aa, Artificial Sequence
  Description of Artificial Sequence: Synthetic polypeptide
DEDEIATTNPVATASWGCVAAANNIEPQDRGGENDG

SEQ ID NO: 192012 - protein, 37 aa, Artificial Sequence
  Description of Artificial Sequence: Synthetic polypeptide
DESEIRTTNPVATEQYGYSVPYQTDEETITPSIEEMP

SEQ ID NO: 192013 - protein, 36 aa, Artificial Sequence
  Description of Artificial Sequence: Synthetic polypeptide
DATEIATTNPVAYEQWGSARCTENNDQDDLHNMDPR

SEQ ID NO: 192014 - protein, 38 aa, Artificial Sequence
  Description of Artificial Sequence: Synthetic polypeptide
DEEEIRTTNPVAYEQYGQCVCPNWEEHNQEFFNSDTQS

SEQ ID NO: 192015 - protein, 37 aa, Artificial Sequence
  Description of Artificial Sequence: Synthetic polypeptide
QEEEIRTTNPVATEQYGMVSVEGMGDGGQGQEAETME

SEQ ID NO: 192016 - protein, 35 aa, Artificial Sequence
  Description of Artificial Sequence: Synthetic polypeptide
DETEIATTNPCAYEHWGSVATPNGNQQLEDEHGGH

SEQ ID NO: 192017 - protein, 38 aa, Artificial Sequence
  Description of Artificial Sequence: Synthetic polypeptide
DEEEISTTNPVATEQYGCVCPNWGEDDNQENFNSDNQS

SEQ ID NO: 192018 - protein, 38 aa, Artificial Sequence
  Description of Artificial Sequence: Synthetic polypeptide
DEEEISTTNPVATEQYGCVCPNWGEDHEQENFNSDNQN

SEQ ID NO: 192019 - protein, 36 aa, Artificial Sequence
  Description of Artificial Sequence: Synthetic polypeptide
DEDEIATTNPVATASWGCVAAANNEVQDRGGELDNN

SEQ ID NO: 192020 - protein, 36 aa, Artificial Sequence
  Description of Artificial Sequence: Synthetic polypeptide
DATEIATTNPVAYEQWGSARCTENNDQHDLHNNDMR

SEQ ID NO: 192021 - protein, 37 aa, Artificial Sequence
  Description of Artificial Sequence: Synthetic polypeptide
DEEEISTTNPVATEQYGCVCPWGEDHNQENFNSDTQS

SEQ ID NO: 192022 - protein, 37 aa, Artificial Sequence
  Description of Artificial Sequence: Synthetic polypeptide
DEEEISTTNPVATEQYGCVCQDWGEHNQENFNSDNQS

SEQ ID NO: 192023 - protein, 38 aa, Artificial Sequence
  Description of Artificial Sequence: Synthetic polypeptide
DEEEISTTNPVATEQYGCVCQNSGEDHNAEFFNSDTQS

SEQ ID NO: 192024 - protein, 37 aa, Artificial Sequence
  Description of Artificial Sequence: Synthetic polypeptide
QEEEIRTTNPVATEQYGMVSVEGMGDGGQGQEAQEGA

SEQ ID NO: 192025 - protein, 38 aa, Artificial Sequence
  Description of Artificial Sequence: Synthetic polypeptide
DEEEISTTNPVATEQYGCVCQNWGEDHNQENFNSDTQG

SEQ ID NO: 192026 - protein, 37 aa, Artificial Sequence
  Description of Artificial Sequence: Synthetic polypeptide
DEEEISTTNPVATEQYGCVCQNWGEHNAENFISENQP

SEQ ID NO: 192027 - protein, 37 aa, Artificial Sequence
  Description of Artificial Sequence: Synthetic polypeptide
DEEEISTTNPVATEQYGCVCQNWGEHNIENFNSDNQA

SEQ ID NO: 192028 - protein, 37 aa, Artificial Sequence
  Description of Artificial Sequence: Synthetic polypeptide
DEEEISTTNPVATEQYGCVCQNWGEHNQENFFSETQS

SEQ ID NO: 192029 - protein, 38 aa, Artificial Sequence
  Description of Artificial Sequence: Synthetic polypeptide
DEEEIRTTNPVAYEQYGQCVCSMWEEHNQEHFNSDFQS

SEQ ID NO: 192030 - protein, 37 aa, Artificial Sequence
  Description of Artificial Sequence: Synthetic polypeptide
DETEIACTNPVAYEQYGSVWAITNGEEAPGNQMEGAH

SEQ ID NO: 192031 - protein, 36 aa, Artificial Sequence
  Description of Artificial Sequence: Synthetic polypeptide
DETEIACTNPVAYEQYGSVCSVAPHLNEAPGGEAAL

SEQ ID NO: 192032 - protein, 37 aa, Artificial Sequence
  Description of Artificial Sequence: Synthetic polypeptide
DEEEISTTNPVATEQYGCVCGNWGEHNIENFNSETQA

SEQ ID NO: 192033 - protein, 34 aa, Artificial Sequence
  Description of Artificial Sequence: Synthetic polypeptide
DDSEVACTNPVSTEGYGNVCYNTDQQSRDGDQER

SEQ ID NO: 192034 - protein, 35 aa, Artificial Sequence
  Description of Artificial Sequence: Synthetic polypeptide
AEEEIATTNPVAYEPYRGQEVAINEGSTSMPGAPR

SEQ ID NO: 192035 - protein, 32 aa, Artificial Sequence
  Description of Artificial Sequence: Synthetic polypeptide
AEEEIATTNPVAYEQWGEAYYPEQQPIEEHGE

SEQ ID NO: 192036 - protein, 36 aa, Artificial Sequence
  Description of Artificial Sequence: Synthetic polypeptide
DETEIACTNPVATEQYGSVCAANNGDENGMDIITFA

SEQ ID NO: 192037 - protein, 36 aa, Artificial Sequence
  Description of Artificial Sequence: Synthetic polypeptide
AEEEIATTNPVAYEQWGEVCSTPNQGNHGEAGDGAN

SEQ ID NO: 192038 - protein, 35 aa, Artificial Sequence
  Description of Artificial Sequence: Synthetic polypeptide
AEEEIATTNPVAYEQWGHCNVAANNGDTDSGGNPP

SEQ ID NO: 192039 - protein, 36 aa, Artificial Sequence
  Description of Artificial Sequence: Synthetic polypeptide
DENEISTTNPVATEQWGCVTSWMEENTENFISDTAS

SEQ ID NO: 192040 - protein, 36 aa, Artificial Sequence
  Description of Artificial Sequence: Synthetic polypeptide
DENEISTTNPVATEQWGCVTSNSEENANNFNSDTAA

SEQ ID NO: 192041 - protein, 37 aa, Artificial Sequence
  Description of Artificial Sequence: Synthetic polypeptide
VETEIRCTNPVATEIYGSVVSANMNEFDNQGGGGEQE

SEQ ID NO: 192042 - protein, 35 aa, Artificial Sequence
  Description of Artificial Sequence: Synthetic polypeptide
DATEIATTNPVAYEQWGSARCTENNDQDDLHGDHI

SEQ ID NO: 192043 - protein, 36 aa, Artificial Sequence
  Description of Artificial Sequence: Synthetic polypeptide
AEEEIATTNPVAYEQYGCSCPSGEDNQEHFNSETQA

SEQ ID NO: 192044 - protein, 34 aa, Artificial Sequence
  Description of Artificial Sequence: Synthetic polypeptide
AEEEIATTNPVAYEQYGCYCPWEDNQHFNSETQA

SEQ ID NO: 192045 - protein, 36 aa, Artificial Sequence
  Description of Artificial Sequence: Synthetic polypeptide
DETEIACTNPVATEQYGSVCWVEPGEATEDGTGAFP

SEQ ID NO: 192046 - protein, 37 aa, Artificial Sequence
  Description of Artificial Sequence: Synthetic polypeptide
AEEEIATTNPVAYEQYGSACAAVATGVNTAGGDTMAW

SEQ ID NO: 192047 - protein, 37 aa, Artificial Sequence
  Description of Artificial Sequence: Synthetic polypeptide
DEEEISTTNPVATEQYGCTCSMWEEDDNQENIGSDQA

SEQ ID NO: 192048 - protein, 36 aa, Artificial Sequence
  Description of Artificial Sequence: Synthetic polypeptide
DETEIACTNPVATEQYGSVPANTGHGEYGAEGMGSN

SEQ ID NO: 192049 - protein, 35 aa, Artificial Sequence
  Description of Artificial Sequence: Synthetic polypeptide
DENEISTTNPVATEQWGCVCSSGEENANNSSSDAA

SEQ ID NO: 192050 - protein, 37 aa, Artificial Sequence
  Description of Artificial Sequence: Synthetic polypeptide
TEEEIRTTNPVAYEQYGCVCGNWGEHNQEYFGSDTQA

SEQ ID NO: 192051 - protein, 37 aa, Artificial Sequence
  Description of Artificial Sequence: Synthetic polypeptide
DEEEISTTNPVATEQYGCVCGNWGEHNIENFGSEFQG

SEQ ID NO: 192052 - protein, 37 aa, Artificial Sequence
  Description of Artificial Sequence: Synthetic polypeptide
DEEEISTTNPVATEQYGCVCGNWGEHNAENFNSDTQS

SEQ ID NO: 192053 - protein, 38 aa, Artificial Sequence
  Description of Artificial Sequence: Synthetic polypeptide
DEEEISTTNPVATEQYGCVCGNWGEDPNQENFNSETQP

SEQ ID NO: 192054 - protein, 38 aa, Artificial Sequence
  Description of Artificial Sequence: Synthetic polypeptide
DEEEISTTNPVATEQYGCVCGNWGEDHNQENFGSDTQS

SEQ ID NO: 192055 - protein, 37 aa, Artificial Sequence
  Description of Artificial Sequence: Synthetic polypeptide
DETEIACTNPVAYEQYGSVAAIMNYEEAPGNQMEKRP

SEQ ID NO: 192056 - protein, 34 aa, Artificial Sequence
  Description of Artificial Sequence: Synthetic polypeptide
DETEIATTNPIATECWGATTANAEDLQEPKGPYI

SEQ ID NO: 192057 - protein, 38 aa, Artificial Sequence
  Description of Artificial Sequence: Synthetic polypeptide
DEEEISTTNPVATEQYGCVCGNSGEDHNAENFNSDTQA

SEQ ID NO: 192058 - protein, 35 aa, Artificial Sequence
  Description of Artificial Sequence: Synthetic polypeptide
DETEIACTNPVAYEQYGSACAMNHGNNEMGNGQDD

SEQ ID NO: 192059 - protein, 37 aa, Artificial Sequence
  Description of Artificial Sequence: Synthetic polypeptide
AEEEICTTNPVATEAYGVVATVNEQQGTQQGTEDEEF

SEQ ID NO: 192060 - protein, 33 aa, Artificial Sequence
  Description of Artificial Sequence: Synthetic polypeptide
DETEIACTNPVAYEQWGSACAAANGLDSEVDDS

SEQ ID NO: 192061 - protein, 37 aa, Artificial Sequence
  Description of Artificial Sequence: Synthetic polypeptide
DEEEISTTNPVATEQYGCTCSNWGEHNAENFSSDNQA

SEQ ID NO: 192062 - protein, 34 aa, Artificial Sequence
  Description of Artificial Sequence: Synthetic polypeptide
DETEIACTNPVAYEQWGHSASLAGMGQAEDPNEN

SEQ ID NO: 192063 - protein, 37 aa, Artificial Sequence
  Description of Artificial Sequence: Synthetic polypeptide
DEEEISTTNPVATEQYGCTCSMWEEPNAEYINSDTQS

SEQ ID NO: 192064 - protein, 40 aa, Artificial Sequence
  Description of Artificial Sequence: Synthetic polypeptide
AEEEICTTNPVATEQYGTVSTTNNTEQGTEQYGSTTDQND

SEQ ID NO: 192065 - protein, 38 aa, Artificial Sequence
  Description of Artificial Sequence: Synthetic polypeptide
DENEISTTNPVATEQYGCVCSMTGEEHNQENFNSDNQS

SEQ ID NO: 192066 - protein, 35 aa, Artificial Sequence
  Description of Artificial Sequence: Synthetic polypeptide
DEDEIATTNPVATASWGCVAAANNEPTDRGGENGN

SEQ ID NO: 192067 - protein, 35 aa, Artificial Sequence
  Description of Artificial Sequence: Synthetic polypeptide
DEDEIATTNPVATASWGCVAAANNEPTDRGGENDI

SEQ ID NO: 192068 - protein, 38 aa, Artificial Sequence
  Description of Artificial Sequence: Synthetic polypeptide
AEEEICTTNPVATEQYGVVATVNNQQGEQQGTEDETEE

SEQ ID NO: 192069 - protein, 39 aa, Artificial Sequence
  Description of Artificial Sequence: Synthetic polypeptide
DEEEIRTTNPVAYEQYGQCVCSNSEEDHNQENFGSDNQA

SEQ ID NO: 192070 - protein, 34 aa, Artificial Sequence
  Description of Artificial Sequence: Synthetic polypeptide
DETEIATTNPIATECWGAVWANAENLAESKGPYI

SEQ ID NO: 192071 - protein, 38 aa, Artificial Sequence
  Description of Artificial Sequence: Synthetic polypeptide
AEEEICTTNPVATEQYGVVATVNNQQGEQQLGTEDEEG

SEQ ID NO: 192072 - protein, 36 aa, Artificial Sequence
  Description of Artificial Sequence: Synthetic polypeptide
DENEISTTNPVATEGYGCVCSWGEHNQEYFNSDTQS

SEQ ID NO: 192073 - protein, 39 aa, Artificial Sequence
  Description of Artificial Sequence: Synthetic polypeptide
DEEEIRTTNPVATEAYGTVSTTIGTTEQGSTNDEQAEED

SEQ ID NO: 192074 - protein, 37 aa, Artificial Sequence
  Description of Artificial Sequence: Synthetic polypeptide
AEEAIRTTNPVATEQYGCVCSNWGEHNQENFNSDTQS

SEQ ID NO: 192075 - protein, 33 aa, Artificial Sequence
  Description of Artificial Sequence: Synthetic polypeptide
DETEIATTNPIATECWGVTMWANAEDWQEPGPI

SEQ ID NO: 192076 - protein, 32 aa, Artificial Sequence
  Description of Artificial Sequence: Synthetic polypeptide
DETEIATTNPIATECYGATAAEDLAEPKEPYL

SEQ ID NO: 192077 - protein, 34 aa, Artificial Sequence
  Description of Artificial Sequence: Synthetic polypeptide
DETEIATTNPIATECYGATTWANADLAEPKGTYI

SEQ ID NO: 192078 - protein, 37 aa, Artificial Sequence
  Description of Artificial Sequence: Synthetic polypeptide
DEEEIRTTNPVSTEQYGQCVCGMWGEHNQGFGSQTQS

SEQ ID NO: 192079 - protein, 33 aa, Artificial Sequence
  Description of Artificial Sequence: Synthetic polypeptide
DETEIATTNPIATECYGATTWSNACWAEPKGPL

SEQ ID NO: 192080 - protein, 33 aa, Artificial Sequence
  Description of Artificial Sequence: Synthetic polypeptide
DETEIATTNPIATECYGATTWSNADWAEPKGPL

SEQ ID NO: 192081 - protein, 35 aa, Artificial Sequence
  Description of Artificial Sequence: Synthetic polypeptide
DETEIATTNPIATECYGATTWSNTEDLEEHKGPYI

SEQ ID NO: 192082 - protein, 39 aa, Artificial Sequence
  Description of Artificial Sequence: Synthetic polypeptide
DEEEIRTTNPVSTEQYGQCVCGNWGEDHNQEGFNSQTQS

SEQ ID NO: 192083 - protein, 35 aa, Artificial Sequence
  Description of Artificial Sequence: Synthetic polypeptide
DETEIATTNPIATECYGATTWSNTEDLEEPKGPYI

SEQ ID NO: 192084 - protein, 36 aa, Artificial Sequence
  Description of Artificial Sequence: Synthetic polypeptide
DEEEIATTNPVAYEQWGGCACAGNNGLDTQMGDSDI

SEQ ID NO: 192085 - protein, 35 aa, Artificial Sequence
  Description of Artificial Sequence: Synthetic polypeptide
DEDEIATTNPVATASWGCVAAANNEDTDRGVENNN

SEQ ID NO: 192086 - protein, 34 aa, Artificial Sequence
  Description of Artificial Sequence: Synthetic polypeptide
DETEIATTNPIATECYGSTVANAEDWADHEGEYL

SEQ ID NO: 192087 - protein, 34 aa, Artificial Sequence
  Description of Artificial Sequence: Synthetic polypeptide
DETEIATTNPIATECYGSTVANAEDWADPEGEYI

SEQ ID NO: 192088 - protein, 34 aa, Artificial Sequence
  Description of Artificial Sequence: Synthetic polypeptide
DETEIATTNPIATECYGSTVANAEDWADPEGEYL

SEQ ID NO: 192089 - protein, 37 aa, Artificial Sequence
  Description of Artificial Sequence: Synthetic polypeptide
DEEEISTTNPVATEQYGCVCSMWEEHNAENFISDTQP

SEQ ID NO: 192090 - protein, 35 aa, Artificial Sequence
  Description of Artificial Sequence: Synthetic polypeptide
DETEIATTNPIATECYGSTVWANAEDWADPEGEYI

SEQ ID NO: 192091 - protein, 33 aa, Artificial Sequence
  Description of Artificial Sequence: Synthetic polypeptide
DETEIATTNPIATEGYGATTWANADWAEPVGQI

SEQ ID NO: 192092 - protein, 33 aa, Artificial Sequence
  Description of Artificial Sequence: Synthetic polypeptide
DETEIATTNPIATEGYGATTWANADWASPVGQI

SEQ ID NO: 192093 - protein, 37 aa, Artificial Sequence
  Description of Artificial Sequence: Synthetic polypeptide
AEEEICTTNPVATEQYGVVATVVEQAGTEAGTEDEEL

SEQ ID NO: 192094 - protein, 39 aa, Artificial Sequence
  Description of Artificial Sequence: Synthetic polypeptide
DEEEIRTTNPVATEAYGTVSTQIGTTEQGSTNDEQNEDD

SEQ ID NO: 192095 - protein, 38 aa, Artificial Sequence
  Description of Artificial Sequence: Synthetic polypeptide
AEEEICTTNPVATEQYGVVATVVNNVGEQLGTEDETEE

SEQ ID NO: 192096 - protein, 38 aa, Artificial Sequence
  Description of Artificial Sequence: Synthetic polypeptide
AEEEICTTNPVATEQYGVVATVVNQQGEQQGTEDEDEG

SEQ ID NO: 192097 - protein, 38 aa, Artificial Sequence
  Description of Artificial Sequence: Synthetic polypeptide
AEEEICTTNPVATEQYGVVATVVVNVGEQQGTEDEEEQ

SEQ ID NO: 192098 - protein, 38 aa, Artificial Sequence
  Description of Artificial Sequence: Synthetic polypeptide
DEEEISTTNPVATEQYGCVCSMWEEDHNIENFGSDTQS

SEQ ID NO: 192099 - protein, 39 aa, Artificial Sequence
  Description of Artificial Sequence: Synthetic polypeptide
DEEEIRTTNPVATEAYGTVVTNGNSNVIGTTSISTTTNT

SEQ ID NO: 192100 - protein, 38 aa, Artificial Sequence
  Description of Artificial Sequence: Synthetic polypeptide
DEEEIRTTNPVSTEQYGQCVCGNWGEPNQEGFGSQTQA

SEQ ID NO: 192101 - protein, 38 aa, Artificial Sequence
  Description of Artificial Sequence: Synthetic polypeptide
DEEEISTTNPVATEQYGCVCSMSGEPHNQENFGSETQS

SEQ ID NO: 192102 - protein, 35 aa, Artificial Sequence
  Description of Artificial Sequence: Synthetic polypeptide
DEAAIRTTNPVATEGYGCFCSWEEHNIENFGSDQS

SEQ ID NO: 192103 - protein, 34 aa, Artificial Sequence
  Description of Artificial Sequence: Synthetic polypeptide
DDSEVACTNPVSTEGYGNVCYNTDIQQRNGDQDR

SEQ ID NO: 192104 - protein, 34 aa, Artificial Sequence
  Description of Artificial Sequence: Synthetic polypeptide
DDSEVACTNPVSTEGYGNVCYNTDIQNRVGDQGR

SEQ ID NO: 192105 - protein, 37 aa, Artificial Sequence
  Description of Artificial Sequence: Synthetic polypeptide
DEEEISTTNPVATEQYGCVCQWGEDHNAENFNSDNQA

SEQ ID NO: 192106 - protein, 35 aa, Artificial Sequence
  Description of Artificial Sequence: Synthetic polypeptide
DEDEIATTNPVATASWGCVAAANNEPMDRGDENDG

SEQ ID NO: 192107 - protein, 37 aa, Artificial Sequence
  Description of Artificial Sequence: Synthetic polypeptide
AEEEICTTNPVATEQYGVVATVGEQAGTESGTEDEEY

SEQ ID NO: 192108 - protein, 37 aa, Artificial Sequence
  Description of Artificial Sequence: Synthetic polypeptide
QEEEIRTTNPVATEQYGMVSVEGMGDGGQGQEFDEGV

SEQ ID NO: 192109 - protein, 38 aa, Artificial Sequence
  Description of Artificial Sequence: Synthetic polypeptide
QEEEIRTTNPVATEQYGMVSVEGMGDGGQGQENQEMGT

SEQ ID NO: 192110 - protein, 34 aa, Artificial Sequence
  Description of Artificial Sequence: Synthetic polypeptide
DETEIATTNPIATECWGATTWANADLQEPKGPYI

SEQ ID NO: 192111 - protein, 38 aa, Artificial Sequence
  Description of Artificial Sequence: Synthetic polypeptide
DEEEISTTNPVATEQYGCVCSDSGEDHNAENFSSDNQS

SEQ ID NO: 192112 - protein, 40 aa, Artificial Sequence
  Description of Artificial Sequence: Synthetic polypeptide
DEEEIRTTNPVATEAYGTVSTTVTNSDEIGTTSISTTGNT

SEQ ID NO: 192113 - protein, 38 aa, Artificial Sequence
  Description of Artificial Sequence: Synthetic polypeptide
DEEEISTTNPVATEQYGCVCSDWEEDHNAENFNSDNQA

SEQ ID NO: 192114 - protein, 36 aa, Artificial Sequence
  Description of Artificial Sequence: Synthetic polypeptide
DEDEIATTNPVATEQWGTVCAANDGPVEDEGGNNDM

SEQ ID NO: 192115 - protein, 38 aa, Artificial Sequence
  Description of Artificial Sequence: Synthetic polypeptide
AEEEICTTNPVATEQYGVVATVNEQQGEQQIGTEDETE

SEQ ID NO: 192116 - protein, 38 aa, Artificial Sequence
  Description of Artificial Sequence: Synthetic polypeptide
AEEEICTTNPVATEQYGVVATVNEQQGTQQGTEDEEEA

SEQ ID NO: 192117 - protein, 38 aa, Artificial Sequence
  Description of Artificial Sequence: Synthetic polypeptide
AEEEICTTNPVATEQYGVVATVNEQQGTQQLGTEDEEQ

SEQ ID NO: 192118 - protein, 37 aa, Artificial Sequence
  Description of Artificial Sequence: Synthetic polypeptide
DEEEISTTNPVATEQYGCVCSDWGEDDNQENFSSDQA

SEQ ID NO: 192119 - protein, 32 aa, Artificial Sequence
  Description of Artificial Sequence: Synthetic polypeptide
DETEIATTNPIATECWGATWSNACWQPKEPYI

SEQ ID NO: 192120 - protein, 38 aa, Artificial Sequence
  Description of Artificial Sequence: Synthetic polypeptide
DEEEIRTTNPVAYEQYGQCVCSMWGEHNQENFGSDFQP

SEQ ID NO: 192121 - protein, 38 aa, Artificial Sequence
  Description of Artificial Sequence: Synthetic polypeptide
DEEEISTTNPVATEQYGCVCSMSGEDHNQENFGSDTQV

SEQ ID NO: 192122 - protein, 36 aa, Artificial Sequence
  Description of Artificial Sequence: Synthetic polypeptide
DEMEIATTNPVAYERWGVVCSNTDNHDRQDGDQEEQ

SEQ ID NO: 192123 - protein, 38 aa, Artificial Sequence
  Description of Artificial Sequence: Synthetic polypeptide
DEEEISTTNPVATEQYGCVCSMSGEDDNQENFNSDTQS

SEQ ID NO: 192124 - protein, 35 aa, Artificial Sequence
  Description of Artificial Sequence: Synthetic polypeptide
QEGEIATTNPIATEQWGATVWSNCEDLQEPKGTYI

SEQ ID NO: 192125 - protein, 35 aa, Artificial Sequence
  Description of Artificial Sequence: Synthetic polypeptide
DEAAIRTTNPVASLHWGSVSRCINNEPDVTDGENM

SEQ ID NO: 192126 - protein, 37 aa, Artificial Sequence
  Description of Artificial Sequence: Synthetic polypeptide
DEEEIRTTNPVATEQYGCAFSNGISDSGDSDTDSICG

SEQ ID NO: 192127 - protein, 35 aa, Artificial Sequence
  Description of Artificial Sequence: Synthetic polypeptide
DEMEIATTNPVAYERWGVVCSNTDQGDRQDGQEEN

SEQ ID NO: 192128 - protein, 34 aa, Artificial Sequence
  Description of Artificial Sequence: Synthetic polypeptide
DETEIATTNPIATECWGATTWSNADLQEPKGPYI

SEQ ID NO: 192129 - protein, 37 aa, Artificial Sequence
  Description of Artificial Sequence: Synthetic polypeptide
DEEEISTTNPVATEQYGCVCSDWGEHEIENFGSDTQS

SEQ ID NO: 192130 - protein, 35 aa, Artificial Sequence
  Description of Artificial Sequence: Synthetic polypeptide
QEGEIATTNPIATEQWGATVWSNAEDLQEPKGTYI

SEQ ID NO: 192131 - protein, 37 aa, Artificial Sequence
  Description of Artificial Sequence: Synthetic polypeptide
DEEEISTTNPVATEQYGCVCSDWGEHEAENFNSDTQV

SEQ ID NO: 192132 - protein, 40 aa, Artificial Sequence
  Description of Artificial Sequence: Synthetic polypeptide
DEEEIRTTNPVATEAYGTVSTTNGNGNVIGTTSISTTGNT

SEQ ID NO: 192133 - protein, 31 aa, Artificial Sequence
  Description of Artificial Sequence: Synthetic polypeptide
DETEIATTNPIATECWGATVANADWAHEPYL

SEQ ID NO: 192134 - protein, 36 aa, Artificial Sequence
  Description of Artificial Sequence: Synthetic polypeptide
AEEEICTTNPVATEQYGVVATVVVVTEQGTEDETEE

SEQ ID NO: 192135 - protein, 34 aa, Artificial Sequence
  Description of Artificial Sequence: Synthetic polypeptide
DDSEVACTNPVSTEGYGNVCYNTDQQSRVGDQRR

SEQ ID NO: 192136 - protein, 37 aa, Artificial Sequence
  Description of Artificial Sequence: Synthetic polypeptide
DENEISTTNPVATEQYGCVCSNWEEHNQENFNSENQS

SEQ ID NO: 192137 - protein, 37 aa, Artificial Sequence
  Description of Artificial Sequence: Synthetic polypeptide
AEEEIATTNPVATEQYGCVCSVWGEDHNQEGFGSDQS

SEQ ID NO: 192138 - protein, 37 aa, Artificial Sequence
  Description of Artificial Sequence: Synthetic polypeptide
AEEEIATTNPVATEQYGCVCSVWGEHNAEGFISDNQS

SEQ ID NO: 192139 - protein, 37 aa, Artificial Sequence
  Description of Artificial Sequence: Synthetic polypeptide
DENEISTTNPVATEQYGSCPMPIVLWPENRSISQQTS

SEQ ID NO: 192140 - protein, 38 aa, Artificial Sequence
  Description of Artificial Sequence: Synthetic polypeptide
DESEIRTTNPVATESYGDVVSDGMEGLTNGEEGDQIGD

SEQ ID NO: 192141 - protein, 37 aa, Artificial Sequence
  Description of Artificial Sequence: Synthetic polypeptide
DENEISTTNPVATEQYGQCVCSSGEHNQENFGSQTQS

SEQ ID NO: 192142 - protein, 38 aa, Artificial Sequence
  Description of Artificial Sequence: Synthetic polypeptide
DENEISTTNPVATEQYGQCVCSSGEDHNQENFGSDNQF

SEQ ID NO: 192143 - protein, 35 aa, Artificial Sequence
  Description of Artificial Sequence: Synthetic polypeptide
AEEEIATTNPVATEQYGCYCPWEDNQEHSNSENQS

SEQ ID NO: 192144 - protein, 38 aa, Artificial Sequence
  Description of Artificial Sequence: Synthetic polypeptide
DENEISTTNPVATEQYGQCVCSNWGETNQEHFNSDTQS

SEQ ID NO: 192145 - protein, 37 aa, Artificial Sequence
  Description of Artificial Sequence: Synthetic polypeptide
DETEIACTNPVATEQYGSAACAANDGLPLGSEGNEHW

SEQ ID NO: 192146 - protein, 37 aa, Artificial Sequence
  Description of Artificial Sequence: Synthetic polypeptide
DAEEIATTNPVATEQWGHCNVAATAGGLPAAPGNGVF

SEQ ID NO: 192147 - protein, 35 aa, Artificial Sequence
  Description of Artificial Sequence: Synthetic polypeptide
DETEIACTNPVATEQYGSACAANDHADPPLGEAAW

SEQ ID NO: 192148 - protein, 36 aa, Artificial Sequence
  Description of Artificial Sequence: Synthetic polypeptide
DETEIACTNPVATEQYGSACAANPQGQEHQDGTQHQ

SEQ ID NO: 192149 - protein, 37 aa, Artificial Sequence
  Description of Artificial Sequence: Synthetic polypeptide
DEEEISTTNPVATEGYGICVCSNWVEDNQENFISNQS

SEQ ID NO: 192150 - protein, 37 aa, Artificial Sequence
  Description of Artificial Sequence: Synthetic polypeptide
DETEIACTNPVATEQYGSACAATMGEEAPGEQMEGNH

SEQ ID NO: 192151 - protein, 38 aa, Artificial Sequence
  Description of Artificial Sequence: Synthetic polypeptide
DETEIACTNPVATEQYGCFVSATGNHDGPAGSGEHMNE

SEQ ID NO: 192152 - protein, 34 aa, Artificial Sequence
  Description of Artificial Sequence: Synthetic polypeptide
AEEEIATTNPVATEQYGCYCPWGEDNIHNSETQA

SEQ ID NO: 192153 - protein, 36 aa, Artificial Sequence
  Description of Artificial Sequence: Synthetic polypeptide
DETEIACTNPVATEQYGSACAGAPHLAEAPMGEDNN

SEQ ID NO: 192154 - protein, 35 aa, Artificial Sequence
  Description of Artificial Sequence: Synthetic polypeptide
CATEIATTNPVAYEQWGSARCTENKDQDDKGGDQR

SEQ ID NO: 192155 - protein, 37 aa, Artificial Sequence
  Description of Artificial Sequence: Synthetic polypeptide
DETEIACTNPVATEQYGSACATNPQEEEGTHGDEDTP

SEQ ID NO: 192156 - protein, 37 aa, Artificial Sequence
  Description of Artificial Sequence: Synthetic polypeptide
DETEIACTNPVATEQYGSACPATNPHEAEAPHGIMND

SEQ ID NO: 192157 - protein, 37 aa, Artificial Sequence
  Description of Artificial Sequence: Synthetic polypeptide
DETEIACTNPVATEQYGSACPATNPHEAEAPTGNMNP

SEQ ID NO: 192158 - protein, 37 aa, Artificial Sequence
  Description of Artificial Sequence: Synthetic polypeptide
DETEIACTNPVATEQYGSACPATNPHHAEAPAGNMNE

SEQ ID NO: 192159 - protein, 36 aa, Artificial Sequence
  Description of Artificial Sequence: Synthetic polypeptide
AEEEIATTNPVATEQYGQCSCPWMEDNQHFNSENQA

SEQ ID NO: 192160 - protein, 37 aa, Artificial Sequence
  Description of Artificial Sequence: Synthetic polypeptide
DETEIACTNPVATEQYGSACSAANPAEADAEIGNDHQ

SEQ ID NO: 192161 - protein, 37 aa, Artificial Sequence
  Description of Artificial Sequence: Synthetic polypeptide
TEEGICTTNPVAYEQYGSCVSCLGNESNDGPPGNNAP

SEQ ID NO: 192162 - protein, 36 aa, Artificial Sequence
  Description of Artificial Sequence: Synthetic polypeptide
DETEIACTNPVATEQYGSACSAGDFINPDDLMGDQM

SEQ ID NO: 192163 - protein, 35 aa, Artificial Sequence
  Description of Artificial Sequence: Synthetic polypeptide
DETEIACTNPVATEQYGSACSAGDGSGDDSDGTAP

SEQ ID NO: 192164 - protein, 38 aa, Artificial Sequence
  Description of Artificial Sequence: Synthetic polypeptide
DEEEISTTNPVATEGYGQCVCSNWGEGHQEGFGSDNQP

SEQ ID NO: 192165 - protein, 37 aa, Artificial Sequence
  Description of Artificial Sequence: Synthetic polypeptide
DEEEISTTNPVATEGYGQCVCSNWGEHNQNFGSDTQT

SEQ ID NO: 192166 - protein, 37 aa, Artificial Sequence
  Description of Artificial Sequence: Synthetic polypeptide
DEEEISTTNPVATEGYGQCVCSNWGEHNQNFGSETQA

SEQ ID NO: 192167 - protein, 37 aa, Artificial Sequence
  Description of Artificial Sequence: Synthetic polypeptide
DETEIACTNPVATEQYGSACAATNPGVNAAGDDLNAD

SEQ ID NO: 192168 - protein, 37 aa, Artificial Sequence
  Description of Artificial Sequence: Synthetic polypeptide
DEEEISTTNPVATEGYGCVCSWGEDHNQENFNSDTQS

SEQ ID NO: 192169 - protein, 37 aa, Artificial Sequence
  Description of Artificial Sequence: Synthetic polypeptide
DEEEISTTNPVATEGYGCVCSWGEDHNQENFNSDPQS

SEQ ID NO: 192170 - protein, 37 aa, Artificial Sequence
  Description of Artificial Sequence: Synthetic polypeptide
DEEEISTTNPVATEGYGCVCSWGEDHNIENFNSDFQA

SEQ ID NO: 192171 - protein, 37 aa, Artificial Sequence
  Description of Artificial Sequence: Synthetic polypeptide
DEEEISTTNPVATEGYGCVCSNWGEHNQENFNSDTQA

SEQ ID NO: 192172 - protein, 37 aa, Artificial Sequence
  Description of Artificial Sequence: Synthetic polypeptide
DEEEISTTNPVATEGYGCVCSNWGEHNQENFNSETQS

SEQ ID NO: 192173 - protein, 38 aa, Artificial Sequence
  Description of Artificial Sequence: Synthetic polypeptide
VESEIRTTNPVATDQYGSVNMNLIMQNDQELDNGQTEQ

SEQ ID NO: 192174 - protein, 34 aa, Artificial Sequence
  Description of Artificial Sequence: Synthetic polypeptide
TEFEIASVNPVCYEPYGVTVNTINLSQAAGGSNV

SEQ ID NO: 192175 - protein, 37 aa, Artificial Sequence
  Description of Artificial Sequence: Synthetic polypeptide
DEEEISTTNPVATEGYGCVCSNWGEHNQESFNSDNQA

SEQ ID NO: 192176 - protein, 37 aa, Artificial Sequence
  Description of Artificial Sequence: Synthetic polypeptide
DEEEISTTNPVATEGYGCVCSNWGEHNQEYFNSDNQS

SEQ ID NO: 192177 - protein, 38 aa, Artificial Sequence
  Description of Artificial Sequence: Synthetic polypeptide
DEEEIRTTNPVATEQYGAVVNGFGQGGQQDTDQTTGFP

SEQ ID NO: 192178 - protein, 37 aa, Artificial Sequence
  Description of Artificial Sequence: Synthetic polypeptide
DEEEISTTNPVATEGYGCVCSNWGEHNTESFNSDNQA

SEQ ID NO: 192179 - protein, 35 aa, Artificial Sequence
  Description of Artificial Sequence: Synthetic polypeptide
AEEEIATTNPVATEQYGCSCPWGPDNQEHFISEQM

SEQ ID NO: 192180 - protein, 37 aa, Artificial Sequence
  Description of Artificial Sequence: Synthetic polypeptide
DEEEISTTNPVATEGYGCVCSNWGEPNQENFNSDNQS

SEQ ID NO: 192181 - protein, 37 aa, Artificial Sequence
  Description of Artificial Sequence: Synthetic polypeptide
DEEEISTTNPVATEGYGCVCSNWGEPNQENFNSEFQG

SEQ ID NO: 192182 - protein, 35 aa, Artificial Sequence
  Description of Artificial Sequence: Synthetic polypeptide
TEEVICTTNPVAYECWGITVPSCYNMSNPRGGNNA

SEQ ID NO: 192183 - protein, 36 aa, Artificial Sequence
  Description of Artificial Sequence: Synthetic polypeptide
DEHEIRTTNPVAYEEWGVVSGGNPGNDDRKGGDGET

SEQ ID NO: 192184 - protein, 36 aa, Artificial Sequence
  Description of Artificial Sequence: Synthetic polypeptide
AEEEIATTNPVATEQYGCSCQNWEDNAEHFISENQA

SEQ ID NO: 192185 - protein, 38 aa, Artificial Sequence
  Description of Artificial Sequence: Synthetic polypeptide
DEEEIATTNPVATEQYGSACAATNPDEEEGRHQDEDTP

SEQ ID NO: 192186 - protein, 36 aa, Artificial Sequence
  Description of Artificial Sequence: Synthetic polypeptide
DEEEIATTNPVAYEMWGGCVAGNNGLQAAPDGSSHN

SEQ ID NO: 192187 - protein, 38 aa, Artificial Sequence
  Description of Artificial Sequence: Synthetic polypeptide
DEEEIRTTNPVAYEQYGQCTCSNWGEHNAENFGSDNQA

SEQ ID NO: 192188 - protein, 37 aa, Artificial Sequence
  Description of Artificial Sequence: Synthetic polypeptide
DAEEIATTNPVATEQWGSTTAGNGGLPAEAENGNMFD

SEQ ID NO: 192189 - protein, 37 aa, Artificial Sequence
  Description of Artificial Sequence: Synthetic polypeptide
DEEEISTTNPVATEGYGCVCSWGEDHNAENFNSETQA

SEQ ID NO: 192190 - protein, 37 aa, Artificial Sequence
  Description of Artificial Sequence: Synthetic polypeptide
DEEEISTTNPVATEGYGCVCSWGEDHNAENFNSENQS

SEQ ID NO: 192191 - protein, 37 aa, Artificial Sequence
  Description of Artificial Sequence: Synthetic polypeptide
DEEEISTTNPVATEGYGCVCSWGEDHNAENFNSDTQA

SEQ ID NO: 192192 - protein, 37 aa, Artificial Sequence
  Description of Artificial Sequence: Synthetic polypeptide
DEEEISTTNPVATEGYGCVCSWGEDHNAENFNSDNQA

SEQ ID NO: 192193 - protein, 37 aa, Artificial Sequence
  Description of Artificial Sequence: Synthetic polypeptide
DEEEISTTNPVATEGYGCVCSWGEDHNAEGFNSENQS

SEQ ID NO: 192194 - protein, 37 aa, Artificial Sequence
  Description of Artificial Sequence: Synthetic polypeptide
DETEIACTNPVATEQYGSACSANPAEGQDHQDDSGAE

SEQ ID NO: 192195 - protein, 36 aa, Artificial Sequence
  Description of Artificial Sequence: Synthetic polypeptide
DEQEIATTNPVATEQWGKVSAVGDLEADTPQGEDMG

SEQ ID NO: 192196 - protein, 36 aa, Artificial Sequence
  Description of Artificial Sequence: Synthetic polypeptide
DETEIACTNPVATEQWGSVSGEGGPLGINHDDTLAG

SEQ ID NO: 192197 - protein, 36 aa, Artificial Sequence
  Description of Artificial Sequence: Synthetic polypeptide
DETEIACTNPVATEQWGSVSATGDPEEAGTEGGEDA

SEQ ID NO: 192198 - protein, 36 aa, Artificial Sequence
  Description of Artificial Sequence: Synthetic polypeptide
DETEIACTNPVATEQWGSVSATGDEEAGTEQGEDAH

SEQ ID NO: 192199 - protein, 36 aa, Artificial Sequence
  Description of Artificial Sequence: Synthetic polypeptide
DETEIACTNPVATEQWGSVSATGDEEAGTEGAEDAW

SEQ ID NO: 192200 - protein, 31 aa, Artificial Sequence
  Description of Artificial Sequence: Synthetic polypeptide
TEESIATTNPVAYERWGEAYMVEQHDEGKGI

SEQ ID NO: 192201 - protein, 37 aa, Artificial Sequence
  Description of Artificial Sequence: Synthetic polypeptide
DEQEIATTNPVATEQWGKVSATGDPGGTDHQGDEDNP

SEQ ID NO: 192202 - protein, 38 aa, Artificial Sequence
  Description of Artificial Sequence: Synthetic polypeptide
DEEEISTTNPVATEGYGCVCSTSGEDHNAENFNSDNQS

SEQ ID NO: 192203 - protein, 36 aa, Artificial Sequence
  Description of Artificial Sequence: Synthetic polypeptide
DATEIATTNPVAYEQWGSARCTENHDQDDLHNDQRV

SEQ ID NO: 192204 - protein, 36 aa, Artificial Sequence
  Description of Artificial Sequence: Synthetic polypeptide
DETEIACTNPVATEQYGSACSAPNPQQEAAHQVDEQ

SEQ ID NO: 192205 - protein, 39 aa, Artificial Sequence
  Description of Artificial Sequence: Synthetic polypeptide
DEEEISTTNPVATEGYGQCVCSTWGEDHNAENFGSENQA

SEQ ID NO: 192206 - protein, 38 aa, Artificial Sequence
  Description of Artificial Sequence: Synthetic polypeptide
DEEEISTTNPVATEQYGCCVCSNWGEHNEENFGSDFQS

SEQ ID NO: 192207 - protein, 37 aa, Artificial Sequence
  Description of Artificial Sequence: Synthetic polypeptide
DEEEISTTNPVATEQYGCFCSNWGEDNAENFNSDTQA

SEQ ID NO: 192208 - protein, 37 aa, Artificial Sequence
  Description of Artificial Sequence: Synthetic polypeptide
DEEEISTTNPVATEQYGCICSMWGEHNQENFNSDTQA

SEQ ID NO: 192209 - protein, 39 aa, Artificial Sequence
  Description of Artificial Sequence: Synthetic polypeptide
DEEEIRTTNPVATEAYGTVTVVVTTQQGNVEQGTTENNE

SEQ ID NO: 192210 - protein, 36 aa, Artificial Sequence
  Description of Artificial Sequence: Synthetic polypeptide
DETEIACTNPVATEQYGSCSAGDPIGNNHADEMNTE

SEQ ID NO: 192211 - protein, 39 aa, Artificial Sequence
  Description of Artificial Sequence: Synthetic polypeptide
DEEEISTTNPVATEQYGCIVCSNWGELHNTENFNSENQS

SEQ ID NO: 192212 - protein, 39 aa, Artificial Sequence
  Description of Artificial Sequence: Synthetic polypeptide
DETEIACTNPVATEQYGSCVAAIGTGDLPQGSGNGQALP

SEQ ID NO: 192213 - protein, 37 aa, Artificial Sequence
  Description of Artificial Sequence: Synthetic polypeptide
DETEIACTNPVATEQYGSTACAANPQGGEHQDGNQHQ

SEQ ID NO: 192214 - protein, 38 aa, Artificial Sequence
  Description of Artificial Sequence: Synthetic polypeptide
DEEEISTTNPVATEQYGCQVCGNSGEHNAENFGSDTQA

SEQ ID NO: 192215 - protein, 38 aa, Artificial Sequence
  Description of Artificial Sequence: Synthetic polypeptide
DENEISTTNPVATEQYGQCVCSNSGEHNQEGFISDNQS

SEQ ID NO: 192216 - protein, 37 aa, Artificial Sequence
  Description of Artificial Sequence: Synthetic polypeptide
DETEIACTNPVATEQYGSVACADHHQPLGADIGPHND

SEQ ID NO: 192217 - protein, 38 aa, Artificial Sequence
  Description of Artificial Sequence: Synthetic polypeptide
DENEISTTNPVATEQYGQCVCSNSGEDHNINFGSDNQA

SEQ ID NO: 192218 - protein, 38 aa, Artificial Sequence
  Description of Artificial Sequence: Synthetic polypeptide
DENEISTTNPVATEQYGQCVCSNSGEDDQENFGSDNQA

SEQ ID NO: 192219 - protein, 36 aa, Artificial Sequence
  Description of Artificial Sequence: Synthetic polypeptide
DEDEIATTNPVATASWGCVAAANYAEDQDRGGENTN

SEQ ID NO: 192220 - protein, 36 aa, Artificial Sequence
  Description of Artificial Sequence: Synthetic polypeptide
DEMEIGTTNPVATEGYGCVCSNWGEPNEFFGSDTQA

SEQ ID NO: 192221 - protein, 37 aa, Artificial Sequence
  Description of Artificial Sequence: Synthetic polypeptide
DENEISTTNPVATEQYGCVCSWGEDHNQENFNSENQS

SEQ ID NO: 192222 - protein, 39 aa, Artificial Sequence
  Description of Artificial Sequence: Synthetic polypeptide
DEEEISTTNPVATEQYGCQVCSNSGEDHNQENFGSENQS

SEQ ID NO: 192223 - protein, 37 aa, Artificial Sequence
  Description of Artificial Sequence: Synthetic polypeptide
DENEISTTNPVATEQYGCVCSWGEDHNAENFNSDTQS

SEQ ID NO: 192224 - protein, 36 aa, Artificial Sequence
  Description of Artificial Sequence: Synthetic polypeptide
DEDEIATTNPVATEQWGTNCSAAADHGMNRTSNDSW

SEQ ID NO: 192225 - protein, 38 aa, Artificial Sequence
  Description of Artificial Sequence: Synthetic polypeptide
DEEEISTTNPVATEQYGCQVCSNSGEHNTENFNSETQA

SEQ ID NO: 192226 - protein, 37 aa, Artificial Sequence
  Description of Artificial Sequence: Synthetic polypeptide
DEEEIATTNPVAYEPYGSTACAANDGEPLGSEGNNHA

SEQ ID NO: 192227 - protein, 37 aa, Artificial Sequence
  Description of Artificial Sequence: Synthetic polypeptide
DENEISTTNPVATEQYGCVCSSGEDHNAENFNSDTQS

SEQ ID NO: 192228 - protein, 37 aa, Artificial Sequence
  Description of Artificial Sequence: Synthetic polypeptide
DENEISTTNPVATEQYGCVCSNWGEHNQENSNSDNQL

SEQ ID NO: 192229 - protein, 39 aa, Artificial Sequence
  Description of Artificial Sequence: Synthetic polypeptide
DEEEISTTNPVATEQYGCQVCSNWGEDHNTENFGSDNQS

SEQ ID NO: 192230 - protein, 38 aa, Artificial Sequence
  Description of Artificial Sequence: Synthetic polypeptide
DEEEISTTNPVATEQYGCQVCSNWGEHNAENFNSDFQS

SEQ ID NO: 192231 - protein, 38 aa, Artificial Sequence
  Description of Artificial Sequence: Synthetic polypeptide
DEEEISTTNPVATEQYGCQVCSNWGEHNQENFISDNQG

SEQ ID NO: 192232 - protein, 38 aa, Artificial Sequence
  Description of Artificial Sequence: Synthetic polypeptide
DEEEISTTNPVATEQYGCQVCSNWGEHNQENSNSDNQS

SEQ ID NO: 192233 - protein, 37 aa, Artificial Sequence
  Description of Artificial Sequence: Synthetic polypeptide
DENEISTTNPVATEQYGCVCSNWGEHNQEFFNSDTQS

SEQ ID NO: 192234 - protein, 37 aa, Artificial Sequence
  Description of Artificial Sequence: Synthetic polypeptide
AEEEIATTNPVAYECWGSVYCTENQDGQNKENGNDEQ

SEQ ID NO: 192235 - protein, 37 aa, Artificial Sequence
  Description of Artificial Sequence: Synthetic polypeptide
AEEEIATTNPVAYECWGSVYCTENQDGQQGEGGNNEQ

SEQ ID NO: 192236 - protein, 37 aa, Artificial Sequence
  Description of Artificial Sequence: Synthetic polypeptide
DENEISTTNPVATEQYGCVCSWGEDHNQEHFNSDNQS

SEQ ID NO: 192237 - protein, 39 aa, Artificial Sequence
  Description of Artificial Sequence: Synthetic polypeptide
DEEEISTTNPVATEQYGCAVCSNWGEDHNAENFGSDNQL

SEQ ID NO: 192238 - protein, 38 aa, Artificial Sequence
  Description of Artificial Sequence: Synthetic polypeptide
DEEEISTTNPVATEQYGCAVCSNWEEHNTENFGSDTQS

SEQ ID NO: 192239 - protein, 39 aa, Artificial Sequence
  Description of Artificial Sequence: Synthetic polypeptide
DEEEISTTNPVATEQYGCAVCSNTGEDHDQEHFGSDTQL

SEQ ID NO: 192240 - protein, 37 aa, Artificial Sequence
  Description of Artificial Sequence: Synthetic polypeptide
DEEEISTTNPVATEGYGQCVCSWGEDHNANFNSDNQS

SEQ ID NO: 192241 - protein, 37 aa, Artificial Sequence
  Description of Artificial Sequence: Synthetic polypeptide
DETEIACTNPVATEQYGSACSMANDTIQPDDLMGDQH

SEQ ID NO: 192242 - protein, 37 aa, Artificial Sequence
  Description of Artificial Sequence: Synthetic polypeptide
DEEEISTTNPVATEGYGQCVCSWGEHNAENFNSDTQP

SEQ ID NO: 192243 - protein, 37 aa, Artificial Sequence
  Description of Artificial Sequence: Synthetic polypeptide
DEEEISTTNPVATEGYGQCVCSWGEHNQENFGSETQA

SEQ ID NO: 192244 - protein, 38 aa, Artificial Sequence
  Description of Artificial Sequence: Synthetic polypeptide
DEEEISTTNPVATEGYGQCVTSTWGADNAEHFGSDPQS

SEQ ID NO: 192245 - protein, 37 aa, Artificial Sequence
  Description of Artificial Sequence: Synthetic polypeptide
DEEEISTTNPVATEHYGCVCSNWGEHNAENFNSDTQD

SEQ ID NO: 192246 - protein, 37 aa, Artificial Sequence
  Description of Artificial Sequence: Synthetic polypeptide
DEEEISTTNPVATEPYGTYACQGNELSGVRFVASNQY

SEQ ID NO: 192247 - protein, 37 aa, Artificial Sequence
  Description of Artificial Sequence: Synthetic polypeptide
DEEEISTTNPVATEQFGQCVCSWMYDNIENFNSDTQS

SEQ ID NO: 192248 - protein, 37 aa, Artificial Sequence
  Description of Artificial Sequence: Synthetic polypeptide
DETEIACTNPVATEQYGSACSPANDTLAPDAEEGKMH

SEQ ID NO: 192249 - protein, 37 aa, Artificial Sequence
  Description of Artificial Sequence: Synthetic polypeptide
DETEIACTNPVATEQYGSACSPANDTLVPDAEEGEMW

SEQ ID NO: 192250 - protein, 37 aa, Artificial Sequence
  Description of Artificial Sequence: Synthetic polypeptide
DETEIACTNPVATEQYGSACSPANPHPLEAMEGVAEK

SEQ ID NO: 192251 - protein, 37 aa, Artificial Sequence
  Description of Artificial Sequence: Synthetic polypeptide
DEEEISTTNPVATEQWGCVCGNWGEHNQENFNSETQP

SEQ ID NO: 192252 - protein, 37 aa, Artificial Sequence
  Description of Artificial Sequence: Synthetic polypeptide
DETEIACTNPVATEQYGSACSPANPSPLEAMGGAAEE

SEQ ID NO: 192253 - protein, 37 aa, Artificial Sequence
  Description of Artificial Sequence: Synthetic polypeptide
DETEIACTNPVATEQYGSACSPANPTSLVDAEEGKME

SEQ ID NO: 192254 - protein, 38 aa, Artificial Sequence
  Description of Artificial Sequence: Synthetic polypeptide
DETEIACTNPVATEQYGSACSPTGEGGVNAMMGDETNH

SEQ ID NO: 192255 - protein, 38 aa, Artificial Sequence
  Description of Artificial Sequence: Synthetic polypeptide
DETEIACTNPVATEQYGSACSPTNNGNPLEATEGFDES

SEQ ID NO: 192256 - protein, 38 aa, Artificial Sequence
  Description of Artificial Sequence: Synthetic polypeptide
TEEEISTTNPVATEQYGCVCSNWMEDHNAENFGSDNQS

SEQ ID NO: 192257 - protein, 36 aa, Artificial Sequence
  Description of Artificial Sequence: Synthetic polypeptide
DETEIACTNPVATEQYGSCAAGDTIGTNHADEYNDW

SEQ ID NO: 192258 - protein, 34 aa, Artificial Sequence
  Description of Artificial Sequence: Synthetic polypeptide
DDSEVACTNPVSTEGYGNVCYNTIDQDRHGMQSR

SEQ ID NO: 192259 - protein, 34 aa, Artificial Sequence
  Description of Artificial Sequence: Synthetic polypeptide
DEDEIATTNPVATASWGCVAGNNNLAEDAGGGKH

SEQ ID NO: 192260 - protein, 34 aa, Artificial Sequence
  Description of Artificial Sequence: Synthetic polypeptide
DDSEVACTNPVSTEGYGNVCYNTIDQSRHGDQRK

SEQ ID NO: 192261 - protein, 36 aa, Artificial Sequence
  Description of Artificial Sequence: Synthetic polypeptide
DETEIACTNPVATEQYGSCAAGDTIGNNHADEMNQW

SEQ ID NO: 192262 - protein, 35 aa, Artificial Sequence
  Description of Artificial Sequence: Synthetic polypeptide
DETEIACTNPVATEQYGSCAAGDIGNNHADEANDW

SEQ ID NO: 192263 - protein, 37 aa, Artificial Sequence
  Description of Artificial Sequence: Synthetic polypeptide
DENEISTTNPVATEQYGQCVCSNWGEHNQEYFNSEQM

SEQ ID NO: 192264 - protein, 39 aa, Artificial Sequence
  Description of Artificial Sequence: Synthetic polypeptide
DEEEIRTTNPVATEAYGTVTNGGNSDVIGTTSISTTGNT

SEQ ID NO: 192265 - protein, 36 aa, Artificial Sequence
  Description of Artificial Sequence: Synthetic polypeptide
TEEEISTTNPVATEQYGCVCGWGEDNAEYFNSDTQS

SEQ ID NO: 192266 - protein, 35 aa, Artificial Sequence
  Description of Artificial Sequence: Synthetic polypeptide
DEDEIATTNPVATEQWGTNCAATDGHPVEFGINDD

SEQ ID NO: 192267 - protein, 36 aa, Artificial Sequence
  Description of Artificial Sequence: Synthetic polypeptide
TEEEISTTNPVATEQYGCVCGWGEHNIEYFGSDTQA

SEQ ID NO: 192268 - protein, 37 aa, Artificial Sequence
  Description of Artificial Sequence: Synthetic polypeptide
TEEEISTTNPVATEQYGCVCNNTGEHNQEYFGSDTQA

SEQ ID NO: 192269 - protein, 37 aa, Artificial Sequence
  Description of Artificial Sequence: Synthetic polypeptide
TEEEISTTNPVATEQYGCVCNNWGEDNQEHFNSDTQS

SEQ ID NO: 192270 - protein, 38 aa, Artificial Sequence
  Description of Artificial Sequence: Synthetic polypeptide
DEEEISTTNPVATEQWGICQVCSYTGNDHNANFGSDQA

SEQ ID NO: 192271 - protein, 37 aa, Artificial Sequence
  Description of Artificial Sequence: Synthetic polypeptide
DETEIACTNPVATEQYGSCAAAPGNEPMAGMEIGNRA

SEQ ID NO: 192272 - protein, 37 aa, Artificial Sequence
  Description of Artificial Sequence: Synthetic polypeptide
DEEEISTTNPVATEGYGCVCSNWGEHNQENFNSDPQL

SEQ ID NO: 192273 - protein, 34 aa, Artificial Sequence
  Description of Artificial Sequence: Synthetic polypeptide
DETEIATTNPIATEQWGATWSNEEDWQEPKGPYI

SEQ ID NO: 192274 - protein, 38 aa, Artificial Sequence
  Description of Artificial Sequence: Synthetic polypeptide
DEEEISTTNPVATEQYGCVCSMWGEAHNAENFNSDNQS

SEQ ID NO: 192275 - protein, 35 aa, Artificial Sequence
  Description of Artificial Sequence: Synthetic polypeptide
DETEIATTNPVAYEQWGCVSGGNGNEAGGDGMKTQ

SEQ ID NO: 192276 - protein, 36 aa, Artificial Sequence
  Description of Artificial Sequence: Synthetic polypeptide
DETEIATTNPVAYEQWGEVCSTPNQGNHGEAGDGLN

SEQ ID NO: 192277 - protein, 35 aa, Artificial Sequence
  Description of Artificial Sequence: Synthetic polypeptide
DETEIATTNPVAYEQWGPSACAAANGLQNSEVDDS

SEQ ID NO: 192278 - protein, 36 aa, Artificial Sequence
  Description of Artificial Sequence: Synthetic polypeptide
DETEIATTNPVAYEQWGSVPAIANNLEQESPDDSEN

SEQ ID NO: 192279 - protein, 37 aa, Artificial Sequence
  Description of Artificial Sequence: Synthetic polypeptide
DETEIATTNPVAYEQWGSVSGGEPANGPNMRNGGGKQ

SEQ ID NO: 192280 - protein, 36 aa, Artificial Sequence
  Description of Artificial Sequence: Synthetic polypeptide
DETEIATTNPVAYEQWGSVSGQGPFPQQDTPGGSEE

SEQ ID NO: 192281 - protein, 36 aa, Artificial Sequence
  Description of Artificial Sequence: Synthetic polypeptide
DETEIATTNPVAYEQWGSVSGQGPPQQETPDGSFEN

SEQ ID NO: 192282 - protein, 37 aa, Artificial Sequence
  Description of Artificial Sequence: Synthetic polypeptide
DETEIATTNPVAYEQWGSVSSTGEPGINPRDGMEKVE

SEQ ID NO: 192283 - protein, 37 aa, Artificial Sequence
  Description of Artificial Sequence: Synthetic polypeptide
QEGEIATTNPVATEQYGNISFSAPDTVREPHEGEDTR

SEQ ID NO: 192284 - protein, 35 aa, Artificial Sequence
  Description of Artificial Sequence: Synthetic polypeptide
DETEIATTNPVAYEQWGTVSGSGNGNEAGGDGMQQ

SEQ ID NO: 192285 - protein, 35 aa, Artificial Sequence
  Description of Artificial Sequence: Synthetic polypeptide
DETEIATTNPVAYEQWGVCVAGTGLADTPQDEAAD

SEQ ID NO: 192286 - protein, 37 aa, Artificial Sequence
  Description of Artificial Sequence: Synthetic polypeptide
DETEIATTNPVAYEQYGSACAAVATGVNTAGGDTQAS

SEQ ID NO: 192287 - protein, 36 aa, Artificial Sequence
  Description of Artificial Sequence: Synthetic polypeptide
DETEIATTNPVAYEQYGSCATANGNGVMNEGGHADQ

SEQ ID NO: 192288 - protein, 37 aa, Artificial Sequence
  Description of Artificial Sequence: Synthetic polypeptide
QEGEIATTNPVATEQYGSCSFSAPDTLCEPHEGEDTR

SEQ ID NO: 192289 - protein, 34 aa, Artificial Sequence
  Description of Artificial Sequence: Synthetic polypeptide
DENEIRTTNPVSTEPYGWISMEDIQQPQSTFEHN

SEQ ID NO: 192290 - protein, 37 aa, Artificial Sequence
  Description of Artificial Sequence: Synthetic polypeptide
DETEIATTNPVAYEQYGSVAAIVNNEEAPGEQMEGMM

SEQ ID NO: 192291 - protein, 37 aa, Artificial Sequence
  Description of Artificial Sequence: Synthetic polypeptide
DETEIATTNPVAYEQYGSVPANMNNEEAPDAQEHGDQ

SEQ ID NO: 192292 - protein, 38 aa, Artificial Sequence
  Description of Artificial Sequence: Synthetic polypeptide
DEEEIRTTNPVATEQYGCVCSNWGEDHNQENFISETQS

SEQ ID NO: 192293 - protein, 37 aa, Artificial Sequence
  Description of Artificial Sequence: Synthetic polypeptide
QEGEIATTNPVATEQYGSISFSAPDTLSEPQEGEDTC

SEQ ID NO: 192294 - protein, 33 aa, Artificial Sequence
  Description of Artificial Sequence: Synthetic polypeptide
AESEIACTNPVAYEGYGNACACENLSQTVGGDP

SEQ ID NO: 192295 - protein, 35 aa, Artificial Sequence
  Description of Artificial Sequence: Synthetic polypeptide
DETEIATTNPVAYEQYGVSACAAANNDAMQGDQHQ

SEQ ID NO: 192296 - protein, 38 aa, Artificial Sequence
  Description of Artificial Sequence: Synthetic polypeptide
DEMEIRTTNPVATEQYGQCICSNWGETNIENFNSDNQS

SEQ ID NO: 192297 - protein, 38 aa, Artificial Sequence
  Description of Artificial Sequence: Synthetic polypeptide
DEEEIRTTNPVATEQYGCVCSNWGEDHNQENFISQTQS

SEQ ID NO: 192298 - protein, 33 aa, Artificial Sequence
  Description of Artificial Sequence: Synthetic polypeptide
QEEEIATTNPVAYEHYGEAWCEVEASQHAEGEQ

SEQ ID NO: 192299 - protein, 38 aa, Artificial Sequence
  Description of Artificial Sequence: Synthetic polypeptide
DEMEIRTTNPVATEQYGQCICSTWGETNIENFGSDTQS

SEQ ID NO: 192300 - protein, 35 aa, Artificial Sequence
  Description of Artificial Sequence: Synthetic polypeptide
DETEICTTNPCAYEQWGSVCGDNNNDQQGQGGGHD

SEQ ID NO: 192301 - protein, 33 aa, Artificial Sequence
  Description of Artificial Sequence: Synthetic polypeptide
AESEIACTNPVAYEGYGEACSCANLSTTVGGDD

SEQ ID NO: 192302 - protein, 37 aa, Artificial Sequence
  Description of Artificial Sequence: Synthetic polypeptide
DETEICTTNPVAYECWGSVATTGNGPTQDDRQQNGTD

SEQ ID NO: 192303 - protein, 32 aa, Artificial Sequence
  Description of Artificial Sequence: Synthetic polypeptide
AESEIAATNPVGTEGWGVCAPTDNQDHQGGDV

SEQ ID NO: 192304 - protein, 37 aa, Artificial Sequence
  Description of Artificial Sequence: Synthetic polypeptide
DEEEIRTTNPVSTEQYGCVCGNWGEHNQENFSSQTQA

SEQ ID NO: 192305 - protein, 37 aa, Artificial Sequence
  Description of Artificial Sequence: Synthetic polypeptide
QEGEIATTNPVATEQYGSISFSAPDTLREPTEGEDDR

SEQ ID NO: 192306 - protein, 33 aa, Artificial Sequence
  Description of Artificial Sequence: Synthetic polypeptide
QEEEIATTNPVAYEPYGEANCEVECSQHAEGEK

SEQ ID NO: 192307 - protein, 38 aa, Artificial Sequence
  Description of Artificial Sequence: Synthetic polypeptide
QEGEIATTNPVATEQYGIISFSDPLDTLREPHEGEETR

SEQ ID NO: 192308 - protein, 37 aa, Artificial Sequence
  Description of Artificial Sequence: Synthetic polypeptide
DEMEIATTNPVAYEQYGTVCSYTDGLPEGVHEGDGDS

SEQ ID NO: 192309 - protein, 37 aa, Artificial Sequence
  Description of Artificial Sequence: Synthetic polypeptide
DETEIATTNPVATEQYGSVCAANNGDENGMDIGISFA

SEQ ID NO: 192310 - protein, 39 aa, Artificial Sequence
  Description of Artificial Sequence: Synthetic polypeptide
DEEEIRTTNPVATEQYGCAVCSNWGEDHNQENFNSDNQA

SEQ ID NO: 192311 - protein, 38 aa, Artificial Sequence
  Description of Artificial Sequence: Synthetic polypeptide
DCEEIATTNHPVATEQYGCMVPSCLGNHSQVDGGVYMM

SEQ ID NO: 192312 - protein, 37 aa, Artificial Sequence
  Description of Artificial Sequence: Synthetic polypeptide
QEEEIRTTNPVATEQYGDVVNGPGQGGQDTDQTTGFS

SEQ ID NO: 192313 - protein, 36 aa, Artificial Sequence
  Description of Artificial Sequence: Synthetic polypeptide
VEDEIACTNPVAYEQYGSACAANPELQEHQDGNQHQ

SEQ ID NO: 192314 - protein, 37 aa, Artificial Sequence
  Description of Artificial Sequence: Synthetic polypeptide
DETEIATTNPVATEQYGSVCAANNGDENGMDISIDQN

SEQ ID NO: 192315 - protein, 36 aa, Artificial Sequence
  Description of Artificial Sequence: Synthetic polypeptide
DEMEIRTTNPVATEQYGECMCVAAVPENEMWTQDEQ

SEQ ID NO: 192316 - protein, 36 aa, Artificial Sequence
  Description of Artificial Sequence: Synthetic polypeptide
DENEIRTTNPVSTEVYGTVQTSPTDIEIQQNDAHHH

SEQ ID NO: 192317 - protein, 35 aa, Artificial Sequence
  Description of Artificial Sequence: Synthetic polypeptide
DENEIRTTNPVSTEVYGTVQTSPMDIEIQQNDVHH

SEQ ID NO: 192318 - protein, 37 aa, Artificial Sequence
  Description of Artificial Sequence: Synthetic polypeptide
VEDEIACTNPVAYEQYGSTVCAANDLPQEHQDGNEAQ

SEQ ID NO: 192319 - protein, 35 aa, Artificial Sequence
  Description of Artificial Sequence: Synthetic polypeptide
DENEIRTTNPVSTEVYGTVQTSPMDIEIQQNDAMP

SEQ ID NO: 192320 - protein, 36 aa, Artificial Sequence
  Description of Artificial Sequence: Synthetic polypeptide
DENEIRTTNPVSTEVYGTVQTSMPMDIEIQQNDNLH

SEQ ID NO: 192321 - protein, 36 aa, Artificial Sequence
  Description of Artificial Sequence: Synthetic polypeptide
QEEEIATTNPVAYEPYRGQSVSYINEGSTSMPGAPG

SEQ ID NO: 192322 - protein, 37 aa, Artificial Sequence
  Description of Artificial Sequence: Synthetic polypeptide
QEGEIATTNPVATEQYGEISFSAPDTLYEPHEGEDTR

SEQ ID NO: 192323 - protein, 36 aa, Artificial Sequence
  Description of Artificial Sequence: Synthetic polypeptide
DEEEIATTNPVAYEQWGSFACAAANGLPQDSEVDDE

SEQ ID NO: 192324 - protein, 38 aa, Artificial Sequence
  Description of Artificial Sequence: Synthetic polypeptide
DETEIATTNPVATEQYGSVCAMNNGEPTNPDDQGEHDM

SEQ ID NO: 192325 - protein, 38 aa, Artificial Sequence
  Description of Artificial Sequence: Synthetic polypeptide
DETEIATTNPVATEQYGSVCAMTGVHGTAPDAQMENNN

SEQ ID NO: 192326 - protein, 38 aa, Artificial Sequence
  Description of Artificial Sequence: Synthetic polypeptide
DEEEIRTTNPVAYEQYGQCVCSWGEDHNAEYFNSQTQA

SEQ ID NO: 192327 - protein, 38 aa, Artificial Sequence
  Description of Artificial Sequence: Synthetic polypeptide
DEEEIRTTNPVATEQYGCVCSNWGEDHNIENFSSDTQS

SEQ ID NO: 192328 - protein, 38 aa, Artificial Sequence
  Description of Artificial Sequence: Synthetic polypeptide
DEEEIRTTNPVAYEQYGQCVCSWGEDHNEENFNSDTQS

SEQ ID NO: 192329 - protein, 36 aa, Artificial Sequence
  Description of Artificial Sequence: Synthetic polypeptide
DEDEIACTNPVAYEQYGSVATPANITNGTHGDEAAP

SEQ ID NO: 192330 - protein, 35 aa, Artificial Sequence
  Description of Artificial Sequence: Synthetic polypeptide
DEDEIACTNPVAYEQYGSVCSANPAGAHMIDLTAM

SEQ ID NO: 192331 - protein, 38 aa, Artificial Sequence
  Description of Artificial Sequence: Synthetic polypeptide
DEMEIATTNPVAYEQYGTVCSYTDGLPENHHEGQDGDS

SEQ ID NO: 192332 - protein, 37 aa, Artificial Sequence
  Description of Artificial Sequence: Synthetic polypeptide
WQSEIGTTNPVATEQYGCVSTIWSAMTNPEKGNEDFD

SEQ ID NO: 192333 - protein, 36 aa, Artificial Sequence
  Description of Artificial Sequence: Synthetic polypeptide
DEDEIACTNPVAYEQYGSVCSMANPAQAHMIDLTAD

SEQ ID NO: 192334 - protein, 37 aa, Artificial Sequence
  Description of Artificial Sequence: Synthetic polypeptide
QEGEIATTNPVATEQYGHFSFSAPDTLREPHEGEDTR

SEQ ID NO: 192335 - protein, 36 aa, Artificial Sequence
  Description of Artificial Sequence: Synthetic polypeptide
VEDEIACTNPVAYEQYGSVCSAPNLGEEHQGDEEAD

SEQ ID NO: 192336 - protein, 36 aa, Artificial Sequence
  Description of Artificial Sequence: Synthetic polypeptide
VEDEIACTNPVAYEQYGSVCAAPALQQEHQDGNAAK

SEQ ID NO: 192337 - protein, 38 aa, Artificial Sequence
  Description of Artificial Sequence: Synthetic polypeptide
DEEEIRTTNPVAYEQYGQCVCSNSGEHNQENSNSDTQA

SEQ ID NO: 192338 - protein, 37 aa, Artificial Sequence
  Description of Artificial Sequence: Synthetic polypeptide
DAEEIATTNPVATEQYGSVCAMANHADDSKAPAGEHH

SEQ ID NO: 192339 - protein, 37 aa, Artificial Sequence
  Description of Artificial Sequence: Synthetic polypeptide
DEDEIATTNPVATEQYGSACAAANGQEVNDDGMGDLH

SEQ ID NO: 192340 - protein, 33 aa, Artificial Sequence
  Description of Artificial Sequence: Synthetic polypeptide
AESEIACTNPVGTEGYGVSCQSEHNTHFGSDQA

SEQ ID NO: 192341 - protein, 37 aa, Artificial Sequence
  Description of Artificial Sequence: Synthetic polypeptide
DETEIATTNPVATEQYGSVCAANNGDENGMDIDEDQW

SEQ ID NO: 192342 - protein, 37 aa, Artificial Sequence
  Description of Artificial Sequence: Synthetic polypeptide
DEEEIRTTNPVSTEQYGCVCGNWGEHNAENFISQNQA

SEQ ID NO: 192343 - protein, 38 aa, Artificial Sequence
  Description of Artificial Sequence: Synthetic polypeptide
DETEIKTTNPVATEFYGVVINMQTNQEGQGEQGAEENP

SEQ ID NO: 192344 - protein, 35 aa, Artificial Sequence
  Description of Artificial Sequence: Synthetic polypeptide
DETEIRTTNPCATEAWGVTTNNNAEGNAEPIGIYI

SEQ ID NO: 192345 - protein, 36 aa, Artificial Sequence
  Description of Artificial Sequence: Synthetic polypeptide
DETEIRTTNPCATEAWGVVTTAANAEDTAEPTGTNI

SEQ ID NO: 192346 - protein, 36 aa, Artificial Sequence
  Description of Artificial Sequence: Synthetic polypeptide
DETEIRTTNPCATEAWGVVTTNANAEQNAETIGIYI

SEQ ID NO: 192347 - protein, 38 aa, Artificial Sequence
  Description of Artificial Sequence: Synthetic polypeptide
AEEEIRTTNPCATEQYGSVVTVVVTTQNATEAGTVDTD

SEQ ID NO: 192348 - protein, 38 aa, Artificial Sequence
  Description of Artificial Sequence: Synthetic polypeptide
AEEEIRTTNPCATEQYGVVATVVNQQQNATEAGTTDDD

SEQ ID NO: 192349 - protein, 37 aa, Artificial Sequence
  Description of Artificial Sequence: Synthetic polypeptide
DETEIRTTNPCATEAYGSVATTNANAEDEAEEEGIYI

SEQ ID NO: 192350 - protein, 37 aa, Artificial Sequence
  Description of Artificial Sequence: Synthetic polypeptide
TEEEIRTTNPVATEQYGQFVTDDWPDNGQDQLESDIP

SEQ ID NO: 192351 - protein, 37 aa, Artificial Sequence
  Description of Artificial Sequence: Synthetic polypeptide
TEEEIRTTNPVATEQYGQFPYPSMPVELGMLNGVEGW

SEQ ID NO: 192352 - protein, 38 aa, Artificial Sequence
  Description of Artificial Sequence: Synthetic polypeptide
TEEEIRTTNPVATEQYGQCVCSNWMEHNIENFNSDNQS

SEQ ID NO: 192353 - protein, 38 aa, Artificial Sequence
  Description of Artificial Sequence: Synthetic polypeptide
TEEEIRTTNPVATEQYGQCVCGNWGEDNQEHFGSDTQS

SEQ ID NO: 192354 - protein, 39 aa, Artificial Sequence
  Description of Artificial Sequence: Synthetic polypeptide
AEEEIRTTNPCATEQYGVVATVVNQQQNATEAYGTNDTT

SEQ ID NO: 192355 - protein, 37 aa, Artificial Sequence
  Description of Artificial Sequence: Synthetic polypeptide
DETEIRTTNPCATEAYGVVATTNANAEDTNNEEGTNI

SEQ ID NO: 192356 - protein, 37 aa, Artificial Sequence
  Description of Artificial Sequence: Synthetic polypeptide
DETEIRTTNPCATEAYGVVATTNANAEGTNNEEGIGE

SEQ ID NO: 192357 - protein, 36 aa, Artificial Sequence
  Description of Artificial Sequence: Synthetic polypeptide
DEAAIRTTNPVATEQYGCFCSWMEHNIENFGSDFQS

SEQ ID NO: 192358 - protein, 35 aa, Artificial Sequence
  Description of Artificial Sequence: Synthetic polypeptide
DETEIRTTNPCATEAWGCQTTANAEDHAENSGQNI

SEQ ID NO: 192359 - protein, 38 aa, Artificial Sequence
  Description of Artificial Sequence: Synthetic polypeptide
AEEEIRTTNPCATEQYGVVSTVVATQQNATEEGTTDTD

SEQ ID NO: 192360 - protein, 37 aa, Artificial Sequence
  Description of Artificial Sequence: Synthetic polypeptide
DETEIRTTNPCATEAYGVVATTNANANQTGTEEGITE

SEQ ID NO: 192361 - protein, 38 aa, Artificial Sequence
  Description of Artificial Sequence: Synthetic polypeptide
DETEIRTTNPCATEAYGVVATTNANANQTGTEEGSNID

SEQ ID NO: 192362 - protein, 37 aa, Artificial Sequence
  Description of Artificial Sequence: Synthetic polypeptide
TEEEIRTTNPVATEQYGKCVPEEAVMIQEVEGQLPIA

SEQ ID NO: 192363 - protein, 37 aa, Artificial Sequence
  Description of Artificial Sequence: Synthetic polypeptide
DETEIRTTNPCATEAYGVVATTNNNANDTGNEEGINI

SEQ ID NO: 192364 - protein, 39 aa, Artificial Sequence
  Description of Artificial Sequence: Synthetic polypeptide
AEEEIRTTNPCATEQYGVVSTVVNTQQGATEAYGTTDTD

SEQ ID NO: 192365 - protein, 38 aa, Artificial Sequence
  Description of Artificial Sequence: Synthetic polypeptide
AEEEIRTTNPCATEQYGVVSTVVNTTNNATEAGTEDTE

SEQ ID NO: 192366 - protein, 39 aa, Artificial Sequence
  Description of Artificial Sequence: Synthetic polypeptide
TEEEIRTTNPVATEQYGETYPSVVRMSEDPIRNQVLENI

SEQ ID NO: 192367 - protein, 39 aa, Artificial Sequence
  Description of Artificial Sequence: Synthetic polypeptide
TEEEIRTTNPVATEQYGETYPSVVKMSEDPSRFEVLENI

SEQ ID NO: 192368 - protein, 38 aa, Artificial Sequence
  Description of Artificial Sequence: Synthetic polypeptide
TEEEIRTTNPVATEQYGETYPSVVKMSEDPIVSVLENI

SEQ ID NO: 192369 - protein, 39 aa, Artificial Sequence
  Description of Artificial Sequence: Synthetic polypeptide
TEEEIRTTNPVATEQYGETYPSVVKMSEDPIRIQVLENT

SEQ ID NO: 192370 - protein, 38 aa, Artificial Sequence
  Description of Artificial Sequence: Synthetic polypeptide
TEEEIRTTNPVATEQYGETYPSIPKMSEDPSRQVLENI

SEQ ID NO: 192371 - protein, 38 aa, Artificial Sequence
  Description of Artificial Sequence: Synthetic polypeptide
TEEEIRTTNPVATEQYGETYPREVNMSEDPIRQVNENI

SEQ ID NO: 192372 - protein, 38 aa, Artificial Sequence
  Description of Artificial Sequence: Synthetic polypeptide
TEEEIRTTNPVATEQYGETYPQVVKMSEDPARQVLENI

SEQ ID NO: 192373 - protein, 34 aa, Artificial Sequence
  Description of Artificial Sequence: Synthetic polypeptide
DEDEIACTNPVAYEQWGCVAANNGGQAAPDGAPN

SEQ ID NO: 192374 - protein, 37 aa, Artificial Sequence
  Description of Artificial Sequence: Synthetic polypeptide
DETEIRTTNPCATEAYGVVATTNANANQTATEEGTQI

SEQ ID NO: 192375 - protein, 38 aa, Artificial Sequence
  Description of Artificial Sequence: Synthetic polypeptide
TEEEIRTTNPVATEQYGSCVPECAVMIQEVECGQLPIA

SEQ ID NO: 192376 - protein, 38 aa, Artificial Sequence
  Description of Artificial Sequence: Synthetic polypeptide
DEMEIRTTNPVATEQYGQCVCSNWGEDDNAENFNSDQA

SEQ ID NO: 192377 - protein, 37 aa, Artificial Sequence
  Description of Artificial Sequence: Synthetic polypeptide
DETEIRSTNPVATDQYGVVNDNSIGQNGGQEDNQDTD

SEQ ID NO: 192378 - protein, 37 aa, Artificial Sequence
  Description of Artificial Sequence: Synthetic polypeptide
DETEIKTTNPVATEGYGSVVTTGDSNEEGETGEGGET

SEQ ID NO: 192379 - protein, 36 aa, Artificial Sequence
  Description of Artificial Sequence: Synthetic polypeptide
DAEEIATTNPVAYMQYGSVCSAANPAEATGGDLAAM

SEQ ID NO: 192380 - protein, 35 aa, Artificial Sequence
  Description of Artificial Sequence: Synthetic polypeptide
VEDEIATTNPVATEMWGSVSAANPSEEAGMSIDEN

SEQ ID NO: 192381 - protein, 39 aa, Artificial Sequence
  Description of Artificial Sequence: Synthetic polypeptide
TEEEIRTTNPVATEQYGSTVTGPHDSNYPEMAQIEDNTQ

SEQ ID NO: 192382 - protein, 36 aa, Artificial Sequence
  Description of Artificial Sequence: Synthetic polypeptide
DETEINTTNPVAYEQYGETVVSYIHELSTESNGGLQ

SEQ ID NO: 192383 - protein, 37 aa, Artificial Sequence
  Description of Artificial Sequence: Synthetic polypeptide
DETEIRATNPVATEQYGSVDNPGDNNEEGETGEGGET

SEQ ID NO: 192384 - protein, 38 aa, Artificial Sequence
  Description of Artificial Sequence: Synthetic polypeptide
DETEIRATNPVATEQYGSVVTTFGDNNEEGETGEGGET

SEQ ID NO: 192385 - protein, 37 aa, Artificial Sequence
  Description of Artificial Sequence: Synthetic polypeptide
AEEEIRATNPVATEQYGSVCAANMGEEAGMMMGGADM

SEQ ID NO: 192386 - protein, 33 aa, Artificial Sequence
  Description of Artificial Sequence: Synthetic polypeptide
DETEIRCTNPIATECWGATTWSNAEDWMPGPYR

SEQ ID NO: 192387 - protein, 34 aa, Artificial Sequence
  Description of Artificial Sequence: Synthetic polypeptide
DCEEIRATNPVAYEQWGSSYYDEHMDQRREKIEV

SEQ ID NO: 192388 - protein, 34 aa, Artificial Sequence
  Description of Artificial Sequence: Synthetic polypeptide
DETEIRCTNPIATECYGETTWANAEDLAEPKGPI

SEQ ID NO: 192389 - protein, 33 aa, Artificial Sequence
  Description of Artificial Sequence: Synthetic polypeptide
DETEIRCTNPIATEQWGATANAEDLAEPKGGYI

SEQ ID NO: 192390 - protein, 33 aa, Artificial Sequence
  Description of Artificial Sequence: Synthetic polypeptide
DETEIRCTNPIATEQWGATANAEDLAEPKGPYI

SEQ ID NO: 192391 - protein, 35 aa, Artificial Sequence
  Description of Artificial Sequence: Synthetic polypeptide
AEEEIRCTNPTAYEQWGSTVYGENDDHQGGDGKTH

SEQ ID NO: 192392 - protein, 34 aa, Artificial Sequence
  Description of Artificial Sequence: Synthetic polypeptide
DETEIRCTNPIATEQWGATTANAEDLAEPKGPYI

SEQ ID NO: 192393 - protein, 35 aa, Artificial Sequence
  Description of Artificial Sequence: Synthetic polypeptide
DETEIRCTNPIATEQWGATTWANEEDWQERKGPYI

SEQ ID NO: 192394 - protein, 38 aa, Artificial Sequence
  Description of Artificial Sequence: Synthetic polypeptide
DEMEIRTTNPVATEQYGQCVCQNSGAHNIENFMSDNQS

SEQ ID NO: 192395 - protein, 38 aa, Artificial Sequence
  Description of Artificial Sequence: Synthetic polypeptide
TEEEIRTTNPVATEQYGSIHHTTLEDHNDDEYGDEEQF

SEQ ID NO: 192396 - protein, 38 aa, Artificial Sequence
  Description of Artificial Sequence: Synthetic polypeptide
DEEEIRTTNPVAYEQYGQCVCSWGEDHNAENFNSDFQP

SEQ ID NO: 192397 - protein, 33 aa, Artificial Sequence
  Description of Artificial Sequence: Synthetic polypeptide
DETEIRSTNPIATECWGATVANAEDLAPKGPYI

SEQ ID NO: 192398 - protein, 33 aa, Artificial Sequence
  Description of Artificial Sequence: Synthetic polypeptide
DETEIRSTNPIATECWGATTANADLAEPKGPYI

SEQ ID NO: 192399 - protein, 38 aa, Artificial Sequence
  Description of Artificial Sequence: Synthetic polypeptide
DEEEIRTTNPVAYEQYGQCVCSWGEDHNAENFNSDFQS

SEQ ID NO: 192400 - protein, 39 aa, Artificial Sequence
  Description of Artificial Sequence: Synthetic polypeptide
DETEIRGTNPVATEQYGTVVMGMNTNDQELLATGQTGEQ

SEQ ID NO: 192401 - protein, 38 aa, Artificial Sequence
  Description of Artificial Sequence: Synthetic polypeptide
DEDEIATTNPVATEQYGSACAATNPIEEAGDSQMGHSM

SEQ ID NO: 192402 - protein, 38 aa, Artificial Sequence
  Description of Artificial Sequence: Synthetic polypeptide
DETEIRGTNPVATEFYGTVMTSNGGQQTGGQGGTEQQR

SEQ ID NO: 192403 - protein, 37 aa, Artificial Sequence
  Description of Artificial Sequence: Synthetic polypeptide
DETEIRGTNPVATDQYGVVNDNSIGQNGGQGDNPDTD

SEQ ID NO: 192404 - protein, 38 aa, Artificial Sequence
  Description of Artificial Sequence: Synthetic polypeptide
DEMEIRTTNPVATEQYGQCVCSDWGEHNQENFSSDNQS

SEQ ID NO: 192405 - protein, 37 aa, Artificial Sequence
  Description of Artificial Sequence: Synthetic polypeptide
VEDEIATTNPVATEPYGSVVAANMGGLPAQDNNFHEN

SEQ ID NO: 192406 - protein, 36 aa, Artificial Sequence
  Description of Artificial Sequence: Synthetic polypeptide
DETEIRGTNPVATDAYGVVNDQSIGQNGGQEDNDTD

SEQ ID NO: 192407 - protein, 35 aa, Artificial Sequence
  Description of Artificial Sequence: Synthetic polypeptide
DETEIRCTNPIATEQWGSTTWSNAENWAEPKGPYI

SEQ ID NO: 192408 - protein, 37 aa, Artificial Sequence
  Description of Artificial Sequence: Synthetic polypeptide
AEEEIRCTNPVATEQYGCVCSNWGEHNDEHFGSDTQS

SEQ ID NO: 192409 - protein, 37 aa, Artificial Sequence
  Description of Artificial Sequence: Synthetic polypeptide
DETEIRGTNPVATDQYGVVNDNSVGQNGGQEDNEDTD

SEQ ID NO: 192410 - protein, 39 aa, Artificial Sequence
  Description of Artificial Sequence: Synthetic polypeptide
TEEEIRTTNPVATEQYGSYVQEPSFSEQTSDIVHQFEPL

SEQ ID NO: 192411 - protein, 37 aa, Artificial Sequence
  Description of Artificial Sequence: Synthetic polypeptide
DETEIATTNPVATEQYGSVCAANNGDENGMDIAIDFG

SEQ ID NO: 192412 - protein, 38 aa, Artificial Sequence
  Description of Artificial Sequence: Synthetic polypeptide
VEEEIRTTNPVATEQYGVVVDDQENVDVEGQGEGEETP

SEQ ID NO: 192413 - protein, 37 aa, Artificial Sequence
  Description of Artificial Sequence: Synthetic polypeptide
DEEEISTTNPVATEQYGCVCSMWMEHNQENFISETQS

SEQ ID NO: 192414 - protein, 38 aa, Artificial Sequence
  Description of Artificial Sequence: Synthetic polypeptide
DEEEISTTNPVATEQYGCVCSNSEEEHNAENFNSDTQS

SEQ ID NO: 192415 - protein, 38 aa, Artificial Sequence
  Description of Artificial Sequence: Synthetic polypeptide
DEEEIRTTNPVAYEQYGQCVCSWMEDHNQESFISQNQS

SEQ ID NO: 192416 - protein, 38 aa, Artificial Sequence
  Description of Artificial Sequence: Synthetic polypeptide
DEEEIRTTNPVATEQYGCVCGNWGEDHNAENFNSDNQS

SEQ ID NO: 192417 - protein, 38 aa, Artificial Sequence
  Description of Artificial Sequence: Synthetic polypeptide
DEEEIRTTNPVAYEQYGQCVCSNSGEHNIENFNSDNQA

SEQ ID NO: 192418 - protein, 36 aa, Artificial Sequence
  Description of Artificial Sequence: Synthetic polypeptide
DETEIATTNPVATAQWGSVSAGGDPGDTDHQGDEDN

SEQ ID NO: 192419 - protein, 35 aa, Artificial Sequence
  Description of Artificial Sequence: Synthetic polypeptide
DEDEIATTNPVATAQWGHTVCAANDGGVTDGGNDA

SEQ ID NO: 192420 - protein, 38 aa, Artificial Sequence
  Description of Artificial Sequence: Synthetic polypeptide
DEEEIRTTNPVAYEQYGQCVCSNSGEHNQEFFNSDFQS

SEQ ID NO: 192421 - protein, 36 aa, Artificial Sequence
  Description of Artificial Sequence: Synthetic polypeptide
DEEEIATTNPVAYEQWGHSACAAANGDAMQGGDQEQ

SEQ ID NO: 192422 - protein, 36 aa, Artificial Sequence
  Description of Artificial Sequence: Synthetic polypeptide
DETEIATTNPVATAQWGSVSLNGDPGGTDHQGDEDN

SEQ ID NO: 192423 - protein, 35 aa, Artificial Sequence
  Description of Artificial Sequence: Synthetic polypeptide
DEEEIATTNPVAYEQWGHSACAAANGLADSEVDDE

SEQ ID NO: 192424 - protein, 35 aa, Artificial Sequence
  Description of Artificial Sequence: Synthetic polypeptide
DETEIATTNPVATASWGCNSAANNEPLDNGEENGD

SEQ ID NO: 192425 - protein, 35 aa, Artificial Sequence
  Description of Artificial Sequence: Synthetic polypeptide
DETEIATTNPVATASWGCVAAANNEVTDRGGENDG

SEQ ID NO: 192426 - protein, 35 aa, Artificial Sequence
  Description of Artificial Sequence: Synthetic polypeptide
DEEEIATTNPVAYEQWGHSACAAANPDAMQGDQAQ

SEQ ID NO: 192427 - protein, 39 aa, Artificial Sequence
  Description of Artificial Sequence: Synthetic polypeptide
AEEEICTTNPVATEQYGVVSVTNPTEQGTESGSTTDQDD

SEQ ID NO: 192428 - protein, 34 aa, Artificial Sequence
  Description of Artificial Sequence: Synthetic polypeptide
DETEIATTNPVATECWGATTANAEDLAEPEGPYI

SEQ ID NO: 192429 - protein, 34 aa, Artificial Sequence
  Description of Artificial Sequence: Synthetic polypeptide
DEDEIATTNPVATAQWGGCCAGTGHQAEQQPNDN

SEQ ID NO: 192430 - protein, 34 aa, Artificial Sequence
  Description of Artificial Sequence: Synthetic polypeptide
DEMEIGTTNPVATEQYGCLCTATDGPVEFEHIEQ

SEQ ID NO: 192431 - protein, 38 aa, Artificial Sequence
  Description of Artificial Sequence: Synthetic polypeptide
DEEEISTTNPVATEQYGCVCSNSGEDHNAEFFNSDNQF

SEQ ID NO: 192432 - protein, 34 aa, Artificial Sequence
  Description of Artificial Sequence: Synthetic polypeptide
DEMEIGTTNPVATEQYGCLCTATDGPVEFEIQKQ

SEQ ID NO: 192433 - protein, 34 aa, Artificial Sequence
  Description of Artificial Sequence: Synthetic polypeptide
DEAEIRTTNPVAYEEWGCVCPNNNDMMDTNDEEP

SEQ ID NO: 192434 - protein, 38 aa, Artificial Sequence
  Description of Artificial Sequence: Synthetic polypeptide
DEEEISTTNPVATEQYGCVCSNSGEDHNAEHFNSDTQS

SEQ ID NO: 192435 - protein, 37 aa, Artificial Sequence
  Description of Artificial Sequence: Synthetic polypeptide
QEEEIATTNPVAYEQYGSVCAANMGEEAPDAQMEGDD

SEQ ID NO: 192436 - protein, 33 aa, Artificial Sequence
  Description of Artificial Sequence: Synthetic polypeptide
AESEIASTNPVGTEGYGVSCQSALNQHFGSDQA

SEQ ID NO: 192437 - protein, 37 aa, Artificial Sequence
  Description of Artificial Sequence: Synthetic polypeptide
VEDEIACTNPVATEQYGSTVCAANPLPQEHQDGTEHN

SEQ ID NO: 192438 - protein, 32 aa, Artificial Sequence
  Description of Artificial Sequence: Synthetic polypeptide
DETEIATTNPVATEQWGATANAEDWAEHKEPI

SEQ ID NO: 192439 - protein, 34 aa, Artificial Sequence
  Description of Artificial Sequence: Synthetic polypeptide
QEEEIATTNPVAYEQYGQEAWCEVEPSQAAEGEK

SEQ ID NO: 192440 - protein, 32 aa, Artificial Sequence
  Description of Artificial Sequence: Synthetic polypeptide
DETEIATTNPVATEQWGATPNEEDWAEHKEPK

SEQ ID NO: 192441 - protein, 33 aa, Artificial Sequence
  Description of Artificial Sequence: Synthetic polypeptide
DETEIATTNPVATEQWGATWPNAEDWAEHKEPK

SEQ ID NO: 192442 - protein, 33 aa, Artificial Sequence
  Description of Artificial Sequence: Synthetic polypeptide
DETEIATTNPVATEQWGATWPNEEDWAEHKEPK

SEQ ID NO: 192443 - protein, 34 aa, Artificial Sequence
  Description of Artificial Sequence: Synthetic polypeptide
DETEIATTNPVATECWGATTANAEDLAEPKGPYI

SEQ ID NO: 192444 - protein, 39 aa, Artificial Sequence
  Description of Artificial Sequence: Synthetic polypeptide
AEEEICTTNPVATEQYGVVSVTNNTEQGSEGGSTTDQDD

SEQ ID NO: 192445 - protein, 39 aa, Artificial Sequence
  Description of Artificial Sequence: Synthetic polypeptide
AEEEICTTNPVATEQYGVVSVTNAEQGTEQYGSTTDQDD

SEQ ID NO: 192446 - protein, 37 aa, Artificial Sequence
  Description of Artificial Sequence: Synthetic polypeptide
DEMEIATTNPVAYERWGSVCSTTDNHDRADGGLQESG

SEQ ID NO: 192447 - protein, 38 aa, Artificial Sequence
  Description of Artificial Sequence: Synthetic polypeptide
DEEEISTTNPVATEQYGCVCSMWGEDDNAENFNSETQS

SEQ ID NO: 192448 - protein, 35 aa, Artificial Sequence
  Description of Artificial Sequence: Synthetic polypeptide
DEDEIATTNPVATASWGCVAAANNEDTDRGGENTL

SEQ ID NO: 192449 - protein, 38 aa, Artificial Sequence
  Description of Artificial Sequence: Synthetic polypeptide
DEEEISTTNPVATEQYGCVCSMWGEDHNAENFGSETQA

SEQ ID NO: 192450 - protein, 39 aa, Artificial Sequence
  Description of Artificial Sequence: Synthetic polypeptide
DEEEIRTTNPVAYEQYGQCVCSNSGEDHNAENFGSDNQS

SEQ ID NO: 192451 - protein, 35 aa, Artificial Sequence
  Description of Artificial Sequence: Synthetic polypeptide
DEDEIATTNPVATASWGCVAAANNEDTDRGGENTA

SEQ ID NO: 192452 - protein, 38 aa, Artificial Sequence
  Description of Artificial Sequence: Synthetic polypeptide
DEEEISTTNPVATEQYGCVCSMWGEDHNAENFNSDNQS

SEQ ID NO: 192453 - protein, 40 aa, Artificial Sequence
  Description of Artificial Sequence: Synthetic polypeptide
DEEEIRTTNPVATEAYGTVSTNGNSNNEIGTTSISTTGNT

SEQ ID NO: 192454 - protein, 38 aa, Artificial Sequence
  Description of Artificial Sequence: Synthetic polypeptide
DEEEISTTNPVATEQYGCVCSMWGEDHNIENFISDNQS

SEQ ID NO: 192455 - protein, 40 aa, Artificial Sequence
  Description of Artificial Sequence: Synthetic polypeptide
DEEEIRTTNPVATEAYGTVSTNGNSDVGIGTTSISTTGNT

SEQ ID NO: 192456 - protein, 38 aa, Artificial Sequence
  Description of Artificial Sequence: Synthetic polypeptide
DEEEISTTNPVATEQYGCVCSMWGEDHNQEGFGSDTQS

SEQ ID NO: 192457 - protein, 36 aa, Artificial Sequence
  Description of Artificial Sequence: Synthetic polypeptide
DEEEIATTNPVAYEQWGGCTAGNNGLQAAPDGSIGN

SEQ ID NO: 192458 - protein, 35 aa, Artificial Sequence
  Description of Artificial Sequence: Synthetic polypeptide
DETEIATTNPIATEQYGATTWANAEDWQEPKGPYI

SEQ ID NO: 192459 - protein, 38 aa, Artificial Sequence
  Description of Artificial Sequence: Synthetic polypeptide
DEEEIRTTNPVAYEQYGQCVCSNSGEDNQENFNSDTQS

SEQ ID NO: 192460 - protein, 34 aa, Artificial Sequence
  Description of Artificial Sequence: Synthetic polypeptide
DEDEIATTNPVATASWGCVAAANNEDTDDGGENN

SEQ ID NO: 192461 - protein, 39 aa, Artificial Sequence
  Description of Artificial Sequence: Synthetic polypeptide
AEEEICTTNPVATEQYGVVSNTNVTEQGTEQGSTTDQDD

SEQ ID NO: 192462 - protein, 39 aa, Artificial Sequence
  Description of Artificial Sequence: Synthetic polypeptide
AEEEICTTNPVATEQYGVVSTTNPAEQGTEQGSTTDQDD

SEQ ID NO: 192463 - protein, 39 aa, Artificial Sequence
  Description of Artificial Sequence: Synthetic polypeptide
AEEEICTTNPVATEQYGVVSTTNTEQGTEQYGSTTDADD

SEQ ID NO: 192464 - protein, 38 aa, Artificial Sequence
  Description of Artificial Sequence: Synthetic polypeptide
DEEEIRTTNPVAYEQYGQCVCSNSGEHNAENFNSDTQS

SEQ ID NO: 192465 - protein, 37 aa, Artificial Sequence
  Description of Artificial Sequence: Synthetic polypeptide
DEEEISTTNPVATEQYGCVCSMWGEHNQENFPSDTQA

SEQ ID NO: 192466 - protein, 40 aa, Artificial Sequence
  Description of Artificial Sequence: Synthetic polypeptide
DEEEIRTTNPVATEAYGTVSTNGNSDEIGTTSISTTTGNT

SEQ ID NO: 192467 - protein, 35 aa, Artificial Sequence
  Description of Artificial Sequence: Synthetic polypeptide
DEAEIRTTNPVAYEEWGCVCPNNNDRQDDTGDEEP

SEQ ID NO: 192468 - protein, 39 aa, Artificial Sequence
  Description of Artificial Sequence: Synthetic polypeptide
QEEEIRTTNPVATEQYGQVSVMDDTNEMTGIEDGDEEGQ

SEQ ID NO: 192469 - protein, 38 aa, Artificial Sequence
  Description of Artificial Sequence: Synthetic polypeptide
QEEEIRTTNPVATEQYGQVSVMDDFNMTGPEDMDEGGQ

SEQ ID NO: 192470 - protein, 38 aa, Artificial Sequence
  Description of Artificial Sequence: Synthetic polypeptide
DEEEISTTNPVATEQYGCVCSNSGEDHNAENFNSDTQA

SEQ ID NO: 192471 - protein, 38 aa, Artificial Sequence
  Description of Artificial Sequence: Synthetic polypeptide
DEEEIRTTNPVAYEQYGQCVCSWMEDHNQENFNSQTQN

SEQ ID NO: 192472 - protein, 38 aa, Artificial Sequence
  Description of Artificial Sequence: Synthetic polypeptide
DEEEIRTTNPVAYEQYGQCVCSWMEDHNQENFGSQPQA

SEQ ID NO: 192473 - protein, 34 aa, Artificial Sequence
  Description of Artificial Sequence: Synthetic polypeptide
DEDEIATTNPVATASWGCVAAANNEDMDNGGENA

SEQ ID NO: 192474 - protein, 39 aa, Artificial Sequence
  Description of Artificial Sequence: Synthetic polypeptide
AEEEICTTNPVATEQYGVVSTTNYTEQGTEQGSTTDQED

SEQ ID NO: 192475 - protein, 37 aa, Artificial Sequence
  Description of Artificial Sequence: Synthetic polypeptide
DEEEIRTTNPVAYEQYGQCVCSWMEDHNINFISQTQA

SEQ ID NO: 192476 - protein, 36 aa, Artificial Sequence
  Description of Artificial Sequence: Synthetic polypeptide
DEDEIATTNPVATASWGCVAAANNEDQDRGGENDGM

SEQ ID NO: 192477 - protein, 38 aa, Artificial Sequence
  Description of Artificial Sequence: Synthetic polypeptide
DEEEIRTTNPVAYEQYGQCVCSNSGEHNAENFNSDNQA

SEQ ID NO: 192478 - protein, 38 aa, Artificial Sequence
  Description of Artificial Sequence: Synthetic polypeptide
DEEEIRTTNPVAYEQYGQCVCSNSGEHNAENFNSDNQL

SEQ ID NO: 192479 - protein, 33 aa, Artificial Sequence
  Description of Artificial Sequence: Synthetic polypeptide
QEEEIATTNPVAYEQYGEAPCEGECSGHAEGEK

SEQ ID NO: 192480 - protein, 35 aa, Artificial Sequence
  Description of Artificial Sequence: Synthetic polypeptide
DETEIATTNPVATEQWGCTAGNGGDTLAAGEEMID

SEQ ID NO: 192481 - protein, 39 aa, Artificial Sequence
  Description of Artificial Sequence: Synthetic polypeptide
DEEEIRTTNPVATEQYGCAVCSNSGEDHNTEGFNSDNQS

SEQ ID NO: 192482 - protein, 35 aa, Artificial Sequence
  Description of Artificial Sequence: Synthetic polypeptide
QEEEIATTNPVAYEQYGEHAPWCVHMFSQHAEGEW

SEQ ID NO: 192483 - protein, 34 aa, Artificial Sequence
  Description of Artificial Sequence: Synthetic polypeptide
DENEIRTTNPVSYEPWGKISCMEDISGQQNVGNF

SEQ ID NO: 192484 - protein, 34 aa, Artificial Sequence
  Description of Artificial Sequence: Synthetic polypeptide
DENEIRTTNPVSYEPWGKISCMEDISFQQTGGNH

SEQ ID NO: 192485 - protein, 36 aa, Artificial Sequence
  Description of Artificial Sequence: Synthetic polypeptide
DETEIATTNPVATEQYGCNVAANHSGDPAMHPGMQG

SEQ ID NO: 192486 - protein, 34 aa, Artificial Sequence
  Description of Artificial Sequence: Synthetic polypeptide
DENEIRTTNPVSYEPWGKISCMEDASQQMNGGNF

SEQ ID NO: 192487 - protein, 35 aa, Artificial Sequence
  Description of Artificial Sequence: Synthetic polypeptide
DENEIRTTNPVSYEPWGKISCHEDSISDQMNGGNL

SEQ ID NO: 192488 - protein, 36 aa, Artificial Sequence
  Description of Artificial Sequence: Synthetic polypeptide
DETEIATTNPVATEQYGCVAANHSGDPAAMHPGDQG

SEQ ID NO: 192489 - protein, 34 aa, Artificial Sequence
  Description of Artificial Sequence: Synthetic polypeptide
DENEIRTTNPVSYEPWGKISCDGDISQQQNGGNF

SEQ ID NO: 192490 - protein, 35 aa, Artificial Sequence
  Description of Artificial Sequence: Synthetic polypeptide
DENEIRTTNPVSYEPWGKIMSCLVDISQQQTGGNF

SEQ ID NO: 192491 - protein, 36 aa, Artificial Sequence
  Description of Artificial Sequence: Synthetic polypeptide
DENEIRTTNPVSYEPWGKIDSCMVSAISQQQTGGNF

SEQ ID NO: 192492 - protein, 37 aa, Artificial Sequence
  Description of Artificial Sequence: Synthetic polypeptide
DEDEIATTNPVATAQWGASVSATWPAGTNQGNGMEPV

SEQ ID NO: 192493 - protein, 31 aa, Artificial Sequence
  Description of Artificial Sequence: Synthetic polypeptide
AESEIASTNPVGTEGWGVCAPTDRDQHQGDI

SEQ ID NO: 192494 - protein, 37 aa, Artificial Sequence
  Description of Artificial Sequence: Synthetic polypeptide
DEMEIGTTNPVATEQYGCVCSNWGEDPNEEYFGSDQS

SEQ ID NO: 192495 - protein, 34 aa, Artificial Sequence
  Description of Artificial Sequence: Synthetic polypeptide
QEEEIATTNPVAYEQYGEAQCEVEASQHAEGEPK

SEQ ID NO: 192496 - protein, 35 aa, Artificial Sequence
  Description of Artificial Sequence: Synthetic polypeptide
QEEEIATTNPVAYEQYGEHAVWCEHEFSQHPEGEW

SEQ ID NO: 192497 - protein, 36 aa, Artificial Sequence
  Description of Artificial Sequence: Synthetic polypeptide
DETEIATTNPVATEQYGSCAAAPGHGQDSPDGSVQN

SEQ ID NO: 192498 - protein, 32 aa, Artificial Sequence
  Description of Artificial Sequence: Synthetic polypeptide
AESEIASTNPVGTEGWGVCAPTDRDQHNGDSR

SEQ ID NO: 192499 - protein, 32 aa, Artificial Sequence
  Description of Artificial Sequence: Synthetic polypeptide
AESEIASTNPVGTEGWGVCAPTDRDQHNGDNP

SEQ ID NO: 192500 - protein, 36 aa, Artificial Sequence
  Description of Artificial Sequence: Synthetic polypeptide
DEAEIRTTNPVAYECWGVVCYTTIDNQDGKGQDGEI

SEQ ID NO: 192501 - protein, 31 aa, Artificial Sequence
  Description of Artificial Sequence: Synthetic polypeptide
AESEIASTNPVGTEGWGVCAPTDRDQHGQDA

SEQ ID NO: 192502 - protein, 31 aa, Artificial Sequence
  Description of Artificial Sequence: Synthetic polypeptide
AESEIASTNPVGTEGWGVCAPTDRDQHGDVQ

SEQ ID NO: 192503 - protein, 34 aa, Artificial Sequence
  Description of Artificial Sequence: Synthetic polypeptide
QEEEIATTNPVAYEQYGEAPPCEVECSAHAEGEK

SEQ ID NO: 192504 - protein, 38 aa, Artificial Sequence
  Description of Artificial Sequence: Synthetic polypeptide
VEEEIRTTNPVATEQYGVYSSPSTASEPMSPVGHPPVC

SEQ ID NO: 192505 - protein, 36 aa, Artificial Sequence
  Description of Artificial Sequence: Synthetic polypeptide
DESEIRTTNPVATEQYGVVLNPVDPWDESPEGFEKN

SEQ ID NO: 192506 - protein, 37 aa, Artificial Sequence
  Description of Artificial Sequence: Synthetic polypeptide
DETEIATTNPVATEQYGSVCAAIEHIEAPDDQMGQLP

SEQ ID NO: 192507 - protein, 37 aa, Artificial Sequence
  Description of Artificial Sequence: Synthetic polypeptide
DETEIATTNPVATEQYGSVCAAMAHDEAGMPPDNHNH

SEQ ID NO: 192508 - protein, 38 aa, Artificial Sequence
  Description of Artificial Sequence: Synthetic polypeptide
VEEEIRTTNPVATEQYGVVVSNGFIQGQGFEGDQEGGN

SEQ ID NO: 192509 - protein, 36 aa, Artificial Sequence
  Description of Artificial Sequence: Synthetic polypeptide
DENEIRTTNPVSTEYYGCICSWEEPNQEQFGSDTQS

SEQ ID NO: 192510 - protein, 37 aa, Artificial Sequence
  Description of Artificial Sequence: Synthetic polypeptide
DETEIATTNPVATEQYGSVCAANMGEEAPDDGMEDAY

SEQ ID NO: 192511 - protein, 34 aa, Artificial Sequence
  Description of Artificial Sequence: Synthetic polypeptide
QEEEIATTNPVAYEQYGEAPCEVEFSMHAEGEQK

SEQ ID NO: 192512 - protein, 38 aa, Artificial Sequence
  Description of Artificial Sequence: Synthetic polypeptide
DEMEIATTNPVAYEQYGTVCSYTDGNNDEKMEGRNDDS

SEQ ID NO: 192513 - protein, 36 aa, Artificial Sequence
  Description of Artificial Sequence: Synthetic polypeptide
DETEIATTNPVATEQWGTNCSAAAAHGMNRGSGDSW

SEQ ID NO: 192514 - protein, 38 aa, Artificial Sequence
  Description of Artificial Sequence: Synthetic polypeptide
DETEIATTNPVATEQWGSVSSMTPAGGTNQGNGMEPVN

SEQ ID NO: 192515 - protein, 37 aa, Artificial Sequence
  Description of Artificial Sequence: Synthetic polypeptide
DEEEISTTNPVATEQYGCVCSNSGEHNAENFISDTQL

SEQ ID NO: 192516 - protein, 36 aa, Artificial Sequence
  Description of Artificial Sequence: Synthetic polypeptide
DETEIATTNPVATEQWGCVAGEGGPTANPNPMGAQA

SEQ ID NO: 192517 - protein, 36 aa, Artificial Sequence
  Description of Artificial Sequence: Synthetic polypeptide
DETEIATTNPVATEQWGCVAGEGPGIANAPGGNNAD

SEQ ID NO: 192518 - protein, 38 aa, Artificial Sequence
  Description of Artificial Sequence: Synthetic polypeptide
DEEEISTTNPVATEQYGCVCSNSGEDHNQEHFGSDTQA

SEQ ID NO: 192519 - protein, 35 aa, Artificial Sequence
  Description of Artificial Sequence: Synthetic polypeptide
VEDEIACTNPVATEQYGSVCAAGGLDNSMNEEANN

SEQ ID NO: 192520 - protein, 35 aa, Artificial Sequence
  Description of Artificial Sequence: Synthetic polypeptide
QEEEIATTNPVAYEQYGEVAPCEVEWSQHAEGEQK

SEQ ID NO: 192521 - protein, 35 aa, Artificial Sequence
  Description of Artificial Sequence: Synthetic polypeptide
DENEIRTTNPVSYERWGKISCMVEAISQQQTGGNF

SEQ ID NO: 192522 - protein, 38 aa, Artificial Sequence
  Description of Artificial Sequence: Synthetic polypeptide
DEEEISTTNPVATEQYGCVCSNSGEDHNQENFGSDTQA

SEQ ID NO: 192523 - protein, 38 aa, Artificial Sequence
  Description of Artificial Sequence: Synthetic polypeptide
DEEEISTTNPVATEQYGCVCSNSGEDHNQENFNSDNQS

SEQ ID NO: 192524 - protein, 35 aa, Artificial Sequence
  Description of Artificial Sequence: Synthetic polypeptide
DEEEIATTNPVAYEQWGPNACAAANGLQDSEVDDS

SEQ ID NO: 192525 - protein, 36 aa, Artificial Sequence
  Description of Artificial Sequence: Synthetic polypeptide
VEDEIACTNPVATEQYGSVCADGAGGLEHQDGAEMK

SEQ ID NO: 192526 - protein, 36 aa, Artificial Sequence
  Description of Artificial Sequence: Synthetic polypeptide
DENEIRTTNPVSYEPYGTVISCFEDAISHQQNGGNH

SEQ ID NO: 192527 - protein, 38 aa, Artificial Sequence
  Description of Artificial Sequence: Synthetic polypeptide
DEEEISTTNPVATEQYGCVCSNSGEDHNQEYFNSDTQS

SEQ ID NO: 192528 - protein, 35 aa, Artificial Sequence
  Description of Artificial Sequence: Synthetic polypeptide
DENEIRTTNPVSYEPYGTTISMEDMISQQQNGGNQ

SEQ ID NO: 192529 - protein, 34 aa, Artificial Sequence
  Description of Artificial Sequence: Synthetic polypeptide
QEEEIATTNPVAYEQYGELAWCEVEFSQHAEGEL

SEQ ID NO: 192530 - protein, 36 aa, Artificial Sequence
  Description of Artificial Sequence: Synthetic polypeptide
DETEIATTNPVATEQWGSVSAQAPPDEATRASLASL

SEQ ID NO: 192531 - protein, 35 aa, Artificial Sequence
  Description of Artificial Sequence: Synthetic polypeptide
VEDEIACTNPVATEQYGSVCAPAGPLDNDMNNNDN

SEQ ID NO: 192532 - protein, 38 aa, Artificial Sequence
  Description of Artificial Sequence: Synthetic polypeptide
VEDEIACTNPVATEQYGSVCSAANTAAMNAHGGDNEAM

SEQ ID NO: 192533 - protein, 37 aa, Artificial Sequence
  Description of Artificial Sequence: Synthetic polypeptide
DEEEISTTNPVATEQYGCVCSNSGEHNAENFISDTQG

SEQ ID NO: 192534 - protein, 35 aa, Artificial Sequence
  Description of Artificial Sequence: Synthetic polypeptide
DENEIRTTNPVSYEPWGKISCMVDISQQQNGGNNF

SEQ ID NO: 192535 - protein, 36 aa, Artificial Sequence
  Description of Artificial Sequence: Synthetic polypeptide
DAVEIATTNPVAYEQYGSVCSAANPAEATGGDLDAM

SEQ ID NO: 192536 - protein, 35 aa, Artificial Sequence
  Description of Artificial Sequence: Synthetic polypeptide
DENEIRTTNPVSYEPWGQKISCMVDISQQQTGGNK

SEQ ID NO: 192537 - protein, 34 aa, Artificial Sequence
  Description of Artificial Sequence: Synthetic polypeptide
QEEEIATTNPVAYEQYGEHAWCEHEISQSAVGEL

SEQ ID NO: 192538 - protein, 37 aa, Artificial Sequence
  Description of Artificial Sequence: Synthetic polypeptide
DEEEISTTNPVATEQYGCVCSNSGEHDAENFISDTQS

SEQ ID NO: 192539 - protein, 36 aa, Artificial Sequence
  Description of Artificial Sequence: Synthetic polypeptide
DETEIATTNPVATEQWGCVAGEGGGGENTADGNSEE

SEQ ID NO: 192540 - protein, 37 aa, Artificial Sequence
  Description of Artificial Sequence: Synthetic polypeptide
DEEEISTTNPVATEQYGCVCSNSGEEHNQENFISDQS

SEQ ID NO: 192541 - protein, 35 aa, Artificial Sequence
  Description of Artificial Sequence: Synthetic polypeptide
DEEEIATTNPVAYEQWGSACAAANGLDNSMEVDDS

SEQ ID NO: 192542 - protein, 38 aa, Artificial Sequence
  Description of Artificial Sequence: Synthetic polypeptide
DEEEISTTNPVATEQYGCVCSNSGEDPNQEHFNSDTQS

SEQ ID NO: 192543 - protein, 38 aa, Artificial Sequence
  Description of Artificial Sequence: Synthetic polypeptide
DEEEISTTNPVATEQYGCVCSNSGEDPNAENFNSDTQS

SEQ ID NO: 192544 - protein, 38 aa, Artificial Sequence
  Description of Artificial Sequence: Synthetic polypeptide
DEEEISTTNPVATEQYGCVCSNSGEDPNAENFNSDTQA

SEQ ID NO: 192545 - protein, 34 aa, Artificial Sequence
  Description of Artificial Sequence: Synthetic polypeptide
DENEIRTTNPVSYEPWGTISCMEDISQQNNGGNH

SEQ ID NO: 192546 - protein, 35 aa, Artificial Sequence
  Description of Artificial Sequence: Synthetic polypeptide
DENEIRTTNPVSYEPWGTISCMEDISTQQNGGNMH

SEQ ID NO: 192547 - protein, 34 aa, Artificial Sequence
  Description of Artificial Sequence: Synthetic polypeptide
DENEIRTTNPVSYEPWGTISCCEDEISQQQNGNH

SEQ ID NO: 192548 - protein, 34 aa, Artificial Sequence
  Description of Artificial Sequence: Synthetic polypeptide
DETEIACTNPVATEQWGCWNATGTPLPAPMENHN

SEQ ID NO: 192549 - protein, 37 aa, Artificial Sequence
  Description of Artificial Sequence: Synthetic polypeptide
DEEEIATTNPVATEQYGSACAGMTHGGAEAPIDDNHT

SEQ ID NO: 192550 - protein, 37 aa, Artificial Sequence
  Description of Artificial Sequence: Synthetic polypeptide
DEMEIRTTNPVATEQYGCVPPVPNQWTEEEIWQESRF

SEQ ID NO: 192551 - protein, 37 aa, Artificial Sequence
  Description of Artificial Sequence: Synthetic polypeptide
DEQEAEIRTTNPVAYEPWGVASTGDNDRPGERQDNNI

SEQ ID NO: 192552 - protein, 37 aa, Artificial Sequence
  Description of Artificial Sequence: Synthetic polypeptide
DEQEAEIRTTNPVAYEAWGVASTGDNDRPGERQDNAQ

SEQ ID NO: 192553 - protein, 36 aa, Artificial Sequence
  Description of Artificial Sequence: Synthetic polypeptide
DEEEISTTNPCATEQYGCVCGWGEHNQENFNSDTAS

SEQ ID NO: 192554 - protein, 35 aa, Artificial Sequence
  Description of Artificial Sequence: Synthetic polypeptide
DESEIRTTNPVSTEHWGCIAPEDMQQQQQQRGTNS

SEQ ID NO: 192555 - protein, 35 aa, Artificial Sequence
  Description of Artificial Sequence: Synthetic polypeptide
DEQEIATTNPVATEQWGCTAGNGGDTLAAGEEMGV

SEQ ID NO: 192556 - protein, 35 aa, Artificial Sequence
  Description of Artificial Sequence: Synthetic polypeptide
DESEIRTTNPVSTEPWGCIAPEDGQQHQQQRGTNS

SEQ ID NO: 192557 - protein, 35 aa, Artificial Sequence
  Description of Artificial Sequence: Synthetic polypeptide
AEECIATTNPVATEQYGCSCPNWMEDNQHFNSEQA

SEQ ID NO: 192558 - protein, 35 aa, Artificial Sequence
  Description of Artificial Sequence: Synthetic polypeptide
DESEIRTTNPVSTEPWGCIAPEDGQQQQQRVGTNS

SEQ ID NO: 192559 - protein, 35 aa, Artificial Sequence
  Description of Artificial Sequence: Synthetic polypeptide
DESEIRTTNPVSTEPWGCIAPEDLQQQNQQRGTES

SEQ ID NO: 192560 - protein, 36 aa, Artificial Sequence
  Description of Artificial Sequence: Synthetic polypeptide
TNQEIATTNPVAYEQWGEVSHTQNGLDQGGPGGGIS

SEQ ID NO: 192561 - protein, 35 aa, Artificial Sequence
  Description of Artificial Sequence: Synthetic polypeptide
TNQEIATTNPVATEAYGCVCPTNDNQDQGQQQGQD

SEQ ID NO: 192562 - protein, 37 aa, Artificial Sequence
  Description of Artificial Sequence: Synthetic polypeptide
DEMEICTTNPVATEQYGSVNNEEMNVDSNAYEETNNQ

SEQ ID NO: 192563 - protein, 36 aa, Artificial Sequence
  Description of Artificial Sequence: Synthetic polypeptide
DEDEIATTNPVAYESWGTVCSNDNHDNQPGQQGNEH

SEQ ID NO: 192564 - protein, 35 aa, Artificial Sequence
  Description of Artificial Sequence: Synthetic polypeptide
TNNAEIATTNPVAYERWGSVACITNWQGGQGQNEG

SEQ ID NO: 192565 - protein, 37 aa, Artificial Sequence
  Description of Artificial Sequence: Synthetic polypeptide
DEMEICTTNPVATEQYGCACVCSATDGSTVEFEGDDV

SEQ ID NO: 192566 - protein, 34 aa, Artificial Sequence
  Description of Artificial Sequence: Synthetic polypeptide
DESEIRTTNPVSTEPWGCIAPEDQQDQQQRDTNH

SEQ ID NO: 192567 - protein, 35 aa, Artificial Sequence
  Description of Artificial Sequence: Synthetic polypeptide
DESEIRTTNPVSTEPWGCIAPEDQQDQQQRIGTNS

SEQ ID NO: 192568 - protein, 38 aa, Artificial Sequence
  Description of Artificial Sequence: Synthetic polypeptide
DEEEIRTTNPVAYEQYGQCAVCSWGEHNQEFFNSDNQS

SEQ ID NO: 192569 - protein, 38 aa, Artificial Sequence
  Description of Artificial Sequence: Synthetic polypeptide
DEEEISTTNPCATEQYGCVCPNWGEDHNQEYFGSQNQA

SEQ ID NO: 192570 - protein, 34 aa, Artificial Sequence
  Description of Artificial Sequence: Synthetic polypeptide
DESEIRTTNPVSTEPWGCIAPEDQQQDQQQGGNP

SEQ ID NO: 192571 - protein, 36 aa, Artificial Sequence
  Description of Artificial Sequence: Synthetic polypeptide
CEDEIATTNPVAYEQYGSCAATGPALGQNHMGMQMN

SEQ ID NO: 192572 - protein, 38 aa, Artificial Sequence
  Description of Artificial Sequence: Synthetic polypeptide
DEMEIRTTNPVATEGYGICVTSTWGEHNAENFNSDPQA

SEQ ID NO: 192573 - protein, 33 aa, Artificial Sequence
  Description of Artificial Sequence: Synthetic polypeptide
DESEIRTTNPVSTEPWGCIAPEDQQQQQQIGTD

SEQ ID NO: 192574 - protein, 34 aa, Artificial Sequence
  Description of Artificial Sequence: Synthetic polypeptide
DESEIRTTNPVSTEPWGCIAPEDQQQQQQQGANS

SEQ ID NO: 192575 - protein, 39 aa, Artificial Sequence
  Description of Artificial Sequence: Synthetic polypeptide
DEEEIRTTNPVATEAYGTVTTIGTSNVIGTTSISTTGNT

SEQ ID NO: 192576 - protein, 35 aa, Artificial Sequence
  Description of Artificial Sequence: Synthetic polypeptide
AEEEIASVNPVCTEQYGQVVCSWEHNQSFGSDNQA

SEQ ID NO: 192577 - protein, 34 aa, Artificial Sequence
  Description of Artificial Sequence: Synthetic polypeptide
DESEIRTTNPVSTEPWGCIAPEDQQQQQTRGTSS

SEQ ID NO: 192578 - protein, 31 aa, Artificial Sequence
  Description of Artificial Sequence: Synthetic polypeptide
QEGEIASTNPCSYEQWGCGYCNDGQSHGDTR

SEQ ID NO: 192579 - protein, 39 aa, Artificial Sequence
  Description of Artificial Sequence: Synthetic polypeptide
DEEEIRTTNPVATEAYGTVTTIGNVDEIGTTSISTTGNT

SEQ ID NO: 192580 - protein, 35 aa, Artificial Sequence
  Description of Artificial Sequence: Synthetic polypeptide
AEEEIASVNPVCTEQYGVVCSNSGNHNQSFGSDQA

SEQ ID NO: 192581 - protein, 34 aa, Artificial Sequence
  Description of Artificial Sequence: Synthetic polypeptide
TNESEIATTNPVAYERWGVCATNLPGDHGENGQK

SEQ ID NO: 192582 - protein, 37 aa, Artificial Sequence
  Description of Artificial Sequence: Synthetic polypeptide
DEQEAEIRTTNPVAYEPWGVASTGDNDRPGERQDRAT

SEQ ID NO: 192583 - protein, 35 aa, Artificial Sequence
  Description of Artificial Sequence: Synthetic polypeptide
DEEEISTTNPCATEGYGCCCSWEDDNAENFGSDQA

SEQ ID NO: 192584 - protein, 37 aa, Artificial Sequence
  Description of Artificial Sequence: Synthetic polypeptide
DEQEAEIRTTNPVAYEPWGVASTGDNDRPGERQNNAP

SEQ ID NO: 192585 - protein, 36 aa, Artificial Sequence
  Description of Artificial Sequence: Synthetic polypeptide
QEEEIKTTNPVATEQYGVVMAGPGEGEGGQGENENT

SEQ ID NO: 192586 - protein, 37 aa, Artificial Sequence
  Description of Artificial Sequence: Synthetic polypeptide
DEMEICTTNPVATEQYGCACVCSATDGSTVEFEYNDI

SEQ ID NO: 192587 - protein, 36 aa, Artificial Sequence
  Description of Artificial Sequence: Synthetic polypeptide
DEHEIRTTNPVAYECWGSTVYQRINENQDRQMKTDG

SEQ ID NO: 192588 - protein, 39 aa, Artificial Sequence
  Description of Artificial Sequence: Synthetic polypeptide
DEEEIRTTNPVATEAYGTVTTQGNSDEIGTTSISTTENT

SEQ ID NO: 192589 - protein, 35 aa, Artificial Sequence
  Description of Artificial Sequence: Synthetic polypeptide
AEEEIASVNPVCTEQYGCVCSMWMELNQSFGSDQA

SEQ ID NO: 192590 - protein, 35 aa, Artificial Sequence
  Description of Artificial Sequence: Synthetic polypeptide
DESEIRTTNPVAYESWGVVSGGNAGNADNGGKGDQ

SEQ ID NO: 192591 - protein, 37 aa, Artificial Sequence
  Description of Artificial Sequence: Synthetic polypeptide
QEEEIKTTNPVATEQYGSVVDLMQNNGQTEDDQEEGD

SEQ ID NO: 192592 - protein, 35 aa, Artificial Sequence
  Description of Artificial Sequence: Synthetic polypeptide
TTTEIATTNPVAYERWGSAVCDGGLQDDRQHQGNH

SEQ ID NO: 192593 - protein, 36 aa, Artificial Sequence
  Description of Artificial Sequence: Synthetic polypeptide
DESEIRTTNPVAYQQYGCVCIWINDDMERNQHDGAM

SEQ ID NO: 192594 - protein, 36 aa, Artificial Sequence
  Description of Artificial Sequence: Synthetic polypeptide
DEMEIRTTNPVATEGWGCVCSWGEPNTEYFGSDTQA

SEQ ID NO: 192595 - protein, 38 aa, Artificial Sequence
  Description of Artificial Sequence: Synthetic polypeptide
QEEEIRGTNPVATEQYGSVVSAIMVGGDINQGENTGDE

SEQ ID NO: 192596 - protein, 35 aa, Artificial Sequence
  Description of Artificial Sequence: Synthetic polypeptide
DEQEIATTNPAVATLEYWGSISATDLEGHEDFEDT

SEQ ID NO: 192597 - protein, 37 aa, Artificial Sequence
  Description of Artificial Sequence: Synthetic polypeptide
AEECIRTTNPVATEQWGCVCQTWGEHNQEGFGSDNQS

SEQ ID NO: 192598 - protein, 37 aa, Artificial Sequence
  Description of Artificial Sequence: Synthetic polypeptide
DEDEIRSTNPVATDQYGVVNDNSIGQNGGQEDNDDVE

SEQ ID NO: 192599 - protein, 37 aa, Artificial Sequence
  Description of Artificial Sequence: Synthetic polypeptide
DEDEIRSTNPVATDQYGVVNDNSIGQNGGQEDNDTDA

SEQ ID NO: 192600 - protein, 37 aa, Artificial Sequence
  Description of Artificial Sequence: Synthetic polypeptide
DEDEIRSTNPVATESYGDAVTDNDDDQEEGQDEENGD

SEQ ID NO: 192601 - protein, 33 aa, Artificial Sequence
  Description of Artificial Sequence: Synthetic polypeptide
TTTEIATTNPVAYERWGVVPTTGLWDGGTQNGE

SEQ ID NO: 192602 - protein, 36 aa, Artificial Sequence
  Description of Artificial Sequence: Synthetic polypeptide
DEHEIRTTNPVAYECWGCVFGGNGEVNRNNMGNGNQ

SEQ ID NO: 192603 - protein, 38 aa, Artificial Sequence
  Description of Artificial Sequence: Synthetic polypeptide
QEEEIRGTNPVATEQYGSVVSAIMVGGDINQGQEDIDN

SEQ ID NO: 192604 - protein, 34 aa, Artificial Sequence
  Description of Artificial Sequence: Synthetic polypeptide
AEEEIASVNPVCTEQYGCVCSWEEHNQSFGSDQA

SEQ ID NO: 192605 - protein, 34 aa, Artificial Sequence
  Description of Artificial Sequence: Synthetic polypeptide
AEEEIASVNPVCTEQYGCVCSWEDNQSFGSETQA

SEQ ID NO: 192606 - protein, 37 aa, Artificial Sequence
  Description of Artificial Sequence: Synthetic polypeptide
DEEEISTTNPCATEEYGCVCGTWGEHNAENFGSDNAA

SEQ ID NO: 192607 - protein, 36 aa, Artificial Sequence
  Description of Artificial Sequence: Synthetic polypeptide
QEEEIKTTNPVATEFYGQVVDDEMNTGDEGGNTTTA

SEQ ID NO: 192608 - protein, 34 aa, Artificial Sequence
  Description of Artificial Sequence: Synthetic polypeptide
DESEIRTTNPVSTEPWGCIAPGDQQQQQQRPGTK

SEQ ID NO: 192609 - protein, 35 aa, Artificial Sequence
  Description of Artificial Sequence: Synthetic polypeptide
AEEEIASVNPVCTEQYGCVCSNWGEHNQSFGSNQA

SEQ ID NO: 192610 - protein, 35 aa, Artificial Sequence
  Description of Artificial Sequence: Synthetic polypeptide
TQGEIRTTNPVATEQYGCTGTYEIVTDERQEDNPE

SEQ ID NO: 192611 - protein, 36 aa, Artificial Sequence
  Description of Artificial Sequence: Synthetic polypeptide
TQSEIRTTNPVATEEWGSVVSCGHEFSQDGEGENGW

SEQ ID NO: 192612 - protein, 35 aa, Artificial Sequence
  Description of Artificial Sequence: Synthetic polypeptide
TSEAEIRTTNPVAYEQWGCVCINNNDEMDTGDNEQ

SEQ ID NO: 192613 - protein, 35 aa, Artificial Sequence
  Description of Artificial Sequence: Synthetic polypeptide
TSEEIATTNPVAYHSYGSVVHSVWHSQENGGINFQ

SEQ ID NO: 192614 - protein, 38 aa, Artificial Sequence
  Description of Artificial Sequence: Synthetic polypeptide
CEEEIRTTNCVATEQYGVVSILIPTGDNDDGEGMDIGD

SEQ ID NO: 192615 - protein, 38 aa, Artificial Sequence
  Description of Artificial Sequence: Synthetic polypeptide
CEEEIRTTNCVATEQYGVVSILIPTGDNDDGEGGQIGQ

SEQ ID NO: 192616 - protein, 40 aa, Artificial Sequence
  Description of Artificial Sequence: Synthetic polypeptide
AETEICTTNPVATEAYGSVSTVSTEDEIGTNLQIGTNEGG

SEQ ID NO: 192617 - protein, 37 aa, Artificial Sequence
  Description of Artificial Sequence: Synthetic polypeptide
AEECIRTTNPVATEQYGCSCSNWGEHNAEYFQSDTQA

SEQ ID NO: 192618 - protein, 35 aa, Artificial Sequence
  Description of Artificial Sequence: Synthetic polypeptide
DESEIRTTNPVSTEPWGCIAPIDQQQQQQRPGTNS

SEQ ID NO: 192619 - protein, 34 aa, Artificial Sequence
  Description of Artificial Sequence: Synthetic polypeptide
DESEIRTTNPVSTEPWGCIAPNDQQQQQQRATKS

SEQ ID NO: 192620 - protein, 37 aa, Artificial Sequence
  Description of Artificial Sequence: Synthetic polypeptide
DEEEISTTNPCATEQYGCVCQNSGEHNAENFGSDTAS

SEQ ID NO: 192621 - protein, 37 aa, Artificial Sequence
  Description of Artificial Sequence: Synthetic polypeptide
DESEISTTNCVATDAYGSVSNVTRGNQGQLEGGQGDT

SEQ ID NO: 192622 - protein, 34 aa, Artificial Sequence
  Description of Artificial Sequence: Synthetic polypeptide
DESEISTTNPVATCHYGCVCSWGEHNQYFTSDQS

SEQ ID NO: 192623 - protein, 38 aa, Artificial Sequence
  Description of Artificial Sequence: Synthetic polypeptide
CEEEIRTTNPVATEQYGCQVCSNWGEHNQENFNSDNQA

SEQ ID NO: 192624 - protein, 36 aa, Artificial Sequence
  Description of Artificial Sequence: Synthetic polypeptide
DESEISTTNPVATEAWGCVCSWMEENAENFGSDNQS

SEQ ID NO: 192625 - protein, 38 aa, Artificial Sequence
  Description of Artificial Sequence: Synthetic polypeptide
DEDEIRTTNPVATAQWGAVSATTPAQGTNQGNGMEPVN

SEQ ID NO: 192626 - protein, 33 aa, Artificial Sequence
  Description of Artificial Sequence: Synthetic polypeptide
VEDEIACTNPVATEQWGCTAGNGLADAMHNDNS

SEQ ID NO: 192627 - protein, 38 aa, Artificial Sequence
  Description of Artificial Sequence: Synthetic polypeptide
CEEEIRTTNPVATEQYGCVCGMWGEDHNQEGFNSDTQS

SEQ ID NO: 192628 - protein, 37 aa, Artificial Sequence
  Description of Artificial Sequence: Synthetic polypeptide
DEEEISTTNPCATEQYGCVCSNWGEHNIENFNSDNQS

SEQ ID NO: 192629 - protein, 31 aa, Artificial Sequence
  Description of Artificial Sequence: Synthetic polypeptide
QEGEIASTNPCSYEQWGITCYCNDQTSGDHR

SEQ ID NO: 192630 - protein, 37 aa, Artificial Sequence
  Description of Artificial Sequence: Synthetic polypeptide
TGEEIATTNPVAYEQWGSCVQNGGNAGEDLMREGNEP

SEQ ID NO: 192631 - protein, 35 aa, Artificial Sequence
  Description of Artificial Sequence: Synthetic polypeptide
TGEEIATTNPCATEEYGCVCYTNDNQDQHGQQGDA

SEQ ID NO: 192632 - protein, 34 aa, Artificial Sequence
  Description of Artificial Sequence: Synthetic polypeptide
TGEAEIATTNPCAYERWGSVCYNNDDQDHGQNGH

SEQ ID NO: 192633 - protein, 34 aa, Artificial Sequence
  Description of Artificial Sequence: Synthetic polypeptide
TGEAEIATTNPCAYEHWGSVCYNNDDQDHGDNDL

SEQ ID NO: 192634 - protein, 31 aa, Artificial Sequence
  Description of Artificial Sequence: Synthetic polypeptide
QEGEIASTNPCSYEQWGITCYCNDQSGDMMR

SEQ ID NO: 192635 - protein, 34 aa, Artificial Sequence
  Description of Artificial Sequence: Synthetic polypeptide
TGEAEIATTNPCAYEAWGSVCYNNDDQDHGHNDH

SEQ ID NO: 192636 - protein, 37 aa, Artificial Sequence
  Description of Artificial Sequence: Synthetic polypeptide
DESEISTTNPVATEQYGCVCSMWGEHNQESFNSDNQS

SEQ ID NO: 192637 - protein, 38 aa, Artificial Sequence
  Description of Artificial Sequence: Synthetic polypeptide
DESEISTTNPVATEQYGCVCSNWGEDHNQENFGSDNQA

SEQ ID NO: 192638 - protein, 31 aa, Artificial Sequence
  Description of Artificial Sequence: Synthetic polypeptide
QEGEIASTNPCSYEQWGITYCFNDQGSGDTR

SEQ ID NO: 192639 - protein, 37 aa, Artificial Sequence
  Description of Artificial Sequence: Synthetic polypeptide
DESEISTTNPVATEQYGQCVCSMSEEHNQSFNSDNQS

SEQ ID NO: 192640 - protein, 36 aa, Artificial Sequence
  Description of Artificial Sequence: Synthetic polypeptide
TEYEIRATNPVATEQYGTVTTVWLPDEQENMQIDEI

SEQ ID NO: 192641 - protein, 38 aa, Artificial Sequence
  Description of Artificial Sequence: Synthetic polypeptide
DESEISTTNPVATEQYGQCVCSNWGEHNQENFGSDNQA

SEQ ID NO: 192642 - protein, 37 aa, Artificial Sequence
  Description of Artificial Sequence: Synthetic polypeptide
CEEEIRTTNPVATEQYGCVCPWGEDHNQENFNSDNQE

SEQ ID NO: 192643 - protein, 31 aa, Artificial Sequence
  Description of Artificial Sequence: Synthetic polypeptide
QEGEIASTNPCSYEQWGITYCNDQGQHGDTR

SEQ ID NO: 192644 - protein, 33 aa, Artificial Sequence
  Description of Artificial Sequence: Synthetic polypeptide
TEVSIAATNPVAYDPWGMVPSCTAEHSPRGTNR

SEQ ID NO: 192645 - protein, 38 aa, Artificial Sequence
  Description of Artificial Sequence: Synthetic polypeptide
QEEEIRGTNPVATEQYGSVVVIMQGMGEQDEGEEGEVR

SEQ ID NO: 192646 - protein, 38 aa, Artificial Sequence
  Description of Artificial Sequence: Synthetic polypeptide
DEMEIRTTNPVATEGYGQCVTSTWGAHNAEHFNSDPQS

SEQ ID NO: 192647 - protein, 39 aa, Artificial Sequence
  Description of Artificial Sequence: Synthetic polypeptide
QEEEIRGTNPVATEQYGTVVMGPNTNDQELLATGQTGEN

SEQ ID NO: 192648 - protein, 33 aa, Artificial Sequence
  Description of Artificial Sequence: Synthetic polypeptide
TEVEIASVNPVCYEPYGVTVSGISLSQSVGNNV

SEQ ID NO: 192649 - protein, 34 aa, Artificial Sequence
  Description of Artificial Sequence: Synthetic polypeptide
DEDEIATTNPVAYERWGTCVYTDIPNDQHHMDEE

SEQ ID NO: 192650 - protein, 36 aa, Artificial Sequence
  Description of Artificial Sequence: Synthetic polypeptide
DESEISTTNPVATEQYGCVCSMWEEHAESFNSDNQS

SEQ ID NO: 192651 - protein, 34 aa, Artificial Sequence
  Description of Artificial Sequence: Synthetic polypeptide
DEDEIATTNPVATEQWGGCCAGTGHPAEAQPMRN

SEQ ID NO: 192652 - protein, 34 aa, Artificial Sequence
  Description of Artificial Sequence: Synthetic polypeptide
TGESEIATTNPCAYEHWGSVCYNNDDLDHGQNDH

SEQ ID NO: 192653 - protein, 37 aa, Artificial Sequence
  Description of Artificial Sequence: Synthetic polypeptide
CEEEIRTTNPVATEGYGCVCSNWGEHNQENFNSDTQA

SEQ ID NO: 192654 - protein, 34 aa, Artificial Sequence
  Description of Artificial Sequence: Synthetic polypeptide
VEDEIACTNPVATAQWGCTTAGNGLGARGHDNSD

SEQ ID NO: 192655 - protein, 34 aa, Artificial Sequence
  Description of Artificial Sequence: Synthetic polypeptide
AEEEIASVNPVCTEQYGVVCSSGEHNASFGSDQS

SEQ ID NO: 192656 - protein, 33 aa, Artificial Sequence
  Description of Artificial Sequence: Synthetic polypeptide
VEDEIACTNPVATAQWGGCVASANDDANGDISD

SEQ ID NO: 192657 - protein, 37 aa, Artificial Sequence
  Description of Artificial Sequence: Synthetic polypeptide
DEMEIRTTNPVATEGYGQCICSWGETNQENFNSDTQS

SEQ ID NO: 192658 - protein, 31 aa, Artificial Sequence
  Description of Artificial Sequence: Synthetic polypeptide
QEGEIASTNPCSYEQWGIGYCNDQGSGDTER

SEQ ID NO: 192659 - protein, 31 aa, Artificial Sequence
  Description of Artificial Sequence: Synthetic polypeptide
QEGEIASTNPCSYEQWGITCYCNDDQHGDTR

SEQ ID NO: 192660 - protein, 36 aa, Artificial Sequence
  Description of Artificial Sequence: Synthetic polypeptide
DEMEICTTNPVATEQYGTVCTARDGSPVEFEFPNEI

SEQ ID NO: 192661 - protein, 39 aa, Artificial Sequence
  Description of Artificial Sequence: Synthetic polypeptide
DEEEIRTTNPVATEAYGTVTTGGNSDEIGTTSISTTGNN

SEQ ID NO: 192662 - protein, 38 aa, Artificial Sequence
  Description of Artificial Sequence: Synthetic polypeptide
DEPEISTTNPVATEQYGSVADDTDQEGGDNDDTTDETT

SEQ ID NO: 192663 - protein, 35 aa, Artificial Sequence
  Description of Artificial Sequence: Synthetic polypeptide
TNEEICTTNPVAYEQWGEVYGNMNDHPNGQNGNNA

SEQ ID NO: 192664 - protein, 37 aa, Artificial Sequence
  Description of Artificial Sequence: Synthetic polypeptide
DEDEIRTTNPCATEQYGVVATTNANANDTGTEEGTTD

SEQ ID NO: 192665 - protein, 39 aa, Artificial Sequence
  Description of Artificial Sequence: Synthetic polypeptide
DEEEIRTTNPVATEAYGTVTQYGNADEIGTTSIQTTGNT

SEQ ID NO: 192666 - protein, 34 aa, Artificial Sequence
  Description of Artificial Sequence: Synthetic polypeptide
VEDEIACTNPVATAQWGGCVASANDGDGAEGNSD

SEQ ID NO: 192667 - protein, 31 aa, Artificial Sequence
  Description of Artificial Sequence: Synthetic polypeptide
QEGEIASTNPCSYEQWGITCYCNDQESGDTR

SEQ ID NO: 192668 - protein, 36 aa, Artificial Sequence
  Description of Artificial Sequence: Synthetic polypeptide
AETEIATTNPVATEQYGQLVACTYEHSQRPPTMPQW

SEQ ID NO: 192669 - protein, 34 aa, Artificial Sequence
  Description of Artificial Sequence: Synthetic polypeptide
DESEIRTTNPVSYESWGCIAPEDDQQQQQQGTNR

SEQ ID NO: 192670 - protein, 35 aa, Artificial Sequence
  Description of Artificial Sequence: Synthetic polypeptide
DEDEIATTNPVATEQWGTNCAANDGGVENDEGNDM

SEQ ID NO: 192671 - protein, 37 aa, Artificial Sequence
  Description of Artificial Sequence: Synthetic polypeptide
CEEEIRTTNPVATEGYGCVCSNWGEHNEEHFNSDNQS

SEQ ID NO: 192672 - protein, 36 aa, Artificial Sequence
  Description of Artificial Sequence: Synthetic polypeptide
DEEEISTTNPCATEQYGCVCPWGEPNQENFNSDNQA

SEQ ID NO: 192673 - protein, 35 aa, Artificial Sequence
  Description of Artificial Sequence: Synthetic polypeptide
DEQEIATTNPVATEQWGCVAANHSGDATMNPAEQG

SEQ ID NO: 192674 - protein, 35 aa, Artificial Sequence
  Description of Artificial Sequence: Synthetic polypeptide
DEDEIATTNPVATEQWGTNCAANDGPVPDEGNNDM

SEQ ID NO: 192675 - protein, 35 aa, Artificial Sequence
  Description of Artificial Sequence: Synthetic polypeptide
TNAEIATTNPVAYERWGSAVSGPGLNDDRQHQGNH

SEQ ID NO: 192676 - protein, 39 aa, Artificial Sequence
  Description of Artificial Sequence: Synthetic polypeptide
DEPEIRTTNPVATEQYGSYAISPLATPLHEVSPMQDWRN

SEQ ID NO: 192677 - protein, 30 aa, Artificial Sequence
  Description of Artificial Sequence: Synthetic polypeptide
QEGEIASTNPCSYEQWGCGYCNDQSNHDTR

SEQ ID NO: 192678 - protein, 39 aa, Artificial Sequence
  Description of Artificial Sequence: Synthetic polypeptide
DEPEIRTTNPVATEQYGSYAISPTATPLEEVSPMQDEHN

SEQ ID NO: 192679 - protein, 32 aa, Artificial Sequence
  Description of Artificial Sequence: Synthetic polypeptide
TNEEIAATNPVAYEQWGVYYTWDQGDHQRHDI

SEQ ID NO: 192680 - protein, 36 aa, Artificial Sequence
  Description of Artificial Sequence: Synthetic polypeptide
TNEEIATTNPVATEAYGCVCPTNDNQDDQDQQQGKD

SEQ ID NO: 192681 - protein, 34 aa, Artificial Sequence
  Description of Artificial Sequence: Synthetic polypeptide
DEDEIATTNPVAYESWGCVCTIDVNDRNNQNKEE

SEQ ID NO: 192682 - protein, 31 aa, Artificial Sequence
  Description of Artificial Sequence: Synthetic polypeptide
QEGEIASTNPCSYEQWGITCYCNDQNQGDTR

SEQ ID NO: 192683 - protein, 37 aa, Artificial Sequence
  Description of Artificial Sequence: Synthetic polypeptide
CEEEIRTTNPVATEFYGNVINNDNGNIQTAEGGGEQV

SEQ ID NO: 192684 - protein, 39 aa, Artificial Sequence
  Description of Artificial Sequence: Synthetic polypeptide
DEPEIRTTNPVATEQYGVVVGSGQEDQEEIDGEGEGNGV

SEQ ID NO: 192685 - protein, 34 aa, Artificial Sequence
  Description of Artificial Sequence: Synthetic polypeptide
DEDEIATTNPVATEQWGTNCAANDGPVEDEINDA

SEQ ID NO: 192686 - protein, 36 aa, Artificial Sequence
  Description of Artificial Sequence: Synthetic polypeptide
TETPIRSTNPVAYEQYGQSVVVSTTYEATSVGNPMN

SEQ ID NO: 192687 - protein, 35 aa, Artificial Sequence
  Description of Artificial Sequence: Synthetic polypeptide
TTGTEIATTNPVAYEQWGSVYSGMQDEKNGRGNEP

SEQ ID NO: 192688 - protein, 38 aa, Artificial Sequence
  Description of Artificial Sequence: Synthetic polypeptide
DEEEISCTNPVATEQYGQCVCSTWGEHNAENFNSDTQS

SEQ ID NO: 192689 - protein, 36 aa, Artificial Sequence
  Description of Artificial Sequence: Synthetic polypeptide
TTAEIATTNPVAYERWGSAVSGIGLNDDRQHQGNSR

SEQ ID NO: 192690 - protein, 36 aa, Artificial Sequence
  Description of Artificial Sequence: Synthetic polypeptide
DEDEIRGTNPVATDAYGVVNDNSIGQNGGQEDNDND

SEQ ID NO: 192691 - protein, 38 aa, Artificial Sequence
  Description of Artificial Sequence: Synthetic polypeptide
CEEEIRSTNPVATEQYGDVVMEQTGDQEGGGEGGNVEG

SEQ ID NO: 192692 - protein, 39 aa, Artificial Sequence
  Description of Artificial Sequence: Synthetic polypeptide
CEEEIRSTNPVATEQYGVVSILIATGDNDQDEFGLDFGD

SEQ ID NO: 192693 - protein, 33 aa, Artificial Sequence
  Description of Artificial Sequence: Synthetic polypeptide
TTAEIATTNPVAYEPWGCVWYSEGIQRGGGQGA

SEQ ID NO: 192694 - protein, 34 aa, Artificial Sequence
  Description of Artificial Sequence: Synthetic polypeptide
TTAEIATTNPVAYECWGTVSGGLNDDRQKEGNTV

SEQ ID NO: 192695 - protein, 34 aa, Artificial Sequence
  Description of Artificial Sequence: Synthetic polypeptide
TTAEIATTNPVAYECWGTVSGGLNDDRQEQGNTN

SEQ ID NO: 192696 - protein, 38 aa, Artificial Sequence
  Description of Artificial Sequence: Synthetic polypeptide
QEEEIRGTNPVATEQYGSVIVDNSDGPEEGGQGDNGVP

SEQ ID NO: 192697 - protein, 36 aa, Artificial Sequence
  Description of Artificial Sequence: Synthetic polypeptide
DEHEIRTTNPVAYECWGTVYQINMENQDRQMMNNGT

SEQ ID NO: 192698 - protein, 35 aa, Artificial Sequence
  Description of Artificial Sequence: Synthetic polypeptide
AEEEIACTNPVATEQYGSACPAGEGGEAEIGNEND

SEQ ID NO: 192699 - protein, 34 aa, Artificial Sequence
  Description of Artificial Sequence: Synthetic polypeptide
TTAEIATTNPVAYECWGSVSGGLNDDRQEQHNTE

SEQ ID NO: 192700 - protein, 35 aa, Artificial Sequence
  Description of Artificial Sequence: Synthetic polypeptide
DESEIRTTNPVAYEGWGCVCSWGEENQEYFNSQQS

SEQ ID NO: 192701 - protein, 37 aa, Artificial Sequence
  Description of Artificial Sequence: Synthetic polypeptide
QEEEIRGTNPVATEFYGAVSIPGNQNEGGGQTEGEDG

SEQ ID NO: 192702 - protein, 37 aa, Artificial Sequence
  Description of Artificial Sequence: Synthetic polypeptide
DEDEIRGTNPVATDQYGSVVMQGMDINQNNNDQEGGG

SEQ ID NO: 192703 - protein, 37 aa, Artificial Sequence
  Description of Artificial Sequence: Synthetic polypeptide
DEQEIATTNPVATAQWGHSVSAAGDMGEDHQGGEDNP

SEQ ID NO: 192704 - protein, 35 aa, Artificial Sequence
  Description of Artificial Sequence: Synthetic polypeptide
DEQEIATTNPIATEQWGATTWSNTEDLADPEGPDL

SEQ ID NO: 192705 - protein, 37 aa, Artificial Sequence
  Description of Artificial Sequence: Synthetic polypeptide
DEDEIRGTNPVATDQYGVVNDNSIGQGQGGQEGNDTD

SEQ ID NO: 192706 - protein, 34 aa, Artificial Sequence
  Description of Artificial Sequence: Synthetic polypeptide
TTAEIATTNPVAYECWGSTVYGGLNDDRQEQGNH

SEQ ID NO: 192707 - protein, 37 aa, Artificial Sequence
  Description of Artificial Sequence: Synthetic polypeptide
DEDEIRGTNPVATDQYGVVNDNSIGQNEGQEDNDGDI

SEQ ID NO: 192708 - protein, 35 aa, Artificial Sequence
  Description of Artificial Sequence: Synthetic polypeptide
TTAEIATTNPVAYECWGIVSGTGLNDDMQEQGNTV

SEQ ID NO: 192709 - protein, 35 aa, Artificial Sequence
  Description of Artificial Sequence: Synthetic polypeptide
TTAEIATTNPVAYECWGIVSGNGLNDDRQEQGNTL

SEQ ID NO: 192710 - protein, 34 aa, Artificial Sequence
  Description of Artificial Sequence: Synthetic polypeptide
TTAEIATTNPVAYECWGIVSGGNNNDRQEQGNTV

SEQ ID NO: 192711 - protein, 34 aa, Artificial Sequence
  Description of Artificial Sequence: Synthetic polypeptide
TTAEIATTNPVAYECWGIVSGGNNDDRQEQGNQK

SEQ ID NO: 192712 - protein, 34 aa, Artificial Sequence
  Description of Artificial Sequence: Synthetic polypeptide
TTAEIATTNPVAYECWGIVSGGLNDDHQEQGNQD

SEQ ID NO: 192713 - protein, 38 aa, Artificial Sequence
  Description of Artificial Sequence: Synthetic polypeptide
QEEEIRCTNPVATEQYGSVVVDGFQTQDQSQGGGGQQQ

SEQ ID NO: 192714 - protein, 37 aa, Artificial Sequence
  Description of Artificial Sequence: Synthetic polypeptide
DEDEIRGTNPVATDQYGVVNDNSIGQNGGQEDNAFND

SEQ ID NO: 192715 - protein, 37 aa, Artificial Sequence
  Description of Artificial Sequence: Synthetic polypeptide
DEDEIRGTNPVATDQYGVVNDNSIGQNGGQEDNDPDS

SEQ ID NO: 192716 - protein, 37 aa, Artificial Sequence
  Description of Artificial Sequence: Synthetic polypeptide
DEEEISCTNPVATEQYGCVCSNWGEHNIENFNSDTQS

SEQ ID NO: 192717 - protein, 37 aa, Artificial Sequence
  Description of Artificial Sequence: Synthetic polypeptide
DEDEIRATNPVATEQWGTVVSTQQQSATNVATEDGSM

SEQ ID NO: 192718 - protein, 37 aa, Artificial Sequence
  Description of Artificial Sequence: Synthetic polypeptide
AEEEIACTNPVATEQYGSACATNPGEEAGAHQDNDAP

SEQ ID NO: 192719 - protein, 34 aa, Artificial Sequence
  Description of Artificial Sequence: Synthetic polypeptide
TTAEIATTNPVAYECWGSVSGEGLNDDRQEQGGH

SEQ ID NO: 192720 - protein, 39 aa, Artificial Sequence
  Description of Artificial Sequence: Synthetic polypeptide
DEDEIRATNPVATEQYGVVSTVNGNNNQLAGTEQGSTDQ

SEQ ID NO: 192721 - protein, 35 aa, Artificial Sequence
  Description of Artificial Sequence: Synthetic polypeptide
DEHEIRTTNPVAYECWGTVYRINENDDRRSDNNGS

SEQ ID NO: 192722 - protein, 35 aa, Artificial Sequence
  Description of Artificial Sequence: Synthetic polypeptide
DEDEIRGTNCVATEAWGQVSAINGEGGDGEQEGQN

SEQ ID NO: 192723 - protein, 36 aa, Artificial Sequence
  Description of Artificial Sequence: Synthetic polypeptide
DESEIRTTNPVAYEAWGILVPSCANSSSDREGGMGC

SEQ ID NO: 192724 - protein, 36 aa, Artificial Sequence
  Description of Artificial Sequence: Synthetic polypeptide
DESEIRTTNPVAYEAWGISTVPNANSSSDREFGHVC

SEQ ID NO: 192725 - protein, 36 aa, Artificial Sequence
  Description of Artificial Sequence: Synthetic polypeptide
DESEIRTTNPVAYEAWGISVPVNANSSSDREGGMVE

SEQ ID NO: 192726 - protein, 36 aa, Artificial Sequence
  Description of Artificial Sequence: Synthetic polypeptide
TTEEIRSTNPVATEQYGSVVIDGGENFEGNGEGQGN

SEQ ID NO: 192727 - protein, 38 aa, Artificial Sequence
  Description of Artificial Sequence: Synthetic polypeptide
DEEEISCTNPVATEQYGCQVCSMTGEHNTENFNSDNQA

SEQ ID NO: 192728 - protein, 39 aa, Artificial Sequence
  Description of Artificial Sequence: Synthetic polypeptide
DEEEIRTTNPVATEAYGTVTTVVNSDVIGTTSISTTNNT

SEQ ID NO: 192729 - protein, 39 aa, Artificial Sequence
  Description of Artificial Sequence: Synthetic polypeptide
DEEEIRTTNPVATEAYGTVTTVVNSDEIGTTTISTTGNT

SEQ ID NO: 192730 - protein, 34 aa, Artificial Sequence
  Description of Artificial Sequence: Synthetic polypeptide
DEHEIRTTNPVAYECWGTVYWINENQDIQMKLDG

SEQ ID NO: 192731 - protein, 39 aa, Artificial Sequence
  Description of Artificial Sequence: Synthetic polypeptide
QEEEIRGTNPVATEQYGSVVIPGNLNGEGGFQITEGEDG

SEQ ID NO: 192732 - protein, 34 aa, Artificial Sequence
  Description of Artificial Sequence: Synthetic polypeptide
DEHEIRTTNPVAYECWGTVYWINENPDQQMKTDG

SEQ ID NO: 192733 - protein, 34 aa, Artificial Sequence
  Description of Artificial Sequence: Synthetic polypeptide
DEHEIRTTNPVAYECWGTVYWINENNDRQMKADG

SEQ ID NO: 192734 - protein, 37 aa, Artificial Sequence
  Description of Artificial Sequence: Synthetic polypeptide
DEAAEIATTNPVAYEQWGSTYSGMPQGNGQQGGDNVV

SEQ ID NO: 192735 - protein, 37 aa, Artificial Sequence
  Description of Artificial Sequence: Synthetic polypeptide
DEEEISCTNPVATEQYGCVCSMWGEDFQEGFGSETQA

SEQ ID NO: 192736 - protein, 38 aa, Artificial Sequence
  Description of Artificial Sequence: Synthetic polypeptide
DEEEISCTNPVATEQYGCVCSMWGEDTNAENFNSENQA

SEQ ID NO: 192737 - protein, 39 aa, Artificial Sequence
  Description of Artificial Sequence: Synthetic polypeptide
DEEEIRTTNPVATEAYGTVTTYGNNDVIGTTSISTTGNT

SEQ ID NO: 192738 - protein, 37 aa, Artificial Sequence
  Description of Artificial Sequence: Synthetic polypeptide
DEDEIRCTNPVATEQYGSCPMPIMLWPENRSISQQTS

SEQ ID NO: 192739 - protein, 36 aa, Artificial Sequence
  Description of Artificial Sequence: Synthetic polypeptide
TTEEIRGTNPVATEGYGSVVIDGGENGEGNGNGQGQ

SEQ ID NO: 192740 - protein, 38 aa, Artificial Sequence
  Description of Artificial Sequence: Synthetic polypeptide
DEEEISCTNPVATEQYGCVCSNWGEDHNQENFGSDNQA

SEQ ID NO: 192741 - protein, 38 aa, Artificial Sequence
  Description of Artificial Sequence: Synthetic polypeptide
DEEEISCTNPVATEQYGCVCSNWGEDHNAENFGSENQA

SEQ ID NO: 192742 - protein, 38 aa, Artificial Sequence
  Description of Artificial Sequence: Synthetic polypeptide
CEEEIRCTNPVATEQYGQCVCSTWGEHNQENFNSDTQS

SEQ ID NO: 192743 - protein, 34 aa, Artificial Sequence
  Description of Artificial Sequence: Synthetic polypeptide
TTAENATTNPVAYECWGSVSGGLNDDRQTQGNHV

SEQ ID NO: 192744 - protein, 35 aa, Artificial Sequence
  Description of Artificial Sequence: Synthetic polypeptide
TTDEIASTNPVATEQYGAVYCTWNDQHHQGHPDGS

SEQ ID NO: 192745 - protein, 36 aa, Artificial Sequence
  Description of Artificial Sequence: Synthetic polypeptide
DEHEIRTTNPVAYECWGTVYTWINQENQDRQMMTDG

SEQ ID NO: 192746 - protein, 37 aa, Artificial Sequence
  Description of Artificial Sequence: Synthetic polypeptide
DEDEIRGTNPVATDQYGVVNDNSIGQNGGQEDNDTIQ

SEQ ID NO: 192747 - protein, 34 aa, Artificial Sequence
  Description of Artificial Sequence: Synthetic polypeptide
DEQEIATTNPVATAQWGTICAATDGPEETEIGND

SEQ ID NO: 192748 - protein, 39 aa, Artificial Sequence
  Description of Artificial Sequence: Synthetic polypeptide
QEEEIRGTNPVATEQYGSVVINGNLNLEGGGQLTEGEDG

SEQ ID NO: 192749 - protein, 36 aa, Artificial Sequence
  Description of Artificial Sequence: Synthetic polypeptide
AEEEIACTNPVATEQYGSCPATTNDIGAPGEQGDPV

SEQ ID NO: 192750 - protein, 34 aa, Artificial Sequence
  Description of Artificial Sequence: Synthetic polypeptide
DEHEIRTTNPVAYECWGTVYWINENDPRQMMTDG

SEQ ID NO: 192751 - protein, 37 aa, Artificial Sequence
  Description of Artificial Sequence: Synthetic polypeptide
DEEEISCTNPVATEQYGCVCSNSGEDNAENFNSDNQS

SEQ ID NO: 192752 - protein, 36 aa, Artificial Sequence
  Description of Artificial Sequence: Synthetic polypeptide
TTEEIRGTNCVATEQYGSVVIDGGENTQGNGEGQGQ

SEQ ID NO: 192753 - protein, 37 aa, Artificial Sequence
  Description of Artificial Sequence: Synthetic polypeptide
AEEEIACTNPVATEQYGSTACSAANPLPAEAPIGDHQ

SEQ ID NO: 192754 - protein, 39 aa, Artificial Sequence
  Description of Artificial Sequence: Synthetic polypeptide
QEEEIRGTNPVATEQYGSVVIPGNLVGEGGGQFTEGEDG

SEQ ID NO: 192755 - protein, 37 aa, Artificial Sequence
  Description of Artificial Sequence: Synthetic polypeptide
DEEEISCTNPVATEQYGQCVCSWGEHNAENFNSENQS

SEQ ID NO: 192756 - protein, 33 aa, Artificial Sequence
  Description of Artificial Sequence: Synthetic polypeptide
DEQEIATTNPIATEQWGATTAAADLAEPKGPYI

SEQ ID NO: 192757 - protein, 37 aa, Artificial Sequence
  Description of Artificial Sequence: Synthetic polypeptide
DEDEIRGTNPVATDQYGVVNDNSIGQNGGQEDNGDTG

SEQ ID NO: 192758 - protein, 34 aa, Artificial Sequence
  Description of Artificial Sequence: Synthetic polypeptide
DEMEIRTTNPVATECWGATWANAEDWAEFKGPYI

SEQ ID NO: 192759 - protein, 35 aa, Artificial Sequence
  Description of Artificial Sequence: Synthetic polypeptide
TTGAEIATTNPVAYECWGSVSGGLNDDRQDQGNHT

SEQ ID NO: 192760 - protein, 35 aa, Artificial Sequence
  Description of Artificial Sequence: Synthetic polypeptide
TTGAEIATTNPVAYECWGSVSGGLNDDRQEQGNTV

SEQ ID NO: 192761 - protein, 36 aa, Artificial Sequence
  Description of Artificial Sequence: Synthetic polypeptide
DEDEIRGTNPVATEFWGVVSAADGEGQRGQGEQSGV

SEQ ID NO: 192762 - protein, 36 aa, Artificial Sequence
  Description of Artificial Sequence: Synthetic polypeptide
DEEEISCTNPVATEQYGCVCSWGEHNDEHFSSDTQS

SEQ ID NO: 192763 - protein, 36 aa, Artificial Sequence
  Description of Artificial Sequence: Synthetic polypeptide
DEDEIRGTNPVATEFWGVVSAANGEGQDGQDEQQGD

SEQ ID NO: 192764 - protein, 35 aa, Artificial Sequence
  Description of Artificial Sequence: Synthetic polypeptide
TTGAEIATTNPVAYECWGSVSGGPLNDDRQHQGNH

SEQ ID NO: 192765 - protein, 37 aa, Artificial Sequence
  Description of Artificial Sequence: Synthetic polypeptide
DESEIRTTNPVAYEQWGTVCPTDNHGEQNGQKGDDQE

SEQ ID NO: 192766 - protein, 37 aa, Artificial Sequence
  Description of Artificial Sequence: Synthetic polypeptide
DESEIRTTNPVAYEQWGTVCPTDNHGEVNGQKGDQHN

SEQ ID NO: 192767 - protein, 37 aa, Artificial Sequence
  Description of Artificial Sequence: Synthetic polypeptide
DESEIRTTNPVAYEQWGTVCPTDNHGMVNGQKGDDQI

SEQ ID NO: 192768 - protein, 34 aa, Artificial Sequence
  Description of Artificial Sequence: Synthetic polypeptide
DEMEIRTTNPVATECWGTTTWANTDDPAPKGPYI

SEQ ID NO: 192769 - protein, 39 aa, Artificial Sequence
  Description of Artificial Sequence: Synthetic polypeptide
DEEEIRTTNPVATEAYGTVTTVGNADEIGTTSISTTNNT

SEQ ID NO: 192770 - protein, 39 aa, Artificial Sequence
  Description of Artificial Sequence: Synthetic polypeptide
DEEEIRTTNPVATEAYGTVTTQIGTTEQGSTNDEQDEED

SEQ ID NO: 192771 - protein, 37 aa, Artificial Sequence
  Description of Artificial Sequence: Synthetic polypeptide
DESEIRTTNPVAYEQWGTVCPTDNHGPVNGQKGDQQK

SEQ ID NO: 192772 - protein, 34 aa, Artificial Sequence
  Description of Artificial Sequence: Synthetic polypeptide
DEMEIRTTNPVATECWGATWANADDWVAPKGPYD

SEQ ID NO: 192773 - protein, 35 aa, Artificial Sequence
  Description of Artificial Sequence: Synthetic polypeptide
TTGDEIATTNPVAYEQWGSVYQENGQAQDQGDSNL

SEQ ID NO: 192774 - protein, 36 aa, Artificial Sequence
  Description of Artificial Sequence: Synthetic polypeptide
DEEEIATTNPVATEQYGTCAAAMGHGPADSGEGNGS

SEQ ID NO: 192775 - protein, 38 aa, Artificial Sequence
  Description of Artificial Sequence: Synthetic polypeptide
QEEEIRATNPVATEQYGSVVNPGTPIGPEMGQGENGEG

SEQ ID NO: 192776 - protein, 38 aa, Artificial Sequence
  Description of Artificial Sequence: Synthetic polypeptide
QEEEIRATNPVATEQYGSVVNPETLEGPEMGQGENEEG

SEQ ID NO: 192777 - protein, 39 aa, Artificial Sequence
  Description of Artificial Sequence: Synthetic polypeptide
QEEEIRGTNPVATEQYGSVVIPGSLNGEGGGQETEGEDG

SEQ ID NO: 192778 - protein, 38 aa, Artificial Sequence
  Description of Artificial Sequence: Synthetic polypeptide
DEEEISCTNPVATEQYGQCVCSDWGEHNQENFGSDNQS

SEQ ID NO: 192779 - protein, 34 aa, Artificial Sequence
  Description of Artificial Sequence: Synthetic polypeptide
AEVEIATTNPVAYEQWGSTCQTFEDRTTRDGGSQ

SEQ ID NO: 192780 - protein, 38 aa, Artificial Sequence
  Description of Artificial Sequence: Synthetic polypeptide
QEEEIRGTNPVATEQYGSVVIPGVQNEGGGQVTEGEDI

SEQ ID NO: 192781 - protein, 36 aa, Artificial Sequence
  Description of Artificial Sequence: Synthetic polypeptide
DEMEIRTTNPVATEGWGCVCSNWMEDNQEHFGSDQA

SEQ ID NO: 192782 - protein, 33 aa, Artificial Sequence
  Description of Artificial Sequence: Synthetic polypeptide
AEVEIATTNPVAYEQWGCTWNEEHNMEDGHNTQ

SEQ ID NO: 192783 - protein, 35 aa, Artificial Sequence
  Description of Artificial Sequence: Synthetic polypeptide
DEDEIRGTNPVATEGWGEVSAGMEGQDGEGEQGGI

SEQ ID NO: 192784 - protein, 33 aa, Artificial Sequence
  Description of Artificial Sequence: Synthetic polypeptide
AEVEIATTNPVAYEQWGCFTWNNHNMEDGDNTE

SEQ ID NO: 192785 - protein, 35 aa, Artificial Sequence
  Description of Artificial Sequence: Synthetic polypeptide
DEDEIRGTNPVATEGWGMSVAAGMEGQDGEGEQGI

SEQ ID NO: 192786 - protein, 34 aa, Artificial Sequence
  Description of Artificial Sequence: Synthetic polypeptide
DEDEIRGTNPVATEGWGNVSAGMEGEDGEGEQGI

SEQ ID NO: 192787 - protein, 36 aa, Artificial Sequence
  Description of Artificial Sequence: Synthetic polypeptide
DEDEIRGTNPVATEGWGSAVSVAGMEGQDGEGEQTI

SEQ ID NO: 192788 - protein, 37 aa, Artificial Sequence
  Description of Artificial Sequence: Synthetic polypeptide
DESEIRTTNPVAYEQWGTVCPTDNVGHVNGQKGDDQK

SEQ ID NO: 192789 - protein, 34 aa, Artificial Sequence
  Description of Artificial Sequence: Synthetic polypeptide
DEMEIRTTNPVATECWGATWANADDWEEFKGPYI

SEQ ID NO: 192790 - protein, 36 aa, Artificial Sequence
  Description of Artificial Sequence: Synthetic polypeptide
DEDEIRGTNPVATEFWGNVSAANGEGQDGQDGQGGD

SEQ ID NO: 192791 - protein, 34 aa, Artificial Sequence
  Description of Artificial Sequence: Synthetic polypeptide
DEMEIRTTNPVATECWGATWANADDWAEFKGPYI

SEQ ID NO: 192792 - protein, 37 aa, Artificial Sequence
  Description of Artificial Sequence: Synthetic polypeptide
DEDEIRGTNPVATDQYGVVNDNSIGQNGGQEDNITTA

SEQ ID NO: 192793 - protein, 37 aa, Artificial Sequence
  Description of Artificial Sequence: Synthetic polypeptide
DEDEIRGTNPVATDQYGVVNDNSIGQNGGQEDNIVTD

SEQ ID NO: 192794 - protein, 37 aa, Artificial Sequence
  Description of Artificial Sequence: Synthetic polypeptide
DEDEIRGTNPVATDQYGVVNDNSIGQNGGQEDNNDNS

SEQ ID NO: 192795 - protein, 34 aa, Artificial Sequence
  Description of Artificial Sequence: Synthetic polypeptide
TTAEIATTNPCATEHWGSVCYNNDDQDDRQNDHA

SEQ ID NO: 192796 - protein, 34 aa, Artificial Sequence
  Description of Artificial Sequence: Synthetic polypeptide
TTAEIATTNPCATECWGSVSGGLNDDRQHQNNDG

SEQ ID NO: 192797 - protein, 34 aa, Artificial Sequence
  Description of Artificial Sequence: Synthetic polypeptide
TTAEIASTNPVAYECWGSVSGGLNDDQQEQGNHE

SEQ ID NO: 192798 - protein, 35 aa, Artificial Sequence
  Description of Artificial Sequence: Synthetic polypeptide
DEDEICTTNPVAYESWGTVCSNDNHDQPGQGGDEH

SEQ ID NO: 192799 - protein, 35 aa, Artificial Sequence
  Description of Artificial Sequence: Synthetic polypeptide
ATNSEIATTNPVAYEQWGSVYGGWDDQPQGNTGNR

SEQ ID NO: 192800 - protein, 37 aa, Artificial Sequence
  Description of Artificial Sequence: Synthetic polypeptide
DEDEIRGTNPVATDQYGVVNDNSIGQNGGQIEDNDTV

SEQ ID NO: 192801 - protein, 37 aa, Artificial Sequence
  Description of Artificial Sequence: Synthetic polypeptide
DEDEIRGTNPVATDQYGVVNDNSIGQNQGGQEDNIGD

SEQ ID NO: 192802 - protein, 37 aa, Artificial Sequence
  Description of Artificial Sequence: Synthetic polypeptide
DEDEIRGTNPVATDQYGVVNDNSIGQNQGGQIDNGTD

SEQ ID NO: 192803 - protein, 37 aa, Artificial Sequence
  Description of Artificial Sequence: Synthetic polypeptide
DEDEIRGTNPVATDQYGVVNDNSIGQNQGGQTDNDAD

SEQ ID NO: 192804 - protein, 37 aa, Artificial Sequence
  Description of Artificial Sequence: Synthetic polypeptide
DEDEIRGTNPVATDQYGVVNDNSMGQNGGQEDNDTGI

SEQ ID NO: 192805 - protein, 37 aa, Artificial Sequence
  Description of Artificial Sequence: Synthetic polypeptide
DEDEIRGTNPVATDQYGVVNDNSVGQNGGQTEDNDTD

SEQ ID NO: 192806 - protein, 38 aa, Artificial Sequence
  Description of Artificial Sequence: Synthetic polypeptide
TTEEIRTTNPVATEQYGSVCPKSVDGWTDEHPNELNIN

SEQ ID NO: 192807 - protein, 36 aa, Artificial Sequence
  Description of Artificial Sequence: Synthetic polypeptide
DEAEIRTTNPVAYEGWGCVCSWGEENQEYFGSNTQS

SEQ ID NO: 192808 - protein, 37 aa, Artificial Sequence
  Description of Artificial Sequence: Synthetic polypeptide
DESEIRTTNPVAYEQWGEVSGGEPANGPNMRNGGGKK

SEQ ID NO: 192809 - protein, 36 aa, Artificial Sequence
  Description of Artificial Sequence: Synthetic polypeptide
AEECIRTTNPVATEQYGCVCSNWGEHNAEYFLSDQS

SEQ ID NO: 192810 - protein, 39 aa, Artificial Sequence
  Description of Artificial Sequence: Synthetic polypeptide
QEEEIRCTNPVATEIYGSVNNSTTPENGPEMGQGENDED

SEQ ID NO: 192811 - protein, 37 aa, Artificial Sequence
  Description of Artificial Sequence: Synthetic polypeptide
CAEEIATTNPVATAQWGSVSMSGDTPTNNDDGMGNQA

SEQ ID NO: 192812 - protein, 37 aa, Artificial Sequence
  Description of Artificial Sequence: Synthetic polypeptide
DEDEIRGTNPVATEFWGMVVSAANGEGQRGQGEQDGV

SEQ ID NO: 192813 - protein, 37 aa, Artificial Sequence
  Description of Artificial Sequence: Synthetic polypeptide
DEDEIRGTNPVATEFWGIVSAVANGEGQRGQGEDEGD

SEQ ID NO: 192814 - protein, 35 aa, Artificial Sequence
  Description of Artificial Sequence: Synthetic polypeptide
DEDEIRGTNPVATEFWGGVSAANGEGNDGQGEQGD

SEQ ID NO: 192815 - protein, 37 aa, Artificial Sequence
  Description of Artificial Sequence: Synthetic polypeptide
CEEEIRCTNPVATEQYGQCVCSMWGEHNTENFNSDQP

SEQ ID NO: 192816 - protein, 34 aa, Artificial Sequence
  Description of Artificial Sequence: Synthetic polypeptide
DEQEIATTNPIATECWGSVWSNAEDWAEPEGPYI

SEQ ID NO: 192817 - protein, 33 aa, Artificial Sequence
  Description of Artificial Sequence: Synthetic polypeptide
DEMEIRTTNPVATECWGATCAAADDPVAPEGPD

SEQ ID NO: 192818 - protein, 35 aa, Artificial Sequence
  Description of Artificial Sequence: Synthetic polypeptide
DEHEIRTTNPVAYECWGTVYQINENQDDQKMNNGP

SEQ ID NO: 192819 - protein, 37 aa, Artificial Sequence
  Description of Artificial Sequence: Synthetic polypeptide
DESEIRTTNPVAYEQWGEVVHTLGDNQDQQNGGDQGN

SEQ ID NO: 192820 - protein, 34 aa, Artificial Sequence
  Description of Artificial Sequence: Synthetic polypeptide
DEHEIRTTNPVAYECWGTVYWINENQDQQMVHVG

SEQ ID NO: 192821 - protein, 38 aa, Artificial Sequence
  Description of Artificial Sequence: Synthetic polypeptide
DEEEISCTNPVATEQYGCVCSTWGEDDNQEGFISDTQA

SEQ ID NO: 192822 - protein, 35 aa, Artificial Sequence
  Description of Artificial Sequence: Synthetic polypeptide
DEHEIRTTNPVAYECWGTVYQINENQDQQMMNNGV

SEQ ID NO: 192823 - protein, 35 aa, Artificial Sequence
  Description of Artificial Sequence: Synthetic polypeptide
DEHEIRTTNPVAYECWGTVYQIDEQQDRQMMNNGP

SEQ ID NO: 192824 - protein, 36 aa, Artificial Sequence
  Description of Artificial Sequence: Synthetic polypeptide
TETPIRSTNPVAYEQYGQSVVVSTDYEWTSVGNPMW

SEQ ID NO: 192825 - protein, 38 aa, Artificial Sequence
  Description of Artificial Sequence: Synthetic polypeptide
CEEEIRTTNPVATEQYGCVCSMWGEDHNAENFNSDTQD

SEQ ID NO: 192826 - protein, 38 aa, Artificial Sequence
  Description of Artificial Sequence: Synthetic polypeptide
DEEEIATTNPVATEQYGSTVCAANMGEEAPDDLMGDAD

SEQ ID NO: 192827 - protein, 36 aa, Artificial Sequence
  Description of Artificial Sequence: Synthetic polypeptide
TENEIRATNPVATEQYGTVTTVWLPDEQENTQIDEH

SEQ ID NO: 192828 - protein, 36 aa, Artificial Sequence
  Description of Artificial Sequence: Synthetic polypeptide
DETAEIATTNPCAYECWGSVATPNGNQQLEGDHQRQ

SEQ ID NO: 192829 - protein, 39 aa, Artificial Sequence
  Description of Artificial Sequence: Synthetic polypeptide
VENEIRTTNPVATEFYGEVVTTDGGNNLLREEDEGNEGA

SEQ ID NO: 192830 - protein, 32 aa, Artificial Sequence
  Description of Artificial Sequence: Synthetic polypeptide
TENEIATTNPVSTEPYGVCYCEDGQQQQNGQH

SEQ ID NO: 192831 - protein, 36 aa, Artificial Sequence
  Description of Artificial Sequence: Synthetic polypeptide
DEHEIRTTNPVAYEEWGCVAGGGNMGNERGGEGDQR

SEQ ID NO: 192832 - protein, 34 aa, Artificial Sequence
  Description of Artificial Sequence: Synthetic polypeptide
TENEIATTNPVAYEQWGCLYCFEGPGQRQQNGDR

SEQ ID NO: 192833 - protein, 39 aa, Artificial Sequence
  Description of Artificial Sequence: Synthetic polypeptide
VENEIRTTNPVATEFYGNVSTTDGGNNLLHEEDEGNEGP

SEQ ID NO: 192834 - protein, 35 aa, Artificial Sequence
  Description of Artificial Sequence: Synthetic polypeptide
DETAEIATTNPVAYECWGSVYHPNNDTQPGGQGVA

SEQ ID NO: 192835 - protein, 36 aa, Artificial Sequence
  Description of Artificial Sequence: Synthetic polypeptide
DETAEIATTNPVAYEQWGSICAMANWDNASGENGRE

SEQ ID NO: 192836 - protein, 37 aa, Artificial Sequence
  Description of Artificial Sequence: Synthetic polypeptide
DETAEIATTNPVAYEQWGSVCAMANWQDNASIENDRP

SEQ ID NO: 192837 - protein, 39 aa, Artificial Sequence
  Description of Artificial Sequence: Synthetic polypeptide
VENEIRTTNPVATEFYGQVSTTDGGNNLLSEEDEGNFGP

SEQ ID NO: 192838 - protein, 37 aa, Artificial Sequence
  Description of Artificial Sequence: Synthetic polypeptide
DETAEIATTNPVAYEQWGSVCSANPALQEHHIDLTAM

SEQ ID NO: 192839 - protein, 35 aa, Artificial Sequence
  Description of Artificial Sequence: Synthetic polypeptide
DETAEIATTNPVAYEQWGTVCLPNDQQQATGGGDQ

SEQ ID NO: 192840 - protein, 34 aa, Artificial Sequence
  Description of Artificial Sequence: Synthetic polypeptide
TENEIATTNPVATEGYGCVCSWGEHNIHFISEQA

SEQ ID NO: 192841 - protein, 37 aa, Artificial Sequence
  Description of Artificial Sequence: Synthetic polypeptide
DEEEISTTNPVATEEYGQCVCSSGEHNAENFNSDTQS

SEQ ID NO: 192842 - protein, 38 aa, Artificial Sequence
  Description of Artificial Sequence: Synthetic polypeptide
DEEEISTTNPVATEGYGCQVCSNWGEHNTENFNSENQS

SEQ ID NO: 192843 - protein, 34 aa, Artificial Sequence
  Description of Artificial Sequence: Synthetic polypeptide
TENEIASVNPVCYEPYGVTVSTINLSFSAGGNND

SEQ ID NO: 192844 - protein, 35 aa, Artificial Sequence
  Description of Artificial Sequence: Synthetic polypeptide
DEDEIATTNPVAYERWGSVSGGNPGNAGEHDGQFG

SEQ ID NO: 192845 - protein, 36 aa, Artificial Sequence
  Description of Artificial Sequence: Synthetic polypeptide
DENEISTTNPVSTEGYGCICSWEDHNQEQFGSDNQA

SEQ ID NO: 192846 - protein, 36 aa, Artificial Sequence
  Description of Artificial Sequence: Synthetic polypeptide
VENEIRTTNPVATEQYGMVSVEGMGDGGQGQEMEEP

SEQ ID NO: 192847 - protein, 35 aa, Artificial Sequence
  Description of Artificial Sequence: Synthetic polypeptide
DEDEIATTNPVATEQWGCNAGNGHLEATMDIDSNM

SEQ ID NO: 192848 - protein, 37 aa, Artificial Sequence
  Description of Artificial Sequence: Synthetic polypeptide
VENEIRTTNPVATEQYGSVNVITGEEGGDQDQDDEEI

SEQ ID NO: 192849 - protein, 35 aa, Artificial Sequence
  Description of Artificial Sequence: Synthetic polypeptide
DETCIRTTNPLATEQFGCVCSWGEHNQESFNSNQA

SEQ ID NO: 192850 - protein, 35 aa, Artificial Sequence
  Description of Artificial Sequence: Synthetic polypeptide
DENEISTTNPVAYEQYGQCVCSWEEHQENFPSDQM

SEQ ID NO: 192851 - protein, 37 aa, Artificial Sequence
  Description of Artificial Sequence: Synthetic polypeptide
VENEIRTTNPVATEQYGSYSSPSTAEPMAPVGHPPVC

SEQ ID NO: 192852 - protein, 33 aa, Artificial Sequence
  Description of Artificial Sequence: Synthetic polypeptide
AESEIRCTNPTAYECWGCVYGENDDMHRGDDVR

SEQ ID NO: 192853 - protein, 31 aa, Artificial Sequence
  Description of Artificial Sequence: Synthetic polypeptide
AESEIATTNPVAYEQWGEAYYVEMPEEMTQK

SEQ ID NO: 192854 - protein, 34 aa, Artificial Sequence
  Description of Artificial Sequence: Synthetic polypeptide
DETCISTTNPLATEQFGCVCSWEEHNQSFGSDQA

SEQ ID NO: 192855 - protein, 37 aa, Artificial Sequence
  Description of Artificial Sequence: Synthetic polypeptide
DEEEISTTNPVATEGYGCVCGNWGEHNIENFGSDNQA

SEQ ID NO: 192856 - protein, 35 aa, Artificial Sequence
  Description of Artificial Sequence: Synthetic polypeptide
TENEEIATTNPVAYERWGSVACNTNWDNGGGMDGE

SEQ ID NO: 192857 - protein, 37 aa, Artificial Sequence
  Description of Artificial Sequence: Synthetic polypeptide
DEEEISTTNPVATEGYGCVCFNTGEHNTEYFGSDTQS

SEQ ID NO: 192858 - protein, 38 aa, Artificial Sequence
  Description of Artificial Sequence: Synthetic polypeptide
DEEEISTTNPVATEEYGQCVCSNTGEHNTEFFGSDTQL

SEQ ID NO: 192859 - protein, 36 aa, Artificial Sequence
  Description of Artificial Sequence: Synthetic polypeptide
DEDEIRTTNPVATEGYGVVNNDEFDEEDEDGGNDGN

SEQ ID NO: 192860 - protein, 37 aa, Artificial Sequence
  Description of Artificial Sequence: Synthetic polypeptide
VEEEISTTNPVAYEQWGSVSGGPPGNGGNMRNMEGIS

SEQ ID NO: 192861 - protein, 36 aa, Artificial Sequence
  Description of Artificial Sequence: Synthetic polypeptide
DEMEIRTTNPVATEQYGCTIVPVIHEMENGFSETQQ

SEQ ID NO: 192862 - protein, 36 aa, Artificial Sequence
  Description of Artificial Sequence: Synthetic polypeptide
TEQEIATTNPVATEQWGCVAGEGAHNTNPANQEGEL

SEQ ID NO: 192863 - protein, 38 aa, Artificial Sequence
  Description of Artificial Sequence: Synthetic polypeptide
DEEEIRTTNPVATEQYGCVCSNSGEDHEQENFMSDTQS

SEQ ID NO: 192864 - protein, 37 aa, Artificial Sequence
  Description of Artificial Sequence: Synthetic polypeptide
DEMEIRTTNPVATEQYGCVCQNWEAHNIENFNSDTQS

SEQ ID NO: 192865 - protein, 37 aa, Artificial Sequence
  Description of Artificial Sequence: Synthetic polypeptide
DEEEISTTNPVATEEYGCVCSMWGEHNAENFNSDTQS

SEQ ID NO: 192866 - protein, 38 aa, Artificial Sequence
  Description of Artificial Sequence: Synthetic polypeptide
VENEIRTTNPVATEFYGCVNSTDGGNNLLHEEDQGDEG

SEQ ID NO: 192867 - protein, 36 aa, Artificial Sequence
  Description of Artificial Sequence: Synthetic polypeptide
QEEEIRSTNPVATEQYGAVMGDAGQTGGETEQGEEG

SEQ ID NO: 192868 - protein, 35 aa, Artificial Sequence
  Description of Artificial Sequence: Synthetic polypeptide
TEQDEIATTNPVAYEPWGVVYTGGNQQDRTNDGET

SEQ ID NO: 192869 - protein, 37 aa, Artificial Sequence
  Description of Artificial Sequence: Synthetic polypeptide
DEEEISTTNPVATEEYGCVCSNWGEHNAENFNSDTQL

SEQ ID NO: 192870 - protein, 37 aa, Artificial Sequence
  Description of Artificial Sequence: Synthetic polypeptide
DEEEISTTNPVATEEYGCVCSNWGEHNAENFNSDTQS

SEQ ID NO: 192871 - protein, 35 aa, Artificial Sequence
  Description of Artificial Sequence: Synthetic polypeptide
DESVEIATTNPVAYEQWGVVCSTIDFEDGHGMTES

SEQ ID NO: 192872 - protein, 36 aa, Artificial Sequence
  Description of Artificial Sequence: Synthetic polypeptide
DESVIAGTNPVAYTEAYGQVSVLLNETSQRNGGDQA

SEQ ID NO: 192873 - protein, 36 aa, Artificial Sequence
  Description of Artificial Sequence: Synthetic polypeptide
DEMEIRTTNPVATEQYGCVCQWEEHNIENFMSQTQS

SEQ ID NO: 192874 - protein, 38 aa, Artificial Sequence
  Description of Artificial Sequence: Synthetic polypeptide
DEMEIRTTNPVATEQYGCVCSDWGEDHNIENFSSDNQS

SEQ ID NO: 192875 - protein, 39 aa, Artificial Sequence
  Description of Artificial Sequence: Synthetic polypeptide
TENNEEEISTTNPVAYEQWGSVCAWNEDLQDERQDNNRR

SEQ ID NO: 192876 - protein, 37 aa, Artificial Sequence
  Description of Artificial Sequence: Synthetic polypeptide
AEEEIATTNPVATEGYGCVCSTWGEHNAEGFISDNQA

SEQ ID NO: 192877 - protein, 40 aa, Artificial Sequence
  Description of Artificial Sequence: Synthetic polypeptide
VENEIRTTNPVATEFYGEVNTTDQGGNNLQREEDEGNEGA

SEQ ID NO: 192878 - protein, 37 aa, Artificial Sequence
  Description of Artificial Sequence: Synthetic polypeptide
DENEIVTTNPVATEQYGSVVIDPDDENEFNVQGEDGE

SEQ ID NO: 192879 - protein, 39 aa, Artificial Sequence
  Description of Artificial Sequence: Synthetic polypeptide
VENEIRTTNPVATEFYGEVSTTDGGNNLLMEEDEGNEGD

SEQ ID NO: 192880 - protein, 39 aa, Artificial Sequence
  Description of Artificial Sequence: Synthetic polypeptide
TENEIRTTNPVATEQYGTSTVICPVSTAQQVLTSGGAVS

SEQ ID NO: 192881 - protein, 37 aa, Artificial Sequence
  Description of Artificial Sequence: Synthetic polypeptide
DEDEIRTTNPVATEGYGSVVNVDEFDEEDEDGGNQGN

SEQ ID NO: 192882 - protein, 38 aa, Artificial Sequence
  Description of Artificial Sequence: Synthetic polypeptide
DEEEIATTNPVATEQYGSACSAANPAEEADAEIGEGTA

SEQ ID NO: 192883 - protein, 37 aa, Artificial Sequence
  Description of Artificial Sequence: Synthetic polypeptide
DEQEIATTNPVATEQWGCVSATGDPGGTAHQGDEDNG

SEQ ID NO: 192884 - protein, 37 aa, Artificial Sequence
  Description of Artificial Sequence: Synthetic polypeptide
DEEEISTTNPVATEGYGCVCGNWGEHNQENFNSDTQD

SEQ ID NO: 192885 - protein, 38 aa, Artificial Sequence
  Description of Artificial Sequence: Synthetic polypeptide
DEMEIRTTNPVATEQYGCVCSNWGEDHNQEHFNSDTQS

SEQ ID NO: 192886 - protein, 37 aa, Artificial Sequence
  Description of Artificial Sequence: Synthetic polypeptide
DEDEIRTTNPVATEGYGMVNQDEFDEQEDEDGGNQGQ

SEQ ID NO: 192887 - protein, 37 aa, Artificial Sequence
  Description of Artificial Sequence: Synthetic polypeptide
DEDEIRTTNPVATEGYGMVNNDEFDNLTEFEDDGDGN

SEQ ID NO: 192888 - protein, 36 aa, Artificial Sequence
  Description of Artificial Sequence: Synthetic polypeptide
TENEIRTTNPVSTEPYGTVISCMEDAISDTQNGGNH

SEQ ID NO: 192889 - protein, 37 aa, Artificial Sequence
  Description of Artificial Sequence: Synthetic polypeptide
DEDEIRTTNPVATEGYGMVNNDEFDENEDEDDGNQGN

SEQ ID NO: 192890 - protein, 34 aa, Artificial Sequence
  Description of Artificial Sequence: Synthetic polypeptide
TENEIRTTNPVSYEPWGTVISCMEDISQQQNGNH

SEQ ID NO: 192891 - protein, 33 aa, Artificial Sequence
  Description of Artificial Sequence: Synthetic polypeptide
DENEIVTTNPVSTEPWGTISMEDIQQQQNDNCH

SEQ ID NO: 192892 - protein, 34 aa, Artificial Sequence
  Description of Artificial Sequence: Synthetic polypeptide
VEDEIACTNPVATEQWGGCVAATANGMMPGGVHW

SEQ ID NO: 192893 - protein, 36 aa, Artificial Sequence
  Description of Artificial Sequence: Synthetic polypeptide
DEMEIRTTNPVATEQYGCTINPVIHENENGFSETPQ

SEQ ID NO: 192894 - protein, 35 aa, Artificial Sequence
  Description of Artificial Sequence: Synthetic polypeptide
TENAINTTNPVATEYYCSVSDSNNPLVEPLNELTM

SEQ ID NO: 192895 - protein, 35 aa, Artificial Sequence
  Description of Artificial Sequence: Synthetic polypeptide
QEEEIATVNPVATAQWGGCVAGNGLQSNANAQTEK

SEQ ID NO: 192896 - protein, 38 aa, Artificial Sequence
  Description of Artificial Sequence: Synthetic polypeptide
DEEEISTTNPVATEGYGCVCSNWEEDTNIENFNSDNQS

SEQ ID NO: 192897 - protein, 37 aa, Artificial Sequence
  Description of Artificial Sequence: Synthetic polypeptide
DEEEISTTNPVATEGYGCVCSNWEEHNAEFFNSDFQA

SEQ ID NO: 192898 - protein, 35 aa, Artificial Sequence
  Description of Artificial Sequence: Synthetic polypeptide
DEDEIATTNPVAYERWGSVCSGGNPGNAGEHDGID

SEQ ID NO: 192899 - protein, 37 aa, Artificial Sequence
  Description of Artificial Sequence: Synthetic polypeptide
DEEEISTTNPVATEGYGCVCSNWEEHNAEFFNSDTQP

SEQ ID NO: 192900 - protein, 38 aa, Artificial Sequence
  Description of Artificial Sequence: Synthetic polypeptide
DEEEIRTTNPVAYEQYGQCSCSMWEEDNAEYFNSDTQA

SEQ ID NO: 192901 - protein, 34 aa, Artificial Sequence
  Description of Artificial Sequence: Synthetic polypeptide
DEDEIATTNPVAYERWGEVSGINPGNAGEHDGQT

SEQ ID NO: 192902 - protein, 37 aa, Artificial Sequence
  Description of Artificial Sequence: Synthetic polypeptide
DEEEISTTNPVATEGYGCVCSNWGEDHNAENFNSDQG

SEQ ID NO: 192903 - protein, 34 aa, Artificial Sequence
  Description of Artificial Sequence: Synthetic polypeptide
DETEIACTNPVATASWGCVAGNNNLQEDMIGGKH

SEQ ID NO: 192904 - protein, 37 aa, Artificial Sequence
  Description of Artificial Sequence: Synthetic polypeptide
TEGEIATTNPVATEQYGSISFSAPDTLREPHEGQDTR

SEQ ID NO: 192905 - protein, 38 aa, Artificial Sequence
  Description of Artificial Sequence: Synthetic polypeptide
DEEEIRTTNPVATEQYGCVCQNWMEDHNAEYFNSQNQA

SEQ ID NO: 192906 - protein, 37 aa, Artificial Sequence
  Description of Artificial Sequence: Synthetic polypeptide
DEEEISTTNPVATEGYGCVCSNWGEDHNAENFNSQQS

SEQ ID NO: 192907 - protein, 35 aa, Artificial Sequence
  Description of Artificial Sequence: Synthetic polypeptide
DESEIRTTNPVATETYGSVCCVEDMAHVDIEDDQQ

SEQ ID NO: 192908 - protein, 36 aa, Artificial Sequence
  Description of Artificial Sequence: Synthetic polypeptide
DEDEIATTNPVATECYGSACSAGNHNNEAPGGQEHN

SEQ ID NO: 192909 - protein, 37 aa, Artificial Sequence
  Description of Artificial Sequence: Synthetic polypeptide
DEEEISTTNPVATEGYGCVCSNWGEDNQENFNSDNQE

SEQ ID NO: 192910 - protein, 36 aa, Artificial Sequence
  Description of Artificial Sequence: Synthetic polypeptide
DETEIACTNPVATAQWGSVSVSGNPLENTGGVEQSN

SEQ ID NO: 192911 - protein, 37 aa, Artificial Sequence
  Description of Artificial Sequence: Synthetic polypeptide
DEEEISTTNPVATEGYGCVCSNWGEDNQEYFNSDTQS

SEQ ID NO: 192912 - protein, 33 aa, Artificial Sequence
  Description of Artificial Sequence: Synthetic polypeptide
DETEIACTNPVATEMWGTNCSAAAHGMRSNDSW

SEQ ID NO: 192913 - protein, 37 aa, Artificial Sequence
  Description of Artificial Sequence: Synthetic polypeptide
DEEEISTTNPVATEGYGCVCSNWGEHNAEFFNSDNQA

SEQ ID NO: 192914 - protein, 36 aa, Artificial Sequence
  Description of Artificial Sequence: Synthetic polypeptide
DETEIACTNPVATEPYGSACAANPQPQEHQDGNQHQ

SEQ ID NO: 192915 - protein, 37 aa, Artificial Sequence
  Description of Artificial Sequence: Synthetic polypeptide
DEEEISTTNPVATEGYGCVCSNWGEHNAENFNSDNQA

SEQ ID NO: 192916 - protein, 37 aa, Artificial Sequence
  Description of Artificial Sequence: Synthetic polypeptide
DEEEISTTNPVATEGYGCVCSNWGEHNAENFNSDTQP

SEQ ID NO: 192917 - protein, 37 aa, Artificial Sequence
  Description of Artificial Sequence: Synthetic polypeptide
DEEEISTTNPVATEGYGCVCSNWGEHNAENFNSDTQS

SEQ ID NO: 192918 - protein, 36 aa, Artificial Sequence
  Description of Artificial Sequence: Synthetic polypeptide
DEMEIRTTNPVATEQYGCVIWCDPLIIEDSESSQAE

SEQ ID NO: 192919 - protein, 37 aa, Artificial Sequence
  Description of Artificial Sequence: Synthetic polypeptide
DEEEISTTNPVATEGYGCVCSNWGEHNQEHFNSDNQS

SEQ ID NO: 192920 - protein, 37 aa, Artificial Sequence
  Description of Artificial Sequence: Synthetic polypeptide
DEEEISTTNPVATEGYGCVCSNWGEHNQENFGSDTQS

SEQ ID NO: 192921 - protein, 37 aa, Artificial Sequence
  Description of Artificial Sequence: Synthetic polypeptide
DEEEISTTNPVATEGYGCVCSNWGEHNQENFNSDNQI

SEQ ID NO: 192922 - protein, 34 aa, Artificial Sequence
  Description of Artificial Sequence: Synthetic polypeptide
DETEIACTNPVATEQWGCVAGKEGLEAGPGEEDH

SEQ ID NO: 192923 - protein, 35 aa, Artificial Sequence
  Description of Artificial Sequence: Synthetic polypeptide
DETEIACTNPVATEQWGCVAGTEGLEAGPPGEEDA

SEQ ID NO: 192924 - protein, 36 aa, Artificial Sequence
  Description of Artificial Sequence: Synthetic polypeptide
TEGAEISTTNPVAYEQWGSVCVTTDNGEWMEGGNNG

SEQ ID NO: 192925 - protein, 37 aa, Artificial Sequence
  Description of Artificial Sequence: Synthetic polypeptide
TEGAEISTTNPVAYEQWGSVCSTTDNGEWMEGGDNGE

SEQ ID NO: 192926 - protein, 38 aa, Artificial Sequence
  Description of Artificial Sequence: Synthetic polypeptide
DEEEISTTNPVATEGYGCVCSNWGEDTNAENFNSENQA

SEQ ID NO: 192927 - protein, 36 aa, Artificial Sequence
  Description of Artificial Sequence: Synthetic polypeptide
DETEIACTNPVATAQWGSVSVSGNPLENTGGLEESF

SEQ ID NO: 192928 - protein, 36 aa, Artificial Sequence
  Description of Artificial Sequence: Synthetic polypeptide
DETEIACTNPVATAQWGSVSVSGNPLEDTGGVEESD

SEQ ID NO: 192929 - protein, 38 aa, Artificial Sequence
  Description of Artificial Sequence: Synthetic polypeptide
TEGEIRTTNPVATEQYGSSPSVHLNFMEQLENQNEEEL

SEQ ID NO: 192930 - protein, 37 aa, Artificial Sequence
  Description of Artificial Sequence: Synthetic polypeptide
DEEEISTTNPVATEGYGCVCSMSGEHNAENFNSDNQA

SEQ ID NO: 192931 - protein, 35 aa, Artificial Sequence
  Description of Artificial Sequence: Synthetic polypeptide
DEEEIATTNPVAYEKWGCVYNLNDNHNGQLGMGDP

SEQ ID NO: 192932 - protein, 35 aa, Artificial Sequence
  Description of Artificial Sequence: Synthetic polypeptide
DETDEIATTNPVAYERWGSVSGINPGNAGEHDGQD

SEQ ID NO: 192933 - protein, 37 aa, Artificial Sequence
  Description of Artificial Sequence: Synthetic polypeptide
DEMEIRTTNPVATCQYGQCVCSWMEHNEENFNSDTQS

SEQ ID NO: 192934 - protein, 36 aa, Artificial Sequence
  Description of Artificial Sequence: Synthetic polypeptide
CEDEIATTNPVAYEQYGSCSAGPALGVNHQMGMQMN

SEQ ID NO: 192935 - protein, 38 aa, Artificial Sequence
  Description of Artificial Sequence: Synthetic polypeptide
VEQEIRTTNPVATEQYGVVMSNNDNNTGGPEQTGQTGD

SEQ ID NO: 192936 - protein, 38 aa, Artificial Sequence
  Description of Artificial Sequence: Synthetic polypeptide
VEQEIRTTNPVATESYGSVVMSVNDNNTGGGQTGQVGD

SEQ ID NO: 192937 - protein, 35 aa, Artificial Sequence
  Description of Artificial Sequence: Synthetic polypeptide
VEQEISTTNPVATEFYGVVSGTGDGEDEEGEGDGD

SEQ ID NO: 192938 - protein, 37 aa, Artificial Sequence
  Description of Artificial Sequence: Synthetic polypeptide
DEMEIRTTNPVATCQYGQCVCSWGEHNEEYFNSDNQS

SEQ ID NO: 192939 - protein, 35 aa, Artificial Sequence
  Description of Artificial Sequence: Synthetic polypeptide
VEDEIACTNPVATEQWGGCVANNNLENGMQEGDFI

SEQ ID NO: 192940 - protein, 36 aa, Artificial Sequence
  Description of Artificial Sequence: Synthetic polypeptide
VESEIASTNPVATEAWGSVVSCGHEFSQDREGENGW

SEQ ID NO: 192941 - protein, 37 aa, Artificial Sequence
  Description of Artificial Sequence: Synthetic polypeptide
VEDEIACTNPVATEQWGSVSATWPALGTNQGNPMEPV

SEQ ID NO: 192942 - protein, 38 aa, Artificial Sequence
  Description of Artificial Sequence: Synthetic polypeptide
DEEEISTTNPVATEGYGCVCSNSGEDHNQENFGSDNQA

SEQ ID NO: 192943 - protein, 37 aa, Artificial Sequence
  Description of Artificial Sequence: Synthetic polypeptide
DEEEISTTNPVATEGYGCVCSNSGEHNAEFFNSDFQS

SEQ ID NO: 192944 - protein, 37 aa, Artificial Sequence
  Description of Artificial Sequence: Synthetic polypeptide
DEEEISTTNPVATEGYGCVCSNSGEHNAENFNSDTQS

SEQ ID NO: 192945 - protein, 37 aa, Artificial Sequence
  Description of Artificial Sequence: Synthetic polypeptide
DEEEISTTNPVATEGYGCVCSNSGEHNQENFNSDNQD

SEQ ID NO: 192946 - protein, 33 aa, Artificial Sequence
  Description of Artificial Sequence: Synthetic polypeptide
DETEIACTNPIATECYGETWANAEDWQEPGPYI

SEQ ID NO: 192947 - protein, 36 aa, Artificial Sequence
  Description of Artificial Sequence: Synthetic polypeptide
DETEIACTNPVATAQWGSVSVSGNPEENTGGVENQM

SEQ ID NO: 192948 - protein, 36 aa, Artificial Sequence
  Description of Artificial Sequence: Synthetic polypeptide
DETEIACTNPVATAQWGSVSVSGNPDENTSGVEESR

SEQ ID NO: 192949 - protein, 35 aa, Artificial Sequence
  Description of Artificial Sequence: Synthetic polypeptide
DETEIACTNPVATAQWGSVSVSGDPLENTSGVEEM

SEQ ID NO: 192950 - protein, 37 aa, Artificial Sequence
  Description of Artificial Sequence: Synthetic polypeptide
AEEEIATTNPVATEQYGCQSCPNWEDNQEHFISENQA

SEQ ID NO: 192951 - protein, 36 aa, Artificial Sequence
  Description of Artificial Sequence: Synthetic polypeptide
DETEIACTNPVATAQWGSVAVSGNPLENTGGVEEQH

SEQ ID NO: 192952 - protein, 35 aa, Artificial Sequence
  Description of Artificial Sequence: Synthetic polypeptide
DEDEIATTNPVAYERWGSVSGANPGNAGEHDGQDM

SEQ ID NO: 192953 - protein, 35 aa, Artificial Sequence
  Description of Artificial Sequence: Synthetic polypeptide
DETDEIATTNPVAYEAWGSVYYVIQDEQGQGGNGE

SEQ ID NO: 192954 - protein, 35 aa, Artificial Sequence
  Description of Artificial Sequence: Synthetic polypeptide
AEEEIATTNPVATEQYGCFCPTWGEDNQHFSSEQS

SEQ ID NO: 192955 - protein, 34 aa, Artificial Sequence
  Description of Artificial Sequence: Synthetic polypeptide
TEHEIASVNPVCYEPYGVTVTSYINLSQSGGNNT

SEQ ID NO: 192956 - protein, 37 aa, Artificial Sequence
  Description of Artificial Sequence: Synthetic polypeptide
QEEEIRTTNPVATEQYGMITVNMGMEDDNEEGGGGIQ

SEQ ID NO: 192957 - protein, 36 aa, Artificial Sequence
  Description of Artificial Sequence: Synthetic polypeptide
DEMEICTTNPMATETYGSVPCSPDPHQHASGEIFMG

SEQ ID NO: 192958 - protein, 37 aa, Artificial Sequence
  Description of Artificial Sequence: Synthetic polypeptide
DEMEICTTNPMATETYGSVPCTVPDPEQHASGENFMG

SEQ ID NO: 192959 - protein, 33 aa, Artificial Sequence
  Description of Artificial Sequence: Synthetic polypeptide
DETEIACTNPIATECYGETWSNAEDWQEPGPYI

SEQ ID NO: 192960 - protein, 36 aa, Artificial Sequence
  Description of Artificial Sequence: Synthetic polypeptide
DEEEIATTNPVAYEKWGCVYNLPDNHNGNQLGNGSG

SEQ ID NO: 192961 - protein, 36 aa, Artificial Sequence
  Description of Artificial Sequence: Synthetic polypeptide
DEDEIATTNPVATEPWGSVCLIEDNGDDRDGGDAMD

SEQ ID NO: 192962 - protein, 35 aa, Artificial Sequence
  Description of Artificial Sequence: Synthetic polypeptide
DEDEIATTNPVAYERWGSVSGGNPGNPGEDDGQDG

SEQ ID NO: 192963 - protein, 34 aa, Artificial Sequence
  Description of Artificial Sequence: Synthetic polypeptide
VEDEIACTNPVATEQWGGCVAATANGATMEPGGT

SEQ ID NO: 192964 - protein, 36 aa, Artificial Sequence
  Description of Artificial Sequence: Synthetic polypeptide
DESTICTTNPVATEFYGQYSVDINGLEQGEEDDQDD

SEQ ID NO: 192965 - protein, 34 aa, Artificial Sequence
  Description of Artificial Sequence: Synthetic polypeptide
DEHEIRTTNPVAYECWGVVYRINENQDQQMKTDG

SEQ ID NO: 192966 - protein, 34 aa, Artificial Sequence
  Description of Artificial Sequence: Synthetic polypeptide
DEDEIATTNPVAYERWGSVTGGNPGNAGEHKGQV

SEQ ID NO: 192967 - protein, 35 aa, Artificial Sequence
  Description of Artificial Sequence: Synthetic polypeptide
AEECCAEIATNPVAYEQWGTVAWLDNMQRQGGGNN

SEQ ID NO: 192968 - protein, 38 aa, Artificial Sequence
  Description of Artificial Sequence: Synthetic polypeptide
DEEEIATTNPVATEQYGSCVAAIGTGDEPATDTGDGLP

SEQ ID NO: 192969 - protein, 33 aa, Artificial Sequence
  Description of Artificial Sequence: Synthetic polypeptide
DESEVASTNPVSTEGYGNIAAMEDIQQSRVGQR

SEQ ID NO: 192970 - protein, 35 aa, Artificial Sequence
  Description of Artificial Sequence: Synthetic polypeptide
DEDEIATTNPVATEQWGCVAGEHGVEMNAAEDNAM

SEQ ID NO: 192971 - protein, 38 aa, Artificial Sequence
  Description of Artificial Sequence: Synthetic polypeptide
DEPEIATTNPVATDQYGNVVDSTTDGGEQGGQGENETF

SEQ ID NO: 192972 - protein, 35 aa, Artificial Sequence
  Description of Artificial Sequence: Synthetic polypeptide
DEQEIATTNPVATEQWGCVAANNGTEATMNPEGAH

SEQ ID NO: 192973 - protein, 35 aa, Artificial Sequence
  Description of Artificial Sequence: Synthetic polypeptide
DENSIATTNPVAYECWGSVYNWMNDVKGREGHNME

SEQ ID NO: 192974 - protein, 37 aa, Artificial Sequence
  Description of Artificial Sequence: Synthetic polypeptide
DENSEICTTNPVAYECWGSVATGNGPLIDDRQQNGVD

SEQ ID NO: 192975 - protein, 38 aa, Artificial Sequence
  Description of Artificial Sequence: Synthetic polypeptide
DEEEIATTNPVATEQYGSCAAAGGNGLTNPDDGMGDFN

SEQ ID NO: 192976 - protein, 33 aa, Artificial Sequence
  Description of Artificial Sequence: Synthetic polypeptide
DESEVATTNPVSTEGYGTIAAMEDIQQSRVGQH

SEQ ID NO: 192977 - protein, 35 aa, Artificial Sequence
  Description of Artificial Sequence: Synthetic polypeptide
DEEEISTTNPEATCQYGCVCPWGEHNIYFGSDTQA

SEQ ID NO: 192978 - protein, 38 aa, Artificial Sequence
  Description of Artificial Sequence: Synthetic polypeptide
TESEIRTTNPVATEAWGSVVTSCGHEFSQDREGENEGW

SEQ ID NO: 192979 - protein, 32 aa, Artificial Sequence
  Description of Artificial Sequence: Synthetic polypeptide
DESEVASTNPIATEGWGNTANNTWQEPVGQYR

SEQ ID NO: 192980 - protein, 33 aa, Artificial Sequence
  Description of Artificial Sequence: Synthetic polypeptide
DESEVATTNPVSTEPYGTIAAMEDIQQSRVGQH

SEQ ID NO: 192981 - protein, 36 aa, Artificial Sequence
  Description of Artificial Sequence: Synthetic polypeptide
DEMEIRTTNPVATEQYGACWICPQLMIEDSESSQRE

SEQ ID NO: 192982 - protein, 38 aa, Artificial Sequence
  Description of Artificial Sequence: Synthetic polypeptide
DEEEIATTNPVAYAQWGSVCSEANPALPDDHGGGMMRW

SEQ ID NO: 192983 - protein, 37 aa, Artificial Sequence
  Description of Artificial Sequence: Synthetic polypeptide
DEDEIRTTNPVATEAWGVVVTVVNNTEQGTNVEQGGT

SEQ ID NO: 192984 - protein, 39 aa, Artificial Sequence
  Description of Artificial Sequence: Synthetic polypeptide
DEMEIRTTNPVATEQYGASSCEPTTVMEQEGDEVSLQER

SEQ ID NO: 192985 - protein, 37 aa, Artificial Sequence
  Description of Artificial Sequence: Synthetic polypeptide
TESEIKTTNPVATEAWGCSVVSCGHEFSQDREGENGW

SEQ ID NO: 192986 - protein, 31 aa, Artificial Sequence
  Description of Artificial Sequence: Synthetic polypeptide
TESEIATTNPVAYERWGEAYMVEQHDEGEGY

SEQ ID NO: 192987 - protein, 35 aa, Artificial Sequence
  Description of Artificial Sequence: Synthetic polypeptide
DEEEISTTNPEATEQYGCVCPWGEDNANFNSDTQS

SEQ ID NO: 192988 - protein, 36 aa, Artificial Sequence
  Description of Artificial Sequence: Synthetic polypeptide
DEAEIRTTNPVAYEPYYSLPNPNVDFMNFQSGQDEW

SEQ ID NO: 192989 - protein, 36 aa, Artificial Sequence
  Description of Artificial Sequence: Synthetic polypeptide
QEEEIRSTNPVATECYGSVNNDNTFEEGGGDTEQGE

SEQ ID NO: 192990 - protein, 32 aa, Artificial Sequence
  Description of Artificial Sequence: Synthetic polypeptide
TESEIASTNPVGYENYGVCACSTLSQTHGGDI

SEQ ID NO: 192991 - protein, 32 aa, Artificial Sequence
  Description of Artificial Sequence: Synthetic polypeptide
TESEIASTNPVGYEGYGVMACSTLSQHGGDYI

SEQ ID NO: 192992 - protein, 31 aa, Artificial Sequence
  Description of Artificial Sequence: Synthetic polypeptide
TESEIASTNPVGYEGYGVCACLTLSQHGGDI

SEQ ID NO: 192993 - protein, 32 aa, Artificial Sequence
  Description of Artificial Sequence: Synthetic polypeptide
TESEIASTNPVGYEGYGTCACSTLSQHGGDIY

SEQ ID NO: 192994 - protein, 37 aa, Artificial Sequence
  Description of Artificial Sequence: Synthetic polypeptide
DEEEISTTNPVATCQYGCVCSNWEEHNAENFNSDNQS

SEQ ID NO: 192995 - protein, 37 aa, Artificial Sequence
  Description of Artificial Sequence: Synthetic polypeptide
DEMEIRTTNPVATEQYGACCWVWDVDVEQLEGGEDHL

SEQ ID NO: 192996 - protein, 36 aa, Artificial Sequence
  Description of Artificial Sequence: Synthetic polypeptide
CEDEIATTNPVAYEQWGSVCSANPALAEAHQDLTAM

SEQ ID NO: 192997 - protein, 35 aa, Artificial Sequence
  Description of Artificial Sequence: Synthetic polypeptide
DEAEIRTTNPVAYEKWGEVAWGEQEQGNHGNGEGG

SEQ ID NO: 192998 - protein, 35 aa, Artificial Sequence
  Description of Artificial Sequence: Synthetic polypeptide
AEEEIASVNPVGTEQYGCVCSWGELNQESFGSQQA

SEQ ID NO: 192999 - protein, 38 aa, Artificial Sequence
  Description of Artificial Sequence: Synthetic polypeptide
CEEEIRTTNPVATEQYGCVCSNTGEDHNQENFISDTQA

SEQ ID NO: 193000 - protein, 35 aa, Artificial Sequence
  Description of Artificial Sequence: Synthetic polypeptide
DEDEIATTNPVATEQWGGCCAGNGHQSAEDQPMRN

SEQ ID NO: 193001 - protein, 37 aa, Artificial Sequence
  Description of Artificial Sequence: Synthetic polypeptide
DEEEIRTTNPVAYEQYGQCVCSWGEDPNQENFSSEQA

SEQ ID NO: 193002 - protein, 34 aa, Artificial Sequence
  Description of Artificial Sequence: Synthetic polypeptide
DEDEIATTNPVATEQWGGCCAGAGHQAEGQPMDN

SEQ ID NO: 193003 - protein, 37 aa, Artificial Sequence
  Description of Artificial Sequence: Synthetic polypeptide
DESEIVTTNPVATEGYGSVNNNDEFDEGDEDGGNQGN

SEQ ID NO: 193004 - protein, 32 aa, Artificial Sequence
  Description of Artificial Sequence: Synthetic polypeptide
QEGEIASTNPCSYEQWGIVWCNDQGSGGDTDR

SEQ ID NO: 193005 - protein, 38 aa, Artificial Sequence
  Description of Artificial Sequence: Synthetic polypeptide
CEEEIRTTNPVATEQYGCVCSNWEEDHNAENFNSQPQS

SEQ ID NO: 193006 - protein, 37 aa, Artificial Sequence
  Description of Artificial Sequence: Synthetic polypeptide
DEEEISTTNPCATEQYGQCVCPWMEHNQENFGSNTQA

SEQ ID NO: 193007 - protein, 37 aa, Artificial Sequence
  Description of Artificial Sequence: Synthetic polypeptide
TETAIRSTNPVAYENYGQSVVPSTNNEWTESVGNTRN

SEQ ID NO: 193008 - protein, 35 aa, Artificial Sequence
  Description of Artificial Sequence: Synthetic polypeptide
TETAIRSTNPVAYENWGQSVVSTNNEWTSVGPTRN

SEQ ID NO: 193009 - protein, 35 aa, Artificial Sequence
  Description of Artificial Sequence: Synthetic polypeptide
TESVGATTNPVAYEQWGTVCSTNDRHDQNGQNGSQ

SEQ ID NO: 193010 - protein, 36 aa, Artificial Sequence
  Description of Artificial Sequence: Synthetic polypeptide
DEDEIATTNPVAYERWGSVYSAGNPGNAGEHDGQRE

SEQ ID NO: 193011 - protein, 39 aa, Artificial Sequence
  Description of Artificial Sequence: Synthetic polypeptide
DEPEIRTTNPVATEQYGSTAISPTATPLHEVSPMQDEVN

SEQ ID NO: 193012 - protein, 31 aa, Artificial Sequence
  Description of Artificial Sequence: Synthetic polypeptide
QEGEIASTNPCSYEQWGYTYCNDQASGDTDR

SEQ ID NO: 193013 - protein, 31 aa, Artificial Sequence
  Description of Artificial Sequence: Synthetic polypeptide
QEGEIASTNPCSYEQWGYTYCNDQGSLGDTR

SEQ ID NO: 193014 - protein, 38 aa, Artificial Sequence
  Description of Artificial Sequence: Synthetic polypeptide
CEEEIRTTNPVATEQYGCVCSNWGEDHNQEGFGSDTQS

SEQ ID NO: 193015 - protein, 38 aa, Artificial Sequence
  Description of Artificial Sequence: Synthetic polypeptide
CEEEIRTTNPVATEQYGCVCSNWGEDHNQENFGSDTQA

SEQ ID NO: 193016 - protein, 37 aa, Artificial Sequence
  Description of Artificial Sequence: Synthetic polypeptide
DAEEIATTNPVATEQYGSVCAANMGEEAPDDQANMHM

SEQ ID NO: 193017 - protein, 39 aa, Artificial Sequence
  Description of Artificial Sequence: Synthetic polypeptide
QEEEIRPTNPVATEIYGSVNNSTTPDNGPEMGQGENEEG

SEQ ID NO: 193018 - protein, 36 aa, Artificial Sequence
  Description of Artificial Sequence: Synthetic polypeptide
DEHEIRTTNPVAYECWGCVAGGGNMGNQRDGEGDGN

SEQ ID NO: 193019 - protein, 37 aa, Artificial Sequence
  Description of Artificial Sequence: Synthetic polypeptide
DEEEISTTNPCATEQYGQCVCSWGEHNAEYFGSDTQA

SEQ ID NO: 193020 - protein, 30 aa, Artificial Sequence
  Description of Artificial Sequence: Synthetic polypeptide
QEGEIASTNPCSYERWGITYCNDQSSGDTR

SEQ ID NO: 193021 - protein, 36 aa, Artificial Sequence
  Description of Artificial Sequence: Synthetic polypeptide
QEGEIASTNPCSYEQYGVTVSCLTNMLSQTVGGTPR

SEQ ID NO: 193022 - protein, 39 aa, Artificial Sequence
  Description of Artificial Sequence: Synthetic polypeptide
DEDEIRTTNPVATEAYGVVATTVTNLQQSAEQGTTTVTD

SEQ ID NO: 193023 - protein, 35 aa, Artificial Sequence
  Description of Artificial Sequence: Synthetic polypeptide
QEGEIASTNPCSYEQYGVTVSCLNMLSQGVGGTDR

SEQ ID NO: 193024 - protein, 35 aa, Artificial Sequence
  Description of Artificial Sequence: Synthetic polypeptide
DEAEIRTTNPVAYEKWGEVAMGENQGNHGNGNGTT

SEQ ID NO: 193025 - protein, 37 aa, Artificial Sequence
  Description of Artificial Sequence: Synthetic polypeptide
DEEEIATTNPVATEQYGSTCAANMGEEAPDDLMEDAM

SEQ ID NO: 193026 - protein, 35 aa, Artificial Sequence
  Description of Artificial Sequence: Synthetic polypeptide
DEDEIATTNPVAYERWGSVTGMNPGNAGEHDGQRE

SEQ ID NO: 193027 - protein, 37 aa, Artificial Sequence
  Description of Artificial Sequence: Synthetic polypeptide
CEEEIRTTNPVATEQYGCVCSNWGEHNQENFISDTQS

SEQ ID NO: 193028 - protein, 31 aa, Artificial Sequence
  Description of Artificial Sequence: Synthetic polypeptide
QEGEIASTNPCSYEQWGYTYCNEDQNSGDTR

SEQ ID NO: 193029 - protein, 38 aa, Artificial Sequence
  Description of Artificial Sequence: Synthetic polypeptide
CEEEIRTTNPVATEQYGCVCSNWGEDHNQENFNSDNQS

SEQ ID NO: 193030 - protein, 36 aa, Artificial Sequence
  Description of Artificial Sequence: Synthetic polypeptide
DEHEIRTTNPVAYECWGCVAGGGNQGNERGGEGDER

SEQ ID NO: 193031 - protein, 33 aa, Artificial Sequence
  Description of Artificial Sequence: Synthetic polypeptide
TESEIASTNPVGTEGYGVTIASTEESQSTLGDI

SEQ ID NO: 193032 - protein, 36 aa, Artificial Sequence
  Description of Artificial Sequence: Synthetic polypeptide
DESGIATTNPVAYTEAYGCVQVLLNEPSQREGGDQA

SEQ ID NO: 193033 - protein, 33 aa, Artificial Sequence
  Description of Artificial Sequence: Synthetic polypeptide
VEDEIACTNPVATEQWGGCSAAPANGMMPGGMT

SEQ ID NO: 193034 - protein, 31 aa, Artificial Sequence
  Description of Artificial Sequence: Synthetic polypeptide
TESEIASTNPVGTEGWGVCAPTDDQHQGDQI

SEQ ID NO: 193035 - protein, 36 aa, Artificial Sequence
  Description of Artificial Sequence: Synthetic polypeptide
DESPIATTNPVAYTESYGCVSVLLNETSLREGGDQA

SEQ ID NO: 193036 - protein, 33 aa, Artificial Sequence
  Description of Artificial Sequence: Synthetic polypeptide
VEDEIACTNPVATEQWGGCTAGNGLADVHDNSP

SEQ ID NO: 193037 - protein, 34 aa, Artificial Sequence
  Description of Artificial Sequence: Synthetic polypeptide
VEDEIACTNPVATEQWGGCVAATANGAAHPGGTQ

SEQ ID NO: 193038 - protein, 35 aa, Artificial Sequence
  Description of Artificial Sequence: Synthetic polypeptide
VEDEIACTNPVATEQWGGCVAATANGALMHPGGVT

SEQ ID NO: 193039 - protein, 34 aa, Artificial Sequence
  Description of Artificial Sequence: Synthetic polypeptide
DEDEIATTNPVATEQWGCVAAKAGPEADPGGPPP

SEQ ID NO: 193040 - protein, 35 aa, Artificial Sequence
  Description of Artificial Sequence: Synthetic polypeptide
DEDEIATTNPVATEQWGCTAGNEHLEATMDIDDRM

SEQ ID NO: 193041 - protein, 31 aa, Artificial Sequence
  Description of Artificial Sequence: Synthetic polypeptide
TESEIASTNPVGTEAWGVCAPTDRDQHQGDV

SEQ ID NO: 193042 - protein, 36 aa, Artificial Sequence
  Description of Artificial Sequence: Synthetic polypeptide
DAQEIATTNPVAYEQYGSVCSMANPAEATGGDLAAM

SEQ ID NO: 193043 - protein, 37 aa, Artificial Sequence
  Description of Artificial Sequence: Synthetic polypeptide
DEEEISTTNPVATCQYGQCVCSWGEHNAENFNSENQA

SEQ ID NO: 193044 - protein, 35 aa, Artificial Sequence
  Description of Artificial Sequence: Synthetic polypeptide
DEDEIATTNPVATEQWGCTAGNEHLEATFDIDTRM

SEQ ID NO: 193045 - protein, 39 aa, Artificial Sequence
  Description of Artificial Sequence: Synthetic polypeptide
DEEEIRTTNPVATEQYGSVGMVAIVYGFEQETQLLNPLE

SEQ ID NO: 193046 - protein, 35 aa, Artificial Sequence
  Description of Artificial Sequence: Synthetic polypeptide
DENENATTNPVAYEAWGSTVYVNENDPDQGRNGGP

SEQ ID NO: 193047 - protein, 34 aa, Artificial Sequence
  Description of Artificial Sequence: Synthetic polypeptide
VEDEIACTNPVATEQWGGCVAATANGAMPGGMHN

SEQ ID NO: 193048 - protein, 34 aa, Artificial Sequence
  Description of Artificial Sequence: Synthetic polypeptide
DESSIATTNPVAYECWGSVYNWMNDVAEREGQHM

SEQ ID NO: 193049 - protein, 37 aa, Artificial Sequence
  Description of Artificial Sequence: Synthetic polypeptide
TESCIRTTNPVAYENYGTTVYSCTQNVSQLSSGDDNA

SEQ ID NO: 193050 - protein, 33 aa, Artificial Sequence
  Description of Artificial Sequence: Synthetic polypeptide
DESSIATTNPVAYECWGSVYNWMNDVAGEGHHM

SEQ ID NO: 193051 - protein, 38 aa, Artificial Sequence
  Description of Artificial Sequence: Synthetic polypeptide
VENEIRTTNPVATDQYGSVNMNLIMGNQLQEFNENNEQ

SEQ ID NO: 193052 - protein, 36 aa, Artificial Sequence
  Description of Artificial Sequence: Synthetic polypeptide
DESTICTTNPVATEFYGQYSVDINGLEGGEFDDEDD

SEQ ID NO: 193053 - protein, 37 aa, Artificial Sequence
  Description of Artificial Sequence: Synthetic polypeptide
DESTICTTNPVATEFYGQVSVVNDINGLEQGGGDDED

SEQ ID NO: 193054 - protein, 37 aa, Artificial Sequence
  Description of Artificial Sequence: Synthetic polypeptide
DESTICTTNPVATEFYGQSVSNDINGLEIGGGDDEDN

SEQ ID NO: 193055 - protein, 40 aa, Artificial Sequence
  Description of Artificial Sequence: Synthetic polypeptide
DEEEIRTTNPVATEAYGTVTQQYGNSDEISTTSIGTTGNT

SEQ ID NO: 193056 - protein, 38 aa, Artificial Sequence
  Description of Artificial Sequence: Synthetic polypeptide
VENEIRTTNPVATDQYGSVNMNLEMQNQLQEENGQAEG

SEQ ID NO: 193057 - protein, 31 aa, Artificial Sequence
  Description of Artificial Sequence: Synthetic polypeptide
TESEIASTNPVGTEGWGVCAPTDKDQHGDQG

SEQ ID NO: 193058 - protein, 36 aa, Artificial Sequence
  Description of Artificial Sequence: Synthetic polypeptide
DESTEIATTNPCAYEAWGSVATPNGNQQLEGDHQRQ

SEQ ID NO: 193059 - protein, 36 aa, Artificial Sequence
  Description of Artificial Sequence: Synthetic polypeptide
AEEEIATTNPVATEEYGCSCSWGEHNAENFNSDTQA

SEQ ID NO: 193060 - protein, 37 aa, Artificial Sequence
  Description of Artificial Sequence: Synthetic polypeptide
DEMEIRTTNPVATEQYGCMYVFANPENEKMWTQDPEQ

SEQ ID NO: 193061 - protein, 36 aa, Artificial Sequence
  Description of Artificial Sequence: Synthetic polypeptide
TESCIRATNPVAYEQYGTTVSCTQNEVSQLSSDDNH

SEQ ID NO: 193062 - protein, 36 aa, Artificial Sequence
  Description of Artificial Sequence: Synthetic polypeptide
TESCIRTTNPLAYENYGTTVSCTQNVSQLSSGDPNA

SEQ ID NO: 193063 - protein, 37 aa, Artificial Sequence
  Description of Artificial Sequence: Synthetic polypeptide
DEMEIRTTNPVATEQYGCMTCVFANPENEMWTQDHEQ

SEQ ID NO: 193064 - protein, 37 aa, Artificial Sequence
  Description of Artificial Sequence: Synthetic polypeptide
DEMEIRTTNPVATEQYGCMNCVKANPENEMWTQDAEQ

SEQ ID NO: 193065 - protein, 36 aa, Artificial Sequence
  Description of Artificial Sequence: Synthetic polypeptide
DESSVIACTNPVATEQWGCVAGTNLPDAAGSEMNQE

SEQ ID NO: 193066 - protein, 38 aa, Artificial Sequence
  Description of Artificial Sequence: Synthetic polypeptide
TEEEIRTTNPVATEQYGEAHEHAPGVSNENVRTTLGSE

SEQ ID NO: 193067 - protein, 36 aa, Artificial Sequence
  Description of Artificial Sequence: Synthetic polypeptide
DAEEIATTNPVATEQYGCVAANHSGDPAMHPGMQGN

SEQ ID NO: 193068 - protein, 35 aa, Artificial Sequence
  Description of Artificial Sequence: Synthetic polypeptide
DESPIATTNPVAYTEAYGQVSVLLNETSNKGGDQA

SEQ ID NO: 193069 - protein, 39 aa, Artificial Sequence
  Description of Artificial Sequence: Synthetic polypeptide
DEMEIRTTNPVATEQYGAVTTYSTDSMEQATFTEILNGH

SEQ ID NO: 193070 - protein, 38 aa, Artificial Sequence
  Description of Artificial Sequence: Synthetic polypeptide
DEEEISTTNPVATCQYGCVCSNWGEDHNQENFGSENQS

SEQ ID NO: 193071 - protein, 34 aa, Artificial Sequence
  Description of Artificial Sequence: Synthetic polypeptide
VEDEIACTNPVATEQWGGCSAATANGGMPGGMHK

SEQ ID NO: 193072 - protein, 33 aa, Artificial Sequence
  Description of Artificial Sequence: Synthetic polypeptide
TESEIASTNPVGTEGYGVIPASTELSSSTGGDI

SEQ ID NO: 193073 - protein, 36 aa, Artificial Sequence
  Description of Artificial Sequence: Synthetic polypeptide
DESNEIATTNPVAYEQWGCVYSEVNNDNQGERNSQG

SEQ ID NO: 193074 - protein, 34 aa, Artificial Sequence
  Description of Artificial Sequence: Synthetic polypeptide
TESEIASTNPVGTEGYGVIATSTELSQSTGGDII

SEQ ID NO: 193075 - protein, 33 aa, Artificial Sequence
  Description of Artificial Sequence: Synthetic polypeptide
TESEIASTNPVGTEGYGVIATATELSQHTGGDI

SEQ ID NO: 193076 - protein, 39 aa, Artificial Sequence
  Description of Artificial Sequence: Synthetic polypeptide
DESNEIATTNPVAYEQWGVVAVNPTGNGDVQDRKGDNMR

SEQ ID NO: 193077 - protein, 36 aa, Artificial Sequence
  Description of Artificial Sequence: Synthetic polypeptide
DEMEIRTTNPVATEQYGCAINCPQLMIEDSESSQRE

SEQ ID NO: 193078 - protein, 35 aa, Artificial Sequence
  Description of Artificial Sequence: Synthetic polypeptide
DESPIAGTNPVAYTEAYGCVSVLLNETSQIGGDQA

SEQ ID NO: 193079 - protein, 36 aa, Artificial Sequence
  Description of Artificial Sequence: Synthetic polypeptide
DESPIAGTNPVAYTEAYGQTVSVLLNETSQRGGDKA

SEQ ID NO: 193080 - protein, 36 aa, Artificial Sequence
  Description of Artificial Sequence: Synthetic polypeptide
DESPIAGTNPVAYTEAYGQVSVLLNEWSQRGGDPQA

SEQ ID NO: 193081 - protein, 36 aa, Artificial Sequence
  Description of Artificial Sequence: Synthetic polypeptide
DESPIATTNPLAYTEAYGCVSVLLNETSQREGGDQT

SEQ ID NO: 193082 - protein, 36 aa, Artificial Sequence
  Description of Artificial Sequence: Synthetic polypeptide
DEQEIATTNPVATEQWGCVAGSGDPDANDNPMGAQP

SEQ ID NO: 193083 - protein, 33 aa, Artificial Sequence
  Description of Artificial Sequence: Synthetic polypeptide
TESEIASTNPVGTEGYGVIAITELSQSTLGDIW

SEQ ID NO: 193084 - protein, 33 aa, Artificial Sequence
  Description of Artificial Sequence: Synthetic polypeptide
TESEIASTNPVGTEGYGVIAGLTELSQSTGGDI

SEQ ID NO: 193085 - protein, 36 aa, Artificial Sequence
  Description of Artificial Sequence: Synthetic polypeptide
DESPIATTNPVAYTEAWGHSVSVLLNETSQQGGDQA

SEQ ID NO: 193086 - protein, 36 aa, Artificial Sequence
  Description of Artificial Sequence: Synthetic polypeptide
DEQEIATTNPVATEQWGCVSANGDPGGTDHQGDEDN

SEQ ID NO: 193087 - protein, 37 aa, Artificial Sequence
  Description of Artificial Sequence: Synthetic polypeptide
DESPIATTNPVAYTEAYGFVCSVLLNETSQREGGDQA

SEQ ID NO: 193088 - protein, 37 aa, Artificial Sequence
  Description of Artificial Sequence: Synthetic polypeptide
DEQEIATTNPVATEQWGCVAGTPGQSTGPDDQMINSD

SEQ ID NO: 193089 - protein, 32 aa, Artificial Sequence
  Description of Artificial Sequence: Synthetic polypeptide
TESEIASTNPVGTEGWGVCAPTDLQHGQDDAQ

SEQ ID NO: 193090 - protein, 36 aa, Artificial Sequence
  Description of Artificial Sequence: Synthetic polypeptide
DEMEIRTTNPVATEQYGCFICPQLMIEDSIESSQRE

SEQ ID NO: 193091 - protein, 32 aa, Artificial Sequence
  Description of Artificial Sequence: Synthetic polypeptide
TESEIASTNPVGTEGWGVCAPTDLQHHKGDAD

SEQ ID NO: 193092 - protein, 35 aa, Artificial Sequence
  Description of Artificial Sequence: Synthetic polypeptide
VEDEIACTNPVATEQWGGCSAGNGLQGMFMHEDNS

SEQ ID NO: 193093 - protein, 36 aa, Artificial Sequence
  Description of Artificial Sequence: Synthetic polypeptide
DESPIATTNPVAYTEAYGCVSVLLNETSQEEGFDQA

SEQ ID NO: 193094 - protein, 36 aa, Artificial Sequence
  Description of Artificial Sequence: Synthetic polypeptide
DESPIATTNPVAYTEAYGCVSVLLNETIQQEGGDQA

SEQ ID NO: 193095 - protein, 32 aa, Artificial Sequence
  Description of Artificial Sequence: Synthetic polypeptide
TESEIASTNPVGTEGWGVCAPTDLQQHQGDTE

SEQ ID NO: 193096 - protein, 36 aa, Artificial Sequence
  Description of Artificial Sequence: Synthetic polypeptide
DESPIATTNPVAYTEAYGCVQVLNNETSQRNGGDQA

SEQ ID NO: 193097 - protein, 31 aa, Artificial Sequence
  Description of Artificial Sequence: Synthetic polypeptide
TESEIASTNPVGTEGWGVCAPTDQGQHDGDI

SEQ ID NO: 193098 - protein, 36 aa, Artificial Sequence
  Description of Artificial Sequence: Synthetic polypeptide
DESPIATTNPVAYTEAYGCVQVLENETSQREGGDQS

SEQ ID NO: 193099 - protein, 31 aa, Artificial Sequence
  Description of Artificial Sequence: Synthetic polypeptide
TESEIASTNPVGTEGWGVCAPTDRDQHHGDA

SEQ ID NO: 193100 - protein, 32 aa, Artificial Sequence
  Description of Artificial Sequence: Synthetic polypeptide
TESEIASTNPVGTEGWGVCAPTDLQHQGGDDK

SEQ ID NO: 193101 - protein, 37 aa, Artificial Sequence
  Description of Artificial Sequence: Synthetic polypeptide
TEEEIRTTNPVATEQYGDYPRPYERWELENQLENNEC

SEQ ID NO: 193102 - protein, 37 aa, Artificial Sequence
  Description of Artificial Sequence: Synthetic polypeptide
DETEIRTTNPCATEQYGVVATTNANAEDINEEEGIYI

SEQ ID NO: 193103 - protein, 37 aa, Artificial Sequence
  Description of Artificial Sequence: Synthetic polypeptide
DETEIRTTNPCATEQYGVVATTNANAEETAENEGIYI

SEQ ID NO: 193104 - protein, 39 aa, Artificial Sequence
  Description of Artificial Sequence: Synthetic polypeptide
DEEEIRTTNPVAFEFYGVVNNANGQENDPGQRGGQRGDQ

SEQ ID NO: 193105 - protein, 37 aa, Artificial Sequence
  Description of Artificial Sequence: Synthetic polypeptide
DEDAIRTTNPVAYDQYGSVQQCTGGQSQNWTGTMNGV

SEQ ID NO: 193106 - protein, 38 aa, Artificial Sequence
  Description of Artificial Sequence: Synthetic polypeptide
DEMEIATTNPVATEQYGQCVCSTWGEPNAEFFGSDTQS

SEQ ID NO: 193107 - protein, 34 aa, Artificial Sequence
  Description of Artificial Sequence: Synthetic polypeptide
SESEIACTNPVAYEVYGEACSCENLSQAVGGDTG

SEQ ID NO: 193108 - protein, 34 aa, Artificial Sequence
  Description of Artificial Sequence: Synthetic polypeptide
SESEIACTNPVAYERYGEACSCENELSQAVGGDT

SEQ ID NO: 193109 - protein, 34 aa, Artificial Sequence
  Description of Artificial Sequence: Synthetic polypeptide
SESEIACTNPVAYEGYGHACSCENLSQAVGGDTM

SEQ ID NO: 193110 - protein, 33 aa, Artificial Sequence
  Description of Artificial Sequence: Synthetic polypeptide
SESEIACTNPVAYEGYGEACSCYNGSQAVGGDQ

SEQ ID NO: 193111 - protein, 34 aa, Artificial Sequence
  Description of Artificial Sequence: Synthetic polypeptide
SESEIACTNPVAYEGYGEACSCQGNLSQAVGGDT

SEQ ID NO: 193112 - protein, 34 aa, Artificial Sequence
  Description of Artificial Sequence: Synthetic polypeptide
SESEIACTNPVAYEGYGEACSCENLSQTVGGGDW

SEQ ID NO: 193113 - protein, 33 aa, Artificial Sequence
  Description of Artificial Sequence: Synthetic polypeptide
SESEIACTNPVAYEGYGEACSCENLSEAVGGMT

SEQ ID NO: 193114 - protein, 34 aa, Artificial Sequence
  Description of Artificial Sequence: Synthetic polypeptide
SESEIACTNPVAYEGYGEACSCENGLSQQVGGDD

SEQ ID NO: 193115 - protein, 33 aa, Artificial Sequence
  Description of Artificial Sequence: Synthetic polypeptide
SESEIACTNPVAYEGYGEACSCENFSQAVGGDP

SEQ ID NO: 193116 - protein, 33 aa, Artificial Sequence
  Description of Artificial Sequence: Synthetic polypeptide
SESEIACTNPVAYECYGEACSCENGSQAVGSDT

SEQ ID NO: 193117 - protein, 34 aa, Artificial Sequence
  Description of Artificial Sequence: Synthetic polypeptide
DETEIRTTNPVATECWGATTWANAEDWAEPKGPI

SEQ ID NO: 193118 - protein, 34 aa, Artificial Sequence
  Description of Artificial Sequence: Synthetic polypeptide
DETEIRTTNPVATECWGATTWANAEDWAEHKGPI

SEQ ID NO: 193119 - protein, 33 aa, Artificial Sequence
  Description of Artificial Sequence: Synthetic polypeptide
SESEIACTNPVAYAHYGEACSCENLSQAVGGDD

SEQ ID NO: 193120 - protein, 38 aa, Artificial Sequence
  Description of Artificial Sequence: Synthetic polypeptide
DEEEIRTTNPVATEQYGSVILPWPNSEGIEATDSIDIQ

SEQ ID NO: 193121 - protein, 38 aa, Artificial Sequence
  Description of Artificial Sequence: Synthetic polypeptide
DEEEISTTNPVATEQYGQCVCGNWGEHNAEGFNSDTQA

SEQ ID NO: 193122 - protein, 37 aa, Artificial Sequence
  Description of Artificial Sequence: Synthetic polypeptide
DEEEISTTNPVATEQYGQCVCGNWGEHNAENSNSDQS

SEQ ID NO: 193123 - protein, 38 aa, Artificial Sequence
  Description of Artificial Sequence: Synthetic polypeptide
DEEEISTTNPVATEQYGQCVCGNWGEHNQENFGSDTQS

SEQ ID NO: 193124 - protein, 35 aa, Artificial Sequence
  Description of Artificial Sequence: Synthetic polypeptide
DETEIRTTNPVATECWGATTWANAEDWQEPKGPYI

SEQ ID NO: 193125 - protein, 36 aa, Artificial Sequence
  Description of Artificial Sequence: Synthetic polypeptide
SESEEIATTNPVAYEQWGSCATGGLNDERNMDRGEE

SEQ ID NO: 193126 - protein, 36 aa, Artificial Sequence
  Description of Artificial Sequence: Synthetic polypeptide
SESDEIATTNPVAYEQWGSVCLQNNDVNEMRGQNNS

SEQ ID NO: 193127 - protein, 35 aa, Artificial Sequence
  Description of Artificial Sequence: Synthetic polypeptide
DCMEICTTNPMATETYGCVPCTPDPQHASGENFMG

SEQ ID NO: 193128 - protein, 33 aa, Artificial Sequence
  Description of Artificial Sequence: Synthetic polypeptide
SESAIACTNPVAYEGYGQACSCENLSQAVGGDD

SEQ ID NO: 193129 - protein, 36 aa, Artificial Sequence
  Description of Artificial Sequence: Synthetic polypeptide
DEAEIRTTNPVSTEGYGCICSWEEDNQENFGSDNQS

SEQ ID NO: 193130 - protein, 36 aa, Artificial Sequence
  Description of Artificial Sequence: Synthetic polypeptide
DEAEIRTTNPVSTEGYGCICSWEEHNQEYFGSDNQA

SEQ ID NO: 193131 - protein, 36 aa, Artificial Sequence
  Description of Artificial Sequence: Synthetic polypeptide
DEAEIRTTNPVSTEGYGCICSWEEINAENFGSDNQA

SEQ ID NO: 193132 - protein, 38 aa, Artificial Sequence
  Description of Artificial Sequence: Synthetic polypeptide
DEMEIATTNPVATEQYGQCVCSTWGEHNAEHFQSETQA

SEQ ID NO: 193133 - protein, 38 aa, Artificial Sequence
  Description of Artificial Sequence: Synthetic polypeptide
DEEEISTTNPVATEQYGQCVCGNWGEHNQENFPSDNQS

SEQ ID NO: 193134 - protein, 35 aa, Artificial Sequence
  Description of Artificial Sequence: Synthetic polypeptide
DETEIRTTNPVATECWGATTWANAEDWAERKGPYI

SEQ ID NO: 193135 - protein, 39 aa, Artificial Sequence
  Description of Artificial Sequence: Synthetic polypeptide
DEEEIRTTNPVAYEQYGQCVCSNTGEEHNQENFNSDNQG

SEQ ID NO: 193136 - protein, 39 aa, Artificial Sequence
  Description of Artificial Sequence: Synthetic polypeptide
DEEEIRTTNPVAFEFYGVVNVANGQENDNGQRGQQRGDQ

SEQ ID NO: 193137 - protein, 35 aa, Artificial Sequence
  Description of Artificial Sequence: Synthetic polypeptide
DETEIRTTNPVATECWGATTWANAEDLAEPKGPYI

SEQ ID NO: 193138 - protein, 39 aa, Artificial Sequence
  Description of Artificial Sequence: Synthetic polypeptide
DEEEISTTNPVATEQYGQCAVCSMWGEHNTEGFGSDNQS

SEQ ID NO: 193139 - protein, 33 aa, Artificial Sequence
  Description of Artificial Sequence: Synthetic polypeptide
DETEIRTTNPVATECWGATANAEIEMEPKGDYI

SEQ ID NO: 193140 - protein, 39 aa, Artificial Sequence
  Description of Artificial Sequence: Synthetic polypeptide
DEAEIRTTNPVATEQYGVGVTWSPVNWLENPNTWSEVGN

SEQ ID NO: 193141 - protein, 37 aa, Artificial Sequence
  Description of Artificial Sequence: Synthetic polypeptide
DEACIRTTNPVATEQYGCVCENWEEPNQEYFGSDTQS

SEQ ID NO: 193142 - protein, 37 aa, Artificial Sequence
  Description of Artificial Sequence: Synthetic polypeptide
VEDEIATTNPVAYEQYGSVANPNQGLDNLNNADGMRA

SEQ ID NO: 193143 - protein, 35 aa, Artificial Sequence
  Description of Artificial Sequence: Synthetic polypeptide
CEAEIATVNPVATAQWGGCVAGNGLQSRANMQGEN

SEQ ID NO: 193144 - protein, 33 aa, Artificial Sequence
  Description of Artificial Sequence: Synthetic polypeptide
DETEIRTTNPVATECWGATAWAAEDWAEPKGPI

SEQ ID NO: 193145 - protein, 38 aa, Artificial Sequence
  Description of Artificial Sequence: Synthetic polypeptide
DAAEIATTNPVATEQYGSVCAMNNGVEPAGTVGDNMRH

SEQ ID NO: 193146 - protein, 35 aa, Artificial Sequence
  Description of Artificial Sequence: Synthetic polypeptide
DETEIRTTNPVATECWGATSANTEDWPAEPKGPYV

SEQ ID NO: 193147 - protein, 33 aa, Artificial Sequence
  Description of Artificial Sequence: Synthetic polypeptide
DETEIRTTNPVATECWGATTAEEDWAEPKGPYI

SEQ ID NO: 193148 - protein, 34 aa, Artificial Sequence
  Description of Artificial Sequence: Synthetic polypeptide
DETEIRTTNPVATECWGATTANAEDEAEPKGPYI

SEQ ID NO: 193149 - protein, 34 aa, Artificial Sequence
  Description of Artificial Sequence: Synthetic polypeptide
DETEIRTTNPVATECWGATTANAEDWAEHKGPYI

SEQ ID NO: 193150 - protein, 39 aa, Artificial Sequence
  Description of Artificial Sequence: Synthetic polypeptide
DEEEISTTNPVATEQYGQCQVCSNWGEDNTENFNSENQF

SEQ ID NO: 193151 - protein, 39 aa, Artificial Sequence
  Description of Artificial Sequence: Synthetic polypeptide
DEEEISTTNPVATEQYGQCQVCSTTGEHNQENFGSDTQS

SEQ ID NO: 193152 - protein, 40 aa, Artificial Sequence
  Description of Artificial Sequence: Synthetic polypeptide
DEEEISTTNPVATEQYGQCQVCSTWGEDHNQENFGSDNQS

SEQ ID NO: 193153 - protein, 38 aa, Artificial Sequence
  Description of Artificial Sequence: Synthetic polypeptide
DEEEISTTNPVATEQYGQCQVCSWGEHNAENFNSDNQS

SEQ ID NO: 193154 - protein, 38 aa, Artificial Sequence
  Description of Artificial Sequence: Synthetic polypeptide
DEEEISTTNPVATEQYGQCSCSNWNEDNAENFNSDTQA

SEQ ID NO: 193155 - protein, 32 aa, Artificial Sequence
  Description of Artificial Sequence: Synthetic polypeptide
SESEIASTNPVGTEGYGVSCASEDQHFGSDIS

SEQ ID NO: 193156 - protein, 35 aa, Artificial Sequence
  Description of Artificial Sequence: Synthetic polypeptide
DETEIRTTNPVATECWGATTWANAEDLADHKGPDI

SEQ ID NO: 193157 - protein, 35 aa, Artificial Sequence
  Description of Artificial Sequence: Synthetic polypeptide
DETEIRTTNPVATECWGATTWANAECLAEPKGPYI

SEQ ID NO: 193158 - protein, 37 aa, Artificial Sequence
  Description of Artificial Sequence: Synthetic polypeptide
DAAEIATTNPVATEQYGSVCAMNNGGTEANGDVNNVA

SEQ ID NO: 193159 - protein, 36 aa, Artificial Sequence
  Description of Artificial Sequence: Synthetic polypeptide
SESEIGTTNPVATEQYGAVCSAWDGPVEWFEGNNQE

SEQ ID NO: 193160 - protein, 38 aa, Artificial Sequence
  Description of Artificial Sequence: Synthetic polypeptide
DEEEISTTNPVATEQYGQCVCGNSGEDNQENFNSETQA

SEQ ID NO: 193161 - protein, 37 aa, Artificial Sequence
  Description of Artificial Sequence: Synthetic polypeptide
DEEEISTTNPVATEQYGQCVCGNWMEHNANFNSETQP

SEQ ID NO: 193162 - protein, 39 aa, Artificial Sequence
  Description of Artificial Sequence: Synthetic polypeptide
DEEEISTTNPVATEQYGQCVCGNSGEDHNAENFGSDNQA

SEQ ID NO: 193163 - protein, 38 aa, Artificial Sequence
  Description of Artificial Sequence: Synthetic polypeptide
DEEEIRTTNPVAFEQYGDVTVTGGQTDDGDQQDGGGGG

SEQ ID NO: 193164 - protein, 37 aa, Artificial Sequence
  Description of Artificial Sequence: Synthetic polypeptide
DEDEIATTNPVAYEQYGSVCSLANPALGEHMIDLTAM

SEQ ID NO: 193165 - protein, 34 aa, Artificial Sequence
  Description of Artificial Sequence: Synthetic polypeptide
DETEIRTTNPVATECWGATTSNAEDEAEPKGPYI

SEQ ID NO: 193166 - protein, 34 aa, Artificial Sequence
  Description of Artificial Sequence: Synthetic polypeptide
DETEIRTTNPVATECWGATTANEEDWAEPKGPYI

SEQ ID NO: 193167 - protein, 38 aa, Artificial Sequence
  Description of Artificial Sequence: Synthetic polypeptide
DEEEISTTNPVATEQYGQCTCSMWEEDNQEYIGSQNQS

SEQ ID NO: 193168 - protein, 33 aa, Artificial Sequence
  Description of Artificial Sequence: Synthetic polypeptide
DETEIRTTNPVATECWGATTANAEIWMEPAEPI

SEQ ID NO: 193169 - protein, 38 aa, Artificial Sequence
  Description of Artificial Sequence: Synthetic polypeptide
DEEEISTTNPVATEQYGQCVCGMWGEHNEEFFGSDNQA

SEQ ID NO: 193170 - protein, 33 aa, Artificial Sequence
  Description of Artificial Sequence: Synthetic polypeptide
DETEIRTTNPVATECWGATANAEIEMEPAGDYI

SEQ ID NO: 193171 - protein, 35 aa, Artificial Sequence
  Description of Artificial Sequence: Synthetic polypeptide
DETEIRTTNPVATECWGATTWANAINEPAERKGPI

SEQ ID NO: 193172 - protein, 35 aa, Artificial Sequence
  Description of Artificial Sequence: Synthetic polypeptide
DEHEIRTTNPVAYESWGCVCSGLPGEDERNMNGAD

SEQ ID NO: 193173 - protein, 37 aa, Artificial Sequence
  Description of Artificial Sequence: Synthetic polypeptide
DAAEIATTNPVATEQYGSVCAANMGEEAPDDQANGAD

SEQ ID NO: 193174 - protein, 36 aa, Artificial Sequence
  Description of Artificial Sequence: Synthetic polypeptide
SEQEIATTNPVATEQWGKVSAVGDLEADTPGGEDNG

SEQ ID NO: 193175 - protein, 35 aa, Artificial Sequence
  Description of Artificial Sequence: Synthetic polypeptide
SEQEIATTNPVATEQWGCVAGEGAHGTNPANENGE

SEQ ID NO: 193176 - protein, 33 aa, Artificial Sequence
  Description of Artificial Sequence: Synthetic polypeptide
DETEIRTTNPVATECWGATWSNAEDWAEAKEPA

SEQ ID NO: 193177 - protein, 34 aa, Artificial Sequence
  Description of Artificial Sequence: Synthetic polypeptide
DETEIRTTNPVATECWGDTTWSNEIEMNPAGPYA

SEQ ID NO: 193178 - protein, 37 aa, Artificial Sequence
  Description of Artificial Sequence: Synthetic polypeptide
DEMEIATTNPVATEQYGQCVCSNWELNEEHFGSEDQA

SEQ ID NO: 193179 - protein, 38 aa, Artificial Sequence
  Description of Artificial Sequence: Synthetic polypeptide
VEDEIATTNPVAYEQYGSVCSAANNPAQAAHGGDNEAM

SEQ ID NO: 193180 - protein, 38 aa, Artificial Sequence
  Description of Artificial Sequence: Synthetic polypeptide
DEEEISTTNPVATEQYGQCVCSDWEEDNQENFNSDTQP

SEQ ID NO: 193181 - protein, 38 aa, Artificial Sequence
  Description of Artificial Sequence: Synthetic polypeptide
DEEEISTTNPVATEQYGQCVCSDWEEHNAENFNSDTQS

SEQ ID NO: 193182 - protein, 35 aa, Artificial Sequence
  Description of Artificial Sequence: Synthetic polypeptide
DETEIRTTNPVATECWGSTTWANAEDWAEPEGPYI

SEQ ID NO: 193183 - protein, 34 aa, Artificial Sequence
  Description of Artificial Sequence: Synthetic polypeptide
DEAEIRTTNPVSTEPWGCIAPNDQQQQQQENTHQ

SEQ ID NO: 193184 - protein, 35 aa, Artificial Sequence
  Description of Artificial Sequence: Synthetic polypeptide
DETEIRTTNPVATECWGSTTWANAEDWAEPKGPYI

SEQ ID NO: 193185 - protein, 38 aa, Artificial Sequence
  Description of Artificial Sequence: Synthetic polypeptide
SEPEIRTTNPVATEQYGASAVVAWPVNELEEGQEDQEY

SEQ ID NO: 193186 - protein, 37 aa, Artificial Sequence
  Description of Artificial Sequence: Synthetic polypeptide
VEDEIATTNPVAYEQYGSVCSANPALPNAHGEDLTAM

SEQ ID NO: 193187 - protein, 38 aa, Artificial Sequence
  Description of Artificial Sequence: Synthetic polypeptide
DEEEIRTTNPVATEQYGCGVVLGIADMTMEEPEQELTP

SEQ ID NO: 193188 - protein, 35 aa, Artificial Sequence
  Description of Artificial Sequence: Synthetic polypeptide
DETEIRTTNPVATECWGSTTWANAEDWAMPKGPYI

SEQ ID NO: 193189 - protein, 38 aa, Artificial Sequence
  Description of Artificial Sequence: Synthetic polypeptide
DEEEISTTNPVATEQYGQCVCSDWGEDHNAENSNSEQA

SEQ ID NO: 193190 - protein, 35 aa, Artificial Sequence
  Description of Artificial Sequence: Synthetic polypeptide
DETEIRTTNPVATECWGSTTWANAPDWAEPKGPYV

SEQ ID NO: 193191 - protein, 36 aa, Artificial Sequence
  Description of Artificial Sequence: Synthetic polypeptide
SEPEIATTNPVATEQYGGVFMANQVEVLINGQSTDT

SEQ ID NO: 193192 - protein, 34 aa, Artificial Sequence
  Description of Artificial Sequence: Synthetic polypeptide
DEAEIRTTNPVSTEPWGCIAPTDQQQQQQHNEHY

SEQ ID NO: 193193 - protein, 37 aa, Artificial Sequence
  Description of Artificial Sequence: Synthetic polypeptide
DEMEIATTNPVATEQYGQCVCSNWEHNEEHFISENQS

SEQ ID NO: 193194 - protein, 36 aa, Artificial Sequence
  Description of Artificial Sequence: Synthetic polypeptide
SENNEIATTNPVAYERWGSVSGGNADDSRNNGNGNM

SEQ ID NO: 193195 - protein, 35 aa, Artificial Sequence
  Description of Artificial Sequence: Synthetic polypeptide
DEAEIRTTNPVSYEPWGKISCKEDSQSDQMNGGNT

SEQ ID NO: 193196 - protein, 35 aa, Artificial Sequence
  Description of Artificial Sequence: Synthetic polypeptide
DEAEIRTTNPVSYEPWGKISCMEDISQQQNGGNFR

SEQ ID NO: 193197 - protein, 35 aa, Artificial Sequence
  Description of Artificial Sequence: Synthetic polypeptide
VEDEIATTNPVAYEQYGSVCSMPGSNAMAPTPKVH

SEQ ID NO: 193198 - protein, 36 aa, Artificial Sequence
  Description of Artificial Sequence: Synthetic polypeptide
DEAEIRTTNSVAYCQYGCVCSNWEHNAENFGSDNQA

SEQ ID NO: 193199 - protein, 38 aa, Artificial Sequence
  Description of Artificial Sequence: Synthetic polypeptide
DEEEISTTNPVATEQYGQCVCSDWGEHNAEHFNSENQA

SEQ ID NO: 193200 - protein, 38 aa, Artificial Sequence
  Description of Artificial Sequence: Synthetic polypeptide
DEEEISTTNPVATEQYGQCVCSDWGEHNAENFNSQNQA

SEQ ID NO: 193201 - protein, 38 aa, Artificial Sequence
  Description of Artificial Sequence: Synthetic polypeptide
DEEEISTTNPVATEQYGQCVCSDWGEHNEENFGSDTQS

SEQ ID NO: 193202 - protein, 37 aa, Artificial Sequence
  Description of Artificial Sequence: Synthetic polypeptide
VEDEIATTNPVAYEQYGSVCSVDHQGPADHQDGNEMW

SEQ ID NO: 193203 - protein, 35 aa, Artificial Sequence
  Description of Artificial Sequence: Synthetic polypeptide
DETEIRTTNPVATECWGSTTWANAEDWNMPKGPYI

SEQ ID NO: 193204 - protein, 34 aa, Artificial Sequence
  Description of Artificial Sequence: Synthetic polypeptide
DETEIRTTNPVATECWGATWANTEDWAEPKGPYV

SEQ ID NO: 193205 - protein, 36 aa, Artificial Sequence
  Description of Artificial Sequence: Synthetic polypeptide
DCNEIRTTNPVATEQYGCVDTDIENGSDETEESQVE

SEQ ID NO: 193206 - protein, 34 aa, Artificial Sequence
  Description of Artificial Sequence: Synthetic polypeptide
DETEIRTTNPVATECWGATWANAEDWAEPKGPYV

SEQ ID NO: 193207 - protein, 38 aa, Artificial Sequence
  Description of Artificial Sequence: Synthetic polypeptide
DEEEIRTTNPVATEAYGVVDNGFLGEEGDQEEDEFNEN

SEQ ID NO: 193208 - protein, 37 aa, Artificial Sequence
  Description of Artificial Sequence: Synthetic polypeptide
DEEEISTTNPVATEQYGQCVCGSGEHNAENFISETQS

SEQ ID NO: 193209 - protein, 34 aa, Artificial Sequence
  Description of Artificial Sequence: Synthetic polypeptide
DETEIRTTNPVATECWGATTWSNAEDWAEPGPYI

SEQ ID NO: 193210 - protein, 38 aa, Artificial Sequence
  Description of Artificial Sequence: Synthetic polypeptide
DEEEISTTNPVATEQYGQCVCGTWEEHNAENFNSDNQM

SEQ ID NO: 193211 - protein, 38 aa, Artificial Sequence
  Description of Artificial Sequence: Synthetic polypeptide
SEQEIRTTNPVATEQYGSQWTSAVSAINPNIDESTQYR

SEQ ID NO: 193212 - protein, 38 aa, Artificial Sequence
  Description of Artificial Sequence: Synthetic polypeptide
DEEEISTTNPVATEQYGQCVCGWGEDHNAENFGSENQA

SEQ ID NO: 193213 - protein, 37 aa, Artificial Sequence
  Description of Artificial Sequence: Synthetic polypeptide
DEEEISTTNPVATEQYGQCVCGWGEDHNQEYFNSEQP

SEQ ID NO: 193214 - protein, 37 aa, Artificial Sequence
  Description of Artificial Sequence: Synthetic polypeptide
DEEEISTTNPVATEQYGQCVCGWGEHNAENFNSDFQA

SEQ ID NO: 193215 - protein, 37 aa, Artificial Sequence
  Description of Artificial Sequence: Synthetic polypeptide
DEEEISTTNPVATEQYGQCVCGWGEHNIENFNSETQP

SEQ ID NO: 193216 - protein, 37 aa, Artificial Sequence
  Description of Artificial Sequence: Synthetic polypeptide
DEEEISTTNPVATEQYGQCVCGWGEHNQENFGSDFQS

SEQ ID NO: 193217 - protein, 37 aa, Artificial Sequence
  Description of Artificial Sequence: Synthetic polypeptide
DEEEISTTNPVATEQYGQCVCGWGEHNQENFGSDTQS

SEQ ID NO: 193218 - protein, 34 aa, Artificial Sequence
  Description of Artificial Sequence: Synthetic polypeptide
DETEIRTTNPVATECWGATTWSNAIEMNPAGPYA

SEQ ID NO: 193219 - protein, 34 aa, Artificial Sequence
  Description of Artificial Sequence: Synthetic polypeptide
DETEIRTTNPVATECWGATTWSNEIEMNPAGPYA

SEQ ID NO: 193220 - protein, 35 aa, Artificial Sequence
  Description of Artificial Sequence: Synthetic polypeptide
DETEIRTTNPVATECWGATTWSNTEDWEEHKGPYI

SEQ ID NO: 193221 - protein, 37 aa, Artificial Sequence
  Description of Artificial Sequence: Synthetic polypeptide
DEEEISTTNPVATEQYGQCVCPWEEHEAENFGSDNQN

SEQ ID NO: 193222 - protein, 37 aa, Artificial Sequence
  Description of Artificial Sequence: Synthetic polypeptide
DAAEIATTNPVATEQYGSVCAMNNGEPNATPGDETNH

SEQ ID NO: 193223 - protein, 36 aa, Artificial Sequence
  Description of Artificial Sequence: Synthetic polypeptide
DETEIRTTNPVATECWGATVSANAEDWAEPKGMPPI

SEQ ID NO: 193224 - protein, 34 aa, Artificial Sequence
  Description of Artificial Sequence: Synthetic polypeptide
DETEIRTTNPVATECWGATWANAEDWAEPKGPYI

SEQ ID NO: 193225 - protein, 37 aa, Artificial Sequence
  Description of Artificial Sequence: Synthetic polypeptide
VEDEIATTNPVAYEQYGSVCAMNNGQNPTASGGNQVH

SEQ ID NO: 193226 - protein, 33 aa, Artificial Sequence
  Description of Artificial Sequence: Synthetic polypeptide
DETEIRTTNPVATECWGATWAAADWAEPKGPDI

SEQ ID NO: 193227 - protein, 38 aa, Artificial Sequence
  Description of Artificial Sequence: Synthetic polypeptide
DEEEISTTNPVATEQYGQCVCQWGEDTNQENFNSDNQL

SEQ ID NO: 193228 - protein, 39 aa, Artificial Sequence
  Description of Artificial Sequence: Synthetic polypeptide
DEEEIRTTNPVATEAYGVVSTDIGTTEQGSTNDEQNEED

SEQ ID NO: 193229 - protein, 38 aa, Artificial Sequence
  Description of Artificial Sequence: Synthetic polypeptide
DEEEISTTNPVATEQYGQCVCQNWMEHNQENFNSENQP

SEQ ID NO: 193230 - protein, 38 aa, Artificial Sequence
  Description of Artificial Sequence: Synthetic polypeptide
DEMEIATTNPVATEQYGQCVCSTTGEHNEEHFGSETLA

SEQ ID NO: 193231 - protein, 38 aa, Artificial Sequence
  Description of Artificial Sequence: Synthetic polypeptide
DEAEIRTTNPVATEQYGTSAPTLAYLNVPTQIEVQIHD

SEQ ID NO: 193232 - protein, 37 aa, Artificial Sequence
  Description of Artificial Sequence: Synthetic polypeptide
DETEIRTTNPVATECWGATVSANTEAGPAERNGMPPI

SEQ ID NO: 193233 - protein, 38 aa, Artificial Sequence
  Description of Artificial Sequence: Synthetic polypeptide
DEEEISTTNPVATEQYGQCVCQNWGEDNQENFNSDTQP

SEQ ID NO: 193234 - protein, 36 aa, Artificial Sequence
  Description of Artificial Sequence: Synthetic polypeptide
CEAEIRATNPVATDQYGVVTMQDGDNGQRFNDNGQG

SEQ ID NO: 193235 - protein, 36 aa, Artificial Sequence
  Description of Artificial Sequence: Synthetic polypeptide
DETEIRTTNPVATECWGATVSANAEDWAEPNGMPPI

SEQ ID NO: 193236 - protein, 36 aa, Artificial Sequence
  Description of Artificial Sequence: Synthetic polypeptide
DETEIRTTNPVATECWGATVSANAEDWAEPKGMPYI

SEQ ID NO: 193237 - protein, 37 aa, Artificial Sequence
  Description of Artificial Sequence: Synthetic polypeptide
DEEEISTTNPVATEQYGQCVCPWGEHNQENFGSDTQS

SEQ ID NO: 193238 - protein, 38 aa, Artificial Sequence
  Description of Artificial Sequence: Synthetic polypeptide
DEEEISTTNPVATEQYGQCVCQNWGEHNQENFLSENQP

SEQ ID NO: 193239 - protein, 35 aa, Artificial Sequence
  Description of Artificial Sequence: Synthetic polypeptide
DETEIRTTNPVATECYGATTWANAEDWAEPKGEYI

SEQ ID NO: 193240 - protein, 33 aa, Artificial Sequence
  Description of Artificial Sequence: Synthetic polypeptide
DETEIRTTNPVATECWGATANAEIEAEPKGDYI

SEQ ID NO: 193241 - protein, 39 aa, Artificial Sequence
  Description of Artificial Sequence: Synthetic polypeptide
DEEEISTTNPVATEQYGICVTSTWGADDNAEYFNSDNQS

SEQ ID NO: 193242 - protein, 35 aa, Artificial Sequence
  Description of Artificial Sequence: Synthetic polypeptide
DETEIRTTNPIATEQWGATTWANAEDWAEPKGNYV

SEQ ID NO: 193243 - protein, 35 aa, Artificial Sequence
  Description of Artificial Sequence: Synthetic polypeptide
DETEIRTTNPIATEQWGATTWANAEDWQEPKGGYI

SEQ ID NO: 193244 - protein, 35 aa, Artificial Sequence
  Description of Artificial Sequence: Synthetic polypeptide
DETEIRTTNPIATEQWGATTWANAEDWQEPKGPYI

SEQ ID NO: 193245 - protein, 35 aa, Artificial Sequence
  Description of Artificial Sequence: Synthetic polypeptide
DETEIRTTNPIATEQWGATTWANAEDWQEPKGTYI

SEQ ID NO: 193246 - protein, 35 aa, Artificial Sequence
  Description of Artificial Sequence: Synthetic polypeptide
DETEIRTTNPIATEQWGATTWANTEDWAEPKGNYI

SEQ ID NO: 193247 - protein, 36 aa, Artificial Sequence
  Description of Artificial Sequence: Synthetic polypeptide
DETEIRTTNPIATEQWGATTWATTPDWPNEPKGNPI

SEQ ID NO: 193248 - protein, 34 aa, Artificial Sequence
  Description of Artificial Sequence: Synthetic polypeptide
DETEIRTTNPIATEQWGATTWPNAEVWAEHGEYI

SEQ ID NO: 193249 - protein, 34 aa, Artificial Sequence
  Description of Artificial Sequence: Synthetic polypeptide
DETEIRTTNPIATEQWGATVANAEDWAEPKGTYI

SEQ ID NO: 193250 - protein, 35 aa, Artificial Sequence
  Description of Artificial Sequence: Synthetic polypeptide
DETEIRTTNPIATEQWGATVCANADDWAEPKGPYI

SEQ ID NO: 193251 - protein, 35 aa, Artificial Sequence
  Description of Artificial Sequence: Synthetic polypeptide
DETEIRTTNPIATEQWGATVCANAEDWAEPKGPYI

SEQ ID NO: 193252 - protein, 34 aa, Artificial Sequence
  Description of Artificial Sequence: Synthetic polypeptide
DETEIRTTNPIATEQWGATWANAEDWAEPKGPDL

SEQ ID NO: 193253 - protein, 34 aa, Artificial Sequence
  Description of Artificial Sequence: Synthetic polypeptide
DETEIRTTNPIATEQWGATWSNAEDWAEPKGDYA

SEQ ID NO: 193254 - protein, 36 aa, Artificial Sequence
  Description of Artificial Sequence: Synthetic polypeptide
CEEEIATTNPVAYEPYRGQSVAINNEGSTSMPGAPR

SEQ ID NO: 193255 - protein, 35 aa, Artificial Sequence
  Description of Artificial Sequence: Synthetic polypeptide
DETEIRTTNPIATEQWGAVCANADDWVAEPEGPYI

SEQ ID NO: 193256 - protein, 35 aa, Artificial Sequence
  Description of Artificial Sequence: Synthetic polypeptide
DETEIRTTNPIATEQWGATTWANAEDWAEPKGNYI

SEQ ID NO: 193257 - protein, 37 aa, Artificial Sequence
  Description of Artificial Sequence: Synthetic polypeptide
SEYEIRCTNPVATEQYGQCVCETGEHNQEHFGSDNQS

SEQ ID NO: 193258 - protein, 38 aa, Artificial Sequence
  Description of Artificial Sequence: Synthetic polypeptide
DEEEIRTTNPVATEAYGCSCSNWGEPHNQENFNSDTQA

SEQ ID NO: 193259 - protein, 33 aa, Artificial Sequence
  Description of Artificial Sequence: Synthetic polypeptide
DETEIRTTNPIATEQWGDTTWSEIWMEAAEPYI

SEQ ID NO: 193260 - protein, 33 aa, Artificial Sequence
  Description of Artificial Sequence: Synthetic polypeptide
DETEIRTTNPIATEQWGETANAEDWAEHKGEYI

SEQ ID NO: 193261 - protein, 33 aa, Artificial Sequence
  Description of Artificial Sequence: Synthetic polypeptide
DETEIRTTNPIATEQWGETANAEDWAEPKGEYI

SEQ ID NO: 193262 - protein, 38 aa, Artificial Sequence
  Description of Artificial Sequence: Synthetic polypeptide
DEMEIRTTNPVATEQYGSVQYMWTPNNEVSDIAVQAEP

SEQ ID NO: 193263 - protein, 34 aa, Artificial Sequence
  Description of Artificial Sequence: Synthetic polypeptide
DETEIRTTNPIATEQWGETAWANEEDWAEPKGGI

SEQ ID NO: 193264 - protein, 37 aa, Artificial Sequence
  Description of Artificial Sequence: Synthetic polypeptide
DAAEIATTNPVAYEQWGSVCSPPTEGGNNAVGNDNHH

SEQ ID NO: 193265 - protein, 34 aa, Artificial Sequence
  Description of Artificial Sequence: Synthetic polypeptide
DETEIRTTNPIATEQWGETTANAEDWAEPKGEYI

SEQ ID NO: 193266 - protein, 34 aa, Artificial Sequence
  Description of Artificial Sequence: Synthetic polypeptide
DETEIRTTNPIATEQWGETTANAEDWAEPKGPYI

SEQ ID NO: 193267 - protein, 36 aa, Artificial Sequence
  Description of Artificial Sequence: Synthetic polypeptide
SEYEIRCTNPVATEQYGCVCETWGEHNQEHFNSDQA

SEQ ID NO: 193268 - protein, 36 aa, Artificial Sequence
  Description of Artificial Sequence: Synthetic polypeptide
DETEIRTTNPIATEQWGSTTWANAEDWPAMRKGPPV

SEQ ID NO: 193269 - protein, 39 aa, Artificial Sequence
  Description of Artificial Sequence: Synthetic polypeptide
DEEEIRTTNPVATEAYGVVATQIGTTEQGSTNDEQGQTD

SEQ ID NO: 193270 - protein, 35 aa, Artificial Sequence
  Description of Artificial Sequence: Synthetic polypeptide
DETEIRTTNPIATEQYGATTCSNADGWAEPKGPYI

SEQ ID NO: 193271 - protein, 36 aa, Artificial Sequence
  Description of Artificial Sequence: Synthetic polypeptide
SEYEIRCTNPVATEQYGCVCENWGEHNQHFGSETQA

SEQ ID NO: 193272 - protein, 35 aa, Artificial Sequence
  Description of Artificial Sequence: Synthetic polypeptide
DETEIRTTNPIATEQWGAVCANADDWVAEPKGPYI

SEQ ID NO: 193273 - protein, 35 aa, Artificial Sequence
  Description of Artificial Sequence: Synthetic polypeptide
DETEIRTTNPIATEQWGATTWANAEDWAEPEGNYI

SEQ ID NO: 193274 - protein, 35 aa, Artificial Sequence
  Description of Artificial Sequence: Synthetic polypeptide
SEYEISCTNPVATEQYGCVCEWGEHNQEHFGSNQS

SEQ ID NO: 193275 - protein, 35 aa, Artificial Sequence
  Description of Artificial Sequence: Synthetic polypeptide
DETEIRTTNPIATEQWGATTWANAEDGAEPKGNYV

SEQ ID NO: 193276 - protein, 36 aa, Artificial Sequence
  Description of Artificial Sequence: Synthetic polypeptide
DETEIRTTNPIATECYGTTTWANAEDIQQQPKGNYH

SEQ ID NO: 193277 - protein, 34 aa, Artificial Sequence
  Description of Artificial Sequence: Synthetic polypeptide
SQEEIRTTNPVATEHWGTYSSWNNETEVPINMKT

SEQ ID NO: 193278 - protein, 36 aa, Artificial Sequence
  Description of Artificial Sequence: Synthetic polypeptide
DETEIRTTNPIATECYGTTTWANAEDIQQQQKGNYH

SEQ ID NO: 193279 - protein, 34 aa, Artificial Sequence
  Description of Artificial Sequence: Synthetic polypeptide
SQEEIRTTNPVATEHWGTIYSSWNETEFPINVKT

SEQ ID NO: 193280 - protein, 35 aa, Artificial Sequence
  Description of Artificial Sequence: Synthetic polypeptide
DETEIRTTNPIATEEWGCQTTQNAEDHAENSGQNI

SEQ ID NO: 193281 - protein, 33 aa, Artificial Sequence
  Description of Artificial Sequence: Synthetic polypeptide
DETEIRTTNPIATEGWGATTAAATWQEPKGPYI

SEQ ID NO: 193282 - protein, 34 aa, Artificial Sequence
  Description of Artificial Sequence: Synthetic polypeptide
DETEIRTTNPIATEGWGATTWANAETLAEPGPYI

SEQ ID NO: 193283 - protein, 33 aa, Artificial Sequence
  Description of Artificial Sequence: Synthetic polypeptide
DDTEIATTNPVATEGWGATANNEDWQSPKGPYI

SEQ ID NO: 193284 - protein, 34 aa, Artificial Sequence
  Description of Artificial Sequence: Synthetic polypeptide
DETEIRTTNPIATEMWGATTANAEDWAEPKGPRI

SEQ ID NO: 193285 - protein, 33 aa, Artificial Sequence
  Description of Artificial Sequence: Synthetic polypeptide
DETEIRTTNPIATEPWGATIAAEDWAEQKGPYI

SEQ ID NO: 193286 - protein, 34 aa, Artificial Sequence
  Description of Artificial Sequence: Synthetic polypeptide
DETEIRTTNPIATEPWGATIANAEDWAEQKGPYI

SEQ ID NO: 193287 - protein, 34 aa, Artificial Sequence
  Description of Artificial Sequence: Synthetic polypeptide
DETEIRTTNPIATEPWGATTWAMEDWAEQKGNYI

SEQ ID NO: 193288 - protein, 34 aa, Artificial Sequence
  Description of Artificial Sequence: Synthetic polypeptide
DETEIRTTNPIATEPWGATTWAMEDWAQQKGNYI

SEQ ID NO: 193289 - protein, 37 aa, Artificial Sequence
  Description of Artificial Sequence: Synthetic polypeptide
SNEEIRTTNPVATEQYGSVWPAQDSMVEGIIETMNSH

SEQ ID NO: 193290 - protein, 36 aa, Artificial Sequence
  Description of Artificial Sequence: Synthetic polypeptide
SNEEIRTTNPVATEQYGSVCFPDVSLEDDITDFHDF

SEQ ID NO: 193291 - protein, 36 aa, Artificial Sequence
  Description of Artificial Sequence: Synthetic polypeptide
SNEEIRTTNPVATEQWGVCSELFPVTEQNEGGQNPC

SEQ ID NO: 193292 - protein, 38 aa, Artificial Sequence
  Description of Artificial Sequence: Synthetic polypeptide
DCEEIRTTNPVATEQWGYAVTQAVALEQVAIVGQTHRG

SEQ ID NO: 193293 - protein, 34 aa, Artificial Sequence
  Description of Artificial Sequence: Synthetic polypeptide
DETEIRTTNPIATEQWGATTWANADWAEPKGPYI

SEQ ID NO: 193294 - protein, 34 aa, Artificial Sequence
  Description of Artificial Sequence: Synthetic polypeptide
DETEIRTTNPIATEQWGATTWANADWAEPKGDYI

SEQ ID NO: 193295 - protein, 37 aa, Artificial Sequence
  Description of Artificial Sequence: Synthetic polypeptide
VEDEIATTNPVAYEQYGSTVCAANDGVQDTPDGNMGN

SEQ ID NO: 193296 - protein, 35 aa, Artificial Sequence
  Description of Artificial Sequence: Synthetic polypeptide
VEDEIATTNPVAYEQYGSCSAGPPGANGALMGAED

SEQ ID NO: 193297 - protein, 38 aa, Artificial Sequence
  Description of Artificial Sequence: Synthetic polypeptide
DEAEIATTNPVATEQYGSVCAMNNGVLPEPDPLENANQ

SEQ ID NO: 193298 - protein, 36 aa, Artificial Sequence
  Description of Artificial Sequence: Synthetic polypeptide
DETEIRTTNPIATEQWGATTSANAPDGPNMPNGPYV

SEQ ID NO: 193299 - protein, 39 aa, Artificial Sequence
  Description of Artificial Sequence: Synthetic polypeptide
DEDCIRTTNPVATEQWGSQVYATTGNMESDYNTEGNNRN

SEQ ID NO: 193300 - protein, 35 aa, Artificial Sequence
  Description of Artificial Sequence: Synthetic polypeptide
SMGEIRSTNPVATEQYGCIVFNCPEHTVESQDENV

SEQ ID NO: 193301 - protein, 36 aa, Artificial Sequence
  Description of Artificial Sequence: Synthetic polypeptide
DETEIRTTNPIATEQWGATTSANAPDGPAMPNGPYV

SEQ ID NO: 193302 - protein, 37 aa, Artificial Sequence
  Description of Artificial Sequence: Synthetic polypeptide
QEEEIATTNPVATEQYGSVCAANMGEEAPDNGMEGAY

SEQ ID NO: 193303 - protein, 36 aa, Artificial Sequence
  Description of Artificial Sequence: Synthetic polypeptide
VEDEIATTNPVAYEQYGSACAVANPLQEHQMGDFHK

SEQ ID NO: 193304 - protein, 38 aa, Artificial Sequence
  Description of Artificial Sequence: Synthetic polypeptide
DCEEIRTTNPVATEQWGYAVTQAVALEQVAIVNTEERG

SEQ ID NO: 193305 - protein, 35 aa, Artificial Sequence
  Description of Artificial Sequence: Synthetic polypeptide
DETEIRTTNPIATEQWGATAWANAEDWQEPKGGYI

SEQ ID NO: 193306 - protein, 35 aa, Artificial Sequence
  Description of Artificial Sequence: Synthetic polypeptide
DETEIRTTNPIATEPYGATTWSNMEDWQEPKGPYI

SEQ ID NO: 193307 - protein, 36 aa, Artificial Sequence
  Description of Artificial Sequence: Synthetic polypeptide
SMGEIRTTNPVATEQYGCIVGNCPLEHTVESQQENV

SEQ ID NO: 193308 - protein, 32 aa, Artificial Sequence
  Description of Artificial Sequence: Synthetic polypeptide
DETEIRTTNPVATECWGATANAEDWAEHKEPI

SEQ ID NO: 193309 - protein, 39 aa, Artificial Sequence
  Description of Artificial Sequence: Synthetic polypeptide
DEEEIRTTNPVATEAYGVVATVIGTTEQGSTNDEQAEED

SEQ ID NO: 193310 - protein, 37 aa, Artificial Sequence
  Description of Artificial Sequence: Synthetic polypeptide
SEVEIATTNPVATEQYGSVCAAIEHLEAPDNQMENNY

SEQ ID NO: 193311 - protein, 33 aa, Artificial Sequence
  Description of Artificial Sequence: Synthetic polypeptide
DAAEIATTNPVAYEPWGSVCTTPGNDSNPTEGM

SEQ ID NO: 193312 - protein, 36 aa, Artificial Sequence
  Description of Artificial Sequence: Synthetic polypeptide
DEACIRTTNPLATEQWGCVCSWGEDNQEYFGSDNQA

SEQ ID NO: 193313 - protein, 34 aa, Artificial Sequence
  Description of Artificial Sequence: Synthetic polypeptide
DETEIRTTNPISTEPYGATWSNMEDIQAEQNGPI

SEQ ID NO: 193314 - protein, 37 aa, Artificial Sequence
  Description of Artificial Sequence: Synthetic polypeptide
SESEIRTTNPVATEQYGTVYMDYTLMGMHQELQDDTQ

SEQ ID NO: 193315 - protein, 34 aa, Artificial Sequence
  Description of Artificial Sequence: Synthetic polypeptide
DAAEIATTNPVAYEPWGSVCTGTGNDRNPTEGMD

SEQ ID NO: 193316 - protein, 39 aa, Artificial Sequence
  Description of Artificial Sequence: Synthetic polypeptide
DEEEIRTTNPVAYEQWGSACYTGDRLQNDRNTQGQDDEE

SEQ ID NO: 193317 - protein, 35 aa, Artificial Sequence
  Description of Artificial Sequence: Synthetic polypeptide
AESDEIATTNPVAYEQWGSVYGGWDDQPGQGNTGA

SEQ ID NO: 193318 - protein, 36 aa, Artificial Sequence
  Description of Artificial Sequence: Synthetic polypeptide
AESDEIATTNPVAYEQWGSVSTLGGNAGEHQGTDEQ

SEQ ID NO: 193319 - protein, 39 aa, Artificial Sequence
  Description of Artificial Sequence: Synthetic polypeptide
DEEEIRTTNPVAYEQWGSACYTGDRLQNDNRNTQGQDGD

SEQ ID NO: 193320 - protein, 38 aa, Artificial Sequence
  Description of Artificial Sequence: Synthetic polypeptide
DEDEIATTNPVAYEQYGSVCSPANPALQQEHMIDLMAM

SEQ ID NO: 193321 - protein, 38 aa, Artificial Sequence
  Description of Artificial Sequence: Synthetic polypeptide
DEEEIRTTNPVATCQYGQCVCSWGEDHNEENFNSENQA

SEQ ID NO: 193322 - protein, 36 aa, Artificial Sequence
  Description of Artificial Sequence: Synthetic polypeptide
SESEIRTTNPVATEQYGSVPYQTDEEDITPSIEEPP

SEQ ID NO: 193323 - protein, 37 aa, Artificial Sequence
  Description of Artificial Sequence: Synthetic polypeptide
SESEIRTTNPVATEQYGEQAWTNDEELNKEYINQSKN

SEQ ID NO: 193324 - protein, 36 aa, Artificial Sequence
  Description of Artificial Sequence: Synthetic polypeptide
AESDEIATTNPVAYEQWGSVCYQNDVNEDGRGQNNS

SEQ ID NO: 193325 - protein, 34 aa, Artificial Sequence
  Description of Artificial Sequence: Synthetic polypeptide
DETEIRTTNPISTEPYGATWANAEDIQAEQNGPI

SEQ ID NO: 193326 - protein, 37 aa, Artificial Sequence
  Description of Artificial Sequence: Synthetic polypeptide
SESEIRTTNPVATEQYGCYPSETFPLYEFREEEIFED

SEQ ID NO: 193327 - protein, 34 aa, Artificial Sequence
  Description of Artificial Sequence: Synthetic polypeptide
QEGEIRTTNPVAYESYGSVCCLGGHSHPEGGTKK

SEQ ID NO: 193328 - protein, 35 aa, Artificial Sequence
  Description of Artificial Sequence: Synthetic polypeptide
AESDEIATTNPVAYEQWGSVCLQNDVNDERQQNNE

SEQ ID NO: 193329 - protein, 35 aa, Artificial Sequence
  Description of Artificial Sequence: Synthetic polypeptide
AESDEIATTNPCAYEQWGSVCLQNDVNDSRGQNNH

SEQ ID NO: 193330 - protein, 36 aa, Artificial Sequence
  Description of Artificial Sequence: Synthetic polypeptide
DEACIRTTNPVATEQYGCFCSWGEHNIENFNSDTQS

SEQ ID NO: 193331 - protein, 36 aa, Artificial Sequence
  Description of Artificial Sequence: Synthetic polypeptide
AESDEIACTNPVAYEQWGSVSTGGNAGEHQPGKTDE

SEQ ID NO: 193332 - protein, 37 aa, Artificial Sequence
  Description of Artificial Sequence: Synthetic polypeptide
DEEEIATTNPVATEQYGSVCAANMGVEEAPDDLMEDA

SEQ ID NO: 193333 - protein, 36 aa, Artificial Sequence
  Description of Artificial Sequence: Synthetic polypeptide
DAEEIATTNPVAYEQYGSVCAGNNGDEATAGEGVEK

SEQ ID NO: 193334 - protein, 35 aa, Artificial Sequence
  Description of Artificial Sequence: Synthetic polypeptide
AESAEIATTNPVAYEQWGSVYGGWDDQPNGNKNGQ

SEQ ID NO: 193335 - protein, 37 aa, Artificial Sequence
  Description of Artificial Sequence: Synthetic polypeptide
DEAEIRTTNPVGTEQYGCVCSNSEDHNAENFGSDTQA

SEQ ID NO: 193336 - protein, 39 aa, Artificial Sequence
  Description of Artificial Sequence: Synthetic polypeptide
DEEEIRTTNPVATEQYGCFVNGATILEYDDSNSNEIHQI

SEQ ID NO: 193337 - protein, 34 aa, Artificial Sequence
  Description of Artificial Sequence: Synthetic polypeptide
DEHEIRTTNPVAYEKWGEVCGDQGEGDRQQDGGA

SEQ ID NO: 193338 - protein, 39 aa, Artificial Sequence
  Description of Artificial Sequence: Synthetic polypeptide
DEEEISTTNPVATEQYGICVCSNWGEDHNTENFNSDNQS

SEQ ID NO: 193339 - protein, 37 aa, Artificial Sequence
  Description of Artificial Sequence: Synthetic polypeptide
DAAEIATTNPVATEQYGSVCSPAGPNMDNDMSEGADE

SEQ ID NO: 193340 - protein, 34 aa, Artificial Sequence
  Description of Artificial Sequence: Synthetic polypeptide
DETEIRTTNPVATECWGATACIDWPADREGEPYG

SEQ ID NO: 193341 - protein, 36 aa, Artificial Sequence
  Description of Artificial Sequence: Synthetic polypeptide
QEGEIRTTNPVAYEQYGTTIHACCVNSLSDNRTENP

SEQ ID NO: 193342 - protein, 34 aa, Artificial Sequence
  Description of Artificial Sequence: Synthetic polypeptide
DETEIRTTNPISTEPYGATWAMEDIQQQPNGNYI

SEQ ID NO: 193343 - protein, 36 aa, Artificial Sequence
  Description of Artificial Sequence: Synthetic polypeptide
DEACIRTTNPLATEQWGCVCSTWGEDNQESFGSDQS

SEQ ID NO: 193344 - protein, 34 aa, Artificial Sequence
  Description of Artificial Sequence: Synthetic polypeptide
DETEIRTTNPISTEPWGTTTWSMEDWQEQKGNYH

SEQ ID NO: 193345 - protein, 37 aa, Artificial Sequence
  Description of Artificial Sequence: Synthetic polypeptide
SEVEIATTNPVATEQYGSVCAAIEHLEAPDNQDEHNH

SEQ ID NO: 193346 - protein, 37 aa, Artificial Sequence
  Description of Artificial Sequence: Synthetic polypeptide
SEVEIATTNPVATEQYGSTACAATNGEEAPDDGANAN

SEQ ID NO: 193347 - protein, 36 aa, Artificial Sequence
  Description of Artificial Sequence: Synthetic polypeptide
DESEIRTTNPVATECWGSTVWACIDWPQDPKGEPYG

SEQ ID NO: 193348 - protein, 37 aa, Artificial Sequence
  Description of Artificial Sequence: Synthetic polypeptide
DEAEIRTTNPVAYEQYGSTIPWTPPWEENIHSQIEHQ

SEQ ID NO: 193349 - protein, 37 aa, Artificial Sequence
  Description of Artificial Sequence: Synthetic polypeptide
DEDCIRTTNPVATEEWGSQVATTGSMESDYNEGNNRN

SEQ ID NO: 193350 - protein, 39 aa, Artificial Sequence
  Description of Artificial Sequence: Synthetic polypeptide
DEEEIRTTNPVATEAYGVVATVTGNQAGTEAGTVNQEVE

SEQ ID NO: 193351 - protein, 39 aa, Artificial Sequence
  Description of Artificial Sequence: Synthetic polypeptide
DEEEIRTTNPVATEAYGVVATVTNAQAGTEAGTVTDEEE

SEQ ID NO: 193352 - protein, 33 aa, Artificial Sequence
  Description of Artificial Sequence: Synthetic polypeptide
DETEIRTTNPIGTECWGATTWANAEDLAPKGDI

SEQ ID NO: 193353 - protein, 35 aa, Artificial Sequence
  Description of Artificial Sequence: Synthetic polypeptide
SETEIRTTNPIATECWGSTTWANEEDWAERKGNYI

SEQ ID NO: 193354 - protein, 33 aa, Artificial Sequence
  Description of Artificial Sequence: Synthetic polypeptide
SETEIRTTNPIATECWGSTTWANADWMEPGPYI

SEQ ID NO: 193355 - protein, 37 aa, Artificial Sequence
  Description of Artificial Sequence: Synthetic polypeptide
DEAEIRTTNPVAYEQYQSLPNPNVLMMNFQSGQDDEW

SEQ ID NO: 193356 - protein, 37 aa, Artificial Sequence
  Description of Artificial Sequence: Synthetic polypeptide
DEDCIRTTNPIATEQWGISVATTPNMESIENGGNNSH

SEQ ID NO: 193357 - protein, 36 aa, Artificial Sequence
  Description of Artificial Sequence: Synthetic polypeptide
VEDEIATTNPVAYEQYGSVAGCDGEDTQNRNQNDQL

SEQ ID NO: 193358 - protein, 34 aa, Artificial Sequence
  Description of Artificial Sequence: Synthetic polypeptide
DETEIRTTNPISTEPWGATISNMEDWQQQKGNYI

SEQ ID NO: 193359 - protein, 36 aa, Artificial Sequence
  Description of Artificial Sequence: Synthetic polypeptide
CEAEIACTNPVATEQYGSACSAANPLPAEAIGDWHQ

SEQ ID NO: 193360 - protein, 36 aa, Artificial Sequence
  Description of Artificial Sequence: Synthetic polypeptide
DDSEIRTTNPVATEQYGSVPYQTDEEDITPSIEEWS

SEQ ID NO: 193361 - protein, 37 aa, Artificial Sequence
  Description of Artificial Sequence: Synthetic polypeptide
DEDCIRTTNPCATEQWGSVQATTPNMESIYNGGNNSN

SEQ ID NO: 193362 - protein, 34 aa, Artificial Sequence
  Description of Artificial Sequence: Synthetic polypeptide
DETEIRTTNPISTEPWGTTTWSMEDWQEPKGNYH

SEQ ID NO: 193363 - protein, 33 aa, Artificial Sequence
  Description of Artificial Sequence: Synthetic polypeptide
SESVIACTNPVAYEGYGEACSCENLSQAVGGYD

SEQ ID NO: 193364 - protein, 35 aa, Artificial Sequence
  Description of Artificial Sequence: Synthetic polypeptide
SESVIATTNPVAYEQWGCYVGEQQNDLQDGQNQGN

SEQ ID NO: 193365 - protein, 34 aa, Artificial Sequence
  Description of Artificial Sequence: Synthetic polypeptide
SESVISTTNPVAYEQWGVCYVGEMQNDQDGQNQG

SEQ ID NO: 193366 - protein, 38 aa, Artificial Sequence
  Description of Artificial Sequence: Synthetic polypeptide
SETAEEEIRTTNPVAYEQWGSVAWTDQMEQDQRGGDKS

SEQ ID NO: 193367 - protein, 37 aa, Artificial Sequence
  Description of Artificial Sequence: Synthetic polypeptide
DAEEIATTNPVAYEQYGSVCAMANHADDSKAPGDNHN

SEQ ID NO: 193368 - protein, 37 aa, Artificial Sequence
  Description of Artificial Sequence: Synthetic polypeptide
DEEEIRTTNPVATEQYGCFCSNWEEDHNQNFDSDTQS

SEQ ID NO: 193369 - protein, 36 aa, Artificial Sequence
  Description of Artificial Sequence: Synthetic polypeptide
SETAEIACTNPVATEQYGCVATNNHPAEADGHGDNS

SEQ ID NO: 193370 - protein, 37 aa, Artificial Sequence
  Description of Artificial Sequence: Synthetic polypeptide
DEAEIRTTNPVAYEQYWSPLPNPNVDMMNFQSGQDEW

SEQ ID NO: 193371 - protein, 37 aa, Artificial Sequence
  Description of Artificial Sequence: Synthetic polypeptide
DEAEIRTTNPVAYEQYWQSIPNPNVDMMNFQSGQDEW

SEQ ID NO: 193372 - protein, 38 aa, Artificial Sequence
  Description of Artificial Sequence: Synthetic polypeptide
DEEEIRTTNPVATDQYGSVCTPPKFDSGEGTFYGEPFE

SEQ ID NO: 193373 - protein, 35 aa, Artificial Sequence
  Description of Artificial Sequence: Synthetic polypeptide
VEDEIATTNPVAYEQYGSVAIANHADEGTGELGEQ

SEQ ID NO: 193374 - protein, 36 aa, Artificial Sequence
  Description of Artificial Sequence: Synthetic polypeptide
SETEICTTNPVATECYGCVCTIDHGEHNGQQGGDDA

SEQ ID NO: 193375 - protein, 36 aa, Artificial Sequence
  Description of Artificial Sequence: Synthetic polypeptide
SETEICTTNPVATECYGCVCTIDHNEHNGQGGGDDI

SEQ ID NO: 193376 - protein, 34 aa, Artificial Sequence
  Description of Artificial Sequence: Synthetic polypeptide
DETEIRTTNPISTEPWGTTIWSMEDWQEQKGNYH

SEQ ID NO: 193377 - protein, 35 aa, Artificial Sequence
  Description of Artificial Sequence: Synthetic polypeptide
DETEIRTTNPVATECYGATTWANDEDWAEPKGPYI

SEQ ID NO: 193378 - protein, 38 aa, Artificial Sequence
  Description of Artificial Sequence: Synthetic polypeptide
DEEEISTTNPVATEQYGQCVCSDWGEHNQENFGSETQP

SEQ ID NO: 193379 - protein, 38 aa, Artificial Sequence
  Description of Artificial Sequence: Synthetic polypeptide
DEEEISTTNPVATEQYGQCVCSMSGEHNAEYFNSDTQS

SEQ ID NO: 193380 - protein, 33 aa, Artificial Sequence
  Description of Artificial Sequence: Synthetic polypeptide
SEMEIACTNPCSYEQYGCVCSWGELNQSFNSDQ

SEQ ID NO: 193381 - protein, 36 aa, Artificial Sequence
  Description of Artificial Sequence: Synthetic polypeptide
DEMEIATTNPVATEQYGCVCSNWGEHNEEHFISETL

SEQ ID NO: 193382 - protein, 34 aa, Artificial Sequence
  Description of Artificial Sequence: Synthetic polypeptide
DESEIRTTNPVATECWGATTANAIDWAEPKGPYI

SEQ ID NO: 193383 - protein, 34 aa, Artificial Sequence
  Description of Artificial Sequence: Synthetic polypeptide
DESEIRTTNPVATECWGATTANAIDWAEPEGPYI

SEQ ID NO: 193384 - protein, 36 aa, Artificial Sequence
  Description of Artificial Sequence: Synthetic polypeptide
DEQEIATTNPVAYEQWGCNVAVANHDQDQGGGNQDE

SEQ ID NO: 193385 - protein, 35 aa, Artificial Sequence
  Description of Artificial Sequence: Synthetic polypeptide
DEQEIATTNPVAYEQWGCTAGNGGDTLAAGEEMRD

SEQ ID NO: 193386 - protein, 33 aa, Artificial Sequence
  Description of Artificial Sequence: Synthetic polypeptide
SEMEIACTNPCSYEQYGCVCSWEPLQSFGSDQS

SEQ ID NO: 193387 - protein, 34 aa, Artificial Sequence
  Description of Artificial Sequence: Synthetic polypeptide
SEMEIACTNPCSYEQYGCVCSWENHQSFGSDNQS

SEQ ID NO: 193388 - protein, 38 aa, Artificial Sequence
  Description of Artificial Sequence: Synthetic polypeptide
QEEEIRTTNPVATDVYGSVIVGLENLDGFGNGGQEGDS

SEQ ID NO: 193389 - protein, 33 aa, Artificial Sequence
  Description of Artificial Sequence: Synthetic polypeptide
SEMEIACTNPCSYEQYGCVCSWELQSFGSDPQS

SEQ ID NO: 193390 - protein, 32 aa, Artificial Sequence
  Description of Artificial Sequence: Synthetic polypeptide
SEMEIACTNPCSYEQYGCVCSWEHQSFGSDQN

SEQ ID NO: 193391 - protein, 31 aa, Artificial Sequence
  Description of Artificial Sequence: Synthetic polypeptide
DDSPVASTNPVSTEGYGNVAANTIQNPVGQM

SEQ ID NO: 193392 - protein, 34 aa, Artificial Sequence
  Description of Artificial Sequence: Synthetic polypeptide
SEMEIACTNPCSYEQYGCVCSTWELQESFGSDQS

SEQ ID NO: 193393 - protein, 37 aa, Artificial Sequence
  Description of Artificial Sequence: Synthetic polypeptide
DEDEIATTNPVAYEQYGSVCAMNNGNLEPPDDQANGA

SEQ ID NO: 193394 - protein, 34 aa, Artificial Sequence
  Description of Artificial Sequence: Synthetic polypeptide
SEMEIACTNPCSYEQYGCVCSWGNDLQSFGSDQS

SEQ ID NO: 193395 - protein, 33 aa, Artificial Sequence
  Description of Artificial Sequence: Synthetic polypeptide
SEMEIACTNPCSYEQYGCVCSNWNDQESFGSDQ

SEQ ID NO: 193396 - protein, 38 aa, Artificial Sequence
  Description of Artificial Sequence: Synthetic polypeptide
DEEEIRTTNPVATEQYGAQCVAYIQVIDASRYEGTQIE

SEQ ID NO: 193397 - protein, 33 aa, Artificial Sequence
  Description of Artificial Sequence: Synthetic polypeptide
SEMEIACTNPCSYEQYGCVCSNWALQSFGSDQS

SEQ ID NO: 193398 - protein, 38 aa, Artificial Sequence
  Description of Artificial Sequence: Synthetic polypeptide
DEEEIRTTNPVATEQYGAIREAPTNVVTSPIGGEDIGY

SEQ ID NO: 193399 - protein, 34 aa, Artificial Sequence
  Description of Artificial Sequence: Synthetic polypeptide
DETEIRTTNPVSYEPWGKISCMEDISQQVNGGNH

SEQ ID NO: 193400 - protein, 36 aa, Artificial Sequence
  Description of Artificial Sequence: Synthetic polypeptide
DECEIGTTNPVAYEEWGSVATTGGNTGNAGNDNQNH

SEQ ID NO: 193401 - protein, 36 aa, Artificial Sequence
  Description of Artificial Sequence: Synthetic polypeptide
CEDEIATTNPVAYEQYGSVAIANPWTIQENGDQTAQ

SEQ ID NO: 193402 - protein, 39 aa, Artificial Sequence
  Description of Artificial Sequence: Synthetic polypeptide
DEEEIRTTNPVATEQYGAFCNGATILEYDDSRSDENFQY

SEQ ID NO: 193403 - protein, 37 aa, Artificial Sequence
  Description of Artificial Sequence: Synthetic polypeptide
DEMEIATTNPVATEQYGCVCSNWGEDNEEHFGSEFLA

SEQ ID NO: 193404 - protein, 38 aa, Artificial Sequence
  Description of Artificial Sequence: Synthetic polypeptide
DEDEIATTNPVATEQYGSVCSADNPPGDNAHPMDQEAM

SEQ ID NO: 193405 - protein, 38 aa, Artificial Sequence
  Description of Artificial Sequence: Synthetic polypeptide
DEEEIRTTNPVATEQYGAATSLCPLLEAVSDDAIMRED

SEQ ID NO: 193406 - protein, 35 aa, Artificial Sequence
  Description of Artificial Sequence: Synthetic polypeptide
VEDEVATTNPVAYEQWGSTCSTWEHMDYQGHGNAQ

SEQ ID NO: 193407 - protein, 38 aa, Artificial Sequence
  Description of Artificial Sequence: Synthetic polypeptide
DEEEISTTNPVATEQYGQCVCSNWGEDHNQENFNSDQS

SEQ ID NO: 193408 - protein, 38 aa, Artificial Sequence
  Description of Artificial Sequence: Synthetic polypeptide
DECEICTVNPVATEQYGVVSSTTQQLQAGTEQGSTVTD

SEQ ID NO: 193409 - protein, 35 aa, Artificial Sequence
  Description of Artificial Sequence: Synthetic polypeptide
VEDEVATTNPVAYEQWGSTCSTWEHMDYQGHGQER

SEQ ID NO: 193410 - protein, 37 aa, Artificial Sequence
  Description of Artificial Sequence: Synthetic polypeptide
CEAEISTTNPVATEQYGCVCSTEEAHNQENFNSDTQA

SEQ ID NO: 193411 - protein, 34 aa, Artificial Sequence
  Description of Artificial Sequence: Synthetic polypeptide
SEMEIACTNPCSYEQYGCVCSWGNDQSFGSENQS

SEQ ID NO: 193412 - protein, 36 aa, Artificial Sequence
  Description of Artificial Sequence: Synthetic polypeptide
DESEIRTTNPVATECWGATTWANAEDWQEPKGENYG

SEQ ID NO: 193413 - protein, 34 aa, Artificial Sequence
  Description of Artificial Sequence: Synthetic polypeptide
DETEIRTTNPVSTECWGATTANMEDIAQQKGPYH

SEQ ID NO: 193414 - protein, 36 aa, Artificial Sequence
  Description of Artificial Sequence: Synthetic polypeptide
SEMEIRTTNPVATEQYGSTSYPCPDWEGMGTEDVEQ

SEQ ID NO: 193415 - protein, 38 aa, Artificial Sequence
  Description of Artificial Sequence: Synthetic polypeptide
VEDEIRTTNPVATEQYGSVVVEMVGTMGDEGGQTQNIA

SEQ ID NO: 193416 - protein, 34 aa, Artificial Sequence
  Description of Artificial Sequence: Synthetic polypeptide
QEHEIRTTNPVAYMQWGAAPTWEGDQQIEQGNDH

SEQ ID NO: 193417 - protein, 35 aa, Artificial Sequence
  Description of Artificial Sequence: Synthetic polypeptide
QEHEIRTTNPVAYMQWGAAPTWENDQQIEQGNLDS

SEQ ID NO: 193418 - protein, 37 aa, Artificial Sequence
  Description of Artificial Sequence: Synthetic polypeptide
DEMEIATTNPVATEQYGCVCSTTGEHNAEHFISETQA

SEQ ID NO: 193419 - protein, 36 aa, Artificial Sequence
  Description of Artificial Sequence: Synthetic polypeptide
SEMEIRTTNPVATEQYGSSNYPCTYEGAMGTEDVEQ

SEQ ID NO: 193420 - protein, 35 aa, Artificial Sequence
  Description of Artificial Sequence: Synthetic polypeptide
SEMEIRTTNPVATEQYGSSCYPCIYEHQGTEDVEQ

SEQ ID NO: 193421 - protein, 39 aa, Artificial Sequence
  Description of Artificial Sequence: Synthetic polypeptide
DEEEISTTNPVATEQYGQCVCSNWGEDHNAENFGSDNQS

SEQ ID NO: 193422 - protein, 39 aa, Artificial Sequence
  Description of Artificial Sequence: Synthetic polypeptide
DEEEISTTNPVATEQYGQCVCSNWGEDHNAENFGSENQP

SEQ ID NO: 193423 - protein, 39 aa, Artificial Sequence
  Description of Artificial Sequence: Synthetic polypeptide
VEDEIRTTNPVATEQYGVVVDTLIMNMQNDTEGQGNEQE

SEQ ID NO: 193424 - protein, 39 aa, Artificial Sequence
  Description of Artificial Sequence: Synthetic polypeptide
DEEEISTTNPVATEQYGQCVCSNWGEDHNAENFGSENQS

SEQ ID NO: 193425 - protein, 35 aa, Artificial Sequence
  Description of Artificial Sequence: Synthetic polypeptide
SEMEIRCTNPVATEQYGCVCEWGEHNQEHFGSDQM

SEQ ID NO: 193426 - protein, 38 aa, Artificial Sequence
  Description of Artificial Sequence: Synthetic polypeptide
SEMEIATTNPVATEQYGQCVCSTWGEHNEEHFGSENQS

SEQ ID NO: 193427 - protein, 37 aa, Artificial Sequence
  Description of Artificial Sequence: Synthetic polypeptide
SEMEIATTNPVATEQYGCVCSTWGEHNIEHFGSETQA

SEQ ID NO: 193428 - protein, 34 aa, Artificial Sequence
  Description of Artificial Sequence: Synthetic polypeptide
SEMEIATTNPVATEGYGCVCSWGEHNQHFISEQA

SEQ ID NO: 193429 - protein, 38 aa, Artificial Sequence
  Description of Artificial Sequence: Synthetic polypeptide
AENEIRTTNPVATEQYGSTTCETVPNHNTEIQGKDGEQ

SEQ ID NO: 193430 - protein, 39 aa, Artificial Sequence
  Description of Artificial Sequence: Synthetic polypeptide
DEEEIRTTNPVATEAYGVVSTQIGTTEQGSTNDEDEEED

SEQ ID NO: 193431 - protein, 33 aa, Artificial Sequence
  Description of Artificial Sequence: Synthetic polypeptide
SEMEIACTNPCSYEQYGCVCSWNDQSFNSDTQS

SEQ ID NO: 193432 - protein, 32 aa, Artificial Sequence
  Description of Artificial Sequence: Synthetic polypeptide
SEMEIACTNPCSYEQYGCVCSWNDQSFSSEQS

SEQ ID NO: 193433 - protein, 36 aa, Artificial Sequence
  Description of Artificial Sequence: Synthetic polypeptide
DESEIRTTNPVATECWGATTWANAEDWQEPKGENYI

SEQ ID NO: 193434 - protein, 33 aa, Artificial Sequence
  Description of Artificial Sequence: Synthetic polypeptide
SEMEIACTNPCSYEQYGCVCSWNHQSFGSETQA

SEQ ID NO: 193435 - protein, 34 aa, Artificial Sequence
  Description of Artificial Sequence: Synthetic polypeptide
DETEIRTTNPVSTECWGATIANMEDIAQQKGPYH

SEQ ID NO: 193436 - protein, 33 aa, Artificial Sequence
  Description of Artificial Sequence: Synthetic polypeptide
DETEIRTTNPVSTECWGAIANMEDIAQQNGPYH

SEQ ID NO: 193437 - protein, 38 aa, Artificial Sequence
  Description of Artificial Sequence: Synthetic polypeptide
DECEICTVNPVATEQYGVVSSTTQALQQGTEQGSTDTD

SEQ ID NO: 193438 - protein, 34 aa, Artificial Sequence
  Description of Artificial Sequence: Synthetic polypeptide
DESEIRTTNPVATECWGATVANAIDWPAEPEGPI

SEQ ID NO: 193439 - protein, 39 aa, Artificial Sequence
  Description of Artificial Sequence: Synthetic polypeptide
DEEEISTTNPVATEQYGQCVCSNWGEDHNQENFGSDNQI

SEQ ID NO: 193440 - protein, 38 aa, Artificial Sequence
  Description of Artificial Sequence: Synthetic polypeptide
DEMEIATTNPVATEQYGCVCSNWMEEHNEEHFGSENQA

SEQ ID NO: 193441 - protein, 37 aa, Artificial Sequence
  Description of Artificial Sequence: Synthetic polypeptide
DEMEIATTNPVATEQYGCVCSNWMEHNTEHFGSETQA

SEQ ID NO: 193442 - protein, 37 aa, Artificial Sequence
  Description of Artificial Sequence: Synthetic polypeptide
DEEEIRTTNPVATEQYGATVMPIFNNNVVDPIMDEVP

SEQ ID NO: 193443 - protein, 38 aa, Artificial Sequence
  Description of Artificial Sequence: Synthetic polypeptide
AENEIRTTNPVATEQYGSTPETVPNHNTETQGIDGHQM

SEQ ID NO: 193444 - protein, 38 aa, Artificial Sequence
  Description of Artificial Sequence: Synthetic polypeptide
DEEEISTTNPVATEQYGQCVCSNWGEDHNQEHFGSDQS

SEQ ID NO: 193445 - protein, 39 aa, Artificial Sequence
  Description of Artificial Sequence: Synthetic polypeptide
DEEEIRTTNPVATEAYGVVSTQIGTTEQGSTNDEQQTED

SEQ ID NO: 193446 - protein, 39 aa, Artificial Sequence
  Description of Artificial Sequence: Synthetic polypeptide
DEEEISTTNPVATEQYGQCVCSNWGEDHNAENFGSDNQL

SEQ ID NO: 193447 - protein, 37 aa, Artificial Sequence
  Description of Artificial Sequence: Synthetic polypeptide
DECEICTVNPVATEQYGVVATTQLLQQGTEQGSTVTD

SEQ ID NO: 193448 - protein, 33 aa, Artificial Sequence
  Description of Artificial Sequence: Synthetic polypeptide
DETEISTTNPCAYEQWGVVCYNIEKSDQDNIDS

SEQ ID NO: 193449 - protein, 39 aa, Artificial Sequence
  Description of Artificial Sequence: Synthetic polypeptide
DEEEISTTNPVATEQYGQCVCSNWGEDTNAENFNSDTQS

SEQ ID NO: 193450 - protein, 38 aa, Artificial Sequence
  Description of Artificial Sequence: Synthetic polypeptide
DEEEISTTNPVATEQYGQCVCSNWGEGHNANFNSDTQP

SEQ ID NO: 193451 - protein, 39 aa, Artificial Sequence
  Description of Artificial Sequence: Synthetic polypeptide
DEEEISTTNPVATEQYGQCVCSNWGEGHNQEGFGSDNQG

SEQ ID NO: 193452 - protein, 35 aa, Artificial Sequence
  Description of Artificial Sequence: Synthetic polypeptide
DETEIVTTNPIATEQWGTTVCSATDGPVEEFKGPI

SEQ ID NO: 193453 - protein, 33 aa, Artificial Sequence
  Description of Artificial Sequence: Synthetic polypeptide
DEQEIATTNPVAYEQWGHCTAANTGLATPADPH

SEQ ID NO: 193454 - protein, 36 aa, Artificial Sequence
  Description of Artificial Sequence: Synthetic polypeptide
DESEIRTTNPVAYEAWGIAVSCGNSSSSDREGGMGC

SEQ ID NO: 193455 - protein, 37 aa, Artificial Sequence
  Description of Artificial Sequence: Synthetic polypeptide
DEEEISTTNPVATEQYGQCVCSNWGEHEQENFSSDAS

SEQ ID NO: 193456 - protein, 34 aa, Artificial Sequence
  Description of Artificial Sequence: Synthetic polypeptide
DETEIVTTNPIATEQWGTVCAAADDWVAPEGNYI

SEQ ID NO: 193457 - protein, 38 aa, Artificial Sequence
  Description of Artificial Sequence: Synthetic polypeptide
DEEEISTTNPVATEQYGQCVCSNWGEHNAEFFNSDTQA

SEQ ID NO: 193458 - protein, 38 aa, Artificial Sequence
  Description of Artificial Sequence: Synthetic polypeptide
DEEEISTTNPVATEQYGQCVCSNWGEHNAEFSNSDTQA

SEQ ID NO: 193459 - protein, 38 aa, Artificial Sequence
  Description of Artificial Sequence: Synthetic polypeptide
DEEEISTTNPVATEQYGQCVCSNWGEHNAEGFISDNQA

SEQ ID NO: 193460 - protein, 38 aa, Artificial Sequence
  Description of Artificial Sequence: Synthetic polypeptide
DEEEISTTNPVATEQYGQCVCSNWGEHNAEGFNSDNQA

SEQ ID NO: 193461 - protein, 38 aa, Artificial Sequence
  Description of Artificial Sequence: Synthetic polypeptide
DEEEISTTNPVATEQYGQCVCSNWGEHNAEGFNSQTQN

SEQ ID NO: 193462 - protein, 35 aa, Artificial Sequence
  Description of Artificial Sequence: Synthetic polypeptide
DETEIVTTNPVATEQYGAVCAAADGPVEEFKGPYD

SEQ ID NO: 193463 - protein, 38 aa, Artificial Sequence
  Description of Artificial Sequence: Synthetic polypeptide
QEEEIRTTNPVATEAYGQVQNPTTLEGPEMGQGENEEG

SEQ ID NO: 193464 - protein, 38 aa, Artificial Sequence
  Description of Artificial Sequence: Synthetic polypeptide
DEEEISTTNPVATEQYGQCVCSNWGEHNAENFGSDTQM

SEQ ID NO: 193465 - protein, 38 aa, Artificial Sequence
  Description of Artificial Sequence: Synthetic polypeptide
DEEEISTTNPVATEQYGQCVCSNWGEHNAENFISDNQP

SEQ ID NO: 193466 - protein, 38 aa, Artificial Sequence
  Description of Artificial Sequence: Synthetic polypeptide
DEEEISTTNPVATEQYGQCVCSNWGEHNAENFISENQA

SEQ ID NO: 193467 - protein, 38 aa, Artificial Sequence
  Description of Artificial Sequence: Synthetic polypeptide
DEEEISTTNPVATEQYGQCVCSNWGEHNAENFNSDPQA

SEQ ID NO: 193468 - protein, 38 aa, Artificial Sequence
  Description of Artificial Sequence: Synthetic polypeptide
DEEEISTTNPVATEQYGQCVCSNWGEHNAENFNSDTQL

SEQ ID NO: 193469 - protein, 38 aa, Artificial Sequence
  Description of Artificial Sequence: Synthetic polypeptide
DEEEISTTNPVATEQYGQCVCSNWGEHNAENFNSDTQM

SEQ ID NO: 193470 - protein, 38 aa, Artificial Sequence
  Description of Artificial Sequence: Synthetic polypeptide
DEEEISTTNPVATEQYGQCVCSNWGEHNAENFNSDTQS

SEQ ID NO: 193471 - protein, 38 aa, Artificial Sequence
  Description of Artificial Sequence: Synthetic polypeptide
DEEEISTTNPVATEQYGQCVCSNWGEHNAENFNSENQA

SEQ ID NO: 193472 - protein, 38 aa, Artificial Sequence
  Description of Artificial Sequence: Synthetic polypeptide
DEEEISTTNPVATEQYGQCVCSNWGEHNAENFNSETQS

SEQ ID NO: 193473 - protein, 38 aa, Artificial Sequence
  Description of Artificial Sequence: Synthetic polypeptide
DEEEISTTNPVATEQYGQCVCSNWGEHNAENFQSETQA

SEQ ID NO: 193474 - protein, 38 aa, Artificial Sequence
  Description of Artificial Sequence: Synthetic polypeptide
DEEEISTTNPVATEQYGQCVCSNWGEHNAENSNSDTQA

SEQ ID NO: 193475 - protein, 37 aa, Artificial Sequence
  Description of Artificial Sequence: Synthetic polypeptide
DEMEIATTNPVATEQYGCVCSNWEEHNEEHFNSEDQS

SEQ ID NO: 193476 - protein, 38 aa, Artificial Sequence
  Description of Artificial Sequence: Synthetic polypeptide
DEEEISTTNPVATEQYGQCVCSNWGEHNAESFNSDTQM

SEQ ID NO: 193477 - protein, 33 aa, Artificial Sequence
  Description of Artificial Sequence: Synthetic polypeptide
DEHEIRTTNPVAYMQWGAAPTWEGDQQMQDDDK

SEQ ID NO: 193478 - protein, 38 aa, Artificial Sequence
  Description of Artificial Sequence: Synthetic polypeptide
DEEEISTTNPVATEQYGQCVCSNWGEHNAEYFNSDNQA

SEQ ID NO: 193479 - protein, 38 aa, Artificial Sequence
  Description of Artificial Sequence: Synthetic polypeptide
DEEEISTTNPVATEQYGQCVCSNWGEHNAENFISDNQA

SEQ ID NO: 193480 - protein, 39 aa, Artificial Sequence
  Description of Artificial Sequence: Synthetic polypeptide
DEEEISTTNPVATEQYGQCVCSNWGEDTNAENFISDNQA

SEQ ID NO: 193481 - protein, 39 aa, Artificial Sequence
  Description of Artificial Sequence: Synthetic polypeptide
DEEEISTTNPVATEQYGQCVCSNWGEDTNAEHFNSDTQP

SEQ ID NO: 193482 - protein, 35 aa, Artificial Sequence
  Description of Artificial Sequence: Synthetic polypeptide
DETEIVTTNPIATEQWGAVCANADDWVAEPEGNYI

SEQ ID NO: 193483 - protein, 39 aa, Artificial Sequence
  Description of Artificial Sequence: Synthetic polypeptide
DEEEISTTNPVATEQYGQCVCSNWGEDHNQESFGSDNQA

SEQ ID NO: 193484 - protein, 37 aa, Artificial Sequence
  Description of Artificial Sequence: Synthetic polypeptide
CEAEISTTNPVATEQYGQCVCSNTGEDNQENFGSDQS

SEQ ID NO: 193485 - protein, 38 aa, Artificial Sequence
  Description of Artificial Sequence: Synthetic polypeptide
CEAEISTTNPVATEQYGQCVCSNTGNDHNQNFNSDTQS

SEQ ID NO: 193486 - protein, 39 aa, Artificial Sequence
  Description of Artificial Sequence: Synthetic polypeptide
DEEEISTTNPVATEQYGQCVCSNWGEDHNQESFGSDNQS

SEQ ID NO: 193487 - protein, 38 aa, Artificial Sequence
  Description of Artificial Sequence: Synthetic polypeptide
DEEEISTTNPVATEQYGQCVCSNWGEDHNQNFNSQTQS

SEQ ID NO: 193488 - protein, 38 aa, Artificial Sequence
  Description of Artificial Sequence: Synthetic polypeptide
DEEEISTTNPVATEQYGQCVCSNWGEDNAEGFNSDNQS

SEQ ID NO: 193489 - protein, 38 aa, Artificial Sequence
  Description of Artificial Sequence: Synthetic polypeptide
DEEEISTTNPVATEQYGQCVCSNWGEDNAENFISENQS

SEQ ID NO: 193490 - protein, 38 aa, Artificial Sequence
  Description of Artificial Sequence: Synthetic polypeptide
DEEEISTTNPVATEQYGQCVCSNWGEDNAENFNSDFQS

SEQ ID NO: 193491 - protein, 38 aa, Artificial Sequence
  Description of Artificial Sequence: Synthetic polypeptide
DEEEISTTNPVATEQYGQCVCSNWGEDNAENFNSDNQP

SEQ ID NO: 193492 - protein, 38 aa, Artificial Sequence
  Description of Artificial Sequence: Synthetic polypeptide
DEEEISTTNPVATEQYGQCVCSNWGEDNAENFNSDTQS

SEQ ID NO: 193493 - protein, 36 aa, Artificial Sequence
  Description of Artificial Sequence: Synthetic polypeptide
SEGEIRTTNPVATEQYGVNWTPAKGIENNMDNNDFD

SEQ ID NO: 193494 - protein, 38 aa, Artificial Sequence
  Description of Artificial Sequence: Synthetic polypeptide
DEEEISTTNPVATEQYGQCVCSNWGEDNEEHFNSDNQS

SEQ ID NO: 193495 - protein, 34 aa, Artificial Sequence
  Description of Artificial Sequence: Synthetic polypeptide
QEKSIRCTNPVATEPYGCVCHGQMLLTSGGQNEP

SEQ ID NO: 193496 - protein, 38 aa, Artificial Sequence
  Description of Artificial Sequence: Synthetic polypeptide
DEEEISTTNPVATEQYGQCVCSNWGEDNEEHFNSDTQA

SEQ ID NO: 193497 - protein, 37 aa, Artificial Sequence
  Description of Artificial Sequence: Synthetic polypeptide
SEGEIRTTNPVATEQYGSSFSYVENEDVEGSHDGIIE

SEQ ID NO: 193498 - protein, 38 aa, Artificial Sequence
  Description of Artificial Sequence: Synthetic polypeptide
DEDEIRTTNPVATEQWGTVVVSTEQIRTTNVATEDGAQ

SEQ ID NO: 193499 - protein, 38 aa, Artificial Sequence
  Description of Artificial Sequence: Synthetic polypeptide
DEDEIRTTNPVATEQWGTVVVSTQQQSATNVATEDGSD

SEQ ID NO: 193500 - protein, 38 aa, Artificial Sequence
  Description of Artificial Sequence: Synthetic polypeptide
DEEEISTTNPVATEQYGQCVCSNWGEDPNQENFGSEQS

SEQ ID NO: 193501 - protein, 38 aa, Artificial Sequence
  Description of Artificial Sequence: Synthetic polypeptide
DEEEISTTNPVATEQYGQCVCSNWGEDNQENFNSETQG

SEQ ID NO: 193502 - protein, 38 aa, Artificial Sequence
  Description of Artificial Sequence: Synthetic polypeptide
DEEEISTTNPVATEQYGQCVCSNWGEDNQENFNSDTQP

SEQ ID NO: 193503 - protein, 38 aa, Artificial Sequence
  Description of Artificial Sequence: Synthetic polypeptide
DEEEISTTNPVATEQYGQCVCSNWGEDNQENFNSDTQA

SEQ ID NO: 193504 - protein, 33 aa, Artificial Sequence
  Description of Artificial Sequence: Synthetic polypeptide
DETEIVTTNPIATECWGTVWSAADDWAEPEGPI

SEQ ID NO: 193505 - protein, 38 aa, Artificial Sequence
  Description of Artificial Sequence: Synthetic polypeptide
DEEEISTTNPVATEQYGQCVCSNWGEDNQENFNSDNQD

SEQ ID NO: 193506 - protein, 32 aa, Artificial Sequence
  Description of Artificial Sequence: Synthetic polypeptide
SEHEIASTNPVGYEAYGVVMAYSGQSQHVGDS

SEQ ID NO: 193507 - protein, 33 aa, Artificial Sequence
  Description of Artificial Sequence: Synthetic polypeptide
DETEIVTTNPIATECWGTTCSATEDPVAFKGPD

SEQ ID NO: 193508 - protein, 38 aa, Artificial Sequence
  Description of Artificial Sequence: Synthetic polypeptide
DEEEISTTNPVATEQYGQCVCSNWGEDNQENFNSDNQA

SEQ ID NO: 193509 - protein, 38 aa, Artificial Sequence
  Description of Artificial Sequence: Synthetic polypeptide
DEEEISTTNPVATEQYGQCVCSNWGEDNQENFISDNQD

SEQ ID NO: 193510 - protein, 38 aa, Artificial Sequence
  Description of Artificial Sequence: Synthetic polypeptide
DEEEISTTNPVATEQYGQCVCSNWGEDNQENFGSEFQA

SEQ ID NO: 193511 - protein, 35 aa, Artificial Sequence
  Description of Artificial Sequence: Synthetic polypeptide
DETEISTTNPVAYEKWGEVASGDNQGNHGNGNSNN

SEQ ID NO: 193512 - protein, 38 aa, Artificial Sequence
  Description of Artificial Sequence: Synthetic polypeptide
DEEEISTTNPVATEQYGQCVCSNWGEDNIENFNSDFQS

SEQ ID NO: 193513 - protein, 38 aa, Artificial Sequence
  Description of Artificial Sequence: Synthetic polypeptide
SEGEIRTTNPVATEQYGECVVFTVETPLEDGDENSIEE

SEQ ID NO: 193514 - protein, 33 aa, Artificial Sequence
  Description of Artificial Sequence: Synthetic polypeptide
DETEIVTTNPIATECWGATWSATEDWAEPKGPD

SEQ ID NO: 193515 - protein, 39 aa, Artificial Sequence
  Description of Artificial Sequence: Synthetic polypeptide
DEEEISTTNPVATEQYGQCVCSNWGEDHNAENFGSDNQA

SEQ ID NO: 193516 - protein, 39 aa, Artificial Sequence
  Description of Artificial Sequence: Synthetic polypeptide
DEEEISTTNPVATEQYGQCVCSNWGEDHNAEFFQSDNQA

SEQ ID NO: 193517 - protein, 38 aa, Artificial Sequence
  Description of Artificial Sequence: Synthetic polypeptide
DEMEIATTNPVATEQYGCVCSTTGEPHNEEHFGSETQA

SEQ ID NO: 193518 - protein, 34 aa, Artificial Sequence
  Description of Artificial Sequence: Synthetic polypeptide
DETEIRTTNPVATEQWGATWAAAEDWAEPEGPDL

SEQ ID NO: 193519 - protein, 37 aa, Artificial Sequence
  Description of Artificial Sequence: Synthetic polypeptide
DEDEIATTNPVAYEQYGSVCPAVADAGQDHQGDNMAM

SEQ ID NO: 193520 - protein, 37 aa, Artificial Sequence
  Description of Artificial Sequence: Synthetic polypeptide
SENEIRTTNPVATEQYGSIFYPTEADMDNNGFENNMV

SEQ ID NO: 193521 - protein, 38 aa, Artificial Sequence
  Description of Artificial Sequence: Synthetic polypeptide
SENEIRTTNPVATEQYGSGFVANEHHDTENRPEDSQRE

SEQ ID NO: 193522 - protein, 34 aa, Artificial Sequence
  Description of Artificial Sequence: Synthetic polypeptide
DAAEIATTNPVATAQWGCSNAAGNPLPAPMENHN

SEQ ID NO: 193523 - protein, 36 aa, Artificial Sequence
  Description of Artificial Sequence: Synthetic polypeptide
AEECISTTNPVATEQYGCVCSNWGEHNAENFNSDQS

SEQ ID NO: 193524 - protein, 37 aa, Artificial Sequence
  Description of Artificial Sequence: Synthetic polypeptide
SENEIRTTNPVATEQYGSGFANEPHDDENRPEDSQRE

SEQ ID NO: 193525 - protein, 36 aa, Artificial Sequence
  Description of Artificial Sequence: Synthetic polypeptide
DETEIRTTNPVATEQWGEVDNEEGEEMNDGEGGGQQ

SEQ ID NO: 193526 - protein, 36 aa, Artificial Sequence
  Description of Artificial Sequence: Synthetic polypeptide
DCVCIATTNPVATEGYGHVPSTQNEGSTDSTGGNEY

SEQ ID NO: 193527 - protein, 36 aa, Artificial Sequence
  Description of Artificial Sequence: Synthetic polypeptide
DCVCIATTNPVATEGYGSVPSTQVEGSTDSTGGNEA

SEQ ID NO: 193528 - protein, 38 aa, Artificial Sequence
  Description of Artificial Sequence: Synthetic polypeptide
DEEEISTTNPVATEQYGQCVCSMWGEPHNQNFGSETQS

SEQ ID NO: 193529 - protein, 39 aa, Artificial Sequence
  Description of Artificial Sequence: Synthetic polypeptide
AEDEICTTNPVATEAYGVVATTVSTEEIGTNLQIGNEEM

SEQ ID NO: 193530 - protein, 36 aa, Artificial Sequence
  Description of Artificial Sequence: Synthetic polypeptide
DAAEIACTNPVATEQYGSVCSPAGPNDNDMSEGADD

SEQ ID NO: 193531 - protein, 38 aa, Artificial Sequence
  Description of Artificial Sequence: Synthetic polypeptide
DEEEISTTNPVATEQYGQCVCSMWMEHNQENFGSDTQS

SEQ ID NO: 193532 - protein, 32 aa, Artificial Sequence
  Description of Artificial Sequence: Synthetic polypeptide
QEHEIAPTNPCSYEQWGIVWCNDHQDSGDTDR

SEQ ID NO: 193533 - protein, 38 aa, Artificial Sequence
  Description of Artificial Sequence: Synthetic polypeptide
DEEEISTTNPVATEQYGQCVCSNSEEDNQENFGSDTQS

SEQ ID NO: 193534 - protein, 36 aa, Artificial Sequence
  Description of Artificial Sequence: Synthetic polypeptide
SENEIRTTNPVATEQYGCMVVFANPENEMWTQDPEQ

SEQ ID NO: 193535 - protein, 35 aa, Artificial Sequence
  Description of Artificial Sequence: Synthetic polypeptide
SENEIRTTNPVATEQYGCCWTTHVVEQLTPPEDSI

SEQ ID NO: 193536 - protein, 37 aa, Artificial Sequence
  Description of Artificial Sequence: Synthetic polypeptide
DETEIRTTNPVATEQYGSIIEECFPNWVQAQIQPQDG

SEQ ID NO: 193537 - protein, 37 aa, Artificial Sequence
  Description of Artificial Sequence: Synthetic polypeptide
DETEIRTTNPVATEQYGSIIEECFPTWYQAQIQPQDM

SEQ ID NO: 193538 - protein, 38 aa, Artificial Sequence
  Description of Artificial Sequence: Synthetic polypeptide
DETEIRTTNPVATEQYGSIIEECLPQYSQQLQIQPQDY

SEQ ID NO: 193539 - protein, 38 aa, Artificial Sequence
  Description of Artificial Sequence: Synthetic polypeptide
DETEIRTTNPVATEQYGSIYYWTYDELNETTAQSNQVH

SEQ ID NO: 193540 - protein, 38 aa, Artificial Sequence
  Description of Artificial Sequence: Synthetic polypeptide
AEDEICTTNPVATEAYGSVYTVNTEEIGTNLQIGTEEM

SEQ ID NO: 193541 - protein, 39 aa, Artificial Sequence
  Description of Artificial Sequence: Synthetic polypeptide
DEEEISTTNPVATEQYGQCVCSNSGEDDNEEFFGSENQA

SEQ ID NO: 193542 - protein, 36 aa, Artificial Sequence
  Description of Artificial Sequence: Synthetic polypeptide
AEQEIATTNPVATEQWGCVAGEGAHPTNPANQNGEL

SEQ ID NO: 193543 - protein, 36 aa, Artificial Sequence
  Description of Artificial Sequence: Synthetic polypeptide
AEQEIATTNPVATEQWGCVAGEGAHDTNPANQNGHH

SEQ ID NO: 193544 - protein, 38 aa, Artificial Sequence
  Description of Artificial Sequence: Synthetic polypeptide
DEEEISTTNPVATEQYGQCVCSNSGEDNQENFQSEFQG

SEQ ID NO: 193545 - protein, 38 aa, Artificial Sequence
  Description of Artificial Sequence: Synthetic polypeptide
DEEEISTTNPVATEQYGQCVCSNSGEDNQESFGSETQP

SEQ ID NO: 193546 - protein, 39 aa, Artificial Sequence
  Description of Artificial Sequence: Synthetic polypeptide
DEEEISTTNPVATEQYGQCVCSNSGEDPNQEFFGSDNQS

SEQ ID NO: 193547 - protein, 37 aa, Artificial Sequence
  Description of Artificial Sequence: Synthetic polypeptide
SENEIRTTNPVATEFYGSVVVDGQNEQNVGEEGEFLQ

SEQ ID NO: 193548 - protein, 38 aa, Artificial Sequence
  Description of Artificial Sequence: Synthetic polypeptide
DETEIRTTNPVATEQYGEVVTGGGDNNEEGEEGEGGET

SEQ ID NO: 193549 - protein, 35 aa, Artificial Sequence
  Description of Artificial Sequence: Synthetic polypeptide
DETEIRTTNPVATEQWGATTWSNAEDWADPKGEYI

SEQ ID NO: 193550 - protein, 35 aa, Artificial Sequence
  Description of Artificial Sequence: Synthetic polypeptide
DETEIRTTNPVATEQWGATTWANAEDWEEPEGPYI

SEQ ID NO: 193551 - protein, 35 aa, Artificial Sequence
  Description of Artificial Sequence: Synthetic polypeptide
DETEIRTTNPVATEQWGATTWANAEDWADPKGPYI

SEQ ID NO: 193552 - protein, 37 aa, Artificial Sequence
  Description of Artificial Sequence: Synthetic polypeptide
DEEEISTTNPVATEQYGQCVCSMSGEHNQESFISDQA

SEQ ID NO: 193553 - protein, 37 aa, Artificial Sequence
  Description of Artificial Sequence: Synthetic polypeptide
DEEEIRTTNPVGYEQYGCVCSSGEDHNAENFISDNQA

SEQ ID NO: 193554 - protein, 37 aa, Artificial Sequence
  Description of Artificial Sequence: Synthetic polypeptide
SENEIRTTNPVATEQYGTVYNDYTLMEMHAELQDDTQ

SEQ ID NO: 193555 - protein, 38 aa, Artificial Sequence
  Description of Artificial Sequence: Synthetic polypeptide
SENEIRTTNPVATEQYGTVYISYTLMGMHQNETQDKTQ

SEQ ID NO: 193556 - protein, 38 aa, Artificial Sequence
  Description of Artificial Sequence: Synthetic polypeptide
SENEIRTTNPVATEQYGTVYISYTLMGDHQEELQDDTQ

SEQ ID NO: 193557 - protein, 38 aa, Artificial Sequence
  Description of Artificial Sequence: Synthetic polypeptide
SENEIRTTNPVATEQYGTVYISSYTLMDMHQELQDDTQ

SEQ ID NO: 193558 - protein, 37 aa, Artificial Sequence
  Description of Artificial Sequence: Synthetic polypeptide
SENEIRTTNPVATEQYGTVYISCTLMGMHQEVQDDTQ

SEQ ID NO: 193559 - protein, 37 aa, Artificial Sequence
  Description of Artificial Sequence: Synthetic polypeptide
SENEIRTTNPVATEQYGTVLISYALMGMHQELQDDTQ

SEQ ID NO: 193560 - protein, 36 aa, Artificial Sequence
  Description of Artificial Sequence: Synthetic polypeptide
DAAEIATTNPVATEQYGCVAATAHDPQDSMIENDGN

SEQ ID NO: 193561 - protein, 36 aa, Artificial Sequence
  Description of Artificial Sequence: Synthetic polypeptide
AEREIRTTNPVATEQYGCVCGWGEHNAENFGSDTQS

SEQ ID NO: 193562 - protein, 35 aa, Artificial Sequence
  Description of Artificial Sequence: Synthetic polypeptide
DAAEIATTNPVATEQYGCVAANHSGDATMNPAEQG

SEQ ID NO: 193563 - protein, 38 aa, Artificial Sequence
  Description of Artificial Sequence: Synthetic polypeptide
DETEIRTTNPVATEFYGQVVTPGQLINMQGEGEGDGQV

SEQ ID NO: 193564 - protein, 38 aa, Artificial Sequence
  Description of Artificial Sequence: Synthetic polypeptide
DEEEISTTNPVATEQYGQCVCSMWEEDNQENFISDNQA

SEQ ID NO: 193565 - protein, 36 aa, Artificial Sequence
  Description of Artificial Sequence: Synthetic polypeptide
DETEIRTTNPVATEFYGSVVDMQDGGGEEDGGGEPL

SEQ ID NO: 193566 - protein, 38 aa, Artificial Sequence
  Description of Artificial Sequence: Synthetic polypeptide
QEEEIRTTNPVATDFYGSVIVGLENLDGFGNGNQEDDA

SEQ ID NO: 193567 - protein, 35 aa, Artificial Sequence
  Description of Artificial Sequence: Synthetic polypeptide
DEHEIRTTNPVAYEKWGSVCGDQGEGDRQGDGGVT

SEQ ID NO: 193568 - protein, 36 aa, Artificial Sequence
  Description of Artificial Sequence: Synthetic polypeptide
VEDEIATTNPVAYEQYGSVSANPDPPNAHMIDLTAM

SEQ ID NO: 193569 - protein, 37 aa, Artificial Sequence
  Description of Artificial Sequence: Synthetic polypeptide
SENEIRTTNPVATEQYGSVFYPFADMDNNGFEFNNMV

SEQ ID NO: 193570 - protein, 35 aa, Artificial Sequence
  Description of Artificial Sequence: Synthetic polypeptide
DETEIRTTNPVATEQWGATTWANAEDWADPKGEYI

SEQ ID NO: 193571 - protein, 35 aa, Artificial Sequence
  Description of Artificial Sequence: Synthetic polypeptide
VEDEIATVNPVATEQWGCVAGNGGLADAPGGNLHM

SEQ ID NO: 193572 - protein, 38 aa, Artificial Sequence
  Description of Artificial Sequence: Synthetic polypeptide
DEDEIATTNPVAYEQYGSVCSADNPPGGNAHPGDLAAM

SEQ ID NO: 193573 - protein, 35 aa, Artificial Sequence
  Description of Artificial Sequence: Synthetic polypeptide
AEQEIATTNPVAYEQWGSTCSVLDNNDQVGDEDDY

SEQ ID NO: 193574 - protein, 34 aa, Artificial Sequence
  Description of Artificial Sequence: Synthetic polypeptide
DETEIRTTNPVATEPWGTTTWSNAEDWAEPNGPI

SEQ ID NO: 193575 - protein, 38 aa, Artificial Sequence
  Description of Artificial Sequence: Synthetic polypeptide
DEEEISTTNPVATEQYGQCVCSNSGEHNAENFQSDTQA

SEQ ID NO: 193576 - protein, 34 aa, Artificial Sequence
  Description of Artificial Sequence: Synthetic polypeptide
DETEIRTTNPVATEPWGATTWSNAEDWAEPNGPI

SEQ ID NO: 193577 - protein, 38 aa, Artificial Sequence
  Description of Artificial Sequence: Synthetic polypeptide
DEEEISTTNPVATEQYGQCVCSMWGEHNEEYSNSDTQS

SEQ ID NO: 193578 - protein, 36 aa, Artificial Sequence
  Description of Artificial Sequence: Synthetic polypeptide
DAAEIATTNPVATEQWGSVCWPTPGPNDSGDGMGMN

SEQ ID NO: 193579 - protein, 38 aa, Artificial Sequence
  Description of Artificial Sequence: Synthetic polypeptide
DEEEISTTNPVATEQYGQCVCSMWGEHNAEYFNSETQS

SEQ ID NO: 193580 - protein, 38 aa, Artificial Sequence
  Description of Artificial Sequence: Synthetic polypeptide
DEEEISTTNPVATEQYGQCVCSMWGEHNAENFNSDTQS

SEQ ID NO: 193581 - protein, 35 aa, Artificial Sequence
  Description of Artificial Sequence: Synthetic polypeptide
DCSEIRTTNPVAYEAWGISVPQANSSSDREGGMVC

SEQ ID NO: 193582 - protein, 37 aa, Artificial Sequence
  Description of Artificial Sequence: Synthetic polypeptide
DEEEISTTNPVATEQYGQCVCSMWEHNIENFISEFQA

SEQ ID NO: 193583 - protein, 34 aa, Artificial Sequence
  Description of Artificial Sequence: Synthetic polypeptide
DETEIRTTNPVATEPWGATTAMEDWQAEPKGPYI

SEQ ID NO: 193584 - protein, 37 aa, Artificial Sequence
  Description of Artificial Sequence: Synthetic polypeptide
DEEEISTTNPVATEQYGQCVCSNSGEHNAENFSSEQS

SEQ ID NO: 193585 - protein, 37 aa, Artificial Sequence
  Description of Artificial Sequence: Synthetic polypeptide
DEEEISTTNPVATEQYGQCVCSNSGEHNAYFNSETQA

SEQ ID NO: 193586 - protein, 38 aa, Artificial Sequence
  Description of Artificial Sequence: Synthetic polypeptide
DEEEISTTNPVATEQYGQCVCSNSGEHNIENFGSDTQA

SEQ ID NO: 193587 - protein, 34 aa, Artificial Sequence
  Description of Artificial Sequence: Synthetic polypeptide
DDSEVASTNPVSTEGYGNVAANSTWYQSDVGQRF

SEQ ID NO: 193588 - protein, 35 aa, Artificial Sequence
  Description of Artificial Sequence: Synthetic polypeptide
SENEIATTNPVATEGYGCVCSWGELNQEHFISELF

SEQ ID NO: 193589 - protein, 35 aa, Artificial Sequence
  Description of Artificial Sequence: Synthetic polypeptide
SENEIATTNPVATEGYGCVCSWGEDNQEHFNSEQA

SEQ ID NO: 193590 - protein, 37 aa, Artificial Sequence
  Description of Artificial Sequence: Synthetic polypeptide
VEDEIRGTNPVATEAYGSVVMDNSNDLEQDGGGQQQG

SEQ ID NO: 193591 - protein, 34 aa, Artificial Sequence
  Description of Artificial Sequence: Synthetic polypeptide
SENEIATTNPVATEGYGCVCSWEHNTEHFISELA

SEQ ID NO: 193592 - protein, 34 aa, Artificial Sequence
  Description of Artificial Sequence: Synthetic polypeptide
SENEIATTNPVATEGYGCVCSWEGHNQHFISEQA

SEQ ID NO: 193593 - protein, 35 aa, Artificial Sequence
  Description of Artificial Sequence: Synthetic polypeptide
SENEIATTNPVATEGYGCVCSTWEDNQEHFISEQA

SEQ ID NO: 193594 - protein, 34 aa, Artificial Sequence
  Description of Artificial Sequence: Synthetic polypeptide
SENEIATTNPVATEGYGCVCSSEDNQEHFSSELA

SEQ ID NO: 193595 - protein, 34 aa, Artificial Sequence
  Description of Artificial Sequence: Synthetic polypeptide
SENEIATTNPVATEGYGCVCSNWEDNAHFISEQA

SEQ ID NO: 193596 - protein, 34 aa, Artificial Sequence
  Description of Artificial Sequence: Synthetic polypeptide
SENEIATTNPVATEGYGCVCSMWEDQHFSSETLA

SEQ ID NO: 193597 - protein, 37 aa, Artificial Sequence
  Description of Artificial Sequence: Synthetic polypeptide
VEDEIRGTNPVATEQYGTVNNMGFPELDQQRGEMGDT

SEQ ID NO: 193598 - protein, 38 aa, Artificial Sequence
  Description of Artificial Sequence: Synthetic polypeptide
VEDEIRTTNPVATDQYGSVNMNLIMEGQLQEFNENNDQ

SEQ ID NO: 193599 - protein, 36 aa, Artificial Sequence
  Description of Artificial Sequence: Synthetic polypeptide
DEAEIATTNPVAYECWGVVCYTTIDNQDGKGQDGWR

SEQ ID NO: 193600 - protein, 31 aa, Artificial Sequence
  Description of Artificial Sequence: Synthetic polypeptide
DDSEVASTNPVSTEGWGNTAANTIQSPVGQR

SEQ ID NO: 193601 - protein, 38 aa, Artificial Sequence
  Description of Artificial Sequence: Synthetic polypeptide
DEEEISTTNPVATEQYGQCVCSNWGAHNQENFNSDTQS

SEQ ID NO: 193602 - protein, 38 aa, Artificial Sequence
  Description of Artificial Sequence: Synthetic polypeptide
DEEEISTTNPVATEQYGQCVCSNWGAHNQENFNSENAE

SEQ ID NO: 193603 - protein, 36 aa, Artificial Sequence
  Description of Artificial Sequence: Synthetic polypeptide
DEAEISTTNPVATEGWGCVCSWGEENQEYFGSNTQA

SEQ ID NO: 193604 - protein, 37 aa, Artificial Sequence
  Description of Artificial Sequence: Synthetic polypeptide
QEEEIRTTNPVATDQYGMITVNMGMEDIQEEGGNEGI

SEQ ID NO: 193605 - protein, 38 aa, Artificial Sequence
  Description of Artificial Sequence: Synthetic polypeptide
VEDEIRTTNPVATEQYGMVSVEGMGDGGQGQENQERGT

SEQ ID NO: 193606 - protein, 38 aa, Artificial Sequence
  Description of Artificial Sequence: Synthetic polypeptide
DEMEIATTNPVATEQYGCVCSTWGEDHNEEHFNSENQS

SEQ ID NO: 193607 - protein, 34 aa, Artificial Sequence
  Description of Artificial Sequence: Synthetic polypeptide
DDSEVASTNPVSTEGYGNVAANTHIDQSRVGQKR

SEQ ID NO: 193608 - protein, 39 aa, Artificial Sequence
  Description of Artificial Sequence: Synthetic polypeptide
AEDEICTTNPVATEAYGSVATVVNEEIGTNLQIGTNEEM

SEQ ID NO: 193609 - protein, 39 aa, Artificial Sequence
  Description of Artificial Sequence: Synthetic polypeptide
AEDEICTTNPVATEAYGSVATVVTEEIGTNLQLGNNEEM

SEQ ID NO: 193610 - protein, 34 aa, Artificial Sequence
  Description of Artificial Sequence: Synthetic polypeptide
SENEIATTNPVATEGYGQCVCSWEHNQHFISELA

SEQ ID NO: 193611 - protein, 39 aa, Artificial Sequence
  Description of Artificial Sequence: Synthetic polypeptide
AEDEICTTNPVATEAYGSVATVVTEEIGTNLQLIGNEEM

SEQ ID NO: 193612 - protein, 36 aa, Artificial Sequence
  Description of Artificial Sequence: Synthetic polypeptide
DEAEISTTNPVATEGYGCVCSWGEHNAEYFNSDNQA

SEQ ID NO: 193613 - protein, 38 aa, Artificial Sequence
  Description of Artificial Sequence: Synthetic polypeptide
DEMEIATTNPVATEQYGCVCSTWGEDHNTEHFGSETLA

SEQ ID NO: 193614 - protein, 35 aa, Artificial Sequence
  Description of Artificial Sequence: Synthetic polypeptide
DEAEISTTNPVATEGWGCVCSWMEENQENFGSDQM

SEQ ID NO: 193615 - protein, 36 aa, Artificial Sequence
  Description of Artificial Sequence: Synthetic polypeptide
DEAEISTTNPVATEGWGCVCSWMEENAEHFGSDNQA

SEQ ID NO: 193616 - protein, 39 aa, Artificial Sequence
  Description of Artificial Sequence: Synthetic polypeptide
DEEEISTTNPVATEQYGQCVCSNWGEDDNIENFGSENQS

SEQ ID NO: 193617 - protein, 34 aa, Artificial Sequence
  Description of Artificial Sequence: Synthetic polypeptide
DEAEIATTNPVAYEEWGCVCPNNNDQRDTEDEEL

SEQ ID NO: 193618 - protein, 38 aa, Artificial Sequence
  Description of Artificial Sequence: Synthetic polypeptide
DEEEISTTNPVATEQYGQCVCSNWGEDDNTNFNSDTQA

SEQ ID NO: 193619 - protein, 34 aa, Artificial Sequence
  Description of Artificial Sequence: Synthetic polypeptide
DETEIRTTNPIATECYGTTCANAEDWAEPKGPYI

SEQ ID NO: 193620 - protein, 32 aa, Artificial Sequence
  Description of Artificial Sequence: Synthetic polypeptide
DDSEVASTNPVSTEGYGNVAANSTIQSPVGQT

SEQ ID NO: 193621 - protein, 38 aa, Artificial Sequence
  Description of Artificial Sequence: Synthetic polypeptide
DEEEISTTNPVATEQYGQCVCSNWEEHNTESFGSDTQS

SEQ ID NO: 193622 - protein, 38 aa, Artificial Sequence
  Description of Artificial Sequence: Synthetic polypeptide
DEEEISTTNPVATEQYGQCVCSNSGEHNIENFGSQTQQ

SEQ ID NO: 193623 - protein, 38 aa, Artificial Sequence
  Description of Artificial Sequence: Synthetic polypeptide
DEEEISTTNPVATEQYGQCVCSNSGEHNQEAFISDNQS

SEQ ID NO: 193624 - protein, 35 aa, Artificial Sequence
  Description of Artificial Sequence: Synthetic polypeptide
VEDEIATVNPVATEQWGCVAGNTGLADAPGGNFHM

SEQ ID NO: 193625 - protein, 38 aa, Artificial Sequence
  Description of Artificial Sequence: Synthetic polypeptide
DEEEISTTNPVATEQYGQCVCSNSGEHNQENFGSDTQS

SEQ ID NO: 193626 - protein, 38 aa, Artificial Sequence
  Description of Artificial Sequence: Synthetic polypeptide
DETEIRTTNPVATEQYGSVADDGDEEGGQNDDGTDGVT

SEQ ID NO: 193627 - protein, 38 aa, Artificial Sequence
  Description of Artificial Sequence: Synthetic polypeptide
DEEEISTTNPVATEQYGQCVCSNSGEHNQESFGSDTQA

SEQ ID NO: 193628 - protein, 38 aa, Artificial Sequence
  Description of Artificial Sequence: Synthetic polypeptide
DEEEISTTNPVATEQYGQCVCSNSGEHNQESFGSETQI

SEQ ID NO: 193629 - protein, 38 aa, Artificial Sequence
  Description of Artificial Sequence: Synthetic polypeptide
DETEIRTTNPVATEQYGSVDDPIGDNNEEGDTGEGGET

SEQ ID NO: 193630 - protein, 38 aa, Artificial Sequence
  Description of Artificial Sequence: Synthetic polypeptide
DEEEISTTNPVATEQYGQCVCSNSGEHNQEYFNSDTQS

SEQ ID NO: 193631 - protein, 38 aa, Artificial Sequence
  Description of Artificial Sequence: Synthetic polypeptide
DEEEISTTNPVATEQYGQCVCSNSGEPNAENFGSEFQG

SEQ ID NO: 193632 - protein, 33 aa, Artificial Sequence
  Description of Artificial Sequence: Synthetic polypeptide
DDSEVASTNPVSTEGYGNVAANITIQSRVGEQG

SEQ ID NO: 193633 - protein, 33 aa, Artificial Sequence
  Description of Artificial Sequence: Synthetic polypeptide
DDSEVASTNPVSTEGYGMVHANTIQESKVGVQR

SEQ ID NO: 193634 - protein, 32 aa, Artificial Sequence
  Description of Artificial Sequence: Synthetic polypeptide
DDSEVASTNPVSTEGYGMVALWTIQESKVGQR

SEQ ID NO: 193635 - protein, 36 aa, Artificial Sequence
  Description of Artificial Sequence: Synthetic polypeptide
AEECISTTNPVATEQYGCVCSSGEDDNQNFNSDTQA

SEQ ID NO: 193636 - protein, 38 aa, Artificial Sequence
  Description of Artificial Sequence: Synthetic polypeptide
DEEEISTTNPVATEQYGQCVCSNTGEHNAENFISEFQG

SEQ ID NO: 193637 - protein, 35 aa, Artificial Sequence
  Description of Artificial Sequence: Synthetic polypeptide
DEHEIRTTNPVAYEKWGSVCGDQGVGDRQGDGGGA

SEQ ID NO: 193638 - protein, 38 aa, Artificial Sequence
  Description of Artificial Sequence: Synthetic polypeptide
DETEIRTTNPVATEQYGSVVDPGDNDNEEGEEGEGGET

SEQ ID NO: 193639 - protein, 38 aa, Artificial Sequence
  Description of Artificial Sequence: Synthetic polypeptide
DEEEISTTNPVATEQYGQCVCSNWEEHNTENFISDTQA

SEQ ID NO: 193640 - protein, 38 aa, Artificial Sequence
  Description of Artificial Sequence: Synthetic polypeptide
DEEEISTTNPVATEQYGQCVCSNWEEHNQEHFNSDTQA

SEQ ID NO: 193641 - protein, 38 aa, Artificial Sequence
  Description of Artificial Sequence: Synthetic polypeptide
DEEEISTTNPVATEQYGQCVCSNWEEHNQEGFISDTQF

SEQ ID NO: 193642 - protein, 38 aa, Artificial Sequence
  Description of Artificial Sequence: Synthetic polypeptide
DEEEISTTNPVATEQYGQCVCSNWEEHNEEYFNSDTQA

SEQ ID NO: 193643 - protein, 38 aa, Artificial Sequence
  Description of Artificial Sequence: Synthetic polypeptide
DEEEISTTNPVATEQYGQCVCSNWEEDNTENFNSDTQS

SEQ ID NO: 193644 - protein, 32 aa, Artificial Sequence
  Description of Artificial Sequence: Synthetic polypeptide
DDSEVASTNPVSTEGYGMVAAYWIQESVVGQR

SEQ ID NO: 193645 - protein, 36 aa, Artificial Sequence
  Description of Artificial Sequence: Synthetic polypeptide
SENEIATTNPVATEQYGQLVACTYEHSHRPGTMPQT

SEQ ID NO: 193646 - protein, 34 aa, Artificial Sequence
  Description of Artificial Sequence: Synthetic polypeptide
DEAEISTTNGVAYCQYGCVCSWGEHNQYFGSDQA

SEQ ID NO: 193647 - protein, 39 aa, Artificial Sequence
  Description of Artificial Sequence: Synthetic polypeptide
DEEEISTTNPVATEQYGQCVCSNWEEDHNAENFGSDNQS

SEQ ID NO: 193648 - protein, 38 aa, Artificial Sequence
  Description of Artificial Sequence: Synthetic polypeptide
DEEEISTTNPVATEQYGQCVCSNWEDHNQEYFNSENAE

SEQ ID NO: 193649 - protein, 38 aa, Artificial Sequence
  Description of Artificial Sequence: Synthetic polypeptide
DEEEISTTNPVATEQYGQCVCSNWEAHNAENFNSDTQA

SEQ ID NO: 193650 - protein, 38 aa, Artificial Sequence
  Description of Artificial Sequence: Synthetic polypeptide
DEACIRTTNPVATEQYGCVCENWGEDPNQEYFGSQNQS

SEQ ID NO: 193651 - protein, 37 aa, Artificial Sequence
  Description of Artificial Sequence: Synthetic polypeptide
VEDEIRATNPVATEQYGTVNNMGFGELDQQRGEGGDT

SEQ ID NO: 193652 - protein, 37 aa, Artificial Sequence
  Description of Artificial Sequence: Synthetic polypeptide
DEDEIRTTNPVATEPWGSVCLIEDRGDRDRNGGGDDI

SEQ ID NO: 193653 - protein, 38 aa, Artificial Sequence
  Description of Artificial Sequence: Synthetic polypeptide
DETEIRTTNPVATESYGSVNDNNNMDQENMTEGEFGQE

SEQ ID NO: 193654 - protein, 38 aa, Artificial Sequence
  Description of Artificial Sequence: Synthetic polypeptide
DEEEISTTNPVATEQYGQCVCSNWGEHNAEYFNSDTQS

SEQ ID NO: 193655 - protein, 34 aa, Artificial Sequence
  Description of Artificial Sequence: Synthetic polypeptide
DETEIRTTNPIATECYGTTCANAEDWAEPKGPYD

SEQ ID NO: 193656 - protein, 37 aa, Artificial Sequence
  Description of Artificial Sequence: Synthetic polypeptide
SQEEIRTTNPVATEQWGCVCSNWEDHNAENFGSDNQA

SEQ ID NO: 193657 - protein, 36 aa, Artificial Sequence
  Description of Artificial Sequence: Synthetic polypeptide
CEEEIATTNPVAYEQYGSCANGPAIGPNHQMGMQMN

SEQ ID NO: 193658 - protein, 37 aa, Artificial Sequence
  Description of Artificial Sequence: Synthetic polypeptide
DEEEISTTNPVATEQYGCVCSNWGEHNAENFISDFQS

SEQ ID NO: 193659 - protein, 37 aa, Artificial Sequence
  Description of Artificial Sequence: Synthetic polypeptide
DEEEISTTNPVATEQYGCVCSNWGEHNAENFISDTQS

SEQ ID NO: 193660 - protein, 37 aa, Artificial Sequence
  Description of Artificial Sequence: Synthetic polypeptide
DEEEIRTTNPVATEAYGTVQVHPSPVHMPNFVDMFEG

SEQ ID NO: 193661 - protein, 39 aa, Artificial Sequence
  Description of Artificial Sequence: Synthetic polypeptide
DEEEIRTTNPVATEAYGTVQTTGNSNVIGTTSISTTNNT

SEQ ID NO: 193662 - protein, 34 aa, Artificial Sequence
  Description of Artificial Sequence: Synthetic polypeptide
DETEIRTTNPIATECWGATTWANADWAEPKGPYR

SEQ ID NO: 193663 - protein, 33 aa, Artificial Sequence
  Description of Artificial Sequence: Synthetic polypeptide
DETEIRTTNPIATECWGATTWANADWANPKGPI

SEQ ID NO: 193664 - protein, 33 aa, Artificial Sequence
  Description of Artificial Sequence: Synthetic polypeptide
DETEIRTTNPIATECWGATTWANADWMEPKGPI

SEQ ID NO: 193665 - protein, 37 aa, Artificial Sequence
  Description of Artificial Sequence: Synthetic polypeptide
DEEEISTTNPVATEQYGCVCSNWGEHNAENFPSETQA

SEQ ID NO: 193666 - protein, 38 aa, Artificial Sequence
  Description of Artificial Sequence: Synthetic polypeptide
DEMEIATTNPVAYEQYGCVCSTWGEGHNEEHFGSENQS

SEQ ID NO: 193667 - protein, 36 aa, Artificial Sequence
  Description of Artificial Sequence: Synthetic polypeptide
DEAEIRTTNPVAYEQWGVVYMNPNPGEQPNDGGQKA

SEQ ID NO: 193668 - protein, 37 aa, Artificial Sequence
  Description of Artificial Sequence: Synthetic polypeptide
DEMEIRCTNPVATEQYGQCICSWGETNQENFGSDTQS

SEQ ID NO: 193669 - protein, 37 aa, Artificial Sequence
  Description of Artificial Sequence: Synthetic polypeptide
DEAEIRTTNPVAYEQWGVVYMSPNPGEQPEDGGQGKT

SEQ ID NO: 193670 - protein, 36 aa, Artificial Sequence
  Description of Artificial Sequence: Synthetic polypeptide
VEDEIATTNPVATEQYGSVCAAMHDPQDSMGGMTVM

SEQ ID NO: 193671 - protein, 39 aa, Artificial Sequence
  Description of Artificial Sequence: Synthetic polypeptide
DEEEIRTTNPVATEAYGTVSTDIGTTEQGSTNQEQQDED

SEQ ID NO: 193672 - protein, 39 aa, Artificial Sequence
  Description of Artificial Sequence: Synthetic polypeptide
DEEEIRTTNPVATEAYGVVSTVTANQAGTEAGSVQTQVD

SEQ ID NO: 193673 - protein, 36 aa, Artificial Sequence
  Description of Artificial Sequence: Synthetic polypeptide
DEAEIRTTNPVAYEQYGCICSNWEHNAENFNSDNQA

SEQ ID NO: 193674 - protein, 37 aa, Artificial Sequence
  Description of Artificial Sequence: Synthetic polypeptide
DEEEISTTNPVATEQYGCVCSNWGEHNIENFISDTQA

SEQ ID NO: 193675 - protein, 34 aa, Artificial Sequence
  Description of Artificial Sequence: Synthetic polypeptide
DETEIRTTNPIATECWGATTWANAEDLAEHKGPI

SEQ ID NO: 193676 - protein, 35 aa, Artificial Sequence
  Description of Artificial Sequence: Synthetic polypeptide
CDEEISTTNPVATEGYGCVCSNSEEHQESFGSDQA

SEQ ID NO: 193677 - protein, 34 aa, Artificial Sequence
  Description of Artificial Sequence: Synthetic polypeptide
DETEIRTTNPIATECWGATTWANAEDLAEPKGPI

SEQ ID NO: 193678 - protein, 35 aa, Artificial Sequence
  Description of Artificial Sequence: Synthetic polypeptide
DETEIRTTNPIATECWGATTWANAEDLAEPKGPRI

SEQ ID NO: 193679 - protein, 35 aa, Artificial Sequence
  Description of Artificial Sequence: Synthetic polypeptide
DETEIRTTNPIATECWGATTWANAEDLAERKGPYI

SEQ ID NO: 193680 - protein, 35 aa, Artificial Sequence
  Description of Artificial Sequence: Synthetic polypeptide
DETEIRTTNPIATECWGATTWANAEDQAEPKGPRI

SEQ ID NO: 193681 - protein, 37 aa, Artificial Sequence
  Description of Artificial Sequence: Synthetic polypeptide
DEEEISTTNPVATEQYGCVCSNWGEHNQENFISDTQA

SEQ ID NO: 193682 - protein, 32 aa, Artificial Sequence
  Description of Artificial Sequence: Synthetic polypeptide
TEEEIATTNPVAYERWGEAYMVEWQHDEGGGI

SEQ ID NO: 193683 - protein, 32 aa, Artificial Sequence
  Description of Artificial Sequence: Synthetic polypeptide
TEEEIATTNPVAYERWGEAYMVEQHHDEGEGM

SEQ ID NO: 193684 - protein, 32 aa, Artificial Sequence
  Description of Artificial Sequence: Synthetic polypeptide
TEEEIATTNPVAYERWGEAYMREQKHDEGEGI

SEQ ID NO: 193685 - protein, 37 aa, Artificial Sequence
  Description of Artificial Sequence: Synthetic polypeptide
DEEEISTTNPVATEQYGCVCSNWGEHNQESFISETQA

SEQ ID NO: 193686 - protein, 38 aa, Artificial Sequence
  Description of Artificial Sequence: Synthetic polypeptide
DEDEIACTNPVATEQWGSVSATWPALGTNQGNGMEPDH

SEQ ID NO: 193687 - protein, 37 aa, Artificial Sequence
  Description of Artificial Sequence: Synthetic polypeptide
DEEEISTTNPVATEQYGCVCSNWGEHNEENFSSETQT

SEQ ID NO: 193688 - protein, 37 aa, Artificial Sequence
  Description of Artificial Sequence: Synthetic polypeptide
DEEEISTTNPVATEQYGCVCSNWGEHFQENFISDTQA

SEQ ID NO: 193689 - protein, 37 aa, Artificial Sequence
  Description of Artificial Sequence: Synthetic polypeptide
DAEEIATTNPVAYEQYGSVCSMANPADEATGGDLSAM

SEQ ID NO: 193690 - protein, 39 aa, Artificial Sequence
  Description of Artificial Sequence: Synthetic polypeptide
DEEEIRTTNPVATEAYGTVSTLIGTTEQGSTNDEQNDED

SEQ ID NO: 193691 - protein, 38 aa, Artificial Sequence
  Description of Artificial Sequence: Synthetic polypeptide
DEEEISTTNPVATEQYGCVCSNWGEDHNIENFGSDTQS

SEQ ID NO: 193692 - protein, 38 aa, Artificial Sequence
  Description of Artificial Sequence: Synthetic polypeptide
DEEEISTTNPVATEQYGCVCSNWGEDHNIENFGSETQD

SEQ ID NO: 193693 - protein, 38 aa, Artificial Sequence
  Description of Artificial Sequence: Synthetic polypeptide
DEEEISTTNPVATEQYGCVCSNWGEDHNIENFNSDTQS

SEQ ID NO: 193694 - protein, 38 aa, Artificial Sequence
  Description of Artificial Sequence: Synthetic polypeptide
DEEEISTTNPVATEQYGCVCSNWGEDHNQEGFISDTQS

SEQ ID NO: 193695 - protein, 38 aa, Artificial Sequence
  Description of Artificial Sequence: Synthetic polypeptide
DEEEISTTNPVATEQYGCVCSNWGEDHNQEHFISDNQS

SEQ ID NO: 193696 - protein, 38 aa, Artificial Sequence
  Description of Artificial Sequence: Synthetic polypeptide
DEEEISTTNPVATEQYGCVCSNWGEDHNQENFGSDTQA

SEQ ID NO: 193697 - protein, 38 aa, Artificial Sequence
  Description of Artificial Sequence: Synthetic polypeptide
DEEEISTTNPVATEQYGCVCSNWGEDHNQENFGSDTQM

SEQ ID NO: 193698 - protein, 38 aa, Artificial Sequence
  Description of Artificial Sequence: Synthetic polypeptide
DEEEISTTNPVATEQYGCVCSNWGEDHNQENFLSETQA

SEQ ID NO: 193699 - protein, 38 aa, Artificial Sequence
  Description of Artificial Sequence: Synthetic polypeptide
DEEEISTTNPVATEQYGCVCSNWGEDHNQENFNSDPQL

SEQ ID NO: 193700 - protein, 38 aa, Artificial Sequence
  Description of Artificial Sequence: Synthetic polypeptide
DEEEISTTNPVATEQYGCVCSNWGEDHNQENFNSDTQG

SEQ ID NO: 193701 - protein, 38 aa, Artificial Sequence
  Description of Artificial Sequence: Synthetic polypeptide
DEEEISTTNPVATEQYGCVCSNWGEDHNQENFNSDTQM

SEQ ID NO: 193702 - protein, 38 aa, Artificial Sequence
  Description of Artificial Sequence: Synthetic polypeptide
DEEEIRTTNPVAYEQYGQCVCSWGEDHNAEGFNSENQA

SEQ ID NO: 193703 - protein, 38 aa, Artificial Sequence
  Description of Artificial Sequence: Synthetic polypeptide
DEEEISTTNPVATEQYGCVCSNWGEDHNQENFNSDTQN

SEQ ID NO: 193704 - protein, 37 aa, Artificial Sequence
  Description of Artificial Sequence: Synthetic polypeptide
DEEEISTTNPVATEQYGCVCSNWGEDHNQENFPSEQP

SEQ ID NO: 193705 - protein, 38 aa, Artificial Sequence
  Description of Artificial Sequence: Synthetic polypeptide
DEEEISTTNPVATEQYGCVCSNWGEDHNQENFQSETQS

SEQ ID NO: 193706 - protein, 38 aa, Artificial Sequence
  Description of Artificial Sequence: Synthetic polypeptide
DEEEISTTNPVATEQYGCVCSNWGEDHNQEYFNSDNQS

SEQ ID NO: 193707 - protein, 38 aa, Artificial Sequence
  Description of Artificial Sequence: Synthetic polypeptide
DEEEISTTNPVATEQYGCVCSNWGEDHNQEYFNSDTQS

SEQ ID NO: 193708 - protein, 37 aa, Artificial Sequence
  Description of Artificial Sequence: Synthetic polypeptide
DEEEISTTNPVATEQYGCVCSNWGEHDTEFFFSDTQS

SEQ ID NO: 193709 - protein, 38 aa, Artificial Sequence
  Description of Artificial Sequence: Synthetic polypeptide
DEEEISTTNPVATEQYGCVCSNWGEEHNQENFNSDTQS

SEQ ID NO: 193710 - protein, 38 aa, Artificial Sequence
  Description of Artificial Sequence: Synthetic polypeptide
DEEEISTTNPVATEQYGCVCSNWGEEHNQENFNSDTQA

SEQ ID NO: 193711 - protein, 37 aa, Artificial Sequence
  Description of Artificial Sequence: Synthetic polypeptide
DEDEIATTNPVATEQYGSACAATNPPEVDDDGMGDFH

SEQ ID NO: 193712 - protein, 32 aa, Artificial Sequence
  Description of Artificial Sequence: Synthetic polypeptide
DETEIRTTNPIATECWGATTWAAEDWAEPGPI

SEQ ID NO: 193713 - protein, 38 aa, Artificial Sequence
  Description of Artificial Sequence: Synthetic polypeptide
DEEEISTTNPVATEQYGCVCSNWGEDPNQENFNSDNQA

SEQ ID NO: 193714 - protein, 39 aa, Artificial Sequence
  Description of Artificial Sequence: Synthetic polypeptide
DEEEIRTTNPVATEAYGTVQTNGNGNVIGTTSISTTQNT

SEQ ID NO: 193715 - protein, 37 aa, Artificial Sequence
  Description of Artificial Sequence: Synthetic polypeptide
CDEEIRTTNPVAYEQYGQCVCSNWGEHEQNFGSDNQS

SEQ ID NO: 193716 - protein, 37 aa, Artificial Sequence
  Description of Artificial Sequence: Synthetic polypeptide
DEEEISTTNPVATEQYGCVCSNWGEDPAENFGSEFQG

SEQ ID NO: 193717 - protein, 36 aa, Artificial Sequence
  Description of Artificial Sequence: Synthetic polypeptide
DAEEIATTNPVAYEQYGSVCSPAGPNDNDMSEIEAE

SEQ ID NO: 193718 - protein, 38 aa, Artificial Sequence
  Description of Artificial Sequence: Synthetic polypeptide
DEEEISTTNPVATEQYGCVCSNWGEDHNTENFNSQTQA

SEQ ID NO: 193719 - protein, 38 aa, Artificial Sequence
  Description of Artificial Sequence: Synthetic polypeptide
DEEEISTTNPVATEQYGCVCSNWGEDHNTENFISQTQS

SEQ ID NO: 193720 - protein, 38 aa, Artificial Sequence
  Description of Artificial Sequence: Synthetic polypeptide
DEEEISTTNPVATEQYGCVCSNWGEDHNTENFISDTQA

SEQ ID NO: 193721 - protein, 38 aa, Artificial Sequence
  Description of Artificial Sequence: Synthetic polypeptide
DEEEISTTNPVATEQYGCVCSNWGEDHNTEGFNSENQA

SEQ ID NO: 193722 - protein, 38 aa, Artificial Sequence
  Description of Artificial Sequence: Synthetic polypeptide
DEEEISTTNPVATEQYGCVCSNWGEDPNAEFFNSETQS

SEQ ID NO: 193723 - protein, 37 aa, Artificial Sequence
  Description of Artificial Sequence: Synthetic polypeptide
DEMEIATTNPVAYEQYGCVCSTWGEHNAEHFISENQS

SEQ ID NO: 193724 - protein, 39 aa, Artificial Sequence
  Description of Artificial Sequence: Synthetic polypeptide
DEEEIRTTNPVATEAYGTVQTNGNADVIGTTSISTTGNT

SEQ ID NO: 193725 - protein, 36 aa, Artificial Sequence
  Description of Artificial Sequence: Synthetic polypeptide
VEDEIATTNPVATEQYGSVCAATMHGEATADGDGAG

SEQ ID NO: 193726 - protein, 36 aa, Artificial Sequence
  Description of Artificial Sequence: Synthetic polypeptide
DEDEIACTNPVATEQWGSIAGANPAPAQEHGDNAAM

SEQ ID NO: 193727 - protein, 33 aa, Artificial Sequence
  Description of Artificial Sequence: Synthetic polypeptide
YEDEIRCTNPAATEQYGVVVYEGGMGPGEGGET

SEQ ID NO: 193728 - protein, 35 aa, Artificial Sequence
  Description of Artificial Sequence: Synthetic polypeptide
YEDEIRGTNCVATEAWGSVSAINGEGGDGEQNEQN

SEQ ID NO: 193729 - protein, 38 aa, Artificial Sequence
  Description of Artificial Sequence: Synthetic polypeptide
VEEEIRTTNPVATEQYGSYSSPSTADEWMSPVGHPPVC

SEQ ID NO: 193730 - protein, 36 aa, Artificial Sequence
  Description of Artificial Sequence: Synthetic polypeptide
YEDEIRGTNPVATEFWGIVSAANGEGQRGQAEDEGD

SEQ ID NO: 193731 - protein, 37 aa, Artificial Sequence
  Description of Artificial Sequence: Synthetic polypeptide
DEEEISTTNPVATEQYGCVCSSGEDDEAENFNSDFQS

SEQ ID NO: 193732 - protein, 37 aa, Artificial Sequence
  Description of Artificial Sequence: Synthetic polypeptide
DEEEISTTNPVATEQYGCVCSSGEDHNQEHFISETQS

SEQ ID NO: 193733 - protein, 35 aa, Artificial Sequence
  Description of Artificial Sequence: Synthetic polypeptide
TEEEIASVNPVCYEPYGVTVSTIKNHSQSNGGNNV

SEQ ID NO: 193734 - protein, 36 aa, Artificial Sequence
  Description of Artificial Sequence: Synthetic polypeptide
TEEEIASVNPVCYEPYGVTVSTIGNLSQSNGGNNVL

SEQ ID NO: 193735 - protein, 35 aa, Artificial Sequence
  Description of Artificial Sequence: Synthetic polypeptide
TEEEIASVNPVCYEPYGVTVSTICLSQSNGGNNVK

SEQ ID NO: 193736 - protein, 35 aa, Artificial Sequence
  Description of Artificial Sequence: Synthetic polypeptide
DETEIRTTNPIATECWGATTWANAEDWAERKGPRI

SEQ ID NO: 193737 - protein, 36 aa, Artificial Sequence
  Description of Artificial Sequence: Synthetic polypeptide
TEEEIASVNPVCYEPYGVTVISTINMLSQSAGGNNV

SEQ ID NO: 193738 - protein, 35 aa, Artificial Sequence
  Description of Artificial Sequence: Synthetic polypeptide
TEEEIASVNPVCYEPYGVTVATINLSQSAGGNNVV

SEQ ID NO: 193739 - protein, 37 aa, Artificial Sequence
  Description of Artificial Sequence: Synthetic polypeptide
DEDEIATTNPVATEQYGSACSATMPGIAEAAPEDGRN

SEQ ID NO: 193740 - protein, 37 aa, Artificial Sequence
  Description of Artificial Sequence: Synthetic polypeptide
DEDEIACTNPVATEQWGSVSATWPAGTNQGNGMEPVN

SEQ ID NO: 193741 - protein, 34 aa, Artificial Sequence
  Description of Artificial Sequence: Synthetic polypeptide
TEEEIASVNPVCYEPWGVTVSTINFSQSMGGNNV

SEQ ID NO: 193742 - protein, 33 aa, Artificial Sequence
  Description of Artificial Sequence: Synthetic polypeptide
DETEIRTTNPIATECWGATTWANAEDWAPGPYI

SEQ ID NO: 193743 - protein, 33 aa, Artificial Sequence
  Description of Artificial Sequence: Synthetic polypeptide
DETEIRTTNPIATECWGATTWANAEDWAPGPYK

SEQ ID NO: 193744 - protein, 36 aa, Artificial Sequence
  Description of Artificial Sequence: Synthetic polypeptide
QEEEIATTNPVATEQYGVVMGGPGEGEGGQGQNEGD

SEQ ID NO: 193745 - protein, 35 aa, Artificial Sequence
  Description of Artificial Sequence: Synthetic polypeptide
DETEIRTTNPIATECWGATTWANAEDWARPKGPRI

SEQ ID NO: 193746 - protein, 40 aa, Artificial Sequence
  Description of Artificial Sequence: Synthetic polypeptide
DEEEIRTTNPVATEAYGSVVVTVTTTQAGTEAGTVTNEEE

SEQ ID NO: 193747 - protein, 40 aa, Artificial Sequence
  Description of Artificial Sequence: Synthetic polypeptide
DEEEIRTTNPVATEAYGSVVVTVTTNQAGTESGTVVNEVE

SEQ ID NO: 193748 - protein, 40 aa, Artificial Sequence
  Description of Artificial Sequence: Synthetic polypeptide
DEEEIRTTNPVATEAYGSVVVTVTTNQAGTEAGTVTNEAN

SEQ ID NO: 193749 - protein, 40 aa, Artificial Sequence
  Description of Artificial Sequence: Synthetic polypeptide
DEEEIRTTNPVATEAYGSVVVTVTTNQAGTEAGTVNQEGE

SEQ ID NO: 193750 - protein, 40 aa, Artificial Sequence
  Description of Artificial Sequence: Synthetic polypeptide
DEEEIRTTNPVATEAYGSVVVTVTTNQAGTEAGTVNNEQS

SEQ ID NO: 193751 - protein, 40 aa, Artificial Sequence
  Description of Artificial Sequence: Synthetic polypeptide
DEEEIRTTNPVATEAYGSVVVTVTTNQAGTEAGTVNNAVE

SEQ ID NO: 193752 - protein, 40 aa, Artificial Sequence
  Description of Artificial Sequence: Synthetic polypeptide
DEEEIRTTNPVATEAYGSVVVTVTTNQAGTEAGTVNAEVD

SEQ ID NO: 193753 - protein, 40 aa, Artificial Sequence
  Description of Artificial Sequence: Synthetic polypeptide
DEEEIRTTNPVATEAYGSVVVSVTTNQAGTEAGTVATEAG

SEQ ID NO: 193754 - protein, 36 aa, Artificial Sequence
  Description of Artificial Sequence: Synthetic polypeptide
YEDEIRTTNPVATEGYGAVVNGFGNGDDTEQTTGIQ

SEQ ID NO: 193755 - protein, 36 aa, Artificial Sequence
  Description of Artificial Sequence: Synthetic polypeptide
DEAEIRTTNPVAYEQYGCICSTWEEHNENFPSDTQA

SEQ ID NO: 193756 - protein, 35 aa, Artificial Sequence
  Description of Artificial Sequence: Synthetic polypeptide
TEEEIASVNPVCYAPYGVTVSTINLSQSNGGNNVM

SEQ ID NO: 193757 - protein, 38 aa, Artificial Sequence
  Description of Artificial Sequence: Synthetic polypeptide
TEEEIATTNPCCAYEQYGVCVSTANMIPQDRTVTDNFF

SEQ ID NO: 193758 - protein, 38 aa, Artificial Sequence
  Description of Artificial Sequence: Synthetic polypeptide
TEEEIATTNPCCCAYEQYGVSVSTANMIPQDTVTDNFF

SEQ ID NO: 193759 - protein, 37 aa, Artificial Sequence
  Description of Artificial Sequence: Synthetic polypeptide
AEEEIRTTNPVATEEYGCSCSNWEDHNQENFGSDTQA

SEQ ID NO: 193760 - protein, 38 aa, Artificial Sequence
  Description of Artificial Sequence: Synthetic polypeptide
DEEEISTTNPVATEQYGCVCSNWGELHNAENFNSDFQP

SEQ ID NO: 193761 - protein, 38 aa, Artificial Sequence
  Description of Artificial Sequence: Synthetic polypeptide
DEEEISTTNPVATEQYGCVCSNWGELHNAENFNSDNQM

SEQ ID NO: 193762 - protein, 39 aa, Artificial Sequence
  Description of Artificial Sequence: Synthetic polypeptide
DEEEIRTTNPVATEAYGTVQQNGNSDEIGTTSIGTTGNT

SEQ ID NO: 193763 - protein, 36 aa, Artificial Sequence
  Description of Artificial Sequence: Synthetic polypeptide
VEDEIATTNPVATEQYGSVCAATMHGEATGDGDDQG

SEQ ID NO: 193764 - protein, 38 aa, Artificial Sequence
  Description of Artificial Sequence: Synthetic polypeptide
DEEEISTTNPVATEQYGCVCSNWGELHNEENFNSDTQA

SEQ ID NO: 193765 - protein, 38 aa, Artificial Sequence
  Description of Artificial Sequence: Synthetic polypeptide
DEEEISTTNPVATEQYGCVCSNWGELHNTENFNSDTQQ

SEQ ID NO: 193766 - protein, 38 aa, Artificial Sequence
  Description of Artificial Sequence: Synthetic polypeptide
DEEEISTTNPVATEQYGCVCSNWGELHNTENFNSQTQS

SEQ ID NO: 193767 - protein, 39 aa, Artificial Sequence
  Description of Artificial Sequence: Synthetic polypeptide
DEEEIRTTNPVATEAYGTVQNNGNNNVISTTSISTTGNT

SEQ ID NO: 193768 - protein, 39 aa, Artificial Sequence
  Description of Artificial Sequence: Synthetic polypeptide
DEEEIRTTNPVATEAYGTVNTTGNGNVIGTTSISTTGNT

SEQ ID NO: 193769 - protein, 34 aa, Artificial Sequence
  Description of Artificial Sequence: Synthetic polypeptide
DETEIRTTNPIATECWGATTWANAEDWAEPKGND

SEQ ID NO: 193770 - protein, 38 aa, Artificial Sequence
  Description of Artificial Sequence: Synthetic polypeptide
DEEEISTTNPVATEQYGCVCSNWGPDHNAENFNSDTQA

SEQ ID NO: 193771 - protein, 38 aa, Artificial Sequence
  Description of Artificial Sequence: Synthetic polypeptide
DEEEISTTNPVATEQYGCVCSNWGPDHNTENFNSDTQL

SEQ ID NO: 193772 - protein, 39 aa, Artificial Sequence
  Description of Artificial Sequence: Synthetic polypeptide
DEEEIRTTNPVATEAYGTVNTNGNSDEIGTTISTTGNDT

SEQ ID NO: 193773 - protein, 40 aa, Artificial Sequence
  Description of Artificial Sequence: Synthetic polypeptide
DEEEIRTTNPVATEAYGTVNQQYGNNDEISTTSIQTTGNT

SEQ ID NO: 193774 - protein, 39 aa, Artificial Sequence
  Description of Artificial Sequence: Synthetic polypeptide
DEEEIRTTNPVATEAYGTVNEYGNNNVISTTSISTTGNT

SEQ ID NO: 193775 - protein, 38 aa, Artificial Sequence
  Description of Artificial Sequence: Synthetic polypeptide
DEEEISTTNPVATEQYGCVCSNWMEDHNAENFNSDNQA

SEQ ID NO: 193776 - protein, 38 aa, Artificial Sequence
  Description of Artificial Sequence: Synthetic polypeptide
DEEEISTTNPVATEQYGCVCSNWMEDHNEENFGSDTQS

SEQ ID NO: 193777 - protein, 35 aa, Artificial Sequence
  Description of Artificial Sequence: Synthetic polypeptide
TEEEIATTNPVATEQYGCYCPWMEDNQEHFNSEQS

SEQ ID NO: 193778 - protein, 38 aa, Artificial Sequence
  Description of Artificial Sequence: Synthetic polypeptide
DEEEISTTNPVATEQYGCVCSNWPEDPNIENFNSENQA

SEQ ID NO: 193779 - protein, 38 aa, Artificial Sequence
  Description of Artificial Sequence: Synthetic polypeptide
DEEEISTTNPVATEQYGCVCSNWNEDHNAENFGSETQS

SEQ ID NO: 193780 - protein, 39 aa, Artificial Sequence
  Description of Artificial Sequence: Synthetic polypeptide
DEEEIRTTNPVATEAYGTVATEAGNADIGTTSISTTGNT

SEQ ID NO: 193781 - protein, 38 aa, Artificial Sequence
  Description of Artificial Sequence: Synthetic polypeptide
DAEEIATTNPVATEQYGSVCAMNNNDLTPADGSDGGDP

SEQ ID NO: 193782 - protein, 39 aa, Artificial Sequence
  Description of Artificial Sequence: Synthetic polypeptide
DEEEIRTTNPVATEAYGTVATENGNSEIGTTSISTTGNT

SEQ ID NO: 193783 - protein, 39 aa, Artificial Sequence
  Description of Artificial Sequence: Synthetic polypeptide
DEEEIRTTNPVATEAYGTVQTIGNVNVIGTTSISTTGNT

SEQ ID NO: 193784 - protein, 39 aa, Artificial Sequence
  Description of Artificial Sequence: Synthetic polypeptide
DEEEIRTTNPVATEAYGTVATNGNSDEIGTTTISTTGNT

SEQ ID NO: 193785 - protein, 37 aa, Artificial Sequence
  Description of Artificial Sequence: Synthetic polypeptide
VEDEIATTNPVATEQYGSVCAMNNGNLEPTRDVPDTA

SEQ ID NO: 193786 - protein, 37 aa, Artificial Sequence
  Description of Artificial Sequence: Synthetic polypeptide
VEDEIATTNPVATEQYGSVCAGMTHGGAEAPIGDNNE

SEQ ID NO: 193787 - protein, 40 aa, Artificial Sequence
  Description of Artificial Sequence: Synthetic polypeptide
DEEEIRTTNPVATEAYGTVATVNGNSDQIGTTSISTTGNT

SEQ ID NO: 193788 - protein, 34 aa, Artificial Sequence
  Description of Artificial Sequence: Synthetic polypeptide
DETEIRTTNPIATECWGATTWANAEDWAEPKGPR

SEQ ID NO: 193789 - protein, 38 aa, Artificial Sequence
  Description of Artificial Sequence: Synthetic polypeptide
DEEEISTTNPVATEQYGCVCSNWMEDHNTENFNSDTQS

SEQ ID NO: 193790 - protein, 38 aa, Artificial Sequence
  Description of Artificial Sequence: Synthetic polypeptide
DEEEISTTNPVATEQYGCVCSNWMEDHNQENFISENQS

SEQ ID NO: 193791 - protein, 39 aa, Artificial Sequence
  Description of Artificial Sequence: Synthetic polypeptide
DEEEIRTTNPVATEAYGTVATNGNSDEISTTTISTTGNT

SEQ ID NO: 193792 - protein, 35 aa, Artificial Sequence
  Description of Artificial Sequence: Synthetic polypeptide
DEAEIRTTNPVAYEQYGCICSWEEHNENFPSETQS

SEQ ID NO: 193793 - protein, 38 aa, Artificial Sequence
  Description of Artificial Sequence: Synthetic polypeptide
DEEEISTTNPVATEQYGCVCSNWGEDHNIENFGSDTQA

SEQ ID NO: 193794 - protein, 34 aa, Artificial Sequence
  Description of Artificial Sequence: Synthetic polypeptide
DDSEVASTNPVSTEGYGNVAANDTGIQSRGGDQR

SEQ ID NO: 193795 - protein, 33 aa, Artificial Sequence
  Description of Artificial Sequence: Synthetic polypeptide
VEDEIATTNPVATEQWGGCVAGAGGLINNMAMN

SEQ ID NO: 193796 - protein, 38 aa, Artificial Sequence
  Description of Artificial Sequence: Synthetic polypeptide
AEEEIRTTNPCATEQYGVVVTVVNQQQNATEAGTTDTN

SEQ ID NO: 193797 - protein, 37 aa, Artificial Sequence
  Description of Artificial Sequence: Synthetic polypeptide
AEEEIRTTNPCATEQYGVVVTVVTTNNATEAGTTDED

SEQ ID NO: 193798 - protein, 33 aa, Artificial Sequence
  Description of Artificial Sequence: Synthetic polypeptide
DETEIRTTNPIATECWGAIWSNAEDWAEPKGPI

SEQ ID NO: 193799 - protein, 37 aa, Artificial Sequence
  Description of Artificial Sequence: Synthetic polypeptide
DEMEIATTNPVAYEQYGTVCSYTDGLPEESHDGKGDS

SEQ ID NO: 193800 - protein, 32 aa, Artificial Sequence
  Description of Artificial Sequence: Synthetic polypeptide
DETEIRTTNPIATECWGATAAEDWMEPKGPYI

SEQ ID NO: 193801 - protein, 32 aa, Artificial Sequence
  Description of Artificial Sequence: Synthetic polypeptide
DETEIRTTNPIATECWGATAAEIWMEPKGPYA

SEQ ID NO: 193802 - protein, 35 aa, Artificial Sequence
  Description of Artificial Sequence: Synthetic polypeptide
VEDEIATTNPVATEQWGSTTAGNGLPAEAENNMDD

SEQ ID NO: 193803 - protein, 34 aa, Artificial Sequence
  Description of Artificial Sequence: Synthetic polypeptide
DETEIRTTNPIATECWGATANAENEADRKGEPYG

SEQ ID NO: 193804 - protein, 38 aa, Artificial Sequence
  Description of Artificial Sequence: Synthetic polypeptide
DEEEISTTNPVATEQYGCVCSNWEEDDNQENFNSDNQD

SEQ ID NO: 193805 - protein, 38 aa, Artificial Sequence
  Description of Artificial Sequence: Synthetic polypeptide
DEEEISTTNPVATEQYGCVCSNWEEDHNAEHFFSENQA

SEQ ID NO: 193806 - protein, 38 aa, Artificial Sequence
  Description of Artificial Sequence: Synthetic polypeptide
DEEEISTTNPVATEQYGCVCSNWEEDHNAEYFNSDNQS

SEQ ID NO: 193807 - protein, 38 aa, Artificial Sequence
  Description of Artificial Sequence: Synthetic polypeptide
DEEEISTTNPVATEQYGCVCSNWEEDHNAEYFNSDTQS

SEQ ID NO: 193808 - protein, 38 aa, Artificial Sequence
  Description of Artificial Sequence: Synthetic polypeptide
DEEEISTTNPVATEQYGCVCSNWEEDHNIEYFNSDTQS

SEQ ID NO: 193809 - protein, 38 aa, Artificial Sequence
  Description of Artificial Sequence: Synthetic polypeptide
CDEEIRTTNPVATEQYGCVCSTWGPDHNEENFNSDNQS

SEQ ID NO: 193810 - protein, 38 aa, Artificial Sequence
  Description of Artificial Sequence: Synthetic polypeptide
DEEEISTTNPVATEQYGCVCSNWEEDHNQEGFISDPQS

SEQ ID NO: 193811 - protein, 38 aa, Artificial Sequence
  Description of Artificial Sequence: Synthetic polypeptide
DEEEISTTNPVATEQYGCVCSNWEEDHNQEHFNSDTQP

SEQ ID NO: 193812 - protein, 38 aa, Artificial Sequence
  Description of Artificial Sequence: Synthetic polypeptide
DEEEISTTNPVATEQYGCVCSNWEEDHNQENFLSDTQS

SEQ ID NO: 193813 - protein, 38 aa, Artificial Sequence
  Description of Artificial Sequence: Synthetic polypeptide
DEEEISTTNPVATEQYGCVCSNWEEDHNQENFPSQNQA

SEQ ID NO: 193814 - protein, 38 aa, Artificial Sequence
  Description of Artificial Sequence: Synthetic polypeptide
DEEEISTTNPVATEQYGCVCSNWEEDHNQEYFNSDTQQ

SEQ ID NO: 193815 - protein, 33 aa, Artificial Sequence
  Description of Artificial Sequence: Synthetic polypeptide
DETEIRTTNPIATECWGATCANADDPAFKGPYD

SEQ ID NO: 193816 - protein, 33 aa, Artificial Sequence
  Description of Artificial Sequence: Synthetic polypeptide
DETEIRTTNPIATECWGATCANADDPAFKGPYI

SEQ ID NO: 193817 - protein, 33 aa, Artificial Sequence
  Description of Artificial Sequence: Synthetic polypeptide
DETEIRTTNPIATECWGATCANADDWAFKGPYI

SEQ ID NO: 193818 - protein, 38 aa, Artificial Sequence
  Description of Artificial Sequence: Synthetic polypeptide
DEEEISTTNPVATEQYGCVCSNWEEDHNTENFGSDTQQ

SEQ ID NO: 193819 - protein, 33 aa, Artificial Sequence
  Description of Artificial Sequence: Synthetic polypeptide
DETEIRTTNPIATECWGATCSNADDPAFKGPYD

SEQ ID NO: 193820 - protein, 37 aa, Artificial Sequence
  Description of Artificial Sequence: Synthetic polypeptide
DEEEISTTNPVATEQYGCVCSNWEEDHNTHFNSDTQS

SEQ ID NO: 193821 - protein, 33 aa, Artificial Sequence
  Description of Artificial Sequence: Synthetic polypeptide
DETEIRTTNPIATECWGATCSNADDPEFKGPYD

SEQ ID NO: 193822 - protein, 36 aa, Artificial Sequence
  Description of Artificial Sequence: Synthetic polypeptide
DCEEIRATNPVAYEQWGSSYYRTPEHMARRNGHGNM

SEQ ID NO: 193823 - protein, 33 aa, Artificial Sequence
  Description of Artificial Sequence: Synthetic polypeptide
DETEIRTTNPIATECWGATMWANAEDWAEPGPI

SEQ ID NO: 193824 - protein, 37 aa, Artificial Sequence
  Description of Artificial Sequence: Synthetic polypeptide
DEEEISTTNPVATEQYGCVCSNWEEHNQENFISQTQA

SEQ ID NO: 193825 - protein, 38 aa, Artificial Sequence
  Description of Artificial Sequence: Synthetic polypeptide
DEEEISTTNPVATEQYGCVCSNWEEDHNQEHFISQNQS

SEQ ID NO: 193826 - protein, 38 aa, Artificial Sequence
  Description of Artificial Sequence: Synthetic polypeptide
AEEEIRTTNPCATEQYGVVTVVVTTNNATEAYGTNVTD

SEQ ID NO: 193827 - protein, 38 aa, Artificial Sequence
  Description of Artificial Sequence: Synthetic polypeptide
AEEEIRTTNPCATEQYGVVSTVVVVTNVATEAGVTDTQ

SEQ ID NO: 193828 - protein, 37 aa, Artificial Sequence
  Description of Artificial Sequence: Synthetic polypeptide
CDEEIRTTNPVATEQYGCVCSNWGEHNEENFNSDNQE

SEQ ID NO: 193829 - protein, 38 aa, Artificial Sequence
  Description of Artificial Sequence: Synthetic polypeptide
TEEEIRTTNPVATEQYGDVGVNNVDTPGQLGEDGQGQL

SEQ ID NO: 193830 - protein, 38 aa, Artificial Sequence
  Description of Artificial Sequence: Synthetic polypeptide
AEEEIRTTNPCATEQYGVVSTVVTQQQNATEAGTTDQP

SEQ ID NO: 193831 - protein, 38 aa, Artificial Sequence
  Description of Artificial Sequence: Synthetic polypeptide
AEEEIRTTNPCATEQYGVVSTVVTTQQNATEQGTTDQQ

SEQ ID NO: 193832 - protein, 38 aa, Artificial Sequence
  Description of Artificial Sequence: Synthetic polypeptide
AEEEIRTTNPCATEQYGVVSTVVVTQQNATEAGTTDTQ

SEQ ID NO: 193833 - protein, 35 aa, Artificial Sequence
  Description of Artificial Sequence: Synthetic polypeptide
DETEIRTTNPCAYEQWGIVCGDNPNDQQGQGGGKD

SEQ ID NO: 193834 - protein, 38 aa, Artificial Sequence
  Description of Artificial Sequence: Synthetic polypeptide
AEEEIRTTNPCATEQYGVVSTVVVTQQNATEAGTTTQE

SEQ ID NO: 193835 - protein, 36 aa, Artificial Sequence
  Description of Artificial Sequence: Synthetic polypeptide
DETEIRTTNPCAYEQWGSVCGDNHNDQPQGQQMGDD

SEQ ID NO: 193836 - protein, 38 aa, Artificial Sequence
  Description of Artificial Sequence: Synthetic polypeptide
AEEEIRTTNPCATEQYGVVSTVVVTQQNATEEGTTDQG

SEQ ID NO: 193837 - protein, 38 aa, Artificial Sequence
  Description of Artificial Sequence: Synthetic polypeptide
AEEEIRTTNPCATEQYGVVSTVVVTQQNGTEAGTTDEP

SEQ ID NO: 193838 - protein, 37 aa, Artificial Sequence
  Description of Artificial Sequence: Synthetic polypeptide
CDEEIRTTNPVATEQYGCVCSNWEEHNAEHFNSENQA

SEQ ID NO: 193839 - protein, 39 aa, Artificial Sequence
  Description of Artificial Sequence: Synthetic polypeptide
AEEEIRTTNPCATEQYGVVSTVVVTTNNATEAGNTNDTD

SEQ ID NO: 193840 - protein, 34 aa, Artificial Sequence
  Description of Artificial Sequence: Synthetic polypeptide
DCEEIRATNPVAYEQWGSSYYDEHMHQREQQKQV

SEQ ID NO: 193841 - protein, 38 aa, Artificial Sequence
  Description of Artificial Sequence: Synthetic polypeptide
DEMEIRTTNPVATEQYGQCVCSNWGEHNAENFNSENQS

SEQ ID NO: 193842 - protein, 38 aa, Artificial Sequence
  Description of Artificial Sequence: Synthetic polypeptide
DEMEIRTTNPVATEQYGQCVCSTWGADNAEYFISDPQS

SEQ ID NO: 193843 - protein, 36 aa, Artificial Sequence
  Description of Artificial Sequence: Synthetic polypeptide
DETEIRTTNPCAYEQWGSVCGDNNNDMQQGQGGGLD

SEQ ID NO: 193844 - protein, 37 aa, Artificial Sequence
  Description of Artificial Sequence: Synthetic polypeptide
CDEEIRTTNPVATEQYGCVCSNWEPHNEENFNSDTQS

SEQ ID NO: 193845 - protein, 36 aa, Artificial Sequence
  Description of Artificial Sequence: Synthetic polypeptide
DETEIRTTNPCAYEQWGSVCGDNNNDQHQGQEGGDM

SEQ ID NO: 193846 - protein, 39 aa, Artificial Sequence
  Description of Artificial Sequence: Synthetic polypeptide
AEEEIRTTNPCATEQYGVVSTVVVTTNVATEAYGVNDDD

SEQ ID NO: 193847 - protein, 38 aa, Artificial Sequence
  Description of Artificial Sequence: Synthetic polypeptide
DEDEIACTNPVATEQYGSVSSMTPAGGTNQGNGMEPVN

SEQ ID NO: 193848 - protein, 37 aa, Artificial Sequence
  Description of Artificial Sequence: Synthetic polypeptide
DEMEIATTNPVAYEQYGTVCSYTDGLPEGHEGDDGDQ

SEQ ID NO: 193849 - protein, 37 aa, Artificial Sequence
  Description of Artificial Sequence: Synthetic polypeptide
DEAEIATTNPVATEQYGSVCAAMAHEEAGMPPDNTNH

SEQ ID NO: 193850 - protein, 37 aa, Artificial Sequence
  Description of Artificial Sequence: Synthetic polypeptide
CDEEIRTTNPVATEQYGCVCSNWGEHNAENFNSDTQS

SEQ ID NO: 193851 - protein, 38 aa, Artificial Sequence
  Description of Artificial Sequence: Synthetic polypeptide
DEAAIRTTNPVATEQYGCVCSNWGEDHNTENFNSDNQS

SEQ ID NO: 193852 - protein, 35 aa, Artificial Sequence
  Description of Artificial Sequence: Synthetic polypeptide
DETEIRTTNPIATECWGATSATAEAGPNEPKGPPV

SEQ ID NO: 193853 - protein, 36 aa, Artificial Sequence
  Description of Artificial Sequence: Synthetic polypeptide
DETEIRTTNPCAYEQWGSVCGDNQNDQAQGQGGGDD

SEQ ID NO: 193854 - protein, 37 aa, Artificial Sequence
  Description of Artificial Sequence: Synthetic polypeptide
CDEEIRTTNPVATEQYGCVCSNWGEHNAENFNSDNQA

SEQ ID NO: 193855 - protein, 38 aa, Artificial Sequence
  Description of Artificial Sequence: Synthetic polypeptide
DEMEIRTTNPVATEQYGSCMCCVFASPENEPMNTQDEG

SEQ ID NO: 193856 - protein, 37 aa, Artificial Sequence
  Description of Artificial Sequence: Synthetic polypeptide
DEMEIRTTNPVATEQYGSANWEANPDDDGGSGQEEIG

SEQ ID NO: 193857 - protein, 35 aa, Artificial Sequence
  Description of Artificial Sequence: Synthetic polypeptide
DCEEIRATNPVAYEQWGSSYYMDEHMHQREGQIDV

SEQ ID NO: 193858 - protein, 35 aa, Artificial Sequence
  Description of Artificial Sequence: Synthetic polypeptide
VEDEIATTNPVATEQWGGCNVAGTGGLINNMAMNN

SEQ ID NO: 193859 - protein, 36 aa, Artificial Sequence
  Description of Artificial Sequence: Synthetic polypeptide
DETEIRTTNPCAYEQWGSVCGDNNNDQHQGQGGGPD

SEQ ID NO: 193860 - protein, 38 aa, Artificial Sequence
  Description of Artificial Sequence: Synthetic polypeptide
DEMEIRTTNPVATEQYGSCMMCVFAMPENEMNTQDHEG

SEQ ID NO: 193861 - protein, 38 aa, Artificial Sequence
  Description of Artificial Sequence: Synthetic polypeptide
DEEEISTTNPVATEQYGCVCSNWGEDHNIEHFNSDTQA

SEQ ID NO: 193862 - protein, 35 aa, Artificial Sequence
  Description of Artificial Sequence: Synthetic polypeptide
DETEIRTTNPIATECWGATSATAEAGPNMPKGPPV

SEQ ID NO: 193863 - protein, 38 aa, Artificial Sequence
  Description of Artificial Sequence: Synthetic polypeptide
DEEEISTTNPVATEQYGCVCSNWEEPHNTENFNSQTQS

SEQ ID NO: 193864 - protein, 37 aa, Artificial Sequence
  Description of Artificial Sequence: Synthetic polypeptide
DEMEIATTNPVAYEQYGTVCSYTDGLPEDHEGHDGDS

SEQ ID NO: 193865 - protein, 38 aa, Artificial Sequence
  Description of Artificial Sequence: Synthetic polypeptide
DEEEISTTNPVATEQYGCVCSNWGEDHNAEFFNSDPQN

SEQ ID NO: 193866 - protein, 38 aa, Artificial Sequence
  Description of Artificial Sequence: Synthetic polypeptide
DEEEISTTNPVATEQYGCVCSNWGEDHNAEFFNSDTQS

SEQ ID NO: 193867 - protein, 38 aa, Artificial Sequence
  Description of Artificial Sequence: Synthetic polypeptide
DEEEISTTNPVATEQYGCVCSNWGEDHNAEGFISDNQS

SEQ ID NO: 193868 - protein, 38 aa, Artificial Sequence
  Description of Artificial Sequence: Synthetic polypeptide
DEEEISTTNPVATEQYGCVCSNWGEDHNAEGFNSENQG

SEQ ID NO: 193869 - protein, 38 aa, Artificial Sequence
  Description of Artificial Sequence: Synthetic polypeptide
DEEEISTTNPVATEQYGCVCSNWGEDHNAEHFNSDNQA

SEQ ID NO: 193870 - protein, 38 aa, Artificial Sequence
  Description of Artificial Sequence: Synthetic polypeptide
DEEEISTTNPVATEQYGCVCSNWGEDHNAEHFNSDPQA

SEQ ID NO: 193871 - protein, 38 aa, Artificial Sequence
  Description of Artificial Sequence: Synthetic polypeptide
CDEEIRTTNPVATEQYGQCVCSNWGEHNQENFGSDNQE

SEQ ID NO: 193872 - protein, 37 aa, Artificial Sequence
  Description of Artificial Sequence: Synthetic polypeptide
DDVCIATTNPVATEGYGSVPFTQNEGSQDSTGGNNEM

SEQ ID NO: 193873 - protein, 37 aa, Artificial Sequence
  Description of Artificial Sequence: Synthetic polypeptide
DEAEIRTTNPVAYEQWGVVCYTQDNDDQLTGGGGTGE

SEQ ID NO: 193874 - protein, 38 aa, Artificial Sequence
  Description of Artificial Sequence: Synthetic polypeptide
DEEEISTTNPVATEQYGCVCSNWGEDHNAENFGSDTQL

SEQ ID NO: 193875 - protein, 38 aa, Artificial Sequence
  Description of Artificial Sequence: Synthetic polypeptide
DEEEISTTNPVATEQYGCVCSNWGEDHNAENFGSDTQS

SEQ ID NO: 193876 - protein, 38 aa, Artificial Sequence
  Description of Artificial Sequence: Synthetic polypeptide
DEEEISTTNPVATEQYGCVCSNWGEDHNAENFGSETQS

SEQ ID NO: 193877 - protein, 38 aa, Artificial Sequence
  Description of Artificial Sequence: Synthetic polypeptide
DEEEISTTNPVATEQYGCVCSNWGEDHNAENFISDNQA

SEQ ID NO: 193878 - protein, 38 aa, Artificial Sequence
  Description of Artificial Sequence: Synthetic polypeptide
DEEEISTTNPVATEQYGCVCSNWGEDDNQENFNSDTQS

SEQ ID NO: 193879 - protein, 38 aa, Artificial Sequence
  Description of Artificial Sequence: Synthetic polypeptide
DEEEISTTNPVATEQYGCVCSNWGEDHNAENFISDNQN

SEQ ID NO: 193880 - protein, 38 aa, Artificial Sequence
  Description of Artificial Sequence: Synthetic polypeptide
DEEEISTTNPVATEQYGCVCSNWGEDHNAENFNSDTQA

SEQ ID NO: 193881 - protein, 38 aa, Artificial Sequence
  Description of Artificial Sequence: Synthetic polypeptide
DEEEISTTNPVATEQYGCVCSNWGEDHNAENFNSDTQG

SEQ ID NO: 193882 - protein, 38 aa, Artificial Sequence
  Description of Artificial Sequence: Synthetic polypeptide
DEEEISTTNPVATEQYGCVCSNWGEDHNAENFNSDTQL

SEQ ID NO: 193883 - protein, 38 aa, Artificial Sequence
  Description of Artificial Sequence: Synthetic polypeptide
DEEEISTTNPVATEQYGCVCSNWGEDHNAENFNSDTQS

SEQ ID NO: 193884 - protein, 38 aa, Artificial Sequence
  Description of Artificial Sequence: Synthetic polypeptide
DEEEISTTNPVATEQYGCVCSNWGEDHNAENSISENQT

SEQ ID NO: 193885 - protein, 38 aa, Artificial Sequence
  Description of Artificial Sequence: Synthetic polypeptide
DEEEISTTNPVATEQYGCVCSNWGEDHNAESFISENQA

SEQ ID NO: 193886 - protein, 37 aa, Artificial Sequence
  Description of Artificial Sequence: Synthetic polypeptide
CDEEIRTTNPVATEQYGQCVCSNWPHNEENFNSDTQE

SEQ ID NO: 193887 - protein, 38 aa, Artificial Sequence
  Description of Artificial Sequence: Synthetic polypeptide
DEEEISTTNPVATEQYGCVCSNWGEDHNAEYFNSDNQA

SEQ ID NO: 193888 - protein, 35 aa, Artificial Sequence
  Description of Artificial Sequence: Synthetic polypeptide
VEDEIATTNPVATEQYGCVAANPHDDADSGADGHE

SEQ ID NO: 193889 - protein, 38 aa, Artificial Sequence
  Description of Artificial Sequence: Synthetic polypeptide
DEEEISTTNPVATEQYGCVCSNWGEDHNAEYFNSDNQD

SEQ ID NO: 193890 - protein, 38 aa, Artificial Sequence
  Description of Artificial Sequence: Synthetic polypeptide
DEEEISTTNPVATEQYGCVCSNWGEDHNAEYFNSDNQS

SEQ ID NO: 193891 - protein, 36 aa, Artificial Sequence
  Description of Artificial Sequence: Synthetic polypeptide
CEEEIATTNPVAYEQYGSCSAGPAPGWNHPMGMQMN

SEQ ID NO: 193892 - protein, 38 aa, Artificial Sequence
  Description of Artificial Sequence: Synthetic polypeptide
DEEEISTTNPVATEQYGCVCSNWGEDHNEEGFLSDNQA

SEQ ID NO: 193893 - protein, 38 aa, Artificial Sequence
  Description of Artificial Sequence: Synthetic polypeptide
DEEEISTTNPVATEQYGCVCSNWGEDHNEEYFNSDTQP

SEQ ID NO: 193894 - protein, 38 aa, Artificial Sequence
  Description of Artificial Sequence: Synthetic polypeptide
DEEEISTTNPVATEQYGCVCSNWGEDHNAENFISDNQS

SEQ ID NO: 193895 - protein, 38 aa, Artificial Sequence
  Description of Artificial Sequence: Synthetic polypeptide
DEEEISTTNPVATEQYGCVCSNWGEDDNQENFNSDTQA

SEQ ID NO: 193896 - protein, 38 aa, Artificial Sequence
  Description of Artificial Sequence: Synthetic polypeptide
DEEEISTTNPVATEQYGCVCSNWGEDDNQENFGSETQS

SEQ ID NO: 193897 - protein, 38 aa, Artificial Sequence
  Description of Artificial Sequence: Synthetic polypeptide
DEEEISTTNPVATEQYGCVCSNWGEDDNQEHFNSENQA

SEQ ID NO: 193898 - protein, 38 aa, Artificial Sequence
  Description of Artificial Sequence: Synthetic polypeptide
DEDEIACTNPVATEQYGSVCSAANNPTPEAHGGDNEAM

SEQ ID NO: 193899 - protein, 33 aa, Artificial Sequence
  Description of Artificial Sequence: Synthetic polypeptide
DETEIRTTNPIATECWGATTAAEDIAEQKGPYI

SEQ ID NO: 193900 - protein, 36 aa, Artificial Sequence
  Description of Artificial Sequence: Synthetic polypeptide
DEAEIRTTNPVAYEQWGVCCTENENDQNLEERTDEN

SEQ ID NO: 193901 - protein, 33 aa, Artificial Sequence
  Description of Artificial Sequence: Synthetic polypeptide
DETEIRTTNPIATECWGATTAMEDIAEQKGPYI

SEQ ID NO: 193902 - protein, 33 aa, Artificial Sequence
  Description of Artificial Sequence: Synthetic polypeptide
DETEIRTTNPIATECWGATTAMEDIQEQKGPYH

SEQ ID NO: 193903 - protein, 33 aa, Artificial Sequence
  Description of Artificial Sequence: Synthetic polypeptide
DETEIRTTNPIATECWGATTAMEDIQEQKGPYI

SEQ ID NO: 193904 - protein, 33 aa, Artificial Sequence
  Description of Artificial Sequence: Synthetic polypeptide
DETEIRTTNPIATECWGATTANADWAEPKGGYI

SEQ ID NO: 193905 - protein, 37 aa, Artificial Sequence
  Description of Artificial Sequence: Synthetic polypeptide
DEMEIRTTNPVATCQYGCVCSWGELHNEENFGSDTQS

SEQ ID NO: 193906 - protein, 36 aa, Artificial Sequence
  Description of Artificial Sequence: Synthetic polypeptide
DCEEIRATNPVAYEQWGSSYYRTPEVHNRQGMTNDQ

SEQ ID NO: 193907 - protein, 34 aa, Artificial Sequence
  Description of Artificial Sequence: Synthetic polypeptide
DETEIRTTNPIATECWGATTANAEDLAEPKGPYI

SEQ ID NO: 193908 - protein, 34 aa, Artificial Sequence
  Description of Artificial Sequence: Synthetic polypeptide
VEDEIATTNPVATEQWGTNCAANDGDVEDEGGND

SEQ ID NO: 193909 - protein, 34 aa, Artificial Sequence
  Description of Artificial Sequence: Synthetic polypeptide
DETEIRTTNPIATECWGATTANAEDWAEPKGNYI

SEQ ID NO: 193910 - protein, 34 aa, Artificial Sequence
  Description of Artificial Sequence: Synthetic polypeptide
DETEIRTTNPIATECWGATTANAEDWAEQKGPYI

SEQ ID NO: 193911 - protein, 33 aa, Artificial Sequence
  Description of Artificial Sequence: Synthetic polypeptide
DETEIRTTNPIATECWGATTANAEDWAHKGPYI

SEQ ID NO: 193912 - protein, 33 aa, Artificial Sequence
  Description of Artificial Sequence: Synthetic polypeptide
DETEIRTTNPIATECWGATTANAEDWAPKGPYI

SEQ ID NO: 193913 - protein, 33 aa, Artificial Sequence
  Description of Artificial Sequence: Synthetic polypeptide
DETEIRTTNPIATECWGATTANAEDWAPKGPYK

SEQ ID NO: 193914 - protein, 34 aa, Artificial Sequence
  Description of Artificial Sequence: Synthetic polypeptide
DETEIRTTNPIATECWGATTANAEDWMEPKGNYI

SEQ ID NO: 193915 - protein, 38 aa, Artificial Sequence
  Description of Artificial Sequence: Synthetic polypeptide
DEEEISTTNPVATEQYGCVCSNWGEDDNIENFNSDNQD

SEQ ID NO: 193916 - protein, 38 aa, Artificial Sequence
  Description of Artificial Sequence: Synthetic polypeptide
DEEEISTTNPVATEQYGCVCSNWGEDDNEEHFNSENQA

SEQ ID NO: 193917 - protein, 38 aa, Artificial Sequence
  Description of Artificial Sequence: Synthetic polypeptide
DEEEISTTNPVATEQYGCVCSNWGEDDNAENFSSDNQA

SEQ ID NO: 193918 - protein, 38 aa, Artificial Sequence
  Description of Artificial Sequence: Synthetic polypeptide
DEEEISTTNPVATEQYGCVCSNWGEDDNAENFNSETQA

SEQ ID NO: 193919 - protein, 38 aa, Artificial Sequence
  Description of Artificial Sequence: Synthetic polypeptide
DEEEISTTNPVATEQYGCVCSNWGEDDNAENFNSDTQA

SEQ ID NO: 193920 - protein, 38 aa, Artificial Sequence
  Description of Artificial Sequence: Synthetic polypeptide
DEEEISTTNPVATEQYGCVCSNWGEDDNAENFNSDNQA

SEQ ID NO: 193921 - protein, 35 aa, Artificial Sequence
  Description of Artificial Sequence: Synthetic polypeptide
DETEIRTTNPIATECWGATSATAEAGPNMRKGPPV

SEQ ID NO: 193922 - protein, 38 aa, Artificial Sequence
  Description of Artificial Sequence: Synthetic polypeptide
DEEEISTTNPVATEQYGCVCSNWGEDDDAENFGSENQP

SEQ ID NO: 193923 - protein, 35 aa, Artificial Sequence
  Description of Artificial Sequence: Synthetic polypeptide
DETEIRTTNPIATECWGATTHANLEDWREPKGPYI

SEQ ID NO: 193924 - protein, 34 aa, Artificial Sequence
  Description of Artificial Sequence: Synthetic polypeptide
DETEIRTTNPIATECWGATTFANAEDWAEPGPRI

SEQ ID NO: 193925 - protein, 34 aa, Artificial Sequence
  Description of Artificial Sequence: Synthetic polypeptide
DETEIRTTNPIATECWGATTANMEDWAQQKGPYI

SEQ ID NO: 193926 - protein, 34 aa, Artificial Sequence
  Description of Artificial Sequence: Synthetic polypeptide
DETEIRTTNPIATECWGATTANMEDWAEQKGPYI

SEQ ID NO: 193927 - protein, 33 aa, Artificial Sequence
  Description of Artificial Sequence: Synthetic polypeptide
DETEIRTTNPIATECWGATTANANWAEPKGPYI

SEQ ID NO: 193928 - protein, 34 aa, Artificial Sequence
  Description of Artificial Sequence: Synthetic polypeptide
DETEIRTTNPIATECWGATTANAEDWQEPKGPYI

SEQ ID NO: 193929 - protein, 38 aa, Artificial Sequence
  Description of Artificial Sequence: Synthetic polypeptide
DEEEISTTNPVATEQYGCVCSNWGEAHNAENFNSDNQA

SEQ ID NO: 193930 - protein, 34 aa, Artificial Sequence
  Description of Artificial Sequence: Synthetic polypeptide
DEAAISTTNPVASLCWGSVSRCINEPQVTDPENG

SEQ ID NO: 193931 - protein, 36 aa, Artificial Sequence
  Description of Artificial Sequence: Synthetic polypeptide
TEECISTTNPVAYEQYAEEVTTGNGNPNDQGGKKNQ

SEQ ID NO: 193932 - protein, 37 aa, Artificial Sequence
  Description of Artificial Sequence: Synthetic polypeptide
DEDEIACTNPVATEQWGHSVSAIWPAGTNQGNPMEPV

SEQ ID NO: 193933 - protein, 37 aa, Artificial Sequence
  Description of Artificial Sequence: Synthetic polypeptide
DAEEIATTNPVATEQYGSVCAMANHADDSKAPDGVHN

SEQ ID NO: 193934 - protein, 34 aa, Artificial Sequence
  Description of Artificial Sequence: Synthetic polypeptide
DETEIRTTNPIATECWGAVWANAEDWAEPKGPYI

SEQ ID NO: 193935 - protein, 34 aa, Artificial Sequence
  Description of Artificial Sequence: Synthetic polypeptide
VEDEIATTNPVAYEPYGSVAGNGGVTTAENPNNK

SEQ ID NO: 193936 - protein, 36 aa, Artificial Sequence
  Description of Artificial Sequence: Synthetic polypeptide
VEDEIATTNPVAYEPYGSVANTQGLDQATANDENNN

SEQ ID NO: 193937 - protein, 34 aa, Artificial Sequence
  Description of Artificial Sequence: Synthetic polypeptide
DETEIRTTNPIATECWGAVWANAENWAEPKGPYI

SEQ ID NO: 193938 - protein, 39 aa, Artificial Sequence
  Description of Artificial Sequence: Synthetic polypeptide
DEEEIRTTNPVATEAYGVVSTVIGTTEQGSTNDEEEDED

SEQ ID NO: 193939 - protein, 34 aa, Artificial Sequence
  Description of Artificial Sequence: Synthetic polypeptide
DETEIRTTNPIATECWGAVWATTEAGAEPKGPYV

SEQ ID NO: 193940 - protein, 35 aa, Artificial Sequence
  Description of Artificial Sequence: Synthetic polypeptide
VEDEIATTNPVAYEQWGCNVAATNDTATGGGNQDN

SEQ ID NO: 193941 - protein, 38 aa, Artificial Sequence
  Description of Artificial Sequence: Synthetic polypeptide
AEEEIRTTNPVATEQYGICSCSNWGEHNQEYFQSDTQA

SEQ ID NO: 193942 - protein, 34 aa, Artificial Sequence
  Description of Artificial Sequence: Synthetic polypeptide
DETEIRTTNPIATECWGDTVWANAEDWAEAKGPI

SEQ ID NO: 193943 - protein, 39 aa, Artificial Sequence
  Description of Artificial Sequence: Synthetic polypeptide
DEEEIRTTNPVATEAYGVVSTVTTNQAGTEAGSVATEDE

SEQ ID NO: 193944 - protein, 38 aa, Artificial Sequence
  Description of Artificial Sequence: Synthetic polypeptide
AEEEIRTTNPVATEQYGQCVCSMWGEHNQENFNSDNQA

SEQ ID NO: 193945 - protein, 38 aa, Artificial Sequence
  Description of Artificial Sequence: Synthetic polypeptide
AEEEIRTTNPVATEQYGQCVCSNSGEHNQENFNSDPQS

SEQ ID NO: 193946 - protein, 38 aa, Artificial Sequence
  Description of Artificial Sequence: Synthetic polypeptide
AEEEIRTTNPVATEQYGQCVCSNWEEHNAENFNSDNQS

SEQ ID NO: 193947 - protein, 32 aa, Artificial Sequence
  Description of Artificial Sequence: Synthetic polypeptide
VEDEIATTNPVAYEPYGETAAMANDTVSNDTN

SEQ ID NO: 193948 - protein, 33 aa, Artificial Sequence
  Description of Artificial Sequence: Synthetic polypeptide
DETEIRTTNPIATECWGETTANAEDWAPKGPYK

SEQ ID NO: 193949 - protein, 34 aa, Artificial Sequence
  Description of Artificial Sequence: Synthetic polypeptide
VEDEIATTNPVAYEQWGCVAAANNLQEAHHVDHP

SEQ ID NO: 193950 - protein, 38 aa, Artificial Sequence
  Description of Artificial Sequence: Synthetic polypeptide
AEEEIRTTNPVATEQYGQCVCSNWGEHNAEFFNSDFQS

SEQ ID NO: 193951 - protein, 38 aa, Artificial Sequence
  Description of Artificial Sequence: Synthetic polypeptide
AEEEIRTTNPVATEQYGQCVCSNWGEHNAEFFNSDTQS

SEQ ID NO: 193952 - protein, 38 aa, Artificial Sequence
  Description of Artificial Sequence: Synthetic polypeptide
AEEEIRTTNPVATEQYGQCVCSNWGEHNAENFNSDNQS

SEQ ID NO: 193953 - protein, 38 aa, Artificial Sequence
  Description of Artificial Sequence: Synthetic polypeptide
AEEEIRTTNPVATEQYGQCVCSNWGEHNAENFNSDTQA

SEQ ID NO: 193954 - protein, 38 aa, Artificial Sequence
  Description of Artificial Sequence: Synthetic polypeptide
AEEEIRTTNPVATEQYGQCVCSNWGEHNAENFNSDTQD

SEQ ID NO: 193955 - protein, 38 aa, Artificial Sequence
  Description of Artificial Sequence: Synthetic polypeptide
AEEEIRTTNPVATEQYGQCVCSNWGEHNQEFFNSDTQA

SEQ ID NO: 193956 - protein, 39 aa, Artificial Sequence
  Description of Artificial Sequence: Synthetic polypeptide
DEEEIRTTNPVATEAYGVVSTVTTNQAGTEAGSVQTDDD

SEQ ID NO: 193957 - protein, 38 aa, Artificial Sequence
  Description of Artificial Sequence: Synthetic polypeptide
AEEEIRTTNPVATEQYGQCVCSNWGEHNQENFNSDNQM

SEQ ID NO: 193958 - protein, 38 aa, Artificial Sequence
  Description of Artificial Sequence: Synthetic polypeptide
AEEEIRTTNPVATEQYGQCVCSNWGEHNTENFNSDTQA

SEQ ID NO: 193959 - protein, 36 aa, Artificial Sequence
  Description of Artificial Sequence: Synthetic polypeptide
SSEEIRTTNPVATCQYGQCVCSWGEHNQNFGSDTQA

SEQ ID NO: 193960 - protein, 36 aa, Artificial Sequence
  Description of Artificial Sequence: Synthetic polypeptide
SSEEIRTTNPVATCQYGQCVCSWGEHNQENFGSDFS

SEQ ID NO: 193961 - protein, 38 aa, Artificial Sequence
  Description of Artificial Sequence: Synthetic polypeptide
DEEEIATTNPVATEQYGQCVCSWGEDHNQENFNSDNQS

SEQ ID NO: 193962 - protein, 34 aa, Artificial Sequence
  Description of Artificial Sequence: Synthetic polypeptide
QEGEIAPTNPCSYDQYGVTVSCCNMLSQSGGTRC

SEQ ID NO: 193963 - protein, 39 aa, Artificial Sequence
  Description of Artificial Sequence: Synthetic polypeptide
AEEEIRTTNPVATEQYGQCVCSNWEEPHNTENFNSDNQS

SEQ ID NO: 193964 - protein, 38 aa, Artificial Sequence
  Description of Artificial Sequence: Synthetic polypeptide
DEMEIRTTNPVATEQYGSLMYCVFANPENEQMNTQDEG

SEQ ID NO: 193965 - protein, 32 aa, Artificial Sequence
  Description of Artificial Sequence: Synthetic polypeptide
DETEIRTTNPIATECWGAVWAADWAEPKEDYA

SEQ ID NO: 193966 - protein, 35 aa, Artificial Sequence
  Description of Artificial Sequence: Synthetic polypeptide
DETEIRTTNPIATECWGAVTLANAEDQAEPAGPYI

SEQ ID NO: 193967 - protein, 36 aa, Artificial Sequence
  Description of Artificial Sequence: Synthetic polypeptide
SSSEISTTNPVATEQYGASAVVALTVNHIEGEEDQE

SEQ ID NO: 193968 - protein, 35 aa, Artificial Sequence
  Description of Artificial Sequence: Synthetic polypeptide
DETEIRTTNPIATECWGATVWANAEDWPQEPEGPI

SEQ ID NO: 193969 - protein, 37 aa, Artificial Sequence
  Description of Artificial Sequence: Synthetic polypeptide
DEDEIATTNPVATEQYGSVCAANMGEEAPDDLMEDAQ

SEQ ID NO: 193970 - protein, 37 aa, Artificial Sequence
  Description of Artificial Sequence: Synthetic polypeptide
SSSEIRTTNPVATEQYGASAVVWTVNHIETGTESQEM

SEQ ID NO: 193971 - protein, 37 aa, Artificial Sequence
  Description of Artificial Sequence: Synthetic polypeptide
DEDEIATTNPVATEQYGSVCAANMGEEAPDSGMEEAH

SEQ ID NO: 193972 - protein, 35 aa, Artificial Sequence
  Description of Artificial Sequence: Synthetic polypeptide
DETEIRTTNPIATECWGATVWANAEDWQEPKGPYI

SEQ ID NO: 193973 - protein, 38 aa, Artificial Sequence
  Description of Artificial Sequence: Synthetic polypeptide
DEAEIRTTNPVATESYGSVTWSPVYWLENPNTWEEVGN

SEQ ID NO: 193974 - protein, 35 aa, Artificial Sequence
  Description of Artificial Sequence: Synthetic polypeptide
DETEIRTTNPIATECWGATVWSNAEDLAEPKGPYI

SEQ ID NO: 193975 - protein, 35 aa, Artificial Sequence
  Description of Artificial Sequence: Synthetic polypeptide
DETEIRTTNPIATECWGATVWSNAEDWPQEPEGPI

SEQ ID NO: 193976 - protein, 37 aa, Artificial Sequence
  Description of Artificial Sequence: Synthetic polypeptide
SSSEIGTTNPVATEQYGASAVVATVNDILETGTESQE

SEQ ID NO: 193977 - protein, 36 aa, Artificial Sequence
  Description of Artificial Sequence: Synthetic polypeptide
SSSEIGTTNPVATEQYGASAVSATVPHIETGTESQE

SEQ ID NO: 193978 - protein, 35 aa, Artificial Sequence
  Description of Artificial Sequence: Synthetic polypeptide
SSNEIRTTNPVATEQYGACAVVATVDHIEGEEDQE

SEQ ID NO: 193979 - protein, 36 aa, Artificial Sequence
  Description of Artificial Sequence: Synthetic polypeptide
CEEEIATTNPVAYEQYGEVAIANNWTIQENGDQTAQ

SEQ ID NO: 193980 - protein, 37 aa, Artificial Sequence
  Description of Artificial Sequence: Synthetic polypeptide
DEAEIRTTNPVATESYGSVTWFPVPWLENPNTWEVGN

SEQ ID NO: 193981 - protein, 33 aa, Artificial Sequence
  Description of Artificial Sequence: Synthetic polypeptide
DETEIRTTNPIATECWGATWANADDWAFKGPYI

SEQ ID NO: 193982 - protein, 33 aa, Artificial Sequence
  Description of Artificial Sequence: Synthetic polypeptide
DETEIRTTNPIATECWGATWANADDWAPKGPYI

SEQ ID NO: 193983 - protein, 34 aa, Artificial Sequence
  Description of Artificial Sequence: Synthetic polypeptide
DETEIRTTNPIATECWGATWANAEAGAERNGPYI

SEQ ID NO: 193984 - protein, 34 aa, Artificial Sequence
  Description of Artificial Sequence: Synthetic polypeptide
DETEIRTTNPIATECWGATWSNTEDWAEPKGPYI

SEQ ID NO: 193985 - protein, 38 aa, Artificial Sequence
  Description of Artificial Sequence: Synthetic polypeptide
DEDEIATTNPVATEQYGSVCAGMTHGGPAEAPIGENNK

SEQ ID NO: 193986 - protein, 38 aa, Artificial Sequence
  Description of Artificial Sequence: Synthetic polypeptide
DEDEIATTNPVATEQYGSVCAAVANVGGEEHQDDNLAK

SEQ ID NO: 193987 - protein, 34 aa, Artificial Sequence
  Description of Artificial Sequence: Synthetic polypeptide
DETEIRTTNPIATECWGATWSNAIDWAEPKGNYG

SEQ ID NO: 193988 - protein, 33 aa, Artificial Sequence
  Description of Artificial Sequence: Synthetic polypeptide
DETEIRTTNPIATECWGATWSAADDWAEPKGPI

SEQ ID NO: 193989 - protein, 33 aa, Artificial Sequence
  Description of Artificial Sequence: Synthetic polypeptide
DETEIRTTNPIATECWGATWPNAEDWAEPGEYI

SEQ ID NO: 193990 - protein, 35 aa, Artificial Sequence
  Description of Artificial Sequence: Synthetic polypeptide
DETEIRTTNPIATECWGITVWANAEDLAEPKGPYI

SEQ ID NO: 193991 - protein, 34 aa, Artificial Sequence
  Description of Artificial Sequence: Synthetic polypeptide
DETEIRTTNPIATECWGATWANTEDWAEPKGNYI

SEQ ID NO: 193992 - protein, 33 aa, Artificial Sequence
  Description of Artificial Sequence: Synthetic polypeptide
DETEIRTTNPIATECWGATWANAEDWAPKGPYI

SEQ ID NO: 193993 - protein, 34 aa, Artificial Sequence
  Description of Artificial Sequence: Synthetic polypeptide
DETEIRTTNPIATECWGATWANAEDWAERNGPYI

SEQ ID NO: 193994 - protein, 34 aa, Artificial Sequence
  Description of Artificial Sequence: Synthetic polypeptide
DETEIRTTNPIATECWGATWANAEDWAERKGPYI

SEQ ID NO: 193995 - protein, 34 aa, Artificial Sequence
  Description of Artificial Sequence: Synthetic polypeptide
DETEIRTTNPIATECWGATWANAEDWAEPKGNYI

SEQ ID NO: 193996 - protein, 37 aa, Artificial Sequence
  Description of Artificial Sequence: Synthetic polypeptide
DEMEIRTTNPVATEQYGSISSMSASTEQAETDDEQKD

SEQ ID NO: 193997 - protein, 34 aa, Artificial Sequence
  Description of Artificial Sequence: Synthetic polypeptide
DETEIRTTNPIATECWGATWANAEDGAERNGPYI

SEQ ID NO: 193998 - protein, 38 aa, Artificial Sequence
  Description of Artificial Sequence: Synthetic polypeptide
DAEEIATTNPVATEQYGSVCAMNNGEPGNANPGDNMNP

SEQ ID NO: 193999 - protein, 32 aa, Artificial Sequence
  Description of Artificial Sequence: Synthetic polypeptide
STAEIACTNPVATASWGCVAGTTGLARPGDQD

SEQ ID NO: 194000 - protein, 37 aa, Artificial Sequence
  Description of Artificial Sequence: Synthetic polypeptide
DEEEISTTNPVATEQYGCVCSWEEDHNAENFISETQA

SEQ ID NO: 194001 - protein, 38 aa, Artificial Sequence
  Description of Artificial Sequence: Synthetic polypeptide
DEEEIATTNPVATEQYGQCVCSNWGEHNAENFNSETQS

SEQ ID NO: 194002 - protein, 39 aa, Artificial Sequence
  Description of Artificial Sequence: Synthetic polypeptide
DEEEIRTTNPVATEAYGVVSTVTTQQAGTEAGTVTQEED

SEQ ID NO: 194003 - protein, 39 aa, Artificial Sequence
  Description of Artificial Sequence: Synthetic polypeptide
DEEEIRTTNPVATEAYGVVSTVTTQQAGTEAGTVTTQVD

SEQ ID NO: 194004 - protein, 34 aa, Artificial Sequence
  Description of Artificial Sequence: Synthetic polypeptide
DETEIRTTNPIATECWGTTTWANAEDWAQPKGPI

SEQ ID NO: 194005 - protein, 37 aa, Artificial Sequence
  Description of Artificial Sequence: Synthetic polypeptide
DEEEISTTNPVATEQYGCVCSWGEDDNQENFISDTQS

SEQ ID NO: 194006 - protein, 37 aa, Artificial Sequence
  Description of Artificial Sequence: Synthetic polypeptide
DEEEISTTNPVATEQYGCVCSWGEDHDAENFNSDTQS

SEQ ID NO: 194007 - protein, 33 aa, Artificial Sequence
  Description of Artificial Sequence: Synthetic polypeptide
DETEIRTTNPIATECWGTTWANADGWEEPKGPI

SEQ ID NO: 194008 - protein, 33 aa, Artificial Sequence
  Description of Artificial Sequence: Synthetic polypeptide
DETEIRTTNPIATECWGTTWSAADDWAEPEGPI

SEQ ID NO: 194009 - protein, 35 aa, Artificial Sequence
  Description of Artificial Sequence: Synthetic polypeptide
DAAEIATTNPVAYEQYGSCSTGDIGQPDDLMEDAM

SEQ ID NO: 194010 - protein, 37 aa, Artificial Sequence
  Description of Artificial Sequence: Synthetic polypeptide
DEEEISTTNPVATEQYGCVCSWGEDHNIENFISETQS

SEQ ID NO: 194011 - protein, 37 aa, Artificial Sequence
  Description of Artificial Sequence: Synthetic polypeptide
DEEEISTTNPVATEQYGCVCSWGEDHNQENFFSDTQS

SEQ ID NO: 194012 - protein, 37 aa, Artificial Sequence
  Description of Artificial Sequence: Synthetic polypeptide
DEEEISTTNPVATEQYGCVCSWGEDHNQENFISDTQA

SEQ ID NO: 194013 - protein, 37 aa, Artificial Sequence
  Description of Artificial Sequence: Synthetic polypeptide
DEEEISTTNPVATEQYGCVCSWGEDHNQENFISDTQP

SEQ ID NO: 194014 - protein, 37 aa, Artificial Sequence
  Description of Artificial Sequence: Synthetic polypeptide
DEMEIATTNPVAYEGWGSVCSGTDMDQDRDGGGQQEQ

SEQ ID NO: 194015 - protein, 34 aa, Artificial Sequence
  Description of Artificial Sequence: Synthetic polypeptide
DETEIRTTNPIATECYGATCANAEDWAEPKGPYI

SEQ ID NO: 194016 - protein, 36 aa, Artificial Sequence
  Description of Artificial Sequence: Synthetic polypeptide
VEDEIATTNPVAYEQWGSTAGTNTLPQLHQDGTEPN

SEQ ID NO: 194017 - protein, 38 aa, Artificial Sequence
  Description of Artificial Sequence: Synthetic polypeptide
DEAEIATTNPVATEQYGSVCAMNNGEDTNPDDEMENNM

SEQ ID NO: 194018 - protein, 35 aa, Artificial Sequence
  Description of Artificial Sequence: Synthetic polypeptide
DETEIRTTNPIATECYGATTWANAEDLEEHKGPDI

SEQ ID NO: 194019 - protein, 34 aa, Artificial Sequence
  Description of Artificial Sequence: Synthetic polypeptide
DETEIRTTNPIATECYGATTWANAEDWAEHKGPI

SEQ ID NO: 194020 - protein, 32 aa, Artificial Sequence
  Description of Artificial Sequence: Synthetic polypeptide
DETEIRTTNPIATECYGATWAADWAEHKEPYI

SEQ ID NO: 194021 - protein, 33 aa, Artificial Sequence
  Description of Artificial Sequence: Synthetic polypeptide
DETEIRTTNPIATECYGATWAAEDWAEHKGPYI

SEQ ID NO: 194022 - protein, 35 aa, Artificial Sequence
  Description of Artificial Sequence: Synthetic polypeptide
VEDEIATTNPVAYEQWGSVCAAAGGGDNDDPDNRN

SEQ ID NO: 194023 - protein, 34 aa, Artificial Sequence
  Description of Artificial Sequence: Synthetic polypeptide
DETEIRTTNPIATECYGATWANAEDWAEPKGPYI

SEQ ID NO: 194024 - protein, 38 aa, Artificial Sequence
  Description of Artificial Sequence: Synthetic polypeptide
DEMEIRTTNPVATEQYGSVCVMLGVNDNETQIEPEPEN

SEQ ID NO: 194025 - protein, 35 aa, Artificial Sequence
  Description of Artificial Sequence: Synthetic polypeptide
DETEIRTTNPIATECYGATWATAEAWAERNGMPYI

SEQ ID NO: 194026 - protein, 38 aa, Artificial Sequence
  Description of Artificial Sequence: Synthetic polypeptide
DAEEIATTNPVATEQYGSVCAMANHADDSKAPGGEMNN

SEQ ID NO: 194027 - protein, 36 aa, Artificial Sequence
  Description of Artificial Sequence: Synthetic polypeptide
VEDEIATTNPVAYEQWGSVCSANPALQEHMIDLTAA

SEQ ID NO: 194028 - protein, 33 aa, Artificial Sequence
  Description of Artificial Sequence: Synthetic polypeptide
DETEIRTTNPIATECYGETAWPEEVWAHKGEYI

SEQ ID NO: 194029 - protein, 36 aa, Artificial Sequence
  Description of Artificial Sequence: Synthetic polypeptide
SQEEIRTTNPVATEQWGCVCSNWGEHNQENFNSQQA

SEQ ID NO: 194030 - protein, 36 aa, Artificial Sequence
  Description of Artificial Sequence: Synthetic polypeptide
SQEEIRTTNPVATEQWGCVCSNWEEHNQEHFGSDQA

SEQ ID NO: 194031 - protein, 35 aa, Artificial Sequence
  Description of Artificial Sequence: Synthetic polypeptide
DETEIRTTNPIATECYGSTTWANAEDWAEPKGPYI

SEQ ID NO: 194032 - protein, 36 aa, Artificial Sequence
  Description of Artificial Sequence: Synthetic polypeptide
SQEEIRTTNPVATEQWGCVCSWGEDHNQENFGSQQA

SEQ ID NO: 194033 - protein, 37 aa, Artificial Sequence
  Description of Artificial Sequence: Synthetic polypeptide
DEMEIRCTNPVATEQYGSVWMPVILENGPAEIDDAPK

SEQ ID NO: 194034 - protein, 34 aa, Artificial Sequence
  Description of Artificial Sequence: Synthetic polypeptide
DETEIRTTNPIATECWGSTWANAEDWAEPKGPYI

SEQ ID NO: 194035 - protein, 35 aa, Artificial Sequence
  Description of Artificial Sequence: Synthetic polypeptide
DETEIRTTNPIATECWGSTVWANAENWMEPKGPYI

SEQ ID NO: 194036 - protein, 37 aa, Artificial Sequence
  Description of Artificial Sequence: Synthetic polypeptide
SSEEIRTTNPAATDAYGSVSVTTEGQGEQGGGQGNGQ

SEQ ID NO: 194037 - protein, 37 aa, Artificial Sequence
  Description of Artificial Sequence: Synthetic polypeptide
SSEEIRTTNPAATDAYGSVSVTDEGQGEQGQGFGNGQ

SEQ ID NO: 194038 - protein, 39 aa, Artificial Sequence
  Description of Artificial Sequence: Synthetic polypeptide
DEEEIRTTNPVATEAYGVVSTVTTNQAGTEAGSVSTEVD

SEQ ID NO: 194039 - protein, 39 aa, Artificial Sequence
  Description of Artificial Sequence: Synthetic polypeptide
DEEEIRTTNPVATEAYGVVSTVTTNQAGTEAGTTTDTDE

SEQ ID NO: 194040 - protein, 39 aa, Artificial Sequence
  Description of Artificial Sequence: Synthetic polypeptide
DEEEIRTTNPVATEAYGVVSTVTTNQAGTEAGTTTQEDD

SEQ ID NO: 194041 - protein, 39 aa, Artificial Sequence
  Description of Artificial Sequence: Synthetic polypeptide
DEEEIRTTNPVATEAYGVVSTVTTNQAGTEAGTVTTETE

SEQ ID NO: 194042 - protein, 36 aa, Artificial Sequence
  Description of Artificial Sequence: Synthetic polypeptide
SSEEIATTNPVAYHQYGSVVHCCVPISQERGGINFQ

SEQ ID NO: 194043 - protein, 35 aa, Artificial Sequence
  Description of Artificial Sequence: Synthetic polypeptide
SSEEIATTNPVAYHQYGSVVACVPHSQEVGGDNFQ

SEQ ID NO: 194044 - protein, 35 aa, Artificial Sequence
  Description of Artificial Sequence: Synthetic polypeptide
SSEEIATTNPVAYHPYGSVVHSVWHSQENGGINFA

SEQ ID NO: 194045 - protein, 34 aa, Artificial Sequence
  Description of Artificial Sequence: Synthetic polypeptide
DETEIRTTNPIATECWGNTVWANADWAEPKGQYI

SEQ ID NO: 194046 - protein, 38 aa, Artificial Sequence
  Description of Artificial Sequence: Synthetic polypeptide
SQGEIRTTNPVATEQYGSVAMPTPNDIIDGNMESSQIE

SEQ ID NO: 194047 - protein, 35 aa, Artificial Sequence
  Description of Artificial Sequence: Synthetic polypeptide
CEEEIATTNPVAYEQWGSVCADGALANTGGVMQMN

SEQ ID NO: 194048 - protein, 36 aa, Artificial Sequence
  Description of Artificial Sequence: Synthetic polypeptide
SQEEISTTNPVATEQWGCVCSWGEHNAEHFGSDNQA

SEQ ID NO: 194049 - protein, 39 aa, Artificial Sequence
  Description of Artificial Sequence: Synthetic polypeptide
DEEEIRTTNPVATEAYGVVSTVTTNQAGTESGTVTQEVD

SEQ ID NO: 194050 - protein, 38 aa, Artificial Sequence
  Description of Artificial Sequence: Synthetic polypeptide
AEEEIRTTNPVATEQYGQCVCSWGEDHNQENFGSETQS

SEQ ID NO: 194051 - protein, 38 aa, Artificial Sequence
  Description of Artificial Sequence: Synthetic polypeptide
AEEEIRTTNPVATEQYGQCVCSWGEDHNQENFNSDTQD

SEQ ID NO: 194052 - protein, 36 aa, Artificial Sequence
  Description of Artificial Sequence: Synthetic polypeptide
SQEEIRTTNPVATEQYGSSCIVQNDENGGETEISDT

SEQ ID NO: 194053 - protein, 35 aa, Artificial Sequence
  Description of Artificial Sequence: Synthetic polypeptide
DETEIRTTNPIATECWGSTVWANAENWAEPKGPYI

SEQ ID NO: 194054 - protein, 36 aa, Artificial Sequence
  Description of Artificial Sequence: Synthetic polypeptide
DETEIRTTNPIATECWGSTTWSTAEDWPNEPNGPYI

SEQ ID NO: 194055 - protein, 38 aa, Artificial Sequence
  Description of Artificial Sequence: Synthetic polypeptide
DEEEIATTNPVATEQYGQCVCSMWGEHNQENFNSDNQS

SEQ ID NO: 194056 - protein, 34 aa, Artificial Sequence
  Description of Artificial Sequence: Synthetic polypeptide
DETEIRTTNPIATECWGSTTWSNAEDWAEPKGPI

SEQ ID NO: 194057 - protein, 38 aa, Artificial Sequence
  Description of Artificial Sequence: Synthetic polypeptide
DEEEIATTNPVATEQYGQCVCSNSGEDNQENFNSDTQA

SEQ ID NO: 194058 - protein, 35 aa, Artificial Sequence
  Description of Artificial Sequence: Synthetic polypeptide
DETEIRTTNPIATECWGSTTWANTEDWAMRKGPYI

SEQ ID NO: 194059 - protein, 35 aa, Artificial Sequence
  Description of Artificial Sequence: Synthetic polypeptide
DETEIRTTNPIATECWGITVWANAENLAEPKGPYI

SEQ ID NO: 194060 - protein, 35 aa, Artificial Sequence
  Description of Artificial Sequence: Synthetic polypeptide
DETEIRTTNPIATECWGSTTWANTEDWAERKGPYI

SEQ ID NO: 194061 - protein, 34 aa, Artificial Sequence
  Description of Artificial Sequence: Synthetic polypeptide
DETEIRTTNPIATECWGSTTWANAEDWAEPGPYI

SEQ ID NO: 194062 - protein, 36 aa, Artificial Sequence
  Description of Artificial Sequence: Synthetic polypeptide
VEDEIATTNPVAYEQWGSICAIANNLQEAPGGTDNL

SEQ ID NO: 194063 - protein, 35 aa, Artificial Sequence
  Description of Artificial Sequence: Synthetic polypeptide
DETEIRTTNPIATECWGSTTWANAEDLMEPKGPYI

SEQ ID NO: 194064 - protein, 35 aa, Artificial Sequence
  Description of Artificial Sequence: Synthetic polypeptide
DETEIRTTNPIATECWGSTTWANAEDLAEPKGPYI

SEQ ID NO: 194065 - protein, 35 aa, Artificial Sequence
  Description of Artificial Sequence: Synthetic polypeptide
DETEIRTTNPIATECWGSTTWANAEAWAERNGPYV

SEQ ID NO: 194066 - protein, 34 aa, Artificial Sequence
  Description of Artificial Sequence: Synthetic polypeptide
DETEIRTTNPIATECWGSTTWAAEDLMEPKGPYI

SEQ ID NO: 194067 - protein, 34 aa, Artificial Sequence
  Description of Artificial Sequence: Synthetic polypeptide
DETEIRTTNPIATECWGSTTWANAEDWAEPKGPI

SEQ ID NO: 194068 - protein, 40 aa, Artificial Sequence
  Description of Artificial Sequence: Synthetic polypeptide
DEEEIRTTNPVATEAYGSVATVVVTTQAGNVEQGTNNNNE

SEQ ID NO: 194069 - protein, 34 aa, Artificial Sequence
  Description of Artificial Sequence: Synthetic polypeptide
DETEIRTTNPIATECWGATVWANAEDWAEPGPYI

SEQ ID NO: 194070 - protein, 34 aa, Artificial Sequence
  Description of Artificial Sequence: Synthetic polypeptide
STEEICTTNPAATDAYGSVVNTTGGEQEGQGEGQ

SEQ ID NO: 194071 - protein, 35 aa, Artificial Sequence
  Description of Artificial Sequence: Synthetic polypeptide
DETEIRTTNPIATECWGATTWANAIDWQEPKGNYI

SEQ ID NO: 194072 - protein, 37 aa, Artificial Sequence
  Description of Artificial Sequence: Synthetic polypeptide
TEECIRATNPVAYEQYGICVSCELNEVSQSFLPGNVC

SEQ ID NO: 194073 - protein, 33 aa, Artificial Sequence
  Description of Artificial Sequence: Synthetic polypeptide
DETEIRTTNPIATECWGATTWANAIWANPKGPI

SEQ ID NO: 194074 - protein, 38 aa, Artificial Sequence
  Description of Artificial Sequence: Synthetic polypeptide
TEECIRATNPVATEQYGICLVSCELNEVSQSFPGGNDC

SEQ ID NO: 194075 - protein, 34 aa, Artificial Sequence
  Description of Artificial Sequence: Synthetic polypeptide
DETEIRTTNPIATECWGATTWANANWMERKGPYI

SEQ ID NO: 194076 - protein, 36 aa, Artificial Sequence
  Description of Artificial Sequence: Synthetic polypeptide
DEEEIRTTNPVAYEQYGCVCQWGEHNEEYFDSDTQS

SEQ ID NO: 194077 - protein, 37 aa, Artificial Sequence
  Description of Artificial Sequence: Synthetic polypeptide
DEEEIRTTNPVAYEQYGCVCQWGEDHNQEYFNSDTQS

SEQ ID NO: 194078 - protein, 38 aa, Artificial Sequence
  Description of Artificial Sequence: Synthetic polypeptide
AEEEIRTTNPVATEQFGQCVCSTWGEDNAEHFNSDTQS

SEQ ID NO: 194079 - protein, 38 aa, Artificial Sequence
  Description of Artificial Sequence: Synthetic polypeptide
AEEEIRTTNPVATEQWGICQVCSYTGEDHNANFGSDQA

SEQ ID NO: 194080 - protein, 38 aa, Artificial Sequence
  Description of Artificial Sequence: Synthetic polypeptide
TEEAIRLTTCNPVAYEHYGQSVIADTNSLSINPGGPNE

SEQ ID NO: 194081 - protein, 36 aa, Artificial Sequence
  Description of Artificial Sequence: Synthetic polypeptide
DEAEIRTTNPVAYECWGCVAGGGNMGNERGGEGDDR

SEQ ID NO: 194082 - protein, 34 aa, Artificial Sequence
  Description of Artificial Sequence: Synthetic polypeptide
DETEIRTTNPIATECWGATTWANDEDLAPKGPYI

SEQ ID NO: 194083 - protein, 37 aa, Artificial Sequence
  Description of Artificial Sequence: Synthetic polypeptide
DAEEIATTNPVATEQYGSVCAMNNGNPEPPDDQANGA

SEQ ID NO: 194084 - protein, 38 aa, Artificial Sequence
  Description of Artificial Sequence: Synthetic polypeptide
AEEEIRTTNPVATEQYGCAVCSNSGEHNAENFNSETQA

SEQ ID NO: 194085 - protein, 38 aa, Artificial Sequence
  Description of Artificial Sequence: Synthetic polypeptide
DEEEIRTTNPVAYEQYGCVCSMWEEDHNQENFNSDNQS

SEQ ID NO: 194086 - protein, 33 aa, Artificial Sequence
  Description of Artificial Sequence: Synthetic polypeptide
TEDSIAATNPVAYTPWGIVPSCTAEHSQRGENQ

SEQ ID NO: 194087 - protein, 34 aa, Artificial Sequence
  Description of Artificial Sequence: Synthetic polypeptide
TEDGIQTTNPVAYEAYGKTVACQSSHMMVGNDRC

SEQ ID NO: 194088 - protein, 35 aa, Artificial Sequence
  Description of Artificial Sequence: Synthetic polypeptide
TEDEIRTTNPVAYESWGEVCSNDNDDQPGQQGQEH

SEQ ID NO: 194089 - protein, 36 aa, Artificial Sequence
  Description of Artificial Sequence: Synthetic polypeptide
AEEEIRTTNPVATEQYGCFCSWPEDHNQNFDSDTQS

SEQ ID NO: 194090 - protein, 35 aa, Artificial Sequence
  Description of Artificial Sequence: Synthetic polypeptide
DEDEIACTNPVATEQWGGCVAGTGEAQAPMDNEML

SEQ ID NO: 194091 - protein, 37 aa, Artificial Sequence
  Description of Artificial Sequence: Synthetic polypeptide
DEEEIRTTNPVAYEQYGCVCQNWGEHNAEYFNSDNQS

SEQ ID NO: 194092 - protein, 36 aa, Artificial Sequence
  Description of Artificial Sequence: Synthetic polypeptide
DEEEIRTTNPVAYEQYGCVCGWGAHNQEYFISDTQS

SEQ ID NO: 194093 - protein, 35 aa, Artificial Sequence
  Description of Artificial Sequence: Synthetic polypeptide
TEDEIMATTNPVAYEHYGSVVFTNEESTDNSSNSP

SEQ ID NO: 194094 - protein, 34 aa, Artificial Sequence
  Description of Artificial Sequence: Synthetic polypeptide
DETEIRTTNPIATECWGATTWANSETWAEPGPYI

SEQ ID NO: 194095 - protein, 34 aa, Artificial Sequence
  Description of Artificial Sequence: Synthetic polypeptide
TEDEIASVNPVCYEHYGVTVNTINLSQSAGGPNV

SEQ ID NO: 194096 - protein, 36 aa, Artificial Sequence
  Description of Artificial Sequence: Synthetic polypeptide
TECGICTTNPVAYEVYGSVSCLNESSNDRPPGNNAY

SEQ ID NO: 194097 - protein, 37 aa, Artificial Sequence
  Description of Artificial Sequence: Synthetic polypeptide
DEEEIRTTNPVAYEQYGCVCGNWGEDHNIENFGSDQA

SEQ ID NO: 194098 - protein, 36 aa, Artificial Sequence
  Description of Artificial Sequence: Synthetic polypeptide
DEAEIRTTNPVAYEQYGCTCSNWGEHNAENFGSDQS

SEQ ID NO: 194099 - protein, 37 aa, Artificial Sequence
  Description of Artificial Sequence: Synthetic polypeptide
TEATEICTTNPVAYECWGSVATGNGPLNDDRGQNGDD

SEQ ID NO: 194100 - protein, 33 aa, Artificial Sequence
  Description of Artificial Sequence: Synthetic polypeptide
TEASIAATNPVAYDPWGIVPSCTKEHSQRGENQ

SEQ ID NO: 194101 - protein, 36 aa, Artificial Sequence
  Description of Artificial Sequence: Synthetic polypeptide
DEEEIRTTNPVAYEQYGCVCQWEDDNQENFDSDTQA

SEQ ID NO: 194102 - protein, 38 aa, Artificial Sequence
  Description of Artificial Sequence: Synthetic polypeptide
DEEEIRTTNPVAYEQYGCVCSMWGEDHNQENFNSDTQA

SEQ ID NO: 194103 - protein, 37 aa, Artificial Sequence
  Description of Artificial Sequence: Synthetic polypeptide
DEEEIRTTNPVAYEQYGCVCSMWGEHEAENFNSDPQS

SEQ ID NO: 194104 - protein, 38 aa, Artificial Sequence
  Description of Artificial Sequence: Synthetic polypeptide
DEEEIRTTNPVAYEQYGCVCSNSGEDHNQENFGSETQS

SEQ ID NO: 194105 - protein, 37 aa, Artificial Sequence
  Description of Artificial Sequence: Synthetic polypeptide
TEECISTTNPVATEQYGCVCSNWMEHNTENFGSDNQS

SEQ ID NO: 194106 - protein, 37 aa, Artificial Sequence
  Description of Artificial Sequence: Synthetic polypeptide
YEDEIRTTNPVATEQYGSVMGNFNENNGQGEQEVEQE

SEQ ID NO: 194107 - protein, 37 aa, Artificial Sequence
  Description of Artificial Sequence: Synthetic polypeptide
DEMEIATTNPVAYEQYGCVCSNWMEHNEEHFGSENLS

SEQ ID NO: 194108 - protein, 34 aa, Artificial Sequence
  Description of Artificial Sequence: Synthetic polypeptide
DETEIRTTNPIATECWGATTWANAEDWQEPEGPI

SEQ ID NO: 194109 - protein, 36 aa, Artificial Sequence
  Description of Artificial Sequence: Synthetic polypeptide
QEEEIATTNPVATEQYGVVMGGPGEGEGGQGENDTD

SEQ ID NO: 194110 - protein, 35 aa, Artificial Sequence
  Description of Artificial Sequence: Synthetic polypeptide
DETEIRTTNPIATECWGATTWANAEDWQEPKGNYI

SEQ ID NO: 194111 - protein, 34 aa, Artificial Sequence
  Description of Artificial Sequence: Synthetic polypeptide
DETEIRTTNPIATECWGATTWANAEDWQEPKGPI

SEQ ID NO: 194112 - protein, 37 aa, Artificial Sequence
  Description of Artificial Sequence: Synthetic polypeptide
DEEEIRTTNPVAYEQYGCVCSNWGEHNEENFISETQT

SEQ ID NO: 194113 - protein, 38 aa, Artificial Sequence
  Description of Artificial Sequence: Synthetic polypeptide
DEEEIRTTNPVAYEQYGCVCSNWGEDHNTENFNSDTQA

SEQ ID NO: 194114 - protein, 40 aa, Artificial Sequence
  Description of Artificial Sequence: Synthetic polypeptide
DEEEIRTTNPVATEAYGSVVTTQIGTTEQGSTNDEQNDED

SEQ ID NO: 194115 - protein, 38 aa, Artificial Sequence
  Description of Artificial Sequence: Synthetic polypeptide
DEEEIRTTNPVAYEQYGCVCSNWGEDHNQENFNSDNQS

SEQ ID NO: 194116 - protein, 38 aa, Artificial Sequence
  Description of Artificial Sequence: Synthetic polypeptide
DEEEIRTTNPVAYEQYGCVCSNWGEDHNQENFNSDNQA

SEQ ID NO: 194117 - protein, 37 aa, Artificial Sequence
  Description of Artificial Sequence: Synthetic polypeptide
AEEEIRTTNPVATEGYGCVCSNWGEPNAEYFNSDTQS

SEQ ID NO: 194118 - protein, 38 aa, Artificial Sequence
  Description of Artificial Sequence: Synthetic polypeptide
DEEEIRTTNPVAYEQYGCVCSNWGEDHNIENFNSDTQS

SEQ ID NO: 194119 - protein, 38 aa, Artificial Sequence
  Description of Artificial Sequence: Synthetic polypeptide
DEEEIRTTNPVAYEQYGCVCSNWGEDHNAENFNSDNQS

SEQ ID NO: 194120 - protein, 37 aa, Artificial Sequence
  Description of Artificial Sequence: Synthetic polypeptide
TEECIRTTNPVATEQYGQCVCSNWGEDNAYFNSDNQS

SEQ ID NO: 194121 - protein, 38 aa, Artificial Sequence
  Description of Artificial Sequence: Synthetic polypeptide
DEEEIRTTNPVAYEQYGCVCSNWEEDHNTENFGSETQS

SEQ ID NO: 194122 - protein, 36 aa, Artificial Sequence
  Description of Artificial Sequence: Synthetic polypeptide
DEMEIATTNPVAYEQYGCVCSNWEHNEEHFGSEDQS

SEQ ID NO: 194123 - protein, 37 aa, Artificial Sequence
  Description of Artificial Sequence: Synthetic polypeptide
TEECIRTTNPTATECYGQCVSCTQAEPSQFPGGNDDP

SEQ ID NO: 194124 - protein, 35 aa, Artificial Sequence
  Description of Artificial Sequence: Synthetic polypeptide
DEAEIRTTNPVAYECWGCVYYNPNQQQNTDHDIGQ

SEQ ID NO: 194125 - protein, 37 aa, Artificial Sequence
  Description of Artificial Sequence: Synthetic polypeptide
TEECIRTTNPTATEQYGQCVVCTQEEPSQKLGGNNDP

SEQ ID NO: 194126 - protein, 37 aa, Artificial Sequence
  Description of Artificial Sequence: Synthetic polypeptide
DEEEIRTTNPVAYEQYGCVCSNSGEDHNQENFISDQS

SEQ ID NO: 194127 - protein, 36 aa, Artificial Sequence
  Description of Artificial Sequence: Synthetic polypeptide
TEECIRTTNPVATEHWGVVCFTNEDQHHPGGTKGKG

SEQ ID NO: 194128 - protein, 35 aa, Artificial Sequence
  Description of Artificial Sequence: Synthetic polypeptide
TEAQEIAATNPVAYECWGSVSGGLNDDRQEQGNEV

SEQ ID NO: 194129 - protein, 37 aa, Artificial Sequence
  Description of Artificial Sequence: Synthetic polypeptide
TEECIRTTNPVATEQYGCVCSNWGEDHNAEYFNSDQS

SEQ ID NO: 194130 - protein, 35 aa, Artificial Sequence
  Description of Artificial Sequence: Synthetic polypeptide
DEDEIACTNPVATEQWGHCSAASTEFEHQDDIKHQ

SEQ ID NO: 194131 - protein, 35 aa, Artificial Sequence
  Description of Artificial Sequence: Synthetic polypeptide
DETEIRTTNPIATECWGATTWANAEQRAEPKGPYI

SEQ ID NO: 194132 - protein, 38 aa, Artificial Sequence
  Description of Artificial Sequence: Synthetic polypeptide
DEEEIRTTNPVAYEQYGCVCSNWEEDHNQENFNSDPQS

SEQ ID NO: 194133 - protein, 37 aa, Artificial Sequence
  Description of Artificial Sequence: Synthetic polypeptide
TEECIRTTNPVATEQYGCVCSWEEDHNAEYFNSDTQS

SEQ ID NO: 194134 - protein, 37 aa, Artificial Sequence
  Description of Artificial Sequence: Synthetic polypeptide
TEECIRTTNPVATEQYGCVCSWGEDHNAEYFISDNQS

SEQ ID NO: 194135 - protein, 38 aa, Artificial Sequence
  Description of Artificial Sequence: Synthetic polypeptide
DEEEIRTTNPVAYEQYGCVCSNWEEDHNQENFNSDTQS

SEQ ID NO: 194136 - protein, 36 aa, Artificial Sequence
  Description of Artificial Sequence: Synthetic polypeptide
TEECIRTTNPVATEQYGCVCSNWGEHNAYFNSQTQA

SEQ ID NO: 194137 - protein, 36 aa, Artificial Sequence
  Description of Artificial Sequence: Synthetic polypeptide
DEAEIRTTNPVAYEQYGCTCSWGEHNAENFNSDNQS

SEQ ID NO: 194138 - protein, 37 aa, Artificial Sequence
  Description of Artificial Sequence: Synthetic polypeptide
DEAEIRTTNPVAYEQYGCVCGTWGEHNAEYFNSDTQS

SEQ ID NO: 194139 - protein, 34 aa, Artificial Sequence
  Description of Artificial Sequence: Synthetic polypeptide
TEAEIRTTNPVSTEPWGCIAPNDQQQQQQRDNEH

SEQ ID NO: 194140 - protein, 40 aa, Artificial Sequence
  Description of Artificial Sequence: Synthetic polypeptide
DEEEIRTTNPVAYEQYGQSCVCSERLRDLLDAQSGQITKN

SEQ ID NO: 194141 - protein, 35 aa, Artificial Sequence
  Description of Artificial Sequence: Synthetic polypeptide
TDEAEIRTTNPVSYECWGSVATTNMPHEDNGGGDM

SEQ ID NO: 194142 - protein, 35 aa, Artificial Sequence
  Description of Artificial Sequence: Synthetic polypeptide
TDAEIATTNPVAYEQWGSVCSNWENDDDHRNGGAN

SEQ ID NO: 194143 - protein, 35 aa, Artificial Sequence
  Description of Artificial Sequence: Synthetic polypeptide
DEDEIACTNPVATEQWGAVCAQNPVNTAGNPEGTA

SEQ ID NO: 194144 - protein, 39 aa, Artificial Sequence
  Description of Artificial Sequence: Synthetic polypeptide
DEEEIRTTNPVAYEQYGQSGVCFQLNDLLDAQSDQITKN

SEQ ID NO: 194145 - protein, 37 aa, Artificial Sequence
  Description of Artificial Sequence: Synthetic polypeptide
DEDEIACTNPVATEMWGSVAATGAQPTNPGNQTEGNN

SEQ ID NO: 194146 - protein, 35 aa, Artificial Sequence
  Description of Artificial Sequence: Synthetic polypeptide
DETEIRTTNPIATECWGATTWSNTEDLADPEGPDL

SEQ ID NO: 194147 - protein, 36 aa, Artificial Sequence
  Description of Artificial Sequence: Synthetic polypeptide
TAEEIATTNPVAYEQWGSVCYQENGQAQDLGDTENN

SEQ ID NO: 194148 - protein, 36 aa, Artificial Sequence
  Description of Artificial Sequence: Synthetic polypeptide
DEACAEIATTNPCAYEQWGSVVITPNFEVNEGNGDV

SEQ ID NO: 194149 - protein, 35 aa, Artificial Sequence
  Description of Artificial Sequence: Synthetic polypeptide
TADEIATTNPVATEAYGCVCPTNDNQDQHQQGGDD

SEQ ID NO: 194150 - protein, 38 aa, Artificial Sequence
  Description of Artificial Sequence: Synthetic polypeptide
DEEEIRTTNPVAYEQYGQCVCSWGEDDNAENFNSDTQS

SEQ ID NO: 194151 - protein, 36 aa, Artificial Sequence
  Description of Artificial Sequence: Synthetic polypeptide
AEDEIRTTNPVATEPWGSVCLIEDNGDRDRDGDDDI

SEQ ID NO: 194152 - protein, 35 aa, Artificial Sequence
  Description of Artificial Sequence: Synthetic polypeptide
DEDEIACTNPVATASWGCVAAANNEPLDRGGENDG

SEQ ID NO: 194153 - protein, 35 aa, Artificial Sequence
  Description of Artificial Sequence: Synthetic polypeptide
DETEIRTTNPIATECWGATVANAIDWAEREGENYG

SEQ ID NO: 194154 - protein, 35 aa, Artificial Sequence
  Description of Artificial Sequence: Synthetic polypeptide
DETEIRTTNPIATECWGATVANAIDWAERKGENYG

SEQ ID NO: 194155 - protein, 35 aa, Artificial Sequence
  Description of Artificial Sequence: Synthetic polypeptide
DETEIRTTNPIATECWGATVSANAEDWAEPKGPYI

SEQ ID NO: 194156 - protein, 33 aa, Artificial Sequence
  Description of Artificial Sequence: Synthetic polypeptide
DETEIRTTNPIATECWGATVWAADEANPKEPYI

SEQ ID NO: 194157 - protein, 35 aa, Artificial Sequence
  Description of Artificial Sequence: Synthetic polypeptide
DETEIRTTNPIATECWGATVWANAEDLAEPKGPYI

SEQ ID NO: 194158 - protein, 34 aa, Artificial Sequence
  Description of Artificial Sequence: Synthetic polypeptide
DETEIRTTNPIATECWGATVWANADWAEPKGQYI

SEQ ID NO: 194159 - protein, 35 aa, Artificial Sequence
  Description of Artificial Sequence: Synthetic polypeptide
STEEICTTNPAATDAYGVVVNTEGLGEQRGQGEGQ

SEQ ID NO: 194160 - protein, 38 aa, Artificial Sequence
  Description of Artificial Sequence: Synthetic polypeptide
DEDEIATTNPVATEQYGSVCAANAGVGGEEHQDDNLAG

SEQ ID NO: 194161 - protein, 34 aa, Artificial Sequence
  Description of Artificial Sequence: Synthetic polypeptide
DETEIRTTNPIATECWGATVWANADWAEPKGPYI

SEQ ID NO: 194162 - protein, 34 aa, Artificial Sequence
  Description of Artificial Sequence: Synthetic polypeptide
DETEIRTTNPIATECWGATVWANADEANPKEPYI

SEQ ID NO: 194163 - protein, 36 aa, Artificial Sequence
  Description of Artificial Sequence: Synthetic polypeptide
DETEIRTTNPIATECWGATTWSNCIDEPQERKGNYI

SEQ ID NO: 194164 - protein, 33 aa, Artificial Sequence
  Description of Artificial Sequence: Synthetic polypeptide
DETEIRTTNPIATECWGATVWAEDEANPKEPYI

SEQ ID NO: 194165 - protein, 36 aa, Artificial Sequence
  Description of Artificial Sequence: Synthetic polypeptide
STEEIRTTNPAATDAYGSVNVTTEGQGEQGGQGNGQ

SEQ ID NO: 194166 - protein, 33 aa, Artificial Sequence
  Description of Artificial Sequence: Synthetic polypeptide
DETEIRTTNPIATECWGATVWAEDEANPAEPYI

SEQ ID NO: 194167 - protein, 35 aa, Artificial Sequence
  Description of Artificial Sequence: Synthetic polypeptide
DETEIRTTNPIATECWGATVWACENEPQEPKGPYG

SEQ ID NO: 194168 - protein, 35 aa, Artificial Sequence
  Description of Artificial Sequence: Synthetic polypeptide
DEACIGTTNPVATEQWGCVCSWEDDNQYFGSDTQA

SEQ ID NO: 194169 - protein, 34 aa, Artificial Sequence
  Description of Artificial Sequence: Synthetic polypeptide
DETEIRTTNPIATECWGATVWACENEAEPKGPYG

SEQ ID NO: 194170 - protein, 37 aa, Artificial Sequence
  Description of Artificial Sequence: Synthetic polypeptide
DEMEIATTNPVAYEGWGSVCSGTDMQDRQDGGDQQEQ

SEQ ID NO: 194171 - protein, 39 aa, Artificial Sequence
  Description of Artificial Sequence: Synthetic polypeptide
DEEEIRTTNPVATEAYGSVMENQENINMDTGGIGFNGNI

SEQ ID NO: 194172 - protein, 36 aa, Artificial Sequence
  Description of Artificial Sequence: Synthetic polypeptide
VEDEIATTNPVAYEQWGSVCSANPALQNAHEDLTAM

SEQ ID NO: 194173 - protein, 36 aa, Artificial Sequence
  Description of Artificial Sequence: Synthetic polypeptide
DETEIRTTNPIATECWGATTWSNCEDEPQERKGNYI

SEQ ID NO: 194174 - protein, 34 aa, Artificial Sequence
  Description of Artificial Sequence: Synthetic polypeptide
DETEIRTTNPIATECWGATTWSNAEGWAEPKGND

SEQ ID NO: 194175 - protein, 40 aa, Artificial Sequence
  Description of Artificial Sequence: Synthetic polypeptide
DEEEIRTTNPVATEAYGVVSTVTNNNQQSATNEEGVTAQQ

SEQ ID NO: 194176 - protein, 36 aa, Artificial Sequence
  Description of Artificial Sequence: Synthetic polypeptide
DEMEIATTNPVAYEGYGCVCSTWEHNEEHFGSETQA

SEQ ID NO: 194177 - protein, 38 aa, Artificial Sequence
  Description of Artificial Sequence: Synthetic polypeptide
DEEEIRTTNPVAYEQYGCSCSNWPEDHNTENFDSDTQS

SEQ ID NO: 194178 - protein, 38 aa, Artificial Sequence
  Description of Artificial Sequence: Synthetic polypeptide
DEEEIRTTNPVAYEQYGCSCSNWNEDHNAENFNSDTQA

SEQ ID NO: 194179 - protein, 38 aa, Artificial Sequence
  Description of Artificial Sequence: Synthetic polypeptide
DEEEIRTTNPVAYEQYGCSCSNWGEPHNAENFISDNQA

SEQ ID NO: 194180 - protein, 38 aa, Artificial Sequence
  Description of Artificial Sequence: Synthetic polypeptide
AEEEIRTTNPVATEQYGCVCSNWEEDHNAENFNSDNQS

SEQ ID NO: 194181 - protein, 38 aa, Artificial Sequence
  Description of Artificial Sequence: Synthetic polypeptide
AEEEIRTTNPVATEQYGCVCSNWEEDHNQENFNSDTQD

SEQ ID NO: 194182 - protein, 37 aa, Artificial Sequence
  Description of Artificial Sequence: Synthetic polypeptide
DEAEIRTTNPVAYEQYGCVCSNWMEHNAEYFNSQNQS

SEQ ID NO: 194183 - protein, 36 aa, Artificial Sequence
  Description of Artificial Sequence: Synthetic polypeptide
DEAAISTTNPVATEQYGCVCSNWEHNAEYFGSDTQS

SEQ ID NO: 194184 - protein, 38 aa, Artificial Sequence
  Description of Artificial Sequence: Synthetic polypeptide
AEEEIRTTNPVATEQYGCVCSNWGEDDNAENFGSDTQA

SEQ ID NO: 194185 - protein, 38 aa, Artificial Sequence
  Description of Artificial Sequence: Synthetic polypeptide
AEEEIRTTNPVATEQYGCVCSNWGEDHNAENFNSDNQA

SEQ ID NO: 194186 - protein, 38 aa, Artificial Sequence
  Description of Artificial Sequence: Synthetic polypeptide
AEEEIRTTNPVATEQYGCVCSNWGEDHNAENFNSDNQS

SEQ ID NO: 194187 - protein, 38 aa, Artificial Sequence
  Description of Artificial Sequence: Synthetic polypeptide
AEEEIRTTNPVATEQYGCVCSNWGEDHNIENFNSENQA

SEQ ID NO: 194188 - protein, 37 aa, Artificial Sequence
  Description of Artificial Sequence: Synthetic polypeptide
TEAEICTTNPVAYECWGSVATTGNGPLNDDRGQNGAD

SEQ ID NO: 194189 - protein, 37 aa, Artificial Sequence
  Description of Artificial Sequence: Synthetic polypeptide
TEAEICTTNPVAYECWGSVATTGIGNLNDDRGQNGTD

SEQ ID NO: 194190 - protein, 36 aa, Artificial Sequence
  Description of Artificial Sequence: Synthetic polypeptide
TEAEICTTNPVAYECWGSVATGNGPMNDDRGQNNTD

SEQ ID NO: 194191 - protein, 38 aa, Artificial Sequence
  Description of Artificial Sequence: Synthetic polypeptide
AEEEIRTTNPVATEQYGCVCSNWGEDHNQENFGSETQA

SEQ ID NO: 194192 - protein, 37 aa, Artificial Sequence
  Description of Artificial Sequence: Synthetic polypeptide
QEEEIATTNPVATEQYGVVAGPGEGEGGQGGGNIEDT

SEQ ID NO: 194193 - protein, 38 aa, Artificial Sequence
  Description of Artificial Sequence: Synthetic polypeptide
TDESIRTTNPVATEQYGSYVVESANQQEQVMTLNVVDF

SEQ ID NO: 194194 - protein, 39 aa, Artificial Sequence
  Description of Artificial Sequence: Synthetic polypeptide
VEEEIRTTNPVATEQYGSVVYDGTDQQEQENEMGEGGGE

SEQ ID NO: 194195 - protein, 35 aa, Artificial Sequence
  Description of Artificial Sequence: Synthetic polypeptide
TDTEIATTNPVAYEQWGSVCSNWENDDEHGNHGQN

SEQ ID NO: 194196 - protein, 36 aa, Artificial Sequence
  Description of Artificial Sequence: Synthetic polypeptide
TEAAEIATTNPVAYEQWGSVCSTGDHHENHRGEDQK

SEQ ID NO: 194197 - protein, 34 aa, Artificial Sequence
  Description of Artificial Sequence: Synthetic polypeptide
DETEIRTTNPIATECWGATTWSNAEDWMPKGPYR

SEQ ID NO: 194198 - protein, 38 aa, Artificial Sequence
  Description of Artificial Sequence: Synthetic polypeptide
DEEEIATTNPVAYEQWGSVSGGEPANGPNMRNGGGVVD

SEQ ID NO: 194199 - protein, 36 aa, Artificial Sequence
  Description of Artificial Sequence: Synthetic polypeptide
DEAEIRTTNPVAYEQYGQCICSTMEHNEENFPSDQA

SEQ ID NO: 194200 - protein, 38 aa, Artificial Sequence
  Description of Artificial Sequence: Synthetic polypeptide
AEEEIRTTNPVATEQYGCVCSNWGEDHNQENFNSDNQM

SEQ ID NO: 194201 - protein, 37 aa, Artificial Sequence
  Description of Artificial Sequence: Synthetic polypeptide
TEADEICTTNPVAYECWGSVATGNGPLNDARGQNGTT

SEQ ID NO: 194202 - protein, 38 aa, Artificial Sequence
  Description of Artificial Sequence: Synthetic polypeptide
AEEEIRTTNPVATEQYGCVCSNWGEDHNQENFGSETQS

SEQ ID NO: 194203 - protein, 33 aa, Artificial Sequence
  Description of Artificial Sequence: Synthetic polypeptide
DETEIRTTNPIATECWGATTWSNADWAPKGPYI

SEQ ID NO: 194204 - protein, 33 aa, Artificial Sequence
  Description of Artificial Sequence: Synthetic polypeptide
DETEIRTTNPIATECWGATTWSNADWAPKGGYI

SEQ ID NO: 194205 - protein, 32 aa, Artificial Sequence
  Description of Artificial Sequence: Synthetic polypeptide
DDSEVACTNPVSTEGYGCVANWTIQERSGSQQ

SEQ ID NO: 194206 - protein, 38 aa, Artificial Sequence
  Description of Artificial Sequence: Synthetic polypeptide
DEEEIRTTNPVAYEQWGVSTVCPMIEGLGPPDQGDSRM

SEQ ID NO: 194207 - protein, 34 aa, Artificial Sequence
  Description of Artificial Sequence: Synthetic polypeptide
DETEIRTTNPVATECWGATWANADDWVAPKGPYD

SEQ ID NO: 194208 - protein, 35 aa, Artificial Sequence
  Description of Artificial Sequence: Synthetic polypeptide
QENEIATTNPVAYEPYGQNVSGEHLNQNHMEMNLN

SEQ ID NO: 194209 - protein, 34 aa, Artificial Sequence
  Description of Artificial Sequence: Synthetic polypeptide
DEMEIRTTNPIATECWGAVCSNADGWVAFEGPYD

SEQ ID NO: 194210 - protein, 40 aa, Artificial Sequence
  Description of Artificial Sequence: Synthetic polypeptide
DEEEIRTTNPVATESYGTVTNLQSGTISTNNTNNSEVGNV

SEQ ID NO: 194211 - protein, 38 aa, Artificial Sequence
  Description of Artificial Sequence: Synthetic polypeptide
MTEEIRTTNPVATEQYGSVCVKSVDVWTDEHPNECNSN

SEQ ID NO: 194212 - protein, 37 aa, Artificial Sequence
  Description of Artificial Sequence: Synthetic polypeptide
DEECISTTNPVATEQYGCVCSNWGEHDQESFNSDNQA

SEQ ID NO: 194213 - protein, 39 aa, Artificial Sequence
  Description of Artificial Sequence: Synthetic polypeptide
DEEEIRTTNPVATEQYGSTANCCCSEQLLIEMEEQEDLI

SEQ ID NO: 194214 - protein, 37 aa, Artificial Sequence
  Description of Artificial Sequence: Synthetic polypeptide
DEECISTTNPVATEQYGCVCSNWGEHNAEGFNSDNQA

SEQ ID NO: 194215 - protein, 38 aa, Artificial Sequence
  Description of Artificial Sequence: Synthetic polypeptide
MTEEIRTTNPVATEQYGSVCPKSVDGWTDEHFNETNIN

SEQ ID NO: 194216 - protein, 36 aa, Artificial Sequence
  Description of Artificial Sequence: Synthetic polypeptide
DEAEISTVNPVATEQYGCVCSWGAHNAENFNSDNQA

SEQ ID NO: 194217 - protein, 33 aa, Artificial Sequence
  Description of Artificial Sequence: Synthetic polypeptide
QECEICATNPCTTEIYGVVATQSGTVNQNGDTT

SEQ ID NO: 194218 - protein, 38 aa, Artificial Sequence
  Description of Artificial Sequence: Synthetic polypeptide
MTEEIRTTNPVATEQYGSVCPKSIDWWTDEHPNENNIN

SEQ ID NO: 194219 - protein, 38 aa, Artificial Sequence
  Description of Artificial Sequence: Synthetic polypeptide
MTEEIRTTNPVATEQYGSVCNKSVDEWTDEHPNENNIN

SEQ ID NO: 194220 - protein, 37 aa, Artificial Sequence
  Description of Artificial Sequence: Synthetic polypeptide
AEEEISTTNPVATEQYGCVTSTWGADNAEHFISDPQA

SEQ ID NO: 194221 - protein, 32 aa, Artificial Sequence
  Description of Artificial Sequence: Synthetic polypeptide
QESEIASTNPVGTEGWGVTMWANSTLQHKGDI

SEQ ID NO: 194222 - protein, 34 aa, Artificial Sequence
  Description of Artificial Sequence: Synthetic polypeptide
QECEICATNPCTTEIYGVVATQSGTVNNQGNGDT

SEQ ID NO: 194223 - protein, 37 aa, Artificial Sequence
  Description of Artificial Sequence: Synthetic polypeptide
DEECISTTNPVATEQYGCVCSNWGEHNAENFNSDTQS

SEQ ID NO: 194224 - protein, 37 aa, Artificial Sequence
  Description of Artificial Sequence: Synthetic polypeptide
DEECISTTNPVATEQYGCVCSNWGEHNAESFNSENQP

SEQ ID NO: 194225 - protein, 38 aa, Artificial Sequence
  Description of Artificial Sequence: Synthetic polypeptide
DEQEIRTTNPVATEQYGVVMSNNDNDTGGPGQTDQTGE

SEQ ID NO: 194226 - protein, 37 aa, Artificial Sequence
  Description of Artificial Sequence: Synthetic polypeptide
DEECISTTNPVATEQYGCVCSNWGEHNEENFNSDTQS

SEQ ID NO: 194227 - protein, 35 aa, Artificial Sequence
  Description of Artificial Sequence: Synthetic polypeptide
CEGTIRATNPVATDQYGVVTMQDGDNGQRFNDNGQ

SEQ ID NO: 194228 - protein, 37 aa, Artificial Sequence
  Description of Artificial Sequence: Synthetic polypeptide
DEECISTTNPVATEQYGCVCSNWGEHNQEFFNSDNQA

SEQ ID NO: 194229 - protein, 38 aa, Artificial Sequence
  Description of Artificial Sequence: Synthetic polypeptide
DDEEIRTTNPVATEFYGCVNMNMTGLQEENDGGIETTT

SEQ ID NO: 194230 - protein, 40 aa, Artificial Sequence
  Description of Artificial Sequence: Synthetic polypeptide
DEEEIRTTNPVATESYGTVTNLQSGTISTNNTNNTETGNA

SEQ ID NO: 194231 - protein, 36 aa, Artificial Sequence
  Description of Artificial Sequence: Synthetic polypeptide
DEMAISTTNPVATEQYGCVCSNWGEHQENFNSDTQA

SEQ ID NO: 194232 - protein, 37 aa, Artificial Sequence
  Description of Artificial Sequence: Synthetic polypeptide
DEECISTTNPVATEQYGCVCSNWGEDNAENFNSENQS

SEQ ID NO: 194233 - protein, 33 aa, Artificial Sequence
  Description of Artificial Sequence: Synthetic polypeptide
DENEIRTTNPVATECWGATTWAAEIEAEPAGPI

SEQ ID NO: 194234 - protein, 33 aa, Artificial Sequence
  Description of Artificial Sequence: Synthetic polypeptide
QECEICATNPCTTEIYGVVATTQNGTNNQNGDT

SEQ ID NO: 194235 - protein, 33 aa, Artificial Sequence
  Description of Artificial Sequence: Synthetic polypeptide
DENEIRTTNPVATECWGATTAEEDWAEPKGPYI

SEQ ID NO: 194236 - protein, 31 aa, Artificial Sequence
  Description of Artificial Sequence: Synthetic polypeptide
QESEIASTNPVGTEGWGATANSTWAPKGPYI

SEQ ID NO: 194237 - protein, 32 aa, Artificial Sequence
  Description of Artificial Sequence: Synthetic polypeptide
DENEIRTTNPVATECWGATTAEDWAEPAEPYA

SEQ ID NO: 194238 - protein, 38 aa, Artificial Sequence
  Description of Artificial Sequence: Synthetic polypeptide
DEECISTTNPVATEQYGCVCSNWGEDHNIENFGSENQS

SEQ ID NO: 194239 - protein, 40 aa, Artificial Sequence
  Description of Artificial Sequence: Synthetic polypeptide
DEEEIRTTNPVATEGYGVVDPGMGTGNVGQQEGDEGNDTS

SEQ ID NO: 194240 - protein, 38 aa, Artificial Sequence
  Description of Artificial Sequence: Synthetic polypeptide
DEECISTTNPVATEQYGCVCSNWGEDHNQEGFNSDNQA

SEQ ID NO: 194241 - protein, 36 aa, Artificial Sequence
  Description of Artificial Sequence: Synthetic polypeptide
ADECIRTTNPVATEQYGCVCSWGEHNQENFNSDTQS

SEQ ID NO: 194242 - protein, 34 aa, Artificial Sequence
  Description of Artificial Sequence: Synthetic polypeptide
QECEICATNPCTTEIYGVVATQSGTTNNQNGEDT

SEQ ID NO: 194243 - protein, 32 aa, Artificial Sequence
  Description of Artificial Sequence: Synthetic polypeptide
QESEIASTNPVGTEGWGVCAPTDLGQNHGGDI

SEQ ID NO: 194244 - protein, 31 aa, Artificial Sequence
  Description of Artificial Sequence: Synthetic polypeptide
QESEIASTNPVGTEGWGVCAPTDNQDHHGDA

SEQ ID NO: 194245 - protein, 35 aa, Artificial Sequence
  Description of Artificial Sequence: Synthetic polypeptide
NATEIATTNPVAYEQWGSARCTENDDQDHLHGDMR

SEQ ID NO: 194246 - protein, 34 aa, Artificial Sequence
  Description of Artificial Sequence: Synthetic polypeptide
CEESIATTNPVAYECWGSVYNWMNDVRREGGIHE

SEQ ID NO: 194247 - protein, 31 aa, Artificial Sequence
  Description of Artificial Sequence: Synthetic polypeptide
QESEIASTNPVGTEGWGVCAPTDQGQHGDIQ

SEQ ID NO: 194248 - protein, 34 aa, Artificial Sequence
  Description of Artificial Sequence: Synthetic polypeptide
QAEEIATTNPVATAQWGCVAGNGNPANADPPGRA

SEQ ID NO: 194249 - protein, 31 aa, Artificial Sequence
  Description of Artificial Sequence: Synthetic polypeptide
QESEIASTNPVGTEGWGVCAWTDQGQHGGDI

SEQ ID NO: 194250 - protein, 37 aa, Artificial Sequence
  Description of Artificial Sequence: Synthetic polypeptide
DEEEIACTNPVATEQWGSVSGEGGPLDINHSDDNSAG

SEQ ID NO: 194251 - protein, 37 aa, Artificial Sequence
  Description of Artificial Sequence: Synthetic polypeptide
DEECISTTNPVATEQYGCVCSNWGEDNAEFFNSQNQA

SEQ ID NO: 194252 - protein, 36 aa, Artificial Sequence
  Description of Artificial Sequence: Synthetic polypeptide
CEGTIRTTNPVATDAYGSVMGHMMLNLDGIGGENDI

SEQ ID NO: 194253 - protein, 35 aa, Artificial Sequence
  Description of Artificial Sequence: Synthetic polypeptide
NATEIATTNPVAYEQWGSARCTENKDQDDGLGDMR

SEQ ID NO: 194254 - protein, 38 aa, Artificial Sequence
  Description of Artificial Sequence: Synthetic polypeptide
DEECISTTNPVATEQYGCVCSNWGEDHNAENFGSDNQS

SEQ ID NO: 194255 - protein, 35 aa, Artificial Sequence
  Description of Artificial Sequence: Synthetic polypeptide
MSNEIRTTNPVATEQYGSCYFPLNDSDIIDLNNGQ

SEQ ID NO: 194256 - protein, 36 aa, Artificial Sequence
  Description of Artificial Sequence: Synthetic polypeptide
DEHEIQTTNPVATAAWGQTVACVANLSQRTGTGYDM

SEQ ID NO: 194257 - protein, 38 aa, Artificial Sequence
  Description of Artificial Sequence: Synthetic polypeptide
DEECISTTNPVATEQYGCVCSTWGEDHNQENFNSDTQA

SEQ ID NO: 194258 - protein, 35 aa, Artificial Sequence
  Description of Artificial Sequence: Synthetic polypeptide
MQGEIRTTNPVATEQYGCTFTEEIVTDERQEDNNE

SEQ ID NO: 194259 - protein, 37 aa, Artificial Sequence
  Description of Artificial Sequence: Synthetic polypeptide
DEECISTTNPVATEQYGCVCSWEEDHNAENFNSDNQG

SEQ ID NO: 194260 - protein, 34 aa, Artificial Sequence
  Description of Artificial Sequence: Synthetic polypeptide
QEYEICTTNPVATEFYGNVVVTEGGDEGEGEEGD

SEQ ID NO: 194261 - protein, 37 aa, Artificial Sequence
  Description of Artificial Sequence: Synthetic polypeptide
DEMEIVTTNPVAYEQYGCVCSNTGEPNEEFFNSDTQS

SEQ ID NO: 194262 - protein, 33 aa, Artificial Sequence
  Description of Artificial Sequence: Synthetic polypeptide
CEEVIACTNPVATEQWGCVAGTGPAAMMGEQEW

SEQ ID NO: 194263 - protein, 38 aa, Artificial Sequence
  Description of Artificial Sequence: Synthetic polypeptide
DDEEIRTTNPVATEFYGCVNVNMTGLQEENDGGGEGTT

SEQ ID NO: 194264 - protein, 37 aa, Artificial Sequence
  Description of Artificial Sequence: Synthetic polypeptide
DEECISTTNPVATEQYGCVCSWGEDHNAENFNSDTQS

SEQ ID NO: 194265 - protein, 37 aa, Artificial Sequence
  Description of Artificial Sequence: Synthetic polypeptide
DEECISTTNPVATEQYGCVCSWGEDHNIENFNSDTQS

SEQ ID NO: 194266 - protein, 37 aa, Artificial Sequence
  Description of Artificial Sequence: Synthetic polypeptide
DEECISTTNPVATEQYGCVCSWGEDHNQENFGSDTQA

SEQ ID NO: 194267 - protein, 36 aa, Artificial Sequence
  Description of Artificial Sequence: Synthetic polypeptide
MNDEIRTTNPVATEQYGSVVIVSAEDEWEGQMEDWQ

SEQ ID NO: 194268 - protein, 38 aa, Artificial Sequence
  Description of Artificial Sequence: Synthetic polypeptide
AEEEISTTNPVATEQYGCVCSTWMEDHNAEYFGSQTQS

SEQ ID NO: 194269 - protein, 38 aa, Artificial Sequence
  Description of Artificial Sequence: Synthetic polypeptide
DDEEIRTTNPVATEFYGCVTVNMQGLQEDQEEGGETTT

SEQ ID NO: 194270 - protein, 39 aa, Artificial Sequence
  Description of Artificial Sequence: Synthetic polypeptide
DEEEIRTTNPVATEGYGVVDVGEGTGNVGQTEGEGEDTI

SEQ ID NO: 194271 - protein, 37 aa, Artificial Sequence
  Description of Artificial Sequence: Synthetic polypeptide
DEECISTTNPVATEQYGCVCSWGEDHNQENFISENQS

SEQ ID NO: 194272 - protein, 38 aa, Artificial Sequence
  Description of Artificial Sequence: Synthetic polypeptide
AEEEISTTNPVATEQYGCVCSTWGEDHNAENFNSENQA

SEQ ID NO: 194273 - protein, 38 aa, Artificial Sequence
  Description of Artificial Sequence: Synthetic polypeptide
AEEEISTTNPVATEQYGCVCSTWGEDHNAENFNSDNQL

SEQ ID NO: 194274 - protein, 37 aa, Artificial Sequence
  Description of Artificial Sequence: Synthetic polypeptide
DEECISTTNPVATEQYGCVCSWGEDHNQENFNSDTQG

SEQ ID NO: 194275 - protein, 40 aa, Artificial Sequence
  Description of Artificial Sequence: Synthetic polypeptide
DEEEIRTTNPVATEQYGVVSTVVVVTTNQEQGTEETEEED

SEQ ID NO: 194276 - protein, 38 aa, Artificial Sequence
  Description of Artificial Sequence: Synthetic polypeptide
DEECISTTNPVATEQYGCVCSTWGEDHNAENFNSDNQA

SEQ ID NO: 194277 - protein, 37 aa, Artificial Sequence
  Description of Artificial Sequence: Synthetic polypeptide
MQGEIRTTNPVATEQYGCTSETYEIVTDERQETDNRE

SEQ ID NO: 194278 - protein, 37 aa, Artificial Sequence
  Description of Artificial Sequence: Synthetic polypeptide
MQGEIRTTNPVATEQYGCTSVWEEIVTDERFEDDNRE

SEQ ID NO: 194279 - protein, 34 aa, Artificial Sequence
  Description of Artificial Sequence: Synthetic polypeptide
QECEICATNPCTTEIYGVVATQAGTVNNQNGNDT

SEQ ID NO: 194280 - protein, 38 aa, Artificial Sequence
  Description of Artificial Sequence: Synthetic polypeptide
FEEEIRTTNPVATEQYGSVRSFVSAQLEEVSPMEQVDS

SEQ ID NO: 194281 - protein, 37 aa, Artificial Sequence
  Description of Artificial Sequence: Synthetic polypeptide
FEEEIRTTNPVATEQYGSVRVREAGHEEVSPMNQVDY

SEQ ID NO: 194282 - protein, 34 aa, Artificial Sequence
  Description of Artificial Sequence: Synthetic polypeptide
QECEICATNPCTTEIYGVVATQSGTNNQNNNGDT

SEQ ID NO: 194283 - protein, 34 aa, Artificial Sequence
  Description of Artificial Sequence: Synthetic polypeptide
QECEICATNPCTTEIYGVVATQSGTNNQNIGDTD

SEQ ID NO: 194284 - protein, 34 aa, Artificial Sequence
  Description of Artificial Sequence: Synthetic polypeptide
QECEICATNPCTTEIYGVVATQSGTNNQNGTDTA

SEQ ID NO: 194285 - protein, 37 aa, Artificial Sequence
  Description of Artificial Sequence: Synthetic polypeptide
AEEEISTTNPVATEQYGCVCSWGEDHNQENFGSDTQS

SEQ ID NO: 194286 - protein, 37 aa, Artificial Sequence
  Description of Artificial Sequence: Synthetic polypeptide
DEECISTTNPVATEQYGCVCSNWGEHNQENFGSDTQS

SEQ ID NO: 194287 - protein, 37 aa, Artificial Sequence
  Description of Artificial Sequence: Synthetic polypeptide
DEECISTTNPVATEQYGCVCSNWGEHNQEYFGSDTQA

SEQ ID NO: 194288 - protein, 37 aa, Artificial Sequence
  Description of Artificial Sequence: Synthetic polypeptide
DEECISTTNPVATEQYGCVCSNWGEHNTENFISEFQG

SEQ ID NO: 194289 - protein, 33 aa, Artificial Sequence
  Description of Artificial Sequence: Synthetic polypeptide
QECEICATNPCTTEIYGVVATQSGTNNQQNADT

SEQ ID NO: 194290 - protein, 37 aa, Artificial Sequence
  Description of Artificial Sequence: Synthetic polypeptide
DEECISTTNPVATEQYGCVCSNWGEPHNQENFNSDQS

SEQ ID NO: 194291 - protein, 38 aa, Artificial Sequence
  Description of Artificial Sequence: Synthetic polypeptide
DEEEIRCTNPVATEGYGQCVTSTWGAHNAEHFGSDPQS

SEQ ID NO: 194292 - protein, 34 aa, Artificial Sequence
  Description of Artificial Sequence: Synthetic polypeptide
QECEICATNPCTTEIYGVVATQSGTNNQNGDTTT

SEQ ID NO: 194293 - protein, 37 aa, Artificial Sequence
  Description of Artificial Sequence: Synthetic polypeptide
DEEEIRCTNPVATEGYGQCVCSWGEHNDEHFGSDTQS

SEQ ID NO: 194294 - protein, 39 aa, Artificial Sequence
  Description of Artificial Sequence: Synthetic polypeptide
DDEEIKTTNPVATEQYGAVNMTNGIEQEGDQEEGGNQIF

SEQ ID NO: 194295 - protein, 37 aa, Artificial Sequence
  Description of Artificial Sequence: Synthetic polypeptide
AEEEISTTNPVATEQYGCVCSWGEDHNAENFNSDTQS

SEQ ID NO: 194296 - protein, 39 aa, Artificial Sequence
  Description of Artificial Sequence: Synthetic polypeptide
DDEEIKTTNPVATEQYGAVNMTNFTIEQEGDQDEGGNQI

SEQ ID NO: 194297 - protein, 37 aa, Artificial Sequence
  Description of Artificial Sequence: Synthetic polypeptide
AEEEISTTNPVATEQYGCVCSWGEDDNAENFNSENQS

SEQ ID NO: 194298 - protein, 34 aa, Artificial Sequence
  Description of Artificial Sequence: Synthetic polypeptide
QECEICATNPCTTEIYGVVATQSGTNNNQNGDTS

SEQ ID NO: 194299 - protein, 36 aa, Artificial Sequence
  Description of Artificial Sequence: Synthetic polypeptide
MQGEIRTTNPVATEQYGCTYSTYEIVTDERQEDVRE

SEQ ID NO: 194300 - protein, 40 aa, Artificial Sequence
  Description of Artificial Sequence: Synthetic polypeptide
DEEEIRTTNPVATESYGTVTNLQSGTIGTNTNNNEVGNNT

SEQ ID NO: 194301 - protein, 38 aa, Artificial Sequence
  Description of Artificial Sequence: Synthetic polypeptide
DEQEIRTTNPVATEQYGVVMSNNDNMTEGPGQTDQTDD

SEQ ID NO: 194302 - protein, 39 aa, Artificial Sequence
  Description of Artificial Sequence: Synthetic polypeptide
DDEEIKTTNPVATEQYGAVNMTNTIEQEGDQEEGGNNIQ

SEQ ID NO: 194303 - protein, 34 aa, Artificial Sequence
  Description of Artificial Sequence: Synthetic polypeptide
DENEIRTTNPVATECWGATTWANAEIEAEPAGPI

SEQ ID NO: 194304 - protein, 35 aa, Artificial Sequence
  Description of Artificial Sequence: Synthetic polypeptide
DEECISTTNPVATEIYGCVCGWGEHNQEYFNSDQS

SEQ ID NO: 194305 - protein, 35 aa, Artificial Sequence
  Description of Artificial Sequence: Synthetic polypeptide
DEECISTTNPVATEIYGCVCQWGEHNQENFGSDQA

SEQ ID NO: 194306 - protein, 36 aa, Artificial Sequence
  Description of Artificial Sequence: Synthetic polypeptide
DEECISTTNPVATEQFGQCVCSWGYHNAHFGSDTQS

SEQ ID NO: 194307 - protein, 38 aa, Artificial Sequence
  Description of Artificial Sequence: Synthetic polypeptide
DENEIATTNPVATEQYGSVCAMTGVGGTAPDAQMENNH

SEQ ID NO: 194308 - protein, 38 aa, Artificial Sequence
  Description of Artificial Sequence: Synthetic polypeptide
AEEEISTTNPVATEQYGQCVCSNWEEHNAENFGSDNQA

SEQ ID NO: 194309 - protein, 37 aa, Artificial Sequence
  Description of Artificial Sequence: Synthetic polypeptide
NEAEIRCTNPVAYEQWGTVVPTDNHGLQNRERGGGQP

SEQ ID NO: 194310 - protein, 35 aa, Artificial Sequence
  Description of Artificial Sequence: Synthetic polypeptide
NEAEIRATNPVAYEQWGSVCYTTDNNDHGHGDTQH

SEQ ID NO: 194311 - protein, 37 aa, Artificial Sequence
  Description of Artificial Sequence: Synthetic polypeptide
NEAEIQCTNPVAYESYGHVVQSTCLNEQVDRPGGNNV

SEQ ID NO: 194312 - protein, 36 aa, Artificial Sequence
  Description of Artificial Sequence: Synthetic polypeptide
DEMGIGTTNPVATEQYGTVCSATDVTSVEVFEMNDI

SEQ ID NO: 194313 - protein, 38 aa, Artificial Sequence
  Description of Artificial Sequence: Synthetic polypeptide
DEMESEIATTNPVAYEQWGSVAKTLEANGDGDGGTNTG

SEQ ID NO: 194314 - protein, 39 aa, Artificial Sequence
  Description of Artificial Sequence: Synthetic polypeptide
DEGEIRTTNPVATEQYGSNIVTWTPNDEEMNNEPEIMEV

SEQ ID NO: 194315 - protein, 32 aa, Artificial Sequence
  Description of Artificial Sequence: Synthetic polypeptide
QESEIASTNPVGTEAWGVCAPTDRDQHEGNDI

SEQ ID NO: 194316 - protein, 37 aa, Artificial Sequence
  Description of Artificial Sequence: Synthetic polypeptide
DEMELATTNPVAYEQYGTVCSCTDGLPDEMEGQPDDR

SEQ ID NO: 194317 - protein, 36 aa, Artificial Sequence
  Description of Artificial Sequence: Synthetic polypeptide
NSGEIRTTNPVATEQYGSFVFFASPDESHTTEDDRQ

SEQ ID NO: 194318 - protein, 35 aa, Artificial Sequence
  Description of Artificial Sequence: Synthetic polypeptide
DEECISTTNPVATEQWGCVCQWGEHNQGFGSDTQS

SEQ ID NO: 194319 - protein, 40 aa, Artificial Sequence
  Description of Artificial Sequence: Synthetic polypeptide
DEEEIRTTNPVATESYGTVTNLQSGTISTNTNNTEQGNVA

SEQ ID NO: 194320 - protein, 38 aa, Artificial Sequence
  Description of Artificial Sequence: Synthetic polypeptide
AEEEISTTNPVATEQYGQCVCSNSGEHNQENFGSDNQD

SEQ ID NO: 194321 - protein, 37 aa, Artificial Sequence
  Description of Artificial Sequence: Synthetic polypeptide
DEECISTTNPVATEQYGCSCSMWEEHNAEYIGSDTQS

SEQ ID NO: 194322 - protein, 40 aa, Artificial Sequence
  Description of Artificial Sequence: Synthetic polypeptide
DEEEIRTTNPVATESYGTVTNLQSGTISTNTNNNTEQGNI

SEQ ID NO: 194323 - protein, 35 aa, Artificial Sequence
  Description of Artificial Sequence: Synthetic polypeptide
DEECISTTNPVATEIYGCVCGWGEHNAENFGSQQA

SEQ ID NO: 194324 - protein, 36 aa, Artificial Sequence
  Description of Artificial Sequence: Synthetic polypeptide
FEEEIRTTNPVATEQYGSTPQPPCNDAPEYAHELIM

SEQ ID NO: 194325 - protein, 36 aa, Artificial Sequence
  Description of Artificial Sequence: Synthetic polypeptide
FEEEIRTTNPVATEQYGSTIYEPANGVEPHIVMTGE

SEQ ID NO: 194326 - protein, 36 aa, Artificial Sequence
  Description of Artificial Sequence: Synthetic polypeptide
NEAEIRTTNPVATEHYGVVPCEINDGQQQQGKGDDS

SEQ ID NO: 194327 - protein, 34 aa, Artificial Sequence
  Description of Artificial Sequence: Synthetic polypeptide
SAEEIATTNPVATAQWGCVAGNGNGPDNADPGAR

SEQ ID NO: 194328 - protein, 38 aa, Artificial Sequence
  Description of Artificial Sequence: Synthetic polypeptide
FEEEIRTTNPVATEQYGQCVCSNWGEDNQENFGSDTQA

SEQ ID NO: 194329 - protein, 38 aa, Artificial Sequence
  Description of Artificial Sequence: Synthetic polypeptide
FEEEIRTTNPVATEQYGQIVTPSMPVELGMLNGVEGWS

SEQ ID NO: 194330 - protein, 37 aa, Artificial Sequence
  Description of Artificial Sequence: Synthetic polypeptide
QECEICTTNPVATEAYGVVSTVQQQQLQQGTTDEQET

SEQ ID NO: 194331 - protein, 40 aa, Artificial Sequence
  Description of Artificial Sequence: Synthetic polypeptide
FEEEIRTTNPVATEQYGQVVYTQGPDQLIDQEGEGGNQGT

SEQ ID NO: 194332 - protein, 37 aa, Artificial Sequence
  Description of Artificial Sequence: Synthetic polypeptide
QECEICTTNPVATEAYGVVSTVQQQLQQQGTEDEQEA

SEQ ID NO: 194333 - protein, 37 aa, Artificial Sequence
  Description of Artificial Sequence: Synthetic polypeptide
DEGEIRTTNPVATEQYGSTYMSYASEDDVYSQNNEIQ

SEQ ID NO: 194334 - protein, 33 aa, Artificial Sequence
  Description of Artificial Sequence: Synthetic polypeptide
SAEEIATTNPVATAAWGGCVAGTAGLAAGDQVM

SEQ ID NO: 194335 - protein, 33 aa, Artificial Sequence
  Description of Artificial Sequence: Synthetic polypeptide
SAEEIATTNPVATAAWGGCSAGTGLAAGGDQVM

SEQ ID NO: 194336 - protein, 35 aa, Artificial Sequence
  Description of Artificial Sequence: Synthetic polypeptide
NEAEIATTNPVAYEQWGCTSTGNPMNGNHGEGNHP

SEQ ID NO: 194337 - protein, 33 aa, Artificial Sequence
  Description of Artificial Sequence: Synthetic polypeptide
DEEEIASTNPIATECWGAVWSNDEDWAEPGPYQ

SEQ ID NO: 194338 - protein, 38 aa, Artificial Sequence
  Description of Artificial Sequence: Synthetic polypeptide
CEEEIVTTNPVATEQYGSVVIDPDDENEQFNVQGEDGD

SEQ ID NO: 194339 - protein, 40 aa, Artificial Sequence
  Description of Artificial Sequence: Synthetic polypeptide
DEEEIRTTNPVATESYGTVTNLQSGTISTTNTNNNEVGNT

SEQ ID NO: 194340 - protein, 36 aa, Artificial Sequence
  Description of Artificial Sequence: Synthetic polypeptide
RSNEIRTTNPVATEQYGSVSWCGVAEIPFSHQEQET

SEQ ID NO: 194341 - protein, 40 aa, Artificial Sequence
  Description of Artificial Sequence: Synthetic polypeptide
DEEEIRTTNPVATESYGTVTNLQSGTISTNTTNTEQGNVT

SEQ ID NO: 194342 - protein, 37 aa, Artificial Sequence
  Description of Artificial Sequence: Synthetic polypeptide
QECEICTTNPVATEAYGVVSTVNQQNNQQGTEDEQEE

SEQ ID NO: 194343 - protein, 38 aa, Artificial Sequence
  Description of Artificial Sequence: Synthetic polypeptide
FEEEIRTTNPVATEQYGSIARMDPVSLSAEETLEILTE

SEQ ID NO: 194344 - protein, 38 aa, Artificial Sequence
  Description of Artificial Sequence: Synthetic polypeptide
NEAEIRTTNPVATEQYGCQWTSAVSQLNPNIDESTQYR

SEQ ID NO: 194345 - protein, 37 aa, Artificial Sequence
  Description of Artificial Sequence: Synthetic polypeptide
DEEEIACTNPVATEQYGCTACAANDGLPLGSEGNHHA

SEQ ID NO: 194346 - protein, 37 aa, Artificial Sequence
  Description of Artificial Sequence: Synthetic polypeptide
DEEEIACTNPVATEQYGCTACAANDGEPLGSEGNNHI

SEQ ID NO: 194347 - protein, 39 aa, Artificial Sequence
  Description of Artificial Sequence: Synthetic polypeptide
NEAEIRTTNPVATEQYGSHVCTVGGLGNVTSREGSFQEG

SEQ ID NO: 194348 - protein, 37 aa, Artificial Sequence
  Description of Artificial Sequence: Synthetic polypeptide
DEECISTTNPVATEQYGCVCSNWGEDENAEYFGSDQS

SEQ ID NO: 194349 - protein, 36 aa, Artificial Sequence
  Description of Artificial Sequence: Synthetic polypeptide
NSNEIRTTNPVATEQYGSVCSVTWPIYEDMFVEEHQ

SEQ ID NO: 194350 - protein, 35 aa, Artificial Sequence
  Description of Artificial Sequence: Synthetic polypeptide
NEAEIATTNPVAYDQYGTVATGPGDHQPEGRGEVD

SEQ ID NO: 194351 - protein, 38 aa, Artificial Sequence
  Description of Artificial Sequence: Synthetic polypeptide
DEGEIRTTNPVATEQYGSCNTSAEDTMLEHFYEEDLIN

SEQ ID NO: 194352 - protein, 36 aa, Artificial Sequence
  Description of Artificial Sequence: Synthetic polypeptide
NDEEISTTNPVATEQYGCVCSWGEDNIENFGSDTQS

SEQ ID NO: 194353 - protein, 34 aa, Artificial Sequence
  Description of Artificial Sequence: Synthetic polypeptide
DEEEIASVNPIATECYGVTVANAENWQEPKGPYQ

SEQ ID NO: 194354 - protein, 37 aa, Artificial Sequence
  Description of Artificial Sequence: Synthetic polypeptide
DEECISTTNPVATEQYGCVCSNWEEHNIENFNSDTQA

SEQ ID NO: 194355 - protein, 37 aa, Artificial Sequence
  Description of Artificial Sequence: Synthetic polypeptide
DEECISTTNPVATEQYGCVCSNWEEHNTENFISDTQS

SEQ ID NO: 194356 - protein, 37 aa, Artificial Sequence
  Description of Artificial Sequence: Synthetic polypeptide
NDEEIRTTNPVAYEQYGCVCSTWGEHNQENFGSDTQS

SEQ ID NO: 194357 - protein, 36 aa, Artificial Sequence
  Description of Artificial Sequence: Synthetic polypeptide
NTGEIRTTNPVATEQYGSCSVTAVEHCDEELFEEHV

SEQ ID NO: 194358 - protein, 38 aa, Artificial Sequence
  Description of Artificial Sequence: Synthetic polypeptide
FEEEIRTTNPVATEQYGSVMGDIGEQEGQDLDEEGGQQ

SEQ ID NO: 194359 - protein, 38 aa, Artificial Sequence
  Description of Artificial Sequence: Synthetic polypeptide
FEEEIRTTNPVATEQYGSVMGQIGEQEGQTLTEEGGQM

SEQ ID NO: 194360 - protein, 39 aa, Artificial Sequence
  Description of Artificial Sequence: Synthetic polypeptide
DEEEIRTTNPVATEQYGTTTTYQNDHSLAEMQEVFQQGL

SEQ ID NO: 194361 - protein, 39 aa, Artificial Sequence
  Description of Artificial Sequence: Synthetic polypeptide
FEEEIRTTNPVATEQYGSVMGSVIGEQDGQTLTEEGIQQ

SEQ ID NO: 194362 - protein, 39 aa, Artificial Sequence
  Description of Artificial Sequence: Synthetic polypeptide
DDEEIKTTNPVATEQYGAVNMTNTIEQEGDQEGGGNQIT

SEQ ID NO: 194363 - protein, 35 aa, Artificial Sequence
  Description of Artificial Sequence: Synthetic polypeptide
DEHEIRTTNPCATECWGNVCTIDGGDRQGQGQGDI

SEQ ID NO: 194364 - protein, 37 aa, Artificial Sequence
  Description of Artificial Sequence: Synthetic polypeptide
NTTEIATTNPVATEPWGSVCSNWDHNQQDRNGDKNDN

SEQ ID NO: 194365 - protein, 37 aa, Artificial Sequence
  Description of Artificial Sequence: Synthetic polypeptide
NDEEIRTTNPVATEQYGQCVCSNWMEHNQENFGSDQS

SEQ ID NO: 194366 - protein, 37 aa, Artificial Sequence
  Description of Artificial Sequence: Synthetic polypeptide
CEGTIRTTNPVATEAYGSVMGQMMLNLDGTIGGENDI

SEQ ID NO: 194367 - protein, 37 aa, Artificial Sequence
  Description of Artificial Sequence: Synthetic polypeptide
DEEEIACTNPVATEQWGSVSGEGGPQGINHSDDNSAN

SEQ ID NO: 194368 - protein, 37 aa, Artificial Sequence
  Description of Artificial Sequence: Synthetic polypeptide
DESAIATTNPVAYTEAYGCVMSVLLNETSQREGGDQA

SEQ ID NO: 194369 - protein, 37 aa, Artificial Sequence
  Description of Artificial Sequence: Synthetic polypeptide
DEEEIACTNPVATEQWGSVSGEGGPMGINHSDDNEAG

SEQ ID NO: 194370 - protein, 36 aa, Artificial Sequence
  Description of Artificial Sequence: Synthetic polypeptide
NDEEISTTNPVATEQYGCVCSWGEHNQENFNSDTQS

SEQ ID NO: 194371 - protein, 37 aa, Artificial Sequence
  Description of Artificial Sequence: Synthetic polypeptide
DEECISTTNPVATEQYGCVCSNWEEHNAENFNSDTQA

SEQ ID NO: 194372 - protein, 37 aa, Artificial Sequence
  Description of Artificial Sequence: Synthetic polypeptide
DEECISTTNPVATEQYGCVCSNWEEDNTESFNSENQS

SEQ ID NO: 194373 - protein, 38 aa, Artificial Sequence
  Description of Artificial Sequence: Synthetic polypeptide
DEEEIACTNPVATEQWGSVSSMTPAGGTNQGNNMEPVN

SEQ ID NO: 194374 - protein, 40 aa, Artificial Sequence
  Description of Artificial Sequence: Synthetic polypeptide
DEEEIRTTNPVATESYGTVTNLQSGTISTNTNNNEQGTNT

SEQ ID NO: 194375 - protein, 37 aa, Artificial Sequence
  Description of Artificial Sequence: Synthetic polypeptide
FEEEIRTTNPVATEQYGSVGPWPAILPHASMIMPAEN

SEQ ID NO: 194376 - protein, 40 aa, Artificial Sequence
  Description of Artificial Sequence: Synthetic polypeptide
DEEEIRTTNPVATESYGTVTNLQSGTISTNTINTEVGNVA

SEQ ID NO: 194377 - protein, 40 aa, Artificial Sequence
  Description of Artificial Sequence: Synthetic polypeptide
DEEEIRTTNPVATESYGTVTNLQSGTISTNTINTEEGTNE

SEQ ID NO: 194378 - protein, 37 aa, Artificial Sequence
  Description of Artificial Sequence: Synthetic polypeptide
FEEEIRTTNPVATEQYGSVGPWPPILPHASMITPAVN

SEQ ID NO: 194379 - protein, 37 aa, Artificial Sequence
  Description of Artificial Sequence: Synthetic polypeptide
FEEEIRTTNPVATEQYGSVGPWPPTEPHASMIMPACN

SEQ ID NO: 194380 - protein, 37 aa, Artificial Sequence
  Description of Artificial Sequence: Synthetic polypeptide
DEECISTTNPVATEQYGCVCGNWGEHNQENFNSDTQA

SEQ ID NO: 194381 - protein, 38 aa, Artificial Sequence
  Description of Artificial Sequence: Synthetic polypeptide
DEEEIRTTNPVATEQYGSYVTPLPPVLEAVMPDDVHSV

SEQ ID NO: 194382 - protein, 40 aa, Artificial Sequence
  Description of Artificial Sequence: Synthetic polypeptide
DEEEIRTTNPVATESYGTVTNLQSGTISTNTIGTTEVGNV

SEQ ID NO: 194383 - protein, 35 aa, Artificial Sequence
  Description of Artificial Sequence: Synthetic polypeptide
NEAEIATTNPVAYEPWGVVWGDTNDQDQDRQMENP

SEQ ID NO: 194384 - protein, 37 aa, Artificial Sequence
  Description of Artificial Sequence: Synthetic polypeptide
DEECISTTNPVATEQYGCVCSMWGEHNQENFNSDTQM

SEQ ID NO: 194385 - protein, 37 aa, Artificial Sequence
  Description of Artificial Sequence: Synthetic polypeptide
DEECISTTNPVATEQYGCVCSMWGEHNQENFNSETQS

SEQ ID NO: 194386 - protein, 38 aa, Artificial Sequence
  Description of Artificial Sequence: Synthetic polypeptide
CEEEIACTNPVATEQYGSCAAATGNHQPLDSGEGNDLH

SEQ ID NO: 194387 - protein, 38 aa, Artificial Sequence
  Description of Artificial Sequence: Synthetic polypeptide
FEEEIRTTNPVATEQYGSVIEPEMYESWVPDFGIVEMH

SEQ ID NO: 194388 - protein, 38 aa, Artificial Sequence
  Description of Artificial Sequence: Synthetic polypeptide
DDEEIRTTNPVATEFYGCVNENMTGLQEENDGGGETIT

SEQ ID NO: 194389 - protein, 37 aa, Artificial Sequence
  Description of Artificial Sequence: Synthetic polypeptide
DEECISTTNPVATEQYGCVCSNSGEHNQENSNSDTQA

SEQ ID NO: 194390 - protein, 35 aa, Artificial Sequence
  Description of Artificial Sequence: Synthetic polypeptide
DEAVIATTNPVAYEGWGTVCPTNDLHDQNGQGHSP

SEQ ID NO: 194391 - protein, 36 aa, Artificial Sequence
  Description of Artificial Sequence: Synthetic polypeptide
DEAEISTVNPVATEQYGCVCSNWGEHNANFISQNQA

SEQ ID NO: 194392 - protein, 41 aa, Artificial Sequence
  Description of Artificial Sequence: Synthetic polypeptide
DEEEIRTTNPVATESYGTVTNLQSGTISTNNTTNQEIGTNV

SEQ ID NO: 194393 - protein, 38 aa, Artificial Sequence
  Description of Artificial Sequence: Synthetic polypeptide
DEECISTTNPVATEQYGCVCSNWEEDHNTENFGSDNQS

SEQ ID NO: 194394 - protein, 33 aa, Artificial Sequence
  Description of Artificial Sequence: Synthetic polypeptide
NEAEIATTNPCAYEQWGTVAWTDIDQNHQGDAP

SEQ ID NO: 194395 - protein, 37 aa, Artificial Sequence
  Description of Artificial Sequence: Synthetic polypeptide
NEAEIRTTNPVATEQYGSVWPETPWATNIEGSEEPQP

SEQ ID NO: 194396 - protein, 33 aa, Artificial Sequence
  Description of Artificial Sequence: Synthetic polypeptide
CEEVIACTNPVATEQWGCVAGTGPEAMMGEGDW

SEQ ID NO: 194397 - protein, 38 aa, Artificial Sequence
  Description of Artificial Sequence: Synthetic polypeptide
DDEEIRTTNPVATEFYGNVTVNMNGLQEDQDEGGETTT

SEQ ID NO: 194398 - protein, 37 aa, Artificial Sequence
  Description of Artificial Sequence: Synthetic polypeptide
DEMEIVTTNPVAYEQYGCVCSNTGEDPNEEFFGSDQS

SEQ ID NO: 194399 - protein, 36 aa, Artificial Sequence
  Description of Artificial Sequence: Synthetic polypeptide
MESEIRTTNPVATCQYGCCVAAGVPNLDSLGGQFED

SEQ ID NO: 194400 - protein, 38 aa, Artificial Sequence
  Description of Artificial Sequence: Synthetic polypeptide
DEEEIRTTNPVATEQYGSTGEICAVFGEEVQLEMEDAW

SEQ ID NO: 194401 - protein, 36 aa, Artificial Sequence
  Description of Artificial Sequence: Synthetic polypeptide
MESEIRTTNPVATCQYGCCCATGVPNLDSLGGQTED

SEQ ID NO: 194402 - protein, 37 aa, Artificial Sequence
  Description of Artificial Sequence: Synthetic polypeptide
DEEEIRATNPVATEQWGTTICAGNDGLGTDHQGGEDK

SEQ ID NO: 194403 - protein, 35 aa, Artificial Sequence
  Description of Artificial Sequence: Synthetic polypeptide
MESEICTTNPVATEQYGSVIWMDFLNEKIESTQQM

SEQ ID NO: 194404 - protein, 36 aa, Artificial Sequence
  Description of Artificial Sequence: Synthetic polypeptide
MESEICTTNPVATCQYGCCVATGVPNNDSRGGSQMD

SEQ ID NO: 194405 - protein, 35 aa, Artificial Sequence
  Description of Artificial Sequence: Synthetic polypeptide
DEGEIRTTNPIATEQWGATTWANAEDWAEPKGPYR

SEQ ID NO: 194406 - protein, 31 aa, Artificial Sequence
  Description of Artificial Sequence: Synthetic polypeptide
QETEIATTNPIATEQYGETAPEEVCAHEEYK

SEQ ID NO: 194407 - protein, 37 aa, Artificial Sequence
  Description of Artificial Sequence: Synthetic polypeptide
DENEIRTTNPVAFEEYGQSAVIDGDLGQGEQGDEDGI

SEQ ID NO: 194408 - protein, 35 aa, Artificial Sequence
  Description of Artificial Sequence: Synthetic polypeptide
QAEEIATTNPVATEQWGCTAGNNGLDTQAGDQVSG

SEQ ID NO: 194409 - protein, 37 aa, Artificial Sequence
  Description of Artificial Sequence: Synthetic polypeptide
AEEEISTTNPVATEQYGCVCSNSGEHNQENFSSENQS

SEQ ID NO: 194410 - protein, 37 aa, Artificial Sequence
  Description of Artificial Sequence: Synthetic polypeptide
AEEEISTTNPVATEQYGCVCSNSGEDNQENFNSDTQA

SEQ ID NO: 194411 - protein, 37 aa, Artificial Sequence
  Description of Artificial Sequence: Synthetic polypeptide
AEEEISTTNPVATEQYGCVCSNSGEDNAENFNSETQS

SEQ ID NO: 194412 - protein, 34 aa, Artificial Sequence
  Description of Artificial Sequence: Synthetic polypeptide
QETEIATTNPIATEQYGATTWANAEDWQEPKGPI

SEQ ID NO: 194413 - protein, 38 aa, Artificial Sequence
  Description of Artificial Sequence: Synthetic polypeptide
AEEEISTTNPVATEQYGCVCSNSGEDHNAENFGSENQP

SEQ ID NO: 194414 - protein, 37 aa, Artificial Sequence
  Description of Artificial Sequence: Synthetic polypeptide
AEEEISTTNPVATEQYGCVCSNAGEHNDEFFGSDTQS

SEQ ID NO: 194415 - protein, 37 aa, Artificial Sequence
  Description of Artificial Sequence: Synthetic polypeptide
AEEEISTTNPVATEQYGCVCSMWGEHNQENFNSQNQS

SEQ ID NO: 194416 - protein, 37 aa, Artificial Sequence
  Description of Artificial Sequence: Synthetic polypeptide
AEEEISTTNPVATEQYGCVCSMWGEHNQENFNSQNQA

SEQ ID NO: 194417 - protein, 37 aa, Artificial Sequence
  Description of Artificial Sequence: Synthetic polypeptide
MESEIRTTNPVATCQYGQTCVATGVPNLDSLGGQFED

SEQ ID NO: 194418 - protein, 35 aa, Artificial Sequence
  Description of Artificial Sequence: Synthetic polypeptide
DEAEIRTTNGVAYCQYGCVCSNSEHNQEYFGSDQS

SEQ ID NO: 194419 - protein, 38 aa, Artificial Sequence
  Description of Artificial Sequence: Synthetic polypeptide
DEAEIRTTNCVAYNAYGSTCCSQTTNEGSQRTVGDNEH

SEQ ID NO: 194420 - protein, 39 aa, Artificial Sequence
  Description of Artificial Sequence: Synthetic polypeptide
DEEEIRTTNPVATEGYGVVDVGVGTGNDGEEEGEGNDTE

SEQ ID NO: 194421 - protein, 36 aa, Artificial Sequence
  Description of Artificial Sequence: Synthetic polypeptide
DEAEISTVNPVATEQYGCVCSWGEHNAENFISNNQA

SEQ ID NO: 194422 - protein, 37 aa, Artificial Sequence
  Description of Artificial Sequence: Synthetic polypeptide
QETEIGTTNPVATEQYGVVVSATDGGDEEEEGGNNTI

SEQ ID NO: 194423 - protein, 35 aa, Artificial Sequence
  Description of Artificial Sequence: Synthetic polypeptide
QETEIATTNPVAYEQWGVVSGGNGNEAQGGDGMTQ

SEQ ID NO: 194424 - protein, 37 aa, Artificial Sequence
  Description of Artificial Sequence: Synthetic polypeptide
MESEIRTTNPVATEQYGAVSVPNCDAEPQYIPQEEPQ

SEQ ID NO: 194425 - protein, 39 aa, Artificial Sequence
  Description of Artificial Sequence: Synthetic polypeptide
DDEEIRTTNPVATEQYGSVAGQGQGGDDEFGNGGQEETM

SEQ ID NO: 194426 - protein, 37 aa, Artificial Sequence
  Description of Artificial Sequence: Synthetic polypeptide
MESEIRTTNPVATEQYGAVSSPNTDAEPQPIPQEEPQ

SEQ ID NO: 194427 - protein, 38 aa, Artificial Sequence
  Description of Artificial Sequence: Synthetic polypeptide
DDEEIRTTNPVATEFYGQVNVNMNLQLDQEGGGGETGT

SEQ ID NO: 194428 - protein, 32 aa, Artificial Sequence
  Description of Artificial Sequence: Synthetic polypeptide
QETEIATTNPVATEQWGATPNEEVCQEHKEEK

SEQ ID NO: 194429 - protein, 37 aa, Artificial Sequence
  Description of Artificial Sequence: Synthetic polypeptide
AEEEISTTNPVATEQYGCVCSNWEEHNTENFGSDTQA

SEQ ID NO: 194430 - protein, 32 aa, Artificial Sequence
  Description of Artificial Sequence: Synthetic polypeptide
QETEIATTNPIATECWGITTWSNAEDWQSGTI

SEQ ID NO: 194431 - protein, 32 aa, Artificial Sequence
  Description of Artificial Sequence: Synthetic polypeptide
QETEIATTNPVATEQWGATANEEVWAEPKGPK

SEQ ID NO: 194432 - protein, 37 aa, Artificial Sequence
  Description of Artificial Sequence: Synthetic polypeptide
AEEEISTTNPVATEQYGCVCSNWEEHNAENFNSDTQA

SEQ ID NO: 194433 - protein, 32 aa, Artificial Sequence
  Description of Artificial Sequence: Synthetic polypeptide
QETEIATTNPVATEQWGATANEEVCQEHKEEK

SEQ ID NO: 194434 - protein, 32 aa, Artificial Sequence
  Description of Artificial Sequence: Synthetic polypeptide
QETEIATTNPVATEQWGATANEEVCAEPKGPK

SEQ ID NO: 194435 - protein, 38 aa, Artificial Sequence
  Description of Artificial Sequence: Synthetic polypeptide
AEEEISTTNPVATEQYGCVCSNWEEDHNIENFGSDNQA

SEQ ID NO: 194436 - protein, 38 aa, Artificial Sequence
  Description of Artificial Sequence: Synthetic polypeptide
DAEEIATTNPVATEQYGSVCSPVGDNNHNIDAEGEGAH

SEQ ID NO: 194437 - protein, 33 aa, Artificial Sequence
  Description of Artificial Sequence: Synthetic polypeptide
QECEICATNPCTTEIYGVVATNNTNNQNGTDTE

SEQ ID NO: 194438 - protein, 39 aa, Artificial Sequence
  Description of Artificial Sequence: Synthetic polypeptide
DEEEIRTTNPVATEGYGVVDVGVGMENVGQQEGEGNDTI

SEQ ID NO: 194439 - protein, 38 aa, Artificial Sequence
  Description of Artificial Sequence: Synthetic polypeptide
DEECISTTNPVATEQYGQCVCSNWGEDNAEFFGSQNQS

SEQ ID NO: 194440 - protein, 39 aa, Artificial Sequence
  Description of Artificial Sequence: Synthetic polypeptide
DEEEIRTTNPVATEGYGVVDVGVGNGNVGQEEGEGNDQE

SEQ ID NO: 194441 - protein, 37 aa, Artificial Sequence
  Description of Artificial Sequence: Synthetic polypeptide
AEEEISTTNPVATEQYGCVCSNWEEHNAENFNSDTQS

SEQ ID NO: 194442 - protein, 37 aa, Artificial Sequence
  Description of Artificial Sequence: Synthetic polypeptide
DDEEIGTTNPVATEQYGCVCSNWGEDDNQENFGSQQS

SEQ ID NO: 194443 - protein, 32 aa, Artificial Sequence
  Description of Artificial Sequence: Synthetic polypeptide
QETEIATTNPIATECWGITTWSNAEDWQSGPI

SEQ ID NO: 194444 - protein, 37 aa, Artificial Sequence
  Description of Artificial Sequence: Synthetic polypeptide
MESCIRTTNPVATCQYGCCVATGVPNLDSRGGTQFED

SEQ ID NO: 194445 - protein, 37 aa, Artificial Sequence
  Description of Artificial Sequence: Synthetic polypeptide
YEQEICTTNPVATEQYGVVQGEGNNNGLGQEEGEGED

SEQ ID NO: 194446 - protein, 38 aa, Artificial Sequence
  Description of Artificial Sequence: Synthetic polypeptide
MEPEIRTTNPVATEQYGETTASTLFNPKEEFRQADNAF

SEQ ID NO: 194447 - protein, 38 aa, Artificial Sequence
  Description of Artificial Sequence: Synthetic polypeptide
DDEEIRTTNPVATEQYGQCVCSNWGEHNIENFNSDNQA

SEQ ID NO: 194448 - protein, 38 aa, Artificial Sequence
  Description of Artificial Sequence: Synthetic polypeptide
DDEEIRTTNPVATEQYGQCVCSNWGEHNAENFNSDTQA

SEQ ID NO: 194449 - protein, 38 aa, Artificial Sequence
  Description of Artificial Sequence: Synthetic polypeptide
DDEEIRTTNPVATEQYGQCVCSNWGEHNAEFFNSETQG

SEQ ID NO: 194450 - protein, 38 aa, Artificial Sequence
  Description of Artificial Sequence: Synthetic polypeptide
MENEIRTVNPVATEFYGSVSTGGDDGEGQLEGVFGNGT

SEQ ID NO: 194451 - protein, 36 aa, Artificial Sequence
  Description of Artificial Sequence: Synthetic polypeptide
MENEIRTTNPVSTEPYGFTITSWSDGQVQQNGQNLH

SEQ ID NO: 194452 - protein, 35 aa, Artificial Sequence
  Description of Artificial Sequence: Synthetic polypeptide
DEGEIRPTNPIATEQWGATTWANAEDWQEPKGPYR

SEQ ID NO: 194453 - protein, 36 aa, Artificial Sequence
  Description of Artificial Sequence: Synthetic polypeptide
MENEIRTTNPVATETYGSVPVGDVSLEEDILSTQEE

SEQ ID NO: 194454 - protein, 38 aa, Artificial Sequence
  Description of Artificial Sequence: Synthetic polypeptide
DDEEIRTTNPVATEQYGQCVCSNWGEDHNEENFGSDQV

SEQ ID NO: 194455 - protein, 35 aa, Artificial Sequence
  Description of Artificial Sequence: Synthetic polypeptide
CEGEIATTNPVATEQWGTNCSAAADHGMNRSNDSW

SEQ ID NO: 194456 - protein, 39 aa, Artificial Sequence
  Description of Artificial Sequence: Synthetic polypeptide
DEQEIRTTNPVATEQYGVVVMSNNDNNTEGPGQTGQTED

SEQ ID NO: 194457 - protein, 38 aa, Artificial Sequence
  Description of Artificial Sequence: Synthetic polypeptide
YEQEICTTNPVATEAYGSVVNNGNNTNGLGQQEGEGED

SEQ ID NO: 194458 - protein, 37 aa, Artificial Sequence
  Description of Artificial Sequence: Synthetic polypeptide
MENEIRTTNPVATEQYGSVTSWCGVAEIPFSDQVVET

SEQ ID NO: 194459 - protein, 36 aa, Artificial Sequence
  Description of Artificial Sequence: Synthetic polypeptide
MENEIRTTNPVATEQYGSVSWCQVAEIPFSHEEVET

SEQ ID NO: 194460 - protein, 37 aa, Artificial Sequence
  Description of Artificial Sequence: Synthetic polypeptide
DEQEIRTTNPVATESYGDVVVNGFGQGGQDTEQTTGF

SEQ ID NO: 194461 - protein, 38 aa, Artificial Sequence
  Description of Artificial Sequence: Synthetic polypeptide
CEEEIACTNPVATEQYGSVACSADNPLPAEAPIGDQHQ

SEQ ID NO: 194462 - protein, 38 aa, Artificial Sequence
  Description of Artificial Sequence: Synthetic polypeptide
DDEEIRTTNPVATEQYGQCVCSNWEEHNIEFFNSDTQA

SEQ ID NO: 194463 - protein, 38 aa, Artificial Sequence
  Description of Artificial Sequence: Synthetic polypeptide
DDEEIRTTNPVATEQYGQCVCSNWEEDHQEHFGSDTQQ

SEQ ID NO: 194464 - protein, 38 aa, Artificial Sequence
  Description of Artificial Sequence: Synthetic polypeptide
DDEEIRTTNPVATEQYGQCVCSNWGEHNQENFGSETQD

SEQ ID NO: 194465 - protein, 38 aa, Artificial Sequence
  Description of Artificial Sequence: Synthetic polypeptide
DDEEIRTTNPVATEQYGQCVCSNWGEHNQENFNSDTQF

SEQ ID NO: 194466 - protein, 39 aa, Artificial Sequence
  Description of Artificial Sequence: Synthetic polypeptide
DEEEIRTTNPVATEGYGVVDVGVGTGNVGQEEGEGDDTI

SEQ ID NO: 194467 - protein, 36 aa, Artificial Sequence
  Description of Artificial Sequence: Synthetic polypeptide
QETAEIATTNPVAYEQWGSVAITNNEEAGDSTGNDM

SEQ ID NO: 194468 - protein, 34 aa, Artificial Sequence
  Description of Artificial Sequence: Synthetic polypeptide
MESCIRCTNPVATEQYGCVWPWVDMSANGNMPEN

SEQ ID NO: 194469 - protein, 35 aa, Artificial Sequence
  Description of Artificial Sequence: Synthetic polypeptide
DEEEIACTNPVATEQWGCVAATGQEADTPGGDTPW

SEQ ID NO: 194470 - protein, 38 aa, Artificial Sequence
  Description of Artificial Sequence: Synthetic polypeptide
MEQEIVTTNPVATEFYGAVSNMNLVGDDQDQEDDDGNP

SEQ ID NO: 194471 - protein, 36 aa, Artificial Sequence
  Description of Artificial Sequence: Synthetic polypeptide
MEQEIRTTNPVATEQYGVVSESENWDNTDFDEVQVQ

SEQ ID NO: 194472 - protein, 39 aa, Artificial Sequence
  Description of Artificial Sequence: Synthetic polypeptide
MEQEIRTTNPVATEQYGSVVMSVNDNNTGGFGQTGQVGD

SEQ ID NO: 194473 - protein, 33 aa, Artificial Sequence
  Description of Artificial Sequence: Synthetic polypeptide
QECEICATNPCTTEIYGVVATNNATTNQNGEDT

SEQ ID NO: 194474 - protein, 37 aa, Artificial Sequence
  Description of Artificial Sequence: Synthetic polypeptide
AEEEISTTNPVATEQYGCVCSDWGEHNAENFNSDNQS

SEQ ID NO: 194475 - protein, 37 aa, Artificial Sequence
  Description of Artificial Sequence: Synthetic polypeptide
DEHEIATTNPVATEQYGSVYPDATERGEEDFGSLQVG

SEQ ID NO: 194476 - protein, 36 aa, Artificial Sequence
  Description of Artificial Sequence: Synthetic polypeptide
QAEEIATTNPVATEQWGCTNAGNNGLQTQAGDQNSH

SEQ ID NO: 194477 - protein, 39 aa, Artificial Sequence
  Description of Artificial Sequence: Synthetic polypeptide
DEEEIRTTNPVATEGYGVVDVGVGTGNVGEEEGEGNNII

SEQ ID NO: 194478 - protein, 37 aa, Artificial Sequence
  Description of Artificial Sequence: Synthetic polypeptide
AEEEISTTNPVATEQYGCVCQNWGEHNQENFNSETQG

SEQ ID NO: 194479 - protein, 32 aa, Artificial Sequence
  Description of Artificial Sequence: Synthetic polypeptide
QETEIATTNPCASEQWGATTANCDWAEPKGPR

SEQ ID NO: 194480 - protein, 38 aa, Artificial Sequence
  Description of Artificial Sequence: Synthetic polypeptide
MEQEIRTTNPVATEQYGCVWSCTQDMEQNLRSTEEEHL

SEQ ID NO: 194481 - protein, 37 aa, Artificial Sequence
  Description of Artificial Sequence: Synthetic polypeptide
DEECISTTNPVATEQYGQCVCSNWGEHDQSFNSDNQS

SEQ ID NO: 194482 - protein, 32 aa, Artificial Sequence
  Description of Artificial Sequence: Synthetic polypeptide
QETEIASTNPIATECWGATMANSTLQHKGPYI

SEQ ID NO: 194483 - protein, 38 aa, Artificial Sequence
  Description of Artificial Sequence: Synthetic polypeptide
MEQEIRTTNPVATEFYGTVSNMNLVGDDQDQEDDDENP

SEQ ID NO: 194484 - protein, 38 aa, Artificial Sequence
  Description of Artificial Sequence: Synthetic polypeptide
DDEEIRTTNPVATEQYGQCVCSNWGEHNQEYFNSETQS

SEQ ID NO: 194485 - protein, 38 aa, Artificial Sequence
  Description of Artificial Sequence: Synthetic polypeptide
YEQEIRTTNPVATDQYGSVVMSVNDNNTGGGQTGQVGD

SEQ ID NO: 194486 - protein, 38 aa, Artificial Sequence
  Description of Artificial Sequence: Synthetic polypeptide
DDEEIRTTNPVATEQYGQCVCSNWGEHNQEYFNSDTQS

SEQ ID NO: 194487 - protein, 38 aa, Artificial Sequence
  Description of Artificial Sequence: Synthetic polypeptide
DDEEIRTTNPVATEQYGQCVCSNWGEHNQEYFGSDTQA

SEQ ID NO: 194488 - protein, 38 aa, Artificial Sequence
  Description of Artificial Sequence: Synthetic polypeptide
DDEEIRTTNPVATEQYGQCVCSWGEDHNEENFGSDTQS

SEQ ID NO: 194489 - protein, 35 aa, Artificial Sequence
  Description of Artificial Sequence: Synthetic polypeptide
CEEVIACTNPVATEQWGCVAGTGPHAAMLMGENRW

SEQ ID NO: 194490 - protein, 34 aa, Artificial Sequence
  Description of Artificial Sequence: Synthetic polypeptide
QETEIRTTNPIATECWGATTWANAEDLQEHKGPL

SEQ ID NO: 194491 - protein, 37 aa, Artificial Sequence
  Description of Artificial Sequence: Synthetic polypeptide
MESEIRTTNPVATEQYGSFSPVFNESDMTTFPGYVEK

SEQ ID NO: 194492 - protein, 36 aa, Artificial Sequence
  Description of Artificial Sequence: Synthetic polypeptide
CEGEIRATNPVATDQYGVVTMQDGDNGQRFTDNGQN

SEQ ID NO: 194493 - protein, 37 aa, Artificial Sequence
  Description of Artificial Sequence: Synthetic polypeptide
AEEEISTTNPVATEQYGCVCSNWPEHNQENFNSDTQS

SEQ ID NO: 194494 - protein, 37 aa, Artificial Sequence
  Description of Artificial Sequence: Synthetic polypeptide
DEEEIRTTNPVATELYGSVCSVEIDMAHVDVIDDQQY

SEQ ID NO: 194495 - protein, 37 aa, Artificial Sequence
  Description of Artificial Sequence: Synthetic polypeptide
DENEIRTTNPVATDFYGSVVMSGMFNNLVGEMVEDDI

SEQ ID NO: 194496 - protein, 36 aa, Artificial Sequence
  Description of Artificial Sequence: Synthetic polypeptide
AEEEISTTNPVATEQYGCVCSNWGEHQEYFISETQP

SEQ ID NO: 194497 - protein, 37 aa, Artificial Sequence
  Description of Artificial Sequence: Synthetic polypeptide
AEEEISTTNPVATEQYGCVCSNWGEHNTENFNSETAE

SEQ ID NO: 194498 - protein, 33 aa, Artificial Sequence
  Description of Artificial Sequence: Synthetic polypeptide
QECEICATNPCTTEIYGVVATNNTNQNGTDTTT

SEQ ID NO: 194499 - protein, 37 aa, Artificial Sequence
  Description of Artificial Sequence: Synthetic polypeptide
AEEEISTTNPVATEQYGCVCSNWGEHNQEYFNSETQS

SEQ ID NO: 194500 - protein, 37 aa, Artificial Sequence
  Description of Artificial Sequence: Synthetic polypeptide
AEEEISTTNPVATEQYGCVCSNWGEHNQENFNSENQS

SEQ ID NO: 194501 - protein, 38 aa, Artificial Sequence
  Description of Artificial Sequence: Synthetic polypeptide
QEVEIRTTNPVATEQYGQIVTTGDGNDQGEGEEGIGGP

SEQ ID NO: 194502 - protein, 37 aa, Artificial Sequence
  Description of Artificial Sequence: Synthetic polypeptide
AEEEISTTNPVATEQYGCVCSNWGEHNQENFNSDTQA

SEQ ID NO: 194503 - protein, 35 aa, Artificial Sequence
  Description of Artificial Sequence: Synthetic polypeptide
DENEIRTTNPVATCHYGCVCSWGEHNQEYFTSDQA

SEQ ID NO: 194504 - protein, 37 aa, Artificial Sequence
  Description of Artificial Sequence: Synthetic polypeptide
AEEEISTTNPVATEQYGCVCSNWGEHNQENFGSDTQA

SEQ ID NO: 194505 - protein, 37 aa, Artificial Sequence
  Description of Artificial Sequence: Synthetic polypeptide
AEEEISTTNPVATEQYGCVCSNWGEHNQEHFNSDTQA

SEQ ID NO: 194506 - protein, 38 aa, Artificial Sequence
  Description of Artificial Sequence: Synthetic polypeptide
DDEEIRTTNPVATEFYGQVNFNMDLQLDPGGGGGETGA

SEQ ID NO: 194507 - protein, 37 aa, Artificial Sequence
  Description of Artificial Sequence: Synthetic polypeptide
AEEEISTTNPVATEQYGCVCSNWGEHNIENFNSETQA

SEQ ID NO: 194508 - protein, 36 aa, Artificial Sequence
  Description of Artificial Sequence: Synthetic polypeptide
AEEEISTTNPVATEQYGCVCSNWGEHNANFNSETQA

SEQ ID NO: 194509 - protein, 38 aa, Artificial Sequence
  Description of Artificial Sequence: Synthetic polypeptide
DDEEIKTTNPVATEQYGAVNMGNTIEQEGDQEEGGNTI

SEQ ID NO: 194510 - protein, 37 aa, Artificial Sequence
  Description of Artificial Sequence: Synthetic polypeptide
MESEIRTTNPVATESYGSVVSDGMQGLTLGEGDQSGD

SEQ ID NO: 194511 - protein, 37 aa, Artificial Sequence
  Description of Artificial Sequence: Synthetic polypeptide
DEECISTTNPVATEQYGQCVCGWGETNEENFNSDNQS

SEQ ID NO: 194512 - protein, 37 aa, Artificial Sequence
  Description of Artificial Sequence: Synthetic polypeptide
DEECISTTNPVATEQYGQCVCGSGEHNEEGFNSDTQA

SEQ ID NO: 194513 - protein, 37 aa, Artificial Sequence
  Description of Artificial Sequence: Synthetic polypeptide
DEECISTTNPVATEQYGQCVCGNWGEHNEEGFNSDQT

SEQ ID NO: 194514 - protein, 33 aa, Artificial Sequence
  Description of Artificial Sequence: Synthetic polypeptide
QECEICATNPCTTEIYGVVATNNTTNQNGTDTN

SEQ ID NO: 194515 - protein, 38 aa, Artificial Sequence
  Description of Artificial Sequence: Synthetic polypeptide
DDEEIRTTNPVATEFYGQVNANMDLQLDIGGGGGEQGD

SEQ ID NO: 194516 - protein, 34 aa, Artificial Sequence
  Description of Artificial Sequence: Synthetic polypeptide
CEEVIACTNPVATEQWGCVAGTGPQAAMMGEPPW

SEQ ID NO: 194517 - protein, 31 aa, Artificial Sequence
  Description of Artificial Sequence: Synthetic polypeptide
QEWEIATTNPVAYERWGEAYMVEQHKEGEGT

SEQ ID NO: 194518 - protein, 38 aa, Artificial Sequence
  Description of Artificial Sequence: Synthetic polypeptide
METEIRTTNPVATEQYGSVADDGDQEGGQNDDTTDETT

SEQ ID NO: 194519 - protein, 37 aa, Artificial Sequence
  Description of Artificial Sequence: Synthetic polypeptide
DDEEIRTTNPVATEFYGQVNFNMDDQVIGGGGGEDGT

SEQ ID NO: 194520 - protein, 38 aa, Artificial Sequence
  Description of Artificial Sequence: Synthetic polypeptide
DDEEIRTTNPVATEFYGQVNFNMDLDLDQGGGEGEQGD

SEQ ID NO: 194521 - protein, 38 aa, Artificial Sequence
  Description of Artificial Sequence: Synthetic polypeptide
DDEEIRTTNPVATEFYGQVNFNMDLEQDQGGGGGEQID

SEQ ID NO: 194522 - protein, 38 aa, Artificial Sequence
  Description of Artificial Sequence: Synthetic polypeptide
DDEEIRTTNPVATEFYGQVNFNMDLQEDQGGGGGETDT

SEQ ID NO: 194523 - protein, 38 aa, Artificial Sequence
  Description of Artificial Sequence: Synthetic polypeptide
DDEEIRTTNPVATEFYGQVNFNMDLQLDLGGGDGEGGT

SEQ ID NO: 194524 - protein, 36 aa, Artificial Sequence
  Description of Artificial Sequence: Synthetic polypeptide
QEVEIHTTNPVATEQYGTVVSATDGDDEEGEGGGDE

SEQ ID NO: 194525 - protein, 31 aa, Artificial Sequence
  Description of Artificial Sequence: Synthetic polypeptide
QEWEIATTNPVAYERWGEAYMVEQHDTGEGK

SEQ ID NO: 194526 - protein, 38 aa, Artificial Sequence
  Description of Artificial Sequence: Synthetic polypeptide
DDEEIRTTNPVATEFYGQVNFNMDLQLDNGGPGGQQGD

SEQ ID NO: 194527 - protein, 33 aa, Artificial Sequence
  Description of Artificial Sequence: Synthetic polypeptide
QECEICATNPCTTEIYGVVATNTNNNQNGTDET

SEQ ID NO: 194528 - protein, 34 aa, Artificial Sequence
  Description of Artificial Sequence: Synthetic polypeptide
CEEVIACTNPVATEQWGCVAGTISHLEADMLINH

SEQ ID NO: 194529 - protein, 38 aa, Artificial Sequence
  Description of Artificial Sequence: Synthetic polypeptide
DEQEIRTTNPVATEQYGVVMSNNDNMTGGPGQTEQTGD

SEQ ID NO: 194530 - protein, 35 aa, Artificial Sequence
  Description of Artificial Sequence: Synthetic polypeptide
DEMAISTTNPVATEQYGCFCSWGEHNIENFNSDQA

SEQ ID NO: 194531 - protein, 36 aa, Artificial Sequence
  Description of Artificial Sequence: Synthetic polypeptide
METEINTTNPVAYEQYGETVVSINELSTESNGGLQM

SEQ ID NO: 194532 - protein, 38 aa, Artificial Sequence
  Description of Artificial Sequence: Synthetic polypeptide
DEECISTTNPVATEQYGQCVCGNTGEHNEEGFGSDNQS

SEQ ID NO: 194533 - protein, 37 aa, Artificial Sequence
  Description of Artificial Sequence: Synthetic polypeptide
QEVEIVTTNPVATEQYGTVVSATDGDDEEGEGGNGDE

SEQ ID NO: 194534 - protein, 36 aa, Artificial Sequence
  Description of Artificial Sequence: Synthetic polypeptide
QEVEIVTTNPVATEQYGTVVSAMDGDDEEGGEGGND

SEQ ID NO: 194535 - protein, 39 aa, Artificial Sequence
  Description of Artificial Sequence: Synthetic polypeptide
DDEEIKTTNPVATEQYGAVNMGNTTINQEAGQEEGGNTT

SEQ ID NO: 194536 - protein, 38 aa, Artificial Sequence
  Description of Artificial Sequence: Synthetic polypeptide
AEEEISTTNPVATEQYGCVCSNWGEDHNAESFGSENQP

SEQ ID NO: 194537 - protein, 37 aa, Artificial Sequence
  Description of Artificial Sequence: Synthetic polypeptide
QEVEIGTTNPVATEQYGVVVVGTDGGDEEEEGGNNDR

SEQ ID NO: 194538 - protein, 37 aa, Artificial Sequence
  Description of Artificial Sequence: Synthetic polypeptide
QEVEIGTTNPVATEQYGVVVSITDDGDEEEEGGNNGI

SEQ ID NO: 194539 - protein, 36 aa, Artificial Sequence
  Description of Artificial Sequence: Synthetic polypeptide
DEEEIACTNPVATEQWGCWNATGNPLPAPMEHNHNN

SEQ ID NO: 194540 - protein, 35 aa, Artificial Sequence
  Description of Artificial Sequence: Synthetic polypeptide
DEEEIACTNPVATEQWGCWNALQGNPLPAPMEGHN

SEQ ID NO: 194541 - protein, 33 aa, Artificial Sequence
  Description of Artificial Sequence: Synthetic polypeptide
QAEEIATTNPVATASWGCNVAGAGPQTAGGDNF

SEQ ID NO: 194542 - protein, 36 aa, Artificial Sequence
  Description of Artificial Sequence: Synthetic polypeptide
AEEEISTTNPVATEQYGCVCSNWGEHAEYFNSDNQP

SEQ ID NO: 194543 - protein, 38 aa, Artificial Sequence
  Description of Artificial Sequence: Synthetic polypeptide
AEEEISTTNPVATEQYGCVCSNWGEDTNAENFNSETQS

SEQ ID NO: 194544 - protein, 38 aa, Artificial Sequence
  Description of Artificial Sequence: Synthetic polypeptide
AEEEISTTNPVATEQYGCVCSNWGEDPNQENFGSENQS

SEQ ID NO: 194545 - protein, 37 aa, Artificial Sequence
  Description of Artificial Sequence: Synthetic polypeptide
DEEEIACTNPVATEQWGCVAITNAQPEASGDGMDTDM

SEQ ID NO: 194546 - protein, 33 aa, Artificial Sequence
  Description of Artificial Sequence: Synthetic polypeptide
QECEICATNPCTTEIYGVVATNNTNNQNGTDTG

SEQ ID NO: 194547 - protein, 37 aa, Artificial Sequence
  Description of Artificial Sequence: Synthetic polypeptide
AEEEISTTNPVATEQYGCVCSNWGEDNQENFNSDFQS

SEQ ID NO: 194548 - protein, 38 aa, Artificial Sequence
  Description of Artificial Sequence: Synthetic polypeptide
DDEEIRTTNPVATEFYGQVNFNMDLQLGGGGGGGETGT

SEQ ID NO: 194549 - protein, 34 aa, Artificial Sequence
  Description of Artificial Sequence: Synthetic polypeptide
QETEIRTTNPVATEQWGATTWANEEDWAEPKGPK

SEQ ID NO: 194550 - protein, 36 aa, Artificial Sequence
  Description of Artificial Sequence: Synthetic polypeptide
MESEIRTTNPVATEQYGSSYMVANMVNQIDESHQAE

SEQ ID NO: 194551 - protein, 33 aa, Artificial Sequence
  Description of Artificial Sequence: Synthetic polypeptide
QETEIRTTNPIATECWGITTWSNAEDWQESGPI

SEQ ID NO: 194552 - protein, 33 aa, Artificial Sequence
  Description of Artificial Sequence: Synthetic polypeptide
QETEIRTTNPIATECWGITTWSNAEDWQEPGPI

SEQ ID NO: 194553 - protein, 33 aa, Artificial Sequence
  Description of Artificial Sequence: Synthetic polypeptide
QETEIRTTNPIATECWGITTWANAEDWQEPGPI

SEQ ID NO: 194554 - protein, 38 aa, Artificial Sequence
  Description of Artificial Sequence: Synthetic polypeptide
AEEEISTTNPVATEQYGCVCSNWGEDHNQEHFGSENQA

SEQ ID NO: 194555 - protein, 34 aa, Artificial Sequence
  Description of Artificial Sequence: Synthetic polypeptide
QETEIRTTNPIATECWGATVWANAEDWQEPKGPI

SEQ ID NO: 194556 - protein, 35 aa, Artificial Sequence
  Description of Artificial Sequence: Synthetic polypeptide
MESEIRTTNPVATEQYGSHYYYDDMIDTMELNEDM

SEQ ID NO: 194557 - protein, 33 aa, Artificial Sequence
  Description of Artificial Sequence: Synthetic polypeptide
QETEIRTTNPIATECWGATTWANAEDWQPKGPI

SEQ ID NO: 194558 - protein, 37 aa, Artificial Sequence
  Description of Artificial Sequence: Synthetic polypeptide
AEEEISTTNPVATEQYGCVCSNWGEHNAEFFNSDTQA

SEQ ID NO: 194559 - protein, 37 aa, Artificial Sequence
  Description of Artificial Sequence: Synthetic polypeptide
AEEEISTTNPVATEQYGCVCSNWGEHNAENFNSDNQF

SEQ ID NO: 194560 - protein, 37 aa, Artificial Sequence
  Description of Artificial Sequence: Synthetic polypeptide
AEEEISTTNPVATEQYGCVCSNWGEHNAENFNSDTQA

SEQ ID NO: 194561 - protein, 37 aa, Artificial Sequence
  Description of Artificial Sequence: Synthetic polypeptide
AEEEISTTNPVATEQYGCVCSNWGEHNAENFNSDTQS

SEQ ID NO: 194562 - protein, 37 aa, Artificial Sequence
  Description of Artificial Sequence: Synthetic polypeptide
QEVEIGTTNPVATEQYGVVVSGTDIGDEEEEGGNNDN

SEQ ID NO: 194563 - protein, 37 aa, Artificial Sequence
  Description of Artificial Sequence: Synthetic polypeptide
QEVEIGTTNPVATEQYGVVVSGTDGGDEEEEGGNNFV

SEQ ID NO: 194564 - protein, 34 aa, Artificial Sequence
  Description of Artificial Sequence: Synthetic polypeptide
QAEEIATTNPVATASWGCNVAGAGLQTAGGDINL

SEQ ID NO: 194565 - protein, 37 aa, Artificial Sequence
  Description of Artificial Sequence: Synthetic polypeptide
QEVEIGTTNPVATEQYGVVVDGTDGGDEEQEGGNNDT

SEQ ID NO: 194566 - protein, 38 aa, Artificial Sequence
  Description of Artificial Sequence: Synthetic polypeptide
DEGEIRTTNPVATEQYGCLSGPTSLALNIPQHIDEDDS

SEQ ID NO: 194567 - protein, 39 aa, Artificial Sequence
  Description of Artificial Sequence: Synthetic polypeptide
DEGEIRTTNPVATEQYGCLSCGPTLLALNYPQHGDEQDS

SEQ ID NO: 194568 - protein, 36 aa, Artificial Sequence
  Description of Artificial Sequence: Synthetic polypeptide
DEGEIRTTNPVATEQYGCFTYTPMNEMMIETPQQPM

SEQ ID NO: 194569 - protein, 37 aa, Artificial Sequence
  Description of Artificial Sequence: Synthetic polypeptide
DEGEIRTTNPVATEQYGCFTYTPMNEDKIEEPQQHPM

SEQ ID NO: 194570 - protein, 37 aa, Artificial Sequence
  Description of Artificial Sequence: Synthetic polypeptide
QEVEIGTTNPVATEQYGAVVSGTDGGDEEVEGGNNDE

SEQ ID NO: 194571 - protein, 37 aa, Artificial Sequence
  Description of Artificial Sequence: Synthetic polypeptide
AEEEISTTNPVATEQYGCVCSNWGEHNAEYFNSENQA

SEQ ID NO: 194572 - protein, 37 aa, Artificial Sequence
  Description of Artificial Sequence: Synthetic polypeptide
QEVEIGTTNPVATEQYGAVVSGTDGGDEEEGGGNNDI

SEQ ID NO: 194573 - protein, 37 aa, Artificial Sequence
  Description of Artificial Sequence: Synthetic polypeptide
QEVEIGTTNPVATEFYGVVVSGTDGGNEEEEGGNNDT

SEQ ID NO: 194574 - protein, 37 aa, Artificial Sequence
  Description of Artificial Sequence: Synthetic polypeptide
QEVEICTTNPVATEQYGVVVSGTDQGDEEEEGGNNDI

SEQ ID NO: 194575 - protein, 37 aa, Artificial Sequence
  Description of Artificial Sequence: Synthetic polypeptide
QEVEICTTNPVATEQYGTVVSDTDGDDDEEEGGNGDI

SEQ ID NO: 194576 - protein, 37 aa, Artificial Sequence
  Description of Artificial Sequence: Synthetic polypeptide
QEVEICTTNPVATEQYGTVVSATDGDDDEEEGGNDDG

SEQ ID NO: 194577 - protein, 38 aa, Artificial Sequence
  Description of Artificial Sequence: Synthetic polypeptide
QEVEICTTNPVATEQYGSVNNEGNNVNGLGQQEGEGED

SEQ ID NO: 194578 - protein, 37 aa, Artificial Sequence
  Description of Artificial Sequence: Synthetic polypeptide
QEVEIATTNPVATEQYGVVVSGTDGGDEEEEGGVNDI

SEQ ID NO: 194579 - protein, 37 aa, Artificial Sequence
  Description of Artificial Sequence: Synthetic polypeptide
AEEEISTTNPVATEQYGCVCSNWGEHNAENFNSQTQA

SEQ ID NO: 194580 - protein, 37 aa, Artificial Sequence
  Description of Artificial Sequence: Synthetic polypeptide
AEEEISTTNPVATEQYGCVCSNWGEHNAENFNSEPQS

SEQ ID NO: 194581 - protein, 38 aa, Artificial Sequence
  Description of Artificial Sequence: Synthetic polypeptide
DEEEIRTTNPVATEQYGSTCNCCHSELPIEMEEQEILI

SEQ ID NO: 194582 - protein, 36 aa, Artificial Sequence
  Description of Artificial Sequence: Synthetic polypeptide
CEGEIATTNPVAYEQYGSCATGPALGQNHQMGMQMN

SEQ ID NO: 194583 - protein, 34 aa, Artificial Sequence
  Description of Artificial Sequence: Synthetic polypeptide
QAEEIATTNPVATEQWGCVAPGEGGGNESEEENQ

SEQ ID NO: 194584 - protein, 37 aa, Artificial Sequence
  Description of Artificial Sequence: Synthetic polypeptide
DENEIATTNPVATEQYGSVCAANMGEEAPDNGEEGAY

SEQ ID NO: 194585 - protein, 37 aa, Artificial Sequence
  Description of Artificial Sequence: Synthetic polypeptide
DENEIATTNPVATEQYGSVCAANMGEEAPDEQMEKAH

SEQ ID NO: 194586 - protein, 36 aa, Artificial Sequence
  Description of Artificial Sequence: Synthetic polypeptide
DENAINTTNPVATEYYCSVSDSNKPLVESPYGEVTM

SEQ ID NO: 194587 - protein, 38 aa, Artificial Sequence
  Description of Artificial Sequence: Synthetic polypeptide
NEEEIRTTNPVATEQYGQCVCSNWGEHNAENFNSDTQS

SEQ ID NO: 194588 - protein, 36 aa, Artificial Sequence
  Description of Artificial Sequence: Synthetic polypeptide
QEQEISTTNPVATEQYGDVVVDLEGEFEEGGDGENG

SEQ ID NO: 194589 - protein, 38 aa, Artificial Sequence
  Description of Artificial Sequence: Synthetic polypeptide
QEQEISTTNPVATEQYGSVNNEGGNVNGLGQQEGEGED

SEQ ID NO: 194590 - protein, 38 aa, Artificial Sequence
  Description of Artificial Sequence: Synthetic polypeptide
DESEIATTNPTATEAYGISTVASCTNMVSADYGGNNHF

SEQ ID NO: 194591 - protein, 38 aa, Artificial Sequence
  Description of Artificial Sequence: Synthetic polypeptide
DDEEIRATNPVATEFYGQVNFNMDLQLDQGGGGNEQGE

SEQ ID NO: 194592 - protein, 37 aa, Artificial Sequence
  Description of Artificial Sequence: Synthetic polypeptide
NEEEIRTTNPVATEQYGMVSVGGMGDGGQGQEQDIGV

SEQ ID NO: 194593 - protein, 37 aa, Artificial Sequence
  Description of Artificial Sequence: Synthetic polypeptide
DEEEIGTTNPVAYEQYGCVCSWGEDDNAENFNSDNQS

SEQ ID NO: 194594 - protein, 39 aa, Artificial Sequence
  Description of Artificial Sequence: Synthetic polypeptide
NEEEIRTTNPVATEQYGMVSVENGMGDGGQGQEQDEGGN

SEQ ID NO: 194595 - protein, 36 aa, Artificial Sequence
  Description of Artificial Sequence: Synthetic polypeptide
DDEEIRTTNPCATEHYGCVCSNWGEDNQENFNSEQA

SEQ ID NO: 194596 - protein, 36 aa, Artificial Sequence
  Description of Artificial Sequence: Synthetic polypeptide
DEEEIRATNPVATEQWGCVAGEGGEGNAHMDDNDNQ

SEQ ID NO: 194597 - protein, 38 aa, Artificial Sequence
  Description of Artificial Sequence: Synthetic polypeptide
DDEEIRATNPVATEFYGCVSVNMTGLQEEQDEGGETTT

SEQ ID NO: 194598 - protein, 38 aa, Artificial Sequence
  Description of Artificial Sequence: Synthetic polypeptide
NEEEIRTTNPVATEQYGMVSVEGMDDGGQGNEQDEIGV

SEQ ID NO: 194599 - protein, 38 aa, Artificial Sequence
  Description of Artificial Sequence: Synthetic polypeptide
DEEEIACTNPVATEQYGSACATTNPMEEAGAHQDGAAD

SEQ ID NO: 194600 - protein, 38 aa, Artificial Sequence
  Description of Artificial Sequence: Synthetic polypeptide
DENEIRTTNPVATEFYGSVVVDGNNFEQNVGEEGGFLQ

SEQ ID NO: 194601 - protein, 32 aa, Artificial Sequence
  Description of Artificial Sequence: Synthetic polypeptide
CENEIATTNPVAYEPYGKVGIIGHLSGHETEG

SEQ ID NO: 194602 - protein, 35 aa, Artificial Sequence
  Description of Artificial Sequence: Synthetic polypeptide
DENAINTTNPVATEYQCCVSDSNNPLVEPLGELTM

SEQ ID NO: 194603 - protein, 34 aa, Artificial Sequence
  Description of Artificial Sequence: Synthetic polypeptide
CENEIATTNPVAYEPYGKVASIIGHLSQHETEGK

SEQ ID NO: 194604 - protein, 37 aa, Artificial Sequence
  Description of Artificial Sequence: Synthetic polypeptide
NEEEIRTTNPVATEQYGCVCSNWGEHNIEFFISDTQS

SEQ ID NO: 194605 - protein, 36 aa, Artificial Sequence
  Description of Artificial Sequence: Synthetic polypeptide
DDEEIRTTNPCATEGYGCVCSNWGEHNQEHFNSDQA

SEQ ID NO: 194606 - protein, 38 aa, Artificial Sequence
  Description of Artificial Sequence: Synthetic polypeptide
QEQEIRSTNPVATEQYGSVVMSVNDNNTGGGQTGQVGD

SEQ ID NO: 194607 - protein, 35 aa, Artificial Sequence
  Description of Artificial Sequence: Synthetic polypeptide
QEQEIHTTNPVATEQYGTVNLGPIEGEGGQGENED

SEQ ID NO: 194608 - protein, 37 aa, Artificial Sequence
  Description of Artificial Sequence: Synthetic polypeptide
DEEEIACTNPVATESYGSACAAANPHQAEAEMGNGNF

SEQ ID NO: 194609 - protein, 36 aa, Artificial Sequence
  Description of Artificial Sequence: Synthetic polypeptide
NEEEIRTTNPVATEQYGSIELCEADMVMHSFEDERE

SEQ ID NO: 194610 - protein, 37 aa, Artificial Sequence
  Description of Artificial Sequence: Synthetic polypeptide
NEEEIRTTNPVATEQYGSHEEPPSAYLILIWDEVEDN

SEQ ID NO: 194611 - protein, 35 aa, Artificial Sequence
  Description of Artificial Sequence: Synthetic polypeptide
DENAINTTNPVYTEYYCSVTDSNNPLVEPLGEVTM

SEQ ID NO: 194612 - protein, 36 aa, Artificial Sequence
  Description of Artificial Sequence: Synthetic polypeptide
DENAINTTNPVATVEYYCSVTDSNNPLYEPLGELTM

SEQ ID NO: 194613 - protein, 36 aa, Artificial Sequence
  Description of Artificial Sequence: Synthetic polypeptide
DEEEIACTNPVATEQYGSACPANPAEGQDHQDDSAE

SEQ ID NO: 194614 - protein, 38 aa, Artificial Sequence
  Description of Artificial Sequence: Synthetic polypeptide
AEEEISTTNPVATEQYGQCVCSNWGEHNQEGFGSDNQS

SEQ ID NO: 194615 - protein, 37 aa, Artificial Sequence
  Description of Artificial Sequence: Synthetic polypeptide
FEEEIRATNPVATEQYGDVGNNVDTPGQLGEGGQGQT

SEQ ID NO: 194616 - protein, 35 aa, Artificial Sequence
  Description of Artificial Sequence: Synthetic polypeptide
SDEEIRCTNPCATEQYGCVCSWGELNANFGSDTQS

SEQ ID NO: 194617 - protein, 35 aa, Artificial Sequence
  Description of Artificial Sequence: Synthetic polypeptide
SDEEIRCTNPCATEQYGCVCSWGEHNAENFGSDQS

SEQ ID NO: 194618 - protein, 34 aa, Artificial Sequence
  Description of Artificial Sequence: Synthetic polypeptide
CENEIATTNPVAYEPYGKLVSIIGHLSQHETEGT

SEQ ID NO: 194619 - protein, 33 aa, Artificial Sequence
  Description of Artificial Sequence: Synthetic polypeptide
CENEIATTNPVAYEPYGKVNIIGHLSQYHDTEG

SEQ ID NO: 194620 - protein, 38 aa, Artificial Sequence
  Description of Artificial Sequence: Synthetic polypeptide
DEEEIACTNPVATEQYGSACNPVPDGLPLGAMEGFHND

SEQ ID NO: 194621 - protein, 38 aa, Artificial Sequence
  Description of Artificial Sequence: Synthetic polypeptide
DEEEIRTTNPVATEGYGICVCSTTVEHNQENFISQTQS

SEQ ID NO: 194622 - protein, 36 aa, Artificial Sequence
  Description of Artificial Sequence: Synthetic polypeptide
CEEEIACTNPVATEQYGNACATNPELGQLHQDDEAG

SEQ ID NO: 194623 - protein, 38 aa, Artificial Sequence
  Description of Artificial Sequence: Synthetic polypeptide
DEEEIACTNPVATEQYGSACNPTPDGLPLGAMEGQNNQ

SEQ ID NO: 194624 - protein, 38 aa, Artificial Sequence
  Description of Artificial Sequence: Synthetic polypeptide
DEEEIACTNPVATEQYGSACNPTPDGLPLGAMEGGNAW

SEQ ID NO: 194625 - protein, 33 aa, Artificial Sequence
  Description of Artificial Sequence: Synthetic polypeptide
CENEIATTNPVAYEPYGKVNIHGHLSQHTETEG

SEQ ID NO: 194626 - protein, 38 aa, Artificial Sequence
  Description of Artificial Sequence: Synthetic polypeptide
DEEEIACTNPVATEQYGSACNPTPDGLPLGAMEGFTNK

SEQ ID NO: 194627 - protein, 38 aa, Artificial Sequence
  Description of Artificial Sequence: Synthetic polypeptide
DEEEIACTNPVATEQYGSACNPTPDGLPLGAAEGPHNQ

SEQ ID NO: 194628 - protein, 38 aa, Artificial Sequence
  Description of Artificial Sequence: Synthetic polypeptide
DEEEIACTNPVATEQYGSACNPTPDGGPLGAGEGPNDQ

SEQ ID NO: 194629 - protein, 35 aa, Artificial Sequence
  Description of Artificial Sequence: Synthetic polypeptide
DDEEIRTTNCVATEFYGDVVDFEMGDNGEENGDGI

SEQ ID NO: 194630 - protein, 37 aa, Artificial Sequence
  Description of Artificial Sequence: Synthetic polypeptide
NEEEIRTTNPVATEQYGSIMDLRPNLEAVSEVAMSED

SEQ ID NO: 194631 - protein, 37 aa, Artificial Sequence
  Description of Artificial Sequence: Synthetic polypeptide
AEEEISTTNPVATEQYGQCVCSNWGEHNEENFGSDQA

SEQ ID NO: 194632 - protein, 36 aa, Artificial Sequence
  Description of Artificial Sequence: Synthetic polypeptide
CESEIATTNPCAYEQYGTVCSATGEEWSENFNGGND

SEQ ID NO: 194633 - protein, 39 aa, Artificial Sequence
  Description of Artificial Sequence: Synthetic polypeptide
NEEEIRTTNPVATEFYGSVVTMQGINNMDNQTGEFTEEG

SEQ ID NO: 194634 - protein, 36 aa, Artificial Sequence
  Description of Artificial Sequence: Synthetic polypeptide
NNEEIRTTNPVATEQYGSTVCFPDVTEDDITDFHDF

SEQ ID NO: 194635 - protein, 33 aa, Artificial Sequence
  Description of Artificial Sequence: Synthetic polypeptide
DESEIATTNPIGTEGWGATMANSTLQEHKGPYI

SEQ ID NO: 194636 - protein, 39 aa, Artificial Sequence
  Description of Artificial Sequence: Synthetic polypeptide
DEEEIRTTNPVATEGYGICVTSTWGADHNAENFGSDFQA

SEQ ID NO: 194637 - protein, 38 aa, Artificial Sequence
  Description of Artificial Sequence: Synthetic polypeptide
NEEEIRTTNCVATEQYGVVSMGGDLNNEQTTEGQGQGE

SEQ ID NO: 194638 - protein, 31 aa, Artificial Sequence
  Description of Artificial Sequence: Synthetic polypeptide
DESEIATTNPIGTECWGATTWAAEDLAHGPI

SEQ ID NO: 194639 - protein, 37 aa, Artificial Sequence
  Description of Artificial Sequence: Synthetic polypeptide
NNEEIRTTNPVATEQYGSVCFPDDVGNEDDITDFQDF

SEQ ID NO: 194640 - protein, 38 aa, Artificial Sequence
  Description of Artificial Sequence: Synthetic polypeptide
NEEEIGTTNPVATEQYGSVPVVPSSGLDEVIGLAPTGS

SEQ ID NO: 194641 - protein, 38 aa, Artificial Sequence
  Description of Artificial Sequence: Synthetic polypeptide
NEEEIGTTNPVATEQYGSVPVVPATGLDEVIILANEGF

SEQ ID NO: 194642 - protein, 38 aa, Artificial Sequence
  Description of Artificial Sequence: Synthetic polypeptide
DESEIATTNPGATEAYGSTVASCTANMVSADYGGNMHF

SEQ ID NO: 194643 - protein, 35 aa, Artificial Sequence
  Description of Artificial Sequence: Synthetic polypeptide
DESEIATTNPCVYECWGSVATPNGNQQLEGDHGGR

SEQ ID NO: 194644 - protein, 35 aa, Artificial Sequence
  Description of Artificial Sequence: Synthetic polypeptide
DENEIATTNPVATEQWGCVAGEGENANAAEMDNAD

SEQ ID NO: 194645 - protein, 35 aa, Artificial Sequence
  Description of Artificial Sequence: Synthetic polypeptide
DENEIATTNPVATEQWGCVAGEGGPANPNPMGAVP

SEQ ID NO: 194646 - protein, 36 aa, Artificial Sequence
  Description of Artificial Sequence: Synthetic polypeptide
DENEIATTNPVATEQWGCVAGEGGPGENTADGNMFE

SEQ ID NO: 194647 - protein, 34 aa, Artificial Sequence
  Description of Artificial Sequence: Synthetic polypeptide
DENEIATTNPVATEQWGCVAGEGVDMNAAEEDTM

SEQ ID NO: 194648 - protein, 35 aa, Artificial Sequence
  Description of Artificial Sequence: Synthetic polypeptide
DESEIATTNPCAYECWGSVATPNGNQQLEDDGGGY

SEQ ID NO: 194649 - protein, 37 aa, Artificial Sequence
  Description of Artificial Sequence: Synthetic polypeptide
DEEEIRATNPVATEQWGGCNAINNHEEAAGAMGNARW

SEQ ID NO: 194650 - protein, 32 aa, Artificial Sequence
  Description of Artificial Sequence: Synthetic polypeptide
NEEEIATTNPVAYERWGEAYMVEQPHDEGEGI

SEQ ID NO: 194651 - protein, 35 aa, Artificial Sequence
  Description of Artificial Sequence: Synthetic polypeptide
DENEIATTNPVATEQWGCVAGEGVEMNAAEEGGAH

SEQ ID NO: 194652 - protein, 32 aa, Artificial Sequence
  Description of Artificial Sequence: Synthetic polypeptide
DESEIATTNPIGTEGYGVMWAAETLAPKGDYI

SEQ ID NO: 194653 - protein, 32 aa, Artificial Sequence
  Description of Artificial Sequence: Synthetic polypeptide
DESEIATTNPIGTEGYGVMWAAETWAPKGDYI

SEQ ID NO: 194654 - protein, 32 aa, Artificial Sequence
  Description of Artificial Sequence: Synthetic polypeptide
DESEIATTNPISTEGWGNTAAAETIQSRVGPI

SEQ ID NO: 194655 - protein, 32 aa, Artificial Sequence
  Description of Artificial Sequence: Synthetic polypeptide
DESEIATTNPISTEGWGNTANAETWQSRVGPI

SEQ ID NO: 194656 - protein, 36 aa, Artificial Sequence
  Description of Artificial Sequence: Synthetic polypeptide
DEHEIATTNPVATECYGAVAYGEDQHQGQQGQGGNP

SEQ ID NO: 194657 - protein, 36 aa, Artificial Sequence
  Description of Artificial Sequence: Synthetic polypeptide
DDEEIRTTNPCATEHYGCVCSWGEDNIENFNSENQA

SEQ ID NO: 194658 - protein, 36 aa, Artificial Sequence
  Description of Artificial Sequence: Synthetic polypeptide
DEHEIATTNPVATECYGSVAYGEDQHQGQQQQGGGP

SEQ ID NO: 194659 - protein, 36 aa, Artificial Sequence
  Description of Artificial Sequence: Synthetic polypeptide
DEHEIATTNPVATECYGSVAYGGDQHQGQQGGGGGP

SEQ ID NO: 194660 - protein, 39 aa, Artificial Sequence
  Description of Artificial Sequence: Synthetic polypeptide
NEEEIRTTNPVATEQYGAVITNNDGMENLTANEGGLEDV

SEQ ID NO: 194661 - protein, 35 aa, Artificial Sequence
  Description of Artificial Sequence: Synthetic polypeptide
DENEIATTNPVATEQWGCCAGEGVEMNDALLDNAW

SEQ ID NO: 194662 - protein, 38 aa, Artificial Sequence
  Description of Artificial Sequence: Synthetic polypeptide
DEEEIACTNPVATEQYGSACATANPDEEAGAHQDENFP

SEQ ID NO: 194663 - protein, 36 aa, Artificial Sequence
  Description of Artificial Sequence: Synthetic polypeptide
DEEEIRATNPVATEQWGGCCTAATNHDEFAMMENNN

SEQ ID NO: 194664 - protein, 36 aa, Artificial Sequence
  Description of Artificial Sequence: Synthetic polypeptide
DEEEIRATNPVATEQWGGCCTAITNPDEFAAMENSN

SEQ ID NO: 194665 - protein, 34 aa, Artificial Sequence
  Description of Artificial Sequence: Synthetic polypeptide
CENEIATTNPVAYEPYGKHVFIIGHLSQHETENG

SEQ ID NO: 194666 - protein, 38 aa, Artificial Sequence
  Description of Artificial Sequence: Synthetic polypeptide
DEEEIACTNPVATEQYGSACAPTPDGDPLGAMEGFNNQ

SEQ ID NO: 194667 - protein, 35 aa, Artificial Sequence
  Description of Artificial Sequence: Synthetic polypeptide
DENEIATTNPVATEQWGCNVAGEGGEANDASDNAW

SEQ ID NO: 194668 - protein, 37 aa, Artificial Sequence
  Description of Artificial Sequence: Synthetic polypeptide
DEEEIRATNPVATEQWGGCNAINNHAEEQAGMENADT

SEQ ID NO: 194669 - protein, 38 aa, Artificial Sequence
  Description of Artificial Sequence: Synthetic polypeptide
DEEEIRTTNPVATEQYGSIQSPSLHWEVTEVEVVKLEQ

SEQ ID NO: 194670 - protein, 35 aa, Artificial Sequence
  Description of Artificial Sequence: Synthetic polypeptide
DENEIATTNPVATEQWGCTAGNEHLEAPMDIDSRM

SEQ ID NO: 194671 - protein, 37 aa, Artificial Sequence
  Description of Artificial Sequence: Synthetic polypeptide
FEEEIRGTNPVATEQYGQVVDIMVNEMDQDNVGGGDG

SEQ ID NO: 194672 - protein, 37 aa, Artificial Sequence
  Description of Artificial Sequence: Synthetic polypeptide
FEEEIRGTNPVATEQYGSIARMDPVSLVAETLEILQG

SEQ ID NO: 194673 - protein, 35 aa, Artificial Sequence
  Description of Artificial Sequence: Synthetic polypeptide
NNEEIRTTNPVATEQYGSAYFPDVLEDDITDFQDF

SEQ ID NO: 194674 - protein, 33 aa, Artificial Sequence
  Description of Artificial Sequence: Synthetic polypeptide
DESEIATTNPISTEGWGNTTANAETWQSRVGPI

SEQ ID NO: 194675 - protein, 35 aa, Artificial Sequence
  Description of Artificial Sequence: Synthetic polypeptide
SDEACIATTNPVAYEQWGGVCSTWEDHQQQVNDSV

SEQ ID NO: 194676 - protein, 35 aa, Artificial Sequence
  Description of Artificial Sequence: Synthetic polypeptide
DENEIATTNPVATEQWGCNAGENGVDMNAMEEDNA

SEQ ID NO: 194677 - protein, 35 aa, Artificial Sequence
  Description of Artificial Sequence: Synthetic polypeptide
DENEIATTNPVATEQWGCVAGEGVEMNAAELDNHW

SEQ ID NO: 194678 - protein, 36 aa, Artificial Sequence
  Description of Artificial Sequence: Synthetic polypeptide
SDEEIRCTNPVATEQYGCVCSNWGEHNQENSNSQQA

SEQ ID NO: 194679 - protein, 38 aa, Artificial Sequence
  Description of Artificial Sequence: Synthetic polypeptide
AEEEISTTNPVATEQYGQCVCSNWGEHNTENFISDNQA

SEQ ID NO: 194680 - protein, 35 aa, Artificial Sequence
  Description of Artificial Sequence: Synthetic polypeptide
DENEIATTNPTAYEQWGATYYSSEIEMNQRENDFR

SEQ ID NO: 194681 - protein, 37 aa, Artificial Sequence
  Description of Artificial Sequence: Synthetic polypeptide
DEREISTTNPVATEQYGCVCSNWGEDHNQENFGSEQS

SEQ ID NO: 194682 - protein, 37 aa, Artificial Sequence
  Description of Artificial Sequence: Synthetic polypeptide
CEEEIACTNPVATEQYGSVCAMNNGEPTGGDLENGGM

SEQ ID NO: 194683 - protein, 39 aa, Artificial Sequence
  Description of Artificial Sequence: Synthetic polypeptide
DEEEIRTTNPVAYEQYGSTVCAVTEAGGAAASGGDNMAN

SEQ ID NO: 194684 - protein, 39 aa, Artificial Sequence
  Description of Artificial Sequence: Synthetic polypeptide
DEEEIRTTNPVAYEQYGSTVCAVTEAGGAQASGGDEMAH

SEQ ID NO: 194685 - protein, 37 aa, Artificial Sequence
  Description of Artificial Sequence: Synthetic polypeptide
DEREISTTNPVATEQYGCVCSNWGEDHNQENFNSDQQ

SEQ ID NO: 194686 - protein, 34 aa, Artificial Sequence
  Description of Artificial Sequence: Synthetic polypeptide
QEEVACCTNPVAYEQWGSVSMNNSNPAGGPNESM

SEQ ID NO: 194687 - protein, 36 aa, Artificial Sequence
  Description of Artificial Sequence: Synthetic polypeptide
CEEEIACTNPVATEQYGSVCAGNNGLADAPLDEMAM

SEQ ID NO: 194688 - protein, 37 aa, Artificial Sequence
  Description of Artificial Sequence: Synthetic polypeptide
DEMCIATTNPVATEQYGCVCSTWGEHNAEHFNSENQS

SEQ ID NO: 194689 - protein, 35 aa, Artificial Sequence
  Description of Artificial Sequence: Synthetic polypeptide
DENEIATTNPVATAQWGCVAGETGEEMNAALDNGQ

SEQ ID NO: 194690 - protein, 33 aa, Artificial Sequence
  Description of Artificial Sequence: Synthetic polypeptide
CENEIATTNPVAYEPYGQKVAIMHLSQQHETSL

SEQ ID NO: 194691 - protein, 36 aa, Artificial Sequence
  Description of Artificial Sequence: Synthetic polypeptide
DENEIATTNPVATAQWGSVSATGAGGTAPQDNAEFN

SEQ ID NO: 194692 - protein, 36 aa, Artificial Sequence
  Description of Artificial Sequence: Synthetic polypeptide
DENEIATTNPVATAQWGSVSATGDPGDTPHQGDEDN

SEQ ID NO: 194693 - protein, 35 aa, Artificial Sequence
  Description of Artificial Sequence: Synthetic polypeptide
DENEIATTNPVATASWGCNVAGNNGLQEDAGGGHQ

SEQ ID NO: 194694 - protein, 32 aa, Artificial Sequence
  Description of Artificial Sequence: Synthetic polypeptide
DDSEVASTNPVSTEGYGNVTAANTYESDVGQR

SEQ ID NO: 194695 - protein, 35 aa, Artificial Sequence
  Description of Artificial Sequence: Synthetic polypeptide
DENEIATTNPVATASWGCNVAGNNNLQDDAGGGHH

SEQ ID NO: 194696 - protein, 35 aa, Artificial Sequence
  Description of Artificial Sequence: Synthetic polypeptide
DENEIATTNPVATASWGCNVAGNNNLQEDAGGGKH

SEQ ID NO: 194697 - protein, 36 aa, Artificial Sequence
  Description of Artificial Sequence: Synthetic polypeptide
CEEEIACTNPVATEQYGSVCAAGPLGFATMGDIEGY

SEQ ID NO: 194698 - protein, 39 aa, Artificial Sequence
  Description of Artificial Sequence: Synthetic polypeptide
DEEEIACTNPVATEQYGSTVCAMNNGEPTNPDDQGEHRM

SEQ ID NO: 194699 - protein, 35 aa, Artificial Sequence
  Description of Artificial Sequence: Synthetic polypeptide
DENEIATTNPTAYEQWGATYYSMEIEMEQREMDNR

SEQ ID NO: 194700 - protein, 35 aa, Artificial Sequence
  Description of Artificial Sequence: Synthetic polypeptide
DECEIATTNPVAYECWGCVSGDNGEERNNMAQGDA

SEQ ID NO: 194701 - protein, 34 aa, Artificial Sequence
  Description of Artificial Sequence: Synthetic polypeptide
DECEIATTNPVAYECWGCVSGGNGNEAGGEGMTH

SEQ ID NO: 194702 - protein, 34 aa, Artificial Sequence
  Description of Artificial Sequence: Synthetic polypeptide
DECEIATTNPVAYECWGCVSGLGNGNEAGGEGMW

SEQ ID NO: 194703 - protein, 35 aa, Artificial Sequence
  Description of Artificial Sequence: Synthetic polypeptide
AEACISTTNPVATEQYGCVCSWEHNQENFNSDTQS

SEQ ID NO: 194704 - protein, 35 aa, Artificial Sequence
  Description of Artificial Sequence: Synthetic polypeptide
DENAIRTTNPVSTEPYGCHICSMEAMQQPQSGQNH

SEQ ID NO: 194705 - protein, 37 aa, Artificial Sequence
  Description of Artificial Sequence: Synthetic polypeptide
CESEIATTNPCATEQYGTVCSYTGEEWSVNMNGGNDV

SEQ ID NO: 194706 - protein, 36 aa, Artificial Sequence
  Description of Artificial Sequence: Synthetic polypeptide
AEACIRTTNPVATEQYGCVCEWGEPNQEYFGSDNQS

SEQ ID NO: 194707 - protein, 37 aa, Artificial Sequence
  Description of Artificial Sequence: Synthetic polypeptide
NEEEIRTTNPVATEQYGSYMDLRPNLEAVSEMAMMED

SEQ ID NO: 194708 - protein, 36 aa, Artificial Sequence
  Description of Artificial Sequence: Synthetic polypeptide
CESEIATTNPCATESYGTVCSYTGEEWSENMNGGND

SEQ ID NO: 194709 - protein, 35 aa, Artificial Sequence
  Description of Artificial Sequence: Synthetic polypeptide
DEHEIATTNPCAYEEWGSVAWTWNDHQGDIQGGAK

SEQ ID NO: 194710 - protein, 34 aa, Artificial Sequence
  Description of Artificial Sequence: Synthetic polypeptide
DENEIATTNPIATECYGATVWAEEDWQEHKGEYL

SEQ ID NO: 194711 - protein, 38 aa, Artificial Sequence
  Description of Artificial Sequence: Synthetic polypeptide
DEEEIRTTNPVATEGYGCVCSNWGEDHNQENFNSDTQL

SEQ ID NO: 194712 - protein, 36 aa, Artificial Sequence
  Description of Artificial Sequence: Synthetic polypeptide
DEEEIACTNPVATEQYGSTACAGAPHLAEAPMGETN

SEQ ID NO: 194713 - protein, 35 aa, Artificial Sequence
  Description of Artificial Sequence: Synthetic polypeptide
DENEIATTNPIATECYGATVWANEEDWQEHKGEYL

SEQ ID NO: 194714 - protein, 39 aa, Artificial Sequence
  Description of Artificial Sequence: Synthetic polypeptide
DEEEIRTTNPVATEQYGSIVNGAAINEYHDSRSEESEEV

SEQ ID NO: 194715 - protein, 36 aa, Artificial Sequence
  Description of Artificial Sequence: Synthetic polypeptide
AEACEIATTNPVAYEQWGWVSTGGNAGEHQGTGDES

SEQ ID NO: 194716 - protein, 38 aa, Artificial Sequence
  Description of Artificial Sequence: Synthetic polypeptide
DDEEIRSTNPVATEQYGCVCSNWGEDHNQENSGSQNQS

SEQ ID NO: 194717 - protein, 37 aa, Artificial Sequence
  Description of Artificial Sequence: Synthetic polypeptide
SEAAEICTTNPVAYECWGSVATGNGPLNDDRGQNGTQ

SEQ ID NO: 194718 - protein, 32 aa, Artificial Sequence
  Description of Artificial Sequence: Synthetic polypeptide
SDSEVASTNPVSTEGYGNVAANTIGQSIVGQR

SEQ ID NO: 194719 - protein, 38 aa, Artificial Sequence
  Description of Artificial Sequence: Synthetic polypeptide
DEEEIRTTNPVATEGYGCVCSNWGEDHNQENFNSDTQS

SEQ ID NO: 194720 - protein, 37 aa, Artificial Sequence
  Description of Artificial Sequence: Synthetic polypeptide
DEGEIRTTNPVATEWYGSVPVGDVSSEEDEIGSTQED

SEQ ID NO: 194721 - protein, 35 aa, Artificial Sequence
  Description of Artificial Sequence: Synthetic polypeptide
AEAAEIATTNPVAYEQWGSVVCNAAMPREDAEDER

SEQ ID NO: 194722 - protein, 37 aa, Artificial Sequence
  Description of Artificial Sequence: Synthetic polypeptide
CEEEIACTNPVATEQYGSVCAQAGPLGFATMGDNSGM

SEQ ID NO: 194723 - protein, 36 aa, Artificial Sequence
  Description of Artificial Sequence: Synthetic polypeptide
DEHEIATTNPCAYEEWGSVAWTWNDHQGDRQGDGAK

SEQ ID NO: 194724 - protein, 39 aa, Artificial Sequence
  Description of Artificial Sequence: Synthetic polypeptide
DEEEIACTNPVATEQYGVSTACAANDGDPLGSAEGNTHG

SEQ ID NO: 194725 - protein, 33 aa, Artificial Sequence
  Description of Artificial Sequence: Synthetic polypeptide
DDSEVASTNPVSTEGYGNVWAPNMTIQSGVGQR

SEQ ID NO: 194726 - protein, 37 aa, Artificial Sequence
  Description of Artificial Sequence: Synthetic polypeptide
DEEEIACTNPVATEQYGSCVAAGEGVPLEAMEEGHHE

SEQ ID NO: 194727 - protein, 38 aa, Artificial Sequence
  Description of Artificial Sequence: Synthetic polypeptide
DEEEIACTNPVATEQYGSACSPTGEGGVGAMLNDETNH

SEQ ID NO: 194728 - protein, 37 aa, Artificial Sequence
  Description of Artificial Sequence: Synthetic polypeptide
DEEEIACTNPVATEQYGSACSPANGTHAGEAGMSMGD

SEQ ID NO: 194729 - protein, 36 aa, Artificial Sequence
  Description of Artificial Sequence: Synthetic polypeptide
DEEEIACTNPVATEQYGSACSPAGDGSGPDDSDGTN

SEQ ID NO: 194730 - protein, 39 aa, Artificial Sequence
  Description of Artificial Sequence: Synthetic polypeptide
FEDEIRTTNCVATEQYGSVVVSDGNMGELGEQEGGQEDT

SEQ ID NO: 194731 - protein, 38 aa, Artificial Sequence
  Description of Artificial Sequence: Synthetic polypeptide
FEDEIRTTNPVATEFYGQVVISDEFGTQDQSGNGGGNP

SEQ ID NO: 194732 - protein, 37 aa, Artificial Sequence
  Description of Artificial Sequence: Synthetic polypeptide
DENEIRTTNPVATEGYGSCPMPIMLWPENRSISQQTI

SEQ ID NO: 194733 - protein, 38 aa, Artificial Sequence
  Description of Artificial Sequence: Synthetic polypeptide
FEDEIRTTNPVATEQYGSVMGDEMNGPEGGQGQEGDGE

SEQ ID NO: 194734 - protein, 37 aa, Artificial Sequence
  Description of Artificial Sequence: Synthetic polypeptide
SDEEIRTTNPVATEQYGCVCSNWEEDNAENFGSDTQS

SEQ ID NO: 194735 - protein, 34 aa, Artificial Sequence
  Description of Artificial Sequence: Synthetic polypeptide
CENEIATTNPVAYEPYGKVSIIGHLSQQSETEGM

SEQ ID NO: 194736 - protein, 36 aa, Artificial Sequence
  Description of Artificial Sequence: Synthetic polypeptide
SDEEIRTTNPVATEQWGQCVCSWGEDNQNFGSDTQA

SEQ ID NO: 194737 - protein, 36 aa, Artificial Sequence
  Description of Artificial Sequence: Synthetic polypeptide
DENEIRTTNPVATEGYGMVSVEGMGDGGQGQEMEGT

SEQ ID NO: 194738 - protein, 37 aa, Artificial Sequence
  Description of Artificial Sequence: Synthetic polypeptide
SDEEIRTTNPVATEQWGCVCSNWGEHNQEYFGSDNQA

SEQ ID NO: 194739 - protein, 38 aa, Artificial Sequence
  Description of Artificial Sequence: Synthetic polypeptide
CEEEISTTNPVATEQYGQCVCSTWGEHNAENFNSDTQD

SEQ ID NO: 194740 - protein, 36 aa, Artificial Sequence
  Description of Artificial Sequence: Synthetic polypeptide
DEEEIACTNPVATEQYGSACSAGDGSGPDDSDGTAD

SEQ ID NO: 194741 - protein, 37 aa, Artificial Sequence
  Description of Artificial Sequence: Synthetic polypeptide
DENEIRTTNPVATEGYGCVCSWGEDHNQENFISDNQA

SEQ ID NO: 194742 - protein, 34 aa, Artificial Sequence
  Description of Artificial Sequence: Synthetic polypeptide
CENEIATTNPVAYEPYGKVSIIGHLSQHHETEQG

SEQ ID NO: 194743 - protein, 36 aa, Artificial Sequence
  Description of Artificial Sequence: Synthetic polypeptide
SDEEIRTTNPVATCQYGCVCSWGEHNQEYFNSDNQA

SEQ ID NO: 194744 - protein, 33 aa, Artificial Sequence
  Description of Artificial Sequence: Synthetic polypeptide
CENEIATTNPVAYEPYGKVSIIGHLSFHETEGA

SEQ ID NO: 194745 - protein, 32 aa, Artificial Sequence
  Description of Artificial Sequence: Synthetic polypeptide
CENEIATTNPVAYEPYGKVSIIGHASDHETEG

SEQ ID NO: 194746 - protein, 38 aa, Artificial Sequence
  Description of Artificial Sequence: Synthetic polypeptide
DEEEIACTNPVATEQYGSACSPTPDGLPLEAMEGTAQF

SEQ ID NO: 194747 - protein, 33 aa, Artificial Sequence
  Description of Artificial Sequence: Synthetic polypeptide
CENEIATTNPVAYEPYGKVSIMGHLSTHETEGY

SEQ ID NO: 194748 - protein, 37 aa, Artificial Sequence
  Description of Artificial Sequence: Synthetic polypeptide
CEEEIACTNPVATEQYGCVSPTGEAGINPRDGMEKVH

SEQ ID NO: 194749 - protein, 38 aa, Artificial Sequence
  Description of Artificial Sequence: Synthetic polypeptide
DEEEIACTNPVATEQYGSACSPVGDTHHNIDHSDGEAP

SEQ ID NO: 194750 - protein, 37 aa, Artificial Sequence
  Description of Artificial Sequence: Synthetic polypeptide
DDEEIRSTNPVATEQYGQCSCSSGEHNQENFGSDTQS

SEQ ID NO: 194751 - protein, 31 aa, Artificial Sequence
  Description of Artificial Sequence: Synthetic polypeptide
NEVEIATTNPVAYECWGEVYYVEDIHQHNEA

SEQ ID NO: 194752 - protein, 36 aa, Artificial Sequence
  Description of Artificial Sequence: Synthetic polypeptide
CEEEIACTNPVATEQYGSVCAAGPLGEATMGDEEAW

SEQ ID NO: 194753 - protein, 36 aa, Artificial Sequence
  Description of Artificial Sequence: Synthetic polypeptide
DEEEIACTNPVATEQYGSCAAMGNGDNIAPMGEGPH

SEQ ID NO: 194754 - protein, 36 aa, Artificial Sequence
  Description of Artificial Sequence: Synthetic polypeptide
DEEEIACTNPVATEQYGSCAAMGAGDNIAPMGEEHH

SEQ ID NO: 194755 - protein, 36 aa, Artificial Sequence
  Description of Artificial Sequence: Synthetic polypeptide
DEEEIACTNPVATEQYGSCAAGNPPPDDPEIENGEE

SEQ ID NO: 194756 - protein, 34 aa, Artificial Sequence
  Description of Artificial Sequence: Synthetic polypeptide
DESEIATTNPVATECWGATTANAEDLAEPKGPYI

SEQ ID NO: 194757 - protein, 36 aa, Artificial Sequence
  Description of Artificial Sequence: Synthetic polypeptide
DEEEIACTNPVATEQYGSCAAGNPPFDNGEPEEGAE

SEQ ID NO: 194758 - protein, 32 aa, Artificial Sequence
  Description of Artificial Sequence: Synthetic polypeptide
DDSEVASTNPVSTEGYGQVAAETDIESRVGQQ

SEQ ID NO: 194759 - protein, 37 aa, Artificial Sequence
  Description of Artificial Sequence: Synthetic polypeptide
DEREISTTNPVATEQYGCVCSNWGEHNTENFNSDTQS

SEQ ID NO: 194760 - protein, 38 aa, Artificial Sequence
  Description of Artificial Sequence: Synthetic polypeptide
DEEEIACTNPVATEQYGSCAAGMGNGTTNPADGMENDN

SEQ ID NO: 194761 - protein, 38 aa, Artificial Sequence
  Description of Artificial Sequence: Synthetic polypeptide
DEEEIGTTNPVAYEQYGQCVCSTGEDHNQENFNSDNQG

SEQ ID NO: 194762 - protein, 37 aa, Artificial Sequence
  Description of Artificial Sequence: Synthetic polypeptide
DEEEIACTNPVATEQYGSCAAAPGNHPMMGMEIGNVT

SEQ ID NO: 194763 - protein, 37 aa, Artificial Sequence
  Description of Artificial Sequence: Synthetic polypeptide
DEEEIACTNPVATEQYGSCAAAPGNHPMADMEIGNTA

SEQ ID NO: 194764 - protein, 37 aa, Artificial Sequence
  Description of Artificial Sequence: Synthetic polypeptide
DEEEIACTNPVATEQYGSCAAAPGNEPMAGMEIGNND

SEQ ID NO: 194765 - protein, 37 aa, Artificial Sequence
  Description of Artificial Sequence: Synthetic polypeptide
DEEEIACTNPVATEQYGSCAAAGGNLTNPDDMMGDMA

SEQ ID NO: 194766 - protein, 37 aa, Artificial Sequence
  Description of Artificial Sequence: Synthetic polypeptide
DEEEIACTNPVATEQYGSCAAAGGNGLTNPDDSEGRM

SEQ ID NO: 194767 - protein, 37 aa, Artificial Sequence
  Description of Artificial Sequence: Synthetic polypeptide
DEHEIATTNPVAIYEPQPWGQSVAMNDGLQTDGGITY

SEQ ID NO: 194768 - protein, 39 aa, Artificial Sequence
  Description of Artificial Sequence: Synthetic polypeptide
DEEEIRTTNPVATEQYGSWQIPPCSVEEYEEVIGTRVVL

SEQ ID NO: 194769 - protein, 38 aa, Artificial Sequence
  Description of Artificial Sequence: Synthetic polypeptide
DEEEIACTNPVATEQYGSACSVTGDFIGQPDDLMGDWH

SEQ ID NO: 194770 - protein, 38 aa, Artificial Sequence
  Description of Artificial Sequence: Synthetic polypeptide
DEREISTTNPVATEQYGCVCSTWGEDHNAENFNSDNQS

SEQ ID NO: 194771 - protein, 35 aa, Artificial Sequence
  Description of Artificial Sequence: Synthetic polypeptide
DEECISTTNPVATEIYGCVCGWEHNQENFGSDTQA

SEQ ID NO: 194772 - protein, 35 aa, Artificial Sequence
  Description of Artificial Sequence: Synthetic polypeptide
DENEIATTNPVATEQWGCVAGEGVEMNAAEPDNAD

SEQ ID NO: 194773 - protein, 39 aa, Artificial Sequence
  Description of Artificial Sequence: Synthetic polypeptide
FEEEIRGTNPVATEQYGVVYTQGQDQLIDQEGEGGNQGT

SEQ ID NO: 194774 - protein, 35 aa, Artificial Sequence
  Description of Artificial Sequence: Synthetic polypeptide
NEECISTTNPVAYEQWGYYWSDQNDDTQRQDERQQ

SEQ ID NO: 194775 - protein, 35 aa, Artificial Sequence
  Description of Artificial Sequence: Synthetic polypeptide
NEECIRTTNPVAYEQWGYYWSDQQDDTQRQDERDQ

SEQ ID NO: 194776 - protein, 37 aa, Artificial Sequence
  Description of Artificial Sequence: Synthetic polypeptide
QECEICTTNPVATEAYGVVSTVTQQNQQQGTTDEQEM

SEQ ID NO: 194777 - protein, 40 aa, Artificial Sequence
  Description of Artificial Sequence: Synthetic polypeptide
DEEEIRTTNPVATEQYGVVSTVVNVNNNTEQGTEEEEEED

SEQ ID NO: 194778 - protein, 36 aa, Artificial Sequence
  Description of Artificial Sequence: Synthetic polypeptide
DEAEIRTTNPVATEAYGSVGVEDDFTAPHGPEEHHI

SEQ ID NO: 194779 - protein, 35 aa, Artificial Sequence
  Description of Artificial Sequence: Synthetic polypeptide
CEEEISTTNPVAYEQYGCVCSWGEHNANFNSETQA

SEQ ID NO: 194780 - protein, 39 aa, Artificial Sequence
  Description of Artificial Sequence: Synthetic polypeptide
DEQEIRTTNPVATEQYGSVVMDNNDNNTEGPGQTGQTGD

SEQ ID NO: 194781 - protein, 38 aa, Artificial Sequence
  Description of Artificial Sequence: Synthetic polypeptide
DEEEIGTTNPVATEQYGQCVCSNWEEHNQENFGSDTQS

SEQ ID NO: 194782 - protein, 34 aa, Artificial Sequence
  Description of Artificial Sequence: Synthetic polypeptide
NEEATECTTNPVAYEEWGTVSIWNGNGPNGNNSR

SEQ ID NO: 194783 - protein, 33 aa, Artificial Sequence
  Description of Artificial Sequence: Synthetic polypeptide
SAEEIATTNPVATASWGCVAGTGNPDNADPTGR

SEQ ID NO: 194784 - protein, 35 aa, Artificial Sequence
  Description of Artificial Sequence: Synthetic polypeptide
DEAEICATNPVAYEQWGSVCYTTDNNDHGHGETMH

SEQ ID NO: 194785 - protein, 38 aa, Artificial Sequence
  Description of Artificial Sequence: Synthetic polypeptide
DEEEIRTTNPVATEQYGSICTPWPMVGEQIQQTQEYED

SEQ ID NO: 194786 - protein, 38 aa, Artificial Sequence
  Description of Artificial Sequence: Synthetic polypeptide
FEEEIRTTNPVATEQYGDVGANNVDNFPGQLGEGGQGL

SEQ ID NO: 194787 - protein, 37 aa, Artificial Sequence
  Description of Artificial Sequence: Synthetic polypeptide
QECEICTTNPVATEAYGVVSTVTQQLTQQGTEEEQEE

SEQ ID NO: 194788 - protein, 33 aa, Artificial Sequence
  Description of Artificial Sequence: Synthetic polypeptide
SAEEIATTNPVATASWGCNVAGAGPQTAGGNFN

SEQ ID NO: 194789 - protein, 34 aa, Artificial Sequence
  Description of Artificial Sequence: Synthetic polypeptide
SAEEIATTNPVATASWGCNVAGAGPLQTAGGGNH

SEQ ID NO: 194790 - protein, 34 aa, Artificial Sequence
  Description of Artificial Sequence: Synthetic polypeptide
SAEEIATTNPVATASWGCNVAGAGLQTAGNNNFE

SEQ ID NO: 194791 - protein, 34 aa, Artificial Sequence
  Description of Artificial Sequence: Synthetic polypeptide
DEAEIATTNPVSTEPWGCIAPEDQQQQLQRDNEH

SEQ ID NO: 194792 - protein, 35 aa, Artificial Sequence
  Description of Artificial Sequence: Synthetic polypeptide
NEDEIRTTNPVAYEEWGSVCVQNDNDQPEKNNMDT

SEQ ID NO: 194793 - protein, 37 aa, Artificial Sequence
  Description of Artificial Sequence: Synthetic polypeptide
DEEEIACTNPVATEQYGSACAAMNGEEAPGEQMENNH

SEQ ID NO: 194794 - protein, 32 aa, Artificial Sequence
  Description of Artificial Sequence: Synthetic polypeptide
QESEIASTNPVATEGYGTMCAASDGPVEFGDD

SEQ ID NO: 194795 - protein, 36 aa, Artificial Sequence
  Description of Artificial Sequence: Synthetic polypeptide
DEHEIATTNPVATEQYGSCAAMGHGPADSGEGNDHE

SEQ ID NO: 194796 - protein, 36 aa, Artificial Sequence
  Description of Artificial Sequence: Synthetic polypeptide
DEAVIRATNPVATENYGSVSYSALLEFPNYSQNTGM

SEQ ID NO: 194797 - protein, 34 aa, Artificial Sequence
  Description of Artificial Sequence: Synthetic polypeptide
QEDEIACTNPVAYEQWGEYYSIENDQDLQGPGES

SEQ ID NO: 194798 - protein, 33 aa, Artificial Sequence
  Description of Artificial Sequence: Synthetic polypeptide
QEDEIACTNPVAYEQWGEYYSIENDDDRGPGEM

SEQ ID NO: 194799 - protein, 37 aa, Artificial Sequence
  Description of Artificial Sequence: Synthetic polypeptide
DEEEIACTNPVATEQYGSACAANPTEEAGAHQDNDAP

SEQ ID NO: 194800 - protein, 35 aa, Artificial Sequence
  Description of Artificial Sequence: Synthetic polypeptide
SAEEIATTNPVATEQWGGCVAGNNNLDTEMEIARN

SEQ ID NO: 194801 - protein, 36 aa, Artificial Sequence
  Description of Artificial Sequence: Synthetic polypeptide
SAEEIATTNPVATEQWGGCVAGNNNLATEMGNNDNN

SEQ ID NO: 194802 - protein, 36 aa, Artificial Sequence
  Description of Artificial Sequence: Synthetic polypeptide
DEAEICTTNPMATETYGSVPTMPDPMQHVNSESFWG

SEQ ID NO: 194803 - protein, 37 aa, Artificial Sequence
  Description of Artificial Sequence: Synthetic polypeptide
QECEICTTNPVATEAYGVVSTVTQQQLQQGTEDEQEE

SEQ ID NO: 194804 - protein, 35 aa, Artificial Sequence
  Description of Artificial Sequence: Synthetic polypeptide
DENEIRTTNPVATECYGATTWANAEDWAEPKGPYI

SEQ ID NO: 194805 - protein, 38 aa, Artificial Sequence
  Description of Artificial Sequence: Synthetic polypeptide
DEEEIGTTNPVATEQYGQCVCSNWGEHNEENFGSDTQS

SEQ ID NO: 194806 - protein, 37 aa, Artificial Sequence
  Description of Artificial Sequence: Synthetic polypeptide
DEEEIACTNPVATEQYGSACAAAIPHQAEAEMGNGND

SEQ ID NO: 194807 - protein, 39 aa, Artificial Sequence
  Description of Artificial Sequence: Synthetic polypeptide
DEEEIRTTNPVATEQYGSCCQNVDSDAIGFFVQEPVSEM

SEQ ID NO: 194808 - protein, 36 aa, Artificial Sequence
  Description of Artificial Sequence: Synthetic polypeptide
DEAEIQTTNPVATAAWGQTVACIANQSQRTGTAYRM

SEQ ID NO: 194809 - protein, 35 aa, Artificial Sequence
  Description of Artificial Sequence: Synthetic polypeptide
NEEEIACTNPVATEQYGSCAAGNAEGADSLSGEDA

SEQ ID NO: 194810 - protein, 37 aa, Artificial Sequence
  Description of Artificial Sequence: Synthetic polypeptide
NEEEIACTNPVATEQYGSACATNPELGQLHQDDEKAG

SEQ ID NO: 194811 - protein, 39 aa, Artificial Sequence
  Description of Artificial Sequence: Synthetic polypeptide
DEEEIRTTNPVATEQYGSCCQNVDSYAIGFARQEEVSEM

SEQ ID NO: 194812 - protein, 36 aa, Artificial Sequence
  Description of Artificial Sequence: Synthetic polypeptide
NEEEIACTNPVATEQYGSACAAANPLPAEAPIGDHQ

SEQ ID NO: 194813 - protein, 38 aa, Artificial Sequence
  Description of Artificial Sequence: Synthetic polypeptide
DEEEIRTTNPVATEQYGSIGEPCMFTDFDIGQAPIQVQ

SEQ ID NO: 194814 - protein, 38 aa, Artificial Sequence
  Description of Artificial Sequence: Synthetic polypeptide
DEEEIGTTNPVATEQYGQCVCSNWGEHNAENFNSDTQS

SEQ ID NO: 194815 - protein, 36 aa, Artificial Sequence
  Description of Artificial Sequence: Synthetic polypeptide
DEEEIACTNPVATEQYGSACAANPAEGPDHQDDSAY

SEQ ID NO: 194816 - protein, 37 aa, Artificial Sequence
  Description of Artificial Sequence: Synthetic polypeptide
FEEEIRTTNPVATEQYGAVVNGFGQGGQQDTDPTTGF

SEQ ID NO: 194817 - protein, 34 aa, Artificial Sequence
  Description of Artificial Sequence: Synthetic polypeptide
DEAEIKTTNPVSTEPWGCIAPNDQQQQQNRNQHG

SEQ ID NO: 194818 - protein, 37 aa, Artificial Sequence
  Description of Artificial Sequence: Synthetic polypeptide
DDEEIKTTNPVATEQYGSVYGGNTGDGEEGEGQGTGG

SEQ ID NO: 194819 - protein, 37 aa, Artificial Sequence
  Description of Artificial Sequence: Synthetic polypeptide
DEEEIACTNPVAYEQYGSVPAIANNEEAPANQAEGTV

SEQ ID NO: 194820 - protein, 38 aa, Artificial Sequence
  Description of Artificial Sequence: Synthetic polypeptide
DENEIATTNPVATEQYGSTACAVNPAEGQNHQDGMQMN

SEQ ID NO: 194821 - protein, 36 aa, Artificial Sequence
  Description of Artificial Sequence: Synthetic polypeptide
NEDEIACTNPVATEQWGGCSAITNHLAPDPQMGKSN

SEQ ID NO: 194822 - protein, 37 aa, Artificial Sequence
  Description of Artificial Sequence: Synthetic polypeptide
NECEIRTTNPVATEQYGSSCPPTALSVETTIESQSDN

SEQ ID NO: 194823 - protein, 36 aa, Artificial Sequence
  Description of Artificial Sequence: Synthetic polypeptide
DEAEIRATNPVAYEQWGSVCYTTDNNDHGHDGTQHF

SEQ ID NO: 194824 - protein, 38 aa, Artificial Sequence
  Description of Artificial Sequence: Synthetic polypeptide
DEEEIACTNPVAYEQYGVSTACAANDGDPLGSEGNEHG

SEQ ID NO: 194825 - protein, 36 aa, Artificial Sequence
  Description of Artificial Sequence: Synthetic polypeptide
DESAEIATTNPCAYECWGSVATPNGNQNLEGDHQNQ

SEQ ID NO: 194826 - protein, 36 aa, Artificial Sequence
  Description of Artificial Sequence: Synthetic polypeptide
NEAEISTTNPVATEQYGCSCSWGEHNQEHFQSDTQA

SEQ ID NO: 194827 - protein, 36 aa, Artificial Sequence
  Description of Artificial Sequence: Synthetic polypeptide
DEAEIRTTNPVATCHYGCVCSWGEHNQEYFISDNQS

SEQ ID NO: 194828 - protein, 35 aa, Artificial Sequence
  Description of Artificial Sequence: Synthetic polypeptide
SAEEIATTNPVATAQWGGCVAGNNGLAVAGMNQMG

SEQ ID NO: 194829 - protein, 36 aa, Artificial Sequence
  Description of Artificial Sequence: Synthetic polypeptide
DEAEIRATNPVAYEQWGSVCYTTDNNDHGHPGETTH

SEQ ID NO: 194830 - protein, 37 aa, Artificial Sequence
  Description of Artificial Sequence: Synthetic polypeptide
FEEEIRTTNPVATEQYGMVSVEGMGDGGQGQEMDEGT

SEQ ID NO: 194831 - protein, 35 aa, Artificial Sequence
  Description of Artificial Sequence: Synthetic polypeptide
DEAEIRCTNPVATEGWGCVCSWGEENQEYFGSQQS

SEQ ID NO: 194832 - protein, 38 aa, Artificial Sequence
  Description of Artificial Sequence: Synthetic polypeptide
FEEEIRTTNPVATEQYGMVSVEGMGDGGQGQEQDENGV

SEQ ID NO: 194833 - protein, 37 aa, Artificial Sequence
  Description of Artificial Sequence: Synthetic polypeptide
FEEEIRTTNPVATEQYGMVSVEGMGDGGQGQEQDQGD

SEQ ID NO: 194834 - protein, 35 aa, Artificial Sequence
  Description of Artificial Sequence: Synthetic polypeptide
DEAEIRTTNPVATCHYGCVCSWGEHNAYFISDTQS

SEQ ID NO: 194835 - protein, 34 aa, Artificial Sequence
  Description of Artificial Sequence: Synthetic polypeptide
SAEEIATTNPVATAQWGCVAGTGNPDNADPGEKN

SEQ ID NO: 194836 - protein, 36 aa, Artificial Sequence
  Description of Artificial Sequence: Synthetic polypeptide
DEAEIRTTNPVATCHYGCVCSTMEHNQENFTSDTQA

SEQ ID NO: 194837 - protein, 36 aa, Artificial Sequence
  Description of Artificial Sequence: Synthetic polypeptide
NNNEIVTTNPVATEQYGVCVWNTQNLNMIDGGPEME

SEQ ID NO: 194838 - protein, 35 aa, Artificial Sequence
  Description of Artificial Sequence: Synthetic polypeptide
NEAEIRTTNPVAYECWGVCSTTNLPGMNEGGMTQN

SEQ ID NO: 194839 - protein, 38 aa, Artificial Sequence
  Description of Artificial Sequence: Synthetic polypeptide
DDEEIRTTNPVATDQYGSVTGQGQGDDEFGNGGQEETA

SEQ ID NO: 194840 - protein, 35 aa, Artificial Sequence
  Description of Artificial Sequence: Synthetic polypeptide
DEAEIRATNPVAYECWGSVCYTTDNNDHGHGTQGG

SEQ ID NO: 194841 - protein, 34 aa, Artificial Sequence
  Description of Artificial Sequence: Synthetic polypeptide
NEDEIACTNPVAYEQWGEYYSIENDQRPTNGESM

SEQ ID NO: 194842 - protein, 32 aa, Artificial Sequence
  Description of Artificial Sequence: Synthetic polypeptide
NEDEIACTNPVAYEQWGITHTNWIDLMGEDDS

SEQ ID NO: 194843 - protein, 37 aa, Artificial Sequence
  Description of Artificial Sequence: Synthetic polypeptide
CEEEIACTNPVATEQYGSACATNPQEEAGAHLDGDVP

SEQ ID NO: 194844 - protein, 36 aa, Artificial Sequence
  Description of Artificial Sequence: Synthetic polypeptide
NEDEIRTTNPVATEGYGSVNNDEFDEEDEDGGNQGN

SEQ ID NO: 194845 - protein, 39 aa, Artificial Sequence
  Description of Artificial Sequence: Synthetic polypeptide
NEDEIRTTNPVATEFYGQVVISDEFGTQDQIGNRGANAQ

SEQ ID NO: 194846 - protein, 38 aa, Artificial Sequence
  Description of Artificial Sequence: Synthetic polypeptide
NEDEIRTTNPVATDQYGSVNMNLIDEGQLQEFNENNEQ

SEQ ID NO: 194847 - protein, 37 aa, Artificial Sequence
  Description of Artificial Sequence: Synthetic polypeptide
DEHEIATTNPVATEQYGSVCAAMAHDEAGMPMDNPNH

SEQ ID NO: 194848 - protein, 34 aa, Artificial Sequence
  Description of Artificial Sequence: Synthetic polypeptide
NEDEIATTNPVAYERWGSVSGGNPGNKGEDDGQD

SEQ ID NO: 194849 - protein, 35 aa, Artificial Sequence
  Description of Artificial Sequence: Synthetic polypeptide
DEAEIRATNPVAYECWGSVCYTTDNNDHGHGMTQK

SEQ ID NO: 194850 - protein, 35 aa, Artificial Sequence
  Description of Artificial Sequence: Synthetic polypeptide
DEMVIGTTNPVATEQWGCVCSSEDHNQEYFGSDQS

SEQ ID NO: 194851 - protein, 38 aa, Artificial Sequence
  Description of Artificial Sequence: Synthetic polypeptide
FEEEIRTTNPVATEQYGDVVMGVNDNPIEGQGNFNTII

SEQ ID NO: 194852 - protein, 38 aa, Artificial Sequence
  Description of Artificial Sequence: Synthetic polypeptide
FEEEIRTTNPVATEQYGDVVNMQGPEIGQGNDDQGDQL

SEQ ID NO: 194853 - protein, 39 aa, Artificial Sequence
  Description of Artificial Sequence: Synthetic polypeptide
NEDEIRTTNPVATEQYGSVDPNTQNEVGDQEEGGDQEGG

SEQ ID NO: 194854 - protein, 34 aa, Artificial Sequence
  Description of Artificial Sequence: Synthetic polypeptide
NEDEIATTNPVAYECWGSVYMTPQQGEDTGQDET

SEQ ID NO: 194855 - protein, 37 aa, Artificial Sequence
  Description of Artificial Sequence: Synthetic polypeptide
QECEICTTNPVATEAYGVVSTVTQQLQQQGTTDEQTQ

SEQ ID NO: 194856 - protein, 37 aa, Artificial Sequence
  Description of Artificial Sequence: Synthetic polypeptide
QECEICTTNPVATEAYGVVSTVTQQLNQQGTEEEDED

SEQ ID NO: 194857 - protein, 37 aa, Artificial Sequence
  Description of Artificial Sequence: Synthetic polypeptide
QECEICTTNPVATEAYGVVSTVTQQLLQQGTEDEDET

SEQ ID NO: 194858 - protein, 39 aa, Artificial Sequence
  Description of Artificial Sequence: Synthetic polypeptide
DEEEIRTTNPVATEQYGSIANWEAGNPDDLLGSGQEEIG

SEQ ID NO: 194859 - protein, 38 aa, Artificial Sequence
  Description of Artificial Sequence: Synthetic polypeptide
DEEEIRTTNPVATEQYGSIANSGINVHDDDDSVESIMM

SEQ ID NO: 194860 - protein, 38 aa, Artificial Sequence
  Description of Artificial Sequence: Synthetic polypeptide
FEEEIRTTNPVATEQYGDVVVAGVNDNMNGQGEFNEID

SEQ ID NO: 194861 - protein, 38 aa, Artificial Sequence
  Description of Artificial Sequence: Synthetic polypeptide
DEEEIRTTNPVATEQYGSIAFPTFSTLEESEIVEVQVL

SEQ ID NO: 194862 - protein, 36 aa, Artificial Sequence
  Description of Artificial Sequence: Synthetic polypeptide
NEDEIATTNPVATECYGCVCTIDSNNHNGQQGGDDA

SEQ ID NO: 194863 - protein, 33 aa, Artificial Sequence
  Description of Artificial Sequence: Synthetic polypeptide
NEDEIATTNPCAYEQWGTVAWTDIDQNPNGDQQ

SEQ ID NO: 194864 - protein, 36 aa, Artificial Sequence
  Description of Artificial Sequence: Synthetic polypeptide
DERNEIATTNPVAYERWGCVSGGNADDSRNNGNGNM

SEQ ID NO: 194865 - protein, 38 aa, Artificial Sequence
  Description of Artificial Sequence: Synthetic polypeptide
FEEEIRGTNPVATEQYGVVVNDTTGNNDQGEEFDQGDE

SEQ ID NO: 194866 - protein, 36 aa, Artificial Sequence
  Description of Artificial Sequence: Synthetic polypeptide
SAEEIATTNPVATEQWGSVSCAGEGLQPDDSMISAM

SEQ ID NO: 194867 - protein, 37 aa, Artificial Sequence
  Description of Artificial Sequence: Synthetic polypeptide
DEAEISTVNPVATEQYGCVCSMWGNHNAENFGSDNQA

SEQ ID NO: 194868 - protein, 38 aa, Artificial Sequence
  Description of Artificial Sequence: Synthetic polypeptide
DDEEIKTTNPVATEQYGSVYGQGQGDLEVGNGGDEETA

SEQ ID NO: 194869 - protein, 37 aa, Artificial Sequence
  Description of Artificial Sequence: Synthetic polypeptide
NEEEIATTNPVAYEQWGSVSGGEPANGPNMRNGGGKV

SEQ ID NO: 194870 - protein, 37 aa, Artificial Sequence
  Description of Artificial Sequence: Synthetic polypeptide
DESEIATTNPCATEQYGTICSATGGEPSENFNGGNDN

SEQ ID NO: 194871 - protein, 37 aa, Artificial Sequence
  Description of Artificial Sequence: Synthetic polypeptide
DDEEIKTTNPVATEQYGSVYGGVTGDGEEGEGQGIEG

SEQ ID NO: 194872 - protein, 38 aa, Artificial Sequence
  Description of Artificial Sequence: Synthetic polypeptide
DDEEIRTTNPVATCQYGCVCSNWGEDDNAENFGSDNQS

SEQ ID NO: 194873 - protein, 35 aa, Artificial Sequence
  Description of Artificial Sequence: Synthetic polypeptide
DEECISTTNPVATEGYGCVCQWEDDNQEYFGSDQS

SEQ ID NO: 194874 - protein, 38 aa, Artificial Sequence
  Description of Artificial Sequence: Synthetic polypeptide
CEEEISTTNPVATEQYGQCVCSWGEDTNAENFISDNQS

SEQ ID NO: 194875 - protein, 36 aa, Artificial Sequence
  Description of Artificial Sequence: Synthetic polypeptide
DEEEIACTNPVATEQYGSACAITNPGENTADVESFP

SEQ ID NO: 194876 - protein, 37 aa, Artificial Sequence
  Description of Artificial Sequence: Synthetic polypeptide
SAEEIATTNPVATEQYGSVCSPANPALGIDHADDTAW

SEQ ID NO: 194877 - protein, 37 aa, Artificial Sequence
  Description of Artificial Sequence: Synthetic polypeptide
DDEEIRTTNPVATCQYGCVCSWGEGDNAENFISDNQS

SEQ ID NO: 194878 - protein, 37 aa, Artificial Sequence
  Description of Artificial Sequence: Synthetic polypeptide
SAEEIATTNPVATEQYGSVCAMNNGLNPTAPGPMESG

SEQ ID NO: 194879 - protein, 38 aa, Artificial Sequence
  Description of Artificial Sequence: Synthetic polypeptide
DEREISTTNPVATEQYGQCVCSTWGEHNQENFNSDTQS

SEQ ID NO: 194880 - protein, 38 aa, Artificial Sequence
  Description of Artificial Sequence: Synthetic polypeptide
DEEEIRATNPVATEQWGGCNAITNHGDEQTGMENNMNQ

SEQ ID NO: 194881 - protein, 32 aa, Artificial Sequence
  Description of Artificial Sequence: Synthetic polypeptide
DDSEVASTNPVSTQGYGNVAANTIQLRVGQEI

SEQ ID NO: 194882 - protein, 37 aa, Artificial Sequence
  Description of Artificial Sequence: Synthetic polypeptide
DEREISTTNPVATEQYGQCVCSWEEHNQENFISDNQS

SEQ ID NO: 194883 - protein, 35 aa, Artificial Sequence
  Description of Artificial Sequence: Synthetic polypeptide
CEEEIACTNPVATEQYGSACNPADHQEAEDPNENN

SEQ ID NO: 194884 - protein, 37 aa, Artificial Sequence
  Description of Artificial Sequence: Synthetic polypeptide
DDEEIRTTNPVATDAYGSVIGNNDGGEEDNEGGGNTA

SEQ ID NO: 194885 - protein, 37 aa, Artificial Sequence
  Description of Artificial Sequence: Synthetic polypeptide
DDEEIRTTNPVATDAYGSVIGNNNGIEEDNEGGGNTD

SEQ ID NO: 194886 - protein, 38 aa, Artificial Sequence
  Description of Artificial Sequence: Synthetic polypeptide
DDEEIRTTNPVATDAYGSVITNNINGGEEDNEGGNNTD

SEQ ID NO: 194887 - protein, 36 aa, Artificial Sequence
  Description of Artificial Sequence: Synthetic polypeptide
DENEIATTNPVATEQWGCVCSSGEENAENSSSDNAA

SEQ ID NO: 194888 - protein, 35 aa, Artificial Sequence
  Description of Artificial Sequence: Synthetic polypeptide
DENEIATTNPVATEQWGCVAGQGVEMNAAEMDNDM

SEQ ID NO: 194889 - protein, 36 aa, Artificial Sequence
  Description of Artificial Sequence: Synthetic polypeptide
NNEEIRTTNPVATEQYGSVCFPDVSGEDDIFDFQDF

SEQ ID NO: 194890 - protein, 35 aa, Artificial Sequence
  Description of Artificial Sequence: Synthetic polypeptide
DEECISTTNPVATEGYGCVCNWGEGHNQYFISDQS

SEQ ID NO: 194891 - protein, 37 aa, Artificial Sequence
  Description of Artificial Sequence: Synthetic polypeptide
FEEEIRITNPVATEQYGEYTYTCEEVNVTMAQYQNDT

SEQ ID NO: 194892 - protein, 37 aa, Artificial Sequence
  Description of Artificial Sequence: Synthetic polypeptide
DEEEIRATNPVATEQWGGCNAINNHEEAMGMEMNARM

SEQ ID NO: 194893 - protein, 35 aa, Artificial Sequence
  Description of Artificial Sequence: Synthetic polypeptide
DENEIATTNPVATEQWGCVAGEGVEMNDDLMDNAW

SEQ ID NO: 194894 - protein, 36 aa, Artificial Sequence
  Description of Artificial Sequence: Synthetic polypeptide
DENEIATTNPVATEQWGCVAGEGVEQMNGAEMDNAM

SEQ ID NO: 194895 - protein, 37 aa, Artificial Sequence
  Description of Artificial Sequence: Synthetic polypeptide
FEEEIRSTNPVATEQYGVVVSGGQGQIGQGGEGTTQG

SEQ ID NO: 194896 - protein, 37 aa, Artificial Sequence
  Description of Artificial Sequence: Synthetic polypeptide
FEEEIRTTNCVATEGYGSVVMNFDDNNDQTGGEGEED

SEQ ID NO: 194897 - protein, 35 aa, Artificial Sequence
  Description of Artificial Sequence: Synthetic polypeptide
DENEIATTNPVATEQWGCVAGEGVGGMNAAEDNAW

SEQ ID NO: 194898 - protein, 36 aa, Artificial Sequence
  Description of Artificial Sequence: Synthetic polypeptide
DESEIATTNPCATERYGTVCHATGVEPSENFNGGND

SEQ ID NO: 194899 - protein, 35 aa, Artificial Sequence
  Description of Artificial Sequence: Synthetic polypeptide
DENEIATTNPVATEQWGCVAGENGVDDNAAEEDNA

SEQ ID NO: 194900 - protein, 37 aa, Artificial Sequence
  Description of Artificial Sequence: Synthetic polypeptide
DDEEIRTTNPVATDAYGSVQGNFNGGEEDNEGGNNTI

SEQ ID NO: 194901 - protein, 38 aa, Artificial Sequence
  Description of Artificial Sequence: Synthetic polypeptide
DEEEIRTTNPVATEMWGHVVANAGPAQGGEHQDDNLDK

SEQ ID NO: 194902 - protein, 38 aa, Artificial Sequence
  Description of Artificial Sequence: Synthetic polypeptide
DEEEIRTTNPVATEQYGSCADQNMNTHTETENFPPHEQ

SEQ ID NO: 194903 - protein, 37 aa, Artificial Sequence
  Description of Artificial Sequence: Synthetic polypeptide
DENEIRTTNPVATEFYGMVSVEGMGDRGQGQEATEGN

SEQ ID NO: 194904 - protein, 35 aa, Artificial Sequence
  Description of Artificial Sequence: Synthetic polypeptide
DENEIATTNPVATEQWGCVAGENGVEMNAAEDGAH

SEQ ID NO: 194905 - protein, 38 aa, Artificial Sequence
  Description of Artificial Sequence: Synthetic polypeptide
AEEEISTTNPVATEQYGQCVCSNWGEHNAENFGSENQA

SEQ ID NO: 194906 - protein, 35 aa, Artificial Sequence
  Description of Artificial Sequence: Synthetic polypeptide
DEECISTTNPVATEGYGCVCNWEAPNQEYFNSDQS

SEQ ID NO: 194907 - protein, 36 aa, Artificial Sequence
  Description of Artificial Sequence: Synthetic polypeptide
DENEIRTTNPVATEFYGMVNNMEFDEEDEDGGNQGE

SEQ ID NO: 194908 - protein, 35 aa, Artificial Sequence
  Description of Artificial Sequence: Synthetic polypeptide
DEECISTTNPVATEGYGCVCNWEEADQYFGSDTQS

SEQ ID NO: 194909 - protein, 35 aa, Artificial Sequence
  Description of Artificial Sequence: Synthetic polypeptide
QEFEIAPTNPCSYEQYGVTVSCANMLSQSNGGTDR

SEQ ID NO: 194910 - protein, 35 aa, Artificial Sequence
  Description of Artificial Sequence: Synthetic polypeptide
DEECISTTNPVATEGYGCVCNWGEAHNQYFGSEQS

SEQ ID NO: 194911 - protein, 35 aa, Artificial Sequence
  Description of Artificial Sequence: Synthetic polypeptide
DENEIATTNPVATEQWGCVAGENGVDMNDAEDNAW

SEQ ID NO: 194912 - protein, 38 aa, Artificial Sequence
  Description of Artificial Sequence: Synthetic polypeptide
DEEEIRTTNPVATEQYGSIGEPIMFTDMDAAQAPIQVL

SEQ ID NO: 194913 - protein, 35 aa, Artificial Sequence
  Description of Artificial Sequence: Synthetic polypeptide
NEEEIATTNPVAYEPWGKTFVTLNALPQNDVGTVF

SEQ ID NO: 194914 - protein, 37 aa, Artificial Sequence
  Description of Artificial Sequence: Synthetic polypeptide
SAEEIATTNPVATEQYGSVCAMANHADDSKAPGNMEN

SEQ ID NO: 194915 - protein, 37 aa, Artificial Sequence
  Description of Artificial Sequence: Synthetic polypeptide
NEEEIATTNPVATEQWGSVSGEGGPLGINHKDDNSAE

SEQ ID NO: 194916 - protein, 30 aa, Artificial Sequence
  Description of Artificial Sequence: Synthetic polypeptide
QESEIASTNPIGTECYGATAAEDWQPKGPI

SEQ ID NO: 194917 - protein, 36 aa, Artificial Sequence
  Description of Artificial Sequence: Synthetic polypeptide
NEEEIATTNPVATEQWGGCVCTAAAGNPDNMDPNDH

SEQ ID NO: 194918 - protein, 34 aa, Artificial Sequence
  Description of Artificial Sequence: Synthetic polypeptide
NEEEIATTNPVATEQWGGCCTAAAGNPDNMTPEH

SEQ ID NO: 194919 - protein, 35 aa, Artificial Sequence
  Description of Artificial Sequence: Synthetic polypeptide
NEEEIATTNPVATEQWGGCCTAAAGNPDNMPNVHD

SEQ ID NO: 194920 - protein, 38 aa, Artificial Sequence
  Description of Artificial Sequence: Synthetic polypeptide
DEEEIGTTNPVATEQYGQCVCSNWGEHNTENFNSDTQS

SEQ ID NO: 194921 - protein, 38 aa, Artificial Sequence
  Description of Artificial Sequence: Synthetic polypeptide
DDEEIKTTNPVATEQYGSVYGGNTGDGLEEGEGQGAEG

SEQ ID NO: 194922 - protein, 38 aa, Artificial Sequence
  Description of Artificial Sequence: Synthetic polypeptide
NEEEIATTNPVATEQWGCNVAGNNGGLPQENNHGTENP

SEQ ID NO: 194923 - protein, 37 aa, Artificial Sequence
  Description of Artificial Sequence: Synthetic polypeptide
DEHEIATTNPVATEQYGCVYVWEMNDIQQQTQDANHP

SEQ ID NO: 194924 - protein, 36 aa, Artificial Sequence
  Description of Artificial Sequence: Synthetic polypeptide
DESEIATTNPCATEAYGTVCAATGGEWSENMNGGND

SEQ ID NO: 194925 - protein, 37 aa, Artificial Sequence
  Description of Artificial Sequence: Synthetic polypeptide
NEEEIATTNPVATAQWGSFVANANGLPQEAPHENMHN

SEQ ID NO: 194926 - protein, 38 aa, Artificial Sequence
  Description of Artificial Sequence: Synthetic polypeptide
DEEEIRTTNPVATEQYGSIGEPTMFTDEDIGQVPIQVL

SEQ ID NO: 194927 - protein, 37 aa, Artificial Sequence
  Description of Artificial Sequence: Synthetic polypeptide
DEAEIGTTNPVATEQYGCVCSNWGEDHNAENFGSDQA

SEQ ID NO: 194928 - protein, 38 aa, Artificial Sequence
  Description of Artificial Sequence: Synthetic polypeptide
DEEEIGTTNPVATEQYGQCVCSNWGEHNIENFNSDTQL

SEQ ID NO: 194929 - protein, 35 aa, Artificial Sequence
  Description of Artificial Sequence: Synthetic polypeptide
QEDEIAPTNPCSYEQYGVTVSCCNMLSQSEGGTRC

SEQ ID NO: 194930 - protein, 36 aa, Artificial Sequence
  Description of Artificial Sequence: Synthetic polypeptide
SAEEIATTNPVATEQWGSVSGTGDPPPDANGSGDSP

SEQ ID NO: 194931 - protein, 37 aa, Artificial Sequence
  Description of Artificial Sequence: Synthetic polypeptide
CEEEISTTNPVAYEQYGCVCSNTGEDDNQENFGSDQS

SEQ ID NO: 194932 - protein, 36 aa, Artificial Sequence
  Description of Artificial Sequence: Synthetic polypeptide
SAEEIATTNPVATEQWGSVSGQGNPPPDANGSPDSW

SEQ ID NO: 194933 - protein, 36 aa, Artificial Sequence
  Description of Artificial Sequence: Synthetic polypeptide
FEEEIRTTNPVATEQYGATPQPPCNWAPENAHELSM

SEQ ID NO: 194934 - protein, 39 aa, Artificial Sequence
  Description of Artificial Sequence: Synthetic polypeptide
DEEEIGTTNPVATEQYGQCVCSTWGEDDNAENFNSDNQS

SEQ ID NO: 194935 - protein, 37 aa, Artificial Sequence
  Description of Artificial Sequence: Synthetic polypeptide
DENEIATTNPVATEQYGCVAAGKGNSHGMNAEPNNNQ

SEQ ID NO: 194936 - protein, 32 aa, Artificial Sequence
  Description of Artificial Sequence: Synthetic polypeptide
QESEIASTNPIATECWGVTMANSTLQHKGPYI

SEQ ID NO: 194937 - protein, 36 aa, Artificial Sequence
  Description of Artificial Sequence: Synthetic polypeptide
DEEEIACTNPVAYEQYGSCAAAPNPGNAEGGIGARV

SEQ ID NO: 194938 - protein, 36 aa, Artificial Sequence
  Description of Artificial Sequence: Synthetic polypeptide
SAEEIATTNPVATEQYGSVCAMANHADDSKAPGHHN

SEQ ID NO: 194939 - protein, 38 aa, Artificial Sequence
  Description of Artificial Sequence: Synthetic polypeptide
SAEEIATTNPVATEQYGSVCAANNGGLEADMPGGNMHN

SEQ ID NO: 194940 - protein, 36 aa, Artificial Sequence
  Description of Artificial Sequence: Synthetic polypeptide
SAEEIATTNPVATEQYGSVCAANMGEEAPDDQMEKA

SEQ ID NO: 194941 - protein, 35 aa, Artificial Sequence
  Description of Artificial Sequence: Synthetic polypeptide
DEEEIACTNPVAYEQWGHSPASLAGMGQAQDPNEN

SEQ ID NO: 194942 - protein, 37 aa, Artificial Sequence
  Description of Artificial Sequence: Synthetic polypeptide
DEECISTTNPVATEGYGCVCSNWGEDNAENFGSDNQS

SEQ ID NO: 194943 - protein, 36 aa, Artificial Sequence
  Description of Artificial Sequence: Synthetic polypeptide
DEEEIACTNPVATEQYGSACAGAPHLAEAPMGEWAN

SEQ ID NO: 194944 - protein, 35 aa, Artificial Sequence
  Description of Artificial Sequence: Synthetic polypeptide
CENEIATTNPVATEGYGCVCSWGELNQHFSSETLA

SEQ ID NO: 194945 - protein, 34 aa, Artificial Sequence
  Description of Artificial Sequence: Synthetic polypeptide
CENEIATTNPVATEGYGCVCSWGEHNQHFESELA

SEQ ID NO: 194946 - protein, 38 aa, Artificial Sequence
  Description of Artificial Sequence: Synthetic polypeptide
SAEEIATTNPVATEQYGSACSTANPAEGQDHQDDSNAH

SEQ ID NO: 194947 - protein, 34 aa, Artificial Sequence
  Description of Artificial Sequence: Synthetic polypeptide
NEEEIATTNPVAYEHWGCFSWINDHNRRQGQKEQ

SEQ ID NO: 194948 - protein, 33 aa, Artificial Sequence
  Description of Artificial Sequence: Synthetic polypeptide
DDSEVATTNPVATEGWGATANNEDWQSPKGPYR

SEQ ID NO: 194949 - protein, 38 aa, Artificial Sequence
  Description of Artificial Sequence: Synthetic polypeptide
DEEEIACTNPVATEQYGSACAATNPDEEAGAHQDNDAD

SEQ ID NO: 194950 - protein, 38 aa, Artificial Sequence
  Description of Artificial Sequence: Synthetic polypeptide
DEEEIACTNPVATEQYGSACAATNPAEEAGTHLDNAAP

SEQ ID NO: 194951 - protein, 38 aa, Artificial Sequence
  Description of Artificial Sequence: Synthetic polypeptide
AEEEIRTTNPVATEQYGSYSSPSTAWEPESPVGHPPVC

SEQ ID NO: 194952 - protein, 36 aa, Artificial Sequence
  Description of Artificial Sequence: Synthetic polypeptide
DEEEIACTNPVAYEQYGSACSAAPHLNEAPGGEAFQ

SEQ ID NO: 194953 - protein, 38 aa, Artificial Sequence
  Description of Artificial Sequence: Synthetic polypeptide
DEEEIACTNPVAYEQYGSACSPTPDGVPLGAMEGFNNQ

SEQ ID NO: 194954 - protein, 36 aa, Artificial Sequence
  Description of Artificial Sequence: Synthetic polypeptide
DEEEIACTNPVAYEQYGSCAAAGGNHGNAEGNGMGN

SEQ ID NO: 194955 - protein, 38 aa, Artificial Sequence
  Description of Artificial Sequence: Synthetic polypeptide
DENEIATTNPVATEQYGCNVPANMNPAEEAGDSMMNRD

SEQ ID NO: 194956 - protein, 37 aa, Artificial Sequence
  Description of Artificial Sequence: Synthetic polypeptide
DENEIATTNPVATEQYGCTTAANAGGLPGANMHGMND

SEQ ID NO: 194957 - protein, 32 aa, Artificial Sequence
  Description of Artificial Sequence: Synthetic polypeptide
QESEIASTNPIATECWGATMANSTLQHKGPYI

SEQ ID NO: 194958 - protein, 34 aa, Artificial Sequence
  Description of Artificial Sequence: Synthetic polypeptide
DENEIATTNPVATEQWGTNCAATDGGVEDESNND

SEQ ID NO: 194959 - protein, 31 aa, Artificial Sequence
  Description of Artificial Sequence: Synthetic polypeptide
DENEIATTNPIATECWGATVANADWAHEPYL

SEQ ID NO: 194960 - protein, 39 aa, Artificial Sequence
  Description of Artificial Sequence: Synthetic polypeptide
DDEEIRTTNPVATEQYGQCVCSNWEEDHNAENFGSENQA

SEQ ID NO: 194961 - protein, 37 aa, Artificial Sequence
  Description of Artificial Sequence: Synthetic polypeptide
CEEEIACTNPVATEQYGSVAAPGNGGPPTAGNPNENG

SEQ ID NO: 194962 - protein, 35 aa, Artificial Sequence
  Description of Artificial Sequence: Synthetic polypeptide
QAEEIATTNPVAYEQYGSVPAIANNDEQDSKAIEH

SEQ ID NO: 194963 - protein, 37 aa, Artificial Sequence
  Description of Artificial Sequence: Synthetic polypeptide
DEGEIATTNPVATEFYGSINFTAPDTLREPHEGEDTR

SEQ ID NO: 194964 - protein, 38 aa, Artificial Sequence
  Description of Artificial Sequence: Synthetic polypeptide
DEGEIATTNPVATEFYGSISFSAPDTLREPHEGNEDIR

SEQ ID NO: 194965 - protein, 36 aa, Artificial Sequence
  Description of Artificial Sequence: Synthetic polypeptide
DEAEIRTTNPCATEAWGCVVCWENDNHMGQQGNTDH

SEQ ID NO: 194966 - protein, 34 aa, Artificial Sequence
  Description of Artificial Sequence: Synthetic polypeptide
DENEIATTNPVSTEPWGTICSGMEDIQQQQHGNH

SEQ ID NO: 194967 - protein, 33 aa, Artificial Sequence
  Description of Artificial Sequence: Synthetic polypeptide
KEDEIRCTNPTAYECWGCVYYENDDRHRGDISR

SEQ ID NO: 194968 - protein, 39 aa, Artificial Sequence
  Description of Artificial Sequence: Synthetic polypeptide
DEEEIRTTNPVATEQYGYAISVINNSKENEWSEVSTTSF

SEQ ID NO: 194969 - protein, 33 aa, Artificial Sequence
  Description of Artificial Sequence: Synthetic polypeptide
KEDEIRCTNPTAYECWGSSYYENDDRHRTDINR

SEQ ID NO: 194970 - protein, 35 aa, Artificial Sequence
  Description of Artificial Sequence: Synthetic polypeptide
KEDEIRCTNPTAYECWGSVYYENDDMRHRGDIHNR

SEQ ID NO: 194971 - protein, 34 aa, Artificial Sequence
  Description of Artificial Sequence: Synthetic polypeptide
KEDEIRCTNPTAYECWGSVYYENDDRHREGDDSR

SEQ ID NO: 194972 - protein, 38 aa, Artificial Sequence
  Description of Artificial Sequence: Synthetic polypeptide
DDEEIRTTNPVATEQYGASVPTTVYNNEFEIEEVQSQT

SEQ ID NO: 194973 - protein, 33 aa, Artificial Sequence
  Description of Artificial Sequence: Synthetic polypeptide
KEDEIRCTNPTAYECWGSVYYENDDRHRGDDQI

SEQ ID NO: 194974 - protein, 34 aa, Artificial Sequence
  Description of Artificial Sequence: Synthetic polypeptide
KEDEIRCTNPTAYECWGSVYYENDDRHRGDISYR

SEQ ID NO: 194975 - protein, 34 aa, Artificial Sequence
  Description of Artificial Sequence: Synthetic polypeptide
KEDEIRCTNPTAYECWGSVYYMNDDRHRGDDERR

SEQ ID NO: 194976 - protein, 37 aa, Artificial Sequence
  Description of Artificial Sequence: Synthetic polypeptide
DENEIRGTNPVATEAYGSVVDITNVNMDDEGQQDQEN

SEQ ID NO: 194977 - protein, 36 aa, Artificial Sequence
  Description of Artificial Sequence: Synthetic polypeptide
DEGEIATTNPVATEQWGCCAVTNAATQIDGLMDSTM

SEQ ID NO: 194978 - protein, 35 aa, Artificial Sequence
  Description of Artificial Sequence: Synthetic polypeptide
DEHEIATTNPVAYECWGTVYWINENQDRQMIRVGE

SEQ ID NO: 194979 - protein, 37 aa, Artificial Sequence
  Description of Artificial Sequence: Synthetic polypeptide
DENEIRGTNPVATDQYGVVNDNSIGQNQGGQEDNDEC

SEQ ID NO: 194980 - protein, 35 aa, Artificial Sequence
  Description of Artificial Sequence: Synthetic polypeptide
DEECISTVNPVATEGYGCVCSMWEHNENFGSDTQS

SEQ ID NO: 194981 - protein, 37 aa, Artificial Sequence
  Description of Artificial Sequence: Synthetic polypeptide
QAEEIATTNPVAYEQYGSVPAIANNGLMTATPDGENH

SEQ ID NO: 194982 - protein, 37 aa, Artificial Sequence
  Description of Artificial Sequence: Synthetic polypeptide
DEEEIRATNPVATEQYGSACAAGPPLDNDASGAGMGA

SEQ ID NO: 194983 - protein, 39 aa, Artificial Sequence
  Description of Artificial Sequence: Synthetic polypeptide
DEEEIRTTNPVATEQYGSFVADQNMNTHEETENGPPHED

SEQ ID NO: 194984 - protein, 37 aa, Artificial Sequence
  Description of Artificial Sequence: Synthetic polypeptide
MEEEISTTNPVATEQYGCVCSNWGEHNAENFNSDNQS

SEQ ID NO: 194985 - protein, 35 aa, Artificial Sequence
  Description of Artificial Sequence: Synthetic polypeptide
DEGEIATTNPVATAQWGSVAATGAGGTAPQDNAFN

SEQ ID NO: 194986 - protein, 38 aa, Artificial Sequence
  Description of Artificial Sequence: Synthetic polypeptide
MEEEISTTNPVATEQYGQCVCSNWGEHNAENFGSENQS

SEQ ID NO: 194987 - protein, 36 aa, Artificial Sequence
  Description of Artificial Sequence: Synthetic polypeptide
QAHEIATTNPVATEQYGSVCSPAGPNDNDMSEGAEQ

SEQ ID NO: 194988 - protein, 37 aa, Artificial Sequence
  Description of Artificial Sequence: Synthetic polypeptide
MEEEISTTNPVATEQYGQCVCSMWEETNENFNSDTQS

SEQ ID NO: 194989 - protein, 34 aa, Artificial Sequence
  Description of Artificial Sequence: Synthetic polypeptide
DEGEIATTNPVATASWGCVAAANNEPGDNGGENG

SEQ ID NO: 194990 - protein, 36 aa, Artificial Sequence
  Description of Artificial Sequence: Synthetic polypeptide
DEGEIATTNPVATASWGCVAAANNEVQDRGGENDEH

SEQ ID NO: 194991 - protein, 33 aa, Artificial Sequence
  Description of Artificial Sequence: Synthetic polypeptide
DENEIATTNPVGTEPYGVCYCEDGQQQQNGMEM

SEQ ID NO: 194992 - protein, 34 aa, Artificial Sequence
  Description of Artificial Sequence: Synthetic polypeptide
DEHEIATTNPVAYECWGTVYRINEMADRRSDNNG

SEQ ID NO: 194993 - protein, 36 aa, Artificial Sequence
  Description of Artificial Sequence: Synthetic polypeptide
DEEEIACTNPVATAQWGSVSLAGPPNEETPGGQMHQ

SEQ ID NO: 194994 - protein, 37 aa, Artificial Sequence
  Description of Artificial Sequence: Synthetic polypeptide
DEGEIATTNPVATEQYGSVCNPMPNQNNEAMIGDGPN

SEQ ID NO: 194995 - protein, 37 aa, Artificial Sequence
  Description of Artificial Sequence: Synthetic polypeptide
QAEEIATTNPVATEQYGSVCAANNGEEADAPAGEMNH

SEQ ID NO: 194996 - protein, 37 aa, Artificial Sequence
  Description of Artificial Sequence: Synthetic polypeptide
MEEEISTTNPVATEQYGCVCSWGEDHNQENFNSDTQA

SEQ ID NO: 194997 - protein, 37 aa, Artificial Sequence
  Description of Artificial Sequence: Synthetic polypeptide
QAEEIATTNPVATEQYGSVCAANNGEPADAPGGNMHN

SEQ ID NO: 194998 - protein, 35 aa, Artificial Sequence
  Description of Artificial Sequence: Synthetic polypeptide
DEEEIACTNPVATAQWGSVAATGAGGTAPQDIAFK

SEQ ID NO: 194999 - protein, 38 aa, Artificial Sequence
  Description of Artificial Sequence: Synthetic polypeptide
DEEEIRTTNPVATEGYGQCVCSNWGEHNIENFNSDFQS

SEQ ID NO: 195000 - protein, 36 aa, Artificial Sequence
  Description of Artificial Sequence: Synthetic polypeptide
DEECISTTNPVAYEQYGQCVCSWGEHNQYFGSDTQA

SEQ ID NO: 195001 - protein, 36 aa, Artificial Sequence
  Description of Artificial Sequence: Synthetic polypeptide
QAHEIATTNPVATEQYGSVCAATAHLPADSMINDGN

SEQ ID NO: 195002 - protein, 38 aa, Artificial Sequence
  Description of Artificial Sequence: Synthetic polypeptide
DEEEIRTTNPVATEQYGSFTLAHATTDQQSMIEFEQDE

SEQ ID NO: 195003 - protein, 38 aa, Artificial Sequence
  Description of Artificial Sequence: Synthetic polypeptide
DEEEIRTTNPVATEGYGQCVCSNWEEHNTENFNSETQS

SEQ ID NO: 195004 - protein, 36 aa, Artificial Sequence
  Description of Artificial Sequence: Synthetic polypeptide
DEATIATTNPVAYEQWGETVCPINDLHDQDGQNDVK

SEQ ID NO: 195005 - protein, 38 aa, Artificial Sequence
  Description of Artificial Sequence: Synthetic polypeptide
DEEEIRTTNPVATEGYGQCVCSNWGEHNIENFNSDNQS

SEQ ID NO: 195006 - protein, 37 aa, Artificial Sequence
  Description of Artificial Sequence: Synthetic polypeptide
QAEEIATTNPVATEQYGSVCAANNGDEAGAPGDEMNH

SEQ ID NO: 195007 - protein, 36 aa, Artificial Sequence
  Description of Artificial Sequence: Synthetic polypeptide
DEECISTVNPVATEGYGCVCSTWGEHNENFGSETQS

SEQ ID NO: 195008 - protein, 38 aa, Artificial Sequence
  Description of Artificial Sequence: Synthetic polypeptide
MEEEIRTTNPVATESYGSVMGLNVGNLEDELNGGQGDT

SEQ ID NO: 195009 - protein, 35 aa, Artificial Sequence
  Description of Artificial Sequence: Synthetic polypeptide
DEGEIATTNPVATEQWGCVAGEGVEMNNALMDNAM

SEQ ID NO: 195010 - protein, 37 aa, Artificial Sequence
  Description of Artificial Sequence: Synthetic polypeptide
QAEEIATTNPVATEQYGSVCAANNGPEADGPGGEMNN

SEQ ID NO: 195011 - protein, 36 aa, Artificial Sequence
  Description of Artificial Sequence: Synthetic polypeptide
QAEEIATTNPVAYEQYGSVCAGNGGDEATAGTGVND

SEQ ID NO: 195012 - protein, 39 aa, Artificial Sequence
  Description of Artificial Sequence: Synthetic polypeptide
DEEEIRTTNPVATEQYGSTVGCMVCPSQIMQEVADLHEQ

SEQ ID NO: 195013 - protein, 33 aa, Artificial Sequence
  Description of Artificial Sequence: Synthetic polypeptide
DENEIATTNPVSTEPYGVCYCEDGQQQQNGGVE

SEQ ID NO: 195014 - protein, 33 aa, Artificial Sequence
  Description of Artificial Sequence: Synthetic polypeptide
DENEIATTNPVSTEPYGVCYCEDGQQQQNGHMH

SEQ ID NO: 195015 - protein, 34 aa, Artificial Sequence
  Description of Artificial Sequence: Synthetic polypeptide
DENEIATTNPVSTEPYGVCYCEDGQQQQNGLNKE

SEQ ID NO: 195016 - protein, 34 aa, Artificial Sequence
  Description of Artificial Sequence: Synthetic polypeptide
DENEIATTNPVSTEPYGVCYCEDGQQQQNGLREE

SEQ ID NO: 195017 - protein, 38 aa, Artificial Sequence
  Description of Artificial Sequence: Synthetic polypeptide
DEGEIATTNPVATEQYGSVCAMNNGEPTNPDDQGLHHM

SEQ ID NO: 195018 - protein, 33 aa, Artificial Sequence
  Description of Artificial Sequence: Synthetic polypeptide
DENEIATTNPVSTEPYGVCYCEDGQQQQNGMGP

SEQ ID NO: 195019 - protein, 36 aa, Artificial Sequence
  Description of Artificial Sequence: Synthetic polypeptide
QAEEIATTNPVATEQYGSVCAANPALGIDHPDDTAE

SEQ ID NO: 195020 - protein, 37 aa, Artificial Sequence
  Description of Artificial Sequence: Synthetic polypeptide
QAEEIATTNPVATEQYGSVCAANPALGIEHPDGTAAK

SEQ ID NO: 195021 - protein, 34 aa, Artificial Sequence
  Description of Artificial Sequence: Synthetic polypeptide
CEEVIACTNPVATEQYGCVAMNNSNAAGGPGEWG

SEQ ID NO: 195022 - protein, 33 aa, Artificial Sequence
  Description of Artificial Sequence: Synthetic polypeptide
DENEIATTNPVSTEPYGVCYCEDGQQQQNGQGM

SEQ ID NO: 195023 - protein, 36 aa, Artificial Sequence
  Description of Artificial Sequence: Synthetic polypeptide
DEGEIATTNPVATEQWGCVATTNHIGDTTAQDDTDH

SEQ ID NO: 195024 - protein, 32 aa, Artificial Sequence
  Description of Artificial Sequence: Synthetic polypeptide
DEEEIATTNPIATEQWGETAWAAVCAEHKEEI

SEQ ID NO: 195025 - protein, 33 aa, Artificial Sequence
  Description of Artificial Sequence: Synthetic polypeptide
DENEIATTNPVSTEPYGVCYCEDGQQQQNGTQE

SEQ ID NO: 195026 - protein, 36 aa, Artificial Sequence
  Description of Artificial Sequence: Synthetic polypeptide
LEEEICTTNPMCYEPYGVVVSCDPNHSQNREGGGND

SEQ ID NO: 195027 - protein, 33 aa, Artificial Sequence
  Description of Artificial Sequence: Synthetic polypeptide
DENEIATTNPVSTEPYGVCYCEDGQQQQNHNEM

SEQ ID NO: 195028 - protein, 37 aa, Artificial Sequence
  Description of Artificial Sequence: Synthetic polypeptide
LEAEIRTTNPVATEQYGCVTTLPEDVPNNPEEKNDQY

SEQ ID NO: 195029 - protein, 35 aa, Artificial Sequence
  Description of Artificial Sequence: Synthetic polypeptide
DEGEIATTNPVATEQWGCVAGEGMPANPNPMGAQP

SEQ ID NO: 195030 - protein, 33 aa, Artificial Sequence
  Description of Artificial Sequence: Synthetic polypeptide
DENEIATTNPVSTEPYGVCYCEDGQQQQNGDEY

SEQ ID NO: 195031 - protein, 33 aa, Artificial Sequence
  Description of Artificial Sequence: Synthetic polypeptide
DENEIATTNPVSTEPYGVCYCEDGQQQNNGQSE

SEQ ID NO: 195032 - protein, 36 aa, Artificial Sequence
  Description of Artificial Sequence: Synthetic polypeptide
QAEEIATTNPVAYEQYGSVCAVGDGGQDHQDGMNHW

SEQ ID NO: 195033 - protein, 36 aa, Artificial Sequence
  Description of Artificial Sequence: Synthetic polypeptide
DEGEIATTNPVATEQWGCTTAGNNGENAMQMDGTNP

SEQ ID NO: 195034 - protein, 35 aa, Artificial Sequence
  Description of Artificial Sequence: Synthetic polypeptide
DEHEIATTNPVAYECWGTVYWINENQDRQMNHVGG

SEQ ID NO: 195035 - protein, 38 aa, Artificial Sequence
  Description of Artificial Sequence: Synthetic polypeptide
KEGEIATTNPVATEQYGNISFSAPEDTLNEPHEGEDTR

SEQ ID NO: 195036 - protein, 35 aa, Artificial Sequence
  Description of Artificial Sequence: Synthetic polypeptide
DEECISTVNPVATEGYGCVCSWEEHNENFGSDPQS

SEQ ID NO: 195037 - protein, 39 aa, Artificial Sequence
  Description of Artificial Sequence: Synthetic polypeptide
MEEEIRTTNPVATEQYGVVVLSGQEDQEEQIGEGEGNGV

SEQ ID NO: 195038 - protein, 36 aa, Artificial Sequence
  Description of Artificial Sequence: Synthetic polypeptide
QAEEIATTNPVAYEQYGSVCAMNNGGEADIGGNEMW

SEQ ID NO: 195039 - protein, 37 aa, Artificial Sequence
  Description of Artificial Sequence: Synthetic polypeptide
DEEEIRATNPVATEQYGSACAAAGPPLDNDASLAGMN

SEQ ID NO: 195040 - protein, 37 aa, Artificial Sequence
  Description of Artificial Sequence: Synthetic polypeptide
DEEEIRATNPVATEQYGSACAAAGPPLDNDASGSGMT

SEQ ID NO: 195041 - protein, 34 aa, Artificial Sequence
  Description of Artificial Sequence: Synthetic polypeptide
DEHEIATTNPVAYECWGTVYWINENQDRQMITVD

SEQ ID NO: 195042 - protein, 38 aa, Artificial Sequence
  Description of Artificial Sequence: Synthetic polypeptide
MEEEIRTTNPVATEQYGVVGSHVWKDDAEVPQPIGDDG

SEQ ID NO: 195043 - protein, 38 aa, Artificial Sequence
  Description of Artificial Sequence: Synthetic polypeptide
MEEEIRTTNPVATEQYGVISDDFENVDVEGQGGGEETP

SEQ ID NO: 195044 - protein, 38 aa, Artificial Sequence
  Description of Artificial Sequence: Synthetic polypeptide
MEEEIRTTNPVATEQYGVANGSIVWNDAEVPQPIGDDG

SEQ ID NO: 195045 - protein, 38 aa, Artificial Sequence
  Description of Artificial Sequence: Synthetic polypeptide
DEEEIRATNPVATEQYGSACAAAGPPLDNDASGAGSNA

SEQ ID NO: 195046 - protein, 39 aa, Artificial Sequence
  Description of Artificial Sequence: Synthetic polypeptide
DEEEIRATNPVATEQYGQYSVNLDIMLGENGEMDEDEII

SEQ ID NO: 195047 - protein, 37 aa, Artificial Sequence
  Description of Artificial Sequence: Synthetic polypeptide
DEEEIRATNPVATEQYGMVSVEGMGDGGQGQEDQEGT

SEQ ID NO: 195048 - protein, 36 aa, Artificial Sequence
  Description of Artificial Sequence: Synthetic polypeptide
DEHEIATTNPVAYEQWGSVCYQDEQQRNLEDGGGQT

SEQ ID NO: 195049 - protein, 35 aa, Artificial Sequence
  Description of Artificial Sequence: Synthetic polypeptide
LEAEIRTTNPVATEQYGAVCMPNANMESEYETQDG

SEQ ID NO: 195050 - protein, 38 aa, Artificial Sequence
  Description of Artificial Sequence: Synthetic polypeptide
DEEEIGTTNPVATEQYGCVCSNWMEDHNAEYFNSQTQS

SEQ ID NO: 195051 - protein, 37 aa, Artificial Sequence
  Description of Artificial Sequence: Synthetic polypeptide
QAEEIATTNPVATEQYGSVCAANNGLPADAPGGEMHH

SEQ ID NO: 195052 - protein, 38 aa, Artificial Sequence
  Description of Artificial Sequence: Synthetic polypeptide
DEEEIRATNPVATEQYGSACAAAGPPLDNDASGEGMNY

SEQ ID NO: 195053 - protein, 36 aa, Artificial Sequence
  Description of Artificial Sequence: Synthetic polypeptide
QAEEIATTNPVATEQYGSVCAMANHADDSKAPDNNN

SEQ ID NO: 195054 - protein, 37 aa, Artificial Sequence
  Description of Artificial Sequence: Synthetic polypeptide
MEEEISTTNPVATEQYGQCVCSVWGEHNQGFGSDTQM

SEQ ID NO: 195055 - protein, 37 aa, Artificial Sequence
  Description of Artificial Sequence: Synthetic polypeptide
DEGEIATTNPVATAQWGHVVANTGNGEAGAEQDGNTV

SEQ ID NO: 195056 - protein, 36 aa, Artificial Sequence
  Description of Artificial Sequence: Synthetic polypeptide
DESCIRTTNPVATEQYGCIFWPKNNNESIRIDDQNL

SEQ ID NO: 195057 - protein, 36 aa, Artificial Sequence
  Description of Artificial Sequence: Synthetic polypeptide
CEEEIACTNPVATEQYGSCAAMGNGTTNTADGGEDT

SEQ ID NO: 195058 - protein, 39 aa, Artificial Sequence
  Description of Artificial Sequence: Synthetic polypeptide
DEEEIRTTNPVATEGYGQCVCSVSGEDHNQENFNSDTQS

SEQ ID NO: 195059 - protein, 39 aa, Artificial Sequence
  Description of Artificial Sequence: Synthetic polypeptide
DEEEIRTTNPVATEGYGQCVCSTWGEDHNQENFNSENQF

SEQ ID NO: 195060 - protein, 38 aa, Artificial Sequence
  Description of Artificial Sequence: Synthetic polypeptide
IAEEIATTNPVATEQYGSVCAMNNGNLEPPDDQANGAA

SEQ ID NO: 195061 - protein, 31 aa, Artificial Sequence
  Description of Artificial Sequence: Synthetic polypeptide
QESEIATTNPIGTECWGATTWAAEDLQHGPI

SEQ ID NO: 195062 - protein, 39 aa, Artificial Sequence
  Description of Artificial Sequence: Synthetic polypeptide
DEEEIRTTNPVATEGYGQCVCSTWGADHNAENFGSDPQA

SEQ ID NO: 195063 - protein, 34 aa, Artificial Sequence
  Description of Artificial Sequence: Synthetic polypeptide
DESEIACTNPVATEQWGGCCAGTGHQAEGSPMDN

SEQ ID NO: 195064 - protein, 31 aa, Artificial Sequence
  Description of Artificial Sequence: Synthetic polypeptide
QESEIATTNPIATECWGATTWAADWQPGPYI

SEQ ID NO: 195065 - protein, 39 aa, Artificial Sequence
  Description of Artificial Sequence: Synthetic polypeptide
DEEEIRTTNPVATEQYGSYYSSPHMVTVEVAANHFQQQH

SEQ ID NO: 195066 - protein, 36 aa, Artificial Sequence
  Description of Artificial Sequence: Synthetic polypeptide
DDEEIRTTNPVATEQYGCTCPAVVCVIEPSMQEVMN

SEQ ID NO: 195067 - protein, 38 aa, Artificial Sequence
  Description of Artificial Sequence: Synthetic polypeptide
DENEIRGTNPVATEQYGSVYVQGNQGLEMGEGGGQDGE

SEQ ID NO: 195068 - protein, 38 aa, Artificial Sequence
  Description of Artificial Sequence: Synthetic polypeptide
DESEIAATNPVATEPYGSVCIWVQNDQRDQRRTGNTSN

SEQ ID NO: 195069 - protein, 38 aa, Artificial Sequence
  Description of Artificial Sequence: Synthetic polypeptide
DEEEIRTTNPVATEGYGQCVCSNWEEHNEEHFNSDNQA

SEQ ID NO: 195070 - protein, 38 aa, Artificial Sequence
  Description of Artificial Sequence: Synthetic polypeptide
DEEEIRTTNPVATEGYGQCVCSNWEEHNQENFNSDTQA

SEQ ID NO: 195071 - protein, 38 aa, Artificial Sequence
  Description of Artificial Sequence: Synthetic polypeptide
DENEIRGTNPVATEQYGSVYGQVNIQDEQGEGGGQDDE

SEQ ID NO: 195072 - protein, 38 aa, Artificial Sequence
  Description of Artificial Sequence: Synthetic polypeptide
DEEEIRTTNPVATEQYGYSFFQCPTLTEGSEEQELFIS

SEQ ID NO: 195073 - protein, 38 aa, Artificial Sequence
  Description of Artificial Sequence: Synthetic polypeptide
DESEIAATNPVATEPYGSVCIWVQNDQRDQRMNGNTSA

SEQ ID NO: 195074 - protein, 37 aa, Artificial Sequence
  Description of Artificial Sequence: Synthetic polypeptide
DENEIRGTNPVATEQYGSVYGQVNGDEMGEGGEQDDE

SEQ ID NO: 195075 - protein, 34 aa, Artificial Sequence
  Description of Artificial Sequence: Synthetic polypeptide
DEGEIATTNPVAYEQWGHCVAANNGDTTDSMGDN

SEQ ID NO: 195076 - protein, 37 aa, Artificial Sequence
  Description of Artificial Sequence: Synthetic polypeptide
DEGEIATTNPVAYEQWGHCVAITNPQDENIGNMESDD

SEQ ID NO: 195077 - protein, 37 aa, Artificial Sequence
  Description of Artificial Sequence: Synthetic polypeptide
DENEIRGTNPVATEQYGSVYVQVNGMENGEGGGQDDE

SEQ ID NO: 195078 - protein, 34 aa, Artificial Sequence
  Description of Artificial Sequence: Synthetic polypeptide
QENEIATTNPVATEPWGPNVAGEGLQNHMEMQNN

SEQ ID NO: 195079 - protein, 38 aa, Artificial Sequence
  Description of Artificial Sequence: Synthetic polypeptide
MEGEIRTTNPVATEQYGCSVVEDYGNLMEFMSISQEGT

SEQ ID NO: 195080 - protein, 39 aa, Artificial Sequence
  Description of Artificial Sequence: Synthetic polypeptide
MEGEIRTTNPVATEQYGCSDVGSVAFNVTTERGVQADEV

SEQ ID NO: 195081 - protein, 38 aa, Artificial Sequence
  Description of Artificial Sequence: Synthetic polypeptide
DEEEIRATNPVATEQYGSVCAAIEGGEEAGMNQDNNTM

SEQ ID NO: 195082 - protein, 36 aa, Artificial Sequence
  Description of Artificial Sequence: Synthetic polypeptide
DEECISTTNPVAYEQYGCVCSWGEENAENFNSDTQS

SEQ ID NO: 195083 - protein, 36 aa, Artificial Sequence
  Description of Artificial Sequence: Synthetic polypeptide
DEECISTTNPVAYEQYGCVCSWGEHNQENFNSDNQS

SEQ ID NO: 195084 - protein, 36 aa, Artificial Sequence
  Description of Artificial Sequence: Synthetic polypeptide
MEGEIRTTNPVATEQYGCNPTPAKGIENHMDNNDFD

SEQ ID NO: 195085 - protein, 35 aa, Artificial Sequence
  Description of Artificial Sequence: Synthetic polypeptide
MEGEIRTTNPVATEQYGCFFDPWNHAEQEWEEDQI

SEQ ID NO: 195086 - protein, 37 aa, Artificial Sequence
  Description of Artificial Sequence: Synthetic polypeptide
HENEIRTTNPVATEQYGAIGLSFEETEIVREMQLTRA

SEQ ID NO: 195087 - protein, 37 aa, Artificial Sequence
  Description of Artificial Sequence: Synthetic polypeptide
DENEIRGTNPVATEQYGVASGNMDDMGEGQAGGIEGT

SEQ ID NO: 195088 - protein, 38 aa, Artificial Sequence
  Description of Artificial Sequence: Synthetic polypeptide
DENEIRGTNPVATEQYGSVYGQVNDGLEGGEGGGQDDE

SEQ ID NO: 195089 - protein, 35 aa, Artificial Sequence
  Description of Artificial Sequence: Synthetic polypeptide
HESEIRTTNPVAYEAWGISVSCANSSSDHEGGMGC

SEQ ID NO: 195090 - protein, 38 aa, Artificial Sequence
  Description of Artificial Sequence: Synthetic polypeptide
DEEEIRTTNPVATEGYGQCVCSMWGEHNQENFNSDTQS

SEQ ID NO: 195091 - protein, 39 aa, Artificial Sequence
  Description of Artificial Sequence: Synthetic polypeptide
DENEIRGTNPVATEQYGSVYVQVNLGLLEQGIGGGQDDE

SEQ ID NO: 195092 - protein, 38 aa, Artificial Sequence
  Description of Artificial Sequence: Synthetic polypeptide
DDEEIRTTNPVATEQYGCVCSMWGEDHNEENFNSDTQS

SEQ ID NO: 195093 - protein, 37 aa, Artificial Sequence
  Description of Artificial Sequence: Synthetic polypeptide
MEGEIRTTNPVATEQYGAVCWEKSENLMEIEEHMAEP

SEQ ID NO: 195094 - protein, 38 aa, Artificial Sequence
  Description of Artificial Sequence: Synthetic polypeptide
DENEIRGTNPVATEQYGSVYVQVNLGLEMGEGGGQIDI

SEQ ID NO: 195095 - protein, 36 aa, Artificial Sequence
  Description of Artificial Sequence: Synthetic polypeptide
DEGEIATTNPVAYEQWGSVAACPNPLATETNGGSVG

SEQ ID NO: 195096 - protein, 37 aa, Artificial Sequence
  Description of Artificial Sequence: Synthetic polypeptide
MEGEIRTTNPVATEQYGAVCSYTNENPMEIEETMAEP

SEQ ID NO: 195097 - protein, 38 aa, Artificial Sequence
  Description of Artificial Sequence: Synthetic polypeptide
MEGEIRTTNPVATEQYGAVCSETVNENLMEPEEHMAEP

SEQ ID NO: 195098 - protein, 36 aa, Artificial Sequence
  Description of Artificial Sequence: Synthetic polypeptide
HMGEIRTTNPVATEQYGSCSVTAVEHIDEELFEEHV

SEQ ID NO: 195099 - protein, 35 aa, Artificial Sequence
  Description of Artificial Sequence: Synthetic polypeptide
MEGEIRTTNPVATEQYGCCYTYETNGFFEDEVDGP

SEQ ID NO: 195100 - protein, 38 aa, Artificial Sequence
  Description of Artificial Sequence: Synthetic polypeptide
DEEEIRTTNPVATEGYGQCVCSNWGEHNQENFNSDTQS

SEQ ID NO: 195101 - protein, 37 aa, Artificial Sequence
  Description of Artificial Sequence: Synthetic polypeptide
DENEIRGTNPVATEQYGSVYGQVIGDEQGEGGGQGDE

SEQ ID NO: 195102 - protein, 39 aa, Artificial Sequence
  Description of Artificial Sequence: Synthetic polypeptide
DEEEIRTTNPVATEQYGSFNNAHTIPMDSQMEYQEVNDN

SEQ ID NO: 195103 - protein, 38 aa, Artificial Sequence
  Description of Artificial Sequence: Synthetic polypeptide
DENEIRGTNPVATEQYGSVIVDNSVGPEEGGQGNNGQP

SEQ ID NO: 195104 - protein, 38 aa, Artificial Sequence
  Description of Artificial Sequence: Synthetic polypeptide
DENEIRGTNPVATEQYGSVIVDNSDGPEEGGQGDNNQG

SEQ ID NO: 195105 - protein, 37 aa, Artificial Sequence
  Description of Artificial Sequence: Synthetic polypeptide
IENEIRTTNPVATEQYGSVNSWCGVAEIPFSHQEQET

SEQ ID NO: 195106 - protein, 38 aa, Artificial Sequence
  Description of Artificial Sequence: Synthetic polypeptide
DENEIRGTNPVATEQYGSVIVDNSDGPEEGGQGDMGQP

SEQ ID NO: 195107 - protein, 37 aa, Artificial Sequence
  Description of Artificial Sequence: Synthetic polypeptide
IENEIRTTNPVATEQYGSVYTTWSPMFQTESSEEHIQ

SEQ ID NO: 195108 - protein, 38 aa, Artificial Sequence
  Description of Artificial Sequence: Synthetic polypeptide
DENEIRGTNPVATEQYGSVIVDNEDGDEEGGQDDNGQP

SEQ ID NO: 195109 - protein, 38 aa, Artificial Sequence
  Description of Artificial Sequence: Synthetic polypeptide
DEGEIATTNPVATEQYGVISFSAPMDTLREPHEGEDTR

SEQ ID NO: 195110 - protein, 38 aa, Artificial Sequence
  Description of Artificial Sequence: Synthetic polypeptide
DEEEIRTTNPVATEGYGQCVCSNWEEHNQENFNSDTQS

SEQ ID NO: 195111 - protein, 36 aa, Artificial Sequence
  Description of Artificial Sequence: Synthetic polypeptide
QAHEIATTNPVATEQYGSVCSVGDGGQEHQDGMQMW

SEQ ID NO: 195112 - protein, 37 aa, Artificial Sequence
  Description of Artificial Sequence: Synthetic polypeptide
DDEEIRTTNPVATEQWGCVCSNWGEDNAEYFGSDTQQ

SEQ ID NO: 195113 - protein, 37 aa, Artificial Sequence
  Description of Artificial Sequence: Synthetic polypeptide
DENEIATTNPVAYEQYGSVPANANDTPAGDPMGNGAE

SEQ ID NO: 195114 - protein, 36 aa, Artificial Sequence
  Description of Artificial Sequence: Synthetic polypeptide
QAHEIATTNPVATEQYGSVCSPANPANGIDHDDTAH

SEQ ID NO: 195115 - protein, 37 aa, Artificial Sequence
  Description of Artificial Sequence: Synthetic polypeptide
DDEEIRTTNPVATEQWGCVTSNWGEDNQENFSSDNQS

SEQ ID NO: 195116 - protein, 36 aa, Artificial Sequence
  Description of Artificial Sequence: Synthetic polypeptide
IESEIRTTNPVATEQYGSVPYQTDEEEITPSIEEVP

SEQ ID NO: 195117 - protein, 38 aa, Artificial Sequence
  Description of Artificial Sequence: Synthetic polypeptide
DEEEIRTTNPVATEGYGQCVCSNWVEDNQENFISDNQA

SEQ ID NO: 195118 - protein, 36 aa, Artificial Sequence
  Description of Artificial Sequence: Synthetic polypeptide
QAEEIATTNPVATEQYGSVCAAGPLGFATMGDQEGA

SEQ ID NO: 195119 - protein, 37 aa, Artificial Sequence
  Description of Artificial Sequence: Synthetic polypeptide
QAEEIATTNPVATEQYGSVCAANNGDEADAPMGEHNH

SEQ ID NO: 195120 - protein, 37 aa, Artificial Sequence
  Description of Artificial Sequence: Synthetic polypeptide
DENEIRGTNPVATEFYGSVVVDGNNEQNVGEEEEFLQ

SEQ ID NO: 195121 - protein, 38 aa, Artificial Sequence
  Description of Artificial Sequence: Synthetic polypeptide
DEEEIRTTNPVATEGYGQCVCSNWPEHNQENFNSDNQS

SEQ ID NO: 195122 - protein, 35 aa, Artificial Sequence
  Description of Artificial Sequence: Synthetic polypeptide
DEEEICTTNPVAYEQWGSVCADAIPQEHPDDTEAW

SEQ ID NO: 195123 - protein, 36 aa, Artificial Sequence
  Description of Artificial Sequence: Synthetic polypeptide
IENEIRATNPVATEQYGTVTTVWLPDEQENMQIDLI

SEQ ID NO: 195124 - protein, 36 aa, Artificial Sequence
  Description of Artificial Sequence: Synthetic polypeptide
IENAIRATNPVATEQYGSVAVTPWDSNSAETQNNVQ

SEQ ID NO: 195125 - protein, 37 aa, Artificial Sequence
  Description of Artificial Sequence: Synthetic polypeptide
IEGEIRTTNPVATEQYGEVYCPTNEVGNVQIELEDHI

SEQ ID NO: 195126 - protein, 37 aa, Artificial Sequence
  Description of Artificial Sequence: Synthetic polypeptide
DESEIAATNPVATEPYGSVCIWVQNDQRDDRRGGTTS

SEQ ID NO: 195127 - protein, 38 aa, Artificial Sequence
  Description of Artificial Sequence: Synthetic polypeptide
DENEIRGTNPVATEQYGSVVFSDGQITGQGEIENEETQ

SEQ ID NO: 195128 - protein, 37 aa, Artificial Sequence
  Description of Artificial Sequence: Synthetic polypeptide
DEEEIRTTNPVATEQYGSFPEGWNMGMDIPSTFESQS

SEQ ID NO: 195129 - protein, 36 aa, Artificial Sequence
  Description of Artificial Sequence: Synthetic polypeptide
DEGEIATTNPVAYEQWGCVAANTGGLEAIANPDQRP

SEQ ID NO: 195130 - protein, 38 aa, Artificial Sequence
  Description of Artificial Sequence: Synthetic polypeptide
DEEEIRTTNPVATEQYGYSAFQCPTGTEGAEEQEQYLM

SEQ ID NO: 195131 - protein, 35 aa, Artificial Sequence
  Description of Artificial Sequence: Synthetic polypeptide
DEAEIATTNPVAYERWGVVCSNRDNHDRQDGQHEQ

SEQ ID NO: 195132 - protein, 38 aa, Artificial Sequence
  Description of Artificial Sequence: Synthetic polypeptide
DEEEIRTTNPVATEQYGYSAFQCPTFTEGAMEEQEQYL

SEQ ID NO: 195133 - protein, 38 aa, Artificial Sequence
  Description of Artificial Sequence: Synthetic polypeptide
DDEEIRTTNPVATEIYGSVYGQGLGDDEFGNGGQEDTA

SEQ ID NO: 195134 - protein, 37 aa, Artificial Sequence
  Description of Artificial Sequence: Synthetic polypeptide
DEATEIATTNPVAYEQWGEVCSTPNQGNHGEAGDGRE

SEQ ID NO: 195135 - protein, 38 aa, Artificial Sequence
  Description of Artificial Sequence: Synthetic polypeptide
DESEIAATNPVATEPYGSVCIWVQNDQRDDVRGGNTSD

SEQ ID NO: 195136 - protein, 37 aa, Artificial Sequence
  Description of Artificial Sequence: Synthetic polypeptide
MEGEIRTTNPVATEQWGCVSPTIECNPDEITDNGLQE

SEQ ID NO: 195137 - protein, 34 aa, Artificial Sequence
  Description of Artificial Sequence: Synthetic polypeptide
DEGEIATTNPVAYEPWGPFVAAANGLIANPDDNG

SEQ ID NO: 195138 - protein, 38 aa, Artificial Sequence
  Description of Artificial Sequence: Synthetic polypeptide
IEEEIRTTNPVATEQYGTVTVGTANDLLTHPSFTMEPD

SEQ ID NO: 195139 - protein, 34 aa, Artificial Sequence
  Description of Artificial Sequence: Synthetic polypeptide
DEGEIATTNPVAYEPVWGCIAGTNLADAPMGSGD

SEQ ID NO: 195140 - protein, 37 aa, Artificial Sequence
  Description of Artificial Sequence: Synthetic polypeptide
IEGEIRTTNPVATEQWGCVSPTIECNPDDHTDNGLQE

SEQ ID NO: 195141 - protein, 37 aa, Artificial Sequence
  Description of Artificial Sequence: Synthetic polypeptide
QAEEIATTNPVATEQYGSACATNHNGPLDSMIGTDEN

SEQ ID NO: 195142 - protein, 39 aa, Artificial Sequence
  Description of Artificial Sequence: Synthetic polypeptide
DEEEIRTTNPVATEQYGYFHNTLHISTDDNQREHETEQQ

SEQ ID NO: 195143 - protein, 37 aa, Artificial Sequence
  Description of Artificial Sequence: Synthetic polypeptide
IEGEIRTTNPVATEQYGEVFCPTPEVGNWQIESEDHI

SEQ ID NO: 195144 - protein, 37 aa, Artificial Sequence
  Description of Artificial Sequence: Synthetic polypeptide
IEGEIRTTNPVATEQYGEVFCPTPEVVNVQQELEDHI

SEQ ID NO: 195145 - protein, 37 aa, Artificial Sequence
  Description of Artificial Sequence: Synthetic polypeptide
IEGEIRTTNPVATEQYGEVFCPTPEWGNVQIELEDHQ

SEQ ID NO: 195146 - protein, 36 aa, Artificial Sequence
  Description of Artificial Sequence: Synthetic polypeptide
QAVEIATTNPVATEQYGSVCSANPALGIDHPDDTAQ

SEQ ID NO: 195147 - protein, 38 aa, Artificial Sequence
  Description of Artificial Sequence: Synthetic polypeptide
DEEEIRTTNPVATEGYGQCVCSWGEDHNQEFFNSETQS

SEQ ID NO: 195148 - protein, 33 aa, Artificial Sequence
  Description of Artificial Sequence: Synthetic polypeptide
DENEIATTNPVSTEPYGVCYCEDQGQQQQNGEE

SEQ ID NO: 195149 - protein, 36 aa, Artificial Sequence
  Description of Artificial Sequence: Synthetic polypeptide
DEAVEATTNPVAYEQWGCVYSVNNDLIGEQKGDNEM

SEQ ID NO: 195150 - protein, 38 aa, Artificial Sequence
  Description of Artificial Sequence: Synthetic polypeptide
MEEEIRTTNPVATEQYGCVCSNSGEDHNQENFNSDNQS

SEQ ID NO: 195151 - protein, 36 aa, Artificial Sequence
  Description of Artificial Sequence: Synthetic polypeptide
DEECLRTTNPCAYEQYGCVCSWGEDHNQNFGSDNQS

SEQ ID NO: 195152 - protein, 35 aa, Artificial Sequence
  Description of Artificial Sequence: Synthetic polypeptide
DEECLRTTNPCAYEQYGCVCSWGEHNQNFNSDTQA

SEQ ID NO: 195153 - protein, 37 aa, Artificial Sequence
  Description of Artificial Sequence: Synthetic polypeptide
DENEIRATNPVATEQYGWTVTTVDLPDEQENMQIDEH

SEQ ID NO: 195154 - protein, 37 aa, Artificial Sequence
  Description of Artificial Sequence: Synthetic polypeptide
DEEEIGCTNPVATEQYGCVCSNWGEHNQENFNSENQS

SEQ ID NO: 195155 - protein, 37 aa, Artificial Sequence
  Description of Artificial Sequence: Synthetic polypeptide
DENEIRATNPVATEQYGTVTTVWLPDEQEEFMQIDEI

SEQ ID NO: 195156 - protein, 37 aa, Artificial Sequence
  Description of Artificial Sequence: Synthetic polypeptide
MEEEIRTTNPVATEQYGAVGLGGDGEGDGQGDTNENQ

SEQ ID NO: 195157 - protein, 38 aa, Artificial Sequence
  Description of Artificial Sequence: Synthetic polypeptide
DEEEIGCTNPVATEQYGQCVCSNWGEHDQENFGSENQS

SEQ ID NO: 195158 - protein, 35 aa, Artificial Sequence
  Description of Artificial Sequence: Synthetic polypeptide
DEAVEATTNPVAYEQWGCVYSMVNNDEGEQGGNEM

SEQ ID NO: 195159 - protein, 37 aa, Artificial Sequence
  Description of Artificial Sequence: Synthetic polypeptide
MEEEIRTTNPVATEQYGAIIHGTWLEDANDEYGMEQN

SEQ ID NO: 195160 - protein, 36 aa, Artificial Sequence
  Description of Artificial Sequence: Synthetic polypeptide
DEGEIATTNPVATEQYGSACAATMPGAEAAPEDGWN

SEQ ID NO: 195161 - protein, 36 aa, Artificial Sequence
  Description of Artificial Sequence: Synthetic polypeptide
MEEEICTTNPVATEFYGCVGTNQTDGGEEEEGGEED

SEQ ID NO: 195162 - protein, 37 aa, Artificial Sequence
  Description of Artificial Sequence: Synthetic polypeptide
DEGEIATTNPVATEQYGSACAATNPEEAGDSGMGHQM

SEQ ID NO: 195163 - protein, 36 aa, Artificial Sequence
  Description of Artificial Sequence: Synthetic polypeptide
MEEEIRTTNPVATEQYGAIIHGTTMEDHNDEYDDEQ

SEQ ID NO: 195164 - protein, 37 aa, Artificial Sequence
  Description of Artificial Sequence: Synthetic polypeptide
DEECLRTTNPCAYEQYGQCVCSTGEHNQEYFGSDNQS

SEQ ID NO: 195165 - protein, 37 aa, Artificial Sequence
  Description of Artificial Sequence: Synthetic polypeptide
DEHEIATTNPVAYEQWGEVCSTPNQGNHGEQGGDGGN

SEQ ID NO: 195166 - protein, 37 aa, Artificial Sequence
  Description of Artificial Sequence: Synthetic polypeptide
MEEEIRTTNPVATEQYGAIIHGTTLEDANDEYNMEEQ

SEQ ID NO: 195167 - protein, 36 aa, Artificial Sequence
  Description of Artificial Sequence: Synthetic polypeptide
DEGEIATTNPVATEQYGSACGATAPGAEAAPEDGHN

SEQ ID NO: 195168 - protein, 36 aa, Artificial Sequence
  Description of Artificial Sequence: Synthetic polypeptide
DEHEIATTNPVAYEQWGEVCSTPNQGNHGEMGDGIN

SEQ ID NO: 195169 - protein, 35 aa, Artificial Sequence
  Description of Artificial Sequence: Synthetic polypeptide
CEEVIACTNPVATEQYGSVANMNNSNAAGEPGEDD

SEQ ID NO: 195170 - protein, 38 aa, Artificial Sequence
  Description of Artificial Sequence: Synthetic polypeptide
MEEEIRTTNPVATEQYGCVCSNWGEDHNAENFNSENQS

SEQ ID NO: 195171 - protein, 40 aa, Artificial Sequence
  Description of Artificial Sequence: Synthetic polypeptide
DEEEIRTTNPVATEQYGVVTVVVVSNNDQAGTTTTTTTEY

SEQ ID NO: 195172 - protein, 37 aa, Artificial Sequence
  Description of Artificial Sequence: Synthetic polypeptide
MEEEIATTNPVATEQYGCVCSNWEEHNQEGFISDTQA

SEQ ID NO: 195173 - protein, 38 aa, Artificial Sequence
  Description of Artificial Sequence: Synthetic polypeptide
MEEEIRTTNPVATEQYGESYSSPITAEPNSSVNTPPVC

SEQ ID NO: 195174 - protein, 37 aa, Artificial Sequence
  Description of Artificial Sequence: Synthetic polypeptide
DEGEIATTNPVATEQYGSVCAANMGEEANDAPMEKAH

SEQ ID NO: 195175 - protein, 33 aa, Artificial Sequence
  Description of Artificial Sequence: Synthetic polypeptide
QAEEIATTNPVATESYGCVAAGEGGGQSAEEPK

SEQ ID NO: 195176 - protein, 38 aa, Artificial Sequence
  Description of Artificial Sequence: Synthetic polypeptide
MEEEIRTTNPVATEQYGDVTTVMNNGFEGGDEGGQTQS

SEQ ID NO: 195177 - protein, 36 aa, Artificial Sequence
  Description of Artificial Sequence: Synthetic polypeptide
DEAVEATTNPVAYEQWGCVYSIVNNDLEGEQGGNEM

SEQ ID NO: 195178 - protein, 36 aa, Artificial Sequence
  Description of Artificial Sequence: Synthetic polypeptide
DEECTCTTNPVAVEQYGVVSTVNNNNNDEQGTTTDD

SEQ ID NO: 195179 - protein, 33 aa, Artificial Sequence
  Description of Artificial Sequence: Synthetic polypeptide
DENEIRCTNPIATEQWGATANAEDLAEPKGGYI

SEQ ID NO: 195180 - protein, 34 aa, Artificial Sequence
  Description of Artificial Sequence: Synthetic polypeptide
DENEIRCTNPIATECWGATWANAEDLAEPKGPYR

SEQ ID NO: 195181 - protein, 37 aa, Artificial Sequence
  Description of Artificial Sequence: Synthetic polypeptide
DEECTCTTNPVAVEQYGVVSTTVNNNNADEQGTNVTD

SEQ ID NO: 195182 - protein, 37 aa, Artificial Sequence
  Description of Artificial Sequence: Synthetic polypeptide
DEHEIATTNPVAYEQWGEVCSTPNQGNHGEHGGDGRQ

SEQ ID NO: 195183 - protein, 35 aa, Artificial Sequence
  Description of Artificial Sequence: Synthetic polypeptide
DEAVEATTNPVAYEQWGCVYSVNNDIGEQGGDNEM

SEQ ID NO: 195184 - protein, 38 aa, Artificial Sequence
  Description of Artificial Sequence: Synthetic polypeptide
DEECTCTTNICTTVATEQYGVVSTNATQNGTTIATEAR

SEQ ID NO: 195185 - protein, 35 aa, Artificial Sequence
  Description of Artificial Sequence: Synthetic polypeptide
DEECLRTTNPCAYEQYGCVCSWEDHNQENFGSDQA

SEQ ID NO: 195186 - protein, 35 aa, Artificial Sequence
  Description of Artificial Sequence: Synthetic polypeptide
DEECLRTTNPCAYEQYGCVCSWEEDQENFGSDTQA

SEQ ID NO: 195187 - protein, 39 aa, Artificial Sequence
  Description of Artificial Sequence: Synthetic polypeptide
DEEEIRTTNPVATEQYGVVVGPGQEDQEEQDGEEEGNGV

SEQ ID NO: 195188 - protein, 39 aa, Artificial Sequence
  Description of Artificial Sequence: Synthetic polypeptide
DEEEIRTTNPVATEQYGVVVGFDQEDQEEQDGEGEGNGV

SEQ ID NO: 195189 - protein, 35 aa, Artificial Sequence
  Description of Artificial Sequence: Synthetic polypeptide
CEEEIACTNPVATEQYGSCAAGNAEGADGGSGEDA

SEQ ID NO: 195190 - protein, 37 aa, Artificial Sequence
  Description of Artificial Sequence: Synthetic polypeptide
DEHEIATTNPVAYEQWGEVCSTPNQGNRGEAGGDGKN

SEQ ID NO: 195191 - protein, 39 aa, Artificial Sequence
  Description of Artificial Sequence: Synthetic polypeptide
DEEEIRTTNPVATEQYGVVTVVVVSNNNAETTTTNNAES

SEQ ID NO: 195192 - protein, 40 aa, Artificial Sequence
  Description of Artificial Sequence: Synthetic polypeptide
DEEEIRTTNPVATEQYGVVTVVVVSNNDQQGTTTTTTEEA

SEQ ID NO: 195193 - protein, 37 aa, Artificial Sequence
  Description of Artificial Sequence: Synthetic polypeptide
DEHEIATTNPVAYEQWGEVCSTPNQGNVGERGGDGQN

SEQ ID NO: 195194 - protein, 38 aa, Artificial Sequence
  Description of Artificial Sequence: Synthetic polypeptide
MEEEIRTTNPVATEQYGEYCIGSLEVMTAQTELAENEI

SEQ ID NO: 195195 - protein, 38 aa, Artificial Sequence
  Description of Artificial Sequence: Synthetic polypeptide
MEEEIKTTNPVATEQYGDVVVVDTIGNLTDGGQGDTTT

SEQ ID NO: 195196 - protein, 37 aa, Artificial Sequence
  Description of Artificial Sequence: Synthetic polypeptide
MEEEIRTTNPVATEQYGACIHGVTLEDHNEEYGDEQQ

SEQ ID NO: 195197 - protein, 37 aa, Artificial Sequence
  Description of Artificial Sequence: Synthetic polypeptide
DEEEIGTTNPVATEEYGCVCSMSGEHNQENFNSDNQS

SEQ ID NO: 195198 - protein, 37 aa, Artificial Sequence
  Description of Artificial Sequence: Synthetic polypeptide
MEEEIRTTNPVATEFYGVVVQVTDTNMNGTGGEEEGD

SEQ ID NO: 195199 - protein, 34 aa, Artificial Sequence
  Description of Artificial Sequence: Synthetic polypeptide
QAEEIATTNPVAYEQWGCIATTGHGQDSNGNPYN

SEQ ID NO: 195200 - protein, 39 aa, Artificial Sequence
  Description of Artificial Sequence: Synthetic polypeptide
MEEEIRGTNPVATEQYGTVVLLPNTNDQELLATGQTGEQ

SEQ ID NO: 195201 - protein, 38 aa, Artificial Sequence
  Description of Artificial Sequence: Synthetic polypeptide
MEEEIRTTNPVATEFYGVVNMSGISNMDNQTGEFTEEG

SEQ ID NO: 195202 - protein, 40 aa, Artificial Sequence
  Description of Artificial Sequence: Synthetic polypeptide
DEEEIRTTNPVATEQYGVVSVVVVTTQQNNSEQGTTEAGS

SEQ ID NO: 195203 - protein, 39 aa, Artificial Sequence
  Description of Artificial Sequence: Synthetic polypeptide
MEEEIRGTNPVATEQYGTVVMGLNTNDQELLATGQTGEQ

SEQ ID NO: 195204 - protein, 37 aa, Artificial Sequence
  Description of Artificial Sequence: Synthetic polypeptide
MEEEIRSTNPVATEFYGSVYDQEENTNFGMEGDGGDD

SEQ ID NO: 195205 - protein, 36 aa, Artificial Sequence
  Description of Artificial Sequence: Synthetic polypeptide
MEEEIRSTNPVATEFYGSVYDQNINFNIGEGIGGED

SEQ ID NO: 195206 - protein, 38 aa, Artificial Sequence
  Description of Artificial Sequence: Synthetic polypeptide
MEEEIRTTNPVATEFYGVVGVPGGGNATNQDDDGGNQG

SEQ ID NO: 195207 - protein, 36 aa, Artificial Sequence
  Description of Artificial Sequence: Synthetic polypeptide
MEEEIRSTNPVATEFYGSVYDQQNFNIGEGIGGAEG

SEQ ID NO: 195208 - protein, 37 aa, Artificial Sequence
  Description of Artificial Sequence: Synthetic polypeptide
DEEEIGTTNPVATEGYGQCVCSNWGEHNQENFNSEQF

SEQ ID NO: 195209 - protein, 37 aa, Artificial Sequence
  Description of Artificial Sequence: Synthetic polypeptide
MEEEIRTTNPVATEFYGQVVYDDMFQGTGEMGENEDG

SEQ ID NO: 195210 - protein, 38 aa, Artificial Sequence
  Description of Artificial Sequence: Synthetic polypeptide
DEEEIRTTNPVATEGYGQCVCSNWGEDHQESFNSDTQS

SEQ ID NO: 195211 - protein, 36 aa, Artificial Sequence
  Description of Artificial Sequence: Synthetic polypeptide
MEEEIRTTNPVATEAYGVVNGFGGEGDQEEDEFNEM

SEQ ID NO: 195212 - protein, 38 aa, Artificial Sequence
  Description of Artificial Sequence: Synthetic polypeptide
DENEIKTTNCVATEQYGSVSIVDNTNMDGENDEGGDGT

SEQ ID NO: 195213 - protein, 37 aa, Artificial Sequence
  Description of Artificial Sequence: Synthetic polypeptide
DEHEIATTNPVAYEQWGEVCSTINQGNHGESGGDGRN

SEQ ID NO: 195214 - protein, 36 aa, Artificial Sequence
  Description of Artificial Sequence: Synthetic polypeptide
DDEEIRTTNPVATEQWGCVTSWGEHNQENFISDTQS

SEQ ID NO: 195215 - protein, 37 aa, Artificial Sequence
  Description of Artificial Sequence: Synthetic polypeptide
MEEEIRTTNPVATDFYGVVVDGGGNATNDDDGGNQGS

SEQ ID NO: 195216 - protein, 37 aa, Artificial Sequence
  Description of Artificial Sequence: Synthetic polypeptide
DENEIKTTNPVATEFYGSVVDFEENDEFQDEMEGEGD

SEQ ID NO: 195217 - protein, 37 aa, Artificial Sequence
  Description of Artificial Sequence: Synthetic polypeptide
MEEEIRTTNPVATEGYGMVNGQGTFNQGEGGGEQFGE

SEQ ID NO: 195218 - protein, 37 aa, Artificial Sequence
  Description of Artificial Sequence: Synthetic polypeptide
MEEEIRGTNPVATEQYGSFGDAEGEQGGGEDDGENIV

SEQ ID NO: 195219 - protein, 31 aa, Artificial Sequence
  Description of Artificial Sequence: Synthetic polypeptide
QESEIASTNPVGTEGYGVMCQSEHQHGSDTI

SEQ ID NO: 195220 - protein, 35 aa, Artificial Sequence
  Description of Artificial Sequence: Synthetic polypeptide
DEECLSTTNPCAYEQYGCVCSWGEHNANFGSDNQS

SEQ ID NO: 195221 - protein, 38 aa, Artificial Sequence
  Description of Artificial Sequence: Synthetic polypeptide
DEGEIATTNPVATEQYGSIACAANNPEEAGDSGMGNRM

SEQ ID NO: 195222 - protein, 37 aa, Artificial Sequence
  Description of Artificial Sequence: Synthetic polypeptide
DEGEIATTNPVATEQYGSIMFCAPDTLREPHEGEDTR

SEQ ID NO: 195223 - protein, 37 aa, Artificial Sequence
  Description of Artificial Sequence: Synthetic polypeptide
DEGEIATTNPVATEQYGSISFFAPDTLREPHEGEDTS

SEQ ID NO: 195224 - protein, 37 aa, Artificial Sequence
  Description of Artificial Sequence: Synthetic polypeptide
DEGEIATTNPVATEQYGSISFSAPDTLLEPHEKEDTS

SEQ ID NO: 195225 - protein, 35 aa, Artificial Sequence
  Description of Artificial Sequence: Synthetic polypeptide
DEECLSTTNPCAYEQYGCVCSWGELNQNFGSDTQS

SEQ ID NO: 195226 - protein, 34 aa, Artificial Sequence
  Description of Artificial Sequence: Synthetic polypeptide
DEECLSTTNPIAYEQYGCVCSWEEHNQNFGSDQA

SEQ ID NO: 195227 - protein, 37 aa, Artificial Sequence
  Description of Artificial Sequence: Synthetic polypeptide
DEGEIATTNPVATEQYGSMSFSAAYDTLEPHEGEDTG

SEQ ID NO: 195228 - protein, 37 aa, Artificial Sequence
  Description of Artificial Sequence: Synthetic polypeptide
DEHEIATTNPVAYEQWGEVCSTPNQGNAGEEGIDGRN

SEQ ID NO: 195229 - protein, 39 aa, Artificial Sequence
  Description of Artificial Sequence: Synthetic polypeptide
MEEEIKTTNPVATEQYGSVSVGQDEQNSGIQNGGQEGIT

SEQ ID NO: 195230 - protein, 37 aa, Artificial Sequence
  Description of Artificial Sequence: Synthetic polypeptide
DEHEIATTNPVAYEQWGEVCSTPNNGNHGEAGGDGRT

SEQ ID NO: 195231 - protein, 37 aa, Artificial Sequence
  Description of Artificial Sequence: Synthetic polypeptide
DEGEIATTNPVATEQYGSVCAAMAHDEAGMPPDEHNA

SEQ ID NO: 195232 - protein, 38 aa, Artificial Sequence
  Description of Artificial Sequence: Synthetic polypeptide
MEEEIRGTNPVATDQYGSVVGMGVPGQGLDQGDDTGNG

SEQ ID NO: 195233 - protein, 37 aa, Artificial Sequence
  Description of Artificial Sequence: Synthetic polypeptide
DEHEIATTNPVAYEQWGEVCSTPNMGNHGEAGGDSRN

SEQ ID NO: 195234 - protein, 37 aa, Artificial Sequence
  Description of Artificial Sequence: Synthetic polypeptide
MEEEIRGTNPVATECYGSVYANDDGNEEGQGEEVGDM

SEQ ID NO: 195235 - protein, 37 aa, Artificial Sequence
  Description of Artificial Sequence: Synthetic polypeptide
DENEIKTTNPVATEFYGSVVDFEENNEENDGQGGEGD

SEQ ID NO: 195236 - protein, 38 aa, Artificial Sequence
  Description of Artificial Sequence: Synthetic polypeptide
DENEIKTTNPVATEFYGSVVDFEENDITNDGQGQGEGD

SEQ ID NO: 195237 - protein, 36 aa, Artificial Sequence
  Description of Artificial Sequence: Synthetic polypeptide
CEEEIACTNPVATEQYGSACAANPELGQLHQDDEAH

SEQ ID NO: 195238 - protein, 35 aa, Artificial Sequence
  Description of Artificial Sequence: Synthetic polypeptide
DESDEIATTNPVAYECWGSVYNTPQQGEDAGQDET

SEQ ID NO: 195239 - protein, 36 aa, Artificial Sequence
  Description of Artificial Sequence: Synthetic polypeptide
MEEEIRTTNPVATEGYGMVSVEGMGDGGQGQEAEQT

SEQ ID NO: 195240 - protein, 37 aa, Artificial Sequence
  Description of Artificial Sequence: Synthetic polypeptide
DEGEIATTNPVATEQYGSVCAAMAHDEAGMPPDNHPP

SEQ ID NO: 195241 - protein, 35 aa, Artificial Sequence
  Description of Artificial Sequence: Synthetic polypeptide
DEAEIRTTNPCATEEYGCVCGWGEHNANFNSDNAA

SEQ ID NO: 195242 - protein, 36 aa, Artificial Sequence
  Description of Artificial Sequence: Synthetic polypeptide
DEAEIRTTNPCAYEQWGSVCGDDNNNDQQGQTGGKD

SEQ ID NO: 195243 - protein, 35 aa, Artificial Sequence
  Description of Artificial Sequence: Synthetic polypeptide
DEHEIATTNPVAYEPWGTVVPTDNHDHNRQGGSAD

SEQ ID NO: 195244 - protein, 37 aa, Artificial Sequence
  Description of Artificial Sequence: Synthetic polypeptide
DEGEIATTNPVATEQYGSVCADHNHPEENGMPMEDAH

SEQ ID NO: 195245 - protein, 36 aa, Artificial Sequence
  Description of Artificial Sequence: Synthetic polypeptide
LNDEIRTTNPVATEQYGSVFIWSAEDEWEGQMEDAQ

SEQ ID NO: 195246 - protein, 37 aa, Artificial Sequence
  Description of Artificial Sequence: Synthetic polypeptide
DEGEIATTNPVATEQYGSVCAAVAHGEADMPPGEANP

SEQ ID NO: 195247 - protein, 36 aa, Artificial Sequence
  Description of Artificial Sequence: Synthetic polypeptide
LNDEIRTTNPVATEQYGSVSVSAEDEHKEGQMEDLQ

SEQ ID NO: 195248 - protein, 38 aa, Artificial Sequence
  Description of Artificial Sequence: Synthetic polypeptide
DEEEIRTTNPVATEGYGQCVCSNWGEHNAENFNSDNQA

SEQ ID NO: 195249 - protein, 37 aa, Artificial Sequence
  Description of Artificial Sequence: Synthetic polypeptide
LNDEIRTTNPVATEQYGSVVIVSAEAEWLEGQMEDWT

SEQ ID NO: 195250 - protein, 38 aa, Artificial Sequence
  Description of Artificial Sequence: Synthetic polypeptide
DEEEIRTTNPVATEGYGQCVCSNWGEHEIENFISENQF

SEQ ID NO: 195251 - protein, 36 aa, Artificial Sequence
  Description of Artificial Sequence: Synthetic polypeptide
DEECLRTTNPCAYEQYGCVCSNWEHNIENFGSDNQS

SEQ ID NO: 195252 - protein, 37 aa, Artificial Sequence
  Description of Artificial Sequence: Synthetic polypeptide
DENEICTTNPVATEQYGSAFTDPTYDPQTQFQSNQIM

SEQ ID NO: 195253 - protein, 37 aa, Artificial Sequence
  Description of Artificial Sequence: Synthetic polypeptide
LNNEIRTTNPVATEQYGSVYTTWNPMIQTESSEEHTQ

SEQ ID NO: 195254 - protein, 36 aa, Artificial Sequence
  Description of Artificial Sequence: Synthetic polypeptide
LNSEIRTTNPVATEQYGSVSVSAEDEVIEGQMEDLQ

SEQ ID NO: 195255 - protein, 36 aa, Artificial Sequence
  Description of Artificial Sequence: Synthetic polypeptide
QAEEIATTNPVAYEQYGSTFAGNNGLPQDSNGQDYH

SEQ ID NO: 195256 - protein, 36 aa, Artificial Sequence
  Description of Artificial Sequence: Synthetic polypeptide
LSSEIRTTNPVATEQYGACAVVATVNHIEGEEDQEE

SEQ ID NO: 195257 - protein, 37 aa, Artificial Sequence
  Description of Artificial Sequence: Synthetic polypeptide
DEHEIATTNPVAYEQWGSTYSGGPNGLLGEDANGDLR

SEQ ID NO: 195258 - protein, 35 aa, Artificial Sequence
  Description of Artificial Sequence: Synthetic polypeptide
DEAVEATTNPVAYEQWGCVYNVNNDLGEQGGLNEM

SEQ ID NO: 195259 - protein, 37 aa, Artificial Sequence
  Description of Artificial Sequence: Synthetic polypeptide
DEHEIATTNPVAYEQWGSTVYGLPNDDRGQHGRQDDI

SEQ ID NO: 195260 - protein, 37 aa, Artificial Sequence
  Description of Artificial Sequence: Synthetic polypeptide
DENEICTTNPVATEQYGSAFTMWTYDPDTQFQSNQIM

SEQ ID NO: 195261 - protein, 36 aa, Artificial Sequence
  Description of Artificial Sequence: Synthetic polypeptide
QAEEIATTNPVAYEQYGSTACAANNGLADAPGGNMW

SEQ ID NO: 195262 - protein, 36 aa, Artificial Sequence
  Description of Artificial Sequence: Synthetic polypeptide
DEGEIATTNPVATEQYGCVAANHSGDPAMHPGDQGN

SEQ ID NO: 195263 - protein, 37 aa, Artificial Sequence
  Description of Artificial Sequence: Synthetic polypeptide
DEGEIATTNPVATEQYGSVCADHNHPEENGMPMEEAA

SEQ ID NO: 195264 - protein, 38 aa, Artificial Sequence
  Description of Artificial Sequence: Synthetic polypeptide
DEGEIATTNPVATEQYGSVCADHNHPEENGMPMENANY

SEQ ID NO: 195265 - protein, 38 aa, Artificial Sequence
  Description of Artificial Sequence: Synthetic polypeptide
DEEEIRTTNPVATEGYGQCVCSNWGEHNAENFNSDNQL

SEQ ID NO: 195266 - protein, 37 aa, Artificial Sequence
  Description of Artificial Sequence: Synthetic polypeptide
DEGEIATTNPVATEQYGSVCADHNHPGENGMPMEFTH

SEQ ID NO: 195267 - protein, 38 aa, Artificial Sequence
  Description of Artificial Sequence: Synthetic polypeptide
DEEEIRTTNPVATEGYGQCVCSNWGEHNAENFNSETQS

SEQ ID NO: 195268 - protein, 37 aa, Artificial Sequence
  Description of Artificial Sequence: Synthetic polypeptide
DEGEIATTNPVATEQYGSVCADHNHPLENIMPMEEEH

SEQ ID NO: 195269 - protein, 38 aa, Artificial Sequence
  Description of Artificial Sequence: Synthetic polypeptide
DEGEIATTNPVATEQYGSVCADHNHPLENGMPMESVHW

SEQ ID NO: 195270 - protein, 38 aa, Artificial Sequence
  Description of Artificial Sequence: Synthetic polypeptide
LEEEIRTTNPVATEQYGSYSSPHMVTVEVAANHAQQQH

SEQ ID NO: 195271 - protein, 35 aa, Artificial Sequence
  Description of Artificial Sequence: Synthetic polypeptide
DEECISTVNPVATEGYGQCVCSWGEHNANFGSDQS

SEQ ID NO: 195272 - protein, 37 aa, Artificial Sequence
  Description of Artificial Sequence: Synthetic polypeptide
DEGEIATTNPVATEQWGHCNVAATMNGLDAGAPGGDF

SEQ ID NO: 195273 - protein, 37 aa, Artificial Sequence
  Description of Artificial Sequence: Synthetic polypeptide
DEGEIATTNPVATEQWGSISFSAPDTLYEPHEGEDTR

SEQ ID NO: 195274 - protein, 36 aa, Artificial Sequence
  Description of Artificial Sequence: Synthetic polypeptide
DENEIRCTNPVATEQYGCVDTDAENGSVETEETQVE

SEQ ID NO: 195275 - protein, 39 aa, Artificial Sequence
  Description of Artificial Sequence: Synthetic polypeptide
LEPEIRTTNPVATEQYGVVCSDTTTNNCSQQEFTQEGTQ

SEQ ID NO: 195276 - protein, 37 aa, Artificial Sequence
  Description of Artificial Sequence: Synthetic polypeptide
DEGEIATTNPVATEQYGCVAANHVASEAGTPPDNNAK

SEQ ID NO: 195277 - protein, 39 aa, Artificial Sequence
  Description of Artificial Sequence: Synthetic polypeptide
LEPEIRTTNPVATEQYGWVVCSDTTYNCSQQEFTQEGTF

SEQ ID NO: 195278 - protein, 38 aa, Artificial Sequence
  Description of Artificial Sequence: Synthetic polypeptide
DEEEIRTTNPVATEQYGVYFEPVTLSQIETAEVAVVHS

SEQ ID NO: 195279 - protein, 38 aa, Artificial Sequence
  Description of Artificial Sequence: Synthetic polypeptide
DEEEIRTTNPVATEGYGQCVCSNWGEHNAENFNSENQA

SEQ ID NO: 195280 - protein, 34 aa, Artificial Sequence
  Description of Artificial Sequence: Synthetic polypeptide
DEGEIATTNPVATEQWGTNCAATDGGVEDESNDP

SEQ ID NO: 195281 - protein, 34 aa, Artificial Sequence
  Description of Artificial Sequence: Synthetic polypeptide
DEGEIATTNPVATEQWGTNCAATDGGVEMEINGD

SEQ ID NO: 195282 - protein, 38 aa, Artificial Sequence
  Description of Artificial Sequence: Synthetic polypeptide
DEEEIRTTNPVATEGYGQCVCSNWGEHNAENFNSDNQS

SEQ ID NO: 195283 - protein, 34 aa, Artificial Sequence
  Description of Artificial Sequence: Synthetic polypeptide
DEGEIATTNPVATEQWGTNCAATDGHPVEFEINN

SEQ ID NO: 195284 - protein, 36 aa, Artificial Sequence
  Description of Artificial Sequence: Synthetic polypeptide
ADEEIRTTNPVATEQYGCVCSWGEDNQENFISDTQS

SEQ ID NO: 195285 - protein, 35 aa, Artificial Sequence
  Description of Artificial Sequence: Synthetic polypeptide
DEGEIATTNPVATEQWGTNCAATDGPEEMEIGNPD

SEQ ID NO: 195286 - protein, 36 aa, Artificial Sequence
  Description of Artificial Sequence: Synthetic polypeptide
DEGEIATTNPVATEQYGCACAAINGEEAGMVMDNDH

SEQ ID NO: 195287 - protein, 39 aa, Artificial Sequence
  Description of Artificial Sequence: Synthetic polypeptide
DEEEIRTTNPVATEQYGSTTVQPTSSADAEAPTLFSISE

SEQ ID NO: 195288 - protein, 36 aa, Artificial Sequence
  Description of Artificial Sequence: Synthetic polypeptide
QAEEIATTNPVATEQYGSVCWPTPGPDDSGDGMGVN

SEQ ID NO: 195289 - protein, 37 aa, Artificial Sequence
  Description of Artificial Sequence: Synthetic polypeptide
MDGEIRTTNPVATEQYGSCTSPASVTINEHFSSNEDI

SEQ ID NO: 195290 - protein, 37 aa, Artificial Sequence
  Description of Artificial Sequence: Synthetic polypeptide
MDGEIRTTNPVATEQYGSCTSWASVTINEHFSSNSDE

SEQ ID NO: 195291 - protein, 37 aa, Artificial Sequence
  Description of Artificial Sequence: Synthetic polypeptide
QAEEIATTNPVATEQYGSVCSANPVSDIEHGDGTEMK

SEQ ID NO: 195292 - protein, 40 aa, Artificial Sequence
  Description of Artificial Sequence: Synthetic polypeptide
DEEEIRTTNPVATEQYGVVVVVVVSNQNGTNNQQSTTDET

SEQ ID NO: 195293 - protein, 38 aa, Artificial Sequence
  Description of Artificial Sequence: Synthetic polypeptide
QAEEIATTNPVATEQYGSVCSPDGTFGNNEAGIGMADN

SEQ ID NO: 195294 - protein, 38 aa, Artificial Sequence
  Description of Artificial Sequence: Synthetic polypeptide
MEEEIRTTNPVATEQYGQYTTVMTNGFEGGDEGGQEQI

SEQ ID NO: 195295 - protein, 37 aa, Artificial Sequence
  Description of Artificial Sequence: Synthetic polypeptide
QAEEIATTNPVATEQYGSVCSPVDNNHNIDAMGEGDL

SEQ ID NO: 195296 - protein, 35 aa, Artificial Sequence
  Description of Artificial Sequence: Synthetic polypeptide
DEHEIATTNPVAYEKWGCVSGDNGETERNNMQGDA

SEQ ID NO: 195297 - protein, 40 aa, Artificial Sequence
  Description of Artificial Sequence: Synthetic polypeptide
DEEEIRTTNPVATEQYGVVVVTVVTNGTQAGTTEAGSTVE

SEQ ID NO: 195298 - protein, 40 aa, Artificial Sequence
  Description of Artificial Sequence: Synthetic polypeptide
DEEEIRTTNPVATEQYGVVVVTVVSNGTQAGTTEAGSTDD

SEQ ID NO: 195299 - protein, 37 aa, Artificial Sequence
  Description of Artificial Sequence: Synthetic polypeptide
MEEEIRTTNPVATEQYGMVSVEGMGDGGQGMEQEEGV

SEQ ID NO: 195300 - protein, 36 aa, Artificial Sequence
  Description of Artificial Sequence: Synthetic polypeptide
CEEVIACTNPVATEQYGSVCAAGPLGVATMGDNAAM

SEQ ID NO: 195301 - protein, 40 aa, Artificial Sequence
  Description of Artificial Sequence: Synthetic polypeptide
DEEEIRTTNPVATEQYGVVVVTVVNNGTQAGTTEQGSTVD

SEQ ID NO: 195302 - protein, 40 aa, Artificial Sequence
  Description of Artificial Sequence: Synthetic polypeptide
DEEEIRTTNPVATEQYGVVVVSVVNVATNVATEEGSTDDD

SEQ ID NO: 195303 - protein, 35 aa, Artificial Sequence
  Description of Artificial Sequence: Synthetic polypeptide
CEEVIACTNPVATEQYGSVCAAGPLGVATMGDEEA

SEQ ID NO: 195304 - protein, 37 aa, Artificial Sequence
  Description of Artificial Sequence: Synthetic polypeptide
QAEEIATTNPVATEQYGSVCTPANPANGIDHDDTVAH

SEQ ID NO: 195305 - protein, 36 aa, Artificial Sequence
  Description of Artificial Sequence: Synthetic polypeptide
MEDEIRGTNPVATEFWGIVSAANGEGQRGQGADEGD

SEQ ID NO: 195306 - protein, 37 aa, Artificial Sequence
  Description of Artificial Sequence: Synthetic polypeptide
MEDEIRGTNPVATEQYGSVIVMGMGINFNNNDQEGGG

SEQ ID NO: 195307 - protein, 36 aa, Artificial Sequence
  Description of Artificial Sequence: Synthetic polypeptide
MEDEIRTTNPVATEGYGSVNNDEFDEENEDGGEQGN

SEQ ID NO: 195308 - protein, 37 aa, Artificial Sequence
  Description of Artificial Sequence: Synthetic polypeptide
MEDEIRTTNPVATEGYGSVQNNDEFDEEDEDGGNQGQ

SEQ ID NO: 195309 - protein, 37 aa, Artificial Sequence
  Description of Artificial Sequence: Synthetic polypeptide
MEDEIRTTNPVATEGYGSVYDDDIMNEGQEEEEEGGQ

SEQ ID NO: 195310 - protein, 37 aa, Artificial Sequence
  Description of Artificial Sequence: Synthetic polypeptide
QAEEIATTNPVATEQYGSVCSANPALGIEHPDDTDAM

SEQ ID NO: 195311 - protein, 36 aa, Artificial Sequence
  Description of Artificial Sequence: Synthetic polypeptide
MEAEIRTTNPVATESYGSVCDVSPPIDILFDSIEHK

SEQ ID NO: 195312 - protein, 36 aa, Artificial Sequence
  Description of Artificial Sequence: Synthetic polypeptide
MEAEIRTTNPVATESYGSVCDVSPIDILFDSIEEGK

SEQ ID NO: 195313 - protein, 36 aa, Artificial Sequence
  Description of Artificial Sequence: Synthetic polypeptide
QAEEIATTNPVAYEQYGSACATNPQLDINHGDQLAK

SEQ ID NO: 195314 - protein, 35 aa, Artificial Sequence
  Description of Artificial Sequence: Synthetic polypeptide
MDMEIGCTNPVATEQYGSIAYVLDNSSEEEGNENN

SEQ ID NO: 195315 - protein, 37 aa, Artificial Sequence
  Description of Artificial Sequence: Synthetic polypeptide
DENEICTTNPVATEQYGSAFTTWTYWPQTQSQSNQIM

SEQ ID NO: 195316 - protein, 36 aa, Artificial Sequence
  Description of Artificial Sequence: Synthetic polypeptide
DENEICTTNPVATEQYGSAFTWTPDPQTQFQSPQIM

SEQ ID NO: 195317 - protein, 37 aa, Artificial Sequence
  Description of Artificial Sequence: Synthetic polypeptide
DENEICTTNPVATEQYGSAFTWTYWPMQTQDQSNQIM

SEQ ID NO: 195318 - protein, 38 aa, Artificial Sequence
  Description of Artificial Sequence: Synthetic polypeptide
DEEEIGTTNPVATEQYGCVCSNWGEDHDQENFNSENQS

SEQ ID NO: 195319 - protein, 35 aa, Artificial Sequence
  Description of Artificial Sequence: Synthetic polypeptide
MDMEIGCTNPVATEQYGSVAYVLDNSSTEEVNENI

SEQ ID NO: 195320 - protein, 34 aa, Artificial Sequence
  Description of Artificial Sequence: Synthetic polypeptide
MDMEISCTNPVATEQYGSVANVPDNSEEEHNENI

SEQ ID NO: 195321 - protein, 37 aa, Artificial Sequence
  Description of Artificial Sequence: Synthetic polypeptide
ADEEIRTTNPVATEQYGCVCSNWGEHNAENFNSDNQS

SEQ ID NO: 195322 - protein, 37 aa, Artificial Sequence
  Description of Artificial Sequence: Synthetic polypeptide
DENEICTTNPVATEQYGSNFQDWTYDPQTQFQSNQIM

SEQ ID NO: 195323 - protein, 36 aa, Artificial Sequence
  Description of Artificial Sequence: Synthetic polypeptide
MDGEIRTTNPVATEQYGSCTSPASVTYSEHFSSNSD

SEQ ID NO: 195324 - protein, 38 aa, Artificial Sequence
  Description of Artificial Sequence: Synthetic polypeptide
DEEEIGTTNPVATEQYGCVCSNWEEDHNQENFNSDTQD

SEQ ID NO: 195325 - protein, 36 aa, Artificial Sequence
  Description of Artificial Sequence: Synthetic polypeptide
MDNEIRTTNPVATEQYGSVVWPPNDMDGSFFEPVIN

SEQ ID NO: 195326 - protein, 36 aa, Artificial Sequence
  Description of Artificial Sequence: Synthetic polypeptide
MDNEIRTTNPVATEQYGSVVWPPNDPDASFFSPVGN

SEQ ID NO: 195327 - protein, 39 aa, Artificial Sequence
  Description of Artificial Sequence: Synthetic polypeptide
DEEEIRTTNPVATEQYGSFYQELHPVTVEVARNVEQNAH

SEQ ID NO: 195328 - protein, 37 aa, Artificial Sequence
  Description of Artificial Sequence: Synthetic polypeptide
QAEEIATTNPVATEQYGSVCSANPALGIDHPDDTVAT

SEQ ID NO: 195329 - protein, 37 aa, Artificial Sequence
  Description of Artificial Sequence: Synthetic polypeptide
ADEEIRTTNPVATEQYGCVCSNWGEDNAENFNSDFQA

SEQ ID NO: 195330 - protein, 37 aa, Artificial Sequence
  Description of Artificial Sequence: Synthetic polypeptide
DENEIRCTNPVATECYGSVNNSVDDNGEMTEEDEGQG

SEQ ID NO: 195331 - protein, 37 aa, Artificial Sequence
  Description of Artificial Sequence: Synthetic polypeptide
ADEEIRTTNPVATEQYGCVCSNWEEHNQEHFNSETQA

SEQ ID NO: 195332 - protein, 37 aa, Artificial Sequence
  Description of Artificial Sequence: Synthetic polypeptide
MEAEIATTNPVATEQYGCVCSTWGEHNAEGFISDNQA

SEQ ID NO: 195333 - protein, 37 aa, Artificial Sequence
  Description of Artificial Sequence: Synthetic polypeptide
MEAEIGTTNPVATEQYGSVNSWEASQVEFPNNSNEEQ

SEQ ID NO: 195334 - protein, 36 aa, Artificial Sequence
  Description of Artificial Sequence: Synthetic polypeptide
MDNEIRTTNPVATEQYGSVVSWPPNDMDMSFFPVIN

SEQ ID NO: 195335 - protein, 39 aa, Artificial Sequence
  Description of Artificial Sequence: Synthetic polypeptide
DEQEIRTTNPVATESYGSVVMSVNDNNTGGFDQTGQVGD

SEQ ID NO: 195336 - protein, 36 aa, Artificial Sequence
  Description of Artificial Sequence: Synthetic polypeptide
QAEEIATTNPVATEQYGCVSPGEGGHGQNESAEEAM

SEQ ID NO: 195337 - protein, 40 aa, Artificial Sequence
  Description of Artificial Sequence: Synthetic polypeptide
DEEEIRTTNPVATEQYGSVVVTVVTVGTQAGTTEQGSTVD

SEQ ID NO: 195338 - protein, 37 aa, Artificial Sequence
  Description of Artificial Sequence: Synthetic polypeptide
DEECISTTNPVATEQYGQCVCSWGEHNQENFFSENQS

SEQ ID NO: 195339 - protein, 37 aa, Artificial Sequence
  Description of Artificial Sequence: Synthetic polypeptide
DEECISTTNPVATEQYGQCVCSWGEHNQENFGSDFQS

SEQ ID NO: 195340 - protein, 34 aa, Artificial Sequence
  Description of Artificial Sequence: Synthetic polypeptide
QENEIATTNPVATEQWGCVSGEGVEMNAAEEDGA

SEQ ID NO: 195341 - protein, 37 aa, Artificial Sequence
  Description of Artificial Sequence: Synthetic polypeptide
MENEIRTTNPVATEQYGACVVRTVNNLEDEIFAEQED

SEQ ID NO: 195342 - protein, 36 aa, Artificial Sequence
  Description of Artificial Sequence: Synthetic polypeptide
MENEIRTTNPVATEQYGACCWSQDVSEQDEIYSAMK

SEQ ID NO: 195343 - protein, 37 aa, Artificial Sequence
  Description of Artificial Sequence: Synthetic polypeptide
DEECISTTNPVATEQYGQCYCSNSGEHQENFNSDTQS

SEQ ID NO: 195344 - protein, 33 aa, Artificial Sequence
  Description of Artificial Sequence: Synthetic polypeptide
DEGAIATTNPVAYERWGQATTNGGDHQGGDDKH

SEQ ID NO: 195345 - protein, 37 aa, Artificial Sequence
  Description of Artificial Sequence: Synthetic polypeptide
MENEIRTTNPVATEQYGACCWSQDVSEDEEDGSAQMK

SEQ ID NO: 195346 - protein, 36 aa, Artificial Sequence
  Description of Artificial Sequence: Synthetic polypeptide
DEECISTTNPVATEQYSACVCSWGEDNQNFGSDTQA

SEQ ID NO: 195347 - protein, 36 aa, Artificial Sequence
  Description of Artificial Sequence: Synthetic polypeptide
MENEIRTTNPVATEQYGACCWSQDVSEDEDGSASMK

SEQ ID NO: 195348 - protein, 34 aa, Artificial Sequence
  Description of Artificial Sequence: Synthetic polypeptide
DENEIRTTNPIATECYGATWANMEDWAEPNGPYI

SEQ ID NO: 195349 - protein, 39 aa, Artificial Sequence
  Description of Artificial Sequence: Synthetic polypeptide
FEEEIRTTNPVATEQYGVVYTQGTDQIIDQEGEGGNQGT

SEQ ID NO: 195350 - protein, 36 aa, Artificial Sequence
  Description of Artificial Sequence: Synthetic polypeptide
MENEIRTTNPVATEQYGACCTSQDVSEDEIGSAVMD

SEQ ID NO: 195351 - protein, 39 aa, Artificial Sequence
  Description of Artificial Sequence: Synthetic polypeptide
FEEEIRTTNPVATEQYGVVYTQGTDQLIDQEGEGGQQGE

SEQ ID NO: 195352 - protein, 37 aa, Artificial Sequence
  Description of Artificial Sequence: Synthetic polypeptide
DEECISTTNPVATEQYSACVCSWMEDNQENFGSDNQA

SEQ ID NO: 195353 - protein, 34 aa, Artificial Sequence
  Description of Artificial Sequence: Synthetic polypeptide
DEEEIATTNPVATAQWGCTLAGNNGGEATANGEV

SEQ ID NO: 195354 - protein, 39 aa, Artificial Sequence
  Description of Artificial Sequence: Synthetic polypeptide
DEEEIRATNPVATEQYGSVYQELHMVTVEVARTVEQNAH

SEQ ID NO: 195355 - protein, 34 aa, Artificial Sequence
  Description of Artificial Sequence: Synthetic polypeptide
QEAEIATTNPVATEGYGCVCSWGEHNQHFISELA

SEQ ID NO: 195356 - protein, 37 aa, Artificial Sequence
  Description of Artificial Sequence: Synthetic polypeptide
QEAEIATTNPVATAQWGSFVANANGLPQAAPGENAHW

SEQ ID NO: 195357 - protein, 38 aa, Artificial Sequence
  Description of Artificial Sequence: Synthetic polypeptide
MENEIRTTNPVATEQYGCCYSVSPDELAMASFDENQFE

SEQ ID NO: 195358 - protein, 38 aa, Artificial Sequence
  Description of Artificial Sequence: Synthetic polypeptide
DEGAEICTTNPVAYEQWGSCVYSDEINDGQHRMSQGMP

SEQ ID NO: 195359 - protein, 37 aa, Artificial Sequence
  Description of Artificial Sequence: Synthetic polypeptide
DEECISTTNPVATEQYGQCVCSWGEHNAENFNSDTQS

SEQ ID NO: 195360 - protein, 37 aa, Artificial Sequence
  Description of Artificial Sequence: Synthetic polypeptide
DEECISTTNPVATEQYGQCVCSWGEHNAEGFNSDNQS

SEQ ID NO: 195361 - protein, 38 aa, Artificial Sequence
  Description of Artificial Sequence: Synthetic polypeptide
DEAEIATTNPVATEQYGCTTAANAGGLPQANMHPMNRW

SEQ ID NO: 195362 - protein, 33 aa, Artificial Sequence
  Description of Artificial Sequence: Synthetic polypeptide
DENEIRTTNPIATEQWGATANEEDEMNPKEPYI

SEQ ID NO: 195363 - protein, 37 aa, Artificial Sequence
  Description of Artificial Sequence: Synthetic polypeptide
DEHEIATTNPVAYEQYGSVPANANNEPAQMQHQQERM

SEQ ID NO: 195364 - protein, 38 aa, Artificial Sequence
  Description of Artificial Sequence: Synthetic polypeptide
FEEEIRTTNPVATEQYGSYSSPITADEPNSRVSHPPVC

SEQ ID NO: 195365 - protein, 36 aa, Artificial Sequence
  Description of Artificial Sequence: Synthetic polypeptide
DEHEIATTNPVAYEQYGSVPAANGEPAQMQHQQEEW

SEQ ID NO: 195366 - protein, 33 aa, Artificial Sequence
  Description of Artificial Sequence: Synthetic polypeptide
DENEIRTTNPIATEQWGATANEEDEANPKEPYI

SEQ ID NO: 195367 - protein, 37 aa, Artificial Sequence
  Description of Artificial Sequence: Synthetic polypeptide
AEEEIRTTNPVAYEQYGCVCSNWGEHNDEFFGSDTQS

SEQ ID NO: 195368 - protein, 36 aa, Artificial Sequence
  Description of Artificial Sequence: Synthetic polypeptide
DEEEIATTNPVATAQWGGCCSAGNGNGLEATANGEF

SEQ ID NO: 195369 - protein, 38 aa, Artificial Sequence
  Description of Artificial Sequence: Synthetic polypeptide
FEEEIRTTNPVATEQYGTVYSSPITAEMNSRVAHPPVC

SEQ ID NO: 195370 - protein, 33 aa, Artificial Sequence
  Description of Artificial Sequence: Synthetic polypeptide
DENEIRTTNPIATECWGDVANEEDWANPKEPYI

SEQ ID NO: 195371 - protein, 38 aa, Artificial Sequence
  Description of Artificial Sequence: Synthetic polypeptide
DEEEIRTTNPVATEQYGSTYGCMQINQIQQEVPDEVEQ

SEQ ID NO: 195372 - protein, 37 aa, Artificial Sequence
  Description of Artificial Sequence: Synthetic polypeptide
MENEIRTTNPVATEQYGCVDTDAENGSDGTGEESQVE

SEQ ID NO: 195373 - protein, 35 aa, Artificial Sequence
  Description of Artificial Sequence: Synthetic polypeptide
DEEEIATTNPVATAQWGGCCAGTGPGLEATANGEH

SEQ ID NO: 195374 - protein, 38 aa, Artificial Sequence
  Description of Artificial Sequence: Synthetic polypeptide
DEECISTTNPVATEQYGQCVCSTWGEDNQEFFGSDTQS

SEQ ID NO: 195375 - protein, 36 aa, Artificial Sequence
  Description of Artificial Sequence: Synthetic polypeptide
CEGEIATTNPVATAQWGSVSAAGDMGEDHQGGEDNP

SEQ ID NO: 195376 - protein, 36 aa, Artificial Sequence
  Description of Artificial Sequence: Synthetic polypeptide
QEAEIATTNPVAYEQYGSVCADGALTGHHGNDMQMW

SEQ ID NO: 195377 - protein, 38 aa, Artificial Sequence
  Description of Artificial Sequence: Synthetic polypeptide
FEEEIRTTNPVATEQYGVVIVDDLDDEGQTNDGDEQEF

SEQ ID NO: 195378 - protein, 33 aa, Artificial Sequence
  Description of Artificial Sequence: Synthetic polypeptide
DENEIRTTNPIATEPWGATIAAEDWAEQKGPYI

SEQ ID NO: 195379 - protein, 37 aa, Artificial Sequence
  Description of Artificial Sequence: Synthetic polypeptide
DEECISTTNPVATEQYGQCVCSWGEDNDENFGSDTQA

SEQ ID NO: 195380 - protein, 36 aa, Artificial Sequence
  Description of Artificial Sequence: Synthetic polypeptide
DEEEIACTNPVATEQWGAVVCAQNPPVNTAGNPEGT

SEQ ID NO: 195381 - protein, 38 aa, Artificial Sequence
  Description of Artificial Sequence: Synthetic polypeptide
DEEEIRTTNPVATEQYGSTYGCMQINQIQNEVADMVGQ

SEQ ID NO: 195382 - protein, 36 aa, Artificial Sequence
  Description of Artificial Sequence: Synthetic polypeptide
DEEEIATTNPVATAQWGHVVANTGAGENGAEGDGTT

SEQ ID NO: 195383 - protein, 38 aa, Artificial Sequence
  Description of Artificial Sequence: Synthetic polypeptide
DEEEIRATNPVATEQYGSVVANGGGGGPADSPIGEAEN

SEQ ID NO: 195384 - protein, 33 aa, Artificial Sequence
  Description of Artificial Sequence: Synthetic polypeptide
DENEIRTTNPIATECWGDVANEEDWANAKEDYI

SEQ ID NO: 195385 - protein, 33 aa, Artificial Sequence
  Description of Artificial Sequence: Synthetic polypeptide
DESEIASTNPVGTEGYGAMWANAEDLAHKGPYI

SEQ ID NO: 195386 - protein, 35 aa, Artificial Sequence
  Description of Artificial Sequence: Synthetic polypeptide
DEEEIACTNPVATEQWGAVVCAGNPVNTAGDPTGT

SEQ ID NO: 195387 - protein, 36 aa, Artificial Sequence
  Description of Artificial Sequence: Synthetic polypeptide
MENEIRCTNPVATEQYGSVSWCGVAEIPFSHQEVEG

SEQ ID NO: 195388 - protein, 36 aa, Artificial Sequence
  Description of Artificial Sequence: Synthetic polypeptide
MENEIRCTNPVATEQYGSVSWCGGVAEIPFHQEIET

SEQ ID NO: 195389 - protein, 38 aa, Artificial Sequence
  Description of Artificial Sequence: Synthetic polypeptide
DDEEIRTTNPVATEQYGCVCSNWGEDHNAEFFNSDNQS

SEQ ID NO: 195390 - protein, 37 aa, Artificial Sequence
  Description of Artificial Sequence: Synthetic polypeptide
CEEEIACTNPVATEQYGSCALAGNPLENGAPMENGVE

SEQ ID NO: 195391 - protein, 37 aa, Artificial Sequence
  Description of Artificial Sequence: Synthetic polypeptide
CEEEIACTNPVATEQYGSCAAVPGPALDYTAGGDQNH

SEQ ID NO: 195392 - protein, 35 aa, Artificial Sequence
  Description of Artificial Sequence: Synthetic polypeptide
DEEEIACTNPVATEQWGAVICAQNPVETAGEPTGF

SEQ ID NO: 195393 - protein, 36 aa, Artificial Sequence
  Description of Artificial Sequence: Synthetic polypeptide
QAEEIATTNPVATEQYGCVAAGEGGHGQDSAEEGNT

SEQ ID NO: 195394 - protein, 35 aa, Artificial Sequence
  Description of Artificial Sequence: Synthetic polypeptide
DENEIATTNPVAYEQWGATYYSIEIEMNQREGDSY

SEQ ID NO: 195395 - protein, 39 aa, Artificial Sequence
  Description of Artificial Sequence: Synthetic polypeptide
DEEEIRTTNPVATEQYGSTIISLEHLNEQEHHIAQEIEN

SEQ ID NO: 195396 - protein, 35 aa, Artificial Sequence
  Description of Artificial Sequence: Synthetic polypeptide
DEEEIACTNPVATEQWGAVCAQNPVPETAGEPTGK

SEQ ID NO: 195397 - protein, 37 aa, Artificial Sequence
  Description of Artificial Sequence: Synthetic polypeptide
CEEEIACTNPVATEQYGSCAATGNHLPLDSGEGIDLQ

SEQ ID NO: 195398 - protein, 34 aa, Artificial Sequence
  Description of Artificial Sequence: Synthetic polypeptide
DENEIATTNPVAYEQWGATYYSIEIEMNQRSMDP

SEQ ID NO: 195399 - protein, 39 aa, Artificial Sequence
  Description of Artificial Sequence: Synthetic polypeptide
DEEEIRTTNPVATEQYGSTIISLEHLNWQEHAIALEIEN

SEQ ID NO: 195400 - protein, 35 aa, Artificial Sequence
  Description of Artificial Sequence: Synthetic polypeptide
QEGEIAATNPCSYEQYGVTVSCLNMLSQGEGGTPR

SEQ ID NO: 195401 - protein, 34 aa, Artificial Sequence
  Description of Artificial Sequence: Synthetic polypeptide
DENEIATTNPVAYEQWGATYYSIEQEMNQRTPDH

SEQ ID NO: 195402 - protein, 32 aa, Artificial Sequence
  Description of Artificial Sequence: Synthetic polypeptide
QEAEIACTNPVATEQWGGCCAGTMHQHADDPP

SEQ ID NO: 195403 - protein, 36 aa, Artificial Sequence
  Description of Artificial Sequence: Synthetic polypeptide
CEEEIACTNPVATEQYGSACAAAHGILDSMDGNAQE

SEQ ID NO: 195404 - protein, 38 aa, Artificial Sequence
  Description of Artificial Sequence: Synthetic polypeptide
DDEEIRTTNPVATEQYGCVCSNWGEDHNAENFNSDNQS

SEQ ID NO: 195405 - protein, 36 aa, Artificial Sequence
  Description of Artificial Sequence: Synthetic polypeptide
MENEIRTTNPVATEFYGQVVDDNFDGTGEGEFNEDA

SEQ ID NO: 195406 - protein, 37 aa, Artificial Sequence
  Description of Artificial Sequence: Synthetic polypeptide
DDEEIRTTNPVATEGYGCVCSNWGEHNQENFNSDNQS

SEQ ID NO: 195407 - protein, 38 aa, Artificial Sequence
  Description of Artificial Sequence: Synthetic polypeptide
DDEEIRTTNPVATEQYGCVCSNWGEDHNAENFNSDTQA

SEQ ID NO: 195408 - protein, 34 aa, Artificial Sequence
  Description of Artificial Sequence: Synthetic polypeptide
DENEIRTTNPIATECWGDTVWANEEDWAEAKGPI

SEQ ID NO: 195409 - protein, 37 aa, Artificial Sequence
  Description of Artificial Sequence: Synthetic polypeptide
DDEEIRTTNPVATEGYGCVCSNWEEHNAENFNSENQS

SEQ ID NO: 195410 - protein, 31 aa, Artificial Sequence
  Description of Artificial Sequence: Synthetic polypeptide
QEAEIASTNPCSYEQWGITCYCNDQGSGDTR

SEQ ID NO: 195411 - protein, 38 aa, Artificial Sequence
  Description of Artificial Sequence: Synthetic polypeptide
DDEEIRTTNPVATEQYGCVCSNWMEDHNEENFNSDNQS

SEQ ID NO: 195412 - protein, 33 aa, Artificial Sequence
  Description of Artificial Sequence: Synthetic polypeptide
DENEIRTTNPIATECWGDTTANADEANAKGDYA

SEQ ID NO: 195413 - protein, 35 aa, Artificial Sequence
  Description of Artificial Sequence: Synthetic polypeptide
QEAEIAPTNPCSYEQYGVTVSCCNMLSQVNGGTLR

SEQ ID NO: 195414 - protein, 33 aa, Artificial Sequence
  Description of Artificial Sequence: Synthetic polypeptide
DENEIRTTNPIATECWGAVANEEDWAEPKGPYI

SEQ ID NO: 195415 - protein, 40 aa, Artificial Sequence
  Description of Artificial Sequence: Synthetic polypeptide
DEEEIRTTNPVATEQYGVVSVTVVTTGTQAGTTEAGSTVQ

SEQ ID NO: 195416 - protein, 35 aa, Artificial Sequence
  Description of Artificial Sequence: Synthetic polypeptide
DENEIATTNPVAYEQWGATYYSHEIEMNQREMDNH

SEQ ID NO: 195417 - protein, 33 aa, Artificial Sequence
  Description of Artificial Sequence: Synthetic polypeptide
DENEIRTTNPIATECWGDVANEEDWANPKEDYI

SEQ ID NO: 195418 - protein, 37 aa, Artificial Sequence
  Description of Artificial Sequence: Synthetic polypeptide
QEGAIATTNPVATEQYGSISFSAPDTLREPQEGEDGR

SEQ ID NO: 195419 - protein, 36 aa, Artificial Sequence
  Description of Artificial Sequence: Synthetic polypeptide
MENEIRTTNPVATEGYGVVVDDNENMVGGGNTEEEG

SEQ ID NO: 195420 - protein, 35 aa, Artificial Sequence
  Description of Artificial Sequence: Synthetic polypeptide
DEQEIRTTNPVSYEPWGKISCMVDAISQQQTSGNF

SEQ ID NO: 195421 - protein, 37 aa, Artificial Sequence
  Description of Artificial Sequence: Synthetic polypeptide
MENEIRTTNPVATEGYGSVVYDNIIQGGQGEEEDEQN

SEQ ID NO: 195422 - protein, 38 aa, Artificial Sequence
  Description of Artificial Sequence: Synthetic polypeptide
DDEEIRTTNPVATEQYGCVCSNWGEDHNAENFNSDTQS

SEQ ID NO: 195423 - protein, 37 aa, Artificial Sequence
  Description of Artificial Sequence: Synthetic polypeptide
MENEIRTTNPVATEFYGVVGVDGGGNATNDDDNGNQG

SEQ ID NO: 195424 - protein, 36 aa, Artificial Sequence
  Description of Artificial Sequence: Synthetic polypeptide
MENEIRTTNPVATEFYGTVVLDLINMDQSTGEGGQG

SEQ ID NO: 195425 - protein, 34 aa, Artificial Sequence
  Description of Artificial Sequence: Synthetic polypeptide
DENEIATTNPVAYEQWGATYYSIEDEMNQREPDY

SEQ ID NO: 195426 - protein, 34 aa, Artificial Sequence
  Description of Artificial Sequence: Synthetic polypeptide
DENEIATTNPVAYEQWGATYYSIEIADNQREMDH

SEQ ID NO: 195427 - protein, 38 aa, Artificial Sequence
  Description of Artificial Sequence: Synthetic polypeptide
CEEEIACTNPVATEQYGSCAPAVGNVLTQPDDGMGDNH

SEQ ID NO: 195428 - protein, 33 aa, Artificial Sequence
  Description of Artificial Sequence: Synthetic polypeptide
DENEIRTTNPIATECWGATVWAEDEANPAEPYI

SEQ ID NO: 195429 - protein, 34 aa, Artificial Sequence
  Description of Artificial Sequence: Synthetic polypeptide
DEGCINTTNPVAYEQWGCFSWDNGDFDNGKNAEN

SEQ ID NO: 195430 - protein, 39 aa, Artificial Sequence
  Description of Artificial Sequence: Synthetic polypeptide
DEEEIRTTNPVATEQYGSTYTGPHYNNYPEMDQSQDYTP

SEQ ID NO: 195431 - protein, 38 aa, Artificial Sequence
  Description of Artificial Sequence: Synthetic polypeptide
FEEEIRTTNPVATEQYGSVVYDGMFGQEGEQEEDDEGS

SEQ ID NO: 195432 - protein, 37 aa, Artificial Sequence
  Description of Artificial Sequence: Synthetic polypeptide
CEEEIACTNPVATEQYGSTACAANDGLPLGSEGNNDD

SEQ ID NO: 195433 - protein, 38 aa, Artificial Sequence
  Description of Artificial Sequence: Synthetic polypeptide
DEECISTTNPVATEQYGQCVCSNWGEHNQENFGSDNQA

SEQ ID NO: 195434 - protein, 32 aa, Artificial Sequence
  Description of Artificial Sequence: Synthetic polypeptide
QESEIRTTNPVGTEGWGVMAAETLAEHKGDYI

SEQ ID NO: 195435 - protein, 37 aa, Artificial Sequence
  Description of Artificial Sequence: Synthetic polypeptide
DEMAIRTTNPVAYEQYGCFCSNTGEHNIENFGSDNQS

SEQ ID NO: 195436 - protein, 38 aa, Artificial Sequence
  Description of Artificial Sequence: Synthetic polypeptide
DDEEIRTTNPVATEFYGSVYGMGQGDDEFGNGGQEETA

SEQ ID NO: 195437 - protein, 36 aa, Artificial Sequence
  Description of Artificial Sequence: Synthetic polypeptide
MENEIRTTNPVATEQYGSCYYPLNVDSDIIDLNTMA

SEQ ID NO: 195438 - protein, 36 aa, Artificial Sequence
  Description of Artificial Sequence: Synthetic polypeptide
MENEIRTTNPVATEQYGSCYYPLNSDSDIEDLNNMA

SEQ ID NO: 195439 - protein, 36 aa, Artificial Sequence
  Description of Artificial Sequence: Synthetic polypeptide
QESEIRTTNPVCYEPYGVVVSCDPQHSQNRQGGGND

SEQ ID NO: 195440 - protein, 36 aa, Artificial Sequence
  Description of Artificial Sequence: Synthetic polypeptide
MENEIRTTNPVATEQYGSCYWPLNSDSDIIDLNNGA

SEQ ID NO: 195441 - protein, 38 aa, Artificial Sequence
  Description of Artificial Sequence: Synthetic polypeptide
QESEIRTTNPVATEQYGSVVNPTVPEGPEMGQGENEEG

SEQ ID NO: 195442 - protein, 38 aa, Artificial Sequence
  Description of Artificial Sequence: Synthetic polypeptide
DEMAIRTTNPVATEQYGQCSCSNWGEHNIENFGSDNQS

SEQ ID NO: 195443 - protein, 35 aa, Artificial Sequence
  Description of Artificial Sequence: Synthetic polypeptide
DEQEIRTTNPVAYESFGSVCCLGGHSHTEGGTDRL

SEQ ID NO: 195444 - protein, 36 aa, Artificial Sequence
  Description of Artificial Sequence: Synthetic polypeptide
ADEEISTTNPVATEQYGCVCSWMEDNQENFGSDTQS

SEQ ID NO: 195445 - protein, 36 aa, Artificial Sequence
  Description of Artificial Sequence: Synthetic polypeptide
MENEIRTTNPVATEQYGSCYSPLSSDSDIIDLNNMQ

SEQ ID NO: 195446 - protein, 37 aa, Artificial Sequence
  Description of Artificial Sequence: Synthetic polypeptide
ADEEISTTNPVATEQYGCVCSTWGEHNAENFNSDTQS

SEQ ID NO: 195447 - protein, 36 aa, Artificial Sequence
  Description of Artificial Sequence: Synthetic polypeptide
MENEIRTTNPVATEQYGSCYLPLNDSDIIDLNTHMQ

SEQ ID NO: 195448 - protein, 36 aa, Artificial Sequence
  Description of Artificial Sequence: Synthetic polypeptide
AEEEISCTNPVATEQYGCVCSWGEHNQENFNSDNQS

SEQ ID NO: 195449 - protein, 34 aa, Artificial Sequence
  Description of Artificial Sequence: Synthetic polypeptide
DEAEIATTNPVATEQWGTNCAATDGHPVEAEIND

SEQ ID NO: 195450 - protein, 36 aa, Artificial Sequence
  Description of Artificial Sequence: Synthetic polypeptide
DEGEICTTNPVAYEQWGSCVYVDEWNDGQHRDQAMD

SEQ ID NO: 195451 - protein, 37 aa, Artificial Sequence
  Description of Artificial Sequence: Synthetic polypeptide
DEECISTTNPVATEQYGQCVCSNWGEHNQEGFGSDQA

SEQ ID NO: 195452 - protein, 32 aa, Artificial Sequence
  Description of Artificial Sequence: Synthetic polypeptide
QESEIRTTNPVGTEGWGVTAAETWAEHKGDYI

SEQ ID NO: 195453 - protein, 38 aa, Artificial Sequence
  Description of Artificial Sequence: Synthetic polypeptide
MENEIRTTNPVATEQYGSIVNMWPAEDLGQDSGQYTTQ

SEQ ID NO: 195454 - protein, 35 aa, Artificial Sequence
  Description of Artificial Sequence: Synthetic polypeptide
QAEEIATTNPVATEQWGHCNVAATGGLPAGAPGGH

SEQ ID NO: 195455 - protein, 35 aa, Artificial Sequence
  Description of Artificial Sequence: Synthetic polypeptide
CEEEIACTNPVATEQYGSACAIINHDNNEMGDTEM

SEQ ID NO: 195456 - protein, 37 aa, Artificial Sequence
  Description of Artificial Sequence: Synthetic polypeptide
CEEEIACTNPVATEQYGSVAANPEGTPAGEGMGMNMN

SEQ ID NO: 195457 - protein, 36 aa, Artificial Sequence
  Description of Artificial Sequence: Synthetic polypeptide
AEEEISTTNPVATEGYGCVCSWGEHNQENFNSDNQS

SEQ ID NO: 195458 - protein, 35 aa, Artificial Sequence
  Description of Artificial Sequence: Synthetic polypeptide
QESENIRTTNSHATEQMTDMCSTDELQIGGVANQN

SEQ ID NO: 195459 - protein, 34 aa, Artificial Sequence
  Description of Artificial Sequence: Synthetic polypeptide
QAEEIATTNPVATEQWGGCHCAGSGMHQNHDDNP

SEQ ID NO: 195460 - protein, 38 aa, Artificial Sequence
  Description of Artificial Sequence: Synthetic polypeptide
DENEIATTNPVAYAQWGSVCSEANPALPDDNGNGMNRW

SEQ ID NO: 195461 - protein, 39 aa, Artificial Sequence
  Description of Artificial Sequence: Synthetic polypeptide
DDEEIRTTNPVATEFYGSVVNSTDGFGLEEGEDGDQTTN

SEQ ID NO: 195462 - protein, 36 aa, Artificial Sequence
  Description of Artificial Sequence: Synthetic polypeptide
AEEEISTTNPVATEEYGCVCSWGEHNQENFNSDNQA

SEQ ID NO: 195463 - protein, 37 aa, Artificial Sequence
  Description of Artificial Sequence: Synthetic polypeptide
AEEEISTTNPVATEEYGCSCSNWGEDNQENFGSDNQA

SEQ ID NO: 195464 - protein, 35 aa, Artificial Sequence
  Description of Artificial Sequence: Synthetic polypeptide
DEGEICTTNPVAYEQWGSCVYVDEWNDGQHQKQGM

SEQ ID NO: 195465 - protein, 39 aa, Artificial Sequence
  Description of Artificial Sequence: Synthetic polypeptide
DEEEIRTTNPVATEQYGSTHTRSMINVEVYEEMGPLQGE

SEQ ID NO: 195466 - protein, 35 aa, Artificial Sequence
  Description of Artificial Sequence: Synthetic polypeptide
DENEIATTNPVAYAQWGSVSQGPPQQDTPGGSMEN

SEQ ID NO: 195467 - protein, 39 aa, Artificial Sequence
  Description of Artificial Sequence: Synthetic polypeptide
DEEEIRCTNPAATEQYGSVNDPDVTTDGEQNEGGQTGGD

SEQ ID NO: 195468 - protein, 39 aa, Artificial Sequence
  Description of Artificial Sequence: Synthetic polypeptide
DEEEIRCTNPAATEQYGSVGDPEVTTDGEQNEGGQEGGD

SEQ ID NO: 195469 - protein, 36 aa, Artificial Sequence
  Description of Artificial Sequence: Synthetic polypeptide
QAEEIATTNPVATEQWGHCNVAATANGLPATAPGGF

SEQ ID NO: 195470 - protein, 37 aa, Artificial Sequence
  Description of Artificial Sequence: Synthetic polypeptide
MENEIRTTNPVATEQYGSVISWCGVAEIPFTHQEVET

SEQ ID NO: 195471 - protein, 36 aa, Artificial Sequence
  Description of Artificial Sequence: Synthetic polypeptide
MENEIRTTNPVATEQYGSVHWCGVAEIPFSHQVVET

SEQ ID NO: 195472 - protein, 38 aa, Artificial Sequence
  Description of Artificial Sequence: Synthetic polypeptide
DDEEIRTTNPVATEFYGSVVSVMGQGLEGGEDGDQTTN

SEQ ID NO: 195473 - protein, 36 aa, Artificial Sequence
  Description of Artificial Sequence: Synthetic polypeptide
MENEIRTTNPVATEQYGSLYFPLNSDSDHIDLNNMQ

SEQ ID NO: 195474 - protein, 37 aa, Artificial Sequence
  Description of Artificial Sequence: Synthetic polypeptide
DDEEIRTTNPVATEFYGSVVVVSNMDLNGEFDDEEQA

SEQ ID NO: 195475 - protein, 37 aa, Artificial Sequence
  Description of Artificial Sequence: Synthetic polypeptide
DEGEICVTNPVAYEQWGSCVYSDELNDGQHRMSQGMV

SEQ ID NO: 195476 - protein, 38 aa, Artificial Sequence
  Description of Artificial Sequence: Synthetic polypeptide
AEEEIRTTNPVAYEQYGCVTSTWGADHNAEHFGSDPQS

SEQ ID NO: 195477 - protein, 37 aa, Artificial Sequence
  Description of Artificial Sequence: Synthetic polypeptide
QAEEIATTNPVATEQWGSVAIANHGIEAPDNQDGGNP

SEQ ID NO: 195478 - protein, 38 aa, Artificial Sequence
  Description of Artificial Sequence: Synthetic polypeptide
DEFELATTNPVAYEQYGTVCSCTDGLPDETMEGQNGDR

SEQ ID NO: 195479 - protein, 32 aa, Artificial Sequence
  Description of Artificial Sequence: Synthetic polypeptide
QEGEIACTNPCSYEQWGITCYCNDQSDRGKDR

SEQ ID NO: 195480 - protein, 38 aa, Artificial Sequence
  Description of Artificial Sequence: Synthetic polypeptide
MENEIRTTNPVATEQYGSCSSPAPAEGPNMVFEGNSGC

SEQ ID NO: 195481 - protein, 37 aa, Artificial Sequence
  Description of Artificial Sequence: Synthetic polypeptide
CEGEIATTNPVATAQWGSVSMSGDTPTPNDDGMGNQM

SEQ ID NO: 195482 - protein, 39 aa, Artificial Sequence
  Description of Artificial Sequence: Synthetic polypeptide
DEEEIRTTNPVATESYGMTVVATNFLGANQTEHPQVQST

SEQ ID NO: 195483 - protein, 34 aa, Artificial Sequence
  Description of Artificial Sequence: Synthetic polypeptide
DENEIRTTNPISTEPWGATWSNMEDIQAEPKGNH

SEQ ID NO: 195484 - protein, 37 aa, Artificial Sequence
  Description of Artificial Sequence: Synthetic polypeptide
MENEIRTTNPVATEQYGSCFYFPLNSDSLIIDLNNMA

SEQ ID NO: 195485 - protein, 35 aa, Artificial Sequence
  Description of Artificial Sequence: Synthetic polypeptide
DEFVICTTNPVAFEQWGSDNSEQIQQTGNGMEEAN

SEQ ID NO: 195486 - protein, 34 aa, Artificial Sequence
  Description of Artificial Sequence: Synthetic polypeptide
DENEIRTTNPISTEPWGATISNMEDWQQQNGNYI

SEQ ID NO: 195487 - protein, 34 aa, Artificial Sequence
  Description of Artificial Sequence: Synthetic polypeptide
DENEIRTTNPISTEPWGATISNMEDWQQQKGNYI

SEQ ID NO: 195488 - protein, 37 aa, Artificial Sequence
  Description of Artificial Sequence: Synthetic polypeptide
MENEIRTTNPVATEQYGSCCYFPLNVDSDIEDLNNMA

SEQ ID NO: 195489 - protein, 35 aa, Artificial Sequence
  Description of Artificial Sequence: Synthetic polypeptide
DEHEIATTNPVAYESWGCVCSGLNGEDERNMNGAN

SEQ ID NO: 195490 - protein, 38 aa, Artificial Sequence
  Description of Artificial Sequence: Synthetic polypeptide
DDEEIRTTNPVATEFYGTVNVDTTGLQEEQDEGGETTT

SEQ ID NO: 195491 - protein, 34 aa, Artificial Sequence
  Description of Artificial Sequence: Synthetic polypeptide
CEEVIACTNPVATEQWGCVANMNNSNAAGNPGEQ

SEQ ID NO: 195492 - protein, 38 aa, Artificial Sequence
  Description of Artificial Sequence: Synthetic polypeptide
DEECISTTNPVATEQYGQCVCSNWMEHNQENFGSENQS

SEQ ID NO: 195493 - protein, 35 aa, Artificial Sequence
  Description of Artificial Sequence: Synthetic polypeptide
DEHEIATTNPVAYESWGCVASGGLGEDERNMNGGY

SEQ ID NO: 195494 - protein, 33 aa, Artificial Sequence
  Description of Artificial Sequence: Synthetic polypeptide
DENEIRTTNPIATEQWGATWSNEEDWAEPKEDA

SEQ ID NO: 195495 - protein, 34 aa, Artificial Sequence
  Description of Artificial Sequence: Synthetic polypeptide
DENEIRTTNPIATEQWGATWSNAEDWAEPKGDYA

SEQ ID NO: 195496 - protein, 33 aa, Artificial Sequence
  Description of Artificial Sequence: Synthetic polypeptide
DENEIRTTNPIATEQWGATWSNAEDWAEPKEDA

SEQ ID NO: 195497 - protein, 36 aa, Artificial Sequence
  Description of Artificial Sequence: Synthetic polypeptide
DEEEIACTNPVATEQWGAVVCAQNPVQETAGDPTGT

SEQ ID NO: 195498 - protein, 34 aa, Artificial Sequence
  Description of Artificial Sequence: Synthetic polypeptide
DENEIRTTNPISTEPWGTTTSNMEDIQAQPKGNH

SEQ ID NO: 195499 - protein, 33 aa, Artificial Sequence
  Description of Artificial Sequence: Synthetic polypeptide
QAEEIATTNPVATEQYGCAPGEGHGTDSEEEKN

SEQ ID NO: 195500 - protein, 37 aa, Artificial Sequence
  Description of Artificial Sequence: Synthetic polypeptide
DEFETCTVNPVATEQYGCVAWTENDQHMQQKGRGDHH

SEQ ID NO: 195501 - protein, 37 aa, Artificial Sequence
  Description of Artificial Sequence: Synthetic polypeptide
MENEIRTTNPVATEQYGSCYFPLCSDSDIIDLNNGWA

SEQ ID NO: 195502 - protein, 36 aa, Artificial Sequence
  Description of Artificial Sequence: Synthetic polypeptide
DEQEIRTTNPVGTEFYGAVNIMDNIMQQDEDGGDGD

SEQ ID NO: 195503 - protein, 37 aa, Artificial Sequence
  Description of Artificial Sequence: Synthetic polypeptide
DEFELCTVNPVATEPYGTVSWTENDNHDKQKGGGDDR

SEQ ID NO: 195504 - protein, 37 aa, Artificial Sequence
  Description of Artificial Sequence: Synthetic polypeptide
DEFELCTVNPVATEQYGNVSWTENDQHDKQGGGGDAM

SEQ ID NO: 195505 - protein, 37 aa, Artificial Sequence
  Description of Artificial Sequence: Synthetic polypeptide
DEFELCTVNPVATEQYGNVSWTENDQHDKQKEGGDDS

SEQ ID NO: 195506 - protein, 34 aa, Artificial Sequence
  Description of Artificial Sequence: Synthetic polypeptide
QEGAIAPTNPCSYEQYGVTVSCCNMLSQSVGGTR

SEQ ID NO: 195507 - protein, 36 aa, Artificial Sequence
  Description of Artificial Sequence: Synthetic polypeptide
MENEIRTTNPVATEQYGSCYFPLNSDVDIIDINNMA

SEQ ID NO: 195508 - protein, 36 aa, Artificial Sequence
  Description of Artificial Sequence: Synthetic polypeptide
MENEIRTTNPVATEQYGSCYFPLNSDSDIIDLNPME

SEQ ID NO: 195509 - protein, 34 aa, Artificial Sequence
  Description of Artificial Sequence: Synthetic polypeptide
CEEVIACTNPVATEQWGCVAGTNPAAMHMGELDW

SEQ ID NO: 195510 - protein, 37 aa, Artificial Sequence
  Description of Artificial Sequence: Synthetic polypeptide
AEEEIRTTNPVGTEQYGQCVCSWGEDHNANFGSQTQS

SEQ ID NO: 195511 - protein, 36 aa, Artificial Sequence
  Description of Artificial Sequence: Synthetic polypeptide
DEAEIATTNPVATEQWGTNCSVAAAAHGMRGSGDSW

SEQ ID NO: 195512 - protein, 36 aa, Artificial Sequence
  Description of Artificial Sequence: Synthetic polypeptide
MENEIRTTNPVATEQYGSCYFPLNSDSDIIDINEMD

SEQ ID NO: 195513 - protein, 34 aa, Artificial Sequence
  Description of Artificial Sequence: Synthetic polypeptide
QECEICATNPCTTEIYGVVATNNATNNQNGNDTG

SEQ ID NO: 195514 - protein, 36 aa, Artificial Sequence
  Description of Artificial Sequence: Synthetic polypeptide
MENEIRTTNPVATEQYGSCYFPLNDSDIIDLNNQMC

SEQ ID NO: 195515 - protein, 38 aa, Artificial Sequence
  Description of Artificial Sequence: Synthetic polypeptide
AEEEIRTTNPVAYEQYGQCVCSNWGEHNTENFNSDNQG

SEQ ID NO: 195516 - protein, 33 aa, Artificial Sequence
  Description of Artificial Sequence: Synthetic polypeptide
QAEEIATTNPVATEQYGCANPGIGHGTDSEEEK

SEQ ID NO: 195517 - protein, 33 aa, Artificial Sequence
  Description of Artificial Sequence: Synthetic polypeptide
QECEICATNPCTTEIYGVVATNNATNNQEGEDT

SEQ ID NO: 195518 - protein, 37 aa, Artificial Sequence
  Description of Artificial Sequence: Synthetic polypeptide
DEFELCTVNPVATEQYGTVSWTENDQHMQQKGGGDGG

SEQ ID NO: 195519 - protein, 34 aa, Artificial Sequence
  Description of Artificial Sequence: Synthetic polypeptide
DENEIRTTNPISTEPYGAIWANMEDWQQPNGPYI

SEQ ID NO: 195520 - protein, 36 aa, Artificial Sequence
  Description of Artificial Sequence: Synthetic polypeptide
MENEIRTTNPVATEQYGSCYFPLDDSDIIDLNNSMQ

SEQ ID NO: 195521 - protein, 34 aa, Artificial Sequence
  Description of Artificial Sequence: Synthetic polypeptide
DEFEQATTNPVAYEQWGSVCQTFETDDGPKGDTQ

SEQ ID NO: 195522 - protein, 36 aa, Artificial Sequence
  Description of Artificial Sequence: Synthetic polypeptide
MENEIRTTNPVATEQYGSCYFPLNSDSDIIDFNSMA

SEQ ID NO: 195523 - protein, 40 aa, Artificial Sequence
  Description of Artificial Sequence: Synthetic polypeptide
DEEEIRTTNPVATEQYGSVVVTVVTVGTQQGTTEAGSTVM

SEQ ID NO: 195524 - protein, 38 aa, Artificial Sequence
  Description of Artificial Sequence: Synthetic polypeptide
FEGEIRTTNPVATEQYGSTVYSPDVESMNGETWQEHPG

SEQ ID NO: 195525 - protein, 37 aa, Artificial Sequence
  Description of Artificial Sequence: Synthetic polypeptide
QESEICTTNPVATEQYGTVVSTTDGDDEEEEGGNFDI

SEQ ID NO: 195526 - protein, 38 aa, Artificial Sequence
  Description of Artificial Sequence: Synthetic polypeptide
DEEEIRTTNPVATEQYGYVPVHPSPVNMSNAVDMPFEI

SEQ ID NO: 195527 - protein, 35 aa, Artificial Sequence
  Description of Artificial Sequence: Synthetic polypeptide
QAEEIATTNPVATEQYGCVAPGEGTHGNEGAEEEK

SEQ ID NO: 195528 - protein, 38 aa, Artificial Sequence
  Description of Artificial Sequence: Synthetic polypeptide
MEGEIRTTNPVATEQYGSIVNMWPNEDLGQDSIQMTTQ

SEQ ID NO: 195529 - protein, 37 aa, Artificial Sequence
  Description of Artificial Sequence: Synthetic polypeptide
DEECISTTNPVAYEQWGSVSGGPPGNGGNMRNQMGMS

SEQ ID NO: 195530 - protein, 34 aa, Artificial Sequence
  Description of Artificial Sequence: Synthetic polypeptide
DEECISTTNPVAYEQWGTYVYNQDSDDDRGEDDS

SEQ ID NO: 195531 - protein, 36 aa, Artificial Sequence
  Description of Artificial Sequence: Synthetic polypeptide
DEECISTTNPVAYEQYAEEVTTGNGNPNDQGGGAGK

SEQ ID NO: 195532 - protein, 38 aa, Artificial Sequence
  Description of Artificial Sequence: Synthetic polypeptide
DEEEIRTTNPVATEQYGYVCWHPSPVNMSNAVDMFFEI

SEQ ID NO: 195533 - protein, 38 aa, Artificial Sequence
  Description of Artificial Sequence: Synthetic polypeptide
DEEEIRTTNPVATEQYGYVCVHTSPVNMSNAVDMFPEI

SEQ ID NO: 195534 - protein, 38 aa, Artificial Sequence
  Description of Artificial Sequence: Synthetic polypeptide
MEGEIRTTNPVATEQYGSINNMWPNEDLGQDSNQYTTQ

SEQ ID NO: 195535 - protein, 36 aa, Artificial Sequence
  Description of Artificial Sequence: Synthetic polypeptide
DEECISTTNPVAYEQYAEEVTTGNGNPNDQGGGKHV

SEQ ID NO: 195536 - protein, 38 aa, Artificial Sequence
  Description of Artificial Sequence: Synthetic polypeptide
DEEEIRTTNPVATEQYGYVCVHPSPVNMSNAEDMFFIL

SEQ ID NO: 195537 - protein, 36 aa, Artificial Sequence
  Description of Artificial Sequence: Synthetic polypeptide
DEECISTTNPVAYEQYAEEVTTGNGNPNDQGGKGMA

SEQ ID NO: 195538 - protein, 37 aa, Artificial Sequence
  Description of Artificial Sequence: Synthetic polypeptide
DEEEIRTTNPVATEGYGQCVCFWMEHNTEYFNSDTQS

SEQ ID NO: 195539 - protein, 38 aa, Artificial Sequence
  Description of Artificial Sequence: Synthetic polypeptide
DEEEIRTTNPVATEQYGYVCVHPSPSNMSNAVDMFFEL

SEQ ID NO: 195540 - protein, 36 aa, Artificial Sequence
  Description of Artificial Sequence: Synthetic polypeptide
HEEEIRTTNPVAYEAYGSTVPCFGNSPSWTEPVGKG

SEQ ID NO: 195541 - protein, 37 aa, Artificial Sequence
  Description of Artificial Sequence: Synthetic polypeptide
DEEEIRTTNPVATEQYGYVCVHPHPVNMSNAVDMFIE

SEQ ID NO: 195542 - protein, 34 aa, Artificial Sequence
  Description of Artificial Sequence: Synthetic polypeptide
QESEIATTNPVATEFYGNVVVTEGGDEGEGEEGG

SEQ ID NO: 195543 - protein, 37 aa, Artificial Sequence
  Description of Artificial Sequence: Synthetic polypeptide
DEECISTTNPVAYEQYAEEVTTGNGNPNDQGGKKHNT

SEQ ID NO: 195544 - protein, 37 aa, Artificial Sequence
  Description of Artificial Sequence: Synthetic polypeptide
DEECISTTNPVAYEQYAEEVTTGNGNPNDQGGKKNHP

SEQ ID NO: 195545 - protein, 35 aa, Artificial Sequence
  Description of Artificial Sequence: Synthetic polypeptide
DEECISTTNPVAYEHYGQTTVAVTNEPATWGGEAG

SEQ ID NO: 195546 - protein, 36 aa, Artificial Sequence
  Description of Artificial Sequence: Synthetic polypeptide
MEGEIRTTNPVATEQYGSNGTPAKGIENNMDNIDFD

SEQ ID NO: 195547 - protein, 35 aa, Artificial Sequence
  Description of Artificial Sequence: Synthetic polypeptide
QAEEIATTNPVATEQYGCVAPGEGPHGNESAEEEH

SEQ ID NO: 195548 - protein, 37 aa, Artificial Sequence
  Description of Artificial Sequence: Synthetic polypeptide
MEGEIRTTNPVATEQYGSNPSTPAKGIENNMDNEDFQ

SEQ ID NO: 195549 - protein, 38 aa, Artificial Sequence
  Description of Artificial Sequence: Synthetic polypeptide
DEEEIRTTNPVATEGYGQCSCSNWGEENAEYFNSDNQA

SEQ ID NO: 195550 - protein, 39 aa, Artificial Sequence
  Description of Artificial Sequence: Synthetic polypeptide
DENEIRSTNPVATEQYGSVVTTDGMNSNQTGESEQGIET

SEQ ID NO: 195551 - protein, 38 aa, Artificial Sequence
  Description of Artificial Sequence: Synthetic polypeptide
DEEEIRATNPVATEQYGSVCAATMGPEEAGMPMGEAAW

SEQ ID NO: 195552 - protein, 36 aa, Artificial Sequence
  Description of Artificial Sequence: Synthetic polypeptide
QESEIATTNPVATEQYGCVYVWEMNDIQQQTQDNHV

SEQ ID NO: 195553 - protein, 34 aa, Artificial Sequence
  Description of Artificial Sequence: Synthetic polypeptide
DEEEIACTNPVATASWGCAIATTAEQDTPDGNEN

SEQ ID NO: 195554 - protein, 35 aa, Artificial Sequence
  Description of Artificial Sequence: Synthetic polypeptide
DEATEIATTNPCAYEAWGSVAWNENEGEQNNGDAR

SEQ ID NO: 195555 - protein, 35 aa, Artificial Sequence
  Description of Artificial Sequence: Synthetic polypeptide
QENEIATTNPVATEPYGNTVSGEHLQNHQMDEDLH

SEQ ID NO: 195556 - protein, 35 aa, Artificial Sequence
  Description of Artificial Sequence: Synthetic polypeptide
QAEEIATTNPVATEQYGCVAPGEGGHGQESEEENL

SEQ ID NO: 195557 - protein, 35 aa, Artificial Sequence
  Description of Artificial Sequence: Synthetic polypeptide
QAEEIATTNPVATEQYGCVAPGEGGHGQESENEGM

SEQ ID NO: 195558 - protein, 34 aa, Artificial Sequence
  Description of Artificial Sequence: Synthetic polypeptide
DEAEIATTNPVAYERWGAVCTWDNMPNGGEQGGS

SEQ ID NO: 195559 - protein, 37 aa, Artificial Sequence
  Description of Artificial Sequence: Synthetic polypeptide
DDEEIRTTNPVATEGYGQCVCSNWEHNQENFNSETQA

SEQ ID NO: 195560 - protein, 34 aa, Artificial Sequence
  Description of Artificial Sequence: Synthetic polypeptide
QENEIATTNPVATEPYGNTVAGEHLQHQMDEQLH

SEQ ID NO: 195561 - protein, 37 aa, Artificial Sequence
  Description of Artificial Sequence: Synthetic polypeptide
DENEIRSTNPVATEAYGSVVGVNVDDGNNEFDQSEGN

SEQ ID NO: 195562 - protein, 34 aa, Artificial Sequence
  Description of Artificial Sequence: Synthetic polypeptide
QENEIATTNPVATEPYGNTVAGEGLQHQMDEDAH

SEQ ID NO: 195563 - protein, 34 aa, Artificial Sequence
  Description of Artificial Sequence: Synthetic polypeptide
QENEIATTNPVATEPYGNTVAGEGGQHQMDGDLH

SEQ ID NO: 195564 - protein, 37 aa, Artificial Sequence
  Description of Artificial Sequence: Synthetic polypeptide
DENEIRSTNPVATDQYGVVNDNSIGQNGGQEDNDDTP

SEQ ID NO: 195565 - protein, 38 aa, Artificial Sequence
  Description of Artificial Sequence: Synthetic polypeptide
DEEEIRTTNPVATEQYGTECCYPSVNCELENPAEEFKG

SEQ ID NO: 195566 - protein, 37 aa, Artificial Sequence
  Description of Artificial Sequence: Synthetic polypeptide
QAEEIATTNPVATEQYGCVAPGEGGHGQNEQAEGANN

SEQ ID NO: 195567 - protein, 35 aa, Artificial Sequence
  Description of Artificial Sequence: Synthetic polypeptide
QAEEIATTNPVATEQYGCVAPGEGPGNESAEEEKK

SEQ ID NO: 195568 - protein, 30 aa, Artificial Sequence
  Description of Artificial Sequence: Synthetic polypeptide
QDSEIASTNPVSTEGYGEVAEVCQSHVEQK

SEQ ID NO: 195569 - protein, 35 aa, Artificial Sequence
  Description of Artificial Sequence: Synthetic polypeptide
QAEEIATTNPVATEQYGCVAPGEGGHGQESGEEMK

SEQ ID NO: 195570 - protein, 36 aa, Artificial Sequence
  Description of Artificial Sequence: Synthetic polypeptide
QAEEIATTNPVATEQYGCVAPGEGGHGQEAEGANKT

SEQ ID NO: 195571 - protein, 37 aa, Artificial Sequence
  Description of Artificial Sequence: Synthetic polypeptide
MEGEIRTTNPVATEQYGSIIHGTTLEDHNDEYGDEQI

SEQ ID NO: 195572 - protein, 38 aa, Artificial Sequence
  Description of Artificial Sequence: Synthetic polypeptide
MEGEIRTTNPVATEQYGSCVWQETHVQDFEGFDQDFEG

SEQ ID NO: 195573 - protein, 38 aa, Artificial Sequence
  Description of Artificial Sequence: Synthetic polypeptide
MEGEIRTTNPVATEQYGSCSSPAPAEGPNMRFEENSVC

SEQ ID NO: 195574 - protein, 36 aa, Artificial Sequence
  Description of Artificial Sequence: Synthetic polypeptide
DEGEIATTNPVAYEQYGSCAAAVGNGLNAAGGHADD

SEQ ID NO: 195575 - protein, 36 aa, Artificial Sequence
  Description of Artificial Sequence: Synthetic polypeptide
DEHEIATTNPVAYECWGCVAGGGNMGNQRNGEGDKR

SEQ ID NO: 195576 - protein, 38 aa, Artificial Sequence
  Description of Artificial Sequence: Synthetic polypeptide
MEGEIRTTNPVATEQYGSCSLPAPDEGPNMVFEGNSDI

SEQ ID NO: 195577 - protein, 38 aa, Artificial Sequence
  Description of Artificial Sequence: Synthetic polypeptide
MEGEIRTTNPVATEQYGSCSLPAKAEGPNMVFEGNSDC

SEQ ID NO: 195578 - protein, 38 aa, Artificial Sequence
  Description of Artificial Sequence: Synthetic polypeptide
MEGEIRTTNPVATEQYGSCSIPAPAEGGNMVFEGNSDC

SEQ ID NO: 195579 - protein, 39 aa, Artificial Sequence
  Description of Artificial Sequence: Synthetic polypeptide
DEEEIRTTNPVATEQYGSTLFSPENHSVVVQSNMEEMWD

SEQ ID NO: 195580 - protein, 37 aa, Artificial Sequence
  Description of Artificial Sequence: Synthetic polypeptide
MEGEIRTTNPVATEQYGSCLWQCVVQDFEGANQFEEG

SEQ ID NO: 195581 - protein, 34 aa, Artificial Sequence
  Description of Artificial Sequence: Synthetic polypeptide
DEHEIATTNPVAYECWGCVSGDQGEERNNMQGTA

SEQ ID NO: 195582 - protein, 37 aa, Artificial Sequence
  Description of Artificial Sequence: Synthetic polypeptide
DEECISTTNPVAYEQYGCVCSNWGEHNIEYFGSDNQS

SEQ ID NO: 195583 - protein, 39 aa, Artificial Sequence
  Description of Artificial Sequence: Synthetic polypeptide
DEEEIRTTNPVATEQYGSTNISLEHLNEQEHAIAVEIEN

SEQ ID NO: 195584 - protein, 38 aa, Artificial Sequence
  Description of Artificial Sequence: Synthetic polypeptide
MEGEIRTTNPVATEQYGQVSSPAPSEGPNMRFEGNSVE

SEQ ID NO: 195585 - protein, 37 aa, Artificial Sequence
  Description of Artificial Sequence: Synthetic polypeptide
MEGEIRTTNPVATEQYGMVCSEPVENLMEIEEHMAEF

SEQ ID NO: 195586 - protein, 39 aa, Artificial Sequence
  Description of Artificial Sequence: Synthetic polypeptide
MEGEIRTTNPVATEQYGMCVHSLEVLEQNNIGENNFFFD

SEQ ID NO: 195587 - protein, 40 aa, Artificial Sequence
  Description of Artificial Sequence: Synthetic polypeptide
DEEEIRTTNPVATEQYGSVVVTVVTVGTQAGTTEAGVTVG

SEQ ID NO: 195588 - protein, 35 aa, Artificial Sequence
  Description of Artificial Sequence: Synthetic polypeptide
MEGEIRTTNPVATEQYGCWWAMNEDEEQESFSLQF

SEQ ID NO: 195589 - protein, 35 aa, Artificial Sequence
  Description of Artificial Sequence: Synthetic polypeptide
DEHEIATTNPVAYECWGCVSGINGEERNNMQQGDA

SEQ ID NO: 195590 - protein, 38 aa, Artificial Sequence
  Description of Artificial Sequence: Synthetic polypeptide
DDEEIRTTNPVATEQYGCVCSMWGEDHNQENFNSDTQS

SEQ ID NO: 195591 - protein, 37 aa, Artificial Sequence
  Description of Artificial Sequence: Synthetic polypeptide
QAEEIATTNPVATEQYGCVSPGEGGHGQESGEEEGNH

SEQ ID NO: 195592 - protein, 38 aa, Artificial Sequence
  Description of Artificial Sequence: Synthetic polypeptide
MEGEIRTTNPVATEQYGSCSSPAPAEMPNMVEEGNSDC

SEQ ID NO: 195593 - protein, 38 aa, Artificial Sequence
  Description of Artificial Sequence: Synthetic polypeptide
MEGEIRTTNPVATEQYGSCSSPAPDEGDNMVFEGNSDQ

SEQ ID NO: 195594 - protein, 38 aa, Artificial Sequence
  Description of Artificial Sequence: Synthetic polypeptide
MEGEIRTTNPVATEQYGSCSSPAPDEGMNQVFEGNSDC

SEQ ID NO: 195595 - protein, 38 aa, Artificial Sequence
  Description of Artificial Sequence: Synthetic polypeptide
MEGEIRTTNPVATEQYGSCSSPAPEEGPNTVFEGNSDC

SEQ ID NO: 195596 - protein, 37 aa, Artificial Sequence
  Description of Artificial Sequence: Synthetic polypeptide
MEGEIRTTNPVATEQYGSCTSPDDNVAHSIIDEGIGA

SEQ ID NO: 195597 - protein, 35 aa, Artificial Sequence
  Description of Artificial Sequence: Synthetic polypeptide
HEEEISTTNPVATMQWGCVIPNCIDMSSTASGGNP

SEQ ID NO: 195598 - protein, 37 aa, Artificial Sequence
  Description of Artificial Sequence: Synthetic polypeptide
DEECISTTNPVAYEQYAEEVTTTGNGNPNDQGGKKTR

SEQ ID NO: 195599 - protein, 37 aa, Artificial Sequence
  Description of Artificial Sequence: Synthetic polypeptide
DEEEIRTTNPVATEQYGSTIYPCRMEMWEVRNPQPSD

SEQ ID NO: 195600 - protein, 37 aa, Artificial Sequence
  Description of Artificial Sequence: Synthetic polypeptide
QAEEIATTNPVATEQYGCVSAGEGGHGNESGEEMGMR

SEQ ID NO: 195601 - protein, 36 aa, Artificial Sequence
  Description of Artificial Sequence: Synthetic polypeptide
DEHEIATTNPVAYECWGCAVSGWNGEFERNNMQGNA

SEQ ID NO: 195602 - protein, 38 aa, Artificial Sequence
  Description of Artificial Sequence: Synthetic polypeptide
MEGEIRTTNPVATEQYGSCSSPVPDEGPNMVFEGNSDF

SEQ ID NO: 195603 - protein, 38 aa, Artificial Sequence
  Description of Artificial Sequence: Synthetic polypeptide
MEGEIRTTNPVATEQYGSCSSPIPAEGPNMVFEGNSVC

SEQ ID NO: 195604 - protein, 37 aa, Artificial Sequence
  Description of Artificial Sequence: Synthetic polypeptide
DEGEIATTNPVAYEQYGSVAACPYNPLATETNGDSVG

SEQ ID NO: 195605 - protein, 35 aa, Artificial Sequence
  Description of Artificial Sequence: Synthetic polypeptide
QAEEIATTNPVATEQYGCVAPGIGGHGNESEEEKD

SEQ ID NO: 195606 - protein, 37 aa, Artificial Sequence
  Description of Artificial Sequence: Synthetic polypeptide
HEGEIRTTNPVATEQYGIAVWTVEKLTDLENSQEMTM

SEQ ID NO: 195607 - protein, 37 aa, Artificial Sequence
  Description of Artificial Sequence: Synthetic polypeptide
HEGEIRTTNPVATEQYGSGVASCADNQDIFDFSSMEH

SEQ ID NO: 195608 - protein, 33 aa, Artificial Sequence
  Description of Artificial Sequence: Synthetic polypeptide
QDNEIATTNPVATEGYGCVCSWEHNQHFISEQA

SEQ ID NO: 195609 - protein, 36 aa, Artificial Sequence
  Description of Artificial Sequence: Synthetic polypeptide
DEAVIRTTNPVATEQYGQCVCEWEPNQEYFNSDNQA

SEQ ID NO: 195610 - protein, 32 aa, Artificial Sequence
  Description of Artificial Sequence: Synthetic polypeptide
DEGEIAPTNPISSECWGIVANCENLAESKGTR

SEQ ID NO: 195611 - protein, 37 aa, Artificial Sequence
  Description of Artificial Sequence: Synthetic polypeptide
QDGEIATTNPVATEQYGSINFSAPDTLREPQEGEDTR

SEQ ID NO: 195612 - protein, 39 aa, Artificial Sequence
  Description of Artificial Sequence: Synthetic polypeptide
DEGEIATTNPVAYEQYGSTVCAVTEAGGAQARGSENQMW

SEQ ID NO: 195613 - protein, 40 aa, Artificial Sequence
  Description of Artificial Sequence: Synthetic polypeptide
DEEEIRTTNPVATEQYGSVVVTVVTVGTQAGTTEAGSTQE

SEQ ID NO: 195614 - protein, 38 aa, Artificial Sequence
  Description of Artificial Sequence: Synthetic polypeptide
MEGEIRTTNPVATEQYGSCSSPAPMEGPNMVFEGNSEC

SEQ ID NO: 195615 - protein, 38 aa, Artificial Sequence
  Description of Artificial Sequence: Synthetic polypeptide
MEGEIRTTNPVATEQYGSCSSPAPEWGPNMVFEGNGDC

SEQ ID NO: 195616 - protein, 38 aa, Artificial Sequence
  Description of Artificial Sequence: Synthetic polypeptide
MEGEIRTTNPVATEQYGSCSSPAVDEGLNMVFEGNSDC

SEQ ID NO: 195617 - protein, 33 aa, Artificial Sequence
  Description of Artificial Sequence: Synthetic polypeptide
DENEIRTTNPIATECWGATTWANAIWANPKGPI

SEQ ID NO: 195618 - protein, 35 aa, Artificial Sequence
  Description of Artificial Sequence: Synthetic polypeptide
DEASIATTNPVAYECWGCVSGPNGEGERNNMTGNA

SEQ ID NO: 195619 - protein, 36 aa, Artificial Sequence
  Description of Artificial Sequence: Synthetic polypeptide
DEGEIACTNPVATEQYGSVCAVNAGLIATPEAEAQN

SEQ ID NO: 195620 - protein, 36 aa, Artificial Sequence
  Description of Artificial Sequence: Synthetic polypeptide
DEEEIRTTNPVATEQYLTQTCVEPGEEVPEGEVPEI

SEQ ID NO: 195621 - protein, 36 aa, Artificial Sequence
  Description of Artificial Sequence: Synthetic polypeptide
MEGEIRTTNPVATEQYGTYCFTDDNTQNEADMEEQL

SEQ ID NO: 195622 - protein, 30 aa, Artificial Sequence
  Description of Artificial Sequence: Synthetic polypeptide
QESEIATTNPVGTEQWGVMAEIEMNAAEDA

SEQ ID NO: 195623 - protein, 39 aa, Artificial Sequence
  Description of Artificial Sequence: Synthetic polypeptide
DEEEIRTTNPVATEGYGQCVTSTWGADHNAENFNSDTQA

SEQ ID NO: 195624 - protein, 35 aa, Artificial Sequence
  Description of Artificial Sequence: Synthetic polypeptide
DEGEIACTNPVATAQWGCSNATTGNHLPAPMEGHN

SEQ ID NO: 195625 - protein, 37 aa, Artificial Sequence
  Description of Artificial Sequence: Synthetic polypeptide
DEEEIRTTNPVATEGYGMVSAEGMGDGGQQQEAEDGT

SEQ ID NO: 195626 - protein, 38 aa, Artificial Sequence
  Description of Artificial Sequence: Synthetic polypeptide
DEEEIRTTNPVATEHYGCVCSNWGEDHNQENFNSDTQS

SEQ ID NO: 195627 - protein, 37 aa, Artificial Sequence
  Description of Artificial Sequence: Synthetic polypeptide
DEGEIATTNPVAYEQYGSVCSPMPNQNNEAMIGDGAE

SEQ ID NO: 195628 - protein, 34 aa, Artificial Sequence
  Description of Artificial Sequence: Synthetic polypeptide
DEGEIACTNPVATAQWGGCTVAITNADTQDAQDH

SEQ ID NO: 195629 - protein, 33 aa, Artificial Sequence
  Description of Artificial Sequence: Synthetic polypeptide
DENEIRTTNPCSYEPYGTTSMEDWIQQQQNGPH

SEQ ID NO: 195630 - protein, 36 aa, Artificial Sequence
  Description of Artificial Sequence: Synthetic polypeptide
DEGEIACTNPVATAQWGGCTVAITNALTQDDGQGDH

SEQ ID NO: 195631 - protein, 35 aa, Artificial Sequence
  Description of Artificial Sequence: Synthetic polypeptide
DEEEIACTNPVATEQWGAVACAQNPVNTAGEPTGT

SEQ ID NO: 195632 - protein, 38 aa, Artificial Sequence
  Description of Artificial Sequence: Synthetic polypeptide
DEGEIATTNPVAYEQYGSVCSPAGNHEGFATVGDNSAA

SEQ ID NO: 195633 - protein, 36 aa, Artificial Sequence
  Description of Artificial Sequence: Synthetic polypeptide
DEEEIACTNPVATEQWGATVCAQNPVDNTAGNPEGT

SEQ ID NO: 195634 - protein, 37 aa, Artificial Sequence
  Description of Artificial Sequence: Synthetic polypeptide
AEEEIRTTNPVATEYYGCSCSNWGEHNQENFGSDTQA

SEQ ID NO: 195635 - protein, 37 aa, Artificial Sequence
  Description of Artificial Sequence: Synthetic polypeptide
MEGEIRTTNPVATEQYGSVWPPDDNGVHTTFEDNYCD

SEQ ID NO: 195636 - protein, 37 aa, Artificial Sequence
  Description of Artificial Sequence: Synthetic polypeptide
MEGEIRTTNPVATEQYGSVWELDDNGVHTTFEDNYDD

SEQ ID NO: 195637 - protein, 38 aa, Artificial Sequence
  Description of Artificial Sequence: Synthetic polypeptide
DEGEIATTNPVAYEQYGSVCAMNNGELTNPDDQMEHRM

SEQ ID NO: 195638 - protein, 37 aa, Artificial Sequence
  Description of Artificial Sequence: Synthetic polypeptide
CEEEIACTNPVATEQYGSACAAANPQPQEHQDGNVHG

SEQ ID NO: 195639 - protein, 38 aa, Artificial Sequence
  Description of Artificial Sequence: Synthetic polypeptide
MEGEIRTTNPVATEWYGCSFVSVADNLTTEGGVQADEV

SEQ ID NO: 195640 - protein, 37 aa, Artificial Sequence
  Description of Artificial Sequence: Synthetic polypeptide
DEGEIATTNPVAYEQYGSVPANANHADQHAADDQTNE

SEQ ID NO: 195641 - protein, 36 aa, Artificial Sequence
  Description of Artificial Sequence: Synthetic polypeptide
DESCIRTTNPVATEGWGCVCSWGEENQEYFGSDNQG

SEQ ID NO: 195642 - protein, 34 aa, Artificial Sequence
  Description of Artificial Sequence: Synthetic polypeptide
DENEIRTTNPIATECWGATTANAEDWQEPKGPYL

SEQ ID NO: 195643 - protein, 37 aa, Artificial Sequence
  Description of Artificial Sequence: Synthetic polypeptide
QESEICTTNPVATEQYGTVVSATDGGDEEEEGGNNGI

SEQ ID NO: 195644 - protein, 38 aa, Artificial Sequence
  Description of Artificial Sequence: Synthetic polypeptide
DDEEIRTTNPVATEQYGCVCSNWEEDHNTEHFNSDTQS

SEQ ID NO: 195645 - protein, 38 aa, Artificial Sequence
  Description of Artificial Sequence: Synthetic polypeptide
DDEEIRTTNPVATEQYGCVCSNWEEDHNQEHFNSDTQA

SEQ ID NO: 195646 - protein, 37 aa, Artificial Sequence
  Description of Artificial Sequence: Synthetic polypeptide
CEEEIACTNPVATEQYGSACAATNPGVNAAGNDNADD

SEQ ID NO: 195647 - protein, 37 aa, Artificial Sequence
  Description of Artificial Sequence: Synthetic polypeptide
DEGEIATTNPVAYEQYGSVVAAAAGELQDSLDLNDSN

SEQ ID NO: 195648 - protein, 38 aa, Artificial Sequence
  Description of Artificial Sequence: Synthetic polypeptide
CEEEIACTNPVATEQYGSACAATNPAEEAGRHGDNDAP

SEQ ID NO: 195649 - protein, 36 aa, Artificial Sequence
  Description of Artificial Sequence: Synthetic polypeptide
DEHEIATTNPVATTQWGCVCIDWDNDMARNTGGDNL

SEQ ID NO: 195650 - protein, 33 aa, Artificial Sequence
  Description of Artificial Sequence: Synthetic polypeptide
DECEIATTNPCVYEQWGCVYGNPPGNAGEGDNS

SEQ ID NO: 195651 - protein, 33 aa, Artificial Sequence
  Description of Artificial Sequence: Synthetic polypeptide
DEGCISTTNPVAYEQWGCFSWDNGDFDNAKHAE

SEQ ID NO: 195652 - protein, 32 aa, Artificial Sequence
  Description of Artificial Sequence: Synthetic polypeptide
GEEEIATTNPVAYEQWGVAYYPEQPIEEHAGE

SEQ ID NO: 195653 - protein, 35 aa, Artificial Sequence
  Description of Artificial Sequence: Synthetic polypeptide
QAEEIATTNPVATEQYGCVAANNGPAEDPMENGHD

SEQ ID NO: 195654 - protein, 33 aa, Artificial Sequence
  Description of Artificial Sequence: Synthetic polypeptide
DEGCISTTNPVAYEQWGCFSWDNGDFDNLKDAY

SEQ ID NO: 195655 - protein, 33 aa, Artificial Sequence
  Description of Artificial Sequence: Synthetic polypeptide
DEGCISTTNPVAYEQWGCFSWDNGDFDNTKNPE

SEQ ID NO: 195656 - protein, 33 aa, Artificial Sequence
  Description of Artificial Sequence: Synthetic polypeptide
DENEIRTTNPIATECWGATTWANADWMNPKGDI

SEQ ID NO: 195657 - protein, 37 aa, Artificial Sequence
  Description of Artificial Sequence: Synthetic polypeptide
CEEEIACTNPVATEQYGSACAAANPAEADAQIGANTA

SEQ ID NO: 195658 - protein, 36 aa, Artificial Sequence
  Description of Artificial Sequence: Synthetic polypeptide
QAEEIATTNPVATEQYGCVANPGEGGGNESAEEGND

SEQ ID NO: 195659 - protein, 35 aa, Artificial Sequence
  Description of Artificial Sequence: Synthetic polypeptide
QEAEIACTNPVATEQWGCNVAGTNGLAEAEIGTDD

SEQ ID NO: 195660 - protein, 37 aa, Artificial Sequence
  Description of Artificial Sequence: Synthetic polypeptide
MEHEIATVNPAATEQYGSVIITNNGLGGGQEGGEETA

SEQ ID NO: 195661 - protein, 33 aa, Artificial Sequence
  Description of Artificial Sequence: Synthetic polypeptide
DENEIRTTNPIATECWGATTSNAEDIAEPKGPI

SEQ ID NO: 195662 - protein, 38 aa, Artificial Sequence
  Description of Artificial Sequence: Synthetic polypeptide
FEQEIRTTNPVATEQYGDVGQNNVDTPGQLGENGQGQL

SEQ ID NO: 195663 - protein, 33 aa, Artificial Sequence
  Description of Artificial Sequence: Synthetic polypeptide
DENEIRTTNPIATECWGATTWANADWMNPKGPI

SEQ ID NO: 195664 - protein, 35 aa, Artificial Sequence
  Description of Artificial Sequence: Synthetic polypeptide
DEASIATTNPVATEQYGCVAGNHSGDPAMNPGEEG

SEQ ID NO: 195665 - protein, 37 aa, Artificial Sequence
  Description of Artificial Sequence: Synthetic polypeptide
MEGEIRTTNPVATEQYGSVVEDYGGLFEFQNISQEET

SEQ ID NO: 195666 - protein, 39 aa, Artificial Sequence
  Description of Artificial Sequence: Synthetic polypeptide
GEEEIRTTNPVATEQYGSVAQRNPYLMAEEMHVGQPAQK

SEQ ID NO: 195667 - protein, 37 aa, Artificial Sequence
  Description of Artificial Sequence: Synthetic polypeptide
DEGEIACTNPVATEQYGSACAPANNHPLEAMAGNAEP

SEQ ID NO: 195668 - protein, 38 aa, Artificial Sequence
  Description of Artificial Sequence: Synthetic polypeptide
MEGEIRTTNPVATEQYGSVSSPAPAEGPNMVFEGSSDQ

SEQ ID NO: 195669 - protein, 31 aa, Artificial Sequence
  Description of Artificial Sequence: Synthetic polypeptide
QESEIATTNPVGTECWGATMWAADWQPGDYI

SEQ ID NO: 195670 - protein, 35 aa, Artificial Sequence
  Description of Artificial Sequence: Synthetic polypeptide
QAEEIATTNPVATEQYGCVAPGEGGHGNESAEEVN

SEQ ID NO: 195671 - protein, 35 aa, Artificial Sequence
  Description of Artificial Sequence: Synthetic polypeptide
QAEEIATTNPVATEQYGCVAPGEGGHGNESDEEEK

SEQ ID NO: 195672 - protein, 37 aa, Artificial Sequence
  Description of Artificial Sequence: Synthetic polypeptide
DEGEIACTNPVATEQYGSACSMANPHTAEAPMGDGNN

SEQ ID NO: 195673 - protein, 36 aa, Artificial Sequence
  Description of Artificial Sequence: Synthetic polypeptide
DEAVISTTNPVATEQWGCVCSTGEDDNQEYFGSDQA

SEQ ID NO: 195674 - protein, 39 aa, Artificial Sequence
  Description of Artificial Sequence: Synthetic polypeptide
HCEECEHRVRTNPNVAATSQFYGTSVVSTYNCQVGCSRH

SEQ ID NO: 195675 - protein, 37 aa, Artificial Sequence
  Description of Artificial Sequence: Synthetic polypeptide
HEAEIRTTNPVATEQYGSSAWPANNHMDERFEESNIS

SEQ ID NO: 195676 - protein, 37 aa, Artificial Sequence
  Description of Artificial Sequence: Synthetic polypeptide
HEAEIRTTNPVATEQYGSTIPWTPTLEENQHSQIEMQ

SEQ ID NO: 195677 - protein, 39 aa, Artificial Sequence
  Description of Artificial Sequence: Synthetic polypeptide
DEEEIRTTNPVATEQYGTMMFPPVPTPLIEHNVNIINSI

SEQ ID NO: 195678 - protein, 37 aa, Artificial Sequence
  Description of Artificial Sequence: Synthetic polypeptide
DENEIATTNPVAYEQYGSNCATANGNGLMNEGGHADQ

SEQ ID NO: 195679 - protein, 39 aa, Artificial Sequence
  Description of Artificial Sequence: Synthetic polypeptide
DEEEIRTTNPVATEQYGTGYTSLCPNLEAVSKVAAMRED

SEQ ID NO: 195680 - protein, 35 aa, Artificial Sequence
  Description of Artificial Sequence: Synthetic polypeptide
HEDEIRTTNPVAYECWGVVCSTWEQGDTGGGGTTE

SEQ ID NO: 195681 - protein, 35 aa, Artificial Sequence
  Description of Artificial Sequence: Synthetic polypeptide
DEASIATTNPTAYEQWGSYYSHDNHDGKRSNGGNW

SEQ ID NO: 195682 - protein, 34 aa, Artificial Sequence
  Description of Artificial Sequence: Synthetic polypeptide
DEQEIYTTNPVAFECWGSFGPCINEPEAREFENG

SEQ ID NO: 195683 - protein, 36 aa, Artificial Sequence
  Description of Artificial Sequence: Synthetic polypeptide
DEAEIATTNPVATEQYGSACSAPMPGAEAAPEDGRN

SEQ ID NO: 195684 - protein, 36 aa, Artificial Sequence
  Description of Artificial Sequence: Synthetic polypeptide
QAEEIATTNPVATEQYGCVAPGEGGHGQEAAEEGNK

SEQ ID NO: 195685 - protein, 35 aa, Artificial Sequence
  Description of Artificial Sequence: Synthetic polypeptide
DEGEIACTNPVATEQYGSVCAAMAHGEADMPPGEN

SEQ ID NO: 195686 - protein, 37 aa, Artificial Sequence
  Description of Artificial Sequence: Synthetic polypeptide
DEGEIACTNPVATEQYGSACAPAANHPLEAMIGNAEE

SEQ ID NO: 195687 - protein, 37 aa, Artificial Sequence
  Description of Artificial Sequence: Synthetic polypeptide
DEEEIRTTNPVATEGYGMVSVQGMGDGGQGQEAEIGT

SEQ ID NO: 195688 - protein, 38 aa, Artificial Sequence
  Description of Artificial Sequence: Synthetic polypeptide
MEGEIRTTNPVATEQYGSVSSPAPAEGPNTVFEGLSDC

SEQ ID NO: 195689 - protein, 35 aa, Artificial Sequence
  Description of Artificial Sequence: Synthetic polypeptide
DEASIATTNPTAYEQWGSYYSFDNQDLKRSNGGSG

SEQ ID NO: 195690 - protein, 36 aa, Artificial Sequence
  Description of Artificial Sequence: Synthetic polypeptide
CEEEIACTNPVATEQYGSACAANDIGQLHADENDHH

SEQ ID NO: 195691 - protein, 38 aa, Artificial Sequence
  Description of Artificial Sequence: Synthetic polypeptide
DEEEIRTTNPVATEGYGQCVCSWGEDHNQENFNSDTQS

SEQ ID NO: 195692 - protein, 35 aa, Artificial Sequence
  Description of Artificial Sequence: Synthetic polypeptide
DEEEIACTNPVATEQWGAICAQNPPVNTAGNTEGT

SEQ ID NO: 195693 - protein, 36 aa, Artificial Sequence
  Description of Artificial Sequence: Synthetic polypeptide
DEEEIACTNPVATEQWGAFVCAQGPVNTAGNPTGSR

SEQ ID NO: 195694 - protein, 35 aa, Artificial Sequence
  Description of Artificial Sequence: Synthetic polypeptide
DEHEIATTNPVAYEQWGVAAYTVGNGNLGEHMGGE

SEQ ID NO: 195695 - protein, 35 aa, Artificial Sequence
  Description of Artificial Sequence: Synthetic polypeptide
CEEVIACTNPVATEQWGSVSNMNNSNAAGTPGESQ

SEQ ID NO: 195696 - protein, 38 aa, Artificial Sequence
  Description of Artificial Sequence: Synthetic polypeptide
DENEIRTTNCVATEQYGVVSVVDNPNMDGQNDEGGDGT

SEQ ID NO: 195697 - protein, 35 aa, Artificial Sequence
  Description of Artificial Sequence: Synthetic polypeptide
QAEEIATTNPVATEQYGCVAPGEGGGNESMEEEKN

SEQ ID NO: 195698 - protein, 37 aa, Artificial Sequence
  Description of Artificial Sequence: Synthetic polypeptide
DENEIRTTNCVATEQYGMVSVEGMGGGQGQEGTEDGM

SEQ ID NO: 195699 - protein, 35 aa, Artificial Sequence
  Description of Artificial Sequence: Synthetic polypeptide
DEGEIACTNPVATEQWGAVCAQNPVQETAGEPTGT

SEQ ID NO: 195700 - protein, 36 aa, Artificial Sequence
  Description of Artificial Sequence: Synthetic polypeptide
DEGEIACTNPVATEQWGSVSATGDEEAGTEGGEEAW

SEQ ID NO: 195701 - protein, 34 aa, Artificial Sequence
  Description of Artificial Sequence: Synthetic polypeptide
QAEEIATTNPVATEQYGCVAPGEGGGQESEEMAK

SEQ ID NO: 195702 - protein, 37 aa, Artificial Sequence
  Description of Artificial Sequence: Synthetic polypeptide
DENEIRTTNCVATEAYGSVVVANNGQDQQDGGQEGQD

SEQ ID NO: 195703 - protein, 36 aa, Artificial Sequence
  Description of Artificial Sequence: Synthetic polypeptide
DEASIATTNPTAYEQWGSYYSFDNPDLKRSNGGSQR

SEQ ID NO: 195704 - protein, 37 aa, Artificial Sequence
  Description of Artificial Sequence: Synthetic polypeptide
DENEIATTNPVAYEQYGSACAATNPQEVNDDGMGDDH

SEQ ID NO: 195705 - protein, 37 aa, Artificial Sequence
  Description of Artificial Sequence: Synthetic polypeptide
DECEAEIRTTNPVAYEPWGVASTGDNDRPGERQDNHD

SEQ ID NO: 195706 - protein, 38 aa, Artificial Sequence
  Description of Artificial Sequence: Synthetic polypeptide
DEEEIRTTNPVATEGYGMVSVEGMGDGGQGQEANEDTT

SEQ ID NO: 195707 - protein, 36 aa, Artificial Sequence
  Description of Artificial Sequence: Synthetic polypeptide
GMGEIRTTNPVATEQYGSCSVTAVEHCDEELIEEHV

SEQ ID NO: 195708 - protein, 37 aa, Artificial Sequence
  Description of Artificial Sequence: Synthetic polypeptide
DENEIATTNPVAYEQYGSACSAGDHLANGAPMGEGNH

SEQ ID NO: 195709 - protein, 37 aa, Artificial Sequence
  Description of Artificial Sequence: Synthetic polypeptide
DEEEIRTTNPVATEGYGMVSVEGMGDGGQGQEDEDGT

SEQ ID NO: 195710 - protein, 35 aa, Artificial Sequence
  Description of Artificial Sequence: Synthetic polypeptide
DEASIACTNPVATEQYGSVCAAGPSQGMHNDEDAH

SEQ ID NO: 195711 - protein, 31 aa, Artificial Sequence
  Description of Artificial Sequence: Synthetic polypeptide
DENEIATTNPIATECWGATVANADWAHEEYL

SEQ ID NO: 195712 - protein, 38 aa, Artificial Sequence
  Description of Artificial Sequence: Synthetic polypeptide
DDEEIKTTNPVATEQYGAVNMGNTIDQTGDQEEGGNQI

SEQ ID NO: 195713 - protein, 39 aa, Artificial Sequence
  Description of Artificial Sequence: Synthetic polypeptide
DEEEIRTTNPVAYEQYGQVAVMQFQMNDLLQPNGQIPYF

SEQ ID NO: 195714 - protein, 38 aa, Artificial Sequence
  Description of Artificial Sequence: Synthetic polypeptide
DEEEIRCTNPVATEQYGCVCSNWGEDHNAENFNSENQL

SEQ ID NO: 195715 - protein, 33 aa, Artificial Sequence
  Description of Artificial Sequence: Synthetic polypeptide
AEAEIASTNPVGYEAYGVVSAYSPGLSQHVGDI

SEQ ID NO: 195716 - protein, 36 aa, Artificial Sequence
  Description of Artificial Sequence: Synthetic polypeptide
DEMAIGTTNPVATEQWGCVCSTGEDDNAEYFGSDQA

SEQ ID NO: 195717 - protein, 38 aa, Artificial Sequence
  Description of Artificial Sequence: Synthetic polypeptide
DEEEIRTTNPVATEQYGSYHNCCCSEGPIEMEEQEILI

SEQ ID NO: 195718 - protein, 37 aa, Artificial Sequence
  Description of Artificial Sequence: Synthetic polypeptide
DENAISTTNPVATEQYGCVCSWGEDHNQENFGSDNQS

SEQ ID NO: 195719 - protein, 33 aa, Artificial Sequence
  Description of Artificial Sequence: Synthetic polypeptide
EITEIATTNPVAYERWGVVSWNNTGNAGEDGAD

SEQ ID NO: 195720 - protein, 36 aa, Artificial Sequence
  Description of Artificial Sequence: Synthetic polypeptide
DEGEIRTTNPVAYESYGSVICCLGGHSHTEGGTLKL

SEQ ID NO: 195721 - protein, 36 aa, Artificial Sequence
  Description of Artificial Sequence: Synthetic polypeptide
NESEIRTTNPVATEQYGSVPYQTDEETITPSIEEWD

SEQ ID NO: 195722 - protein, 36 aa, Artificial Sequence
  Description of Artificial Sequence: Synthetic polypeptide
CEEEIACTNPVATEQYGSACSAANGTPAEAPIGDHQ

SEQ ID NO: 195723 - protein, 38 aa, Artificial Sequence
  Description of Artificial Sequence: Synthetic polypeptide
SEAEIRTTNPVATECYGGYGSDNVGEDRGGEDGGENER

SEQ ID NO: 195724 - protein, 37 aa, Artificial Sequence
  Description of Artificial Sequence: Synthetic polypeptide
DEEEIACTNPVATEQYGSVCAAIEHLDAGAPLDEDAA

SEQ ID NO: 195725 - protein, 38 aa, Artificial Sequence
  Description of Artificial Sequence: Synthetic polypeptide
QEPEIRGTNPVATEQYGSVAIPGNLNLEGGGQTEGEDG

SEQ ID NO: 195726 - protein, 37 aa, Artificial Sequence
  Description of Artificial Sequence: Synthetic polypeptide
DDEEIRCTNPVATEQYGQCSCSWGEHNAENFISDNQA

SEQ ID NO: 195727 - protein, 35 aa, Artificial Sequence
  Description of Artificial Sequence: Synthetic polypeptide
DENDEIATTNPVAYERWGSVSGGNPGNAGEDDGQA

SEQ ID NO: 195728 - protein, 38 aa, Artificial Sequence
  Description of Artificial Sequence: Synthetic polypeptide
DDEEIRATNPVATEQYGSVYGQGQGDLEVGNGGFEEIE

SEQ ID NO: 195729 - protein, 36 aa, Artificial Sequence
  Description of Artificial Sequence: Synthetic polypeptide
CEEEIACTNPVAYEQYGSACGATMGLQNSMNDEANN

SEQ ID NO: 195730 - protein, 36 aa, Artificial Sequence
  Description of Artificial Sequence: Synthetic polypeptide
DEGQIATTNPVATASWGSVAGTNHGPLASGEGNGTN

SEQ ID NO: 195731 - protein, 34 aa, Artificial Sequence
  Description of Artificial Sequence: Synthetic polypeptide
ENEEIATTNPVAYEQWGVTYYTWTQGDHQRTDRP

SEQ ID NO: 195732 - protein, 35 aa, Artificial Sequence
  Description of Artificial Sequence: Synthetic polypeptide
ENSEEIACTNPVAYEKWGEVATGNMMDQRQGMNTG

SEQ ID NO: 195733 - protein, 37 aa, Artificial Sequence
  Description of Artificial Sequence: Synthetic polypeptide
NEEEIRTTNPVAYEQWGCSYTVPMDDTDQRERHRPNS

SEQ ID NO: 195734 - protein, 39 aa, Artificial Sequence
  Description of Artificial Sequence: Synthetic polypeptide
DDEEIRCTNPVATEQYGQCQVCSNWGNHNQENFGSDNQS

SEQ ID NO: 195735 - protein, 32 aa, Artificial Sequence
  Description of Artificial Sequence: Synthetic polypeptide
EEVEIATTNPVAYECWGTVYYVEDIGQHEENA

SEQ ID NO: 195736 - protein, 31 aa, Artificial Sequence
  Description of Artificial Sequence: Synthetic polypeptide
EEVEIATTNPVAYECWGTVYYVEDHHGHEED

SEQ ID NO: 195737 - protein, 37 aa, Artificial Sequence
  Description of Artificial Sequence: Synthetic polypeptide
CEEEIACTNPVATEQYGSACSADNPLPAEAPLGDAHQ

SEQ ID NO: 195738 - protein, 36 aa, Artificial Sequence
  Description of Artificial Sequence: Synthetic polypeptide
NEQEIRTTNPVATEQYGSCITVPYEEEMPEGSEFKS

SEQ ID NO: 195739 - protein, 36 aa, Artificial Sequence
  Description of Artificial Sequence: Synthetic polypeptide
DEHCIATVNPVATECYGSVVCIDDNQDDRRQQTGER

SEQ ID NO: 195740 - protein, 35 aa, Artificial Sequence
  Description of Artificial Sequence: Synthetic polypeptide
DENCIATVNPVATECYGNVVCIDHQDQERQGTNET

SEQ ID NO: 195741 - protein, 38 aa, Artificial Sequence
  Description of Artificial Sequence: Synthetic polypeptide
SEAEIACTNPVATEQYGSVCSPTNHAGFNEAPMGEGNH

SEQ ID NO: 195742 - protein, 36 aa, Artificial Sequence
  Description of Artificial Sequence: Synthetic polypeptide
DEECISTTNPVATEGYGCVCGSGEADNQYFGSDTQS

SEQ ID NO: 195743 - protein, 38 aa, Artificial Sequence
  Description of Artificial Sequence: Synthetic polypeptide
DEEEIRTTNPVATEQYGSYVCVETTAMEMEEVIEEMDE

SEQ ID NO: 195744 - protein, 37 aa, Artificial Sequence
  Description of Artificial Sequence: Synthetic polypeptide
AEEEISTTNPVATEQYGQCVCSWGEDNQENFNSEPQS

SEQ ID NO: 195745 - protein, 33 aa, Artificial Sequence
  Description of Artificial Sequence: Synthetic polypeptide
ETEEIATTNPCAYEEWGCVYYIVDEQRGQGNHG

SEQ ID NO: 195746 - protein, 37 aa, Artificial Sequence
  Description of Artificial Sequence: Synthetic polypeptide
SEAEIRTTNPVATEQYGASAVVAWPVHHLEGQEDQEM

SEQ ID NO: 195747 - protein, 39 aa, Artificial Sequence
  Description of Artificial Sequence: Synthetic polypeptide
NENEIRTTNPVATEFYGEVSTTDGGNNLLSEEDEGNPGP

SEQ ID NO: 195748 - protein, 34 aa, Artificial Sequence
  Description of Artificial Sequence: Synthetic polypeptide
EGEEIATTNPVAYEQWGSCVTWAEGDQKHGRTDG

SEQ ID NO: 195749 - protein, 37 aa, Artificial Sequence
  Description of Artificial Sequence: Synthetic polypeptide
DEEEIRTTNPVATEQYGSYCNWPEIPGEDAPEKDIQG

SEQ ID NO: 195750 - protein, 36 aa, Artificial Sequence
  Description of Artificial Sequence: Synthetic polypeptide
CESEIATTNPCATEQWGTVCSLTGEEDSSNMNGGNP

SEQ ID NO: 195751 - protein, 35 aa, Artificial Sequence
  Description of Artificial Sequence: Synthetic polypeptide
EGEEIATTNPVAYEQWGSCVTLITEGDQKHGRTTK

SEQ ID NO: 195752 - protein, 33 aa, Artificial Sequence
  Description of Artificial Sequence: Synthetic polypeptide
ENSEIATTNPVAYEQWGVTYYTWLQGDHQQHDR

SEQ ID NO: 195753 - protein, 40 aa, Artificial Sequence
  Description of Artificial Sequence: Synthetic polypeptide
DEEEIKTTNPVATEQYGSVSVGQAEQNSGGQNGEGQEGIT

SEQ ID NO: 195754 - protein, 38 aa, Artificial Sequence
  Description of Artificial Sequence: Synthetic polypeptide
QEDEIRGTNPVATEQYGSVQIPGNLNGEGGGQTEGEDG

SEQ ID NO: 195755 - protein, 34 aa, Artificial Sequence
  Description of Artificial Sequence: Synthetic polypeptide
QEQDIRTTNPVATECWGSFGPCINEPEARETENG

SEQ ID NO: 195756 - protein, 38 aa, Artificial Sequence
  Description of Artificial Sequence: Synthetic polypeptide
CEEEISTTNPVATEQYGQCVCSNWGEDTNQNFGSDTQS

SEQ ID NO: 195757 - protein, 36 aa, Artificial Sequence
  Description of Artificial Sequence: Synthetic polypeptide
CEEEIACTNPVAYEQYGSACSVNPHQNEHQDGTEMK

SEQ ID NO: 195758 - protein, 37 aa, Artificial Sequence
  Description of Artificial Sequence: Synthetic polypeptide
DDEEIRCTNPVATEQYGCVCSNWGEHNTEYSNSQTQS

SEQ ID NO: 195759 - protein, 38 aa, Artificial Sequence
  Description of Artificial Sequence: Synthetic polypeptide
SEAEIRTTNPVATEQYGSVCENFHVPNQSMESTQFHRR

SEQ ID NO: 195760 - protein, 35 aa, Artificial Sequence
  Description of Artificial Sequence: Synthetic polypeptide
DEAVIGTTNPVATEQWGCVCSNWDDHQEYFGSDQS

SEQ ID NO: 195761 - protein, 38 aa, Artificial Sequence
  Description of Artificial Sequence: Synthetic polypeptide
QEDEIRGTNCVATEQYGSVMTGDNMNLVGEGGQGNDGD

SEQ ID NO: 195762 - protein, 35 aa, Artificial Sequence
  Description of Artificial Sequence: Synthetic polypeptide
CEEEIACTNPVATESYGCVAATAGGTTAEGPNENQ

SEQ ID NO: 195763 - protein, 36 aa, Artificial Sequence
  Description of Artificial Sequence: Synthetic polypeptide
ESEAEIRTTNPVAYEQWGVVYQWGTNPPGERGDSST

SEQ ID NO: 195764 - protein, 32 aa, Artificial Sequence
  Description of Artificial Sequence: Synthetic polypeptide
ETEEIATTNPCAYEEWGCVYYIVDEQHGQGNE

SEQ ID NO: 195765 - protein, 36 aa, Artificial Sequence
  Description of Artificial Sequence: Synthetic polypeptide
AEAEIATTNPVAYEQWGVVVHTDQGLDQNRAGEGGG

SEQ ID NO: 195766 - protein, 37 aa, Artificial Sequence
  Description of Artificial Sequence: Synthetic polypeptide
AAEEIATTNPVATEQYGSVCAANMGEEAPDAQAEGGD

SEQ ID NO: 195767 - protein, 37 aa, Artificial Sequence
  Description of Artificial Sequence: Synthetic polypeptide
DEREISTTNPVATEQYGCVCSNWEDHNQENFNSDTQA

SEQ ID NO: 195768 - protein, 35 aa, Artificial Sequence
  Description of Artificial Sequence: Synthetic polypeptide
SEDEIACTNPVATEQYGSCSAGPPGANGALMGAQE

SEQ ID NO: 195769 - protein, 37 aa, Artificial Sequence
  Description of Artificial Sequence: Synthetic polypeptide
CESEIATTNPCATEQYGTVCSATGEEWSENMNSGNED

SEQ ID NO: 195770 - protein, 38 aa, Artificial Sequence
  Description of Artificial Sequence: Synthetic polypeptide
CEEEIACTNPVATEQYGVSTACAANPIEQEAEHGQDNQ

SEQ ID NO: 195771 - protein, 38 aa, Artificial Sequence
  Description of Artificial Sequence: Synthetic polypeptide
DEGESEIATTNPVAYEQWGSVAKTLEANGDGDGGGNTP

SEQ ID NO: 195772 - protein, 37 aa, Artificial Sequence
  Description of Artificial Sequence: Synthetic polypeptide
QEPEIGTTNPVATEQYGTVVSATDGDDEEFGEGGNDE

SEQ ID NO: 195773 - protein, 38 aa, Artificial Sequence
  Description of Artificial Sequence: Synthetic polypeptide
DDEEIRTTNPVATEQYGSVTGFGQGDILVGEGGDEETA

SEQ ID NO: 195774 - protein, 38 aa, Artificial Sequence
  Description of Artificial Sequence: Synthetic polypeptide
DEEEIRTTNPVAYEQYGQVAHSFQMEDLLHPNGQIPYF

SEQ ID NO: 195775 - protein, 37 aa, Artificial Sequence
  Description of Artificial Sequence: Synthetic polypeptide
AEEEISTTNPVATEQYGQCVCSSGEHNQENFGSDTQS

SEQ ID NO: 195776 - protein, 37 aa, Artificial Sequence
  Description of Artificial Sequence: Synthetic polypeptide
DEEEIRTTNPVATEGYGCVCGNWGEHNTEYFISDTQA

SEQ ID NO: 195777 - protein, 38 aa, Artificial Sequence
  Description of Artificial Sequence: Synthetic polypeptide
CEEEIACTNPVATEQYGVSTACAANDGDPLGSMEGNEH

SEQ ID NO: 195778 - protein, 37 aa, Artificial Sequence
  Description of Artificial Sequence: Synthetic polypeptide
DEEEIACTNPVATEQYGSVCAAPDGPIENNDDLGAQA

SEQ ID NO: 195779 - protein, 34 aa, Artificial Sequence
  Description of Artificial Sequence: Synthetic polypeptide
SEAEIACTNPVATEQWGCWNATGNPLPAPMENHN

SEQ ID NO: 195780 - protein, 32 aa, Artificial Sequence
  Description of Artificial Sequence: Synthetic polypeptide
EEVEIATTNPVAYECWGTVYYVEDTNRHEEED

SEQ ID NO: 195781 - protein, 36 aa, Artificial Sequence
  Description of Artificial Sequence: Synthetic polypeptide
CEEEIACTNPVATEQYGSACSAGDIGLNHADEAGHH

SEQ ID NO: 195782 - protein, 34 aa, Artificial Sequence
  Description of Artificial Sequence: Synthetic polypeptide
AEAEIATTNPVAYEPWGSVYGGWDDQPQGNNGQP

SEQ ID NO: 195783 - protein, 37 aa, Artificial Sequence
  Description of Artificial Sequence: Synthetic polypeptide
DEEEIKTTNPVATEQYGMVSVEGMGDGGQGQEMEVGT

SEQ ID NO: 195784 - protein, 35 aa, Artificial Sequence
  Description of Artificial Sequence: Synthetic polypeptide
DENCIATVNPVATECYGSVVCIDHQDQNRQGDTEM

SEQ ID NO: 195785 - protein, 31 aa, Artificial Sequence
  Description of Artificial Sequence: Synthetic polypeptide
EESEISTTNPVAYECWGCVYYVEDIHQHEEA

SEQ ID NO: 195786 - protein, 33 aa, Artificial Sequence
  Description of Artificial Sequence: Synthetic polypeptide
ENPEIATTNPVAYEQWGVYATWDQMDLGPNMPG

SEQ ID NO: 195787 - protein, 36 aa, Artificial Sequence
  Description of Artificial Sequence: Synthetic polypeptide
DEGEIRTTNPVAYESYGSVTCLGGEHSHTEGGTFKL

SEQ ID NO: 195788 - protein, 34 aa, Artificial Sequence
  Description of Artificial Sequence: Synthetic polypeptide
EGEAEIATTNPCAYEHWGSVCYNNDDQDHGQNDK

SEQ ID NO: 195789 - protein, 33 aa, Artificial Sequence
  Description of Artificial Sequence: Synthetic polypeptide
ENPEIATTNPVAYEQWGVYATWDQGDLGPNMQP

SEQ ID NO: 195790 - protein, 37 aa, Artificial Sequence
  Description of Artificial Sequence: Synthetic polypeptide
AEEEISTTNPVATEQYGQCYCSNSGEHQENFNSDNQS

SEQ ID NO: 195791 - protein, 37 aa, Artificial Sequence
  Description of Artificial Sequence: Synthetic polypeptide
DEEEIRTTNPVATEQYGSYTYAPIGIQQQLSVEEYCS

SEQ ID NO: 195792 - protein, 35 aa, Artificial Sequence
  Description of Artificial Sequence: Synthetic polypeptide
NENEIRTTNPVATEQYGSVMWAAYHEDEFIMSSQN

SEQ ID NO: 195793 - protein, 37 aa, Artificial Sequence
  Description of Artificial Sequence: Synthetic polypeptide
AEEEISTTNPVATEQYGQCVCSWGEHNQENFGSDFQP

SEQ ID NO: 195794 - protein, 33 aa, Artificial Sequence
  Description of Artificial Sequence: Synthetic polypeptide
QENEIATTNPVAYAPYGNTVAGEGHLQHKMNMK

SEQ ID NO: 195795 - protein, 38 aa, Artificial Sequence
  Description of Artificial Sequence: Synthetic polypeptide
DDEEIRATNPVATEQYGSVYGQGQGQLEVGNGGFENTM

SEQ ID NO: 195796 - protein, 37 aa, Artificial Sequence
  Description of Artificial Sequence: Synthetic polypeptide
DECEIATTNPVAYEQWGSVSGGEPGNGGNMRNMAEMM

SEQ ID NO: 195797 - protein, 38 aa, Artificial Sequence
  Description of Artificial Sequence: Synthetic polypeptide
DEEEIRTTNPVATEQYGSYCNWPEIPLLDGADEKDIEG

SEQ ID NO: 195798 - protein, 33 aa, Artificial Sequence
  Description of Artificial Sequence: Synthetic polypeptide
DDSEVASTNPVSYEGYGNVACNTISQNRTGGQR

SEQ ID NO: 195799 - protein, 34 aa, Artificial Sequence
  Description of Artificial Sequence: Synthetic polypeptide
DEHCIRTTNPVAYEQWGTYVYNQDSDDDRGEDDI

SEQ ID NO: 195800 - protein, 38 aa, Artificial Sequence
  Description of Artificial Sequence: Synthetic polypeptide
NEQEIRTTNPVATEQYGCQWTSAVSAENPIIDESTQYR

SEQ ID NO: 195801 - protein, 33 aa, Artificial Sequence
  Description of Artificial Sequence: Synthetic polypeptide
ETEEIATTNPCAYEEWGCVYYIVDEQQRGQGND

SEQ ID NO: 195802 - protein, 37 aa, Artificial Sequence
  Description of Artificial Sequence: Synthetic polypeptide
DEHEIATTNPCATEHWGTVCSTWEHQQQDRQMEGNQP

SEQ ID NO: 195803 - protein, 38 aa, Artificial Sequence
  Description of Artificial Sequence: Synthetic polypeptide
CEEEIACTNPVATEQYGSACSPTPDGHPLGAMEGFDNQ

SEQ ID NO: 195804 - protein, 32 aa, Artificial Sequence
  Description of Artificial Sequence: Synthetic polypeptide
DENEIASTNPVSTEPYGVCYCEDGQQQQNGME

SEQ ID NO: 195805 - protein, 36 aa, Artificial Sequence
  Description of Artificial Sequence: Synthetic polypeptide
CEEEIACTNPVAYEQYGSACAANPQPQEHQDGNVHK

SEQ ID NO: 195806 - protein, 39 aa, Artificial Sequence
  Description of Artificial Sequence: Synthetic polypeptide
DEEEIRTTNPVATEQYGSNIVTWSVHDEEQNNEPEITEE

SEQ ID NO: 195807 - protein, 36 aa, Artificial Sequence
  Description of Artificial Sequence: Synthetic polypeptide
SEAEIRTTNPVATEQYGCWYNAPPNHLVQDSAEEQN

SEQ ID NO: 195808 - protein, 35 aa, Artificial Sequence
  Description of Artificial Sequence: Synthetic polypeptide
DEGNEIATTNPVAYERWGVCATNNLDPGDHPNDAE

SEQ ID NO: 195809 - protein, 36 aa, Artificial Sequence
  Description of Artificial Sequence: Synthetic polypeptide
SEAEIRTTNPVATEQYGCVCGWGAHNQENFNSDTQA

SEQ ID NO: 195810 - protein, 34 aa, Artificial Sequence
  Description of Artificial Sequence: Synthetic polypeptide
AEAEIATTNPEATDAYGQVCCCDQDQKREGGHHR

SEQ ID NO: 195811 - protein, 38 aa, Artificial Sequence
  Description of Artificial Sequence: Synthetic polypeptide
CEEEIACTNPVATEQYGSACSPTPDGEPLEAAEGFDNQ

SEQ ID NO: 195812 - protein, 38 aa, Artificial Sequence
  Description of Artificial Sequence: Synthetic polypeptide
AEEEISTTNPVATEQYGQCVCSWGELHNEENFGSDNQS

SEQ ID NO: 195813 - protein, 37 aa, Artificial Sequence
  Description of Artificial Sequence: Synthetic polypeptide
DEGPISMTNPVAYEAYGSTVPSCTVELSQMTDENNRF

SEQ ID NO: 195814 - protein, 33 aa, Artificial Sequence
  Description of Artificial Sequence: Synthetic polypeptide
ENEEIATTNPVAYEQWGVYATWDQGDLHPNMPG

SEQ ID NO: 195815 - protein, 39 aa, Artificial Sequence
  Description of Artificial Sequence: Synthetic polypeptide
DEEEIRTTNPVATEQYGSYAISPTATPYHEVSPMQDEVN

SEQ ID NO: 195816 - protein, 36 aa, Artificial Sequence
  Description of Artificial Sequence: Synthetic polypeptide
NEEEISTTNPVAYEQYGCSCSWGEHNAEHFQSDTQA

SEQ ID NO: 195817 - protein, 35 aa, Artificial Sequence
  Description of Artificial Sequence: Synthetic polypeptide
NENEIATTNPVAYEQWGKTFVTLNAWSQNDVGTRF

SEQ ID NO: 195818 - protein, 33 aa, Artificial Sequence
  Description of Artificial Sequence: Synthetic polypeptide
EEVEIATTNPVAYECWGCVYYNEQHQIQHEREA

SEQ ID NO: 195819 - protein, 38 aa, Artificial Sequence
  Description of Artificial Sequence: Synthetic polypeptide
DEEEIRTTNPVATEQYGSYVEHPVGVWEAIRPMMEVGQ

SEQ ID NO: 195820 - protein, 35 aa, Artificial Sequence
  Description of Artificial Sequence: Synthetic polypeptide
ENCEIATTNPVATTQWGNVSKTWNPNEQQAQEGEA

SEQ ID NO: 195821 - protein, 37 aa, Artificial Sequence
  Description of Artificial Sequence: Synthetic polypeptide
DDEEIRCTNPVATEQYGQCVCSWGEHNIENSGSQTQS

SEQ ID NO: 195822 - protein, 36 aa, Artificial Sequence
  Description of Artificial Sequence: Synthetic polypeptide
CESEIATTNPCATEAYGTVCSDTGVEVSENMNGGNP

SEQ ID NO: 195823 - protein, 37 aa, Artificial Sequence
  Description of Artificial Sequence: Synthetic polypeptide
NEREIRTTNPVATEQYGCVCGNWGEHNQESFGSDTQS

SEQ ID NO: 195824 - protein, 37 aa, Artificial Sequence
  Description of Artificial Sequence: Synthetic polypeptide
NEEEIRTTNPVAYEQWGVVSGGEPANGPNMRNGGGVV

SEQ ID NO: 195825 - protein, 35 aa, Artificial Sequence
  Description of Artificial Sequence: Synthetic polypeptide
NESEIATTNPVAYEQWGSCATGGWNDERNMDGGEE

SEQ ID NO: 195826 - protein, 37 aa, Artificial Sequence
  Description of Artificial Sequence: Synthetic polypeptide
QEDEIRTTNPVATESYGSVVMGEAVNGDEDEGEENEG

SEQ ID NO: 195827 - protein, 33 aa, Artificial Sequence
  Description of Artificial Sequence: Synthetic polypeptide
DEMAIATTNSVATEYYGMVCAATTGEVEFEVND

SEQ ID NO: 195828 - protein, 37 aa, Artificial Sequence
  Description of Artificial Sequence: Synthetic polypeptide
DEEEIACTNPVATEQYGSVCAAIEHLDAGDPLAEDAW

SEQ ID NO: 195829 - protein, 38 aa, Artificial Sequence
  Description of Artificial Sequence: Synthetic polypeptide
QEDEIRTTNPVATESYGSVDTVMTANEGDEDLNEDGQE

SEQ ID NO: 195830 - protein, 38 aa, Artificial Sequence
  Description of Artificial Sequence: Synthetic polypeptide
DEEEIKTTNPVATEFYGVVINMQTNQEGQGDEQGGEEN

SEQ ID NO: 195831 - protein, 39 aa, Artificial Sequence
  Description of Artificial Sequence: Synthetic polypeptide
DEEEIRTTNPVATEQYGSYAISPTATPLHVVSPMIEEKN

SEQ ID NO: 195832 - protein, 35 aa, Artificial Sequence
  Description of Artificial Sequence: Synthetic polypeptide
NENEIATTNPVATEGYGCVCSWELNQEHFISETQA

SEQ ID NO: 195833 - protein, 31 aa, Artificial Sequence
  Description of Artificial Sequence: Synthetic polypeptide
EEVEIATTNPVAYECWGCVYYEDIHQMEDAN

SEQ ID NO: 195834 - protein, 37 aa, Artificial Sequence
  Description of Artificial Sequence: Synthetic polypeptide
DENEIRTTNPVATEIYGQCVCSNWGEHNQENFGSDQA

SEQ ID NO: 195835 - protein, 31 aa, Artificial Sequence
  Description of Artificial Sequence: Synthetic polypeptide
EEVEIATTNPVAYECWGCVYYGEHGQHEQEA

SEQ ID NO: 195836 - protein, 34 aa, Artificial Sequence
  Description of Artificial Sequence: Synthetic polypeptide
DEMAIATTNCVATEQYGCTVCAATDGEVEFEVND

SEQ ID NO: 195837 - protein, 34 aa, Artificial Sequence
  Description of Artificial Sequence: Synthetic polypeptide
AEAEIATTNPVAYERWGSVYYINDNGDYNRNDND

SEQ ID NO: 195838 - protein, 33 aa, Artificial Sequence
  Description of Artificial Sequence: Synthetic polypeptide
AEAEIASTNPVGYEHYGVVMAYSPGLSQHVGDM

SEQ ID NO: 195839 - protein, 33 aa, Artificial Sequence
  Description of Artificial Sequence: Synthetic polypeptide
AEAEIASTNPVGYEAYGEVMAYSPGLSQHVGEI

SEQ ID NO: 195840 - protein, 36 aa, Artificial Sequence
  Description of Artificial Sequence: Synthetic polypeptide
QEDEIRTTNPVATEFYGVVYTDQGQDQTDEGEQGGI

SEQ ID NO: 195841 - protein, 38 aa, Artificial Sequence
  Description of Artificial Sequence: Synthetic polypeptide
DDEEIRCTNPVATEQYGQCSCSWGEGHNQENFGSDNQA

SEQ ID NO: 195842 - protein, 36 aa, Artificial Sequence
  Description of Artificial Sequence: Synthetic polypeptide
CENEICTTNPVATEQYGSAATWTYDPQTQFQSNQIM

SEQ ID NO: 195843 - protein, 37 aa, Artificial Sequence
  Description of Artificial Sequence: Synthetic polypeptide
DEEEIRCTNPVATEQYGCVCSNWGEHNAEYFISDTQS

SEQ ID NO: 195844 - protein, 38 aa, Artificial Sequence
  Description of Artificial Sequence: Synthetic polypeptide
AEEEISTTNPVATEQYGQCVCSNWMEHNQENFGSDNQE

SEQ ID NO: 195845 - protein, 36 aa, Artificial Sequence
  Description of Artificial Sequence: Synthetic polypeptide
QEDEIRTTNPVATEFYGVVYTDQGQDQNDEGGQTGI

SEQ ID NO: 195846 - protein, 33 aa, Artificial Sequence
  Description of Artificial Sequence: Synthetic polypeptide
YETEIRTTNPVATEQWGATWAAEDWAEPKGPYI

SEQ ID NO: 195847 - protein, 35 aa, Artificial Sequence
  Description of Artificial Sequence: Synthetic polypeptide
NESEIATTNPVAYEQWGSCATGGLNDERNMDRGDL

SEQ ID NO: 195848 - protein, 33 aa, Artificial Sequence
  Description of Artificial Sequence: Synthetic polypeptide
EEVEIATTNPVAYECWGCVYYNEHQIQDHEENA

SEQ ID NO: 195849 - protein, 38 aa, Artificial Sequence
  Description of Artificial Sequence: Synthetic polypeptide
SEAEIATTNPVATEQYGSVCAMNNGVLPEGADGGNYNQ

SEQ ID NO: 195850 - protein, 37 aa, Artificial Sequence
  Description of Artificial Sequence: Synthetic polypeptide
QEDEIRTTNPVAYEQYGTICSCHVNSLSQTSTEENPP

SEQ ID NO: 195851 - protein, 32 aa, Artificial Sequence
  Description of Artificial Sequence: Synthetic polypeptide
SEAEIACTNPVATASWGCVAGTGLADPGEDQD

SEQ ID NO: 195852 - protein, 32 aa, Artificial Sequence
  Description of Artificial Sequence: Synthetic polypeptide
NESEIASTNPVGTEGWGVCAPTDLQHQGGDSI

SEQ ID NO: 195853 - protein, 38 aa, Artificial Sequence
  Description of Artificial Sequence: Synthetic polypeptide
CEEEIACTNPVATEQYGSACSPTPDGHPLEAGEGMNNQ

SEQ ID NO: 195854 - protein, 39 aa, Artificial Sequence
  Description of Artificial Sequence: Synthetic polypeptide
DEEEIRTTNPVATEQYGSYAIAPTATPLHEVSPMQDEHN

SEQ ID NO: 195855 - protein, 37 aa, Artificial Sequence
  Description of Artificial Sequence: Synthetic polypeptide
CEEEIACTNPVATEQYGSACTAANPLPAEAPIGDAHQ

SEQ ID NO: 195856 - protein, 35 aa, Artificial Sequence
  Description of Artificial Sequence: Synthetic polypeptide
ENEEIATTNPVATTQWGNVAKTWNPNEQQEPNGPP

SEQ ID NO: 195857 - protein, 36 aa, Artificial Sequence
  Description of Artificial Sequence: Synthetic polypeptide
CEEEIACTNPVAYEQYGSCATANGNGLMTEGVHADQ

SEQ ID NO: 195858 - protein, 35 aa, Artificial Sequence
  Description of Artificial Sequence: Synthetic polypeptide
DEEEIKTTNPCAYAEYGESVAYAANEHSGIGGNNG

SEQ ID NO: 195859 - protein, 35 aa, Artificial Sequence
  Description of Artificial Sequence: Synthetic polypeptide
SEAEIGTTNPVATEQYGCLFTATDGTPVEIEGNKQ

SEQ ID NO: 195860 - protein, 32 aa, Artificial Sequence
  Description of Artificial Sequence: Synthetic polypeptide
NESEIASTNPVGTEGWGVCAPTDLQGHQGDDI

SEQ ID NO: 195861 - protein, 34 aa, Artificial Sequence
  Description of Artificial Sequence: Synthetic polypeptide
DEGEIRTTNPVSYEPWGKISCMEDISDQQNGGNF

SEQ ID NO: 195862 - protein, 35 aa, Artificial Sequence
  Description of Artificial Sequence: Synthetic polypeptide
CEEEIACTNPVAYEQYGCVAATTGLDNIGGEMLMW

SEQ ID NO: 195863 - protein, 37 aa, Artificial Sequence
  Description of Artificial Sequence: Synthetic polypeptide
AEEEISTTNPVATEQYGQCVCSWGEHNAENFISDNQS

SEQ ID NO: 195864 - protein, 39 aa, Artificial Sequence
  Description of Artificial Sequence: Synthetic polypeptide
QENEIRTTNPVATEIYGSVNNSTTPENGPEMGQGENEEG

SEQ ID NO: 195865 - protein, 34 aa, Artificial Sequence
  Description of Artificial Sequence: Synthetic polypeptide
SEAEIGTTNPVATEQYGCLWTATDGPVEFEGDKQ

SEQ ID NO: 195866 - protein, 37 aa, Artificial Sequence
  Description of Artificial Sequence: Synthetic polypeptide
NEEEIRTTNPVAYEQWGHNTVYTWEHQQHGRPMGEES

SEQ ID NO: 195867 - protein, 37 aa, Artificial Sequence
  Description of Artificial Sequence: Synthetic polypeptide
ENTEIATTNPVATENYGCVSCTLNGLNDHEGGRGEQQ

SEQ ID NO: 195868 - protein, 38 aa, Artificial Sequence
  Description of Artificial Sequence: Synthetic polypeptide
DEREIRTTNPVATEQYGQCVCSNWEEHNTENFNSDTQA

SEQ ID NO: 195869 - protein, 36 aa, Artificial Sequence
  Description of Artificial Sequence: Synthetic polypeptide
CEEEIACTNPVATEQYGSACSAPNPQQEAAHQVDHQ

SEQ ID NO: 195870 - protein, 36 aa, Artificial Sequence
  Description of Artificial Sequence: Synthetic polypeptide
DEEVIACTNPVATAQWGSVASGHPGPLAAPGGNGHQ

SEQ ID NO: 195871 - protein, 37 aa, Artificial Sequence
  Description of Artificial Sequence: Synthetic polypeptide
AEEEISTTNPVATEQYGQCVCSWGEHNAENFNSDTQF

SEQ ID NO: 195872 - protein, 36 aa, Artificial Sequence
  Description of Artificial Sequence: Synthetic polypeptide
CESEIATTNPCATENYGTVCSATGSEWSENMNVGND

SEQ ID NO: 195873 - protein, 36 aa, Artificial Sequence
  Description of Artificial Sequence: Synthetic polypeptide
NEREIRTTNPVATEQYGCVCGWMEHNQENFNSDNQS

SEQ ID NO: 195874 - protein, 37 aa, Artificial Sequence
  Description of Artificial Sequence: Synthetic polypeptide
SEAEIRTTNPVATEQYGSIPRTPFLEENQDHQSEEQP

SEQ ID NO: 195875 - protein, 34 aa, Artificial Sequence
  Description of Artificial Sequence: Synthetic polypeptide
ENEEIATTNPVAYEQWGVYYTWANQGDHQRHDTM

SEQ ID NO: 195876 - protein, 35 aa, Artificial Sequence
  Description of Artificial Sequence: Synthetic polypeptide
NESEIATTNPVAYEQWGSVYGGWDDQPGQGNNTGN

SEQ ID NO: 195877 - protein, 38 aa, Artificial Sequence
  Description of Artificial Sequence: Synthetic polypeptide
DEEEIRTTNPVATEQYGSYTILCPNLENVSSVAHMWED

SEQ ID NO: 195878 - protein, 37 aa, Artificial Sequence
  Description of Artificial Sequence: Synthetic polypeptide
DERAIRTTNPVATEQYGCVCSNSGEHNQENFNSDNQS

SEQ ID NO: 195879 - protein, 40 aa, Artificial Sequence
  Description of Artificial Sequence: Synthetic polypeptide
DEETIRTTNPVATEQYGVVSTVVNTEQGNNDEQGTEEGTD

SEQ ID NO: 195880 - protein, 32 aa, Artificial Sequence
  Description of Artificial Sequence: Synthetic polypeptide
DDSEVASTNPVSWEGYGNVAANTIQSRVGQDT

SEQ ID NO: 195881 - protein, 37 aa, Artificial Sequence
  Description of Artificial Sequence: Synthetic polypeptide
AEEEISTTNPVATEQYGQCVCSWGEHNTENFISEFQA

SEQ ID NO: 195882 - protein, 32 aa, Artificial Sequence
  Description of Artificial Sequence: Synthetic polypeptide
CESEIASTNPVGTEGWGVCAPTDNQDHRGGDA

SEQ ID NO: 195883 - protein, 35 aa, Artificial Sequence
  Description of Artificial Sequence: Synthetic polypeptide
SEAEIGTTNPVATEQYGCLFTATDGPVEFEGNFKM

SEQ ID NO: 195884 - protein, 32 aa, Artificial Sequence
  Description of Artificial Sequence: Synthetic polypeptide
EGAEIATTNPVAYEQWGCCHTWEDQGHKTGDD

SEQ ID NO: 195885 - protein, 37 aa, Artificial Sequence
  Description of Artificial Sequence: Synthetic polypeptide
SEAEIRTTNPVATEQYGSHYYYPDDNILTMELNEDMP

SEQ ID NO: 195886 - protein, 36 aa, Artificial Sequence
  Description of Artificial Sequence: Synthetic polypeptide
NEREIRTTNPVATEQYGCVCGWGEDHNQNFGSDTQS

SEQ ID NO: 195887 - protein, 35 aa, Artificial Sequence
  Description of Artificial Sequence: Synthetic polypeptide
DEGEIRTTNPVSYEPYGTTISCMEDEISQQQNGNH

SEQ ID NO: 195888 - protein, 33 aa, Artificial Sequence
  Description of Artificial Sequence: Synthetic polypeptide
ETEEIATTNPCAYEEWGSVYYVVDERQDGQGNM

SEQ ID NO: 195889 - protein, 38 aa, Artificial Sequence
  Description of Artificial Sequence: Synthetic polypeptide
DENEIRTTNPVATEGYGSVVDITQNVNFDDEGGQEQEN

SEQ ID NO: 195890 - protein, 38 aa, Artificial Sequence
  Description of Artificial Sequence: Synthetic polypeptide
DDEEIRATNPVATEQYGSVYGQGIGDLEVGNGGFEETL

SEQ ID NO: 195891 - protein, 40 aa, Artificial Sequence
  Description of Artificial Sequence: Synthetic polypeptide
DEETIRTTNPVATEQYGVVSTVVNNSEQGNNQQGTEEGSD

SEQ ID NO: 195892 - protein, 37 aa, Artificial Sequence
  Description of Artificial Sequence: Synthetic polypeptide
NENEIKTTNPVATETYGSVSRNFNSLITEEVGDTVPA

SEQ ID NO: 195893 - protein, 38 aa, Artificial Sequence
  Description of Artificial Sequence: Synthetic polypeptide
DDEEIRCTNPVATEQYGQCQVCSTMEHNQENFGSDTQA

SEQ ID NO: 195894 - protein, 37 aa, Artificial Sequence
  Description of Artificial Sequence: Synthetic polypeptide
NEEEISTTNPVAYEQWGCSYNVPMDDTDQREGHRPRG

SEQ ID NO: 195895 - protein, 37 aa, Artificial Sequence
  Description of Artificial Sequence: Synthetic polypeptide
SEAEIRTTNPVATEQYGCNCMETVPCLEWQEGIQEDN

SEQ ID NO: 195896 - protein, 37 aa, Artificial Sequence
  Description of Artificial Sequence: Synthetic polypeptide
CEEEIACTNPVATEQYGSACSAANPQEAEAPIGDAHQ

SEQ ID NO: 195897 - protein, 33 aa, Artificial Sequence
  Description of Artificial Sequence: Synthetic polypeptide
SEAEIACTNPCSYEQYGCVCSWNPNQSFGSEQA

SEQ ID NO: 195898 - protein, 35 aa, Artificial Sequence
  Description of Artificial Sequence: Synthetic polypeptide
EIEEIATTNPVAYEQWGSSVTWTPEGDQKHGRTDK

SEQ ID NO: 195899 - protein, 38 aa, Artificial Sequence
  Description of Artificial Sequence: Synthetic polypeptide
DEEEIRTTNPVATEGYGCVCSNWGEDHNAEYFNSDTQA

SEQ ID NO: 195900 - protein, 32 aa, Artificial Sequence
  Description of Artificial Sequence: Synthetic polypeptide
EGAEIATTNPVAYEQWGCCGTDWDQGHQSGDI

SEQ ID NO: 195901 - protein, 36 aa, Artificial Sequence
  Description of Artificial Sequence: Synthetic polypeptide
QEPEIATTNPVATEQYGGVFMASNVEVLINGQSTDT

SEQ ID NO: 195902 - protein, 33 aa, Artificial Sequence
  Description of Artificial Sequence: Synthetic polypeptide
QENEIATTNPVAYEPYGPNVAGEGLQHMEMQLN

SEQ ID NO: 195903 - protein, 36 aa, Artificial Sequence
  Description of Artificial Sequence: Synthetic polypeptide
CEEEIACTNPVAYEQYGSCSAGPALGVNHQDGMQMQ

SEQ ID NO: 195904 - protein, 35 aa, Artificial Sequence
  Description of Artificial Sequence: Synthetic polypeptide
SEAEIRCTNPCATEQYGCVCSWGEHNAEHFGSDQS

SEQ ID NO: 195905 - protein, 35 aa, Artificial Sequence
  Description of Artificial Sequence: Synthetic polypeptide
SEAEIATTNPVATECYGSVCAANNGEEADSGGEHM

SEQ ID NO: 195906 - protein, 36 aa, Artificial Sequence
  Description of Artificial Sequence: Synthetic polypeptide
EEVEIRCTNPTAYEQWGSTVYGENMDGDQRGGDNKN

SEQ ID NO: 195907 - protein, 35 aa, Artificial Sequence
  Description of Artificial Sequence: Synthetic polypeptide
SEAEIATTNPVAYEQWGCNVAGTGHGQDSGGNAQE

SEQ ID NO: 195908 - protein, 37 aa, Artificial Sequence
  Description of Artificial Sequence: Synthetic polypeptide
CEEEIACTNPVAYEQYGSPCSAGPALGQNHQDGMQNN

SEQ ID NO: 195909 - protein, 36 aa, Artificial Sequence
  Description of Artificial Sequence: Synthetic polypeptide
SEAEIACTNPVATEQYGSACAANPQPQEHQDGNQMQ

SEQ ID NO: 195910 - protein, 34 aa, Artificial Sequence
  Description of Artificial Sequence: Synthetic polypeptide
DEEVIACTNPVATEQWGCWNATGGPLPAPMENHN

SEQ ID NO: 195911 - protein, 38 aa, Artificial Sequence
  Description of Artificial Sequence: Synthetic polypeptide
DEEEIRTTNPVATEGYGCVCSNWGEDHNEENFNSDTQA

SEQ ID NO: 195912 - protein, 37 aa, Artificial Sequence
  Description of Artificial Sequence: Synthetic polypeptide
DEAVIGTTNPVATEQWGCVCSTWEDHNQEYFGSDNQA

SEQ ID NO: 195913 - protein, 35 aa, Artificial Sequence
  Description of Artificial Sequence: Synthetic polypeptide
EIEEIATTNPVAYEQWGSCVTWTPDGDQKHGRTDP

SEQ ID NO: 195914 - protein, 34 aa, Artificial Sequence
  Description of Artificial Sequence: Synthetic polypeptide
EGTEIATTNPVAYEQWGSVYTWPGEESQNQGEGS

SEQ ID NO: 195915 - protein, 35 aa, Artificial Sequence
  Description of Artificial Sequence: Synthetic polypeptide
NEQEIATTNPVAYEQWGSTCSATDNNDHMGDDSDY

SEQ ID NO: 195916 - protein, 37 aa, Artificial Sequence
  Description of Artificial Sequence: Synthetic polypeptide
DENCIATVNPVATECYGSVVCIDHQDQEQRQGDTKNR

SEQ ID NO: 195917 - protein, 35 aa, Artificial Sequence
  Description of Artificial Sequence: Synthetic polypeptide
CEEEIACTNPVATEQYGSACSPADHPEAEDPMENN

SEQ ID NO: 195918 - protein, 37 aa, Artificial Sequence
  Description of Artificial Sequence: Synthetic polypeptide
NESEIRTTNPVAYEQWGCSYNVPMDDTDQREGHRPYY

SEQ ID NO: 195919 - protein, 35 aa, Artificial Sequence
  Description of Artificial Sequence: Synthetic polypeptide
SEAEIATTNPEATDQYGQVCCCDQDQKREGDHGHR

SEQ ID NO: 195920 - protein, 36 aa, Artificial Sequence
  Description of Artificial Sequence: Synthetic polypeptide
CEEEIACTNPVATEQYGSACSPADGHQDAEDPTENN

SEQ ID NO: 195921 - protein, 34 aa, Artificial Sequence
  Description of Artificial Sequence: Synthetic polypeptide
NETEIATTNPVAYESWGCVCTIDSNDRNDFQNRT

SEQ ID NO: 195922 - protein, 37 aa, Artificial Sequence
  Description of Artificial Sequence: Synthetic polypeptide
CEEEIACTNPVATEQYGSACSAANPAEADAEIGENFM

SEQ ID NO: 195923 - protein, 36 aa, Artificial Sequence
  Description of Artificial Sequence: Synthetic polypeptide
CEEEIACTNPVATEQYGSACSAPDIGQDHADEQDNH

SEQ ID NO: 195924 - protein, 36 aa, Artificial Sequence
  Description of Artificial Sequence: Synthetic polypeptide
NEPEIATTNPVATEQYGGVFMANGVEVLLNGQSTDT

SEQ ID NO: 195925 - protein, 33 aa, Artificial Sequence
  Description of Artificial Sequence: Synthetic polypeptide
AEAEIASTNPVGYEAYGVVMAYSEGLSQQVGDI

SEQ ID NO: 195926 - protein, 35 aa, Artificial Sequence
  Description of Artificial Sequence: Synthetic polypeptide
NEMEIGTTNPVATEQYGCLCTATMGPVENFEGNKQ

SEQ ID NO: 195927 - protein, 35 aa, Artificial Sequence
  Description of Artificial Sequence: Synthetic polypeptide
ETAEIATTNPVAYERWGSVYITDNHDQRNGDQEHQ

SEQ ID NO: 195928 - protein, 34 aa, Artificial Sequence
  Description of Artificial Sequence: Synthetic polypeptide
QENEISTTNPVATEFYGNVVVTEGGDEGEGEEGV

SEQ ID NO: 195929 - protein, 36 aa, Artificial Sequence
  Description of Artificial Sequence: Synthetic polypeptide
SEAEIRCTNPVATEQYGCVCETGEHNAEHFGSDTQS

SEQ ID NO: 195930 - protein, 37 aa, Artificial Sequence
  Description of Artificial Sequence: Synthetic polypeptide
EESEIRTTNPVAYEQWGSVSGGEPANGPNMRNGGGAV

SEQ ID NO: 195931 - protein, 34 aa, Artificial Sequence
  Description of Artificial Sequence: Synthetic polypeptide
AEAEIACTNPCSYEQYGCVCSWNDNQSFGSENQA

SEQ ID NO: 195932 - protein, 35 aa, Artificial Sequence
  Description of Artificial Sequence: Synthetic polypeptide
EIAEIATTNPVATECYGCVCLINDDQNQMGGNQMG

SEQ ID NO: 195933 - protein, 37 aa, Artificial Sequence
  Description of Artificial Sequence: Synthetic polypeptide
CEEEISTTNPVATEQYGQCVCSNWGEDNQENFNSDQA

SEQ ID NO: 195934 - protein, 36 aa, Artificial Sequence
  Description of Artificial Sequence: Synthetic polypeptide
CEEEIACTNPVATEQYGSACPANPDQQEHQDGTEAK

SEQ ID NO: 195935 - protein, 38 aa, Artificial Sequence
  Description of Artificial Sequence: Synthetic polypeptide
DAEEIATTNPVATEQYGSVCSPMEHGGPADSGEGNNHN

SEQ ID NO: 195936 - protein, 37 aa, Artificial Sequence
  Description of Artificial Sequence: Synthetic polypeptide
QEDEIRTTNPAATEQYGVVSVGGNNDGNQEGGEEQDG

SEQ ID NO: 195937 - protein, 36 aa, Artificial Sequence
  Description of Artificial Sequence: Synthetic polypeptide
SEAEIATTNPVATEPWGSVCPTDNQNQDEGGQHGSP

SEQ ID NO: 195938 - protein, 33 aa, Artificial Sequence
  Description of Artificial Sequence: Synthetic polypeptide
DENEIATTNPCSTEPYGVCYCEDGQQQQNGNES

SEQ ID NO: 195939 - protein, 36 aa, Artificial Sequence
  Description of Artificial Sequence: Synthetic polypeptide
SEAEIRCTNPVATEQYGCVCETWGEHNQEHFGSDQS

SEQ ID NO: 195940 - protein, 37 aa, Artificial Sequence
  Description of Artificial Sequence: Synthetic polypeptide
DDEEIRCTNPVATEQYGCVCSWGEDHNIENSNSQTQA

SEQ ID NO: 195941 - protein, 32 aa, Artificial Sequence
  Description of Artificial Sequence: Synthetic polypeptide
DENEIACTNPIATECWGATTANAEDWAPGPYR

SEQ ID NO: 195942 - protein, 35 aa, Artificial Sequence
  Description of Artificial Sequence: Synthetic polypeptide
NETEIATTNPVAYEQWGSCATGGLNDERNMERGEQ

SEQ ID NO: 195943 - protein, 34 aa, Artificial Sequence
  Description of Artificial Sequence: Synthetic polypeptide
SEDEIATTNPVATASWGCVAAANPEPLDNGGENG

SEQ ID NO: 195944 - protein, 33 aa, Artificial Sequence
  Description of Artificial Sequence: Synthetic polypeptide
SEAEIASTNPVGTEGYGCSCGSEHNQHFGSDQS

SEQ ID NO: 195945 - protein, 37 aa, Artificial Sequence
  Description of Artificial Sequence: Synthetic polypeptide
CEEEIACTNPVATEQYGSVCAWHNLLENLDGLEGAHE

SEQ ID NO: 195946 - protein, 33 aa, Artificial Sequence
  Description of Artificial Sequence: Synthetic polypeptide
DENEIATTNPCLYEPYGTTSMWDWDQQQQNGNH

SEQ ID NO: 195947 - protein, 37 aa, Artificial Sequence
  Description of Artificial Sequence: Synthetic polypeptide
DENCISTTNPVATEQYGQCVCSNSGEHNQNFGSDNQA

SEQ ID NO: 195948 - protein, 37 aa, Artificial Sequence
  Description of Artificial Sequence: Synthetic polypeptide
CEEEIACTNPVATEQYGSACSANDMIGQNHADEGGHE

SEQ ID NO: 195949 - protein, 34 aa, Artificial Sequence
  Description of Artificial Sequence: Synthetic polypeptide
ENGTEIATTNPVAYEQWGSVYTWPGEMDQNGSED

SEQ ID NO: 195950 - protein, 37 aa, Artificial Sequence
  Description of Artificial Sequence: Synthetic polypeptide
DEMAIATTNPVATEQYGCVCSTWGEHNEEHFGSETLA

SEQ ID NO: 195951 - protein, 36 aa, Artificial Sequence
  Description of Artificial Sequence: Synthetic polypeptide
DEGTIATTNPVATDQYGVVSTGDEGMGGGQGEENTV

SEQ ID NO: 195952 - protein, 35 aa, Artificial Sequence
  Description of Artificial Sequence: Synthetic polypeptide
DENCIRTTNPLATEQFGCVCSWGEPNQESFGSDQA

SEQ ID NO: 195953 - protein, 36 aa, Artificial Sequence
  Description of Artificial Sequence: Synthetic polypeptide
NENVEIATTNPVAYEPWGSVYCTPNLGEDAGGNGGT

SEQ ID NO: 195954 - protein, 36 aa, Artificial Sequence
  Description of Artificial Sequence: Synthetic polypeptide
DEGTICTTNPVATEFYGQYSVDIGGLEQGEGDDEDD

SEQ ID NO: 195955 - protein, 38 aa, Artificial Sequence
  Description of Artificial Sequence: Synthetic polypeptide
NETEACEIATTNPVAYEQWGCVTGGNEPLQDRGGGNVD

SEQ ID NO: 195956 - protein, 34 aa, Artificial Sequence
  Description of Artificial Sequence: Synthetic polypeptide
YETEIASTNPIATEQWGAVWANAENLQESKGPYI

SEQ ID NO: 195957 - protein, 33 aa, Artificial Sequence
  Description of Artificial Sequence: Synthetic polypeptide
QENEIATTNPVAYEPYHNVSGEHLNQHMEMQLN

SEQ ID NO: 195958 - protein, 37 aa, Artificial Sequence
  Description of Artificial Sequence: Synthetic polypeptide
EEVEIRCTNPTAYEQWGSTYYGENNMDLDQRGGDNKR

SEQ ID NO: 195959 - protein, 37 aa, Artificial Sequence
  Description of Artificial Sequence: Synthetic polypeptide
DDEEIRCTNPVATEQYGCVCSWGEDHNQENFGSQTQS

SEQ ID NO: 195960 - protein, 37 aa, Artificial Sequence
  Description of Artificial Sequence: Synthetic polypeptide
DEEEIACTNPVATEQYGSVCAMNNGNLEPPADIAEDA

SEQ ID NO: 195961 - protein, 37 aa, Artificial Sequence
  Description of Artificial Sequence: Synthetic polypeptide
DDEEIRCTNPVATEQYGCSCSNWGEDNIENFNSDTQS

SEQ ID NO: 195962 - protein, 37 aa, Artificial Sequence
  Description of Artificial Sequence: Synthetic polypeptide
AEEEISTTNPVATEQYGQCVCSSGEHNAENFGSETQP

SEQ ID NO: 195963 - protein, 39 aa, Artificial Sequence
  Description of Artificial Sequence: Synthetic polypeptide
DEEEIRTTNPVATEQYGSAWVNGNVMISGDSEQQDSIVE

SEQ ID NO: 195964 - protein, 38 aa, Artificial Sequence
  Description of Artificial Sequence: Synthetic polypeptide
AEAEIRTTNPVATEQYGQCVCSNWMEHNAEYFGSQNQS

SEQ ID NO: 195965 - protein, 39 aa, Artificial Sequence
  Description of Artificial Sequence: Synthetic polypeptide
DEEEIKTTNPAATEQYGDVSVGQAEQNSGGQNGGQEGIT

SEQ ID NO: 195966 - protein, 34 aa, Artificial Sequence
  Description of Artificial Sequence: Synthetic polypeptide
ENEEIATTNPVAYEQWGVTYYTWQDQGDHQRHDR

SEQ ID NO: 195967 - protein, 35 aa, Artificial Sequence
  Description of Artificial Sequence: Synthetic polypeptide
NEMEIVTTNPVATEQYGAVCTATDGPVEFEGQFDY

SEQ ID NO: 195968 - protein, 38 aa, Artificial Sequence
  Description of Artificial Sequence: Synthetic polypeptide
NEQEIRTTNPVATEQYGCQATSAVSALNPNIDESDQYR

SEQ ID NO: 195969 - protein, 36 aa, Artificial Sequence
  Description of Artificial Sequence: Synthetic polypeptide
CEEEISTTNPVATEQYGQCVCSNWGEDAENFGSDQS

SEQ ID NO: 195970 - protein, 37 aa, Artificial Sequence
  Description of Artificial Sequence: Synthetic polypeptide
DEEEIACTNPVATEQYGSVCAMIEHLDAGTPGDEDAF

SEQ ID NO: 195971 - protein, 35 aa, Artificial Sequence
  Description of Artificial Sequence: Synthetic polypeptide
EIEEIATTNPVAYEQWGTYYIITPNDQHEHGPDRH

SEQ ID NO: 195972 - protein, 37 aa, Artificial Sequence
  Description of Artificial Sequence: Synthetic polypeptide
CEEEIACTNPVATEQYGVSACAGINHLQTEMNNDAEM

SEQ ID NO: 195973 - protein, 32 aa, Artificial Sequence
  Description of Artificial Sequence: Synthetic polypeptide
QENEIATTNPVAYEPYGNTPAGEGHLQHMIMK

SEQ ID NO: 195974 - protein, 37 aa, Artificial Sequence
  Description of Artificial Sequence: Synthetic polypeptide
SEAEIATTNPVATEQWGSVSATAHAGGNAPMNNAGMS

SEQ ID NO: 195975 - protein, 37 aa, Artificial Sequence
  Description of Artificial Sequence: Synthetic polypeptide
NEMEIRTTNPVATEQYGCVSPTIQSGTETLPEDQIED

SEQ ID NO: 195976 - protein, 38 aa, Artificial Sequence
  Description of Artificial Sequence: Synthetic polypeptide
QENEIRTTNPVATDQYGSVNSTTNADGPEMGEGEGEEG

SEQ ID NO: 195977 - protein, 36 aa, Artificial Sequence
  Description of Artificial Sequence: Synthetic polypeptide
CEEEIACTNPVAYEQYGSVAIANNWTIQENGDQLAH

SEQ ID NO: 195978 - protein, 36 aa, Artificial Sequence
  Description of Artificial Sequence: Synthetic polypeptide
CEEEIACTNPVATEQYGSACSPADFHTEAEDPNENQ

SEQ ID NO: 195979 - protein, 36 aa, Artificial Sequence
  Description of Artificial Sequence: Synthetic polypeptide
DEHEIRTTNPCAYEEWGSVAWTWNDHQGDQQGDGAQ

SEQ ID NO: 195980 - protein, 36 aa, Artificial Sequence
  Description of Artificial Sequence: Synthetic polypeptide
DDEEIRCTNPVATEQYGCVCSWGEDHNQENSISQQA

SEQ ID NO: 195981 - protein, 34 aa, Artificial Sequence
  Description of Artificial Sequence: Synthetic polypeptide
YETEIASTNPIATEQWGAVWANDENLQESKGPYI

SEQ ID NO: 195982 - protein, 36 aa, Artificial Sequence
  Description of Artificial Sequence: Synthetic polypeptide
DEHCEATTNPVAYEQWGVVSIPNAGDDQDRQGDSGR

SEQ ID NO: 195983 - protein, 36 aa, Artificial Sequence
  Description of Artificial Sequence: Synthetic polypeptide
DENCIATVNPVATECYGSVVCIDHQDQHQRQGDNEE

SEQ ID NO: 195984 - protein, 30 aa, Artificial Sequence
  Description of Artificial Sequence: Synthetic polypeptide
QEGEIACTNPVGYAGWGGCSASMLQHGDEA

SEQ ID NO: 195985 - protein, 34 aa, Artificial Sequence
  Description of Artificial Sequence: Synthetic polypeptide
SEAEIASTNPVGTEGYGVSCGSGELNQHFGSDQS

SEQ ID NO: 195986 - protein, 39 aa, Artificial Sequence
  Description of Artificial Sequence: Synthetic polypeptide
DEEEIRTTNPVAYEQYGSTVCAVGEAGGAQARGGDIEAM

SEQ ID NO: 195987 - protein, 36 aa, Artificial Sequence
  Description of Artificial Sequence: Synthetic polypeptide
NEQEIATTNPVAIEAYGSTVSCTAHFSEDHEGGDNG

SEQ ID NO: 195988 - protein, 36 aa, Artificial Sequence
  Description of Artificial Sequence: Synthetic polypeptide
DENEIRTTNPVATEIYGQCVCSWGEHNQNFISDTQS

SEQ ID NO: 195989 - protein, 31 aa, Artificial Sequence
  Description of Artificial Sequence: Synthetic polypeptide
EIAEIATTNPVAYEQWGCCGTWEDQGHESGD

SEQ ID NO: 195990 - protein, 34 aa, Artificial Sequence
  Description of Artificial Sequence: Synthetic polypeptide
SEDEIACTNPVAYEGYGEACSCENLSQAVGGDDP

SEQ ID NO: 195991 - protein, 35 aa, Artificial Sequence
  Description of Artificial Sequence: Synthetic polypeptide
DEMAIATTNPVATEQYGCLCTATDVSPVEFETNKQ

SEQ ID NO: 195992 - protein, 35 aa, Artificial Sequence
  Description of Artificial Sequence: Synthetic polypeptide
SEAEIRCTNPVATEQYGCVCEWGEHNQHFGSDTQA

SEQ ID NO: 195993 - protein, 36 aa, Artificial Sequence
  Description of Artificial Sequence: Synthetic polypeptide
CEEEIACTNPVAYEQYGSCSAGPALGPNHQMGMQMN

SEQ ID NO: 195994 - protein, 36 aa, Artificial Sequence
  Description of Artificial Sequence: Synthetic polypeptide
DENCIATVNPVATEHYGSVVCIDHQDQEQRQGDNSN

SEQ ID NO: 195995 - protein, 37 aa, Artificial Sequence
  Description of Artificial Sequence: Synthetic polypeptide
EEVEIRCTNPTAYEQWGSTVYGEGAMDLDQRGGDNKR

SEQ ID NO: 195996 - protein, 33 aa, Artificial Sequence
  Description of Artificial Sequence: Synthetic polypeptide
DENEIAATNPVSTEPYGVCYCEDGQQQQNGANE

SEQ ID NO: 195997 - protein, 35 aa, Artificial Sequence
  Description of Artificial Sequence: Synthetic polypeptide
ENEEIATTNPVAYEQWGTYYMITPNDQHEHGNDMH

SEQ ID NO: 195998 - protein, 34 aa, Artificial Sequence
  Description of Artificial Sequence: Synthetic polypeptide
SEDEIACTNPVAYEGYGEACSCANLSQAVGGDTC

SEQ ID NO: 195999 - protein, 36 aa, Artificial Sequence
  Description of Artificial Sequence: Synthetic polypeptide
DEHEIRTTNPCAYEEWGSVAWTWNDHQGDQQMGGAQ

SEQ ID NO: 196000 - protein, 33 aa, Artificial Sequence
  Description of Artificial Sequence: Synthetic polypeptide
DENCIATTNPVAYEQWGTYVYPQDSDDDRGEDD

SEQ ID NO: 196001 - protein, 38 aa, Artificial Sequence
  Description of Artificial Sequence: Synthetic polypeptide
CEQEIRTTNPVATEQYGVVMSNNDNNTEGPGQTGQTGD

SEQ ID NO: 196002 - protein, 37 aa, Artificial Sequence
  Description of Artificial Sequence: Synthetic polypeptide
DDEEIRCTNPVATEQYGCVCSMWGEHNQENSGSQTQS

SEQ ID NO: 196003 - protein, 35 aa, Artificial Sequence
  Description of Artificial Sequence: Synthetic polypeptide
SEAEIRCTNPCATEQYGCVCSWGEHNANFGSQTQS

SEQ ID NO: 196004 - protein, 38 aa, Artificial Sequence
  Description of Artificial Sequence: Synthetic polypeptide
NEREIRTTNPVATEQYGQCVCQNWGEHNQEYFGSDNQS

SEQ ID NO: 196005 - protein, 33 aa, Artificial Sequence
  Description of Artificial Sequence: Synthetic polypeptide
AEAEIACTNPCSYEQYGCVCSWALNQSFGSEQA

SEQ ID NO: 196006 - protein, 36 aa, Artificial Sequence
  Description of Artificial Sequence: Synthetic polypeptide
NEPEIATTNPVATEQYGGVWMANGVEVLINGQSTDF

SEQ ID NO: 196007 - protein, 33 aa, Artificial Sequence
  Description of Artificial Sequence: Synthetic polypeptide
SEAEIASVNPVCTEQYGCVCSWEHNQSFGSDQA

SEQ ID NO: 196008 - protein, 32 aa, Artificial Sequence
  Description of Artificial Sequence: Synthetic polypeptide
QEAEIASTNPCSYEQWGITCYCNDQQDKGDTR

SEQ ID NO: 196009 - protein, 38 aa, Artificial Sequence
  Description of Artificial Sequence: Synthetic polypeptide
DEAEIRTTNPVATEPYGQSCYITLMTLWDEDISQNDDM

SEQ ID NO: 196010 - protein, 35 aa, Artificial Sequence
  Description of Artificial Sequence: Synthetic polypeptide
DENEIRTTNPVSYEPWGKISCMEDISDQQNGGNNH

SEQ ID NO: 196011 - protein, 35 aa, Artificial Sequence
  Description of Artificial Sequence: Synthetic polypeptide
DENEIATTNPVAYEQWGATYYSPEIEVMNQREMDH

SEQ ID NO: 196012 - protein, 37 aa, Artificial Sequence
  Description of Artificial Sequence: Synthetic polypeptide
QEGEIATTNPVATEIYGQISFSAPDTLREPHEGEDTR

SEQ ID NO: 196013 - protein, 36 aa, Artificial Sequence
  Description of Artificial Sequence: Synthetic polypeptide
QAEEIATTNPVATEQYGCVAAGEGPHGNPSGEEEGM

SEQ ID NO: 196014 - protein, 35 aa, Artificial Sequence
  Description of Artificial Sequence: Synthetic polypeptide
DENEIRTTNPVSYEPWGKIHCMVDISQQQTGGNFI

SEQ ID NO: 196015 - protein, 38 aa, Artificial Sequence
  Description of Artificial Sequence: Synthetic polypeptide
SEEEISTTNPVATEQYGQCVCGTWGADNQENFGSDTQS

SEQ ID NO: 196016 - protein, 39 aa, Artificial Sequence
  Description of Artificial Sequence: Synthetic polypeptide
SEEEIRTTNPVAYEQYGQCVCSVSGEDDNAENFNSDTQA

SEQ ID NO: 196017 - protein, 35 aa, Artificial Sequence
  Description of Artificial Sequence: Synthetic polypeptide
DENEIRTTNPVSYEPWGKINCMEDSISDQQNGGNE

SEQ ID NO: 196018 - protein, 34 aa, Artificial Sequence
  Description of Artificial Sequence: Synthetic polypeptide
DEMEIRTTNPIATECWGATTCSNAEGWAFEGPYD

SEQ ID NO: 196019 - protein, 36 aa, Artificial Sequence
  Description of Artificial Sequence: Synthetic polypeptide
DEAEIASTNPVAYEQWGSVVCGNAQLDHVDQDQEQQ

SEQ ID NO: 196020 - protein, 39 aa, Artificial Sequence
  Description of Artificial Sequence: Synthetic polypeptide
DEEEISTTNPVATEQYGQCVCSTWGEDHNAEGFISETQS

SEQ ID NO: 196021 - protein, 36 aa, Artificial Sequence
  Description of Artificial Sequence: Synthetic polypeptide
DEAEIASTNPVAYEQWGSVVCGNAQLDHVDTGQDDP

SEQ ID NO: 196022 - protein, 37 aa, Artificial Sequence
  Description of Artificial Sequence: Synthetic polypeptide
CEREISTTNPVATEQYGCVCSNWGEHNAEYFNSENQS

SEQ ID NO: 196023 - protein, 38 aa, Artificial Sequence
  Description of Artificial Sequence: Synthetic polypeptide
FEEEIRTTNPVATEVYGVVNMQGINNMDNQTGEFTEEG

SEQ ID NO: 196024 - protein, 39 aa, Artificial Sequence
  Description of Artificial Sequence: Synthetic polypeptide
DEEEIRTTNPVAYEQYGQCVCSNWGEDHNAEFFNSDTQA

SEQ ID NO: 196025 - protein, 35 aa, Artificial Sequence
  Description of Artificial Sequence: Synthetic polypeptide
AENEIATTNPVATEGYGCVCSWMEEHNQHFISEQS

SEQ ID NO: 196026 - protein, 37 aa, Artificial Sequence
  Description of Artificial Sequence: Synthetic polypeptide
ADEEISTTNPVATEQYGCVCSNWGEHNIENFGSDFQS

SEQ ID NO: 196027 - protein, 36 aa, Artificial Sequence
  Description of Artificial Sequence: Synthetic polypeptide
MEMEIGTTNPVATEQYGCLCTATDGPVEKFEGSNEQ

SEQ ID NO: 196028 - protein, 38 aa, Artificial Sequence
  Description of Artificial Sequence: Synthetic polypeptide
SEAEIRTTNPVAYEQYGCVTSTWGADDNAEYFNSDPQS

SEQ ID NO: 196029 - protein, 39 aa, Artificial Sequence
  Description of Artificial Sequence: Synthetic polypeptide
SEEEISTTNPVATEQYGQCVCSNWGEDHNAEFFGSDNQS

SEQ ID NO: 196030 - protein, 35 aa, Artificial Sequence
  Description of Artificial Sequence: Synthetic polypeptide
DENEIRTTNPVSYEPWGKISCMEDISDQQNGGNIA

SEQ ID NO: 196031 - protein, 36 aa, Artificial Sequence
  Description of Artificial Sequence: Synthetic polypeptide
DEEEIACTNPVATEQWGAVVCAQNPGVETAGEPTGT

SEQ ID NO: 196032 - protein, 34 aa, Artificial Sequence
  Description of Artificial Sequence: Synthetic polypeptide
DEDEIATTNPVATAQWGGCCAGNGDQAEMQPMDN

SEQ ID NO: 196033 - protein, 37 aa, Artificial Sequence
  Description of Artificial Sequence: Synthetic polypeptide
VEEEIATTNPVATEQWGSVSVADGPGAGEHGIDLAVM

SEQ ID NO: 196034 - protein, 37 aa, Artificial Sequence
  Description of Artificial Sequence: Synthetic polypeptide
DENEIRTTNPVSYEGYGCICSTWEEHNAEYFGSDNQA

SEQ ID NO: 196035 - protein, 34 aa, Artificial Sequence
  Description of Artificial Sequence: Synthetic polypeptide
DEGCISTTNPVAYEQWGCFSWDNGDFDNAKNMEK

SEQ ID NO: 196036 - protein, 32 aa, Artificial Sequence
  Description of Artificial Sequence: Synthetic polypeptide
AESEIASTNPVGTEGWGVCAPTDRDQQHGDDI

SEQ ID NO: 196037 - protein, 39 aa, Artificial Sequence
  Description of Artificial Sequence: Synthetic polypeptide
DEEEIRTTNPVAYEQYGQCVCSNWGEDHNAEHFNSDNQS

SEQ ID NO: 196038 - protein, 34 aa, Artificial Sequence
  Description of Artificial Sequence: Synthetic polypeptide
DENEIRTTNPIATECWGATTWANAEDWAEPKGPI

SEQ ID NO: 196039 - protein, 38 aa, Artificial Sequence
  Description of Artificial Sequence: Synthetic polypeptide
DETEIATTNPVATEQYGSACAATAGVGGEEHQDDNLAH

SEQ ID NO: 196040 - protein, 36 aa, Artificial Sequence
  Description of Artificial Sequence: Synthetic polypeptide
CEDEIACTNPVATEQWGCNVAMTNLTNPDDGMGDMH

SEQ ID NO: 196041 - protein, 35 aa, Artificial Sequence
  Description of Artificial Sequence: Synthetic polypeptide
QEEEIATTNPVAYEQYGEHAPHCEYEFSQHAEGEW

SEQ ID NO: 196042 - protein, 37 aa, Artificial Sequence
  Description of Artificial Sequence: Synthetic polypeptide
QAEEIATTNPVATEQYGCVAGNNGGPTGAAMQDNVNN

SEQ ID NO: 196043 - protein, 35 aa, Artificial Sequence
  Description of Artificial Sequence: Synthetic polypeptide
QEEEIATTNPVAYEQYGEAWCEGVECSQHAEGELS

SEQ ID NO: 196044 - protein, 39 aa, Artificial Sequence
  Description of Artificial Sequence: Synthetic polypeptide
DEEEIRTTNPVAYEQYGQCVCSNWGEDHNAENFNSDTQA

SEQ ID NO: 196045 - protein, 37 aa, Artificial Sequence
  Description of Artificial Sequence: Synthetic polypeptide
CEEEISTTNPVATEQYGCVCSNWEEHNQEHFISDFQA

SEQ ID NO: 196046 - protein, 38 aa, Artificial Sequence
  Description of Artificial Sequence: Synthetic polypeptide
DEEEIRATNPVATEQYGTVMQVHPSPVHMPNFVDMFEG

SEQ ID NO: 196047 - protein, 39 aa, Artificial Sequence
  Description of Artificial Sequence: Synthetic polypeptide
CEDEIRTTNPVATEQYGVVVGSGQTDQEEQDGEGEGGGE

SEQ ID NO: 196048 - protein, 39 aa, Artificial Sequence
  Description of Artificial Sequence: Synthetic polypeptide
CEDEIRTTNPVATEQYGVVVGSGQEDQEEQDGEIEGNGE

SEQ ID NO: 196049 - protein, 39 aa, Artificial Sequence
  Description of Artificial Sequence: Synthetic polypeptide
DEEEIRTTNPVAYEQYGQCVCSNWGEDHNAENFNSDTQS

SEQ ID NO: 196050 - protein, 37 aa, Artificial Sequence
  Description of Artificial Sequence: Synthetic polypeptide
SEEEIACTNPVATEQYGSCAAAPGNHPMAGMEIGNNA

SEQ ID NO: 196051 - protein, 36 aa, Artificial Sequence
  Description of Artificial Sequence: Synthetic polypeptide
DEQEIATTNPVAYEQWGSTCSCNDNINDHQGDDDDY

SEQ ID NO: 196052 - protein, 38 aa, Artificial Sequence
  Description of Artificial Sequence: Synthetic polypeptide
DDEEIRTTNPVATEGYGCVCSNWEEDHNEEFFNSDTQA

SEQ ID NO: 196053 - protein, 39 aa, Artificial Sequence
  Description of Artificial Sequence: Synthetic polypeptide
DEEEIRTTNPVAYEQYGQCVCSNWGEDHNAEYFGSDTQM

SEQ ID NO: 196054 - protein, 36 aa, Artificial Sequence
  Description of Artificial Sequence: Synthetic polypeptide
DEAEIASTNPVAYEQWGSVVCGNAQLDHVDQDEAGQ

SEQ ID NO: 196055 - protein, 37 aa, Artificial Sequence
  Description of Artificial Sequence: Synthetic polypeptide
SEEEIACTNPVATEQYGSCAAAGEGVPLEAMEHGHNE

SEQ ID NO: 196056 - protein, 39 aa, Artificial Sequence
  Description of Artificial Sequence: Synthetic polypeptide
DEAEIRTTNPVATEPYGQSCISITLGTLWDEDISQNHDM

SEQ ID NO: 196057 - protein, 37 aa, Artificial Sequence
  Description of Artificial Sequence: Synthetic polypeptide
DDEEIRTTNPVATEGWGQCVTSWGEHNAENFNSDTAS

SEQ ID NO: 196058 - protein, 36 aa, Artificial Sequence
  Description of Artificial Sequence: Synthetic polypeptide
DEAEIASTNPVAYEQWGEVVCGNAQLDHVDQNRDHQ

SEQ ID NO: 196059 - protein, 34 aa, Artificial Sequence
  Description of Artificial Sequence: Synthetic polypeptide
DENEIRTTNPIATECWGATTSNAEDIAEPKGPYI

SEQ ID NO: 196060 - protein, 37 aa, Artificial Sequence
  Description of Artificial Sequence: Synthetic polypeptide
ADEEISTTNPVATEQYGCVCSNWGEDHNQENFNSDAS

SEQ ID NO: 196061 - protein, 38 aa, Artificial Sequence
  Description of Artificial Sequence: Synthetic polypeptide
SEEEISTTNPVATEQYGQCVCSWGEDHNEENFGSDTQS

SEQ ID NO: 196062 - protein, 36 aa, Artificial Sequence
  Description of Artificial Sequence: Synthetic polypeptide
DENEIRTTNPVSYEGYGCICSWEEHNQEQFGSDTQG

SEQ ID NO: 196063 - protein, 39 aa, Artificial Sequence
  Description of Artificial Sequence: Synthetic polypeptide
SEEEISTTNPVATEQYGQCVCSTWGEDHNTENFNSDTQS

SEQ ID NO: 196064 - protein, 39 aa, Artificial Sequence
  Description of Artificial Sequence: Synthetic polypeptide
DEEEISTTNPVATEQYGQCVCSTWGEDHNAENFISDTQS

SEQ ID NO: 196065 - protein, 38 aa, Artificial Sequence
  Description of Artificial Sequence: Synthetic polypeptide
AEEEISTTNPVAYEQYGQCVCSNWGEHNAEFFGSDNQS

SEQ ID NO: 196066 - protein, 38 aa, Artificial Sequence
  Description of Artificial Sequence: Synthetic polypeptide
DEHEIRTTNPVAYEQWGVACYTGDNLHNDQMTQGQTDD

SEQ ID NO: 196067 - protein, 39 aa, Artificial Sequence
  Description of Artificial Sequence: Synthetic polypeptide
SEEEISTTNPVATEQYGQCVCSNWGEDHNQENFGSDNQS

SEQ ID NO: 196068 - protein, 35 aa, Artificial Sequence
  Description of Artificial Sequence: Synthetic polypeptide
DENEIRTTNPVSYEGYGCICSWEEHNQEYFGSDQA

SEQ ID NO: 196069 - protein, 39 aa, Artificial Sequence
  Description of Artificial Sequence: Synthetic polypeptide
SEEEISTTNPVATEQYGQCVCSNWGEDHNTENFGSDNQQ

SEQ ID NO: 196070 - protein, 38 aa, Artificial Sequence
  Description of Artificial Sequence: Synthetic polypeptide
SEEEISTTNPVATEQYGQCVCSNWGEDNAENFNSDNQS

SEQ ID NO: 196071 - protein, 40 aa, Artificial Sequence
  Description of Artificial Sequence: Synthetic polypeptide
DEEEIRTTNPVATEQYGQSWVIPPCSVEEYAEVIGTPQEL

SEQ ID NO: 196072 - protein, 35 aa, Artificial Sequence
  Description of Artificial Sequence: Synthetic polypeptide
QEEEIATTNPVAYEQYGWHAPACEHEFSQHAEGEW

SEQ ID NO: 196073 - protein, 35 aa, Artificial Sequence
  Description of Artificial Sequence: Synthetic polypeptide
DENEIRTTNPVSYEPWGKISCMEDSISDQHNGGPF

SEQ ID NO: 196074 - protein, 35 aa, Artificial Sequence
  Description of Artificial Sequence: Synthetic polypeptide
AEAENATTNPVAYEQWGSVYGGWDDQPQQGNKNGQ

SEQ ID NO: 196075 - protein, 35 aa, Artificial Sequence
  Description of Artificial Sequence: Synthetic polypeptide
AENEIATTNPVATEGYGCVCSWGEHNTHFISETQA

SEQ ID NO: 196076 - protein, 38 aa, Artificial Sequence
  Description of Artificial Sequence: Synthetic polypeptide
SEEEISTTNPVATEQYGQCVCSNWGEDNQENFNSDNQS

SEQ ID NO: 196077 - protein, 39 aa, Artificial Sequence
  Description of Artificial Sequence: Synthetic polypeptide
DEEEISTTNPVATEQYGQCVCSTWGEDHNAENFISDTQL

SEQ ID NO: 196078 - protein, 38 aa, Artificial Sequence
  Description of Artificial Sequence: Synthetic polypeptide
SEEEISTTNPVATEQYGQCVCSNWGEHNAEFFISENQS

SEQ ID NO: 196079 - protein, 38 aa, Artificial Sequence
  Description of Artificial Sequence: Synthetic polypeptide
SEEEISTTNPVATEQYGQCVCSNWGEHNAENFNSDNQS

SEQ ID NO: 196080 - protein, 38 aa, Artificial Sequence
  Description of Artificial Sequence: Synthetic polypeptide
SEEEISTTNPVATEQYGQCVCSNWGEHNAENFNSDTQA

SEQ ID NO: 196081 - protein, 38 aa, Artificial Sequence
  Description of Artificial Sequence: Synthetic polypeptide
SEEEISTTNPVATEQYGQCVCSNWGEHNAENFNSDTQL

SEQ ID NO: 196082 - protein, 38 aa, Artificial Sequence
  Description of Artificial Sequence: Synthetic polypeptide
SEEEISTTNPVATEQYGQCVCSNWGEHNAENFNSQTQS

SEQ ID NO: 196083 - protein, 38 aa, Artificial Sequence
  Description of Artificial Sequence: Synthetic polypeptide
SEEEISTTNPVATEQYGQCVCSNWGEHNAESFNSDTQS

SEQ ID NO: 196084 - protein, 38 aa, Artificial Sequence
  Description of Artificial Sequence: Synthetic polypeptide
SEEEISTTNPVATEQYGQCVCSNWGEHNEENFGSDTQA

SEQ ID NO: 196085 - protein, 37 aa, Artificial Sequence
  Description of Artificial Sequence: Synthetic polypeptide
ADEEISTTNPVATEQYGCVCSNWGEHNAENFNSDTQS

SEQ ID NO: 196086 - protein, 38 aa, Artificial Sequence
  Description of Artificial Sequence: Synthetic polypeptide
SEEEISTTNPVATEQYGQCVCSNWGEHNQENFNSDNQS

SEQ ID NO: 196087 - protein, 38 aa, Artificial Sequence
  Description of Artificial Sequence: Synthetic polypeptide
SEEEISTTNPVATEQYGQCVCSNWGEHNQENFNSDTQS

SEQ ID NO: 196088 - protein, 38 aa, Artificial Sequence
  Description of Artificial Sequence: Synthetic polypeptide
SEEEISTTNPVATEQYGQCVCSNWGEHNQENFNSENQI

SEQ ID NO: 196089 - protein, 39 aa, Artificial Sequence
  Description of Artificial Sequence: Synthetic polypeptide
DEEEIRTTNPVAYEQYGQCVCSNWGEDHNAEFFNSDTQS

SEQ ID NO: 196090 - protein, 35 aa, Artificial Sequence
  Description of Artificial Sequence: Synthetic polypeptide
AENEIATTNPVATEGYGCVCSWGEDNQENFISEQA

SEQ ID NO: 196091 - protein, 39 aa, Artificial Sequence
  Description of Artificial Sequence: Synthetic polypeptide
SEEEISTTNPVATEQYGQCVCSTWGEDHNQEYFNSENQA

SEQ ID NO: 196092 - protein, 33 aa, Artificial Sequence
  Description of Artificial Sequence: Synthetic polypeptide
DETEIATTNPVATECWGATWAAADWAEPKGPDI

SEQ ID NO: 196093 - protein, 38 aa, Artificial Sequence
  Description of Artificial Sequence: Synthetic polypeptide
DEEEISTTNPVATEQYGCVCSNSGEDDNQENFISDTQA

SEQ ID NO: 196094 - protein, 36 aa, Artificial Sequence
  Description of Artificial Sequence: Synthetic polypeptide
DCAEIRTTNPVAYEAYYSLPNPNVDMMNFQSGQDEW

SEQ ID NO: 196095 - protein, 33 aa, Artificial Sequence
  Description of Artificial Sequence: Synthetic polypeptide
DEVEIATTNPCVYEQWGCVYGNPPGNAGEGDSG

SEQ ID NO: 196096 - protein, 35 aa, Artificial Sequence
  Description of Artificial Sequence: Synthetic polypeptide
DENEIRTTNPVSYEPWGTISCMEDAISQQQNGGNF

SEQ ID NO: 196097 - protein, 37 aa, Artificial Sequence
  Description of Artificial Sequence: Synthetic polypeptide
YETEIRATNPVATEFYGVMTSNGGQGDGQGTTEQNAN

SEQ ID NO: 196098 - protein, 38 aa, Artificial Sequence
  Description of Artificial Sequence: Synthetic polypeptide
SEEEISTTNPVATEGYGCVTSTWGADHNAENFGSDPQA

SEQ ID NO: 196099 - protein, 37 aa, Artificial Sequence
  Description of Artificial Sequence: Synthetic polypeptide
FEETIRTTNPVAYEQYGESMSSPSVTLEPFRVSEPVD

SEQ ID NO: 196100 - protein, 37 aa, Artificial Sequence
  Description of Artificial Sequence: Synthetic polypeptide
DEVEIATTNPVATEQWGHVVAAYSGAGGENTPDVNDL

SEQ ID NO: 196101 - protein, 35 aa, Artificial Sequence
  Description of Artificial Sequence: Synthetic polypeptide
DENEIATTNPVAYEQWGATYYSIEIEMNQREMEHY

SEQ ID NO: 196102 - protein, 35 aa, Artificial Sequence
  Description of Artificial Sequence: Synthetic polypeptide
DENEIATTNPVAYEQWGATYYSIEIEMNQREPDHK

SEQ ID NO: 196103 - protein, 34 aa, Artificial Sequence
  Description of Artificial Sequence: Synthetic polypeptide
CEDEIACTNPVATEQWGCVAGTGSEQEADMLIDE

SEQ ID NO: 196104 - protein, 37 aa, Artificial Sequence
  Description of Artificial Sequence: Synthetic polypeptide
QAEEIATTNPVATEQYGCVAAGEGGHGQESAEEGNKE

SEQ ID NO: 196105 - protein, 34 aa, Artificial Sequence
  Description of Artificial Sequence: Synthetic polypeptide
CEDEIACTNPVATEQWGCVAGTISHQEADMLITF

SEQ ID NO: 196106 - protein, 36 aa, Artificial Sequence
  Description of Artificial Sequence: Synthetic polypeptide
QAEEIATTNPVATEQYGCVAAGEGGHGQHSGEEEHS

SEQ ID NO: 196107 - protein, 38 aa, Artificial Sequence
  Description of Artificial Sequence: Synthetic polypeptide
DEEEIATTNPVAYEQWGHSACAAANPLQAAAPIEDNHQ

SEQ ID NO: 196108 - protein, 35 aa, Artificial Sequence
  Description of Artificial Sequence: Synthetic polypeptide
DENEIATTNPVAYEQWGATYYSIEINEMNKREMDY

SEQ ID NO: 196109 - protein, 37 aa, Artificial Sequence
  Description of Artificial Sequence: Synthetic polypeptide
DEVEIATTNPVATEQWGNTTAGTNHADATAPGNETAE

SEQ ID NO: 196110 - protein, 36 aa, Artificial Sequence
  Description of Artificial Sequence: Synthetic polypeptide
DENEIRTTNPVSYEPWGKISCMVDAISSQQTGGNSF

SEQ ID NO: 196111 - protein, 35 aa, Artificial Sequence
  Description of Artificial Sequence: Synthetic polypeptide
DEVEIATTNPVATEQWGTNCSAAADHMNNNSNDSW

SEQ ID NO: 196112 - protein, 36 aa, Artificial Sequence
  Description of Artificial Sequence: Synthetic polypeptide
DETEIATTNPVATEQWGCVAGEGGPMANDNPMGAQE

SEQ ID NO: 196113 - protein, 38 aa, Artificial Sequence
  Description of Artificial Sequence: Synthetic polypeptide
SEEEIRTTNPVSTEQYGCVCGNWGEDHNAEGFNSQTQA

SEQ ID NO: 196114 - protein, 39 aa, Artificial Sequence
  Description of Artificial Sequence: Synthetic polypeptide
DEEEIRTTNPVATEQYGQVPVPANNMIMATPETQQILFT

SEQ ID NO: 196115 - protein, 37 aa, Artificial Sequence
  Description of Artificial Sequence: Synthetic polypeptide
SEEEISTTNPVATEGYGQCVCSNWGEHNAYFGSDTQS

SEQ ID NO: 196116 - protein, 34 aa, Artificial Sequence
  Description of Artificial Sequence: Synthetic polypeptide
DENEIRTTNPVSYEPWGKISCMPDISQQQTGGMF

SEQ ID NO: 196117 - protein, 34 aa, Artificial Sequence
  Description of Artificial Sequence: Synthetic polypeptide
DENEIATTNPVAYEQWGATYYSIEIPMNQTEMDH

SEQ ID NO: 196118 - protein, 32 aa, Artificial Sequence
  Description of Artificial Sequence: Synthetic polypeptide
NEQEIATTNPVAYEQWGEAYYVWEVQHHDAEG

SEQ ID NO: 196119 - protein, 38 aa, Artificial Sequence
  Description of Artificial Sequence: Synthetic polypeptide
SEEEISTTNPVATEQYGCQVCSNSGEHNEENFNSDTQL

SEQ ID NO: 196120 - protein, 37 aa, Artificial Sequence
  Description of Artificial Sequence: Synthetic polypeptide
SEEEISTTNPVATEQYGCTCSMWEEDNAEYFGSDTQA

SEQ ID NO: 196121 - protein, 35 aa, Artificial Sequence
  Description of Artificial Sequence: Synthetic polypeptide
QEEEIATTNPVAYEQYGEHAWCAHEASQHAEGEQL

SEQ ID NO: 196122 - protein, 36 aa, Artificial Sequence
  Description of Artificial Sequence: Synthetic polypeptide
DETEIATTNPVATEQWGCVAGEGGEPANPNPMGAQP

SEQ ID NO: 196123 - protein, 39 aa, Artificial Sequence
  Description of Artificial Sequence: Synthetic polypeptide
NEQEIRTTNPVATEQYGCQWTSHAVSALNPNINESTQYR

SEQ ID NO: 196124 - protein, 36 aa, Artificial Sequence
  Description of Artificial Sequence: Synthetic polypeptide
DEAEIATTNPVAYEPWGHNVATPAHQGADSDGNAQE

SEQ ID NO: 196125 - protein, 33 aa, Artificial Sequence
  Description of Artificial Sequence: Synthetic polypeptide
CEDEIACTNPVATEQWGCVAGTGDEAMHMETDD

SEQ ID NO: 196126 - protein, 36 aa, Artificial Sequence
  Description of Artificial Sequence: Synthetic polypeptide
SEEEISTTNPVATEGYGCVCSNWEHNAEHFISDTQA

SEQ ID NO: 196127 - protein, 38 aa, Artificial Sequence
  Description of Artificial Sequence: Synthetic polypeptide
DEAEISTTNPVATEGYGQCVCSNWGEHNTENFNSDNQA

SEQ ID NO: 196128 - protein, 38 aa, Artificial Sequence
  Description of Artificial Sequence: Synthetic polypeptide
DEMCIRTTNPVATEQYGQCICSNWGETNQENFISDNQS

SEQ ID NO: 196129 - protein, 37 aa, Artificial Sequence
  Description of Artificial Sequence: Synthetic polypeptide
QAEEIATTNPVATEQYGCVAAGEGGHGQDSAEDGNKV

SEQ ID NO: 196130 - protein, 37 aa, Artificial Sequence
  Description of Artificial Sequence: Synthetic polypeptide
DEHEIRTTNPVGTEHWGCVYCWIPNDQDDQRQGGDSI

SEQ ID NO: 196131 - protein, 38 aa, Artificial Sequence
  Description of Artificial Sequence: Synthetic polypeptide
MENEIRTTNPVATEFYGCVGSTNQTDGGEFEEEGGEED

SEQ ID NO: 196132 - protein, 35 aa, Artificial Sequence
  Description of Artificial Sequence: Synthetic polypeptide
QEGEIAPTNPCSYEQYGVVVSCCNMLSQSNGGTDG

SEQ ID NO: 196133 - protein, 36 aa, Artificial Sequence
  Description of Artificial Sequence: Synthetic polypeptide
SEEEISCTNPIATEQYGCVCSWGEHNAENFGSDTQS

SEQ ID NO: 196134 - protein, 38 aa, Artificial Sequence
  Description of Artificial Sequence: Synthetic polypeptide
AEEEISTTNPVAYEQYGQCVCSNWGEDDNANFGSDNQS

SEQ ID NO: 196135 - protein, 37 aa, Artificial Sequence
  Description of Artificial Sequence: Synthetic polypeptide
DEHEIRTTNPVGTEHWGSVYCWIPNDQDDQIQGGDSP

SEQ ID NO: 196136 - protein, 37 aa, Artificial Sequence
  Description of Artificial Sequence: Synthetic polypeptide
SEEEISCTNPVATEQYGCVCSMSGEDNAEGFGSDTQA

SEQ ID NO: 196137 - protein, 35 aa, Artificial Sequence
  Description of Artificial Sequence: Synthetic polypeptide
QEEEIATTNPVAYEQYGETAWCEVECSQHAEGETK

SEQ ID NO: 196138 - protein, 38 aa, Artificial Sequence
  Description of Artificial Sequence: Synthetic polypeptide
NEQEIRTTNPVATEQYGCQWTPAVSQQNPNIDESTQYR

SEQ ID NO: 196139 - protein, 37 aa, Artificial Sequence
  Description of Artificial Sequence: Synthetic polypeptide
DEEEIRTTNPVGTEQWGVVAGTAMEPGGEHGGDIEAM

SEQ ID NO: 196140 - protein, 39 aa, Artificial Sequence
  Description of Artificial Sequence: Synthetic polypeptide
DEEEIRTTNPVAYEQYGQCVCSNWGEDDNAENFNSENQA

SEQ ID NO: 196141 - protein, 36 aa, Artificial Sequence
  Description of Artificial Sequence: Synthetic polypeptide
DENEIATTNPVAYEQWGATYYSIEIEEMNQREMDYR

SEQ ID NO: 196142 - protein, 38 aa, Artificial Sequence
  Description of Artificial Sequence: Synthetic polypeptide
DEQEIATTNPVAYEQWGSVSGGEPGNGGNMRNMMEMMQ

SEQ ID NO: 196143 - protein, 38 aa, Artificial Sequence
  Description of Artificial Sequence: Synthetic polypeptide
NEQEIRTTNPVATEQYGCQWTSAVEALNPMIDESTQYR

SEQ ID NO: 196144 - protein, 33 aa, Artificial Sequence
  Description of Artificial Sequence: Synthetic polypeptide
SEEEISTTNPCGCMQWYGSCCTIEGAARNADAV

SEQ ID NO: 196145 - protein, 34 aa, Artificial Sequence
  Description of Artificial Sequence: Synthetic polypeptide
DEGAIRTTNPVAYEEWGYCTLDGGDHQRMGMQKA

SEQ ID NO: 196146 - protein, 37 aa, Artificial Sequence
  Description of Artificial Sequence: Synthetic polypeptide
CEEEIACTNPVAYEQYGSACSANPDQQQEHQDGTEMK

SEQ ID NO: 196147 - protein, 36 aa, Artificial Sequence
  Description of Artificial Sequence: Synthetic polypeptide
DAEEIATTNPVAYEQWGCNTAGNNGLTTAEAGNVDF

SEQ ID NO: 196148 - protein, 36 aa, Artificial Sequence
  Description of Artificial Sequence: Synthetic polypeptide
SEEEISCTNPCATEQYGCVCSNWGEHNANFGSDTQS

SEQ ID NO: 196149 - protein, 36 aa, Artificial Sequence
  Description of Artificial Sequence: Synthetic polypeptide
DEEEIATTNPVAYEQWGHSACAAANPLVAAPIEDHQ

SEQ ID NO: 196150 - protein, 38 aa, Artificial Sequence
  Description of Artificial Sequence: Synthetic polypeptide
DEEEIRCTNPVAYEQYGQCVCSNSGEHNAENFNSETQA

SEQ ID NO: 196151 - protein, 35 aa, Artificial Sequence
  Description of Artificial Sequence: Synthetic polypeptide
QEEEIATTNPVAYEQYGEHAWCEHEWSQHAEGEQE

SEQ ID NO: 196152 - protein, 35 aa, Artificial Sequence
  Description of Artificial Sequence: Synthetic polypeptide
QENEIATTNPVATEQWGCVAGEGVEMNAAEEDNAW

SEQ ID NO: 196153 - protein, 35 aa, Artificial Sequence
  Description of Artificial Sequence: Synthetic polypeptide
DEGNEIATTNPVAYEAWGVVWPGPNNENDGQEGEM

SEQ ID NO: 196154 - protein, 38 aa, Artificial Sequence
  Description of Artificial Sequence: Synthetic polypeptide
DEEEIRCTNPVAYEQYGQCVCSMWGEDNAEGFNSDTQG

SEQ ID NO: 196155 - protein, 35 aa, Artificial Sequence
  Description of Artificial Sequence: Synthetic polypeptide
DENEIRTTNPIATECWGAVTWANAEDWAEPKGPYI

SEQ ID NO: 196156 - protein, 35 aa, Artificial Sequence
  Description of Artificial Sequence: Synthetic polypeptide
DENEIRTTNPVSYEPWGKISCMGDISDQQNGGNDF

SEQ ID NO: 196157 - protein, 36 aa, Artificial Sequence
  Description of Artificial Sequence: Synthetic polypeptide
DEMAIRTTNPVATEQYGCFCSWGEDHIENFGSDTQA

SEQ ID NO: 196158 - protein, 38 aa, Artificial Sequence
  Description of Artificial Sequence: Synthetic polypeptide
NEQEIRTTNPVATEQYGCTWTRAVSALNPNIDESTQYR

SEQ ID NO: 196159 - protein, 38 aa, Artificial Sequence
  Description of Artificial Sequence: Synthetic polypeptide
FEGEIATTNPVATEQYGNISFSAPPDTLREPHEGEDTR

SEQ ID NO: 196160 - protein, 38 aa, Artificial Sequence
  Description of Artificial Sequence: Synthetic polypeptide
DEEEIRCTNPVAYEGYGCVTSTWGADHNAENFGSDPQA

SEQ ID NO: 196161 - protein, 36 aa, Artificial Sequence
  Description of Artificial Sequence: Synthetic polypeptide
DDEEIRTTNPVGYEQWGCVCSWGEHNAENFNSVTQA

SEQ ID NO: 196162 - protein, 35 aa, Artificial Sequence
  Description of Artificial Sequence: Synthetic polypeptide
DENEIATTNPVAYEQWGATYYSNEWIEMNQREMDY

SEQ ID NO: 196163 - protein, 34 aa, Artificial Sequence
  Description of Artificial Sequence: Synthetic polypeptide
DENEIATTNPVAYEQWGATYYHIEIEMNQREMDH

SEQ ID NO: 196164 - protein, 34 aa, Artificial Sequence
  Description of Artificial Sequence: Synthetic polypeptide
QESEIRSTNPIATEGWGVTTWANSETWQPKGDYI

SEQ ID NO: 196165 - protein, 35 aa, Artificial Sequence
  Description of Artificial Sequence: Synthetic polypeptide
AENEIATTNPVATEGYGQCVCSWGEDQEHFISELA

SEQ ID NO: 196166 - protein, 35 aa, Artificial Sequence
  Description of Artificial Sequence: Synthetic polypeptide
QEGEIAPTNPCSYEQYGVTVSCLNMLSQGVGGMYP

SEQ ID NO: 196167 - protein, 38 aa, Artificial Sequence
  Description of Artificial Sequence: Synthetic polypeptide
DEACIRTTNPVATEQYGCVCGNWGEDPNQEYFGSDTQS

SEQ ID NO: 196168 - protein, 37 aa, Artificial Sequence
  Description of Artificial Sequence: Synthetic polypeptide
DEACIRTTNPVATEQYGCVCGNWGEPNAEYFISDTQS

SEQ ID NO: 196169 - protein, 37 aa, Artificial Sequence
  Description of Artificial Sequence: Synthetic polypeptide
CEEEIACTNPVATEQYGSACAAANPAEADAEIGNTTA

SEQ ID NO: 196170 - protein, 35 aa, Artificial Sequence
  Description of Artificial Sequence: Synthetic polypeptide
DEVEIATTNPVATAQWGGCCAGTNGPEATANGEFT

SEQ ID NO: 196171 - protein, 36 aa, Artificial Sequence
  Description of Artificial Sequence: Synthetic polypeptide
DEVEIATTNPVATAQWGGCCAGTNGLEATANGEQFP

SEQ ID NO: 196172 - protein, 37 aa, Artificial Sequence
  Description of Artificial Sequence: Synthetic polypeptide
DEVEIATTNPVATAQWGANTTTAATNHLEAGMGGNDH

SEQ ID NO: 196173 - protein, 35 aa, Artificial Sequence
  Description of Artificial Sequence: Synthetic polypeptide
DEVEIATTNPTAYEQWGATYYSIEIEMNQRESDYR

SEQ ID NO: 196174 - protein, 37 aa, Artificial Sequence
  Description of Artificial Sequence: Synthetic polypeptide
DEACIRTTNPVATEQYGCVCGWGEDPNAEYFNSDTQS

SEQ ID NO: 196175 - protein, 34 aa, Artificial Sequence
  Description of Artificial Sequence: Synthetic polypeptide
DEVEIATTNPCVYEQWGCVYNNPPLGNAGETQDN

SEQ ID NO: 196176 - protein, 34 aa, Artificial Sequence
  Description of Artificial Sequence: Synthetic polypeptide
DEVEIATTNPCVYEQWGCVYGNPPLGNAGETDAS

SEQ ID NO: 196177 - protein, 35 aa, Artificial Sequence
  Description of Artificial Sequence: Synthetic polypeptide
QENEIATTNPVATEQWGCVAGENGVHMNAAEDNAW

SEQ ID NO: 196178 - protein, 37 aa, Artificial Sequence
  Description of Artificial Sequence: Synthetic polypeptide
ADEEISTTNPVATEQYGCVCSNWGEHNAEYFNSENQS

SEQ ID NO: 196179 - protein, 33 aa, Artificial Sequence
  Description of Artificial Sequence: Synthetic polypeptide
DEVEIATTNPCVYEQWGCVYGNPPGNAGETMGQ

SEQ ID NO: 196180 - protein, 35 aa, Artificial Sequence
  Description of Artificial Sequence: Synthetic polypeptide
DETEIATTNPVATECYGATTWANEECWAEPKGPYI

SEQ ID NO: 196181 - protein, 35 aa, Artificial Sequence
  Description of Artificial Sequence: Synthetic polypeptide
DETEIATTNPVATECYGATTWANAECWAEPKGPYI

SEQ ID NO: 196182 - protein, 38 aa, Artificial Sequence
  Description of Artificial Sequence: Synthetic polypeptide
AEEEIKTTNPVATEFYGVVINMQTNQEGQGEEQGAEEA

SEQ ID NO: 196183 - protein, 39 aa, Artificial Sequence
  Description of Artificial Sequence: Synthetic polypeptide
FEHEIRTTNPVATEQYGAASVCEPTTVEMEGDFVSNQEQ

SEQ ID NO: 196184 - protein, 33 aa, Artificial Sequence
  Description of Artificial Sequence: Synthetic polypeptide
DEVEIATTNPCVYEQWGCVYGNPPGNAGEHDAQ

SEQ ID NO: 196185 - protein, 34 aa, Artificial Sequence
  Description of Artificial Sequence: Synthetic polypeptide
DETEIATTNPVATEQWGTNCAAGDGHPVEFEIND

SEQ ID NO: 196186 - protein, 35 aa, Artificial Sequence
  Description of Artificial Sequence: Synthetic polypeptide
DEEEIATTNPVATAQWGCSNAAGDPGPAPMEDNHN

SEQ ID NO: 196187 - protein, 33 aa, Artificial Sequence
  Description of Artificial Sequence: Synthetic polypeptide
DECEIATTNPCVYEQWGCVYGNPPGNAGETDAG

SEQ ID NO: 196188 - protein, 35 aa, Artificial Sequence
  Description of Artificial Sequence: Synthetic polypeptide
DEGCEIATTNPVAYERWGVVYITGNQGIEQQLTDS

SEQ ID NO: 196189 - protein, 38 aa, Artificial Sequence
  Description of Artificial Sequence: Synthetic polypeptide
DENEIRTTNPVSTEPYGCTVISCMMDAISQTQNGGNNH

SEQ ID NO: 196190 - protein, 35 aa, Artificial Sequence
  Description of Artificial Sequence: Synthetic polypeptide
DENEIRTTNPVSYEPWGKISCMEDWISQQQNGGNP

SEQ ID NO: 196191 - protein, 37 aa, Artificial Sequence
  Description of Artificial Sequence: Synthetic polypeptide
DEQEIATTNPVAYEQWGSVAITPHQDENNGDGMGQDD

SEQ ID NO: 196192 - protein, 35 aa, Artificial Sequence
  Description of Artificial Sequence: Synthetic polypeptide
DAYEIAATNPVAYEQWGSARCIELKIQDDTGIHMR

SEQ ID NO: 196193 - protein, 38 aa, Artificial Sequence
  Description of Artificial Sequence: Synthetic polypeptide
DEANEIATTNPVAYEQYGSVAITNHAEEATGGLMGMAM

SEQ ID NO: 196194 - protein, 36 aa, Artificial Sequence
  Description of Artificial Sequence: Synthetic polypeptide
MENEIRTTNPVATEIYGSCYFPLNSDSDIIDLNSMQ

SEQ ID NO: 196195 - protein, 33 aa, Artificial Sequence
  Description of Artificial Sequence: Synthetic polypeptide
DEGCCSTTNPVAYEQWGCFSWDNGDFDNAKNDE

SEQ ID NO: 196196 - protein, 38 aa, Artificial Sequence
  Description of Artificial Sequence: Synthetic polypeptide
SEEEISTTNPVATEQYGCVCSNSGEDHNAENFNSDTQS

SEQ ID NO: 196197 - protein, 35 aa, Artificial Sequence
  Description of Artificial Sequence: Synthetic polypeptide
QEAEIAPTNPCSYECYGVTVSCCNMLSQSVGGTDR

SEQ ID NO: 196198 - protein, 39 aa, Artificial Sequence
  Description of Artificial Sequence: Synthetic polypeptide
DEEEIRTTNPVAYEQYGQCVCSNWGEDDNEENFNSETQP

SEQ ID NO: 196199 - protein, 37 aa, Artificial Sequence
  Description of Artificial Sequence: Synthetic polypeptide
DEAEISTTNPVATEGYGQCVCSWGEHNQENFNSDTQS

SEQ ID NO: 196200 - protein, 35 aa, Artificial Sequence
  Description of Artificial Sequence: Synthetic polypeptide
DENEIATTNPVAYEQWGATYYSIEAIEMNQREMDT

SEQ ID NO: 196201 - protein, 36 aa, Artificial Sequence
  Description of Artificial Sequence: Synthetic polypeptide
DENEIRTTNPVSYEPWGKISCMEDSISDQSNGGNFH

SEQ ID NO: 196202 - protein, 36 aa, Artificial Sequence
  Description of Artificial Sequence: Synthetic polypeptide
DETEIATTNPVATEQWGCCAGPTGEPGQEHNINQVD

SEQ ID NO: 196203 - protein, 37 aa, Artificial Sequence
  Description of Artificial Sequence: Synthetic polypeptide
DEVEIATTNPVATDQYGQVVSTGDEGDGGGQGEEFTD

SEQ ID NO: 196204 - protein, 38 aa, Artificial Sequence
  Description of Artificial Sequence: Synthetic polypeptide
SEEEISTTNPVATEQYGCVCSNWGEDHNAEFFNSDNQA

SEQ ID NO: 196205 - protein, 38 aa, Artificial Sequence
  Description of Artificial Sequence: Synthetic polypeptide
SEEEISTTNPVATEQYGCVCSNWGEDHNAENFFSENQS

SEQ ID NO: 196206 - protein, 38 aa, Artificial Sequence
  Description of Artificial Sequence: Synthetic polypeptide
SEEEISTTNPVATEQYGCVCSNWGEDHNAENFNSDTQA

SEQ ID NO: 196207 - protein, 37 aa, Artificial Sequence
  Description of Artificial Sequence: Synthetic polypeptide
DEACIRTTNPVATEQYGCVCEWGEDPNAEYFNSDNQA

SEQ ID NO: 196208 - protein, 38 aa, Artificial Sequence
  Description of Artificial Sequence: Synthetic polypeptide
SEEEISTTNPVATEQYGCVCSNWGEDHNAENFNSDTQS

SEQ ID NO: 196209 - protein, 39 aa, Artificial Sequence
  Description of Artificial Sequence: Synthetic polypeptide
CEQEIRTTNPVATEQYGVVVLSGQEDQEEQDGEDEGNGE

SEQ ID NO: 196210 - protein, 38 aa, Artificial Sequence
  Description of Artificial Sequence: Synthetic polypeptide
DDEEIRTTNPVATEGYGCVCSNWGEDHNQENFNSDTQS

SEQ ID NO: 196211 - protein, 38 aa, Artificial Sequence
  Description of Artificial Sequence: Synthetic polypeptide
DEAGEIATTNPVAYEQWGEVCSTPNQGNHGEAGGDGRN

SEQ ID NO: 196212 - protein, 38 aa, Artificial Sequence
  Description of Artificial Sequence: Synthetic polypeptide
FEEEISTTNPVATEQYGSVGQSSADDIEPAEPGQPMQQ

SEQ ID NO: 196213 - protein, 36 aa, Artificial Sequence
  Description of Artificial Sequence: Synthetic polypeptide
DENEIRTTNPVSYEPWGKISCMEDSISDQQTGGNFL

SEQ ID NO: 196214 - protein, 37 aa, Artificial Sequence
  Description of Artificial Sequence: Synthetic polypeptide
QEEEIATTNPVAYEQYGSACSVAPHLNNEAPMGEAAN

SEQ ID NO: 196215 - protein, 38 aa, Artificial Sequence
  Description of Artificial Sequence: Synthetic polypeptide
SEEEISTTNPVATEQYGCVCSNWGEDHNQENFISDNQA

SEQ ID NO: 196216 - protein, 38 aa, Artificial Sequence
  Description of Artificial Sequence: Synthetic polypeptide
DEAEISTTNPVATEQYGCAVCSNWGEHNQENFNSDTQS

SEQ ID NO: 196217 - protein, 36 aa, Artificial Sequence
  Description of Artificial Sequence: Synthetic polypeptide
DENEIRTTNPVSYEPWGKISCMVDAISQQQTGGNQA

SEQ ID NO: 196218 - protein, 38 aa, Artificial Sequence
  Description of Artificial Sequence: Synthetic polypeptide
DAEEIATTNPVATEQYGSVCAMANHADDSKAPADGAHN

SEQ ID NO: 196219 - protein, 37 aa, Artificial Sequence
  Description of Artificial Sequence: Synthetic polypeptide
VEEEIATTNPVATEQYGCVAGNHSGDPAAMHMGEEGG

SEQ ID NO: 196220 - protein, 37 aa, Artificial Sequence
  Description of Artificial Sequence: Synthetic polypeptide
NEREIRTTNPVATEQYGQCVCGWMEHNQENFGSDTQS

SEQ ID NO: 196221 - protein, 36 aa, Artificial Sequence
  Description of Artificial Sequence: Synthetic polypeptide
DEQEIATTNPVAYEQWGHCIVAGNSGLVDNDGGDMD

SEQ ID NO: 196222 - protein, 37 aa, Artificial Sequence
  Description of Artificial Sequence: Synthetic polypeptide
SEGEIRTTNPVATEQYGSSFSEVEREDVEGGHDGIIE

SEQ ID NO: 196223 - protein, 37 aa, Artificial Sequence
  Description of Artificial Sequence: Synthetic polypeptide
AENEIRTTNPVATEGYGCVCSNWGEHNIENFNSDTQA

SEQ ID NO: 196224 - protein, 37 aa, Artificial Sequence
  Description of Artificial Sequence: Synthetic polypeptide
DEDEIACTNPVAYEQWGSVCSANPALPQEHMIDITAQ

SEQ ID NO: 196225 - protein, 37 aa, Artificial Sequence
  Description of Artificial Sequence: Synthetic polypeptide
SEGEIRTTNPVATEQYGSFSFSVEAEDVEGGHDGIIE

SEQ ID NO: 196226 - protein, 35 aa, Artificial Sequence
  Description of Artificial Sequence: Synthetic polypeptide
SEEEIACTNPVATEQWGCVAGTPGEADAEIGEEAD

SEQ ID NO: 196227 - protein, 37 aa, Artificial Sequence
  Description of Artificial Sequence: Synthetic polypeptide
DEQEIATTNPVAYEQWGHCNVAAASGLEQTANGNDYL

SEQ ID NO: 196228 - protein, 34 aa, Artificial Sequence
  Description of Artificial Sequence: Synthetic polypeptide
AESEIACTNPVAYEGWGEAHACETNLSQTVGGDN

SEQ ID NO: 196229 - protein, 37 aa, Artificial Sequence
  Description of Artificial Sequence: Synthetic polypeptide
SEGEIRTTNPVATEQYGCSSFWVENEDVEGGHDGIIE

SEQ ID NO: 196230 - protein, 33 aa, Artificial Sequence
  Description of Artificial Sequence: Synthetic polypeptide
AESEIACTNPVAYEGWGEATACENLSQPVGGDD

SEQ ID NO: 196231 - protein, 34 aa, Artificial Sequence
  Description of Artificial Sequence: Synthetic polypeptide
DETEIVTTNPIATECWGATCSATEDPVAEFKGPD

SEQ ID NO: 196232 - protein, 38 aa, Artificial Sequence
  Description of Artificial Sequence: Synthetic polypeptide
TEEEIRTTNPVATEQYGSVCGFVMPHAAIQDEHQPFSQ

SEQ ID NO: 196233 - protein, 33 aa, Artificial Sequence
  Description of Artificial Sequence: Synthetic polypeptide
DETEIVTTNPIATECWGATWSAAEDWAEPKGPD

SEQ ID NO: 196234 - protein, 34 aa, Artificial Sequence
  Description of Artificial Sequence: Synthetic polypeptide
DETEIVTTNPIATECWGATWSATEDPVAEFKGPD

SEQ ID NO: 196235 - protein, 34 aa, Artificial Sequence
  Description of Artificial Sequence: Synthetic polypeptide
DETEIVTTNPIATECWGATWSATEDPVAEPKGPD

SEQ ID NO: 196236 - protein, 37 aa, Artificial Sequence
  Description of Artificial Sequence: Synthetic polypeptide
AEEEIACTNPVATEQYGCSCPNSGEDNAEHFNSENQS

SEQ ID NO: 196237 - protein, 37 aa, Artificial Sequence
  Description of Artificial Sequence: Synthetic polypeptide
CEEEIACTNPVATEQYGSACAANDTIGQNHADENGHN

SEQ ID NO: 196238 - protein, 40 aa, Artificial Sequence
  Description of Artificial Sequence: Synthetic polypeptide
DEEEIRTTNPVATEGYGQCAVCSNWGEDHNTENFNSDNQS

SEQ ID NO: 196239 - protein, 37 aa, Artificial Sequence
  Description of Artificial Sequence: Synthetic polypeptide
CEDEIACTNPVATEQYGSACSAANPAEADAEIGNNTM

SEQ ID NO: 196240 - protein, 35 aa, Artificial Sequence
  Description of Artificial Sequence: Synthetic polypeptide
SEEEIACTNPVATEQWGCVAGPGGTADAEIGEEAD

SEQ ID NO: 196241 - protein, 39 aa, Artificial Sequence
  Description of Artificial Sequence: Synthetic polypeptide
DEEEISTTNPVATEQYGQCVCSNWGEDHNQENFNSDPQA

SEQ ID NO: 196242 - protein, 39 aa, Artificial Sequence
  Description of Artificial Sequence: Synthetic polypeptide
VEEEIRATNPVATEAYGVVVPDTNFLNRNEGIPGEDEGD

SEQ ID NO: 196243 - protein, 39 aa, Artificial Sequence
  Description of Artificial Sequence: Synthetic polypeptide
DEAEIATTNPVATEQYGSTACATVNPAEGQNHQDGMQMW

SEQ ID NO: 196244 - protein, 38 aa, Artificial Sequence
  Description of Artificial Sequence: Synthetic polypeptide
DDEEIRTTNPVAYEQYGQCVCSNSGEHNQENFNSDFQM

SEQ ID NO: 196245 - protein, 39 aa, Artificial Sequence
  Description of Artificial Sequence: Synthetic polypeptide
DEEEISTTNPVATEQYGQCVCSNWGEDHNQENFNSDTQA

SEQ ID NO: 196246 - protein, 35 aa, Artificial Sequence
  Description of Artificial Sequence: Synthetic polypeptide
DEMEIRTTNPIATECWGATTWANAEDWAERKGPYI

SEQ ID NO: 196247 - protein, 39 aa, Artificial Sequence
  Description of Artificial Sequence: Synthetic polypeptide
DEEEISTTNPVATEQYGQCVCSNWGEDHNQENFNSDTQF

SEQ ID NO: 196248 - protein, 39 aa, Artificial Sequence
  Description of Artificial Sequence: Synthetic polypeptide
DEEEISTTNPVATEQYGQCVCSNWGEDHNQENFQSDTQA

SEQ ID NO: 196249 - protein, 38 aa, Artificial Sequence
  Description of Artificial Sequence: Synthetic polypeptide
DDEEIRTTNPVATEGYGQCVCSNWEEHNQEHFNSETQA

SEQ ID NO: 196250 - protein, 38 aa, Artificial Sequence
  Description of Artificial Sequence: Synthetic polypeptide
DDEEIRTTNPVATEGYGQCVCFNWGEHNTENFGSDNQS

SEQ ID NO: 196251 - protein, 38 aa, Artificial Sequence
  Description of Artificial Sequence: Synthetic polypeptide
DEAEIATTNPVATEQYGSCAAGMGNGDTNNGMLMEEAH

SEQ ID NO: 196252 - protein, 39 aa, Artificial Sequence
  Description of Artificial Sequence: Synthetic polypeptide
DEEEISTTNPVATEQYGQCVCSNWGEDHNQESFNSDTQA

SEQ ID NO: 196253 - protein, 39 aa, Artificial Sequence
  Description of Artificial Sequence: Synthetic polypeptide
DEEEISTTNPVATEQYGQCVCSNWGEDHNQEYFGSETQS

SEQ ID NO: 196254 - protein, 39 aa, Artificial Sequence
  Description of Artificial Sequence: Synthetic polypeptide
DEEEISTTNPVATEQYGQCVCSNWGEDHNQEYFNSDTQG

SEQ ID NO: 196255 - protein, 37 aa, Artificial Sequence
  Description of Artificial Sequence: Synthetic polypeptide
CEDEIACTNPVATEQYGSACSADNPLPAEAPIGDEHE

SEQ ID NO: 196256 - protein, 39 aa, Artificial Sequence
  Description of Artificial Sequence: Synthetic polypeptide
DEEEISTTNPVATEQYGQCVCSNWGEDHNTEYFNSDTQA

SEQ ID NO: 196257 - protein, 39 aa, Artificial Sequence
  Description of Artificial Sequence: Synthetic polypeptide
DEEEIRTTNPVATEQYGTFNNAHIIPMDSQMEYQEGKDN

SEQ ID NO: 196258 - protein, 34 aa, Artificial Sequence
  Description of Artificial Sequence: Synthetic polypeptide
QEEEIATTNPVAYEAYGEAWCEAVECSQHAEGEL

SEQ ID NO: 196259 - protein, 36 aa, Artificial Sequence
  Description of Artificial Sequence: Synthetic polypeptide
QAEEIATTNPVATEQYGCVAPGEGGHGQEAEEANHD

SEQ ID NO: 196260 - protein, 34 aa, Artificial Sequence
  Description of Artificial Sequence: Synthetic polypeptide
DETEIVTTNPIATECWGTTCSATEDPVAEFKGPD

SEQ ID NO: 196261 - protein, 36 aa, Artificial Sequence
  Description of Artificial Sequence: Synthetic polypeptide
DEASIATTNPTAYEQWGSYYSVFDNDGKRSNGGNGW

SEQ ID NO: 196262 - protein, 38 aa, Artificial Sequence
  Description of Artificial Sequence: Synthetic polypeptide
DEEEIKTTNPAATEFYGVVINMQTNQEGQGEEQGAEEV

SEQ ID NO: 196263 - protein, 37 aa, Artificial Sequence
  Description of Artificial Sequence: Synthetic polypeptide
DEQEIATTNPVATEQYGCVAINHSGDPAAMHMGEEGD

SEQ ID NO: 196264 - protein, 38 aa, Artificial Sequence
  Description of Artificial Sequence: Synthetic polypeptide
CESEIATTNPCATEQYGTVCSATGEEWSENMNGGNTDP

SEQ ID NO: 196265 - protein, 35 aa, Artificial Sequence
  Description of Artificial Sequence: Synthetic polypeptide
QEGEIAPTNPCSYEQYGVTVSCCNMASQSVSGTRC

SEQ ID NO: 196266 - protein, 35 aa, Artificial Sequence
  Description of Artificial Sequence: Synthetic polypeptide
DEHEIRTTNPVAYMQWGAAATWEKDQQQMQGVHDK

SEQ ID NO: 196267 - protein, 35 aa, Artificial Sequence
  Description of Artificial Sequence: Synthetic polypeptide
DETEIVTTNPVATECYGAVCAAADDPVEEFKGPYD

SEQ ID NO: 196268 - protein, 35 aa, Artificial Sequence
  Description of Artificial Sequence: Synthetic polypeptide
AESEIACTNPVAYEGYGEATACETNLSQATVGTDD

SEQ ID NO: 196269 - protein, 35 aa, Artificial Sequence
  Description of Artificial Sequence: Synthetic polypeptide
AESEIACTNPVAYEGYGEATACETNLSQQVGGDDH

SEQ ID NO: 196270 - protein, 34 aa, Artificial Sequence
  Description of Artificial Sequence: Synthetic polypeptide
AESEIACTNPVAYEGYGEATACETNQSQTVGGDN

SEQ ID NO: 196271 - protein, 36 aa, Artificial Sequence
  Description of Artificial Sequence: Synthetic polypeptide
GTEAEIATTNPVAYEAWGNICATTDNQGDTQRGNHA

SEQ ID NO: 196272 - protein, 39 aa, Artificial Sequence
  Description of Artificial Sequence: Synthetic polypeptide
DEEEIRTTNPVGTEQYGQCVCSNWGEDDNAENFNSQTQA

SEQ ID NO: 196273 - protein, 34 aa, Artificial Sequence
  Description of Artificial Sequence: Synthetic polypeptide
AESEIACTNPVAYEGYGECTACETNVSQTVGGDD

SEQ ID NO: 196274 - protein, 38 aa, Artificial Sequence
  Description of Artificial Sequence: Synthetic polypeptide
DEEEISTTNPVATEQYGQCVCSNWGEHNAENFISDTQA

SEQ ID NO: 196275 - protein, 38 aa, Artificial Sequence
  Description of Artificial Sequence: Synthetic polypeptide
DEEEISTTNPVATEQYGQCVCSNWGEHNAENFISDTQS

SEQ ID NO: 196276 - protein, 38 aa, Artificial Sequence
  Description of Artificial Sequence: Synthetic polypeptide
QEGEIATTNPVATEQYGSISFSAPTDTLREPHEFEDTR

SEQ ID NO: 196277 - protein, 38 aa, Artificial Sequence
  Description of Artificial Sequence: Synthetic polypeptide
DEEEISTTNPVATEQYGQCVCSNWGEHNAENFISETQG

SEQ ID NO: 196278 - protein, 38 aa, Artificial Sequence
  Description of Artificial Sequence: Synthetic polypeptide
DEEEISTTNPVATEQYGQCVCSNWGEHNAENFISQFQP

SEQ ID NO: 196279 - protein, 38 aa, Artificial Sequence
  Description of Artificial Sequence: Synthetic polypeptide
DEEEISTTNPVATEQYGQCVCSNWGEHNAEFFISDTQE

SEQ ID NO: 196280 - protein, 38 aa, Artificial Sequence
  Description of Artificial Sequence: Synthetic polypeptide
DEEEISTTNPVATEQYGQCVCSNWGEHNAEFFISDTQA

SEQ ID NO: 196281 - protein, 38 aa, Artificial Sequence
  Description of Artificial Sequence: Synthetic polypeptide
DEEEISTTNPVATEQYGQCVCSNWGEHETEYFGSETQA

SEQ ID NO: 196282 - protein, 38 aa, Artificial Sequence
  Description of Artificial Sequence: Synthetic polypeptide
DEEEIRTTNPVATEQYGTLQTCVEMGGEEVPEGEVPEI

SEQ ID NO: 196283 - protein, 37 aa, Artificial Sequence
  Description of Artificial Sequence: Synthetic polypeptide
CEEEIACTNPVATEQYGSACAANDMIGQNHADENNHH

SEQ ID NO: 196284 - protein, 38 aa, Artificial Sequence
  Description of Artificial Sequence: Synthetic polypeptide
QEGEIATTNPVATEQYGWIISFSDPDTLREPHEGEDTR

SEQ ID NO: 196285 - protein, 35 aa, Artificial Sequence
  Description of Artificial Sequence: Synthetic polypeptide
DETEIVTTNPIATEQWGATTWANAEDPAEPEGNYI

SEQ ID NO: 196286 - protein, 34 aa, Artificial Sequence
  Description of Artificial Sequence: Synthetic polypeptide
DESEIASTNPIATECWGNTTWANNTWQEPVGQYR

SEQ ID NO: 196287 - protein, 37 aa, Artificial Sequence
  Description of Artificial Sequence: Synthetic polypeptide
DEGEIACTNPVATEQYGSVCAAIEHLDAGAPLDPDAE

SEQ ID NO: 196288 - protein, 39 aa, Artificial Sequence
  Description of Artificial Sequence: Synthetic polypeptide
DEEEISTTNPVATEQYGQCVCSNWGEDPNAENFNSDTQA

SEQ ID NO: 196289 - protein, 39 aa, Artificial Sequence
  Description of Artificial Sequence: Synthetic polypeptide
DEEEISTTNPVATEQYGQCVCSNWGEDPNAENFNSDTQN

SEQ ID NO: 196290 - protein, 36 aa, Artificial Sequence
  Description of Artificial Sequence: Synthetic polypeptide
QEGEIAPTNPCSYEQYGVTVSCCANMLSQSNGGTDR

SEQ ID NO: 196291 - protein, 39 aa, Artificial Sequence
  Description of Artificial Sequence: Synthetic polypeptide
SEIATEEEIRTTNPVAYEQWGSVAWTDQLNQDQGGDHMS

SEQ ID NO: 196292 - protein, 39 aa, Artificial Sequence
  Description of Artificial Sequence: Synthetic polypeptide
DEEEISTTNPVATEQYGQCVCSNWGEEHNAEGFNSDTQS

SEQ ID NO: 196293 - protein, 39 aa, Artificial Sequence
  Description of Artificial Sequence: Synthetic polypeptide
DEEEISTTNPVATEQYGQCVCSNWGEGHNAENFNSDTQS

SEQ ID NO: 196294 - protein, 39 aa, Artificial Sequence
  Description of Artificial Sequence: Synthetic polypeptide
DEEEISTTNPVATEQYGQCVCSNWGEGHNAENFNSETQA

SEQ ID NO: 196295 - protein, 38 aa, Artificial Sequence
  Description of Artificial Sequence: Synthetic polypeptide
QEGEIATTNPVATEQYGSISFSVPWDTLREPHEGEDTR

SEQ ID NO: 196296 - protein, 35 aa, Artificial Sequence
  Description of Artificial Sequence: Synthetic polypeptide
SEGEIATVNPVATAQWGGCNVAGNGLQSAANAQES

SEQ ID NO: 196297 - protein, 38 aa, Artificial Sequence
  Description of Artificial Sequence: Synthetic polypeptide
DEEEISTTNPVATEQYGQCVCSNWGEHDAENFNSDTQS

SEQ ID NO: 196298 - protein, 38 aa, Artificial Sequence
  Description of Artificial Sequence: Synthetic polypeptide
HECEIRTTNPVATEQYGEVFCPTPEVGHNVQIELEDHI

SEQ ID NO: 196299 - protein, 37 aa, Artificial Sequence
  Description of Artificial Sequence: Synthetic polypeptide
DEEEIACTNPVATEAYGNCAAATGNGNTDNSMEEETR

SEQ ID NO: 196300 - protein, 35 aa, Artificial Sequence
  Description of Artificial Sequence: Synthetic polypeptide
AESEIACTNPVAYEGYGEATACENLSQTEVGGDDR

SEQ ID NO: 196301 - protein, 39 aa, Artificial Sequence
  Description of Artificial Sequence: Synthetic polypeptide
DEEEISTTNPVATEQYGQCVCSNWGEGDNAENFNSDNQS

SEQ ID NO: 196302 - protein, 39 aa, Artificial Sequence
  Description of Artificial Sequence: Synthetic polypeptide
DETEIKTTNPVATEQYGVVSVGQAEQNQGEQGGGQEGIT

SEQ ID NO: 196303 - protein, 37 aa, Artificial Sequence
  Description of Artificial Sequence: Synthetic polypeptide
DETEISATNPVAYEQWGSVSGGEPGNGGNMRNMTNMM

SEQ ID NO: 196304 - protein, 35 aa, Artificial Sequence
  Description of Artificial Sequence: Synthetic polypeptide
DETEIRTVNPIATEQWGVTTWSNAEDWAEPKGPYI

SEQ ID NO: 196305 - protein, 36 aa, Artificial Sequence
  Description of Artificial Sequence: Synthetic polypeptide
QEGEIAPTNPCSYEQYGTTVSCCNMLSQNSNVGTDR

SEQ ID NO: 196306 - protein, 39 aa, Artificial Sequence
  Description of Artificial Sequence: Synthetic polypeptide
MEGEIRTTNPVATEQYGSIVNMWPLEEDTGQHSGQYTTG

SEQ ID NO: 196307 - protein, 38 aa, Artificial Sequence
  Description of Artificial Sequence: Synthetic polypeptide
AEAEIRTTNPVATEQYGQCVCSNWGEHNAENFNSDNQE

SEQ ID NO: 196308 - protein, 38 aa, Artificial Sequence
  Description of Artificial Sequence: Synthetic polypeptide
DETEIRSTNPVATDQYGVVNDNSIGQNGGQEDNDGTDI

SEQ ID NO: 196309 - protein, 38 aa, Artificial Sequence
  Description of Artificial Sequence: Synthetic polypeptide
DETEIRSTNPVATDQYGVVNDNSIGQNGGQEDNDDVDA

SEQ ID NO: 196310 - protein, 38 aa, Artificial Sequence
  Description of Artificial Sequence: Synthetic polypeptide
DETEIRSTNPVATDQYGVVNDNSIGQNGGQEDNDDTMF

SEQ ID NO: 196311 - protein, 38 aa, Artificial Sequence
  Description of Artificial Sequence: Synthetic polypeptide
DETEIRSTNPVATDQYGVVNDNSIGQNGGDEDNDDDDG

SEQ ID NO: 196312 - protein, 38 aa, Artificial Sequence
  Description of Artificial Sequence: Synthetic polypeptide
CEDEIACTNPVATEQYGSACSPTPDGLPLAAGEGMNKD

SEQ ID NO: 196313 - protein, 35 aa, Artificial Sequence
  Description of Artificial Sequence: Synthetic polypeptide
DEMAIGTTNPVATEQYGCLCTATQGSPHEFETDKQ

SEQ ID NO: 196314 - protein, 34 aa, Artificial Sequence
  Description of Artificial Sequence: Synthetic polypeptide
DETEIRSTNPIATECWGATTWANADLAEPKGPYI

SEQ ID NO: 196315 - protein, 39 aa, Artificial Sequence
  Description of Artificial Sequence: Synthetic polypeptide
MEGEIRTTNPVATEQYGSLCSSPAPAEGNNMVFEGNSDC

SEQ ID NO: 196316 - protein, 31 aa, Artificial Sequence
  Description of Artificial Sequence: Synthetic polypeptide
QDSEIASTNPVSTEGYGEVAAEVCQSHVEQK

SEQ ID NO: 196317 - protein, 39 aa, Artificial Sequence
  Description of Artificial Sequence: Synthetic polypeptide
DEEEISTTNPVATEQYGQCVCSNWGEDHNQENFGSDTQS

SEQ ID NO: 196318 - protein, 37 aa, Artificial Sequence
  Description of Artificial Sequence: Synthetic polypeptide
DDEEIRTTNPVAYEQWGQCVTSNWGEDNQENFGSDAS

SEQ ID NO: 196319 - protein, 34 aa, Artificial Sequence
  Description of Artificial Sequence: Synthetic polypeptide
SEMEIACTNPCSYEQYGCVCSNWNHNQSFGSDQL

SEQ ID NO: 196320 - protein, 39 aa, Artificial Sequence
  Description of Artificial Sequence: Synthetic polypeptide
VEEEIRCTNPVATDQYGSVNMNLIMQGQLQSEFNENNGQ

SEQ ID NO: 196321 - protein, 37 aa, Artificial Sequence
  Description of Artificial Sequence: Synthetic polypeptide
MEGEIRTTNPVATEQYGSNPTPAKGIEDVNMDNNDFD

SEQ ID NO: 196322 - protein, 35 aa, Artificial Sequence
  Description of Artificial Sequence: Synthetic polypeptide
DETEIRTTNPVSTECWGATVWAAAEDIAEPKGPYR

SEQ ID NO: 196323 - protein, 32 aa, Artificial Sequence
  Description of Artificial Sequence: Synthetic polypeptide
SEMEIACTNPCSYEQYGCVCSWEPQSFISDQA

SEQ ID NO: 196324 - protein, 38 aa, Artificial Sequence
  Description of Artificial Sequence: Synthetic polypeptide
DETEIRSTNPVATDQYGVVNDNSIGQQGGQEDNDDTAG

SEQ ID NO: 196325 - protein, 38 aa, Artificial Sequence
  Description of Artificial Sequence: Synthetic polypeptide
DETEIRSTNPVATDQYGVVNDNSMGQNGGQEDNDDGDG

SEQ ID NO: 196326 - protein, 37 aa, Artificial Sequence
  Description of Artificial Sequence: Synthetic polypeptide
DDEEIRTTNPVAYCQYGCVCSWGEGDNAENFNSDTQA

SEQ ID NO: 196327 - protein, 38 aa, Artificial Sequence
  Description of Artificial Sequence: Synthetic polypeptide
AEEEIRTTNPCATEAYGVVSTVVATQQNATEAGTTDQP

SEQ ID NO: 196328 - protein, 35 aa, Artificial Sequence
  Description of Artificial Sequence: Synthetic polypeptide
DEAEISTTNPVAYEQYGCICSSGEHNAENFPSDQA

SEQ ID NO: 196329 - protein, 38 aa, Artificial Sequence
  Description of Artificial Sequence: Synthetic polypeptide
AEAEIRTTNPVATEQYGQCVCSWGEDHNAENFPSDNQA

SEQ ID NO: 196330 - protein, 33 aa, Artificial Sequence
  Description of Artificial Sequence: Synthetic polypeptide
SEMEIACTNPCSYEQYGCVCSWGELISFGSDQS

SEQ ID NO: 196331 - protein, 35 aa, Artificial Sequence
  Description of Artificial Sequence: Synthetic polypeptide
DETEIRTTNPCATEAWGVTTNANAEDNAEEIGVEI

SEQ ID NO: 196332 - protein, 33 aa, Artificial Sequence
  Description of Artificial Sequence: Synthetic polypeptide
SEMEIACTNPCSYEQYGCVCSWGEHQSFNSDQS

SEQ ID NO: 196333 - protein, 35 aa, Artificial Sequence
  Description of Artificial Sequence: Synthetic polypeptide
DETEIRTTNPCATEAWGVTTNANAEDEEEPIGIYI

SEQ ID NO: 196334 - protein, 39 aa, Artificial Sequence
  Description of Artificial Sequence: Synthetic polypeptide
DEEEIRTTNPVATEQYGAQPCAWTNGPIGEIMYDVDEAF

SEQ ID NO: 196335 - protein, 36 aa, Artificial Sequence
  Description of Artificial Sequence: Synthetic polypeptide
DETEIRTTNPCATEAWGTVTTNTNAEDNAEPIGIYI

SEQ ID NO: 196336 - protein, 35 aa, Artificial Sequence
  Description of Artificial Sequence: Synthetic polypeptide
DETEIRTTNPCATEAWGTVTNANAEDNAETIGIYI

SEQ ID NO: 196337 - protein, 38 aa, Artificial Sequence
  Description of Artificial Sequence: Synthetic polypeptide
MEGEIRTTNPVATEQYGSIMNMWPNEDTGQDSGQQTGG

SEQ ID NO: 196338 - protein, 37 aa, Artificial Sequence
  Description of Artificial Sequence: Synthetic polypeptide
CEDEIACTNPVATEQYGSCAAATGHLPQDSMNGEAAN

SEQ ID NO: 196339 - protein, 37 aa, Artificial Sequence
  Description of Artificial Sequence: Synthetic polypeptide
DEMEIATTNPVATEQYGCVCSNWGEHNAEHFSSETQG

SEQ ID NO: 196340 - protein, 37 aa, Artificial Sequence
  Description of Artificial Sequence: Synthetic polypeptide
DEEEIATTNPVATEPYGTCCCQGAELSSVRFVANNQY

SEQ ID NO: 196341 - protein, 35 aa, Artificial Sequence
  Description of Artificial Sequence: Synthetic polypeptide
AESEIAATNPVAYEGYGQEATACETNLSQTVGGDN

SEQ ID NO: 196342 - protein, 37 aa, Artificial Sequence
  Description of Artificial Sequence: Synthetic polypeptide
DEQEIATTNPVAYEQWGCNVNATNGNIEPPDNQEGMD

SEQ ID NO: 196343 - protein, 38 aa, Artificial Sequence
  Description of Artificial Sequence: Synthetic polypeptide
DETEIRSTNPVATDQYGVVNGNSIGQNGGQEDNIDTDG

SEQ ID NO: 196344 - protein, 36 aa, Artificial Sequence
  Description of Artificial Sequence: Synthetic polypeptide
DETEIRTTNPCATEAWGTVTTNANAEDTAEPNGIYI

SEQ ID NO: 196345 - protein, 35 aa, Artificial Sequence
  Description of Artificial Sequence: Synthetic polypeptide
QENEIATTNPVATEPYGNVPSGEHDNQNHMEMQLN

SEQ ID NO: 196346 - protein, 35 aa, Artificial Sequence
  Description of Artificial Sequence: Synthetic polypeptide
DDSEVASTNPVSTEGYGNVCYNTIDQDRHGMQDRN

SEQ ID NO: 196347 - protein, 38 aa, Artificial Sequence
  Description of Artificial Sequence: Synthetic polypeptide
DEMEIRTTNPVATEQYGQCVCQNWGAHNIENFSSDTQS

SEQ ID NO: 196348 - protein, 33 aa, Artificial Sequence
  Description of Artificial Sequence: Synthetic polypeptide
DEGEIAPTNPCATEQWGATVANADWAEPKGTYI

SEQ ID NO: 196349 - protein, 38 aa, Artificial Sequence
  Description of Artificial Sequence: Synthetic polypeptide
DESEIRTTNPVATEAYGDVTVNAGDEEGQGGGEIIVEE

SEQ ID NO: 196350 - protein, 36 aa, Artificial Sequence
  Description of Artificial Sequence: Synthetic polypeptide
CEDEIATTNPVAYEQYGSVAISNNDTATAHIDDEAM

SEQ ID NO: 196351 - protein, 34 aa, Artificial Sequence
  Description of Artificial Sequence: Synthetic polypeptide
DETEIRCTNPIATECWGATTANAEDLAEPKGPYI

SEQ ID NO: 196352 - protein, 35 aa, Artificial Sequence
  Description of Artificial Sequence: Synthetic polypeptide
DEDEIACTNPVAYEQWGHCVAGAGLDNIGGEMNAE

SEQ ID NO: 196353 - protein, 38 aa, Artificial Sequence
  Description of Artificial Sequence: Synthetic polypeptide
AEEEISTTNPVAYEQYGCIVCSNWGEHNTENFNSENQS

SEQ ID NO: 196354 - protein, 35 aa, Artificial Sequence
  Description of Artificial Sequence: Synthetic polypeptide
DEQEIATTNPVAYEQWGHCIVAAASGLEEANGQDS

SEQ ID NO: 196355 - protein, 36 aa, Artificial Sequence
  Description of Artificial Sequence: Synthetic polypeptide
AEEEIRATNPVATEQWGGCNAINNHAEEQAGMEWAD

SEQ ID NO: 196356 - protein, 36 aa, Artificial Sequence
  Description of Artificial Sequence: Synthetic polypeptide
DEQEIATTNPVAYEQWGHCIVAAASGLEEMNMGFRV

SEQ ID NO: 196357 - protein, 37 aa, Artificial Sequence
  Description of Artificial Sequence: Synthetic polypeptide
DEDEIACTNPVAYEQWGHSVCSANPALQEHMIDITAK

SEQ ID NO: 196358 - protein, 38 aa, Artificial Sequence
  Description of Artificial Sequence: Synthetic polypeptide
DEQEIATTNPVAYEQWGHCIVAAASGNLEDMNPTGDNH

SEQ ID NO: 196359 - protein, 37 aa, Artificial Sequence
  Description of Artificial Sequence: Synthetic polypeptide
DEDEIACTNPVAYEQWGHSVSAMWPAGTNQGNGMEPV

SEQ ID NO: 196360 - protein, 36 aa, Artificial Sequence
  Description of Artificial Sequence: Synthetic polypeptide
QAEEIATTNPVATEQYGCVAPGEGGHGQHSGEEIHP

SEQ ID NO: 196361 - protein, 39 aa, Artificial Sequence
  Description of Artificial Sequence: Synthetic polypeptide
DEEEISTTNPVATEQYGQCVCSNWGEDHNQENFISDNQS

SEQ ID NO: 196362 - protein, 37 aa, Artificial Sequence
  Description of Artificial Sequence: Synthetic polypeptide
NEREIRTTNPVATEQYGQCVCQWGEHNIENFGSDTQS

SEQ ID NO: 196363 - protein, 39 aa, Artificial Sequence
  Description of Artificial Sequence: Synthetic polypeptide
DEEEISTTNPVATEQYGQCVCSNWGEDHNQENFISENQA

SEQ ID NO: 196364 - protein, 39 aa, Artificial Sequence
  Description of Artificial Sequence: Synthetic polypeptide
DEEEIRTTNPVATEGYGQCVCFNWGEDHNAENFGSDNQS

SEQ ID NO: 196365 - protein, 38 aa, Artificial Sequence
  Description of Artificial Sequence: Synthetic polypeptide
DENEIRSTNPVATEAYGSVVTTDGMENQTGEDEQGIET

SEQ ID NO: 196366 - protein, 38 aa, Artificial Sequence
  Description of Artificial Sequence: Synthetic polypeptide
DEMEIATTNPVATEQYGCVCSNWGEDPNEEFFNSDTQS

SEQ ID NO: 196367 - protein, 37 aa, Artificial Sequence
  Description of Artificial Sequence: Synthetic polypeptide
DEMEIATTNPVATEQYGCVCSNWGEHNAEFFISDTQA

SEQ ID NO: 196368 - protein, 37 aa, Artificial Sequence
  Description of Artificial Sequence: Synthetic polypeptide
DEHEIATTNPVAYEQWGSVYCQNPNEEPGEQMGMDKS

SEQ ID NO: 196369 - protein, 35 aa, Artificial Sequence
  Description of Artificial Sequence: Synthetic polypeptide
DETEIRCTNPIATEQWGSTTWSNAEDWAEPKGPYI

SEQ ID NO: 196370 - protein, 35 aa, Artificial Sequence
  Description of Artificial Sequence: Synthetic polypeptide
DETEIRCTNPIATEQWGSTTWANAEDWAEPKGPYI

SEQ ID NO: 196371 - protein, 37 aa, Artificial Sequence
  Description of Artificial Sequence: Synthetic polypeptide
DEHEIATTNPVAYEQWGSVVCPNPNEEQGEQMGMDKS

SEQ ID NO: 196372 - protein, 37 aa, Artificial Sequence
  Description of Artificial Sequence: Synthetic polypeptide
AEEEIRCTNPVATEEYGCSCSNWGEHNAENFNSDTQA

SEQ ID NO: 196373 - protein, 34 aa, Artificial Sequence
  Description of Artificial Sequence: Synthetic polypeptide
SEMEIACTNPCSYEQYGCVCSMWGNDQSFGSQQA

SEQ ID NO: 196374 - protein, 36 aa, Artificial Sequence
  Description of Artificial Sequence: Synthetic polypeptide
QAEEIATTNPVATEQYGCVAPGEGGHGQNENAEEGN

SEQ ID NO: 196375 - protein, 38 aa, Artificial Sequence
  Description of Artificial Sequence: Synthetic polypeptide
AEEEIRATNPVAYEQYGVTACATNPQDTNNGMLMENNH

SEQ ID NO: 196376 - protein, 37 aa, Artificial Sequence
  Description of Artificial Sequence: Synthetic polypeptide
AEEEIRATNPVAYEQYGSVCAANMGEEAGMGMLGADP

SEQ ID NO: 196377 - protein, 36 aa, Artificial Sequence
  Description of Artificial Sequence: Synthetic polypeptide
MEGEIRTTNPVATEQYGSNPWPAKGIENNMDNMDFD

SEQ ID NO: 196378 - protein, 35 aa, Artificial Sequence
  Description of Artificial Sequence: Synthetic polypeptide
QENEIATTNPVATEPYGNCPSGEHLNQNHDEMQLN

SEQ ID NO: 196379 - protein, 38 aa, Artificial Sequence
  Description of Artificial Sequence: Synthetic polypeptide
DEMEIRTTNPVATCQYGCVCNNWGEDHNQENFNSDTQS

SEQ ID NO: 196380 - protein, 34 aa, Artificial Sequence
  Description of Artificial Sequence: Synthetic polypeptide
DETEIRCTNPIATECWGATWANAEDLAEPKGPYI

SEQ ID NO: 196381 - protein, 37 aa, Artificial Sequence
  Description of Artificial Sequence: Synthetic polypeptide
CEDEIATTNPVAYEQYGSTTCASNDGPQEHQDGNEMK

SEQ ID NO: 196382 - protein, 38 aa, Artificial Sequence
  Description of Artificial Sequence: Synthetic polypeptide
CEDEIACTNPVATEQYGSACSPTPDGHPLEAAEGFDNW

SEQ ID NO: 196383 - protein, 34 aa, Artificial Sequence
  Description of Artificial Sequence: Synthetic polypeptide
DETEIRCTNPIATECWGATTWSNAEDWMPKGPYR

SEQ ID NO: 196384 - protein, 38 aa, Artificial Sequence
  Description of Artificial Sequence: Synthetic polypeptide
AEEEIRATNPVATEQYGSVCAATMGPEEAGMGMDGADV

SEQ ID NO: 196385 - protein, 33 aa, Artificial Sequence
  Description of Artificial Sequence: Synthetic polypeptide
DENEIACTNPIATECWGATTWANAEDWAPGPYR

SEQ ID NO: 196386 - protein, 35 aa, Artificial Sequence
  Description of Artificial Sequence: Synthetic polypeptide
DETEIRCTNPIATECWGATTWANEEDWQERKGPYI

SEQ ID NO: 196387 - protein, 36 aa, Artificial Sequence
  Description of Artificial Sequence: Synthetic polypeptide
QAEEIATTNPVATEQYGCVAPGEGGHGQHSGEEQDK

SEQ ID NO: 196388 - protein, 38 aa, Artificial Sequence
  Description of Artificial Sequence: Synthetic polypeptide
QEGEIATTNPVATEQYGSISFSAPMDELREPHEGEDTR

SEQ ID NO: 196389 - protein, 35 aa, Artificial Sequence
  Description of Artificial Sequence: Synthetic polypeptide
SEGEIACTNPVATAQWGGCVAGTGMLGGHGDDNPH

SEQ ID NO: 196390 - protein, 36 aa, Artificial Sequence
  Description of Artificial Sequence: Synthetic polypeptide
QAEEIATTNPVATEQYGCVAPGEGGHGPNASAEHAN

SEQ ID NO: 196391 - protein, 34 aa, Artificial Sequence
  Description of Artificial Sequence: Synthetic polypeptide
QEEEIATTNPVAYEQWGEAPCEVECSQHAEGEEK

SEQ ID NO: 196392 - protein, 36 aa, Artificial Sequence
  Description of Artificial Sequence: Synthetic polypeptide
CESEIATTNPCASEGYGTVCSVTGGEWSENMNVGND

SEQ ID NO: 196393 - protein, 39 aa, Artificial Sequence
  Description of Artificial Sequence: Synthetic polypeptide
DEDEIRTTNPVATEQWGVVVVVSTEQQSATNVATEDGSQ

SEQ ID NO: 196394 - protein, 38 aa, Artificial Sequence
  Description of Artificial Sequence: Synthetic polypeptide
DEEEISTTNPVATEQYGQCVCSSEEDHNQEYFISEFQA

SEQ ID NO: 196395 - protein, 34 aa, Artificial Sequence
  Description of Artificial Sequence: Synthetic polypeptide
QEMEIACTNPCSYEQYGCVCSWENHNQSFGSEQS

SEQ ID NO: 196396 - protein, 37 aa, Artificial Sequence
  Description of Artificial Sequence: Synthetic polypeptide
CESEIATTNPCAFEQYGCVCSATGEEWSTNMNVGNDD

SEQ ID NO: 196397 - protein, 36 aa, Artificial Sequence
  Description of Artificial Sequence: Synthetic polypeptide
DEGEIACTNPVATAQWGCSNATTGNPLNAPMENHNW

SEQ ID NO: 196398 - protein, 36 aa, Artificial Sequence
  Description of Artificial Sequence: Synthetic polypeptide
DEGEIACTNPVATAQWGCSNATTGNHQAPAPMENHN

SEQ ID NO: 196399 - protein, 38 aa, Artificial Sequence
  Description of Artificial Sequence: Synthetic polypeptide
DEDEIRTTNPVATEQYGMMGTDGIGNMNDIMDEGGTGT

SEQ ID NO: 196400 - protein, 38 aa, Artificial Sequence
  Description of Artificial Sequence: Synthetic polypeptide
DEDEIRTTNPVATEQYGMMGYDGSGNMNDIMDEEGTGT

SEQ ID NO: 196401 - protein, 38 aa, Artificial Sequence
  Description of Artificial Sequence: Synthetic polypeptide
SEEEIVTTNPVATEGYGMVDNGQGTNDQEGGGGEQQGD

SEQ ID NO: 196402 - protein, 38 aa, Artificial Sequence
  Description of Artificial Sequence: Synthetic polypeptide
DEDEIRTTNPVATEQYGMMGYDGSGNMNDIMDPGGEGT

SEQ ID NO: 196403 - protein, 39 aa, Artificial Sequence
  Description of Artificial Sequence: Synthetic polypeptide
DEDEIRTTNPVATEQYGMMGYDGSGNMNQDIMDQGGTGT

SEQ ID NO: 196404 - protein, 38 aa, Artificial Sequence
  Description of Artificial Sequence: Synthetic polypeptide
CEDEIRTTNPVATEGYGSVINNDNDDEEEDEDGGNQGN

SEQ ID NO: 196405 - protein, 38 aa, Artificial Sequence
  Description of Artificial Sequence: Synthetic polypeptide
DEDEIRTTNPVATEQYGMYGYDGSGNMNDEMDEGGTGT

SEQ ID NO: 196406 - protein, 36 aa, Artificial Sequence
  Description of Artificial Sequence: Synthetic polypeptide
CESEIATTNPCAFEQWGTVCSATGEEWSENMNVGNM

SEQ ID NO: 196407 - protein, 37 aa, Artificial Sequence
  Description of Artificial Sequence: Synthetic polypeptide
CEEEIACTNPVATEQYGSCAATGHAGPAAQGEHNPQA

SEQ ID NO: 196408 - protein, 37 aa, Artificial Sequence
  Description of Artificial Sequence: Synthetic polypeptide
SEEELRTTNPVATEQYGCVCSNWGEHNAEYIISDTQS

SEQ ID NO: 196409 - protein, 36 aa, Artificial Sequence
  Description of Artificial Sequence: Synthetic polypeptide
NEREIGTTNPVATEQYGCVCQWGEHNQENFGSDTQS

SEQ ID NO: 196410 - protein, 37 aa, Artificial Sequence
  Description of Artificial Sequence: Synthetic polypeptide
AEEEISTTNPVAYEQYGCVCSNWGEHNQENFGSDTQS

SEQ ID NO: 196411 - protein, 38 aa, Artificial Sequence
  Description of Artificial Sequence: Synthetic polypeptide
AEEEIRTTNPVATEYYGQCVCSNWGEHNQENFNSETQS

SEQ ID NO: 196412 - protein, 38 aa, Artificial Sequence
  Description of Artificial Sequence: Synthetic polypeptide
SEEEVRTTNPVATEQYGCVCSNWMEDHNAENFGSDTQA

SEQ ID NO: 196413 - protein, 32 aa, Artificial Sequence
  Description of Artificial Sequence: Synthetic polypeptide
GEEEIATTNPVAYEQWGEAYYPERPIEEHTGE

SEQ ID NO: 196414 - protein, 37 aa, Artificial Sequence
  Description of Artificial Sequence: Synthetic polypeptide
QEGEIATTNPVATEQYGIISFAIPDTLREPHEGEDTR

SEQ ID NO: 196415 - protein, 39 aa, Artificial Sequence
  Description of Artificial Sequence: Synthetic polypeptide
DEEEISTTNPVATEQYGQCVCSNWMEDHNQENFGSDTQG

SEQ ID NO: 196416 - protein, 40 aa, Artificial Sequence
  Description of Artificial Sequence: Synthetic polypeptide
DEMEIRTTNPVATEQYGQAIAWSRVMLESELDRFDGSIME

SEQ ID NO: 196417 - protein, 39 aa, Artificial Sequence
  Description of Artificial Sequence: Synthetic polypeptide
DEEEISTTNPVATEQYGQCVCSNWMEDHNTENFGSETQS

SEQ ID NO: 196418 - protein, 32 aa, Artificial Sequence
  Description of Artificial Sequence: Synthetic polypeptide
DDSEVASTNPVSTEGWGNVWANNTIASPVGPR

SEQ ID NO: 196419 - protein, 36 aa, Artificial Sequence
  Description of Artificial Sequence: Synthetic polypeptide
CEEEIACTNPVAYEQYGSCAAGPALGINHQDGMQMA

SEQ ID NO: 196420 - protein, 38 aa, Artificial Sequence
  Description of Artificial Sequence: Synthetic polypeptide
CEDEIRTTNPVATEGYGSVNMDEFDLEEEDEDGGNQGN

SEQ ID NO: 196421 - protein, 38 aa, Artificial Sequence
  Description of Artificial Sequence: Synthetic polypeptide
DEGEIACTNPVATAQWGSVSATWPALGTNQGNPMEPVE

SEQ ID NO: 196422 - protein, 34 aa, Artificial Sequence
  Description of Artificial Sequence: Synthetic polypeptide
GEAEIATTNPVAYESWGCVCTIDSNDRNDQNNET

SEQ ID NO: 196423 - protein, 36 aa, Artificial Sequence
  Description of Artificial Sequence: Synthetic polypeptide
QAEEIATTNPVATEQYGCVANPGEGGHMQESEEENH

SEQ ID NO: 196424 - protein, 37 aa, Artificial Sequence
  Description of Artificial Sequence: Synthetic polypeptide
AEEEISTTNPVAYEQYGCVCSNWGEHNAENFNSDTQS

SEQ ID NO: 196425 - protein, 38 aa, Artificial Sequence
  Description of Artificial Sequence: Synthetic polypeptide
CEEEIACTNPVATEQYGSCAATGGHQLTGPDDLMGDNH

SEQ ID NO: 196426 - protein, 37 aa, Artificial Sequence
  Description of Artificial Sequence: Synthetic polypeptide
QEEEIATTNPVAYEPYRGQSVSINEGSTSMPGAPFSY

SEQ ID NO: 196427 - protein, 36 aa, Artificial Sequence
  Description of Artificial Sequence: Synthetic polypeptide
DEEEIACTNPVATEQWGATVCAQNPVETAGEPTGTA

SEQ ID NO: 196428 - protein, 35 aa, Artificial Sequence
  Description of Artificial Sequence: Synthetic polypeptide
DEDEIATTNPVATAQWGGCCAGTGHQPAENQPMDN

SEQ ID NO: 196429 - protein, 36 aa, Artificial Sequence
  Description of Artificial Sequence: Synthetic polypeptide
DENEIRTTNPVSTEVYGTVQTSPMDIEIQQNDAHCL

SEQ ID NO: 196430 - protein, 36 aa, Artificial Sequence
  Description of Artificial Sequence: Synthetic polypeptide
DEGEIACTNPVATAQWGHVVANSGNGEYGAEGDGNT

SEQ ID NO: 196431 - protein, 36 aa, Artificial Sequence
  Description of Artificial Sequence: Synthetic polypeptide
CEEEIACTNPVAYEQYGSCAAGPALGQNHQMGMQMK

SEQ ID NO: 196432 - protein, 39 aa, Artificial Sequence
  Description of Artificial Sequence: Synthetic polypeptide
DEEEIRTTNPVATEGYGQMGYDGSGNMDNDIMDEGGEGT

SEQ ID NO: 196433 - protein, 39 aa, Artificial Sequence
  Description of Artificial Sequence: Synthetic polypeptide
DEEEIRTTNPVAYEQYGQCVCSNWGEDHNQENFGSDTQS

SEQ ID NO: 196434 - protein, 32 aa, Artificial Sequence
  Description of Artificial Sequence: Synthetic polypeptide
AESEIASTNPVGTEGWGVCAPTDRDQHGGDDH

SEQ ID NO: 196435 - protein, 38 aa, Artificial Sequence
  Description of Artificial Sequence: Synthetic polypeptide
SEEEIACTNPVATEQYGSACNPTPDGLPLTAGEGMNKD

SEQ ID NO: 196436 - protein, 35 aa, Artificial Sequence
  Description of Artificial Sequence: Synthetic polypeptide
QEEEIATTNPVAYEQYGEAPWCEPHECSQHAEGEL

SEQ ID NO: 196437 - protein, 38 aa, Artificial Sequence
  Description of Artificial Sequence: Synthetic polypeptide
ADEEISTTNPVATEQYGCVCSNWGEDHNAENFGSDNQA

SEQ ID NO: 196438 - protein, 37 aa, Artificial Sequence
  Description of Artificial Sequence: Synthetic polypeptide
DESEIRTTNPVATCHYGQCVCSWGEHNQEYFTSDNQS

SEQ ID NO: 196439 - protein, 33 aa, Artificial Sequence
  Description of Artificial Sequence: Synthetic polypeptide
DENEIRTTNPIATECWGATANAEDWAEPKGPYI

SEQ ID NO: 196440 - protein, 33 aa, Artificial Sequence
  Description of Artificial Sequence: Synthetic polypeptide
DEGCNSTTNPVAYEQWGCFSWDNGDFDNQKNAE

SEQ ID NO: 196441 - protein, 33 aa, Artificial Sequence
  Description of Artificial Sequence: Synthetic polypeptide
DENEIRTTNPIATECWGATANEEDEANPKEPYI

SEQ ID NO: 196442 - protein, 32 aa, Artificial Sequence
  Description of Artificial Sequence: Synthetic polypeptide
AESEIASTNPVGTEGWGVCAPTDRDQHGQDDE

SEQ ID NO: 196443 - protein, 34 aa, Artificial Sequence
  Description of Artificial Sequence: Synthetic polypeptide
DENEIRTTNPIATECWGATTANAEDWAEPKGPYL

SEQ ID NO: 196444 - protein, 37 aa, Artificial Sequence
  Description of Artificial Sequence: Synthetic polypeptide
SEEEISTTNPVAYEQYGCVCSNWGEHNTENFNSDFQA

SEQ ID NO: 196445 - protein, 37 aa, Artificial Sequence
  Description of Artificial Sequence: Synthetic polypeptide
SEEEISTTNPVAYEQYGCVCSNWGEHNAENFNSDNQS

SEQ ID NO: 196446 - protein, 35 aa, Artificial Sequence
  Description of Artificial Sequence: Synthetic polypeptide
DDSEVASTNPVSTEGYGNVCYCTIDQDRHGGQDRM

SEQ ID NO: 196447 - protein, 36 aa, Artificial Sequence
  Description of Artificial Sequence: Synthetic polypeptide
DEEEIACTNPVATEQWGAVCAQGPPVNTAGNPEGTW

SEQ ID NO: 196448 - protein, 35 aa, Artificial Sequence
  Description of Artificial Sequence: Synthetic polypeptide
DENEIRTTNPVSYEAWGKIQSCMEDISDQQNGGNF

SEQ ID NO: 196449 - protein, 39 aa, Artificial Sequence
  Description of Artificial Sequence: Synthetic polypeptide
DEMCIRTTNPVATEQYGQCICSNWGEDTNAENFGSDNQS

SEQ ID NO: 196450 - protein, 32 aa, Artificial Sequence
  Description of Artificial Sequence: Synthetic polypeptide
AESEIASTNPVGTEGWGVCAPTDRDQHPGDAD

SEQ ID NO: 196451 - protein, 37 aa, Artificial Sequence
  Description of Artificial Sequence: Synthetic polypeptide
DEEEIACTNPVATEQWGAVCAGQNPPVNTAGNPEGTV

SEQ ID NO: 196452 - protein, 32 aa, Artificial Sequence
  Description of Artificial Sequence: Synthetic polypeptide
AESEIASTNPVGTEGWGVCAPTDRDQHGDEID

SEQ ID NO: 196453 - protein, 32 aa, Artificial Sequence
  Description of Artificial Sequence: Synthetic polypeptide
AESEIASTNPVGTEGWGVCAPTDRDQHEGGDQ

SEQ ID NO: 196454 - protein, 33 aa, Artificial Sequence
  Description of Artificial Sequence: Synthetic polypeptide
AESEIASTNPVGTEGWGVCAPTDNQQNHQGDIH

SEQ ID NO: 196455 - protein, 37 aa, Artificial Sequence
  Description of Artificial Sequence: Synthetic polypeptide
MEGEIRTTNPVATEQYGWCSKCPGEIWDQDENQFFGM

SEQ ID NO: 196456 - protein, 38 aa, Artificial Sequence
  Description of Artificial Sequence: Synthetic polypeptide
MEGEIRTTNPVATEQYGWCSSPAPAEGPNMVFEGNSDQ

SEQ ID NO: 196457 - protein, 36 aa, Artificial Sequence
  Description of Artificial Sequence: Synthetic polypeptide
MEGEIRTTNPVATEQYWSTSSIVDEWQEDEYSDEDI

SEQ ID NO: 196458 - protein, 36 aa, Artificial Sequence
  Description of Artificial Sequence: Synthetic polypeptide
DEGEIACTNPVATAQWGCSNATQGNHLPAPMENHNW

SEQ ID NO: 196459 - protein, 36 aa, Artificial Sequence
  Description of Artificial Sequence: Synthetic polypeptide
MEGEIRTTNPVATEWYGCNCNNNVLLSDGTGFEDGF

SEQ ID NO: 196460 - protein, 37 aa, Artificial Sequence
  Description of Artificial Sequence: Synthetic polypeptide
AEAEICTTNPIAYEPYGSVVCGQDNELSQAEGTSNGI

SEQ ID NO: 196461 - protein, 38 aa, Artificial Sequence
  Description of Artificial Sequence: Synthetic polypeptide
MEGEIRTTNPVATEWYGSCSSPVPEEGPNMGFEGNSDC

SEQ ID NO: 196462 - protein, 32 aa, Artificial Sequence
  Description of Artificial Sequence: Synthetic polypeptide
QEAEIACTNPCSYEQWGITCYCNDQQDTGDGR

SEQ ID NO: 196463 - protein, 37 aa, Artificial Sequence
  Description of Artificial Sequence: Synthetic polypeptide
CEDEIRTTNPVATEGYGSVNNDEFDEEEDGDGGQQGN

SEQ ID NO: 196464 - protein, 36 aa, Artificial Sequence
  Description of Artificial Sequence: Synthetic polypeptide
DETVIQTTNPVAYEMWGCVAACTVNPSQRPPGQEPG

SEQ ID NO: 196465 - protein, 37 aa, Artificial Sequence
  Description of Artificial Sequence: Synthetic polypeptide
ADEEISTTNPVATEQYGCVCSMSGEHNQENFNSDTQA

SEQ ID NO: 196466 - protein, 37 aa, Artificial Sequence
  Description of Artificial Sequence: Synthetic polypeptide
ADEEISTTNPVATEQYGCVCSMWGEDNAENFNSETQS

SEQ ID NO: 196467 - protein, 37 aa, Artificial Sequence
  Description of Artificial Sequence: Synthetic polypeptide
DEGEIATTNPVAYEQYGSVPANANHADEHAAGDQTAE

SEQ ID NO: 196468 - protein, 39 aa, Artificial Sequence
  Description of Artificial Sequence: Synthetic polypeptide
DEEEIRTTNPVAYEQYGQCVCSNWGEDHNQEHFNSDTQS

SEQ ID NO: 196469 - protein, 37 aa, Artificial Sequence
  Description of Artificial Sequence: Synthetic polypeptide
FESEIATTNPCATEQYGTVVCAATGGEWSENMNGGND

SEQ ID NO: 196470 - protein, 37 aa, Artificial Sequence
  Description of Artificial Sequence: Synthetic polypeptide
SEEEISTVNPVATEQYGCVCSNSGEHNAEYFNSQTQS

SEQ ID NO: 196471 - protein, 37 aa, Artificial Sequence
  Description of Artificial Sequence: Synthetic polypeptide
SEEEISTTNPVAYEQYGQCVCSWGEHNAENFNSDNQS

SEQ ID NO: 196472 - protein, 33 aa, Artificial Sequence
  Description of Artificial Sequence: Synthetic polypeptide
AESEIASTNPVGTEGWGVCAPTDNQDDQGGDVE

SEQ ID NO: 196473 - protein, 36 aa, Artificial Sequence
  Description of Artificial Sequence: Synthetic polypeptide
DETVIQTTNPVAYEQWGCVAACTVNMPSDREPGQEP

SEQ ID NO: 196474 - protein, 37 aa, Artificial Sequence
  Description of Artificial Sequence: Synthetic polypeptide
DESEIRTTNPVATCHYGCVCSNWGEHNIEYFNSDTQA

SEQ ID NO: 196475 - protein, 39 aa, Artificial Sequence
  Description of Artificial Sequence: Synthetic polypeptide
DEEEISTTNPVATEQYGQCVCSNWMEDHNAENFGSETQA

SEQ ID NO: 196476 - protein, 39 aa, Artificial Sequence
  Description of Artificial Sequence: Synthetic polypeptide
DEEEISTTNPVATEQYGQCVCSNWMEDHNAEGFNSDTQA

SEQ ID NO: 196477 - protein, 36 aa, Artificial Sequence
  Description of Artificial Sequence: Synthetic polypeptide
DEGQIATTNPVATASWGSIAGTNHGPLASGEGNMTW

SEQ ID NO: 196478 - protein, 36 aa, Artificial Sequence
  Description of Artificial Sequence: Synthetic polypeptide
QAEEIATTNPVATEQYGCVAPGEGGHGAQESEEENS

SEQ ID NO: 196479 - protein, 38 aa, Artificial Sequence
  Description of Artificial Sequence: Synthetic polypeptide
DEEEISTTNPVATEQYGQCVCSNWGEHNQENFISDTQA

SEQ ID NO: 196480 - protein, 38 aa, Artificial Sequence
  Description of Artificial Sequence: Synthetic polypeptide
DEEEISTTNPVATEQYGQCVCSNWGEHNQENFISDTQL

SEQ ID NO: 196481 - protein, 38 aa, Artificial Sequence
  Description of Artificial Sequence: Synthetic polypeptide
DEEEISTTNPVATEQYGQCVCSNWGEHNQENFISQTQA

SEQ ID NO: 196482 - protein, 37 aa, Artificial Sequence
  Description of Artificial Sequence: Synthetic polypeptide
DEQEIATTNPVATEQYGCVAGNHIGDPATMHMGEEHN

SEQ ID NO: 196483 - protein, 35 aa, Artificial Sequence
  Description of Artificial Sequence: Synthetic polypeptide
QAEEIATTNPVATEQYGCVAPGEGGGQESLEEEKH

SEQ ID NO: 196484 - protein, 38 aa, Artificial Sequence
  Description of Artificial Sequence: Synthetic polypeptide
CEDEIATTNPVAYEQYGSVCSAANNPAPEAHGGDNEAM

SEQ ID NO: 196485 - protein, 37 aa, Artificial Sequence
  Description of Artificial Sequence: Synthetic polypeptide
DETEIATTNPVAYEQWGGCVAGNNGDLQAAPDGSIHN

SEQ ID NO: 196486 - protein, 38 aa, Artificial Sequence
  Description of Artificial Sequence: Synthetic polypeptide
DDEEIRTTNPVAYEQYGQCVCSWGEDDNQENFNSETQA

SEQ ID NO: 196487 - protein, 37 aa, Artificial Sequence
  Description of Artificial Sequence: Synthetic polypeptide
DETEIATTNPVAYEQWGCVYSSWNNDEMNERGEGMAV

SEQ ID NO: 196488 - protein, 39 aa, Artificial Sequence
  Description of Artificial Sequence: Synthetic polypeptide
QEGEIATTNPVATEQYGNFSFSAPDDTGLEPHEKQEDTR

SEQ ID NO: 196489 - protein, 36 aa, Artificial Sequence
  Description of Artificial Sequence: Synthetic polypeptide
DEGQIATTNPVATASWGCVAGTNHGPLASGEGNMTE

SEQ ID NO: 196490 - protein, 36 aa, Artificial Sequence
  Description of Artificial Sequence: Synthetic polypeptide
DETEIATTNPVAYEQWGCNVSGQGPPQQETPDGSEN

SEQ ID NO: 196491 - protein, 36 aa, Artificial Sequence
  Description of Artificial Sequence: Synthetic polypeptide
DETENATTNPVAYEQWGVVCSNENMIGEHQGQKGEN

SEQ ID NO: 196492 - protein, 34 aa, Artificial Sequence
  Description of Artificial Sequence: Synthetic polypeptide
DETEIATTNPVAYEQWGATYYSIEIEMNQKEMDH

SEQ ID NO: 196493 - protein, 39 aa, Artificial Sequence
  Description of Artificial Sequence: Synthetic polypeptide
DEEEISTTNPVATEQYGQCVCSNWGELHNAENFNSDFQF

SEQ ID NO: 196494 - protein, 38 aa, Artificial Sequence
  Description of Artificial Sequence: Synthetic polypeptide
QEGEIATTNPVATEQYGNISFSAPDDTLSEPHEGEDPR

SEQ ID NO: 196495 - protein, 38 aa, Artificial Sequence
  Description of Artificial Sequence: Synthetic polypeptide
DDEEIRTTNPVAYEQYGQCVCSSGEDHNAENFNSDNQA

SEQ ID NO: 196496 - protein, 38 aa, Artificial Sequence
  Description of Artificial Sequence: Synthetic polypeptide
QEGEIATTNPVATEQYGNISFSAPPDTDREPHEGEDAR

SEQ ID NO: 196497 - protein, 37 aa, Artificial Sequence
  Description of Artificial Sequence: Synthetic polypeptide
DEAWCIVRTTNHPVAYESWGEVSCTENMPSTVGFVNG

SEQ ID NO: 196498 - protein, 37 aa, Artificial Sequence
  Description of Artificial Sequence: Synthetic polypeptide
DEQEIATTNPVATEQYGCVAGNHSGDPAAMHMGEEWG

SEQ ID NO: 196499 - protein, 37 aa, Artificial Sequence
  Description of Artificial Sequence: Synthetic polypeptide
QAEEIATTNPVATEQYGCVAPGEGGHGNESGEEEGNT

SEQ ID NO: 196500 - protein, 38 aa, Artificial Sequence
  Description of Artificial Sequence: Synthetic polypeptide
QEGEIATTNPVATEQYGSISFSAPDDTPREPHEGEDTR

SEQ ID NO: 196501 - protein, 36 aa, Artificial Sequence
  Description of Artificial Sequence: Synthetic polypeptide
QAEEIATTNPVATEQYGCVAPGEGGHGNESAEEPKT

SEQ ID NO: 196502 - protein, 36 aa, Artificial Sequence
  Description of Artificial Sequence: Synthetic polypeptide
QAEEIATTNPVATEQYGCVAPGEGGHGNESAEEDMK

SEQ ID NO: 196503 - protein, 38 aa, Artificial Sequence
  Description of Artificial Sequence: Synthetic polypeptide
DEGEIACTNPVATEQYGSACPATNPHEEAEAPAGNMNH

SEQ ID NO: 196504 - protein, 38 aa, Artificial Sequence
  Description of Artificial Sequence: Synthetic polypeptide
DEGEIACTNPVATEQYGSACAPANNNHPLEAMGGNAES

SEQ ID NO: 196505 - protein, 38 aa, Artificial Sequence
  Description of Artificial Sequence: Synthetic polypeptide
DDEEIRTTNPVAYEQYGQCVCSNWGEHNAENFNSDTQS

SEQ ID NO: 196506 - protein, 39 aa, Artificial Sequence
  Description of Artificial Sequence: Synthetic polypeptide
DEEEISTTNPVATEQYGQCVCSNWGELHNAENFNSDTQA

SEQ ID NO: 196507 - protein, 37 aa, Artificial Sequence
  Description of Artificial Sequence: Synthetic polypeptide
DETEIATTNPVAYEQYGSACSVAPHLNNEAPGGEAVN

SEQ ID NO: 196508 - protein, 37 aa, Artificial Sequence
  Description of Artificial Sequence: Synthetic polypeptide
QEGEIATTNPVATEQYGSASFSAPDTLREPHEIEDTR

SEQ ID NO: 196509 - protein, 37 aa, Artificial Sequence
  Description of Artificial Sequence: Synthetic polypeptide
SEEEIACTNPVATEQYGCSSAANTHGPEAGGNLEPEN

SEQ ID NO: 196510 - protein, 37 aa, Artificial Sequence
  Description of Artificial Sequence: Synthetic polypeptide
SEEVIRTTNPVAYEPWGQKVVPASEMNAGLGTVENRT

SEQ ID NO: 196511 - protein, 37 aa, Artificial Sequence
  Description of Artificial Sequence: Synthetic polypeptide
SEEVIRTTNPVATEQYGCISQTETVMWAEIERSIDDV

SEQ ID NO: 196512 - protein, 35 aa, Artificial Sequence
  Description of Artificial Sequence: Synthetic polypeptide
VEEEIATTNPVAYEQWGTVAAANNDTMTAGGGGMT

SEQ ID NO: 196513 - protein, 38 aa, Artificial Sequence
  Description of Artificial Sequence: Synthetic polypeptide
DEEEISTTNPVATEQYGQCVCSNWGEHNEENFISETQS

SEQ ID NO: 196514 - protein, 37 aa, Artificial Sequence
  Description of Artificial Sequence: Synthetic polypeptide
AEEEISTTNPVAYEQYGCVCSNWEEHNAENFNSDTQA

SEQ ID NO: 196515 - protein, 38 aa, Artificial Sequence
  Description of Artificial Sequence: Synthetic polypeptide
DEEEISTTNPVATEQYGQCVCSNWGEHNIENFISDTQF

SEQ ID NO: 196516 - protein, 38 aa, Artificial Sequence
  Description of Artificial Sequence: Synthetic polypeptide
DETEIATTNPVAYEQYGSACAAANPAEEAGRHGDNDAP

SEQ ID NO: 196517 - protein, 39 aa, Artificial Sequence
  Description of Artificial Sequence: Synthetic polypeptide
DEEEISTTNPVATEQYGQCVCSNWMEDHNAEHFNSETQA

SEQ ID NO: 196518 - protein, 39 aa, Artificial Sequence
  Description of Artificial Sequence: Synthetic polypeptide
DEEEISTTNPVATEQYGQCVCSNWGELHNAENFNSDTQS

SEQ ID NO: 196519 - protein, 39 aa, Artificial Sequence
  Description of Artificial Sequence: Synthetic polypeptide
DEEEISTTNPVATEQYGQCVCSNWGELHNIENFISEFQA

SEQ ID NO: 196520 - protein, 39 aa, Artificial Sequence
  Description of Artificial Sequence: Synthetic polypeptide
DEEEISTTNPVATEQYGQCVCSNWGYDHNQEYFNSDNQS

SEQ ID NO: 196521 - protein, 37 aa, Artificial Sequence
  Description of Artificial Sequence: Synthetic polypeptide
DENEIATTNPVAYEQWGSVAITPHQDENTGDEMEKDD

SEQ ID NO: 196522 - protein, 39 aa, Artificial Sequence
  Description of Artificial Sequence: Synthetic polypeptide
CEDEIRTTNPVATEFYGQVVISDEFGTQDQIGNVGGNAQ

SEQ ID NO: 196523 - protein, 34 aa, Artificial Sequence
  Description of Artificial Sequence: Synthetic polypeptide
AESEIACTNPVGTEGYGIVSCGSEHNQHFGSDQS

SEQ ID NO: 196524 - protein, 37 aa, Artificial Sequence
  Description of Artificial Sequence: Synthetic polypeptide
DEGEIACTNPVATEQWGCVACATVGNLDNIAGDDSDM

SEQ ID NO: 196525 - protein, 35 aa, Artificial Sequence
  Description of Artificial Sequence: Synthetic polypeptide
AESEIACTNPVGTEGYGVSCGSEDHNQHFGSDNQS

SEQ ID NO: 196526 - protein, 35 aa, Artificial Sequence
  Description of Artificial Sequence: Synthetic polypeptide
AESEIACTNPVGTEGYGVSCGSEHNAEHFGSDNQS

SEQ ID NO: 196527 - protein, 35 aa, Artificial Sequence
  Description of Artificial Sequence: Synthetic polypeptide
QEGEIAPTNPCSYEQYGVTVSCCNMLSQSVGGDPC

SEQ ID NO: 196528 - protein, 34 aa, Artificial Sequence
  Description of Artificial Sequence: Synthetic polypeptide
AESEIACTNPVGTEGYGVSCGSELNQHFGSDFQS

SEQ ID NO: 196529 - protein, 35 aa, Artificial Sequence
  Description of Artificial Sequence: Synthetic polypeptide
QEGEIAPTNPCSYEQYGVTVSCCNMLSQSVGGTQV

SEQ ID NO: 196530 - protein, 38 aa, Artificial Sequence
  Description of Artificial Sequence: Synthetic polypeptide
DETNEIATTNPVAYEQWGEVCSTHNQGNHGEEGGDGRN

SEQ ID NO: 196531 - protein, 38 aa, Artificial Sequence
  Description of Artificial Sequence: Synthetic polypeptide
AEAEIRTTNPVATEQYGCSCSNWGEPHNQENFNSDTQA

SEQ ID NO: 196532 - protein, 39 aa, Artificial Sequence
  Description of Artificial Sequence: Synthetic polypeptide
DEEEISTTNPVATEQYGQCVCSNWMEDDNQENFNSDNQA

SEQ ID NO: 196533 - protein, 38 aa, Artificial Sequence
  Description of Artificial Sequence: Synthetic polypeptide
CEDEIRTTNPVATEGYGSVGNNDEFDEEEDEDGGNQGG

SEQ ID NO: 196534 - protein, 33 aa, Artificial Sequence
  Description of Artificial Sequence: Synthetic polypeptide
QEMEIACTNPCSYEQYGCVCSWEDQESFGSEQA

SEQ ID NO: 196535 - protein, 35 aa, Artificial Sequence
  Description of Artificial Sequence: Synthetic polypeptide
DETNEIATTNPVAYERWGVCYTINGNQGEWGDGDY

SEQ ID NO: 196536 - protein, 39 aa, Artificial Sequence
  Description of Artificial Sequence: Synthetic polypeptide
DEEEISTTNPVATEQYGQCVCSNWMEDHNAEFFNSDTQP

SEQ ID NO: 196537 - protein, 37 aa, Artificial Sequence
  Description of Artificial Sequence: Synthetic polypeptide
DEEEIACTNPVATEPYGSACAAANPAEADAEIGNNTM

SEQ ID NO: 196538 - protein, 35 aa, Artificial Sequence
  Description of Artificial Sequence: Synthetic polypeptide
QEGEIAPTNPCSYEQYGVTVSCCNMLSQFNGGTDP

SEQ ID NO: 196539 - protein, 38 aa, Artificial Sequence
  Description of Artificial Sequence: Synthetic polypeptide
DDEEIRTTNPVGTEQWGCVCSNWGELHNAENFGSVNQS

SEQ ID NO: 196540 - protein, 37 aa, Artificial Sequence
  Description of Artificial Sequence: Synthetic polypeptide
SEAEISTTNPVATEQYGCVCSNWGEHNEEGFNSETQA

SEQ ID NO: 196541 - protein, 38 aa, Artificial Sequence
  Description of Artificial Sequence: Synthetic polypeptide
QEGEIATTNPVATEQYGIVSFSAVDDTLREPHEGEDTR

SEQ ID NO: 196542 - protein, 38 aa, Artificial Sequence
  Description of Artificial Sequence: Synthetic polypeptide
QENEIRTTNPVATEFYGSVVNPTTPIGPEMGQGENEEG

SEQ ID NO: 196543 - protein, 39 aa, Artificial Sequence
  Description of Artificial Sequence: Synthetic polypeptide
DEEEISTTNPVATEQYGQCVCSNWGEPHNTEHFNSDTQA

SEQ ID NO: 196544 - protein, 34 aa, Artificial Sequence
  Description of Artificial Sequence: Synthetic polypeptide
DEASIATTNPIAYECWGSVYHWHNDVQRQDQITM

SEQ ID NO: 196545 - protein, 36 aa, Artificial Sequence
  Description of Artificial Sequence: Synthetic polypeptide
DETEIATTNPVAYEAWGVVWPGPNNENDQGQGNGEM

SEQ ID NO: 196546 - protein, 38 aa, Artificial Sequence
  Description of Artificial Sequence: Synthetic polypeptide
CEEEISTTNPVATEQYGCVCSNWGEADNQENFNSDNQS

SEQ ID NO: 196547 - protein, 37 aa, Artificial Sequence
  Description of Artificial Sequence: Synthetic polypeptide
DEGEIACTNPVATEQYGCSSAANTHGPEAGNQMENTN

SEQ ID NO: 196548 - protein, 35 aa, Artificial Sequence
  Description of Artificial Sequence: Synthetic polypeptide
GEETEIATTNPVAYESWGCVCTIDSNDRNDQQNET

SEQ ID NO: 196549 - protein, 39 aa, Artificial Sequence
  Description of Artificial Sequence: Synthetic polypeptide
DEEEISTTNPVATEQYGQCVCSNWGELHNAENFNSETQD

SEQ ID NO: 196550 - protein, 35 aa, Artificial Sequence
  Description of Artificial Sequence: Synthetic polypeptide
DEGEIACTNPVATEQWGTNCAATDGNPVEFEINED

SEQ ID NO: 196551 - protein, 38 aa, Artificial Sequence
  Description of Artificial Sequence: Synthetic polypeptide
QEGEIATTNPVATEQYGIISWSAPDDTLREPHEGEDTR

SEQ ID NO: 196552 - protein, 37 aa, Artificial Sequence
  Description of Artificial Sequence: Synthetic polypeptide
DEGEIACTNPVATEQWGSVSGEGGPGGINHSDDNSAA

SEQ ID NO: 196553 - protein, 38 aa, Artificial Sequence
  Description of Artificial Sequence: Synthetic polypeptide
QEGEIATTNPVATEQYGIISFSPPDDTTREPHEGEDTR

SEQ ID NO: 196554 - protein, 39 aa, Artificial Sequence
  Description of Artificial Sequence: Synthetic polypeptide
DEEEISTTNPVATEQYGQCVCSNWGEWHNQENFGSDTQS

SEQ ID NO: 196555 - protein, 38 aa, Artificial Sequence
  Description of Artificial Sequence: Synthetic polypeptide
CEDEIRSTNPVATEQYGSVSDMDDDGDQQQVDNGGGDT

SEQ ID NO: 196556 - protein, 36 aa, Artificial Sequence
  Description of Artificial Sequence: Synthetic polypeptide
DDEEIRTTNPVGTEQWGCVCSNWGEHNAENFISVQS

SEQ ID NO: 196557 - protein, 38 aa, Artificial Sequence
  Description of Artificial Sequence: Synthetic polypeptide
DEEEISTTNPVATEQYGQCVCSNWGPDHNAFFNSDTQS

SEQ ID NO: 196558 - protein, 36 aa, Artificial Sequence
  Description of Artificial Sequence: Synthetic polypeptide
DEGEIACTNPVATEQWGGCVAGTTGSHQEPDMIENF

SEQ ID NO: 196559 - protein, 34 aa, Artificial Sequence
  Description of Artificial Sequence: Synthetic polypeptide
DETGIACTNPVATASWGCVAGNNNLQEDAPGGKH

SEQ ID NO: 196560 - protein, 38 aa, Artificial Sequence
  Description of Artificial Sequence: Synthetic polypeptide
DEEEIRTTNPVATEQYGRQCVAYIQVNDASDYEITQIE

SEQ ID NO: 196561 - protein, 38 aa, Artificial Sequence
  Description of Artificial Sequence: Synthetic polypeptide
DENEIRTTNPVSTEGYGCICSTWEELHNAEQFNSDNQA

SEQ ID NO: 196562 - protein, 36 aa, Artificial Sequence
  Description of Artificial Sequence: Synthetic polypeptide
AENEIATTNPVATEGYGCVCSMWGEDNAHFISENQA

SEQ ID NO: 196563 - protein, 34 aa, Artificial Sequence
  Description of Artificial Sequence: Synthetic polypeptide
DESEIRTTNPIATECWGATWANCENWAEPEGPYI

SEQ ID NO: 196564 - protein, 39 aa, Artificial Sequence
  Description of Artificial Sequence: Synthetic polypeptide
DEEEIRTTNPVATEAYGVVTTQIGTTEQGSTNDEEEEEQ

SEQ ID NO: 196565 - protein, 39 aa, Artificial Sequence
  Description of Artificial Sequence: Synthetic polypeptide
DEVEIRTTNPVATESYGSAVIMQDGPEGQGDEQGQEEQR

SEQ ID NO: 196566 - protein, 34 aa, Artificial Sequence
  Description of Artificial Sequence: Synthetic polypeptide
DESEIRTTNPIATECWGATWANAIDWAEPEGPYI

SEQ ID NO: 196567 - protein, 37 aa, Artificial Sequence
  Description of Artificial Sequence: Synthetic polypeptide
DEEEIRTTNPVGTEQWGCVAGPANEPGGEHGSDIEAM

SEQ ID NO: 196568 - protein, 35 aa, Artificial Sequence
  Description of Artificial Sequence: Synthetic polypeptide
SEEEIASVNPVCTEQYGVVCSWGEDDQESFGSDQA

SEQ ID NO: 196569 - protein, 38 aa, Artificial Sequence
  Description of Artificial Sequence: Synthetic polypeptide
DEECISTTNPVATEQYGQCVCSNWGEHNAEHFNSDNQS

SEQ ID NO: 196570 - protein, 38 aa, Artificial Sequence
  Description of Artificial Sequence: Synthetic polypeptide
VEDEIRTTNPVATEQYGQYDTDNMDVGIGQGGGGQTVD

SEQ ID NO: 196571 - protein, 34 aa, Artificial Sequence
  Description of Artificial Sequence: Synthetic polypeptide
NENAEIATTNPVAYEAWGTVYCSDLNDDEKQGMV

SEQ ID NO: 196572 - protein, 37 aa, Artificial Sequence
  Description of Artificial Sequence: Synthetic polypeptide
MEQEIRTTNPVATEGYGTIVSDLFTGDPEGQGEDEGI

SEQ ID NO: 196573 - protein, 38 aa, Artificial Sequence
  Description of Artificial Sequence: Synthetic polypeptide
DEMEIATTNPVATEEYGQCVCSTWGEHNEEHFGSETQA

SEQ ID NO: 196574 - protein, 36 aa, Artificial Sequence
  Description of Artificial Sequence: Synthetic polypeptide
WEEEIACTNPVATEQYGSCAAAGNAEGADSGSGEDA

SEQ ID NO: 196575 - protein, 40 aa, Artificial Sequence
  Description of Artificial Sequence: Synthetic polypeptide
DEEEIRTTNPVATEGYGVVDVGVGTGNVGEEEGGEGNDLI

SEQ ID NO: 196576 - protein, 36 aa, Artificial Sequence
  Description of Artificial Sequence: Synthetic polypeptide
DEDEIATTNPVATASWGCVAAANPAEPTDRGGENGD

SEQ ID NO: 196577 - protein, 38 aa, Artificial Sequence
  Description of Artificial Sequence: Synthetic polypeptide
MEQEIRTTNPVATEQYGDVTTVMTNGFEGGDEGGQTQY

SEQ ID NO: 196578 - protein, 39 aa, Artificial Sequence
  Description of Artificial Sequence: Synthetic polypeptide
DEEEIRTTNPVAYEQYGQCVCSNWEEDHNAESFNSETQS

SEQ ID NO: 196579 - protein, 38 aa, Artificial Sequence
  Description of Artificial Sequence: Synthetic polypeptide
DEEEISTTNPVATEYYGCVCSNSGEDHNAENFNSDTQA

SEQ ID NO: 196580 - protein, 34 aa, Artificial Sequence
  Description of Artificial Sequence: Synthetic polypeptide
DESEIRTTNPIATECWGATWSNAEDWAEPKGPYI

SEQ ID NO: 196581 - protein, 38 aa, Artificial Sequence
  Description of Artificial Sequence: Synthetic polypeptide
DEEEISTTNPVATEYYGCVCSNWGEDHNAENFNSETQA

SEQ ID NO: 196582 - protein, 38 aa, Artificial Sequence
  Description of Artificial Sequence: Synthetic polypeptide
DEECISTTNPVATEQYGQCVCSNWGEHNAENFGSDTQS

SEQ ID NO: 196583 - protein, 35 aa, Artificial Sequence
  Description of Artificial Sequence: Synthetic polypeptide
DESEIRTTNPIATECWGATWSNAIDEAERKGEPYI

SEQ ID NO: 196584 - protein, 37 aa, Artificial Sequence
  Description of Artificial Sequence: Synthetic polypeptide
DEAEIRTTNPVATEGWGCVCSNWGEHNAEYFGSQTQS

SEQ ID NO: 196585 - protein, 38 aa, Artificial Sequence
  Description of Artificial Sequence: Synthetic polypeptide
DEEEIACTNPVATEQWGCSSAAGTHGPEAGGNLMEGTN

SEQ ID NO: 196586 - protein, 38 aa, Artificial Sequence
  Description of Artificial Sequence: Synthetic polypeptide
DEEEISTTNPVATEQYGCVCQNWGEDHNAENFNSDTQS

SEQ ID NO: 196587 - protein, 32 aa, Artificial Sequence
  Description of Artificial Sequence: Synthetic polypeptide
DETEIATTNPIATECWGATAAEEDWAEPKGPI

SEQ ID NO: 196588 - protein, 38 aa, Artificial Sequence
  Description of Artificial Sequence: Synthetic polypeptide
DEEEISTTNPVATEQYGCVCQNWGEDHNAENFNSDNQQ

SEQ ID NO: 196589 - protein, 38 aa, Artificial Sequence
  Description of Artificial Sequence: Synthetic polypeptide
DEEEISTTNPVATEQYGCVCQNWGEDHNAENFNSDNQA

SEQ ID NO: 196590 - protein, 38 aa, Artificial Sequence
  Description of Artificial Sequence: Synthetic polypeptide
DEEEISTTNPVATEQYGCVCQNWGEDHNAEFFNSDNQA

SEQ ID NO: 196591 - protein, 38 aa, Artificial Sequence
  Description of Artificial Sequence: Synthetic polypeptide
DEEEIRTTNPVGTEQWGSFVAGPANEPGGEAGGDIEAM

SEQ ID NO: 196592 - protein, 36 aa, Artificial Sequence
  Description of Artificial Sequence: Synthetic polypeptide
DEDEIATTNPVATASWGCVAAANNEVDDRGGENTHQ

SEQ ID NO: 196593 - protein, 34 aa, Artificial Sequence
  Description of Artificial Sequence: Synthetic polypeptide
DAEEIATTNPVGYAQWGGCSAGNNLATMNPGDHE

SEQ ID NO: 196594 - protein, 38 aa, Artificial Sequence
  Description of Artificial Sequence: Synthetic polypeptide
DEEEISTTNPVATEQYGCVCQNWEEDHNAENFNSDTQA

SEQ ID NO: 196595 - protein, 38 aa, Artificial Sequence
  Description of Artificial Sequence: Synthetic polypeptide
DEEEISTTNPVATEQYGCVCQNWEEDHNAENFNSDNQP

SEQ ID NO: 196596 - protein, 38 aa, Artificial Sequence
  Description of Artificial Sequence: Synthetic polypeptide
QEEEIRTTNPVATDQYGMITVNMGMEDINEEGGNIGDQ

SEQ ID NO: 196597 - protein, 36 aa, Artificial Sequence
  Description of Artificial Sequence: Synthetic polypeptide
QEDEIRGTNPVATEFYGVVYTDQGQDQTDEGGQTGF

SEQ ID NO: 196598 - protein, 40 aa, Artificial Sequence
  Description of Artificial Sequence: Synthetic polypeptide
DEEEIRTTNPVATEGYGVVDVGVGTGNVGNEEGNEGNDTG

SEQ ID NO: 196599 - protein, 36 aa, Artificial Sequence
  Description of Artificial Sequence: Synthetic polypeptide
DEDEIATTNPVATASWGCVAAANNEVQDAGGENDGN

SEQ ID NO: 196600 - protein, 38 aa, Artificial Sequence
  Description of Artificial Sequence: Synthetic polypeptide
DEEEIRTTNPVGTEQWGHSVAGPANEPGGEHGGDIEAM

SEQ ID NO: 196601 - protein, 34 aa, Artificial Sequence
  Description of Artificial Sequence: Synthetic polypeptide
DESEIRTTNPIATECWGATWSNAIDEAEPKGPYI

SEQ ID NO: 196602 - protein, 37 aa, Artificial Sequence
  Description of Artificial Sequence: Synthetic polypeptide
QETAEIATTNPVAYEQWGSVAITNNEEAGDGTMGNTM

SEQ ID NO: 196603 - protein, 37 aa, Artificial Sequence
  Description of Artificial Sequence: Synthetic polypeptide
DEVEISTTNPVATEQYGVIADDLTQIMDGGDDGGGDL

SEQ ID NO: 196604 - protein, 36 aa, Artificial Sequence
  Description of Artificial Sequence: Synthetic polypeptide
DEDEIATTNPVATASWGCVAAANWEVADQGGQNDNW

SEQ ID NO: 196605 - protein, 34 aa, Artificial Sequence
  Description of Artificial Sequence: Synthetic polypeptide
DESEIRTTNPIATECWGATVANAIDWPAEPEGPI

SEQ ID NO: 196606 - protein, 37 aa, Artificial Sequence
  Description of Artificial Sequence: Synthetic polypeptide
AEEEISTTNPVATEQYGCVCGNWGEHNAENFISENQS

SEQ ID NO: 196607 - protein, 34 aa, Artificial Sequence
  Description of Artificial Sequence: Synthetic polypeptide
DESEIRTTNPIATECWGATVANAIDWAEPEGPYI

SEQ ID NO: 196608 - protein, 37 aa, Artificial Sequence
  Description of Artificial Sequence: Synthetic polypeptide
AEEEISTTNPVATEQYGCVCGNWGEHNAENFNSDTQA

SEQ ID NO: 196609 - protein, 34 aa, Artificial Sequence
  Description of Artificial Sequence: Synthetic polypeptide
DETEIASTNPIATEGYGATTWANAEDWQEPKGPI

SEQ ID NO: 196610 - protein, 38 aa, Artificial Sequence
  Description of Artificial Sequence: Synthetic polypeptide
DDAEIRTTNPVATEQYGTSACPTLARLNHTQIEVQIHD

SEQ ID NO: 196611 - protein, 40 aa, Artificial Sequence
  Description of Artificial Sequence: Synthetic polypeptide
DEEEIRTTNPVATEAYGVVVTTNIGTTEQGSTNDESNSET

SEQ ID NO: 196612 - protein, 39 aa, Artificial Sequence
  Description of Artificial Sequence: Synthetic polypeptide
AEDEICATNPVATEQYGVVATVVVTNQLLQQLNGNDEDD

SEQ ID NO: 196613 - protein, 37 aa, Artificial Sequence
  Description of Artificial Sequence: Synthetic polypeptide
AEDEICATNPVATEQYGVVATVVSNNQQQLNGIGTDQ

SEQ ID NO: 196614 - protein, 40 aa, Artificial Sequence
  Description of Artificial Sequence: Synthetic polypeptide
DEEEIRTTNPVATEAYGVVVTTQIGTTEQGSTNDEQNQEE

SEQ ID NO: 196615 - protein, 37 aa, Artificial Sequence
  Description of Artificial Sequence: Synthetic polypeptide
MEQEIRTTNPVATEQYGSIFNWCCPDDGSHESQFIQW

SEQ ID NO: 196616 - protein, 37 aa, Artificial Sequence
  Description of Artificial Sequence: Synthetic polypeptide
MEQEIRTTNPVATEQYGSIFNWCCPGDGSHEDQFIKK

SEQ ID NO: 196617 - protein, 39 aa, Artificial Sequence
  Description of Artificial Sequence: Synthetic polypeptide
DEEEIRTTNPVATEAYGVVVTVVTNQAGTEAGTVTEESE

SEQ ID NO: 196618 - protein, 37 aa, Artificial Sequence
  Description of Artificial Sequence: Synthetic polypeptide
DEECIRTTNPVAYEGYGCVCSNWGEHNQEYFISDNQS

SEQ ID NO: 196619 - protein, 37 aa, Artificial Sequence
  Description of Artificial Sequence: Synthetic polypeptide
DEECIRTTNPVAYEGYGCVCSNWGEENAENFNSDNQS

SEQ ID NO: 196620 - protein, 36 aa, Artificial Sequence
  Description of Artificial Sequence: Synthetic polypeptide
TEEEIRTTNPVAYEQWGHNNVYYWEEQQHHPGKGHE

SEQ ID NO: 196621 - protein, 33 aa, Artificial Sequence
  Description of Artificial Sequence: Synthetic polypeptide
DETEIASTNPIATECWGATTANSDLAEPKGPYI

SEQ ID NO: 196622 - protein, 37 aa, Artificial Sequence
  Description of Artificial Sequence: Synthetic polypeptide
DEVEISTTNPVATEQYGVIVDDLTQTMDGGGDGGEDD

SEQ ID NO: 196623 - protein, 36 aa, Artificial Sequence
  Description of Artificial Sequence: Synthetic polypeptide
DEDEIATTNPVATASWGCVAAANWEEADRGGENDHW

SEQ ID NO: 196624 - protein, 38 aa, Artificial Sequence
  Description of Artificial Sequence: Synthetic polypeptide
MEQEIRTTNPVATEQYGSIFNWCCPDDGSHENGQFIKM

SEQ ID NO: 196625 - protein, 38 aa, Artificial Sequence
  Description of Artificial Sequence: Synthetic polypeptide
AEEEISTTNPVATEQYGCQVCSNWGEHNTENFNSETQF

SEQ ID NO: 196626 - protein, 36 aa, Artificial Sequence
  Description of Artificial Sequence: Synthetic polypeptide
DEDEIATTNPVATASWGCVAAANWEVADRGGEIDNM

SEQ ID NO: 196627 - protein, 39 aa, Artificial Sequence
  Description of Artificial Sequence: Synthetic polypeptide
DEEEISTTNPVATEYYGQCVCSTWGEDHNAENFNSENQA

SEQ ID NO: 196628 - protein, 35 aa, Artificial Sequence
  Description of Artificial Sequence: Synthetic polypeptide
DESEIRTTNPIATECWGATVWANAIDWAEPEGPYI

SEQ ID NO: 196629 - protein, 38 aa, Artificial Sequence
  Description of Artificial Sequence: Synthetic polypeptide
DEVEISTTNPVATEQYGVIVDDDLTQIMDGGDDGGEDA

SEQ ID NO: 196630 - protein, 38 aa, Artificial Sequence
  Description of Artificial Sequence: Synthetic polypeptide
DEEEISTTNPVAWEQYGCVCSNWGEDHNAENFNSDTQA

SEQ ID NO: 196631 - protein, 38 aa, Artificial Sequence
  Description of Artificial Sequence: Synthetic polypeptide
DEEEISTTNPVAWEQYGCVCSNWGEDHNQENFGSETQS

SEQ ID NO: 196632 - protein, 37 aa, Artificial Sequence
  Description of Artificial Sequence: Synthetic polypeptide
DEVEISTTNPVATEQYGVIVDDLTQIMDGEDDGGEDT

SEQ ID NO: 196633 - protein, 37 aa, Artificial Sequence
  Description of Artificial Sequence: Synthetic polypeptide
DEVEISTTNPVATEQYGVIVDDLTQIMDGGDDGGEMY

SEQ ID NO: 196634 - protein, 34 aa, Artificial Sequence
  Description of Artificial Sequence: Synthetic polypeptide
DETEIATTNPCATECWGATTWANCDWAEPKGPYR

SEQ ID NO: 196635 - protein, 38 aa, Artificial Sequence
  Description of Artificial Sequence: Synthetic polypeptide
DEEEISTTNPVAWEQYGQCVCSWEEDHNAENFNSDTQA

SEQ ID NO: 196636 - protein, 37 aa, Artificial Sequence
  Description of Artificial Sequence: Synthetic polypeptide
AEEEISTTNPVATEGYGQCVCSWGEHNQENFNSDNQG

SEQ ID NO: 196637 - protein, 34 aa, Artificial Sequence
  Description of Artificial Sequence: Synthetic polypeptide
DETEIATTNPCATECWGATTWANADWAEPKGPYR

SEQ ID NO: 196638 - protein, 38 aa, Artificial Sequence
  Description of Artificial Sequence: Synthetic polypeptide
AEEEICTTNPVATEQYGVVATVAEQGAEQYGVEEEDED

SEQ ID NO: 196639 - protein, 34 aa, Artificial Sequence
  Description of Artificial Sequence: Synthetic polypeptide
DETEIASTNPVSTECWGNTVWAAATIQERVGQYI

SEQ ID NO: 196640 - protein, 38 aa, Artificial Sequence
  Description of Artificial Sequence: Synthetic polypeptide
AEEEISTTNPVATEQYGCIVCSSGEDHNTENFNSETQA

SEQ ID NO: 196641 - protein, 35 aa, Artificial Sequence
  Description of Artificial Sequence: Synthetic polypeptide
DESEIRTTNPIATECWGATVWAAAEDWQSPKGPYI

SEQ ID NO: 196642 - protein, 39 aa, Artificial Sequence
  Description of Artificial Sequence: Synthetic polypeptide
AEEEISTTNPVATEQYGCQVCSNWGEDHNTENFNSENQS

SEQ ID NO: 196643 - protein, 36 aa, Artificial Sequence
  Description of Artificial Sequence: Synthetic polypeptide
DETEIASTNPVATEQWGTHCSAAAAHGMNRGSGDSW

SEQ ID NO: 196644 - protein, 36 aa, Artificial Sequence
  Description of Artificial Sequence: Synthetic polypeptide
QETAEIATTNPVAYEQWGSVAITNNEEAGDGTGAQE

SEQ ID NO: 196645 - protein, 35 aa, Artificial Sequence
  Description of Artificial Sequence: Synthetic polypeptide
AEEVIATTNPCATQEYGCICCCLNELSTRPPGNNV

SEQ ID NO: 196646 - protein, 37 aa, Artificial Sequence
  Description of Artificial Sequence: Synthetic polypeptide
DEMEIRTTNPVSTEGYGCICSNWEEHNAENFGSDNQA

SEQ ID NO: 196647 - protein, 36 aa, Artificial Sequence
  Description of Artificial Sequence: Synthetic polypeptide
QAEEIATTNPVATEQWGCVAGTDGPTDGDNLNDDEL

SEQ ID NO: 196648 - protein, 36 aa, Artificial Sequence
  Description of Artificial Sequence: Synthetic polypeptide
CEEEIACTNPVATEQYGCAAGTGNPITEAEGGTEHG

SEQ ID NO: 196649 - protein, 38 aa, Artificial Sequence
  Description of Artificial Sequence: Synthetic polypeptide
DEGEIRCTNPVATEQYGCCGVVKFVNVHEGDQISGEME

SEQ ID NO: 196650 - protein, 37 aa, Artificial Sequence
  Description of Artificial Sequence: Synthetic polypeptide
CEEEIACTNPVATEQYGSACAPNPEEEAGAHQDGDAP

SEQ ID NO: 196651 - protein, 36 aa, Artificial Sequence
  Description of Artificial Sequence: Synthetic polypeptide
CETEIACTNPVAYEQYGSACAANPQPQEHQDGNQHQ

SEQ ID NO: 196652 - protein, 38 aa, Artificial Sequence
  Description of Artificial Sequence: Synthetic polypeptide
DEAEIRTTNPVATEQYGSTIPWPPPLENNQSHSQIEMQ

SEQ ID NO: 196653 - protein, 38 aa, Artificial Sequence
  Description of Artificial Sequence: Synthetic polypeptide
DEEEIATTNPVAYEQYGQCVCSNWMEDHNQENFGSQQA

SEQ ID NO: 196654 - protein, 39 aa, Artificial Sequence
  Description of Artificial Sequence: Synthetic polypeptide
DENEIRTTNPVATESYGVVVDIMGQDNVLQNEENQGDEE

SEQ ID NO: 196655 - protein, 38 aa, Artificial Sequence
  Description of Artificial Sequence: Synthetic polypeptide
DEGEIRCTNPVATEQYGCCGWVSDVWVHEGIQISNEME

SEQ ID NO: 196656 - protein, 38 aa, Artificial Sequence
  Description of Artificial Sequence: Synthetic polypeptide
DEAEIRTTNPVATEQYGSTIPWPPPLEENQHSQIEYMQ

SEQ ID NO: 196657 - protein, 33 aa, Artificial Sequence
  Description of Artificial Sequence: Synthetic polypeptide
DETEIATTNPIATECWGATTWSNADWAEPKGPL

SEQ ID NO: 196658 - protein, 37 aa, Artificial Sequence
  Description of Artificial Sequence: Synthetic polypeptide
CEEEIACTNPVATEQYGSCAAGGTVETGPDDGMGDFH

SEQ ID NO: 196659 - protein, 38 aa, Artificial Sequence
  Description of Artificial Sequence: Synthetic polypeptide
YEQEICTTNPVATDQYGSVVDIMDDNNEQEGINGQTNA

SEQ ID NO: 196660 - protein, 39 aa, Artificial Sequence
  Description of Artificial Sequence: Synthetic polypeptide
VEDEIRTTNPVATEQYGSVVNPQTLEMGPEMGQGENEEG

SEQ ID NO: 196661 - protein, 35 aa, Artificial Sequence
  Description of Artificial Sequence: Synthetic polypeptide
DEDEIATTNPVATASWGCVAAANNEPLDNGGEGGP

SEQ ID NO: 196662 - protein, 38 aa, Artificial Sequence
  Description of Artificial Sequence: Synthetic polypeptide
DENEIRTTNPVATEQYWGACCWVADVDVEQLEGPEDHL

SEQ ID NO: 196663 - protein, 39 aa, Artificial Sequence
  Description of Artificial Sequence: Synthetic polypeptide
DEEEIRGTNPVATEQYGCVNVPCISFEMSEFNSVPPGDV

SEQ ID NO: 196664 - protein, 37 aa, Artificial Sequence
  Description of Artificial Sequence: Synthetic polypeptide
CETEIACTNPVAYEQYGSVAAITNNEEAPGNQMEGEP

SEQ ID NO: 196665 - protein, 38 aa, Artificial Sequence
  Description of Artificial Sequence: Synthetic polypeptide
CEEEIACTNPVATEQYGSACATGNPDEEAGAHQDNDFP

SEQ ID NO: 196666 - protein, 38 aa, Artificial Sequence
  Description of Artificial Sequence: Synthetic polypeptide
DEEEISTTNPVATEQYGCVCSMSGEDHNQENFSSDTQT

SEQ ID NO: 196667 - protein, 38 aa, Artificial Sequence
  Description of Artificial Sequence: Synthetic polypeptide
DEEEIATTNPVAYEQYGQCVCSNWGEDDNQEYFNSDQA

SEQ ID NO: 196668 - protein, 38 aa, Artificial Sequence
  Description of Artificial Sequence: Synthetic polypeptide
AEEAISTTNPVATEQYGCVCSTWGEDHNTENFNSDTQS

SEQ ID NO: 196669 - protein, 36 aa, Artificial Sequence
  Description of Artificial Sequence: Synthetic polypeptide
DEEEIRTTNPCAYEQYGSACAAVANGAEPPMIDQHE

SEQ ID NO: 196670 - protein, 37 aa, Artificial Sequence
  Description of Artificial Sequence: Synthetic polypeptide
DEAAIRTTNPVATEQYGCFCSNWGEHNAENFNSDTQS

SEQ ID NO: 196671 - protein, 38 aa, Artificial Sequence
  Description of Artificial Sequence: Synthetic polypeptide
DEVEIRTTNPVATEQYGMMGYDGSGNMDDIMDEGGTAT

SEQ ID NO: 196672 - protein, 39 aa, Artificial Sequence
  Description of Artificial Sequence: Synthetic polypeptide
DEEEIRGTNPVATEQYGCVNHPCASFEMHEFNTVPNGDF

SEQ ID NO: 196673 - protein, 37 aa, Artificial Sequence
  Description of Artificial Sequence: Synthetic polypeptide
DEEEIRTTNPCAYEQYGCVCGNWGEDNAEYFNSDTQS

SEQ ID NO: 196674 - protein, 38 aa, Artificial Sequence
  Description of Artificial Sequence: Synthetic polypeptide
DENEIRTTNPVATEQWGAVVDNNEEGEEMNTGEGQGTN

SEQ ID NO: 196675 - protein, 38 aa, Artificial Sequence
  Description of Artificial Sequence: Synthetic polypeptide
DENEIRTTNPVATEQWGAVVDNQEEGEEMNAGEGDIEQ

SEQ ID NO: 196676 - protein, 38 aa, Artificial Sequence
  Description of Artificial Sequence: Synthetic polypeptide
CEEEIACTNPVATEQYGSVACSAANPLPAEAPIEDAHQ

SEQ ID NO: 196677 - protein, 36 aa, Artificial Sequence
  Description of Artificial Sequence: Synthetic polypeptide
SEEEIASVNPVCTEQYGCVCSWGEHNQESFGSDNQA

SEQ ID NO: 196678 - protein, 37 aa, Artificial Sequence
  Description of Artificial Sequence: Synthetic polypeptide
DDAEIRTTNPVATEQYGCVCSWGEDHNAENFPSDTQS

SEQ ID NO: 196679 - protein, 38 aa, Artificial Sequence
  Description of Artificial Sequence: Synthetic polypeptide
DESEIRTTNPVATEQYGVYGNSGMGQGNQEAEIAGQDD

SEQ ID NO: 196680 - protein, 33 aa, Artificial Sequence
  Description of Artificial Sequence: Synthetic polypeptide
DETEIATTNPIATECWGATWSNAECWQPKEPYI

SEQ ID NO: 196681 - protein, 38 aa, Artificial Sequence
  Description of Artificial Sequence: Synthetic polypeptide
DENEIRTTNPVATEWYGQAWYTYNPDPGQDLEQNDYQE

SEQ ID NO: 196682 - protein, 39 aa, Artificial Sequence
  Description of Artificial Sequence: Synthetic polypeptide
DENEIRTTNPVATEWYGQAWCTYNTDPLGQDLEHNDYQE

SEQ ID NO: 196683 - protein, 38 aa, Artificial Sequence
  Description of Artificial Sequence: Synthetic polypeptide
DEGEIRCTNPVATEQYGCCCVQNTYYTLTPGEPQEVHE

SEQ ID NO: 196684 - protein, 38 aa, Artificial Sequence
  Description of Artificial Sequence: Synthetic polypeptide
DENEIRTTNPVATEQWGAVVDNTEEGEEMNGGNGDGTN

SEQ ID NO: 196685 - protein, 38 aa, Artificial Sequence
  Description of Artificial Sequence: Synthetic polypeptide
DDEEIRTTNPVATEQYGQCVCSNWEEHNQENFISDTQA

SEQ ID NO: 196686 - protein, 37 aa, Artificial Sequence
  Description of Artificial Sequence: Synthetic polypeptide
DDAEIRTTNPVATEQYGCYCSNWGEHNAEHFGSQTQA

SEQ ID NO: 196687 - protein, 39 aa, Artificial Sequence
  Description of Artificial Sequence: Synthetic polypeptide
DDEEIRTTNPVATEQYGQCVCSNWGEDDNAENFNSDNQS

SEQ ID NO: 196688 - protein, 38 aa, Artificial Sequence
  Description of Artificial Sequence: Synthetic polypeptide
DEEEIACTNPVATEQWGCNATANGPGLDTGAPDGSVRN

SEQ ID NO: 196689 - protein, 37 aa, Artificial Sequence
  Description of Artificial Sequence: Synthetic polypeptide
DEMEIATTNPVATEGYGCVCSNSGEPNAEFFGSDTQA

SEQ ID NO: 196690 - protein, 33 aa, Artificial Sequence
  Description of Artificial Sequence: Synthetic polypeptide
DETEIATTNPIATECWGATTWAAEDLAPKGPYI

SEQ ID NO: 196691 - protein, 37 aa, Artificial Sequence
  Description of Artificial Sequence: Synthetic polypeptide
SEAEIRTTNPVATEQYGCACMETVPALIWQEIQEDDN

SEQ ID NO: 196692 - protein, 38 aa, Artificial Sequence
  Description of Artificial Sequence: Synthetic polypeptide
DEAEISTTNPVATEQYGCVCSMWGEDHNAENFNSDNQA

SEQ ID NO: 196693 - protein, 34 aa, Artificial Sequence
  Description of Artificial Sequence: Synthetic polypeptide
QAEEIATTNPVATEQWGCVAAGEGGHGQESEEEN

SEQ ID NO: 196694 - protein, 38 aa, Artificial Sequence
  Description of Artificial Sequence: Synthetic polypeptide
DEAEISTVNPVATEQYGQCVCSNWGEHNAEYFGSDNQS

SEQ ID NO: 196695 - protein, 37 aa, Artificial Sequence
  Description of Artificial Sequence: Synthetic polypeptide
DEMEIRTTNPVAYEQYGCTIVNVIHEREEHGFSETPQ

SEQ ID NO: 196696 - protein, 38 aa, Artificial Sequence
  Description of Artificial Sequence: Synthetic polypeptide
DENEIRTTNPVATEQWGCVCSNSGEDTNAEYSISDTAS

SEQ ID NO: 196697 - protein, 38 aa, Artificial Sequence
  Description of Artificial Sequence: Synthetic polypeptide
DDEEIRTTNPVATEQYGQCVCSNWGEHNAENFISETQS

SEQ ID NO: 196698 - protein, 37 aa, Artificial Sequence
  Description of Artificial Sequence: Synthetic polypeptide
DENEIRTTNPVATEQWGCVCSNSGEENAEAFSSDTAA

SEQ ID NO: 196699 - protein, 37 aa, Artificial Sequence
  Description of Artificial Sequence: Synthetic polypeptide
CEGEIATTNPVATEQYGSACAANNGEEAGMEMDGLNH

SEQ ID NO: 196700 - protein, 39 aa, Artificial Sequence
  Description of Artificial Sequence: Synthetic polypeptide
DEEEIRTTNPVAYEQYGQCVCSNWEEDHNEEHFNSDNQA

SEQ ID NO: 196701 - protein, 34 aa, Artificial Sequence
  Description of Artificial Sequence: Synthetic polypeptide
DETEIATTNPIATECWGATTANAEDLAEPKGPYI

SEQ ID NO: 196702 - protein, 33 aa, Artificial Sequence
  Description of Artificial Sequence: Synthetic polypeptide
DETEIATTNPIATECWGATMWANAEDWAEPGPI

SEQ ID NO: 196703 - protein, 33 aa, Artificial Sequence
  Description of Artificial Sequence: Synthetic polypeptide
QEEEIATTNPIATEQWGEAANAEVCAEHKGEYK

SEQ ID NO: 196704 - protein, 38 aa, Artificial Sequence
  Description of Artificial Sequence: Synthetic polypeptide
DENEIRTTNPVATEQYGSYQQPVMYMPEVSSQDVVITY

SEQ ID NO: 196705 - protein, 38 aa, Artificial Sequence
  Description of Artificial Sequence: Synthetic polypeptide
DENEIRTTNPVATEQWGCVCSNSMPDHNANAFNSDTAA

SEQ ID NO: 196706 - protein, 34 aa, Artificial Sequence
  Description of Artificial Sequence: Synthetic polypeptide
DETEIATTNPIATECWGATTWAANETWAEPKGPR

SEQ ID NO: 196707 - protein, 37 aa, Artificial Sequence
  Description of Artificial Sequence: Synthetic polypeptide
DEAEIVTTNPVATEGYGSVNNDEFMDEGTEDGGNQGN

SEQ ID NO: 196708 - protein, 34 aa, Artificial Sequence
  Description of Artificial Sequence: Synthetic polypeptide
DETEIATTNPIATECWGATTWAANETWAEPVGPR

SEQ ID NO: 196709 - protein, 37 aa, Artificial Sequence
  Description of Artificial Sequence: Synthetic polypeptide
SEAEIRTTNPVATEQYGCACMETVPASEWQESIQEDN

SEQ ID NO: 196710 - protein, 39 aa, Artificial Sequence
  Description of Artificial Sequence: Synthetic polypeptide
DDAEIRTTNPVATEQYGQCVCSNTGEDHNQEGFGSETQS

SEQ ID NO: 196711 - protein, 38 aa, Artificial Sequence
  Description of Artificial Sequence: Synthetic polypeptide
DDAEIRTTNPVATEQYGQCVCSNWEDHNQESFGSDTQA

SEQ ID NO: 196712 - protein, 36 aa, Artificial Sequence
  Description of Artificial Sequence: Synthetic polypeptide
DEMEIRTTNPVAYEGWGCVCSWGEDNQEYFGSDTQA

SEQ ID NO: 196713 - protein, 39 aa, Artificial Sequence
  Description of Artificial Sequence: Synthetic polypeptide
DDEEIRTTNPVATEQYGQCVCSNWGEDHNAENFGSDFQS

SEQ ID NO: 196714 - protein, 37 aa, Artificial Sequence
  Description of Artificial Sequence: Synthetic polypeptide
DEEEIACTNPVATEQWGCNATNNGNGLDTGAPDGSAN

SEQ ID NO: 196715 - protein, 35 aa, Artificial Sequence
  Description of Artificial Sequence: Synthetic polypeptide
MENEIRTTNPVATESYGSCVWVPADIVETAMPEDQ

SEQ ID NO: 196716 - protein, 39 aa, Artificial Sequence
  Description of Artificial Sequence: Synthetic polypeptide
DDEEIRTTNPVATEQYGQCVCSNWGEDHNAENFNSDTQA

SEQ ID NO: 196717 - protein, 34 aa, Artificial Sequence
  Description of Artificial Sequence: Synthetic polypeptide
DEGEIRPTNPIATECWGATTWANAEDWQEPKGPI

SEQ ID NO: 196718 - protein, 38 aa, Artificial Sequence
  Description of Artificial Sequence: Synthetic polypeptide
AEEEISTTNPVATEQYGCVCQTWGEDHNAENFNSETQG

SEQ ID NO: 196719 - protein, 38 aa, Artificial Sequence
  Description of Artificial Sequence: Synthetic polypeptide
DDAEIRTTNPVATEQYGQCVCSWGEDHNAESFGSDTQS

SEQ ID NO: 196720 - protein, 39 aa, Artificial Sequence
  Description of Artificial Sequence: Synthetic polypeptide
DDEEIRTTNPVATEQYGQCVCSNWGEDHNAENFNSDTQM

SEQ ID NO: 196721 - protein, 39 aa, Artificial Sequence
  Description of Artificial Sequence: Synthetic polypeptide
DDEEIRTTNPVATEQYGQCVCSNWGEDHNAENFNSDTQS

SEQ ID NO: 196722 - protein, 39 aa, Artificial Sequence
  Description of Artificial Sequence: Synthetic polypeptide
DENEIRTTNPVATEQYGVCVVDTDAENGSDETQEESQVE

SEQ ID NO: 196723 - protein, 37 aa, Artificial Sequence
  Description of Artificial Sequence: Synthetic polypeptide
DEEEIRTTNPCAYEPPWGSPVAASTDHVGEGGDIEAM

SEQ ID NO: 196724 - protein, 37 aa, Artificial Sequence
  Description of Artificial Sequence: Synthetic polypeptide
CEAEISTTNPVATEQYGCVCSNWGEHNQEYFNSDTQS

SEQ ID NO: 196725 - protein, 34 aa, Artificial Sequence
  Description of Artificial Sequence: Synthetic polypeptide
DETEIATTNPIATECWGATTWANAEDLAPKGPYI

SEQ ID NO: 196726 - protein, 36 aa, Artificial Sequence
  Description of Artificial Sequence: Synthetic polypeptide
AENEIACTNPVATEQYGQCSCSWGEHNQYFGSETQS

SEQ ID NO: 196727 - protein, 36 aa, Artificial Sequence
  Description of Artificial Sequence: Synthetic polypeptide
CEAEISTTNPVATEQYGCVCSNWGEHNANFISETQS

SEQ ID NO: 196728 - protein, 32 aa, Artificial Sequence
  Description of Artificial Sequence: Synthetic polypeptide
QENEIACTNPCSYEQWGWTCYCNDQQDQGDTR

SEQ ID NO: 196729 - protein, 37 aa, Artificial Sequence
  Description of Artificial Sequence: Synthetic polypeptide
AEEAISTTNPVATEQYGCVCSNWGEHNAEGFNSDNQS

SEQ ID NO: 196730 - protein, 36 aa, Artificial Sequence
  Description of Artificial Sequence: Synthetic polypeptide
DEAAIRTTNPVASLCWGSVSRKINNEPQVTDGEQAG

SEQ ID NO: 196731 - protein, 33 aa, Artificial Sequence
  Description of Artificial Sequence: Synthetic polypeptide
DETEIASTNPIATECWGATTANADLAEPKGPYI

SEQ ID NO: 196732 - protein, 38 aa, Artificial Sequence
  Description of Artificial Sequence: Synthetic polypeptide
DENEISTTNPVATEQYGCVCSNWGEDHNAENFNSDTQS

SEQ ID NO: 196733 - protein, 37 aa, Artificial Sequence
  Description of Artificial Sequence: Synthetic polypeptide
QEEEIATTNPVATAQWGCVAGTVGQDGATGNNNPLMD

SEQ ID NO: 196734 - protein, 38 aa, Artificial Sequence
  Description of Artificial Sequence: Synthetic polypeptide
DENEISTTNPVATEQYGCVCSNWGEDHNEENFNSDTAA

SEQ ID NO: 196735 - protein, 38 aa, Artificial Sequence
  Description of Artificial Sequence: Synthetic polypeptide
MESEIRTTNPVATEIYGECVCPNLRVPEEQMEGFGVEN

SEQ ID NO: 196736 - protein, 38 aa, Artificial Sequence
  Description of Artificial Sequence: Synthetic polypeptide
DEEEISTTNPVAYEGYGQCVCSNWGEHNTENFQSETQS

SEQ ID NO: 196737 - protein, 39 aa, Artificial Sequence
  Description of Artificial Sequence: Synthetic polypeptide
DEEEISTTNPVATEQYGCQVCSNWGEDHNIENFNSDTQA

SEQ ID NO: 196738 - protein, 39 aa, Artificial Sequence
  Description of Artificial Sequence: Synthetic polypeptide
DEEEISTTNPVATEQYGCQVCSNWGEDHNAENFNSDTQS

SEQ ID NO: 196739 - protein, 39 aa, Artificial Sequence
  Description of Artificial Sequence: Synthetic polypeptide
DEEEISTTNPVATEQYGCQVCSNWGEDHNAENFNSDTQA

SEQ ID NO: 196740 - protein, 36 aa, Artificial Sequence
  Description of Artificial Sequence: Synthetic polypeptide
DDEEISTTNPVATCQYGQCVCSNWGEPAENFGSDQA

SEQ ID NO: 196741 - protein, 39 aa, Artificial Sequence
  Description of Artificial Sequence: Synthetic polypeptide
DEEEISTTNPVATEQYGCQVCSNWGEDHNAEHFNSDNQS

SEQ ID NO: 196742 - protein, 37 aa, Artificial Sequence
  Description of Artificial Sequence: Synthetic polypeptide
DEEEISTTNPVAYEHYGCVCSWGEDHNAENFNSETQS

SEQ ID NO: 196743 - protein, 34 aa, Artificial Sequence
  Description of Artificial Sequence: Synthetic polypeptide
QETEIATTNPVATECYGATTANEECWAEHKGEYI

SEQ ID NO: 196744 - protein, 34 aa, Artificial Sequence
  Description of Artificial Sequence: Synthetic polypeptide
DESEIRTTNPIATECWGATTANAIDWAEPKGPYI

SEQ ID NO: 196745 - protein, 33 aa, Artificial Sequence
  Description of Artificial Sequence: Synthetic polypeptide
QETEIATTNPVATECYGATTWANAEDWAHKEPK

SEQ ID NO: 196746 - protein, 37 aa, Artificial Sequence
  Description of Artificial Sequence: Synthetic polypeptide
AEECISTTNPVATEQYGCVCSNWMEHNAENFGSDTQS

SEQ ID NO: 196747 - protein, 39 aa, Artificial Sequence
  Description of Artificial Sequence: Synthetic polypeptide
DEEEISTTNPVATEQYGCQVCSNWGEDHNAEGFNSDNQA

SEQ ID NO: 196748 - protein, 36 aa, Artificial Sequence
  Description of Artificial Sequence: Synthetic polypeptide
MESEIRTTNPVATEQWGNCFNAFTVVIQEPDDNQDQ

SEQ ID NO: 196749 - protein, 37 aa, Artificial Sequence
  Description of Artificial Sequence: Synthetic polypeptide
DEEEIATTNPVATEPYGTYCCCGNEDSSDRFVANNQY

SEQ ID NO: 196750 - protein, 39 aa, Artificial Sequence
  Description of Artificial Sequence: Synthetic polypeptide
DEEEIRTTNPVATEGYGVVDVGVGEGNVGEEEGEGNDTG

SEQ ID NO: 196751 - protein, 37 aa, Artificial Sequence
  Description of Artificial Sequence: Synthetic polypeptide
QAEEIATTNPVATECYGSVCAAANHGPLDSGEGIAMK

SEQ ID NO: 196752 - protein, 36 aa, Artificial Sequence
  Description of Artificial Sequence: Synthetic polypeptide
DEAAIRTTNPVASACWGSVISRWINNEPDVTDGENL

SEQ ID NO: 196753 - protein, 35 aa, Artificial Sequence
  Description of Artificial Sequence: Synthetic polypeptide
QETEIATTNPVATAQWGCVAGKGEEMNAMLPDNNM

SEQ ID NO: 196754 - protein, 37 aa, Artificial Sequence
  Description of Artificial Sequence: Synthetic polypeptide
CEEEIACTNPVATEQYGSACSAGDPIGQNHADEGGHH

SEQ ID NO: 196755 - protein, 37 aa, Artificial Sequence
  Description of Artificial Sequence: Synthetic polypeptide
DENEISTTNPVATEQWGCVTSNSEEDNAEAFNSDTAA

SEQ ID NO: 196756 - protein, 38 aa, Artificial Sequence
  Description of Artificial Sequence: Synthetic polypeptide
DEEEISTTNPVATEQYGCTCSMWEEDDNAEYIISDNQA

SEQ ID NO: 196757 - protein, 33 aa, Artificial Sequence
  Description of Artificial Sequence: Synthetic polypeptide
DDSEVASTNPVSTEGYGMVPAANTIQESKVVQR

SEQ ID NO: 196758 - protein, 38 aa, Artificial Sequence
  Description of Artificial Sequence: Synthetic polypeptide
DETEIACTNPVATEQYGSVCAMTNPEPTNPDDQMEHGM

SEQ ID NO: 196759 - protein, 38 aa, Artificial Sequence
  Description of Artificial Sequence: Synthetic polypeptide
DETEIACTNPVATEQYGSVCAGVTHAGDAGAGIGNEQG

SEQ ID NO: 196760 - protein, 38 aa, Artificial Sequence
  Description of Artificial Sequence: Synthetic polypeptide
DEEEIATTNPVAYEQWGACYTGDFLQNDIQNTQGNGDD

SEQ ID NO: 196761 - protein, 38 aa, Artificial Sequence
  Description of Artificial Sequence: Synthetic polypeptide
DEEEISTTNPVATEQYGCSCSNWGEDHNAENFDSDTQS

SEQ ID NO: 196762 - protein, 33 aa, Artificial Sequence
  Description of Artificial Sequence: Synthetic polypeptide
QEEEIATTNPIATEQWGEAANAEVWAEHKGEYK

SEQ ID NO: 196763 - protein, 37 aa, Artificial Sequence
  Description of Artificial Sequence: Synthetic polypeptide
QAEEIATTNPVATECYGSVCAMANHGPLDSGEGTAML

SEQ ID NO: 196764 - protein, 36 aa, Artificial Sequence
  Description of Artificial Sequence: Synthetic polypeptide
CEGEIATTNPVATEQYGSACSAPMPGAEAAPEDGYN

SEQ ID NO: 196765 - protein, 36 aa, Artificial Sequence
  Description of Artificial Sequence: Synthetic polypeptide
QEEEIATTNPTAYEPYRGQSVSINEGSTNMPGAPDT

SEQ ID NO: 196766 - protein, 36 aa, Artificial Sequence
  Description of Artificial Sequence: Synthetic polypeptide
DEAAIRTTNPVASACWGSVSRCINNEPDVTAGENGQ

SEQ ID NO: 196767 - protein, 37 aa, Artificial Sequence
  Description of Artificial Sequence: Synthetic polypeptide
DEMEISTTNPVATEGYGQCSCSWGEENQEYFNSDTQA

SEQ ID NO: 196768 - protein, 32 aa, Artificial Sequence
  Description of Artificial Sequence: Synthetic polypeptide
QETEIATTNPVATECWGATAAEEDWAEPKGPI

SEQ ID NO: 196769 - protein, 37 aa, Artificial Sequence
  Description of Artificial Sequence: Synthetic polypeptide
CEGEIATTNPVATEQYGSVCAANMGEEAPDSGMEGAH

SEQ ID NO: 196770 - protein, 32 aa, Artificial Sequence
  Description of Artificial Sequence: Synthetic polypeptide
QETEIATTNPVATECWGATANAECWQHKEPYI

SEQ ID NO: 196771 - protein, 34 aa, Artificial Sequence
  Description of Artificial Sequence: Synthetic polypeptide
AEEEIATTNPVAYEQYGCFCPWEDNQHFSSETQS

SEQ ID NO: 196772 - protein, 39 aa, Artificial Sequence
  Description of Artificial Sequence: Synthetic polypeptide
DEEEISTTNPVATEQYGCQVCSNSGEDHNAENFNSDTQD

SEQ ID NO: 196773 - protein, 38 aa, Artificial Sequence
  Description of Artificial Sequence: Synthetic polypeptide
DDEEIRTTNPVATEQYGSSMISLSPSMMIEPNNTSVQT

SEQ ID NO: 196774 - protein, 37 aa, Artificial Sequence
  Description of Artificial Sequence: Synthetic polypeptide
MESEIRTTNPVATEQYGACIPGTTLEDHNDEYGDEQV

SEQ ID NO: 196775 - protein, 38 aa, Artificial Sequence
  Description of Artificial Sequence: Synthetic polypeptide
DEEEISTTNPVAYEQYGCVCQNWGELHNQENFDSDTQA

SEQ ID NO: 196776 - protein, 35 aa, Artificial Sequence
  Description of Artificial Sequence: Synthetic polypeptide
DATEIATTNPVAYEQWGSARCNENNDQDDLHGDMN

SEQ ID NO: 196777 - protein, 32 aa, Artificial Sequence
  Description of Artificial Sequence: Synthetic polypeptide
QEGEIACTNPCSYEQWGVTCYCNDQQDQGGTR

SEQ ID NO: 196778 - protein, 38 aa, Artificial Sequence
  Description of Artificial Sequence: Synthetic polypeptide
AEEEISTTNPVATEQYGCVCSNWGEDHNAEGFNSDTQS

SEQ ID NO: 196779 - protein, 38 aa, Artificial Sequence
  Description of Artificial Sequence: Synthetic polypeptide
AEEEISTTNPVATEQYGCVCSNWGEDHNAEHFNSDTQS

SEQ ID NO: 196780 - protein, 38 aa, Artificial Sequence
  Description of Artificial Sequence: Synthetic polypeptide
DEEEISTTNPVAYEQYGCVCSMWGEDHNQENFNSDTQA

SEQ ID NO: 196781 - protein, 36 aa, Artificial Sequence
  Description of Artificial Sequence: Synthetic polypeptide
CEEEIACTNPVAYEQWGTCSAGTAGLVQTAENAGMN

SEQ ID NO: 196782 - protein, 37 aa, Artificial Sequence
  Description of Artificial Sequence: Synthetic polypeptide
DDEEIGTTNPVATDAYGSVIGNNNGGEEDNEGGGNTT

SEQ ID NO: 196783 - protein, 38 aa, Artificial Sequence
  Description of Artificial Sequence: Synthetic polypeptide
DEEEISTTNPVAYEQYGCVCSNSGEDHNAENFNSQTQA

SEQ ID NO: 196784 - protein, 37 aa, Artificial Sequence
  Description of Artificial Sequence: Synthetic polypeptide
DEEEIATVNPVATAQWGGCVAGNVGELQSIANAQAEN

SEQ ID NO: 196785 - protein, 37 aa, Artificial Sequence
  Description of Artificial Sequence: Synthetic polypeptide
DDAEISTTNPVATEGYGCVCSNWGEHNTENFNSENQA

SEQ ID NO: 196786 - protein, 37 aa, Artificial Sequence
  Description of Artificial Sequence: Synthetic polypeptide
DEEEISTTNPVATEQYGCFCSWPEDHNAENFDSDTQS

SEQ ID NO: 196787 - protein, 39 aa, Artificial Sequence
  Description of Artificial Sequence: Synthetic polypeptide
DEECISTTNPVATEQYGQCVCSNWGEDHNAENFQSDNQA

SEQ ID NO: 196788 - protein, 36 aa, Artificial Sequence
  Description of Artificial Sequence: Synthetic polypeptide
QEEEIATTNPVATASWGSVSATGAGGTAPQDIADFK

SEQ ID NO: 196789 - protein, 34 aa, Artificial Sequence
  Description of Artificial Sequence: Synthetic polypeptide
DESEIRTTNPIATECWGATTAAEDWPADPEGNYI

SEQ ID NO: 196790 - protein, 33 aa, Artificial Sequence
  Description of Artificial Sequence: Synthetic polypeptide
DESEIRTTNPIATECWGATTAAEDWAEPKGPYI

SEQ ID NO: 196791 - protein, 36 aa, Artificial Sequence
  Description of Artificial Sequence: Synthetic polypeptide
DDAEISTTNPVATCQYGCVCSNWGEPNAENFNSDQA

SEQ ID NO: 196792 - protein, 39 aa, Artificial Sequence
  Description of Artificial Sequence: Synthetic polypeptide
DEEEISTTNPVATEQYGCQVCSMSGEDHNAENFNSDTQQ

SEQ ID NO: 196793 - protein, 37 aa, Artificial Sequence
  Description of Artificial Sequence: Synthetic polypeptide
DEEEISTTNPVAYEQYGCVCQNWGEDNQEYFISDTQS

SEQ ID NO: 196794 - protein, 38 aa, Artificial Sequence
  Description of Artificial Sequence: Synthetic polypeptide
AEEEISTTNPVATEQYGCVCSNWGEDDNIENFNSEFQG

SEQ ID NO: 196795 - protein, 38 aa, Artificial Sequence
  Description of Artificial Sequence: Synthetic polypeptide
DENEISTTNPVATEQYGQCVCSMWGEHNAEYFNSDTQS

SEQ ID NO: 196796 - protein, 37 aa, Artificial Sequence
  Description of Artificial Sequence: Synthetic polypeptide
MESEIRTTNPVATEQWGNCVATYVMIQEPDFDHNQDQ

SEQ ID NO: 196797 - protein, 38 aa, Artificial Sequence
  Description of Artificial Sequence: Synthetic polypeptide
DEMEISTTNPVATEGYGQCVCSNWGEPNAEFFGSDNQA

SEQ ID NO: 196798 - protein, 37 aa, Artificial Sequence
  Description of Artificial Sequence: Synthetic polypeptide
AEECISTTNPVATEQYGCVCSNWGEHNQENFGSEFQG

SEQ ID NO: 196799 - protein, 37 aa, Artificial Sequence
  Description of Artificial Sequence: Synthetic polypeptide
DDEEISTTNPVATCQYGQCVCSNWGEPNAEYFNSDQS

SEQ ID NO: 196800 - protein, 38 aa, Artificial Sequence
  Description of Artificial Sequence: Synthetic polypeptide
DEEEISTTNPVATEQYGCQVCGNWGEHNAEFFNSENQA

SEQ ID NO: 196801 - protein, 39 aa, Artificial Sequence
  Description of Artificial Sequence: Synthetic polypeptide
DEEEISTTNPVATEQYGCQVCGNWGEDHNQENFNSETQS

SEQ ID NO: 196802 - protein, 34 aa, Artificial Sequence
  Description of Artificial Sequence: Synthetic polypeptide
YETEIATTNPIATECWGAVWANAENLAESKGPYI

SEQ ID NO: 196803 - protein, 34 aa, Artificial Sequence
  Description of Artificial Sequence: Synthetic polypeptide
DESEIRTTNPIATECWGATTAAEDWPAEPEGNYI

SEQ ID NO: 196804 - protein, 39 aa, Artificial Sequence
  Description of Artificial Sequence: Synthetic polypeptide
DDEEIRTTNPVATEFYGQVTVNMTGLQEDQDEGGGETLT

SEQ ID NO: 196805 - protein, 38 aa, Artificial Sequence
  Description of Artificial Sequence: Synthetic polypeptide
DEEEISTTNPVAYEQYGCQVCSNWGEHNAENFNSDNQS

SEQ ID NO: 196806 - protein, 39 aa, Artificial Sequence
  Description of Artificial Sequence: Synthetic polypeptide
DEEEIRTTNPVATEQYGQSFQPHESIHEMAEYVLTMQVD

SEQ ID NO: 196807 - protein, 35 aa, Artificial Sequence
  Description of Artificial Sequence: Synthetic polypeptide
EIEEIATTNPVAYEQWGSCHTWAPEGDQKHGRTDK

SEQ ID NO: 196808 - protein, 38 aa, Artificial Sequence
  Description of Artificial Sequence: Synthetic polypeptide
DEEEISTTNPVAYEQYGCTCSMWEEDDNQEYIGSDNQS

SEQ ID NO: 196809 - protein, 38 aa, Artificial Sequence
  Description of Artificial Sequence: Synthetic polypeptide
DENEISTTNPVATEQYGQCVCSNWEEDNAENFNSDNQA

SEQ ID NO: 196810 - protein, 38 aa, Artificial Sequence
  Description of Artificial Sequence: Synthetic polypeptide
DETEIACTNPVATEQYGSTACAPANDGDPLGSEGNEHD

SEQ ID NO: 196811 - protein, 37 aa, Artificial Sequence
  Description of Artificial Sequence: Synthetic polypeptide
DEEEISTTNPVAYEQYGCVCGWGEDHNQENFNSETQP

SEQ ID NO: 196812 - protein, 38 aa, Artificial Sequence
  Description of Artificial Sequence: Synthetic polypeptide
AEEEISTTNPVATEQYGCVCSNWGEDHNAEGFNSDTQA

SEQ ID NO: 196813 - protein, 38 aa, Artificial Sequence
  Description of Artificial Sequence: Synthetic polypeptide
DEECISTTNPVATEQYGQCVCSNWGEDNQENFNSDTQS

SEQ ID NO: 196814 - protein, 34 aa, Artificial Sequence
  Description of Artificial Sequence: Synthetic polypeptide
DESEIRTTNPIATECWGATTWANADWAEPKGPYI

SEQ ID NO: 196815 - protein, 39 aa, Artificial Sequence
  Description of Artificial Sequence: Synthetic polypeptide
DEECISTTNPVATEQYGQCVCSNWGEDTNAENFNSDTQS

SEQ ID NO: 196816 - protein, 38 aa, Artificial Sequence
  Description of Artificial Sequence: Synthetic polypeptide
DEEEISTTNPVATEQYGCVCGNWGEDHNAENFNSENQS

SEQ ID NO: 196817 - protein, 35 aa, Artificial Sequence
  Description of Artificial Sequence: Synthetic polypeptide
DDAEIRTTNPVAYEQYGCICSSGEHNEENFPSDQA

SEQ ID NO: 196818 - protein, 32 aa, Artificial Sequence
  Description of Artificial Sequence: Synthetic polypeptide
QETEIATTNPIATECWGEAWPNEEVCQEPEEK

SEQ ID NO: 196819 - protein, 38 aa, Artificial Sequence
  Description of Artificial Sequence: Synthetic polypeptide
DEEEISTTNPVATEQYGCVCGNWGEDHNAENFNSDTQS

SEQ ID NO: 196820 - protein, 38 aa, Artificial Sequence
  Description of Artificial Sequence: Synthetic polypeptide
DEEEISTTNPVATEQYGCVCGNWGEDHNAENFISDNQS

SEQ ID NO: 196821 - protein, 37 aa, Artificial Sequence
  Description of Artificial Sequence: Synthetic polypeptide
DEEEISTTNPVAYEGYGCVCSNWGEHNAENFNSETQG

SEQ ID NO: 196822 - protein, 37 aa, Artificial Sequence
  Description of Artificial Sequence: Synthetic polypeptide
DEMEISTTNPVATEEYGCVCSNWGEPNAENFGSDTQA

SEQ ID NO: 196823 - protein, 37 aa, Artificial Sequence
  Description of Artificial Sequence: Synthetic polypeptide
DEEEISTTNPVAYEGYGCVCSNWGEHNIENFNSDTQA

SEQ ID NO: 196824 - protein, 35 aa, Artificial Sequence
  Description of Artificial Sequence: Synthetic polypeptide
DESEIRTTNPIATECWGATTWANAETWAEPVGQYR

SEQ ID NO: 196825 - protein, 37 aa, Artificial Sequence
  Description of Artificial Sequence: Synthetic polypeptide
DEEEISTTNPVAYEGYGCVCSNWGEHNIENFNSDTQS

SEQ ID NO: 196826 - protein, 38 aa, Artificial Sequence
  Description of Artificial Sequence: Synthetic polypeptide
DEEEISTTNPVATEQYGCVCGNWGEDHNAEFFNSENQS

SEQ ID NO: 196827 - protein, 37 aa, Artificial Sequence
  Description of Artificial Sequence: Synthetic polypeptide
DENEISTTNPVATEQWGCVCSNSGEDNANASNSDTAS

SEQ ID NO: 196828 - protein, 37 aa, Artificial Sequence
  Description of Artificial Sequence: Synthetic polypeptide
DEEEISTTNPVAYEGYGCVCSNWGEHNQENFNSDTQS

SEQ ID NO: 196829 - protein, 38 aa, Artificial Sequence
  Description of Artificial Sequence: Synthetic polypeptide
DEEEISTTNPVAYEGYGCVCSVSGEDDNAENFNSDTQA

SEQ ID NO: 196830 - protein, 38 aa, Artificial Sequence
  Description of Artificial Sequence: Synthetic polypeptide
AEEEISTTNPVATEQYGCVCSMWGEDHNQENFNSDNQA

SEQ ID NO: 196831 - protein, 34 aa, Artificial Sequence
  Description of Artificial Sequence: Synthetic polypeptide
NENAEIATTNPVAYEAWGSVYCSDLADEKDGMDE

SEQ ID NO: 196832 - protein, 35 aa, Artificial Sequence
  Description of Artificial Sequence: Synthetic polypeptide
EGTEIATTNPVAYEQWGSVYTWPGEEDQPNQSEGN

SEQ ID NO: 196833 - protein, 38 aa, Artificial Sequence
  Description of Artificial Sequence: Synthetic polypeptide
DEEEISTTNPVATEQYGCVCGNWGEDHNIENFISDTQA

SEQ ID NO: 196834 - protein, 36 aa, Artificial Sequence
  Description of Artificial Sequence: Synthetic polypeptide
DEMEISTTNPVATEGWGCVCSWGEDENQEYFGSQQS

SEQ ID NO: 196835 - protein, 37 aa, Artificial Sequence
  Description of Artificial Sequence: Synthetic polypeptide
DEAEIACTNPVAYEQWGSVAACPGNPLATGTNGGSVG

SEQ ID NO: 196836 - protein, 38 aa, Artificial Sequence
  Description of Artificial Sequence: Synthetic polypeptide
DEMEISTTNPVATCQYGCVCSTWGEDHNEENFNSDTQS

SEQ ID NO: 196837 - protein, 37 aa, Artificial Sequence
  Description of Artificial Sequence: Synthetic polypeptide
DEEEISTTNPVAYEGYGCVCSMWGEHNQENFNSDTQS

SEQ ID NO: 196838 - protein, 36 aa, Artificial Sequence
  Description of Artificial Sequence: Synthetic polypeptide
QEDEIRGTNPVATEFYGVVYTDQGQDQIDEGGQGQI

SEQ ID NO: 196839 - protein, 33 aa, Artificial Sequence
  Description of Artificial Sequence: Synthetic polypeptide
DETEIAPTNPIATECWGAVWAAENWAEPKGPYI

SEQ ID NO: 196840 - protein, 38 aa, Artificial Sequence
  Description of Artificial Sequence: Synthetic polypeptide
QEEEIRTTNPVATDQYGMITVNMGMEDINEEGGNEGGD

SEQ ID NO: 196841 - protein, 38 aa, Artificial Sequence
  Description of Artificial Sequence: Synthetic polypeptide
DEMCIRTTNPVAYEGYGCVTSTWGADHNAENFGSDNQA

SEQ ID NO: 196842 - protein, 39 aa, Artificial Sequence
  Description of Artificial Sequence: Synthetic polypeptide
VEDEIRTTNPVATEFYGEVSTTDGGNNLLHEEDEGQEGP

SEQ ID NO: 196843 - protein, 32 aa, Artificial Sequence
  Description of Artificial Sequence: Synthetic polypeptide
DETEIAPTNPCATECWGATWAAEDLAPKGPYI

SEQ ID NO: 196844 - protein, 38 aa, Artificial Sequence
  Description of Artificial Sequence: Synthetic polypeptide
MEQEIRTTNPVATEQYGVVMSNNDNNTEGPGQTDQTGT

SEQ ID NO: 196845 - protein, 37 aa, Artificial Sequence
  Description of Artificial Sequence: Synthetic polypeptide
DENEIRTTNPVATEQWGCVCSSGEAENAEYSISDTAS

SEQ ID NO: 196846 - protein, 37 aa, Artificial Sequence
  Description of Artificial Sequence: Synthetic polypeptide
DENEISTTNPVATEGYGQCVCSWGEHNAENFNSDNQS

SEQ ID NO: 196847 - protein, 37 aa, Artificial Sequence
  Description of Artificial Sequence: Synthetic polypeptide
DENEISTTNPVATEIYGCVCSWGEDHNQENFGSDTQA

SEQ ID NO: 196848 - protein, 37 aa, Artificial Sequence
  Description of Artificial Sequence: Synthetic polypeptide
DEHEAATTNPVAYEQWGEVCSTPNQGNHGEAGGSGRN

SEQ ID NO: 196849 - protein, 36 aa, Artificial Sequence
  Description of Artificial Sequence: Synthetic polypeptide
DEEEIACTNPVATEQWGCVAGEGGPGNNTADGGMES

SEQ ID NO: 196850 - protein, 38 aa, Artificial Sequence
  Description of Artificial Sequence: Synthetic polypeptide
AEEEISTTNPVATEQYGCVCSMWGEDHNAENFNSDTQS

SEQ ID NO: 196851 - protein, 37 aa, Artificial Sequence
  Description of Artificial Sequence: Synthetic polypeptide
DEMEISTTNPVATCQYGCVCSNWGEDNEENFNSDNQA

SEQ ID NO: 196852 - protein, 36 aa, Artificial Sequence
  Description of Artificial Sequence: Synthetic polypeptide
DEEEIACTNPVATEQWGCVAGQAGPEAPDAQMGTPV

SEQ ID NO: 196853 - protein, 37 aa, Artificial Sequence
  Description of Artificial Sequence: Synthetic polypeptide
DENEISTTNPVATEIYGQCVCSWGEHNAENFGSDTQA

SEQ ID NO: 196854 - protein, 37 aa, Artificial Sequence
  Description of Artificial Sequence: Synthetic polypeptide
QEDEIRGTNPVATEFYGVVYTDLVGQDQTDEGGQGGI

SEQ ID NO: 196855 - protein, 35 aa, Artificial Sequence
  Description of Artificial Sequence: Synthetic polypeptide
DETEIACTNPVAYEQYGSCAAGDIGNNHADEMNEW

SEQ ID NO: 196856 - protein, 38 aa, Artificial Sequence
  Description of Artificial Sequence: Synthetic polypeptide
DEEEISTTNPVATEQYGCVCGMTGEDHFAEFFNSDPQS

SEQ ID NO: 196857 - protein, 36 aa, Artificial Sequence
  Description of Artificial Sequence: Synthetic polypeptide
DETEIACTNPVAYEQYGSCAAAGGTHGNAEGGGMQN

SEQ ID NO: 196858 - protein, 37 aa, Artificial Sequence
  Description of Artificial Sequence: Synthetic polypeptide
DEEEISTTNPVATEQYGCTCSNWMEHNQENFISDTQA

SEQ ID NO: 196859 - protein, 35 aa, Artificial Sequence
  Description of Artificial Sequence: Synthetic polypeptide
DEGEIRTTNPIATECWGATTWANAEDWAEPKGPYR

SEQ ID NO: 196860 - protein, 39 aa, Artificial Sequence
  Description of Artificial Sequence: Synthetic polypeptide
DEAEIRTTNPVATEQYGTFIWEGTENPDSSMVATGNQNF

SEQ ID NO: 196861 - protein, 38 aa, Artificial Sequence
  Description of Artificial Sequence: Synthetic polypeptide
DEYEIGTTNPVATEFYGSVVTATGDQPIEDQEGGEDGD

SEQ ID NO: 196862 - protein, 36 aa, Artificial Sequence
  Description of Artificial Sequence: Synthetic polypeptide
DEDEIATTNPVATASWGCVAAANWEVQDAGGDNAGG

SEQ ID NO: 196863 - protein, 35 aa, Artificial Sequence
  Description of Artificial Sequence: Synthetic polypeptide
DEDEIATTNPVATASWGCVAAANWEVQDAGGEKAG

SEQ ID NO: 196864 - protein, 37 aa, Artificial Sequence
  Description of Artificial Sequence: Synthetic polypeptide
DEMEISTTNPVATEGYGCVCSNWGEDPNEEFFGSDQS

SEQ ID NO: 196865 - protein, 39 aa, Artificial Sequence
  Description of Artificial Sequence: Synthetic polypeptide
DEEEIRTTNPCATEQYGSVVVVVVSNQAGTEQGSTQQQM

SEQ ID NO: 196866 - protein, 39 aa, Artificial Sequence
  Description of Artificial Sequence: Synthetic polypeptide
DETEIACTNPVATEQYGVSTACAANDGDPLGSAEGNEHN

SEQ ID NO: 196867 - protein, 37 aa, Artificial Sequence
  Description of Artificial Sequence: Synthetic polypeptide
CEEEIACTNPVATEQYGSACATNPDEEAGQHQDPDAP

SEQ ID NO: 196868 - protein, 37 aa, Artificial Sequence
  Description of Artificial Sequence: Synthetic polypeptide
DEEEISTTNPVATEQYGCTCSMWEEDNAEYFISDTQS

SEQ ID NO: 196869 - protein, 36 aa, Artificial Sequence
  Description of Artificial Sequence: Synthetic polypeptide
SEAEIRCTNPVATEQYGCVCQWGEDNQEHFGSDTQA

SEQ ID NO: 196870 - protein, 38 aa, Artificial Sequence
  Description of Artificial Sequence: Synthetic polypeptide
DEEEISTTNPVAYEGYGQCVCSNWEEHNIENFGSDNQA

SEQ ID NO: 196871 - protein, 37 aa, Artificial Sequence
  Description of Artificial Sequence: Synthetic polypeptide
DEMEISTTNPVATEGYGCVCSTWGEPNAEFFISDTQS

SEQ ID NO: 196872 - protein, 37 aa, Artificial Sequence
  Description of Artificial Sequence: Synthetic polypeptide
DEITIATTNPVATDQYGVVVSETGDEGQGGGQGEETD

SEQ ID NO: 196873 - protein, 38 aa, Artificial Sequence
  Description of Artificial Sequence: Synthetic polypeptide
DEECISTTNPVATEQYGQCVCSNWGEENAEYFISDNQA

SEQ ID NO: 196874 - protein, 38 aa, Artificial Sequence
  Description of Artificial Sequence: Synthetic polypeptide
AEEEIATTNPVAYEQYGCVCSNWGEDHNAEGFGSDNQA

SEQ ID NO: 196875 - protein, 38 aa, Artificial Sequence
  Description of Artificial Sequence: Synthetic polypeptide
DEYEIGTTNPVATEFYGSVTTATGTQGQEDQEGGPDGD

SEQ ID NO: 196876 - protein, 35 aa, Artificial Sequence
  Description of Artificial Sequence: Synthetic polypeptide
DESEIRTTNPIATECWGATTWANAEDWAEPKGNYG

SEQ ID NO: 196877 - protein, 38 aa, Artificial Sequence
  Description of Artificial Sequence: Synthetic polypeptide
DEEEIRTTNPVGTEGYGQCVCSNSEDHNAENFGSDTQA

SEQ ID NO: 196878 - protein, 34 aa, Artificial Sequence
  Description of Artificial Sequence: Synthetic polypeptide
DDSEVACTNPVSTEGYGNVCYNTDIQSRVGDQDM

SEQ ID NO: 196879 - protein, 40 aa, Artificial Sequence
  Description of Artificial Sequence: Synthetic polypeptide
DEEEIRTTNPVATEAYGVVVVTVTTNQAGTEAGTVNNEEE

SEQ ID NO: 196880 - protein, 40 aa, Artificial Sequence
  Description of Artificial Sequence: Synthetic polypeptide
DEEEIRTTNPVATEAYGVVVVTVTTNQAGTEAGTVNQEDT

SEQ ID NO: 196881 - protein, 37 aa, Artificial Sequence
  Description of Artificial Sequence: Synthetic polypeptide
DEYEIATTNPVAYERWGSVCSTTDNHNGHDGGGQEEQ

SEQ ID NO: 196882 - protein, 38 aa, Artificial Sequence
  Description of Artificial Sequence: Synthetic polypeptide
DEEEISTTNPVATEQYGCVCENWEEDHNEENFNSDNQA

SEQ ID NO: 196883 - protein, 40 aa, Artificial Sequence
  Description of Artificial Sequence: Synthetic polypeptide
DEEEIRTTNPVATEAYGVVVVTVTTTQAGTEAGTVNDEVD

SEQ ID NO: 196884 - protein, 35 aa, Artificial Sequence
  Description of Artificial Sequence: Synthetic polypeptide
DEAAIRTTNPVASACWGSVTRCINNEPDVTDGENQ

SEQ ID NO: 196885 - protein, 38 aa, Artificial Sequence
  Description of Artificial Sequence: Synthetic polypeptide
DETEIACTNPVAYEQYGSACSPANDTNALIDAEEGKAE

SEQ ID NO: 196886 - protein, 35 aa, Artificial Sequence
  Description of Artificial Sequence: Synthetic polypeptide
DEAAIRTTNPVASACWGSVSRCINNEPDVTTIENH

SEQ ID NO: 196887 - protein, 37 aa, Artificial Sequence
  Description of Artificial Sequence: Synthetic polypeptide
DEMEISTTNPVATCQYGCVCNTWGEHNQENFGSDTQS

SEQ ID NO: 196888 - protein, 35 aa, Artificial Sequence
  Description of Artificial Sequence: Synthetic polypeptide
EGTEIATTNPVAYEQWGSVYTWPGEESQLNQDEGM

SEQ ID NO: 196889 - protein, 37 aa, Artificial Sequence
  Description of Artificial Sequence: Synthetic polypeptide
DEMEISTTNPVATEGYGCVCFNWGEHNTENFNSDNQS

SEQ ID NO: 196890 - protein, 39 aa, Artificial Sequence
  Description of Artificial Sequence: Synthetic polypeptide
DEEEIRTTNPVAYEQYGQCVCSNWEEDHNAENFNSDNQA

SEQ ID NO: 196891 - protein, 37 aa, Artificial Sequence
  Description of Artificial Sequence: Synthetic polypeptide
DETEIACTNPVAYEQYGSACPATNPHEEAEAPDGNMN

SEQ ID NO: 196892 - protein, 37 aa, Artificial Sequence
  Description of Artificial Sequence: Synthetic polypeptide
DETEIACTNPVAYEQYGSACPATNPHEAEAPIGNMHM

SEQ ID NO: 196893 - protein, 37 aa, Artificial Sequence
  Description of Artificial Sequence: Synthetic polypeptide
DENEIRTTNPVATEQWGCVCSSGEDHNANASSSDTAA

SEQ ID NO: 196894 - protein, 37 aa, Artificial Sequence
  Description of Artificial Sequence: Synthetic polypeptide
DETEIACTNPVAYEQYGSACPATNPHEAEAPGGNMND

SEQ ID NO: 196895 - protein, 36 aa, Artificial Sequence
  Description of Artificial Sequence: Synthetic polypeptide
SEAEIRCTNPVATEQYGQCVCEWGEHNAHFGSDTQS

SEQ ID NO: 196896 - protein, 35 aa, Artificial Sequence
  Description of Artificial Sequence: Synthetic polypeptide
DEDEIATTNPVATASWGCVAAANWEVPDAGLENGD

SEQ ID NO: 196897 - protein, 40 aa, Artificial Sequence
  Description of Artificial Sequence: Synthetic polypeptide
DEEEIRTTNPVATEAYGVVVVTVVTNQAGTEAGTTNQEDE

SEQ ID NO: 196898 - protein, 36 aa, Artificial Sequence
  Description of Artificial Sequence: Synthetic polypeptide
AENEIATTNPVATEGYGCVCSNWEHNQEHFISENLA

SEQ ID NO: 196899 - protein, 37 aa, Artificial Sequence
  Description of Artificial Sequence: Synthetic polypeptide
DEAAIRTTNPVATEQYGCFCSNWGEHNIESFGSDTQS

SEQ ID NO: 196900 - protein, 39 aa, Artificial Sequence
  Description of Artificial Sequence: Synthetic polypeptide
DDEEIRTTNPVATEQYGQCVCSNWEEDHNAEHFNSDNQA

SEQ ID NO: 196901 - protein, 36 aa, Artificial Sequence
  Description of Artificial Sequence: Synthetic polypeptide
DEDEIATTNPVATASWGCVAAANHAEPTDRGGENAG

SEQ ID NO: 196902 - protein, 36 aa, Artificial Sequence
  Description of Artificial Sequence: Synthetic polypeptide
CEDVIATTNPVATAQWGCSFVANANNLQEAPGGTHG

SEQ ID NO: 196903 - protein, 34 aa, Artificial Sequence
  Description of Artificial Sequence: Synthetic polypeptide
DENEIRTTNPISTECWGATTANMEDIQQQPNGPH

SEQ ID NO: 196904 - protein, 36 aa, Artificial Sequence
  Description of Artificial Sequence: Synthetic polypeptide
DENEIRTTNPVSTEAYGCICSWEEDNQENFGSDTQS

SEQ ID NO: 196905 - protein, 40 aa, Artificial Sequence
  Description of Artificial Sequence: Synthetic polypeptide
DEEEIRTTNPVATEQYGTSWVIHPCSVEEYAEVIGTTQLL

SEQ ID NO: 196906 - protein, 38 aa, Artificial Sequence
  Description of Artificial Sequence: Synthetic polypeptide
VEEATCSEIATTNPVAYEQWGVVVPTDNHQIENRIDAR

SEQ ID NO: 196907 - protein, 32 aa, Artificial Sequence
  Description of Artificial Sequence: Synthetic polypeptide
EGASEIATTNPVAYEQWGCCGTWDQGHTSPDN

SEQ ID NO: 196908 - protein, 39 aa, Artificial Sequence
  Description of Artificial Sequence: Synthetic polypeptide
VEEATCSEIATTNPVAYEQWGVVVPTDNHQIENRGDRRD

SEQ ID NO: 196909 - protein, 36 aa, Artificial Sequence
  Description of Artificial Sequence: Synthetic polypeptide
AEEEVRTTNPVAYEQYGCVCSWGEHDAEYFGSDTQS

SEQ ID NO: 196910 - protein, 37 aa, Artificial Sequence
  Description of Artificial Sequence: Synthetic polypeptide
DEDEIATTNPVATASWGCVAAANNAEVQDRGGENTNE

SEQ ID NO: 196911 - protein, 34 aa, Artificial Sequence
  Description of Artificial Sequence: Synthetic polypeptide
DENEIRTTNPISTEPWGATWSNMEDIQAEPKGPH

SEQ ID NO: 196912 - protein, 34 aa, Artificial Sequence
  Description of Artificial Sequence: Synthetic polypeptide
DENEIRTTNPISTEPWGATWSNMEDIQAEPKGPI

SEQ ID NO: 196913 - protein, 33 aa, Artificial Sequence
  Description of Artificial Sequence: Synthetic polypeptide
DESEIRTTNPIATEGWGATWAAEDWAEHKGPYI

SEQ ID NO: 196914 - protein, 38 aa, Artificial Sequence
  Description of Artificial Sequence: Synthetic polypeptide
DEEEIRATNPVATEQYGYVCVAPLPVNMSNAVDMFFEI

SEQ ID NO: 196915 - protein, 38 aa, Artificial Sequence
  Description of Artificial Sequence: Synthetic polypeptide
DEEEIRATNPVATEQYGYVCVHPSPVNMSNAVDMFEEH

SEQ ID NO: 196916 - protein, 34 aa, Artificial Sequence
  Description of Artificial Sequence: Synthetic polypeptide
DENEIRTTNPISTEPWGATWSNMEDWQAEPKGPI

SEQ ID NO: 196917 - protein, 35 aa, Artificial Sequence
  Description of Artificial Sequence: Synthetic polypeptide
AEDEISTTNPVAYEQWGTCCYTNENGEDMGGQENQ

SEQ ID NO: 196918 - protein, 37 aa, Artificial Sequence
  Description of Artificial Sequence: Synthetic polypeptide
MENEIRTTNPVATEQYGSCAYFALNSDSDIIDLNNMA

SEQ ID NO: 196919 - protein, 35 aa, Artificial Sequence
  Description of Artificial Sequence: Synthetic polypeptide
DEGENATTNPCAYECWGCVATPNGNQQLEGDHQRE

SEQ ID NO: 196920 - protein, 36 aa, Artificial Sequence
  Description of Artificial Sequence: Synthetic polypeptide
DENCIATVNPVATECYGSVVCIDHQDQEQRQGDGKE

SEQ ID NO: 196921 - protein, 36 aa, Artificial Sequence
  Description of Artificial Sequence: Synthetic polypeptide
DEDEIATTNPVATASWGCVAAANGEVQDAGDENAGG

SEQ ID NO: 196922 - protein, 33 aa, Artificial Sequence
  Description of Artificial Sequence: Synthetic polypeptide
DETEIATTNPISTEGWGATTANAETWQSPKGPI

SEQ ID NO: 196923 - protein, 37 aa, Artificial Sequence
  Description of Artificial Sequence: Synthetic polypeptide
DEMEIRTTNPVATCQYGCVCNWGEDHNAENFISDNQS

SEQ ID NO: 196924 - protein, 39 aa, Artificial Sequence
  Description of Artificial Sequence: Synthetic polypeptide
DEECISTTNPVATEQYGQCVCSTWGEDHNAENFNSDNQQ

SEQ ID NO: 196925 - protein, 33 aa, Artificial Sequence
  Description of Artificial Sequence: Synthetic polypeptide
DETEIATTNPIGTECWGATTWANAEDLAHGPYI

SEQ ID NO: 196926 - protein, 37 aa, Artificial Sequence
  Description of Artificial Sequence: Synthetic polypeptide
DENEISTTNPVATEEYGCVCSNWGEHNAENFNSDTQA

SEQ ID NO: 196927 - protein, 39 aa, Artificial Sequence
  Description of Artificial Sequence: Synthetic polypeptide
DEEEIRTTNPVATEQYGTSWVIHPCMVNEYAEVIMTTEL

SEQ ID NO: 196928 - protein, 35 aa, Artificial Sequence
  Description of Artificial Sequence: Synthetic polypeptide
VEEEIACTNPVATAQWGCSNAAGNPGPAPMEGNHN

SEQ ID NO: 196929 - protein, 38 aa, Artificial Sequence
  Description of Artificial Sequence: Synthetic polypeptide
DEECISTTNPVATEQYGQCVCSNWMEHNQENFNSDTQA

SEQ ID NO: 196930 - protein, 39 aa, Artificial Sequence
  Description of Artificial Sequence: Synthetic polypeptide
DEEEIRTTNPVATEQYGCVGVEPGTLSQILVAEVAVVHG

SEQ ID NO: 196931 - protein, 38 aa, Artificial Sequence
  Description of Artificial Sequence: Synthetic polypeptide
DEECISTTNPVATEQYGQCVCSNWMEHNAENFNSDTQS

SEQ ID NO: 196932 - protein, 34 aa, Artificial Sequence
  Description of Artificial Sequence: Synthetic polypeptide
CEEVIACTNPVATEQWGHCTAGNNLATMMGEDEW

SEQ ID NO: 196933 - protein, 33 aa, Artificial Sequence
  Description of Artificial Sequence: Synthetic polypeptide
DESEIRTTNPIGTEGWGVTWANATWAEPKGDYI

SEQ ID NO: 196934 - protein, 35 aa, Artificial Sequence
  Description of Artificial Sequence: Synthetic polypeptide
CEEVIACTNPVATEQWGCVANMNNSNLAGGPGEQV

SEQ ID NO: 196935 - protein, 33 aa, Artificial Sequence
  Description of Artificial Sequence: Synthetic polypeptide
QEEEIATTNPIATECWGATTWANADWAEPKGEI

SEQ ID NO: 196936 - protein, 33 aa, Artificial Sequence
  Description of Artificial Sequence: Synthetic polypeptide
DESEIRTTNPIGTECWGVTWANATWAEPKGDYI

SEQ ID NO: 196937 - protein, 35 aa, Artificial Sequence
  Description of Artificial Sequence: Synthetic polypeptide
DENEIATTNPVAYECWGTVYWINENQDRQLIHVGS

SEQ ID NO: 196938 - protein, 37 aa, Artificial Sequence
  Description of Artificial Sequence: Synthetic polypeptide
MENEIRTTNPVATEQYGLCYFPMNSDSDIIDLNNDMA

SEQ ID NO: 196939 - protein, 37 aa, Artificial Sequence
  Description of Artificial Sequence: Synthetic polypeptide
MENEIRTTNPVATEQYGNCYFPLNSDSDIIDLNNPMA

SEQ ID NO: 196940 - protein, 33 aa, Artificial Sequence
  Description of Artificial Sequence: Synthetic polypeptide
EGAEIATTNPVAYEQWGCCGTWEDQGHKSIGVD

SEQ ID NO: 196941 - protein, 37 aa, Artificial Sequence
  Description of Artificial Sequence: Synthetic polypeptide
AEEEVSTTNPVATEQYGCVCSNWGEHNAEYFGSDTQS

SEQ ID NO: 196942 - protein, 38 aa, Artificial Sequence
  Description of Artificial Sequence: Synthetic polypeptide
DEEEIRTTNPVATESYGMVSVEGMGDGGQGQEAQEFGT

SEQ ID NO: 196943 - protein, 37 aa, Artificial Sequence
  Description of Artificial Sequence: Synthetic polypeptide
DEEEIATTNPVAYEQWGGCVAASNNDTATAHINDEAM

SEQ ID NO: 196944 - protein, 34 aa, Artificial Sequence
  Description of Artificial Sequence: Synthetic polypeptide
DEMEIRTTNPIATECWGATCANADDWAEPEGPYI

SEQ ID NO: 196945 - protein, 38 aa, Artificial Sequence
  Description of Artificial Sequence: Synthetic polypeptide
AEEEIRTTNPVAYEQYGQCVCSWGEDHNAENFNSETQA

SEQ ID NO: 196946 - protein, 38 aa, Artificial Sequence
  Description of Artificial Sequence: Synthetic polypeptide
AEEEIRTTNPVAYEQYGQCVCSWGEDHNQEYFNSENQA

SEQ ID NO: 196947 - protein, 38 aa, Artificial Sequence
  Description of Artificial Sequence: Synthetic polypeptide
QEDEIRTTNPAATEQYGTVVSVAGNNDGNQEGGEEQIQ

SEQ ID NO: 196948 - protein, 37 aa, Artificial Sequence
  Description of Artificial Sequence: Synthetic polypeptide
DEAEIATTNPVAYEQWGCNVAGNNGGLPEENNHGINQ

SEQ ID NO: 196949 - protein, 35 aa, Artificial Sequence
  Description of Artificial Sequence: Synthetic polypeptide
QEMEIGTTNPVATEQYGCLCTATDGSPVEFEGQKQ

SEQ ID NO: 196950 - protein, 38 aa, Artificial Sequence
  Description of Artificial Sequence: Synthetic polypeptide
AEEEIRTTNPVSTEQYGCVCGNWGEDHNAEGFISQNQA

SEQ ID NO: 196951 - protein, 37 aa, Artificial Sequence
  Description of Artificial Sequence: Synthetic polypeptide
DDAEIRTTNPVATEQYGCSCSNWGEHNAEHFSSDTQA

SEQ ID NO: 196952 - protein, 37 aa, Artificial Sequence
  Description of Artificial Sequence: Synthetic polypeptide
MENEIRTTNPVATEQYGSCYFPLNSDSDIIDLNNNEA

SEQ ID NO: 196953 - protein, 35 aa, Artificial Sequence
  Description of Artificial Sequence: Synthetic polypeptide
DDEEISTTNPCAYEHYGCVCSWGEDNAENFNSDQA

SEQ ID NO: 196954 - protein, 35 aa, Artificial Sequence
  Description of Artificial Sequence: Synthetic polypeptide
DEVEIATTNPVGYEQWGSTCSCWINNDHQDDDDDY

SEQ ID NO: 196955 - protein, 37 aa, Artificial Sequence
  Description of Artificial Sequence: Synthetic polypeptide
ADEEISTTNPVATEQYGCVCSNWGEHNTENFGSETQA

SEQ ID NO: 196956 - protein, 37 aa, Artificial Sequence
  Description of Artificial Sequence: Synthetic polypeptide
AEECISTTNPVATEQYGCVCSWEEDHNAENFGSDTQS

SEQ ID NO: 196957 - protein, 36 aa, Artificial Sequence
  Description of Artificial Sequence: Synthetic polypeptide
SEEEIRTTNPVATESWGAVFWNENDDHEKQTMDQSQ

SEQ ID NO: 196958 - protein, 35 aa, Artificial Sequence
  Description of Artificial Sequence: Synthetic polypeptide
EGEEIATTNPVAYEQWGSCVTWEPEGDQKHGRTDK

SEQ ID NO: 196959 - protein, 38 aa, Artificial Sequence
  Description of Artificial Sequence: Synthetic polypeptide
DEAEIRTTNPVATEQWGAYCCFWTESVTEENYEAGPME

SEQ ID NO: 196960 - protein, 36 aa, Artificial Sequence
  Description of Artificial Sequence: Synthetic polypeptide
DDEEISTTNPCATEHYGCVCSNWGEDNQNFNSDTQA

SEQ ID NO: 196961 - protein, 35 aa, Artificial Sequence
  Description of Artificial Sequence: Synthetic polypeptide
DENEIRTTNPISTEPWGTTTSNAEDIQAQPKGNYH

SEQ ID NO: 196962 - protein, 38 aa, Artificial Sequence
  Description of Artificial Sequence: Synthetic polypeptide
AEEEIRTTNPVAYEQYGQCVCSNWGEHNAENFNSDTQP

SEQ ID NO: 196963 - protein, 38 aa, Artificial Sequence
  Description of Artificial Sequence: Synthetic polypeptide
AEEEIRTTNPVAYEQYGQCVCSNWGEHNAENFNSDNQA

SEQ ID NO: 196964 - protein, 36 aa, Artificial Sequence
  Description of Artificial Sequence: Synthetic polypeptide
CSSEIATTNPCATEQYGTVCSYTGEEWSENMNGTND

SEQ ID NO: 196965 - protein, 37 aa, Artificial Sequence
  Description of Artificial Sequence: Synthetic polypeptide
DEEEIRTTNPIATECWGSTTWSNAPDWPNEPNGMPYI

SEQ ID NO: 196966 - protein, 37 aa, Artificial Sequence
  Description of Artificial Sequence: Synthetic polypeptide
DEEEIRTTNPIATECWGSTTSSNAPDWPAMPNGMPPI

SEQ ID NO: 196967 - protein, 35 aa, Artificial Sequence
  Description of Artificial Sequence: Synthetic polypeptide
DENEIRTTNPISTEPWGTTTSNMEDIQAQPKGNYH

SEQ ID NO: 196968 - protein, 33 aa, Artificial Sequence
  Description of Artificial Sequence: Synthetic polypeptide
QECEICATNPCTTEIYGVVATEAGTVNQNGDTT

SEQ ID NO: 196969 - protein, 38 aa, Artificial Sequence
  Description of Artificial Sequence: Synthetic polypeptide
DEEEIRTTNPVATESYGQMGYDGMGNMDDIMDEGGNGT

SEQ ID NO: 196970 - protein, 37 aa, Artificial Sequence
  Description of Artificial Sequence: Synthetic polypeptide
MENEIRTTNPVATEQYGSCVYVPADTIVETTAMPVPQ

SEQ ID NO: 196971 - protein, 36 aa, Artificial Sequence
  Description of Artificial Sequence: Synthetic polypeptide
AEEEVSTTNPVATEQYGCVCSWGEHDAEYINSDNQS

SEQ ID NO: 196972 - protein, 38 aa, Artificial Sequence
  Description of Artificial Sequence: Synthetic polypeptide
DDAEIRTTNPVATEGYGQCVCSWGEDHNQESFGSDNQS

SEQ ID NO: 196973 - protein, 36 aa, Artificial Sequence
  Description of Artificial Sequence: Synthetic polypeptide
CEQEIRSTNPVATEAYGTVSVLVGMGGGGDTTNVGE

SEQ ID NO: 196974 - protein, 34 aa, Artificial Sequence
  Description of Artificial Sequence: Synthetic polypeptide
DEEEIRTTNPIATECWGATWANAEDWAEPKEPYI

SEQ ID NO: 196975 - protein, 40 aa, Artificial Sequence
  Description of Artificial Sequence: Synthetic polypeptide
DEEEIRTTNPVATEQYGTYYAISPEATPVHVVSPFQNERN

SEQ ID NO: 196976 - protein, 34 aa, Artificial Sequence
  Description of Artificial Sequence: Synthetic polypeptide
QECEICATNPCTTEIYGVVATNNATNNNQNGTDT

SEQ ID NO: 196977 - protein, 39 aa, Artificial Sequence
  Description of Artificial Sequence: Synthetic polypeptide
AEEEIRTTNPVAYEQYGQCVCSNWGEDHNQEGFNSDNQA

SEQ ID NO: 196978 - protein, 36 aa, Artificial Sequence
  Description of Artificial Sequence: Synthetic polypeptide
DEEEIRTTNPIATECWGATTWSNAPDWPNEPNGPYI

SEQ ID NO: 196979 - protein, 37 aa, Artificial Sequence
  Description of Artificial Sequence: Synthetic polypeptide
MENEIRTTNPVATEQYGSCYFPLFSDSDIIDLNNLMQ

SEQ ID NO: 196980 - protein, 38 aa, Artificial Sequence
  Description of Artificial Sequence: Synthetic polypeptide
QEDEIRTTNPAATEQYGVVSVAGNNDGNQEGGEQEQDQ

SEQ ID NO: 196981 - protein, 35 aa, Artificial Sequence
  Description of Artificial Sequence: Synthetic polypeptide
DEDEIATTNPVATASWGCVAAANNEDTDNGGENDG

SEQ ID NO: 196982 - protein, 37 aa, Artificial Sequence
  Description of Artificial Sequence: Synthetic polypeptide
DESEIRTTNPMAYEAWGISVPPNANSSSDREGGMNVC

SEQ ID NO: 196983 - protein, 39 aa, Artificial Sequence
  Description of Artificial Sequence: Synthetic polypeptide
DDEEIRTTNPVATEFYGTVNVNMTGLEQEEQDEGGETTT

SEQ ID NO: 196984 - protein, 39 aa, Artificial Sequence
  Description of Artificial Sequence: Synthetic polypeptide
DDEEIRTTNPVATEFYGTVNVNMTGLQEEQDEDGGETTG

SEQ ID NO: 196985 - protein, 35 aa, Artificial Sequence
  Description of Artificial Sequence: Synthetic polypeptide
VEEEIACTNPVATEQWGGCVAGTAGDLIDNMAMEW

SEQ ID NO: 196986 - protein, 37 aa, Artificial Sequence
  Description of Artificial Sequence: Synthetic polypeptide
AEEEISTTNPVAYEQYGQCVCSWGEHNAENFNSDNQG

SEQ ID NO: 196987 - protein, 36 aa, Artificial Sequence
  Description of Artificial Sequence: Synthetic polypeptide
DEQEIATTNPVAYEQWGSVYGAGAPGEQEQGLGDDH

SEQ ID NO: 196988 - protein, 38 aa, Artificial Sequence
  Description of Artificial Sequence: Synthetic polypeptide
DEECISTTNPVATEQYGQCVCSWGEDHNAENFNSDFQF

SEQ ID NO: 196989 - protein, 37 aa, Artificial Sequence
  Description of Artificial Sequence: Synthetic polypeptide
DETEIATTNPVATAQWGHSASAVGDLEADTPGGEDNI

SEQ ID NO: 196990 - protein, 37 aa, Artificial Sequence
  Description of Artificial Sequence: Synthetic polypeptide
DENEIRTTNPVSTEGYGQCICSWEEPNQEQFGSDTQA

SEQ ID NO: 196991 - protein, 37 aa, Artificial Sequence
  Description of Artificial Sequence: Synthetic polypeptide
DETEIATTNPVATAQWGHSAFAVGSLEADTPGGENNH

SEQ ID NO: 196992 - protein, 40 aa, Artificial Sequence
  Description of Artificial Sequence: Synthetic polypeptide
AEEEICTTNPVATEQYGVVSVTNVTEQGTEQYGSTTTQDD

SEQ ID NO: 196993 - protein, 35 aa, Artificial Sequence
  Description of Artificial Sequence: Synthetic polypeptide
DETEIATTNPVATAQWGCVAGENGEEMNAALDNID

SEQ ID NO: 196994 - protein, 39 aa, Artificial Sequence
  Description of Artificial Sequence: Synthetic polypeptide
DEEEIRTTNPVATEQYGSTYGCMPINPQIQQEVADEVGQ

SEQ ID NO: 196995 - protein, 37 aa, Artificial Sequence
  Description of Artificial Sequence: Synthetic polypeptide
AEEEISTTNPVAYEQYGQCVCSWGEHNQENFGSETQA

SEQ ID NO: 196996 - protein, 38 aa, Artificial Sequence
  Description of Artificial Sequence: Synthetic polypeptide
DENEIRTTNPVSTEGYGQCICSNWEEHNIEQFGSDNQA

SEQ ID NO: 196997 - protein, 35 aa, Artificial Sequence
  Description of Artificial Sequence: Synthetic polypeptide
DETEIATTNPVATAQWGCVAGEGEEMNGALLDNAD

SEQ ID NO: 196998 - protein, 38 aa, Artificial Sequence
  Description of Artificial Sequence: Synthetic polypeptide
DEACIRTTNPVATEQYGCVCSNWGEDHNAENFPSDNQS

SEQ ID NO: 196999 - protein, 37 aa, Artificial Sequence
  Description of Artificial Sequence: Synthetic polypeptide
DEVEIATTNPVAYEQWGGCTVAGNNGLQAAPDGSIHN

SEQ ID NO: 197000 - protein, 38 aa, Artificial Sequence
  Description of Artificial Sequence: Synthetic polypeptide
DENEIRTTNPVSTEGYGICICSTWEEHNAENFGSDNQA

SEQ ID NO: 197001 - protein, 34 aa, Artificial Sequence
  Description of Artificial Sequence: Synthetic polypeptide
VEEEIACTNPVATEQWGGCNAIIHEQPDDQGQAM

SEQ ID NO: 197002 - protein, 38 aa, Artificial Sequence
  Description of Artificial Sequence: Synthetic polypeptide
DEECISTTNPVATEQYGQCVCSWGEDHNAENFNSDNQA

SEQ ID NO: 197003 - protein, 36 aa, Artificial Sequence
  Description of Artificial Sequence: Synthetic polypeptide
DEVEIATTNPVAYEQWGSTCSCWQINNDHQMDDDDY

SEQ ID NO: 197004 - protein, 36 aa, Artificial Sequence
  Description of Artificial Sequence: Synthetic polypeptide
DEGAEIATTNPCAYEHWGSVATPNGNQQLEGDHGGH

SEQ ID NO: 197005 - protein, 36 aa, Artificial Sequence
  Description of Artificial Sequence: Synthetic polypeptide
DEEEIATTNPVATAQWGGCCAGQGNGLEATANGEVG

SEQ ID NO: 197006 - protein, 39 aa, Artificial Sequence
  Description of Artificial Sequence: Synthetic polypeptide
DEEEISTTNPVATEQYGQCVCSVWGEDHNAENFNSDNQA

SEQ ID NO: 197007 - protein, 34 aa, Artificial Sequence
  Description of Artificial Sequence: Synthetic polypeptide
QENEIATTNPVAYEPWGNTVSGEHLNQHMEMQLN

SEQ ID NO: 197008 - protein, 35 aa, Artificial Sequence
  Description of Artificial Sequence: Synthetic polypeptide
DEQEIATTNPVAYEQWGSVVCNAAMPMEDAEDTHK

SEQ ID NO: 197009 - protein, 39 aa, Artificial Sequence
  Description of Artificial Sequence: Synthetic polypeptide
DEMEIATTNPVATEQYGCQVCSTWGEDHNEEHFGSETQA

SEQ ID NO: 197010 - protein, 35 aa, Artificial Sequence
  Description of Artificial Sequence: Synthetic polypeptide
DETEIATTNPVATASWGCVAAANNEPTDNGGENDE

SEQ ID NO: 197011 - protein, 36 aa, Artificial Sequence
  Description of Artificial Sequence: Synthetic polypeptide
QAEEIATTNPVATEQYGCVAAGEGGHGNESAEEDNH

SEQ ID NO: 197012 - protein, 35 aa, Artificial Sequence
  Description of Artificial Sequence: Synthetic polypeptide
DEEEIATTNPVAYEQWGHSACAAANGMDSESVDDS

SEQ ID NO: 197013 - protein, 37 aa, Artificial Sequence
  Description of Artificial Sequence: Synthetic polypeptide
MENEIRTTNPVATEQYGACQCTSQDVSEDEIGSAMMK

SEQ ID NO: 197014 - protein, 38 aa, Artificial Sequence
  Description of Artificial Sequence: Synthetic polypeptide
DEEEIRTTNPVATEQYGVGGEPGTLSQIEDAEVAVVHS

SEQ ID NO: 197015 - protein, 38 aa, Artificial Sequence
  Description of Artificial Sequence: Synthetic polypeptide
DEEEIRTTNPVATEQYGVFHNTHISIDDNQSEHETEQQ

SEQ ID NO: 197016 - protein, 37 aa, Artificial Sequence
  Description of Artificial Sequence: Synthetic polypeptide
DDEEISCTNPVATEQYGCSCSNWGEDNQENFISDNQA

SEQ ID NO: 197017 - protein, 34 aa, Artificial Sequence
  Description of Artificial Sequence: Synthetic polypeptide
CEDCIACTNPVATAQWGGCVAANNLQEAPNGQHH

SEQ ID NO: 197018 - protein, 35 aa, Artificial Sequence
  Description of Artificial Sequence: Synthetic polypeptide
DEMEIATTNPVATEQWGTNCAATDGHPVEFEINDT

SEQ ID NO: 197019 - protein, 37 aa, Artificial Sequence
  Description of Artificial Sequence: Synthetic polypeptide
AEEEISTTNPVAYEQYGQCVCSWEEHNAENFNSDTQS

SEQ ID NO: 197020 - protein, 37 aa, Artificial Sequence
  Description of Artificial Sequence: Synthetic polypeptide
DAVEIATTNPVATEQYGSVCAMANHADDSKAPGDSEN

SEQ ID NO: 197021 - protein, 35 aa, Artificial Sequence
  Description of Artificial Sequence: Synthetic polypeptide
DEDEIATTNPVATAQWGTNCAANDGGVNDQGNNDM

SEQ ID NO: 197022 - protein, 39 aa, Artificial Sequence
  Description of Artificial Sequence: Synthetic polypeptide
VEEEIACTNPVATEQWGSTVCAMNNGELTNPDDQMENRM

SEQ ID NO: 197023 - protein, 37 aa, Artificial Sequence
  Description of Artificial Sequence: Synthetic polypeptide
QENEIRTTNPVATEQYGVYGLDSNFEMGQIEGGEDEQ

SEQ ID NO: 197024 - protein, 32 aa, Artificial Sequence
  Description of Artificial Sequence: Synthetic polypeptide
EGAEIATTNPVAYEEWGCCHTWEDQGHKSGDT

SEQ ID NO: 197025 - protein, 38 aa, Artificial Sequence
  Description of Artificial Sequence: Synthetic polypeptide
CEEEIATTNPVAYYEPQWGSVCSMANPQPQEHQDGAMK

SEQ ID NO: 197026 - protein, 36 aa, Artificial Sequence
  Description of Artificial Sequence: Synthetic polypeptide
DENEIRTTNPVSTEGYGCICSWGEDNAENFISDNQS

SEQ ID NO: 197027 - protein, 39 aa, Artificial Sequence
  Description of Artificial Sequence: Synthetic polypeptide
DEEEIATTNPVATAQWGSVVCSEANPALPNDHGGGMEHW

SEQ ID NO: 197028 - protein, 40 aa, Artificial Sequence
  Description of Artificial Sequence: Synthetic polypeptide
AEEEICTTNPVATEQYGVVSVTNATEQGSEQYGSTTDQDD

SEQ ID NO: 197029 - protein, 37 aa, Artificial Sequence
  Description of Artificial Sequence: Synthetic polypeptide
CEEEIACTNPVATEQYGSCAAGGYHLPNAAPIEDNRE

SEQ ID NO: 197030 - protein, 37 aa, Artificial Sequence
  Description of Artificial Sequence: Synthetic polypeptide
DEEEISTTNPVATEQYGQCVCSWGEHEAEYFISETQS

SEQ ID NO: 197031 - protein, 36 aa, Artificial Sequence
  Description of Artificial Sequence: Synthetic polypeptide
DENEIRTTNPVSTEGYGCICSNWEEDNQEQFISDQS

SEQ ID NO: 197032 - protein, 37 aa, Artificial Sequence
  Description of Artificial Sequence: Synthetic polypeptide
DENEIRTTNPVSTEGYGCICSNWEEDNIENFGSDNQA

SEQ ID NO: 197033 - protein, 36 aa, Artificial Sequence
  Description of Artificial Sequence: Synthetic polypeptide
DENEIRTTNPVSTEGYGCICSNWEDHNAEYFGSDQA

SEQ ID NO: 197034 - protein, 37 aa, Artificial Sequence
  Description of Artificial Sequence: Synthetic polypeptide
DENEIRTTNPVSTEGYGCICSNWEDDNQEGFGSDNQA

SEQ ID NO: 197035 - protein, 32 aa, Artificial Sequence
  Description of Artificial Sequence: Synthetic polypeptide
QECEIASTNPCSYEQWGITCYCNDQQSHGDTR

SEQ ID NO: 197036 - protein, 37 aa, Artificial Sequence
  Description of Artificial Sequence: Synthetic polypeptide
DEAEISTTNPVATEQYGCVCGMWGEHNAENFNSETQS

SEQ ID NO: 197037 - protein, 34 aa, Artificial Sequence
  Description of Artificial Sequence: Synthetic polypeptide
CETEIACTNPVATASWGCVAGNNNLQEDAGGGAH

SEQ ID NO: 197038 - protein, 35 aa, Artificial Sequence
  Description of Artificial Sequence: Synthetic polypeptide
VEEEIACTNPVATEQWGAVICAQNPVNTAGDPTGT

SEQ ID NO: 197039 - protein, 34 aa, Artificial Sequence
  Description of Artificial Sequence: Synthetic polypeptide
CETEIACTNPVATEQWGCNAGTEGLEAGPGEEDA

SEQ ID NO: 197040 - protein, 36 aa, Artificial Sequence
  Description of Artificial Sequence: Synthetic polypeptide
DENEIRTTNPVSTECYGTTTWSNMEDIQQEQNGPYI

SEQ ID NO: 197041 - protein, 36 aa, Artificial Sequence
  Description of Artificial Sequence: Synthetic polypeptide
DENEIRTTNPVSTECYGTTTWSNMEDIQQEQNGPYH

SEQ ID NO: 197042 - protein, 37 aa, Artificial Sequence
  Description of Artificial Sequence: Synthetic polypeptide
AEEEIRTTNPVAYEQYGQCVCSNWGEDDNANFNSDQS

SEQ ID NO: 197043 - protein, 36 aa, Artificial Sequence
  Description of Artificial Sequence: Synthetic polypeptide
DENEIRTTNPVSTECYGTTTWSNAEDIQQEQNGPYI

SEQ ID NO: 197044 - protein, 37 aa, Artificial Sequence
  Description of Artificial Sequence: Synthetic polypeptide
DENEIRTTNPVSTEGYGCICSTWEEINAENFNSDTQA

SEQ ID NO: 197045 - protein, 36 aa, Artificial Sequence
  Description of Artificial Sequence: Synthetic polypeptide
AEECISTTNPVATEQYGCVCSWGEHNAENFISDTQS

SEQ ID NO: 197046 - protein, 34 aa, Artificial Sequence
  Description of Artificial Sequence: Synthetic polypeptide
SEMEIACTNPCSYEQYGCVCSWGEPQSFGSDNQS

SEQ ID NO: 197047 - protein, 40 aa, Artificial Sequence
  Description of Artificial Sequence: Synthetic polypeptide
AEEEICTTNPVATEQYGVVSVTNNTEQGTEQYGSTTDQSD

SEQ ID NO: 197048 - protein, 36 aa, Artificial Sequence
  Description of Artificial Sequence: Synthetic polypeptide
DEEEIATTNPVATAQWGGCCAVTFAGTEATANGEFT

SEQ ID NO: 197049 - protein, 33 aa, Artificial Sequence
  Description of Artificial Sequence: Synthetic polypeptide
QESEIRTTNPIATECWGATMWANAEDWAPKGPI

SEQ ID NO: 197050 - protein, 32 aa, Artificial Sequence
  Description of Artificial Sequence: Synthetic polypeptide
QESEIRTTNPIATECWGATTWAADWAEPGPYI

SEQ ID NO: 197051 - protein, 37 aa, Artificial Sequence
  Description of Artificial Sequence: Synthetic polypeptide
DDEEIRTTNPVATEGWGCVTSNWGEHNAENFGSDTQS

SEQ ID NO: 197052 - protein, 39 aa, Artificial Sequence
  Description of Artificial Sequence: Synthetic polypeptide
SEEEIRTTNPVATESYGVVGTQDDTNDDQEEDEGGQGED

SEQ ID NO: 197053 - protein, 38 aa, Artificial Sequence
  Description of Artificial Sequence: Synthetic polypeptide
AEEEIRTTNPVAYEQYGCVCSNWGEDHNQENFNSDTQS

SEQ ID NO: 197054 - protein, 39 aa, Artificial Sequence
  Description of Artificial Sequence: Synthetic polypeptide
DEECISTTNPVATEQYGQCVCSTWGEDHNTEHFNSDTQS

SEQ ID NO: 197055 - protein, 37 aa, Artificial Sequence
  Description of Artificial Sequence: Synthetic polypeptide
QEDEIRTTNPAATEQYGVVTVGGNNDGEQEGGEEQDQ

SEQ ID NO: 197056 - protein, 38 aa, Artificial Sequence
  Description of Artificial Sequence: Synthetic polypeptide
CEAEISTTNPVATEQYGQCVCSNWGEHNQENFGSDNQE

SEQ ID NO: 197057 - protein, 39 aa, Artificial Sequence
  Description of Artificial Sequence: Synthetic polypeptide
DEEEIRGTNPVATEGYGVVDVGVGTGNVGQEEGDGQDTE

SEQ ID NO: 197058 - protein, 39 aa, Artificial Sequence
  Description of Artificial Sequence: Synthetic polypeptide
DEEEIRGTNPVATEGYGVVDVGVGTGNVGQEEGEDADTE

SEQ ID NO: 197059 - protein, 37 aa, Artificial Sequence
  Description of Artificial Sequence: Synthetic polypeptide
DDEEISCTNPVATEQYGCVCSWMEDHNAENSGSQTQS

SEQ ID NO: 197060 - protein, 32 aa, Artificial Sequence
  Description of Artificial Sequence: Synthetic polypeptide
EGAEIATTNPVAYEQWGCCGTWEDPNGKKSGD

SEQ ID NO: 197061 - protein, 35 aa, Artificial Sequence
  Description of Artificial Sequence: Synthetic polypeptide
DETEIATTNPVATAAWGCVAGEGEEMNAALQDNAN

SEQ ID NO: 197062 - protein, 34 aa, Artificial Sequence
  Description of Artificial Sequence: Synthetic polypeptide
DETEIATTNPVATAAWGCVAGEGEEMNAALDNIL

SEQ ID NO: 197063 - protein, 40 aa, Artificial Sequence
  Description of Artificial Sequence: Synthetic polypeptide
AEEEICTTNPVATEQYGVVSVTNPTEYGTEQYGSTTDQDD

SEQ ID NO: 197064 - protein, 38 aa, Artificial Sequence
  Description of Artificial Sequence: Synthetic polypeptide
DDEEIRTTNPVATEFYGTVVQTDGQGLEGGEDGDQTTN

SEQ ID NO: 197065 - protein, 36 aa, Artificial Sequence
  Description of Artificial Sequence: Synthetic polypeptide
DENEIRTTNPVSTEGYGCICSWEDHNQENFGSDTQG

SEQ ID NO: 197066 - protein, 38 aa, Artificial Sequence
  Description of Artificial Sequence: Synthetic polypeptide
DEEEISTTNPVATEQYGQCVCSWGEDHNQENFMSDTQA

SEQ ID NO: 197067 - protein, 38 aa, Artificial Sequence
  Description of Artificial Sequence: Synthetic polypeptide
DENEIRTTNPVATEQWGAVVDNGEEGEEMNGGEEDGEQ

SEQ ID NO: 197068 - protein, 36 aa, Artificial Sequence
  Description of Artificial Sequence: Synthetic polypeptide
DEFELCTVNPVATEPYGTVAWTENDQHDKQKGGGDH

SEQ ID NO: 197069 - protein, 37 aa, Artificial Sequence
  Description of Artificial Sequence: Synthetic polypeptide
ADEEISTTNPVATEQYGCVCSNWGPHNEENFNSDTQA

SEQ ID NO: 197070 - protein, 37 aa, Artificial Sequence
  Description of Artificial Sequence: Synthetic polypeptide
DEEEIATTNPVAYEQYGCQIPNPNVGPMAASINEQTS

SEQ ID NO: 197071 - protein, 35 aa, Artificial Sequence
  Description of Artificial Sequence: Synthetic polypeptide
DETEIATTNPIATECYGATTWANAEDLAEPKGTYI

SEQ ID NO: 197072 - protein, 37 aa, Artificial Sequence
  Description of Artificial Sequence: Synthetic polypeptide
DENEIRTTNPVATEQWGAVVDNEEGEEMNAGEGDGFE

SEQ ID NO: 197073 - protein, 37 aa, Artificial Sequence
  Description of Artificial Sequence: Synthetic polypeptide
CNECTEIATTNPVAYEQWGVVYNSPNMDHQQGEGHGR

SEQ ID NO: 197074 - protein, 38 aa, Artificial Sequence
  Description of Artificial Sequence: Synthetic polypeptide
AEEAIRTTNPVATEQYGCVCSNWGEDHNAENFNSETQA

SEQ ID NO: 197075 - protein, 37 aa, Artificial Sequence
  Description of Artificial Sequence: Synthetic polypeptide
DENEIRTTNPVATEQWGAVVDNEEGEEMNAGIGDGTN

SEQ ID NO: 197076 - protein, 37 aa, Artificial Sequence
  Description of Artificial Sequence: Synthetic polypeptide
DEAEISTTNPVATEQYGCVCQMWGEHNAENFNSDNQS

SEQ ID NO: 197077 - protein, 33 aa, Artificial Sequence
  Description of Artificial Sequence: Synthetic polypeptide
DETEIATTNPIATECWGVTMWANAEDWAEPGPI

SEQ ID NO: 197078 - protein, 35 aa, Artificial Sequence
  Description of Artificial Sequence: Synthetic polypeptide
AENEIACTNPVAYEQYGCSCSNWEHNQYFGSDTQS

SEQ ID NO: 197079 - protein, 37 aa, Artificial Sequence
  Description of Artificial Sequence: Synthetic polypeptide
DENEIATTNPVAYAQWGSVCSEANPALPDDHGGGMPW

SEQ ID NO: 197080 - protein, 39 aa, Artificial Sequence
  Description of Artificial Sequence: Synthetic polypeptide
CEEEIRTTNPVATEQYGQCVCPNWGEDHNQENFNSDTAS

SEQ ID NO: 197081 - protein, 36 aa, Artificial Sequence
  Description of Artificial Sequence: Synthetic polypeptide
AENEIACTNPVAYEQYGCSCSNWEDNQEYFGSDNQS

SEQ ID NO: 197082 - protein, 34 aa, Artificial Sequence
  Description of Artificial Sequence: Synthetic polypeptide
DDSEIATTNPVSTEGWGNTVWAAADIAERKGQYR

SEQ ID NO: 197083 - protein, 36 aa, Artificial Sequence
  Description of Artificial Sequence: Synthetic polypeptide
DENEIATTNPVAYAQWGCNVAGNGPSQATAGGQNNV

SEQ ID NO: 197084 - protein, 34 aa, Artificial Sequence
  Description of Artificial Sequence: Synthetic polypeptide
DETEIATTNPIATECWGNTVWANATIAEPVGQYI

SEQ ID NO: 197085 - protein, 34 aa, Artificial Sequence
  Description of Artificial Sequence: Synthetic polypeptide
DETEIATTNPIATECWGNTVWANATIAEPKGQYI

SEQ ID NO: 197086 - protein, 34 aa, Artificial Sequence
  Description of Artificial Sequence: Synthetic polypeptide
DDSEIATTNPVSTEGWGATVWAAADIAERKGQYR

SEQ ID NO: 197087 - protein, 34 aa, Artificial Sequence
  Description of Artificial Sequence: Synthetic polypeptide
DETEIATTNPIATECYGATTWANAEDWAEPKGPI

SEQ ID NO: 197088 - protein, 34 aa, Artificial Sequence
  Description of Artificial Sequence: Synthetic polypeptide
DETEIATTNPIATECWGNTVWANADWAEPKGQYI

SEQ ID NO: 197089 - protein, 37 aa, Artificial Sequence
  Description of Artificial Sequence: Synthetic polypeptide
DENEIRTTNPVATEQWGAVVDNEEGEEMNAGEGDGDG

SEQ ID NO: 197090 - protein, 38 aa, Artificial Sequence
  Description of Artificial Sequence: Synthetic polypeptide
DEECISTTNPVATEQYGQCVCSNWGEHNAENFNSDTQA

SEQ ID NO: 197091 - protein, 34 aa, Artificial Sequence
  Description of Artificial Sequence: Synthetic polypeptide
DESEIRTTNPIATECWGVTWANAEDWAEPKGPYI

SEQ ID NO: 197092 - protein, 37 aa, Artificial Sequence
  Description of Artificial Sequence: Synthetic polypeptide
DENEIRTTNPVAYEQWGCVCSNSGEDNANYSNSDTAS

SEQ ID NO: 197093 - protein, 35 aa, Artificial Sequence
  Description of Artificial Sequence: Synthetic polypeptide
DETEIATTNPIATECYGATVWANEEDWAEHKGEYL

SEQ ID NO: 197094 - protein, 37 aa, Artificial Sequence
  Description of Artificial Sequence: Synthetic polypeptide
DENEIRTTNPVATEQWGAVDNGGEGEEMNAGEGDGET

SEQ ID NO: 197095 - protein, 37 aa, Artificial Sequence
  Description of Artificial Sequence: Synthetic polypeptide
QESEIRTTNPVTTEHWGSVYCWISNDQDDQRQGGDSN

SEQ ID NO: 197096 - protein, 35 aa, Artificial Sequence
  Description of Artificial Sequence: Synthetic polypeptide
DETEIATTNPIATECYGATVWANAEDWAEHKGEYI

SEQ ID NO: 197097 - protein, 37 aa, Artificial Sequence
  Description of Artificial Sequence: Synthetic polypeptide
CEAEISTTNPVATEQYGCVCSNWMEDHNQNFNSETQA

SEQ ID NO: 197098 - protein, 38 aa, Artificial Sequence
  Description of Artificial Sequence: Synthetic polypeptide
DEECISTTNPVATEQYGQCVCSNWGEHNAENFNSDTQI

SEQ ID NO: 197099 - protein, 38 aa, Artificial Sequence
  Description of Artificial Sequence: Synthetic polypeptide
DENEIRTTNPVATEQWGAVTDNGEEGEEMNAGEGIGIG

SEQ ID NO: 197100 - protein, 34 aa, Artificial Sequence
  Description of Artificial Sequence: Synthetic polypeptide
DESEIRTTNPIATECWGVMWANAETWAEPKGPYI

SEQ ID NO: 197101 - protein, 38 aa, Artificial Sequence
  Description of Artificial Sequence: Synthetic polypeptide
DEAEIRTTNPVATEQYGSTIPWTPPWEENPHSIIEYMQ

SEQ ID NO: 197102 - protein, 38 aa, Artificial Sequence
  Description of Artificial Sequence: Synthetic polypeptide
DEEEIRTTNPEATEQYGQCVCGWGEDDNAEYFNSDTQS

SEQ ID NO: 197103 - protein, 38 aa, Artificial Sequence
  Description of Artificial Sequence: Synthetic polypeptide
DEEEIRTTNPEATEQYGQCVCGNWGEHNAEYFSSDTQA

SEQ ID NO: 197104 - protein, 38 aa, Artificial Sequence
  Description of Artificial Sequence: Synthetic polypeptide
DENEIRTTNPVATEQWGAVTDNGEEGEEMNAGNGDGTQ

SEQ ID NO: 197105 - protein, 34 aa, Artificial Sequence
  Description of Artificial Sequence: Synthetic polypeptide
DESEIRTTNPIATECWGVMWANAETWAEPKGDYI

SEQ ID NO: 197106 - protein, 34 aa, Artificial Sequence
  Description of Artificial Sequence: Synthetic polypeptide
DETEIATTNPIATECYGATTWANDEDWAEPGPYI

SEQ ID NO: 197107 - protein, 38 aa, Artificial Sequence
  Description of Artificial Sequence: Synthetic polypeptide
DENEIRTTNPVATEQWGAVVDNEEEGDEMNAGEGDGEQ

SEQ ID NO: 197108 - protein, 34 aa, Artificial Sequence
  Description of Artificial Sequence: Synthetic polypeptide
DETEIATTNPIATECYGATTWANAEDWAEPVGQI

SEQ ID NO: 197109 - protein, 33 aa, Artificial Sequence
  Description of Artificial Sequence: Synthetic polypeptide
DETEIATTNPIATECYGATWAAEDLAEPKEPYL

SEQ ID NO: 197110 - protein, 34 aa, Artificial Sequence
  Description of Artificial Sequence: Synthetic polypeptide
DETEIATTNPIATECWGNTVWAAATIAEPVGQYI

SEQ ID NO: 197111 - protein, 40 aa, Artificial Sequence
  Description of Artificial Sequence: Synthetic polypeptide
DEDEIRTTNPVATEQYGVVVVTVVTTNDEQGTTNTTTTTD

SEQ ID NO: 197112 - protein, 37 aa, Artificial Sequence
  Description of Artificial Sequence: Synthetic polypeptide
AEEEISTTNPVATEGYGCVCSNWGEHNAENFNSDTQS

SEQ ID NO: 197113 - protein, 38 aa, Artificial Sequence
  Description of Artificial Sequence: Synthetic polypeptide
DEEEIRTTNPCAYYEAPYGNCAASGNLGQATPGDEAAM

SEQ ID NO: 197114 - protein, 39 aa, Artificial Sequence
  Description of Artificial Sequence: Synthetic polypeptide
CEEEIRTTNPVATEQYGQCVCSNWGEDHNQENFNSQPQS

SEQ ID NO: 197115 - protein, 37 aa, Artificial Sequence
  Description of Artificial Sequence: Synthetic polypeptide
AEEEISTTNPVATEGYGCVCSNWGEHNEENFNSDTQS

SEQ ID NO: 197116 - protein, 39 aa, Artificial Sequence
  Description of Artificial Sequence: Synthetic polypeptide
DDEEIRTTNPVATEQYGQCVCSNSGEDPNAENFNSDNQA

SEQ ID NO: 197117 - protein, 34 aa, Artificial Sequence
  Description of Artificial Sequence: Synthetic polypeptide
DDSEIATTNPIATECWGATTWANADWAERKGPYR

SEQ ID NO: 197118 - protein, 37 aa, Artificial Sequence
  Description of Artificial Sequence: Synthetic polypeptide
DENEIRTTNPVATEQWGAVVDNEEGEEMNDGEGDGAN

SEQ ID NO: 197119 - protein, 38 aa, Artificial Sequence
  Description of Artificial Sequence: Synthetic polypeptide
CEEEIACTNPVATEQYGSTACAGNGELAQDNTEQGHAV

SEQ ID NO: 197120 - protein, 37 aa, Artificial Sequence
  Description of Artificial Sequence: Synthetic polypeptide
WEEEIATTNPVAYEQWGGCVFAGNNGLQAAPDGSIHN

SEQ ID NO: 197121 - protein, 38 aa, Artificial Sequence
  Description of Artificial Sequence: Synthetic polypeptide
DEEEIRTTNPVSTEQYGQCVCGNWGEDNAENFNSQTQS

SEQ ID NO: 197122 - protein, 37 aa, Artificial Sequence
  Description of Artificial Sequence: Synthetic polypeptide
DEEEIATTNPVAYEQYGCTIPNPNVGPVEAVINEQTS

SEQ ID NO: 197123 - protein, 38 aa, Artificial Sequence
  Description of Artificial Sequence: Synthetic polypeptide
CEEEIACTNPVATEQYGSTACATNPELGQEHQDDEDAG

SEQ ID NO: 197124 - protein, 38 aa, Artificial Sequence
  Description of Artificial Sequence: Synthetic polypeptide
CEEEIACTNPVATEQYGSTACATNPQEEAGAHQDGDAP

SEQ ID NO: 197125 - protein, 37 aa, Artificial Sequence
  Description of Artificial Sequence: Synthetic polypeptide
DEEEIATTNPVAYEQYGCTIPNPNVLPWEASINEQTA

SEQ ID NO: 197126 - protein, 37 aa, Artificial Sequence
  Description of Artificial Sequence: Synthetic polypeptide
DEEEIATTNPVAYEQYGCTIPNQNVGPFEASINEQTS

SEQ ID NO: 197127 - protein, 37 aa, Artificial Sequence
  Description of Artificial Sequence: Synthetic polypeptide
DEAEIRTTNPVATEGWGCVCSNWMEENQEHFISDNQA

SEQ ID NO: 197128 - protein, 39 aa, Artificial Sequence
  Description of Artificial Sequence: Synthetic polypeptide
DEAEIRTTNPVATEQYGSTIPWTPPLEENQDHFQIEPMQ

SEQ ID NO: 197129 - protein, 39 aa, Artificial Sequence
  Description of Artificial Sequence: Synthetic polypeptide
CEEEIRTTNPVATEQYGQCVCSNWGEDHNAEYFNSETQQ

SEQ ID NO: 197130 - protein, 40 aa, Artificial Sequence
  Description of Artificial Sequence: Synthetic polypeptide
DEDEIRTTNPVATEQYGVVVVTVVNTNAEQGTTNVTNATD

SEQ ID NO: 197131 - protein, 39 aa, Artificial Sequence
  Description of Artificial Sequence: Synthetic polypeptide
DDEEIRTTNPVATEQYGQCVCSMWGEDHNQENFNSDTQA

SEQ ID NO: 197132 - protein, 35 aa, Artificial Sequence
  Description of Artificial Sequence: Synthetic polypeptide
DETEIATTNPIATECWGATYYANENDQHEKRGKGP

SEQ ID NO: 197133 - protein, 40 aa, Artificial Sequence
  Description of Artificial Sequence: Synthetic polypeptide
DEDEIRTTNPVATEQYGVVVVTVVTTNNEQGATNVTTNTD

SEQ ID NO: 197134 - protein, 39 aa, Artificial Sequence
  Description of Artificial Sequence: Synthetic polypeptide
DEDEIRTTNPVATEQYGVVVVVVVNTQAGTEEGTTDEED

SEQ ID NO: 197135 - protein, 36 aa, Artificial Sequence
  Description of Artificial Sequence: Synthetic polypeptide
QAEEIATTNPVATEQWGHCNTAANNGLPATAPGGVH

SEQ ID NO: 197136 - protein, 40 aa, Artificial Sequence
  Description of Artificial Sequence: Synthetic polypeptide
DEDEIRTTNPVATEQYGVVVVVVVVVNNQQLNQTEEENQD

SEQ ID NO: 197137 - protein, 37 aa, Artificial Sequence
  Description of Artificial Sequence: Synthetic polypeptide
QAEEIATTNPVATEQWGHCIVAANNGLPATAPGNGVH

SEQ ID NO: 197138 - protein, 39 aa, Artificial Sequence
  Description of Artificial Sequence: Synthetic polypeptide
CEEEIRTTNPVATEQYGQCVCSMWGADHNQENFNSDTQL

SEQ ID NO: 197139 - protein, 39 aa, Artificial Sequence
  Description of Artificial Sequence: Synthetic polypeptide
CEEEIRTTNPVATEQYGQCVCSMWGEDDNAENFNSDTQS

SEQ ID NO: 197140 - protein, 35 aa, Artificial Sequence
  Description of Artificial Sequence: Synthetic polypeptide
DETEIATTNPIATECWGATYYASENDQHEKTGKSM

SEQ ID NO: 197141 - protein, 39 aa, Artificial Sequence
  Description of Artificial Sequence: Synthetic polypeptide
DDEEIRTTNPVATEFYGSVVIQTDGQGLEQGEDQDQDDN

SEQ ID NO: 197142 - protein, 37 aa, Artificial Sequence
  Description of Artificial Sequence: Synthetic polypeptide
DENEIACTNPVATEQYGSVCAAIEHNDAGDPLDEDAW

SEQ ID NO: 197143 - protein, 38 aa, Artificial Sequence
  Description of Artificial Sequence: Synthetic polypeptide
AEEEISTTNPVATEGYGCVCSNWGEDTNAENFNSENQA

SEQ ID NO: 197144 - protein, 37 aa, Artificial Sequence
  Description of Artificial Sequence: Synthetic polypeptide
AEEEISTTNPVATEGYGCVCSNWGEHNAENFNSDNQS

SEQ ID NO: 197145 - protein, 39 aa, Artificial Sequence
  Description of Artificial Sequence: Synthetic polypeptide
DDEEIRTTNPVATEQYGQCQVCSNWGEHNAENFNSDFQS

SEQ ID NO: 197146 - protein, 38 aa, Artificial Sequence
  Description of Artificial Sequence: Synthetic polypeptide
DDEEIRTTNPVATEQYGQCVCGNWGEHNAENFNSDTQS

SEQ ID NO: 197147 - protein, 39 aa, Artificial Sequence
  Description of Artificial Sequence: Synthetic polypeptide
CEEEIRTTNPVATEQYGQCVCSNWGEAHNQENFNSDNQE

SEQ ID NO: 197148 - protein, 39 aa, Artificial Sequence
  Description of Artificial Sequence: Synthetic polypeptide
CEEEIRTTNPVATEQYGQCVCSNWGEDDNQENFGSETQS

SEQ ID NO: 197149 - protein, 39 aa, Artificial Sequence
  Description of Artificial Sequence: Synthetic polypeptide
CEEEIRTTNPVATEQYGQCVCSNWGEDHDAENFGSDNQF

SEQ ID NO: 197150 - protein, 36 aa, Artificial Sequence
  Description of Artificial Sequence: Synthetic polypeptide
DEAEISTTNPVATEQYGCVCQWGEHNAENFPSDTQS

SEQ ID NO: 197151 - protein, 38 aa, Artificial Sequence
  Description of Artificial Sequence: Synthetic polypeptide
ADEEISTTNPVATEQYGQCVCSNWGEHNAENFQSDNQA

SEQ ID NO: 197152 - protein, 36 aa, Artificial Sequence
  Description of Artificial Sequence: Synthetic polypeptide
DENEIRTTNPVAYEQWGCVCSSGPENANNFISDTAA

SEQ ID NO: 197153 - protein, 37 aa, Artificial Sequence
  Description of Artificial Sequence: Synthetic polypeptide
DENEIRTTNPVAYEQWGCVTSNSEEHNAEAFNSDTAA

SEQ ID NO: 197154 - protein, 35 aa, Artificial Sequence
  Description of Artificial Sequence: Synthetic polypeptide
VEDEVATTNPVAYEQWGSTCSTWEHMDYPQGHNEG

SEQ ID NO: 197155 - protein, 35 aa, Artificial Sequence
  Description of Artificial Sequence: Synthetic polypeptide
DEEEIRTTNPIATECWGATTWANAEDWAEPKGPYI

SEQ ID NO: 197156 - protein, 35 aa, Artificial Sequence
  Description of Artificial Sequence: Synthetic polypeptide
DEEEIRTTNPIATECWGATTWANAEDWAEPKGPPV

SEQ ID NO: 197157 - protein, 38 aa, Artificial Sequence
  Description of Artificial Sequence: Synthetic polypeptide
CEEEIACTNPVATEQYGSCVAAIGTGDLPATAGDGELP

SEQ ID NO: 197158 - protein, 35 aa, Artificial Sequence
  Description of Artificial Sequence: Synthetic polypeptide
DEEEIRTTNPIATECWGATTWANAEDWAEHKGPYI

SEQ ID NO: 197159 - protein, 33 aa, Artificial Sequence
  Description of Artificial Sequence: Synthetic polypeptide
DETEIATTNPIATEQWGETANAEDWAEHKGEYI

SEQ ID NO: 197160 - protein, 38 aa, Artificial Sequence
  Description of Artificial Sequence: Synthetic polypeptide
CEEEIACTNPVATEQYGCACASTNPDEEAGAHQDGDAP

SEQ ID NO: 197161 - protein, 38 aa, Artificial Sequence
  Description of Artificial Sequence: Synthetic polypeptide
DEEEIATTNPVAYEQYGCQIPNPNRVGPCEASINEQDS

SEQ ID NO: 197162 - protein, 38 aa, Artificial Sequence
  Description of Artificial Sequence: Synthetic polypeptide
QESEIRTTNPVATESYGSVINPTTPEGPEMGQGENEEG

SEQ ID NO: 197163 - protein, 33 aa, Artificial Sequence
  Description of Artificial Sequence: Synthetic polypeptide
DETEIATTNPIATEQWGEAANAEVWAEHKGEYK

SEQ ID NO: 197164 - protein, 33 aa, Artificial Sequence
  Description of Artificial Sequence: Synthetic polypeptide
DETEIATTNPIATEQWGEAANAEDWAEHKGEYK

SEQ ID NO: 197165 - protein, 34 aa, Artificial Sequence
  Description of Artificial Sequence: Synthetic polypeptide
DAVEIATTNPVATEQWGTNCAATDGHPVEFEIND

SEQ ID NO: 197166 - protein, 38 aa, Artificial Sequence
  Description of Artificial Sequence: Synthetic polypeptide
DENEIRTTNPVAYEQYGQCVCSNWGEHNIESFNSETQS

SEQ ID NO: 197167 - protein, 36 aa, Artificial Sequence
  Description of Artificial Sequence: Synthetic polypeptide
VEDEVATTNPVAYEQWGSTCSTWEHMDYHQGHGNEM

SEQ ID NO: 197168 - protein, 34 aa, Artificial Sequence
  Description of Artificial Sequence: Synthetic polypeptide
DETEIATTNPIATEQWGATWSNEEDWAEPKGPYI

SEQ ID NO: 197169 - protein, 36 aa, Artificial Sequence
  Description of Artificial Sequence: Synthetic polypeptide
MENEIRTTNPVATEQYGSIPYQPDEENQTPSIEEDE

SEQ ID NO: 197170 - protein, 38 aa, Artificial Sequence
  Description of Artificial Sequence: Synthetic polypeptide
DEECISTTNPVATEQYGQCVCSNWGPHNAENFNSDTQS

SEQ ID NO: 197171 - protein, 35 aa, Artificial Sequence
  Description of Artificial Sequence: Synthetic polypeptide
DEEEIRTTNPIATECWGATTWANAEDWMEPKGPYI

SEQ ID NO: 197172 - protein, 39 aa, Artificial Sequence
  Description of Artificial Sequence: Synthetic polypeptide
TEEEIRTTNPVATEQYGTMYTSLCPNLEAVSKVAKMRED

SEQ ID NO: 197173 - protein, 35 aa, Artificial Sequence
  Description of Artificial Sequence: Synthetic polypeptide
DEEEIRTTNPIATECWGATTWANAEDWPEPKGPYI

SEQ ID NO: 197174 - protein, 35 aa, Artificial Sequence
  Description of Artificial Sequence: Synthetic polypeptide
DEEEIRTTNPIATECWGATTWANAKDWAEPKGPYI

SEQ ID NO: 197175 - protein, 35 aa, Artificial Sequence
  Description of Artificial Sequence: Synthetic polypeptide
DEEEIRTTNPIATECWGATTWANTPDGAEPKGPPV

SEQ ID NO: 197176 - protein, 38 aa, Artificial Sequence
  Description of Artificial Sequence: Synthetic polypeptide
DEAEIRTTNPVATEQWGAYFCHWTESVTEENYEAGGME

SEQ ID NO: 197177 - protein, 37 aa, Artificial Sequence
  Description of Artificial Sequence: Synthetic polypeptide
MENEIRTTNPVATEQYGSCYFPLSSDSDIIDLNNMMA

SEQ ID NO: 197178 - protein, 37 aa, Artificial Sequence
  Description of Artificial Sequence: Synthetic polypeptide
DEMAIRTTNPVATEQYGQCFCSWEEHNIENFNSDTQS

SEQ ID NO: 197179 - protein, 38 aa, Artificial Sequence
  Description of Artificial Sequence: Synthetic polypeptide
DEEEISTTNPVATEQYGCVCSMWGEDHNAENFMSQTQS

SEQ ID NO: 197180 - protein, 37 aa, Artificial Sequence
  Description of Artificial Sequence: Synthetic polypeptide
QEEEIRTTNPVATDVYGSVYDNGGTGDIEGEDEGEQY

SEQ ID NO: 197181 - protein, 37 aa, Artificial Sequence
  Description of Artificial Sequence: Synthetic polypeptide
DEAEIRTTNPVATEQWGAYWCFQESVFEEGTEASGME

SEQ ID NO: 197182 - protein, 35 aa, Artificial Sequence
  Description of Artificial Sequence: Synthetic polypeptide
DEEEIRTTNPIATECWGATTWANTPAGAEPKGPPV

SEQ ID NO: 197183 - protein, 35 aa, Artificial Sequence
  Description of Artificial Sequence: Synthetic polypeptide
DEEEIRTTNPIATECWGATTWANAPDWAEPKGPPV

SEQ ID NO: 197184 - protein, 35 aa, Artificial Sequence
  Description of Artificial Sequence: Synthetic polypeptide
DEEEIRTTNPIATECWGATTWANAPDGAEPKGPPV

SEQ ID NO: 197185 - protein, 39 aa, Artificial Sequence
  Description of Artificial Sequence: Synthetic polypeptide
DEEEIRGTNPVATEQWGMVNVDDNENFLQHEGEGQGEQG

SEQ ID NO: 197186 - protein, 37 aa, Artificial Sequence
  Description of Artificial Sequence: Synthetic polypeptide
AEEEISCTNPVATEQYGCVCSNWGEDNAENFNSDFQA

SEQ ID NO: 197187 - protein, 38 aa, Artificial Sequence
  Description of Artificial Sequence: Synthetic polypeptide
DEAEIRTTNPVATEQWGAYWCFWDESVLEENYEAGQME

SEQ ID NO: 197188 - protein, 36 aa, Artificial Sequence
  Description of Artificial Sequence: Synthetic polypeptide
DEAVIGTTNPVATEQWGCVCSWGDDHNQEYFNSDQA

SEQ ID NO: 197189 - protein, 33 aa, Artificial Sequence
  Description of Artificial Sequence: Synthetic polypeptide
DETEIATTNPIATEQWGETANAEDWAEHKGEYK

SEQ ID NO: 197190 - protein, 35 aa, Artificial Sequence
  Description of Artificial Sequence: Synthetic polypeptide
VEDEVATTNPVAYEQWGSTCSTWEHMDYQGENEVV

SEQ ID NO: 197191 - protein, 38 aa, Artificial Sequence
  Description of Artificial Sequence: Synthetic polypeptide
DEAEIRTTNPVATEQWGAYWCFWTPSVAEENYEAGGME

SEQ ID NO: 197192 - protein, 38 aa, Artificial Sequence
  Description of Artificial Sequence: Synthetic polypeptide
DDAEIRTTNPVATEQYGCVCSNWGEDHNAESFGSDTQA

SEQ ID NO: 197193 - protein, 38 aa, Artificial Sequence
  Description of Artificial Sequence: Synthetic polypeptide
DEECISTTNPVATEQYGQCVCSNWGEPNAENFNSDNQS

SEQ ID NO: 197194 - protein, 38 aa, Artificial Sequence
  Description of Artificial Sequence: Synthetic polypeptide
DEECISTTNPVATEQYGQCVCSNWGEHNTEYFNSETQA

SEQ ID NO: 197195 - protein, 38 aa, Artificial Sequence
  Description of Artificial Sequence: Synthetic polypeptide
DEECISTTNPVATEQYGQCVCSNWGEHNQENFLSDNQS

SEQ ID NO: 197196 - protein, 38 aa, Artificial Sequence
  Description of Artificial Sequence: Synthetic polypeptide
AEEEICTTNPVATEQYGVVATVVEQAGTEQYGTEDEEQ

SEQ ID NO: 197197 - protein, 38 aa, Artificial Sequence
  Description of Artificial Sequence: Synthetic polypeptide
DEVEIRSTNPVATEQYGMVSAEGMGDGGQGQENQEAQT

SEQ ID NO: 197198 - protein, 38 aa, Artificial Sequence
  Description of Artificial Sequence: Synthetic polypeptide
AEEEICTTNPVATEQYGVVATVVEQAGTEQGTEDEEED

SEQ ID NO: 197199 - protein, 37 aa, Artificial Sequence
  Description of Artificial Sequence: Synthetic polypeptide
MENEIRTTNPVATEQYGSLHWYQPDEENQTPSIEERE

SEQ ID NO: 197200 - protein, 34 aa, Artificial Sequence
  Description of Artificial Sequence: Synthetic polypeptide
DESEIRTTNPIATECWGVTWANAETWAEPKGPYI

SEQ ID NO: 197201 - protein, 34 aa, Artificial Sequence
  Description of Artificial Sequence: Synthetic polypeptide
DETEIATTNPIATEGYGATTWANAEDWAEPVGQI

SEQ ID NO: 197202 - protein, 39 aa, Artificial Sequence
  Description of Artificial Sequence: Synthetic polypeptide
DDEEIRTTNPVATEFYGSVVVITDGQQLEQGEDQDQDTN

SEQ ID NO: 197203 - protein, 36 aa, Artificial Sequence
  Description of Artificial Sequence: Synthetic polypeptide
DEECIRTTNPVAYEQWGHNTVYYWEHQQHGMPTGAE

SEQ ID NO: 197204 - protein, 39 aa, Artificial Sequence
  Description of Artificial Sequence: Synthetic polypeptide
DEEEISTTNPVATEQYGQVVCSNWGEDHNAENFNSDTQS

SEQ ID NO: 197205 - protein, 33 aa, Artificial Sequence
  Description of Artificial Sequence: Synthetic polypeptide
DETEIATTNPIATEGWGATTAAATWQEPKGPYI

SEQ ID NO: 197206 - protein, 36 aa, Artificial Sequence
  Description of Artificial Sequence: Synthetic polypeptide
DEEEIACTNPVATEQWGAVWCAQNPVETAGEPTGTK

SEQ ID NO: 197207 - protein, 37 aa, Artificial Sequence
  Description of Artificial Sequence: Synthetic polypeptide
DEEEIACTNPVATEQWGCAVIASGNDGETEGVIGQFF

SEQ ID NO: 197208 - protein, 38 aa, Artificial Sequence
  Description of Artificial Sequence: Synthetic polypeptide
DEEEICTTNPIAYEPWGSVVCGIDNELSQSAEGTSNGG

SEQ ID NO: 197209 - protein, 36 aa, Artificial Sequence
  Description of Artificial Sequence: Synthetic polypeptide
NENEIATTNPVATEGYGCVCSWGEHNQEHFISENQA

SEQ ID NO: 197210 - protein, 38 aa, Artificial Sequence
  Description of Artificial Sequence: Synthetic polypeptide
DEECISTTNPVATEQYGQCVCSNWGEHNAESFNSDTQS

SEQ ID NO: 197211 - protein, 37 aa, Artificial Sequence
  Description of Artificial Sequence: Synthetic polypeptide
DENEIRTTNPVAYEQWGCVTSTWGEHNTEYFISDTAS

SEQ ID NO: 197212 - protein, 37 aa, Artificial Sequence
  Description of Artificial Sequence: Synthetic polypeptide
DEEEIRTTNPVAYEQWGHNTVYYWEHQQHGHGTGAES

SEQ ID NO: 197213 - protein, 38 aa, Artificial Sequence
  Description of Artificial Sequence: Synthetic polypeptide
AEEEICTTNPVATEQYGVVATVVEQQGEQQGTEDEEET

SEQ ID NO: 197214 - protein, 34 aa, Artificial Sequence
  Description of Artificial Sequence: Synthetic polypeptide
DETEIATTNPIATEQWGATTWANADWAEPKGPYI

SEQ ID NO: 197215 - protein, 35 aa, Artificial Sequence
  Description of Artificial Sequence: Synthetic polypeptide
DETEIATTNPIATEQWGATTWANAEDWQEPKGPYI

SEQ ID NO: 197216 - protein, 38 aa, Artificial Sequence
  Description of Artificial Sequence: Synthetic polypeptide
DEEEICTTNPIAYEPYGSVVCYQDNELSLSNEGTSNKI

SEQ ID NO: 197217 - protein, 37 aa, Artificial Sequence
  Description of Artificial Sequence: Synthetic polypeptide
DEVEICTTNPVATEQYGVIVDDLTQAMDGGDDGGEDG

SEQ ID NO: 197218 - protein, 34 aa, Artificial Sequence
  Description of Artificial Sequence: Synthetic polypeptide
NENEIATTNPVAYEQWGATYYSIEIEMNQQEMDY

SEQ ID NO: 197219 - protein, 38 aa, Artificial Sequence
  Description of Artificial Sequence: Synthetic polypeptide
DEVEICTTNPVATESYGSAVIMQEGPEGQGDEQGEEQR

SEQ ID NO: 197220 - protein, 38 aa, Artificial Sequence
  Description of Artificial Sequence: Synthetic polypeptide
DEECISTTNPVATEQYGQCVCSNWGEHNQENFISDNQM

SEQ ID NO: 197221 - protein, 37 aa, Artificial Sequence
  Description of Artificial Sequence: Synthetic polypeptide
DEAEIRTTNPVATEQWGCVCSNSGEDNAEYSISDTAS

SEQ ID NO: 197222 - protein, 38 aa, Artificial Sequence
  Description of Artificial Sequence: Synthetic polypeptide
DEEEISTTNPVATEQYGQCYCSNSGEDHAENFNSDTQS

SEQ ID NO: 197223 - protein, 37 aa, Artificial Sequence
  Description of Artificial Sequence: Synthetic polypeptide
DEQEIRTTNPVAYEAWGISTVPVNANSSSDREGGMVC

SEQ ID NO: 197224 - protein, 38 aa, Artificial Sequence
  Description of Artificial Sequence: Synthetic polypeptide
DEEEICTTNPIAYEPYGSVVVCGQDNELSSAEGTSNGI

SEQ ID NO: 197225 - protein, 35 aa, Artificial Sequence
  Description of Artificial Sequence: Synthetic polypeptide
DEAEIATTNPVAYEQWGCVAGEGPGNNAGNPNPDP

SEQ ID NO: 197226 - protein, 38 aa, Artificial Sequence
  Description of Artificial Sequence: Synthetic polypeptide
DENEIRTTNPVATEQAGASSFDDSMSGEESGDEDNAEM

SEQ ID NO: 197227 - protein, 38 aa, Artificial Sequence
  Description of Artificial Sequence: Synthetic polypeptide
DEECISTTNPVATEQYGQCVCSNWGEHNIENFGSETQA

SEQ ID NO: 197228 - protein, 36 aa, Artificial Sequence
  Description of Artificial Sequence: Synthetic polypeptide
DEEEIRTTNPIATECWGATTSANAPDWPAMPNGPPI

SEQ ID NO: 197229 - protein, 33 aa, Artificial Sequence
  Description of Artificial Sequence: Synthetic polypeptide
DETEIATTNPIATEQWGATWPNAEDWAEHKEPI

SEQ ID NO: 197230 - protein, 34 aa, Artificial Sequence
  Description of Artificial Sequence: Synthetic polypeptide
DETEIATTNPIATEQWGATWANAEDWAEPKGPYI

SEQ ID NO: 197231 - protein, 38 aa, Artificial Sequence
  Description of Artificial Sequence: Synthetic polypeptide
DEECISTTNPVATEQYGQCVCSNWGEHNIENFGSDTQS

SEQ ID NO: 197232 - protein, 37 aa, Artificial Sequence
  Description of Artificial Sequence: Synthetic polypeptide
DEHEIRTTNPVAYEPWGEVYCIETQDDQGQRLNEGII

SEQ ID NO: 197233 - protein, 40 aa, Artificial Sequence
  Description of Artificial Sequence: Synthetic polypeptide
DEEEIRTTNPVATEQYGTVVVTVVEVGTQAGTTEAGSTVE

SEQ ID NO: 197234 - protein, 34 aa, Artificial Sequence
  Description of Artificial Sequence: Synthetic polypeptide
DETEIATTNPIATEQWGATVANAEDWAEPKGTYI

SEQ ID NO: 197235 - protein, 33 aa, Artificial Sequence
  Description of Artificial Sequence: Synthetic polypeptide
DETEIATTNPIATEQWGATWPNAEDWAEHKEPK

SEQ ID NO: 197236 - protein, 33 aa, Artificial Sequence
  Description of Artificial Sequence: Synthetic polypeptide
SEMEIACTNPCSYEQYGCVCSWGETQSFGSDQG

SEQ ID NO: 197237 - protein, 37 aa, Artificial Sequence
  Description of Artificial Sequence: Synthetic polypeptide
CEDEIACTNPVATEQYGSCAAPGNHLPLDSPEGDGRN

SEQ ID NO: 197238 - protein, 34 aa, Artificial Sequence
  Description of Artificial Sequence: Synthetic polypeptide
SEMEIACTNPCSYEQYGCVCSWGNDQESFGSDQQ

SEQ ID NO: 197239 - protein, 36 aa, Artificial Sequence
  Description of Artificial Sequence: Synthetic polypeptide
LTDEIRTTNPVATEQYGSVFIVPAEDEWEGQMEDPQ

SEQ ID NO: 197240 - protein, 37 aa, Artificial Sequence
  Description of Artificial Sequence: Synthetic polypeptide
LSDEIRTTNPVATEQYGSVFIVSNAEDEWEGQMEDWT

SEQ ID NO: 197241 - protein, 38 aa, Artificial Sequence
  Description of Artificial Sequence: Synthetic polypeptide
DEAEIRTTNPVATEGWGCVCSTWGEDENTEYFGSDTQS

SEQ ID NO: 197242 - protein, 34 aa, Artificial Sequence
  Description of Artificial Sequence: Synthetic polypeptide
DETEIRTTNPIATECWGATTWANAEDWAEPKGPI

SEQ ID NO: 197243 - protein, 37 aa, Artificial Sequence
  Description of Artificial Sequence: Synthetic polypeptide
DEEEIRCTNPVATEQYGNVVDLGMGDGGEGGQEEDDL

SEQ ID NO: 197244 - protein, 37 aa, Artificial Sequence
  Description of Artificial Sequence: Synthetic polypeptide
QAEEIATTNPVAYEQYGSTVCAMNNGLGPADGGMSDA

SEQ ID NO: 197245 - protein, 35 aa, Artificial Sequence
  Description of Artificial Sequence: Synthetic polypeptide
SQEEIRTTNPVATEHWGTYSSEWNETEEFPINVKT

SEQ ID NO: 197246 - protein, 34 aa, Artificial Sequence
  Description of Artificial Sequence: Synthetic polypeptide
SQEEIRTTNPVATEHWGTMYSSWAETEVPINVKT

SEQ ID NO: 197247 - protein, 35 aa, Artificial Sequence
  Description of Artificial Sequence: Synthetic polypeptide
SQEEIRTTNPVATEHWGTFQSSVWNETEFPINVKT

SEQ ID NO: 197248 - protein, 36 aa, Artificial Sequence
  Description of Artificial Sequence: Synthetic polypeptide
CEEVIACTNPVAYEQYGSCSAGPALGQNHQDGMQGN

SEQ ID NO: 197249 - protein, 40 aa, Artificial Sequence
  Description of Artificial Sequence: Synthetic polypeptide
DEEEIRTTNPVATEAYGNVVVTVTNNQAGTEAGTVTTEVE

SEQ ID NO: 197250 - protein, 38 aa, Artificial Sequence
  Description of Artificial Sequence: Synthetic polypeptide
DEAEIRTTNPCATEQYGQCVCSNWGEHNAEHFGSDTQS

SEQ ID NO: 197251 - protein, 40 aa, Artificial Sequence
  Description of Artificial Sequence: Synthetic polypeptide
DEEEIRTTNPVATEAYGNVTTTSIGTTEQGSTNDEQGQED

SEQ ID NO: 197252 - protein, 35 aa, Artificial Sequence
  Description of Artificial Sequence: Synthetic polypeptide
DETEIRTTNPIATECWGATTWANAEDWAEPKGNYI

SEQ ID NO: 197253 - protein, 35 aa, Artificial Sequence
  Description of Artificial Sequence: Synthetic polypeptide
DETEIRTTNPIATEEWGCQTCGNAEDPAENSGENI

SEQ ID NO: 197254 - protein, 36 aa, Artificial Sequence
  Description of Artificial Sequence: Synthetic polypeptide
YEPEIATTNPAATDQYGVVSTGDEGEQGGQGEGETA

SEQ ID NO: 197255 - protein, 38 aa, Artificial Sequence
  Description of Artificial Sequence: Synthetic polypeptide
DEAEIATTNPVATCQYGCVCSTWGADDNQENFNSDTQS

SEQ ID NO: 197256 - protein, 37 aa, Artificial Sequence
  Description of Artificial Sequence: Synthetic polypeptide
SQEEIRTTNPVATEQWGCVCSNWGEHNAEHFNSDNQA

SEQ ID NO: 197257 - protein, 35 aa, Artificial Sequence
  Description of Artificial Sequence: Synthetic polypeptide
DETEIRTTNPIATEGWGATTWANAEDQAEPFGPYI

SEQ ID NO: 197258 - protein, 39 aa, Artificial Sequence
  Description of Artificial Sequence: Synthetic polypeptide
DEEEIRTTNPVATEGYGQCVCSNWGEDHNAENFNSDNQA

SEQ ID NO: 197259 - protein, 36 aa, Artificial Sequence
  Description of Artificial Sequence: Synthetic polypeptide
CEDEIACTNPVAYEQYGSCSAGPALGQNHQMGMEME

SEQ ID NO: 197260 - protein, 34 aa, Artificial Sequence
  Description of Artificial Sequence: Synthetic polypeptide
DDSEVASTNPVSTEGYGCVCQNWEDQERFGSQQM

SEQ ID NO: 197261 - protein, 35 aa, Artificial Sequence
  Description of Artificial Sequence: Synthetic polypeptide
DETEIRTTNPIATECWGATTWANAEDWAEPKGPRI

SEQ ID NO: 197262 - protein, 38 aa, Artificial Sequence
  Description of Artificial Sequence: Synthetic polypeptide
DEAEIRTTNPVAYEQYGQCVCSNWMEDDNQENFNSQQA

SEQ ID NO: 197263 - protein, 37 aa, Artificial Sequence
  Description of Artificial Sequence: Synthetic polypeptide
DEAVIGTTNPVATEQWGCVCSNTGEDDNQYFGSDTQS

SEQ ID NO: 197264 - protein, 39 aa, Artificial Sequence
  Description of Artificial Sequence: Synthetic polypeptide
CEEEISTTNPVATEQYGQCVCSNWGEDHNAENFGSDNQN

SEQ ID NO: 197265 - protein, 35 aa, Artificial Sequence
  Description of Artificial Sequence: Synthetic polypeptide
DETEIRTTNPIATECWGATTWANAEDWAEPKGPNI

SEQ ID NO: 197266 - protein, 35 aa, Artificial Sequence
  Description of Artificial Sequence: Synthetic polypeptide
DETEIRTTNPIATECWGATTWANAEDWAEPKGPNC

SEQ ID NO: 197267 - protein, 36 aa, Artificial Sequence
  Description of Artificial Sequence: Synthetic polypeptide
MDMEIGCTNPVATEQYGSVANKVLDNSEEGGNENIK

SEQ ID NO: 197268 - protein, 37 aa, Artificial Sequence
  Description of Artificial Sequence: Synthetic polypeptide
SQEEIRTTNPVATEQWGCVCSWGEDHNQEYFNSDNQA

SEQ ID NO: 197269 - protein, 34 aa, Artificial Sequence
  Description of Artificial Sequence: Synthetic polypeptide
EENEIATTNPVATEQWGCVAGEGVEMNAAEDTAW

SEQ ID NO: 197270 - protein, 37 aa, Artificial Sequence
  Description of Artificial Sequence: Synthetic polypeptide
CEEEISTTNPVATEQYGCVCSWGEDHNEENFISDTQE

SEQ ID NO: 197271 - protein, 36 aa, Artificial Sequence
  Description of Artificial Sequence: Synthetic polypeptide
DETEIRTTNPIATECYGATVCANADDWVAEFKGPYD

SEQ ID NO: 197272 - protein, 37 aa, Artificial Sequence
  Description of Artificial Sequence: Synthetic polypeptide
DEDEIATTNPVAYEQWGSNCSANPALPGAHGIDLTAM

SEQ ID NO: 197273 - protein, 33 aa, Artificial Sequence
  Description of Artificial Sequence: Synthetic polypeptide
DETEIRTTNPIATECYGATWAAEDWAEHKEPYI

SEQ ID NO: 197274 - protein, 38 aa, Artificial Sequence
  Description of Artificial Sequence: Synthetic polypeptide
DENEICTTNPVATEQYGSAFTMWTYWPESTQFQDNQIM

SEQ ID NO: 197275 - protein, 37 aa, Artificial Sequence
  Description of Artificial Sequence: Synthetic polypeptide
CEEEIACTNPVATEQYGSACSPAGDIGQNHADENGHE

SEQ ID NO: 197276 - protein, 36 aa, Artificial Sequence
  Description of Artificial Sequence: Synthetic polypeptide
CEDEIACTNPVAYEQYGSCSAGPALGQNHQMGMQGN

SEQ ID NO: 197277 - protein, 37 aa, Artificial Sequence
  Description of Artificial Sequence: Synthetic polypeptide
DEDEIATTNPVAYEQWGSVCATATPLPNDSGDGEGHN

SEQ ID NO: 197278 - protein, 38 aa, Artificial Sequence
  Description of Artificial Sequence: Synthetic polypeptide
DEEEIGTTNPVATEQYGCVCSNWGEDHNIENFSSDTQA

SEQ ID NO: 197279 - protein, 33 aa, Artificial Sequence
  Description of Artificial Sequence: Synthetic polypeptide
DETEIRTTNPIATEGWGATWAAEDWAEHKGPYI

SEQ ID NO: 197280 - protein, 37 aa, Artificial Sequence
  Description of Artificial Sequence: Synthetic polypeptide
SQECIRTTNPVATEQWGCVCSNWGEHNQENFGSDNQA

SEQ ID NO: 197281 - protein, 35 aa, Artificial Sequence
  Description of Artificial Sequence: Synthetic polypeptide
DETEIRTTNPIATEPWGATTWANAEDIAEQKGPYI

SEQ ID NO: 197282 - protein, 35 aa, Artificial Sequence
  Description of Artificial Sequence: Synthetic polypeptide
DETEIRTTNPIATEPWGATTWANAEDRAEPKGPYI

SEQ ID NO: 197283 - protein, 35 aa, Artificial Sequence
  Description of Artificial Sequence: Synthetic polypeptide
DETEIRTTNPIATEPWGATTWANAEDWAEPKGNYI

SEQ ID NO: 197284 - protein, 37 aa, Artificial Sequence
  Description of Artificial Sequence: Synthetic polypeptide
DEDEIATTNPVAYEQWGSVCSANPALPEEHMIDLTAM

SEQ ID NO: 197285 - protein, 35 aa, Artificial Sequence
  Description of Artificial Sequence: Synthetic polypeptide
DETEIRTTNPIATEPWGTTIANAEDWQAQPKGPYI

SEQ ID NO: 197286 - protein, 35 aa, Artificial Sequence
  Description of Artificial Sequence: Synthetic polypeptide
DETEIRTTNPIATEPWGTTIANMEDWQAQPKGPYI

SEQ ID NO: 197287 - protein, 37 aa, Artificial Sequence
  Description of Artificial Sequence: Synthetic polypeptide
CEEEIATTNPVAYEQWGCVAGNNGDLGQANAGDISDM

SEQ ID NO: 197288 - protein, 35 aa, Artificial Sequence
  Description of Artificial Sequence: Synthetic polypeptide
DETEIRTTNPIATEPWGVTTWANAEDWAEPKGPYI

SEQ ID NO: 197289 - protein, 38 aa, Artificial Sequence
  Description of Artificial Sequence: Synthetic polypeptide
DCEEIRTTNPVATEQWGYAVTQAVALEEVAIVGGTERG

SEQ ID NO: 197290 - protein, 38 aa, Artificial Sequence
  Description of Artificial Sequence: Synthetic polypeptide
DCEEIRTTNPVATEQWGYAVTQAVALELVAISGDTERG

SEQ ID NO: 197291 - protein, 35 aa, Artificial Sequence
  Description of Artificial Sequence: Synthetic polypeptide
DEGEIATTNPVATEQWGTNCAATDGHPVETEINED

SEQ ID NO: 197292 - protein, 38 aa, Artificial Sequence
  Description of Artificial Sequence: Synthetic polypeptide
DCEEIRTTNPVATEQWGYAVTQAVALEQVAIVGSTECG

SEQ ID NO: 197293 - protein, 38 aa, Artificial Sequence
  Description of Artificial Sequence: Synthetic polypeptide
DEEEIRATNPVATEQYGMVQFPTMGGDEQPEPASVAEI

SEQ ID NO: 197294 - protein, 34 aa, Artificial Sequence
  Description of Artificial Sequence: Synthetic polypeptide
DETEIRTTNPIATEQWGATAWPAEVWAEHKGPYK

SEQ ID NO: 197295 - protein, 38 aa, Artificial Sequence
  Description of Artificial Sequence: Synthetic polypeptide
DCEEIRTTNPVATEQYGAQPCAWTNGPIGEIMYDDEDF

SEQ ID NO: 197296 - protein, 32 aa, Artificial Sequence
  Description of Artificial Sequence: Synthetic polypeptide
DEEEIATTNPIATECWGETAAEDCAEHKEEYI

SEQ ID NO: 197297 - protein, 35 aa, Artificial Sequence
  Description of Artificial Sequence: Synthetic polypeptide
DETEIRTTNPIATEQWGATTCAATDGPVAEFKGPI

SEQ ID NO: 197298 - protein, 34 aa, Artificial Sequence
  Description of Artificial Sequence: Synthetic polypeptide
DETEIRTTNPIATEPWGATTWAMEDWAEPKGNYI

SEQ ID NO: 197299 - protein, 35 aa, Artificial Sequence
  Description of Artificial Sequence: Synthetic polypeptide
DETEIRTTNPIATECWGATTWANAEDWAEPAGPNI

SEQ ID NO: 197300 - protein, 34 aa, Artificial Sequence
  Description of Artificial Sequence: Synthetic polypeptide
DDTEIATTNPIATECWGATTWANADWAERKGPYR

SEQ ID NO: 197301 - protein, 38 aa, Artificial Sequence
  Description of Artificial Sequence: Synthetic polypeptide
DEAEIRTTNPVAYEQYGQCVCSNWMEDHNQNFNSQTQA

SEQ ID NO: 197302 - protein, 38 aa, Artificial Sequence
  Description of Artificial Sequence: Synthetic polypeptide
DEDEIATTNPVAYEQWGSVCSAANPPAPEAHGMDNEAH

SEQ ID NO: 197303 - protein, 35 aa, Artificial Sequence
  Description of Artificial Sequence: Synthetic polypeptide
DETEIRTTNPIATECWGATTWANAEDWAEPKGCNI

SEQ ID NO: 197304 - protein, 35 aa, Artificial Sequence
  Description of Artificial Sequence: Synthetic polypeptide
TEEEIATTNPVAYEQYGEAPCEVECSQHAEGEQKG

SEQ ID NO: 197305 - protein, 35 aa, Artificial Sequence
  Description of Artificial Sequence: Synthetic polypeptide
DETEIRTTNPIATEHWGATSWANAEDWAEPKGPYI

SEQ ID NO: 197306 - protein, 36 aa, Artificial Sequence
  Description of Artificial Sequence: Synthetic polypeptide
TEEEIATTNPVAYEQYGEHAPWCEHENSQHAEGEWQ

SEQ ID NO: 197307 - protein, 35 aa, Artificial Sequence
  Description of Artificial Sequence: Synthetic polypeptide
TEEEIATTNPVAYEQYGEHAWCEHEFSQHAEGEWT

SEQ ID NO: 197308 - protein, 35 aa, Artificial Sequence
  Description of Artificial Sequence: Synthetic polypeptide
DETEIRTTNPIATEIWGATTWANAEDWAEPKGPYR

SEQ ID NO: 197309 - protein, 33 aa, Artificial Sequence
  Description of Artificial Sequence: Synthetic polypeptide
EEVEIATTNPVAYECWGCVYYNEHQIKQHEEAE

SEQ ID NO: 197310 - protein, 36 aa, Artificial Sequence
  Description of Artificial Sequence: Synthetic polypeptide
DETEIRTTNPIATECWGWATTWANAEDWAEPKGPNI

SEQ ID NO: 197311 - protein, 36 aa, Artificial Sequence
  Description of Artificial Sequence: Synthetic polypeptide
LNDEIRTTNPVATEQYGSVFIWPAEDEVEGQMEDPQ

SEQ ID NO: 197312 - protein, 34 aa, Artificial Sequence
  Description of Artificial Sequence: Synthetic polypeptide
DETEIRTTNPIATECWGATTWANAEDWAEPGPYK

SEQ ID NO: 197313 - protein, 34 aa, Artificial Sequence
  Description of Artificial Sequence: Synthetic polypeptide
DETEIRTTNPIATECWGATTWANAEDWAEPGPYI

SEQ ID NO: 197314 - protein, 36 aa, Artificial Sequence
  Description of Artificial Sequence: Synthetic polypeptide
SQAEIRTTNPVATEQWGCVCSNWGEHNQENFGSDQA

SEQ ID NO: 197315 - protein, 35 aa, Artificial Sequence
  Description of Artificial Sequence: Synthetic polypeptide
DETEIRTTNPIATECWGATTWANAEDWAEPEGNYI

SEQ ID NO: 197316 - protein, 35 aa, Artificial Sequence
  Description of Artificial Sequence: Synthetic polypeptide
DETEIRTTNPIATENWGSTTWANAEDWAEPKGPYI

SEQ ID NO: 197317 - protein, 36 aa, Artificial Sequence
  Description of Artificial Sequence: Synthetic polypeptide
LNDEIRTTNPVATEQYGSVFIVVAEDGVEGQMEDPQ

SEQ ID NO: 197318 - protein, 35 aa, Artificial Sequence
  Description of Artificial Sequence: Synthetic polypeptide
DETEIRTTNPIATEPWGATIWANAEDWAEQKGPYI

SEQ ID NO: 197319 - protein, 37 aa, Artificial Sequence
  Description of Artificial Sequence: Synthetic polypeptide
LNDEIRTTNPVATEQYGSVFIVSVQEDEWEGQMEDPQ

SEQ ID NO: 197320 - protein, 34 aa, Artificial Sequence
  Description of Artificial Sequence: Synthetic polypeptide
DETEIRTTNPIATECWGATTWANAEDWAEPGPYL

SEQ ID NO: 197321 - protein, 34 aa, Artificial Sequence
  Description of Artificial Sequence: Synthetic polypeptide
DETEIRTTNPIATECWGVTWANAEDWAEPKGPYI

SEQ ID NO: 197322 - protein, 34 aa, Artificial Sequence
  Description of Artificial Sequence: Synthetic polypeptide
DETEIRTTNPIATECWGVTWANAEDWAEHKGDYI

SEQ ID NO: 197323 - protein, 35 aa, Artificial Sequence
  Description of Artificial Sequence: Synthetic polypeptide
DETEIRTTNPIATECWGVTTWSNAEDWAEPKGPYI

SEQ ID NO: 197324 - protein, 35 aa, Artificial Sequence
  Description of Artificial Sequence: Synthetic polypeptide
CEEVIACTNPVATESYGSVANMNNSNAAGGPGEDA

SEQ ID NO: 197325 - protein, 37 aa, Artificial Sequence
  Description of Artificial Sequence: Synthetic polypeptide
SEEAIRTTNPVATEAYGSIIPPWTYAVTISGSNESQD

SEQ ID NO: 197326 - protein, 36 aa, Artificial Sequence
  Description of Artificial Sequence: Synthetic polypeptide
DETEIRTTNPIATECWGRATTWANAEDWAQPKGPYI

SEQ ID NO: 197327 - protein, 35 aa, Artificial Sequence
  Description of Artificial Sequence: Synthetic polypeptide
DEAAIRTTNPVAWACWGSVSRCINNEPDVTSDENL

SEQ ID NO: 197328 - protein, 38 aa, Artificial Sequence
  Description of Artificial Sequence: Synthetic polypeptide
QAEEIATTNPVATEQYGSVCSPANPALGIDHADDTVAH

SEQ ID NO: 197329 - protein, 34 aa, Artificial Sequence
  Description of Artificial Sequence: Synthetic polypeptide
DETEIRTTNPIATECWGRTTWANAEDWAPKGPYI

SEQ ID NO: 197330 - protein, 37 aa, Artificial Sequence
  Description of Artificial Sequence: Synthetic polypeptide
QAEEIATTNPVAYEQYGSACAANNGLEADMPGNNVNH

SEQ ID NO: 197331 - protein, 36 aa, Artificial Sequence
  Description of Artificial Sequence: Synthetic polypeptide
EEVEIAATNPVAYEQWGSVCYNINGGDDKQNMDRGK

SEQ ID NO: 197332 - protein, 36 aa, Artificial Sequence
  Description of Artificial Sequence: Synthetic polypeptide
DETEIRTTNPIATECWGSATTWANAEDTAEPKGPYI

SEQ ID NO: 197333 - protein, 36 aa, Artificial Sequence
  Description of Artificial Sequence: Synthetic polypeptide
DETEIRTTNPIATECWGSATTWANAEDWAEPKGPYI

SEQ ID NO: 197334 - protein, 36 aa, Artificial Sequence
  Description of Artificial Sequence: Synthetic polypeptide
DETEIRTTNPIATECWGSATTWANAEDWAEPKGPYL

SEQ ID NO: 197335 - protein, 39 aa, Artificial Sequence
  Description of Artificial Sequence: Synthetic polypeptide
DEEEIATTNPVATEQYGQCVCSNWGEDHEQENFGSETQN

SEQ ID NO: 197336 - protein, 37 aa, Artificial Sequence
  Description of Artificial Sequence: Synthetic polypeptide
CEEVIACTNPVATEQYGSACATNPQEEAGAHMDGMAP

SEQ ID NO: 197337 - protein, 39 aa, Artificial Sequence
  Description of Artificial Sequence: Synthetic polypeptide
DEEEIRTTNPVATEGYGQCVCSNWGEDHNQENFNSDNQS

SEQ ID NO: 197338 - protein, 39 aa, Artificial Sequence
  Description of Artificial Sequence: Synthetic polypeptide
DEEEIRTTNPVATEGYGQCVCSNWGEDHNQENFNSDFQS

SEQ ID NO: 197339 - protein, 39 aa, Artificial Sequence
  Description of Artificial Sequence: Synthetic polypeptide
DEEEIRTTNPVATEGYGQCVCSNWGEDHNAENFSSDNQS

SEQ ID NO: 197340 - protein, 35 aa, Artificial Sequence
  Description of Artificial Sequence: Synthetic polypeptide
DETEIRTTNPIATECWGSTTWANAEDWAEPKGPYI

SEQ ID NO: 197341 - protein, 36 aa, Artificial Sequence
  Description of Artificial Sequence: Synthetic polypeptide
YEDEIRGTNPVATEFWGIVSVAANGEGQDGQGEDGD

SEQ ID NO: 197342 - protein, 34 aa, Artificial Sequence
  Description of Artificial Sequence: Synthetic polypeptide
DDSEVASTNPVSTEGYGCVCQTWGEIQERFGQQS

SEQ ID NO: 197343 - protein, 38 aa, Artificial Sequence
  Description of Artificial Sequence: Synthetic polypeptide
DEAEIRTTNPVAYEQYGQCVCSNWGEHNTENFNSDFQA

SEQ ID NO: 197344 - protein, 40 aa, Artificial Sequence
  Description of Artificial Sequence: Synthetic polypeptide
DEEEIRTTNPVATEQYGVVVVTVVTTGTQAGTTEQGVTVE

SEQ ID NO: 197345 - protein, 35 aa, Artificial Sequence
  Description of Artificial Sequence: Synthetic polypeptide
DETEIRTTNPIATECWGATTWANAEDWAERNGPYI

SEQ ID NO: 197346 - protein, 38 aa, Artificial Sequence
  Description of Artificial Sequence: Synthetic polypeptide
CEEEISTTNPVATEQYGQCVCSNWGEDDNQENFGSDQS

SEQ ID NO: 197347 - protein, 39 aa, Artificial Sequence
  Description of Artificial Sequence: Synthetic polypeptide
DEEEIRTTNPVATEQYGSGCGPPTIKAGMEFEQQPEAET

SEQ ID NO: 197348 - protein, 35 aa, Artificial Sequence
  Description of Artificial Sequence: Synthetic polypeptide
DETEIRTTNPIATECWGATTWANAEDWAERKGTYI

SEQ ID NO: 197349 - protein, 35 aa, Artificial Sequence
  Description of Artificial Sequence: Synthetic polypeptide
DETEIRTTNPIATECWGATTWANAEDWAERKGPYI

SEQ ID NO: 197350 - protein, 38 aa, Artificial Sequence
  Description of Artificial Sequence: Synthetic polypeptide
QAEEIATTNPVATEQYGSVCSPVGDNNHNIDAMGEGAQ

SEQ ID NO: 197351 - protein, 36 aa, Artificial Sequence
  Description of Artificial Sequence: Synthetic polypeptide
DETEIRTTNPIATECWGMATTWANAEDWAEPRGPYI

SEQ ID NO: 197352 - protein, 34 aa, Artificial Sequence
  Description of Artificial Sequence: Synthetic polypeptide
DDSEVASTNPVSTEGYGCVCQTWTDQERFGSQQA

SEQ ID NO: 197353 - protein, 35 aa, Artificial Sequence
  Description of Artificial Sequence: Synthetic polypeptide
DETEIRTTNPIATECWGSTTWANAEDWAEPKGTYI

SEQ ID NO: 197354 - protein, 38 aa, Artificial Sequence
  Description of Artificial Sequence: Synthetic polypeptide
MEEEIRTTNPVATEQYGMVSVEGMGDGGQGQEQDEQLV

SEQ ID NO: 197355 - protein, 35 aa, Artificial Sequence
  Description of Artificial Sequence: Synthetic polypeptide
DETEIRTTNPIATECWGATTWANAEDWAEQKGPYI

SEQ ID NO: 197356 - protein, 38 aa, Artificial Sequence
  Description of Artificial Sequence: Synthetic polypeptide
DEAEIRTTNPVAYEQYGQCVCSNWGEHNEEGFNSENQA

SEQ ID NO: 197357 - protein, 37 aa, Artificial Sequence
  Description of Artificial Sequence: Synthetic polypeptide
SQSEIGTTNPVATEQYGASAVVATVNFIETGTESQEE

SEQ ID NO: 197358 - protein, 37 aa, Artificial Sequence
  Description of Artificial Sequence: Synthetic polypeptide
AEECISTTNPVATEQYGQCVCSNWMEHNQEHFGSDQS

SEQ ID NO: 197359 - protein, 35 aa, Artificial Sequence
  Description of Artificial Sequence: Synthetic polypeptide
DETEIRTTNPIATECWGATTWANAEDWAEPRGPYI

SEQ ID NO: 197360 - protein, 36 aa, Artificial Sequence
  Description of Artificial Sequence: Synthetic polypeptide
SQGEIRTTNPVATEQYGSVAMPTPDDIIDYESSQIE

SEQ ID NO: 197361 - protein, 36 aa, Artificial Sequence
  Description of Artificial Sequence: Synthetic polypeptide
DETEIRTTNPIATECWGQATTWANAEDWARPKGPYI

SEQ ID NO: 197362 - protein, 36 aa, Artificial Sequence
  Description of Artificial Sequence: Synthetic polypeptide
DETEIRTTNPIATECWGQATTWANAEDWLEPKGPYI

SEQ ID NO: 197363 - protein, 37 aa, Artificial Sequence
  Description of Artificial Sequence: Synthetic polypeptide
CEEVIACTNPVATEQYGSVNANMNNSENAAGGPGESW

SEQ ID NO: 197364 - protein, 35 aa, Artificial Sequence
  Description of Artificial Sequence: Synthetic polypeptide
CEEEIATTNPVAYEQWGCVAGNGEDTATGGSDSHD

SEQ ID NO: 197365 - protein, 35 aa, Artificial Sequence
  Description of Artificial Sequence: Synthetic polypeptide
DETEIRTTNPIATECWGSTTWANAENWAEPKGPYI

SEQ ID NO: 197366 - protein, 36 aa, Artificial Sequence
  Description of Artificial Sequence: Synthetic polypeptide
DEECLRTTNPCAYEQYGCVCSNWGEHNQENFGSQQA

SEQ ID NO: 197367 - protein, 36 aa, Artificial Sequence
  Description of Artificial Sequence: Synthetic polypeptide
DAAEIATTNPVAYEQWGTTVAGMGPAGNPQGNEQRH

SEQ ID NO: 197368 - protein, 36 aa, Artificial Sequence
  Description of Artificial Sequence: Synthetic polypeptide
MDNEIRTTNPVATEIYGSVDVWDPNDMDSFFGPVGN

SEQ ID NO: 197369 - protein, 35 aa, Artificial Sequence
  Description of Artificial Sequence: Synthetic polypeptide
CEEVIACTNPVAYEQYGSCAAGPALGQNHMGMQMN

SEQ ID NO: 197370 - protein, 36 aa, Artificial Sequence
  Description of Artificial Sequence: Synthetic polypeptide
DEDEIATTNPVAYEQWGSICSANPALTEHMIDLTAM

SEQ ID NO: 197371 - protein, 40 aa, Artificial Sequence
  Description of Artificial Sequence: Synthetic polypeptide
DEEEIRTTNPVATEAYGTVATNYGNSNVIGTTSISTTGNT

SEQ ID NO: 197372 - protein, 37 aa, Artificial Sequence
  Description of Artificial Sequence: Synthetic polypeptide
SQEEIRTTNPVATEQWGQCVCSSGEDNQENFGSDTQA

SEQ ID NO: 197373 - protein, 39 aa, Artificial Sequence
  Description of Artificial Sequence: Synthetic polypeptide
DEEEIRTTNPVATEAYGTVATQIGTTEAGSVNDEEDEED

SEQ ID NO: 197374 - protein, 39 aa, Artificial Sequence
  Description of Artificial Sequence: Synthetic polypeptide
DEEEIRTTNPVATEAYGTVATQIGTTEQGSTTDEQGDED

SEQ ID NO: 197375 - protein, 36 aa, Artificial Sequence
  Description of Artificial Sequence: Synthetic polypeptide
DEDCISTTNPIATEQWGSVATTPPMESIYNSGNNSN

SEQ ID NO: 197376 - protein, 37 aa, Artificial Sequence
  Description of Artificial Sequence: Synthetic polypeptide
SQEEIRTTNPVATEQWGQCVCSNWEHNQEHFGSDTQA

SEQ ID NO: 197377 - protein, 35 aa, Artificial Sequence
  Description of Artificial Sequence: Synthetic polypeptide
CEDEIATTNPVATASWGCVAAANTEDTDRGGENGN

SEQ ID NO: 197378 - protein, 40 aa, Artificial Sequence
  Description of Artificial Sequence: Synthetic polypeptide
DEEEIRTTNPVATEAYGTVATTLGNSDEIGTTSISTTGNT

SEQ ID NO: 197379 - protein, 35 aa, Artificial Sequence
  Description of Artificial Sequence: Synthetic polypeptide
DETEIRTTNPIATECWGVTTWANAADWANPKGPYI

SEQ ID NO: 197380 - protein, 35 aa, Artificial Sequence
  Description of Artificial Sequence: Synthetic polypeptide
DETEIRTTNPIATECWGVTTWANAEDWAEPKGPYI

SEQ ID NO: 197381 - protein, 35 aa, Artificial Sequence
  Description of Artificial Sequence: Synthetic polypeptide
DETEIRTTNPIATECWGVTTWANAEDWAEPKGPYK

SEQ ID NO: 197382 - protein, 35 aa, Artificial Sequence
  Description of Artificial Sequence: Synthetic polypeptide
DETEIRTTNPIATECWGVTTWANAVDWAEPKGPYH

SEQ ID NO: 197383 - protein, 35 aa, Artificial Sequence
  Description of Artificial Sequence: Synthetic polypeptide
DETEIRTTNPIATECWGVTTWCNAEDWAEPKGPYI

SEQ ID NO: 197384 - protein, 34 aa, Artificial Sequence
  Description of Artificial Sequence: Synthetic polypeptide
DDSEVASTNPVSTEGYGCVCQTSGTIQERFGSQQ

SEQ ID NO: 197385 - protein, 35 aa, Artificial Sequence
  Description of Artificial Sequence: Synthetic polypeptide
DEDEIATTNPVAYEQWGSFTAATAHGAAAPPGSQN

SEQ ID NO: 197386 - protein, 39 aa, Artificial Sequence
  Description of Artificial Sequence: Synthetic polypeptide
MEEEIRTTNPVATEQYGSTIISLEHLNEQEHAIALEIQN

SEQ ID NO: 197387 - protein, 36 aa, Artificial Sequence
  Description of Artificial Sequence: Synthetic polypeptide
DEMEIRTTNPIATEQWGTTTWANAEGWVAEPEGNYI

SEQ ID NO: 197388 - protein, 37 aa, Artificial Sequence
  Description of Artificial Sequence: Synthetic polypeptide
SEEAIRTTNPVATEAYGWSIPPWTYVVTISGSNESQD

SEQ ID NO: 197389 - protein, 37 aa, Artificial Sequence
  Description of Artificial Sequence: Synthetic polypeptide
SEEAIRTTNPVATEGYGCVCSNWEEHNAENFNSDTQA

SEQ ID NO: 197390 - protein, 36 aa, Artificial Sequence
  Description of Artificial Sequence: Synthetic polypeptide
DETEIRTTNPIATECWGSTTWSTAEDWPAEPKGPYI

SEQ ID NO: 197391 - protein, 38 aa, Artificial Sequence
  Description of Artificial Sequence: Synthetic polypeptide
TEEEIATTNPVATEAYGKTVPHPTPASSQQPNTDDYRY

SEQ ID NO: 197392 - protein, 35 aa, Artificial Sequence
  Description of Artificial Sequence: Synthetic polypeptide
DETEIRTTNPIATECWGSTTYANAEDWAEPKGPYI

SEQ ID NO: 197393 - protein, 39 aa, Artificial Sequence
  Description of Artificial Sequence: Synthetic polypeptide
DEEEIATTNPVATEQYGQCVCGNWGEDHNQENFNSDNQS

SEQ ID NO: 197394 - protein, 34 aa, Artificial Sequence
  Description of Artificial Sequence: Synthetic polypeptide
DETEIRTTNPIATECWGSTWAAAEDWAEHEGEYI

SEQ ID NO: 197395 - protein, 34 aa, Artificial Sequence
  Description of Artificial Sequence: Synthetic polypeptide
DETEIRTTNPIATECWGATTWANAEDWAEPKGQI

SEQ ID NO: 197396 - protein, 35 aa, Artificial Sequence
  Description of Artificial Sequence: Synthetic polypeptide
DETEIRTTNPIATECWGSTTWANTEDWAEPKGPYI

SEQ ID NO: 197397 - protein, 36 aa, Artificial Sequence
  Description of Artificial Sequence: Synthetic polypeptide
CEDEIATTNPVATEMWGGCVAGNGELADNNSGNPHE

SEQ ID NO: 197398 - protein, 34 aa, Artificial Sequence
  Description of Artificial Sequence: Synthetic polypeptide
DETEIRTTNPIATECWGTTIANAEDWAEPKGPYI

SEQ ID NO: 197399 - protein, 35 aa, Artificial Sequence
  Description of Artificial Sequence: Synthetic polypeptide
DETEIRTTNPIATECWGTTIANAEDWQAEPKGPYI

SEQ ID NO: 197400 - protein, 35 aa, Artificial Sequence
  Description of Artificial Sequence: Synthetic polypeptide
DETEIRTTNPIATECWGTTIANAEDWQAQPKGPYI

SEQ ID NO: 197401 - protein, 35 aa, Artificial Sequence
  Description of Artificial Sequence: Synthetic polypeptide
DETEIRTTNPIATECWGATTWANAEDWAEPKGPYR

SEQ ID NO: 197402 - protein, 35 aa, Artificial Sequence
  Description of Artificial Sequence: Synthetic polypeptide
DEMEIRTTNPIATEGWGCQTTGNAEDHAEHSGQTI

SEQ ID NO: 197403 - protein, 33 aa, Artificial Sequence
  Description of Artificial Sequence: Synthetic polypeptide
DDSEVASTNPVSTEGYGCVCQTWEIQENFGQQA

SEQ ID NO: 197404 - protein, 36 aa, Artificial Sequence
  Description of Artificial Sequence: Synthetic polypeptide
DETEIRTTNPIATECWGTTTWANAEDWQAQPKGNYI

SEQ ID NO: 197405 - protein, 36 aa, Artificial Sequence
  Description of Artificial Sequence: Synthetic polypeptide
DETEIRTTNPIATECWGTTTWANAEDWQQQPKGNYI

SEQ ID NO: 197406 - protein, 37 aa, Artificial Sequence
  Description of Artificial Sequence: Synthetic polypeptide
DAAEIATTNPVAYEQYGSVCSMANPAGIATGGDLAAM

SEQ ID NO: 197407 - protein, 34 aa, Artificial Sequence
  Description of Artificial Sequence: Synthetic polypeptide
DETEIRTTNPIATECWGATTWANAEDWAESKGPI

SEQ ID NO: 197408 - protein, 37 aa, Artificial Sequence
  Description of Artificial Sequence: Synthetic polypeptide
QEDEIRTTNPVATEFYGVVVYTDQGQDQNEEGGQGGI

SEQ ID NO: 197409 - protein, 39 aa, Artificial Sequence
  Description of Artificial Sequence: Synthetic polypeptide
DEEEIRCTNPVATEQYGQCVCSMWGEDHNAENFNSDNQA

SEQ ID NO: 197410 - protein, 37 aa, Artificial Sequence
  Description of Artificial Sequence: Synthetic polypeptide
DDEEIRCTNPVATEGYGCVCSNWGEHNAENSISQNQS

SEQ ID NO: 197411 - protein, 37 aa, Artificial Sequence
  Description of Artificial Sequence: Synthetic polypeptide
DEAEIRTTNPVAYEQYISLPNPNVDFMNFSSGQDHEW

SEQ ID NO: 197412 - protein, 37 aa, Artificial Sequence
  Description of Artificial Sequence: Synthetic polypeptide
TEEEIRATNPVATEGYGSVVNNDGGEITPGEEQGDGG

SEQ ID NO: 197413 - protein, 34 aa, Artificial Sequence
  Description of Artificial Sequence: Synthetic polypeptide
DETEIRTTNPIGTECWGATTWANAEDLAEPKGDI

SEQ ID NO: 197414 - protein, 36 aa, Artificial Sequence
  Description of Artificial Sequence: Synthetic polypeptide
QAEEIATTNPVAYEQYGSVCAAGPLGFATMGDEEAP

SEQ ID NO: 197415 - protein, 34 aa, Artificial Sequence
  Description of Artificial Sequence: Synthetic polypeptide
DETEIRTTNPISTECWGATTANMEDWQQEPNGPH

SEQ ID NO: 197416 - protein, 36 aa, Artificial Sequence
  Description of Artificial Sequence: Synthetic polypeptide
DEECISTVNPVATEGYGCVCSWGEHNEENFNSDTQA

SEQ ID NO: 197417 - protein, 34 aa, Artificial Sequence
  Description of Artificial Sequence: Synthetic polypeptide
SETEIRTTNPIATECWGSTTWANADWMEPKGPYI

SEQ ID NO: 197418 - protein, 34 aa, Artificial Sequence
  Description of Artificial Sequence: Synthetic polypeptide
DETEIRTTNPISTECWGATTANMEDWQQQPNGPH

SEQ ID NO: 197419 - protein, 35 aa, Artificial Sequence
  Description of Artificial Sequence: Synthetic polypeptide
DEECISTVNPVATEGYGCVCSWGEHNANFNSDTQS

SEQ ID NO: 197420 - protein, 37 aa, Artificial Sequence
  Description of Artificial Sequence: Synthetic polypeptide
DENCISTTNPVATEQYGCVCSNWGEHNAENFNSDFQS

SEQ ID NO: 197421 - protein, 35 aa, Artificial Sequence
  Description of Artificial Sequence: Synthetic polypeptide
DETEIRTTNPIATECWGATTWANAEAWAERNGPYV

SEQ ID NO: 197422 - protein, 37 aa, Artificial Sequence
  Description of Artificial Sequence: Synthetic polypeptide
DESEIRTTNPVATEGWGCVCSNWGEDNAEYFNSDTQA

SEQ ID NO: 197423 - protein, 37 aa, Artificial Sequence
  Description of Artificial Sequence: Synthetic polypeptide
DESEIRTTNPVATEGWGCVCSNWGEENAEYFNSDNQG

SEQ ID NO: 197424 - protein, 38 aa, Artificial Sequence
  Description of Artificial Sequence: Synthetic polypeptide
SETEIRCTWNPVATMQFGTSCASETGNLTEQPNANHND

SEQ ID NO: 197425 - protein, 37 aa, Artificial Sequence
  Description of Artificial Sequence: Synthetic polypeptide
DESEIRTTNPVATEGWGCVCSNWGEENQEYFNSNTQA

SEQ ID NO: 197426 - protein, 38 aa, Artificial Sequence
  Description of Artificial Sequence: Synthetic polypeptide
DEEEIRTTNPVATEAFGQCVCSNWMYHNAENFGSETQS

SEQ ID NO: 197427 - protein, 36 aa, Artificial Sequence
  Description of Artificial Sequence: Synthetic polypeptide
SETNDEIATTNPVAYECWGSVATIDDRQNGTGQQER

SEQ ID NO: 197428 - protein, 34 aa, Artificial Sequence
  Description of Artificial Sequence: Synthetic polypeptide
DETEIRTTNPIATECWGATTWANADWAEPKGPYI

SEQ ID NO: 197429 - protein, 32 aa, Artificial Sequence
  Description of Artificial Sequence: Synthetic polypeptide
EEVEIATTNPVAYEKWGCVYYGEDQHQHELDA

SEQ ID NO: 197430 - protein, 35 aa, Artificial Sequence
  Description of Artificial Sequence: Synthetic polypeptide
DETEIRTTNPIATECWGATTWANAEDFARPKGPYI

SEQ ID NO: 197431 - protein, 35 aa, Artificial Sequence
  Description of Artificial Sequence: Synthetic polypeptide
DETEIRTTNPIATEYWGCTTCANAEDPAENSGENI

SEQ ID NO: 197432 - protein, 35 aa, Artificial Sequence
  Description of Artificial Sequence: Synthetic polypeptide
DEACIRTTNGVAYCQYGCVCSNWGEHNQNFGSDQA

SEQ ID NO: 197433 - protein, 38 aa, Artificial Sequence
  Description of Artificial Sequence: Synthetic polypeptide
DEMEIATTNPVATEYYGQCVCSNWGEHNEEHFGSENQS

SEQ ID NO: 197434 - protein, 34 aa, Artificial Sequence
  Description of Artificial Sequence: Synthetic polypeptide
DETEIRTTNPIATHCWGATTWANAEDWAHPGPNI

SEQ ID NO: 197435 - protein, 35 aa, Artificial Sequence
  Description of Artificial Sequence: Synthetic polypeptide
SEVEIATTNPVAYEAWGVVWPGPNNENDGQTNGSR

SEQ ID NO: 197436 - protein, 33 aa, Artificial Sequence
  Description of Artificial Sequence: Synthetic polypeptide
DEEEIATTNPIATECWGETTWANAVWAEHKEPI

SEQ ID NO: 197437 - protein, 37 aa, Artificial Sequence
  Description of Artificial Sequence: Synthetic polypeptide
EEHEIATTNPVAYEQWGEVCSTPNQGNHGELGGDGQN

SEQ ID NO: 197438 - protein, 37 aa, Artificial Sequence
  Description of Artificial Sequence: Synthetic polypeptide
SEVEIATTNPVATEQYGSVCAAIEHGEAPDNQMENSH

SEQ ID NO: 197439 - protein, 38 aa, Artificial Sequence
  Description of Artificial Sequence: Synthetic polypeptide
QAEEIATTNPVATEQYGSVCAMANHADDSKAPGGHNKN

SEQ ID NO: 197440 - protein, 36 aa, Artificial Sequence
  Description of Artificial Sequence: Synthetic polypeptide
DEACIRTTNPCATEQFGCVCSWGEHNAESFGSDTQA

SEQ ID NO: 197441 - protein, 36 aa, Artificial Sequence
  Description of Artificial Sequence: Synthetic polypeptide
DEACIRTTNPCATEQWGCVCSWGEDNQESFGSDTQS

SEQ ID NO: 197442 - protein, 37 aa, Artificial Sequence
  Description of Artificial Sequence: Synthetic polypeptide
TEEEIGCTNPVAYEEYGVCVVQACTNWSTLVETNQRS

SEQ ID NO: 197443 - protein, 34 aa, Artificial Sequence
  Description of Artificial Sequence: Synthetic polypeptide
DETEIRTTNPIATECWGATTWANAEDGAPKGPYI

SEQ ID NO: 197444 - protein, 37 aa, Artificial Sequence
  Description of Artificial Sequence: Synthetic polypeptide
LEEEIRTTNPMCYEPYGVVVSCDPNMHSQNGQGGGND

SEQ ID NO: 197445 - protein, 37 aa, Artificial Sequence
  Description of Artificial Sequence: Synthetic polypeptide
QAEEIATTNPVATEQYGSVCAGNGGGDEATAGEGVEK

SEQ ID NO: 197446 - protein, 37 aa, Artificial Sequence
  Description of Artificial Sequence: Synthetic polypeptide
QEDEIRTTNPVATEFYGTVVYTDQGQDQTDEGGQGGE

SEQ ID NO: 197447 - protein, 36 aa, Artificial Sequence
  Description of Artificial Sequence: Synthetic polypeptide
SEVEIATTNPVATECWGCVCTIDSNNMNGQQGGVDA

SEQ ID NO: 197448 - protein, 37 aa, Artificial Sequence
  Description of Artificial Sequence: Synthetic polypeptide
DENCISTTNPVATEQYGCVCSNWGEHDQESFNSDTQS

SEQ ID NO: 197449 - protein, 38 aa, Artificial Sequence
  Description of Artificial Sequence: Synthetic polypeptide
DEEEIRTTNPVATDQYGYVCVHPSPVNMSNAVDMFVEI

SEQ ID NO: 197450 - protein, 34 aa, Artificial Sequence
  Description of Artificial Sequence: Synthetic polypeptide
DETEIRTTNPIATECWGATTWANADWAEPKGGYI

SEQ ID NO: 197451 - protein, 34 aa, Artificial Sequence
  Description of Artificial Sequence: Synthetic polypeptide
DETEIRTTNPIATECWGATTWANADEANPKGPYI

SEQ ID NO: 197452 - protein, 35 aa, Artificial Sequence
  Description of Artificial Sequence: Synthetic polypeptide
DETEIRTTNPISTEPWGATTWSNMEDWQEPKGNYH

SEQ ID NO: 197453 - protein, 34 aa, Artificial Sequence
  Description of Artificial Sequence: Synthetic polypeptide
DETEIRTTNPISTEPWGATWANAEDIQAEQNGPI

SEQ ID NO: 197454 - protein, 36 aa, Artificial Sequence
  Description of Artificial Sequence: Synthetic polypeptide
SEECIRCTNPCATEQYGQCVCSWGEDNANFGSDTQS

SEQ ID NO: 197455 - protein, 34 aa, Artificial Sequence
  Description of Artificial Sequence: Synthetic polypeptide
DETEIRTTNPISTEPWGATWSNMEDWQAEPKGPI

SEQ ID NO: 197456 - protein, 38 aa, Artificial Sequence
  Description of Artificial Sequence: Synthetic polypeptide
EEGEIRTTNPVATEQYGCLSGPTALALNIPQHFDEDDL

SEQ ID NO: 197457 - protein, 39 aa, Artificial Sequence
  Description of Artificial Sequence: Synthetic polypeptide
DEEEIRTTNPVAYEQYGQCVCSNWMEDHNAENFNSQTQA

SEQ ID NO: 197458 - protein, 37 aa, Artificial Sequence
  Description of Artificial Sequence: Synthetic polypeptide
DESEIRTTNPVATEGWGCVCSNWMEENQENFNSDTQM

SEQ ID NO: 197459 - protein, 37 aa, Artificial Sequence
  Description of Artificial Sequence: Synthetic polypeptide
DEGEIATTNPVATEQWGCVAGEGGPGENTADGPNMEA

SEQ ID NO: 197460 - protein, 36 aa, Artificial Sequence
  Description of Artificial Sequence: Synthetic polypeptide
SETAEIACTNPVAYEQWGSVAITPLLAPRNQNPDQD

SEQ ID NO: 197461 - protein, 37 aa, Artificial Sequence
  Description of Artificial Sequence: Synthetic polypeptide
QEDEIRTTNPVATEFYGEVVVTDQGQDQTDEGGQGGI

SEQ ID NO: 197462 - protein, 33 aa, Artificial Sequence
  Description of Artificial Sequence: Synthetic polypeptide
DETEIRTTNPIATECWGATTWAEEDWAEPKGPI

SEQ ID NO: 197463 - protein, 37 aa, Artificial Sequence
  Description of Artificial Sequence: Synthetic polypeptide
SETAEIACTNPVAYEQWGSVAITNPLPEAPGNQNPKV

SEQ ID NO: 197464 - protein, 37 aa, Artificial Sequence
  Description of Artificial Sequence: Synthetic polypeptide
DEDEIACTNPVATEQYGSACAATNPEEAGDSLMGHSM

SEQ ID NO: 197465 - protein, 37 aa, Artificial Sequence
  Description of Artificial Sequence: Synthetic polypeptide
DDTSEIRTTNPVATEQYGANSVENDVEIHHGGQDVEI

SEQ ID NO: 197466 - protein, 36 aa, Artificial Sequence
  Description of Artificial Sequence: Synthetic polypeptide
DEDEIACTNPVATEQYGSACAPANNTHGEAGAEMGN

SEQ ID NO: 197467 - protein, 35 aa, Artificial Sequence
  Description of Artificial Sequence: Synthetic polypeptide
DEHEIATTNPVAYECWGTVYWINEQQDRQMHHVGS

SEQ ID NO: 197468 - protein, 36 aa, Artificial Sequence
  Description of Artificial Sequence: Synthetic polypeptide
SETAEIACTNPVATEQYGSCPAAGNHPDNEDPGNNN

SEQ ID NO: 197469 - protein, 37 aa, Artificial Sequence
  Description of Artificial Sequence: Synthetic polypeptide
DEAEIRTTNPVAYEQYTYSLPNPNVDMMNFQSTQDEW

SEQ ID NO: 197470 - protein, 35 aa, Artificial Sequence
  Description of Artificial Sequence: Synthetic polypeptide
SEECIRCTNPCATEQYGCVCSWGEHNAEYFISDQS

SEQ ID NO: 197471 - protein, 36 aa, Artificial Sequence
  Description of Artificial Sequence: Synthetic polypeptide
QAEEIATTNPVAYEQYGSVCAGNGGDEATAGSGAED

SEQ ID NO: 197472 - protein, 38 aa, Artificial Sequence
  Description of Artificial Sequence: Synthetic polypeptide
EEGEIRTTNPVATEQYGCLSYPTLLALNIPQHSDEDDL

SEQ ID NO: 197473 - protein, 34 aa, Artificial Sequence
  Description of Artificial Sequence: Synthetic polypeptide
DETEIRTTNPIATECWGATTWANADEANPKEPYI

SEQ ID NO: 197474 - protein, 34 aa, Artificial Sequence
  Description of Artificial Sequence: Synthetic polypeptide
DETEIRTTNPIATECWGATTWANADDWEEPKGPI

SEQ ID NO: 197475 - protein, 35 aa, Artificial Sequence
  Description of Artificial Sequence: Synthetic polypeptide
DETEIRTTNPISTECWGATTWSNMEDWQEPKGNYH

SEQ ID NO: 197476 - protein, 34 aa, Artificial Sequence
  Description of Artificial Sequence: Synthetic polypeptide
DETEIRTTNPIATECWGATTWANADDWAEPKGPI

SEQ ID NO: 197477 - protein, 34 aa, Artificial Sequence
  Description of Artificial Sequence: Synthetic polypeptide
DETEIRTTNPISTECWGATVWAAEDLAEPKGPYI

SEQ ID NO: 197478 - protein, 34 aa, Artificial Sequence
  Description of Artificial Sequence: Synthetic polypeptide
DETEIRTTNPISTECWGATVWAAEDLAEPKGTYI

SEQ ID NO: 197479 - protein, 37 aa, Artificial Sequence
  Description of Artificial Sequence: Synthetic polypeptide
QAEEIATTNPVAYEQYGSVCAANNGDEADAPGGEMNH

SEQ ID NO: 197480 - protein, 37 aa, Artificial Sequence
  Description of Artificial Sequence: Synthetic polypeptide
DDSEIRTTNPVATEQYGSVVPYQTDEEDITPSIEEVP

SEQ ID NO: 197481 - protein, 37 aa, Artificial Sequence
  Description of Artificial Sequence: Synthetic polypeptide
DEACIRCTNPVATEQYGCVCSNWGEHNQEYFNSDNQS

SEQ ID NO: 197482 - protein, 38 aa, Artificial Sequence
  Description of Artificial Sequence: Synthetic polypeptide
DESEIRTTNPVATEGWGCVCSNWMEDENQENFGSDNQA

SEQ ID NO: 197483 - protein, 35 aa, Artificial Sequence
  Description of Artificial Sequence: Synthetic polypeptide
DETEIRTTNPISTEPWGATTANAEDIQAEPKGNYH

SEQ ID NO: 197484 - protein, 35 aa, Artificial Sequence
  Description of Artificial Sequence: Synthetic polypeptide
DETEIRTTNPISTEPWGATTANAEDIQAQPKGNYH

SEQ ID NO: 197485 - protein, 35 aa, Artificial Sequence
  Description of Artificial Sequence: Synthetic polypeptide
DETEIRTTNPISTEPWGATTSNAEDIQAQPKGNYH

SEQ ID NO: 197486 - protein, 35 aa, Artificial Sequence
  Description of Artificial Sequence: Synthetic polypeptide
SETEIRCTNPIATEQWGSTTWSNAENWAEPKGPYI

SEQ ID NO: 197487 - protein, 35 aa, Artificial Sequence
  Description of Artificial Sequence: Synthetic polypeptide
DETEIRTTNPIATECWGATTWANACDQAEPKGPYI

SEQ ID NO: 197488 - protein, 34 aa, Artificial Sequence
  Description of Artificial Sequence: Synthetic polypeptide
DETEIRTTNPISTEPWGATTWANAEDIAQPKGPI

SEQ ID NO: 197489 - protein, 36 aa, Artificial Sequence
  Description of Artificial Sequence: Synthetic polypeptide
SEECIRCTNPCATEQYGCVCSNWGELNANFGSDTQS

SEQ ID NO: 197490 - protein, 36 aa, Artificial Sequence
  Description of Artificial Sequence: Synthetic polypeptide
QAEEIATTNPVAYEQYGSVCAGNGGDEATAGEGVDI

SEQ ID NO: 197491 - protein, 38 aa, Artificial Sequence
  Description of Artificial Sequence: Synthetic polypeptide
LEDEIRTTNPVATEQYGWCNVEIVRQDEVNRSGDEDDQ

SEQ ID NO: 197492 - protein, 36 aa, Artificial Sequence
  Description of Artificial Sequence: Synthetic polypeptide
TEEEICTTNPVAYYEQYGQDVSCIAHAPPGTPDGML

SEQ ID NO: 197493 - protein, 37 aa, Artificial Sequence
  Description of Artificial Sequence: Synthetic polypeptide
TEEEICTTNPVAYYEQYGQCVGSCIANAPPGTPDGML

SEQ ID NO: 197494 - protein, 35 aa, Artificial Sequence
  Description of Artificial Sequence: Synthetic polypeptide
DETEIRTTNPIATECWGATTWANAEDIAEQKGPYI

SEQ ID NO: 197495 - protein, 35 aa, Artificial Sequence
  Description of Artificial Sequence: Synthetic polypeptide
DETEIRTTNPIATEQWGATTWANAEDWAEPKGPPV

SEQ ID NO: 197496 - protein, 35 aa, Artificial Sequence
  Description of Artificial Sequence: Synthetic polypeptide
DETEIRTTNPIATEQWGATTWANAEDWAEPKGPYA

SEQ ID NO: 197497 - protein, 35 aa, Artificial Sequence
  Description of Artificial Sequence: Synthetic polypeptide
DETEIRTTNPIATEQWGATTWANAEDWAEPKGPYF

SEQ ID NO: 197498 - protein, 35 aa, Artificial Sequence
  Description of Artificial Sequence: Synthetic polypeptide
DETEIRTTNPIATEQWGATTWANAEDWAEPKGPYI

SEQ ID NO: 197499 - protein, 35 aa, Artificial Sequence
  Description of Artificial Sequence: Synthetic polypeptide
DETEIRTTNPIATEQWGATTWANAEDWAMPKGPPV

SEQ ID NO: 197500 - protein, 39 aa, Artificial Sequence
  Description of Artificial Sequence: Synthetic polypeptide
DEEEIRCTNPVATEQYGQCVCSNWGEDHNAENFNSDTQS

SEQ ID NO: 197501 - protein, 37 aa, Artificial Sequence
  Description of Artificial Sequence: Synthetic polypeptide
QEDEIRTTNPVATEFYGVVQTDQGQDQTTDEGGQGGI

SEQ ID NO: 197502 - protein, 37 aa, Artificial Sequence
  Description of Artificial Sequence: Synthetic polypeptide
LEPEIATTNPVATEQYGNYTSAPNQEAVVWTHVGGND

SEQ ID NO: 197503 - protein, 36 aa, Artificial Sequence
  Description of Artificial Sequence: Synthetic polypeptide
DETEIRTTNPIATEQWGATTWANAEDWVAEPEGNYI

SEQ ID NO: 197504 - protein, 35 aa, Artificial Sequence
  Description of Artificial Sequence: Synthetic polypeptide
DETEIRTTNPIATEQWGATTWANHEDWAEPKGPYI

SEQ ID NO: 197505 - protein, 35 aa, Artificial Sequence
  Description of Artificial Sequence: Synthetic polypeptide
DETEIRTTNPIATEQWGATTWANTEDWAEPKGPYI

SEQ ID NO: 197506 - protein, 36 aa, Artificial Sequence
  Description of Artificial Sequence: Synthetic polypeptide
DETEIRTTNPIATEQWGATTWANTEDWPAEPKGNYI

SEQ ID NO: 197507 - protein, 36 aa, Artificial Sequence
  Description of Artificial Sequence: Synthetic polypeptide
DETEIRTTNPIATEQWGATTWATTEDWPAEPKGNYI

SEQ ID NO: 197508 - protein, 36 aa, Artificial Sequence
  Description of Artificial Sequence: Synthetic polypeptide
DETEIRTTNPIATEQWGATTWATTPDWPAEPKGNPI

SEQ ID NO: 197509 - protein, 37 aa, Artificial Sequence
  Description of Artificial Sequence: Synthetic polypeptide
LENEIRTTNPVATEQYGACCWVADVDVEQLEGGEDLW

SEQ ID NO: 197510 - protein, 34 aa, Artificial Sequence
  Description of Artificial Sequence: Synthetic polypeptide
DETEIRTTNPIATEQWGATTWPAEVWAEHKGPYK

SEQ ID NO: 197511 - protein, 35 aa, Artificial Sequence
  Description of Artificial Sequence: Synthetic polypeptide
DETEIRTTNPIATEQWGATTWPNAEVWAEHKGEYI

SEQ ID NO: 197512 - protein, 35 aa, Artificial Sequence
  Description of Artificial Sequence: Synthetic polypeptide
DETEIRTTNPIATEQWGATTWANAEDWAEPKGPPI

SEQ ID NO: 197513 - protein, 35 aa, Artificial Sequence
  Description of Artificial Sequence: Synthetic polypeptide
DETEIRTTNPIATEQWGATTWANAEDWAEPKGPEI

SEQ ID NO: 197514 - protein, 32 aa, Artificial Sequence
  Description of Artificial Sequence: Synthetic polypeptide
EEVEIATTNPVAYECWGEVYYVEDIHQHEEGG

SEQ ID NO: 197515 - protein, 35 aa, Artificial Sequence
  Description of Artificial Sequence: Synthetic polypeptide
DETEIRTTNPIATEQWGATTWANAEDWAEPKGGYI

SEQ ID NO: 197516 - protein, 33 aa, Artificial Sequence
  Description of Artificial Sequence: Synthetic polypeptide
TEEEIATTNPVAYERWGEAYMVEDQQHDEGEGI

SEQ ID NO: 197517 - protein, 34 aa, Artificial Sequence
  Description of Artificial Sequence: Synthetic polypeptide
DETEIRTTNPIATECWGATTWANAEDWAEFKGPI

SEQ ID NO: 197518 - protein, 37 aa, Artificial Sequence
  Description of Artificial Sequence: Synthetic polypeptide
LESEIRTTNPVATEQYGSIVCPDDGMIDTRDEKSQQE

SEQ ID NO: 197519 - protein, 32 aa, Artificial Sequence
  Description of Artificial Sequence: Synthetic polypeptide
DEEEIATTNPIATECWGETAAEDCAEPKEEYI

SEQ ID NO: 197520 - protein, 39 aa, Artificial Sequence
  Description of Artificial Sequence: Synthetic polypeptide
DEEEIRCTNPVATEQYGQCVCSNSGEDHNAENFNSDTQS

SEQ ID NO: 197521 - protein, 35 aa, Artificial Sequence
  Description of Artificial Sequence: Synthetic polypeptide
DETEIRTTNPIATEQWGATTWANADDPAEFKGPYI

SEQ ID NO: 197522 - protein, 35 aa, Artificial Sequence
  Description of Artificial Sequence: Synthetic polypeptide
DETEIRTTNPIATEQWGATTWANADDPVAEFKGPI

SEQ ID NO: 197523 - protein, 35 aa, Artificial Sequence
  Description of Artificial Sequence: Synthetic polypeptide
DETEIRTTNPIATEQWGATTWANADGPVAEFKGPI

SEQ ID NO: 197524 - protein, 35 aa, Artificial Sequence
  Description of Artificial Sequence: Synthetic polypeptide
DETEIRTTNPIATEQWGATTWSNAEDWAEPKGDYA

SEQ ID NO: 197525 - protein, 37 aa, Artificial Sequence
  Description of Artificial Sequence: Synthetic polypeptide
DENEIRCTNPVATEQWGCVCSNSGEENAENSSSDNAA

SEQ ID NO: 197526 - protein, 37 aa, Artificial Sequence
  Description of Artificial Sequence: Synthetic polypeptide
CEEVIACTNPVATEQYGSACATNPQEEAGAEQDEDAP

SEQ ID NO: 197527 - protein, 35 aa, Artificial Sequence
  Description of Artificial Sequence: Synthetic polypeptide
DENEIATTNPVSYEPWGTVISCMEDISQQQNGGNH

SEQ ID NO: 197528 - protein, 32 aa, Artificial Sequence
  Description of Artificial Sequence: Synthetic polypeptide
DEEEIATTNPIATECWGETTWAAVCAEHKEEI

SEQ ID NO: 197529 - protein, 37 aa, Artificial Sequence
  Description of Artificial Sequence: Synthetic polypeptide
SEYEISCTNPVATEQYGCVCETWGEHNQEHFGSDNQA

SEQ ID NO: 197530 - protein, 35 aa, Artificial Sequence
  Description of Artificial Sequence: Synthetic polypeptide
DETEIRTTNPIATEQWGATTWANAEDPAEFKGPYI

SEQ ID NO: 197531 - protein, 35 aa, Artificial Sequence
  Description of Artificial Sequence: Synthetic polypeptide
DETEIRTTNPIATEQWGATTWANAEDWAEFKGPYI

SEQ ID NO: 197532 - protein, 36 aa, Artificial Sequence
  Description of Artificial Sequence: Synthetic polypeptide
SEYEISCTNPVATEQYGCVCENWGEHNQHFGSDTQS

SEQ ID NO: 197533 - protein, 37 aa, Artificial Sequence
  Description of Artificial Sequence: Synthetic polypeptide
CEEVIACTNPVATEQYGSACATNPGEEAGMHQDGDAP

SEQ ID NO: 197534 - protein, 36 aa, Artificial Sequence
  Description of Artificial Sequence: Synthetic polypeptide
DENEIRCTNPVATEQWGCVTSWGEHNTEYFISDTAS

SEQ ID NO: 197535 - protein, 37 aa, Artificial Sequence
  Description of Artificial Sequence: Synthetic polypeptide
SNAEIRTTNPVATEQYGSSAVGDKMDAEGMGEGQNND

SEQ ID NO: 197536 - protein, 35 aa, Artificial Sequence
  Description of Artificial Sequence: Synthetic polypeptide
DETEIRTTNPIATEQWGATTWSNAEDWAEPKGPYA

SEQ ID NO: 197537 - protein, 37 aa, Artificial Sequence
  Description of Artificial Sequence: Synthetic polypeptide
LENEICTTNPVATEQYGQCFETVTLNYNNFAETGNQD

SEQ ID NO: 197538 - protein, 35 aa, Artificial Sequence
  Description of Artificial Sequence: Synthetic polypeptide
DETEIRTTNPIATECWGATTWANAEDRAEPKGPYI

SEQ ID NO: 197539 - protein, 36 aa, Artificial Sequence
  Description of Artificial Sequence: Synthetic polypeptide
DETEIRTTNPIATEQWGTTTWANAEDWVAEPEGNYI

SEQ ID NO: 197540 - protein, 36 aa, Artificial Sequence
  Description of Artificial Sequence: Synthetic polypeptide
DETEIRTTNPIATEQWGTTTWANAEGWVAEPEGNYI

SEQ ID NO: 197541 - protein, 34 aa, Artificial Sequence
  Description of Artificial Sequence: Synthetic polypeptide
DEAEIRTTNPCSTEPWGCIAPEDQQQQQQQGTNI

SEQ ID NO: 197542 - protein, 35 aa, Artificial Sequence
  Description of Artificial Sequence: Synthetic polypeptide
DETEIRTTNPIATECWGATTWANAEDQAYPKGPYI

SEQ ID NO: 197543 - protein, 35 aa, Artificial Sequence
  Description of Artificial Sequence: Synthetic polypeptide
DETEIRTTNPIATECWGATTWANAEDQAEPKGPYI

SEQ ID NO: 197544 - protein, 37 aa, Artificial Sequence
  Description of Artificial Sequence: Synthetic polypeptide
AEEEISTTNPVAYEGYGCVCSNWGEHNEENFGSENQS

SEQ ID NO: 197545 - protein, 35 aa, Artificial Sequence
  Description of Artificial Sequence: Synthetic polypeptide
DETEIRTTNPIATECWGATTWANAEDNAEPKGPNI

SEQ ID NO: 197546 - protein, 35 aa, Artificial Sequence
  Description of Artificial Sequence: Synthetic polypeptide
DETEIRTTNPIATECWGATTWANAEDLAESKGPYI

SEQ ID NO: 197547 - protein, 34 aa, Artificial Sequence
  Description of Artificial Sequence: Synthetic polypeptide
DENEIATTNPVSTESWGCIAPEDQQQQQNGNTHT

SEQ ID NO: 197548 - protein, 35 aa, Artificial Sequence
  Description of Artificial Sequence: Synthetic polypeptide
DETEIRTTNPIATECWGATTWANAEDLAEPKGPYI

SEQ ID NO: 197549 - protein, 38 aa, Artificial Sequence
  Description of Artificial Sequence: Synthetic polypeptide
AEAEISTTNPVATEQYGQCVCSTWGEHNAENFNSDTQS

SEQ ID NO: 197550 - protein, 33 aa, Artificial Sequence
  Description of Artificial Sequence: Synthetic polypeptide
EEVEIATTNPVAYECWGTVYYVEDIHRDENEKD

SEQ ID NO: 197551 - protein, 35 aa, Artificial Sequence
  Description of Artificial Sequence: Synthetic polypeptide
DETEIRTTNPIATEWWGATVWANAEDWAEPKGPYI

SEQ ID NO: 197552 - protein, 35 aa, Artificial Sequence
  Description of Artificial Sequence: Synthetic polypeptide
DETEIRTTNPIATECWGATTWANAEDLAEHKGPYI

SEQ ID NO: 197553 - protein, 37 aa, Artificial Sequence
  Description of Artificial Sequence: Synthetic polypeptide
DEAEIRTTNPVAYEQYGCICSNWGEHNEENFTSDNQA

SEQ ID NO: 197554 - protein, 38 aa, Artificial Sequence
  Description of Artificial Sequence: Synthetic polypeptide
CEEEIATTNPVAYAQWGSVCSEANPALPNDHGGGMNHW

SEQ ID NO: 197555 - protein, 35 aa, Artificial Sequence
  Description of Artificial Sequence: Synthetic polypeptide
DETEIRTTNPIATECWGATTWANAEDRMEPKGPYI

SEQ ID NO: 197556 - protein, 37 aa, Artificial Sequence
  Description of Artificial Sequence: Synthetic polypeptide
DETEIRTTNPIATEQWGSTTWSNAEAWPNMRNGMPPI

SEQ ID NO: 197557 - protein, 36 aa, Artificial Sequence
  Description of Artificial Sequence: Synthetic polypeptide
DETEIRTTNPIATEQWGSTTWANAEDWPAMPKGPPV

SEQ ID NO: 197558 - protein, 35 aa, Artificial Sequence
  Description of Artificial Sequence: Synthetic polypeptide
DAAEIATTNPVAYEQWGSVAGEGPGNQNANPNSDD

SEQ ID NO: 197559 - protein, 38 aa, Artificial Sequence
  Description of Artificial Sequence: Synthetic polypeptide
TEEEICTTNPIAYEPYGSVVCGQDNELSQSAEGTENGI

SEQ ID NO: 197560 - protein, 33 aa, Artificial Sequence
  Description of Artificial Sequence: Synthetic polypeptide
DEEEIATTNPIATECWGETTWANAVCAEHKEEI

SEQ ID NO: 197561 - protein, 35 aa, Artificial Sequence
  Description of Artificial Sequence: Synthetic polypeptide
DAAEIATTNPVAYEQWGTCFAGMPAGNPQGNEQRH

SEQ ID NO: 197562 - protein, 39 aa, Artificial Sequence
  Description of Artificial Sequence: Synthetic polypeptide
DEEEIRCTNPVATEQYGQCVCSNWGEDHNQENFNSDPQS

SEQ ID NO: 197563 - protein, 34 aa, Artificial Sequence
  Description of Artificial Sequence: Synthetic polypeptide
DEDEIACTNPVATEQWGTNCAATDGGVEPEINED

SEQ ID NO: 197564 - protein, 37 aa, Artificial Sequence
  Description of Artificial Sequence: Synthetic polypeptide
LEGEIRTTNPVATETYGHVTCSETVTTGSDSTQEAPQ

SEQ ID NO: 197565 - protein, 37 aa, Artificial Sequence
  Description of Artificial Sequence: Synthetic polypeptide
DEAEIRTTNPVAYEQYGCICSSGEDHNEENFPSDNQA

SEQ ID NO: 197566 - protein, 36 aa, Artificial Sequence
  Description of Artificial Sequence: Synthetic polypeptide
LEGEIRTTNPVATEQYGCTCITPTMEDKIEGPQQPM

SEQ ID NO: 197567 - protein, 34 aa, Artificial Sequence
  Description of Artificial Sequence: Synthetic polypeptide
DEEEIATTNPIATECWGETTWANADWAEHKGPYI

SEQ ID NO: 197568 - protein, 37 aa, Artificial Sequence
  Description of Artificial Sequence: Synthetic polypeptide
LEGEIATTNPVATEQYGSISFSAPDTLREPHEDEDTR

SEQ ID NO: 197569 - protein, 35 aa, Artificial Sequence
  Description of Artificial Sequence: Synthetic polypeptide
DETEIRTTNPIATECWGATTWANAEDSALPKGPYI

SEQ ID NO: 197570 - protein, 40 aa, Artificial Sequence
  Description of Artificial Sequence: Synthetic polypeptide
DEEEIRTTNPVATEAYGAVVTTQIGTTEQGSTNDEQGQED

SEQ ID NO: 197571 - protein, 36 aa, Artificial Sequence
  Description of Artificial Sequence: Synthetic polypeptide
DEECISTVNPVATEGYGQCVCSWGEHNEENFNSDQS

SEQ ID NO: 197572 - protein, 38 aa, Artificial Sequence
  Description of Artificial Sequence: Synthetic polypeptide
DEEEIRCTNPVATEQYGQCVCSNWGEDNTEYFISDTQS

SEQ ID NO: 197573 - protein, 37 aa, Artificial Sequence
  Description of Artificial Sequence: Synthetic polypeptide
LEEGIRTTNPVATETYGHVTCTETVNTTSDSTQEAPQ

SEQ ID NO: 197574 - protein, 33 aa, Artificial Sequence
  Description of Artificial Sequence: Synthetic polypeptide
DEEEIATTNPIATECWGETTWANAVCAEHKEPI

SEQ ID NO: 197575 - protein, 37 aa, Artificial Sequence
  Description of Artificial Sequence: Synthetic polypeptide
SEYEIRCTNPVATEQYGCVCQNWGEHNQEHFGSDTQA

SEQ ID NO: 197576 - protein, 35 aa, Artificial Sequence
  Description of Artificial Sequence: Synthetic polypeptide
DETEIRTTNPIATEQWGETTWANAEDWAEPKGPYI

SEQ ID NO: 197577 - protein, 40 aa, Artificial Sequence
  Description of Artificial Sequence: Synthetic polypeptide
DEEEIRTTNPVATEAYGAVVTTVIGTTEQGSTNDEQNEED

SEQ ID NO: 197578 - protein, 36 aa, Artificial Sequence
  Description of Artificial Sequence: Synthetic polypeptide
MEDEIRGTNCVATEAWGSVSAINGEGGDGEQEEGQT

SEQ ID NO: 197579 - protein, 36 aa, Artificial Sequence
  Description of Artificial Sequence: Synthetic polypeptide
SSEEIATTNPVAYHQYGSVVHCGVWHSQEHGGINFQ

SEQ ID NO: 197580 - protein, 34 aa, Artificial Sequence
  Description of Artificial Sequence: Synthetic polypeptide
EENEIATTNPVAYEQWGATYYSIEIEMNQREMDN

SEQ ID NO: 197581 - protein, 35 aa, Artificial Sequence
  Description of Artificial Sequence: Synthetic polypeptide
DETEIRTTNPIATECWGATTWSNMEDWAEPKGNYI

SEQ ID NO: 197582 - protein, 38 aa, Artificial Sequence
  Description of Artificial Sequence: Synthetic polypeptide
DEAEIRTTNPVAYEQYGQCVCSNWGEDDNANFNSDNQS

SEQ ID NO: 197583 - protein, 37 aa, Artificial Sequence
  Description of Artificial Sequence: Synthetic polypeptide
TDDEIRTTNPVAYEAWGSTVFMNQALSQTHSGTNTDT

SEQ ID NO: 197584 - protein, 35 aa, Artificial Sequence
  Description of Artificial Sequence: Synthetic polypeptide
DETEIRTTNPIATECWGATTWANAETWAERKGPYI

SEQ ID NO: 197585 - protein, 38 aa, Artificial Sequence
  Description of Artificial Sequence: Synthetic polypeptide
AEEEIRTTNPVATEGYGQCVCSNWEEHNIENFNSDTQS

SEQ ID NO: 197586 - protein, 38 aa, Artificial Sequence
  Description of Artificial Sequence: Synthetic polypeptide
MEEEIRGTNPVATDQYGSVVGMGVPGQGLDQGDGTEGG

SEQ ID NO: 197587 - protein, 37 aa, Artificial Sequence
  Description of Artificial Sequence: Synthetic polypeptide
CEEEIATTNPVAYEQYGSACSANPAEGQDHQDDSFAW

SEQ ID NO: 197588 - protein, 34 aa, Artificial Sequence
  Description of Artificial Sequence: Synthetic polypeptide
DETEIRTTNPIATECWGATTWANAETWAEPGPYI

SEQ ID NO: 197589 - protein, 36 aa, Artificial Sequence
  Description of Artificial Sequence: Synthetic polypeptide
DEDEIACTNPVATEQWGGCVAGTTGLEAPAMDNGMA

SEQ ID NO: 197590 - protein, 35 aa, Artificial Sequence
  Description of Artificial Sequence: Synthetic polypeptide
TCTNDEIATTNPVAYEPWGVVTGGNQQDREGDNEP

SEQ ID NO: 197591 - protein, 35 aa, Artificial Sequence
  Description of Artificial Sequence: Synthetic polypeptide
DETEIRTTNPIATECWGATTWSNTEDWAEPKGPYI

SEQ ID NO: 197592 - protein, 35 aa, Artificial Sequence
  Description of Artificial Sequence: Synthetic polypeptide
DETEIRTTNPIATECWGATTWSTAEDWAEPKGPYI

SEQ ID NO: 197593 - protein, 35 aa, Artificial Sequence
  Description of Artificial Sequence: Synthetic polypeptide
DETEIRTTNPIATECWGATTWTNAEDWAEPKGFYI

SEQ ID NO: 197594 - protein, 35 aa, Artificial Sequence
  Description of Artificial Sequence: Synthetic polypeptide
DETEIRTTNPIATECWGATTWTNAEDWAEPKGPYI

SEQ ID NO: 197595 - protein, 37 aa, Artificial Sequence
  Description of Artificial Sequence: Synthetic polypeptide
DEDEIACTNPVATEAYGSVTANAGAPGNGSPGGQPNE

SEQ ID NO: 197596 - protein, 35 aa, Artificial Sequence
  Description of Artificial Sequence: Synthetic polypeptide
DETEIRTTNPIATECWGATTWANAERWAEPKGPYI

SEQ ID NO: 197597 - protein, 35 aa, Artificial Sequence
  Description of Artificial Sequence: Synthetic polypeptide
DETEIRTTNPIATECWGATTWTNAEDWEEPQEPQF

SEQ ID NO: 197598 - protein, 39 aa, Artificial Sequence
  Description of Artificial Sequence: Synthetic polypeptide
DEAEIRTTNPVAYEQYGQCVCSNWEEPHNTENFNSDNQS

SEQ ID NO: 197599 - protein, 38 aa, Artificial Sequence
  Description of Artificial Sequence: Synthetic polypeptide
DEACAEIATTNPCAYEQWGSVCSTWEESERGERRGEDH

SEQ ID NO: 197600 - protein, 38 aa, Artificial Sequence
  Description of Artificial Sequence: Synthetic polypeptide
MEEEIRGTNPVATECYGSVYANDINGNEEGQGEEVDDD

SEQ ID NO: 197601 - protein, 36 aa, Artificial Sequence
  Description of Artificial Sequence: Synthetic polypeptide
DETEIRTTNPIATECWGATTWSNCEDEPQEPKGNYI

SEQ ID NO: 197602 - protein, 34 aa, Artificial Sequence
  Description of Artificial Sequence: Synthetic polypeptide
DETEIRTTNPIATECWGATTWSNAEDWAEPKGPI

SEQ ID NO: 197603 - protein, 36 aa, Artificial Sequence
  Description of Artificial Sequence: Synthetic polypeptide
TEACISTTNPVATEQYGCVCSSGEHNAEYFLSDTQS

SEQ ID NO: 197604 - protein, 37 aa, Artificial Sequence
  Description of Artificial Sequence: Synthetic polypeptide
DESDEIATTNPVAYEQWGSACSNDNGNDAGRNGSQDA

SEQ ID NO: 197605 - protein, 35 aa, Artificial Sequence
  Description of Artificial Sequence: Synthetic polypeptide
DETEIRTTNPIATECWGATTWSNAEDWMEPKGPYR

SEQ ID NO: 197606 - protein, 36 aa, Artificial Sequence
  Description of Artificial Sequence: Synthetic polypeptide
TEACIRTTNPTATECYGQCISCTQEEPSQFLEGNDP

SEQ ID NO: 197607 - protein, 35 aa, Artificial Sequence
  Description of Artificial Sequence: Synthetic polypeptide
NETEICTTNPVAYEQWGVVPCWDSQSDQPMNGDSN

SEQ ID NO: 197608 - protein, 35 aa, Artificial Sequence
  Description of Artificial Sequence: Synthetic polypeptide
DEDEIACTNPVATEQWGCVAGEGVEMNAAEMDNAM

SEQ ID NO: 197609 - protein, 37 aa, Artificial Sequence
  Description of Artificial Sequence: Synthetic polypeptide
MEEEIRGTNPVATEQYGMVSVEGMGDGGQGQEQDEGV

SEQ ID NO: 197610 - protein, 35 aa, Artificial Sequence
  Description of Artificial Sequence: Synthetic polypeptide
TEAAEIATTNPVAYEQWGIVSGGNGGEAGGDGMTQ

SEQ ID NO: 197611 - protein, 35 aa, Artificial Sequence
  Description of Artificial Sequence: Synthetic polypeptide
TEAAEIATTNPVATEPWGVVCFTNEDWTDLGGTTS

SEQ ID NO: 197612 - protein, 37 aa, Artificial Sequence
  Description of Artificial Sequence: Synthetic polypeptide
DEDEIACTNPVATEQWGCSPSAMWPAGTNQGNPMEPV

SEQ ID NO: 197613 - protein, 35 aa, Artificial Sequence
  Description of Artificial Sequence: Synthetic polypeptide
QAEEIATTNPVAYEPYGSVAAIANNDTATAHPDNA

SEQ ID NO: 197614 - protein, 37 aa, Artificial Sequence
  Description of Artificial Sequence: Synthetic polypeptide
CEEEIACTNPVATEQYGSCAAGMGNGTTNTADGGEGM

SEQ ID NO: 197615 - protein, 37 aa, Artificial Sequence
  Description of Artificial Sequence: Synthetic polypeptide
DEDEIATTNPVAYEPWGHNIVATPAHQGADSDGNARS

SEQ ID NO: 197616 - protein, 37 aa, Artificial Sequence
  Description of Artificial Sequence: Synthetic polypeptide
DEAEIRTTNPVAYEQYGQCICSWGEHNEENFISDNQA

SEQ ID NO: 197617 - protein, 35 aa, Artificial Sequence
  Description of Artificial Sequence: Synthetic polypeptide
DETEIRTTNPIATECWGATTWSNAPDWNEPKGPYI

SEQ ID NO: 197618 - protein, 38 aa, Artificial Sequence
  Description of Artificial Sequence: Synthetic polypeptide
AEEEIRTTNPVATEGYGQCVCSNWGEHNQENFNSENQF

SEQ ID NO: 197619 - protein, 38 aa, Artificial Sequence
  Description of Artificial Sequence: Synthetic polypeptide
AEEEIRTTNPVATEGYGQCVCSNWGEDNAENFNSDNQA

SEQ ID NO: 197620 - protein, 35 aa, Artificial Sequence
  Description of Artificial Sequence: Synthetic polypeptide
DETEIRTTNPIATECWGATTWTNKEDWAEPKGPYI

SEQ ID NO: 197621 - protein, 38 aa, Artificial Sequence
  Description of Artificial Sequence: Synthetic polypeptide
MEEEIRGTNPVATDQYGSVVGMGVPGNGLDQGDDTEGL

SEQ ID NO: 197622 - protein, 35 aa, Artificial Sequence
  Description of Artificial Sequence: Synthetic polypeptide
DETEIRTTNPIATECWGATTWANAERWAEPKGDYI

SEQ ID NO: 197623 - protein, 35 aa, Artificial Sequence
  Description of Artificial Sequence: Synthetic polypeptide
DETEIRTTNPIATECWGATVCANAEDWAEPKGPYI

SEQ ID NO: 197624 - protein, 37 aa, Artificial Sequence
  Description of Artificial Sequence: Synthetic polypeptide
DEDEIACTNPVATAQWGSVSAQWPAGTNQGNGMEPVH

SEQ ID NO: 197625 - protein, 37 aa, Artificial Sequence
  Description of Artificial Sequence: Synthetic polypeptide
DEHEIATTNPVAYEQWGEVCSTPNQGNHGEAGGMGDN

SEQ ID NO: 197626 - protein, 33 aa, Artificial Sequence
  Description of Artificial Sequence: Synthetic polypeptide
DETEIRTTNPIATECWGATVWAADWAEPKEDYA

SEQ ID NO: 197627 - protein, 33 aa, Artificial Sequence
  Description of Artificial Sequence: Synthetic polypeptide
DETEIRTTNPIATECWGATVWAADWAEPKEDYI

SEQ ID NO: 197628 - protein, 33 aa, Artificial Sequence
  Description of Artificial Sequence: Synthetic polypeptide
DETEIRTTNPIATECWGATVWAADWAEPKEPYI

SEQ ID NO: 197629 - protein, 36 aa, Artificial Sequence
  Description of Artificial Sequence: Synthetic polypeptide
QEEEIACTNPVATEQWGGCNVAGTGQDDNQMGGGLH

SEQ ID NO: 197630 - protein, 34 aa, Artificial Sequence
  Description of Artificial Sequence: Synthetic polypeptide
DETEIRTTNPIATECWGATVWAAEDWAEPKGPYI

SEQ ID NO: 197631 - protein, 34 aa, Artificial Sequence
  Description of Artificial Sequence: Synthetic polypeptide
DETEIRTTNPIATECWGATVWAAEDWMNPKGPYI

SEQ ID NO: 197632 - protein, 36 aa, Artificial Sequence
  Description of Artificial Sequence: Synthetic polypeptide
DEAVEATTNPVAYEQWGCVYSQVNNDAGEQGGNQMN

SEQ ID NO: 197633 - protein, 35 aa, Artificial Sequence
  Description of Artificial Sequence: Synthetic polypeptide
DEDEIATTNPVAYEQWGCNNAGNGHGADSNGNAQH

SEQ ID NO: 197634 - protein, 35 aa, Artificial Sequence
  Description of Artificial Sequence: Synthetic polypeptide
DETEIRTTNPIATECWGATVWACENEPAEPKGPYG

SEQ ID NO: 197635 - protein, 36 aa, Artificial Sequence
  Description of Artificial Sequence: Synthetic polypeptide
DEACIGTTNPVATEQWGCVCSWMEDHNQEYFGSDQA

SEQ ID NO: 197636 - protein, 38 aa, Artificial Sequence
  Description of Artificial Sequence: Synthetic polypeptide
CEEEISTTNPVATEQYGQCVCGSGEDHNAENFGSDTQS

SEQ ID NO: 197637 - protein, 38 aa, Artificial Sequence
  Description of Artificial Sequence: Synthetic polypeptide
EEQEIRTTNPVATEQYGSHCIHPWEHDEQPEGTENDQG

SEQ ID NO: 197638 - protein, 37 aa, Artificial Sequence
  Description of Artificial Sequence: Synthetic polypeptide
EEQEIRTTNPVATEQYGSHCICPWVHDEQPEVENDQG

SEQ ID NO: 197639 - protein, 34 aa, Artificial Sequence
  Description of Artificial Sequence: Synthetic polypeptide
DETEIRTTNPIATECWGATVWANADWAEPKEPYI

SEQ ID NO: 197640 - protein, 35 aa, Artificial Sequence
  Description of Artificial Sequence: Synthetic polypeptide
DETEIRTTNPIATECWGATVANAIDWAERKGEPYG

SEQ ID NO: 197641 - protein, 38 aa, Artificial Sequence
  Description of Artificial Sequence: Synthetic polypeptide
AEEEIRTTNPVATEGYGQCVCFNWGEHNTENFISDNQS

SEQ ID NO: 197642 - protein, 38 aa, Artificial Sequence
  Description of Artificial Sequence: Synthetic polypeptide
DEGEIATTNPVATEQYGSSCSPAYMDSFEDTDGDNDEY

SEQ ID NO: 197643 - protein, 37 aa, Artificial Sequence
  Description of Artificial Sequence: Synthetic polypeptide
DEGEIATTNPVATEQYGSSCYPAYMDSEDTYGDNDEY

SEQ ID NO: 197644 - protein, 35 aa, Artificial Sequence
  Description of Artificial Sequence: Synthetic polypeptide
DETEIRTTNPIATECWGATTWANAEQWAEPKGPYI

SEQ ID NO: 197645 - protein, 37 aa, Artificial Sequence
  Description of Artificial Sequence: Synthetic polypeptide
DEDEIACTNPVATEQWGHCVSATWPAGTNQGNGMEPV

SEQ ID NO: 197646 - protein, 35 aa, Artificial Sequence
  Description of Artificial Sequence: Synthetic polypeptide
DETEIRTTNPIATECWGATTWVNAEDWAERKGPYI

SEQ ID NO: 197647 - protein, 35 aa, Artificial Sequence
  Description of Artificial Sequence: Synthetic polypeptide
DETEIRTTNPIATECWGATTWANAEQCAEPKGPYI

SEQ ID NO: 197648 - protein, 37 aa, Artificial Sequence
  Description of Artificial Sequence: Synthetic polypeptide
MEEEIRGTNCVATEQYGSFGSAEGETGQGNDDEEDDT

SEQ ID NO: 197649 - protein, 35 aa, Artificial Sequence
  Description of Artificial Sequence: Synthetic polypeptide
DETEIRTTNPIATECWGATTWANAENWQEPKGPYI

SEQ ID NO: 197650 - protein, 34 aa, Artificial Sequence
  Description of Artificial Sequence: Synthetic polypeptide
DETEIRTTNPIATECWGATTWYNAEDWAEPKGPI

SEQ ID NO: 197651 - protein, 35 aa, Artificial Sequence
  Description of Artificial Sequence: Synthetic polypeptide
DETEIRTTNPIATECWGATTWANAENWPAERKGPI

SEQ ID NO: 197652 - protein, 35 aa, Artificial Sequence
  Description of Artificial Sequence: Synthetic polypeptide
QENEIATTNPVAYEQWGSVCADGALANTGGVMQMD

SEQ ID NO: 197653 - protein, 34 aa, Artificial Sequence
  Description of Artificial Sequence: Synthetic polypeptide
DETEIRTTNPIATECWGATTWANAENWAPKGPYI

SEQ ID NO: 197654 - protein, 38 aa, Artificial Sequence
  Description of Artificial Sequence: Synthetic polypeptide
CEEEISTTNPVATEQYGQCVCSNSEEDNQENFGSDTQA

SEQ ID NO: 197655 - protein, 38 aa, Artificial Sequence
  Description of Artificial Sequence: Synthetic polypeptide
MEEEIRTTNPVATEQYGACIHGTTLEDHNDGEYHDEQP

SEQ ID NO: 197656 - protein, 35 aa, Artificial Sequence
  Description of Artificial Sequence: Synthetic polypeptide
DETEIRTTNPIATECWGATTWANAELWAEPKGPYI

SEQ ID NO: 197657 - protein, 37 aa, Artificial Sequence
  Description of Artificial Sequence: Synthetic polypeptide
DEHEIATTNPVAYEQWGEVCSTPNQGNHGEAGGDDIN

SEQ ID NO: 197658 - protein, 37 aa, Artificial Sequence
  Description of Artificial Sequence: Synthetic polypeptide
DEACICTTNPVAYEQYGCSTSVNCAMTSNTHVGKYSC

SEQ ID NO: 197659 - protein, 35 aa, Artificial Sequence
  Description of Artificial Sequence: Synthetic polypeptide
DETEIRTTNPIATECWGATTWANAELLAEPKGPYI

SEQ ID NO: 197660 - protein, 35 aa, Artificial Sequence
  Description of Artificial Sequence: Synthetic polypeptide
DETEIRTTNPIATECWGATTWANAEKWQEPKGPYI

SEQ ID NO: 197661 - protein, 34 aa, Artificial Sequence
  Description of Artificial Sequence: Synthetic polypeptide
DETEIRTTNPIATECWGATVANAEDWAEPKGTYI

SEQ ID NO: 197662 - protein, 35 aa, Artificial Sequence
  Description of Artificial Sequence: Synthetic polypeptide
DETEIRTTNPIATECWGATTWANAENWAERKGPYI

SEQ ID NO: 197663 - protein, 35 aa, Artificial Sequence
  Description of Artificial Sequence: Synthetic polypeptide
DETEIRTTNPIATECWGATTWSNAEDLAEPKGPYI

SEQ ID NO: 197664 - protein, 35 aa, Artificial Sequence
  Description of Artificial Sequence: Synthetic polypeptide
DETEIRTTNPIATECWGATTWSNAEDEAEPKGNYI

SEQ ID NO: 197665 - protein, 35 aa, Artificial Sequence
  Description of Artificial Sequence: Synthetic polypeptide
DEAVEATTNPVAYEQWGCVYSVNNDAGEQGGMVEM

SEQ ID NO: 197666 - protein, 34 aa, Artificial Sequence
  Description of Artificial Sequence: Synthetic polypeptide
DEDEIATTNPVAYEPWVSVAATAHGAAAPPGSHN

SEQ ID NO: 197667 - protein, 36 aa, Artificial Sequence
  Description of Artificial Sequence: Synthetic polypeptide
DETEIRTTNPIATECWGATTWANMEDIQAEPNGNYI

SEQ ID NO: 197668 - protein, 35 aa, Artificial Sequence
  Description of Artificial Sequence: Synthetic polypeptide
DETEIRTTNPIATECWGATTWANLEDWAEPKGPYI

SEQ ID NO: 197669 - protein, 37 aa, Artificial Sequence
  Description of Artificial Sequence: Synthetic polypeptide
TEAEISTTNPVATEQYGCVCSNWMEHNQENFNSDNQS

SEQ ID NO: 197670 - protein, 35 aa, Artificial Sequence
  Description of Artificial Sequence: Synthetic polypeptide
DETEIRTTNPIATECWGATTWANLEDWAEPKGPII

SEQ ID NO: 197671 - protein, 38 aa, Artificial Sequence
  Description of Artificial Sequence: Synthetic polypeptide
DEAEIRTTNPVAYEQYGCVCSNWGEDHNQENFNSDNQA

SEQ ID NO: 197672 - protein, 35 aa, Artificial Sequence
  Description of Artificial Sequence: Synthetic polypeptide
TEAEIRTTNPVSYEPWGKISCMEDSISDQMNEGNT

SEQ ID NO: 197673 - protein, 37 aa, Artificial Sequence
  Description of Artificial Sequence: Synthetic polypeptide
DDEEIRTTNPVATEQWGQCVTSWGEHNIENFISDTAS

SEQ ID NO: 197674 - protein, 40 aa, Artificial Sequence
  Description of Artificial Sequence: Synthetic polypeptide
DEEEIRTTNPVATEQYGVVTVTVVTVGTQAGTTEQGTTVE

SEQ ID NO: 197675 - protein, 38 aa, Artificial Sequence
  Description of Artificial Sequence: Synthetic polypeptide
DEAEIRTTNPVAYEQYGCVCSNWGEDHNQENFNSETQS

SEQ ID NO: 197676 - protein, 35 aa, Artificial Sequence
  Description of Artificial Sequence: Synthetic polypeptide
DETEIRTTNPIATECWGATTWANHLDWAEPKGPYI

SEQ ID NO: 197677 - protein, 34 aa, Artificial Sequence
  Description of Artificial Sequence: Synthetic polypeptide
DETEIRTTNPIATECWGATTWANHEDWAEPGPYI

SEQ ID NO: 197678 - protein, 38 aa, Artificial Sequence
  Description of Artificial Sequence: Synthetic polypeptide
AEAEISTTNPVATEQYGCVCSNWGEDTNQENFNSETQS

SEQ ID NO: 197679 - protein, 39 aa, Artificial Sequence
  Description of Artificial Sequence: Synthetic polypeptide
DENEIKTTNCVATEQYGVVSIVDNTGMDGENDQEGGDGT

SEQ ID NO: 197680 - protein, 38 aa, Artificial Sequence
  Description of Artificial Sequence: Synthetic polypeptide
MEEEIRTTNPVATEFYGCVGSNNQTDGGEFEEEGGEVD

SEQ ID NO: 197681 - protein, 37 aa, Artificial Sequence
  Description of Artificial Sequence: Synthetic polypeptide
TEDEIRTTNPVAYEQWGVVSGGEPANGPNMRNGGGKQ

SEQ ID NO: 197682 - protein, 37 aa, Artificial Sequence
  Description of Artificial Sequence: Synthetic polypeptide
MEEEIRTTNPVATEFYGCVGSNQDDGGEFEEEGGEEE

SEQ ID NO: 197683 - protein, 34 aa, Artificial Sequence
  Description of Artificial Sequence: Synthetic polypeptide
DETEIRTTNPIATECWGATTWANMEDWAEPNGPH

SEQ ID NO: 197684 - protein, 35 aa, Artificial Sequence
  Description of Artificial Sequence: Synthetic polypeptide
DETEIRTTNPIATECWGATTWANMEDWAERKGPYI

SEQ ID NO: 197685 - protein, 37 aa, Artificial Sequence
  Description of Artificial Sequence: Synthetic polypeptide
AEAEISTTNPVATEQYGCVCSMSGEHNAENFNSETQA

SEQ ID NO: 197686 - protein, 37 aa, Artificial Sequence
  Description of Artificial Sequence: Synthetic polypeptide
DEDEIACTNPVATEQWGCVSAAWPAGTNQGNGMEPVH

SEQ ID NO: 197687 - protein, 35 aa, Artificial Sequence
  Description of Artificial Sequence: Synthetic polypeptide
DETEIRTTNPIATECWGATTWANTEDLADPEGPDL

SEQ ID NO: 197688 - protein, 35 aa, Artificial Sequence
  Description of Artificial Sequence: Synthetic polypeptide
DETEIRTTNPIATECWGATTWANTEDLADPKGPYL

SEQ ID NO: 197689 - protein, 34 aa, Artificial Sequence
  Description of Artificial Sequence: Synthetic polypeptide
TEDAIASVNPVCYEEYGVTVNTINLSQAAGGNNV

SEQ ID NO: 197690 - protein, 36 aa, Artificial Sequence
  Description of Artificial Sequence: Synthetic polypeptide
TEDEIATTNPVATECWGCVCTIDSHNHNGQQGGDHA

SEQ ID NO: 197691 - protein, 35 aa, Artificial Sequence
  Description of Artificial Sequence: Synthetic polypeptide
TECYDEIATTNPVAYEPWGVVTGGNQQDRQGDGET

SEQ ID NO: 197692 - protein, 34 aa, Artificial Sequence
  Description of Artificial Sequence: Synthetic polypeptide
QAEEIATTNPVAYEQWGHCNVAANNGLTAAPAGH

SEQ ID NO: 197693 - protein, 35 aa, Artificial Sequence
  Description of Artificial Sequence: Synthetic polypeptide
DETEIRTTNPIATECWGATTWANVEDWAEPKGPRI

SEQ ID NO: 197694 - protein, 36 aa, Artificial Sequence
  Description of Artificial Sequence: Synthetic polypeptide
TEDEIATTNPVATECWGCVCTIDSNEHNGQQGGDDA

SEQ ID NO: 197695 - protein, 36 aa, Artificial Sequence
  Description of Artificial Sequence: Synthetic polypeptide
DETEIRTTNPIATECWGATTWCNAEDQAEPKGPNIE

SEQ ID NO: 197696 - protein, 36 aa, Artificial Sequence
  Description of Artificial Sequence: Synthetic polypeptide
TEDEIATTNPVATESWGCVCTIDSNNHNGQQDGDDA

SEQ ID NO: 197697 - protein, 34 aa, Artificial Sequence
  Description of Artificial Sequence: Synthetic polypeptide
DETEIRTTNPIATECWGATTWANSDWAEPKGPYI

SEQ ID NO: 197698 - protein, 34 aa, Artificial Sequence
  Description of Artificial Sequence: Synthetic polypeptide
TEDEIATTNPVAYERWGSVWGGNPGNAGEDDGQD

SEQ ID NO: 197699 - protein, 34 aa, Artificial Sequence
  Description of Artificial Sequence: Synthetic polypeptide
TECEIASVNPVCYEPYGVTVNTINLSTAAGGNNT

SEQ ID NO: 197700 - protein, 39 aa, Artificial Sequence
  Description of Artificial Sequence: Synthetic polypeptide
MEEEIRTTNCVATEFYGSVNFDGADNENDGQGQEGNNTN

SEQ ID NO: 197701 - protein, 34 aa, Artificial Sequence
  Description of Artificial Sequence: Synthetic polypeptide
DETEIRTTNPIATECWGATTWANQEDWAEPKGPI

SEQ ID NO: 197702 - protein, 38 aa, Artificial Sequence
  Description of Artificial Sequence: Synthetic polypeptide
MEEEIRTTNPVATEAYGMANIMTENMNLTVEMGGQTED

SEQ ID NO: 197703 - protein, 38 aa, Artificial Sequence
  Description of Artificial Sequence: Synthetic polypeptide
DDEEIRTTNPVATEQWGQCVTSNWGEDNAEYFNSDTQA

SEQ ID NO: 197704 - protein, 36 aa, Artificial Sequence
  Description of Artificial Sequence: Synthetic polypeptide
TEDEIRTTNPSAYEAWGKTVVMQALSQTHEGTNADR

SEQ ID NO: 197705 - protein, 37 aa, Artificial Sequence
  Description of Artificial Sequence: Synthetic polypeptide
DENEIKTTFPVATGYWYIGSIVISYIYNNQQNQSNFL

SEQ ID NO: 197706 - protein, 35 aa, Artificial Sequence
  Description of Artificial Sequence: Synthetic polypeptide
DEECLSTTNPCAYEQYGCVCSWGEHNQENFGSDQS

SEQ ID NO: 197707 - protein, 35 aa, Artificial Sequence
  Description of Artificial Sequence: Synthetic polypeptide
TEDGIQTTNPVAYEAWGKTVACTSELLMMVGNDRT

SEQ ID NO: 197708 - protein, 37 aa, Artificial Sequence
  Description of Artificial Sequence: Synthetic polypeptide
AEAEISTTNPVATEQYGCVCSNWGEHNAENFNSDNQN

SEQ ID NO: 197709 - protein, 38 aa, Artificial Sequence
  Description of Artificial Sequence: Synthetic polypeptide
MEEEIRTTNPVATEFYGVVNMQGVNNMDNQTGEFTEET

SEQ ID NO: 197710 - protein, 35 aa, Artificial Sequence
  Description of Artificial Sequence: Synthetic polypeptide
DETEIRTTNPIATECWGATTWMNAEDWLEPQGPYI

SEQ ID NO: 197711 - protein, 34 aa, Artificial Sequence
  Description of Artificial Sequence: Synthetic polypeptide
DETEIRTTNPIATECWGATTWANANWAEPKGPYI

SEQ ID NO: 197712 - protein, 35 aa, Artificial Sequence
  Description of Artificial Sequence: Synthetic polypeptide
DETEIRTTNPIATECWGATTWQNAEDQAEPKGPYI

SEQ ID NO: 197713 - protein, 35 aa, Artificial Sequence
  Description of Artificial Sequence: Synthetic polypeptide
DEDEIACTNPVATEQWGGCVAGTGEEAAPMDNGMF

SEQ ID NO: 197714 - protein, 35 aa, Artificial Sequence
  Description of Artificial Sequence: Synthetic polypeptide
DETEIRTTNPIATECWGATTWANALDWVEPKGPYI

SEQ ID NO: 197715 - protein, 35 aa, Artificial Sequence
  Description of Artificial Sequence: Synthetic polypeptide
DETEIRTTNPIATECWGATTWANALDWAEPKGPYI

SEQ ID NO: 197716 - protein, 35 aa, Artificial Sequence
  Description of Artificial Sequence: Synthetic polypeptide
QAEEIATTNPVAYEQWGCNTAGNNGLTTAEGGNDI

SEQ ID NO: 197717 - protein, 35 aa, Artificial Sequence
  Description of Artificial Sequence: Synthetic polypeptide
DETEIRTTNPIATECWGATTWANAINWPAERKGPI

SEQ ID NO: 197718 - protein, 38 aa, Artificial Sequence
  Description of Artificial Sequence: Synthetic polypeptide
CEEEISTTNPVATEQYGQCVCSNWEEHNTEGFGSDTQA

SEQ ID NO: 197719 - protein, 34 aa, Artificial Sequence
  Description of Artificial Sequence: Synthetic polypeptide
DETEIRTTNPIATECWGATTWSAADDWAEPKGPI

SEQ ID NO: 197720 - protein, 33 aa, Artificial Sequence
  Description of Artificial Sequence: Synthetic polypeptide
QAEEIATTNPVAYEQWGCNTAGNNGLTAEDHAN

SEQ ID NO: 197721 - protein, 38 aa, Artificial Sequence
  Description of Artificial Sequence: Synthetic polypeptide
DEAEIATTNPVATEQYGSVCAAMAHKDEAGMPPDNPNP

SEQ ID NO: 197722 - protein, 34 aa, Artificial Sequence
  Description of Artificial Sequence: Synthetic polypeptide
DETEIRTTNPIATECWGATTWSNADWAEPKGGYI

SEQ ID NO: 197723 - protein, 35 aa, Artificial Sequence
  Description of Artificial Sequence: Synthetic polypeptide
DETEIRTTNPIATECWGATTWANAINEPAERKGPI

SEQ ID NO: 197724 - protein, 36 aa, Artificial Sequence
  Description of Artificial Sequence: Synthetic polypeptide
DEAEIRTTNPVAYEQYGQCICSNWEHNAENFPSDQA

SEQ ID NO: 197725 - protein, 37 aa, Artificial Sequence
  Description of Artificial Sequence: Synthetic polypeptide
TEECIRCTNPVATEQYGCVCSNWMEHNAEYFNSDTQS

SEQ ID NO: 197726 - protein, 35 aa, Artificial Sequence
  Description of Artificial Sequence: Synthetic polypeptide
DETEIRTTNPIATECWGATTWANAQDPAEPKGPYI

SEQ ID NO: 197727 - protein, 35 aa, Artificial Sequence
  Description of Artificial Sequence: Synthetic polypeptide
DETEIRTTNPIATECWGATTWANAQDWAEPKGPTI

SEQ ID NO: 197728 - protein, 37 aa, Artificial Sequence
  Description of Artificial Sequence: Synthetic polypeptide
DEAAISTTNPVATEQYGCVCSNWGEHNAENFNSDTQS

SEQ ID NO: 197729 - protein, 35 aa, Artificial Sequence
  Description of Artificial Sequence: Synthetic polypeptide
SEDEIATTNPVAYERWGSVSGGNPGNAGEHDGQDW

SEQ ID NO: 197730 - protein, 37 aa, Artificial Sequence
  Description of Artificial Sequence: Synthetic polypeptide
TEAEIRTTNPVATEQYGCVCNNWGEHNAEYFNSDTQS

SEQ ID NO: 197731 - protein, 35 aa, Artificial Sequence
  Description of Artificial Sequence: Synthetic polypeptide
DETEIRTTNPIATECWGATTWANEEDWQEPKGPYI

SEQ ID NO: 197732 - protein, 35 aa, Artificial Sequence
  Description of Artificial Sequence: Synthetic polypeptide
DETEIRTTNPIATECWGATTWANEEDWAERKGPYI

SEQ ID NO: 197733 - protein, 35 aa, Artificial Sequence
  Description of Artificial Sequence: Synthetic polypeptide
DETEIRTTNPIATECWGATTWANDEDLAEPKGPYI

SEQ ID NO: 197734 - protein, 37 aa, Artificial Sequence
  Description of Artificial Sequence: Synthetic polypeptide
DEECISCTNPVATEQYGCVCSNWGEHNQENFNSEFQG

SEQ ID NO: 197735 - protein, 34 aa, Artificial Sequence
  Description of Artificial Sequence: Synthetic polypeptide
DETEIRTTNPIATECWGATTWANCDWAESKGTYI

SEQ ID NO: 197736 - protein, 38 aa, Artificial Sequence
  Description of Artificial Sequence: Synthetic polypeptide
MEEEIRTTNPVATEFYGVVNMQGINGMDNQTGEFTEEG

SEQ ID NO: 197737 - protein, 38 aa, Artificial Sequence
  Description of Artificial Sequence: Synthetic polypeptide
MEEEIRTTNPVATEFYGVVNMQGINNMDNQEGEFTEED

SEQ ID NO: 197738 - protein, 38 aa, Artificial Sequence
  Description of Artificial Sequence: Synthetic polypeptide
MEEEIRTTNPVATEFYGMVSVEQGMGDRGQGQEIQEGT

SEQ ID NO: 197739 - protein, 34 aa, Artificial Sequence
  Description of Artificial Sequence: Synthetic polypeptide
DETEIRTTNPIATECWGATTWANCDWAESKGPYI

SEQ ID NO: 197740 - protein, 38 aa, Artificial Sequence
  Description of Artificial Sequence: Synthetic polypeptide
CEEEISTTNPVATEQYGQCVCSNWEEPNTEGFGSETQS

SEQ ID NO: 197741 - protein, 38 aa, Artificial Sequence
  Description of Artificial Sequence: Synthetic polypeptide
DEEEIGTTNPVATEGYGCVCSNWGEDHNQENFNSDNQS

SEQ ID NO: 197742 - protein, 38 aa, Artificial Sequence
  Description of Artificial Sequence: Synthetic polypeptide
MEEEIRSTNPVATEFYGSVYDQENNFDNGQEGDGGGED

SEQ ID NO: 197743 - protein, 36 aa, Artificial Sequence
  Description of Artificial Sequence: Synthetic polypeptide
DEECISCTNPVATEQYGCVCSNWGEDNAEYFISDQS

SEQ ID NO: 197744 - protein, 38 aa, Artificial Sequence
  Description of Artificial Sequence: Synthetic polypeptide
DENEIKTTNCVATEQYGVVSVNDNTNMDGENDEGGQGT

SEQ ID NO: 197745 - protein, 38 aa, Artificial Sequence
  Description of Artificial Sequence: Synthetic polypeptide
MEEEIRTTNPVATEFYGVVNMQGINNMDNQTGEFTAIG

SEQ ID NO: 197746 - protein, 35 aa, Artificial Sequence
  Description of Artificial Sequence: Synthetic polypeptide
DETEIRTTNPIATECWGATTWANAQHWAEPKGPYI

SEQ ID NO: 197747 - protein, 35 aa, Artificial Sequence
  Description of Artificial Sequence: Synthetic polypeptide
DETEIRTTNPIATECWGATTWANAQDWAEPKGPYI

SEQ ID NO: 197748 - protein, 34 aa, Artificial Sequence
  Description of Artificial Sequence: Synthetic polypeptide
DETEIRTTNPIATECWGATTWANCDWAEPKGPYI

SEQ ID NO: 197749 - protein, 39 aa, Artificial Sequence
  Description of Artificial Sequence: Synthetic polypeptide
DEEEIRTTNPVATEGYGQCVCSNWGEDHNQENFNSDTQS

SEQ ID NO: 197750 - protein, 36 aa, Artificial Sequence
  Description of Artificial Sequence: Synthetic polypeptide
DEAEIRTTNPVATEGWGCVCSWGEENQEYFISETQA

SEQ ID NO: 197751 - protein, 35 aa, Artificial Sequence
  Description of Artificial Sequence: Synthetic polypeptide
DETEIRTTNPIATECWGATVWANAEDWAEFKGPYI

SEQ ID NO: 197752 - protein, 39 aa, Artificial Sequence
  Description of Artificial Sequence: Synthetic polypeptide
DEEEIRTTNPVATEQYGCQSCSNWGEPHNQENFISDTQS

SEQ ID NO: 197753 - protein, 35 aa, Artificial Sequence
  Description of Artificial Sequence: Synthetic polypeptide
DEDEIATTNPVAYEQWGHSACAAANGLDSAEVDDS

SEQ ID NO: 197754 - protein, 39 aa, Artificial Sequence
  Description of Artificial Sequence: Synthetic polypeptide
AEEEIRTTNPVATEQYGQCVCSMWGEDHNQENFNSDTQA

SEQ ID NO: 197755 - protein, 34 aa, Artificial Sequence
  Description of Artificial Sequence: Synthetic polypeptide
DAAEIATTNPVGTAQWGGCSAGNNLATMNPGDHT

SEQ ID NO: 197756 - protein, 34 aa, Artificial Sequence
  Description of Artificial Sequence: Synthetic polypeptide
DETEIRTTNPIATECWGETAWANEEDWAEPKGGI

SEQ ID NO: 197757 - protein, 37 aa, Artificial Sequence
  Description of Artificial Sequence: Synthetic polypeptide
CEEVIACTNPVATEQYGSACSADNPALPAEAPIGDHQ

SEQ ID NO: 197758 - protein, 37 aa, Artificial Sequence
  Description of Artificial Sequence: Synthetic polypeptide
CEEVIACTNPVATEQYGSACATNPTEEAGAHQDGAAP

SEQ ID NO: 197759 - protein, 37 aa, Artificial Sequence
  Description of Artificial Sequence: Synthetic polypeptide
CEEVIACTNPVATEQYGSACATNPQEEAHAHQDGDAP

SEQ ID NO: 197760 - protein, 39 aa, Artificial Sequence
  Description of Artificial Sequence: Synthetic polypeptide
AEEEIRTTNPVATEQYGQCVCSNWGEDDNAENFNSENQA

SEQ ID NO: 197761 - protein, 39 aa, Artificial Sequence
  Description of Artificial Sequence: Synthetic polypeptide
AEEEIRTTNPVATEQYGQCVCSNWGEDHNAEFFNSDTQS

SEQ ID NO: 197762 - protein, 38 aa, Artificial Sequence
  Description of Artificial Sequence: Synthetic polypeptide
DEDEIACTNPVATEQWGHSVSAMWPAGTNQGNGMETVM

SEQ ID NO: 197763 - protein, 39 aa, Artificial Sequence
  Description of Artificial Sequence: Synthetic polypeptide
AEEEIRTTNPVATEQYGQCVCSNWGEDHNAENFNSDNQA

SEQ ID NO: 197764 - protein, 39 aa, Artificial Sequence
  Description of Artificial Sequence: Synthetic polypeptide
AEEEIRTTNPVATEQYGQCVCSNWGEDHNAENFNSDTQA

SEQ ID NO: 197765 - protein, 39 aa, Artificial Sequence
  Description of Artificial Sequence: Synthetic polypeptide
AEEEIRTTNPVATEQYGQCVCSNWGEDHNAENFNSDTQL

SEQ ID NO: 197766 - protein, 39 aa, Artificial Sequence
  Description of Artificial Sequence: Synthetic polypeptide
AEEEIRTTNPVATEQYGQCVCSNWGEDHNAENFNSDTQS

SEQ ID NO: 197767 - protein, 35 aa, Artificial Sequence
  Description of Artificial Sequence: Synthetic polypeptide
DETEIRTTNPIATECWGATTWANAEDWCEPRGPYI

SEQ ID NO: 197768 - protein, 34 aa, Artificial Sequence
  Description of Artificial Sequence: Synthetic polypeptide
DETEIRTTNPIATECWGETTWANEEDWAEPKGGI

SEQ ID NO: 197769 - protein, 38 aa, Artificial Sequence
  Description of Artificial Sequence: Synthetic polypeptide
CEEEIACTNPVATEQYGSACSPVPDGHPLEAAEGFDNN

SEQ ID NO: 197770 - protein, 35 aa, Artificial Sequence
  Description of Artificial Sequence: Synthetic polypeptide
DEAAISTTNPVASLCWGSVSRCINMEPQVTDGEDG

SEQ ID NO: 197771 - protein, 35 aa, Artificial Sequence
  Description of Artificial Sequence: Synthetic polypeptide
DEDEIATTNPVAYEQWGHCNVAANNGDTTDSMNDI

SEQ ID NO: 197772 - protein, 37 aa, Artificial Sequence
  Description of Artificial Sequence: Synthetic polypeptide
CEEEIACTNPVATEQYGSACSPVPDGLPLEAMEGTQQ

SEQ ID NO: 197773 - protein, 36 aa, Artificial Sequence
  Description of Artificial Sequence: Synthetic polypeptide
DETEIRTTNPIATECWGATTWANAEDWQAEPKGNYI

SEQ ID NO: 197774 - protein, 37 aa, Artificial Sequence
  Description of Artificial Sequence: Synthetic polypeptide
SEDEIRTTNPVAYEQWGMVSGPEPANGPNMRNGGGKQ

SEQ ID NO: 197775 - protein, 35 aa, Artificial Sequence
  Description of Artificial Sequence: Synthetic polypeptide
DETEIRTTNPIATECWGAVTWANAEDWAEPKGPYI

SEQ ID NO: 197776 - protein, 35 aa, Artificial Sequence
  Description of Artificial Sequence: Synthetic polypeptide
DETEIRTTNPIATECWGAVTWLNAEDWAEPKGPYI

SEQ ID NO: 197777 - protein, 37 aa, Artificial Sequence
  Description of Artificial Sequence: Synthetic polypeptide
DEDEIATTNPVAYEQWGGSVCSANPASQEHMIDLTAM

SEQ ID NO: 197778 - protein, 37 aa, Artificial Sequence
  Description of Artificial Sequence: Synthetic polypeptide
AEAEISTTNPVATEQYGCVCSNWGEHNQENFPSDNQS

SEQ ID NO: 197779 - protein, 37 aa, Artificial Sequence
  Description of Artificial Sequence: Synthetic polypeptide
AEAEISTTNPVATEQYGCVCSNWMEHNQENFNSENQS

SEQ ID NO: 197780 - protein, 35 aa, Artificial Sequence
  Description of Artificial Sequence: Synthetic polypeptide
DEDEIATTNPVAYEKWGCVATTLGGNTGADQKDTS

SEQ ID NO: 197781 - protein, 39 aa, Artificial Sequence
  Description of Artificial Sequence: Synthetic polypeptide
AEEEIRTTNPVATEQYGQCVCSNWGEDHNAENFNSQTQS

SEQ ID NO: 197782 - protein, 33 aa, Artificial Sequence
  Description of Artificial Sequence: Synthetic polypeptide
DDSEVASTNPVSTEGYGCVGNSTIQENFGSQQA

SEQ ID NO: 197783 - protein, 38 aa, Artificial Sequence
  Description of Artificial Sequence: Synthetic polypeptide
CEEEIACTNPVATEQYGSCAALAGNPLENGMPMENGVH

SEQ ID NO: 197784 - protein, 37 aa, Artificial Sequence
  Description of Artificial Sequence: Synthetic polypeptide
TEECISTTNPVATEQYGCVCSNWGEHNAEYFISDNQS

SEQ ID NO: 197785 - protein, 35 aa, Artificial Sequence
  Description of Artificial Sequence: Synthetic polypeptide
DETEIRTTNPIATECWGCATCQNAEDPAEYSGDNI

SEQ ID NO: 197786 - protein, 38 aa, Artificial Sequence
  Description of Artificial Sequence: Synthetic polypeptide
DEECTCTTNICTTVATEQYGVVSTIATQNGTTIRGEEE

SEQ ID NO: 197787 - protein, 35 aa, Artificial Sequence
  Description of Artificial Sequence: Synthetic polypeptide
DETEIRTTNPIATECWGATTWANAEDWLEPKGPYI

SEQ ID NO: 197788 - protein, 35 aa, Artificial Sequence
  Description of Artificial Sequence: Synthetic polypeptide
DETEIRTTNPIATECWGATTWANAEDWLEPEGPYI

SEQ ID NO: 197789 - protein, 37 aa, Artificial Sequence
  Description of Artificial Sequence: Synthetic polypeptide
TEECISTTNPVATEQYGQCVCSNWGEHNAYFLSDNQS

SEQ ID NO: 197790 - protein, 33 aa, Artificial Sequence
  Description of Artificial Sequence: Synthetic polypeptide
DDSEVASTNPVSTEGYGCVGNSEIQERFGSQQS

SEQ ID NO: 197791 - protein, 34 aa, Artificial Sequence
  Description of Artificial Sequence: Synthetic polypeptide
DENEIRCTNPIATECWGATWANAEDLAEPKGPYI

SEQ ID NO: 197792 - protein, 35 aa, Artificial Sequence
  Description of Artificial Sequence: Synthetic polypeptide
DETEIRTTNPIATECWGATTWANAEDWQDPKGPYI

SEQ ID NO: 197793 - protein, 39 aa, Artificial Sequence
  Description of Artificial Sequence: Synthetic polypeptide
AEEEIRTTNPVATEQYGQCVCSNWGEDHNIENFNSDPQS

SEQ ID NO: 197794 - protein, 39 aa, Artificial Sequence
  Description of Artificial Sequence: Synthetic polypeptide
AEEEIRTTNPVATEQYGQCVCSNWGEGHNQENFNSDTQS

SEQ ID NO: 197795 - protein, 38 aa, Artificial Sequence
  Description of Artificial Sequence: Synthetic polypeptide
MEEEIRTTNPVATEQYGEYMIGSLEVMTAQVEELAEEV

SEQ ID NO: 197796 - protein, 40 aa, Artificial Sequence
  Description of Artificial Sequence: Synthetic polypeptide
DEEEIRTTNPVATEAYGSVVVVVTTNQAGTEAGTVTEEVE

SEQ ID NO: 197797 - protein, 34 aa, Artificial Sequence
  Description of Artificial Sequence: Synthetic polypeptide
DETEIRTTNPIATECWGATTWANAEDWAPKGPYI

SEQ ID NO: 197798 - protein, 34 aa, Artificial Sequence
  Description of Artificial Sequence: Synthetic polypeptide
DETEIRTTNPIATECWGITTWANCDWAESKGTYI

SEQ ID NO: 197799 - protein, 34 aa, Artificial Sequence
  Description of Artificial Sequence: Synthetic polypeptide
DETEIRTTNPIATECWGITTWANCNWAESKGTYI

SEQ ID NO: 197800 - protein, 35 aa, Artificial Sequence
  Description of Artificial Sequence: Synthetic polypeptide
DETEIRTTNPIATECWGATTWANAEDWALPKGPYI

SEQ ID NO: 197801 - protein, 37 aa, Artificial Sequence
  Description of Artificial Sequence: Synthetic polypeptide
AEECISTTNPVATEQYGQCVCSWGEHNAENFNSDNQL

SEQ ID NO: 197802 - protein, 34 aa, Artificial Sequence
  Description of Artificial Sequence: Synthetic polypeptide
DETEIRTTNPIATECWGATTWANAEDWAHKGPYI

SEQ ID NO: 197803 - protein, 37 aa, Artificial Sequence
  Description of Artificial Sequence: Synthetic polypeptide
AEECISTTNPVATEQYGQCVCSWEDHNQENFGSDTQS

SEQ ID NO: 197804 - protein, 33 aa, Artificial Sequence
  Description of Artificial Sequence: Synthetic polypeptide
DDSEVASTNPVSTEGYGCVCQVWTIQERFGSQQ

SEQ ID NO: 197805 - protein, 39 aa, Artificial Sequence
  Description of Artificial Sequence: Synthetic polypeptide
DEEEIRTTNPVATEGYGQCVCSNWGEDHNQENFNSDPQL

SEQ ID NO: 197806 - protein, 36 aa, Artificial Sequence
  Description of Artificial Sequence: Synthetic polypeptide
SSEEIATTNPVAYHSYGSVVQHSVWHSQENGGMNFQ

SEQ ID NO: 197807 - protein, 35 aa, Artificial Sequence
  Description of Artificial Sequence: Synthetic polypeptide
SSEEIATTNPVAYHSYGSVVHNVWHSTENGGINFQ

SEQ ID NO: 197808 - protein, 35 aa, Artificial Sequence
  Description of Artificial Sequence: Synthetic polypeptide
SSEEIATTNPVAYHSWGSVVHSVWHSQENGGINVQ

SEQ ID NO: 197809 - protein, 36 aa, Artificial Sequence
  Description of Artificial Sequence: Synthetic polypeptide
DEAEIATTNPVATCQYGCVCSWGEHNQENFISDTQS

SEQ ID NO: 197810 - protein, 36 aa, Artificial Sequence
  Description of Artificial Sequence: Synthetic polypeptide
MEDEIRGTNCVATEAWGSVSAINGEGGDGEQEEQGN

SEQ ID NO: 197811 - protein, 38 aa, Artificial Sequence
  Description of Artificial Sequence: Synthetic polypeptide
DEAEIRTTNPVAYEQYGQCVCSNWGEHNAENFNSETQA

SEQ ID NO: 197812 - protein, 39 aa, Artificial Sequence
  Description of Artificial Sequence: Synthetic polypeptide
AEEEIRTTNPVATEQYGQCVCSNWMEDHNQENFNSDNQG

SEQ ID NO: 197813 - protein, 35 aa, Artificial Sequence
  Description of Artificial Sequence: Synthetic polypeptide
DETEIRTTNPIATECWGATTWANAEDWAQPKGLYI

SEQ ID NO: 197814 - protein, 39 aa, Artificial Sequence
  Description of Artificial Sequence: Synthetic polypeptide
DEEEIRTTNPVATEGYGQCVCSNWGEDHNQENFNSDTQA

SEQ ID NO: 197815 - protein, 34 aa, Artificial Sequence
  Description of Artificial Sequence: Synthetic polypeptide
DEREIATTNPVAYECWGTVYWINENEDRQMMHVG

SEQ ID NO: 197816 - protein, 37 aa, Artificial Sequence
  Description of Artificial Sequence: Synthetic polypeptide
DEGEIATTNPVATEQYGCVAGNHSGDPAAMHMGEEGF

SEQ ID NO: 197817 - protein, 38 aa, Artificial Sequence
  Description of Artificial Sequence: Synthetic polypeptide
YEDEIRSTNPVATEAYGVVVPDTNFLNRNEGIDGEDGT

SEQ ID NO: 197818 - protein, 35 aa, Artificial Sequence
  Description of Artificial Sequence: Synthetic polypeptide
DESEAATTNPVAYEEWGVVATGGNTGNAGNDNQDK

SEQ ID NO: 197819 - protein, 37 aa, Artificial Sequence
  Description of Artificial Sequence: Synthetic polypeptide
ADEEIRTTNPVATEGYGCVCSNWGEHNAENFGSDTQS

SEQ ID NO: 197820 - protein, 38 aa, Artificial Sequence
  Description of Artificial Sequence: Synthetic polypeptide
MEEEIRTTNPVATEQYGDVTTVMTEGFEGGDEGGQTQT

SEQ ID NO: 197821 - protein, 38 aa, Artificial Sequence
  Description of Artificial Sequence: Synthetic polypeptide
AEEEIRTTNPVATEQYGQCVCSNWGEHNEENFISDFQA

SEQ ID NO: 197822 - protein, 34 aa, Artificial Sequence
  Description of Artificial Sequence: Synthetic polypeptide
DEMEIRTTNPIATECWGATTWANAEDWAPKGPYI

SEQ ID NO: 197823 - protein, 36 aa, Artificial Sequence
  Description of Artificial Sequence: Synthetic polypeptide
DEECLRTTNPCAYEQYGCVCSNWGEHNQNFISDNQS

SEQ ID NO: 197824 - protein, 39 aa, Artificial Sequence
  Description of Artificial Sequence: Synthetic polypeptide
AEEEIRTTNPVATEQYGQCVCSNWGEDHNQENFNSDTQA

SEQ ID NO: 197825 - protein, 40 aa, Artificial Sequence
  Description of Artificial Sequence: Synthetic polypeptide
DEEEIRTTNPVATEAYGSVVVTVTTNQAGTEAGTVTDETE

SEQ ID NO: 197826 - protein, 35 aa, Artificial Sequence
  Description of Artificial Sequence: Synthetic polypeptide
DETEIRTTNPIATECWGATTWANAEDWARPKGPYM

SEQ ID NO: 197827 - protein, 38 aa, Artificial Sequence
  Description of Artificial Sequence: Synthetic polypeptide
DENEIRTTNPVATEIYGSVFDQAVNVNMDDEGGQDQGE

SEQ ID NO: 197828 - protein, 35 aa, Artificial Sequence
  Description of Artificial Sequence: Synthetic polypeptide
DETEIRTTNPIATECWGATTWANAEDWARPKGPYI

SEQ ID NO: 197829 - protein, 35 aa, Artificial Sequence
  Description of Artificial Sequence: Synthetic polypeptide
DEDEIATTNPVAYEAWGVVWPGPNNENDGQMNGDE

SEQ ID NO: 197830 - protein, 40 aa, Artificial Sequence
  Description of Artificial Sequence: Synthetic polypeptide
DEEEIRTTNPVATEAYGSVVVTVVTTQAGTEAGTVTEEVE

SEQ ID NO: 197831 - protein, 37 aa, Artificial Sequence
  Description of Artificial Sequence: Synthetic polypeptide
QAEEIATTNPVAYEQWGSVCSMANPDQPQEHQDGTMK

SEQ ID NO: 197832 - protein, 35 aa, Artificial Sequence
  Description of Artificial Sequence: Synthetic polypeptide
DETEIRTTNPIATECWGATTWANAEDWAQPKGPYI

SEQ ID NO: 197833 - protein, 37 aa, Artificial Sequence
  Description of Artificial Sequence: Synthetic polypeptide
SSEEIRTTNPVATCQYGQCVCSWMEHNQENFGSDTQS

SEQ ID NO: 197834 - protein, 40 aa, Artificial Sequence
  Description of Artificial Sequence: Synthetic polypeptide
DEEEIRTTNPVATEAYGSVVVTVTTNQAGTEQGTVTTEVE

SEQ ID NO: 197835 - protein, 32 aa, Artificial Sequence
  Description of Artificial Sequence: Synthetic polypeptide
EEGEIACTNPCSYEQWGITCYCNDQQDDGDTR

SEQ ID NO: 197836 - protein, 35 aa, Artificial Sequence
  Description of Artificial Sequence: Synthetic polypeptide
DETEIRTTNPIATECWGATYYANEGDQAEKKGDTI

SEQ ID NO: 197837 - protein, 36 aa, Artificial Sequence
  Description of Artificial Sequence: Synthetic polypeptide
DEDEIATTNPVAYEQWGCVSGQGPPQQETPDGSEEN

SEQ ID NO: 197838 - protein, 37 aa, Artificial Sequence
  Description of Artificial Sequence: Synthetic polypeptide
DENCIRTTNPVSTEGYGCICSTWEEDNAENFGSDNQS

SEQ ID NO: 197839 - protein, 37 aa, Artificial Sequence
  Description of Artificial Sequence: Synthetic polypeptide
DEDEIACTNPVATEQWGHSCSAMWPAGTNQGNPMEKV

SEQ ID NO: 197840 - protein, 37 aa, Artificial Sequence
  Description of Artificial Sequence: Synthetic polypeptide
AEEEIRTTNPVATEGYGCSCSNWGEHNAENFSSDTQA

SEQ ID NO: 197841 - protein, 33 aa, Artificial Sequence
  Description of Artificial Sequence: Synthetic polypeptide
DETEIRTTNPIATECWGATWAAAEDWAEPKGPD

SEQ ID NO: 197842 - protein, 36 aa, Artificial Sequence
  Description of Artificial Sequence: Synthetic polypeptide
SEDEIRTTNPVATESWGAVFWNENDDHERQGQDGSV

SEQ ID NO: 197843 - protein, 33 aa, Artificial Sequence
  Description of Artificial Sequence: Synthetic polypeptide
DETEIRTTNPIATECWGATWAAEDWAEPKGPYI

SEQ ID NO: 197844 - protein, 37 aa, Artificial Sequence
  Description of Artificial Sequence: Synthetic polypeptide
AEEEIRTTNPVATEEYGQCSCSWGEHNQEHFISDTQA

SEQ ID NO: 197845 - protein, 37 aa, Artificial Sequence
  Description of Artificial Sequence: Synthetic polypeptide
MEEEIATTNPVAYEGYGCVCSNWGEHNAEGFGSDNQA

SEQ ID NO: 197846 - protein, 34 aa, Artificial Sequence
  Description of Artificial Sequence: Synthetic polypeptide
DETEIRTTNPIATECWGATWANAEDEANPKGPYI

SEQ ID NO: 197847 - protein, 34 aa, Artificial Sequence
  Description of Artificial Sequence: Synthetic polypeptide
DETEIRTTNPIATECWGATWANAEDGAEPKGPYV

SEQ ID NO: 197848 - protein, 35 aa, Artificial Sequence
  Description of Artificial Sequence: Synthetic polypeptide
DEHEIRTTNPIATECWGATTWANAEDWAEPKGPNI

SEQ ID NO: 197849 - protein, 34 aa, Artificial Sequence
  Description of Artificial Sequence: Synthetic polypeptide
DETEIRTTNPIATECWGATWANAEDWAEHKGDYI

SEQ ID NO: 197850 - protein, 34 aa, Artificial Sequence
  Description of Artificial Sequence: Synthetic polypeptide
DETEIRTTNPIATECWGATWANAEDWAEHKGPYI

SEQ ID NO: 197851 - protein, 38 aa, Artificial Sequence
  Description of Artificial Sequence: Synthetic polypeptide
AEEEIRTTNPVATEEYGICSCSNWGEHNQENFNSDTQA

SEQ ID NO: 197852 - protein, 34 aa, Artificial Sequence
  Description of Artificial Sequence: Synthetic polypeptide
DETEIRTTNPIATECWGATWANAEDWAEPKGDYI

SEQ ID NO: 197853 - protein, 38 aa, Artificial Sequence
  Description of Artificial Sequence: Synthetic polypeptide
DEAEIRTTNPVAYEQYGQCVCSNWGEHNAENFNSDNQS

SEQ ID NO: 197854 - protein, 36 aa, Artificial Sequence
  Description of Artificial Sequence: Synthetic polypeptide
DEAVEATTNPVAYEQWGCVYSVNNDAGEQGGTNEMN

SEQ ID NO: 197855 - protein, 37 aa, Artificial Sequence
  Description of Artificial Sequence: Synthetic polypeptide
SSNEIRTTNPVATEQYGTVYNSYDLMGMHQELQDDTQ

SEQ ID NO: 197856 - protein, 38 aa, Artificial Sequence
  Description of Artificial Sequence: Synthetic polypeptide
AEEEIRTTNPVATEGYGCVCSDWGEDHNQENFSSDNQS

SEQ ID NO: 197857 - protein, 38 aa, Artificial Sequence
  Description of Artificial Sequence: Synthetic polypeptide
AEEEIRTTNPVATEGYGCVCSNWGEDHNAEFFNSDTQS

SEQ ID NO: 197858 - protein, 38 aa, Artificial Sequence
  Description of Artificial Sequence: Synthetic polypeptide
AEEEIRTTNPVATEGYGCVCSNWGEDHNAENFNSDNQS

SEQ ID NO: 197859 - protein, 38 aa, Artificial Sequence
  Description of Artificial Sequence: Synthetic polypeptide
DEDEIATTNPVAYEPQWGCSAAGSTGHGVNHQGDNAEP

SEQ ID NO: 197860 - protein, 38 aa, Artificial Sequence
  Description of Artificial Sequence: Synthetic polypeptide
MEEEIKTTNPVATEQYGDVVVVDIGNLTDGGQGTTTTD

SEQ ID NO: 197861 - protein, 35 aa, Artificial Sequence
  Description of Artificial Sequence: Synthetic polypeptide
DETEIRTTNPIATECWGATVWANAEDWAEPKGPYC

SEQ ID NO: 197862 - protein, 36 aa, Artificial Sequence
  Description of Artificial Sequence: Synthetic polypeptide
SSSEISTTNPVATEQYGAVAVVATVNHIEGEEDQEA

SEQ ID NO: 197863 - protein, 34 aa, Artificial Sequence
  Description of Artificial Sequence: Synthetic polypeptide
DETEIRTTNPIATECWGATTWANAEGWAEFKGPI

SEQ ID NO: 197864 - protein, 37 aa, Artificial Sequence
  Description of Artificial Sequence: Synthetic polypeptide
DEECISCTNPVATEQYGCVCSMSGEDNAEGFNSDTQA

SEQ ID NO: 197865 - protein, 35 aa, Artificial Sequence
  Description of Artificial Sequence: Synthetic polypeptide
DETEIRTTNPIATECWGATVWANAEDWAEPKGPYI

SEQ ID NO: 197866 - protein, 35 aa, Artificial Sequence
  Description of Artificial Sequence: Synthetic polypeptide
DETEIRTTNPIATECWGATVWANAEDWAEPKGTYI

SEQ ID NO: 197867 - protein, 34 aa, Artificial Sequence
  Description of Artificial Sequence: Synthetic polypeptide
DETEIRTTNPIATECWGATWANAEDWAEPKGPDL

SEQ ID NO: 197868 - protein, 38 aa, Artificial Sequence
  Description of Artificial Sequence: Synthetic polypeptide
DEEEIRTTNPVAYEQYGCVCSNWGEDHNAENFISDTQS

SEQ ID NO: 197869 - protein, 37 aa, Artificial Sequence
  Description of Artificial Sequence: Synthetic polypeptide
AEAEISTTNPVATEQYGCVCSNWGEHNAENFNSDTQA

SEQ ID NO: 197870 - protein, 35 aa, Artificial Sequence
  Description of Artificial Sequence: Synthetic polypeptide
DEHEIATTNPVAYEPYGHNVVAAAGHMGDREMGMP

SEQ ID NO: 197871 - protein, 37 aa, Artificial Sequence
  Description of Artificial Sequence: Synthetic polypeptide
DEECLRTTNPCAYEQYGQCVCSWGEHNAENFGSDNQS

SEQ ID NO: 197872 - protein, 35 aa, Artificial Sequence
  Description of Artificial Sequence: Synthetic polypeptide
DETEIRTTNPIATECWGATVWANCENEAEPKGPYG

SEQ ID NO: 197873 - protein, 37 aa, Artificial Sequence
  Description of Artificial Sequence: Synthetic polypeptide
SSSEIRTTNPVATEQYGASAVVAEVNHIEETGTEKQE

SEQ ID NO: 197874 - protein, 35 aa, Artificial Sequence
  Description of Artificial Sequence: Synthetic polypeptide
DETEIRTTNPIATECWGATTWANAEEWAEPKGPYR

SEQ ID NO: 197875 - protein, 37 aa, Artificial Sequence
  Description of Artificial Sequence: Synthetic polypeptide
AEAEISTTNPVATEQYGCVCSNWGEHNAENFNSDTQP

SEQ ID NO: 197876 - protein, 38 aa, Artificial Sequence
  Description of Artificial Sequence: Synthetic polypeptide
AEEEIRTTNPVATEGYGCVCSNWGEDHNAENFNSENQA

SEQ ID NO: 197877 - protein, 32 aa, Artificial Sequence
  Description of Artificial Sequence: Synthetic polypeptide
DDSEVASTNPVSTEGYGCVQNWTIQEGSGSQQ

SEQ ID NO: 197878 - protein, 35 aa, Artificial Sequence
  Description of Artificial Sequence: Synthetic polypeptide
DETEIRTTNPIATECWGATYYANEEDQAEKKGPTE

SEQ ID NO: 197879 - protein, 34 aa, Artificial Sequence
  Description of Artificial Sequence: Synthetic polypeptide
DETEIRTTNPIATECWGATWANAEDWAEPKGPYI

SEQ ID NO: 197880 - protein, 34 aa, Artificial Sequence
  Description of Artificial Sequence: Synthetic polypeptide
DETEIRTTNPIATECWGATWANAEDWAEPKGPYV

SEQ ID NO: 197881 - protein, 35 aa, Artificial Sequence
  Description of Artificial Sequence: Synthetic polypeptide
DEMEIRTTNPIATECYGTTCANADGWVEEPEGPYD

SEQ ID NO: 197882 - protein, 34 aa, Artificial Sequence
  Description of Artificial Sequence: Synthetic polypeptide
DETEIRTTNPIATECWGATWPNAEDWAEPKGPYI

SEQ ID NO: 197883 - protein, 35 aa, Artificial Sequence
  Description of Artificial Sequence: Synthetic polypeptide
DETEIRTTNPIATECWGATWSNAEDWQAEPKGPYI

SEQ ID NO: 197884 - protein, 34 aa, Artificial Sequence
  Description of Artificial Sequence: Synthetic polypeptide
DETEIRTTNPIATECWGATWSNAEIWAEPKGPYA

SEQ ID NO: 197885 - protein, 34 aa, Artificial Sequence
  Description of Artificial Sequence: Synthetic polypeptide
DETEIRTTNPIATECWGATWSNAEIWAEPKGPYI

SEQ ID NO: 197886 - protein, 37 aa, Artificial Sequence
  Description of Artificial Sequence: Synthetic polypeptide
DENEIRATNPVAYEQYGVTVTTVWLPDEQENMQIDEH

SEQ ID NO: 197887 - protein, 34 aa, Artificial Sequence
  Description of Artificial Sequence: Synthetic polypeptide
DETEIRTTNPIATECWGATWSNAIDWAEPKGPYG

SEQ ID NO: 197888 - protein, 38 aa, Artificial Sequence
  Description of Artificial Sequence: Synthetic polypeptide
MEEEIATTNPVATEQYGCVCSNWGEDPNAEGFNSDTQA

SEQ ID NO: 197889 - protein, 34 aa, Artificial Sequence
  Description of Artificial Sequence: Synthetic polypeptide
DETEIRTTNPIATECWGATWSNEEDWAEPKGPYI

SEQ ID NO: 197890 - protein, 38 aa, Artificial Sequence
  Description of Artificial Sequence: Synthetic polypeptide
MEEEIATTNPVATEQYGCVCSNWGEDDNAENFGSDTQA

SEQ ID NO: 197891 - protein, 35 aa, Artificial Sequence
  Description of Artificial Sequence: Synthetic polypeptide
DETEIRTTNPIATECWGATTWANAEDWREPKGYYI

SEQ ID NO: 197892 - protein, 35 aa, Artificial Sequence
  Description of Artificial Sequence: Synthetic polypeptide
DETEIRTTNPIATECWGATTWANAEDWREPKGPYI

SEQ ID NO: 197893 - protein, 35 aa, Artificial Sequence
  Description of Artificial Sequence: Synthetic polypeptide
DETEIRTTNPIATECWGATTWANAEDWQEPKGPYI

SEQ ID NO: 197894 - protein, 37 aa, Artificial Sequence
  Description of Artificial Sequence: Synthetic polypeptide
AEAEISTTNPVATEQYGCVCSNWGEHNAENFNSENQI

SEQ ID NO: 197895 - protein, 37 aa, Artificial Sequence
  Description of Artificial Sequence: Synthetic polypeptide
AEAEISTTNPVATEQYGCVCSNWGEHNIENFNSDNQS

SEQ ID NO: 197896 - protein, 35 aa, Artificial Sequence
  Description of Artificial Sequence: Synthetic polypeptide
DETEIRTTNPIATECWGATYWDNVEDRHEPKGDYM

SEQ ID NO: 197897 - protein, 36 aa, Artificial Sequence
  Description of Artificial Sequence: Synthetic polypeptide
CEEVIACTNPVATEQYGSVCAAGPLGFATPGDLAAM

SEQ ID NO: 197898 - protein, 35 aa, Artificial Sequence
  Description of Artificial Sequence: Synthetic polypeptide
DETEIRTTNPIATECWGATWATTPDGPAEPKGNYV

SEQ ID NO: 197899 - protein, 35 aa, Artificial Sequence
  Description of Artificial Sequence: Synthetic polypeptide
DETEIRTTNPIATECWGATWATTPDGPAEPKGNYI

SEQ ID NO: 197900 - protein, 35 aa, Artificial Sequence
  Description of Artificial Sequence: Synthetic polypeptide
DETEIRTTNPIATECWGATWATTPDGPAEPKGNPV

SEQ ID NO: 197901 - protein, 35 aa, Artificial Sequence
  Description of Artificial Sequence: Synthetic polypeptide
DETEIRTTNPIATECWGATWATTEDWPAEPKGNYI

SEQ ID NO: 197902 - protein, 35 aa, Artificial Sequence
  Description of Artificial Sequence: Synthetic polypeptide
DEACIGTTNPVAYEQWGCVCSWEDDNQEYFGSDQS

SEQ ID NO: 197903 - protein, 36 aa, Artificial Sequence
  Description of Artificial Sequence: Synthetic polypeptide
QAEEIATTNPVAYAPWGSSASGTGNPQNGNPTEGAA

SEQ ID NO: 197904 - protein, 35 aa, Artificial Sequence
  Description of Artificial Sequence: Synthetic polypeptide
DEDEIATTNPVAYEQWGCVAGEGPGNNAGNPNEHP

SEQ ID NO: 197905 - protein, 39 aa, Artificial Sequence
  Description of Artificial Sequence: Synthetic polypeptide
DENEIRTTNPVATEIYGSVNDDQTVNVNMDDEGGQDQGE

SEQ ID NO: 197906 - protein, 34 aa, Artificial Sequence
  Description of Artificial Sequence: Synthetic polypeptide
DETEIRTTNPIATECWGATWANAEDWASPKGPYI

SEQ ID NO: 197907 - protein, 34 aa, Artificial Sequence
  Description of Artificial Sequence: Synthetic polypeptide
DETEIRTTNPIATECWGATWANAETWAEPKGDYI

SEQ ID NO: 197908 - protein, 34 aa, Artificial Sequence
  Description of Artificial Sequence: Synthetic polypeptide
DETEIRTTNPIATECWGATWANAETWAEPKGPYI

SEQ ID NO: 197909 - protein, 34 aa, Artificial Sequence
  Description of Artificial Sequence: Synthetic polypeptide
DETEIRTTNPIATECWGATWANAIDWAEPEGPYI

SEQ ID NO: 197910 - protein, 34 aa, Artificial Sequence
  Description of Artificial Sequence: Synthetic polypeptide
DETEIRTTNPIATECWGATWANAEDWAEPKGPYL

SEQ ID NO: 197911 - protein, 34 aa, Artificial Sequence
  Description of Artificial Sequence: Synthetic polypeptide
DETEIRTTNPIATECWGATWANAIDWAEPKGPYG

SEQ ID NO: 197912 - protein, 34 aa, Artificial Sequence
  Description of Artificial Sequence: Synthetic polypeptide
DETEIRTTNPIATECWGATWANEEDEANPKEPYI

SEQ ID NO: 197913 - protein, 34 aa, Artificial Sequence
  Description of Artificial Sequence: Synthetic polypeptide
DETEIRTTNPIATECWGATWANEEDEANPKGPYI

SEQ ID NO: 197914 - protein, 34 aa, Artificial Sequence
  Description of Artificial Sequence: Synthetic polypeptide
DETEIRTTNPIATECWGATWANNEDWASPKGPYI

SEQ ID NO: 197915 - protein, 35 aa, Artificial Sequence
  Description of Artificial Sequence: Synthetic polypeptide
DEDEIATTNPVAYEQWGCVAGEGPGNNAGTPNQDP

SEQ ID NO: 197916 - protein, 35 aa, Artificial Sequence
  Description of Artificial Sequence: Synthetic polypeptide
DETEIRTTNPIATECWGATWANTEDWPAEPKGNYI

SEQ ID NO: 197917 - protein, 34 aa, Artificial Sequence
  Description of Artificial Sequence: Synthetic polypeptide
DETEIRTTNPIATECWGATWATAEDGAEPKGPYV

SEQ ID NO: 197918 - protein, 34 aa, Artificial Sequence
  Description of Artificial Sequence: Synthetic polypeptide
DETEIRTTNPIATECWGATWATTEDGAEPKGPYV

SEQ ID NO: 197919 - protein, 35 aa, Artificial Sequence
  Description of Artificial Sequence: Synthetic polypeptide
DETEIRTTNPIATECWGATWATTEDGPAEPKGNYI

SEQ ID NO: 197920 - protein, 34 aa, Artificial Sequence
  Description of Artificial Sequence: Synthetic polypeptide
DETEIRTTNPIATECWGATWANDEDWAEPKGPYI

SEQ ID NO: 197921 - protein, 35 aa, Artificial Sequence
  Description of Artificial Sequence: Synthetic polypeptide
DETEIRTTNPISTEPWGTTTSNAEDIQAQPKGNYH

SEQ ID NO: 197922 - protein, 37 aa, Artificial Sequence
  Description of Artificial Sequence: Synthetic polypeptide
DESEIRTTNPVATEGWGCVCSWGEDENQEYFNSNTQS

SEQ ID NO: 197923 - protein, 35 aa, Artificial Sequence
  Description of Artificial Sequence: Synthetic polypeptide
SESVIRTTNPVAYEQWGCYVGEQQNDQDGGQKQGN

SEQ ID NO: 197924 - protein, 36 aa, Artificial Sequence
  Description of Artificial Sequence: Synthetic polypeptide
DCEEIRATNPVAYEQWGSSYYQDEHMHQRREDINAW

SEQ ID NO: 197925 - protein, 37 aa, Artificial Sequence
  Description of Artificial Sequence: Synthetic polypeptide
QAEEIATTNPVATEQYGSACAANNGPEADMPMGEMRD

SEQ ID NO: 197926 - protein, 37 aa, Artificial Sequence
  Description of Artificial Sequence: Synthetic polypeptide
QAEEIATTNPVATEQYGSACAANNGPEADMPGGNMNH

SEQ ID NO: 197927 - protein, 35 aa, Artificial Sequence
  Description of Artificial Sequence: Synthetic polypeptide
DETEIRTTNPIATECWGASTWANAEDWAEPKGPYI

SEQ ID NO: 197928 - protein, 35 aa, Artificial Sequence
  Description of Artificial Sequence: Synthetic polypeptide
DETEIRTTNPIATECWGAQTWANAEQWAEPKGPYI

SEQ ID NO: 197929 - protein, 33 aa, Artificial Sequence
  Description of Artificial Sequence: Synthetic polypeptide
SENEIATTNPVSTEPYGVCYCEDGQQQQNGLEH

SEQ ID NO: 197930 - protein, 34 aa, Artificial Sequence
  Description of Artificial Sequence: Synthetic polypeptide
DDSEVASTNPVSTEGYGNVAANPTYQSDVGSQTR

SEQ ID NO: 197931 - protein, 36 aa, Artificial Sequence
  Description of Artificial Sequence: Synthetic polypeptide
DETEIRTTNPIATECWGANTWANAIDQAENMGVPNI

SEQ ID NO: 197932 - protein, 34 aa, Artificial Sequence
  Description of Artificial Sequence: Synthetic polypeptide
SENEIATTNPVAYEGYGCVCSWGEHNQHFISELA

SEQ ID NO: 197933 - protein, 35 aa, Artificial Sequence
  Description of Artificial Sequence: Synthetic polypeptide
SENEIATTNPVAYEGYGCVCSWGEHNAHFISENQA

SEQ ID NO: 197934 - protein, 35 aa, Artificial Sequence
  Description of Artificial Sequence: Synthetic polypeptide
DETEIRTTNPIATECWGANTWANAEDQAENMGPGI

SEQ ID NO: 197935 - protein, 35 aa, Artificial Sequence
  Description of Artificial Sequence: Synthetic polypeptide
DETEIRTTNPIATECWGANTVANAEDQTENMGPYI

SEQ ID NO: 197936 - protein, 39 aa, Artificial Sequence
  Description of Artificial Sequence: Synthetic polypeptide
VEEEIRTTNPVATEGYGVVDVGVGTGNVDEEEGEGNDTG

SEQ ID NO: 197937 - protein, 36 aa, Artificial Sequence
  Description of Artificial Sequence: Synthetic polypeptide
SENEIATTNPVATEGYGQCVCSWGEHNQHFISENQA

SEQ ID NO: 197938 - protein, 37 aa, Artificial Sequence
  Description of Artificial Sequence: Synthetic polypeptide
QAEEIATTNPVATEQYGSACAANNGPEADMPGGDMRE

SEQ ID NO: 197939 - protein, 34 aa, Artificial Sequence
  Description of Artificial Sequence: Synthetic polypeptide
DETEIRTTNPIATECWGAITWANAEDWAPKGPYI

SEQ ID NO: 197940 - protein, 35 aa, Artificial Sequence
  Description of Artificial Sequence: Synthetic polypeptide
DETEIRTTNPIATECWGAITWANAEDWAEPRGPYI

SEQ ID NO: 197941 - protein, 33 aa, Artificial Sequence
  Description of Artificial Sequence: Synthetic polypeptide
DETEIRTTNPIATECWGATANAEDWAEPKGPYI

SEQ ID NO: 197942 - protein, 36 aa, Artificial Sequence
  Description of Artificial Sequence: Synthetic polypeptide
DEAEISTTNPCSYEQWGSCYTIDNHRQNGGGKTGTR

SEQ ID NO: 197943 - protein, 36 aa, Artificial Sequence
  Description of Artificial Sequence: Synthetic polypeptide
QENEIATTNPVAYEPYGNTVSGEHLNQNHGMEMWLN

SEQ ID NO: 197944 - protein, 34 aa, Artificial Sequence
  Description of Artificial Sequence: Synthetic polypeptide
DDSEVASTNPVSTEGYGCVCANSTHQERFGSQQM

SEQ ID NO: 197945 - protein, 37 aa, Artificial Sequence
  Description of Artificial Sequence: Synthetic polypeptide
DEACIRTTNPVATEQYGCVCENWGEHNAEYFNSDTQS

SEQ ID NO: 197946 - protein, 36 aa, Artificial Sequence
  Description of Artificial Sequence: Synthetic polypeptide
DEDEIATTNPVAYEQWGTTACAATAGEDPDSGSNRY

SEQ ID NO: 197947 - protein, 36 aa, Artificial Sequence
  Description of Artificial Sequence: Synthetic polypeptide
DEDEIATTNPVAYEQWGTTACAATAGELPDSGPNKT

SEQ ID NO: 197948 - protein, 38 aa, Artificial Sequence
  Description of Artificial Sequence: Synthetic polypeptide
DEEEISTTNPVATEQYGCVCSNWEEDHNAENFISDTQA

SEQ ID NO: 197949 - protein, 37 aa, Artificial Sequence
  Description of Artificial Sequence: Synthetic polypeptide
DEDEIATTNPVAYEQWGTTACAATAGELPDSGSNMRS

SEQ ID NO: 197950 - protein, 39 aa, Artificial Sequence
  Description of Artificial Sequence: Synthetic polypeptide
DEEEISTTNPVATEQYGQCVCSNWEEDDNTENFGSETQS

SEQ ID NO: 197951 - protein, 39 aa, Artificial Sequence
  Description of Artificial Sequence: Synthetic polypeptide
DEEEISTTNPVATEQYGQCVCSNWEEDHNAEGFISDNQF

SEQ ID NO: 197952 - protein, 36 aa, Artificial Sequence
  Description of Artificial Sequence: Synthetic polypeptide
DEAEISTTNGVAYCQYGCVCSTWGEHNQNFGSDTQA

SEQ ID NO: 197953 - protein, 39 aa, Artificial Sequence
  Description of Artificial Sequence: Synthetic polypeptide
DEEEISTTNPVATEQYGQCVCSNWEEDHNAENFISDNQA

SEQ ID NO: 197954 - protein, 33 aa, Artificial Sequence
  Description of Artificial Sequence: Synthetic polypeptide
DETEIRTTNPIATECWGATANEEDEANPKEPYI

SEQ ID NO: 197955 - protein, 39 aa, Artificial Sequence
  Description of Artificial Sequence: Synthetic polypeptide
DEEEISTTNPVATEQYGQCVCSNWEEDHNAENFNSDTQP

SEQ ID NO: 197956 - protein, 39 aa, Artificial Sequence
  Description of Artificial Sequence: Synthetic polypeptide
DEEEISTTNPVATEQYGQCVCSNWEEDHNAENFNSQTAS

SEQ ID NO: 197957 - protein, 39 aa, Artificial Sequence
  Description of Artificial Sequence: Synthetic polypeptide
DEEEISTTNPVATEQYGQCVCSNWEEDHNAEYFNSDTQA

SEQ ID NO: 197958 - protein, 39 aa, Artificial Sequence
  Description of Artificial Sequence: Synthetic polypeptide
DEEEISTTNPVATEQYGQCVCSNWEEDHNQEHFNSDPQG

SEQ ID NO: 197959 - protein, 39 aa, Artificial Sequence
  Description of Artificial Sequence: Synthetic polypeptide
DEEEIRTTNPVATEGYGQCVCSNSGEEDNAENFNSDNQS

SEQ ID NO: 197960 - protein, 39 aa, Artificial Sequence
  Description of Artificial Sequence: Synthetic polypeptide
DEEEISTTNPVATEQYGQCVCSNWEEDHNQEYFNSDNQD

SEQ ID NO: 197961 - protein, 39 aa, Artificial Sequence
  Description of Artificial Sequence: Synthetic polypeptide
DETEIRTTNPVATESYGSVVNDNNNMDSNNMTEGEFGQE

SEQ ID NO: 197962 - protein, 38 aa, Artificial Sequence
  Description of Artificial Sequence: Synthetic polypeptide
DEEEISTTNPVATEQYGQCVCSNWEEHNAENFISDTQN

SEQ ID NO: 197963 - protein, 35 aa, Artificial Sequence
  Description of Artificial Sequence: Synthetic polypeptide
SENEIATTNPVATEGYGCVCSWMEHNQHFISDTQA

SEQ ID NO: 197964 - protein, 35 aa, Artificial Sequence
  Description of Artificial Sequence: Synthetic polypeptide
SENEIATTNPVATEGYGCVCSWGEEHNAHFISEQA

SEQ ID NO: 197965 - protein, 36 aa, Artificial Sequence
  Description of Artificial Sequence: Synthetic polypeptide
SENEIATTNPVATEGYGCVCSWGEDNQEYFISENQA

SEQ ID NO: 197966 - protein, 38 aa, Artificial Sequence
  Description of Artificial Sequence: Synthetic polypeptide
CEEEISTTNPVATEQYGCVCSNWGEDHNAEYFNSDNQS

SEQ ID NO: 197967 - protein, 37 aa, Artificial Sequence
  Description of Artificial Sequence: Synthetic polypeptide
DEECISTTNPVAYEQYGCVCSWGEDHNAENFNSENQA

SEQ ID NO: 197968 - protein, 35 aa, Artificial Sequence
  Description of Artificial Sequence: Synthetic polypeptide
DETEIRTTNPVAYEAWGETVTGGNAGEHNGDAQPG

SEQ ID NO: 197969 - protein, 36 aa, Artificial Sequence
  Description of Artificial Sequence: Synthetic polypeptide
DEDEIRTTNPVATEQWGCCAGAGAHPGDLHPDDKNE

SEQ ID NO: 197970 - protein, 38 aa, Artificial Sequence
  Description of Artificial Sequence: Synthetic polypeptide
CEEEISTTNPVATEQYGCVCSNWGEDHNAEHSNSETQS

SEQ ID NO: 197971 - protein, 37 aa, Artificial Sequence
  Description of Artificial Sequence: Synthetic polypeptide
DECELCTVNPVATEPYGTVAWTENDQHMQQKGGGDHR

SEQ ID NO: 197972 - protein, 36 aa, Artificial Sequence
  Description of Artificial Sequence: Synthetic polypeptide
QEHEIRTTNPCCYEPYGVVVACDPNHSQNRQGGGND

SEQ ID NO: 197973 - protein, 38 aa, Artificial Sequence
  Description of Artificial Sequence: Synthetic polypeptide
TEEEIRTTNPVATEQYGCVCGNWGEDHNAEYFGSDTQS

SEQ ID NO: 197974 - protein, 38 aa, Artificial Sequence
  Description of Artificial Sequence: Synthetic polypeptide
CEDEIATTNPVATEQYGSVCAMNNGEPTNPDDQGEHTM

SEQ ID NO: 197975 - protein, 39 aa, Artificial Sequence
  Description of Artificial Sequence: Synthetic polypeptide
DEEEISTTNPVATEQYGQCVCSNWGEAHNAEGFNSDNQS

SEQ ID NO: 197976 - protein, 39 aa, Artificial Sequence
  Description of Artificial Sequence: Synthetic polypeptide
DEEEISTTNPVATEQYGQCVCSNWGEAHNIEHFNSEFQA

SEQ ID NO: 197977 - protein, 39 aa, Artificial Sequence
  Description of Artificial Sequence: Synthetic polypeptide
DEEEISTTNPVATEQYGQCVCSNWGEDDNAEGFNSDNQS

SEQ ID NO: 197978 - protein, 39 aa, Artificial Sequence
  Description of Artificial Sequence: Synthetic polypeptide
DEEEISTTNPVATEQYGQCVCSNWGEDDNAEHFNSDNQS

SEQ ID NO: 197979 - protein, 39 aa, Artificial Sequence
  Description of Artificial Sequence: Synthetic polypeptide
DEEEISTTNPVATEQYGQCVCSNWGEDDNAENFNSDFQL

SEQ ID NO: 197980 - protein, 39 aa, Artificial Sequence
  Description of Artificial Sequence: Synthetic polypeptide
DEEEISTTNPVATEQYGQCVCSNWGEDDNAENFNSDNQQ

SEQ ID NO: 197981 - protein, 37 aa, Artificial Sequence
  Description of Artificial Sequence: Synthetic polypeptide
DEAEIATTNPVATEQYGSVCAAMAHDEAGMPPDSPVH

SEQ ID NO: 197982 - protein, 34 aa, Artificial Sequence
  Description of Artificial Sequence: Synthetic polypeptide
SENEIACTNPVATEGYGCVCSWEHNQEHFISEQA

SEQ ID NO: 197983 - protein, 35 aa, Artificial Sequence
  Description of Artificial Sequence: Synthetic polypeptide
SENEIATTNPVATEGYGCQVCSWEHNAEHFISEQA

SEQ ID NO: 197984 - protein, 36 aa, Artificial Sequence
  Description of Artificial Sequence: Synthetic polypeptide
SENEIATTNPVATEGYGCVCGNWGEHNQHFISENQA

SEQ ID NO: 197985 - protein, 37 aa, Artificial Sequence
  Description of Artificial Sequence: Synthetic polypeptide
DEEEIACTNPVATEQYGSVCAAIEHIDAGDPLDEDAE

SEQ ID NO: 197986 - protein, 35 aa, Artificial Sequence
  Description of Artificial Sequence: Synthetic polypeptide
SENEIATTNPVATEGYGCVCSDWEHNQHFISETQA

SEQ ID NO: 197987 - protein, 38 aa, Artificial Sequence
  Description of Artificial Sequence: Synthetic polypeptide
HEQEIRTTNPVATEQWGCQWTSAVSALNPNIDESTQYR

SEQ ID NO: 197988 - protein, 36 aa, Artificial Sequence
  Description of Artificial Sequence: Synthetic polypeptide
SENEIATTNPVATEGYGCVCSWGEDNAEHFISENQS

SEQ ID NO: 197989 - protein, 35 aa, Artificial Sequence
  Description of Artificial Sequence: Synthetic polypeptide
DETEIRTTNPIATECWGAGTWANAEDWLEPKGPYI

SEQ ID NO: 197990 - protein, 35 aa, Artificial Sequence
  Description of Artificial Sequence: Synthetic polypeptide
DEAAIRTTNPVAVACWGSVSRCINNEPDVTDGEGL

SEQ ID NO: 197991 - protein, 35 aa, Artificial Sequence
  Description of Artificial Sequence: Synthetic polypeptide
SENEIATTNPVATEGYGCVCSWEEPDNQHFISEQA

SEQ ID NO: 197992 - protein, 35 aa, Artificial Sequence
  Description of Artificial Sequence: Synthetic polypeptide
SENEIATTNPVATEGYGCVCSWEEDNTHFISETQA

SEQ ID NO: 197993 - protein, 35 aa, Artificial Sequence
  Description of Artificial Sequence: Synthetic polypeptide
SENEIATTNPVATEGYGCVCSWEEDNIEHFISEQA

SEQ ID NO: 197994 - protein, 38 aa, Artificial Sequence
  Description of Artificial Sequence: Synthetic polypeptide
DEAAIRTTNPVATEQYGQCVCSNWGEHNAENFNSDNQA

SEQ ID NO: 197995 - protein, 38 aa, Artificial Sequence
  Description of Artificial Sequence: Synthetic polypeptide
DEEEISTTNPVATEQYGCVCSNWEEDHNQEHFISDTQS

SEQ ID NO: 197996 - protein, 38 aa, Artificial Sequence
  Description of Artificial Sequence: Synthetic polypeptide
AEEEIRTTNPCATEQYGVVVTVVTTQQNATEAGTTDEQ

SEQ ID NO: 197997 - protein, 37 aa, Artificial Sequence
  Description of Artificial Sequence: Synthetic polypeptide
DEAEISTTNPVATEEYGCVCSNWGEHNQENFNSDNQA

SEQ ID NO: 197998 - protein, 36 aa, Artificial Sequence
  Description of Artificial Sequence: Synthetic polypeptide
NEREIRTTNPVAYEQYGCVCQWGEHNAENFNSDTQS

SEQ ID NO: 197999 - protein, 33 aa, Artificial Sequence
  Description of Artificial Sequence: Synthetic polypeptide
DDSEVASTNPVSTEGYGNVAANTDIDESQVGQQ

SEQ ID NO: 198000 - protein, 38 aa, Artificial Sequence
  Description of Artificial Sequence: Synthetic polypeptide
DEAEISTTNPVATEEYGQCVCSMWGEHNQENFGSENQS

SEQ ID NO: 198001 - protein, 38 aa, Artificial Sequence
  Description of Artificial Sequence: Synthetic polypeptide
AEEEIRTTNPCATEQYGVVVTTVVTNQNATEAGTTDTS

SEQ ID NO: 198002 - protein, 35 aa, Artificial Sequence
  Description of Artificial Sequence: Synthetic polypeptide
SENEIATTNPVATEGYGCVCSNWEHNAHFSSETQA

SEQ ID NO: 198003 - protein, 37 aa, Artificial Sequence
  Description of Artificial Sequence: Synthetic polypeptide
QAEEIATTNPVATEQYGSACAANNGPEADMPAGNMPW

SEQ ID NO: 198004 - protein, 35 aa, Artificial Sequence
  Description of Artificial Sequence: Synthetic polypeptide
QENEIATTNPVAYEPYGNTVSGEHANQHGMEMQLN

SEQ ID NO: 198005 - protein, 35 aa, Artificial Sequence
  Description of Artificial Sequence: Synthetic polypeptide
AENEISTTNPVATEGYGCVCSWGEDNAHFISETQA

SEQ ID NO: 198006 - protein, 37 aa, Artificial Sequence
  Description of Artificial Sequence: Synthetic polypeptide
DEACIRTTNPVATEQYGCVCENWGEDNQEYFISDTQS

SEQ ID NO: 198007 - protein, 36 aa, Artificial Sequence
  Description of Artificial Sequence: Synthetic polypeptide
DEDEIATTNPVAYEQWGTNCAATAGELPDSMGPNGK

SEQ ID NO: 198008 - protein, 36 aa, Artificial Sequence
  Description of Artificial Sequence: Synthetic polypeptide
QENEIRGTNPVATEFYGVVYTDQGQDQTEEGGQGGI

SEQ ID NO: 198009 - protein, 35 aa, Artificial Sequence
  Description of Artificial Sequence: Synthetic polypeptide
DETEIRTTNPIATECWGATSWANAEDWAEPKGPYI

SEQ ID NO: 198010 - protein, 35 aa, Artificial Sequence
  Description of Artificial Sequence: Synthetic polypeptide
DETEIRTTNPIATECWGATSWANAEDWAEAKGPYI

SEQ ID NO: 198011 - protein, 35 aa, Artificial Sequence
  Description of Artificial Sequence: Synthetic polypeptide
DETEIRTTNPIATECWGATSWANAEDHAEPKGPYI

SEQ ID NO: 198012 - protein, 35 aa, Artificial Sequence
  Description of Artificial Sequence: Synthetic polypeptide
DEAEIATTNPIAYEQWGSIVPTWWDQHEHDQHTKT

SEQ ID NO: 198013 - protein, 36 aa, Artificial Sequence
  Description of Artificial Sequence: Synthetic polypeptide
DEGEIATTNPVAYEQWGCVAGNTGPSIATAGGQNGQ

SEQ ID NO: 198014 - protein, 32 aa, Artificial Sequence
  Description of Artificial Sequence: Synthetic polypeptide
QEHEIASTNPCSYEQWGITCYCNDQQATGDTR

SEQ ID NO: 198015 - protein, 37 aa, Artificial Sequence
  Description of Artificial Sequence: Synthetic polypeptide
DEAEISCTNPVATEQYGCVCSNWGEDNAEYFGSDTQS

SEQ ID NO: 198016 - protein, 35 aa, Artificial Sequence
  Description of Artificial Sequence: Synthetic polypeptide
DETEIRTTNPIATECWGATSATAEAGPAEPKGPPV

SEQ ID NO: 198017 - protein, 35 aa, Artificial Sequence
  Description of Artificial Sequence: Synthetic polypeptide
DETEIRTTNPIATECWGATQWANAEDWQEPKGPYI

SEQ ID NO: 198018 - protein, 38 aa, Artificial Sequence
  Description of Artificial Sequence: Synthetic polypeptide
DEAEISCTNPVATEQYGCVCSVSGEDDNAENFNSDTQA

SEQ ID NO: 198019 - protein, 37 aa, Artificial Sequence
  Description of Artificial Sequence: Synthetic polypeptide
SENEIRTTNPVATEQYGQVWWMPDNNMQNDESHTQQV

SEQ ID NO: 198020 - protein, 37 aa, Artificial Sequence
  Description of Artificial Sequence: Synthetic polypeptide
SENEIRTTNPVATEQYGQCCWVADVDVEQLEGGEDHL

SEQ ID NO: 198021 - protein, 38 aa, Artificial Sequence
  Description of Artificial Sequence: Synthetic polypeptide
DETEIRTTNPVATEQYGACCWVADVDVEQLEGGEDHLG

SEQ ID NO: 198022 - protein, 37 aa, Artificial Sequence
  Description of Artificial Sequence: Synthetic polypeptide
CESHEIRITTNPVAYEAYGNVVSEVEFSQNNGGQDAR

SEQ ID NO: 198023 - protein, 39 aa, Artificial Sequence
  Description of Artificial Sequence: Synthetic polypeptide
DEEEISTTNPVATEQYGQCVCSMWPEDHNAEFFISDNQS

SEQ ID NO: 198024 - protein, 39 aa, Artificial Sequence
  Description of Artificial Sequence: Synthetic polypeptide
AEDEICTTNPVATEAYGSVYTVVTEEIGTNLQIGTTEGM

SEQ ID NO: 198025 - protein, 34 aa, Artificial Sequence
  Description of Artificial Sequence: Synthetic polypeptide
DETEIRTTNPIATECWGATMWANAEDWAEPKGPI

SEQ ID NO: 198026 - protein, 34 aa, Artificial Sequence
  Description of Artificial Sequence: Synthetic polypeptide
DDSEVASTNPVSTEGYGNVCYNTIDQSRHGQDDH

SEQ ID NO: 198027 - protein, 35 aa, Artificial Sequence
  Description of Artificial Sequence: Synthetic polypeptide
DETEIRTTNPIATECWGATSWANAEDWAEPKGPYL

SEQ ID NO: 198028 - protein, 35 aa, Artificial Sequence
  Description of Artificial Sequence: Synthetic polypeptide
DETEIRTTNPIATECWGATSWANAEDWSEPKGPDI

SEQ ID NO: 198029 - protein, 36 aa, Artificial Sequence
  Description of Artificial Sequence: Synthetic polypeptide
NESEIATTNPCATEQYGTVCAATGGEWSENMNGGED

SEQ ID NO: 198030 - protein, 39 aa, Artificial Sequence
  Description of Artificial Sequence: Synthetic polypeptide
DEEEISTTNPVATEQYGQCVCSMWGEDHNQENFNSQNQS

SEQ ID NO: 198031 - protein, 34 aa, Artificial Sequence
  Description of Artificial Sequence: Synthetic polypeptide
DDSEVASTNPVSTEGYGCVCETWAIQERFGSQQA

SEQ ID NO: 198032 - protein, 34 aa, Artificial Sequence
  Description of Artificial Sequence: Synthetic polypeptide
QCDEIRCTNPVAWEPYGCVCHGQMLLTGGGQNEP

SEQ ID NO: 198033 - protein, 38 aa, Artificial Sequence
  Description of Artificial Sequence: Synthetic polypeptide
DEEEISTTNPVATEQYGQCVCSMWGEHNQENFISDTQA

SEQ ID NO: 198034 - protein, 35 aa, Artificial Sequence
  Description of Artificial Sequence: Synthetic polypeptide
DETEIRTTNPVATEPWGATTWAMEDWQAEPKGPYI

SEQ ID NO: 198035 - protein, 35 aa, Artificial Sequence
  Description of Artificial Sequence: Synthetic polypeptide
DETEIRTTNPVATEPWGATTWANAEDWAEPNGPYI

SEQ ID NO: 198036 - protein, 35 aa, Artificial Sequence
  Description of Artificial Sequence: Synthetic polypeptide
DETEIRTTNPVATEPWGATTWANMEDWAEPKGPYI

SEQ ID NO: 198037 - protein, 36 aa, Artificial Sequence
  Description of Artificial Sequence: Synthetic polypeptide
DETEIRTTNPVATEPWGATTWANMEDWQAEPKGPYI

SEQ ID NO: 198038 - protein, 39 aa, Artificial Sequence
  Description of Artificial Sequence: Synthetic polypeptide
DEEEISTTNPVATEQYGQCVCSNSGEDDNAENFNSDTQA

SEQ ID NO: 198039 - protein, 38 aa, Artificial Sequence
  Description of Artificial Sequence: Synthetic polypeptide
DEEEIRTTNPVATEQYGYIFFQCPTLVEGKEEQELFIS

SEQ ID NO: 198040 - protein, 34 aa, Artificial Sequence
  Description of Artificial Sequence: Synthetic polypeptide
DDSEVASTNPVSTEGYGNVCYNTIDQSRHGQQDA

SEQ ID NO: 198041 - protein, 35 aa, Artificial Sequence
  Description of Artificial Sequence: Synthetic polypeptide
DETEIRTTNPIATECWGATTAANAEDQAEPSGHYI

SEQ ID NO: 198042 - protein, 37 aa, Artificial Sequence
  Description of Artificial Sequence: Synthetic polypeptide
SEAEVRTTNPVATEQYGCVCSNWGEHNAEYFNSDTQS

SEQ ID NO: 198043 - protein, 36 aa, Artificial Sequence
  Description of Artificial Sequence: Synthetic polypeptide
DAAEIATTNPVATEQWGCTTAGNNNENAMQMDGTNP

SEQ ID NO: 198044 - protein, 35 aa, Artificial Sequence
  Description of Artificial Sequence: Synthetic polypeptide
DETEIRTTNPIATECWGATSWANVEDWAEPKGPYI

SEQ ID NO: 198045 - protein, 35 aa, Artificial Sequence
  Description of Artificial Sequence: Synthetic polypeptide
DETEIRTTNPIATECWGATSWANPEDWAEPKGPKI

SEQ ID NO: 198046 - protein, 35 aa, Artificial Sequence
  Description of Artificial Sequence: Synthetic polypeptide
DETEIRTTNPIATECWGATSWANAMDWAEPKGPYI

SEQ ID NO: 198047 - protein, 36 aa, Artificial Sequence
  Description of Artificial Sequence: Synthetic polypeptide
DEAEISTTNPVAYEQYGCTCSWGEHNAENFGSDTQS

SEQ ID NO: 198048 - protein, 35 aa, Artificial Sequence
  Description of Artificial Sequence: Synthetic polypeptide
DETEIRTTNPVATEPWGATTWSNAEDWAEPNGPYI

SEQ ID NO: 198049 - protein, 36 aa, Artificial Sequence
  Description of Artificial Sequence: Synthetic polypeptide
DEAEISTTNPVATEGWGCVCSWGEENAEYFNSDTQS

SEQ ID NO: 198050 - protein, 35 aa, Artificial Sequence
  Description of Artificial Sequence: Synthetic polypeptide
DEGEIATTNPVAYEQWGCYAASNDTATAHINDEAM

SEQ ID NO: 198051 - protein, 33 aa, Artificial Sequence
  Description of Artificial Sequence: Synthetic polypeptide
DDSEVASTNPVSTEGYGCVCAYWTPQERFGSQQ

SEQ ID NO: 198052 - protein, 39 aa, Artificial Sequence
  Description of Artificial Sequence: Synthetic polypeptide
DEEEISTTNPVATEQYGQCVCSNSGEGHNQEFFGSDTQS

SEQ ID NO: 198053 - protein, 34 aa, Artificial Sequence
  Description of Artificial Sequence: Synthetic polypeptide
AEQEIASTNPVGYEAYGVVMAYSPGLSQHTVGDI

SEQ ID NO: 198054 - protein, 34 aa, Artificial Sequence
  Description of Artificial Sequence: Synthetic polypeptide
DDSEVASTNPVSTEGYGCVCATWPIQERFGSQQP

SEQ ID NO: 198055 - protein, 38 aa, Artificial Sequence
  Description of Artificial Sequence: Synthetic polypeptide
DEEEIRTTNPVATEWYGQAWITYNTVDGQDLEIIDYQE

SEQ ID NO: 198056 - protein, 37 aa, Artificial Sequence
  Description of Artificial Sequence: Synthetic polypeptide
CEEEIACTNPVATEQYGSACAANPAEGQDHQMDSNAK

SEQ ID NO: 198057 - protein, 32 aa, Artificial Sequence
  Description of Artificial Sequence: Synthetic polypeptide
QESEIATTNPIATECWGATMWASEDWAPKGPI

SEQ ID NO: 198058 - protein, 35 aa, Artificial Sequence
  Description of Artificial Sequence: Synthetic polypeptide
DETEIRTTNPIATECWGATFWANAEDQAENMGPLI

SEQ ID NO: 198059 - protein, 31 aa, Artificial Sequence
  Description of Artificial Sequence: Synthetic polypeptide
QESEIATTNPIATECWGATTWAADWAPGPYI

SEQ ID NO: 198060 - protein, 39 aa, Artificial Sequence
  Description of Artificial Sequence: Synthetic polypeptide
DEEEIRTTNPVATEWYGQAWYTYNTDDGQDLEINQDYQE

SEQ ID NO: 198061 - protein, 39 aa, Artificial Sequence
  Description of Artificial Sequence: Synthetic polypeptide
DEEEISTTNPVATEQYGQCVCSNSMEDHNQENFGSQTQS

SEQ ID NO: 198062 - protein, 35 aa, Artificial Sequence
  Description of Artificial Sequence: Synthetic polypeptide
DEAEIATTNPVAYEAWGVVWPGPNNENDGQSNGEE

SEQ ID NO: 198063 - protein, 31 aa, Artificial Sequence
  Description of Artificial Sequence: Synthetic polypeptide
QESEIATTNPIGTECWGATTWAAEDLAHGPI

SEQ ID NO: 198064 - protein, 39 aa, Artificial Sequence
  Description of Artificial Sequence: Synthetic polypeptide
DEEEIRTTNPVATEWYGQCWITYNTDPGQDLEINSDYQE

SEQ ID NO: 198065 - protein, 37 aa, Artificial Sequence
  Description of Artificial Sequence: Synthetic polypeptide
QENEIRATNPVATEQYGTVTLVWLPDEQLENMQIDEI

SEQ ID NO: 198066 - protein, 39 aa, Artificial Sequence
  Description of Artificial Sequence: Synthetic polypeptide
DEEEIRTTNPVATEQYGYSSCIIMPYDESNGVDIIYEQR

SEQ ID NO: 198067 - protein, 34 aa, Artificial Sequence
  Description of Artificial Sequence: Synthetic polypeptide
DDSEVASTNPVSTEGYGCVCATWMEIQERFGSQQ

SEQ ID NO: 198068 - protein, 36 aa, Artificial Sequence
  Description of Artificial Sequence: Synthetic polypeptide
CEEEIACTNPVATEQYGSACAANPAEGQDHQDDSVE

SEQ ID NO: 198069 - protein, 38 aa, Artificial Sequence
  Description of Artificial Sequence: Synthetic polypeptide
DEECIRTTNPVAYEQYGQCVCSNWGEDNAENFNSDTQA

SEQ ID NO: 198070 - protein, 39 aa, Artificial Sequence
  Description of Artificial Sequence: Synthetic polypeptide
DEEEISTTNPVATEQYGQCVCSNSGEEHNAENFNSQTQA

SEQ ID NO: 198071 - protein, 35 aa, Artificial Sequence
  Description of Artificial Sequence: Synthetic polypeptide
DEDEIATTNPVAYEQWGTNCAATAGELPDSDPNHA

SEQ ID NO: 198072 - protein, 36 aa, Artificial Sequence
  Description of Artificial Sequence: Synthetic polypeptide
DEDEIATTNPVAYEQWGTNCAATAGELPDSASNDRN

SEQ ID NO: 198073 - protein, 35 aa, Artificial Sequence
  Description of Artificial Sequence: Synthetic polypeptide
DEDEIATTNPVAYEQWGTNCAANDGGVEDQGNNDM

SEQ ID NO: 198074 - protein, 35 aa, Artificial Sequence
  Description of Artificial Sequence: Synthetic polypeptide
DEAEIATTNPVAYEAWGVVWPGPINENDGQNNGSE

SEQ ID NO: 198075 - protein, 37 aa, Artificial Sequence
  Description of Artificial Sequence: Synthetic polypeptide
DETEIRTTNPVATEQYGSIIEECFPGWQQAQIQPQDH

SEQ ID NO: 198076 - protein, 34 aa, Artificial Sequence
  Description of Artificial Sequence: Synthetic polypeptide
DETEIRTTNPIATECWGATIWSNAEDWAEPKGPI

SEQ ID NO: 198077 - protein, 32 aa, Artificial Sequence
  Description of Artificial Sequence: Synthetic polypeptide
QEGEIACTNPCSYEQWGITCYCNDQDSEGDTR

SEQ ID NO: 198078 - protein, 37 aa, Artificial Sequence
  Description of Artificial Sequence: Synthetic polypeptide
SENEIRTTNPVATEQWGTVYNDYTLMGMHQELQDDTQ

SEQ ID NO: 198079 - protein, 35 aa, Artificial Sequence
  Description of Artificial Sequence: Synthetic polypeptide
DEAEIATTNPVAYEAWGVVWPGPNNENDGQKTGSE

SEQ ID NO: 198080 - protein, 39 aa, Artificial Sequence
  Description of Artificial Sequence: Synthetic polypeptide
DEEEISTTNPVATEQYGQCVCSNSGEDDNAENFNSDTQS

SEQ ID NO: 198081 - protein, 35 aa, Artificial Sequence
  Description of Artificial Sequence: Synthetic polypeptide
DETEIRTTNPIATECWGATLWTNAEDWEEGQGPQI

SEQ ID NO: 198082 - protein, 38 aa, Artificial Sequence
  Description of Artificial Sequence: Synthetic polypeptide
DETEIRTTNPVATEQYGSIIVEECFPQWQQAQSQPQDP

SEQ ID NO: 198083 - protein, 39 aa, Artificial Sequence
  Description of Artificial Sequence: Synthetic polypeptide
DEEEISTTNPVATEQYGQCVCSNSGEDDNQENFNSDTQA

SEQ ID NO: 198084 - protein, 39 aa, Artificial Sequence
  Description of Artificial Sequence: Synthetic polypeptide
DEEEISTTNPVATEQYGQCVCSNSGEDHNAEGFNSDTQS

SEQ ID NO: 198085 - protein, 39 aa, Artificial Sequence
  Description of Artificial Sequence: Synthetic polypeptide
DEEEISTTNPVATEQYGQCVCSNSGEDHNAEYFNSDTQS

SEQ ID NO: 198086 - protein, 39 aa, Artificial Sequence
  Description of Artificial Sequence: Synthetic polypeptide
DEEEISTTNPVATEQYGQCVCSNSGEDHNQENFGSDTQS

SEQ ID NO: 198087 - protein, 39 aa, Artificial Sequence
  Description of Artificial Sequence: Synthetic polypeptide
DEEEISTTNPVATEQYGQCVCSNSGEDHNQENFISDNQA

SEQ ID NO: 198088 - protein, 39 aa, Artificial Sequence
  Description of Artificial Sequence: Synthetic polypeptide
DEEEISTTNPVATEQYGQCVCSNSGEDHNQEYFGSDTQS

SEQ ID NO: 198089 - protein, 39 aa, Artificial Sequence
  Description of Artificial Sequence: Synthetic polypeptide
DEEEIRTTNPVATEQYGYSFFQCPTLVEGQEEEQELQIS

SEQ ID NO: 198090 - protein, 38 aa, Artificial Sequence
  Description of Artificial Sequence: Synthetic polypeptide
DEEEISTTNPVATEQYGQCVCSNSGEDNQENFISDTQS

SEQ ID NO: 198091 - protein, 35 aa, Artificial Sequence
  Description of Artificial Sequence: Synthetic polypeptide
DETEIRTTNPIATECWGATIWANAEDWAEQKGPYI

SEQ ID NO: 198092 - protein, 37 aa, Artificial Sequence
  Description of Artificial Sequence: Synthetic polypeptide
DEECISTTNPVAYEQYGCVCSNWGEHNTENFNSDTQS

SEQ ID NO: 198093 - protein, 39 aa, Artificial Sequence
  Description of Artificial Sequence: Synthetic polypeptide
DEEEISTTNPVATEQYGQCVCSNWGEDDNAENFNSDNQS

SEQ ID NO: 198094 - protein, 39 aa, Artificial Sequence
  Description of Artificial Sequence: Synthetic polypeptide
DEEEISTTNPVATEQYGQCVCSNWGEDDNAENFNSDTQA

SEQ ID NO: 198095 - protein, 39 aa, Artificial Sequence
  Description of Artificial Sequence: Synthetic polypeptide
DEEEISTTNPVATEQYGQCVCSNWGEDHNAEYFGSDTQA

SEQ ID NO: 198096 - protein, 39 aa, Artificial Sequence
  Description of Artificial Sequence: Synthetic polypeptide
DEEEISTTNPVATEQYGQCVCSNWGEDHNAEYFNSDNQA

SEQ ID NO: 198097 - protein, 39 aa, Artificial Sequence
  Description of Artificial Sequence: Synthetic polypeptide
DEEEISTTNPVATEQYGQCVCSNWGEDHNAEYFNSDTQS

SEQ ID NO: 198098 - protein, 39 aa, Artificial Sequence
  Description of Artificial Sequence: Synthetic polypeptide
DEEEISTTNPVATEQYGQCVCSNWGEDHNAEYFNSDTQT

SEQ ID NO: 198099 - protein, 39 aa, Artificial Sequence
  Description of Artificial Sequence: Synthetic polypeptide
DEEEISTTNPVATEQYGQCVCSNWGEDHNAEYFNSEFQA

SEQ ID NO: 198100 - protein, 37 aa, Artificial Sequence
  Description of Artificial Sequence: Synthetic polypeptide
CEDEIACTNPVATEQYGSCAAPGNHLPLDSMEGNDWE

SEQ ID NO: 198101 - protein, 39 aa, Artificial Sequence
  Description of Artificial Sequence: Synthetic polypeptide
AEEEIRTTNPCATEQYGVVATVVVTQQNATEAYGTTDNP

SEQ ID NO: 198102 - protein, 37 aa, Artificial Sequence
  Description of Artificial Sequence: Synthetic polypeptide
SEMEIRCTNPCATEQYGCVCSWGEDHNAENFGSDNQS

SEQ ID NO: 198103 - protein, 36 aa, Artificial Sequence
  Description of Artificial Sequence: Synthetic polypeptide
QAEEIATTNPVATEQYGCVFPGEGGHGNESAEEASK

SEQ ID NO: 198104 - protein, 39 aa, Artificial Sequence
  Description of Artificial Sequence: Synthetic polypeptide
DEEEISTTNPVATEQYGQCVCSNWGEDHNIENFNSDTQS

SEQ ID NO: 198105 - protein, 37 aa, Artificial Sequence
  Description of Artificial Sequence: Synthetic polypeptide
DETEIRTTNPCATEAYGVVATTNANAEDTNEEEGVGI

SEQ ID NO: 198106 - protein, 38 aa, Artificial Sequence
  Description of Artificial Sequence: Synthetic polypeptide
SEMEIATTNPVATEQYGQCVCSNWGEDNEEHFGSENQA

SEQ ID NO: 198107 - protein, 36 aa, Artificial Sequence
  Description of Artificial Sequence: Synthetic polypeptide
QAEEIATTNPVATEQYGCVFAGEGGHGNESAEEEGN

SEQ ID NO: 198108 - protein, 36 aa, Artificial Sequence
  Description of Artificial Sequence: Synthetic polypeptide
SEMEIATTNPVATEGYGCVCSNWGEHNAHFISENQA

SEQ ID NO: 198109 - protein, 35 aa, Artificial Sequence
  Description of Artificial Sequence: Synthetic polypeptide
SEMEIATTNPVATEGYGCVCSNWEHNQEHFISEQA

SEQ ID NO: 198110 - protein, 37 aa, Artificial Sequence
  Description of Artificial Sequence: Synthetic polypeptide
DETEIRTTNPCATEAYGVVATTNANAEDTNEEEGIAT

SEQ ID NO: 198111 - protein, 39 aa, Artificial Sequence
  Description of Artificial Sequence: Synthetic polypeptide
DEEEISTTNPVATEQYGQCVCSNWGEDHNQEFFGSDTQA

SEQ ID NO: 198112 - protein, 39 aa, Artificial Sequence
  Description of Artificial Sequence: Synthetic polypeptide
DEEEISTTNPVATEQYGQCVCSNWGEDHNAESFNSDTQS

SEQ ID NO: 198113 - protein, 38 aa, Artificial Sequence
  Description of Artificial Sequence: Synthetic polypeptide
DETEIRTTNPCATEAYGVVATTNANAIGTNNEEGTIYE

SEQ ID NO: 198114 - protein, 39 aa, Artificial Sequence
  Description of Artificial Sequence: Synthetic polypeptide
DEEEISTTNPVATEQYGQCVCSNWGEDHNAENFNSDTQS

SEQ ID NO: 198115 - protein, 39 aa, Artificial Sequence
  Description of Artificial Sequence: Synthetic polypeptide
DEEEISTTNPVATEQYGQCVCSNWGEDHNAENFNSDTQG

SEQ ID NO: 198116 - protein, 39 aa, Artificial Sequence
  Description of Artificial Sequence: Synthetic polypeptide
DEEEISTTNPVATEQYGQCVCSNWGEDHNAENFGSDTQS

SEQ ID NO: 198117 - protein, 37 aa, Artificial Sequence
  Description of Artificial Sequence: Synthetic polypeptide
DEECISTTNPVAYEQYGCVCSNSGEHNAENFNSDTQS

SEQ ID NO: 198118 - protein, 37 aa, Artificial Sequence
  Description of Artificial Sequence: Synthetic polypeptide
SEMEIRTTNPVATEQYGCVCGWGADHNAENFNSDNQS

SEQ ID NO: 198119 - protein, 37 aa, Artificial Sequence
  Description of Artificial Sequence: Synthetic polypeptide
DETEIRTTNPCATEAYGVVATTNANGEDTNEEEEIYI

SEQ ID NO: 198120 - protein, 37 aa, Artificial Sequence
  Description of Artificial Sequence: Synthetic polypeptide
DETEIRTTNPCATEAYGVVATTNANATETGEEEGIGI

SEQ ID NO: 198121 - protein, 36 aa, Artificial Sequence
  Description of Artificial Sequence: Synthetic polypeptide
SEMEIRTTNPVATEGYGCVCSNWGEHAENFGSDTQS

SEQ ID NO: 198122 - protein, 38 aa, Artificial Sequence
  Description of Artificial Sequence: Synthetic polypeptide
CEEEIGTTNPVATEQYGQCVCSNWGEDNQENFNSENQI

SEQ ID NO: 198123 - protein, 39 aa, Artificial Sequence
  Description of Artificial Sequence: Synthetic polypeptide
DEEEISTTNPVATEQYGQCVCSNWGEDHNAENFGSETQA

SEQ ID NO: 198124 - protein, 37 aa, Artificial Sequence
  Description of Artificial Sequence: Synthetic polypeptide
CEDEIACTNPVATEQYGSCAAPGNHLPLDSGEGNEVF

SEQ ID NO: 198125 - protein, 39 aa, Artificial Sequence
  Description of Artificial Sequence: Synthetic polypeptide
DEEEISTTNPVATEQYGQCVCSNWGEDHNAENFISDNQA

SEQ ID NO: 198126 - protein, 38 aa, Artificial Sequence
  Description of Artificial Sequence: Synthetic polypeptide
MEGEIRTTNPVATEQYGSCSSPWPDEGPNMVFESNSDC

SEQ ID NO: 198127 - protein, 39 aa, Artificial Sequence
  Description of Artificial Sequence: Synthetic polypeptide
AEEEIRTTNPCATEQYGVVSTVVATQQSATEAYGTTDQP

SEQ ID NO: 198128 - protein, 37 aa, Artificial Sequence
  Description of Artificial Sequence: Synthetic polypeptide
DETEIRTTNPCATEAYGVVATTNANANETGTEEGSTT

SEQ ID NO: 198129 - protein, 38 aa, Artificial Sequence
  Description of Artificial Sequence: Synthetic polypeptide
MEGEIRTTNPVATEQYGSCSSVAPAEGPNMVFEEHSDC

SEQ ID NO: 198130 - protein, 39 aa, Artificial Sequence
  Description of Artificial Sequence: Synthetic polypeptide
DEEEISTTNPVATEQYGQCVCSNWGEDHNAENFNSDFQA

SEQ ID NO: 198131 - protein, 39 aa, Artificial Sequence
  Description of Artificial Sequence: Synthetic polypeptide
DETEIRTTNPCATEAYGVVATTNANALQTATEEGSTQID

SEQ ID NO: 198132 - protein, 39 aa, Artificial Sequence
  Description of Artificial Sequence: Synthetic polypeptide
DEEEISTTNPVATEQYGQCVCSNWGEDHNAENFNSDNQS

SEQ ID NO: 198133 - protein, 39 aa, Artificial Sequence
  Description of Artificial Sequence: Synthetic polypeptide
DEEEISTTNPVATEQYGQCVCSNWGEDHNAENFNSDTQA

SEQ ID NO: 198134 - protein, 38 aa, Artificial Sequence
  Description of Artificial Sequence: Synthetic polypeptide
DDEEIRTTNPVATEFYGQVNFNMDTQDDQGGGGGEQGD

SEQ ID NO: 198135 - protein, 39 aa, Artificial Sequence
  Description of Artificial Sequence: Synthetic polypeptide
DEEEISTTNPVATEQYGQCVCSNWGEDHNAENFGSDTQG

SEQ ID NO: 198136 - protein, 37 aa, Artificial Sequence
  Description of Artificial Sequence: Synthetic polypeptide
DEMEIATTNPVATEQYGCVCSNWMELNEEHFISETQA

SEQ ID NO: 198137 - protein, 38 aa, Artificial Sequence
  Description of Artificial Sequence: Synthetic polypeptide
DEMEIATTNPVATEQYGCVCSNWMELHNAEHFNSENQA

SEQ ID NO: 198138 - protein, 35 aa, Artificial Sequence
  Description of Artificial Sequence: Synthetic polypeptide
HEEEISTTNPVATMAWGCSIPNCINNMDSTDGGNG

SEQ ID NO: 198139 - protein, 39 aa, Artificial Sequence
  Description of Artificial Sequence: Synthetic polypeptide
DEEEISTTNPVATEQYGQCVCSNWGEDHNQENFGSDTQD

SEQ ID NO: 198140 - protein, 37 aa, Artificial Sequence
  Description of Artificial Sequence: Synthetic polypeptide
DEMEIATTNPVATEQYGCVCSNWGEHNIEHFISEDQS

SEQ ID NO: 198141 - protein, 36 aa, Artificial Sequence
  Description of Artificial Sequence: Synthetic polypeptide
HEEEISTTNPVATDQWGCSIPNCILNMDSTDGGNGL

SEQ ID NO: 198142 - protein, 37 aa, Artificial Sequence
  Description of Artificial Sequence: Synthetic polypeptide
MEGEIRTTNPVATEQYGSCWGTDDNGVHTTFEDVYCD

SEQ ID NO: 198143 - protein, 36 aa, Artificial Sequence
  Description of Artificial Sequence: Synthetic polypeptide
DESEIRTTNPVATECWGATTWANAEDWQEPKGEPYI

SEQ ID NO: 198144 - protein, 37 aa, Artificial Sequence
  Description of Artificial Sequence: Synthetic polypeptide
MEGEIRTTNPVATEQYGSHWSCVDMDENGEFHSITPN

SEQ ID NO: 198145 - protein, 36 aa, Artificial Sequence
  Description of Artificial Sequence: Synthetic polypeptide
DETEIRTTNPCATEAWGVVTTNANAEDNTEEIGIYI

SEQ ID NO: 198146 - protein, 37 aa, Artificial Sequence
  Description of Artificial Sequence: Synthetic polypeptide
DDECISTTNPVATEQYGCVCSTWGEHNQENFSSDTQA

SEQ ID NO: 198147 - protein, 35 aa, Artificial Sequence
  Description of Artificial Sequence: Synthetic polypeptide
DETEIRTTNPCATEAWGVVTNANAEDNAEPIGIFI

SEQ ID NO: 198148 - protein, 37 aa, Artificial Sequence
  Description of Artificial Sequence: Synthetic polypeptide
DEECISTTNPVAYEQYAEEVTTTGNGNPNDQGGKKPH

SEQ ID NO: 198149 - protein, 33 aa, Artificial Sequence
  Description of Artificial Sequence: Synthetic polypeptide
DDSEVASTNPVSTEGYGCVANWEINQERSGSQQ

SEQ ID NO: 198150 - protein, 36 aa, Artificial Sequence
  Description of Artificial Sequence: Synthetic polypeptide
DDECISTTNPVATEQYGCVCSNWGEHNQNFSSDTQS

SEQ ID NO: 198151 - protein, 35 aa, Artificial Sequence
  Description of Artificial Sequence: Synthetic polypeptide
DETEIRTTNPCATEAWGVTTNANAEENAEDIGIYI

SEQ ID NO: 198152 - protein, 35 aa, Artificial Sequence
  Description of Artificial Sequence: Synthetic polypeptide
DETEIRTTNPCATEAWGVTTNANAEDNAETIGIGI

SEQ ID NO: 198153 - protein, 38 aa, Artificial Sequence
  Description of Artificial Sequence: Synthetic polypeptide
DDECISTTNPVATEQYGCVCSNWGEDTNAEFFNSETQS

SEQ ID NO: 198154 - protein, 36 aa, Artificial Sequence
  Description of Artificial Sequence: Synthetic polypeptide
CEDEIACTNPVATEQYGSCAAAVGNGNEAEMHPMNS

SEQ ID NO: 198155 - protein, 35 aa, Artificial Sequence
  Description of Artificial Sequence: Synthetic polypeptide
DESEIRTTNPVATECWGATVWACEDWAEPKGEPYG

SEQ ID NO: 198156 - protein, 35 aa, Artificial Sequence
  Description of Artificial Sequence: Synthetic polypeptide
DESEIRTTNPVATECWGATVWACEDWAEPKGEPYI

SEQ ID NO: 198157 - protein, 35 aa, Artificial Sequence
  Description of Artificial Sequence: Synthetic polypeptide
DEAEIATTNPIATEAWGSIVPTWWDQHEHDQHTLH

SEQ ID NO: 198158 - protein, 35 aa, Artificial Sequence
  Description of Artificial Sequence: Synthetic polypeptide
DESEIRTTNPVATECWGATVWACIDWADPKGEPYG

SEQ ID NO: 198159 - protein, 38 aa, Artificial Sequence
  Description of Artificial Sequence: Synthetic polypeptide
TEEEIRTTNPVATEQYGQCVCNNWGEDNAEYFNSDTQS

SEQ ID NO: 198160 - protein, 39 aa, Artificial Sequence
  Description of Artificial Sequence: Synthetic polypeptide
DEEEISTTNPVATEQYGQCVCSNWGEDHNQEGFMSDTQS

SEQ ID NO: 198161 - protein, 38 aa, Artificial Sequence
  Description of Artificial Sequence: Synthetic polypeptide
AEEEIRTTNPVATEQYGVYSSPITAQEPNSPVFHPPVC

SEQ ID NO: 198162 - protein, 38 aa, Artificial Sequence
  Description of Artificial Sequence: Synthetic polypeptide
TEEEIRTTNPVATEQYGQCVCNWGEDDNAEYFNSDTQA

SEQ ID NO: 198163 - protein, 37 aa, Artificial Sequence
  Description of Artificial Sequence: Synthetic polypeptide
DETEIRTTNPCATEAYGVVATTNANAEDTEEQETIYI

SEQ ID NO: 198164 - protein, 37 aa, Artificial Sequence
  Description of Artificial Sequence: Synthetic polypeptide
DETEIRTTNPCATEAYGVVATTNANAEDTEEEEGIYN

SEQ ID NO: 198165 - protein, 37 aa, Artificial Sequence
  Description of Artificial Sequence: Synthetic polypeptide
CEDEIACTNPVATEQYGSCAAPGNHLPLDSGEGFANN

SEQ ID NO: 198166 - protein, 38 aa, Artificial Sequence
  Description of Artificial Sequence: Synthetic polypeptide
DETEIRTTNPCATEAYGVVATTNANAEDGTNNEEGIGI

SEQ ID NO: 198167 - protein, 37 aa, Artificial Sequence
  Description of Artificial Sequence: Synthetic polypeptide
TEEEIRTTNPVATEQYGQCVCGWGEHNQEYFISDTQA

SEQ ID NO: 198168 - protein, 33 aa, Artificial Sequence
  Description of Artificial Sequence: Synthetic polypeptide
SEMEIACTNPCSYEQYGQCVCSWEPQSFGSDQS

SEQ ID NO: 198169 - protein, 37 aa, Artificial Sequence
  Description of Artificial Sequence: Synthetic polypeptide
CEEEISTTNPVATEQYGCVCSNWGEDDNANFNSETQA

SEQ ID NO: 198170 - protein, 37 aa, Artificial Sequence
  Description of Artificial Sequence: Synthetic polypeptide
DETEIRTTNPCATEAYGVVATTNALAGTTTEEEEIYI

SEQ ID NO: 198171 - protein, 38 aa, Artificial Sequence
  Description of Artificial Sequence: Synthetic polypeptide
DDEEIRTTNPVATEGYGQCVCSNWGEHNIENFNSDTQA

SEQ ID NO: 198172 - protein, 36 aa, Artificial Sequence
  Description of Artificial Sequence: Synthetic polypeptide
DESEIRTTNPVATECWGATVWACIDWPQDPKGEPYG

SEQ ID NO: 198173 - protein, 34 aa, Artificial Sequence
  Description of Artificial Sequence: Synthetic polypeptide
DDSEVASTNPVSTEGYGNVCYNTIDQMRHGQDHE

SEQ ID NO: 198174 - protein, 38 aa, Artificial Sequence
  Description of Artificial Sequence: Synthetic polypeptide
AENEIRTTNPVATEQYGCVCSNWGEDHNAENFNSETQS

SEQ ID NO: 198175 - protein, 35 aa, Artificial Sequence
  Description of Artificial Sequence: Synthetic polypeptide
DESEIRTTNPVATECWGATVWACIDWAEPKGEPYG

SEQ ID NO: 198176 - protein, 39 aa, Artificial Sequence
  Description of Artificial Sequence: Synthetic polypeptide
DEEEISTTNPVATEQYGQCVCSNWGEDHNQENFGSDTQA

SEQ ID NO: 198177 - protein, 35 aa, Artificial Sequence
  Description of Artificial Sequence: Synthetic polypeptide
SEMEIACTNPCSYEQYGQCVCSWELNQSFGSDNQS

SEQ ID NO: 198178 - protein, 39 aa, Artificial Sequence
  Description of Artificial Sequence: Synthetic polypeptide
DEEEISTTNPVATEQYGQCVCSMWGEDHNAEYFNSDTQS

SEQ ID NO: 198179 - protein, 37 aa, Artificial Sequence
  Description of Artificial Sequence: Synthetic polypeptide
DETEIRTTNPCATEAYGVVATTNANNEDTGEEEGTGI

SEQ ID NO: 198180 - protein, 39 aa, Artificial Sequence
  Description of Artificial Sequence: Synthetic polypeptide
DETEIRTTNPCATEAYGVVATTNANQLQSATEEGSVYID

SEQ ID NO: 198181 - protein, 38 aa, Artificial Sequence
  Description of Artificial Sequence: Synthetic polypeptide
DEAEIRTTNPVATEGYGCVTGTWGADHNAENFGSDPQA

SEQ ID NO: 198182 - protein, 39 aa, Artificial Sequence
  Description of Artificial Sequence: Synthetic polypeptide
DEEEISTTNPVATEQYGQCVCSNWGEDDNQEFFNSDNQI

SEQ ID NO: 198183 - protein, 37 aa, Artificial Sequence
  Description of Artificial Sequence: Synthetic polypeptide
QAEEIATTNPVATEQYGCVSPGEGGHGNESGEEEGMS

SEQ ID NO: 198184 - protein, 37 aa, Artificial Sequence
  Description of Artificial Sequence: Synthetic polypeptide
DEECISTTNPVAYEQYGCVCSNWGEHNIENFNSDNQA

SEQ ID NO: 198185 - protein, 35 aa, Artificial Sequence
  Description of Artificial Sequence: Synthetic polypeptide
SENAEIATTNPVAYEAWGVVWPGPNNENDGQNGSR

SEQ ID NO: 198186 - protein, 38 aa, Artificial Sequence
  Description of Artificial Sequence: Synthetic polypeptide
DEAEIRTTNPVATEGYGICVCSNTVEHNQENFISDTQS

SEQ ID NO: 198187 - protein, 39 aa, Artificial Sequence
  Description of Artificial Sequence: Synthetic polypeptide
DEEEISTTNPVATEQYGQCVCSNWGEDDNQEHFNSDNQA

SEQ ID NO: 198188 - protein, 39 aa, Artificial Sequence
  Description of Artificial Sequence: Synthetic polypeptide
DEEEISTTNPVATEQYGQCVCSNWGEDDNQENFGSDTQA

SEQ ID NO: 198189 - protein, 36 aa, Artificial Sequence
  Description of Artificial Sequence: Synthetic polypeptide
DEDEIRTTNPVATEQWGCCAMAGMHPGDLHPDDSNN

SEQ ID NO: 198190 - protein, 39 aa, Artificial Sequence
  Description of Artificial Sequence: Synthetic polypeptide
DEEEISTTNPVATEQYGQCVCSNWGEDDNQENFNSENQS

SEQ ID NO: 198191 - protein, 38 aa, Artificial Sequence
  Description of Artificial Sequence: Synthetic polypeptide
CEEEISTTNPVATEQYGCVCSNWGEDHNAEGFNSDNQA

SEQ ID NO: 198192 - protein, 36 aa, Artificial Sequence
  Description of Artificial Sequence: Synthetic polypeptide
MEGEIRTTNPVATEQYGSCPPDPKIGTDEIMYSIEK

SEQ ID NO: 198193 - protein, 39 aa, Artificial Sequence
  Description of Artificial Sequence: Synthetic polypeptide
DEMEIRTTNPVATEQYGQCVCSNWGEDHNEENFNSETQA

SEQ ID NO: 198194 - protein, 39 aa, Artificial Sequence
  Description of Artificial Sequence: Synthetic polypeptide
DEEEISTTNPVATEQYGQCVCSNWGEDDNTEGFNSDTQS

SEQ ID NO: 198195 - protein, 37 aa, Artificial Sequence
  Description of Artificial Sequence: Synthetic polypeptide
DEECISTTNPVAYEQYGCVCSNWGEENAEYFNSDNQA

SEQ ID NO: 198196 - protein, 38 aa, Artificial Sequence
  Description of Artificial Sequence: Synthetic polypeptide
MEGEIRTTNPVATEQYGSCSAPAPAEGPNMVFEENSDM

SEQ ID NO: 198197 - protein, 35 aa, Artificial Sequence
  Description of Artificial Sequence: Synthetic polypeptide
AEEEIACTNPVATEQWGCVAAGMWDTATDDIGSDD

SEQ ID NO: 198198 - protein, 37 aa, Artificial Sequence
  Description of Artificial Sequence: Synthetic polypeptide
DEAEISTTNPVATEGYGCVCSNWGEHNAENFPSDNQS

SEQ ID NO: 198199 - protein, 37 aa, Artificial Sequence
  Description of Artificial Sequence: Synthetic polypeptide
CESEIATTNPCATEQYGTVCSATGEEWSENMNGGPQD

SEQ ID NO: 198200 - protein, 37 aa, Artificial Sequence
  Description of Artificial Sequence: Synthetic polypeptide
MEGEIRTTNPVATEQYGQSCTWCEWASMPELGDDTQV

SEQ ID NO: 198201 - protein, 38 aa, Artificial Sequence
  Description of Artificial Sequence: Synthetic polypeptide
DEAEISTTNPVATEGYGCVCSNSGEDHNEENFGSENQS

SEQ ID NO: 198202 - protein, 39 aa, Artificial Sequence
  Description of Artificial Sequence: Synthetic polypeptide
DEEEISTTNPVATEQYGQCVCSNWGEDDNAENFNSDTQG

SEQ ID NO: 198203 - protein, 39 aa, Artificial Sequence
  Description of Artificial Sequence: Synthetic polypeptide
DEEEISTTNPVATEQYGQCVCSNWGEDDNAENFNSDTQN

SEQ ID NO: 198204 - protein, 39 aa, Artificial Sequence
  Description of Artificial Sequence: Synthetic polypeptide
DEEEISTTNPVATEQYGQCVCSNWGEDDNAENFNSDTQQ

SEQ ID NO: 198205 - protein, 37 aa, Artificial Sequence
  Description of Artificial Sequence: Synthetic polypeptide
MEGEIRTTNPVATEQYGCWEYGAWVINMQDEDNGLDE

SEQ ID NO: 198206 - protein, 39 aa, Artificial Sequence
  Description of Artificial Sequence: Synthetic polypeptide
DEEEISTTNPVATEQYGQCVCSNWGEDDNAENFNSDTQS

SEQ ID NO: 198207 - protein, 39 aa, Artificial Sequence
  Description of Artificial Sequence: Synthetic polypeptide
DEEEISTTNPVATEQYGQCVCSNWGEDDNAENFNSETQS

SEQ ID NO: 198208 - protein, 36 aa, Artificial Sequence
  Description of Artificial Sequence: Synthetic polypeptide
DETEIRTTNPCAYEQWGVVCGDQNNDQHQGQGGGKD

SEQ ID NO: 198209 - protein, 39 aa, Artificial Sequence
  Description of Artificial Sequence: Synthetic polypeptide
DEEEISTTNPVATEQYGQCVCSNWGEDDNEEHFNSDTQP

SEQ ID NO: 198210 - protein, 39 aa, Artificial Sequence
  Description of Artificial Sequence: Synthetic polypeptide
AEEEIRTTNPCATEQYGVVSTVVVTQQNATEAYGTTDED

SEQ ID NO: 198211 - protein, 37 aa, Artificial Sequence
  Description of Artificial Sequence: Synthetic polypeptide
QDGEIATTNPVATEQYGCISFWAPDTLREPQEGEDTR

SEQ ID NO: 198212 - protein, 35 aa, Artificial Sequence
  Description of Artificial Sequence: Synthetic polypeptide
DEDEIATTNPVAYEQWGVVAATAHGAAAPPGSLMN

SEQ ID NO: 198213 - protein, 37 aa, Artificial Sequence
  Description of Artificial Sequence: Synthetic polypeptide
DEECISTTNPVAYEQYGCVCSNWGEHNQESFNSDNQY

SEQ ID NO: 198214 - protein, 36 aa, Artificial Sequence
  Description of Artificial Sequence: Synthetic polypeptide
DENCIATVNPVATECYGSVVCIDHQDQNQRQGDDAN

SEQ ID NO: 198215 - protein, 38 aa, Artificial Sequence
  Description of Artificial Sequence: Synthetic polypeptide
DDEEIRTTNPVATEGYGQCVCSNWGEHNQENFNSDTQS

SEQ ID NO: 198216 - protein, 37 aa, Artificial Sequence
  Description of Artificial Sequence: Synthetic polypeptide
DEAEISTTNPVATEGYGCSCSNWGEENQEYFNSDTQA

SEQ ID NO: 198217 - protein, 36 aa, Artificial Sequence
  Description of Artificial Sequence: Synthetic polypeptide
MEGEIRTTNPVATEQYGMTCTSLEWALEPLTDDQQG

SEQ ID NO: 198218 - protein, 38 aa, Artificial Sequence
  Description of Artificial Sequence: Synthetic polypeptide
CEEEISTTNPVATEQYGCVCSNWGEDHNAEHFGSEFQS

SEQ ID NO: 198219 - protein, 39 aa, Artificial Sequence
  Description of Artificial Sequence: Synthetic polypeptide
DEMEIRTTNPVATEQYGQSMCCVFANPENEPMNTQDTEG

SEQ ID NO: 198220 - protein, 38 aa, Artificial Sequence
  Description of Artificial Sequence: Synthetic polypeptide
DEMEIRTTNPVATEQYGSCNTAWETTMTTEHFYGDTDI

SEQ ID NO: 198221 - protein, 37 aa, Artificial Sequence
  Description of Artificial Sequence: Synthetic polypeptide
DETEIRTTNPCATEAYGVVATTNANNEDTNEEEGIYE

SEQ ID NO: 198222 - protein, 38 aa, Artificial Sequence
  Description of Artificial Sequence: Synthetic polypeptide
MEGEIRTTNPVATEQYGSCSSPAFAEGPNMVFEENSEC

SEQ ID NO: 198223 - protein, 38 aa, Artificial Sequence
  Description of Artificial Sequence: Synthetic polypeptide
MEGEIRTTNPVATEQYGSCSSPAPAEGNNMVFEENSPC

SEQ ID NO: 198224 - protein, 39 aa, Artificial Sequence
  Description of Artificial Sequence: Synthetic polypeptide
DEEEISTTNPVATEQYGQCVCSNWGEDHNAEHFGSETQA

SEQ ID NO: 198225 - protein, 37 aa, Artificial Sequence
  Description of Artificial Sequence: Synthetic polypeptide
DETEIRTTNPCATEAYGVVATTNQNANETGTEEGITI

SEQ ID NO: 198226 - protein, 39 aa, Artificial Sequence
  Description of Artificial Sequence: Synthetic polypeptide
DEEEISTTNPVATEQYGQCVCSNWGEDHNAEHFISDNQS

SEQ ID NO: 198227 - protein, 39 aa, Artificial Sequence
  Description of Artificial Sequence: Synthetic polypeptide
DEEEISTTNPVATEQYGQCVCSNWGEDHNAEHFNSDNQA

SEQ ID NO: 198228 - protein, 39 aa, Artificial Sequence
  Description of Artificial Sequence: Synthetic polypeptide
DEEEISTTNPVATEQYGQCVCSNWGEDHNAEHFNSDTQL

SEQ ID NO: 198229 - protein, 39 aa, Artificial Sequence
  Description of Artificial Sequence: Synthetic polypeptide
DEEEISTTNPVATEQYGQCVCSNWGEDHNAEHFNSDTQS

SEQ ID NO: 198230 - protein, 37 aa, Artificial Sequence
  Description of Artificial Sequence: Synthetic polypeptide
DEDEIRTTNPVATEQWGCVCAGAGAHPGTLHPDDSNW

SEQ ID NO: 198231 - protein, 37 aa, Artificial Sequence
  Description of Artificial Sequence: Synthetic polypeptide
CEDEIACTNPVATEQYGSCAAPGNHPPLDSGEGNDDQ

SEQ ID NO: 198232 - protein, 38 aa, Artificial Sequence
  Description of Artificial Sequence: Synthetic polypeptide
MEGEIRTTNPVATEQYGSCSSPAVAEGPNMVFEGISDC

SEQ ID NO: 198233 - protein, 38 aa, Artificial Sequence
  Description of Artificial Sequence: Synthetic polypeptide
HEGEIRTTNPVATEQYGSGVSSCADSNQDIFDFSTMEH

SEQ ID NO: 198234 - protein, 35 aa, Artificial Sequence
  Description of Artificial Sequence: Synthetic polypeptide
QEHEIRTTNPVAYMQWGAAPTWEKDQQIEHGNDDS

SEQ ID NO: 198235 - protein, 38 aa, Artificial Sequence
  Description of Artificial Sequence: Synthetic polypeptide
DETEIRTTNPVAYEQWGEVVHTLGDNQDQQNGGGDQGM

SEQ ID NO: 198236 - protein, 37 aa, Artificial Sequence
  Description of Artificial Sequence: Synthetic polypeptide
DETEIRTTNPCATEAYGVVATTNNNIGTTAEEEGIYI

SEQ ID NO: 198237 - protein, 36 aa, Artificial Sequence
  Description of Artificial Sequence: Synthetic polypeptide
CEEEIACTNPVAYEQYGSVATPAHITEGTHGDEAAP

SEQ ID NO: 198238 - protein, 33 aa, Artificial Sequence
  Description of Artificial Sequence: Synthetic polypeptide
DEGEIAPTNPIATEQWGATVANADWAEPKGTYI

SEQ ID NO: 198239 - protein, 37 aa, Artificial Sequence
  Description of Artificial Sequence: Synthetic polypeptide
DETEIRTTNPCATEAYGVVATTNNNAEDTGEEEGIGI

SEQ ID NO: 198240 - protein, 38 aa, Artificial Sequence
  Description of Artificial Sequence: Synthetic polypeptide
HEGEIRTTNPVATEQYGAVCEETVNENLNEIEEHMAEP

SEQ ID NO: 198241 - protein, 39 aa, Artificial Sequence
  Description of Artificial Sequence: Synthetic polypeptide
DEEEISTTNPVATEQYGQCVCSNWGEDHNAEGFGSDTQS

SEQ ID NO: 198242 - protein, 35 aa, Artificial Sequence
  Description of Artificial Sequence: Synthetic polypeptide
DEAEIATTNPIATEGWGSIVPTWWDQHDHDQHTKS

SEQ ID NO: 198243 - protein, 37 aa, Artificial Sequence
  Description of Artificial Sequence: Synthetic polypeptide
DECEIRTTNPVAYEQWGHNTVYYWEEQQHRPTTGAEK

SEQ ID NO: 198244 - protein, 36 aa, Artificial Sequence
  Description of Artificial Sequence: Synthetic polypeptide
DETEIRTTNPCATECWGATTQVNVEDIAEIQGGPRI

SEQ ID NO: 198245 - protein, 35 aa, Artificial Sequence
  Description of Artificial Sequence: Synthetic polypeptide
SEEEIACTNPVATAQWGGCQAGTGMLGIHGDDNAH

SEQ ID NO: 198246 - protein, 38 aa, Artificial Sequence
  Description of Artificial Sequence: Synthetic polypeptide
DETEIRTTNPCATEQYGVVATTNANANDTGTEEGSIYG

SEQ ID NO: 198247 - protein, 38 aa, Artificial Sequence
  Description of Artificial Sequence: Synthetic polypeptide
MEGEIRTTNPVATEQYGSCSSPAPAEGPNMAFEENSDA

SEQ ID NO: 198248 - protein, 37 aa, Artificial Sequence
  Description of Artificial Sequence: Synthetic polypeptide
CEDEIACTNPVATEQYGSCAAPGNHSPLDSGEGSDNN

SEQ ID NO: 198249 - protein, 38 aa, Artificial Sequence
  Description of Artificial Sequence: Synthetic polypeptide
MEGEIRTTNPVATEQYGSCSSPAPAEGPNMVFEGMSDP

SEQ ID NO: 198250 - protein, 39 aa, Artificial Sequence
  Description of Artificial Sequence: Synthetic polypeptide
DEMEIRTTNPVATEQYGQCVCSNWGEDHNAEHFNSDNQA

SEQ ID NO: 198251 - protein, 38 aa, Artificial Sequence
  Description of Artificial Sequence: Synthetic polypeptide
MEGEIRTTNPVATEQYGSCSSPAPAEGPNMVFEWSSDC

SEQ ID NO: 198252 - protein, 35 aa, Artificial Sequence
  Description of Artificial Sequence: Synthetic polypeptide
DENCIATVNPVATECYGSVVCIDHQDQERQPDTES

SEQ ID NO: 198253 - protein, 38 aa, Artificial Sequence
  Description of Artificial Sequence: Synthetic polypeptide
DETEIRTTNPCATEQYGVVATTNANANDTIGTEEGIYI

SEQ ID NO: 198254 - protein, 37 aa, Artificial Sequence
  Description of Artificial Sequence: Synthetic polypeptide
CEDEIACTNPVATEQYGSCAAPGNHQPLDSTEGNDNN

SEQ ID NO: 198255 - protein, 38 aa, Artificial Sequence
  Description of Artificial Sequence: Synthetic polypeptide
MEGEIRTTNPVATEQYGSCSSPAPEEGPNMVFEGVSYC

SEQ ID NO: 198256 - protein, 35 aa, Artificial Sequence
  Description of Artificial Sequence: Synthetic polypeptide
DETEIRTTNPCATECWGATTWTNARDWEETQIPQI

SEQ ID NO: 198257 - protein, 37 aa, Artificial Sequence
  Description of Artificial Sequence: Synthetic polypeptide
CEDEIACTNPVATEQYGSCAAPGNHQPLDSGEEDDRN

SEQ ID NO: 198258 - protein, 37 aa, Artificial Sequence
  Description of Artificial Sequence: Synthetic polypeptide
CEEEIACTNPVAYEQYGSVVAITNHADEATGELGEQM

SEQ ID NO: 198259 - protein, 39 aa, Artificial Sequence
  Description of Artificial Sequence: Synthetic polypeptide
DEAEIRTTNPVATEGYGICVTSTWGADHNAENFISDNQA

SEQ ID NO: 198260 - protein, 34 aa, Artificial Sequence
  Description of Artificial Sequence: Synthetic polypeptide
DETEIRTTNPCATECWGATTWANAEDWAESKGPI

SEQ ID NO: 198261 - protein, 38 aa, Artificial Sequence
  Description of Artificial Sequence: Synthetic polypeptide
MEGEIRTTNPVATEQYGSCSSPASAEGPNMVFEEKSDC

SEQ ID NO: 198262 - protein, 35 aa, Artificial Sequence
  Description of Artificial Sequence: Synthetic polypeptide
DEAEIATTNPIATEQWGHIVPTWWDQHDHDQHTKP

SEQ ID NO: 198263 - protein, 38 aa, Artificial Sequence
  Description of Artificial Sequence: Synthetic polypeptide
MEGEIRTTNPVATEQYGSCSSPAPDEGPNMVFEYGSDC

SEQ ID NO: 198264 - protein, 39 aa, Artificial Sequence
  Description of Artificial Sequence: Synthetic polypeptide
DEAEIRTTNPVATEGYGSVHPIGTREMPNNWEEEHINDG

SEQ ID NO: 198265 - protein, 39 aa, Artificial Sequence
  Description of Artificial Sequence: Synthetic polypeptide
DEEEISTTNPVATEQYGQCVCSMWGEDHNAENFNSDTQA

SEQ ID NO: 198266 - protein, 39 aa, Artificial Sequence
  Description of Artificial Sequence: Synthetic polypeptide
YENEIRTTNPVATEFYGSVDTVMTGNNGGDEDQNEDDQR

SEQ ID NO: 198267 - protein, 38 aa, Artificial Sequence
  Description of Artificial Sequence: Synthetic polypeptide
DEEEISTTNPVATEQYGQCQVCSWGEDHAENFNSDTQQ

SEQ ID NO: 198268 - protein, 39 aa, Artificial Sequence
  Description of Artificial Sequence: Synthetic polypeptide
DEEEISTTNPVATEQYGQCSCSNWPEDDNQENFDSDNQS

SEQ ID NO: 198269 - protein, 38 aa, Artificial Sequence
  Description of Artificial Sequence: Synthetic polypeptide
DAAEIATTNPVATEQYGSVCAMNNGVDNQTAPGPMESE

SEQ ID NO: 198270 - protein, 38 aa, Artificial Sequence
  Description of Artificial Sequence: Synthetic polypeptide
QAEEIATTNPVAYEQYGSVPAIANNGLMTANPDGSVNN

SEQ ID NO: 198271 - protein, 37 aa, Artificial Sequence
  Description of Artificial Sequence: Synthetic polypeptide
DCGEIRTTNPVAYEQYGGHFCFFASPDESHFLQDDIQ

SEQ ID NO: 198272 - protein, 37 aa, Artificial Sequence
  Description of Artificial Sequence: Synthetic polypeptide
DEAEIATTNPVATCQYGCVCSNWGEDNAENFGSDTQS

SEQ ID NO: 198273 - protein, 38 aa, Artificial Sequence
  Description of Artificial Sequence: Synthetic polypeptide
DEEEISTTNPVATEQYGQCTCSMWEEPNQEYIGSDTQS

SEQ ID NO: 198274 - protein, 38 aa, Artificial Sequence
  Description of Artificial Sequence: Synthetic polypeptide
DEEEISTTNPVATEQYGQCTCSMWGEDNAEYINSDTQA

SEQ ID NO: 198275 - protein, 38 aa, Artificial Sequence
  Description of Artificial Sequence: Synthetic polypeptide
DEEEISTTNPVATEQYGCVCSNWGEDHNQENFISQTQP

SEQ ID NO: 198276 - protein, 38 aa, Artificial Sequence
  Description of Artificial Sequence: Synthetic polypeptide
DEEEISTTNPVATEQYGQCTCSNWNEHNAENFISDTQA

SEQ ID NO: 198277 - protein, 38 aa, Artificial Sequence
  Description of Artificial Sequence: Synthetic polypeptide
DEEEISTTNPVATEQYGQCVCENWEEDNEENFNSDNQA

SEQ ID NO: 198278 - protein, 38 aa, Artificial Sequence
  Description of Artificial Sequence: Synthetic polypeptide
DESEIRTTNPVATEGWGQCVCSNWGEENQEYFGSDNQG

SEQ ID NO: 198279 - protein, 38 aa, Artificial Sequence
  Description of Artificial Sequence: Synthetic polypeptide
DEEEISTTNPVATEQYGCVCSNWGEDHNQENFISDTQS

SEQ ID NO: 198280 - protein, 38 aa, Artificial Sequence
  Description of Artificial Sequence: Synthetic polypeptide
DEEEISTTNPVATEQYGCVCSNWGEDHNQENFISDTQN

SEQ ID NO: 198281 - protein, 39 aa, Artificial Sequence
  Description of Artificial Sequence: Synthetic polypeptide
DEEEISTTNPVATEQYGQCVCENWGEDHNQENFNSDTQS

SEQ ID NO: 198282 - protein, 38 aa, Artificial Sequence
  Description of Artificial Sequence: Synthetic polypeptide
DEEEIATTNPIAYEPYGSVVCGQDNELSQSAEQTSNGG

SEQ ID NO: 198283 - protein, 38 aa, Artificial Sequence
  Description of Artificial Sequence: Synthetic polypeptide
DESEIRTTNPVATEGWGQCVCSTWGEENAEYFNSDTQA

SEQ ID NO: 198284 - protein, 34 aa, Artificial Sequence
  Description of Artificial Sequence: Synthetic polypeptide
KEDEIACTNPTAYECWGSVYYGENDDMHRGDDRR

SEQ ID NO: 198285 - protein, 39 aa, Artificial Sequence
  Description of Artificial Sequence: Synthetic polypeptide
DEEEISTTNPVATEQYGQCVCGNSGEDDNQENFISDNQS

SEQ ID NO: 198286 - protein, 40 aa, Artificial Sequence
  Description of Artificial Sequence: Synthetic polypeptide
DEEEISTTNPVATEQYGQCQVCSTWGEDHNAENFNSDNQM

SEQ ID NO: 198287 - protein, 34 aa, Artificial Sequence
  Description of Artificial Sequence: Synthetic polypeptide
DETEIRTTNPVATECWGATTANAEDWAEPAEPYI

SEQ ID NO: 198288 - protein, 35 aa, Artificial Sequence
  Description of Artificial Sequence: Synthetic polypeptide
DETEIRTTNPIATECWGATTSANAPDGAMPKGPYV

SEQ ID NO: 198289 - protein, 35 aa, Artificial Sequence
  Description of Artificial Sequence: Synthetic polypeptide
DETEIRTTNPIATECWGATTSANANDNAEPKGPYL

SEQ ID NO: 198290 - protein, 35 aa, Artificial Sequence
  Description of Artificial Sequence: Synthetic polypeptide
DEEEIACTNPVATAQWGCVAGTASHAEADIGIDHF

SEQ ID NO: 198291 - protein, 35 aa, Artificial Sequence
  Description of Artificial Sequence: Synthetic polypeptide
AEECISTVNPVATEGYGCVCSWEEHNEENFGSDQS

SEQ ID NO: 198292 - protein, 34 aa, Artificial Sequence
  Description of Artificial Sequence: Synthetic polypeptide
DENEIATTNPVSTEPWGCIAPEDLTQQQQNMNTS

SEQ ID NO: 198293 - protein, 35 aa, Artificial Sequence
  Description of Artificial Sequence: Synthetic polypeptide
DETEIRTTNPIATECWGATTSANAEDWAEPKGPYI

SEQ ID NO: 198294 - protein, 38 aa, Artificial Sequence
  Description of Artificial Sequence: Synthetic polypeptide
DEGEIATTNPVATEFYGSISFSAPPDTLREPHEGEDTR

SEQ ID NO: 198295 - protein, 35 aa, Artificial Sequence
  Description of Artificial Sequence: Synthetic polypeptide
DEHEIATTNPVAYECWGTVYWINEMQDRQMIHPGS

SEQ ID NO: 198296 - protein, 36 aa, Artificial Sequence
  Description of Artificial Sequence: Synthetic polypeptide
DEMCIRTTNPVATEGWGCVCSWGEHNQEYFGSDTQA

SEQ ID NO: 198297 - protein, 38 aa, Artificial Sequence
  Description of Artificial Sequence: Synthetic polypeptide
DEEEISTTNPVATEQYGCVCSNWGEDHNQENFISQTQS

SEQ ID NO: 198298 - protein, 37 aa, Artificial Sequence
  Description of Artificial Sequence: Synthetic polypeptide
NESEIRTTNPVAYEQWGTVCPTDNHGMVNGQKGDDEK

SEQ ID NO: 198299 - protein, 39 aa, Artificial Sequence
  Description of Artificial Sequence: Synthetic polypeptide
DEEEISTTNPVATEQYGQCQVCSNWGEHNAENFNSDTQA

SEQ ID NO: 198300 - protein, 39 aa, Artificial Sequence
  Description of Artificial Sequence: Synthetic polypeptide
DEEEISTTNPVATEQYGQCQVCSNWGEHNAENFNSDTQG

SEQ ID NO: 198301 - protein, 39 aa, Artificial Sequence
  Description of Artificial Sequence: Synthetic polypeptide
DEEEISTTNPVATEQYGQCQVCSNWGEHNAENFNSDTQP

SEQ ID NO: 198302 - protein, 39 aa, Artificial Sequence
  Description of Artificial Sequence: Synthetic polypeptide
DEEEISTTNPVATEQYGQCQVCSNWGEHNAENFNSDTQS

SEQ ID NO: 198303 - protein, 39 aa, Artificial Sequence
  Description of Artificial Sequence: Synthetic polypeptide
DEEEISTTNPVATEQYGQCQVCSNWGEHNAENFNSETQS

SEQ ID NO: 198304 - protein, 39 aa, Artificial Sequence
  Description of Artificial Sequence: Synthetic polypeptide
DEEEISTTNPVATEQYGQCQVCSNWGEHNTENFNSDTQF

SEQ ID NO: 198305 - protein, 38 aa, Artificial Sequence
  Description of Artificial Sequence: Synthetic polypeptide
DEEEIRATNPVATEQYGSACAAAGPPLDNDASPAGMGN

SEQ ID NO: 198306 - protein, 38 aa, Artificial Sequence
  Description of Artificial Sequence: Synthetic polypeptide
DEEEISTTNPVATEQYGCVCSNWGEDHNQENFISDTQM

SEQ ID NO: 198307 - protein, 39 aa, Artificial Sequence
  Description of Artificial Sequence: Synthetic polypeptide
DEEEISTTNPVATEQYGQCVCGNSGEDHNAENFSSDNQS

SEQ ID NO: 198308 - protein, 37 aa, Artificial Sequence
  Description of Artificial Sequence: Synthetic polypeptide
DEGEIATTNPVATECYGSVCAAVAHALADTPPEEARN

SEQ ID NO: 198309 - protein, 35 aa, Artificial Sequence
  Description of Artificial Sequence: Synthetic polypeptide
SESEIACTNPVGTEGYGVSCGSGELNQHFGSDTIS

SEQ ID NO: 198310 - protein, 35 aa, Artificial Sequence
  Description of Artificial Sequence: Synthetic polypeptide
DEEEIACTNPVATAQWGHSASLAGAGQSAEDPIEN

SEQ ID NO: 198311 - protein, 38 aa, Artificial Sequence
  Description of Artificial Sequence: Synthetic polypeptide
VEEEIRTTNPVATEQYGQMGMDGSGNMDDIMDDGGTGT

SEQ ID NO: 198312 - protein, 38 aa, Artificial Sequence
  Description of Artificial Sequence: Synthetic polypeptide
DEECISTTNPVAYEQYGQCVCSVSGEDNAENFNSDTQA

SEQ ID NO: 198313 - protein, 35 aa, Artificial Sequence
  Description of Artificial Sequence: Synthetic polypeptide
DETEIRTTNPIATECWGATTPANCEDWAEIVGPNV

SEQ ID NO: 198314 - protein, 35 aa, Artificial Sequence
  Description of Artificial Sequence: Synthetic polypeptide
DEHEIATTNPVAYECWGTVYWINDEQQDRQMMHVG

SEQ ID NO: 198315 - protein, 38 aa, Artificial Sequence
  Description of Artificial Sequence: Synthetic polypeptide
DEDEIATTNPVAYEQWGSVSGGEPGNGGNMRNMMEGMD

SEQ ID NO: 198316 - protein, 34 aa, Artificial Sequence
  Description of Artificial Sequence: Synthetic polypeptide
DETEIRTTNPVATECWGATTWANAEDWAEPKEPA

SEQ ID NO: 198317 - protein, 38 aa, Artificial Sequence
  Description of Artificial Sequence: Synthetic polypeptide
DEDEIATTNPVAYEQWGSVSGGEPGNGGNMRNMMGMML

SEQ ID NO: 198318 - protein, 33 aa, Artificial Sequence
  Description of Artificial Sequence: Synthetic polypeptide
SESEIACTNPVAYEGYGEYCNCENGSQAVGGDT

SEQ ID NO: 198319 - protein, 35 aa, Artificial Sequence
  Description of Artificial Sequence: Synthetic polypeptide
SESEIACTNPVAYEGYGEEACSCENLSQAVGGDDA

SEQ ID NO: 198320 - protein, 34 aa, Artificial Sequence
  Description of Artificial Sequence: Synthetic polypeptide
SESEIACTNPVAYEGYGEAPSCENGSQYAVGGDT

SEQ ID NO: 198321 - protein, 38 aa, Artificial Sequence
  Description of Artificial Sequence: Synthetic polypeptide
DEDEIATTNPVAYEQWGSVSGGEPGNGGNMRRKMDTDA

SEQ ID NO: 198322 - protein, 34 aa, Artificial Sequence
  Description of Artificial Sequence: Synthetic polypeptide
SESEIACTNPVAYEGYGEACSCLNGSQAVGGDTN

SEQ ID NO: 198323 - protein, 34 aa, Artificial Sequence
  Description of Artificial Sequence: Synthetic polypeptide
SESEIACTNPVAYEGYGEACSCERLSQAVGGDTD

SEQ ID NO: 198324 - protein, 35 aa, Artificial Sequence
  Description of Artificial Sequence: Synthetic polypeptide
DETEIRTTNPVATECWGATTWANAEDWAEPKGEYI

SEQ ID NO: 198325 - protein, 38 aa, Artificial Sequence
  Description of Artificial Sequence: Synthetic polypeptide
DEECISTTNPVAYEQYGQCVCSNWGEHNTENFISDNQA

SEQ ID NO: 198326 - protein, 35 aa, Artificial Sequence
  Description of Artificial Sequence: Synthetic polypeptide
DENEIATTNPVSTEGYGCICSWEEDNQENFGSDQS

SEQ ID NO: 198327 - protein, 38 aa, Artificial Sequence
  Description of Artificial Sequence: Synthetic polypeptide
DEEEISTTNPVATEQYGCVCSNWGEDHNIENFISDTQS

SEQ ID NO: 198328 - protein, 38 aa, Artificial Sequence
  Description of Artificial Sequence: Synthetic polypeptide
DEEEISTTNPVATEQYGCVCSNWGEDHNQEFFISDTQS

SEQ ID NO: 198329 - protein, 35 aa, Artificial Sequence
  Description of Artificial Sequence: Synthetic polypeptide
DETEIRTTNPVATECWGATTWANAEDWAEPEGPYI

SEQ ID NO: 198330 - protein, 34 aa, Artificial Sequence
  Description of Artificial Sequence: Synthetic polypeptide
DETEIRTTNPVATECWGATTWAAIDWAEPEGPYI

SEQ ID NO: 198331 - protein, 37 aa, Artificial Sequence
  Description of Artificial Sequence: Synthetic polypeptide
DENEIRGTNPVATEAYGSVVLGGQDQEEGMDGEDVGI

SEQ ID NO: 198332 - protein, 38 aa, Artificial Sequence
  Description of Artificial Sequence: Synthetic polypeptide
DEEEISTTNPVATEQYGQCVCGNSGEHNAENFISDTQA

SEQ ID NO: 198333 - protein, 38 aa, Artificial Sequence
  Description of Artificial Sequence: Synthetic polypeptide
DEEEISTTNPVATEQYGCVCSNWGEDHNQENFISDTQA

SEQ ID NO: 198334 - protein, 37 aa, Artificial Sequence
  Description of Artificial Sequence: Synthetic polypeptide
SESEIATTNPVATENYGCVVCMDNGDMQRGTQGDSDP

SEQ ID NO: 198335 - protein, 35 aa, Artificial Sequence
  Description of Artificial Sequence: Synthetic polypeptide
DETEIRTTNPVATECWGATTWANADDWVAPKGPYD

SEQ ID NO: 198336 - protein, 38 aa, Artificial Sequence
  Description of Artificial Sequence: Synthetic polypeptide
DESEIRTTNPVATEGWGQCVCSWGEDENQEYFGSNTQA

SEQ ID NO: 198337 - protein, 37 aa, Artificial Sequence
  Description of Artificial Sequence: Synthetic polypeptide
QAHEIATTNPVATECYGSVCAVANHGPLDSGEGNAMK

SEQ ID NO: 198338 - protein, 39 aa, Artificial Sequence
  Description of Artificial Sequence: Synthetic polypeptide
DEEEISTTNPVATEQYGQCQVCSNWGAHNEENFNSDFQS

SEQ ID NO: 198339 - protein, 35 aa, Artificial Sequence
  Description of Artificial Sequence: Synthetic polypeptide
DETEIRTTNPVATECWGATTWANAEDEAEPKGPYA

SEQ ID NO: 198340 - protein, 37 aa, Artificial Sequence
  Description of Artificial Sequence: Synthetic polypeptide
IVESEVVIRYTQTNPLYLITTEEYLAVGTNLASEGNR

SEQ ID NO: 198341 - protein, 32 aa, Artificial Sequence
  Description of Artificial Sequence: Synthetic polypeptide
QEGEIACTNPCSYEQWGITCYCNDQDSNDTGR

SEQ ID NO: 198342 - protein, 35 aa, Artificial Sequence
  Description of Artificial Sequence: Synthetic polypeptide
DETEIRTTNPVATECWGATTWANAEDTAEPKGPYI

SEQ ID NO: 198343 - protein, 37 aa, Artificial Sequence
  Description of Artificial Sequence: Synthetic polypeptide
DESEIRTTNPVATEGWGQCVCSWGEPNAEYFGSDTQA

SEQ ID NO: 198344 - protein, 35 aa, Artificial Sequence
  Description of Artificial Sequence: Synthetic polypeptide
DETEIRTTNPVATECWGATTWANAEDWAEHKGPYI

SEQ ID NO: 198345 - protein, 33 aa, Artificial Sequence
  Description of Artificial Sequence: Synthetic polypeptide
SESEIASTNPVGTEGYGVICGSGEDQHFGSDIS

SEQ ID NO: 198346 - protein, 37 aa, Artificial Sequence
  Description of Artificial Sequence: Synthetic polypeptide
DEDEIATTNPVAYEQWGSVSGGEPGNGGNMPNMMEHM

SEQ ID NO: 198347 - protein, 34 aa, Artificial Sequence
  Description of Artificial Sequence: Synthetic polypeptide
SESEIASTNPVGTEGYGCSCGSELNQEHFGSDIA

SEQ ID NO: 198348 - protein, 34 aa, Artificial Sequence
  Description of Artificial Sequence: Synthetic polypeptide
DEATIATTNPVAYEAWGVVWPGPNNENDGQSGSE

SEQ ID NO: 198349 - protein, 39 aa, Artificial Sequence
  Description of Artificial Sequence: Synthetic polypeptide
DEEEISTTNPVATEQYGQCQVCSNWEYHNQENFNSETQS

SEQ ID NO: 198350 - protein, 35 aa, Artificial Sequence
  Description of Artificial Sequence: Synthetic polypeptide
DETEIRTTNPIATECWGATTSSTAPDWAEPKGPPI

SEQ ID NO: 198351 - protein, 35 aa, Artificial Sequence
  Description of Artificial Sequence: Synthetic polypeptide
DETEIRTTNPIATECWGATTTANAEDWAEFKGPYI

SEQ ID NO: 198352 - protein, 37 aa, Artificial Sequence
  Description of Artificial Sequence: Synthetic polypeptide
DESEIRTTNPVATEGWGCVCSWGEPDNQEYFGSDTQA

SEQ ID NO: 198353 - protein, 38 aa, Artificial Sequence
  Description of Artificial Sequence: Synthetic polypeptide
DEAEIRTTNPVAYEQYYYSPNPNPNVDMMNFQSGQDEW

SEQ ID NO: 198354 - protein, 37 aa, Artificial Sequence
  Description of Artificial Sequence: Synthetic polypeptide
QAEEIATTNPVAYEQYGSVCAMNNGGEPDIGGDNEMM

SEQ ID NO: 198355 - protein, 36 aa, Artificial Sequence
  Description of Artificial Sequence: Synthetic polypeptide
QAEEIATTNPVAYEQYGSVCAMNNGGEPDIGGIDSL

SEQ ID NO: 198356 - protein, 35 aa, Artificial Sequence
  Description of Artificial Sequence: Synthetic polypeptide
NETEIATTNPTAYEQWGSTCVMWDNPDGNGNTNEP

SEQ ID NO: 198357 - protein, 38 aa, Artificial Sequence
  Description of Artificial Sequence: Synthetic polypeptide
DEAEIRTTNPVATEGWGQCVCSTWGEDNAEYFGSDTQS

SEQ ID NO: 198358 - protein, 37 aa, Artificial Sequence
  Description of Artificial Sequence: Synthetic polypeptide
DEAEIRTTNPVATEGWGQCVCSWGEENQEYFGSQTQM

SEQ ID NO: 198359 - protein, 34 aa, Artificial Sequence
  Description of Artificial Sequence: Synthetic polypeptide
DEDCIATTNPVATEQWGGCCAGTGHQAEPQPMDN

SEQ ID NO: 198360 - protein, 36 aa, Artificial Sequence
  Description of Artificial Sequence: Synthetic polypeptide
DEECISTVNPVATEGYGCVCSWEEHNEENFGSQTQS

SEQ ID NO: 198361 - protein, 36 aa, Artificial Sequence
  Description of Artificial Sequence: Synthetic polypeptide
AESDEIATTNPVAYEQWGSVPTMGGNAGEHQGKTDE

SEQ ID NO: 198362 - protein, 35 aa, Artificial Sequence
  Description of Artificial Sequence: Synthetic polypeptide
DEHEIATTNPVAYECWGTVYWINENQDRQQIHVGQ

SEQ ID NO: 198363 - protein, 38 aa, Artificial Sequence
  Description of Artificial Sequence: Synthetic polypeptide
SESEIRTTNPVATEQYGMVMMQWTLNAYNEGEIQQDEQ

SEQ ID NO: 198364 - protein, 39 aa, Artificial Sequence
  Description of Artificial Sequence: Synthetic polypeptide
DEEEIRTTNPVATEGYGQCVCSNWGEDHNAEFFNSENQA

SEQ ID NO: 198365 - protein, 37 aa, Artificial Sequence
  Description of Artificial Sequence: Synthetic polypeptide
DEECISTVNPVATEGYGCVCSWEEDHNEENFGSDNQS

SEQ ID NO: 198366 - protein, 37 aa, Artificial Sequence
  Description of Artificial Sequence: Synthetic polypeptide
DEGEIATTNPVATEQWGCTTAGNNNIENAMQMDGENP

SEQ ID NO: 198367 - protein, 37 aa, Artificial Sequence
  Description of Artificial Sequence: Synthetic polypeptide
DEAEIRTTNPVATEGWGQCVCSWGEHNAEYFNSDTQA

SEQ ID NO: 198368 - protein, 37 aa, Artificial Sequence
  Description of Artificial Sequence: Synthetic polypeptide
DEMEIRTTNPVATCGYGCVCSNWGEHNQEYFNSDNQA

SEQ ID NO: 198369 - protein, 38 aa, Artificial Sequence
  Description of Artificial Sequence: Synthetic polypeptide
DAEEIATTNPVATEQYGSVCAMANHADDSKAPGDSMDN

SEQ ID NO: 198370 - protein, 37 aa, Artificial Sequence
  Description of Artificial Sequence: Synthetic polypeptide
SESEIRTTNPVATESWGAVFWNENQDDHERQGGDQEM

SEQ ID NO: 198371 - protein, 36 aa, Artificial Sequence
  Description of Artificial Sequence: Synthetic polypeptide
SESEIRTTNPVATESWGAVFWNWNDDHERQGQDESS

SEQ ID NO: 198372 - protein, 33 aa, Artificial Sequence
  Description of Artificial Sequence: Synthetic polypeptide
DETEIRTTNPIATECWGATTWAAEDWAEPKGPI

SEQ ID NO: 198373 - protein, 38 aa, Artificial Sequence
  Description of Artificial Sequence: Synthetic polypeptide
DEEEIRATNPVATEQYGSACAAAGPPFDNDASLAGMDN

SEQ ID NO: 198374 - protein, 38 aa, Artificial Sequence
  Description of Artificial Sequence: Synthetic polypeptide
CESEIATTNPCATEQYGTVCSYTGEEWSENMNGGNYDD

SEQ ID NO: 198375 - protein, 38 aa, Artificial Sequence
  Description of Artificial Sequence: Synthetic polypeptide
TEEEIRCTNPVAYEEYGVSVVACNNAWSTEYKPTNQRS

SEQ ID NO: 198376 - protein, 34 aa, Artificial Sequence
  Description of Artificial Sequence: Synthetic polypeptide
DETEIRTTNPIATECWGATTWAAQDWAEPKGPYI

SEQ ID NO: 198377 - protein, 36 aa, Artificial Sequence
  Description of Artificial Sequence: Synthetic polypeptide
DENEIRCTNPVSTEGYGCICSWEEHNAENFGSDNQA

SEQ ID NO: 198378 - protein, 35 aa, Artificial Sequence
  Description of Artificial Sequence: Synthetic polypeptide
DETEIRTTNPISTEPWGTTTWSNMEDWQEPKGNYH

SEQ ID NO: 198379 - protein, 38 aa, Artificial Sequence
  Description of Artificial Sequence: Synthetic polypeptide
SEECIRTTNPVATEQYGCVCGTWGADHNAENFNSDTQA

SEQ ID NO: 198380 - protein, 36 aa, Artificial Sequence
  Description of Artificial Sequence: Synthetic polypeptide
LDDEIRCTNPVATEQYGCCSWSMVINNQIDTAEDQF

SEQ ID NO: 198381 - protein, 37 aa, Artificial Sequence
  Description of Artificial Sequence: Synthetic polypeptide
SEECIRTTNPVTTEHWGSVYCWMPNDQDDQRQGGDSI

SEQ ID NO: 198382 - protein, 37 aa, Artificial Sequence
  Description of Artificial Sequence: Synthetic polypeptide
DEACIRTTNPLATEQWGCVCSTWGEHNQESFNSDTQA

SEQ ID NO: 198383 - protein, 34 aa, Artificial Sequence
  Description of Artificial Sequence: Synthetic polypeptide
DETEIRTTNPIATECWGATTWAAEDWQEHKGPYI

SEQ ID NO: 198384 - protein, 33 aa, Artificial Sequence
  Description of Artificial Sequence: Synthetic polypeptide
DETEIRTTNPIATECWGATTWAAEDWAPKGPYI

SEQ ID NO: 198385 - protein, 38 aa, Artificial Sequence
  Description of Artificial Sequence: Synthetic polypeptide
DEACIRTTNPVATEGYGCVTSTWGADHNAENFNSDNQA

SEQ ID NO: 198386 - protein, 39 aa, Artificial Sequence
  Description of Artificial Sequence: Synthetic polypeptide
DEEEIRTTNPVAYEQYGQCVCSNWGPDHNQENFNSDTQS

SEQ ID NO: 198387 - protein, 38 aa, Artificial Sequence
  Description of Artificial Sequence: Synthetic polypeptide
SESEIRTTNPVAYEQWGTVCPTDNHGQVNGQKGSNDIP

SEQ ID NO: 198388 - protein, 37 aa, Artificial Sequence
  Description of Artificial Sequence: Synthetic polypeptide
SESEIRTTNPVAYEQWGTVCPTDNHGMVNGQKGLDPP

SEQ ID NO: 198389 - protein, 37 aa, Artificial Sequence
  Description of Artificial Sequence: Synthetic polypeptide
SESEIRTTNPVAYEQWGTVCPTDNHGMVNGQGGGDIP

SEQ ID NO: 198390 - protein, 34 aa, Artificial Sequence
  Description of Artificial Sequence: Synthetic polypeptide
DETEIRTTNPIATECWGATTWAAEDWAERKGPYI

SEQ ID NO: 198391 - protein, 39 aa, Artificial Sequence
  Description of Artificial Sequence: Synthetic polypeptide
DEEEIRTTNPVAYEQYGQCVCSNWMEDDNIEYFNSQNQA

SEQ ID NO: 198392 - protein, 38 aa, Artificial Sequence
  Description of Artificial Sequence: Synthetic polypeptide
DEEEISTTNPVATEQYGCVCSNWGEDHNAENFPSDTQS

SEQ ID NO: 198393 - protein, 39 aa, Artificial Sequence
  Description of Artificial Sequence: Synthetic polypeptide
DEEEIRTTNPVATCQYGQCVCSNWGEDHNQENFNSDNQE

SEQ ID NO: 198394 - protein, 36 aa, Artificial Sequence
  Description of Artificial Sequence: Synthetic polypeptide
AESDEIATTNPCAYEQWGSVCLQNNDVNEERGQNNS

SEQ ID NO: 198395 - protein, 39 aa, Artificial Sequence
  Description of Artificial Sequence: Synthetic polypeptide
DEEEISTTNPVATEQYGQCAVCSNWEEHNAENFGSQTQS

SEQ ID NO: 198396 - protein, 39 aa, Artificial Sequence
  Description of Artificial Sequence: Synthetic polypeptide
DEEEISTTNPVATEQYGQCAVCSNWGEHNAENFNSDNQS

SEQ ID NO: 198397 - protein, 39 aa, Artificial Sequence
  Description of Artificial Sequence: Synthetic polypeptide
DEEEISTTNPVATEQYGQCAVCSNWGEHNIEYFNSDTQA

SEQ ID NO: 198398 - protein, 39 aa, Artificial Sequence
  Description of Artificial Sequence: Synthetic polypeptide
DEEEISTTNPVATEQYGQCAVCSWGEDHNTEGFISDNQS

SEQ ID NO: 198399 - protein, 37 aa, Artificial Sequence
  Description of Artificial Sequence: Synthetic polypeptide
DEAEISTTNPVAYEQYGCVCSNWGEHNAEYFISDNQA

SEQ ID NO: 198400 - protein, 35 aa, Artificial Sequence
  Description of Artificial Sequence: Synthetic polypeptide
DEHEIATTNPVAYECWGTVYWINENQDRQMIHDAS

SEQ ID NO: 198401 - protein, 38 aa, Artificial Sequence
  Description of Artificial Sequence: Synthetic polypeptide
DEEEISTTNPVATEQYGQCAVCSWGEHNQENFFSDTQS

SEQ ID NO: 198402 - protein, 37 aa, Artificial Sequence
  Description of Artificial Sequence: Synthetic polypeptide
CEEEIACTNPVATEQYGCTACAGANGLQEDAGEGEME

SEQ ID NO: 198403 - protein, 39 aa, Artificial Sequence
  Description of Artificial Sequence: Synthetic polypeptide
DEEEISTTNPVATEQYGQCCVCQNSGEHNTENFNSETQA

SEQ ID NO: 198404 - protein, 38 aa, Artificial Sequence
  Description of Artificial Sequence: Synthetic polypeptide
DEEEISTTNPVATEQYGQCICSNWGEHNQENFGSDTQA

SEQ ID NO: 198405 - protein, 37 aa, Artificial Sequence
  Description of Artificial Sequence: Synthetic polypeptide
DEAEISTTNPVAYEQYGCVCSNWGEHNAENFNSENQS

SEQ ID NO: 198406 - protein, 37 aa, Artificial Sequence
  Description of Artificial Sequence: Synthetic polypeptide
DEAEISTTNPVAYEQYGCVCSNWGEHNAENFNSDTQS

SEQ ID NO: 198407 - protein, 38 aa, Artificial Sequence
  Description of Artificial Sequence: Synthetic polypeptide
MEEEIRTTNPVATWQYGSFVDMVFSEHQIVSEQDETTE

SEQ ID NO: 198408 - protein, 35 aa, Artificial Sequence
  Description of Artificial Sequence: Synthetic polypeptide
DETEIRTTNPIATECWGATTTANAEDWAHPKGPYI

SEQ ID NO: 198409 - protein, 35 aa, Artificial Sequence
  Description of Artificial Sequence: Synthetic polypeptide
DETEIRTTNPIATECWGATTTANAEDWAEPKGPYI

SEQ ID NO: 198410 - protein, 37 aa, Artificial Sequence
  Description of Artificial Sequence: Synthetic polypeptide
NESEIRTTNPVAYEQWGTVCPTDNHGQVNGQEGDDQK

SEQ ID NO: 198411 - protein, 39 aa, Artificial Sequence
  Description of Artificial Sequence: Synthetic polypeptide
DEEEISTTNPVATEQYGQCQVCSDWEYHNEENFNSETQA

SEQ ID NO: 198412 - protein, 37 aa, Artificial Sequence
  Description of Artificial Sequence: Synthetic polypeptide
DEAEISTTNPVAYEQYGCVCSNWGEHNIENFNSDTQA

SEQ ID NO: 198413 - protein, 37 aa, Artificial Sequence
  Description of Artificial Sequence: Synthetic polypeptide
QAEEIATTNPVAYEQYGSVCSPVDGNHNIDAMGEGAN

SEQ ID NO: 198414 - protein, 33 aa, Artificial Sequence
  Description of Artificial Sequence: Synthetic polypeptide
DETEIRTTNPVATECWGATANAEDWAEPKEPYI

SEQ ID NO: 198415 - protein, 33 aa, Artificial Sequence
  Description of Artificial Sequence: Synthetic polypeptide
DETEIRTTNPVATECWGATANAEDWAEHKEPYI

SEQ ID NO: 198416 - protein, 37 aa, Artificial Sequence
  Description of Artificial Sequence: Synthetic polypeptide
SESEIRTTNPVATEQWGCYNSETIPLEEFGDEESHED

SEQ ID NO: 198417 - protein, 36 aa, Artificial Sequence
  Description of Artificial Sequence: Synthetic polypeptide
DEHEIRTTNPVAYEQWGHNNVYYWEEQQHGHPGGQE

SEQ ID NO: 198418 - protein, 37 aa, Artificial Sequence
  Description of Artificial Sequence: Synthetic polypeptide
DEECISTVNPVATEGYGCVCSTWGEDHNEENFGSDQS

SEQ ID NO: 198419 - protein, 37 aa, Artificial Sequence
  Description of Artificial Sequence: Synthetic polypeptide
QAEEIATTNPVAYEQYGSVCSANPALGIDHPDDTAAN

SEQ ID NO: 198420 - protein, 37 aa, Artificial Sequence
  Description of Artificial Sequence: Synthetic polypeptide
DEACIRTTNPVATEQYGCTCSWGEDHNAENFNSDTQS

SEQ ID NO: 198421 - protein, 38 aa, Artificial Sequence
  Description of Artificial Sequence: Synthetic polypeptide
DEEEIRTTNPVATEGYGQCVCSNWGEDHEQENFISEQF

SEQ ID NO: 198422 - protein, 36 aa, Artificial Sequence
  Description of Artificial Sequence: Synthetic polypeptide
NESSEIATTNPVAYEQWGSCATGGLNDERNMDRGEQ

SEQ ID NO: 198423 - protein, 37 aa, Artificial Sequence
  Description of Artificial Sequence: Synthetic polypeptide
QAEEIATTNPVAYEQYGSVCSPANPALGIDHDDTLAH

SEQ ID NO: 198424 - protein, 37 aa, Artificial Sequence
  Description of Artificial Sequence: Synthetic polypeptide
QAEEIATTNPVAYEQYGSVCDTDGALTGTPGVPMQMD

SEQ ID NO: 198425 - protein, 36 aa, Artificial Sequence
  Description of Artificial Sequence: Synthetic polypeptide
DEDCIACTNPVATEQWGSNSATWPAGTNQGNGMEPV

SEQ ID NO: 198426 - protein, 35 aa, Artificial Sequence
  Description of Artificial Sequence: Synthetic polypeptide
DEECISTVNPVATEGYGCVCGWGEHNEENFGSDQS

SEQ ID NO: 198427 - protein, 34 aa, Artificial Sequence
  Description of Artificial Sequence: Synthetic polypeptide
DDSEVASTNPVSTEGYGCVCGNSPIQERFGSQQA

SEQ ID NO: 198428 - protein, 34 aa, Artificial Sequence
  Description of Artificial Sequence: Synthetic polypeptide
DETEIRTTNPVATECWGATACIDWPADPEGEPYG

SEQ ID NO: 198429 - protein, 39 aa, Artificial Sequence
  Description of Artificial Sequence: Synthetic polypeptide
DEEEISTTNPVATEQYGICVCSNWEEDDNAENFNSQTQA

SEQ ID NO: 198430 - protein, 37 aa, Artificial Sequence
  Description of Artificial Sequence: Synthetic polypeptide
QEDEIRTTNPVATEFYGAVVYTDFGQDQTDEGGQGGI

SEQ ID NO: 198431 - protein, 34 aa, Artificial Sequence
  Description of Artificial Sequence: Synthetic polypeptide
DDSEVASTNPVSTEGYGNVSAANPTYQSDVGQTK

SEQ ID NO: 198432 - protein, 35 aa, Artificial Sequence
  Description of Artificial Sequence: Synthetic polypeptide
DEEEIACTNPVATAAWGCVAGTASHQEADIGIDHQ

SEQ ID NO: 198433 - protein, 37 aa, Artificial Sequence
  Description of Artificial Sequence: Synthetic polypeptide
DEAEISTTNPVAYEQYGCVCSWGEDHNAENFNSDNQL

SEQ ID NO: 198434 - protein, 38 aa, Artificial Sequence
  Description of Artificial Sequence: Synthetic polypeptide
DEEEIRTTNPVAYEQWGQCVCSNWMEDNAENFGSQTQS

SEQ ID NO: 198435 - protein, 34 aa, Artificial Sequence
  Description of Artificial Sequence: Synthetic polypeptide
SESEIACTNPVAYEGYGEACSCENGSQASGGDTD

SEQ ID NO: 198436 - protein, 38 aa, Artificial Sequence
  Description of Artificial Sequence: Synthetic polypeptide
DEMCIRTTNPVATEGYGCVTSTWGADHNAEHFNSDPQS

SEQ ID NO: 198437 - protein, 34 aa, Artificial Sequence
  Description of Artificial Sequence: Synthetic polypeptide
SESEIACTNPVAYEGYGEACSCENGSQAAVGGDN

SEQ ID NO: 198438 - protein, 35 aa, Artificial Sequence
  Description of Artificial Sequence: Synthetic polypeptide
DETEIRTTNPIATECWGATTGANAEDWREPKGPYI

SEQ ID NO: 198439 - protein, 39 aa, Artificial Sequence
  Description of Artificial Sequence: Synthetic polypeptide
DEEEISTTNPVATEQYGQCVCSDWGEAHNQENFNSETQS

SEQ ID NO: 198440 - protein, 37 aa, Artificial Sequence
  Description of Artificial Sequence: Synthetic polypeptide
SEPEIRCTNPVATEQYGASAVVAVPVHHLEGQEDQEY

SEQ ID NO: 198441 - protein, 39 aa, Artificial Sequence
  Description of Artificial Sequence: Synthetic polypeptide
DEEEISTTNPVATEQYGQCVCSDWGEDDNAEHFNSENQS

SEQ ID NO: 198442 - protein, 39 aa, Artificial Sequence
  Description of Artificial Sequence: Synthetic polypeptide
DEEEISTTNPVATEQYGQCVCSDWGEDHNAENFNSDTQS

SEQ ID NO: 198443 - protein, 38 aa, Artificial Sequence
  Description of Artificial Sequence: Synthetic polypeptide
ADEEIRTTNPVATEQYGQCVCSNWGEHNAENFNSDTQS

SEQ ID NO: 198444 - protein, 39 aa, Artificial Sequence
  Description of Artificial Sequence: Synthetic polypeptide
DEEEISTTNPVATEQYGQCVCSDWGEDHNQEHFNSDTQS

SEQ ID NO: 198445 - protein, 39 aa, Artificial Sequence
  Description of Artificial Sequence: Synthetic polypeptide
DEEEISTTNPVATEQYGQCVCSDWGEDHNQENFGSDTQA

SEQ ID NO: 198446 - protein, 36 aa, Artificial Sequence
  Description of Artificial Sequence: Synthetic polypeptide
DEAVEATTNPVAYEQWGCVYSVVNNDAGEQGGNNEM

SEQ ID NO: 198447 - protein, 37 aa, Artificial Sequence
  Description of Artificial Sequence: Synthetic polypeptide
CEEEIACTNPVATEQYGSACAANPDQAQEHQDGTEMK

SEQ ID NO: 198448 - protein, 39 aa, Artificial Sequence
  Description of Artificial Sequence: Synthetic polypeptide
DEEEISTTNPVATEQYGQCVCSDWGEDHNQEYFNSDTQS

SEQ ID NO: 198449 - protein, 38 aa, Artificial Sequence
  Description of Artificial Sequence: Synthetic polypeptide
DEECIRTTNPVAYEQYGQCVCSNWGEHNAENFNSDNQS

SEQ ID NO: 198450 - protein, 38 aa, Artificial Sequence
  Description of Artificial Sequence: Synthetic polypeptide
DEMEIATTNPVATEQYGQCVCSNWEDHNEEHFGSEDQS

SEQ ID NO: 198451 - protein, 38 aa, Artificial Sequence
  Description of Artificial Sequence: Synthetic polypeptide
DEEEISTTNPVATEQYGQCVCSDWGEHEQENFISDTQS

SEQ ID NO: 198452 - protein, 38 aa, Artificial Sequence
  Description of Artificial Sequence: Synthetic polypeptide
DEMEIATTNPVATEQYGQCVCSNSMDHNEEHFGSETQA

SEQ ID NO: 198453 - protein, 39 aa, Artificial Sequence
  Description of Artificial Sequence: Synthetic polypeptide
DEMEIATTNPVATEQYGQCQVCSNWGEHNAEHFGSENQA

SEQ ID NO: 198454 - protein, 36 aa, Artificial Sequence
  Description of Artificial Sequence: Synthetic polypeptide
DEAEIRTTNPVSYEPWGKIASCMEDSISDQMNGGNH

SEQ ID NO: 198455 - protein, 35 aa, Artificial Sequence
  Description of Artificial Sequence: Synthetic polypeptide
DETEIRTTNPIATECWGATTHANAEDLAEPKGPYI

SEQ ID NO: 198456 - protein, 38 aa, Artificial Sequence
  Description of Artificial Sequence: Synthetic polypeptide
SEPEIRTTNPVATEQYGASAVVAWDVHHSETGQEDQEY

SEQ ID NO: 198457 - protein, 34 aa, Artificial Sequence
  Description of Artificial Sequence: Synthetic polypeptide
DDSEVASTNPVSTEGYGNVCYNTIDQSRVGQQEQ

SEQ ID NO: 198458 - protein, 36 aa, Artificial Sequence
  Description of Artificial Sequence: Synthetic polypeptide
DEDEIATTNPVAYEQWGTACAATAGELPDSGPNDQM

SEQ ID NO: 198459 - protein, 39 aa, Artificial Sequence
  Description of Artificial Sequence: Synthetic polypeptide
DEEEISTTNPVATEQYGQCVCSDSGEDHNQEYFNSDTQP

SEQ ID NO: 198460 - protein, 38 aa, Artificial Sequence
  Description of Artificial Sequence: Synthetic polypeptide
QAEEIATTNPVATEQYGSCPANMNGVETNPDDHMENNN

SEQ ID NO: 198461 - protein, 37 aa, Artificial Sequence
  Description of Artificial Sequence: Synthetic polypeptide
DEMCIRTTNPVATEQWGCVCQNWNEDNAEGFNSDNQS

SEQ ID NO: 198462 - protein, 37 aa, Artificial Sequence
  Description of Artificial Sequence: Synthetic polypeptide
IEQEICTTNPVATEQYGSVPYNTVENYEGHIYSLQDE

SEQ ID NO: 198463 - protein, 37 aa, Artificial Sequence
  Description of Artificial Sequence: Synthetic polypeptide
DAAEIATTNPVATEQYGSVCAMANHADDSKAPGQMES

SEQ ID NO: 198464 - protein, 38 aa, Artificial Sequence
  Description of Artificial Sequence: Synthetic polypeptide
DAAEIATTNPVATEQYGSVCAMANHADDSKAPGDIMNN

SEQ ID NO: 198465 - protein, 36 aa, Artificial Sequence
  Description of Artificial Sequence: Synthetic polypeptide
IEQEICTTNPVATEQYGAVYNTVENYEPHIYSLQDE

SEQ ID NO: 198466 - protein, 36 aa, Artificial Sequence
  Description of Artificial Sequence: Synthetic polypeptide
QAHEIATTNPVAYEQYGSVCAMNNGLGPADGGMEDG

SEQ ID NO: 198467 - protein, 35 aa, Artificial Sequence
  Description of Artificial Sequence: Synthetic polypeptide
DEAEIRTTNPVSYEPWGKICCMEESISDQMNGGNT

SEQ ID NO: 198468 - protein, 38 aa, Artificial Sequence
  Description of Artificial Sequence: Synthetic polypeptide
QEGSIATTNPVATEQYGNISFSAPFDTLLEPHEGEDTR

SEQ ID NO: 198469 - protein, 39 aa, Artificial Sequence
  Description of Artificial Sequence: Synthetic polypeptide
DESEIRTTNPVATEGYGVVDVGVGTGNVGDEEGEGNDTI

SEQ ID NO: 198470 - protein, 38 aa, Artificial Sequence
  Description of Artificial Sequence: Synthetic polypeptide
DEGEIATTNPVATEWYGVSISFSAPDTLREPHEGEDTR

SEQ ID NO: 198471 - protein, 35 aa, Artificial Sequence
  Description of Artificial Sequence: Synthetic polypeptide
DENCIATVNPVATECYGSVVCIDHQHQEQQGMTET

SEQ ID NO: 198472 - protein, 35 aa, Artificial Sequence
  Description of Artificial Sequence: Synthetic polypeptide
DETEIRTTNPVATECWGATWWANAEDWAEPKGPYI

SEQ ID NO: 198473 - protein, 35 aa, Artificial Sequence
  Description of Artificial Sequence: Synthetic polypeptide
DETEIRTTNPIATECWGATTHANAEDQAEPKGPYI

SEQ ID NO: 198474 - protein, 37 aa, Artificial Sequence
  Description of Artificial Sequence: Synthetic polypeptide
IENEIRTTNPVATEQYGSTSDEVMSAFEFGESEQEIV

SEQ ID NO: 198475 - protein, 33 aa, Artificial Sequence
  Description of Artificial Sequence: Synthetic polypeptide
QEGVACCTNPVAYEQWGSVSMNNSNPAGGPGES

SEQ ID NO: 198476 - protein, 35 aa, Artificial Sequence
  Description of Artificial Sequence: Synthetic polypeptide
DEDEIATTNPVAYEQWGTACAATAGELPDSASNPV

SEQ ID NO: 198477 - protein, 37 aa, Artificial Sequence
  Description of Artificial Sequence: Synthetic polypeptide
SEQEIATTNPVATEQYGCVAGNHSGDPATMHNGEEGH

SEQ ID NO: 198478 - protein, 36 aa, Artificial Sequence
  Description of Artificial Sequence: Synthetic polypeptide
IEQEIRTTNPVAYEWWGCVSPTIECNYDITDEGLQE

SEQ ID NO: 198479 - protein, 37 aa, Artificial Sequence
  Description of Artificial Sequence: Synthetic polypeptide
DEAEIATTNPVATCGYGCVCSWGALHNQENFNSDTQS

SEQ ID NO: 198480 - protein, 35 aa, Artificial Sequence
  Description of Artificial Sequence: Synthetic polypeptide
DEAEIRTTNPVSYEPWGKISCMEDSISDQMTGGVT

SEQ ID NO: 198481 - protein, 38 aa, Artificial Sequence
  Description of Artificial Sequence: Synthetic polypeptide
DEAEIATTNPVATAQWGSVCSEANPALPNDHGGGMGHW

SEQ ID NO: 198482 - protein, 38 aa, Artificial Sequence
  Description of Artificial Sequence: Synthetic polypeptide
IEGEIRTTNPVATEQYGEVFCPNPEVGNVQIELGEDHI

SEQ ID NO: 198483 - protein, 38 aa, Artificial Sequence
  Description of Artificial Sequence: Synthetic polypeptide
MEGEIRSTNPVATEQYGSCSSPAPAEGPNMSFEGNSDC

SEQ ID NO: 198484 - protein, 38 aa, Artificial Sequence
  Description of Artificial Sequence: Synthetic polypeptide
SENEIRTTNPVATEQYGTVYNVSYTLMGMHQETQDDTQ

SEQ ID NO: 198485 - protein, 36 aa, Artificial Sequence
  Description of Artificial Sequence: Synthetic polypeptide
CEEEIACTNPVATEQYGSACAAPDIGQNHADENGHH

SEQ ID NO: 198486 - protein, 34 aa, Artificial Sequence
  Description of Artificial Sequence: Synthetic polypeptide
DETEIRTTNPIATECWGATTANAEDWAEPKGPYI

SEQ ID NO: 198487 - protein, 37 aa, Artificial Sequence
  Description of Artificial Sequence: Synthetic polypeptide
SENEIRTTNPVATEQYGTVYNDYRLMGMHLELQDDTQ

SEQ ID NO: 198488 - protein, 37 aa, Artificial Sequence
  Description of Artificial Sequence: Synthetic polypeptide
IEGEIRTTNPVATEQYGEVFCNTPEVGGVQIELEDHI

SEQ ID NO: 198489 - protein, 37 aa, Artificial Sequence
  Description of Artificial Sequence: Synthetic polypeptide
IEGEIRTTNPVATEQWGEVFCPTTEVGNVQIELEDHI

SEQ ID NO: 198490 - protein, 37 aa, Artificial Sequence
  Description of Artificial Sequence: Synthetic polypeptide
DEAEIATTNPVATAQWGANTTTAATNHLAGMGGNDHN

SEQ ID NO: 198491 - protein, 39 aa, Artificial Sequence
  Description of Artificial Sequence: Synthetic polypeptide
TEEEIRTTNPVATEGYGVVDVGVGTGNVGEEEGEGNTTI

SEQ ID NO: 198492 - protein, 34 aa, Artificial Sequence
  Description of Artificial Sequence: Synthetic polypeptide
DDSEVASTNPVSTEGYGNVCYNTIDQSRHGQQSH

SEQ ID NO: 198493 - protein, 37 aa, Artificial Sequence
  Description of Artificial Sequence: Synthetic polypeptide
AEREIRTTNPVATEQYGCVCQNWGEHNAENFISDTQS

SEQ ID NO: 198494 - protein, 39 aa, Artificial Sequence
  Description of Artificial Sequence: Synthetic polypeptide
IEEEIRTTNPVATEQYGTVTVVGTANKLLTHPSITMEPD

SEQ ID NO: 198495 - protein, 38 aa, Artificial Sequence
  Description of Artificial Sequence: Synthetic polypeptide
AEREIRTTNPVATEQYGCVCGNWGEDDNQEYFGSDTQA

SEQ ID NO: 198496 - protein, 38 aa, Artificial Sequence
  Description of Artificial Sequence: Synthetic polypeptide
DETEIRTTNPVATEFYGAVCDNLDAMDEDEGEGGFEQE

SEQ ID NO: 198497 - protein, 35 aa, Artificial Sequence
  Description of Artificial Sequence: Synthetic polypeptide
DETEIRTTNPIATECWGATTANAEDRWAEPKGPYI

SEQ ID NO: 198498 - protein, 34 aa, Artificial Sequence
  Description of Artificial Sequence: Synthetic polypeptide
DDSEVASTNPVSTEGYGCVCFNSAIQERFGSQQS

SEQ ID NO: 198499 - protein, 39 aa, Artificial Sequence
  Description of Artificial Sequence: Synthetic polypeptide
AEDEICTTNPVATEAYGVVATVVTEEIGTNLQIGSNEEM

SEQ ID NO: 198500 - protein, 35 aa, Artificial Sequence
  Description of Artificial Sequence: Synthetic polypeptide
DEGEIATTNPVAYECWGTVYWINENQDRQMIHQGS

SEQ ID NO: 198501 - protein, 38 aa, Artificial Sequence
  Description of Artificial Sequence: Synthetic polypeptide
DEEEIRTTNPVATEQYGYFHNTHISEDDNQGKHETEQQ

SEQ ID NO: 198502 - protein, 36 aa, Artificial Sequence
  Description of Artificial Sequence: Synthetic polypeptide
DEAEIRTTNPVSYEPWGTISCMEDSISDQMNGGNFD

SEQ ID NO: 198503 - protein, 35 aa, Artificial Sequence
  Description of Artificial Sequence: Synthetic polypeptide
AEDEICTTNPVAYEQWGSSYKLPNMLQQADDKDMM

SEQ ID NO: 198504 - protein, 35 aa, Artificial Sequence
  Description of Artificial Sequence: Synthetic polypeptide
AEDEICTTNPVAYEQWGSSYKLPNMLQKQADSDMM

SEQ ID NO: 198505 - protein, 37 aa, Artificial Sequence
  Description of Artificial Sequence: Synthetic polypeptide
DEDEIATTNPVAYEQWGTFACAATAGELPDSGSNMRN

SEQ ID NO: 198506 - protein, 37 aa, Artificial Sequence
  Description of Artificial Sequence: Synthetic polypeptide
DEAEIRYTNPVAYEQYQSLPNPNVDFMNFQSGQDTEW

SEQ ID NO: 198507 - protein, 37 aa, Artificial Sequence
  Description of Artificial Sequence: Synthetic polypeptide
IEGEIRTTNPVATEQYGEVFCPTPEVPNVNIELEDHI

SEQ ID NO: 198508 - protein, 35 aa, Artificial Sequence
  Description of Artificial Sequence: Synthetic polypeptide
DEGEIATTNPVATAQWGCVAGEGEEMNAALMDNGM

SEQ ID NO: 198509 - protein, 36 aa, Artificial Sequence
  Description of Artificial Sequence: Synthetic polypeptide
SENEIRTTNPVSTEVYGTVQTSPMDGIEIQQNDAHH

SEQ ID NO: 198510 - protein, 37 aa, Artificial Sequence
  Description of Artificial Sequence: Synthetic polypeptide
DEAEISTTNPVAYEQYGCVCGNWGEHNQENFNSETQP

SEQ ID NO: 198511 - protein, 37 aa, Artificial Sequence
  Description of Artificial Sequence: Synthetic polypeptide
IEGEIRTTNPVATEQYGEVFCPTPEVGSVQIHLEDHI

SEQ ID NO: 198512 - protein, 36 aa, Artificial Sequence
  Description of Artificial Sequence: Synthetic polypeptide
DEDEIATTNPVAYEQWGTFNCAATAGELPDSGPNSP

SEQ ID NO: 198513 - protein, 39 aa, Artificial Sequence
  Description of Artificial Sequence: Synthetic polypeptide
MEGEICTTNPVATEQYGTYSTMWWVNELEGESGDGNYEG

SEQ ID NO: 198514 - protein, 39 aa, Artificial Sequence
  Description of Artificial Sequence: Synthetic polypeptide
TEEEIRTTNPVATEFYGNVVVDNGNANGEQEDEGGNDEE

SEQ ID NO: 198515 - protein, 37 aa, Artificial Sequence
  Description of Artificial Sequence: Synthetic polypeptide
MEGEIRCTNPVATEQYGCCFDTSVYEHDENGGQNTES

SEQ ID NO: 198516 - protein, 39 aa, Artificial Sequence
  Description of Artificial Sequence: Synthetic polypeptide
DEEEIRTTNPVATEQYGYFHNGCHISFDDNQREHETEQQ

SEQ ID NO: 198517 - protein, 38 aa, Artificial Sequence
  Description of Artificial Sequence: Synthetic polypeptide
IEGEIRTTNPVATEQYGEVFCPTPEVGNVQIELEEDHF

SEQ ID NO: 198518 - protein, 34 aa, Artificial Sequence
  Description of Artificial Sequence: Synthetic polypeptide
DETEIRTTNPIATECWGATTANEEDWAEPKGPYI

SEQ ID NO: 198519 - protein, 38 aa, Artificial Sequence
  Description of Artificial Sequence: Synthetic polypeptide
TEEEIRTTNPVATEFYGVVVDNGNANGEQEDEGGAEEE

SEQ ID NO: 198520 - protein, 36 aa, Artificial Sequence
  Description of Artificial Sequence: Synthetic polypeptide
DEGEIATTNPVATAQWGANITTAATNHLAGMPGGSH

SEQ ID NO: 198521 - protein, 37 aa, Artificial Sequence
  Description of Artificial Sequence: Synthetic polypeptide
CEDEIACTNPVATEQYGSVCAATENPEAGTHGDEDAH

SEQ ID NO: 198522 - protein, 36 aa, Artificial Sequence
  Description of Artificial Sequence: Synthetic polypeptide
DETEIRTTNPVATECWGATVWANAEDWPAEPKGPPI

SEQ ID NO: 198523 - protein, 37 aa, Artificial Sequence
  Description of Artificial Sequence: Synthetic polypeptide
DAAEIATTNPVATEQYGSVCAMANNVPTEDGGVPTEM

SEQ ID NO: 198524 - protein, 38 aa, Artificial Sequence
  Description of Artificial Sequence: Synthetic polypeptide
DEEEISTTNPVATEQYGCVCSNWGEDHNAENFISETQL

SEQ ID NO: 198525 - protein, 38 aa, Artificial Sequence
  Description of Artificial Sequence: Synthetic polypeptide
DEEEISTTNPVATEQYGCVCSNWGEDHNAENFISDTQS

SEQ ID NO: 198526 - protein, 38 aa, Artificial Sequence
  Description of Artificial Sequence: Synthetic polypeptide
DEECISTTNPVAYEQYGQCVCSNWGEHNAENFGSDNQS

SEQ ID NO: 198527 - protein, 38 aa, Artificial Sequence
  Description of Artificial Sequence: Synthetic polypeptide
DEEEISTTNPVATEQYGCVCSNWGEDHNAENFISDTQA

SEQ ID NO: 198528 - protein, 35 aa, Artificial Sequence
  Description of Artificial Sequence: Synthetic polypeptide
DETEIRTTNPVATECWGATTWANAEDWVAPKGPYD

SEQ ID NO: 198529 - protein, 38 aa, Artificial Sequence
  Description of Artificial Sequence: Synthetic polypeptide
DEEEIRTTNPVAYEQYGQCVCSNWGEHNQENFISETQA

SEQ ID NO: 198530 - protein, 33 aa, Artificial Sequence
  Description of Artificial Sequence: Synthetic polypeptide
SESCIACTNPVAYEGYGEACSCELGSQAVGGDT

SEQ ID NO: 198531 - protein, 38 aa, Artificial Sequence
  Description of Artificial Sequence: Synthetic polypeptide
DEEEIRTTNPVSYEQYGCVCGNWGEDHNQEGFISQTQA

SEQ ID NO: 198532 - protein, 35 aa, Artificial Sequence
  Description of Artificial Sequence: Synthetic polypeptide
DETEIRTTNPVATECWGATTWANAEIEAEPKGPYI

SEQ ID NO: 198533 - protein, 36 aa, Artificial Sequence
  Description of Artificial Sequence: Synthetic polypeptide
QEGEIAPTNPCSYEQYGIVTVSCCNMLSQSSVGGTR

SEQ ID NO: 198534 - protein, 37 aa, Artificial Sequence
  Description of Artificial Sequence: Synthetic polypeptide
DENEIRGTNPVATEFYGQVVENMGNFTGQGGEGAEQD

SEQ ID NO: 198535 - protein, 37 aa, Artificial Sequence
  Description of Artificial Sequence: Synthetic polypeptide
MEEEISTTNPVAYEQYGQCVCSWGEHNQENFNSDNQG

SEQ ID NO: 198536 - protein, 35 aa, Artificial Sequence
  Description of Artificial Sequence: Synthetic polypeptide
QENEIATTNPVAYEPYGNVNSGEHLNQNHMEMQLN

SEQ ID NO: 198537 - protein, 38 aa, Artificial Sequence
  Description of Artificial Sequence: Synthetic polypeptide
DEDEIACTNPVATEQYGSVCAMANPAEDQDDPLGFFHQ

SEQ ID NO: 198538 - protein, 35 aa, Artificial Sequence
  Description of Artificial Sequence: Synthetic polypeptide
QENEIATTNPVAYEPYGNVAGENHLNQNHMEMQLN

SEQ ID NO: 198539 - protein, 34 aa, Artificial Sequence
  Description of Artificial Sequence: Synthetic polypeptide
DETEIRTTNPVATECWGATTWANAEIWMEPAEPI

SEQ ID NO: 198540 - protein, 36 aa, Artificial Sequence
  Description of Artificial Sequence: Synthetic polypeptide
DEGEIATTNPVATAQWGHVVANTGAGEAGAEGTGNT

SEQ ID NO: 198541 - protein, 37 aa, Artificial Sequence
  Description of Artificial Sequence: Synthetic polypeptide
DEAEIRTTNPVSTEGYGCICSNWEEHNAEQFISDNQA

SEQ ID NO: 198542 - protein, 38 aa, Artificial Sequence
  Description of Artificial Sequence: Synthetic polypeptide
DEEEISTTNPVATEQYGQCVCGNWGEHNQENFISDTQG

SEQ ID NO: 198543 - protein, 35 aa, Artificial Sequence
  Description of Artificial Sequence: Synthetic polypeptide
DETEIRTTNPVATECWGATTWANAEDWEEHKGPYI

SEQ ID NO: 198544 - protein, 38 aa, Artificial Sequence
  Description of Artificial Sequence: Synthetic polypeptide
DEEEISTTNPVATEQYGQCVCGNWGEHNIEYFNSENQA

SEQ ID NO: 198545 - protein, 33 aa, Artificial Sequence
  Description of Artificial Sequence: Synthetic polypeptide
SESEIACTNPVAYEGYGEACSCENGSGAVGGDT

SEQ ID NO: 198546 - protein, 37 aa, Artificial Sequence
  Description of Artificial Sequence: Synthetic polypeptide
DEECISTTNPVAYEQYGQCVCSNWGEHNQEYFGSDQS

SEQ ID NO: 198547 - protein, 38 aa, Artificial Sequence
  Description of Artificial Sequence: Synthetic polypeptide
DEECIRTTNPVAYEQYGQCVCSNWGEHNQEYFSSDNQS

SEQ ID NO: 198548 - protein, 34 aa, Artificial Sequence
  Description of Artificial Sequence: Synthetic polypeptide
SESEIACTNPVAYEGYGEACSCELFGSQAVGGDT

SEQ ID NO: 198549 - protein, 33 aa, Artificial Sequence
  Description of Artificial Sequence: Synthetic polypeptide
SESEIACTNPVAYEGYGEACSCEELSAAVGGDT

SEQ ID NO: 198550 - protein, 36 aa, Artificial Sequence
  Description of Artificial Sequence: Synthetic polypeptide
DEGEIATTNPVATASWGCVAAANNEVQDQGGENTHQ

SEQ ID NO: 198551 - protein, 38 aa, Artificial Sequence
  Description of Artificial Sequence: Synthetic polypeptide
MEEEISTTNPVATEQYGEVVGQHVWNDAEVPQPIGDDG

SEQ ID NO: 198552 - protein, 38 aa, Artificial Sequence
  Description of Artificial Sequence: Synthetic polypeptide
DEDEIATTNPVAYEQWGSVSGGEPGNGGNMRRQEEMMA

SEQ ID NO: 198553 - protein, 35 aa, Artificial Sequence
  Description of Artificial Sequence: Synthetic polypeptide
DETEIRTTNPVATECWGATTWANAPDWAEPKGPYI

SEQ ID NO: 198554 - protein, 39 aa, Artificial Sequence
  Description of Artificial Sequence: Synthetic polypeptide
DEEEISTTNPVATEQYGQCVCGNWGEDHNQENSNSDTQS

SEQ ID NO: 198555 - protein, 35 aa, Artificial Sequence
  Description of Artificial Sequence: Synthetic polypeptide
DETEIRTTNPVATECWGATTWANAEDWAEPKGPYI

SEQ ID NO: 198556 - protein, 37 aa, Artificial Sequence
  Description of Artificial Sequence: Synthetic polypeptide
DEGEIATTNPVATASWGCVAAANNAEVQDRGGENTDD

SEQ ID NO: 198557 - protein, 38 aa, Artificial Sequence
  Description of Artificial Sequence: Synthetic polypeptide
DEEEISTTNPVATEQYGQCVCGNWGEHNAEFFISDNQA

SEQ ID NO: 198558 - protein, 38 aa, Artificial Sequence
  Description of Artificial Sequence: Synthetic polypeptide
DEEEIRTTNPVATEQYGYCCSCIIMPTEKWGVDIIEEG

SEQ ID NO: 198559 - protein, 38 aa, Artificial Sequence
  Description of Artificial Sequence: Synthetic polypeptide
DEEEISTTNPVATEQYGQCVCGNWGEHNAENFGSDTQS

SEQ ID NO: 198560 - protein, 38 aa, Artificial Sequence
  Description of Artificial Sequence: Synthetic polypeptide
DEEEISTTNPVATEQYGQCVCGNWGEHNAENFISDTQS

SEQ ID NO: 198561 - protein, 38 aa, Artificial Sequence
  Description of Artificial Sequence: Synthetic polypeptide
DEEEISTTNPVATEQYGQCVCGNWGEHNAENFNSETQA

SEQ ID NO: 198562 - protein, 38 aa, Artificial Sequence
  Description of Artificial Sequence: Synthetic polypeptide
DEEEIRTTNPVATEQYGYCSCIIMPTEYWGEDIIEEGQ

SEQ ID NO: 198563 - protein, 35 aa, Artificial Sequence
  Description of Artificial Sequence: Synthetic polypeptide
DETEIRTTNPVATECWGATTWANAEDWAEPKGPYA

SEQ ID NO: 198564 - protein, 38 aa, Artificial Sequence
  Description of Artificial Sequence: Synthetic polypeptide
DEEEISTTNPVATEQYGCVCSNWGEDDNAEYFISDTQA

SEQ ID NO: 198565 - protein, 35 aa, Artificial Sequence
  Description of Artificial Sequence: Synthetic polypeptide
DETEIRTTNPVATECWGATTWANAPDWAEPKGPYV

SEQ ID NO: 198566 - protein, 37 aa, Artificial Sequence
  Description of Artificial Sequence: Synthetic polypeptide
DAEEIATTNPVAYEQYGSVCAANNGKGEPDIGGGEMW

SEQ ID NO: 198567 - protein, 38 aa, Artificial Sequence
  Description of Artificial Sequence: Synthetic polypeptide
CEEEIACTNPVATEQYGCNVAGNNGGLPAENDHGTDRQ

SEQ ID NO: 198568 - protein, 35 aa, Artificial Sequence
  Description of Artificial Sequence: Synthetic polypeptide
DETEIRTTNPVATECWGATTWSNAEIEMNPAGPYA

SEQ ID NO: 198569 - protein, 38 aa, Artificial Sequence
  Description of Artificial Sequence: Synthetic polypeptide
DEEEISTTNPVATEQYGCVCSNWGEDHDIEGFISDTQS

SEQ ID NO: 198570 - protein, 38 aa, Artificial Sequence
  Description of Artificial Sequence: Synthetic polypeptide
DEMEIATTNPVAYEQYGTVCSYTDGLPEEEHDGKQGDS

SEQ ID NO: 198571 - protein, 37 aa, Artificial Sequence
  Description of Artificial Sequence: Synthetic polypeptide
DEGEIATTNPVATAQWGHSASAVGDPEADTHLGEDNH

SEQ ID NO: 198572 - protein, 37 aa, Artificial Sequence
  Description of Artificial Sequence: Synthetic polypeptide
DEGEIATTNPVATAQWGHSASAVGDLEADTPGGDGNK

SEQ ID NO: 198573 - protein, 37 aa, Artificial Sequence
  Description of Artificial Sequence: Synthetic polypeptide
DEGEIATTNPVATAQWGHSASAVGDLEAAMPGGEDNH

SEQ ID NO: 198574 - protein, 39 aa, Artificial Sequence
  Description of Artificial Sequence: Synthetic polypeptide
DEEEISTTNPVATEQYGQCVCQNWGEDHNAEGFNSETQA

SEQ ID NO: 198575 - protein, 39 aa, Artificial Sequence
  Description of Artificial Sequence: Synthetic polypeptide
DEEEISTTNPVATEQYGQCVCQNWGEDHNAENFGSDNQA

SEQ ID NO: 198576 - protein, 38 aa, Artificial Sequence
  Description of Artificial Sequence: Synthetic polypeptide
QAEEIATTNPVATEQYGSTVCAGNGVGDAATAGEGNHN

SEQ ID NO: 198577 - protein, 38 aa, Artificial Sequence
  Description of Artificial Sequence: Synthetic polypeptide
DAAEIATTNPVATEQYGSVCAMNNGEPMNATPGDNMNP

SEQ ID NO: 198578 - protein, 35 aa, Artificial Sequence
  Description of Artificial Sequence: Synthetic polypeptide
SEQEIATTNPVAYEQWGSTCSANDNNDHQGDIDDY

SEQ ID NO: 198579 - protein, 39 aa, Artificial Sequence
  Description of Artificial Sequence: Synthetic polypeptide
DEMEIATTNPVATEQYGQCVCSNWGEDDNEEHFGSDNQA

SEQ ID NO: 198580 - protein, 38 aa, Artificial Sequence
  Description of Artificial Sequence: Synthetic polypeptide
DEGEIATTNPVATAQWGHSASAVGDGLEADQPGGEDNH

SEQ ID NO: 198581 - protein, 34 aa, Artificial Sequence
  Description of Artificial Sequence: Synthetic polypeptide
IESEIRCTNPTAYECWGCVYGENDDMHRGDDVRR

SEQ ID NO: 198582 - protein, 38 aa, Artificial Sequence
  Description of Artificial Sequence: Synthetic polypeptide
QAEEIATTNPVATEQYGSIACAANNGPEADMPMGNMRW

SEQ ID NO: 198583 - protein, 36 aa, Artificial Sequence
  Description of Artificial Sequence: Synthetic polypeptide
DEMEIRTTNPVATCGYGQCVCSWGEHNAENFTSDQA

SEQ ID NO: 198584 - protein, 35 aa, Artificial Sequence
  Description of Artificial Sequence: Synthetic polypeptide
DETEIRTTNPVATECWGATTWSNAEIEANPAGPYA

SEQ ID NO: 198585 - protein, 38 aa, Artificial Sequence
  Description of Artificial Sequence: Synthetic polypeptide
SEQEIRTTNPVATDQYGSVVTTDGMETNQGGEDEQGET

SEQ ID NO: 198586 - protein, 39 aa, Artificial Sequence
  Description of Artificial Sequence: Synthetic polypeptide
DEREIRTTNPVATEQYGQCVCSNSPEDHNQENFNSDTQS

SEQ ID NO: 198587 - protein, 35 aa, Artificial Sequence
  Description of Artificial Sequence: Synthetic polypeptide
DETEIRTTNPVATECWGATTWSNAEIEAEPKGPYA

SEQ ID NO: 198588 - protein, 38 aa, Artificial Sequence
  Description of Artificial Sequence: Synthetic polypeptide
DEEEISTTNPVATEQYGCVCSNWGEDHNAENFFSDTQS

SEQ ID NO: 198589 - protein, 39 aa, Artificial Sequence
  Description of Artificial Sequence: Synthetic polypeptide
DEMEIATTNPVATEQYGQCVCSNWGELHNAEHFGSENQS

SEQ ID NO: 198590 - protein, 38 aa, Artificial Sequence
  Description of Artificial Sequence: Synthetic polypeptide
DEMEIATTNPVATEQYGQCVCSNWGEHNIEHFSSENQS

SEQ ID NO: 198591 - protein, 38 aa, Artificial Sequence
  Description of Artificial Sequence: Synthetic polypeptide
DEMEIATTNPVATEQYGQCVCSNWGEHNEEHFGSETLN

SEQ ID NO: 198592 - protein, 37 aa, Artificial Sequence
  Description of Artificial Sequence: Synthetic polypeptide
DEGEIATTNPVATAQWGHVNAANSGNGEYGAEGDGNT

SEQ ID NO: 198593 - protein, 35 aa, Artificial Sequence
  Description of Artificial Sequence: Synthetic polypeptide
DETEIRTTNPVATECWGATTWANDEDWAEPKGPYI

SEQ ID NO: 198594 - protein, 35 aa, Artificial Sequence
  Description of Artificial Sequence: Synthetic polypeptide
DETEIRTTNPVATECWGATTWANMEDWAEPKGPYI

SEQ ID NO: 198595 - protein, 37 aa, Artificial Sequence
  Description of Artificial Sequence: Synthetic polypeptide
DEGEIATTNPVATAQWGHSAVAVGDLEADTPGGEDNH

SEQ ID NO: 198596 - protein, 39 aa, Artificial Sequence
  Description of Artificial Sequence: Synthetic polypeptide
DEMEIATTNPVATEQYGQCVCSTWGEDHNAEHFGSDTQA

SEQ ID NO: 198597 - protein, 38 aa, Artificial Sequence
  Description of Artificial Sequence: Synthetic polypeptide
DEEEISTTNPVATEQYGCVCSNWGEDHNAEHFSSDTQA

SEQ ID NO: 198598 - protein, 35 aa, Artificial Sequence
  Description of Artificial Sequence: Synthetic polypeptide
DETEIRTTNPVATECWGATTWSNAEDEAEPKGPYA

SEQ ID NO: 198599 - protein, 37 aa, Artificial Sequence
  Description of Artificial Sequence: Synthetic polypeptide
DEGEIATTNPVATAQWGHSASAVNTPEADTPGGEDNH

SEQ ID NO: 198600 - protein, 34 aa, Artificial Sequence
  Description of Artificial Sequence: Synthetic polypeptide
DETEIRTTNPVATECWGATTWSNAEDWAEAKEPA

SEQ ID NO: 198601 - protein, 37 aa, Artificial Sequence
  Description of Artificial Sequence: Synthetic polypeptide
QAEEIATTNPVATEQYGSVCAANNGDEADAPIGEMQH

SEQ ID NO: 198602 - protein, 34 aa, Artificial Sequence
  Description of Artificial Sequence: Synthetic polypeptide
DETEIRTTNPVATECWGATTWSNAEDWAEPKEPA

SEQ ID NO: 198603 - protein, 35 aa, Artificial Sequence
  Description of Artificial Sequence: Synthetic polypeptide
DETEIRTTNPVATECWGATTWSNAEIEAEPAGPYA

SEQ ID NO: 198604 - protein, 38 aa, Artificial Sequence
  Description of Artificial Sequence: Synthetic polypeptide
DEEEISTTNPVATEQYGQCVCGWGEDDNQENFNSENQP

SEQ ID NO: 198605 - protein, 37 aa, Artificial Sequence
  Description of Artificial Sequence: Synthetic polypeptide
DEDEIATTNPVAYEQWGSVTGGEPGNGGNMRNKMEMG

SEQ ID NO: 198606 - protein, 38 aa, Artificial Sequence
  Description of Artificial Sequence: Synthetic polypeptide
QEEEIRTTNPVATEFYGVVNMQNINNMDNQTGEFTEEG

SEQ ID NO: 198607 - protein, 33 aa, Artificial Sequence
  Description of Artificial Sequence: Synthetic polypeptide
DESEIRTTNPIATECWGATTAAEDWAEPEGPYI

SEQ ID NO: 198608 - protein, 33 aa, Artificial Sequence
  Description of Artificial Sequence: Synthetic polypeptide
DETEIATTNPIATECWGATWSNAEDWQPKEPYI

SEQ ID NO: 198609 - protein, 36 aa, Artificial Sequence
  Description of Artificial Sequence: Synthetic polypeptide
QETEIATTNPVAYEPYRGQSVAVINEGSTSMPGAPR

SEQ ID NO: 198610 - protein, 37 aa, Artificial Sequence
  Description of Artificial Sequence: Synthetic polypeptide
AENEIACTNPVATEQYGCQSCSWGEDNQEYFGSDNQS

SEQ ID NO: 198611 - protein, 36 aa, Artificial Sequence
  Description of Artificial Sequence: Synthetic polypeptide
DESEISTTNPVATCHYGCVCSWGEHNQEYFTSDNQA

SEQ ID NO: 198612 - protein, 37 aa, Artificial Sequence
  Description of Artificial Sequence: Synthetic polypeptide
DEACISTVNPVATEQYGCVCSNSGEHNAENFGSDNQA

SEQ ID NO: 198613 - protein, 35 aa, Artificial Sequence
  Description of Artificial Sequence: Synthetic polypeptide
DESEISTTNPVATCHYGCVCSWEHNQENFTSDTQA

SEQ ID NO: 198614 - protein, 40 aa, Artificial Sequence
  Description of Artificial Sequence: Synthetic polypeptide
DEEEIRTTNPVATEAYGTVVTTQIGTTEQGSTNDEQEEED

SEQ ID NO: 198615 - protein, 34 aa, Artificial Sequence
  Description of Artificial Sequence: Synthetic polypeptide
DEACSATTNPIAYEQWGEVCSTWEGEIQHDQNND

SEQ ID NO: 198616 - protein, 38 aa, Artificial Sequence
  Description of Artificial Sequence: Synthetic polypeptide
DEEAISTTNPVATEQYGQCVCSNWGEHNQENFGSDTQA

SEQ ID NO: 198617 - protein, 38 aa, Artificial Sequence
  Description of Artificial Sequence: Synthetic polypeptide
DEEAISTTNPVATEQYGQCVCSNWGEHNAENFNSDNQA

SEQ ID NO: 198618 - protein, 35 aa, Artificial Sequence
  Description of Artificial Sequence: Synthetic polypeptide
DEACSATTNPIAYEQWGEVCSTWEGLDQHHDQNND

SEQ ID NO: 198619 - protein, 37 aa, Artificial Sequence
  Description of Artificial Sequence: Synthetic polypeptide
DEECISTTNPVATEGYGCVCSNWGEHNQENFNSDNQS

SEQ ID NO: 198620 - protein, 39 aa, Artificial Sequence
  Description of Artificial Sequence: Synthetic polypeptide
DEEAISTTNPVATEQYGQCVCSTWGEDHNAENFNSQTQS

SEQ ID NO: 198621 - protein, 38 aa, Artificial Sequence
  Description of Artificial Sequence: Synthetic polypeptide
DENEIATTNPVATEQYGCNVPANMNPAEEAGDSMENVQ

SEQ ID NO: 198622 - protein, 38 aa, Artificial Sequence
  Description of Artificial Sequence: Synthetic polypeptide
DEEAISTTNPVATEQYGQCVCSVWGEHNQENFNSETQS

SEQ ID NO: 198623 - protein, 38 aa, Artificial Sequence
  Description of Artificial Sequence: Synthetic polypeptide
DYKEEWIPNHTNPVYAQQYCYGSVNSTCTLPRCGGNPW

SEQ ID NO: 198624 - protein, 37 aa, Artificial Sequence
  Description of Artificial Sequence: Synthetic polypeptide
DSEEIRTTNPVGTEQWGCVCSNWGEDHNQENFGSDQA

SEQ ID NO: 198625 - protein, 37 aa, Artificial Sequence
  Description of Artificial Sequence: Synthetic polypeptide
DEEAISTTNPVATEQYGQCVCSWEEHNQENFISDFQS

SEQ ID NO: 198626 - protein, 35 aa, Artificial Sequence
  Description of Artificial Sequence: Synthetic polypeptide
DEACSATTNPIAYEQWGEVCSTWEGLHQHDQNNDP

SEQ ID NO: 198627 - protein, 35 aa, Artificial Sequence
  Description of Artificial Sequence: Synthetic polypeptide
AECENATTNPVAYEEWGVVATEGGNTGNAGNDNNR

SEQ ID NO: 198628 - protein, 39 aa, Artificial Sequence
  Description of Artificial Sequence: Synthetic polypeptide
DEAEISTTNPVATEQYGQCVCSNWGEDHNAENFGSDNQA

SEQ ID NO: 198629 - protein, 38 aa, Artificial Sequence
  Description of Artificial Sequence: Synthetic polypeptide
CDEEIRTTNPVATEQYGQCVCSNWGPHNEEHFNSDNQS

SEQ ID NO: 198630 - protein, 39 aa, Artificial Sequence
  Description of Artificial Sequence: Synthetic polypeptide
AEEEISTTNPVATEQYGQCVCSTWGEDDNAENFNSETQA

SEQ ID NO: 198631 - protein, 37 aa, Artificial Sequence
  Description of Artificial Sequence: Synthetic polypeptide
AENEIACTNPVATEQYGCSCSNWGEADNQYFGSDNQS

SEQ ID NO: 198632 - protein, 35 aa, Artificial Sequence
  Description of Artificial Sequence: Synthetic polypeptide
TGEEEIATTNPCAYEQWGSVCYNIEEVHDGIQMDS

SEQ ID NO: 198633 - protein, 38 aa, Artificial Sequence
  Description of Artificial Sequence: Synthetic polypeptide
DEAEISTTNPVGTEQYGCVCSTWGEDHNAENFGSQTQS

SEQ ID NO: 198634 - protein, 30 aa, Artificial Sequence
  Description of Artificial Sequence: Synthetic polypeptide
QESEIASTNPIGTECYGATAAEDWAPKGPI

SEQ ID NO: 198635 - protein, 39 aa, Artificial Sequence
  Description of Artificial Sequence: Synthetic polypeptide
DEEAISTTNPVATEQYGQCVCSNWGEDDNQEGFNSDTQG

SEQ ID NO: 198636 - protein, 36 aa, Artificial Sequence
  Description of Artificial Sequence: Synthetic polypeptide
DESEISTTNPVATEGWGCVCSNWGEENQEYFGSQQS

SEQ ID NO: 198637 - protein, 38 aa, Artificial Sequence
  Description of Artificial Sequence: Synthetic polypeptide
DEEEISTTNPCATEQYGCVCSNWGEDHNAENFNSDNQL

SEQ ID NO: 198638 - protein, 37 aa, Artificial Sequence
  Description of Artificial Sequence: Synthetic polypeptide
AENEIACTNPVATEQYGCSCSNWEDDNQEYFGSDNQA

SEQ ID NO: 198639 - protein, 36 aa, Artificial Sequence
  Description of Artificial Sequence: Synthetic polypeptide
SEAEIACTNPVATEQYGSVCAAGPLGFAMMGDEEGE

SEQ ID NO: 198640 - protein, 31 aa, Artificial Sequence
  Description of Artificial Sequence: Synthetic polypeptide
QEGEIASTNPCSYEQWGITCYCNDQSHGDTA

SEQ ID NO: 198641 - protein, 38 aa, Artificial Sequence
  Description of Artificial Sequence: Synthetic polypeptide
DEEAISTTNPVATEQYGQCVCSNWGEHNAEHFNSDTQS

SEQ ID NO: 198642 - protein, 37 aa, Artificial Sequence
  Description of Artificial Sequence: Synthetic polypeptide
AENEIACTNPVATEQYGCSCSMWGETNQEYFGSDTQA

SEQ ID NO: 198643 - protein, 38 aa, Artificial Sequence
  Description of Artificial Sequence: Synthetic polypeptide
CDEEIRTTNPVATEQYGQCVCSWGEDDNEENFNSDTQA

SEQ ID NO: 198644 - protein, 37 aa, Artificial Sequence
  Description of Artificial Sequence: Synthetic polypeptide
DEEAISTTNPVATEQYGQCVCSNWGEHNAENFFSDQS

SEQ ID NO: 198645 - protein, 38 aa, Artificial Sequence
  Description of Artificial Sequence: Synthetic polypeptide
DEECISTTNPVATEGYGCVTSTWPADDNAEYFNSDPQS

SEQ ID NO: 198646 - protein, 36 aa, Artificial Sequence
  Description of Artificial Sequence: Synthetic polypeptide
NEEPIGTTNPVATEQYGSCFTSPWVDEGEGLFDSQY

SEQ ID NO: 198647 - protein, 38 aa, Artificial Sequence
  Description of Artificial Sequence: Synthetic polypeptide
DEEAISTTNPVATEQYGQCVCSWGEDHNAENFFSDNQS
